United States Patent 7,655,785 (BIOINFORMATICALLY DETECTABLE GROUP OF NOVEL REGULATORY OLIGONUCLEOTIDES AND USES THEREOF) - sequence listing, part 43

SEQ ID NO: 1776244 - RNA, 18 nt, Homo sapiens
cugguggggcagcuccuc

SEQ ID NO: 1776245 - RNA, 22 nt, Homo sapiens
guggaaguuaaagggcauuucc

SEQ ID NO: 1776246 - RNA, 12 nt, Homo sapiens
aaacaacagcuu

SEQ ID NO: 1776247 - RNA, 12 nt, Homo sapiens
uacuuuuugccc

SEQ ID NO: 1776248 - RNA, 21 nt, Homo sapiens
agaaugaccucgcaagacccu

SEQ ID NO: 1776249 - RNA, 21 nt, Homo sapiens
ugcagaggauaaggaggcacu

SEQ ID NO: 1776250 - RNA, 19 nt, Homo sapiens
cagccuggccacgcagcca

SEQ ID NO: 1776251 - RNA, 22 nt, Homo sapiens
cuauaauuuuacaaaguuaaau

SEQ ID NO: 1776252 - RNA, 19 nt, Homo sapiens
acauuguacuuauacaccu

SEQ ID NO: 1776253 - RNA, 19 nt, Homo sapiens
gcuguuuuuauauauguga

SEQ ID NO: 1776254 - RNA, 11 nt, Homo sapiens
uggagaugucu

SEQ ID NO: 1776255 - RNA, 19 nt, Homo sapiens
uuaaaacaauucugugaca

SEQ ID NO: 1776256 - RNA, 20 nt, Homo sapiens
caaagcauugagcaaagggg

SEQ ID NO: 1776257 - RNA, 14 nt, Homo sapiens
uuggcugaccccuc

SEQ ID NO: 1776258 - RNA, 20 nt, Homo sapiens
aucugauguuucauauuuaa

SEQ ID NO: 1776259 - RNA, 23 nt, Homo sapiens
ugagaucuaaggaugucacaggg

SEQ ID NO: 1776260 - RNA, 20 nt, Homo sapiens
uuaaagaaauauaaacacaa

SEQ ID NO: 1776261 - RNA, 18 nt, Homo sapiens
cuucaagaucccauuuga

SEQ ID NO: 1776262 - RNA, 17 nt, Homo sapiens
uguggcauuuucacuuu

SEQ ID NO: 1776263 - RNA, 22 nt, Homo sapiens
gauaguuguucuagcagugaag

SEQ ID NO: 1776264 - RNA, 17 nt, Homo sapiens
auucuuaauaggcuuua

SEQ ID NO: 1776265 - RNA, 18 nt, Homo sapiens
cuccacuugccuugugau

SEQ ID NO: 1776266 - RNA, 23 nt, Homo sapiens
uuaugccaccugaauaaagaaug

SEQ ID NO: 1776267 - RNA, 19 nt, Homo sapiens
auugauccagucauuuuau

SEQ ID NO: 1776268 - RNA, 23 nt, Homo sapiens
cauggccaucuucuuucuuccac

SEQ ID NO: 1776269 - RNA, 21 nt, Homo sapiens
uguaauuaguaauaaaaccca

SEQ ID NO: 1776270 - RNA, 24 nt, Homo sapiens
cuucccaucucaaccaggauccug

SEQ ID NO: 1776271 - RNA, 21 nt, Homo sapiens
cuggagcccagucaccccggg

SEQ ID NO: 1776272 - RNA, 20 nt, Homo sapiens
accccacaccugcagugcca

SEQ ID NO: 1776273 - RNA, 22 nt, Homo sapiens
ugcaguguaacgaugcacuuug

SEQ ID NO: 1776274 - RNA, 21 nt, Homo sapiens
acaaggaguaacaaaacagcc

SEQ ID NO: 1776275 - RNA, 22 nt, Homo sapiens
ccaccucugccuuacaaaauac

SEQ ID NO: 1776276 - RNA, 22 nt, Homo sapiens
accacaucccacucacaacagc

SEQ ID NO: 1776277 - RNA, 22 nt, Homo sapiens
auuuuauaugcuuacugauaua

SEQ ID NO: 1776278 - RNA, 17 nt, Homo sapiens
cccuaguugaguagcca

SEQ ID NO: 1776279 - RNA, 18 nt, Homo sapiens
auuucuaaaucuccaaaa

SEQ ID NO: 1776280 - RNA, 22 nt, Homo sapiens
cacugcuuuuuccuuagcuuaa

SEQ ID NO: 1776281 - RNA, 22 nt, Homo sapiens
cuauguacugccuuagugcuga

SEQ ID NO: 1776282 - RNA, 21 nt, Homo sapiens
cagcaagggaccugcucauca

SEQ ID NO: 1776283 - RNA, 20 nt, Homo sapiens
cgaccccgucacagccucaa

SEQ ID NO: 1776284 - RNA, 23 nt, Homo sapiens
cagcagugaguaaucaauacaga

SEQ ID NO: 1776285 - RNA, 19 nt, Homo sapiens
gcacauucauuuucucagu

SEQ ID NO: 1776286 - RNA, 20 nt, Homo sapiens
uguauauuccaccauucaca

SEQ ID NO: 1776287 - RNA, 14 nt, Homo sapiens
aaacuucucacccg

SEQ ID NO: 1776288 - RNA, 19 nt, Homo sapiens
ucacucuggccacagguga

SEQ ID NO: 1776289 - RNA, 16 nt, Homo sapiens
ucuacuguguugaaau

SEQ ID NO: 1776290 - RNA, 20 nt, Homo sapiens
ccuguuccuggaggucagca

SEQ ID NO: 1776291 - RNA, 13 nt, Homo sapiens
ugccgucuguccc

SEQ ID NO: 1776292 - RNA, 22 nt, Homo sapiens
cacgaucucggcucacugcaac

SEQ ID NO: 1776293 - RNA, 23 nt, Homo sapiens
cauagaggugagggaagccugaa

SEQ ID NO: 1776294 - RNA, 20 nt, Homo sapiens
aaaaaaucaaguauuggcaa

SEQ ID NO: 1776295 - RNA, 21 nt, Homo sapiens
cauucaagucuaugaugcugu

SEQ ID NO: 1776296 - RNA, 22 nt, Homo sapiens
caccaaccuuccaaguguaaaa

SEQ ID NO: 1776297 - RNA, 18 nt, Homo sapiens
acagcugaaaagagcuuu

SEQ ID NO: 1776298 - RNA, 20 nt, Homo sapiens
uauuaaguaugucaacagcc

SEQ ID NO: 1776299 - RNA, 16 nt, Homo sapiens
aguaauccaagcaaau

SEQ ID NO: 1776300 - RNA, 15 nt, Homo sapiens
caaaccuacugccca

SEQ ID NO: 1776301 - RNA, 16 nt, Homo sapiens
gaaaggguaauuuccu

SEQ ID NO: 1776302 - RNA, 18 nt, Homo sapiens
acauugacaaugacaaaa

SEQ ID NO: 1776303 - RNA, 15 nt, Homo sapiens
acguguaacuugugc

SEQ ID NO: 1776304 - RNA, 21 nt, Homo sapiens
cacaaucuugaacauuuuaca

SEQ ID NO: 1776305 - RNA, 20 nt, Homo sapiens
gaucccugugccucuuccca

SEQ ID NO: 1776306 - RNA, 21 nt, Homo sapiens
agaguggucuccgcucugaau

SEQ ID NO: 1776307 - RNA, 19 nt, Homo sapiens
gagaacccggcaacaucag

SEQ ID NO: 1776308 - RNA, 15 nt, Homo sapiens
ugggugaacacucaa

SEQ ID NO: 1776309 - RNA, 14 nt, Homo sapiens
uuuuccauuuggca

SEQ ID NO: 1776310 - RNA, 15 nt, Homo sapiens
aaaucuuaacuugaa

SEQ ID NO: 1776311 - RNA, 20 nt, Homo sapiens
cccccucugccccacgugcc

SEQ ID NO: 1776312 - RNA, 20 nt, Homo sapiens
cugucucccccauugcucua

SEQ ID NO: 1776313 - RNA, 15 nt, Homo sapiens
gaucacuaugcauuu

SEQ ID NO: 1776314 - RNA, 15 nt, Homo sapiens
gaaccucacugaaaa

SEQ ID NO: 1776315 - RNA, 16 nt, Homo sapiens
cauuggcuaauugcac

SEQ ID NO: 1776316 - RNA, 19 nt, Homo sapiens
aaagcagguggcaucucua

SEQ ID NO: 1776317 - RNA, 15 nt, Homo sapiens
uucauuuucacauuu

SEQ ID NO: 1776318 - RNA, 19 nt, Homo sapiens
ucuuagagcacuuuuaaca

SEQ ID NO: 1776319 - RNA, 16 nt, Homo sapiens
uauugaagaugcugcc

SEQ ID NO: 1776320 - RNA, 24 nt, Homo sapiens
cauaauuaugaaaacucaugauca

SEQ ID NO: 1776321 - RNA, 13 nt, Homo sapiens
uuuggcucagagu

SEQ ID NO: 1776322 - RNA, 10 nt, Homo sapiens
cucuugcccu

SEQ ID NO: 1776323 - RNA, 15 nt, Homo sapiens
gcagaaccagugaca

SEQ ID NO: 1776324 - RNA, 15 nt, Homo sapiens
gaggaugggcagcug

SEQ ID NO: 1776325 - RNA, 22 nt, Homo sapiens
aggagaaggcaggaacauugga

SEQ ID NO: 1776326 - RNA, 23 nt, Homo sapiens
cuaaggggcccggccagccaugu

SEQ ID NO: 1776327 - RNA, 19 nt, Homo sapiens
caugaaucaagcaauccag

SEQ ID NO: 1776328 - RNA, 15 nt, Homo sapiens
uguugauugacugca

SEQ ID NO: 1776329 - RNA, 20 nt, Homo sapiens
ucccugggaagccugugcca

SEQ ID NO: 1776330 - RNA, 23 nt, Homo sapiens
uuaugaagaaggugaauagccau

SEQ ID NO: 1776331 - RNA, 11 nt, Homo sapiens
ugccuggucua

SEQ ID NO: 1776332 - RNA, 22 nt, Homo sapiens
agcauuugguuuuacacaggaa

SEQ ID NO: 1776333 - RNA, 13 nt, Homo sapiens
aaugcuuuuacua

SEQ ID NO: 1776334 - RNA, 12 nt, Homo sapiens
cugagaauucca

SEQ ID NO: 1776335 - RNA, 20 nt, Homo sapiens
ccauguaaccacugcacuuu

SEQ ID NO: 1776336 - RNA, 14 nt, Homo sapiens
aucuaguuuacuuc

SEQ ID NO: 1776337 - RNA, 18 nt, Homo sapiens
uuaauauauaguccagac

SEQ ID NO: 1776338 - RNA, 23 nt, Homo sapiens
cugagccgaacauguuauuuaac

SEQ ID NO: 1776339 - RNA, 12 nt, Homo sapiens
acaccauucauu

SEQ ID NO: 1776340 - RNA, 21 nt, Homo sapiens
gcagauugaaaaggacaccuu

SEQ ID NO: 1776341 - RNA, 22 nt, Homo sapiens
gcauaugucacuagaauggaua

SEQ ID NO: 1776342 - RNA, 20 nt, Homo sapiens
gaagcuuuuuguuugcauca

SEQ ID NO: 1776343 - RNA, 16 nt, Homo sapiens
agaggagaaaaaaacu

SEQ ID NO: 1776344 - RNA, 22 nt, Homo sapiens
cuaguguucagaauucaugaaa

SEQ ID NO: 1776345 - RNA, 17 nt, Homo sapiens
cauuucagaaagccuuu

SEQ ID NO: 1776346 - RNA, 13 nt, Homo sapiens
uaucgggucacug

SEQ ID NO: 1776347 - RNA, 12 nt, Homo sapiens
caguccagugag

SEQ ID NO: 1776348 - RNA, 22 nt, Homo sapiens
agacuagauggaccugccugca

SEQ ID NO: 1776349 - RNA, 23 nt, Homo sapiens
aacuacauauuguaaagcccauu

SEQ ID NO: 1776350 - RNA, 23 nt, Homo sapiens
agcacaggccauggugcacaaaa

SEQ ID NO: 1776351 - RNA, 19 nt, Homo sapiens
ugguauuauuuacaaugca

SEQ ID NO: 1776352 - RNA, 22 nt, Homo sapiens
ucucacuuugguuggaacuuua

SEQ ID NO: 1776353 - RNA, 18 nt, Homo sapiens
gccucuucgcugaccucg

SEQ ID NO: 1776354 - RNA, 18 nt, Homo sapiens
aaagccucaaaucuuccu

SEQ ID NO: 1776355 - RNA, 17 nt, Homo sapiens
guuuauggggcucucac

SEQ ID NO: 1776356 - RNA, 14 nt, Homo sapiens
guaggaaaggaaua

SEQ ID NO: 1776357 - RNA, 12 nt, Homo sapiens
ccccuacugugg

SEQ ID NO: 1776358 - RNA, 19 nt, Homo sapiens
ugggucacucauuaaugaa

SEQ ID NO: 1776359 - RNA, 21 nt, Homo sapiens
ucagugcuucccgagugagca

SEQ ID NO: 1776360 - RNA, 17 nt, Homo sapiens
ccuuuggcagaguucua

SEQ ID NO: 1776361 - RNA, 21 nt, Homo sapiens
accuggucgccaauccaugcu

SEQ ID NO: 1776362 - RNA, 22 nt, Homo sapiens
cagauucuccucuaauucugua

SEQ ID NO: 1776363 - RNA, 13 nt, Homo sapiens
aagaaauucugca

SEQ ID NO: 1776364 - RNA, 14 nt, Homo sapiens
cccgucauguuccu

SEQ ID NO: 1776365 - RNA, 14 nt, Homo sapiens
uuggagugcaaugg

SEQ ID NO: 1776366 - RNA, 15 nt, Homo sapiens
aagagccacagugag

SEQ ID NO: 1776367 - RNA, 15 nt, Homo sapiens
ccauauugcucuuaa

SEQ ID NO: 1776368 - RNA, 15 nt, Homo sapiens
ggagcaaauguuucu

SEQ ID NO: 1776369 - RNA, 20 nt, Homo sapiens
ugcacagcuaaaauaauaga

SEQ ID NO: 1776370 - RNA, 19 nt, Homo sapiens
aguuaaacugagaguaauu

SEQ ID NO: 1776371 - RNA, 19 nt, Homo sapiens
cuuaaaacuguaaauuuau

SEQ ID NO: 1776372 - RNA, 23 nt, Homo sapiens
gaacaggucccacgccaggccag

SEQ ID NO: 1776373 - RNA, 20 nt, Homo sapiens
cuucucagcucccauuucua

SEQ ID NO: 1776374 - RNA, 13 nt, Homo sapiens
ccaccacugcagc

SEQ ID NO: 1776375 - RNA, 13 nt, Homo sapiens
ccuccacugcugc

SEQ ID NO: 1776376 - RNA, 21 nt, Homo sapiens
uguugagggaagcuuccauaa

SEQ ID NO: 1776377 - RNA, 20 nt, Homo sapiens
uuaaaauucuggacacauua

SEQ ID NO: 1776378 - RNA, 19 nt, Homo sapiens
ccugccuguggcgccgucu

SEQ ID NO: 1776379 - RNA, 16 nt, Homo sapiens
gacgcuucccuugccg

SEQ ID NO: 1776380 - RNA, 13 nt, Homo sapiens
ccaagguccguga

SEQ ID NO: 1776381 - RNA, 17 nt, Homo sapiens
uucuuuaaucacauuca

SEQ ID NO: 1776382 - RNA, 23 nt, Homo sapiens
ccugaaauuucucauuaguggua

SEQ ID NO: 1776383 - RNA, 13 nt, Homo sapiens
uuagagaugcuac

SEQ ID NO: 1776384 - RNA, 17 nt, Homo sapiens
cucuugaagacacugaa

SEQ ID NO: 1776385 - RNA, 13 nt, Homo sapiens
ucccagggccaug

SEQ ID NO: 1776386 - RNA, 16 nt, Homo sapiens
uaaacgagauaaugua

SEQ ID NO: 1776387 - RNA, 22 nt, Homo sapiens
ccaaguuaccuacaagaacaau

SEQ ID NO: 1776388 - RNA, 19 nt, Homo sapiens
cauaaagaagcaagaaugg

SEQ ID NO: 1776389 - RNA, 19 nt, Homo sapiens
aagacaucugaggaaaaug

SEQ ID NO: 1776390 - RNA, 21 nt, Homo sapiens
aaagaugaucuacucagaaau

SEQ ID NO: 1776391 - RNA, 14 nt, Homo sapiens
uugaugcgacugua

SEQ ID NO: 1776392 - RNA, 14 nt, Homo sapiens
cuuuacuacugugg

SEQ ID NO: 1776393 - RNA, 15 nt, Homo sapiens
cugccuccucuucaa

SEQ ID NO: 1776394 - RNA, 22 nt, Homo sapiens
caguaaagcaggaagccuccaa

SEQ ID NO: 1776395 - RNA, 21 nt, Homo sapiens
cgagcaccuccagccugaaca

SEQ ID NO: 1776396 - RNA, 18 nt, Homo sapiens
aguuucugugguuggcug

SEQ ID NO: 1776397 - RNA, 21 nt, Homo sapiens
uggcaucugagugggcccagc

SEQ ID NO: 1776398 - RNA, 20 nt, Homo sapiens
uauauuuuuuuaaaauguua

SEQ ID NO: 1776399 - RNA, 12 nt, Homo sapiens
ggcacugccaaa

SEQ ID NO: 1776400 - RNA, 15 nt, Homo sapiens
uuuccuaccuugugc

SEQ ID NO: 1776401 - RNA, 15 nt, Homo sapiens
ucuguagugagauag

SEQ ID NO: 1776402 - RNA, 13 nt, Homo sapiens
uaaauauaaacua

SEQ ID NO: 1776403 - RNA, 18 nt, Homo sapiens
cuauuuucugaagugacu

SEQ ID NO: 1776404 - RNA, 13 nt, Homo sapiens
ugccagguaaaga

SEQ ID NO: 1776405 - RNA, 21 nt, Homo sapiens
uucgcaccuaccaucagggac

SEQ ID NO: 1776406 - RNA, 15 nt, Homo sapiens
aguuccccaaauaca

SEQ ID NO: 1776407 - RNA, 12 nt, Homo sapiens
augugcugagaa

SEQ ID NO: 1776408 - RNA, 20 nt, Homo sapiens
gggagagcccugucccugcc

SEQ ID NO: 1776409 - RNA, 18 nt, Homo sapiens
gcucaugcccauaauccc

SEQ ID NO: 1776410 - RNA, 21 nt, Homo sapiens
ugugaaccaacccccaucucc

SEQ ID NO: 1776411 - RNA, 15 nt, Homo sapiens
cccaccccaccaugg

SEQ ID NO: 1776412 - RNA, 16 nt, Homo sapiens
caguggcucauaaaaa

SEQ ID NO: 1776413 - RNA, 18 nt, Homo sapiens
aggggcccuggccaggac

SEQ ID NO: 1776414 - RNA, 15 nt, Homo sapiens
agcuggccuguaauc

SEQ ID NO: 1776415 - RNA, 20 nt, Homo sapiens
aaucccuauguuugucucac

SEQ ID NO: 1776416 - RNA, 14 nt, Homo sapiens
gaucucagggcaga

SEQ ID NO: 1776417 - RNA, 16 nt, Homo sapiens
cuucucguuaaggaga

SEQ ID NO: 1776418 - RNA, 22 nt, Homo sapiens
ugcuucccgagugagcauggaa

SEQ ID NO: 1776419 - RNA, 12 nt, Homo sapiens
auaaucuacucc

SEQ ID NO: 1776420 - RNA, 14 nt, Homo sapiens
gcaauugacuguca

SEQ ID NO: 1776421 - RNA, 21 nt, Homo sapiens
agggucucccucuguugccaa

SEQ ID NO: 1776422 - RNA, 12 nt, Homo sapiens
guaucaucagau

SEQ ID NO: 1776423 - RNA, 17 nt, Homo sapiens
ugcuucuccaaauacaa

SEQ ID NO: 1776424 - RNA, 21 nt, Homo sapiens
ugugaguguacaggagaagaa

SEQ ID NO: 1776425 - RNA, 13 nt, Homo sapiens
uaccuccaugagc

SEQ ID NO: 1776426 - RNA, 13 nt, Homo sapiens
ggaguccagaccc

SEQ ID NO: 1776427 - RNA, 15 nt, Homo sapiens
ccaaaucagcugcua

SEQ ID NO: 1776428 - RNA, 11 nt, Homo sapiens
uauugagacau

SEQ ID NO: 1776429 - RNA, 21 nt, Homo sapiens
ggucugugugugugugugugc

SEQ ID NO: 1776430 - RNA, 15 nt, Homo sapiens
aauguuuuggcaaga

SEQ ID NO: 1776431 - RNA, 20 nt, Homo sapiens
uggucuuuccuaucauggag

SEQ ID NO: 1776432 - RNA, 20 nt, Homo sapiens
gucuaccagagcgugcacuu

SEQ ID NO: 1776433 - RNA, 18 nt, Homo sapiens
cugagugagcugaagagu

SEQ ID NO: 1776434 - RNA, 23 nt, Homo sapiens
caaaugugcuggucacccuucaa

SEQ ID NO: 1776435 - RNA, 13 nt, Homo sapiens
ugcuuggcacuua

SEQ ID NO: 1776436 - RNA, 13 nt, Homo sapiens
uauuuuucugaua

SEQ ID NO: 1776437 - RNA, 16 nt, Homo sapiens
cuauacacauaagcau

SEQ ID NO: 1776438 - RNA, 23 nt, Homo sapiens
uuuguauuguaaaaaauucacau

SEQ ID NO: 1776439 - RNA, 14 nt, Homo sapiens
agacaaauuugcaa

SEQ ID NO: 1776440 - RNA, 14 nt, Homo sapiens
ugacacauaugcac

SEQ ID NO: 1776441 - RNA, 22 nt, Homo sapiens
accuaaguccuuccaccugcca

SEQ ID NO: 1776442 - RNA, 21 nt, Homo sapiens
gcguaggcuacagagaagccu

SEQ ID NO: 1776443 - RNA, 22 nt, Homo sapiens
ucggugggacucguggcuguca

SEQ ID NO: 1776444 - RNA, 20 nt, Homo sapiens
uuagauuuuguauucagggg

SEQ ID NO: 1776445 - RNA, 12 nt, Homo sapiens
caaaacauuccg

SEQ ID NO: 1776446 - RNA, 21 nt, Homo sapiens
cuuuagaaagcugacauugcc

SEQ ID NO: 1776447 - RNA, 19 nt, Homo sapiens
acugcauguuugcuguucc

SEQ ID NO: 1776448 - RNA, 22 nt, Homo sapiens
ccucaaccaacaacaauguguu

SEQ ID NO: 1776449 - RNA, 12 nt, Homo sapiens
uuuaaugagcac

SEQ ID NO: 1776450 - RNA, 21 nt, Homo sapiens
uuccugcaacucaaggacuuu

SEQ ID NO: 1776451 - RNA, 22 nt, Homo sapiens
aauccuuucacccgcuccuaca

SEQ ID NO: 1776452 - RNA, 12 nt, Homo sapiens
uggccaggacau

SEQ ID NO: 1776453 - RNA, 16 nt, Homo sapiens
aggcucuguuccacau

SEQ ID NO: 1776454 - RNA, 23 nt, Homo sapiens
aaugcaaaucaauaaauucccaa

SEQ ID NO: 1776455 - RNA, 21 nt, Homo sapiens
ccugagccuggccauguccuc

SEQ ID NO: 1776456 - RNA, 21 nt, Homo sapiens
aacaccugauggugaaaccaa

SEQ ID NO: 1776457 - RNA, 18 nt, Homo sapiens
caaaaacaagacagacuc

SEQ ID NO: 1776458 - RNA, 18 nt, Homo sapiens
agcauucugcaacauuua

SEQ ID NO: 1776459 - RNA, 17 nt, Homo sapiens
guaucaugcccugugca

SEQ ID NO: 1776460 - RNA, 14 nt, Homo sapiens
gcugagaguacugu

SEQ ID NO: 1776461 - RNA, 13 nt, Homo sapiens
guaccgacuuuga

SEQ ID NO: 1776462 - RNA, 22 nt, Homo sapiens
uugcgucaagucuaaaccaaga

SEQ ID NO: 1776463 - RNA, 22 nt, Homo sapiens
accccggggccucccccgugac

SEQ ID NO: 1776464 - RNA, 22 nt, Homo sapiens
uauauuggcugguaaauugcca

SEQ ID NO: 1776465 - RNA, 21 nt, Homo sapiens
aagaaccaaggaaucauguca

SEQ ID NO: 1776466 - RNA, 22 nt, Homo sapiens
agauucuggcuagugucuauca

SEQ ID NO: 1776467 - RNA, 19 nt, Homo sapiens
agacccucucaagugcccu

SEQ ID NO: 1776468 - RNA, 14 nt, Homo sapiens
ucuaaaaacuucuu

SEQ ID NO: 1776469 - RNA, 14 nt, Homo sapiens
uuccuaaacccaau

SEQ ID NO: 1776470 - RNA, 14 nt, Homo sapiens
cuaauuaaucacaa

SEQ ID NO: 1776471 - RNA, 15 nt, Homo sapiens
ggaagauggggacca

SEQ ID NO: 1776472 - RNA, 19 nt, Homo sapiens
gcuguuuuguggauuuuug

SEQ ID NO: 1776473 - RNA, 24 nt, Homo sapiens
aucaacaaguucuuguugacucag

SEQ ID NO: 1776474 - RNA, 19 nt, Homo sapiens
uacauuuuuuaacuuucua

SEQ ID NO: 1776475 - RNA, 23 nt, Homo sapiens
aaaugcuccuccagggagucuca

SEQ ID NO: 1776476 - RNA, 20 nt, Homo sapiens
uucuuccaucaucacuguaa

SEQ ID NO: 1776477 - RNA, 19 nt, Homo sapiens
uaugucauuuuuaauguau

SEQ ID NO: 1776478 - RNA, 19 nt, Homo sapiens
cugugaucuauaccaccuu

SEQ ID NO: 1776479 - RNA, 16 nt, Homo sapiens
gggcccuuccuuccau

SEQ ID NO: 1776480 - RNA, 21 nt, Homo sapiens
caggugcgccccuggugguca

SEQ ID NO: 1776481 - RNA, 20 nt, Homo sapiens
aauauucauuuuaaagugga

SEQ ID NO: 1776482 - RNA, 15 nt, Homo sapiens
caaggaaaauugcag

SEQ ID NO: 1776483 - RNA, 23 nt, Homo sapiens
cuuggcccaggauuauugucaaa

SEQ ID NO: 1776484 - RNA, 15 nt, Homo sapiens
aacuaagaaauggca

SEQ ID NO: 1776485 - RNA, 15 nt, Homo sapiens
cauggcgacacuaaa

SEQ ID NO: 1776486 - RNA, 19 nt, Homo sapiens
aacaacaauaacacugucu

SEQ ID NO: 1776487 - RNA, 16 nt, Homo sapiens
ccucuuucucucugug

SEQ ID NO: 1776488 - RNA, 17 nt, Homo sapiens
auaauguuaaccaagga

SEQ ID NO: 1776489 - RNA, 22 nt, Homo sapiens
gaugugaaauuaaauucuuauu

SEQ ID NO: 1776490 - RNA, 20 nt, Homo sapiens
gacggggggugggaacaaga

SEQ ID NO: 1776491 - RNA, 17 nt, Homo sapiens
agcuuuacuagugccaa

SEQ ID NO: 1776492 - RNA, 22 nt, Homo sapiens
ggaugguuuuaucuucccuuua

SEQ ID NO: 1776493 - RNA, 14 nt, Homo sapiens
uuugcuguacuuua

SEQ ID NO: 1776494 - RNA, 22 nt, Homo sapiens
ucucauccuccaguaccuugcu

SEQ ID NO: 1776495 - RNA, 12 nt, Homo sapiens
uggucagaugau

SEQ ID NO: 1776496 - RNA, 19 nt, Homo sapiens
gcacccuguaucacagacu

SEQ ID NO: 1776497 - RNA, 20 nt, Homo sapiens
auaucuguuuuacugcuuuu

SEQ ID NO: 1776498 - RNA, 15 nt, Homo sapiens
gucagaaacugccau

SEQ ID NO: 1776499 - RNA, 18 nt, Homo sapiens
guaauuauguuuugugau

SEQ ID NO: 1776500 - RNA, 14 nt, Homo sapiens
gcucuucuaaggaa

SEQ ID NO: 1776501 - RNA, 13 nt, Homo sapiens
cagcucaggauau

SEQ ID NO: 1776502 - RNA, 19 nt, Homo sapiens
uacccuuuaagauauccau

SEQ ID NO: 1776503 - RNA, 22 nt, Homo sapiens
cuugccuuccugccuagucuca

SEQ ID NO: 1776504 - RNA, 21 nt, Homo sapiens
gauuuauugagugccaacugc

SEQ ID NO: 1776505 - RNA, 16 nt, Homo sapiens
ccaugaagacagucca

SEQ ID NO: 1776506 - RNA, 14 nt, Homo sapiens
gccaacauggugaa

SEQ ID NO: 1776507 - RNA, 18 nt, Homo sapiens
auuaugcccuugagucua

SEQ ID NO: 1776508 - RNA, 14 nt, Homo sapiens
acuuugcaucucag

SEQ ID NO: 1776509 - RNA, 12 nt, Homo sapiens
agauuaggucuu

SEQ ID NO: 1776510 - RNA, 16 nt, Homo sapiens
gucagggagaggucac

SEQ ID NO: 1776511 - RNA, 9 nt, Homo sapiens
cccagaccc

SEQ ID NO: 1776512 - RNA, 17 nt, Homo sapiens
aaagccagccaagcuuu

SEQ ID NO: 1776513 - RNA, 13 nt, Homo sapiens
caggacaagagaa

SEQ ID NO: 1776514 - RNA, 15 nt, Homo sapiens
aaugcuucugcacac

SEQ ID NO: 1776515 - RNA, 22 nt, Homo sapiens
gucacaggaaggacuucuucca

SEQ ID NO: 1776516 - RNA, 19 nt, Homo sapiens
cacucagggcugccacuaa

SEQ ID NO: 1776517 - RNA, 18 nt, Homo sapiens
ugcugagugucaucucaa

SEQ ID NO: 1776518 - RNA, 17 nt, Homo sapiens
aagcuuuaucuuugugu

SEQ ID NO: 1776519 - RNA, 24 nt, Homo sapiens
uggcccccucccuggaugacauua

SEQ ID NO: 1776520 - RNA, 23 nt, Homo sapiens
aagcacacuaaaccaaguuauuu

SEQ ID NO: 1776521 - RNA, 22 nt, Homo sapiens
uauuagugccguuaucauggag

SEQ ID NO: 1776522 - RNA, 17 nt, Homo sapiens
ucccucagacccagcgg

SEQ ID NO: 1776523 - RNA, 15 nt, Homo sapiens
uguuguacuugaaaa

SEQ ID NO: 1776524 - RNA, 16 nt, Homo sapiens
caguaaggcagugcag

SEQ ID NO: 1776525 - RNA, 18 nt, Homo sapiens
aaguguucaguguugaca

SEQ ID NO: 1776526 - RNA, 21 nt, Homo sapiens
acuuuaaauccuaccaaagua

SEQ ID NO: 1776527 - RNA, 13 nt, Homo sapiens
ccaccaccaggac

SEQ ID NO: 1776528 - RNA, 11 nt, Homo sapiens
caaccaaaggg

SEQ ID NO: 1776529 - RNA, 19 nt, Homo sapiens
agagggccccucacuggcu

SEQ ID NO: 1776530 - RNA, 18 nt, Homo sapiens
uuacuggggaaagugcau

SEQ ID NO: 1776531 - RNA, 12 nt, Homo sapiens
guuagugcauuu

SEQ ID NO: 1776532 - RNA, 24 nt, Homo sapiens
aaccaagguuuugaaaucccauca

SEQ ID NO: 1776533 - RNA, 17 nt, Homo sapiens
aagaucuugucuccacu

SEQ ID NO: 1776534 - RNA, 13 nt, Homo sapiens
cuucccaugcauu

SEQ ID NO: 1776535 - RNA, 15 nt, Homo sapiens
ccaugauacuuuaau

SEQ ID NO: 1776536 - RNA, 20 nt, Homo sapiens
gaugugagccuugugcaugu

SEQ ID NO: 1776537 - RNA, 18 nt, Homo sapiens
uuuacccaaugcaguuug

SEQ ID NO: 1776538 - RNA, 13 nt, Homo sapiens
auuuacauugccu

SEQ ID NO: 1776539 - RNA, 20 nt, Homo sapiens
ugaaacaagauaacugagaa

SEQ ID NO: 1776540 - RNA, 23 nt, Homo sapiens
uguaugacucccaaauuuucaca

SEQ ID NO: 1776541 - RNA, 17 nt, Homo sapiens
cucugaaacggauccag

SEQ ID NO: 1776542 - RNA, 13 nt, Homo sapiens
cuucagcucugaa

SEQ ID NO: 1776543 - RNA, 12 nt, Homo sapiens
cauggaccacga

SEQ ID NO: 1776544 - RNA, 21 nt, Homo sapiens
cagaguucagggaggggcuga

SEQ ID NO: 1776545 - RNA, 22 nt, Homo sapiens
acgauacuccaaccauauggau

SEQ ID NO: 1776546 - RNA, 14 nt, Homo sapiens
uuauaucacuucac

SEQ ID NO: 1776547 - RNA, 16 nt, Homo sapiens
ugugagaaacaucuca

SEQ ID NO: 1776548 - RNA, 22 nt, Homo sapiens
ccaagcggaugcuccauuucaa

SEQ ID NO: 1776549 - RNA, 14 nt, Homo sapiens
acccacccaugcac

SEQ ID NO: 1776550 - RNA, 12 nt, Homo sapiens
ccagagaccuca

SEQ ID NO: 1776551 - RNA, 17 nt, Homo sapiens
auggaagagucaugugg

SEQ ID NO: 1776552 - RNA, 15 nt, Homo sapiens
agcggauugcucugg

SEQ ID NO: 1776553 - RNA, 19 nt, Homo sapiens
gaaaagagaaaaaaaagac

SEQ ID NO: 1776554 - RNA, 22 nt, Homo sapiens
gaugauuugcuuaaauauccau

SEQ ID NO: 1776555 - RNA, 19 nt, Homo sapiens
aggcuugaaguaaccuuau

SEQ ID NO: 1776556 - RNA, 12 nt, Homo sapiens
uauguugcaauc

SEQ ID NO: 1776557 - RNA, 15 nt, Homo sapiens
cugagaaaaggcaaa

SEQ ID NO: 1776558 - RNA, 17 nt, Homo sapiens
gaauaucuuaauuccuu

SEQ ID NO: 1776559 - RNA, 21 nt, Homo sapiens
cucugaggacacuaaccacgc

SEQ ID NO: 1776560 - RNA, 22 nt, Homo sapiens
aggugucaccuuccuaguucuu

SEQ ID NO: 1776561 - RNA, 19 nt, Homo sapiens
uagaggaagaaaaccagcg

SEQ ID NO: 1776562 - RNA, 22 nt, Homo sapiens
agggaagcugucccucacuguu

SEQ ID NO: 1776563 - RNA, 22 nt, Homo sapiens
uuggagagagaggcugccucag

SEQ ID NO: 1776564 - RNA, 21 nt, Homo sapiens
gaggaaaaaugauccagugga

SEQ ID NO: 1776565 - RNA, 20 nt, Homo sapiens
uuguguuuuguuuuguauca

SEQ ID NO: 1776566 - RNA, 11 nt, Homo sapiens
uuucagaguuu

SEQ ID NO: 1776567 - RNA, 18 nt, Homo sapiens
aauauuuccuccauuccu

SEQ ID NO: 1776568 - RNA, 12 nt, Homo sapiens
ugagaagauuca

SEQ ID NO: 1776569 - RNA, 17 nt, Homo sapiens
uguucaaaauuccauuu

SEQ ID NO: 1776570 - RNA, 16 nt, Homo sapiens
aggaaaacaugcugcu

SEQ ID NO: 1776571 - RNA, 18 nt, Homo sapiens
uccauuuacaaacuacuu

SEQ ID NO: 1776572 - RNA, 21 nt, Homo sapiens
ggcaacaacagcaaaacucca

SEQ ID NO: 1776573 - RNA, 18 nt, Homo sapiens
ugaauuaaaagucuacag

SEQ ID NO: 1776574 - RNA, 14 nt, Homo sapiens
ggaaccaaaaauca

SEQ ID NO: 1776575 - RNA, 19 nt, Homo sapiens
uuaaucucuuaauauugag

SEQ ID NO: 1776576 - RNA, 16 nt, Homo sapiens
acaaaggaaauaucaa

SEQ ID NO: 1776577 - RNA, 12 nt, Homo sapiens
auucagcauuuu

SEQ ID NO: 1776578 - RNA, 19 nt, Homo sapiens
aaggggaauguguccuccu

SEQ ID NO: 1776579 - RNA, 19 nt, Homo sapiens
aaacacacgugcugugggc

SEQ ID NO: 1776580 - RNA, 13 nt, Homo sapiens
ugccuucucagga

SEQ ID NO: 1776581 - RNA, 13 nt, Homo sapiens
cacgaucuuggcu

SEQ ID NO: 1776582 - RNA, 16 nt, Homo sapiens
uccuuccacauguaca

SEQ ID NO: 1776583 - RNA, 14 nt, Homo sapiens
gauggcagugagaa

SEQ ID NO: 1776584 - RNA, 20 nt, Homo sapiens
guuucugaucugaugcaagc

SEQ ID NO: 1776585 - RNA, 16 nt, Homo sapiens
gccccauacagggcau

SEQ ID NO: 1776586 - RNA, 18 nt, Homo sapiens
gcugaccucaccuggucc

SEQ ID NO: 1776587 - RNA, 12 nt, Homo sapiens
cuagucuacuuc

SEQ ID NO: 1776588 - RNA, 19 nt, Homo sapiens
aagauaugugggugcuccu

SEQ ID NO: 1776589 - RNA, 20 nt, Homo sapiens
aaaacaucuuuccaguccuu

SEQ ID NO: 1776590 - RNA, 16 nt, Homo sapiens
aauuuuuugacuugaa

SEQ ID NO: 1776591 - RNA, 16 nt, Homo sapiens
aaauuugcuauuccca

SEQ ID NO: 1776592 - RNA, 13 nt, Homo sapiens
aggacucaaaagu

SEQ ID NO: 1776593 - RNA, 12 nt, Homo sapiens
cacagaacugcu

SEQ ID NO: 1776594 - RNA, 12 nt, Homo sapiens
acuagugccauu

SEQ ID NO: 1776595 - RNA, 15 nt, Homo sapiens
caggaguaagacaag

SEQ ID NO: 1776596 - RNA, 22 nt, Homo sapiens
aaauauauacccccccaugcag

SEQ ID NO: 1776597 - RNA, 21 nt, Homo sapiens
uggcucagcuccuucaugaga

SEQ ID NO: 1776598 - RNA, 17 nt, Homo sapiens
acuuaacggaccaaagc

SEQ ID NO: 1776599 - RNA, 15 nt, Homo sapiens
cuguaaaugacacuu

SEQ ID NO: 1776600 - RNA, 20 nt, Homo sapiens
cagaaggauuaccugaggca

SEQ ID NO: 1776601 - RNA, 16 nt, Homo sapiens
caaggugcugauguca

SEQ ID NO: 1776602 - RNA, 12 nt, Homo sapiens
gcagagcacaga

SEQ ID NO: 1776603 - RNA, 18 nt, Homo sapiens
aauuuguuuuauauucuc

SEQ ID NO: 1776604 - RNA, 18 nt, Homo sapiens
cucugacaguccacaggg

SEQ ID NO: 1776605 - RNA, 19 nt, Homo sapiens
auaagauuuuguuagccaa

SEQ ID NO: 1776606 - RNA, 13 nt, Homo sapiens
auaauacauauua

SEQ ID NO: 1776607 - RNA, 18 nt, Homo sapiens
uguugaaacaaaacugga

SEQ ID NO: 1776608 - RNA, 13 nt, Homo sapiens
ccauggaggcaca

SEQ ID NO: 1776609 - RNA, 13 nt, Homo sapiens
gaucagagcauug

SEQ ID NO: 1776610 - RNA, 13 nt, Homo sapiens
agauccuggaaau

SEQ ID NO: 1776611 - RNA, 14 nt, Homo sapiens
aggccacagccgcc

SEQ ID NO: 1776612 - RNA, 16 nt, Homo sapiens
uacagacuccaaaagg

SEQ ID NO: 1776613 - RNA, 13 nt, Homo sapiens
aauaacauugcac

SEQ ID NO: 1776614 - RNA, 17 nt, Homo sapiens
cuucauggccucaggag

SEQ ID NO: 1776615 - RNA, 13 nt, Homo sapiens
aaagguucuucau

SEQ ID NO: 1776616 - RNA, 13 nt, Homo sapiens
ccaccacacccag

SEQ ID NO: 1776617 - RNA, 15 nt, Homo sapiens
caguauuguggggcu

SEQ ID NO: 1776618 - RNA, 13 nt, Homo sapiens
cagucuauggguu

SEQ ID NO: 1776619 - RNA, 19 nt, Homo sapiens
acagauggcagugccauaa

SEQ ID NO: 1776620 - RNA, 12 nt, Homo sapiens
aggguaacucuu

SEQ ID NO: 1776621 - RNA, 12 nt, Homo sapiens
aaaaacuauucu

SEQ ID NO: 1776622 - RNA, 13 nt, Homo sapiens
gcugcacauuccu

SEQ ID NO: 1776623 - RNA, 12 nt, Homo sapiens
uuagggcacugg

SEQ ID NO: 1776624 - RNA, 17 nt, Homo sapiens
gccaucugaagccaccu

SEQ ID NO: 1776625 - RNA, 14 nt, Homo sapiens
ccaggcuugccuca

SEQ ID NO: 1776626 - RNA, 14 nt, Homo sapiens
acugaggagacaga

SEQ ID NO: 1776627 - RNA, 15 nt, Homo sapiens
gccaagucauagcca

SEQ ID NO: 1776628 - RNA, 23 nt, Homo sapiens
uagcacccuggagagugcacaug

SEQ ID NO: 1776629 - RNA, 16 nt, Homo sapiens
accuucauuuuuaaac

SEQ ID NO: 1776630 - RNA, 18 nt, Homo sapiens
aguucaagugcucuucag

SEQ ID NO: 1776631 - RNA, 18 nt, Homo sapiens
gaguuguggaaagccucu

SEQ ID NO: 1776632 - RNA, 15 nt, Homo sapiens
cacaguugccaugua

SEQ ID NO: 1776633 - RNA, 13 nt, Homo sapiens
guggccacagacu

SEQ ID NO: 1776634 - RNA, 15 nt, Homo sapiens
ccaggaccucuuaag

SEQ ID NO: 1776635 - RNA, 13 nt, Homo sapiens
cccauacucagcc

SEQ ID NO: 1776636 - RNA, 12 nt, Homo sapiens
ugauagaagauu

SEQ ID NO: 1776637 - RNA, 14 nt, Homo sapiens
aagccaccucacca

SEQ ID NO: 1776638 - RNA, 11 nt, Homo sapiens
caucugugaau

SEQ ID NO: 1776639 - RNA, 22 nt, Homo sapiens
uaauuuccuuuuugacacugaa

SEQ ID NO: 1776640 - RNA, 14 nt, Homo sapiens
uauuaauacuaugc

SEQ ID NO: 1776641 - RNA, 14 nt, Homo sapiens
uauugcuacuauaa

SEQ ID NO: 1776642 - RNA, 13 nt, Homo sapiens
uuaucuugcuuca

SEQ ID NO: 1776643 - RNA, 11 nt, Homo sapiens
aggaugugaua

SEQ ID NO: 1776644 - RNA, 20 nt, Homo sapiens
gggagaaccacugacccaaa

SEQ ID NO: 1776645 - RNA, 19 nt, Homo sapiens
aacuguaccaugugcuaca

SEQ ID NO: 1776646 - RNA, 12 nt, Homo sapiens
ugugauaccuua

SEQ ID NO: 1776647 - RNA, 16 nt, Homo sapiens
ggaaaaauuaugugga

SEQ ID NO: 1776648 - RNA, 21 nt, Homo sapiens
gaaacaccagccgaggccaca

SEQ ID NO: 1776649 - RNA, 21 nt, Homo sapiens
gggucuugcuauauugcccag

SEQ ID NO: 1776650 - RNA, 21 nt, Homo sapiens
gaacaaugggaggcugugauu

SEQ ID NO: 1776651 - RNA, 20 nt, Homo sapiens
uucacagggacagaucugau

SEQ ID NO: 1776652 - RNA, 14 nt, Homo sapiens
uguaauugucucaa

SEQ ID NO: 1776653 - RNA, 16 nt, Homo sapiens
aaguugcuuuguuaca

SEQ ID NO: 1776654 - RNA, 22 nt, Homo sapiens
aagugucuuguucacugcagca

SEQ ID NO: 1776655 - RNA, 22 nt, Homo sapiens
cucagaggcgcacugugacccc

SEQ ID NO: 1776656 - RNA, 14 nt, Homo sapiens
aauaaauaaucuca

SEQ ID NO: 1776657 - RNA, 21 nt, Homo sapiens
gaggaaagggaaggcuggcag

SEQ ID NO: 1776658 - RNA, 16 nt, Homo sapiens
agcugggggcugaggg

SEQ ID NO: 1776659 - RNA, 18 nt, Homo sapiens
aacccggggcuggugggc

SEQ ID NO: 1776660 - RNA, 13 nt, Homo sapiens
auuuaaauuccac

SEQ ID NO: 1776661 - RNA, 15 nt, Homo sapiens
agaacuuuagcuauu

SEQ ID NO: 1776662 - RNA, 18 nt, Homo sapiens
cggccacucuaccugaac

SEQ ID NO: 1776663 - RNA, 13 nt, Homo sapiens
ccuaggaccucag

SEQ ID NO: 1776664 - RNA, 13 nt, Homo sapiens
uccuugacuuuuu

SEQ ID NO: 1776665 - RNA, 19 nt, Homo sapiens
aaauucagccaacauguga

SEQ ID NO: 1776666 - RNA, 16 nt, Homo sapiens
uaaaugaagugcaaau

SEQ ID NO: 1776667 - RNA, 20 nt, Homo sapiens
cucguagugguacauuccau

SEQ ID NO: 1776668 - RNA, 16 nt, Homo sapiens
uagaaauccaauugga

SEQ ID NO: 1776669 - RNA, 22 nt, Homo sapiens
ugcgagagaaagggagugcaug

SEQ ID NO: 1776670 - RNA, 19 nt, Homo sapiens
cacaaauaggauguacugu

SEQ ID NO: 1776671 - RNA, 20 nt, Homo sapiens
gacagucaccucauggaauu

SEQ ID NO: 1776672 - RNA, 19 nt, Homo sapiens
aaagcaguucuuaacccag

SEQ ID NO: 1776673 - RNA, 15 nt, Homo sapiens
auauuaacaauguuu

SEQ ID NO: 1776674 - RNA, 22 nt, Homo sapiens
cuaccccaguuccuagcacugc

SEQ ID NO: 1776675 - RNA, 19 nt, Homo sapiens
ucccaccugucaaccugaa

SEQ ID NO: 1776676 - RNA, 14 nt, Homo sapiens
agcuggguggugua

SEQ ID NO: 1776677 - RNA, 16 nt, Homo sapiens
aauucaccaacacagu

SEQ ID NO: 1776678 - RNA, 11 nt, Homo sapiens
aaaaacauguu

SEQ ID NO: 1776679 - RNA, 22 nt, Homo sapiens
caaugaaaacauguacuacagc

SEQ ID NO: 1776680 - RNA, 12 nt, Homo sapiens
cacucaaugucu

SEQ ID NO: 1776681 - RNA, 21 nt, Homo sapiens
uccaccuagagcuagaugugu

SEQ ID NO: 1776682 - RNA, 17 nt, Homo sapiens
uaaauaaaaauaaguca

SEQ ID NO: 1776683 - RNA, 17 nt, Homo sapiens
cuauagcuaaugugcug

SEQ ID NO: 1776684 - RNA, 20 nt, Homo sapiens
ugacaagugagacaaaaagc

SEQ ID NO: 1776685 - RNA, 16 nt, Homo sapiens
aucuucuuacuaagcu

SEQ ID NO: 1776686 - RNA, 23 nt, Homo sapiens
cuaaucagaugauggccauuucu

SEQ ID NO: 1776687 - RNA, 17 nt, Homo sapiens
acaacauguuuccagca

SEQ ID NO: 1776688 - RNA, 15 nt, Homo sapiens
ugggacugggacacu

SEQ ID NO: 1776689 - RNA, 16 nt, Homo sapiens
gaguugacuucugaca

SEQ ID NO: 1776690 - RNA, 17 nt, Homo sapiens
cugucuuuuauuuaaca

SEQ ID NO: 1776691 - RNA, 15 nt, Homo sapiens
accauauguagcauu

SEQ ID NO: 1776692 - RNA, 20 nt, Homo sapiens
guguaaauuaauuacauaca

SEQ ID NO: 1776693 - RNA, 21 nt, Homo sapiens
cccaggccccaggcaucuuuc

SEQ ID NO: 1776694 - RNA, 22 nt, Homo sapiens
caauacacggacacaaccaaau

SEQ ID NO: 1776695 - RNA, 12 nt, Homo sapiens
aacuguuuucuc

SEQ ID NO: 1776696 - RNA, 14 nt, Homo sapiens
ucuuccuccacuuc

SEQ ID NO: 1776697 - RNA, 10 nt, Homo sapiens
cccaucucag

SEQ ID NO: 1776698 - RNA, 21 nt, Homo sapiens
aauucauuucuagacucaaaa

SEQ ID NO: 1776699 - RNA, 23 nt, Homo sapiens
auauugauugggaaaacauuugc

SEQ ID NO: 1776700 - RNA, 20 nt, Homo sapiens
ucaugucggucccugagauc

SEQ ID NO: 1776701 - RNA, 11 nt, Homo sapiens
aauuacugugu

SEQ ID NO: 1776702 - RNA, 20 nt, Homo sapiens
uuucauaaacuucagggauc

SEQ ID NO: 1776703 - RNA, 15 nt, Homo sapiens
agugaagucuaugau

SEQ ID NO: 1776704 - RNA, 15 nt, Homo sapiens
cguugcccagcacug

SEQ ID NO: 1776705 - RNA, 17 nt, Homo sapiens
uguucuuaauugcacuc

SEQ ID NO: 1776706 - RNA, 20 nt, Homo sapiens
guuuucuguaaauaaccuau

SEQ ID NO: 1776707 - RNA, 18 nt, Homo sapiens
aagaauuuuaccauucag

SEQ ID NO: 1776708 - RNA, 17 nt, Homo sapiens
cucuccccuucucugua

SEQ ID NO: 1776709 - RNA, 19 nt, Homo sapiens
ucugugguugcagucuuuc

SEQ ID NO: 1776710 - RNA, 15 nt, Homo sapiens
caccuagcucaaugg

SEQ ID NO: 1776711 - RNA, 15 nt, Homo sapiens
gaauuucuuugucau

SEQ ID NO: 1776712 - RNA, 23 nt, Homo sapiens
uauucuucuaaguauuuugauga

SEQ ID NO: 1776713 - RNA, 22 nt, Homo sapiens
gucacauuuuaccaauaugcau

SEQ ID NO: 1776714 - RNA, 17 nt, Homo sapiens
cuaaaguuuugcaacaa

SEQ ID NO: 1776715 - RNA, 16 nt, Homo sapiens
cuuuccucaucaggcc

SEQ ID NO: 1776716 - RNA, 21 nt, Homo sapiens
agcauugggugcaaauauuca

SEQ ID NO: 1776717 - RNA, 21 nt, Homo sapiens
gacggguuucaccauguuggc

SEQ ID NO: 1776718 - RNA, 18 nt, Homo sapiens
acucucacuccacccaga

SEQ ID NO: 1776719 - RNA, 16 nt, Homo sapiens
uccgaagugcaaugau

SEQ ID NO: 1776720 - RNA, 22 nt, Homo sapiens
gugggccuuugagagccuccag

SEQ ID NO: 1776721 - RNA, 22 nt, Homo sapiens
ccauggauugauucagucuucu

SEQ ID NO: 1776722 - RNA, 18 nt, Homo sapiens
uccuccgugcuuccucag

SEQ ID NO: 1776723 - RNA, 22 nt, Homo sapiens
ccaauaaagcagaguuugacac

SEQ ID NO: 1776724 - RNA, 23 nt, Homo sapiens
caccgcggaggaggcuggugaca

SEQ ID NO: 1776725 - RNA, 14 nt, Homo sapiens
caguuccauuucau

SEQ ID NO: 1776726 - RNA, 13 nt, Homo sapiens
cuccucugaauuu

SEQ ID NO: 1776727 - RNA, 17 nt, Homo sapiens
uuuccaugcuauaauuc

SEQ ID NO: 1776728 - RNA, 17 nt, Homo sapiens
cuuugaauaaagucuga

SEQ ID NO: 1776729 - RNA, 20 nt, Homo sapiens
cagccugggcgacagagcca

SEQ ID NO: 1776730 - RNA, 12 nt, Homo sapiens
aaccugggaugu

SEQ ID NO: 1776731 - RNA, 19 nt, Homo sapiens
uagacuauggaaugucagu

SEQ ID NO: 1776732 - RNA, 20 nt, Homo sapiens
uugcagguugcuuugcccug

SEQ ID NO: 1776733 - RNA, 21 nt, Homo sapiens
agucagagagggugacaagau

SEQ ID NO: 1776734 - RNA, 17 nt, Homo sapiens
cuuagcugaacaaugaa

SEQ ID NO: 1776735 - RNA, 17 nt, Homo sapiens
ggugauuugucuuacaa

SEQ ID NO: 1776736 - RNA, 21 nt, Homo sapiens
cuuucuguuggauuccaugcu

SEQ ID NO: 1776737 - RNA, 13 nt, Homo sapiens
agacaaaggccca

SEQ ID NO: 1776738 - RNA, 15 nt, Homo sapiens
ugggagacaugugac

SEQ ID NO: 1776739 - RNA, 18 nt, Homo sapiens
uagaguccagaucuugcc

SEQ ID NO: 1776740 - RNA, 18 nt, Homo sapiens
gaaaaaaagccguuuuca

SEQ ID NO: 1776741 - RNA, 22 nt, Homo sapiens
ccagcaggcagguggacugacu

SEQ ID NO: 1776742 - RNA, 15 nt, Homo sapiens
accugcucucuccuc

SEQ ID NO: 1776743 - RNA, 23 nt, Homo sapiens
ggucccagccccuccucccucag

SEQ ID NO: 1776744 - RNA, 23 nt, Homo sapiens
uggugugaucucggcucacugca

SEQ ID NO: 1776745 - RNA, 12 nt, Homo sapiens
cccuucaccucc

SEQ ID NO: 1776746 - RNA, 21 nt, Homo sapiens
uaaacucagggacagagccau

SEQ ID NO: 1776747 - RNA, 19 nt, Homo sapiens
uuaaauguuuauaauuuau

SEQ ID NO: 1776748 - RNA, 15 nt, Homo sapiens
acacagaucacagcu

SEQ ID NO: 1776749 - RNA, 15 nt, Homo sapiens
aacgugcugcucaag

SEQ ID NO: 1776750 - RNA, 15 nt, Homo sapiens
caacauaggccugcu

SEQ ID NO: 1776751 - RNA, 17 nt, Homo sapiens
ucccaaaagcccauuca

SEQ ID NO: 1776752 - RNA, 14 nt, Homo sapiens
uggcacuauccaga

SEQ ID NO: 1776753 - RNA, 23 nt, Homo sapiens
agacgaccuuuaccuccugccuu

SEQ ID NO: 1776754 - RNA, 18 nt, Homo sapiens
cucaacauuacauuugaa

SEQ ID NO: 1776755 - RNA, 16 nt, Homo sapiens
cugaugaaaaggucag

SEQ ID NO: 1776756 - RNA, 16 nt, Homo sapiens
gcaaugacugugcuca

SEQ ID NO: 1776757 - RNA, 17 nt, Homo sapiens
auaaaaacuuacacucu

SEQ ID NO: 1776758 - RNA, 22 nt, Homo sapiens
gguccuugcaccccucacucug

SEQ ID NO: 1776759 - RNA, 16 nt, Homo sapiens
ugcccccaacacucca

SEQ ID NO: 1776760 - RNA, 22 nt, Homo sapiens
uauucuuggcaagaaugcuuua

SEQ ID NO: 1776761 - RNA, 15 nt, Homo sapiens
cuugaucagugugcu

SEQ ID NO: 1776762 - RNA, 21 nt, Homo sapiens
uggguuuaacaagcugucuac

SEQ ID NO: 1776763 - RNA, 22 nt, Homo sapiens
gaagauagcucucugacugcuu

SEQ ID NO: 1776764 - RNA, 21 nt, Homo sapiens
ucaagauccugucuugcugag

SEQ ID NO: 1776765 - RNA, 22 nt, Homo sapiens
auuucuguuauggggacuuuau

SEQ ID NO: 1776766 - RNA, 17 nt, Homo sapiens
ccaugcucaccaaggaa

SEQ ID NO: 1776767 - RNA, 12 nt, Homo sapiens
ccagaggggugc

SEQ ID NO: 1776768 - RNA, 12 nt, Homo sapiens
guggagggccac

SEQ ID NO: 1776769 - RNA, 17 nt, Homo sapiens
auucguaugccagcuca

SEQ ID NO: 1776770 - RNA, 16 nt, Homo sapiens
cuuugaacacaucucu

SEQ ID NO: 1776771 - RNA, 20 nt, Homo sapiens
cagucucaauuuuguauuua

SEQ ID NO: 1776772 - RNA, 20 nt, Homo sapiens
ucaucuugcagcauuuacua

SEQ ID NO: 1776773 - RNA, 13 nt, Homo sapiens
ccucaacaagcaa

SEQ ID NO: 1776774 - RNA, 22 nt, Homo sapiens
uucagcauuuguucuuugccag

SEQ ID NO: 1776775 - RNA, 13 nt, Homo sapiens
ugcccacacuugg

SEQ ID NO: 1776776 - RNA, 21 nt, Homo sapiens
aggugcauuggagauucuuag

SEQ ID NO: 1776777 - RNA, 24 nt, Homo sapiens
ccucccauuacuuugauaucugau

SEQ ID NO: 1776778 - RNA, 20 nt, Homo sapiens
acagagcgagagucugucuc

SEQ ID NO: 1776779 - RNA, 17 nt, Homo sapiens
auguuccgagaagaaca

SEQ ID NO: 1776780 - RNA, 16 nt, Homo sapiens
auaauugacuggugga

SEQ ID NO: 1776781 - RNA, 15 nt, Homo sapiens
caaagagaaugccau

SEQ ID NO: 1776782 - RNA, 14 nt, Homo sapiens
auuuuuaccuaauc

SEQ ID NO: 1776783 - RNA, 19 nt, Homo sapiens
guggcucaaugcaaccucu

SEQ ID NO: 1776784 - RNA, 18 nt, Homo sapiens
uaguuuuuaaaaaggccu

SEQ ID NO: 1776785 - RNA, 18 nt, Homo sapiens
uaaaauugcagcaguugc

SEQ ID NO: 1776786 - RNA, 13 nt, Homo sapiens
aaauuaaagcuga

SEQ ID NO: 1776787 - RNA, 20 nt, Homo sapiens
cagaugaacucuuucuggcc

SEQ ID NO: 1776788 - RNA, 17 nt, Homo sapiens
gaauacuugcacucuuu

SEQ ID NO: 1776789 - RNA, 17 nt, Homo sapiens
aaauuuauucacauaua

SEQ ID NO: 1776790 - RNA, 16 nt, Homo sapiens
cgucacuacugcuacc

SEQ ID NO: 1776791 - RNA, 16 nt, Homo sapiens
aacuguauauauuccc

SEQ ID NO: 1776792 - RNA, 14 nt, Homo sapiens
aacacuaacuuaau

SEQ ID NO: 1776793 - RNA, 14 nt, Homo sapiens
aucccuaacaucau

SEQ ID NO: 1776794 - RNA, 19 nt, Homo sapiens
gauauuuuuaugugcagcg

SEQ ID NO: 1776795 - RNA, 23 nt, Homo sapiens
uguagaucagggauagcgcuguu

SEQ ID NO: 1776796 - RNA, 19 nt, Homo sapiens
agugauccucccaccucag

SEQ ID NO: 1776797 - RNA, 20 nt, Homo sapiens
uuccucugcuguagagccau

SEQ ID NO: 1776798 - RNA, 12 nt, Homo sapiens
cuaugugcaaaa

SEQ ID NO: 1776799 - RNA, 17 nt, Homo sapiens
acguuuuuaaacaugaa

SEQ ID NO: 1776800 - RNA, 17 nt, Homo sapiens
cuccccaucaccauggg

SEQ ID NO: 1776801 - RNA, 15 nt, Homo sapiens
ccauccucacugcug

SEQ ID NO: 1776802 - RNA, 14 nt, Homo sapiens
aacagcucucaccu

SEQ ID NO: 1776803 - RNA, 13 nt, Homo sapiens
aaugguuacucau

SEQ ID NO: 1776804 - RNA, 13 nt, Homo sapiens
acacacacacucc

SEQ ID NO: 1776805 - RNA, 20 nt, Homo sapiens
cuccugggcucaagcgaucc

SEQ ID NO: 1776806 - RNA, 17 nt, Homo sapiens
cugcuccucugccugga

SEQ ID NO: 1776807 - RNA, 19 nt, Homo sapiens
uuauugugcuucagugcca

SEQ ID NO: 1776808 - RNA, 19 nt, Homo sapiens
ccuuuccuccccaccuucc

SEQ ID NO: 1776809 - RNA, 15 nt, Homo sapiens
uaugugcgugcaugu

SEQ ID NO: 1776810 - RNA, 20 nt, Homo sapiens
gaacacagccgauucaccug

SEQ ID NO: 1776811 - RNA, 21 nt, Homo sapiens
gguauuuguuuguagcuuucc

SEQ ID NO: 1776812 - RNA, 14 nt, Homo sapiens
gagucaaaaggcaa

SEQ ID NO: 1776813 - RNA, 17 nt, Homo sapiens
uguggaagcagaaggcu

SEQ ID NO: 1776814 - RNA, 22 nt, Homo sapiens
ugaacauuaaaauauagagaca

SEQ ID NO: 1776815 - RNA, 16 nt, Homo sapiens
cauagcaaacagagga

SEQ ID NO: 1776816 - RNA, 23 nt, Homo sapiens
cuaaacccuucaacuaugcaaug

SEQ ID NO: 1776817 - RNA, 18 nt, Homo sapiens
gaaagcaaaauaacaaaa

SEQ ID NO: 1776818 - RNA, 20 nt, Homo sapiens
auucacauauaucaaaguga

SEQ ID NO: 1776819 - RNA, 19 nt, Homo sapiens
ugggaagaaagauucaauu

SEQ ID NO: 1776820 - RNA, 16 nt, Homo sapiens
auccagagaccaaaua

SEQ ID NO: 1776821 - RNA, 14 nt, Homo sapiens
ucagaggccuauaa

SEQ ID NO: 1776822 - RNA, 20 nt, Homo sapiens
caaauaauauuacucuauga

SEQ ID NO: 1776823 - RNA, 13 nt, Homo sapiens
uaaaaaaugucua

SEQ ID NO: 1776824 - RNA, 21 nt, Homo sapiens
cuugugucucauauacccuau

SEQ ID NO: 1776825 - RNA, 12 nt, Homo sapiens
gaggaaagggag

SEQ ID NO: 1776826 - RNA, 20 nt, Homo sapiens
agugcaucacaucugcacac

SEQ ID NO: 1776827 - RNA, 12 nt, Homo sapiens
cuuuaagcacua

SEQ ID NO: 1776828 - RNA, 17 nt, Homo sapiens
uuugcucuucauccagg

SEQ ID NO: 1776829 - RNA, 19 nt, Homo sapiens
uguauuuuugucauaugua

SEQ ID NO: 1776830 - RNA, 12 nt, Homo sapiens
uccaauggggcg

SEQ ID NO: 1776831 - RNA, 17 nt, Homo sapiens
uuucaccauguuggcca

SEQ ID NO: 1776832 - RNA, 20 nt, Homo sapiens
cacgaugcauuuaauaaaga

SEQ ID NO: 1776833 - RNA, 22 nt, Homo sapiens
caggaccagguggcacuuccac

SEQ ID NO: 1776834 - RNA, 15 nt, Homo sapiens
auuccuugaguuuca

SEQ ID NO: 1776835 - RNA, 20 nt, Homo sapiens
cacuacauugugcaauugau

SEQ ID NO: 1776836 - RNA, 16 nt, Homo sapiens
aaacccaacuccucuc

SEQ ID NO: 1776837 - RNA, 11 nt, Homo sapiens
uucucuuugcu

SEQ ID NO: 1776838 - RNA, 16 nt, Homo sapiens
ggguaccaaugcugca

SEQ ID NO: 1776839 - RNA, 22 nt, Homo sapiens
cauagcacuugcagaccugccu

SEQ ID NO: 1776840 - RNA, 22 nt, Homo sapiens
uaacuuugcuggaaaaucugua

SEQ ID NO: 1776841 - RNA, 17 nt, Homo sapiens
acuagcaaacaaaaaua

SEQ ID NO: 1776842 - RNA, 17 nt, Homo sapiens
cuggguaggcagguguc

SEQ ID NO: 1776843 - RNA, 20 nt, Homo sapiens
gauucugcuagccuguucuu

SEQ ID NO: 1776844 - RNA, 14 nt, Homo sapiens
augguuuaacauau

SEQ ID NO: 1776845 - RNA, 22 nt, Homo sapiens
cccugggguuuuuuucaucccu

SEQ ID NO: 1776846 - RNA, 22 nt, Homo sapiens
gauccuuuuccaucccacucca

SEQ ID NO: 1776847 - RNA, 16 nt, Homo sapiens
cucauuuagcauugaa

SEQ ID NO: 1776848 - RNA, 13 nt, Homo sapiens
aacaaagaagcua

SEQ ID NO: 1776849 - RNA, 13 nt, Homo sapiens
caucccacagugg

SEQ ID NO: 1776850 - RNA, 22 nt, Homo sapiens
ugccuuaccgagagccaaacag

SEQ ID NO: 1776851 - RNA, 22 nt, Homo sapiens
aucugcacuauguuuccauuug

SEQ ID NO: 1776852 - RNA, 21 nt, Homo sapiens
auccagaacuaccaccugaca

SEQ ID NO: 1776853 - RNA, 18 nt, Homo sapiens
ugacaaugggagccucau

SEQ ID NO: 1776854 - RNA, 22 nt, Homo sapiens
cugggccccacuggacaacacu

SEQ ID NO: 1776855 - RNA, 15 nt, Homo sapiens
uuauagucaauggcu

SEQ ID NO: 1776856 - RNA, 13 nt, Homo sapiens
ucauuuagcauug

SEQ ID NO: 1776857 - RNA, 15 nt, Homo sapiens
ccagccaagugguga

SEQ ID NO: 1776858 - RNA, 16 nt, Homo sapiens
uucuuaaacaauuuga

SEQ ID NO: 1776859 - RNA, 16 nt, Homo sapiens
uuaugcugaaacagaa

SEQ ID NO: 1776860 - RNA, 19 nt, Homo sapiens
aguaauaaaacaucuuucc

SEQ ID NO: 1776861 - RNA, 17 nt, Homo sapiens
gaggaauugauugucag

SEQ ID NO: 1776862 - RNA, 19 nt, Homo sapiens
cauauucccacagcacuaa

SEQ ID NO: 1776863 - RNA, 17 nt, Homo sapiens
gaugaauaaaaugaagg

SEQ ID NO: 1776864 - RNA, 18 nt, Homo sapiens
acaacuuagaaaccaaau

SEQ ID NO: 1776865 - RNA, 13 nt, Homo sapiens
aaugcuacuuuca

SEQ ID NO: 1776866 - RNA, 19 nt, Homo sapiens
ccuucacuuucuccuggug

SEQ ID NO: 1776867 - RNA, 22 nt, Homo sapiens
acuauuggugcuugacucucac

SEQ ID NO: 1776868 - RNA, 13 nt, Homo sapiens
gacuuaacucuaa

SEQ ID NO: 1776869 - RNA, 19 nt, Homo sapiens
caaguacauggcuagcuuu

SEQ ID NO: 1776870 - RNA, 15 nt, Homo sapiens
cugucugugugcuga

SEQ ID NO: 1776871 - RNA, 16 nt, Homo sapiens
cuacuugucauaucac

SEQ ID NO: 1776872 - RNA, 21 nt, Homo sapiens
gucaugguagagaccgagccu

SEQ ID NO: 1776873 - RNA, 24 nt, Homo sapiens
acaauccaucucucaaguagugua

SEQ ID NO: 1776874 - RNA, 23 nt, Homo sapiens
gucauggccugagaugcagguga

SEQ ID NO: 1776875 - RNA, 15 nt, Homo sapiens
aaaggauugaucacu

SEQ ID NO: 1776876 - RNA, 16 nt, Homo sapiens
auuuacuuccuugcau

SEQ ID NO: 1776877 - RNA, 19 nt, Homo sapiens
uugacaaagugccgugaua

SEQ ID NO: 1776878 - RNA, 15 nt, Homo sapiens
ucagcauuugaucug

SEQ ID NO: 1776879 - RNA, 21 nt, Homo sapiens
acaauaauauauccacaucua

SEQ ID NO: 1776880 - RNA, 19 nt, Homo sapiens
aaauucccuggccuuucau

SEQ ID NO: 1776881 - RNA, 22 nt, Homo sapiens
cuacaguuuuuauuuagcaugg

SEQ ID NO: 1776882 - RNA, 20 nt, Homo sapiens
guuuguaacuugggcuguaa

SEQ ID NO: 1776883 - RNA, 16 nt, Homo sapiens
acaagcaucauggauc

SEQ ID NO: 1776884 - RNA, 14 nt, Homo sapiens
gaaccacaaaaagu

SEQ ID NO: 1776885 - RNA, 21 nt, Homo sapiens
cauugauauauccuuuugcua

SEQ ID NO: 1776886 - RNA, 19 nt, Homo sapiens
ccaagucuuagaccaguga

SEQ ID NO: 1776887 - RNA, 22 nt, Homo sapiens
uugcaugauaucuucaagccug

SEQ ID NO: 1776888 - RNA, 18 nt, Homo sapiens
uaagggacucccacaaca

SEQ ID NO: 1776889 - RNA, 16 nt, Homo sapiens
ugagagcuuugcuuau

SEQ ID NO: 1776890 - RNA, 16 nt, Homo sapiens
uggccuggggcuucug

SEQ ID NO: 1776891 - RNA, 16 nt, Homo sapiens
cuccuuuuuccuucca

SEQ ID NO: 1776892 - RNA, 17 nt, Homo sapiens
uggccaaauagcaaaga

SEQ ID NO: 1776893 - RNA, 18 nt, Homo sapiens
acuucuccuuuaaauucu

SEQ ID NO: 1776894 - RNA, 17 nt, Homo sapiens
ccacuuucaagacagau

SEQ ID NO: 1776895 - RNA, 12 nt, Homo sapiens
gagagacuguuc

SEQ ID NO: 1776896 - RNA, 10 nt, Homo sapiens
ugagugucaa

SEQ ID NO: 1776897 - RNA, 22 nt, Homo sapiens
ugcugguuagguccaccugcua

SEQ ID NO: 1776898 - RNA, 19 nt, Homo sapiens
acuacauuugugaacaaaa

SEQ ID NO: 1776899 - RNA, 14 nt, Homo sapiens
cuuagaggcaaaga

SEQ ID NO: 1776900 - RNA, 20 nt, Homo sapiens
ccugcgccuccagagguccu

SEQ ID NO: 1776901 - RNA, 16 nt, Homo sapiens
aguucuggaaaccacg

SEQ ID NO: 1776902 - RNA, 22 nt, Homo sapiens
ucaccaggggugcuaugacaug

SEQ ID NO: 1776903 - RNA, 22 nt, Homo sapiens
cugggcaacagagcaagaccuc

SEQ ID NO: 1776904 - RNA, 16 nt, Homo sapiens
gugccuuacuauaugu

SEQ ID NO: 1776905 - RNA, 12 nt, Homo sapiens
aagaauucauga

SEQ ID NO: 1776906 - RNA, 12 nt, Homo sapiens
cugcauuccagc

SEQ ID NO: 1776907 - RNA, 13 nt, Homo sapiens
cuagccaucucaa

SEQ ID NO: 1776908 - RNA, 22 nt, Homo sapiens
aacccuaaagcaaaucugccac

SEQ ID NO: 1776909 - RNA, 17 nt, Homo sapiens
cugcuguauuuauagua

SEQ ID NO: 1776910 - RNA, 22 nt, Homo sapiens
gaaucaggauuccuucuucccc

SEQ ID NO: 1776911 - RNA, 22 nt, Homo sapiens
guggaaaaaaaaaaaaaggaaa

SEQ ID NO: 1776912 - RNA, 21 nt, Homo sapiens
cacaaggcacaccagugcaag

SEQ ID NO: 1776913 - RNA, 16 nt, Homo sapiens
gcauguuauggugcua

SEQ ID NO: 1776914 - RNA, 20 nt, Homo sapiens
gacugcuuuuuugccucaca

SEQ ID NO: 1776915 - RNA, 23 nt, Homo sapiens
ccaggaguacaccccaacagcac

SEQ ID NO: 1776916 - RNA, 19 nt, Homo sapiens
aaacacugggggcaccuua

SEQ ID NO: 1776917 - RNA, 19 nt, Homo sapiens
uggauauaccuagauucca

SEQ ID NO: 1776918 - RNA, 21 nt, Homo sapiens
aacguuuuuggacacugugcu

SEQ ID NO: 1776919 - RNA, 20 nt, Homo sapiens
uccuauuucuuauagucaau

SEQ ID NO: 1776920 - RNA, 12 nt, Homo sapiens
cucaugcaagac

SEQ ID NO: 1776921 - RNA, 13 nt, Homo sapiens
aaccagccucaaa

SEQ ID NO: 1776922 - RNA, 14 nt, Homo sapiens
uguggccucagcau

SEQ ID NO: 1776923 - RNA, 16 nt, Homo sapiens
gugcgcaauugcucau

SEQ ID NO: 1776924 - RNA, 16 nt, Homo sapiens
gauaaaugucuuucca

SEQ ID NO: 1776925 - RNA, 18 nt, Homo sapiens
aacugaaaacaagccaug

SEQ ID NO: 1776926 - RNA, 13 nt, Homo sapiens
gagugggggaccg

SEQ ID NO: 1776927 - RNA, 17 nt, Homo sapiens
aauuauauauacuauau

SEQ ID NO: 1776928 - RNA, 18 nt, Homo sapiens
gaaucccagcagcagaga

SEQ ID NO: 1776929 - RNA, 18 nt, Homo sapiens
uuuuuggcugugaccucu

SEQ ID NO: 1776930 - RNA, 23 nt, Homo sapiens
cauaaguaaucacuaaugcucaa

SEQ ID NO: 1776931 - RNA, 22 nt, Homo sapiens
uguuuauacacaacuuugcaaa

SEQ ID NO: 1776932 - RNA, 19 nt, Homo sapiens
guuuccagcacuaucccca

SEQ ID NO: 1776933 - RNA, 17 nt, Homo sapiens
guuacaggaagucccuu

SEQ ID NO: 1776934 - RNA, 14 nt, Homo sapiens
cauuucagcuugaa

SEQ ID NO: 1776935 - RNA, 17 nt, Homo sapiens
caaccugcacaaccugg

SEQ ID NO: 1776936 - RNA, 20 nt, Homo sapiens
uagccaaugcuuacugcgcu

SEQ ID NO: 1776937 - RNA, 18 nt, Homo sapiens
aacaggccgcacaucuca

SEQ ID NO: 1776938 - RNA, 20 nt, Homo sapiens
cuuuuuuaaaaacaaacaaa

SEQ ID NO: 1776939 - RNA, 16 nt, Homo sapiens
uucuuacacacugucu

SEQ ID NO: 1776940 - RNA, 14 nt, Homo sapiens
caguggagcucaga

SEQ ID NO: 1776941 - RNA, 17 nt, Homo sapiens
uguggcugcugcugcca

SEQ ID NO: 1776942 - RNA, 16 nt, Homo sapiens
cagccaggaccaccuc

SEQ ID NO: 1776943 - RNA, 22 nt, Homo sapiens
gauccugcacucuaacacucga

SEQ ID NO: 1776944 - RNA, 22 nt, Homo sapiens
aagguagccaucccaugaacac

SEQ ID NO: 1776945 - RNA, 18 nt, Homo sapiens
aagcuugaagcuguggag

SEQ ID NO: 1776946 - RNA, 14 nt, Homo sapiens
ccuucagguuccuc

SEQ ID NO: 1776947 - RNA, 21 nt, Homo sapiens
gaaccaaaucuggaagccaaa

SEQ ID NO: 1776948 - RNA, 13 nt, Homo sapiens
uuagccaaaagaa

SEQ ID NO: 1776949 - RNA, 15 nt, Homo sapiens
gaaacagcgcugggu

SEQ ID NO: 1776950 - RNA, 18 nt, Homo sapiens
ucaggagcagcaucauuc

SEQ ID NO: 1776951 - RNA, 17 nt, Homo sapiens
agagccuagaggcucac

SEQ ID NO: 1776952 - RNA, 16 nt, Homo sapiens
augcauauaucuccca

SEQ ID NO: 1776953 - RNA, 18 nt, Homo sapiens
acaggcagacacaugcug

SEQ ID NO: 1776954 - RNA, 17 nt, Homo sapiens
uuugccaaucauugcaa

SEQ ID NO: 1776955 - RNA, 23 nt, Homo sapiens
cagcauauguguaaagauuuaua

SEQ ID NO: 1776956 - RNA, 12 nt, Homo sapiens
auuaaaacugag

SEQ ID NO: 1776957 - RNA, 19 nt, Homo sapiens
agacucuccacuguuaccu

SEQ ID NO: 1776958 - RNA, 19 nt, Homo sapiens
ucccccuuucacacuggau

SEQ ID NO: 1776959 - RNA, 20 nt, Homo sapiens
guugcuguuguuccuucaca

SEQ ID NO: 1776960 - RNA, 14 nt, Homo sapiens
gccaaggaugacac

SEQ ID NO: 1776961 - RNA, 14 nt, Homo sapiens
guggcugauuucaa

SEQ ID NO: 1776962 - RNA, 21 nt, Homo sapiens
uacuaauuuucuagauuuucu

SEQ ID NO: 1776963 - RNA, 22 nt, Homo sapiens
gggcugucuuugcagggcacag

SEQ ID NO: 1776964 - RNA, 18 nt, Homo sapiens
cccaaggccccacucucg

SEQ ID NO: 1776965 - RNA, 19 nt, Homo sapiens
auuuuauggcucacuauga

SEQ ID NO: 1776966 - RNA, 18 nt, Homo sapiens
agaugacuuccccugccu

SEQ ID NO: 1776967 - RNA, 17 nt, Homo sapiens
ccaagaaacacuuucag

SEQ ID NO: 1776968 - RNA, 19 nt, Homo sapiens
acaugcuuuagccauacac

SEQ ID NO: 1776969 - RNA, 14 nt, Homo sapiens
cucccagugacaac

SEQ ID NO: 1776970 - RNA, 14 nt, Homo sapiens
ugauuacagcauag

SEQ ID NO: 1776971 - RNA, 21 nt, Homo sapiens
uugcaccacugcacuccaguc

SEQ ID NO: 1776972 - RNA, 15 nt, Homo sapiens
cccagagcacuuuag

SEQ ID NO: 1776973 - RNA, 14 nt, Homo sapiens
uuagcaguacccua

SEQ ID NO: 1776974 - RNA, 16 nt, Homo sapiens
agacugaaaagccaug

SEQ ID NO: 1776975 - RNA, 16 nt, Homo sapiens
uggggcaggucacuuu

SEQ ID NO: 1776976 - RNA, 15 nt, Homo sapiens
cugacagguucccag

SEQ ID NO: 1776977 - RNA, 15 nt, Homo sapiens
aacaauuuggucuua

SEQ ID NO: 1776978 - RNA, 20 nt, Homo sapiens
guguuuauuauaaagcuuaa

SEQ ID NO: 1776979 - RNA, 16 nt, Homo sapiens
ccauugcauuccagcc

SEQ ID NO: 1776980 - RNA, 16 nt, Homo sapiens
gcgagagaaaaggaaa

SEQ ID NO: 1776981 - RNA, 17 nt, Homo sapiens
ucacuacaaaaagaaga

SEQ ID NO: 1776982 - RNA, 16 nt, Homo sapiens
ggacaggagucagugu

SEQ ID NO: 1776983 - RNA, 23 nt, Homo sapiens
acuaggaaaaaauugcuuuugag

SEQ ID NO: 1776984 - RNA, 14 nt, Homo sapiens
cuaccaauaacgua

SEQ ID NO: 1776985 - RNA, 22 nt, Homo sapiens
auagugccagguggcucagugc

SEQ ID NO: 1776986 - RNA, 17 nt, Homo sapiens
agaauaaggcaggcauu

SEQ ID NO: 1776987 - RNA, 22 nt, Homo sapiens
uuccauuuguagguagugagac

SEQ ID NO: 1776988 - RNA, 20 nt, Homo sapiens
agaaguuuggcaguauuuaa

SEQ ID NO: 1776989 - RNA, 16 nt, Homo sapiens
cuaaguuccuucccag

SEQ ID NO: 1776990 - RNA, 18 nt, Homo sapiens
auuaaguguuguacaauu

SEQ ID NO: 1776991 - RNA, 23 nt, Homo sapiens
ugucagaaaagagccacuuucaa

SEQ ID NO: 1776992 - RNA, 20 nt, Homo sapiens
uacagggacacuaucacuca

SEQ ID NO: 1776993 - RNA, 18 nt, Homo sapiens
acaugccaagcacugugc

SEQ ID NO: 1776994 - RNA, 16 nt, Homo sapiens
uccacaggacgcacag

SEQ ID NO: 1776995 - RNA, 18 nt, Homo sapiens
cagccuucccaacaugcc

SEQ ID NO: 1776996 - RNA, 21 nt, Homo sapiens
uucuuccgcaccgucccgcca

SEQ ID NO: 1776997 - RNA, 13 nt, Homo sapiens
aaucuggauucau

SEQ ID NO: 1776998 - RNA, 13 nt, Homo sapiens
auguaaugucaag

SEQ ID NO: 1776999 - RNA, 16 nt, Homo sapiens
acuucaguucucaucu

SEQ ID NO: 1777000 - RNA, 20 nt, Homo sapiens
uaagacagauucuucacugu

SEQ ID NO: 1777001 - RNA, 12 nt, Homo sapiens
auuggugcauuu

SEQ ID NO: 1777002 - RNA, 23 nt, Homo sapiens
gugauaaguugaggaaagaaaua

SEQ ID NO: 1777003 - RNA, 15 nt, Homo sapiens
auccccuguccccug

SEQ ID NO: 1777004 - RNA, 23 nt, Homo sapiens
ccuugagucuguguuguguccug

SEQ ID NO: 1777005 - RNA, 18 nt, Homo sapiens
aguuugagaccagccuga

SEQ ID NO: 1777006 - RNA, 22 nt, Homo sapiens
caugcuucuacugugacacuua

SEQ ID NO: 1777007 - RNA, 23 nt, Homo sapiens
cugcacuuaaauaucaaucauuu

SEQ ID NO: 1777008 - RNA, 14 nt, Homo sapiens
ucauuugaaugcuu

SEQ ID NO: 1777009 - RNA, 17 nt, Homo sapiens
aaaaugguuuguccuga

SEQ ID NO: 1777010 - RNA, 18 nt, Homo sapiens
acuuuguccccucaccuc

SEQ ID NO: 1777011 - RNA, 18 nt, Homo sapiens
uugaggggcugacuucaa

SEQ ID NO: 1777012 - RNA, 17 nt, Homo sapiens
ccugccuuccaaccccu

SEQ ID NO: 1777013 - RNA, 23 nt, Homo sapiens
ccgagcccagcuacauuccucag

SEQ ID NO: 1777014 - RNA, 23 nt, Homo sapiens
ucagccaagcuuguuaucagcuu

SEQ ID NO: 1777015 - RNA, 13 nt, Homo sapiens
aggagagucccag

SEQ ID NO: 1777016 - RNA, 19 nt, Homo sapiens
gaaccagcaagucccagac

SEQ ID NO: 1777017 - RNA, 13 nt, Homo sapiens
cucucauucucac

SEQ ID NO: 1777018 - RNA, 17 nt, Homo sapiens
ucuaaaaguacugcauu

SEQ ID NO: 1777019 - RNA, 17 nt, Homo sapiens
ugacgaacuuccauggc

SEQ ID NO: 1777020 - RNA, 14 nt, Homo sapiens
caagcaucauggau

SEQ ID NO: 1777021 - RNA, 14 nt, Homo sapiens
cacuucaccaagga

SEQ ID NO: 1777022 - RNA, 22 nt, Homo sapiens
ccuuccugggcagcccagagag

SEQ ID NO: 1777023 - RNA, 17 nt, Homo sapiens
agauuaggucacauuac

SEQ ID NO: 1777024 - RNA, 18 nt, Homo sapiens
uaaaaugcuucacuguac

SEQ ID NO: 1777025 - RNA, 12 nt, Homo sapiens
ugagagcaauau

SEQ ID NO: 1777026 - RNA, 12 nt, Homo sapiens
ugcuucagccug

SEQ ID NO: 1777027 - RNA, 12 nt, Homo sapiens
uuugucaugccc

SEQ ID NO: 1777028 - RNA, 21 nt, Homo sapiens
ucuaauuugcaccuuugucug

SEQ ID NO: 1777029 - RNA, 14 nt, Homo sapiens
ccaggcgggcucaa

SEQ ID NO: 1777030 - RNA, 15 nt, Homo sapiens
aaguacuuaauugaa

SEQ ID NO: 1777031 - RNA, 23 nt, Homo sapiens
acugacacauugcugauaugcaa

SEQ ID NO: 1777032 - RNA, 11 nt, Homo sapiens
uugugagcucu

SEQ ID NO: 1777033 - RNA, 18 nt, Homo sapiens
uuccaaagagaaggccug

SEQ ID NO: 1777034 - RNA, 22 nt, Homo sapiens
ucagcuggaaaaggccuguggc

SEQ ID NO: 1777035 - RNA, 19 nt, Homo sapiens
uucucagguguugccaaau

SEQ ID NO: 1777036 - RNA, 22 nt, Homo sapiens
uguuuucgaaaaucaaauggua

SEQ ID NO: 1777037 - RNA, 15 nt, Homo sapiens
gucuucagagcaaaa

SEQ ID NO: 1777038 - RNA, 18 nt, Homo sapiens
cgcuguauuuacagacac

SEQ ID NO: 1777039 - RNA, 22 nt, Homo sapiens
uggcagcaacaaaggauuugaa

SEQ ID NO: 1777040 - RNA, 19 nt, Homo sapiens
uuugaacccuugcuugcaa

SEQ ID NO: 1777041 - RNA, 22 nt, Homo sapiens
gggauguucagcacugucccuu

SEQ ID NO: 1777042 - RNA, 21 nt, Homo sapiens
cuugagaauuacccuuuugcc

SEQ ID NO: 1777043 - RNA, 16 nt, Homo sapiens
gagacauaucacucaa

SEQ ID NO: 1777044 - RNA, 18 nt, Homo sapiens
ucacgccucuguguucag

SEQ ID NO: 1777045 - RNA, 23 nt, Homo sapiens
auuucagaccaguucuuugggcu

SEQ ID NO: 1777046 - RNA, 16 nt, Homo sapiens
uccauguuugcaaugc

SEQ ID NO: 1777047 - RNA, 15 nt, Homo sapiens
caauuuuugaucaau

SEQ ID NO: 1777048 - RNA, 21 nt, Homo sapiens
uaccuggcuuugcuuagcuug

SEQ ID NO: 1777049 - RNA, 16 nt, Homo sapiens
aagaaugauuaugaau

SEQ ID NO: 1777050 - RNA, 14 nt, Homo sapiens
aaaaacuacuguua

SEQ ID NO: 1777051 - RNA, 22 nt, Homo sapiens
aauuagaacuccugaccccaga

SEQ ID NO: 1777052 - RNA, 20 nt, Homo sapiens
gacacagcccgaggaaucaa

SEQ ID NO: 1777053 - RNA, 18 nt, Homo sapiens
acaaaccuuaaaacagcu

SEQ ID NO: 1777054 - RNA, 21 nt, Homo sapiens
uaaggacgaaaaacacagugc

SEQ ID NO: 1777055 - RNA, 19 nt, Homo sapiens
ugccagauggaacaauaaa

SEQ ID NO: 1777056 - RNA, 16 nt, Homo sapiens
gacauuguuuugccaa

SEQ ID NO: 1777057 - RNA, 20 nt, Homo sapiens
cagaucuaugccacaagaac

SEQ ID NO: 1777058 - RNA, 22 nt, Homo sapiens
aaaaagaaagaaaaaagugcaa

SEQ ID NO: 1777059 - RNA, 17 nt, Homo sapiens
caggauuaggagcuggg

SEQ ID NO: 1777060 - RNA, 18 nt, Homo sapiens
acauguaugugcauuuca

SEQ ID NO: 1777061 - RNA, 15 nt, Homo sapiens
auuggcccaacaaga

SEQ ID NO: 1777062 - RNA, 22 nt, Homo sapiens
cacuggaucuucagaaggcuag

SEQ ID NO: 1777063 - RNA, 21 nt, Homo sapiens
gccgagccaugugucuuuaca

SEQ ID NO: 1777064 - RNA, 22 nt, Homo sapiens
gcuguuuccaguuguuacugaa

SEQ ID NO: 1777065 - RNA, 22 nt, Homo sapiens
gagccugucuuucagcauucag

SEQ ID NO: 1777066 - RNA, 14 nt, Homo sapiens
aaaccauucuuucc

SEQ ID NO: 1777067 - RNA, 16 nt, Homo sapiens
uggcacuugggacaaa

SEQ ID NO: 1777068 - RNA, 17 nt, Homo sapiens
auuuguacaaauacugc

SEQ ID NO: 1777069 - RNA, 13 nt, Homo sapiens
aaaauuccacuca

SEQ ID NO: 1777070 - RNA, 15 nt, Homo sapiens
ugcaguugcagugaa

SEQ ID NO: 1777071 - RNA, 22 nt, Homo sapiens
aaaaccuacgcacauaccuuca

SEQ ID NO: 1777072 - RNA, 20 nt, Homo sapiens
uuuaaaacaauauuuauguc

SEQ ID NO: 1777073 - RNA, 22 nt, Homo sapiens
cucagcucacugguccauuucu

SEQ ID NO: 1777074 - RNA, 20 nt, Homo sapiens
gaggcagacagguguaugga

SEQ ID NO: 1777075 - RNA, 22 nt, Homo sapiens
uaaauuauuuuaaaaacuaaaa

SEQ ID NO: 1777076 - RNA, 19 nt, Homo sapiens
aacaacguaaacuuccuaa

SEQ ID NO: 1777077 - RNA, 22 nt, Homo sapiens
gccagcuuggggccaccaaagc

SEQ ID NO: 1777078 - RNA, 12 nt, Homo sapiens
uuuccagaguau

SEQ ID NO: 1777079 - RNA, 19 nt, Homo sapiens
acaauccaugaacagcauu

SEQ ID NO: 1777080 - RNA, 23 nt, Homo sapiens
ucacuuguguguguaccuguggc

SEQ ID NO: 1777081 - RNA, 19 nt, Homo sapiens
cagaggucuggcaugugga

SEQ ID NO: 1777082 - RNA, 18 nt, Homo sapiens
acaucucugucaguguga

SEQ ID NO: 1777083 - RNA, 16 nt, Homo sapiens
cucaaauuaacuuucc

SEQ ID NO: 1777084 - RNA, 19 nt, Homo sapiens
auuuggacuggugugcucu

SEQ ID NO: 1777085 - RNA, 12 nt, Homo sapiens
uuuccucugcau

SEQ ID NO: 1777086 - RNA, 12 nt, Homo sapiens
guuucucuucac

SEQ ID NO: 1777087 - RNA, 24 nt, Homo sapiens
ccugcucagcccugcaccaugcug

SEQ ID NO: 1777088 - RNA, 18 nt, Homo sapiens
uguucaagagcacacuug

SEQ ID NO: 1777089 - RNA, 17 nt, Homo sapiens
aauuuuuugacuugaag

SEQ ID NO: 1777090 - RNA, 22 nt, Homo sapiens
acagaugagaauccuuguggcu

SEQ ID NO: 1777091 - RNA, 23 nt, Homo sapiens
caauucuaggaugaacaauguau

SEQ ID NO: 1777092 - RNA, 21 nt, Homo sapiens
aauccagcaggucacacuggg

SEQ ID NO: 1777093 - RNA, 19 nt, Homo sapiens
agggaucucucuacaagag

SEQ ID NO: 1777094 - RNA, 19 nt, Homo sapiens
cucuccuagcccuccugag

SEQ ID NO: 1777095 - RNA, 21 nt, Homo sapiens
accauuuggucaggauuccug

SEQ ID NO: 1777096 - RNA, 23 nt, Homo sapiens
ucaaauuuauuuccaauguuuca

SEQ ID NO: 1777097 - RNA, 20 nt, Homo sapiens
acgcacacacacacacagga

SEQ ID NO: 1777098 - RNA, 15 nt, Homo sapiens
auaagaauugucucu

SEQ ID NO: 1777099 - RNA, 13 nt, Homo sapiens
aaaaauggcucag

SEQ ID NO: 1777100 - RNA, 20 nt, Homo sapiens
auaaugccuuguaugguguu

SEQ ID NO: 1777101 - RNA, 12 nt, Homo sapiens
aagaaugcucuu

SEQ ID NO: 1777102 - RNA, 14 nt, Homo sapiens
gggaagccuagaga

SEQ ID NO: 1777103 - RNA, 18 nt, Homo sapiens
caauauagcaagauccca

SEQ ID NO: 1777104 - RNA, 13 nt, Homo sapiens
gccauuguucacc

SEQ ID NO: 1777105 - RNA, 18 nt, Homo sapiens
ugcauaauaacuacuucc

SEQ ID NO: 1777106 - RNA, 12 nt, Homo sapiens
aucuuccaauuu

SEQ ID NO: 1777107 - RNA, 13 nt, Homo sapiens
gaucaucagucac

SEQ ID NO: 1777108 - RNA, 19 nt, Homo sapiens
guuccuguagaacugagaa

SEQ ID NO: 1777109 - RNA, 16 nt, Homo sapiens
gucagaguugugcaca

SEQ ID NO: 1777110 - RNA, 23 nt, Homo sapiens
aaucauugauugucagcuacuaa

SEQ ID NO: 1777111 - RNA, 18 nt, Homo sapiens
aggcucagagagguagca

SEQ ID NO: 1777112 - RNA, 22 nt, Homo sapiens
aagaguuucuucucauauccau

SEQ ID NO: 1777113 - RNA, 17 nt, Homo sapiens
ugaaacacacauggaca

SEQ ID NO: 1777114 - RNA, 14 nt, Homo sapiens
ucucugccaugugg

SEQ ID NO: 1777115 - RNA, 12 nt, Homo sapiens
agaaccucaggc

SEQ ID NO: 1777116 - RNA, 15 nt, Homo sapiens
cuggcugguggaaca

SEQ ID NO: 1777117 - RNA, 16 nt, Homo sapiens
aguaaaaggcuuauua

SEQ ID NO: 1777118 - RNA, 20 nt, Homo sapiens
uaucugagcucuuaucuaug

SEQ ID NO: 1777119 - RNA, 23 nt, Homo sapiens
uaauguuggacagacacuguugc

SEQ ID NO: 1777120 - RNA, 16 nt, Homo sapiens
auacagaauuacugua

SEQ ID NO: 1777121 - RNA, 16 nt, Homo sapiens
ugccuauaagccaaaa

SEQ ID NO: 1777122 - RNA, 19 nt, Homo sapiens
gaaucacugcucacacugc

SEQ ID NO: 1777123 - RNA, 19 nt, Homo sapiens
aucuuggauuaugaaguga

SEQ ID NO: 1777124 - RNA, 17 nt, Homo sapiens
uagauuuccacacgcca

SEQ ID NO: 1777125 - RNA, 14 nt, Homo sapiens
cggaugcacagaga

SEQ ID NO: 1777126 - RNA, 23 nt, Homo sapiens
cuauuauagaauggaacucaagg

SEQ ID NO: 1777127 - RNA, 13 nt, Homo sapiens
ccccugucuggaa

SEQ ID NO: 1777128 - RNA, 18 nt, Homo sapiens
gcaggcauggauccagaa

SEQ ID NO: 1777129 - RNA, 22 nt, Homo sapiens
ugacuccccccaucccugccac

SEQ ID NO: 1777130 - RNA, 16 nt, Homo sapiens
aagcaaucaagcacca

SEQ ID NO: 1777131 - RNA, 16 nt, Homo sapiens
agggaaucagggacca

SEQ ID NO: 1777132 - RNA, 16 nt, Homo sapiens
cuaaauacuguacaua

SEQ ID NO: 1777133 - RNA, 22 nt, Homo sapiens
acuaaagcaaauuuuagaacuu

SEQ ID NO: 1777134 - RNA, 18 nt, Homo sapiens
ccagaggcuucuccaaag

SEQ ID NO: 1777135 - RNA, 23 nt, Homo sapiens
aaaauuagccaggcaugguggca

SEQ ID NO: 1777136 - RNA, 17 nt, Homo sapiens
cgauguacacacacaga

SEQ ID NO: 1777137 - RNA, 14 nt, Homo sapiens
uuuagccauaccag

SEQ ID NO: 1777138 - RNA, 14 nt, Homo sapiens
cgccugggaucuga

SEQ ID NO: 1777139 - RNA, 16 nt, Homo sapiens
acugaggcccugugau

SEQ ID NO: 1777140 - RNA, 11 nt, Homo sapiens
cuccugaggga

SEQ ID NO: 1777141 - RNA, 23 nt, Homo sapiens
agggcagcuguggcuucuaggug

SEQ ID NO: 1777142 - RNA, 22 nt, Homo sapiens
aauccuaacauuauauucccaa

SEQ ID NO: 1777143 - RNA, 15 nt, Homo sapiens
auguccaaguccaac

SEQ ID NO: 1777144 - RNA, 16 nt, Homo sapiens
aggagaguguauauga

SEQ ID NO: 1777145 - RNA, 19 nt, Homo sapiens
agagcaaggguucccucaa

SEQ ID NO: 1777146 - RNA, 23 nt, Homo sapiens
aacagccggcugcggcacugugc

SEQ ID NO: 1777147 - RNA, 20 nt, Homo sapiens
cuauugcaaggacagcauca

SEQ ID NO: 1777148 - RNA, 16 nt, Homo sapiens
cagggcaccugccacc

SEQ ID NO: 1777149 - RNA, 21 nt, Homo sapiens
cucuccuuauagacacuugcu

SEQ ID NO: 1777150 - RNA, 13 nt, Homo sapiens
ccgcucuguagug

SEQ ID NO: 1777151 - RNA, 12 nt, Homo sapiens
gaguaacaucua

SEQ ID NO: 1777152 - RNA, 15 nt, Homo sapiens
agaagucccucccau

SEQ ID NO: 1777153 - RNA, 17 nt, Homo sapiens
cacccagccugucccac

SEQ ID NO: 1777154 - RNA, 18 nt, Homo sapiens
ugaaaauaaugcuguucu

SEQ ID NO: 1777155 - RNA, 13 nt, Homo sapiens
uaaaugugcuuug

SEQ ID NO: 1777156 - RNA, 17 nt, Homo sapiens
cucugggcuauaugccu

SEQ ID NO: 1777157 - RNA, 14 nt, Homo sapiens
uuaugauugcauaa

SEQ ID NO: 1777158 - RNA, 17 nt, Homo sapiens
ucaugaggccggaugaa

SEQ ID NO: 1777159 - RNA, 20 nt, Homo sapiens
ccaccagggcucagcuccuu

SEQ ID NO: 1777160 - RNA, 23 nt, Homo sapiens
gacuucugaagggccccuugcaa

SEQ ID NO: 1777161 - RNA, 21 nt, Homo sapiens
ugagauauugggacacacauc

SEQ ID NO: 1777162 - RNA, 20 nt, Homo sapiens
uacuuagacaguaugcauac

SEQ ID NO: 1777163 - RNA, 15 nt, Homo sapiens
gaauuuguaagcaac

SEQ ID NO: 1777164 - RNA, 15 nt, Homo sapiens
uaaggaaacauuggc

SEQ ID NO: 1777165 - RNA, 21 nt, Homo sapiens
gcagcuuuagccaagugcagg

SEQ ID NO: 1777166 - RNA, 15 nt, Homo sapiens
gucugugaguaccug

SEQ ID NO: 1777167 - RNA, 15 nt, Homo sapiens
aaaccaaaaacugaa

SEQ ID NO: 1777168 - RNA, 16 nt, Homo sapiens
uacuguugugaccuga

SEQ ID NO: 1777169 - RNA, 14 nt, Homo sapiens
ccaaccuguaauaa

SEQ ID NO: 1777170 - RNA, 16 nt, Homo sapiens
ucucgucaggcugcca

SEQ ID NO: 1777171 - RNA, 17 nt, Homo sapiens
uccaauuacuccaccau

SEQ ID NO: 1777172 - RNA, 19 nt, Homo sapiens
caugacccggaugaacuca

SEQ ID NO: 1777173 - RNA, 15 nt, Homo sapiens
agcagaggaguccag

SEQ ID NO: 1777174 - RNA, 22 nt, Homo sapiens
uauucuacuacuuggaaggaaa

SEQ ID NO: 1777175 - RNA, 14 nt, Homo sapiens
aaaccacaacuuuu

SEQ ID NO: 1777176 - RNA, 18 nt, Homo sapiens
cuguaaaugcauuggaau

SEQ ID NO: 1777177 - RNA, 19 nt, Homo sapiens
gcuuggggccaccaaagcu

SEQ ID NO: 1777178 - RNA, 21 nt, Homo sapiens
ugaucaucuugaugucuauga

SEQ ID NO: 1777179 - RNA, 16 nt, Homo sapiens
uguggucacagcugua

SEQ ID NO: 1777180 - RNA, 17 nt, Homo sapiens
aacaucauggacugagc

SEQ ID NO: 1777181 - RNA, 15 nt, Homo sapiens
auuacuauacauuga

SEQ ID NO: 1777182 - RNA, 15 nt, Homo sapiens
uucacuuaaguauug

SEQ ID NO: 1777183 - RNA, 19 nt, Homo sapiens
gcuaccauuuuacauuucu

SEQ ID NO: 1777184 - RNA, 19 nt, Homo sapiens
ggcagcaagggaccugcuc

SEQ ID NO: 1777185 - RNA, 19 nt, Homo sapiens
caagaugggacagcaacaa

SEQ ID NO: 1777186 - RNA, 20 nt, Homo sapiens
uccacugggacccccaacau

SEQ ID NO: 1777187 - RNA, 17 nt, Homo sapiens
gcaagaccccaucucaa

SEQ ID NO: 1777188 - RNA, 16 nt, Homo sapiens
agcuaugaucgcgcca

SEQ ID NO: 1777189 - RNA, 18 nt, Homo sapiens
ccacuucuuaaugcuuuc

SEQ ID NO: 1777190 - RNA, 12 nt, Homo sapiens
aucacgaccacu

SEQ ID NO: 1777191 - RNA, 12 nt, Homo sapiens
uccuaaagccaa

SEQ ID NO: 1777192 - RNA, 20 nt, Homo sapiens
gaccuacagggaacugggaa

SEQ ID NO: 1777193 - RNA, 18 nt, Homo sapiens
guuuaaaccuuccauaaa

SEQ ID NO: 1777194 - RNA, 16 nt, Homo sapiens
aaucacaucacuaccu

SEQ ID NO: 1777195 - RNA, 22 nt, Homo sapiens
gcuaggucuugccaacuccauc

SEQ ID NO: 1777196 - RNA, 14 nt, Homo sapiens
agaaauguaauaaa

SEQ ID NO: 1777197 - RNA, 20 nt, Homo sapiens
acagagagagauuccaucuc

SEQ ID NO: 1777198 - RNA, 13 nt, Homo sapiens
uaaggcaggagaa

SEQ ID NO: 1777199 - RNA, 13 nt, Homo sapiens
aacuccagcuccc

SEQ ID NO: 1777200 - RNA, 22 nt, Homo sapiens
ugauuauauuucacccaucucu

SEQ ID NO: 1777201 - RNA, 21 nt, Homo sapiens
uugguuauuuaaucacaguca

SEQ ID NO: 1777202 - RNA, 11 nt, Homo sapiens
ucucugcaaau

SEQ ID NO: 1777203 - RNA, 16 nt, Homo sapiens
acuggacaacacugau

SEQ ID NO: 1777204 - RNA, 20 nt, Homo sapiens
gggaacgaugugucuguauu

SEQ ID NO: 1777205 - RNA, 12 nt, Homo sapiens
uauucaacaacu

SEQ ID NO: 1777206 - RNA, 21 nt, Homo sapiens
uucuggcaaacguuucucaaa

SEQ ID NO: 1777207 - RNA, 21 nt, Homo sapiens
caaccucggggagugccacuu

SEQ ID NO: 1777208 - RNA, 17 nt, Homo sapiens
cugcccuugucugagau

SEQ ID NO: 1777209 - RNA, 19 nt, Homo sapiens
aacaaaguuuucaugugcu

SEQ ID NO: 1777210 - RNA, 23 nt, Homo sapiens
ggcaauaaauauuagaagccugc

SEQ ID NO: 1777211 - RNA, 23 nt, Homo sapiens
cagcuggaagguacuaugccagu

SEQ ID NO: 1777212 - RNA, 22 nt, Homo sapiens
aguuuccugguuuguaaggcag

SEQ ID NO: 1777213 - RNA, 19 nt, Homo sapiens
uauucuuucuaaacuacaa

SEQ ID NO: 1777214 - RNA, 12 nt, Homo sapiens
cagcccugugga

SEQ ID NO: 1777215 - RNA, 21 nt, Homo sapiens
aaccugcagccccucaugccu

SEQ ID NO: 1777216 - RNA, 20 nt, Homo sapiens
ccaggaaagguuuuccuuau

SEQ ID NO: 1777217 - RNA, 21 nt, Homo sapiens
gaaauaacccuuucuguggua

SEQ ID NO: 1777218 - RNA, 21 nt, Homo sapiens
accaaggacugagcacccucu

SEQ ID NO: 1777219 - RNA, 15 nt, Homo sapiens
cacacauuccagggc

SEQ ID NO: 1777220 - RNA, 20 nt, Homo sapiens
caacucacugauucucuaca

SEQ ID NO: 1777221 - RNA, 20 nt, Homo sapiens
uaagacauuuguuaggccau

SEQ ID NO: 1777222 - RNA, 18 nt, Homo sapiens
ucucagaugaacaauuau

SEQ ID NO: 1777223 - RNA, 18 nt, Homo sapiens
gccugugcugugacucga

SEQ ID NO: 1777224 - RNA, 21 nt, Homo sapiens
uggggcaacagauugaaaaga

SEQ ID NO: 1777225 - RNA, 17 nt, Homo sapiens
aacuagaguauguguau

SEQ ID NO: 1777226 - RNA, 11 nt, Homo sapiens
aacacaguaag

SEQ ID NO: 1777227 - RNA, 22 nt, Homo sapiens
gaaaacuuuguuaggccaaaga

SEQ ID NO: 1777228 - RNA, 19 nt, Homo sapiens
agcaauacguuugugcaga

SEQ ID NO: 1777229 - RNA, 17 nt, Homo sapiens
aaagacugauuaccucc

SEQ ID NO: 1777230 - RNA, 22 nt, Homo sapiens
ccaucucgggcacaggcccacc

SEQ ID NO: 1777231 - RNA, 16 nt, Homo sapiens
ugaauuuuaaauguuc

SEQ ID NO: 1777232 - RNA, 18 nt, Homo sapiens
uucuauacccacccagaa

SEQ ID NO: 1777233 - RNA, 21 nt, Homo sapiens
accaggauggcagagagccag

SEQ ID NO: 1777234 - RNA, 17 nt, Homo sapiens
ugcuauaaguucuuuuc

SEQ ID NO: 1777235 - RNA, 23 nt, Homo sapiens
guacugaaaaucuggugcucaau

SEQ ID NO: 1777236 - RNA, 18 nt, Homo sapiens
accaccgucugucucaga

SEQ ID NO: 1777237 - RNA, 18 nt, Homo sapiens
ucacgcagagauuuucau

SEQ ID NO: 1777238 - RNA, 17 nt, Homo sapiens
ccacuugccccuguuac

SEQ ID NO: 1777239 - RNA, 15 nt, Homo sapiens
uauauguacauacau

SEQ ID NO: 1777240 - RNA, 19 nt, Homo sapiens
guccaggucuaccaaaaau

SEQ ID NO: 1777241 - RNA, 23 nt, Homo sapiens
uuuaguacuuguucccucuguug

SEQ ID NO: 1777242 - RNA, 18 nt, Homo sapiens
aaaacaaaauguaauguc

SEQ ID NO: 1777243 - RNA, 15 nt, Homo sapiens
caguacuauguaaau

SEQ ID NO: 1777244 - RNA, 22 nt, Homo sapiens
uuaacugaagccugcuccuucu

SEQ ID NO: 1777245 - RNA, 14 nt, Homo sapiens
cacccaugccauag

SEQ ID NO: 1777246 - RNA, 13 nt, Homo sapiens
gccaggugcaaaa

SEQ ID NO: 1777247 - RNA, 16 nt, Homo sapiens
ugaacuagagcuugca

SEQ ID NO: 1777248 - RNA, 12 nt, Homo sapiens
auacacauacau

SEQ ID NO: 1777249 - RNA, 14 nt, Homo sapiens
auaaacuagaucuc

SEQ ID NO: 1777250 - RNA, 12 nt, Homo sapiens
ccguuuugacau

SEQ ID NO: 1777251 - RNA, 15 nt, Homo sapiens
cugggaagaugcugg

SEQ ID NO: 1777252 - RNA, 21 nt, Homo sapiens
ugaucauguguggaaguuauu

SEQ ID NO: 1777253 - RNA, 11 nt, Homo sapiens
ccaagugugaa

SEQ ID NO: 1777254 - RNA, 13 nt, Homo sapiens
caccauccagugg

SEQ ID NO: 1777255 - RNA, 21 nt, Homo sapiens
cgugcuuuuaaggaaaggcaa

SEQ ID NO: 1777256 - RNA, 14 nt, Homo sapiens
ucacucagagggaa

SEQ ID NO: 1777257 - RNA, 17 nt, Homo sapiens
uguaaucccagcuacuc

SEQ ID NO: 1777258 - RNA, 19 nt, Homo sapiens
uauuaggagacacagggaa

SEQ ID NO: 1777259 - RNA, 14 nt, Homo sapiens
aauugaauucugga

SEQ ID NO: 1777260 - RNA, 12 nt, Homo sapiens
guguuugggauc

SEQ ID NO: 1777261 - RNA, 18 nt, Homo sapiens
gggaguuggugugcuauu

SEQ ID NO: 1777262 - RNA, 14 nt, Homo sapiens
agaggcuacuguaa

SEQ ID NO: 1777263 - RNA, 18 nt, Homo sapiens
agcaaaggaucuggacca

SEQ ID NO: 1777264 - RNA, 18 nt, Homo sapiens
uuugagcuguggcuguga

SEQ ID NO: 1777265 - RNA, 18 nt, Homo sapiens
auacauuggaggcuuuau

SEQ ID NO: 1777266 - RNA, 21 nt, Homo sapiens
ucuugacuguuaguuguccac

SEQ ID NO: 1777267 - RNA, 21 nt, Homo sapiens
agugccuggaguugacugacu

SEQ ID NO: 1777268 - RNA, 15 nt, Homo sapiens
cucucaucacugaaa

SEQ ID NO: 1777269 - RNA, 18 nt, Homo sapiens
acagccccagucuuccuu

SEQ ID NO: 1777270 - RNA, 23 nt, Homo sapiens
gggauggggcggcgguagcagcu

SEQ ID NO: 1777271 - RNA, 17 nt, Homo sapiens
cuggaacuuuagugaaa

SEQ ID NO: 1777272 - RNA, 19 nt, Homo sapiens
acaucuagucucagugcua

SEQ ID NO: 1777273 - RNA, 20 nt, Homo sapiens
ccucagggguuaagagcuca

SEQ ID NO: 1777274 - RNA, 17 nt, Homo sapiens
gucaccagcugccaaaa

SEQ ID NO: 1777275 - RNA, 13 nt, Homo sapiens
ugccuccauuuca

SEQ ID NO: 1777276 - RNA, 11 nt, Homo sapiens
aaaaacugacu

SEQ ID NO: 1777277 - RNA, 13 nt, Homo sapiens
cgugucucaggag

SEQ ID NO: 1777278 - RNA, 15 nt, Homo sapiens
cuuuauaaccugaug

SEQ ID NO: 1777279 - RNA, 16 nt, Homo sapiens
ugguaaggccucugga

SEQ ID NO: 1777280 - RNA, 14 nt, Homo sapiens
cagcugagcacuaa

SEQ ID NO: 1777281 - RNA, 21 nt, Homo sapiens
caagugucucaguccaccuga

SEQ ID NO: 1777282 - RNA, 18 nt, Homo sapiens
uguuuuauugacaucucu

SEQ ID NO: 1777283 - RNA, 21 nt, Homo sapiens
gcauuaaaaaaaaaaucaaug

SEQ ID NO: 1777284 - RNA, 22 nt, Homo sapiens
aaacuguuguggguuccugcca

SEQ ID NO: 1777285 - RNA, 15 nt, Homo sapiens
agauccagggacuga

SEQ ID NO: 1777286 - RNA, 12 nt, Homo sapiens
cucucucagguc

SEQ ID NO: 1777287 - RNA, 21 nt, Homo sapiens
caggcugguauuuaucugcaa

SEQ ID NO: 1777288 - RNA, 23 nt, Homo sapiens
caauggccaacuuauuguauucc

SEQ ID NO: 1777289 - RNA, 15 nt, Homo sapiens
acccagccaugcaau

SEQ ID NO: 1777290 - RNA, 16 nt, Homo sapiens
aauuaaaaaagcauac

SEQ ID NO: 1777291 - RNA, 20 nt, Homo sapiens
aaaauacaguauuauuuagu

SEQ ID NO: 1777292 - RNA, 19 nt, Homo sapiens
ggugugagccaccacaucc

SEQ ID NO: 1777293 - RNA, 16 nt, Homo sapiens
aaggaaacucgaauaa

SEQ ID NO: 1777294 - RNA, 17 nt, Homo sapiens
uuccuacccaaccacuc

SEQ ID NO: 1777295 - RNA, 14 nt, Homo sapiens
uagaacuguacugu

SEQ ID NO: 1777296 - RNA, 16 nt, Homo sapiens
ggaauaugcaucccac

SEQ ID NO: 1777297 - RNA, 23 nt, Homo sapiens
acuggucucuuuccaaagcauuu

SEQ ID NO: 1777298 - RNA, 13 nt, Homo sapiens
ucuggacacuggg

SEQ ID NO: 1777299 - RNA, 24 nt, Homo sapiens
caaggcccugagcuuuguccugaa

SEQ ID NO: 1777300 - RNA, 19 nt, Homo sapiens
cuauuugcacuguagccuc

SEQ ID NO: 1777301 - RNA, 19 nt, Homo sapiens
aguuguuuucccgagcaaa

SEQ ID NO: 1777302 - RNA, 15 nt, Homo sapiens
cuucugagcacagau

SEQ ID NO: 1777303 - RNA, 14 nt, Homo sapiens
aggcugucuucuca

SEQ ID NO: 1777304 - RNA, 21 nt, Homo sapiens
cuuaaaggcaccaucuaauag

SEQ ID NO: 1777305 - RNA, 18 nt, Homo sapiens
uagaauauagcaucuuuc

SEQ ID NO: 1777306 - RNA, 18 nt, Homo sapiens
uauaucagcuuuugccuu

SEQ ID NO: 1777307 - RNA, 19 nt, Homo sapiens
aaagaguaaaaccaaaggu

SEQ ID NO: 1777308 - RNA, 14 nt, Homo sapiens
gagcaucaagccac

SEQ ID NO: 1777309 - RNA, 17 nt, Homo sapiens
uuaaagaaggguugagc

SEQ ID NO: 1777310 - RNA, 16 nt, Homo sapiens
auccacaaaugcaguu

SEQ ID NO: 1777311 - RNA, 12 nt, Homo sapiens
ggguuugcaaga

SEQ ID NO: 1777312 - RNA, 18 nt, Homo sapiens
ugagaaguuacuuuccau

SEQ ID NO: 1777313 - RNA, 17 nt, Homo sapiens
ugcugagcacacaacag

SEQ ID NO: 1777314 - RNA, 13 nt, Homo sapiens
uauguaacagcca

SEQ ID NO: 1777315 - RNA, 17 nt, Homo sapiens
auaguuaauuauuucaa

SEQ ID NO: 1777316 - RNA, 16 nt, Homo sapiens
agugagcaugagcuca

SEQ ID NO: 1777317 - RNA, 22 nt, Homo sapiens
caugcauaucauuaaacaaaua

SEQ ID NO: 1777318 - RNA, 16 nt, Homo sapiens
caauaggcagacugug

SEQ ID NO: 1777319 - RNA, 21 nt, Homo sapiens
aaaaguucccucucacuuuca

SEQ ID NO: 1777320 - RNA, 22 nt, Homo sapiens
cuggcacaguguaauccagggg

SEQ ID NO: 1777321 - RNA, 21 nt, Homo sapiens
acuuuuugguaauagauuuaa

SEQ ID NO: 1777322 - RNA, 19 nt, Homo sapiens
guauauuuuugcaggugcu

SEQ ID NO: 1777323 - RNA, 15 nt, Homo sapiens
ucuuugggcaucaga

SEQ ID NO: 1777324 - RNA, 14 nt, Homo sapiens
cuuacauaucugac

SEQ ID NO: 1777325 - RNA, 15 nt, Homo sapiens
aucugccacaaaaac

SEQ ID NO: 1777326 - RNA, 21 nt, Homo sapiens
aguagccagaucccucuccag

SEQ ID NO: 1777327 - RNA, 11 nt, Homo sapiens
uuuacuuggaa

SEQ ID NO: 1777328 - RNA, 23 nt, Homo sapiens
gggauuacaggcgugagccacug

SEQ ID NO: 1777329 - RNA, 18 nt, Homo sapiens
uucuuucugaugucuucu

SEQ ID NO: 1777330 - RNA, 17 nt, Homo sapiens
acucuuaucaaucccaa

SEQ ID NO: 1777331 - RNA, 16 nt, Homo sapiens
ccggcauggacaaugg

SEQ ID NO: 1777332 - RNA, 24 nt, Homo sapiens
auugaggcuaaccuccaacacagu

SEQ ID NO: 1777333 - RNA, 17 nt, Homo sapiens
gggccugggacuuccau

SEQ ID NO: 1777334 - RNA, 15 nt, Homo sapiens
gguaucuacuucuac

SEQ ID NO: 1777335 - RNA, 14 nt, Homo sapiens
cacagaaaacuaga

SEQ ID NO: 1777336 - RNA, 12 nt, Homo sapiens
uccuuggggaca

SEQ ID NO: 1777337 - RNA, 22 nt, Homo sapiens
cuugagcacaaaauuuggucaa

SEQ ID NO: 1777338 - RNA, 14 nt, Homo sapiens
aaccacaaaccuag

SEQ ID NO: 1777339 - RNA, 19 nt, Homo sapiens
cuuuaguaucaguguuuua

SEQ ID NO: 1777340 - RNA, 18 nt, Homo sapiens
ccuguaauccuagcacuu

SEQ ID NO: 1777341 - RNA, 20 nt, Homo sapiens
aggcuggaagauagcuguga

SEQ ID NO: 1777342 - RNA, 20 nt, Homo sapiens
ggcggguguggagaccaggc

SEQ ID NO: 1777343 - RNA, 20 nt, Homo sapiens
uccaguguguguaacagggu

SEQ ID NO: 1777344 - RNA, 17 nt, Homo sapiens
gagaagacuucuuugca

SEQ ID NO: 1777345 - RNA, 18 nt, Homo sapiens
gcuggcaagauaaacacu

SEQ ID NO: 1777346 - RNA, 22 nt, Homo sapiens
ccacccugcgggccaggguccu

SEQ ID NO: 1777347 - RNA, 18 nt, Homo sapiens
uuccccaaucaauacccu

SEQ ID NO: 1777348 - RNA, 19 nt, Homo sapiens
aucuguuugauacaguauu

SEQ ID NO: 1777349 - RNA, 16 nt, Homo sapiens
cauguuguacauuuca

SEQ ID NO: 1777350 - RNA, 23 nt, Homo sapiens
gaaaaguucuuuacuggugauuu

SEQ ID NO: 1777351 - RNA, 14 nt, Homo sapiens
guggacaccccaga

SEQ ID NO: 1777352 - RNA, 22 nt, Homo sapiens
cacccgugagcgccugugcaca

SEQ ID NO: 1777353 - RNA, 14 nt, Homo sapiens
gagacagugaggcu

SEQ ID NO: 1777354 - RNA, 22 nt, Homo sapiens
uggauuauaaggaaaggcacau

SEQ ID NO: 1777355 - RNA, 15 nt, Homo sapiens
cgcucgccacagucc

SEQ ID NO: 1777356 - RNA, 18 nt, Homo sapiens
cauguuaaugaacagugu

SEQ ID NO: 1777357 - RNA, 14 nt, Homo sapiens
cugggcagugccac

SEQ ID NO: 1777358 - RNA, 17 nt, Homo sapiens
ugugucuuacauugcca

SEQ ID NO: 1777359 - RNA, 16 nt, Homo sapiens
cuguuggcugauugga

SEQ ID NO: 1777360 - RNA, 22 nt, Homo sapiens
uucaagauaaaucaaaguaaua

SEQ ID NO: 1777361 - RNA, 19 nt, Homo sapiens
ccacuuucaccugggauga

SEQ ID NO: 1777362 - RNA, 13 nt, Homo sapiens
gaucacacagugu

SEQ ID NO: 1777363 - RNA, 20 nt, Homo sapiens
auaaccuucaugaugaauua

SEQ ID NO: 1777364 - RNA, 12 nt, Homo sapiens
ccucuucccaca

SEQ ID NO: 1777365 - RNA, 22 nt, Homo sapiens
acagcuaguagacaugaauuuu

SEQ ID NO: 1777366 - RNA, 14 nt, Homo sapiens
aaauagacugugaa

SEQ ID NO: 1777367 - RNA, 15 nt, Homo sapiens
gcucggggugcacag

SEQ ID NO: 1777368 - RNA, 18 nt, Homo sapiens
ggucccagcggaugcugc

SEQ ID NO: 1777369 - RNA, 19 nt, Homo sapiens
ucucccuugggcucugaug

SEQ ID NO: 1777370 - RNA, 16 nt, Homo sapiens
cucucccagugacaac

SEQ ID NO: 1777371 - RNA, 13 nt, Homo sapiens
gauguauucugua

SEQ ID NO: 1777372 - RNA, 12 nt, Homo sapiens
ucuggacacugg

SEQ ID NO: 1777373 - RNA, 18 nt, Homo sapiens
aaagacaggguuucacca

SEQ ID NO: 1777374 - RNA, 17 nt, Homo sapiens
aucaggagcugcucagg

SEQ ID NO: 1777375 - RNA, 15 nt, Homo sapiens
augauguguagggcu

SEQ ID NO: 1777376 - RNA, 19 nt, Homo sapiens
aguucccuaaacuuuagaa

SEQ ID NO: 1777377 - RNA, 17 nt, Homo sapiens
gguccuugcugcaccug

SEQ ID NO: 1777378 - RNA, 15 nt, Homo sapiens
ccugucuaggugccc

SEQ ID NO: 1777379 - RNA, 12 nt, Homo sapiens
accaagugcaau

SEQ ID NO: 1777380 - RNA, 22 nt, Homo sapiens
uuaauccccaucauuacuggua

SEQ ID NO: 1777381 - RNA, 19 nt, Homo sapiens
uauuuuguguuccuaucaa

SEQ ID NO: 1777382 - RNA, 14 nt, Homo sapiens
aggauucagcuauu

SEQ ID NO: 1777383 - RNA, 14 nt, Homo sapiens
uccuuuaccagaug

SEQ ID NO: 1777384 - RNA, 19 nt, Homo sapiens
acucaaccucuacaggguu

SEQ ID NO: 1777385 - RNA, 16 nt, Homo sapiens
uccauguaacugccua

SEQ ID NO: 1777386 - RNA, 21 nt, Homo sapiens
ccuccuugcuuguuacauacc

SEQ ID NO: 1777387 - RNA, 14 nt, Homo sapiens
ccuuguuguaacua

SEQ ID NO: 1777388 - RNA, 18 nt, Homo sapiens
cuacacaauacaguauua

SEQ ID NO: 1777389 - RNA, 19 nt, Homo sapiens
ugacaaauaagauuaauaa

SEQ ID NO: 1777390 - RNA, 13 nt, Homo sapiens
uguaaaaaaugga

SEQ ID NO: 1777391 - RNA, 15 nt, Homo sapiens
aggagccugggauga

SEQ ID NO: 1777392 - RNA, 19 nt, Homo sapiens
gaaacccaccucucuggaa

SEQ ID NO: 1777393 - RNA, 16 nt, Homo sapiens
agcugggcagaccccu

SEQ ID NO: 1777394 - RNA, 13 nt, Homo sapiens
aauuaucuuaaaa

SEQ ID NO: 1777395 - RNA, 14 nt, Homo sapiens
uggugauguaaaac

SEQ ID NO: 1777396 - RNA, 14 nt, Homo sapiens
cuuuggaaguccag

SEQ ID NO: 1777397 - RNA, 17 nt, Homo sapiens
auagcagcuuauucaca

SEQ ID NO: 1777398 - RNA, 13 nt, Homo sapiens
ccaaaacaaucua

SEQ ID NO: 1777399 - RNA, 19 nt, Homo sapiens
ucuacuuccccauggcccu

SEQ ID NO: 1777400 - RNA, 17 nt, Homo sapiens
gcugcugcacacuucuc

SEQ ID NO: 1777401 - RNA, 16 nt, Homo sapiens
uaaagggacacuuuua

SEQ ID NO: 1777402 - RNA, 19 nt, Homo sapiens
acauuuuuccucucugcaa

SEQ ID NO: 1777403 - RNA, 15 nt, Homo sapiens
cuauuagauuuuaga

SEQ ID NO: 1777404 - RNA, 22 nt, Homo sapiens
gacagcugcugggucaggccac

SEQ ID NO: 1777405 - RNA, 18 nt, Homo sapiens
gaaagccaugugcagcca

SEQ ID NO: 1777406 - RNA, 20 nt, Homo sapiens
gcugcugagaaucuagccuc

SEQ ID NO: 1777407 - RNA, 20 nt, Homo sapiens
cuccuccccaaggagacaca

SEQ ID NO: 1777408 - RNA, 22 nt, Homo sapiens
cuccucaaccccuccccuccau

SEQ ID NO: 1777409 - RNA, 14 nt, Homo sapiens
ucugcccuguauau

SEQ ID NO: 1777410 - RNA, 14 nt, Homo sapiens
uauucuugcacuga

SEQ ID NO: 1777411 - RNA, 13 nt, Homo sapiens
guauuuaucuccu

SEQ ID NO: 1777412 - RNA, 14 nt, Homo sapiens
uacaauuacuuuga

SEQ ID NO: 1777413 - RNA, 18 nt, Homo sapiens
gagaaccucuccaaagag

SEQ ID NO: 1777414 - RNA, 22 nt, Homo sapiens
ucuugguugaggaaacaaacau

SEQ ID NO: 1777415 - RNA, 21 nt, Homo sapiens
ucuaaaauugcuucuuuacca

SEQ ID NO: 1777416 - RNA, 21 nt, Homo sapiens
auucacauaguccucagggcu

SEQ ID NO: 1777417 - RNA, 22 nt, Homo sapiens
cugcuccccacgucagcuggga

SEQ ID NO: 1777418 - RNA, 22 nt, Homo sapiens
uaaccaucuuuaaucaauguga

SEQ ID NO: 1777419 - RNA, 19 nt, Homo sapiens
uguuuuaaguacuacacau

SEQ ID NO: 1777420 - RNA, 16 nt, Homo sapiens
ccaaccucagaggcag

SEQ ID NO: 1777421 - RNA, 16 nt, Homo sapiens
ccaagcacagagccug

SEQ ID NO: 1777422 - RNA, 20 nt, Homo sapiens
gagaaccccucugggaaaau

SEQ ID NO: 1777423 - RNA, 23 nt, Homo sapiens
uggcgacugcagcugcaccauca

SEQ ID NO: 1777424 - RNA, 17 nt, Homo sapiens
gaccuggagaugcugcc

SEQ ID NO: 1777425 - RNA, 12 nt, Homo sapiens
ccauuuacuuag

SEQ ID NO: 1777426 - RNA, 19 nt, Homo sapiens
uucaggaaaauguauugau

SEQ ID NO: 1777427 - RNA, 23 nt, Homo sapiens
guauauuucccuguuucuuccac

SEQ ID NO: 1777428 - RNA, 19 nt, Homo sapiens
ccaguguagagauuggcac

SEQ ID NO: 1777429 - RNA, 20 nt, Homo sapiens
gcccaggucccagugccauu

SEQ ID NO: 1777430 - RNA, 23 nt, Homo sapiens
gacuagcaaaggaaaauugcacu

SEQ ID NO: 1777431 - RNA, 21 nt, Homo sapiens
cuguucugggccaggucccag

SEQ ID NO: 1777432 - RNA, 19 nt, Homo sapiens
uguucaguguugacauagc

SEQ ID NO: 1777433 - RNA, 16 nt, Homo sapiens
ccugcaccccugaugu

SEQ ID NO: 1777434 - RNA, 18 nt, Homo sapiens
agauuuggaugcacucau

SEQ ID NO: 1777435 - RNA, 17 nt, Homo sapiens
uucccaucugcaccccu

SEQ ID NO: 1777436 - RNA, 21 nt, Homo sapiens
aaaaucccucuuccuccaaag

SEQ ID NO: 1777437 - RNA, 17 nt, Homo sapiens
cugucccauucuagauc

SEQ ID NO: 1777438 - RNA, 20 nt, Homo sapiens
aacaaagaaccccucugucu

SEQ ID NO: 1777439 - RNA, 18 nt, Homo sapiens
gucugccaggcacucuca

SEQ ID NO: 1777440 - RNA, 15 nt, Homo sapiens
ucauuuguucauuaa

SEQ ID NO: 1777441 - RNA, 20 nt, Homo sapiens
aggccacccugccucuaccc

SEQ ID NO: 1777442 - RNA, 17 nt, Homo sapiens
cuguccugccuccucau

SEQ ID NO: 1777443 - RNA, 22 nt, Homo sapiens
aauugauuuugaaccugaugaa

SEQ ID NO: 1777444 - RNA, 18 nt, Homo sapiens
caucugucugucccaguu

SEQ ID NO: 1777445 - RNA, 18 nt, Homo sapiens
cccuccaagucacaaaga

SEQ ID NO: 1777446 - RNA, 20 nt, Homo sapiens
aucauguuuuaauguagaac

SEQ ID NO: 1777447 - RNA, 21 nt, Homo sapiens
aaugauuauauaaaauacaua

SEQ ID NO: 1777448 - RNA, 14 nt, Homo sapiens
ggagauagugccag

SEQ ID NO: 1777449 - RNA, 15 nt, Homo sapiens
auugagcucucucau

SEQ ID NO: 1777450 - RNA, 14 nt, Homo sapiens
caggcuuucucugg

SEQ ID NO: 1777451 - RNA, 15 nt, Homo sapiens
cuaccuccucaggga

SEQ ID NO: 1777452 - RNA, 21 nt, Homo sapiens
cucuuugaagguuuauacuaa

SEQ ID NO: 1777453 - RNA, 14 nt, Homo sapiens
uguccugcaauuua

SEQ ID NO: 1777454 - RNA, 12 nt, Homo sapiens
aaagaagccagc

SEQ ID NO: 1777455 - RNA, 24 nt, Homo sapiens
aaagcuguuccuugguccuaguaa

SEQ ID NO: 1777456 - RNA, 16 nt, Homo sapiens
gauauucauacuuucc

SEQ ID NO: 1777457 - RNA, 20 nt, Homo sapiens
uauacuuaagaauacacagg

SEQ ID NO: 1777458 - RNA, 12 nt, Homo sapiens
cagaucaagaaa

SEQ ID NO: 1777459 - RNA, 19 nt, Homo sapiens
ggugggcuugggcaauaaa

SEQ ID NO: 1777460 - RNA, 16 nt, Homo sapiens
ggcagggggcaggccu

SEQ ID NO: 1777461 - RNA, 14 nt, Homo sapiens
gcuuaaauuuccag

SEQ ID NO: 1777462 - RNA, 20 nt, Homo sapiens
ucuucaccucuauccaaaga

SEQ ID NO: 1777463 - RNA, 18 nt, Homo sapiens
guuaugucccaugaccuu

SEQ ID NO: 1777464 - RNA, 19 nt, Homo sapiens
augucuuuccuauuugcac

SEQ ID NO: 1777465 - RNA, 23 nt, Homo sapiens
guuuuccaguucaucgauuuucu

SEQ ID NO: 1777466 - RNA, 15 nt, Homo sapiens
augaucaaacuucca

SEQ ID NO: 1777467 - RNA, 14 nt, Homo sapiens
gcaauugacuuccu

SEQ ID NO: 1777468 - RNA, 11 nt, Homo sapiens
aaaacaucacu

SEQ ID NO: 1777469 - RNA, 14 nt, Homo sapiens
cagaggugcuaaau

SEQ ID NO: 1777470 - RNA, 19 nt, Homo sapiens
cuguauuacagcuuucaca

SEQ ID NO: 1777471 - RNA, 13 nt, Homo sapiens
uuugaaugacaaa

SEQ ID NO: 1777472 - RNA, 19 nt, Homo sapiens
uaugcaguauugccacaau

SEQ ID NO: 1777473 - RNA, 18 nt, Homo sapiens
gaguaacgagaagacaaa

SEQ ID NO: 1777474 - RNA, 16 nt, Homo sapiens
cuuuugugugaugcgc

SEQ ID NO: 1777475 - RNA, 12 nt, Homo sapiens
aaaaggaccagc

SEQ ID NO: 1777476 - RNA, 21 nt, Homo sapiens
caaucaauaaaaauggcauuu

SEQ ID NO: 1777477 - RNA, 21 nt, Homo sapiens
ucggggacgcccccaccagcu

SEQ ID NO: 1777478 - RNA, 15 nt, Homo sapiens
uuuguuacacuguua

SEQ ID NO: 1777479 - RNA, 13 nt, Homo sapiens
aguuaauucaccu

SEQ ID NO: 1777480 - RNA, 20 nt, Homo sapiens
aagggaguuggugugcuauu

SEQ ID NO: 1777481 - RNA, 20 nt, Homo sapiens
agcgcucugccucaccgcuu

SEQ ID NO: 1777482 - RNA, 13 nt, Homo sapiens
gacauuucuuugg

SEQ ID NO: 1777483 - RNA, 19 nt, Homo sapiens
cagauuuuuuccucugcau

SEQ ID NO: 1777484 - RNA, 14 nt, Homo sapiens
cccaggucuuccag

SEQ ID NO: 1777485 - RNA, 23 nt, Homo sapiens
auauuaaacauucuugcugcugc

SEQ ID NO: 1777486 - RNA, 16 nt, Homo sapiens
acagcuccuucugucc

SEQ ID NO: 1777487 - RNA, 18 nt, Homo sapiens
uaggcacaaauacauucc

SEQ ID NO: 1777488 - RNA, 23 nt, Homo sapiens
cuguaguagucaaggugcucaau

SEQ ID NO: 1777489 - RNA, 14 nt, Homo sapiens
ugguccuaagcacc

SEQ ID NO: 1777490 - RNA, 14 nt, Homo sapiens
agcaauuucuaauu

SEQ ID NO: 1777491 - RNA, 18 nt, Homo sapiens
aguauaagcaucugccau

SEQ ID NO: 1777492 - RNA, 13 nt, Homo sapiens
guccaucagugac

SEQ ID NO: 1777493 - RNA, 13 nt, Homo sapiens
caugauccaagca

SEQ ID NO: 1777494 - RNA, 16 nt, Homo sapiens
ugcacguggggcccac

SEQ ID NO: 1777495 - RNA, 17 nt, Homo sapiens
ugaccauuugacuguuc

SEQ ID NO: 1777496 - RNA, 22 nt, Homo sapiens
uucucuuaugaucaccauguau

SEQ ID NO: 1777497 - RNA, 14 nt, Homo sapiens
acaggugugcacca

SEQ ID NO: 1777498 - RNA, 15 nt, Homo sapiens
gucaggcccagagaa

SEQ ID NO: 1777499 - RNA, 16 nt, Homo sapiens
acugauguacaauuaa

SEQ ID NO: 1777500 - RNA, 20 nt, Homo sapiens
aggugcuacaaaaacacagc

SEQ ID NO: 1777501 - RNA, 14 nt, Homo sapiens
gagaaaaaaauuca

SEQ ID NO: 1777502 - RNA, 12 nt, Homo sapiens
auacuguugcac

SEQ ID NO: 1777503 - RNA, 14 nt, Homo sapiens
ugucaaccugaauu

SEQ ID NO: 1777504 - RNA, 20 nt, Homo sapiens
ugaggcaugagaaucacuug

SEQ ID NO: 1777505 - RNA, 21 nt, Homo sapiens
aaaacagaaaauuauagucaa

SEQ ID NO: 1777506 - RNA, 19 nt, Homo sapiens
ggguuucuaaagcugccag

SEQ ID NO: 1777507 - RNA, 20 nt, Homo sapiens
gaugguuccucucuuggcaa

SEQ ID NO: 1777508 - RNA, 15 nt, Homo sapiens
ugggccaaucacuga

SEQ ID NO: 1777509 - RNA, 13 nt, Homo sapiens
agagcaggaaaug

SEQ ID NO: 1777510 - RNA, 20 nt, Homo sapiens
uggucaggaaguuugcagau

SEQ ID NO: 1777511 - RNA, 18 nt, Homo sapiens
ucuguuuuuaaaaaucau

SEQ ID NO: 1777512 - RNA, 20 nt, Homo sapiens
augugauggauggcacaaug

SEQ ID NO: 1777513 - RNA, 16 nt, Homo sapiens
uacgaauuguuucaca

SEQ ID NO: 1777514 - RNA, 22 nt, Homo sapiens
gaaaaagcuuaaugauucugau

SEQ ID NO: 1777515 - RNA, 18 nt, Homo sapiens
ugacauuuguauucucag

SEQ ID NO: 1777516 - RNA, 14 nt, Homo sapiens
agacagaguccugc

SEQ ID NO: 1777517 - RNA, 10 nt, Homo sapiens
ucaccacugu

SEQ ID NO: 1777518 - RNA, 21 nt, Homo sapiens
caaaggcagcaaggcagugag

SEQ ID NO: 1777519 - RNA, 19 nt, Homo sapiens
uucagauauuauugcuuua

SEQ ID NO: 1777520 - RNA, 23 nt, Homo sapiens
uaccauuuuaguaugaagcaaug

SEQ ID NO: 1777521 - RNA, 23 nt, Homo sapiens
uguacacaacuuagaaaccaaau

SEQ ID NO: 1777522 - RNA, 14 nt, Homo sapiens
aaguugauacuuga

SEQ ID NO: 1777523 - RNA, 14 nt, Homo sapiens
aauuuuguugauau

SEQ ID NO: 1777524 - RNA, 22 nt, Homo sapiens
ccuguuuauauugguauaauua

SEQ ID NO: 1777525 - RNA, 23 nt, Homo sapiens
aagacugauuuuaauagggaaua

SEQ ID NO: 1777526 - RNA, 15 nt, Homo sapiens
uugaauggguuugcu

SEQ ID NO: 1777527 - RNA, 20 nt, Homo sapiens
auaagcuuucucucagaaau

SEQ ID NO: 1777528 - RNA, 21 nt, Homo sapiens
uucuauuagcuuacugauuaa

SEQ ID NO: 1777529 - RNA, 14 nt, Homo sapiens
auaaauaugcucag

SEQ ID NO: 1777530 - RNA, 20 nt, Homo sapiens
uuagcacaaagaugugcaaa

SEQ ID NO: 1777531 - RNA, 21 nt, Homo sapiens
uguacaugucucccaucagaa

SEQ ID NO: 1777532 - RNA, 19 nt, Homo sapiens
ugaucuuaauauauuugaa

SEQ ID NO: 1777533 - RNA, 18 nt, Homo sapiens
aauaugacagauaaccua

SEQ ID NO: 1777534 - RNA, 21 nt, Homo sapiens
cagcuggaagucuaccugcug

SEQ ID NO: 1777535 - RNA, 18 nt, Homo sapiens
agcacucccgcugcacac

SEQ ID NO: 1777536 - RNA, 14 nt, Homo sapiens
cauauauacuugca

SEQ ID NO: 1777537 - RNA, 22 nt, Homo sapiens
auuuuuaccuaaucuccacuuu

SEQ ID NO: 1777538 - RNA, 17 nt, Homo sapiens
cgagaccaaccuagcca

SEQ ID NO: 1777539 - RNA, 17 nt, Homo sapiens
accaucuaugugaauau

SEQ ID NO: 1777540 - RNA, 13 nt, Homo sapiens
caguaaacacugu

SEQ ID NO: 1777541 - RNA, 18 nt, Homo sapiens
caauauuaugaaauuuca

SEQ ID NO: 1777542 - RNA, 12 nt, Homo sapiens
caagcaccugca

SEQ ID NO: 1777543 - RNA, 23 nt, Homo sapiens
uaaaacauuagucaguugcucau

SEQ ID NO: 1777544 - RNA, 20 nt, Homo sapiens
cacacuuggaugcaggguuu

SEQ ID NO: 1777545 - RNA, 14 nt, Homo sapiens
uauguaaacaauca

SEQ ID NO: 1777546 - RNA, 15 nt, Homo sapiens
gacgcagccacacag

SEQ ID NO: 1777547 - RNA, 19 nt, Homo sapiens
aacccuaucuccugacaga

SEQ ID NO: 1777548 - RNA, 22 nt, Homo sapiens
ugccagucacuccguuuugcaa

SEQ ID NO: 1777549 - RNA, 14 nt, Homo sapiens
cuccugccagcucu

SEQ ID NO: 1777550 - RNA, 19 nt, Homo sapiens
caaagaguauauguucccu

SEQ ID NO: 1777551 - RNA, 19 nt, Homo sapiens
gcagcccucggguccaugu

SEQ ID NO: 1777552 - RNA, 22 nt, Homo sapiens
gucacccaaguuggagugcagu

SEQ ID NO: 1777553 - RNA, 15 nt, Homo sapiens
aaauaccuuuucuca

SEQ ID NO: 1777554 - RNA, 12 nt, Homo sapiens
ccagcauuugag

SEQ ID NO: 1777555 - RNA, 20 nt, Homo sapiens
uuaaaaagguuuacagaauu

SEQ ID NO: 1777556 - RNA, 23 nt, Homo sapiens
cccagggaagccugggugucaag

SEQ ID NO: 1777557 - RNA, 22 nt, Homo sapiens
gccuuaaauuuuugucauuuua

SEQ ID NO: 1777558 - RNA, 20 nt, Homo sapiens
acaucuucccagaguguccc

SEQ ID NO: 1777559 - RNA, 14 nt, Homo sapiens
aucuaauaaauacu

SEQ ID NO: 1777560 - RNA, 19 nt, Homo sapiens
caauacagaacccauucca

SEQ ID NO: 1777561 - RNA, 21 nt, Homo sapiens
uccagccugggcaacacagcg

SEQ ID NO: 1777562 - RNA, 18 nt, Homo sapiens
uagaaccaagcuucagag

SEQ ID NO: 1777563 - RNA, 20 nt, Homo sapiens
agacuuuguguucauuucau

SEQ ID NO: 1777564 - RNA, 15 nt, Homo sapiens
agagccgcauggcac

SEQ ID NO: 1777565 - RNA, 22 nt, Homo sapiens
acaccuucuuggcuucugggac

SEQ ID NO: 1777566 - RNA, 21 nt, Homo sapiens
ucauguugaagccacugccuu

SEQ ID NO: 1777567 - RNA, 14 nt, Homo sapiens
aauaaagcaucuca

SEQ ID NO: 1777568 - RNA, 13 nt, Homo sapiens
accaauguucucu

SEQ ID NO: 1777569 - RNA, 22 nt, Homo sapiens
agcaguccacaaagcauuuuca

SEQ ID NO: 1777570 - RNA, 17 nt, Homo sapiens
uugcaagaugugaauua

SEQ ID NO: 1777571 - RNA, 13 nt, Homo sapiens
acccccaucuuuu

SEQ ID NO: 1777572 - RNA, 18 nt, Homo sapiens
guccuccagaccaccagc

SEQ ID NO: 1777573 - RNA, 19 nt, Homo sapiens
aggcaaacugcaaaccaug

SEQ ID NO: 1777574 - RNA, 17 nt, Homo sapiens
uguccuacucuguguca

SEQ ID NO: 1777575 - RNA, 14 nt, Homo sapiens
cauuuugcaaaauu

SEQ ID NO: 1777576 - RNA, 14 nt, Homo sapiens
auaaaugccuuuau

SEQ ID NO: 1777577 - RNA, 16 nt, Homo sapiens
agaaccaguaccucag

SEQ ID NO: 1777578 - RNA, 22 nt, Homo sapiens
auugaagcuaaaauaaaccaga

SEQ ID NO: 1777579 - RNA, 21 nt, Homo sapiens
ugcauauauuaucaucaaaug

SEQ ID NO: 1777580 - RNA, 20 nt, Homo sapiens
gagggauggggaaaacuaca

SEQ ID NO: 1777581 - RNA, 22 nt, Homo sapiens
cagggugagguucagccuguga

SEQ ID NO: 1777582 - RNA, 20 nt, Homo sapiens
cugaugaugucggucuugca

SEQ ID NO: 1777583 - RNA, 15 nt, Homo sapiens
ccucacugagccuca

SEQ ID NO: 1777584 - RNA, 13 nt, Homo sapiens
ccucuggacaguu

SEQ ID NO: 1777585 - RNA, 18 nt, Homo sapiens
gaguuuuaaaaaugcaaa

SEQ ID NO: 1777586 - RNA, 19 nt, Homo sapiens
aggccauuaugccuggcua

SEQ ID NO: 1777587 - RNA, 18 nt, Homo sapiens
auuuuucaaagacuucau

SEQ ID NO: 1777588 - RNA, 14 nt, Homo sapiens
auucaaauuauucu

SEQ ID NO: 1777589 - RNA, 23 nt, Homo sapiens
uguugcaucccugaaacaucuca

SEQ ID NO: 1777590 - RNA, 21 nt, Homo sapiens
aaaaugaagauacacauuaca

SEQ ID NO: 1777591 - RNA, 18 nt, Homo sapiens
acaaccugaaugucccaa

SEQ ID NO: 1777592 - RNA, 16 nt, Homo sapiens
aggacuuuccagugag

SEQ ID NO: 1777593 - RNA, 15 nt, Homo sapiens
uuccauggacuuugu

SEQ ID NO: 1777594 - RNA, 15 nt, Homo sapiens
cagcugauuccagaa

SEQ ID NO: 1777595 - RNA, 17 nt, Homo sapiens
agccuucugaugucucu

SEQ ID NO: 1777596 - RNA, 16 nt, Homo sapiens
agucauuaaagacagg

SEQ ID NO: 1777597 - RNA, 19 nt, Homo sapiens
acuaccagugggcauguau

SEQ ID NO: 1777598 - RNA, 23 nt, Homo sapiens
uauagucacaggaaacuacuuca

SEQ ID NO: 1777599 - RNA, 23 nt, Homo sapiens
agccagaaaaacguguugccuug

SEQ ID NO: 1777600 - RNA, 12 nt, Homo sapiens
aggugguucuga

SEQ ID NO: 1777601 - RNA, 19 nt, Homo sapiens
cuuacuuagcaugcacaaa

SEQ ID NO: 1777602 - RNA, 18 nt, Homo sapiens
aauuuauucaauuccucu

SEQ ID NO: 1777603 - RNA, 19 nt, Homo sapiens
cagccgugaucaagggaau

SEQ ID NO: 1777604 - RNA, 13 nt, Homo sapiens
agccgcugccagg

SEQ ID NO: 1777605 - RNA, 12 nt, Homo sapiens
uuguuauaccau

SEQ ID NO: 1777606 - RNA, 17 nt, Homo sapiens
uaacaaagaacaagcau

SEQ ID NO: 1777607 - RNA, 17 nt, Homo sapiens
aguuggacucucaggga

SEQ ID NO: 1777608 - RNA, 17 nt, Homo sapiens
aaucuccccuccucaca

SEQ ID NO: 1777609 - RNA, 13 nt, Homo sapiens
acacugauuccuu

SEQ ID NO: 1777610 - RNA, 14 nt, Homo sapiens
uucuuuuacuugaa

SEQ ID NO: 1777611 - RNA, 20 nt, Homo sapiens
cuauccauauuuuacugauc

SEQ ID NO: 1777612 - RNA, 15 nt, Homo sapiens
agaggcugcacuugu

SEQ ID NO: 1777613 - RNA, 22 nt, Homo sapiens
ccaaaucuuaauucaacuagua

SEQ ID NO: 1777614 - RNA, 22 nt, Homo sapiens
acccuuuucccccuucccauuu

SEQ ID NO: 1777615 - RNA, 21 nt, Homo sapiens
aaccaccuggucugcauguau

SEQ ID NO: 1777616 - RNA, 15 nt, Homo sapiens
ugugaugcaugagcu

SEQ ID NO: 1777617 - RNA, 17 nt, Homo sapiens
aaaagagaauuguagau

SEQ ID NO: 1777618 - RNA, 20 nt, Homo sapiens
ccuuccaauaguuagaucua

SEQ ID NO: 1777619 - RNA, 18 nt, Homo sapiens
agcauauguuccaugccu

SEQ ID NO: 1777620 - RNA, 15 nt, Homo sapiens
ucaaaucucuuccac

SEQ ID NO: 1777621 - RNA, 12 nt, Homo sapiens
auacagcuuucu

SEQ ID NO: 1777622 - RNA, 14 nt, Homo sapiens
gagugagugaugaa

SEQ ID NO: 1777623 - RNA, 15 nt, Homo sapiens
ccagcuaacugggcg

SEQ ID NO: 1777624 - RNA, 15 nt, Homo sapiens
uaaaggcauuccaca

SEQ ID NO: 1777625 - RNA, 13 nt, Homo sapiens
uuuuuucccccac

SEQ ID NO: 1777626 - RNA, 22 nt, Homo sapiens
aaggaacauuccuuagucucaa

SEQ ID NO: 1777627 - RNA, 20 nt, Homo sapiens
gucccaauagcucuacugcc

SEQ ID NO: 1777628 - RNA, 23 nt, Homo sapiens
agacagaagagaaggaagccaua

SEQ ID NO: 1777629 - RNA, 20 nt, Homo sapiens
gacuacccauagacaugaaa

SEQ ID NO: 1777630 - RNA, 16 nt, Homo sapiens
auguaaaauccaucca

SEQ ID NO: 1777631 - RNA, 19 nt, Homo sapiens
gacagucuggccacuguca

SEQ ID NO: 1777632 - RNA, 21 nt, Homo sapiens
uugccuuaccuaaaucuguuu

SEQ ID NO: 1777633 - RNA, 22 nt, Homo sapiens
gcuucuccagggaauucuuaca

SEQ ID NO: 1777634 - RNA, 21 nt, Homo sapiens
aucuaugccuaaaaaguauca

SEQ ID NO: 1777635 - RNA, 14 nt, Homo sapiens
aagaaauuuuauga

SEQ ID NO: 1777636 - RNA, 14 nt, Homo sapiens
acugaccuaccuca

SEQ ID NO: 1777637 - RNA, 22 nt, Homo sapiens
agcaauauaucugaagagcuau

SEQ ID NO: 1777638 - RNA, 17 nt, Homo sapiens
uaaaauucuacuguaug

SEQ ID NO: 1777639 - RNA, 16 nt, Homo sapiens
gaaacaccaagauguc

SEQ ID NO: 1777640 - RNA, 22 nt, Homo sapiens
uucaaagugucucauucucaga

SEQ ID NO: 1777641 - RNA, 12 nt, Homo sapiens
uauauuauuugg

SEQ ID NO: 1777642 - RNA, 20 nt, Homo sapiens
cuaaacuucaccuacauuau

SEQ ID NO: 1777643 - RNA, 15 nt, Homo sapiens
ccauauugagucaaa

SEQ ID NO: 1777644 - RNA, 11 nt, Homo sapiens
gcaaagggaau

SEQ ID NO: 1777645 - RNA, 15 nt, Homo sapiens
acaguuacaguugau

SEQ ID NO: 1777646 - RNA, 13 nt, Homo sapiens
augucaguuacaa

SEQ ID NO: 1777647 - RNA, 18 nt, Homo sapiens
ugaauacagcagcaagaa

SEQ ID NO: 1777648 - RNA, 14 nt, Homo sapiens
gcccgaggaccggg

SEQ ID NO: 1777649 - RNA, 16 nt, Homo sapiens
uuuaaugacaaugaag

SEQ ID NO: 1777650 - RNA, 19 nt, Homo sapiens
acaaaucccucauccugac

SEQ ID NO: 1777651 - RNA, 23 nt, Homo sapiens
gucugaggauaccuuccaucuca

SEQ ID NO: 1777652 - RNA, 23 nt, Homo sapiens
aacaacaacgagauaccaucuca

SEQ ID NO: 1777653 - RNA, 15 nt, Homo sapiens
uaaauuaaagagaaa

SEQ ID NO: 1777654 - RNA, 18 nt, Homo sapiens
ccagccagugccauucca

SEQ ID NO: 1777655 - RNA, 18 nt, Homo sapiens
caagaaucuucuguucca

SEQ ID NO: 1777656 - RNA, 16 nt, Homo sapiens
cuaaagauagaguaaa

SEQ ID NO: 1777657 - RNA, 18 nt, Homo sapiens
uccaacgugccuccagca

SEQ ID NO: 1777658 - RNA, 15 nt, Homo sapiens
ucuguuccacauaua

SEQ ID NO: 1777659 - RNA, 23 nt, Homo sapiens
agggacauuuccaagcuguuagu

SEQ ID NO: 1777660 - RNA, 14 nt, Homo sapiens
aagaagaugagccu

SEQ ID NO: 1777661 - RNA, 15 nt, Homo sapiens
ucaacuuacauaugu

SEQ ID NO: 1777662 - RNA, 14 nt, Homo sapiens
aauauaagaucuga

SEQ ID NO: 1777663 - RNA, 18 nt, Homo sapiens
auauguauuuuugucaua

SEQ ID NO: 1777664 - RNA, 21 nt, Homo sapiens
ugccucuguggaagagauucc

SEQ ID NO: 1777665 - RNA, 15 nt, Homo sapiens
gaugagucagugcca

SEQ ID NO: 1777666 - RNA, 13 nt, Homo sapiens
acaguaauguguc

SEQ ID NO: 1777667 - RNA, 15 nt, Homo sapiens
acacagacuguuguc

SEQ ID NO: 1777668 - RNA, 21 nt, Homo sapiens
accgcuguggccggcacucca

SEQ ID NO: 1777669 - RNA, 13 nt, Homo sapiens
uucacauuuugcc

SEQ ID NO: 1777670 - RNA, 14 nt, Homo sapiens
caguuagcucucaa

SEQ ID NO: 1777671 - RNA, 13 nt, Homo sapiens
cucaggauuucau

SEQ ID NO: 1777672 - RNA, 19 nt, Homo sapiens
guuucuugaaguccagugu

SEQ ID NO: 1777673 - RNA, 16 nt, Homo sapiens
cugaacaaaauaaagu

SEQ ID NO: 1777674 - RNA, 22 nt, Homo sapiens
auaguggacauuguuggcagca

SEQ ID NO: 1777675 - RNA, 23 nt, Homo sapiens
acaccauuccuucugcccugcuu

SEQ ID NO: 1777676 - RNA, 16 nt, Homo sapiens
guuuauugauauucaa

SEQ ID NO: 1777677 - RNA, 12 nt, Homo sapiens
augauccagaga

SEQ ID NO: 1777678 - RNA, 18 nt, Homo sapiens
gucuuacucuuuguauga

SEQ ID NO: 1777679 - RNA, 23 nt, Homo sapiens
gaauugccugccauggcugugac

SEQ ID NO: 1777680 - RNA, 15 nt, Homo sapiens
cuaagaggcagugag

SEQ ID NO: 1777681 - RNA, 18 nt, Homo sapiens
cuguggugguugugaucc

SEQ ID NO: 1777682 - RNA, 20 nt, Homo sapiens
uaucaguuauaugauauucu

SEQ ID NO: 1777683 - RNA, 20 nt, Homo sapiens
auuuccucuaguaucacuuu

SEQ ID NO: 1777684 - RNA, 23 nt, Homo sapiens
ugggaggcagaaaccuaucucag

SEQ ID NO: 1777685 - RNA, 21 nt, Homo sapiens
cagaaacuagaaaugugaaug

SEQ ID NO: 1777686 - RNA, 22 nt, Homo sapiens
accagucccgucgugcagucag

SEQ ID NO: 1777687 - RNA, 11 nt, Homo sapiens
aggcaccagag

SEQ ID NO: 1777688 - RNA, 18 nt, Homo sapiens
gacauuucaaauaacugc

SEQ ID NO: 1777689 - RNA, 14 nt, Homo sapiens
agugauaugcauuu

SEQ ID NO: 1777690 - RNA, 14 nt, Homo sapiens
agugacaugcauuc

SEQ ID NO: 1777691 - RNA, 15 nt, Homo sapiens
cuugaagcuguggag

SEQ ID NO: 1777692 - RNA, 13 nt, Homo sapiens
uuuuguucuugcc

SEQ ID NO: 1777693 - RNA, 13 nt, Homo sapiens
caggugcaguuuc

SEQ ID NO: 1777694 - RNA, 13 nt, Homo sapiens
cacgaacuggccu

SEQ ID NO: 1777695 - RNA, 13 nt, Homo sapiens
gaacuuccaggaa

SEQ ID NO: 1777696 - RNA, 23 nt, Homo sapiens
gggaagcuggcuuucuggcugcu

SEQ ID NO: 1777697 - RNA, 14 nt, Homo sapiens
uaucuuugugauaa

SEQ ID NO: 1777698 - RNA, 16 nt, Homo sapiens
cagaaggcuuuuuuaa

SEQ ID NO: 1777699 - RNA, 22 nt, Homo sapiens
uggcggcugugcaucaguggga

SEQ ID NO: 1777700 - RNA, 18 nt, Homo sapiens
cuuuauuguucacacaaa

SEQ ID NO: 1777701 - RNA, 16 nt, Homo sapiens
gcauggccacagccac

SEQ ID NO: 1777702 - RNA, 22 nt, Homo sapiens
gggcucccccauaguucacuga

SEQ ID NO: 1777703 - RNA, 17 nt, Homo sapiens
acaaccuuuuacauugu

SEQ ID NO: 1777704 - RNA, 19 nt, Homo sapiens
acaaauauagagaauuccu

SEQ ID NO: 1777705 - RNA, 19 nt, Homo sapiens
agaauaauccuguuuuaca

SEQ ID NO: 1777706 - RNA, 17 nt, Homo sapiens
caggagaaccacuacau

SEQ ID NO: 1777707 - RNA, 12 nt, Homo sapiens
ugcuuucaaguc

SEQ ID NO: 1777708 - RNA, 11 nt, Homo sapiens
gacaucaugcu

SEQ ID NO: 1777709 - RNA, 20 nt, Homo sapiens
gugccaauacagacaaagca

SEQ ID NO: 1777710 - RNA, 13 nt, Homo sapiens
ugcccuucagccu

SEQ ID NO: 1777711 - RNA, 19 nt, Homo sapiens
uucacucuggguaccaaau

SEQ ID NO: 1777712 - RNA, 16 nt, Homo sapiens
cauccuuguacauacu

SEQ ID NO: 1777713 - RNA, 14 nt, Homo sapiens
gcgguuugcucagc

SEQ ID NO: 1777714 - RNA, 15 nt, Homo sapiens
acuacuguaucugau

SEQ ID NO: 1777715 - RNA, 14 nt, Homo sapiens
ucauaguaacuucu

SEQ ID NO: 1777716 - RNA, 22 nt, Homo sapiens
uuuacaucagaaguuugcaucu

SEQ ID NO: 1777717 - RNA, 19 nt, Homo sapiens
accucuaacauccuugucu

SEQ ID NO: 1777718 - RNA, 17 nt, Homo sapiens
ccaagaagccagcacca

SEQ ID NO: 1777719 - RNA, 15 nt, Homo sapiens
augcaagggacugug

SEQ ID NO: 1777720 - RNA, 17 nt, Homo sapiens
ugguugagaaacauugc

SEQ ID NO: 1777721 - RNA, 19 nt, Homo sapiens
guguggccuccguccuguc

SEQ ID NO: 1777722 - RNA, 19 nt, Homo sapiens
agaaaaggacaaauaucuu

SEQ ID NO: 1777723 - RNA, 15 nt, Homo sapiens
ucagaaccgagugag

SEQ ID NO: 1777724 - RNA, 14 nt, Homo sapiens
caccaaguacagcc

SEQ ID NO: 1777725 - RNA, 17 nt, Homo sapiens
aaaacuaguaguucucu

SEQ ID NO: 1777726 - RNA, 17 nt, Homo sapiens
gguauuagcaaagcaaa

SEQ ID NO: 1777727 - RNA, 17 nt, Homo sapiens
acuuggggcaccuugcu

SEQ ID NO: 1777728 - RNA, 24 nt, Homo sapiens
acguggagaaaaucaaaccgagca

SEQ ID NO: 1777729 - RNA, 12 nt, Homo sapiens
cucaagugccau

SEQ ID NO: 1777730 - RNA, 13 nt, Homo sapiens
ggcacuucauuga

SEQ ID NO: 1777731 - RNA, 18 nt, Homo sapiens
cuugggaggaagcccagu

SEQ ID NO: 1777732 - RNA, 22 nt, Homo sapiens
aguucaccccuuauccugagca

SEQ ID NO: 1777733 - RNA, 20 nt, Homo sapiens
cuuacgaucucuugacauau

SEQ ID NO: 1777734 - RNA, 14 nt, Homo sapiens
ugucuccugagcac

SEQ ID NO: 1777735 - RNA, 19 nt, Homo sapiens
ccuugaaggucacucuucc

SEQ ID NO: 1777736 - RNA, 21 nt, Homo sapiens
ugacaccauucuccugccuca

SEQ ID NO: 1777737 - RNA, 11 nt, Homo sapiens
cguggugugag

SEQ ID NO: 1777738 - RNA, 12 nt, Homo sapiens
uuuccacuucca

SEQ ID NO: 1777739 - RNA, 18 nt, Homo sapiens
aaagggaggaggugcaca

SEQ ID NO: 1777740 - RNA, 14 nt, Homo sapiens
uuacaggaucaugu

SEQ ID NO: 1777741 - RNA, 23 nt, Homo sapiens
cagcuaagggagggccuggggag

SEQ ID NO: 1777742 - RNA, 15 nt, Homo sapiens
uucuaccaaaugugu

SEQ ID NO: 1777743 - RNA, 17 nt, Homo sapiens
acucaccaggcaccaga

SEQ ID NO: 1777744 - RNA, 20 nt, Homo sapiens
agaaauacaguaugaucuca

SEQ ID NO: 1777745 - RNA, 20 nt, Homo sapiens
ugaaaauuauuuuguucaua

SEQ ID NO: 1777746 - RNA, 13 nt, Homo sapiens
aguuuuccagugg

SEQ ID NO: 1777747 - RNA, 20 nt, Homo sapiens
aaucagugaagccaaaggga

SEQ ID NO: 1777748 - RNA, 22 nt, Homo sapiens
ucaaaugaccuagaaacaagga

SEQ ID NO: 1777749 - RNA, 22 nt, Homo sapiens
augaaguuaaagguauuuauca

SEQ ID NO: 1777750 - RNA, 23 nt, Homo sapiens
caggagaaucacuugaacccagg

SEQ ID NO: 1777751 - RNA, 15 nt, Homo sapiens
cuucccccaccacca

SEQ ID NO: 1777752 - RNA, 20 nt, Homo sapiens
uuguauaugcugcauugaga

SEQ ID NO: 1777753 - RNA, 21 nt, Homo sapiens
cucugaaagaccuaugagcaa

SEQ ID NO: 1777754 - RNA, 22 nt, Homo sapiens
aaaaugcugccuagugcuacag

SEQ ID NO: 1777755 - RNA, 14 nt, Homo sapiens
caaaucaaccccag

SEQ ID NO: 1777756 - RNA, 14 nt, Homo sapiens
ccucuguccaggca

SEQ ID NO: 1777757 - RNA, 17 nt, Homo sapiens
gcaacuuguucgugggu

SEQ ID NO: 1777758 - RNA, 13 nt, Homo sapiens
caauguguacaag

SEQ ID NO: 1777759 - RNA, 18 nt, Homo sapiens
ugauuuugaaaucaugaa

SEQ ID NO: 1777760 - RNA, 18 nt, Homo sapiens
caugcucauguguacaca

SEQ ID NO: 1777761 - RNA, 21 nt, Homo sapiens
cauguuuuccgugaaaacgga

SEQ ID NO: 1777762 - RNA, 15 nt, Homo sapiens
gaauauccuauacug

SEQ ID NO: 1777763 - RNA, 12 nt, Homo sapiens
ucagugcaguac

SEQ ID NO: 1777764 - RNA, 22 nt, Homo sapiens
uuguuuaccucuuugucccaga

SEQ ID NO: 1777765 - RNA, 16 nt, Homo sapiens
cagccaacccuuucau

SEQ ID NO: 1777766 - RNA, 18 nt, Homo sapiens
caacauuuguuccaugag

SEQ ID NO: 1777767 - RNA, 18 nt, Homo sapiens
aauacuguuauucuuugc

SEQ ID NO: 1777768 - RNA, 17 nt, Homo sapiens
cucauuauuuuucacug

SEQ ID NO: 1777769 - RNA, 12 nt, Homo sapiens
cguuugcuauau

SEQ ID NO: 1777770 - RNA, 16 nt, Homo sapiens
acuuuuuggucaugaa

SEQ ID NO: 1777771 - RNA, 21 nt, Homo sapiens
uuacuguauauaaacuccuua

SEQ ID NO: 1777772 - RNA, 22 nt, Homo sapiens
caugaaccucaagcugcaucua

SEQ ID NO: 1777773 - RNA, 20 nt, Homo sapiens
uaaaguuuugcaacaauaaa

SEQ ID NO: 1777774 - RNA, 21 nt, Homo sapiens
uaaauccaacucugacuguaa

SEQ ID NO: 1777775 - RNA, 23 nt, Homo sapiens
cuaaaaccuugguuaucaaauac

SEQ ID NO: 1777776 - RNA, 23 nt, Homo sapiens
uggcaaaacaaaaguacauugcu

SEQ ID NO: 1777777 - RNA, 15 nt, Homo sapiens
gcccccagcccagag

SEQ ID NO: 1777778 - RNA, 15 nt, Homo sapiens
ggugcccuccuaucc

SEQ ID NO: 1777779 - RNA, 20 nt, Homo sapiens
ucuaagacuacuaugaacag

SEQ ID NO: 1777780 - RNA, 15 nt, Homo sapiens
cacuguuucaucuca

SEQ ID NO: 1777781 - RNA, 21 nt, Homo sapiens
uacaggaagcaccccaugcca

SEQ ID NO: 1777782 - RNA, 22 nt, Homo sapiens
uagagccaggcacacacugugc

SEQ ID NO: 1777783 - RNA, 15 nt, Homo sapiens
accgcaauaaugaau

SEQ ID NO: 1777784 - RNA, 22 nt, Homo sapiens
uccuuuacuaaugguguugagu

SEQ ID NO: 1777785 - RNA, 17 nt, Homo sapiens
aguauccacaggauauu

SEQ ID NO: 1777786 - RNA, 18 nt, Homo sapiens
gugagaccaggggaccag

SEQ ID NO: 1777787 - RNA, 18 nt, Homo sapiens
ccaaggucucacacuccu

SEQ ID NO: 1777788 - RNA, 23 nt, Homo sapiens
ugcaggaagugucuagaggaaua

SEQ ID NO: 1777789 - RNA, 23 nt, Homo sapiens
cucauugucuuguuauguacaaa

SEQ ID NO: 1777790 - RNA, 20 nt, Homo sapiens
gggggcacagcugucugcca

SEQ ID NO: 1777791 - RNA, 24 nt, Homo sapiens
ucuuugcggggccugucucaguga

SEQ ID NO: 1777792 - RNA, 19 nt, Homo sapiens
acguaaccuaugucagaca

SEQ ID NO: 1777793 - RNA, 21 nt, Homo sapiens
caaguggugccuaaaguuuaa

SEQ ID NO: 1777794 - RNA, 17 nt, Homo sapiens
cauccugucaccaugac

SEQ ID NO: 1777795 - RNA, 19 nt, Homo sapiens
cugcccaggccuaucugga

SEQ ID NO: 1777796 - RNA, 17 nt, Homo sapiens
aauacuuuaaaaugcac

SEQ ID NO: 1777797 - RNA, 17 nt, Homo sapiens
aaaccuuuaaucugcac

SEQ ID NO: 1777798 - RNA, 13 nt, Homo sapiens
ucugggugcagcu

SEQ ID NO: 1777799 - RNA, 19 nt, Homo sapiens
aaguggccaagaagcagug

SEQ ID NO: 1777800 - RNA, 17 nt, Homo sapiens
gacagagaauaacucag

SEQ ID NO: 1777801 - RNA, 20 nt, Homo sapiens
cauauuauaucagacugcuu

SEQ ID NO: 1777802 - RNA, 15 nt, Homo sapiens
gucugcccugcccau

SEQ ID NO: 1777803 - RNA, 14 nt, Homo sapiens
gaauaaagcccuug

SEQ ID NO: 1777804 - RNA, 20 nt, Homo sapiens
caucaaaaccugcgcaguca

SEQ ID NO: 1777805 - RNA, 20 nt, Homo sapiens
gacauuaaggaccaauagca

SEQ ID NO: 1777806 - RNA, 21 nt, Homo sapiens
acccugagccaccguguccuu

SEQ ID NO: 1777807 - RNA, 18 nt, Homo sapiens
aucgcuacuggcaucugu

SEQ ID NO: 1777808 - RNA, 14 nt, Homo sapiens
aaacauugugauca

SEQ ID NO: 1777809 - RNA, 16 nt, Homo sapiens
gauuugcauaaaguga

SEQ ID NO: 1777810 - RNA, 20 nt, Homo sapiens
agagacaacuucccaaagca

SEQ ID NO: 1777811 - RNA, 13 nt, Homo sapiens
ccauuucuuccac

SEQ ID NO: 1777812 - RNA, 22 nt, Homo sapiens
cugucagccccucaucagccuu

SEQ ID NO: 1777813 - RNA, 13 nt, Homo sapiens
ucauaaugacuua

SEQ ID NO: 1777814 - RNA, 14 nt, Homo sapiens
caugcuggccugug

SEQ ID NO: 1777815 - RNA, 22 nt, Homo sapiens
cuauguucuaagaagugaaaau

SEQ ID NO: 1777816 - RNA, 18 nt, Homo sapiens
aggagugugaccacugaa

SEQ ID NO: 1777817 - RNA, 22 nt, Homo sapiens
uuaaaaauaaacucugcacuua

SEQ ID NO: 1777818 - RNA, 21 nt, Homo sapiens
caacacaagaaaacucaaaga

SEQ ID NO: 1777819 - RNA, 20 nt, Homo sapiens
augcgucucuggcccucgug

SEQ ID NO: 1777820 - RNA, 19 nt, Homo sapiens
uguaucccaacuccuauaa

SEQ ID NO: 1777821 - RNA, 16 nt, Homo sapiens
ucaaguuggcuucuaa

SEQ ID NO: 1777822 - RNA, 15 nt, Homo sapiens
gaaggccagugccca

SEQ ID NO: 1777823 - RNA, 17 nt, Homo sapiens
uaaaauuuaaccuacua

SEQ ID NO: 1777824 - RNA, 13 nt, Homo sapiens
gacuaugcaaaag

SEQ ID NO: 1777825 - RNA, 17 nt, Homo sapiens
gaaucugggguuuccau

SEQ ID NO: 1777826 - RNA, 19 nt, Homo sapiens
uuauaucuguaaugauacu

SEQ ID NO: 1777827 - RNA, 15 nt, Homo sapiens
acucuccugugagau

SEQ ID NO: 1777828 - RNA, 22 nt, Homo sapiens
ugccgacucccccaaccaagga

SEQ ID NO: 1777829 - RNA, 13 nt, Homo sapiens
acucagaugucca

SEQ ID NO: 1777830 - RNA, 20 nt, Homo sapiens
uucaauaaaccacaagcauc

SEQ ID NO: 1777831 - RNA, 21 nt, Homo sapiens
aguggcucacgccuaugaucc

SEQ ID NO: 1777832 - RNA, 15 nt, Homo sapiens
auuuuguaugccaau

SEQ ID NO: 1777833 - RNA, 22 nt, Homo sapiens
cugcuucaugggccuggaugca

SEQ ID NO: 1777834 - RNA, 12 nt, Homo sapiens
ccugauaagcaa

SEQ ID NO: 1777835 - RNA, 22 nt, Homo sapiens
uauuuauguuguugaacuaaua

SEQ ID NO: 1777836 - RNA, 23 nt, Homo sapiens
ggcuccacuuggcuccucucacu

SEQ ID NO: 1777837 - RNA, 14 nt, Homo sapiens
uucaugucacugcu

SEQ ID NO: 1777838 - RNA, 13 nt, Homo sapiens
gcagcuuugcccu

SEQ ID NO: 1777839 - RNA, 20 nt, Homo sapiens
uuacccaguauuacugcugc

SEQ ID NO: 1777840 - RNA, 19 nt, Homo sapiens
cagcaugccuucaaaucaa

SEQ ID NO: 1777841 - RNA, 13 nt, Homo sapiens
auucaagauuccc

SEQ ID NO: 1777842 - RNA, 13 nt, Homo sapiens
gagccuggugccc

SEQ ID NO: 1777843 - RNA, 16 nt, Homo sapiens
aggucacguguggaau

SEQ ID NO: 1777844 - RNA, 13 nt, Homo sapiens
uguagcauauaaa

SEQ ID NO: 1777845 - RNA, 13 nt, Homo sapiens
aguaacauuuaag

SEQ ID NO: 1777846 - RNA, 14 nt, Homo sapiens
uuccccaaccacag

SEQ ID NO: 1777847 - RNA, 21 nt, Homo sapiens
aaucaggaaugagucaaucag

SEQ ID NO: 1777848 - RNA, 16 nt, Homo sapiens
cagaucucauguccuc

SEQ ID NO: 1777849 - RNA, 19 nt, Homo sapiens
cagacuaagaaauauucca

SEQ ID NO: 1777850 - RNA, 20 nt, Homo sapiens
uagccaagaggacagaauua

SEQ ID NO: 1777851 - RNA, 12 nt, Homo sapiens
acuuucuucccu

SEQ ID NO: 1777852 - RNA, 18 nt, Homo sapiens
gggaugccacccagcaac

SEQ ID NO: 1777853 - RNA, 14 nt, Homo sapiens
ccccuuccuggcac

SEQ ID NO: 1777854 - RNA, 18 nt, Homo sapiens
gccaacugccuccuugcc

SEQ ID NO: 1777855 - RNA, 17 nt, Homo sapiens
ucauuuccugcccuucc

SEQ ID NO: 1777856 - RNA, 20 nt, Homo sapiens
uuaggaacagcaguguucuc

SEQ ID NO: 1777857 - RNA, 17 nt, Homo sapiens
cccuccccagacucuca

SEQ ID NO: 1777858 - RNA, 13 nt, Homo sapiens
ucuacaaccagag

SEQ ID NO: 1777859 - RNA, 15 nt, Homo sapiens
gaggugggaggugga

SEQ ID NO: 1777860 - RNA, 19 nt, Homo sapiens
cuugagccucccccaaagc

SEQ ID NO: 1777861 - RNA, 15 nt, Homo sapiens
augcacuaagacaag

SEQ ID NO: 1777862 - RNA, 14 nt, Homo sapiens
augaaaguuuugca

SEQ ID NO: 1777863 - RNA, 22 nt, Homo sapiens
acaugagaagaagcacgaagca

SEQ ID NO: 1777864 - RNA, 17 nt, Homo sapiens
cugccucaguggcagca

SEQ ID NO: 1777865 - RNA, 16 nt, Homo sapiens
ucuagacuugugcuga

SEQ ID NO: 1777866 - RNA, 16 nt, Homo sapiens
ccgggagcaguguccu

SEQ ID NO: 1777867 - RNA, 21 nt, Homo sapiens
uauagcaucuucucauuccca

SEQ ID NO: 1777868 - RNA, 16 nt, Homo sapiens
agugaguauaacucua

SEQ ID NO: 1777869 - RNA, 18 nt, Homo sapiens
guucacugcacuguucag

SEQ ID NO: 1777870 - RNA, 21 nt, Homo sapiens
ugccugccgguaaacacgccu

SEQ ID NO: 1777871 - RNA, 18 nt, Homo sapiens
uaaaguuaaaaaaaagcc

SEQ ID NO: 1777872 - RNA, 22 nt, Homo sapiens
ccugugacacuuauaaauaucc

SEQ ID NO: 1777873 - RNA, 21 nt, Homo sapiens
caugcaagggaugaauuguaa

SEQ ID NO: 1777874 - RNA, 22 nt, Homo sapiens
uccucaucugggggaguggaau

SEQ ID NO: 1777875 - RNA, 23 nt, Homo sapiens
augaagcaagcuguguuacuuga

SEQ ID NO: 1777876 - RNA, 13 nt, Homo sapiens
acauaaggaugaa

SEQ ID NO: 1777877 - RNA, 13 nt, Homo sapiens
auugccucugaga

SEQ ID NO: 1777878 - RNA, 14 nt, Homo sapiens
ugcucuuuaccuug

SEQ ID NO: 1777879 - RNA, 21 nt, Homo sapiens
gaacaucuaaaagaugaaguu

SEQ ID NO: 1777880 - RNA, 22 nt, Homo sapiens
uagaagccugcagcggcacaaa

SEQ ID NO: 1777881 - RNA, 17 nt, Homo sapiens
cuccaggacaaccugcu

SEQ ID NO: 1777882 - RNA, 18 nt, Homo sapiens
ucaagugccuuauucuca

SEQ ID NO: 1777883 - RNA, 18 nt, Homo sapiens
ucuagauuuuucugugaa

SEQ ID NO: 1777884 - RNA, 23 nt, Homo sapiens
agaaacaccccucugucuaggac

SEQ ID NO: 1777885 - RNA, 16 nt, Homo sapiens
ugcaguuuacaguauu

SEQ ID NO: 1777886 - RNA, 22 nt, Homo sapiens
caaagcccuuguccccaugaaa

SEQ ID NO: 1777887 - RNA, 17 nt, Homo sapiens
ucauuccaccuucccau

SEQ ID NO: 1777888 - RNA, 14 nt, Homo sapiens
gccaggacuuugag

SEQ ID NO: 1777889 - RNA, 15 nt, Homo sapiens
ugagguuaaggggau

SEQ ID NO: 1777890 - RNA, 22 nt, Homo sapiens
cagaccccuuggcuuuugcuug

SEQ ID NO: 1777891 - RNA, 14 nt, Homo sapiens
auucccauguggaa

SEQ ID NO: 1777892 - RNA, 21 nt, Homo sapiens
gauguuggucaaaugaccuag

SEQ ID NO: 1777893 - RNA, 13 nt, Homo sapiens
cagacuuggagua

SEQ ID NO: 1777894 - RNA, 17 nt, Homo sapiens
agaguagauugauucac

SEQ ID NO: 1777895 - RNA, 22 nt, Homo sapiens
guaacccgauuauuguguauua

SEQ ID NO: 1777896 - RNA, 20 nt, Homo sapiens
ugauauuauguggcuuuuau

SEQ ID NO: 1777897 - RNA, 19 nt, Homo sapiens
cugacccaaccacagagga

SEQ ID NO: 1777898 - RNA, 14 nt, Homo sapiens
auuuugcagcagaa

SEQ ID NO: 1777899 - RNA, 15 nt, Homo sapiens
auauauaaaugaccu

SEQ ID NO: 1777900 - RNA, 20 nt, Homo sapiens
gaguugauggggugcagaua

SEQ ID NO: 1777901 - RNA, 22 nt, Homo sapiens
cauacauuguacgaagaguauu

SEQ ID NO: 1777902 - RNA, 13 nt, Homo sapiens
uuuuaaacauucu

SEQ ID NO: 1777903 - RNA, 21 nt, Homo sapiens
ccugcacguugugcacaugua

SEQ ID NO: 1777904 - RNA, 15 nt, Homo sapiens
uuccaugaugguuau

SEQ ID NO: 1777905 - RNA, 16 nt, Homo sapiens
auuuucacucugggcu

SEQ ID NO: 1777906 - RNA, 11 nt, Homo sapiens
aaaauugugaa

SEQ ID NO: 1777907 - RNA, 13 nt, Homo sapiens
caucaaguugcac

SEQ ID NO: 1777908 - RNA, 12 nt, Homo sapiens
ccguaaggcaag

SEQ ID NO: 1777909 - RNA, 17 nt, Homo sapiens
acuugaaagugaacaau

SEQ ID NO: 1777910 - RNA, 21 nt, Homo sapiens
gcuuaccuuguuuugccagug

SEQ ID NO: 1777911 - RNA, 14 nt, Homo sapiens
auauaaaucucaau

SEQ ID NO: 1777912 - RNA, 18 nt, Homo sapiens
aucagcaucucuucuucc

SEQ ID NO: 1777913 - RNA, 18 nt, Homo sapiens
cuuuaauaaaggccacag

SEQ ID NO: 1777914 - RNA, 23 nt, Homo sapiens
cuugaucagacauucagagauua

SEQ ID NO: 1777915 - RNA, 15 nt, Homo sapiens
aguaccuacugugug

SEQ ID NO: 1777916 - RNA, 17 nt, Homo sapiens
gacaugcuacaacuacu

SEQ ID NO: 1777917 - RNA, 14 nt, Homo sapiens
gaagccgugcccug

SEQ ID NO: 1777918 - RNA, 13 nt, Homo sapiens
aaugaauugccuu

SEQ ID NO: 1777919 - RNA, 15 nt, Homo sapiens
ugcaaccugugcaaa

SEQ ID NO: 1777920 - RNA, 15 nt, Homo sapiens
uccaaagaacuugau

SEQ ID NO: 1777921 - RNA, 17 nt, Homo sapiens
uuacuggacaaagaauu

SEQ ID NO: 1777922 - RNA, 19 nt, Homo sapiens
aguuuucuagaugacauaa

SEQ ID NO: 1777923 - RNA, 12 nt, Homo sapiens
cuuagaaugagg

SEQ ID NO: 1777924 - RNA, 20 nt, Homo sapiens
augauuuuagcaauacccau

SEQ ID NO: 1777925 - RNA, 23 nt, Homo sapiens
aauccuuucauaaagcaccagca

SEQ ID NO: 1777926 - RNA, 13 nt, Homo sapiens
ugaaucuuucaua

SEQ ID NO: 1777927 - RNA, 18 nt, Homo sapiens
acaagaaggccacuggua

SEQ ID NO: 1777928 - RNA, 21 nt, Homo sapiens
aagguuguacauaguggucau

SEQ ID NO: 1777929 - RNA, 13 nt, Homo sapiens
ucuagaaaagcau

SEQ ID NO: 1777930 - RNA, 18 nt, Homo sapiens
ccuucuuuuuguucuuca

SEQ ID NO: 1777931 - RNA, 14 nt, Homo sapiens
cauagugacaugca

SEQ ID NO: 1777932 - RNA, 23 nt, Homo sapiens
aguagcuaggugcacauauacau

SEQ ID NO: 1777933 - RNA, 23 nt, Homo sapiens
ugaaagaguaaaggaaaugauug

SEQ ID NO: 1777934 - RNA, 22 nt, Homo sapiens
agugcagcaaccagagcacugu

SEQ ID NO: 1777935 - RNA, 15 nt, Homo sapiens
aauauaagugaagga

SEQ ID NO: 1777936 - RNA, 23 nt, Homo sapiens
cauuacagagaggagaaacacau

SEQ ID NO: 1777937 - RNA, 19 nt, Homo sapiens
acugggugcggugacucau

SEQ ID NO: 1777938 - RNA, 20 nt, Homo sapiens
agggagcucuggggacagcu

SEQ ID NO: 1777939 - RNA, 16 nt, Homo sapiens
aaaacucgaggacugu

SEQ ID NO: 1777940 - RNA, 20 nt, Homo sapiens
ugugcauuucaccugugaca

SEQ ID NO: 1777941 - RNA, 17 nt, Homo sapiens
ucuggcagacuuacaaa

SEQ ID NO: 1777942 - RNA, 18 nt, Homo sapiens
guaacuugccauccgcac

SEQ ID NO: 1777943 - RNA, 23 nt, Homo sapiens
ugauacauguuuccaauuauccu

SEQ ID NO: 1777944 - RNA, 21 nt, Homo sapiens
accaacccuguuuccugaguu

SEQ ID NO: 1777945 - RNA, 21 nt, Homo sapiens
gcagugccuugugcaauguga

SEQ ID NO: 1777946 - RNA, 23 nt, Homo sapiens
agauuagccuguauucucuucag

SEQ ID NO: 1777947 - RNA, 13 nt, Homo sapiens
ugaagcucagaaa

SEQ ID NO: 1777948 - RNA, 19 nt, Homo sapiens
ggcuacuauagguccagaa

SEQ ID NO: 1777949 - RNA, 16 nt, Homo sapiens
uacagccugcacacac

SEQ ID NO: 1777950 - RNA, 15 nt, Homo sapiens
aaaccaggacauuaa

SEQ ID NO: 1777951 - RNA, 18 nt, Homo sapiens
cugguccuucccugaugg

SEQ ID NO: 1777952 - RNA, 20 nt, Homo sapiens
cugugauauuuuaaauaucc

SEQ ID NO: 1777953 - RNA, 16 nt, Homo sapiens
uugggaagcugaggca

SEQ ID NO: 1777954 - RNA, 18 nt, Homo sapiens
cacuguuguacacagucu

SEQ ID NO: 1777955 - RNA, 14 nt, Homo sapiens
cagcucuccaauac

SEQ ID NO: 1777956 - RNA, 20 nt, Homo sapiens
uuaccagacgguucaccagc

SEQ ID NO: 1777957 - RNA, 14 nt, Homo sapiens
gaaccagcaaugag

SEQ ID NO: 1777958 - RNA, 14 nt, Homo sapiens
ccaaacacaaugau

SEQ ID NO: 1777959 - RNA, 12 nt, Homo sapiens
auuuacacaggu

SEQ ID NO: 1777960 - RNA, 12 nt, Homo sapiens
uuggacacugug

SEQ ID NO: 1777961 - RNA, 15 nt, Homo sapiens
ccacacuugguggga

SEQ ID NO: 1777962 - RNA, 13 nt, Homo sapiens
gcuuagauuucau

SEQ ID NO: 1777963 - RNA, 17 nt, Homo sapiens
ugacaggcgugcaccug

SEQ ID NO: 1777964 - RNA, 19 nt, Homo sapiens
cugaggcagugcuagucaa

SEQ ID NO: 1777965 - RNA, 22 nt, Homo sapiens
augaauuauauucaaugcauuu

SEQ ID NO: 1777966 - RNA, 20 nt, Homo sapiens
cugccuaguuuugaugaauu

SEQ ID NO: 1777967 - RNA, 18 nt, Homo sapiens
agagggaaggucucagga

SEQ ID NO: 1777968 - RNA, 23 nt, Homo sapiens
cauguggaguggacauucaaaaa

SEQ ID NO: 1777969 - RNA, 17 nt, Homo sapiens
caguggggugaucucau

SEQ ID NO: 1777970 - RNA, 20 nt, Homo sapiens
agacagccccagagcagggu

SEQ ID NO: 1777971 - RNA, 14 nt, Homo sapiens
auccucuacugugc

SEQ ID NO: 1777972 - RNA, 18 nt, Homo sapiens
ucacauugagcugauaua

SEQ ID NO: 1777973 - RNA, 15 nt, Homo sapiens
cgugucacacuugug

SEQ ID NO: 1777974 - RNA, 21 nt, Homo sapiens
ugacuaaaaauaucacacuga

SEQ ID NO: 1777975 - RNA, 16 nt, Homo sapiens
cagaucuuuaaauaca

SEQ ID NO: 1777976 - RNA, 23 nt, Homo sapiens
uggcuuuuaguacugaagccaaa

SEQ ID NO: 1777977 - RNA, 17 nt, Homo sapiens
uggcuuagaaaucuuua

SEQ ID NO: 1777978 - RNA, 13 nt, Homo sapiens
caaaugcuauuca

SEQ ID NO: 1777979 - RNA, 22 nt, Homo sapiens
gcggcuuccugaugauggucau

SEQ ID NO: 1777980 - RNA, 14 nt, Homo sapiens
uacuuccacugagg

SEQ ID NO: 1777981 - RNA, 21 nt, Homo sapiens
aggccugaacccguccauuca

SEQ ID NO: 1777982 - RNA, 23 nt, Homo sapiens
uggaggucaggaguuugagacca

SEQ ID NO: 1777983 - RNA, 21 nt, Homo sapiens
aaguugaauuuuacauggcug

SEQ ID NO: 1777984 - RNA, 23 nt, Homo sapiens
gccuggcuucacucucccugacg

SEQ ID NO: 1777985 - RNA, 19 nt, Homo sapiens
gcacuccucugucucugcu

SEQ ID NO: 1777986 - RNA, 15 nt, Homo sapiens
guugcauauauggac

SEQ ID NO: 1777987 - RNA, 16 nt, Homo sapiens
uuaauuaaguaucugg

SEQ ID NO: 1777988 - RNA, 20 nt, Homo sapiens
guuacaagguguuguuaaaa

SEQ ID NO: 1777989 - RNA, 19 nt, Homo sapiens
aaguugaccaaugaaauga

SEQ ID NO: 1777990 - RNA, 19 nt, Homo sapiens
auaacggugcuugugucac

SEQ ID NO: 1777991 - RNA, 18 nt, Homo sapiens
uccuuccacaacugcugc

SEQ ID NO: 1777992 - RNA, 12 nt, Homo sapiens
agagaaggugaa

SEQ ID NO: 1777993 - RNA, 21 nt, Homo sapiens
guuuaagcaauucauucucuc

SEQ ID NO: 1777994 - RNA, 17 nt, Homo sapiens
caagcaccugggauuac

SEQ ID NO: 1777995 - RNA, 17 nt, Homo sapiens
uagauuucgaagccaca

SEQ ID NO: 1777996 - RNA, 13 nt, Homo sapiens
cugaagaaaccuu

SEQ ID NO: 1777997 - RNA, 23 nt, Homo sapiens
aucucuggcccaggcucaagccc

SEQ ID NO: 1777998 - RNA, 23 nt, Homo sapiens
cugcccguaaacacgccugcaaa

SEQ ID NO: 1777999 - RNA, 17 nt, Homo sapiens
auuuucauucaucaugu

SEQ ID NO: 1778000 - RNA, 19 nt, Homo sapiens
uggaaaauaaaaacuguag

SEQ ID NO: 1778001 - RNA, 23 nt, Homo sapiens
uauccacaucccuaacaucaugc

SEQ ID NO: 1778002 - RNA, 14 nt, Homo sapiens
cuagcuuagcuguc

SEQ ID NO: 1778003 - RNA, 13 nt, Homo sapiens
gccucugacucac

SEQ ID NO: 1778004 - RNA, 19 nt, Homo sapiens
gcugcaaaggaaaagccaa

SEQ ID NO: 1778005 - RNA, 18 nt, Homo sapiens
ccuuuacuccuggcucaa

SEQ ID NO: 1778006 - RNA, 16 nt, Homo sapiens
uagugauaucuagaaa

SEQ ID NO: 1778007 - RNA, 14 nt, Homo sapiens
gcauaccuuggacu

SEQ ID NO: 1778008 - RNA, 22 nt, Homo sapiens
gggaaauagccaaaaaggcaaa

SEQ ID NO: 1778009 - RNA, 19 nt, Homo sapiens
cacuuugggaggcugaggc

SEQ ID NO: 1778010 - RNA, 20 nt, Homo sapiens
ccuggcagaacugagcuccu

SEQ ID NO: 1778011 - RNA, 15 nt, Homo sapiens
uacacaaugugauuu

SEQ ID NO: 1778012 - RNA, 14 nt, Homo sapiens
uguucucaguggug

SEQ ID NO: 1778013 - RNA, 13 nt, Homo sapiens
uccuugaguuuca

SEQ ID NO: 1778014 - RNA, 20 nt, Homo sapiens
aauaagagcguuugcccaaa

SEQ ID NO: 1778015 - RNA, 17 nt, Homo sapiens
cucccagcugacagucc

SEQ ID NO: 1778016 - RNA, 21 nt, Homo sapiens
gaauuaggcuguaacuacuuu

SEQ ID NO: 1778017 - RNA, 20 nt, Homo sapiens
aaauugcauauauguauaua

SEQ ID NO: 1778018 - RNA, 20 nt, Homo sapiens
agugugcaugauuguauaug

SEQ ID NO: 1778019 - RNA, 23 nt, Homo sapiens
uaaguuuugaaacuaacuguugg

SEQ ID NO: 1778020 - RNA, 17 nt, Homo sapiens
caaugguuucacauggu

SEQ ID NO: 1778021 - RNA, 11 nt, Homo sapiens
ugauguugcug

SEQ ID NO: 1778022 - RNA, 22 nt, Homo sapiens
gaagccuucuuuuucugagaca

SEQ ID NO: 1778023 - RNA, 13 nt, Homo sapiens
auugcaaugcccg

SEQ ID NO: 1778024 - RNA, 18 nt, Homo sapiens
guaugaaagauguuugua

SEQ ID NO: 1778025 - RNA, 14 nt, Homo sapiens
auaaucucaaagga

SEQ ID NO: 1778026 - RNA, 23 nt, Homo sapiens
ccccuggggcuucuccugaccca

SEQ ID NO: 1778027 - RNA, 19 nt, Homo sapiens
ucaccuaggaagccucaga

SEQ ID NO: 1778028 - RNA, 16 nt, Homo sapiens
guuggccccucugcug

SEQ ID NO: 1778029 - RNA, 15 nt, Homo sapiens
caagugaggccauag

SEQ ID NO: 1778030 - RNA, 11 nt, Homo sapiens
caggugccaga

SEQ ID NO: 1778031 - RNA, 11 nt, Homo sapiens
agagugcccag

SEQ ID NO: 1778032 - RNA, 17 nt, Homo sapiens
agguccaauaaaaugcc

SEQ ID NO: 1778033 - RNA, 15 nt, Homo sapiens
cuaguacaaucuugg

SEQ ID NO: 1778034 - RNA, 12 nt, Homo sapiens
cccuauucccug

SEQ ID NO: 1778035 - RNA, 22 nt, Homo sapiens
uauccuguacauuucacaaaaa

SEQ ID NO: 1778036 - RNA, 22 nt, Homo sapiens
ucuucuggagggaagcaccaug

SEQ ID NO: 1778037 - RNA, 13 nt, Homo sapiens
aauugauuugcau

SEQ ID NO: 1778038 - RNA, 20 nt, Homo sapiens
ugccagcacagggcuguaaa

SEQ ID NO: 1778039 - RNA, 19 nt, Homo sapiens
cuugggcaaaaugacaagg

SEQ ID NO: 1778040 - RNA, 11 nt, Homo sapiens
aucccaggaca

SEQ ID NO: 1778041 - RNA, 14 nt, Homo sapiens
caggcaacgcacaa

SEQ ID NO: 1778042 - RNA, 17 nt, Homo sapiens
gacucuuggcacagcau

SEQ ID NO: 1778043 - RNA, 23 nt, Homo sapiens
aggcugaggcuggcacaggacau

SEQ ID NO: 1778044 - RNA, 22 nt, Homo sapiens
gaggaugacuaacaagauuugu

SEQ ID NO: 1778045 - RNA, 14 nt, Homo sapiens
uuguuaauacuaua

SEQ ID NO: 1778046 - RNA, 15 nt, Homo sapiens
aggggcuacugugac

SEQ ID NO: 1778047 - RNA, 18 nt, Homo sapiens
ccucuuuugugagaagau

SEQ ID NO: 1778048 - RNA, 17 nt, Homo sapiens
ugaagacugaggacaaa

SEQ ID NO: 1778049 - RNA, 15 nt, Homo sapiens
ugcugaggcaugaaa

SEQ ID NO: 1778050 - RNA, 21 nt, Homo sapiens
ugggcaucugugccuucucua

SEQ ID NO: 1778051 - RNA, 19 nt, Homo sapiens
ccaucucacugcaguagca

SEQ ID NO: 1778052 - RNA, 15 nt, Homo sapiens
uuaaagggacacccc

SEQ ID NO: 1778053 - RNA, 13 nt, Homo sapiens
uaaaauguucucu

SEQ ID NO: 1778054 - RNA, 19 nt, Homo sapiens
cagugccagcaaguccuua

SEQ ID NO: 1778055 - RNA, 14 nt, Homo sapiens
gguuggcucugcca

SEQ ID NO: 1778056 - RNA, 18 nt, Homo sapiens
agcauuuugcugcuuuau

SEQ ID NO: 1778057 - RNA, 14 nt, Homo sapiens
aaaaagcauuauua

SEQ ID NO: 1778058 - RNA, 14 nt, Homo sapiens
acaccccacaggca

SEQ ID NO: 1778059 - RNA, 18 nt, Homo sapiens
agacguuuaaaagccauc

SEQ ID NO: 1778060 - RNA, 22 nt, Homo sapiens
ggcaguuacagggcccagguga

SEQ ID NO: 1778061 - RNA, 22 nt, Homo sapiens
ugccacguauagggcacuccca

SEQ ID NO: 1778062 - RNA, 16 nt, Homo sapiens
agaaacagugugcaug

SEQ ID NO: 1778063 - RNA, 18 nt, Homo sapiens
uacccuacccugcacauu

SEQ ID NO: 1778064 - RNA, 22 nt, Homo sapiens
guuuccacucaaaauaugucaa

SEQ ID NO: 1778065 - RNA, 12 nt, Homo sapiens
cugguguucuau

SEQ ID NO: 1778066 - RNA, 22 nt, Homo sapiens
uugauauuucuagcuuaucuac

SEQ ID NO: 1778067 - RNA, 12 nt, Homo sapiens
auacuggucuca

SEQ ID NO: 1778068 - RNA, 22 nt, Homo sapiens
ugcgauuuuguuaacccagcga

SEQ ID NO: 1778069 - RNA, 14 nt, Homo sapiens
aauauugcugaugg

SEQ ID NO: 1778070 - RNA, 20 nt, Homo sapiens
ugaaacgucuaggaaaucua

SEQ ID NO: 1778071 - RNA, 23 nt, Homo sapiens
acacucuauaagauuccaaaaag

SEQ ID NO: 1778072 - RNA, 22 nt, Homo sapiens
ccucugguucugacacuuucug

SEQ ID NO: 1778073 - RNA, 15 nt, Homo sapiens
agagcagcuggucaa

SEQ ID NO: 1778074 - RNA, 20 nt, Homo sapiens
gagaaagcaaaggugcacuc

SEQ ID NO: 1778075 - RNA, 21 nt, Homo sapiens
uucuuuaaaaaaacacauaau

SEQ ID NO: 1778076 - RNA, 18 nt, Homo sapiens
augauccagaacaguggc

SEQ ID NO: 1778077 - RNA, 15 nt, Homo sapiens
gaaugccacagugaa

SEQ ID NO: 1778078 - RNA, 15 nt, Homo sapiens
ccugacuuccucugc

SEQ ID NO: 1778079 - RNA, 18 nt, Homo sapiens
ucucacuuuuauugauaa

SEQ ID NO: 1778080 - RNA, 18 nt, Homo sapiens
gcacuugcugaggccaag

SEQ ID NO: 1778081 - RNA, 19 nt, Homo sapiens
cucccucuuggucuuccca

SEQ ID NO: 1778082 - RNA, 14 nt, Homo sapiens
gagaugagcuuucu

SEQ ID NO: 1778083 - RNA, 21 nt, Homo sapiens
uacgauggaggccuaccucuc

SEQ ID NO: 1778084 - RNA, 22 nt, Homo sapiens
cuuccugcugaguccuuuccag

SEQ ID NO: 1778085 - RNA, 20 nt, Homo sapiens
acaugauuguauaagcaugc

SEQ ID NO: 1778086 - RNA, 15 nt, Homo sapiens
gguggacagaagcuu

SEQ ID NO: 1778087 - RNA, 22 nt, Homo sapiens
gauuccagucuucucuuugaag

SEQ ID NO: 1778088 - RNA, 19 nt, Homo sapiens
uccauuauuugaguuugac

SEQ ID NO: 1778089 - RNA, 13 nt, Homo sapiens
cuguuacuccaaa

SEQ ID NO: 1778090 - RNA, 19 nt, Homo sapiens
cuuuuuuuaaguguucugu

SEQ ID NO: 1778091 - RNA, 19 nt, Homo sapiens
gaaaaguguccuucuugcu

SEQ ID NO: 1778092 - RNA, 17 nt, Homo sapiens
gaaucccggcugucaag

SEQ ID NO: 1778093 - RNA, 22 nt, Homo sapiens
gggacuguuccaaagccaguga

SEQ ID NO: 1778094 - RNA, 12 nt, Homo sapiens
cacacaugcuag

SEQ ID NO: 1778095 - RNA, 14 nt, Homo sapiens
auuuguaguugcau

SEQ ID NO: 1778096 - RNA, 19 nt, Homo sapiens
uaguugcaugaaauuuugc

SEQ ID NO: 1778097 - RNA, 13 nt, Homo sapiens
caugaccuggaaa

SEQ ID NO: 1778098 - RNA, 21 nt, Homo sapiens
caucacgacuuucucuuaaca

SEQ ID NO: 1778099 - RNA, 20 nt, Homo sapiens
ccuugcagauaucugcaugu

SEQ ID NO: 1778100 - RNA, 22 nt, Homo sapiens
acauuggagacaucacuugcca

SEQ ID NO: 1778101 - RNA, 13 nt, Homo sapiens
uauauacuuugaa

SEQ ID NO: 1778102 - RNA, 14 nt, Homo sapiens
ccaaaacaauuuca

SEQ ID NO: 1778103 - RNA, 13 nt, Homo sapiens
cagcccugcugca

SEQ ID NO: 1778104 - RNA, 13 nt, Homo sapiens
gauuucucaaaaa

SEQ ID NO: 1778105 - RNA, 22 nt, Homo sapiens
acaugagauguguggacugugg

SEQ ID NO: 1778106 - RNA, 20 nt, Homo sapiens
gauacagccuuccguaucca

SEQ ID NO: 1778107 - RNA, 20 nt, Homo sapiens
cgcccuggacugugugcuca

SEQ ID NO: 1778108 - RNA, 15 nt, Homo sapiens
agugcagugcucagu

SEQ ID NO: 1778109 - RNA, 17 nt, Homo sapiens
ugaaaagaugguaucau

SEQ ID NO: 1778110 - RNA, 18 nt, Homo sapiens
cuaguauuguccauauca

SEQ ID NO: 1778111 - RNA, 23 nt, Homo sapiens
gaaguugaggcuuagcuauguuu

SEQ ID NO: 1778112 - RNA, 14 nt, Homo sapiens
ggagcuagccagag

SEQ ID NO: 1778113 - RNA, 12 nt, Homo sapiens
aacucuugcuca

SEQ ID NO: 1778114 - RNA, 16 nt, Homo sapiens
ccacaucuugaucugc

SEQ ID NO: 1778115 - RNA, 17 nt, Homo sapiens
cuccacccccaccucaa

SEQ ID NO: 1778116 - RNA, 15 nt, Homo sapiens
auaguacugcacuua

SEQ ID NO: 1778117 - RNA, 17 nt, Homo sapiens
ugcagcugggauuugaa

SEQ ID NO: 1778118 - RNA, 14 nt, Homo sapiens
cgauaauuccucaa

SEQ ID NO: 1778119 - RNA, 17 nt, Homo sapiens
cgugagcuaugauaaga

SEQ ID NO: 1778120 - RNA, 23 nt, Homo sapiens
cuaauuagaaaauauaguuugag

SEQ ID NO: 1778121 - RNA, 17 nt, Homo sapiens
aaaaaucauaguacucu

SEQ ID NO: 1778122 - RNA, 18 nt, Homo sapiens
uaagcgggaucccagcau

SEQ ID NO: 1778123 - RNA, 18 nt, Homo sapiens
augggguuguuagcuuuu

SEQ ID NO: 1778124 - RNA, 13 nt, Homo sapiens
uguuuuaucacuu

SEQ ID NO: 1778125 - RNA, 19 nt, Homo sapiens
ccccgaggagcccgaaguc

SEQ ID NO: 1778126 - RNA, 14 nt, Homo sapiens
ucuggucuguccac

SEQ ID NO: 1778127 - RNA, 23 nt, Homo sapiens
uaaugauggcccauucuacuugc

SEQ ID NO: 1778128 - RNA, 21 nt, Homo sapiens
aaagccugaguacuccacacu

SEQ ID NO: 1778129 - RNA, 17 nt, Homo sapiens
ucaugggaaaguauucu

SEQ ID NO: 1778130 - RNA, 15 nt, Homo sapiens
uuguaucaacacugu

SEQ ID NO: 1778131 - RNA, 21 nt, Homo sapiens
uggagcaagaggggcauacua

SEQ ID NO: 1778132 - RNA, 14 nt, Homo sapiens
uaagggaaacugcc

SEQ ID NO: 1778133 - RNA, 20 nt, Homo sapiens
gaaaccuguccauaaaguaa

SEQ ID NO: 1778134 - RNA, 15 nt, Homo sapiens
ucuugcagcuguaaa

SEQ ID NO: 1778135 - RNA, 14 nt, Homo sapiens
gagcuguguucaca

SEQ ID NO: 1778136 - RNA, 22 nt, Homo sapiens
caaaaagaagauggauguaauu

SEQ ID NO: 1778137 - RNA, 20 nt, Homo sapiens
uggcucacaccuguaauccc

SEQ ID NO: 1778138 - RNA, 21 nt, Homo sapiens
auuuuauaccaaagccaauaa

SEQ ID NO: 1778139 - RNA, 16 nt, Homo sapiens
uacaaggggcccagug

SEQ ID NO: 1778140 - RNA, 23 nt, Homo sapiens
cuucccagcacuaugcuuuccuu

SEQ ID NO: 1778141 - RNA, 14 nt, Homo sapiens
uggucaagcacucg

SEQ ID NO: 1778142 - RNA, 19 nt, Homo sapiens
aaugugauauaaacagcuu

SEQ ID NO: 1778143 - RNA, 21 nt, Homo sapiens
aguaauacaguacaguacuca

SEQ ID NO: 1778144 - RNA, 14 nt, Homo sapiens
ugcgcucaccucag

SEQ ID NO: 1778145 - RNA, 18 nt, Homo sapiens
gaagcugauuuucaugaa

SEQ ID NO: 1778146 - RNA, 21 nt, Homo sapiens
acuccaagccaaauacauucu

SEQ ID NO: 1778147 - RNA, 20 nt, Homo sapiens
aucuccacuuggcauuagcu

SEQ ID NO: 1778148 - RNA, 20 nt, Homo sapiens
aggcccccucucaggagcca

SEQ ID NO: 1778149 - RNA, 20 nt, Homo sapiens
agacuuuugcuuuaugauau

SEQ ID NO: 1778150 - RNA, 16 nt, Homo sapiens
auaccacuuaccucaa

SEQ ID NO: 1778151 - RNA, 15 nt, Homo sapiens
auuccaauuugcacu

SEQ ID NO: 1778152 - RNA, 14 nt, Homo sapiens
cuucuaaagagucu

SEQ ID NO: 1778153 - RNA, 15 nt, Homo sapiens
gcuucuagaucugga

SEQ ID NO: 1778154 - RNA, 17 nt, Homo sapiens
augcaaagcacucucug

SEQ ID NO: 1778155 - RNA, 17 nt, Homo sapiens
ccacaugaccuccauuu

SEQ ID NO: 1778156 - RNA, 14 nt, Homo sapiens
aaaaugcuguuuuc

SEQ ID NO: 1778157 - RNA, 14 nt, Homo sapiens
gaugggggugggca

SEQ ID NO: 1778158 - RNA, 16 nt, Homo sapiens
aauuagauccauuaau

SEQ ID NO: 1778159 - RNA, 16 nt, Homo sapiens
cagucacugacaguua

SEQ ID NO: 1778160 - RNA, 18 nt, Homo sapiens
auuggacgguuucuagcc

SEQ ID NO: 1778161 - RNA, 20 nt, Homo sapiens
agacugaccauauugugcuu

SEQ ID NO: 1778162 - RNA, 23 nt, Homo sapiens
uuuccaguguucuauuugcuuua

SEQ ID NO: 1778163 - RNA, 13 nt, Homo sapiens
gaaaugcucuuuu

SEQ ID NO: 1778164 - RNA, 17 nt, Homo sapiens
agcgcgggagagaguga

SEQ ID NO: 1778165 - RNA, 18 nt, Homo sapiens
aucccaaacugugaugaa

SEQ ID NO: 1778166 - RNA, 14 nt, Homo sapiens
uugucccucuguau

SEQ ID NO: 1778167 - RNA, 17 nt, Homo sapiens
gggcucuccaagcacua

SEQ ID NO: 1778168 - RNA, 21 nt, Homo sapiens
acuaaacaacuaccuccucag

SEQ ID NO: 1778169 - RNA, 13 nt, Homo sapiens
guaauaacaaacg

SEQ ID NO: 1778170 - RNA, 20 nt, Homo sapiens
aggaaaauguucauguucau

SEQ ID NO: 1778171 - RNA, 21 nt, Homo sapiens
aaggcuuacacccacagugga

SEQ ID NO: 1778172 - RNA, 21 nt, Homo sapiens
ccacccuguucccagucuucu

SEQ ID NO: 1778173 - RNA, 17 nt, Homo sapiens
uuguguccccaccucag

SEQ ID NO: 1778174 - RNA, 15 nt, Homo sapiens
cugcacacacaugca

SEQ ID NO: 1778175 - RNA, 15 nt, Homo sapiens
ugcuuuuucagccau

SEQ ID NO: 1778176 - RNA, 17 nt, Homo sapiens
gaauaaaauuauuccuu

SEQ ID NO: 1778177 - RNA, 21 nt, Homo sapiens
aaugguucagaauuaaacuuu

SEQ ID NO: 1778178 - RNA, 19 nt, Homo sapiens
gacagugugggacaggcuc

SEQ ID NO: 1778179 - RNA, 20 nt, Homo sapiens
agacugcaaacauguugccu

SEQ ID NO: 1778180 - RNA, 17 nt, Homo sapiens
uaacaauagguauuucu

SEQ ID NO: 1778181 - RNA, 17 nt, Homo sapiens
cccugacuucccagcug

SEQ ID NO: 1778182 - RNA, 15 nt, Homo sapiens
aagggacacauauca

SEQ ID NO: 1778183 - RNA, 16 nt, Homo sapiens
ggaaaacgaagcucau

SEQ ID NO: 1778184 - RNA, 20 nt, Homo sapiens
cuuuuagaccaaaauaugaa

SEQ ID NO: 1778185 - RNA, 14 nt, Homo sapiens
uaauucaccaaagu

SEQ ID NO: 1778186 - RNA, 15 nt, Homo sapiens
aucuucucauuccca

SEQ ID NO: 1778187 - RNA, 16 nt, Homo sapiens
uggaacuauuccauca

SEQ ID NO: 1778188 - RNA, 18 nt, Homo sapiens
gugagacuccaucucuau

SEQ ID NO: 1778189 - RNA, 15 nt, Homo sapiens
cacaagucccagcgc

SEQ ID NO: 1778190 - RNA, 17 nt, Homo sapiens
ugcuagacacacuccau

SEQ ID NO: 1778191 - RNA, 15 nt, Homo sapiens
guaaaauguucucuu

SEQ ID NO: 1778192 - RNA, 14 nt, Homo sapiens
uuggauuuuaaaca

SEQ ID NO: 1778193 - RNA, 15 nt, Homo sapiens
cacagcaacuauaua

SEQ ID NO: 1778194 - RNA, 14 nt, Homo sapiens
cugugcagucauca

SEQ ID NO: 1778195 - RNA, 21 nt, Homo sapiens
guggagagaaagugacaugca

SEQ ID NO: 1778196 - RNA, 16 nt, Homo sapiens
gggauauggguccucu

SEQ ID NO: 1778197 - RNA, 15 nt, Homo sapiens
gagcccugcuaugaa

SEQ ID NO: 1778198 - RNA, 18 nt, Homo sapiens
gugucugucugaggugac

SEQ ID NO: 1778199 - RNA, 12 nt, Homo sapiens
aguaagugcuuu

SEQ ID NO: 1778200 - RNA, 14 nt, Homo sapiens
auccacaguacuca

SEQ ID NO: 1778201 - RNA, 21 nt, Homo sapiens
uaaggcaacuuauugcagugu

SEQ ID NO: 1778202 - RNA, 14 nt, Homo sapiens
ugggaccaggccaa

SEQ ID NO: 1778203 - RNA, 23 nt, Homo sapiens
ccagccacggggacucagcccuu

SEQ ID NO: 1778204 - RNA, 23 nt, Homo sapiens
uaauuagaaacacacuuuugcac

SEQ ID NO: 1778205 - RNA, 16 nt, Homo sapiens
ccuggcccagaugauc

SEQ ID NO: 1778206 - RNA, 20 nt, Homo sapiens
cuccaccccacaacccaaaa

SEQ ID NO: 1778207 - RNA, 19 nt, Homo sapiens
gagccucgcaacccgugcc

SEQ ID NO: 1778208 - RNA, 21 nt, Homo sapiens
uuagcauuuuucaaaugaucu

SEQ ID NO: 1778209 - RNA, 21 nt, Homo sapiens
aagaucagugaagacagcaau

SEQ ID NO: 1778210 - RNA, 16 nt, Homo sapiens
caggauuggggaccug

SEQ ID NO: 1778211 - RNA, 23 nt, Homo sapiens
ugcagagcaaugacugugcucac

SEQ ID NO: 1778212 - RNA, 17 nt, Homo sapiens
acuugaaauuugccuug

SEQ ID NO: 1778213 - RNA, 22 nt, Homo sapiens
aucagcucguuacuucagccca

SEQ ID NO: 1778214 - RNA, 15 nt, Homo sapiens
uggccaucuaaacau

SEQ ID NO: 1778215 - RNA, 14 nt, Homo sapiens
gucuaaagcuaaac

SEQ ID NO: 1778216 - RNA, 16 nt, Homo sapiens
cuuuuaacagaacaga

SEQ ID NO: 1778217 - RNA, 15 nt, Homo sapiens
aucaguauucugcca

SEQ ID NO: 1778218 - RNA, 15 nt, Homo sapiens
agacaagcuccuccc

SEQ ID NO: 1778219 - RNA, 24 nt, Homo sapiens
caucuuuggguccuuagugcaaua

SEQ ID NO: 1778220 - RNA, 15 nt, Homo sapiens
agccucaucauuucc

SEQ ID NO: 1778221 - RNA, 15 nt, Homo sapiens
uguaugaugagcaua

SEQ ID NO: 1778222 - RNA, 18 nt, Homo sapiens
ugcccuguguacauauaa

SEQ ID NO: 1778223 - RNA, 22 nt, Homo sapiens
caaaucauuuggacaaucugca

SEQ ID NO: 1778224 - RNA, 21 nt, Homo sapiens
agacauccacauaacccuguc

SEQ ID NO: 1778225 - RNA, 15 nt, Homo sapiens
acacucuccaaacag

SEQ ID NO: 1778226 - RNA, 12 nt, Homo sapiens
uggggaagccag

SEQ ID NO: 1778227 - RNA, 11 nt, Homo sapiens
cacaagcaaaa

SEQ ID NO: 1778228 - RNA, 21 nt, Homo sapiens
gggccaggaaggggacaggau

SEQ ID NO: 1778229 - RNA, 22 nt, Homo sapiens
guaaaauauuuauaaaugaaga

SEQ ID NO: 1778230 - RNA, 18 nt, Homo sapiens
cauacucccuuucagggc

SEQ ID NO: 1778231 - RNA, 19 nt, Homo sapiens
uguagagaaaauaagacuu

SEQ ID NO: 1778232 - RNA, 23 nt, Homo sapiens
guucucacaccaacagugugaag

SEQ ID NO: 1778233 - RNA, 11 nt, Homo sapiens
aauacaguaua

SEQ ID NO: 1778234 - RNA, 11 nt, Homo sapiens
aaaacaguauu

SEQ ID NO: 1778235 - RNA, 22 nt, Homo sapiens
caaaacugugucacaguuucag

SEQ ID NO: 1778236 - RNA, 17 nt, Homo sapiens
uaauauuuuacauacac

SEQ ID NO: 1778237 - RNA, 13 nt, Homo sapiens
uggaacaagcaca

SEQ ID NO: 1778238 - RNA, 19 nt, Homo sapiens
ccaggauuuuguauugcca

SEQ ID NO: 1778239 - RNA, 21 nt, Homo sapiens
caaggagaggggaccaugcaa

SEQ ID NO: 1778240 - RNA, 14 nt, Homo sapiens
caaacuguguacau

SEQ ID NO: 1778241 - RNA, 15 nt, Homo sapiens
aagcuugguccacuu

SEQ ID NO: 1778242 - RNA, 13 nt, Homo sapiens
aauccauuuucua

SEQ ID NO: 1778243 - RNA, 15 nt, Homo sapiens
caucagggcaguggc

SEQ ID NO: 1778244 - RNA, 20 nt, Homo sapiens
ccaggcugcuagaggugcuc

SEQ ID NO: 1778245 - RNA, 18 nt, Homo sapiens
aucuucuuuccaccuuuc

SEQ ID NO: 1778246 - RNA, 21 nt, Homo sapiens
aaaguuguccucagccaagga

SEQ ID NO: 1778247 - RNA, 21 nt, Homo sapiens
uauuaaaguggagaagcacac

SEQ ID NO: 1778248 - RNA, 20 nt, Homo sapiens
accaguauuguuuacccaau

SEQ ID NO: 1778249 - RNA, 13 nt, Homo sapiens
agccauaaauugc

SEQ ID NO: 1778250 - RNA, 18 nt, Homo sapiens
uuuguacaagauugucau

SEQ ID NO: 1778251 - RNA, 23 nt, Homo sapiens
auaauacauugcagcaagcaaua

SEQ ID NO: 1778252 - RNA, 16 nt, Homo sapiens
aucuagcucuccauac

SEQ ID NO: 1778253 - RNA, 15 nt, Homo sapiens
gcugggagcaggacu

SEQ ID NO: 1778254 - RNA, 18 nt, Homo sapiens
ucagcggggcuacagucc

SEQ ID NO: 1778255 - RNA, 22 nt, Homo sapiens
aacugucagggaggucuuuccc

SEQ ID NO: 1778256 - RNA, 23 nt, Homo sapiens
aacuguacauuuaaaauugcuau

SEQ ID NO: 1778257 - RNA, 21 nt, Homo sapiens
gcucuaaacaagucccuuuau

SEQ ID NO: 1778258 - RNA, 22 nt, Homo sapiens
agacagagcccugugaggcugg

SEQ ID NO: 1778259 - RNA, 13 nt, Homo sapiens
acuaccaccucag

SEQ ID NO: 1778260 - RNA, 16 nt, Homo sapiens
ccaugaaaccagagac

SEQ ID NO: 1778261 - RNA, 19 nt, Homo sapiens
ggaagggccuacagcccau

SEQ ID NO: 1778262 - RNA, 14 nt, Homo sapiens
guuguuuguuugau

SEQ ID NO: 1778263 - RNA, 14 nt, Homo sapiens
uacaaauggacaua

SEQ ID NO: 1778264 - RNA, 17 nt, Homo sapiens
aaucuguacauguucuu

SEQ ID NO: 1778265 - RNA, 15 nt, Homo sapiens
acuaaaacacugaaa

SEQ ID NO: 1778266 - RNA, 23 nt, Homo sapiens
auagagcuuuuaaaaauguccug

SEQ ID NO: 1778267 - RNA, 20 nt, Homo sapiens
uacaaauauugugaugcauu

SEQ ID NO: 1778268 - RNA, 18 nt, Homo sapiens
uaccugaccaacaguucc

SEQ ID NO: 1778269 - RNA, 14 nt, Homo sapiens
ccuuuuaaaacacu

SEQ ID NO: 1778270 - RNA, 14 nt, Homo sapiens
cuagaacccgugac

SEQ ID NO: 1778271 - RNA, 14 nt, Homo sapiens
ugugccagcaccuu

SEQ ID NO: 1778272 - RNA, 20 nt, Homo sapiens
gugcauaaugcuuuggaaaa

SEQ ID NO: 1778273 - RNA, 18 nt, Homo sapiens
caagguggggggaucaca

SEQ ID NO: 1778274 - RNA, 21 nt, Homo sapiens
ucaguaauacaguacaguacu

SEQ ID NO: 1778275 - RNA, 19 nt, Homo sapiens
gagcaagaagaaaaugugg

SEQ ID NO: 1778276 - RNA, 17 nt, Homo sapiens
auaccuuuauugugauc

SEQ ID NO: 1778277 - RNA, 23 nt, Homo sapiens
ugcccagcagagguuugcugaca

SEQ ID NO: 1778278 - RNA, 17 nt, Homo sapiens
uucucccuucucucacc

SEQ ID NO: 1778279 - RNA, 22 nt, Homo sapiens
ugagacaguuuacuuugccaac

SEQ ID NO: 1778280 - RNA, 12 nt, Homo sapiens
cuuuuccagaaa

SEQ ID NO: 1778281 - RNA, 22 nt, Homo sapiens
ugagaugguucccaauaucaug

SEQ ID NO: 1778282 - RNA, 18 nt, Homo sapiens
aaacuaaauacuguaaca

SEQ ID NO: 1778283 - RNA, 14 nt, Homo sapiens
aggccacaugucac

SEQ ID NO: 1778284 - RNA, 19 nt, Homo sapiens
uuaaagcaagcaacacaga

SEQ ID NO: 1778285 - RNA, 20 nt, Homo sapiens
cuuaaauauuguaauaugac

SEQ ID NO: 1778286 - RNA, 14 nt, Homo sapiens
aaagaguaacacug

SEQ ID NO: 1778287 - RNA, 14 nt, Homo sapiens
cauguguaccucag

SEQ ID NO: 1778288 - RNA, 13 nt, Homo sapiens
ugcacccaugugu

SEQ ID NO: 1778289 - RNA, 20 nt, Homo sapiens
auuguuacuauuauuugcua

SEQ ID NO: 1778290 - RNA, 18 nt, Homo sapiens
agcauuuuuaaucugugu

SEQ ID NO: 1778291 - RNA, 18 nt, Homo sapiens
cugauguuacuagccucu

SEQ ID NO: 1778292 - RNA, 20 nt, Homo sapiens
uggggaaguguuccagauag

SEQ ID NO: 1778293 - RNA, 20 nt, Homo sapiens
aguucacaggaggccagugg

SEQ ID NO: 1778294 - RNA, 16 nt, Homo sapiens
ccauccccagaccagg

SEQ ID NO: 1778295 - RNA, 22 nt, Homo sapiens
uuauaggaaaauauaugaagaa

SEQ ID NO: 1778296 - RNA, 13 nt, Homo sapiens
cuuucaagacaga

SEQ ID NO: 1778297 - RNA, 20 nt, Homo sapiens
uagcaacuccccuacaucaa

SEQ ID NO: 1778298 - RNA, 23 nt, Homo sapiens
ucaaaugcucagaccagcucuuc

SEQ ID NO: 1778299 - RNA, 16 nt, Homo sapiens
gcuacuguucuugaca

SEQ ID NO: 1778300 - RNA, 21 nt, Homo sapiens
gacucaaggucacacagugau

SEQ ID NO: 1778301 - RNA, 16 nt, Homo sapiens
gggccccucaucugcu

SEQ ID NO: 1778302 - RNA, 17 nt, Homo sapiens
aguuuaaaaaucugcca

SEQ ID NO: 1778303 - RNA, 18 nt, Homo sapiens
aggccagaaggaggggga

SEQ ID NO: 1778304 - RNA, 15 nt, Homo sapiens
uggguucacucauuc

SEQ ID NO: 1778305 - RNA, 21 nt, Homo sapiens
cccacugccaaagaacuugga

SEQ ID NO: 1778306 - RNA, 16 nt, Homo sapiens
uuccauuugcaaggga

SEQ ID NO: 1778307 - RNA, 21 nt, Homo sapiens
cuagggacccauuccugugua

SEQ ID NO: 1778308 - RNA, 14 nt, Homo sapiens
cauuucuaucacau

SEQ ID NO: 1778309 - RNA, 23 nt, Homo sapiens
caacugggccugggauggggcuu

SEQ ID NO: 1778310 - RNA, 14 nt, Homo sapiens
cugcagaccugguu

SEQ ID NO: 1778311 - RNA, 11 nt, Homo sapiens
agcagcacagc

SEQ ID NO: 1778312 - RNA, 21 nt, Homo sapiens
cugauguuuauaaacugagag

SEQ ID NO: 1778313 - RNA, 17 nt, Homo sapiens
uuggaaagcaucaccuc

SEQ ID NO: 1778314 - RNA, 14 nt, Homo sapiens
gcccaucccagugu

SEQ ID NO: 1778315 - RNA, 18 nt, Homo sapiens
cucagccuuggcuggagu

SEQ ID NO: 1778316 - RNA, 19 nt, Homo sapiens
agauaacugcuguauucau

SEQ ID NO: 1778317 - RNA, 14 nt, Homo sapiens
aguagaugggacua

SEQ ID NO: 1778318 - RNA, 16 nt, Homo sapiens
auucaggcacugagaa

SEQ ID NO: 1778319 - RNA, 15 nt, Homo sapiens
ucaaugucacuuaaa

SEQ ID NO: 1778320 - RNA, 15 nt, Homo sapiens
uauuuaacaaaaagu

SEQ ID NO: 1778321 - RNA, 19 nt, Homo sapiens
cagagaggcacucagugag

SEQ ID NO: 1778322 - RNA, 10 nt, Homo sapiens
ugaaccuaau

SEQ ID NO: 1778323 - RNA, 15 nt, Homo sapiens
acagagcagaacuuu

SEQ ID NO: 1778324 - RNA, 15 nt, Homo sapiens
cugcauccagagauu

SEQ ID NO: 1778325 - RNA, 14 nt, Homo sapiens
auuuucaguuauua

SEQ ID NO: 1778326 - RNA, 14 nt, Homo sapiens
acagccagucugca

SEQ ID NO: 1778327 - RNA, 20 nt, Homo sapiens
uuaaacacggggcuugcaac

SEQ ID NO: 1778328 - RNA, 16 nt, Homo sapiens
ccaggccucagcucuu

SEQ ID NO: 1778329 - RNA, 18 nt, Homo sapiens
auuuuagcuucaguuguu

SEQ ID NO: 1778330 - RNA, 18 nt, Homo sapiens
agcacaaagaugugcaaa

SEQ ID NO: 1778331 - RNA, 20 nt, Homo sapiens
agucuguguuguguccugac

SEQ ID NO: 1778332 - RNA, 17 nt, Homo sapiens
gauugcauccacuagcu

SEQ ID NO: 1778333 - RNA, 13 nt, Homo sapiens
ggucuucuuccaa

SEQ ID NO: 1778334 - RNA, 18 nt, Homo sapiens
accugcacguugugcaca

SEQ ID NO: 1778335 - RNA, 20 nt, Homo sapiens
ugcaguacaacaguuuuaga

SEQ ID NO: 1778336 - RNA, 23 nt, Homo sapiens
acuuggggaguuaagaccuggca

SEQ ID NO: 1778337 - RNA, 19 nt, Homo sapiens
acaccugauuaacugaggc

SEQ ID NO: 1778338 - RNA, 13 nt, Homo sapiens
cauccuagugaga

SEQ ID NO: 1778339 - RNA, 15 nt, Homo sapiens
cugagccaugcucag

SEQ ID NO: 1778340 - RNA, 23 nt, Homo sapiens
acaucaaagugguaaauacugug

SEQ ID NO: 1778341 - RNA, 20 nt, Homo sapiens
acaacuuuauguagagaaaa

SEQ ID NO: 1778342 - RNA, 23 nt, Homo sapiens
uuucaguagcaggaccugccaag

SEQ ID NO: 1778343 - RNA, 15 nt, Homo sapiens
ggccaaagcaaagga

SEQ ID NO: 1778344 - RNA, 22 nt, Homo sapiens
aaugcauuguuguucugcucaa

SEQ ID NO: 1778345 - RNA, 13 nt, Homo sapiens
ugugucacaaagc

SEQ ID NO: 1778346 - RNA, 20 nt, Homo sapiens
ucaucauuuaauccuuguga

SEQ ID NO: 1778347 - RNA, 19 nt, Homo sapiens
agccaauauuuacucauca

SEQ ID NO: 1778348 - RNA, 13 nt, Homo sapiens
cucaucacuggau

SEQ ID NO: 1778349 - RNA, 13 nt, Homo sapiens
ugcugcaccugug

SEQ ID NO: 1778350 - RNA, 14 nt, Homo sapiens
ugcacccacucugc

SEQ ID NO: 1778351 - RNA, 14 nt, Homo sapiens
ugucugcuguagaa

SEQ ID NO: 1778352 - RNA, 21 nt, Homo sapiens
ucuucgcccugcguuccuucc

SEQ ID NO: 1778353 - RNA, 15 nt, Homo sapiens
aagagcucuugugaa

SEQ ID NO: 1778354 - RNA, 19 nt, Homo sapiens
caaaauuuuacaguaauaa

SEQ ID NO: 1778355 - RNA, 16 nt, Homo sapiens
gucaggcccccagugg

SEQ ID NO: 1778356 - RNA, 14 nt, Homo sapiens
cugcacuccagccu

SEQ ID NO: 1778357 - RNA, 21 nt, Homo sapiens
uuuccaaaaaggaacacugga

SEQ ID NO: 1778358 - RNA, 14 nt, Homo sapiens
ucucugagcuuugu

SEQ ID NO: 1778359 - RNA, 20 nt, Homo sapiens
augguuucacaugguuacau

SEQ ID NO: 1778360 - RNA, 15 nt, Homo sapiens
acuuuguauuuugau

SEQ ID NO: 1778361 - RNA, 21 nt, Homo sapiens
guuaaguuucucuucaccccu

SEQ ID NO: 1778362 - RNA, 23 nt, Homo sapiens
auccaugcaccccaccagcaaua

SEQ ID NO: 1778363 - RNA, 14 nt, Homo sapiens
agaugaaucauuua

SEQ ID NO: 1778364 - RNA, 15 nt, Homo sapiens
aaaagucauucaaga

SEQ ID NO: 1778365 - RNA, 18 nt, Homo sapiens
ccugggcaauaaagugag

SEQ ID NO: 1778366 - RNA, 14 nt, Homo sapiens
gcagggacccgggg

SEQ ID NO: 1778367 - RNA, 16 nt, Homo sapiens
ccuaugcccugcccuu

SEQ ID NO: 1778368 - RNA, 19 nt, Homo sapiens
acaguguugaaauuggaaa

SEQ ID NO: 1778369 - RNA, 17 nt, Homo sapiens
uuaccgagcacugugac

SEQ ID NO: 1778370 - RNA, 23 nt, Homo sapiens
ugccuuuuuuuuaaggagcaaaa

SEQ ID NO: 1778371 - RNA, 14 nt, Homo sapiens
uuaaaaggggccca

SEQ ID NO: 1778372 - RNA, 12 nt, Homo sapiens
caucugcuuaca

SEQ ID NO: 1778373 - RNA, 16 nt, Homo sapiens
uaguaaauucauaucc

SEQ ID NO: 1778374 - RNA, 20 nt, Homo sapiens
ggagacaucacuugccaaug

SEQ ID NO: 1778375 - RNA, 14 nt, Homo sapiens
uggaagauguguga

SEQ ID NO: 1778376 - RNA, 12 nt, Homo sapiens
uaugcuacugaa

SEQ ID NO: 1778377 - RNA, 15 nt, Homo sapiens
acuuguuuuaugcuc

SEQ ID NO: 1778378 - RNA, 17 nt, Homo sapiens
gcaaaguaccaacugag

SEQ ID NO: 1778379 - RNA, 20 nt, Homo sapiens
acuucaagauccucuugcca

SEQ ID NO: 1778380 - RNA, 15 nt, Homo sapiens
caaaaugagaucuca

SEQ ID NO: 1778381 - RNA, 23 nt, Homo sapiens
ucuaugagcccagaucaccaccu

SEQ ID NO: 1778382 - RNA, 17 nt, Homo sapiens
caaggcaggaggccauu

SEQ ID NO: 1778383 - RNA, 15 nt, Homo sapiens
aaauaagcccagugc

SEQ ID NO: 1778384 - RNA, 19 nt, Homo sapiens
ccgcaccaauaaagccuuc

SEQ ID NO: 1778385 - RNA, 20 nt, Homo sapiens
agaaaauaguggugugauuu

SEQ ID NO: 1778386 - RNA, 14 nt, Homo sapiens
acuucugacuuacu

SEQ ID NO: 1778387 - RNA, 16 nt, Homo sapiens
gauguacgagcugcgc

SEQ ID NO: 1778388 - RNA, 14 nt, Homo sapiens
accagagacucuga

SEQ ID NO: 1778389 - RNA, 14 nt, Homo sapiens
accugagacucaga

SEQ ID NO: 1778390 - RNA, 20 nt, Homo sapiens
cuacuccgcagcucuagucc

SEQ ID NO: 1778391 - RNA, 15 nt, Homo sapiens
gcuagacaguuaaac

SEQ ID NO: 1778392 - RNA, 17 nt, Homo sapiens
uccuaugucucagugcc

SEQ ID NO: 1778393 - RNA, 14 nt, Homo sapiens
uguguccagaguuu

SEQ ID NO: 1778394 - RNA, 20 nt, Homo sapiens
augucucccaggacaagcca

SEQ ID NO: 1778395 - RNA, 18 nt, Homo sapiens
cuauuaacucugcauaga

SEQ ID NO: 1778396 - RNA, 12 nt, Homo sapiens
aguauucacaaa

SEQ ID NO: 1778397 - RNA, 16 nt, Homo sapiens
aggcaaggcccagacc

SEQ ID NO: 1778398 - RNA, 13 nt, Homo sapiens
aauuccuaacuau

SEQ ID NO: 1778399 - RNA, 21 nt, Homo sapiens
auacauuccuuuuagaguuaa

SEQ ID NO: 1778400 - RNA, 21 nt, Homo sapiens
auuaaguuaggcagucuucua

SEQ ID NO: 1778401 - RNA, 18 nt, Homo sapiens
agcauguuuuguauacaa

SEQ ID NO: 1778402 - RNA, 16 nt, Homo sapiens
acauauuaugucuuca

SEQ ID NO: 1778403 - RNA, 19 nt, Homo sapiens
gcagagggcgaagcugacc

SEQ ID NO: 1778404 - RNA, 18 nt, Homo sapiens
accuggguaaaugcagcg

SEQ ID NO: 1778405 - RNA, 16 nt, Homo sapiens
gccauuggaaagcaaa

SEQ ID NO: 1778406 - RNA, 17 nt, Homo sapiens
caaauccucuaauugca

SEQ ID NO: 1778407 - RNA, 22 nt, Homo sapiens
acguuacagggaaggaggguag

SEQ ID NO: 1778408 - RNA, 16 nt, Homo sapiens
gaaaauauggguugca

SEQ ID NO: 1778409 - RNA, 18 nt, Homo sapiens
uucucugugaacuauuaa

SEQ ID NO: 1778410 - RNA, 16 nt, Homo sapiens
uuauuaccauuagcau

SEQ ID NO: 1778411 - RNA, 18 nt, Homo sapiens
agccagaggcucuaaugu

SEQ ID NO: 1778412 - RNA, 12 nt, Homo sapiens
ugugugccaggg

SEQ ID NO: 1778413 - RNA, 13 nt, Homo sapiens
gcacucagauuua

SEQ ID NO: 1778414 - RNA, 15 nt, Homo sapiens
caagcaaaaccaaag

SEQ ID NO: 1778415 - RNA, 14 nt, Homo sapiens
auagaaaguucaaa

SEQ ID NO: 1778416 - RNA, 18 nt, Homo sapiens
gaucuguuuugaaggcaa

SEQ ID NO: 1778417 - RNA, 19 nt, Homo sapiens
aaaucgaggaagcaccucu

SEQ ID NO: 1778418 - RNA, 17 nt, Homo sapiens
aucaauauuauauucaa

SEQ ID NO: 1778419 - RNA, 17 nt, Homo sapiens
ccugaugugacauucca

SEQ ID NO: 1778420 - RNA, 16 nt, Homo sapiens
gggauauuuaacugga

SEQ ID NO: 1778421 - RNA, 21 nt, Homo sapiens
accuuacccuacuggcuguaa

SEQ ID NO: 1778422 - RNA, 16 nt, Homo sapiens
gagcuuucaucauuca

SEQ ID NO: 1778423 - RNA, 13 nt, Homo sapiens
uagcuuucaauuc

SEQ ID NO: 1778424 - RNA, 18 nt, Homo sapiens
gaggaacugcuugugcac

SEQ ID NO: 1778425 - RNA, 17 nt, Homo sapiens
ucgauguaggcauucug

SEQ ID NO: 1778426 - RNA, 11 nt, Homo sapiens
uuguucaauua

SEQ ID NO: 1778427 - RNA, 11 nt, Homo sapiens
aaagauuuaca

SEQ ID NO: 1778428 - RNA, 16 nt, Homo sapiens
gcuccaaaugcagcuu

SEQ ID NO: 1778429 - RNA, 23 nt, Homo sapiens
aggcagagacaauaaaacauucc

SEQ ID NO: 1778430 - RNA, 14 nt, Homo sapiens
gagaccgaggacac

SEQ ID NO: 1778431 - RNA, 22 nt, Homo sapiens
aggagcccugaggaccucucag

SEQ ID NO: 1778432 - RNA, 12 nt, Homo sapiens
cccacuuugaag

SEQ ID NO: 1778433 - RNA, 17 nt, Homo sapiens
cacuuuuccccaauuca

SEQ ID NO: 1778434 - RNA, 16 nt, Homo sapiens
acuacuaaagugccua

SEQ ID NO: 1778435 - RNA, 15 nt, Homo sapiens
aggacuugaacccag

SEQ ID NO: 1778436 - RNA, 12 nt, Homo sapiens
ccuuaguucuau

SEQ ID NO: 1778437 - RNA, 20 nt, Homo sapiens
acucaaaucaggaacuguau

SEQ ID NO: 1778438 - RNA, 18 nt, Homo sapiens
cuugaacuccugaccuca

SEQ ID NO: 1778439 - RNA, 23 nt, Homo sapiens
accaagggcagaggggugcucau

SEQ ID NO: 1778440 - RNA, 13 nt, Homo sapiens
cugcacaaggugg

SEQ ID NO: 1778441 - RNA, 21 nt, Homo sapiens
guaaauauucuacacauguaa

SEQ ID NO: 1778442 - RNA, 22 nt, Homo sapiens
accauuauuuuacagucucugu

SEQ ID NO: 1778443 - RNA, 14 nt, Homo sapiens
ccuuccagcugcug

SEQ ID NO: 1778444 - RNA, 13 nt, Homo sapiens
cugcucccuggca

SEQ ID NO: 1778445 - RNA, 14 nt, Homo sapiens
cgucuaugcugcuu

SEQ ID NO: 1778446 - RNA, 13 nt, Homo sapiens
aucccuuccccag

SEQ ID NO: 1778447 - RNA, 15 nt, Homo sapiens
cggccuugggaaauc

SEQ ID NO: 1778448 - RNA, 17 nt, Homo sapiens
uuuauuagacauucucu

SEQ ID NO: 1778449 - RNA, 17 nt, Homo sapiens
ccugucauuuugcacug

SEQ ID NO: 1778450 - RNA, 16 nt, Homo sapiens
ugccauauacucuuca

SEQ ID NO: 1778451 - RNA, 13 nt, Homo sapiens
auugcagcacaga

SEQ ID NO: 1778452 - RNA, 19 nt, Homo sapiens
ugaaagaugcaagcaccug

SEQ ID NO: 1778453 - RNA, 19 nt, Homo sapiens
caaagaacccuagcacaaa

SEQ ID NO: 1778454 - RNA, 15 nt, Homo sapiens
acucucuaccagaua

SEQ ID NO: 1778455 - RNA, 13 nt, Homo sapiens
cagagaagccagc

SEQ ID NO: 1778456 - RNA, 18 nt, Homo sapiens
cuugcaacuaaggacaaa

SEQ ID NO: 1778457 - RNA, 19 nt, Homo sapiens
acauguagaaaaauacuga

SEQ ID NO: 1778458 - RNA, 12 nt, Homo sapiens
uauguaucauaa

SEQ ID NO: 1778459 - RNA, 12 nt, Homo sapiens
acaagaagccac

SEQ ID NO: 1778460 - RNA, 15 nt, Homo sapiens
uugugcuuuuuguca

SEQ ID NO: 1778461 - RNA, 11 nt, Homo sapiens
auggacaugcu

SEQ ID NO: 1778462 - RNA, 17 nt, Homo sapiens
agacuuauguauuagcu

SEQ ID NO: 1778463 - RNA, 16 nt, Homo sapiens
cagggcaggaccagcc

SEQ ID NO: 1778464 - RNA, 19 nt, Homo sapiens
uugccuucuagacacugaa

SEQ ID NO: 1778465 - RNA, 22 nt, Homo sapiens
gaauauuuuuggcauuccucua

SEQ ID NO: 1778466 - RNA, 19 nt, Homo sapiens
cuuaugcaaauaaccauug

SEQ ID NO: 1778467 - RNA, 18 nt, Homo sapiens
gccagcuccuuucccuuu

SEQ ID NO: 1778468 - RNA, 19 nt, Homo sapiens
acacuucugugagaccccc

SEQ ID NO: 1778469 - RNA, 22 nt, Homo sapiens
uucucuguaaccgcuucugggg

SEQ ID NO: 1778470 - RNA, 21 nt, Homo sapiens
accaaauaggauuaaacacac

SEQ ID NO: 1778471 - RNA, 13 nt, Homo sapiens
aaaauuaauauca

SEQ ID NO: 1778472 - RNA, 18 nt, Homo sapiens
agcaagacuucucuuugc

SEQ ID NO: 1778473 - RNA, 18 nt, Homo sapiens
cagucccuggagcugucc

SEQ ID NO: 1778474 - RNA, 17 nt, Homo sapiens
uacccagauuguaucau

SEQ ID NO: 1778475 - RNA, 19 nt, Homo sapiens
ggaaaauaaauuauauuaa

SEQ ID NO: 1778476 - RNA, 18 nt, Homo sapiens
cuucuugcaucuaaugaa

SEQ ID NO: 1778477 - RNA, 20 nt, Homo sapiens
aggguugcuugggccacugc

SEQ ID NO: 1778478 - RNA, 22 nt, Homo sapiens
gagauuauuuuaaucuaauucu

SEQ ID NO: 1778479 - RNA, 20 nt, Homo sapiens
gaauccuuccauuccacaca

SEQ ID NO: 1778480 - RNA, 15 nt, Homo sapiens
acaaaaaaaucuucc

SEQ ID NO: 1778481 - RNA, 18 nt, Homo sapiens
gccacuacaacagaauuu

SEQ ID NO: 1778482 - RNA, 14 nt, Homo sapiens
aaggcccuuuucag

SEQ ID NO: 1778483 - RNA, 17 nt, Homo sapiens
auuucccaacacaaaga

SEQ ID NO: 1778484 - RNA, 16 nt, Homo sapiens
acugaguggagucuga

SEQ ID NO: 1778485 - RNA, 13 nt, Homo sapiens
uaaaaaauugacu

SEQ ID NO: 1778486 - RNA, 18 nt, Homo sapiens
auuucuguucacuuugua

SEQ ID NO: 1778487 - RNA, 15 nt, Homo sapiens
gcagauucgagucac

SEQ ID NO: 1778488 - RNA, 18 nt, Homo sapiens
uugaccuguggugcaaaa

SEQ ID NO: 1778489 - RNA, 20 nt, Homo sapiens
gacaaccaccaggugucaaa

SEQ ID NO: 1778490 - RNA, 21 nt, Homo sapiens
uucaggccgcaagcagcugcc

SEQ ID NO: 1778491 - RNA, 18 nt, Homo sapiens
guuccgcacuuuccacuu

SEQ ID NO: 1778492 - RNA, 22 nt, Homo sapiens
acuaagugauuuguaugucuau

SEQ ID NO: 1778493 - RNA, 18 nt, Homo sapiens
uaguuucuugaggccaaa

SEQ ID NO: 1778494 - RNA, 19 nt, Homo sapiens
cuaccccaagaugccccuc

SEQ ID NO: 1778495 - RNA, 20 nt, Homo sapiens
ucaaggaaagggcaguggac

SEQ ID NO: 1778496 - RNA, 20 nt, Homo sapiens
gagcaggggacuacauguga

SEQ ID NO: 1778497 - RNA, 17 nt, Homo sapiens
ccugcuccaacuccaua

SEQ ID NO: 1778498 - RNA, 15 nt, Homo sapiens
aaaacauucagucug

SEQ ID NO: 1778499 - RNA, 21 nt, Homo sapiens
aacauaucauuugugaagaau

SEQ ID NO: 1778500 - RNA, 19 nt, Homo sapiens
uaugcuuggcuaacuauau

SEQ ID NO: 1778501 - RNA, 23 nt, Homo sapiens
gccugugauuaacuugcuuagua

SEQ ID NO: 1778502 - RNA, 22 nt, Homo sapiens
ccacugugccucagagaccagg

SEQ ID NO: 1778503 - RNA, 19 nt, Homo sapiens
aaaacauuuuauguauaga

SEQ ID NO: 1778504 - RNA, 23 nt, Homo sapiens
gaauaauuagauauauauauuca

SEQ ID NO: 1778505 - RNA, 22 nt, Homo sapiens
cuagugaauguaaaaugcaaaa

SEQ ID NO: 1778506 - RNA, 14 nt, Homo sapiens
uuccaccuucccuc

SEQ ID NO: 1778507 - RNA, 14 nt, Homo sapiens
ccuguacucuugaa

SEQ ID NO: 1778508 - RNA, 22 nt, Homo sapiens
uugcuggaggggcuguccuccu

SEQ ID NO: 1778509 - RNA, 13 nt, Homo sapiens
acaaagcugcuaa

SEQ ID NO: 1778510 - RNA, 13 nt, Homo sapiens
aaaaugcugauau

SEQ ID NO: 1778511 - RNA, 17 nt, Homo sapiens
caaaacaaaaaaaaacu

SEQ ID NO: 1778512 - RNA, 19 nt, Homo sapiens
ugcccggugccaucuucca

SEQ ID NO: 1778513 - RNA, 13 nt, Homo sapiens
uucuggaaaccac

SEQ ID NO: 1778514 - RNA, 14 nt, Homo sapiens
cugauggcacucug

SEQ ID NO: 1778515 - RNA, 15 nt, Homo sapiens
aggucucagcccggg

SEQ ID NO: 1778516 - RNA, 13 nt, Homo sapiens
acaaccacagugc

SEQ ID NO: 1778517 - RNA, 20 nt, Homo sapiens
guggaugaagacccuaucuc

SEQ ID NO: 1778518 - RNA, 19 nt, Homo sapiens
ccucugucuaccugggaga

SEQ ID NO: 1778519 - RNA, 17 nt, Homo sapiens
cucuccugcuuccucuu

SEQ ID NO: 1778520 - RNA, 19 nt, Homo sapiens
gauugcgccuuuguauuau

SEQ ID NO: 1778521 - RNA, 21 nt, Homo sapiens
auuucugggucuuucugacau

SEQ ID NO: 1778522 - RNA, 15 nt, Homo sapiens
uguguucaguacaau

SEQ ID NO: 1778523 - RNA, 17 nt, Homo sapiens
acccccucuucugagca

SEQ ID NO: 1778524 - RNA, 21 nt, Homo sapiens
guuguauaucacuaaaagcau

SEQ ID NO: 1778525 - RNA, 19 nt, Homo sapiens
ugaaauuugauaaacugaa

SEQ ID NO: 1778526 - RNA, 17 nt, Homo sapiens
auuuccucugagcuguu

SEQ ID NO: 1778527 - RNA, 16 nt, Homo sapiens
uaaaauauuauuugau

SEQ ID NO: 1778528 - RNA, 12 nt, Homo sapiens
ugcuaaaccauu

SEQ ID NO: 1778529 - RNA, 17 nt, Homo sapiens
ugacaguaucuuuuuuc

SEQ ID NO: 1778530 - RNA, 22 nt, Homo sapiens
cauacacacacacgcgugcaca

SEQ ID NO: 1778531 - RNA, 15 nt, Homo sapiens
cauggagaaacccug

SEQ ID NO: 1778532 - RNA, 15 nt, Homo sapiens
cacggugaaauccag

SEQ ID NO: 1778533 - RNA, 22 nt, Homo sapiens
cugcuuggauaugaaacuguag

SEQ ID NO: 1778534 - RNA, 22 nt, Homo sapiens
cuaaagcagccagccgugagug

SEQ ID NO: 1778535 - RNA, 21 nt, Homo sapiens
ggccacccaggaacuccugac

SEQ ID NO: 1778536 - RNA, 21 nt, Homo sapiens
cagcauguaaagagcugggag

SEQ ID NO: 1778537 - RNA, 10 nt, Homo sapiens
cacugugagu

SEQ ID NO: 1778538 - RNA, 17 nt, Homo sapiens
cuuucuaggccacuggg

SEQ ID NO: 1778539 - RNA, 18 nt, Homo sapiens
caucagaggacaccugua

SEQ ID NO: 1778540 - RNA, 15 nt, Homo sapiens
aaauaacagccuuaa

SEQ ID NO: 1778541 - RNA, 15 nt, Homo sapiens
auuuagucaugugac

SEQ ID NO: 1778542 - RNA, 14 nt, Homo sapiens
caauacugcccaag

SEQ ID NO: 1778543 - RNA, 18 nt, Homo sapiens
ugggucuucagggggcca

SEQ ID NO: 1778544 - RNA, 12 nt, Homo sapiens
cuauaacacauc

SEQ ID NO: 1778545 - RNA, 17 nt, Homo sapiens
ccaaaggcugcagcauu

SEQ ID NO: 1778546 - RNA, 21 nt, Homo sapiens
uggucuucuacugccuugaaa

SEQ ID NO: 1778547 - RNA, 20 nt, Homo sapiens
uaaaauauuuuuaugugcaa

SEQ ID NO: 1778548 - RNA, 22 nt, Homo sapiens
cagaaugaacccauagggagcu

SEQ ID NO: 1778549 - RNA, 13 nt, Homo sapiens
gcagucuggcuga

SEQ ID NO: 1778550 - RNA, 20 nt, Homo sapiens
gaauugugguucccuaaaga

SEQ ID NO: 1778551 - RNA, 12 nt, Homo sapiens
agaucaagccag

SEQ ID NO: 1778552 - RNA, 15 nt, Homo sapiens
augccaaacacuagc

SEQ ID NO: 1778553 - RNA, 18 nt, Homo sapiens
caucaaaucaucauuaau

SEQ ID NO: 1778554 - RNA, 13 nt, Homo sapiens
auguuagccuuag

SEQ ID NO: 1778555 - RNA, 14 nt, Homo sapiens
ucagagaagucagu

SEQ ID NO: 1778556 - RNA, 16 nt, Homo sapiens
uuccuuuauguaucua

SEQ ID NO: 1778557 - RNA, 19 nt, Homo sapiens
ugucuuuguugaaguauuu

SEQ ID NO: 1778558 - RNA, 14 nt, Homo sapiens
uaugaucauguaaa

SEQ ID NO: 1778559 - RNA, 16 nt, Homo sapiens
cacacuggcuccagac

SEQ ID NO: 1778560 - RNA, 14 nt, Homo sapiens
agcccagggugcug

SEQ ID NO: 1778561 - RNA, 14 nt, Homo sapiens
cauuuucuucagaa

SEQ ID NO: 1778562 - RNA, 15 nt, Homo sapiens
guuugagaccagccu

SEQ ID NO: 1778563 - RNA, 19 nt, Homo sapiens
gugcccuacaaaggcuaga

SEQ ID NO: 1778564 - RNA, 16 nt, Homo sapiens
acucaguuuucuugca

SEQ ID NO: 1778565 - RNA, 21 nt, Homo sapiens
cucccuuccugaggagcuguu

SEQ ID NO: 1778566 - RNA, 18 nt, Homo sapiens
cacuggcaucucacuuua

SEQ ID NO: 1778567 - RNA, 20 nt, Homo sapiens
ccuggggcugaucucaggga

SEQ ID NO: 1778568 - RNA, 21 nt, Homo sapiens
ugccccaugagacagucccag

SEQ ID NO: 1778569 - RNA, 21 nt, Homo sapiens
agcauuuccagccuaucuaau

SEQ ID NO: 1778570 - RNA, 19 nt, Homo sapiens
uaaaggugaugaauuuacc

SEQ ID NO: 1778571 - RNA, 16 nt, Homo sapiens
uggaaaaaaaccacag

SEQ ID NO: 1778572 - RNA, 16 nt, Homo sapiens
ugcaacagaagcaaaa

SEQ ID NO: 1778573 - RNA, 16 nt, Homo sapiens
gacauauuaugccuga

SEQ ID NO: 1778574 - RNA, 13 nt, Homo sapiens
aagaggaauucca

SEQ ID NO: 1778575 - RNA, 18 nt, Homo sapiens
guuuacaaagcaucucau

SEQ ID NO: 1778576 - RNA, 20 nt, Homo sapiens
caguggauucccacagcaca

SEQ ID NO: 1778577 - RNA, 16 nt, Homo sapiens
aaaaccacaguccuca

SEQ ID NO: 1778578 - RNA, 16 nt, Homo sapiens
agacacugucaagauu

SEQ ID NO: 1778579 - RNA, 16 nt, Homo sapiens
cuacccuggcacuaua

SEQ ID NO: 1778580 - RNA, 14 nt, Homo sapiens
ucucuuuaaucucc

SEQ ID NO: 1778581 - RNA, 16 nt, Homo sapiens
ucugugcaggugcugc

SEQ ID NO: 1778582 - RNA, 12 nt, Homo sapiens
cuagcuaucucu

SEQ ID NO: 1778583 - RNA, 17 nt, Homo sapiens
uaaaaugaccucauguc

SEQ ID NO: 1778584 - RNA, 22 nt, Homo sapiens
uaacagggccucucacuaacua

SEQ ID NO: 1778585 - RNA, 12 nt, Homo sapiens
acuuccuuugac

SEQ ID NO: 1778586 - RNA, 20 nt, Homo sapiens
aucucaggauuucaccagaa

SEQ ID NO: 1778587 - RNA, 17 nt, Homo sapiens
cuggccuccaaguccac

SEQ ID NO: 1778588 - RNA, 21 nt, Homo sapiens
uaaacaaagacuuugauccau

SEQ ID NO: 1778589 - RNA, 23 nt, Homo sapiens
auuaauuacucuaacaaacaaga

SEQ ID NO: 1778590 - RNA, 22 nt, Homo sapiens
cuugucuggcagcaggaugcuc

SEQ ID NO: 1778591 - RNA, 20 nt, Homo sapiens
cauuugaagccguccaagaa

SEQ ID NO: 1778592 - RNA, 21 nt, Homo sapiens
uuguugagugcacugacugug

SEQ ID NO: 1778593 - RNA, 18 nt, Homo sapiens
cuggauuugcauacauuc

SEQ ID NO: 1778594 - RNA, 13 nt, Homo sapiens
agaggcugcugca

SEQ ID NO: 1778595 - RNA, 17 nt, Homo sapiens
auaaaauguaauuacuu

SEQ ID NO: 1778596 - RNA, 21 nt, Homo sapiens
uaaggccaaguacacugagag

SEQ ID NO: 1778597 - RNA, 17 nt, Homo sapiens
agugauaacucugagca

SEQ ID NO: 1778598 - RNA, 22 nt, Homo sapiens
uucuguuauaccccauauauua

SEQ ID NO: 1778599 - RNA, 14 nt, Homo sapiens
cuccuaaagcuuuu

SEQ ID NO: 1778600 - RNA, 17 nt, Homo sapiens
uggcuuugaaacuugca

SEQ ID NO: 1778601 - RNA, 15 nt, Homo sapiens
aaauuuaaugcugcc

SEQ ID NO: 1778602 - RNA, 20 nt, Homo sapiens
uaugucacccaaugcauauc

SEQ ID NO: 1778603 - RNA, 17 nt, Homo sapiens
caaauaacagcuuucuu

SEQ ID NO: 1778604 - RNA, 17 nt, Homo sapiens
ugaaacuaggguuugaa

SEQ ID NO: 1778605 - RNA, 18 nt, Homo sapiens
caucggaauucagccaug

SEQ ID NO: 1778606 - RNA, 18 nt, Homo sapiens
ggggccuggggagcccac

SEQ ID NO: 1778607 - RNA, 17 nt, Homo sapiens
uucagaagguugcucua

SEQ ID NO: 1778608 - RNA, 20 nt, Homo sapiens
uucaccucuucccacaagaa

SEQ ID NO: 1778609 - RNA, 20 nt, Homo sapiens
cuucuggccuuguaucuugc

SEQ ID NO: 1778610 - RNA, 13 nt, Homo sapiens
guuuuaacucuau

SEQ ID NO: 1778611 - RNA, 20 nt, Homo sapiens
guucaauaaagcacugagca

SEQ ID NO: 1778612 - RNA, 14 nt, Homo sapiens
ccgcaaagacauca

SEQ ID NO: 1778613 - RNA, 11 nt, Homo sapiens
uaaucuacugu

SEQ ID NO: 1778614 - RNA, 23 nt, Homo sapiens
ggaagcauguacuguacuuccca

SEQ ID NO: 1778615 - RNA, 20 nt, Homo sapiens
cccuuugugaauuaauaaac

SEQ ID NO: 1778616 - RNA, 23 nt, Homo sapiens
auucuuaaaggaaaagucaacau

SEQ ID NO: 1778617 - RNA, 21 nt, Homo sapiens
aucaaaaagguuucugcacau

SEQ ID NO: 1778618 - RNA, 23 nt, Homo sapiens
gcucgggcccaggccaucuucca

SEQ ID NO: 1778619 - RNA, 15 nt, Homo sapiens
agauuuucaaacaaa

SEQ ID NO: 1778620 - RNA, 13 nt, Homo sapiens
acccagagcaccc

SEQ ID NO: 1778621 - RNA, 12 nt, Homo sapiens
cugaccuuccaa

SEQ ID NO: 1778622 - RNA, 21 nt, Homo sapiens
ucuaccuuuuuuucucuccua

SEQ ID NO: 1778623 - RNA, 14 nt, Homo sapiens
ccaaaccgcaggca

SEQ ID NO: 1778624 - RNA, 19 nt, Homo sapiens
caucagcuguuuuuaguua

SEQ ID NO: 1778625 - RNA, 15 nt, Homo sapiens
auuugcucuuugaca

SEQ ID NO: 1778626 - RNA, 18 nt, Homo sapiens
ccgcuacgcacaggaguu

SEQ ID NO: 1778627 - RNA, 15 nt, Homo sapiens
accuauuuuuuucuc

SEQ ID NO: 1778628 - RNA, 18 nt, Homo sapiens
cuaggcuccgucaguauc

SEQ ID NO: 1778629 - RNA, 15 nt, Homo sapiens
aaaaucuccaucuca

SEQ ID NO: 1778630 - RNA, 22 nt, Homo sapiens
cucuuguagcucucugaccucc

SEQ ID NO: 1778631 - RNA, 22 nt, Homo sapiens
aaaguaauuucuuugaucugga

SEQ ID NO: 1778632 - RNA, 22 nt, Homo sapiens
aggagauuccuucauaaaacuc

SEQ ID NO: 1778633 - RNA, 13 nt, Homo sapiens
gggguccaucccc

SEQ ID NO: 1778634 - RNA, 16 nt, Homo sapiens
uucucagcuggaugau

SEQ ID NO: 1778635 - RNA, 23 nt, Homo sapiens
cugcuuguggcggauuccucacc

SEQ ID NO: 1778636 - RNA, 15 nt, Homo sapiens
ucuguuucccaagcu

SEQ ID NO: 1778637 - RNA, 14 nt, Homo sapiens
cugccucagccucc

SEQ ID NO: 1778638 - RNA, 17 nt, Homo sapiens
cuagaguucuccagaca

SEQ ID NO: 1778639 - RNA, 18 nt, Homo sapiens
aacuggacaagauuuccu

SEQ ID NO: 1778640 - RNA, 14 nt, Homo sapiens
aguuucccuaucuc

SEQ ID NO: 1778641 - RNA, 20 nt, Homo sapiens
gcucacaccuguaaucccag

SEQ ID NO: 1778642 - RNA, 14 nt, Homo sapiens
cacuccacuggccu

SEQ ID NO: 1778643 - RNA, 22 nt, Homo sapiens
caauuuuuaaaguaccuuaaaa

SEQ ID NO: 1778644 - RNA, 15 nt, Homo sapiens
auaaugaacagcaga

SEQ ID NO: 1778645 - RNA, 15 nt, Homo sapiens
aauaaucuauauuaa

SEQ ID NO: 1778646 - RNA, 16 nt, Homo sapiens
aagugaggccacugaa

SEQ ID NO: 1778647 - RNA, 14 nt, Homo sapiens
cuuguaaagacugu

SEQ ID NO: 1778648 - RNA, 23 nt, Homo sapiens
uggaauaaaaauuccagaaugaa

SEQ ID NO: 1778649 - RNA, 11 nt, Homo sapiens
gauacuggaaa

SEQ ID NO: 1778650 - RNA, 18 nt, Homo sapiens
aaccucuagagucacuga

SEQ ID NO: 1778651 - RNA, 20 nt, Homo sapiens
cuuaaccucucuaagccaca

SEQ ID NO: 1778652 - RNA, 15 nt, Homo sapiens
uagcaauguuccagg

SEQ ID NO: 1778653 - RNA, 21 nt, Homo sapiens
ucuuggcccucccaccuggag

SEQ ID NO: 1778654 - RNA, 18 nt, Homo sapiens
uuggagaacucauuucaa

SEQ ID NO: 1778655 - RNA, 22 nt, Homo sapiens
agcacagaugugaaggacauga

SEQ ID NO: 1778656 - RNA, 18 nt, Homo sapiens
cacguuuggccagugaca

SEQ ID NO: 1778657 - RNA, 22 nt, Homo sapiens
aucucuuaauauugagaaucag

SEQ ID NO: 1778658 - RNA, 14 nt, Homo sapiens
cauucacaccagcu

SEQ ID NO: 1778659 - RNA, 20 nt, Homo sapiens
cugauagcucugccuuaccc

SEQ ID NO: 1778660 - RNA, 16 nt, Homo sapiens
cuguauuauugcaauu

SEQ ID NO: 1778661 - RNA, 23 nt, Homo sapiens
acacuguuggggaccuuccugau

SEQ ID NO: 1778662 - RNA, 16 nt, Homo sapiens
ucuguuauuaacaaac

SEQ ID NO: 1778663 - RNA, 21 nt, Homo sapiens
aauuuuggaagaauucaugau

SEQ ID NO: 1778664 - RNA, 15 nt, Homo sapiens
guuauuuauagcugu

SEQ ID NO: 1778665 - RNA, 20 nt, Homo sapiens
aaauuuuucuuuucuugauu

SEQ ID NO: 1778666 - RNA, 17 nt, Homo sapiens
uauuccauuuuuacuaa

SEQ ID NO: 1778667 - RNA, 20 nt, Homo sapiens
aauguggagcagcagccacu

SEQ ID NO: 1778668 - RNA, 15 nt, Homo sapiens
cagugaucucacuua

SEQ ID NO: 1778669 - RNA, 16 nt, Homo sapiens
uaauuuuaaagaggaa

SEQ ID NO: 1778670 - RNA, 18 nt, Homo sapiens
uccccacccugucuucca

SEQ ID NO: 1778671 - RNA, 20 nt, Homo sapiens
agaaucguuugaacucagga

SEQ ID NO: 1778672 - RNA, 20 nt, Homo sapiens
aauauauuuuuaaagcaaaa

SEQ ID NO: 1778673 - RNA, 18 nt, Homo sapiens
aaaccacagucaguggag

SEQ ID NO: 1778674 - RNA, 16 nt, Homo sapiens
uauguagcucuuuguc

SEQ ID NO: 1778675 - RNA, 13 nt, Homo sapiens
guuuucacuguaa

SEQ ID NO: 1778676 - RNA, 18 nt, Homo sapiens
cacaguaggcacucaaua

SEQ ID NO: 1778677 - RNA, 17 nt, Homo sapiens
cuuagaguguagcugua

SEQ ID NO: 1778678 - RNA, 20 nt, Homo sapiens
ccuguggccugcucaucacc

SEQ ID NO: 1778679 - RNA, 19 nt, Homo sapiens
aucuuagaagcacuacacc

SEQ ID NO: 1778680 - RNA, 17 nt, Homo sapiens
ugcugaagcugagcuag

SEQ ID NO: 1778681 - RNA, 22 nt, Homo sapiens
gaauaaauaagcaaaaugccaa

SEQ ID NO: 1778682 - RNA, 21 nt, Homo sapiens
cugcaacuggagccaagaaga

SEQ ID NO: 1778683 - RNA, 21 nt, Homo sapiens
uuguuuuaugcucagggucaa

SEQ ID NO: 1778684 - RNA, 14 nt, Homo sapiens
uagcucuuuggucu

SEQ ID NO: 1778685 - RNA, 16 nt, Homo sapiens
aauaaaggaagugccu

SEQ ID NO: 1778686 - RNA, 11 nt, Homo sapiens
cuuuggugggg

SEQ ID NO: 1778687 - RNA, 20 nt, Homo sapiens
caaauauucagaaaaugaag

SEQ ID NO: 1778688 - RNA, 14 nt, Homo sapiens
gcagaaacuuuaca

SEQ ID NO: 1778689 - RNA, 21 nt, Homo sapiens
auuguucuuguaaaacuguga

SEQ ID NO: 1778690 - RNA, 19 nt, Homo sapiens
cugcuccccaacaccugcc

SEQ ID NO: 1778691 - RNA, 17 nt, Homo sapiens
uauggccccaccugcuc

SEQ ID NO: 1778692 - RNA, 17 nt, Homo sapiens
gacugcagugcuguaaa

SEQ ID NO: 1778693 - RNA, 19 nt, Homo sapiens
gcccugacaugcacaccuc

SEQ ID NO: 1778694 - RNA, 17 nt, Homo sapiens
agaaaccacugggcaua

SEQ ID NO: 1778695 - RNA, 15 nt, Homo sapiens
uaguuuuuaaucucu

SEQ ID NO: 1778696 - RNA, 14 nt, Homo sapiens
agcuggucugggug

SEQ ID NO: 1778697 - RNA, 20 nt, Homo sapiens
acaauccaugaacagcauua

SEQ ID NO: 1778698 - RNA, 15 nt, Homo sapiens
gacuguauuuuccaa

SEQ ID NO: 1778699 - RNA, 15 nt, Homo sapiens
cacauaguguuugua

SEQ ID NO: 1778700 - RNA, 15 nt, Homo sapiens
cacuguauguuauag

SEQ ID NO: 1778701 - RNA, 16 nt, Homo sapiens
agagccccacccucag

SEQ ID NO: 1778702 - RNA, 17 nt, Homo sapiens
gccaaaggaggaaauaa

SEQ ID NO: 1778703 - RNA, 15 nt, Homo sapiens
uaccuguaacuuaau

SEQ ID NO: 1778704 - RNA, 21 nt, Homo sapiens
aaaaauugucuucauguacau

SEQ ID NO: 1778705 - RNA, 15 nt, Homo sapiens
uaaaaagccaccaca

SEQ ID NO: 1778706 - RNA, 15 nt, Homo sapiens
agcaggccacugggg

SEQ ID NO: 1778707 - RNA, 14 nt, Homo sapiens
gaaacacacgugcu

SEQ ID NO: 1778708 - RNA, 14 nt, Homo sapiens
uauauguauauuaa

SEQ ID NO: 1778709 - RNA, 19 nt, Homo sapiens
cuccaaagaacaacuugcu

SEQ ID NO: 1778710 - RNA, 19 nt, Homo sapiens
gcaauauuuauagggcuuu

SEQ ID NO: 1778711 - RNA, 20 nt, Homo sapiens
auucacagaaccuacuguuc

SEQ ID NO: 1778712 - RNA, 20 nt, Homo sapiens
uaaagcagaggcaacacugg

SEQ ID NO: 1778713 - RNA, 16 nt, Homo sapiens
aaacccauggagacag

SEQ ID NO: 1778714 - RNA, 16 nt, Homo sapiens
cacucaccucacuguu

SEQ ID NO: 1778715 - RNA, 22 nt, Homo sapiens
caaggagaaugaauacugggaa

SEQ ID NO: 1778716 - RNA, 18 nt, Homo sapiens
cugaacuuacacuguaua

SEQ ID NO: 1778717 - RNA, 15 nt, Homo sapiens
ccacccaacagugau

SEQ ID NO: 1778718 - RNA, 21 nt, Homo sapiens
agguuuguuuagaagaagugu

SEQ ID NO: 1778719 - RNA, 19 nt, Homo sapiens
auauaggauagacacugga

SEQ ID NO: 1778720 - RNA, 18 nt, Homo sapiens
aaagcucucuauaccaaa

SEQ ID NO: 1778721 - RNA, 15 nt, Homo sapiens
cuccaggagccucau

SEQ ID NO: 1778722 - RNA, 18 nt, Homo sapiens
gcccaaaaacaagcaaaa

SEQ ID NO: 1778723 - RNA, 18 nt, Homo sapiens
caaacucaagcuucuuca

SEQ ID NO: 1778724 - RNA, 20 nt, Homo sapiens
cccagaaaagguacacuuug

SEQ ID NO: 1778725 - RNA, 9 nt, Homo sapiens
acuggucca

SEQ ID NO: 1778726 - RNA, 17 nt, Homo sapiens
gcagaaccaaagcucaa

SEQ ID NO: 1778727 - RNA, 20 nt, Homo sapiens
aguaggaaaagcaaugcuuu

SEQ ID NO: 1778728 - RNA, 15 nt, Homo sapiens
uuugagaagcucuga

SEQ ID NO: 1778729 - RNA, 15 nt, Homo sapiens
agacaaccaaaacau

SEQ ID NO: 1778730 - RNA, 18 nt, Homo sapiens
gaagaggaauccagugaa

SEQ ID NO: 1778731 - RNA, 21 nt, Homo sapiens
aguagagucacuggaacacua

SEQ ID NO: 1778732 - RNA, 21 nt, Homo sapiens
ucucacugaugcccuuuggaa

SEQ ID NO: 1778733 - RNA, 20 nt, Homo sapiens
gcuggaaugcaguggugcga

SEQ ID NO: 1778734 - RNA, 16 nt, Homo sapiens
gaagaagauagaucca

SEQ ID NO: 1778735 - RNA, 16 nt, Homo sapiens
cccuugguacugaaaa

SEQ ID NO: 1778736 - RNA, 14 nt, Homo sapiens
uccacuacagugag

SEQ ID NO: 1778737 - RNA, 15 nt, Homo sapiens
caggucuugacucau

SEQ ID NO: 1778738 - RNA, 13 nt, Homo sapiens
agacccagggugg

SEQ ID NO: 1778739 - RNA, 22 nt, Homo sapiens
agacuuccucaugaaucucuca

SEQ ID NO: 1778740 - RNA, 24 nt, Homo sapiens
uggcuuauuucuaugacaaauuca

SEQ ID NO: 1778741 - RNA, 14 nt, Homo sapiens
uucagcauugccua

SEQ ID NO: 1778742 - RNA, 14 nt, Homo sapiens
uuucucauuguaga

SEQ ID NO: 1778743 - RNA, 18 nt, Homo sapiens
aauauuuuuuaaaaccau

SEQ ID NO: 1778744 - RNA, 14 nt, Homo sapiens
auuacauuuagucu

SEQ ID NO: 1778745 - RNA, 22 nt, Homo sapiens
guuccccacguuuguuccccuu

SEQ ID NO: 1778746 - RNA, 14 nt, Homo sapiens
agcugagcugugac

SEQ ID NO: 1778747 - RNA, 12 nt, Homo sapiens
gggccaguuccu

SEQ ID NO: 1778748 - RNA, 21 nt, Homo sapiens
uauaaaaggauguuacaaguu

SEQ ID NO: 1778749 - RNA, 14 nt, Homo sapiens
uugagagacagggu

SEQ ID NO: 1778750 - RNA, 22 nt, Homo sapiens
aguugaaacugcuauagccuaa

SEQ ID NO: 1778751 - RNA, 22 nt, Homo sapiens
ucugagacuccucauaccucag

SEQ ID NO: 1778752 - RNA, 20 nt, Homo sapiens
accuucugggggaaagggaa

SEQ ID NO: 1778753 - RNA, 14 nt, Homo sapiens
gaacuuuuuccucu

SEQ ID NO: 1778754 - RNA, 12 nt, Homo sapiens
aacgugaucucc

SEQ ID NO: 1778755 - RNA, 14 nt, Homo sapiens
ccaacuaacuccag

SEQ ID NO: 1778756 - RNA, 23 nt, Homo sapiens
auguacuauccaaucugugauga

SEQ ID NO: 1778757 - RNA, 16 nt, Homo sapiens
acagaccugcucugga

SEQ ID NO: 1778758 - RNA, 23 nt, Homo sapiens
acucugagucucugaaugaagcu

SEQ ID NO: 1778759 - RNA, 21 nt, Homo sapiens
agcaugucgucaaagcugaaa

SEQ ID NO: 1778760 - RNA, 20 nt, Homo sapiens
uauaauaggaacaaucuuug

SEQ ID NO: 1778761 - RNA, 22 nt, Homo sapiens
augaaagcacuccucccugaug

SEQ ID NO: 1778762 - RNA, 23 nt, Homo sapiens
uaaauuccaucuaucaguaguau

SEQ ID NO: 1778763 - RNA, 12 nt, Homo sapiens
uugguaccaugg

SEQ ID NO: 1778764 - RNA, 12 nt, Homo sapiens
acuuuaccucuu

SEQ ID NO: 1778765 - RNA, 15 nt, Homo sapiens
cugcuuugugagcca

SEQ ID NO: 1778766 - RNA, 15 nt, Homo sapiens
cugcaggucaacagc

SEQ ID NO: 1778767 - RNA, 14 nt, Homo sapiens
auggaaugcaauuu

SEQ ID NO: 1778768 - RNA, 23 nt, Homo sapiens
ucucugaaaacaaugcugagaau

SEQ ID NO: 1778769 - RNA, 22 nt, Homo sapiens
aggacauaccacugccauguca

SEQ ID NO: 1778770 - RNA, 16 nt, Homo sapiens
cccccauccacaguug

SEQ ID NO: 1778771 - RNA, 17 nt, Homo sapiens
cauguauuuuguaugca

SEQ ID NO: 1778772 - RNA, 15 nt, Homo sapiens
aggaugauggccaca

SEQ ID NO: 1778773 - RNA, 16 nt, Homo sapiens
uuccaucucugacuua

SEQ ID NO: 1778774 - RNA, 22 nt, Homo sapiens
uccuccuacuucccuuuccucc

SEQ ID NO: 1778775 - RNA, 19 nt, Homo sapiens
gacugaugacaaacccagg

SEQ ID NO: 1778776 - RNA, 23 nt, Homo sapiens
aaguaugggaaaugagaggcauu

SEQ ID NO: 1778777 - RNA, 20 nt, Homo sapiens
agagaauggguuuacucuca

SEQ ID NO: 1778778 - RNA, 21 nt, Homo sapiens
uagucaucagauaugcuuacu

SEQ ID NO: 1778779 - RNA, 14 nt, Homo sapiens
uccuuaagcaucug

SEQ ID NO: 1778780 - RNA, 15 nt, Homo sapiens
aguuuccccucucau

SEQ ID NO: 1778781 - RNA, 20 nt, Homo sapiens
uuccacuuugacuacaaaga

SEQ ID NO: 1778782 - RNA, 13 nt, Homo sapiens
aaggaaggcuucu

SEQ ID NO: 1778783 - RNA, 17 nt, Homo sapiens
cuaauagaaaacugugg

SEQ ID NO: 1778784 - RNA, 21 nt, Homo sapiens
aacaacucugauuaacuauuc

SEQ ID NO: 1778785 - RNA, 18 nt, Homo sapiens
ccggguguagauucccuu

SEQ ID NO: 1778786 - RNA, 15 nt, Homo sapiens
aaugagaaucugugc

SEQ ID NO: 1778787 - RNA, 17 nt, Homo sapiens
ccucuucuucuccaaag

SEQ ID NO: 1778788 - RNA, 13 nt, Homo sapiens
caaacugagaucc

SEQ ID NO: 1778789 - RNA, 18 nt, Homo sapiens
guaucccaugagccucag

SEQ ID NO: 1778790 - RNA, 14 nt, Homo sapiens
ucugugauggaugg

SEQ ID NO: 1778791 - RNA, 17 nt, Homo sapiens
agguccccugcccugag

SEQ ID NO: 1778792 - RNA, 19 nt, Homo sapiens
accauuuugggguacccac

SEQ ID NO: 1778793 - RNA, 23 nt, Homo sapiens
ucacagaugcuguguaacagaac

SEQ ID NO: 1778794 - RNA, 14 nt, Homo sapiens
uaaauuguguuucc

SEQ ID NO: 1778795 - RNA, 15 nt, Homo sapiens
gacacaccugcagcc

SEQ ID NO: 1778796 - RNA, 20 nt, Homo sapiens
caaaugagauguaugcccaa

SEQ ID NO: 1778797 - RNA, 14 nt, Homo sapiens
ccuuuaccccucau

SEQ ID NO: 1778798 - RNA, 13 nt, Homo sapiens
cuuggagugccac

SEQ ID NO: 1778799 - RNA, 14 nt, Homo sapiens
uaauuggagggaaa

SEQ ID NO: 1778800 - RNA, 15 nt, Homo sapiens
cauucuaucuauucc

SEQ ID NO: 1778801 - RNA, 20 nt, Homo sapiens
gaacuccaccgaccaacugc

SEQ ID NO: 1778802 - RNA, 16 nt, Homo sapiens
cugcauuuuacuguac

SEQ ID NO: 1778803 - RNA, 12 nt, Homo sapiens
auccccugcuac

SEQ ID NO: 1778804 - RNA, 18 nt, Homo sapiens
gagcagccucuggacagc

SEQ ID NO: 1778805 - RNA, 20 nt, Homo sapiens
accccuuggcacuguggaac

SEQ ID NO: 1778806 - RNA, 23 nt, Homo sapiens
ugucuguguuccaaccacugaau

SEQ ID NO: 1778807 - RNA, 22 nt, Homo sapiens
uuaucucccugcuucauaucuc

SEQ ID NO: 1778808 - RNA, 22 nt, Homo sapiens
caggcuucccaaaccaagugcc

SEQ ID NO: 1778809 - RNA, 14 nt, Homo sapiens
accauuagcauugc

SEQ ID NO: 1778810 - RNA, 21 nt, Homo sapiens
agugacaagggcacaagcuca

SEQ ID NO: 1778811 - RNA, 22 nt, Homo sapiens
guuuuuuuuuucuuuuuugcca

SEQ ID NO: 1778812 - RNA, 21 nt, Homo sapiens
uuguuuuaacguucugcugcu

SEQ ID NO: 1778813 - RNA, 12 nt, Homo sapiens
aacccugugauc

SEQ ID NO: 1778814 - RNA, 20 nt, Homo sapiens
cagaauauuagugaccucag

SEQ ID NO: 1778815 - RNA, 23 nt, Homo sapiens
ugagcuaccuggggugggggcca

SEQ ID NO: 1778816 - RNA, 14 nt, Homo sapiens
uccuuuccacucca

SEQ ID NO: 1778817 - RNA, 18 nt, Homo sapiens
ccccagcuccuaggucuc

SEQ ID NO: 1778818 - RNA, 12 nt, Homo sapiens
cuaagcuuucuc

SEQ ID NO: 1778819 - RNA, 15 nt, Homo sapiens
ucaaacaaagccaga

SEQ ID NO: 1778820 - RNA, 15 nt, Homo sapiens
ucagaacauccucca

SEQ ID NO: 1778821 - RNA, 21 nt, Homo sapiens
acccuucaucucuuacuugau

SEQ ID NO: 1778822 - RNA, 16 nt, Homo sapiens
gaacaguauuacagug

SEQ ID NO: 1778823 - RNA, 15 nt, Homo sapiens
uuucaaauuggcacu

SEQ ID NO: 1778824 - RNA, 21 nt, Homo sapiens
aaaaugcuguuuucaacauug

SEQ ID NO: 1778825 - RNA, 18 nt, Homo sapiens
cacucccgaggauguguc

SEQ ID NO: 1778826 - RNA, 21 nt, Homo sapiens
auaaauuuucuucuugguucu

SEQ ID NO: 1778827 - RNA, 18 nt, Homo sapiens
uacauuugauuuguucau

SEQ ID NO: 1778828 - RNA, 17 nt, Homo sapiens
cuauccuccuaccucca

SEQ ID NO: 1778829 - RNA, 14 nt, Homo sapiens
aagauacauaaaag

SEQ ID NO: 1778830 - RNA, 17 nt, Homo sapiens
ugucagcaucugaccau

SEQ ID NO: 1778831 - RNA, 11 nt, Homo sapiens
ucucugaccag

SEQ ID NO: 1778832 - RNA, 13 nt, Homo sapiens
ugugcucuauguc

SEQ ID NO: 1778833 - RNA, 17 nt, Homo sapiens
gucaguuauucuugcaa

SEQ ID NO: 1778834 - RNA, 14 nt, Homo sapiens
aaauuaaucagaaa

SEQ ID NO: 1778835 - RNA, 21 nt, Homo sapiens
uugccuuuccauaaucacuca

SEQ ID NO: 1778836 - RNA, 24 nt, Homo sapiens
guaguuucuguaaaugacacuuuc

SEQ ID NO: 1778837 - RNA, 22 nt, Homo sapiens
agccuuagagcaucucugccuc

SEQ ID NO: 1778838 - RNA, 22 nt, Homo sapiens
ugcaagagacuuugucacuuau

SEQ ID NO: 1778839 - RNA, 15 nt, Homo sapiens
ccuaaggaucucuca

SEQ ID NO: 1778840 - RNA, 14 nt, Homo sapiens
cauagcgagacucc

SEQ ID NO: 1778841 - RNA, 23 nt, Homo sapiens
acaacugccggggguucaggguu

SEQ ID NO: 1778842 - RNA, 18 nt, Homo sapiens
aaguaauaaugugcaaau

SEQ ID NO: 1778843 - RNA, 21 nt, Homo sapiens
cauuuuggggugaagauucag

SEQ ID NO: 1778844 - RNA, 22 nt, Homo sapiens
cucuucuucuuucuacaguauu

SEQ ID NO: 1778845 - RNA, 14 nt, Homo sapiens
ugaugccauaugcc

SEQ ID NO: 1778846 - RNA, 14 nt, Homo sapiens
aguggagaugaagc

SEQ ID NO: 1778847 - RNA, 19 nt, Homo sapiens
ccauggugcagugaagaaa

SEQ ID NO: 1778848 - RNA, 17 nt, Homo sapiens
agauauucagaaguaua

SEQ ID NO: 1778849 - RNA, 13 nt, Homo sapiens
gugcggugcauac

SEQ ID NO: 1778850 - RNA, 22 nt, Homo sapiens
caagcugguggcucugugugcu

SEQ ID NO: 1778851 - RNA, 22 nt, Homo sapiens
uaugccccaccuaucuuuggua

SEQ ID NO: 1778852 - RNA, 15 nt, Homo sapiens
ccaaggacucuucca

SEQ ID NO: 1778853 - RNA, 18 nt, Homo sapiens
aauuuugucaacuaccca

SEQ ID NO: 1778854 - RNA, 22 nt, Homo sapiens
ugaggaaacugagucacucaca

SEQ ID NO: 1778855 - RNA, 12 nt, Homo sapiens
cuaauggucucu

SEQ ID NO: 1778856 - RNA, 21 nt, Homo sapiens
ugcaaaugcaugcuucuucuc

SEQ ID NO: 1778857 - RNA, 16 nt, Homo sapiens
ccuuuuuuguuauuau

SEQ ID NO: 1778858 - RNA, 19 nt, Homo sapiens
gauauacuugguucucucc

SEQ ID NO: 1778859 - RNA, 14 nt, Homo sapiens
ugcccaccugugau

SEQ ID NO: 1778860 - RNA, 15 nt, Homo sapiens
gcacaaggccuugcc

SEQ ID NO: 1778861 - RNA, 20 nt, Homo sapiens
uuauugaagaugugaucaau

SEQ ID NO: 1778862 - RNA, 15 nt, Homo sapiens
gaauuaucaucccaa

SEQ ID NO: 1778863 - RNA, 19 nt, Homo sapiens
ccuaacguuugucauucca

SEQ ID NO: 1778864 - RNA, 22 nt, Homo sapiens
gcccuacaucuucagcucccau

SEQ ID NO: 1778865 - RNA, 22 nt, Homo sapiens
caugaugucuaccucagaauua

SEQ ID NO: 1778866 - RNA, 19 nt, Homo sapiens
gcauucuucuuuuggcaau

SEQ ID NO: 1778867 - RNA, 13 nt, Homo sapiens
caccauggugacu

SEQ ID NO: 1778868 - RNA, 15 nt, Homo sapiens
ccuggacuucuggga

SEQ ID NO: 1778869 - RNA, 15 nt, Homo sapiens
ccucagcuucucaaa

SEQ ID NO: 1778870 - RNA, 15 nt, Homo sapiens
uguagaaggcaagag

SEQ ID NO: 1778871 - RNA, 16 nt, Homo sapiens
uuauaaaaagaaugaa

SEQ ID NO: 1778872 - RNA, 18 nt, Homo sapiens
auuauagugacaaugaag

SEQ ID NO: 1778873 - RNA, 12 nt, Homo sapiens
acacucucacua

SEQ ID NO: 1778874 - RNA, 15 nt, Homo sapiens
ggcgcaggugcacag

SEQ ID NO: 1778875 - RNA, 15 nt, Homo sapiens
gugaaaguacauuug

SEQ ID NO: 1778876 - RNA, 14 nt, Homo sapiens
caaagcacuguuga

SEQ ID NO: 1778877 - RNA, 17 nt, Homo sapiens
cauggcccaucaggggc

SEQ ID NO: 1778878 - RNA, 22 nt, Homo sapiens
gccacccaggcuggagugcagu

SEQ ID NO: 1778879 - RNA, 15 nt, Homo sapiens
caugcucaccaagga

SEQ ID NO: 1778880 - RNA, 13 nt, Homo sapiens
uuuauuuacaaau

SEQ ID NO: 1778881 - RNA, 14 nt, Homo sapiens
ucucugauacacag

SEQ ID NO: 1778882 - RNA, 14 nt, Homo sapiens
auagaaauuuugua

SEQ ID NO: 1778883 - RNA, 23 nt, Homo sapiens
gaaacuggaaugcuguuacuuug

SEQ ID NO: 1778884 - RNA, 18 nt, Homo sapiens
cuggggaugguaggauug

SEQ ID NO: 1778885 - RNA, 21 nt, Homo sapiens
aaacggugaggccccaguggc

SEQ ID NO: 1778886 - RNA, 21 nt, Homo sapiens
uuagaacucuagagagccuua

SEQ ID NO: 1778887 - RNA, 21 nt, Homo sapiens
augugaguuuaaucuuuucag

SEQ ID NO: 1778888 - RNA, 15 nt, Homo sapiens
ccugcguucccagac

SEQ ID NO: 1778889 - RNA, 21 nt, Homo sapiens
ucaugguguucaugacaagug

SEQ ID NO: 1778890 - RNA, 16 nt, Homo sapiens
ccucuugaucugccca

SEQ ID NO: 1778891 - RNA, 17 nt, Homo sapiens
ccauuuccccucuuaaa

SEQ ID NO: 1778892 - RNA, 20 nt, Homo sapiens
ucugcucuaccauguuuaaa

SEQ ID NO: 1778893 - RNA, 23 nt, Homo sapiens
cucugugguuuuaaucuucucau

SEQ ID NO: 1778894 - RNA, 17 nt, Homo sapiens
agaggaccccagggugg

SEQ ID NO: 1778895 - RNA, 19 nt, Homo sapiens
ucuggcaggaaucuaucca

SEQ ID NO: 1778896 - RNA, 16 nt, Homo sapiens
gccucugcacuccccu

SEQ ID NO: 1778897 - RNA, 14 nt, Homo sapiens
aucucagcacuuug

SEQ ID NO: 1778898 - RNA, 24 nt, Homo sapiens
uugugcaggguguguacugcacaa

SEQ ID NO: 1778899 - RNA, 13 nt, Homo sapiens
uccauucacuccc

SEQ ID NO: 1778900 - RNA, 22 nt, Homo sapiens
uacuucgucuucgcccucugaa

SEQ ID NO: 1778901 - RNA, 16 nt, Homo sapiens
uaaauaugaagcucac

SEQ ID NO: 1778902 - RNA, 13 nt, Homo sapiens
cugccuacuuccu

SEQ ID NO: 1778903 - RNA, 15 nt, Homo sapiens
ucuauuugaucugau

SEQ ID NO: 1778904 - RNA, 15 nt, Homo sapiens
cuccaccucuaccaa

SEQ ID NO: 1778905 - RNA, 20 nt, Homo sapiens
aacauuguguugacauuaag

SEQ ID NO: 1778906 - RNA, 21 nt, Homo sapiens
ucaccuaagucucugugaauu

SEQ ID NO: 1778907 - RNA, 21 nt, Homo sapiens
gcauaggugaggcugggcccu

SEQ ID NO: 1778908 - RNA, 17 nt, Homo sapiens
gacagugagacuguggc

SEQ ID NO: 1778909 - RNA, 21 nt, Homo sapiens
aggaaaagaguaucaaaggca

SEQ ID NO: 1778910 - RNA, 13 nt, Homo sapiens
aagggcugcuucc

SEQ ID NO: 1778911 - RNA, 15 nt, Homo sapiens
aaugaaaacaaugca

SEQ ID NO: 1778912 - RNA, 15 nt, Homo sapiens
agaaaugcaaaucga

SEQ ID NO: 1778913 - RNA, 20 nt, Homo sapiens
agaggaaaagaaagaaguua

SEQ ID NO: 1778914 - RNA, 19 nt, Homo sapiens
auggcuuaggaaugacuua

SEQ ID NO: 1778915 - RNA, 22 nt, Homo sapiens
uugucuuuaaauagauacaaau

SEQ ID NO: 1778916 - RNA, 19 nt, Homo sapiens
gcugggacuucuuacccaa

SEQ ID NO: 1778917 - RNA, 11 nt, Homo sapiens
uagaaaccacc

SEQ ID NO: 1778918 - RNA, 14 nt, Homo sapiens
aauaaacuaaagaa

SEQ ID NO: 1778919 - RNA, 16 nt, Homo sapiens
ggcaggccagggcagu

SEQ ID NO: 1778920 - RNA, 20 nt, Homo sapiens
ucuguggggcugagcaacau

SEQ ID NO: 1778921 - RNA, 15 nt, Homo sapiens
auaaggcauggcuca

SEQ ID NO: 1778922 - RNA, 22 nt, Homo sapiens
cagcaucggcuucuugcugcac

SEQ ID NO: 1778923 - RNA, 13 nt, Homo sapiens
cuaagcacuuuau

SEQ ID NO: 1778924 - RNA, 14 nt, Homo sapiens
acaugguucaaauc

SEQ ID NO: 1778925 - RNA, 17 nt, Homo sapiens
gccaagaaaauugccuu

SEQ ID NO: 1778926 - RNA, 20 nt, Homo sapiens
caaaauuuugucccaucucu

SEQ ID NO: 1778927 - RNA, 14 nt, Homo sapiens
gccucaauucacau

SEQ ID NO: 1778928 - RNA, 17 nt, Homo sapiens
uuaauguagaaccucaa

SEQ ID NO: 1778929 - RNA, 20 nt, Homo sapiens
uagagagaagaucacugaag

SEQ ID NO: 1778930 - RNA, 20 nt, Homo sapiens
uaccccagacuagauguagu

SEQ ID NO: 1778931 - RNA, 15 nt, Homo sapiens
ugcccgggagcucag

SEQ ID NO: 1778932 - RNA, 16 nt, Homo sapiens
uugugaacuccaucau

SEQ ID NO: 1778933 - RNA, 15 nt, Homo sapiens
cagggagacugcauc

SEQ ID NO: 1778934 - RNA, 16 nt, Homo sapiens
ucccuuggccucagaa

SEQ ID NO: 1778935 - RNA, 12 nt, Homo sapiens
gaaguacaugaa

SEQ ID NO: 1778936 - RNA, 19 nt, Homo sapiens
uaauuuuuugcacacuguu

SEQ ID NO: 1778937 - RNA, 14 nt, Homo sapiens
agagaugcuggauu

SEQ ID NO: 1778938 - RNA, 21 nt, Homo sapiens
accauggaacauuuugauuau

SEQ ID NO: 1778939 - RNA, 20 nt, Homo sapiens
ccacuuaucaaaucauucaa

SEQ ID NO: 1778940 - RNA, 17 nt, Homo sapiens
agccugaggcagccacu

SEQ ID NO: 1778941 - RNA, 18 nt, Homo sapiens
aguggaauggagauuuca

SEQ ID NO: 1778942 - RNA, 16 nt, Homo sapiens
aaugcucagacuucau

SEQ ID NO: 1778943 - RNA, 17 nt, Homo sapiens
ggcagagcuguggcaca

SEQ ID NO: 1778944 - RNA, 17 nt, Homo sapiens
gcaccuuuucauguaca

SEQ ID NO: 1778945 - RNA, 14 nt, Homo sapiens
aguggauggaauau

SEQ ID NO: 1778946 - RNA, 14 nt, Homo sapiens
guccuaggacuuaa

SEQ ID NO: 1778947 - RNA, 18 nt, Homo sapiens
uuccuucaaauccugcca

SEQ ID NO: 1778948 - RNA, 18 nt, Homo sapiens
acuucuaaauuauaccau

SEQ ID NO: 1778949 - RNA, 18 nt, Homo sapiens
gcuagagccucugccuga

SEQ ID NO: 1778950 - RNA, 15 nt, Homo sapiens
uccuccuccaucacc

SEQ ID NO: 1778951 - RNA, 20 nt, Homo sapiens
aauguucaguucaaaagccu

SEQ ID NO: 1778952 - RNA, 20 nt, Homo sapiens
cugcagaaaauuaauugaaa

SEQ ID NO: 1778953 - RNA, 16 nt, Homo sapiens
aaucaugaguaccuca

SEQ ID NO: 1778954 - RNA, 20 nt, Homo sapiens
gccaagaugacacaacugca

SEQ ID NO: 1778955 - RNA, 20 nt, Homo sapiens
aucaguaauuaacauaucaa

SEQ ID NO: 1778956 - RNA, 19 nt, Homo sapiens
ggcucgaugucugcuucuu

SEQ ID NO: 1778957 - RNA, 16 nt, Homo sapiens
ucuuuugacaccuuag

SEQ ID NO: 1778958 - RNA, 13 nt, Homo sapiens
augcuuacuccac

SEQ ID NO: 1778959 - RNA, 17 nt, Homo sapiens
cagcucuaauacauucc

SEQ ID NO: 1778960 - RNA, 16 nt, Homo sapiens
aaggccuccugugacu

SEQ ID NO: 1778961 - RNA, 14 nt, Homo sapiens
cuuugcuuugugua

SEQ ID NO: 1778962 - RNA, 12 nt, Homo sapiens
ccagaauuuccc

SEQ ID NO: 1778963 - RNA, 20 nt, Homo sapiens
ccugaagucacacagugagu

SEQ ID NO: 1778964 - RNA, 14 nt, Homo sapiens
auagauuugcagcu

SEQ ID NO: 1778965 - RNA, 19 nt, Homo sapiens
ccuaaguuauuaccucucc

SEQ ID NO: 1778966 - RNA, 18 nt, Homo sapiens
uaaaguucaauugugaaa

SEQ ID NO: 1778967 - RNA, 13 nt, Homo sapiens
uuccugguauuau

SEQ ID NO: 1778968 - RNA, 14 nt, Homo sapiens
gcaucaguacuugu

SEQ ID NO: 1778969 - RNA, 15 nt, Homo sapiens
ggcggcccacaccca

SEQ ID NO: 1778970 - RNA, 14 nt, Homo sapiens
cuauuaauucuuaa

SEQ ID NO: 1778971 - RNA, 13 nt, Homo sapiens
gguuuccugccac

SEQ ID NO: 1778972 - RNA, 16 nt, Homo sapiens
auguagcaaaacgcau

SEQ ID NO: 1778973 - RNA, 18 nt, Homo sapiens
aacauuaacucuaacugu

SEQ ID NO: 1778974 - RNA, 22 nt, Homo sapiens
gugucaucuuucuuguuucauc

SEQ ID NO: 1778975 - RNA, 22 nt, Homo sapiens
aggaagaccccagcacagacuc

SEQ ID NO: 1778976 - RNA, 17 nt, Homo sapiens
cuguaauuccagcacuu

SEQ ID NO: 1778977 - RNA, 15 nt, Homo sapiens
cugcagccucaggau

SEQ ID NO: 1778978 - RNA, 17 nt, Homo sapiens
caaaggcucucacucca

SEQ ID NO: 1778979 - RNA, 20 nt, Homo sapiens
gacuugagaugaaaaaggag

SEQ ID NO: 1778980 - RNA, 12 nt, Homo sapiens
cagcaucugcag

SEQ ID NO: 1778981 - RNA, 16 nt, Homo sapiens
agguggcucagugcca

SEQ ID NO: 1778982 - RNA, 15 nt, Homo sapiens
ugcuacccacagcgu

SEQ ID NO: 1778983 - RNA, 19 nt, Homo sapiens
caacaagugcucuuuccac

SEQ ID NO: 1778984 - RNA, 16 nt, Homo sapiens
cauucagucuagcuuu

SEQ ID NO: 1778985 - RNA, 20 nt, Homo sapiens
gucuugcaacuucaguuuua

SEQ ID NO: 1778986 - RNA, 21 nt, Homo sapiens
cacauacauguaaaauauguc

SEQ ID NO: 1778987 - RNA, 15 nt, Homo sapiens
cuucauccguuguga

SEQ ID NO: 1778988 - RNA, 18 nt, Homo sapiens
aggaguucgagaccagcc

SEQ ID NO: 1778989 - RNA, 23 nt, Homo sapiens
cuugaaaauaauaaaguggcauu

SEQ ID NO: 1778990 - RNA, 23 nt, Homo sapiens
uggagacccugcaaacagaacag

SEQ ID NO: 1778991 - RNA, 16 nt, Homo sapiens
cuacccucagucuaca

SEQ ID NO: 1778992 - RNA, 23 nt, Homo sapiens
aucuuauuuugugaacuauauca

SEQ ID NO: 1778993 - RNA, 18 nt, Homo sapiens
gucccuggcgcugugcua

SEQ ID NO: 1778994 - RNA, 18 nt, Homo sapiens
uguuguggguuccugcca

SEQ ID NO: 1778995 - RNA, 17 nt, Homo sapiens
aacccuggagaguucaa

SEQ ID NO: 1778996 - RNA, 17 nt, Homo sapiens
uggauucauauaggcca

SEQ ID NO: 1778997 - RNA, 20 nt, Homo sapiens
agucucaggacagaaccacu

SEQ ID NO: 1778998 - RNA, 15 nt, Homo sapiens
ccaagaucacagugg

SEQ ID NO: 1778999 - RNA, 22 nt, Homo sapiens
uaggaaggcacuacaugaaaua

SEQ ID NO: 1779000 - RNA, 16 nt, Homo sapiens
guagcuaaagugcaag

SEQ ID NO: 1779001 - RNA, 12 nt, Homo sapiens
uguugaggacaa

SEQ ID NO: 1779002 - RNA, 18 nt, Homo sapiens
aggacggacucacuucuc

SEQ ID NO: 1779003 - RNA, 17 nt, Homo sapiens
aggaaggcuucuguguc

SEQ ID NO: 1779004 - RNA, 21 nt, Homo sapiens
gaggccgagucuguccuggaa

SEQ ID NO: 1779005 - RNA, 18 nt, Homo sapiens
aggaugcuucugcucaca

SEQ ID NO: 1779006 - RNA, 13 nt, Homo sapiens
ugcacugacaugu

SEQ ID NO: 1779007 - RNA, 14 nt, Homo sapiens
cugugcugaccaaa

SEQ ID NO: 1779008 - RNA, 19 nt, Homo sapiens
cuaaauguuuggcauguaa

SEQ ID NO: 1779009 - RNA, 18 nt, Homo sapiens
uucaguucugcuugcucc

SEQ ID NO: 1779010 - RNA, 22 nt, Homo sapiens
acuguggaggcuguaaauccag

SEQ ID NO: 1779011 - RNA, 15 nt, Homo sapiens
gaaccuugcuaucaa

SEQ ID NO: 1779012 - RNA, 15 nt, Homo sapiens
uaauaaaucacuugc

SEQ ID NO: 1779013 - RNA, 21 nt, Homo sapiens
gccauucacuucauaauccag

SEQ ID NO: 1779014 - RNA, 18 nt, Homo sapiens
uccuuccugucuuccugc

SEQ ID NO: 1779015 - RNA, 17 nt, Homo sapiens
uuucuaacucacaggca

SEQ ID NO: 1779016 - RNA, 21 nt, Homo sapiens
uacaguauugaaaaauuauca

SEQ ID NO: 1779017 - RNA, 18 nt, Homo sapiens
ucugcugaaugcagggaa

SEQ ID NO: 1779018 - RNA, 18 nt, Homo sapiens
ucuauaaacagacaggcu

SEQ ID NO: 1779019 - RNA, 16 nt, Homo sapiens
gcgcagccaugugauu

SEQ ID NO: 1779020 - RNA, 20 nt, Homo sapiens
aauauuuaaaaugaaaugag

SEQ ID NO: 1779021 - RNA, 20 nt, Homo sapiens
uugaaaaaaaacaguggauc

SEQ ID NO: 1779022 - RNA, 19 nt, Homo sapiens
aauguuggcuguaauguaa

SEQ ID NO: 1779023 - RNA, 12 nt, Homo sapiens
uaaagaauacac

SEQ ID NO: 1779024 - RNA, 13 nt, Homo sapiens
agugauacggauu

SEQ ID NO: 1779025 - RNA, 15 nt, Homo sapiens
agaaggggaagggaa

SEQ ID NO: 1779026 - RNA, 21 nt, Homo sapiens
cuguugcggaucuucauggcc

SEQ ID NO: 1779027 - RNA, 16 nt, Homo sapiens
auuuagauuggcagug

SEQ ID NO: 1779028 - RNA, 16 nt, Homo sapiens
guuuugccaguucaag

SEQ ID NO: 1779029 - RNA, 14 nt, Homo sapiens
aagcccagccacau

SEQ ID NO: 1779030 - RNA, 20 nt, Homo sapiens
agguggagucucauucuguu

SEQ ID NO: 1779031 - RNA, 17 nt, Homo sapiens
aucauggaucaaccaag

SEQ ID NO: 1779032 - RNA, 20 nt, Homo sapiens
gaaguuuugacaucaaugau

SEQ ID NO: 1779033 - RNA, 13 nt, Homo sapiens
aggagaaaucacu

SEQ ID NO: 1779034 - RNA, 17 nt, Homo sapiens
aggacaaguuuuaguua

SEQ ID NO: 1779035 - RNA, 19 nt, Homo sapiens
ccucaacaacaaaccaaaa

SEQ ID NO: 1779036 - RNA, 12 nt, Homo sapiens
gaauuacagaga

SEQ ID NO: 1779037 - RNA, 18 nt, Homo sapiens
cauucaauguuuaugcaa

SEQ ID NO: 1779038 - RNA, 22 nt, Homo sapiens
gccuuuuuauuuauauguacug

SEQ ID NO: 1779039 - RNA, 14 nt, Homo sapiens
uaaaaaacugugaa

SEQ ID NO: 1779040 - RNA, 17 nt, Homo sapiens
cacaugaauaauuucac

SEQ ID NO: 1779041 - RNA, 20 nt, Homo sapiens
ucuguagguauuaaucacau

SEQ ID NO: 1779042 - RNA, 22 nt, Homo sapiens
cuguuuguuuuuaaaaagcaaa

SEQ ID NO: 1779043 - RNA, 20 nt, Homo sapiens
ucuuggcucaccauaaccuc

SEQ ID NO: 1779044 - RNA, 19 nt, Homo sapiens
augucagacccgaacuggc

SEQ ID NO: 1779045 - RNA, 13 nt, Homo sapiens
guauacaugugug

SEQ ID NO: 1779046 - RNA, 19 nt, Homo sapiens
augaucuagguuuaacuca

SEQ ID NO: 1779047 - RNA, 11 nt, Homo sapiens
ugguguuacau

SEQ ID NO: 1779048 - RNA, 16 nt, Homo sapiens
uuauugauguuuucau

SEQ ID NO: 1779049 - RNA, 19 nt, Homo sapiens
auuugcauaauaugcauau

SEQ ID NO: 1779050 - RNA, 12 nt, Homo sapiens
aaaccugugaag

SEQ ID NO: 1779051 - RNA, 15 nt, Homo sapiens
ucuaucaucugcuaa

SEQ ID NO: 1779052 - RNA, 14 nt, Homo sapiens
auuuaagugcaauu

SEQ ID NO: 1779053 - RNA, 20 nt, Homo sapiens
uucuggaaucuuugagacca

SEQ ID NO: 1779054 - RNA, 16 nt, Homo sapiens
ugagacaccugaugac

SEQ ID NO: 1779055 - RNA, 12 nt, Homo sapiens
gcuucgcuggaa

SEQ ID NO: 1779056 - RNA, 19 nt, Homo sapiens
ugagcugcccccaaaucaa

SEQ ID NO: 1779057 - RNA, 15 nt, Homo sapiens
uccaugcaaaccaug

SEQ ID NO: 1779058 - RNA, 21 nt, Homo sapiens
ugaaugaccuuguugcaugau

SEQ ID NO: 1779059 - RNA, 20 nt, Homo sapiens
uucuaguguaaaucaugcaa

SEQ ID NO: 1779060 - RNA, 16 nt, Homo sapiens
aaggucaaaacugaag

SEQ ID NO: 1779061 - RNA, 17 nt, Homo sapiens
uauuuuauagagcagaa

SEQ ID NO: 1779062 - RNA, 17 nt, Homo sapiens
gaggggggcgggugacg

SEQ ID NO: 1779063 - RNA, 19 nt, Homo sapiens
aggaaaaguuauugugaua

SEQ ID NO: 1779064 - RNA, 14 nt, Homo sapiens
cuuauuacauuuaa

SEQ ID NO: 1779065 - RNA, 14 nt, Homo sapiens
uuucuuacuccucc

SEQ ID NO: 1779066 - RNA, 20 nt, Homo sapiens
uuaaguucaggcagcacauc

SEQ ID NO: 1779067 - RNA, 16 nt, Homo sapiens
gcucugcccacuguga

SEQ ID NO: 1779068 - RNA, 18 nt, Homo sapiens
gggccauucuccacagca

SEQ ID NO: 1779069 - RNA, 16 nt, Homo sapiens
ccgagcuguggacaaa

SEQ ID NO: 1779070 - RNA, 15 nt, Homo sapiens
uuguuugucuuccau

SEQ ID NO: 1779071 - RNA, 13 nt, Homo sapiens
ucugagugacaug

SEQ ID NO: 1779072 - RNA, 21 nt, Homo sapiens
cugaaugucaagaaaaggagu

SEQ ID NO: 1779073 - RNA, 14 nt, Homo sapiens
accgcuugccauau

SEQ ID NO: 1779074 - RNA, 18 nt, Homo sapiens
cugcuacaaagaagacau

SEQ ID NO: 1779075 - RNA, 15 nt, Homo sapiens
aaacuaccaauccca

SEQ ID NO: 1779076 - RNA, 15 nt, Homo sapiens
cacagcaguucugca

SEQ ID NO: 1779077 - RNA, 19 nt, Homo sapiens
ccugagauucagaugucau

SEQ ID NO: 1779078 - RNA, 18 nt, Homo sapiens
gugaugggcaaggggcca

SEQ ID NO: 1779079 - RNA, 11 nt, Homo sapiens
uucacuuuaaa

SEQ ID NO: 1779080 - RNA, 16 nt, Homo sapiens
uagacuuuucccaagc

SEQ ID NO: 1779081 - RNA, 23 nt, Homo sapiens
acucagcuuuuucguauuucaaa

SEQ ID NO: 1779082 - RNA, 12 nt, Homo sapiens
agagcaucucau

SEQ ID NO: 1779083 - RNA, 14 nt, Homo sapiens
gugaaagcucucaa

SEQ ID NO: 1779084 - RNA, 15 nt, Homo sapiens
uccaaggcaaauguc

SEQ ID NO: 1779085 - RNA, 15 nt, Homo sapiens
ucaccuuggggccuu

SEQ ID NO: 1779086 - RNA, 21 nt, Homo sapiens
agaccugagaauguaucccca

SEQ ID NO: 1779087 - RNA, 12 nt, Homo sapiens
ugucugccacag

SEQ ID NO: 1779088 - RNA, 12 nt, Homo sapiens
ugugugccacac

SEQ ID NO: 1779089 - RNA, 13 nt, Homo sapiens
guggagagaccag

SEQ ID NO: 1779090 - RNA, 24 nt, Homo sapiens
ccggccccacccccugggcagaug

SEQ ID NO: 1779091 - RNA, 17 nt, Homo sapiens
uucaggaagaugaaaga

SEQ ID NO: 1779092 - RNA, 13 nt, Homo sapiens
gggaaguccuagc

SEQ ID NO: 1779093 - RNA, 21 nt, Homo sapiens
gaaacuuauuuuuuucugauu

SEQ ID NO: 1779094 - RNA, 22 nt, Homo sapiens
caaauagaaccacuaugaagcu

SEQ ID NO: 1779095 - RNA, 21 nt, Homo sapiens
agcuuguucugggcucaggga

SEQ ID NO: 1779096 - RNA, 17 nt, Homo sapiens
cagugucacucuguagu

SEQ ID NO: 1779097 - RNA, 15 nt, Homo sapiens
ggugaugucacucac

SEQ ID NO: 1779098 - RNA, 21 nt, Homo sapiens
cuaguuugcacuauaugauca

SEQ ID NO: 1779099 - RNA, 23 nt, Homo sapiens
ucugggcuacgguuccauguuca

SEQ ID NO: 1779100 - RNA, 15 nt, Homo sapiens
gaacagugcuugcca

SEQ ID NO: 1779101 - RNA, 15 nt, Homo sapiens
ggagcccuacugaag

SEQ ID NO: 1779102 - RNA, 17 nt, Homo sapiens
cucaagagagaggcuga

SEQ ID NO: 1779103 - RNA, 21 nt, Homo sapiens
aaaaugcaucacaugaugaaa

SEQ ID NO: 1779104 - RNA, 15 nt, Homo sapiens
uucuuauuacuauua

SEQ ID NO: 1779105 - RNA, 16 nt, Homo sapiens
ccaggcauguggcagg

SEQ ID NO: 1779106 - RNA, 19 nt, Homo sapiens
auucacaacuaggaccuca

SEQ ID NO: 1779107 - RNA, 19 nt, Homo sapiens
cugagaaacccaccagccu

SEQ ID NO: 1779108 - RNA, 12 nt, Homo sapiens
aaguagugugaa

SEQ ID NO: 1779109 - RNA, 12 nt, Homo sapiens
caggagaaggac

SEQ ID NO: 1779110 - RNA, 19 nt, Homo sapiens
uagccuaugaugauaaaca

SEQ ID NO: 1779111 - RNA, 19 nt, Homo sapiens
uagagaacacgcguauuua

SEQ ID NO: 1779112 - RNA, 23 nt, Homo sapiens
aauuaaaaguuugaaaagcaaua

SEQ ID NO: 1779113 - RNA, 18 nt, Homo sapiens
cagccaucaagagacuga

SEQ ID NO: 1779114 - RNA, 15 nt, Homo sapiens
gccucuagaacagcc

SEQ ID NO: 1779115 - RNA, 12 nt, Homo sapiens
uuaaacuuucaa

SEQ ID NO: 1779116 - RNA, 22 nt, Homo sapiens
caggugagugccaccacacuca

SEQ ID NO: 1779117 - RNA, 24 nt, Homo sapiens
aggauucagcucaggaguaaggga

SEQ ID NO: 1779118 - RNA, 21 nt, Homo sapiens
agucacacgggggcagcugau

SEQ ID NO: 1779119 - RNA, 15 nt, Homo sapiens
aaacuguacaguuuc

SEQ ID NO: 1779120 - RNA, 21 nt, Homo sapiens
gauggcuggggcucucuccau

SEQ ID NO: 1779121 - RNA, 18 nt, Homo sapiens
aagaagugaaaauagcca

SEQ ID NO: 1779122 - RNA, 23 nt, Homo sapiens
ccuaucagaaguuucucagcucc

SEQ ID NO: 1779123 - RNA, 16 nt, Homo sapiens
guuaacuugguucuca

SEQ ID NO: 1779124 - RNA, 22 nt, Homo sapiens
aauauugaauaaguauucuuca

SEQ ID NO: 1779125 - RNA, 23 nt, Homo sapiens
aggaagccugagguugaccagcu

SEQ ID NO: 1779126 - RNA, 17 nt, Homo sapiens
cacaaggugcaaaucaa

SEQ ID NO: 1779127 - RNA, 16 nt, Homo sapiens
uagauauuauucauuc

SEQ ID NO: 1779128 - RNA, 21 nt, Homo sapiens
ggauuuccuugacuucuuuga

SEQ ID NO: 1779129 - RNA, 14 nt, Homo sapiens
aagauauuuacugu

SEQ ID NO: 1779130 - RNA, 12 nt, Homo sapiens
auaaauggacuu

SEQ ID NO: 1779131 - RNA, 23 nt, Homo sapiens
ggcauagcauuagcugcuuccuc

SEQ ID NO: 1779132 - RNA, 20 nt, Homo sapiens
cuuuccauccauuaccucca

SEQ ID NO: 1779133 - RNA, 23 nt, Homo sapiens
aauaaaaaaugggaacauacaga

SEQ ID NO: 1779134 - RNA, 15 nt, Homo sapiens
uaaaaacaaaaccac

SEQ ID NO: 1779135 - RNA, 18 nt, Homo sapiens
aaucagcuuuguaacugu

SEQ ID NO: 1779136 - RNA, 17 nt, Homo sapiens
ccuuucuaaaucugaga

SEQ ID NO: 1779137 - RNA, 15 nt, Homo sapiens
uugaucuucaacaaa

SEQ ID NO: 1779138 - RNA, 16 nt, Homo sapiens
acaaccugugaucaag

SEQ ID NO: 1779139 - RNA, 23 nt, Homo sapiens
ggaagcuucuaaauggugcugca

SEQ ID NO: 1779140 - RNA, 17 nt, Homo sapiens
acauaguagauugacau

SEQ ID NO: 1779141 - RNA, 14 nt, Homo sapiens
caccuucuguaaua

SEQ ID NO: 1779142 - RNA, 19 nt, Homo sapiens
aaagauuagcaaggucauu

SEQ ID NO: 1779143 - RNA, 18 nt, Homo sapiens
cuccagaugcagggcagu

SEQ ID NO: 1779144 - RNA, 23 nt, Homo sapiens
gacucugaccccagcauucucag

SEQ ID NO: 1779145 - RNA, 21 nt, Homo sapiens
ccagcaccugguugaugugua

SEQ ID NO: 1779146 - RNA, 15 nt, Homo sapiens
ccaggagaccuucca

SEQ ID NO: 1779147 - RNA, 22 nt, Homo sapiens
gaggcucaaaaacuugaucaca

SEQ ID NO: 1779148 - RNA, 13 nt, Homo sapiens
agcuggcugugcc

SEQ ID NO: 1779149 - RNA, 21 nt, Homo sapiens
gcucuuucaucucugcuugga

SEQ ID NO: 1779150 - RNA, 13 nt, Homo sapiens
gauauauuuccaa

SEQ ID NO: 1779151 - RNA, 18 nt, Homo sapiens
aggcccagcagagccguu

SEQ ID NO: 1779152 - RNA, 22 nt, Homo sapiens
uggcugagagaguggcauuggc

SEQ ID NO: 1779153 - RNA, 14 nt, Homo sapiens
agaucucuguagaa

SEQ ID NO: 1779154 - RNA, 22 nt, Homo sapiens
ugucaucaaauauuaccaaaaa

SEQ ID NO: 1779155 - RNA, 16 nt, Homo sapiens
uagaacacugcauuag

SEQ ID NO: 1779156 - RNA, 14 nt, Homo sapiens
uaaauucagaucaa

SEQ ID NO: 1779157 - RNA, 19 nt, Homo sapiens
uggcuucuagaucuggaac

SEQ ID NO: 1779158 - RNA, 14 nt, Homo sapiens
cugaggacauucca

SEQ ID NO: 1779159 - RNA, 15 nt, Homo sapiens
ugcuccagucauugc

SEQ ID NO: 1779160 - RNA, 12 nt, Homo sapiens
guccagcccauc

SEQ ID NO: 1779161 - RNA, 18 nt, Homo sapiens
guagacauuuugaaauaa

SEQ ID NO: 1779162 - RNA, 13 nt, Homo sapiens
cugugugacauca

SEQ ID NO: 1779163 - RNA, 19 nt, Homo sapiens
uaaaaggcaaauguguaca

SEQ ID NO: 1779164 - RNA, 14 nt, Homo sapiens
gaaacucacacucc

SEQ ID NO: 1779165 - RNA, 18 nt, Homo sapiens
caucugaacacaaccaga

SEQ ID NO: 1779166 - RNA, 17 nt, Homo sapiens
auacuugaaaccaguau

SEQ ID NO: 1779167 - RNA, 16 nt, Homo sapiens
ggauugaagcccucca

SEQ ID NO: 1779168 - RNA, 14 nt, Homo sapiens
cuuuuucacacuga

SEQ ID NO: 1779169 - RNA, 16 nt, Homo sapiens
ggcaaggaugcauaca

SEQ ID NO: 1779170 - RNA, 22 nt, Homo sapiens
aagacugucaaaugaacuuuua

SEQ ID NO: 1779171 - RNA, 21 nt, Homo sapiens
ccaagggcuucugcacccucc

SEQ ID NO: 1779172 - RNA, 18 nt, Homo sapiens
cuuaacuuugaaccauaa

SEQ ID NO: 1779173 - RNA, 13 nt, Homo sapiens
cacuucugauguc

SEQ ID NO: 1779174 - RNA, 16 nt, Homo sapiens
uggcuaacauggugaa

SEQ ID NO: 1779175 - RNA, 17 nt, Homo sapiens
cuuuauacuggguuuca

SEQ ID NO: 1779176 - RNA, 20 nt, Homo sapiens
gacuacauccugagugugau

SEQ ID NO: 1779177 - RNA, 19 nt, Homo sapiens
aguuucuggauuagcuuuu

SEQ ID NO: 1779178 - RNA, 20 nt, Homo sapiens
gcuccagcaacugcccuucc

SEQ ID NO: 1779179 - RNA, 16 nt, Homo sapiens
guucccuauuuugcca

SEQ ID NO: 1779180 - RNA, 16 nt, Homo sapiens
ucugguaaaacuuuag

SEQ ID NO: 1779181 - RNA, 21 nt, Homo sapiens
aaagcagaaaaucuaccaaga

SEQ ID NO: 1779182 - RNA, 16 nt, Homo sapiens
ccacacuagaauucau

SEQ ID NO: 1779183 - RNA, 19 nt, Homo sapiens
acauuuauuaguuccccaa

SEQ ID NO: 1779184 - RNA, 15 nt, Homo sapiens
augggaugaugauuc

SEQ ID NO: 1779185 - RNA, 20 nt, Homo sapiens
auucugaaaucagucuacca

SEQ ID NO: 1779186 - RNA, 22 nt, Homo sapiens
ucuaaaacauguuugcacuugu

SEQ ID NO: 1779187 - RNA, 18 nt, Homo sapiens
agaauuguagacugaugu

SEQ ID NO: 1779188 - RNA, 23 nt, Homo sapiens
agacgucguacccagccaugugu

SEQ ID NO: 1779189 - RNA, 21 nt, Homo sapiens
accaugacaaaauagcccagc

SEQ ID NO: 1779190 - RNA, 18 nt, Homo sapiens
cagaaagcaaaucagaca

SEQ ID NO: 1779191 - RNA, 20 nt, Homo sapiens
cuguuacacacuaacaucaa

SEQ ID NO: 1779192 - RNA, 16 nt, Homo sapiens
aaugucagaaaccagu

SEQ ID NO: 1779193 - RNA, 21 nt, Homo sapiens
aacucgguauuaauccaaagc

SEQ ID NO: 1779194 - RNA, 15 nt, Homo sapiens
gaacaaacacugcag

SEQ ID NO: 1779195 - RNA, 21 nt, Homo sapiens
cucuugaguuccucugcaguu

SEQ ID NO: 1779196 - RNA, 17 nt, Homo sapiens
uucauugucucagugaa

SEQ ID NO: 1779197 - RNA, 17 nt, Homo sapiens
cuuggaauuuuguaaaa

SEQ ID NO: 1779198 - RNA, 11 nt, Homo sapiens
acuccuuccau

SEQ ID NO: 1779199 - RNA, 16 nt, Homo sapiens
uaagcuguaaccgaua

SEQ ID NO: 1779200 - RNA, 14 nt, Homo sapiens
guuugauauggaga

SEQ ID NO: 1779201 - RNA, 18 nt, Homo sapiens
gccuuuacugcauagcag

SEQ ID NO: 1779202 - RNA, 12 nt, Homo sapiens
ccaguccaugag

SEQ ID NO: 1779203 - RNA, 14 nt, Homo sapiens
ucuuucuuacacaa

SEQ ID NO: 1779204 - RNA, 19 nt, Homo sapiens
uuuuguguacaguaugugu

SEQ ID NO: 1779205 - RNA, 18 nt, Homo sapiens
uagcugguucacacugac

SEQ ID NO: 1779206 - RNA, 16 nt, Homo sapiens
cccagccaggggaacu

SEQ ID NO: 1779207 - RNA, 14 nt, Homo sapiens
uuuccaaccggcuu

SEQ ID NO: 1779208 - RNA, 15 nt, Homo sapiens
uuaaucacuacugua

SEQ ID NO: 1779209 - RNA, 13 nt, Homo sapiens
gcaggacacuggu

SEQ ID NO: 1779210 - RNA, 11 nt, Homo sapiens
auccacugugc

SEQ ID NO: 1779211 - RNA, 13 nt, Homo sapiens
aaguuucacccaa

SEQ ID NO: 1779212 - RNA, 14 nt, Homo sapiens
acaccgaugcacac

SEQ ID NO: 1779213 - RNA, 22 nt, Homo sapiens
uugagugguaaucauauguguc

SEQ ID NO: 1779214 - RNA, 23 nt, Homo sapiens
cacccacccuccaggaccccagc

SEQ ID NO: 1779215 - RNA, 16 nt, Homo sapiens
ugcccagagcacuuua

SEQ ID NO: 1779216 - RNA, 22 nt, Homo sapiens
gaaaaguggauggaagugucug

SEQ ID NO: 1779217 - RNA, 20 nt, Homo sapiens
cagucucucucugccauggc

SEQ ID NO: 1779218 - RNA, 21 nt, Homo sapiens
ggguggggaagaagacacaga

SEQ ID NO: 1779219 - RNA, 18 nt, Homo sapiens
cacccuggaggcaccugg

SEQ ID NO: 1779220 - RNA, 16 nt, Homo sapiens
agggcacucacaugcc

SEQ ID NO: 1779221 - RNA, 13 nt, Homo sapiens
cagagcauuucaa

SEQ ID NO: 1779222 - RNA, 18 nt, Homo sapiens
agaaugggauuggcaagu

SEQ ID NO: 1779223 - RNA, 23 nt, Homo sapiens
ccaggcuagaauggaaaacugcc

SEQ ID NO: 1779224 - RNA, 20 nt, Homo sapiens
gcagaugguggagcugaaua

SEQ ID NO: 1779225 - RNA, 23 nt, Homo sapiens
aguuugcuuuuugcguacacaga

SEQ ID NO: 1779226 - RNA, 16 nt, Homo sapiens
ugauaauagauucucu

SEQ ID NO: 1779227 - RNA, 15 nt, Homo sapiens
acaauuaugauagcu

SEQ ID NO: 1779228 - RNA, 12 nt, Homo sapiens
uuugucagaaac

SEQ ID NO: 1779229 - RNA, 17 nt, Homo sapiens
uaagcccagugcacuga

SEQ ID NO: 1779230 - RNA, 12 nt, Homo sapiens
uaguuaaccaau

SEQ ID NO: 1779231 - RNA, 17 nt, Homo sapiens
aaugaaugaauggcuaa

SEQ ID NO: 1779232 - RNA, 21 nt, Homo sapiens
cacaugaucuguuuuucacca

SEQ ID NO: 1779233 - RNA, 17 nt, Homo sapiens
aagagcacacuuggccc

SEQ ID NO: 1779234 - RNA, 17 nt, Homo sapiens
agccccacccaagcaag

SEQ ID NO: 1779235 - RNA, 15 nt, Homo sapiens
gugcguguguguaug

SEQ ID NO: 1779236 - RNA, 15 nt, Homo sapiens
ccuugccuccucacc

SEQ ID NO: 1779237 - RNA, 15 nt, Homo sapiens
gaccauuugacuguu

SEQ ID NO: 1779238 - RNA, 17 nt, Homo sapiens
aagcagaauguacuuga

SEQ ID NO: 1779239 - RNA, 23 nt, Homo sapiens
accuuuauuaaugaacugugaca

SEQ ID NO: 1779240 - RNA, 20 nt, Homo sapiens
uaagaaauuaaggcauuugu

SEQ ID NO: 1779241 - RNA, 16 nt, Homo sapiens
uagcuugcaguuucau

SEQ ID NO: 1779242 - RNA, 18 nt, Homo sapiens
cuagccagaggacuguga

SEQ ID NO: 1779243 - RNA, 16 nt, Homo sapiens
ugucguaggaaaacca

SEQ ID NO: 1779244 - RNA, 23 nt, Homo sapiens
uuacaacuuauaauuacaaugca

SEQ ID NO: 1779245 - RNA, 16 nt, Homo sapiens
cuuccuguaaugcagg

SEQ ID NO: 1779246 - RNA, 19 nt, Homo sapiens
ucuuucuaaaauacaguuc

SEQ ID NO: 1779247 - RNA, 20 nt, Homo sapiens
ggccucucaccucugugccu

SEQ ID NO: 1779248 - RNA, 22 nt, Homo sapiens
uaggugaaaguuaauccacugu

SEQ ID NO: 1779249 - RNA, 17 nt, Homo sapiens
cuggccacccaaacagg

SEQ ID NO: 1779250 - RNA, 19 nt, Homo sapiens
cuagcauaucugccuuuau

SEQ ID NO: 1779251 - RNA, 17 nt, Homo sapiens
cuuuaaucacauucaau

SEQ ID NO: 1779252 - RNA, 10 nt, Homo sapiens
gccuccucau

SEQ ID NO: 1779253 - RNA, 22 nt, Homo sapiens
auaggacuuaaaauagucucau

SEQ ID NO: 1779254 - RNA, 17 nt, Homo sapiens
augagcuaaaacaucca

SEQ ID NO: 1779255 - RNA, 11 nt, Homo sapiens
gggccaucuca

SEQ ID NO: 1779256 - RNA, 22 nt, Homo sapiens
uggagacuggaaaaauccugag

SEQ ID NO: 1779257 - RNA, 19 nt, Homo sapiens
ucuuugcuucacagguuuu

SEQ ID NO: 1779258 - RNA, 16 nt, Homo sapiens
gcucucuaagaauuca

SEQ ID NO: 1779259 - RNA, 20 nt, Homo sapiens
cuguguuuucgaugaugaug

SEQ ID NO: 1779260 - RNA, 19 nt, Homo sapiens
ugagagaggccacacuaca

SEQ ID NO: 1779261 - RNA, 18 nt, Homo sapiens
gcaaacagaaaaagaagg

SEQ ID NO: 1779262 - RNA, 15 nt, Homo sapiens
ccacuuaucugauca

SEQ ID NO: 1779263 - RNA, 13 nt, Homo sapiens
uugauagauuucu

SEQ ID NO: 1779264 - RNA, 23 nt, Homo sapiens
cugcuggggcugaacaugccugc

SEQ ID NO: 1779265 - RNA, 17 nt, Homo sapiens
caaaacccugaagccau

SEQ ID NO: 1779266 - RNA, 14 nt, Homo sapiens
ggagacgccucucc

SEQ ID NO: 1779267 - RNA, 19 nt, Homo sapiens
cccuaugugggugggacca

SEQ ID NO: 1779268 - RNA, 18 nt, Homo sapiens
cgagcuacucucuugcca

SEQ ID NO: 1779269 - RNA, 14 nt, Homo sapiens
ugccucaacacuga

SEQ ID NO: 1779270 - RNA, 16 nt, Homo sapiens
ccuugaguguguuacc

SEQ ID NO: 1779271 - RNA, 21 nt, Homo sapiens
uuuuaugccuucacuuuacaa

SEQ ID NO: 1779272 - RNA, 15 nt, Homo sapiens
auccaaaacacaaac

SEQ ID NO: 1779273 - RNA, 15 nt, Homo sapiens
cacccacaaucacaa

SEQ ID NO: 1779274 - RNA, 20 nt, Homo sapiens
uggguuggagggaaccacca

SEQ ID NO: 1779275 - RNA, 18 nt, Homo sapiens
auuucccugcagaccuca

SEQ ID NO: 1779276 - RNA, 16 nt, Homo sapiens
ggguaacuugcaccuc

SEQ ID NO: 1779277 - RNA, 14 nt, Homo sapiens
accucugcacuacu

SEQ ID NO: 1779278 - RNA, 21 nt, Homo sapiens
aggauguggaagagcauuagc

SEQ ID NO: 1779279 - RNA, 15 nt, Homo sapiens
ugcauucacccagac

SEQ ID NO: 1779280 - RNA, 19 nt, Homo sapiens
ugcuucaggauaccauaua

SEQ ID NO: 1779281 - RNA, 13 nt, Homo sapiens
ucagaacugaaau

SEQ ID NO: 1779282 - RNA, 12 nt, Homo sapiens
cuuaagauuugg

SEQ ID NO: 1779283 - RNA, 20 nt, Homo sapiens
aaauucaggaugcugugaua

SEQ ID NO: 1779284 - RNA, 23 nt, Homo sapiens
acacaaggucauggccacacugu

SEQ ID NO: 1779285 - RNA, 19 nt, Homo sapiens
ccuaauccaggcagaucca

SEQ ID NO: 1779286 - RNA, 17 nt, Homo sapiens
cuucugccuaacuugua

SEQ ID NO: 1779287 - RNA, 19 nt, Homo sapiens
guacucuuuaaacaguuuu

SEQ ID NO: 1779288 - RNA, 16 nt, Homo sapiens
cuucuugugaucuugc

SEQ ID NO: 1779289 - RNA, 18 nt, Homo sapiens
gccuggcuggaauacuua

SEQ ID NO: 1779290 - RNA, 20 nt, Homo sapiens
uagucaagugcguccacgag

SEQ ID NO: 1779291 - RNA, 20 nt, Homo sapiens
gcugggugaccgacuacccc

SEQ ID NO: 1779292 - RNA, 17 nt, Homo sapiens
aagcauucuaaaugaac

SEQ ID NO: 1779293 - RNA, 22 nt, Homo sapiens
uugaucuugaacuccugaccuc

SEQ ID NO: 1779294 - RNA, 14 nt, Homo sapiens
cugccgucuucacu

SEQ ID NO: 1779295 - RNA, 21 nt, Homo sapiens
guuuuaucaguagaaguguca

SEQ ID NO: 1779296 - RNA, 13 nt, Homo sapiens
gaucccucugggc

SEQ ID NO: 1779297 - RNA, 22 nt, Homo sapiens
uguaacccaccuugaccauaaa

SEQ ID NO: 1779298 - RNA, 18 nt, Homo sapiens
gaaaucaguaaacacugu

SEQ ID NO: 1779299 - RNA, 14 nt, Homo sapiens
uaagauacacuccu

SEQ ID NO: 1779300 - RNA, 21 nt, Homo sapiens
uaaaacccagcauguacaaaa

SEQ ID NO: 1779301 - RNA, 12 nt, Homo sapiens
gguacuaugcag

SEQ ID NO: 1779302 - RNA, 15 nt, Homo sapiens
uaauuguguggauuc

SEQ ID NO: 1779303 - RNA, 20 nt, Homo sapiens
aaaaucugaaaaugugaaua

SEQ ID NO: 1779304 - RNA, 20 nt, Homo sapiens
ucuuggaaucaugcaaaaaa

SEQ ID NO: 1779305 - RNA, 13 nt, Homo sapiens
aagcauacuucua

SEQ ID NO: 1779306 - RNA, 17 nt, Homo sapiens
aguaaagucaacauaug

SEQ ID NO: 1779307 - RNA, 20 nt, Homo sapiens
agauguuucacugacaguuu

SEQ ID NO: 1779308 - RNA, 13 nt, Homo sapiens
gaaauaaaagccu

SEQ ID NO: 1779309 - RNA, 12 nt, Homo sapiens
ggaggcacuuua

SEQ ID NO: 1779310 - RNA, 18 nt, Homo sapiens
uaggcuuuuaaaagcauu

SEQ ID NO: 1779311 - RNA, 12 nt, Homo sapiens
cucagaccucca

SEQ ID NO: 1779312 - RNA, 17 nt, Homo sapiens
ucuguaggaaacccaac

SEQ ID NO: 1779313 - RNA, 13 nt, Homo sapiens
uuaauuuguccuu

SEQ ID NO: 1779314 - RNA, 21 nt, Homo sapiens
guuuuuauuuagcauggggau

SEQ ID NO: 1779315 - RNA, 15 nt, Homo sapiens
ugccaccugucuguc

SEQ ID NO: 1779316 - RNA, 23 nt, Homo sapiens
accccuaguugagagcaccuugc

SEQ ID NO: 1779317 - RNA, 17 nt, Homo sapiens
agcauauacugaagucu

SEQ ID NO: 1779318 - RNA, 21 nt, Homo sapiens
cccuuuagcgggacucaguga

SEQ ID NO: 1779319 - RNA, 20 nt, Homo sapiens
ucuuucaugggcaccaaccu

SEQ ID NO: 1779320 - RNA, 17 nt, Homo sapiens
aaccgugguuacuguau

SEQ ID NO: 1779321 - RNA, 14 nt, Homo sapiens
gugaggcugugucu

SEQ ID NO: 1779322 - RNA, 20 nt, Homo sapiens
cuccuggcaaucugucagaa

SEQ ID NO: 1779323 - RNA, 14 nt, Homo sapiens
gauaguucauucau

SEQ ID NO: 1779324 - RNA, 17 nt, Homo sapiens
augugcuggacacuguc

SEQ ID NO: 1779325 - RNA, 14 nt, Homo sapiens
agugaggaaagccu

SEQ ID NO: 1779326 - RNA, 15 nt, Homo sapiens
cugguggaccacagg

SEQ ID NO: 1779327 - RNA, 17 nt, Homo sapiens
agugcauuugagcacac

SEQ ID NO: 1779328 - RNA, 18 nt, Homo sapiens
gaguuaaugauggcagag

SEQ ID NO: 1779329 - RNA, 15 nt, Homo sapiens
uacaagguuguucau

SEQ ID NO: 1779330 - RNA, 15 nt, Homo sapiens
uccucagcuuaucuc

SEQ ID NO: 1779331 - RNA, 17 nt, Homo sapiens
cagcacucgaugacaca

SEQ ID NO: 1779332 - RNA, 20 nt, Homo sapiens
aucuaccugcccucucucag

SEQ ID NO: 1779333 - RNA, 20 nt, Homo sapiens
auguuuauaaagguaaaaug

SEQ ID NO: 1779334 - RNA, 14 nt, Homo sapiens
cuauguauaucuuc

SEQ ID NO: 1779335 - RNA, 21 nt, Homo sapiens
auucucuggcuguaaggcucu

SEQ ID NO: 1779336 - RNA, 14 nt, Homo sapiens
caugcacacggcug

SEQ ID NO: 1779337 - RNA, 17 nt, Homo sapiens
uaccacugagaccuuca

SEQ ID NO: 1779338 - RNA, 14 nt, Homo sapiens
cauucugaaucaga

SEQ ID NO: 1779339 - RNA, 20 nt, Homo sapiens
gcccaggcuggaaugcagug

SEQ ID NO: 1779340 - RNA, 21 nt, Homo sapiens
cauuggaaaauuuaagacaag

SEQ ID NO: 1779341 - RNA, 15 nt, Homo sapiens
ggauguguuuugcac

SEQ ID NO: 1779342 - RNA, 19 nt, Homo sapiens
uccugccucuacugggaag

SEQ ID NO: 1779343 - RNA, 15 nt, Homo sapiens
ucuucaccucuucca

SEQ ID NO: 1779344 - RNA, 14 nt, Homo sapiens
aucauaugccugac

SEQ ID NO: 1779345 - RNA, 22 nt, Homo sapiens
augguguagcccucccacuuug

SEQ ID NO: 1779346 - RNA, 13 nt, Homo sapiens
gagacaaauggag

SEQ ID NO: 1779347 - RNA, 14 nt, Homo sapiens
uaugugcauuucaa

SEQ ID NO: 1779348 - RNA, 14 nt, Homo sapiens
caugugcacuucaa

SEQ ID NO: 1779349 - RNA, 22 nt, Homo sapiens
uccccggaccggacgcaugcag

SEQ ID NO: 1779350 - RNA, 17 nt, Homo sapiens
ccaucaaggguacacug

SEQ ID NO: 1779351 - RNA, 23 nt, Homo sapiens
ucugggagaaaugagauaaaaga

SEQ ID NO: 1779352 - RNA, 14 nt, Homo sapiens
aguuaaagguugcc

SEQ ID NO: 1779353 - RNA, 19 nt, Homo sapiens
ucuguguauauuauuuggc

SEQ ID NO: 1779354 - RNA, 16 nt, Homo sapiens
ccuugggcaguucuca

SEQ ID NO: 1779355 - RNA, 16 nt, Homo sapiens
cccuggccagcucuga

SEQ ID NO: 1779356 - RNA, 13 nt, Homo sapiens
aagcagauuuucc

SEQ ID NO: 1779357 - RNA, 20 nt, Homo sapiens
aauuagucaaaccacuguua

SEQ ID NO: 1779358 - RNA, 15 nt, Homo sapiens
uaauuuuuaaagguu

SEQ ID NO: 1779359 - RNA, 11 nt, Homo sapiens
gcauguucuca

SEQ ID NO: 1779360 - RNA, 17 nt, Homo sapiens
acaugucuugacuguua

SEQ ID NO: 1779361 - RNA, 21 nt, Homo sapiens
uauugcuaaaagcauguauag

SEQ ID NO: 1779362 - RNA, 15 nt, Homo sapiens
augcuaugucauuuc

SEQ ID NO: 1779363 - RNA, 15 nt, Homo sapiens
gugaaccugccuugg

SEQ ID NO: 1779364 - RNA, 22 nt, Homo sapiens
gagcagccucagaacaaaguga

SEQ ID NO: 1779365 - RNA, 19 nt, Homo sapiens
gauguggagcuacugauga

SEQ ID NO: 1779366 - RNA, 13 nt, Homo sapiens
gcaggcaucgcca

SEQ ID NO: 1779367 - RNA, 21 nt, Homo sapiens
gcgugguauaaucuccauuuc

SEQ ID NO: 1779368 - RNA, 15 nt, Homo sapiens
aguuuaauauuccaa

SEQ ID NO: 1779369 - RNA, 13 nt, Homo sapiens
uucaauacccaaa

SEQ ID NO: 1779370 - RNA, 18 nt, Homo sapiens
aucccaaccagugccaag

SEQ ID NO: 1779371 - RNA, 14 nt, Homo sapiens
accaguguacugcu

SEQ ID NO: 1779372 - RNA, 12 nt, Homo sapiens
acacaacacaga

SEQ ID NO: 1779373 - RNA, 13 nt, Homo sapiens
ugugugucuucag

SEQ ID NO: 1779374 - RNA, 15 nt, Homo sapiens
auucuauuuacuuga

SEQ ID NO: 1779375 - RNA, 21 nt, Homo sapiens
aggcagggccuugcccagaga

SEQ ID NO: 1779376 - RNA, 13 nt, Homo sapiens
cugaggcuuagga

SEQ ID NO: 1779377 - RNA, 23 nt, Homo sapiens
aguccuugauuucaaaguuuugu

SEQ ID NO: 1779378 - RNA, 16 nt, Homo sapiens
auguuaaccaauguau

SEQ ID NO: 1779379 - RNA, 13 nt, Homo sapiens
ucaaugaacugug

SEQ ID NO: 1779380 - RNA, 22 nt, Homo sapiens
gacagaggcugcugcugcugca

SEQ ID NO: 1779381 - RNA, 20 nt, Homo sapiens
ccaacuugguucugcuucaa

SEQ ID NO: 1779382 - RNA, 14 nt, Homo sapiens
ugucggacuaugua

SEQ ID NO: 1779383 - RNA, 23 nt, Homo sapiens
cccaggaggcagcuguugcagug

SEQ ID NO: 1779384 - RNA, 13 nt, Homo sapiens
cuugauuuuugcc

SEQ ID NO: 1779385 - RNA, 23 nt, Homo sapiens
ucccugucauuuuuaacagcaug

SEQ ID NO: 1779386 - RNA, 19 nt, Homo sapiens
cuuauaagaaagaucaaag

SEQ ID NO: 1779387 - RNA, 19 nt, Homo sapiens
uccccacugccuacugcau

SEQ ID NO: 1779388 - RNA, 16 nt, Homo sapiens
uccugcaaaccucaca

SEQ ID NO: 1779389 - RNA, 15 nt, Homo sapiens
aauaguauagacaau

SEQ ID NO: 1779390 - RNA, 19 nt, Homo sapiens
aaacacaagacugucauua

SEQ ID NO: 1779391 - RNA, 11 nt, Homo sapiens
ugcacuuuccu

SEQ ID NO: 1779392 - RNA, 21 nt, Homo sapiens
ucaggacucaaucuacaggcc

SEQ ID NO: 1779393 - RNA, 20 nt, Homo sapiens
gcauugccuuuagugaucac

SEQ ID NO: 1779394 - RNA, 14 nt, Homo sapiens
auaccauugacaca

SEQ ID NO: 1779395 - RNA, 15 nt, Homo sapiens
gacaggcuggugcua

SEQ ID NO: 1779396 - RNA, 13 nt, Homo sapiens
cuggccccaggcg

SEQ ID NO: 1779397 - RNA, 17 nt, Homo sapiens
uuuaauguagagaaaga

SEQ ID NO: 1779398 - RNA, 17 nt, Homo sapiens
gcuugggaaagguggug

SEQ ID NO: 1779399 - RNA, 16 nt, Homo sapiens
aggaaggagauuccac

SEQ ID NO: 1779400 - RNA, 19 nt, Homo sapiens
aggaccaagggcaccugga

SEQ ID NO: 1779401 - RNA, 20 nt, Homo sapiens
gcaauuuuuccaaaagccag

SEQ ID NO: 1779402 - RNA, 16 nt, Homo sapiens
ugcaacuuuguauaaa

SEQ ID NO: 1779403 - RNA, 23 nt, Homo sapiens
uaccaagagugggcuuuguggaa

SEQ ID NO: 1779404 - RNA, 13 nt, Homo sapiens
agauugaugugca

SEQ ID NO: 1779405 - RNA, 17 nt, Homo sapiens
uccuccagggagucuca

SEQ ID NO: 1779406 - RNA, 22 nt, Homo sapiens
ucaggggcaccuccggcugccu

SEQ ID NO: 1779407 - RNA, 22 nt, Homo sapiens
uaugaucuaugcuauauucaaa

SEQ ID NO: 1779408 - RNA, 20 nt, Homo sapiens
accucuagugcuacugcuag

SEQ ID NO: 1779409 - RNA, 20 nt, Homo sapiens
agcgcuucugcugaaaguuc

SEQ ID NO: 1779410 - RNA, 16 nt, Homo sapiens
aaacuacuuugaauag

SEQ ID NO: 1779411 - RNA, 15 nt, Homo sapiens
ccaacaacugucaga

SEQ ID NO: 1779412 - RNA, 16 nt, Homo sapiens
gagugugguuccaaga

SEQ ID NO: 1779413 - RNA, 20 nt, Homo sapiens
accauacuuuauauauguac

SEQ ID NO: 1779414 - RNA, 14 nt, Homo sapiens
gugaucaaagccac

SEQ ID NO: 1779415 - RNA, 19 nt, Homo sapiens
cuggauggggagucucaug

SEQ ID NO: 1779416 - RNA, 17 nt, Homo sapiens
cugcauuuuaagcauaa

SEQ ID NO: 1779417 - RNA, 19 nt, Homo sapiens
ccacugccugcccagugcc

SEQ ID NO: 1779418 - RNA, 13 nt, Homo sapiens
uagggagacaaca

SEQ ID NO: 1779419 - RNA, 16 nt, Homo sapiens
acaggaaaguuccaga

SEQ ID NO: 1779420 - RNA, 13 nt, Homo sapiens
aaaucucacaaau

SEQ ID NO: 1779421 - RNA, 17 nt, Homo sapiens
aggagagucuugcagug

SEQ ID NO: 1779422 - RNA, 14 nt, Homo sapiens
caaucaaaugucug

SEQ ID NO: 1779423 - RNA, 15 nt, Homo sapiens
auaaauauacauaua

SEQ ID NO: 1779424 - RNA, 15 nt, Homo sapiens
gcuucauuguuacau

SEQ ID NO: 1779425 - RNA, 13 nt, Homo sapiens
acucccagcacuc

SEQ ID NO: 1779426 - RNA, 13 nt, Homo sapiens
gcuguacccagau

SEQ ID NO: 1779427 - RNA, 13 nt, Homo sapiens
ccugcauguucug

SEQ ID NO: 1779428 - RNA, 20 nt, Homo sapiens
aaauguaucaacacacauuu

SEQ ID NO: 1779429 - RNA, 22 nt, Homo sapiens
uaugguuaauaaguuucacuga

SEQ ID NO: 1779430 - RNA, 22 nt, Homo sapiens
ugccagccgccaccggggcaca

SEQ ID NO: 1779431 - RNA, 21 nt, Homo sapiens
aacagcguguaaacacauguu

SEQ ID NO: 1779432 - RNA, 12 nt, Homo sapiens
gccucagccagg

SEQ ID NO: 1779433 - RNA, 18 nt, Homo sapiens
ucuuaaaaugggaucuca

SEQ ID NO: 1779434 - RNA, 18 nt, Homo sapiens
ccagucuauuuccacuga

SEQ ID NO: 1779435 - RNA, 14 nt, Homo sapiens
augcagauacuuau

SEQ ID NO: 1779436 - RNA, 21 nt, Homo sapiens
caauuaugugacaaccuuugu

SEQ ID NO: 1779437 - RNA, 17 nt, Homo sapiens
uuaaggugaguucucac

SEQ ID NO: 1779438 - RNA, 19 nt, Homo sapiens
uagucagggcaugcuuuau

SEQ ID NO: 1779439 - RNA, 17 nt, Homo sapiens
gccucgcagccuccgga

SEQ ID NO: 1779440 - RNA, 14 nt, Homo sapiens
cugccuuguguaca

SEQ ID NO: 1779441 - RNA, 15 nt, Homo sapiens
uggaccacagugacu

SEQ ID NO: 1779442 - RNA, 14 nt, Homo sapiens
acccaggguggucu

SEQ ID NO: 1779443 - RNA, 18 nt, Homo sapiens
ucaagaaggaagauuuga

SEQ ID NO: 1779444 - RNA, 15 nt, Homo sapiens
ggccugagauuucau

SEQ ID NO: 1779445 - RNA, 14 nt, Homo sapiens
aauagauacaagag

SEQ ID NO: 1779446 - RNA, 14 nt, Homo sapiens
agaaggaucuucau

SEQ ID NO: 1779447 - RNA, 17 nt, Homo sapiens
ggccacgggggcagugu

SEQ ID NO: 1779448 - RNA, 18 nt, Homo sapiens
gccagaccauggacacua

SEQ ID NO: 1779449 - RNA, 23 nt, Homo sapiens
caaagcagggucugggcaggacu

SEQ ID NO: 1779450 - RNA, 19 nt, Homo sapiens
ugguuaguuaaaagcccau

SEQ ID NO: 1779451 - RNA, 20 nt, Homo sapiens
agccugaccaaaauggugaa

SEQ ID NO: 1779452 - RNA, 17 nt, Homo sapiens
agcauggaacaaagcau

SEQ ID NO: 1779453 - RNA, 21 nt, Homo sapiens
caaagagaaugagaagacaug

SEQ ID NO: 1779454 - RNA, 23 nt, Homo sapiens
uaaccucccacccugcaaaggga

SEQ ID NO: 1779455 - RNA, 17 nt, Homo sapiens
ccuauuaaaacacagcu

SEQ ID NO: 1779456 - RNA, 20 nt, Homo sapiens
gaauguguuauuugucacaa

SEQ ID NO: 1779457 - RNA, 18 nt, Homo sapiens
uuuaucacuucauucaca

SEQ ID NO: 1779458 - RNA, 19 nt, Homo sapiens
acaggucuugcccaaaguc

SEQ ID NO: 1779459 - RNA, 12 nt, Homo sapiens
agggacugccuc

SEQ ID NO: 1779460 - RNA, 12 nt, Homo sapiens
aggcacugccug

SEQ ID NO: 1779461 - RNA, 17 nt, Homo sapiens
cuguuccauaguuaaag

SEQ ID NO: 1779462 - RNA, 17 nt, Homo sapiens
agccccacccuccuuga

SEQ ID NO: 1779463 - RNA, 23 nt, Homo sapiens
ucccucuacugggagccuaccca

SEQ ID NO: 1779464 - RNA, 18 nt, Homo sapiens
aagagugguggcagcuca

SEQ ID NO: 1779465 - RNA, 13 nt, Homo sapiens
uauauuucugaua

SEQ ID NO: 1779466 - RNA, 20 nt, Homo sapiens
cagccucuagaacagccaga

SEQ ID NO: 1779467 - RNA, 17 nt, Homo sapiens
cccuggcuaacagucua

SEQ ID NO: 1779468 - RNA, 16 nt, Homo sapiens
aaguuuuucacuuugg

SEQ ID NO: 1779469 - RNA, 21 nt, Homo sapiens
uacaacgccgagugcacugca

SEQ ID NO: 1779470 - RNA, 22 nt, Homo sapiens
aucuguccagaggcugcaagga

SEQ ID NO: 1779471 - RNA, 19 nt, Homo sapiens
aaaaugguggucuucucca

SEQ ID NO: 1779472 - RNA, 23 nt, Homo sapiens
aagccucugcgucuuuuuacuca

SEQ ID NO: 1779473 - RNA, 19 nt, Homo sapiens
guuggaaaucaguugugaa

SEQ ID NO: 1779474 - RNA, 16 nt, Homo sapiens
ugacaugauauacaau

SEQ ID NO: 1779475 - RNA, 12 nt, Homo sapiens
agucacagccau

SEQ ID NO: 1779476 - RNA, 17 nt, Homo sapiens
gcuuccuggguccugcc

SEQ ID NO: 1779477 - RNA, 13 nt, Homo sapiens
cuuacaauggaca

SEQ ID NO: 1779478 - RNA, 16 nt, Homo sapiens
auaacuaaacuaacga

SEQ ID NO: 1779479 - RNA, 16 nt, Homo sapiens
aaagggagugcaugug

SEQ ID NO: 1779480 - RNA, 23 nt, Homo sapiens
acaaaaccgcauucagugcaccu

SEQ ID NO: 1779481 - RNA, 22 nt, Homo sapiens
uuugaagucuucccucagauuu

SEQ ID NO: 1779482 - RNA, 21 nt, Homo sapiens
ugagcuggaguucagcaguga

SEQ ID NO: 1779483 - RNA, 14 nt, Homo sapiens
cucucugaaccuca

SEQ ID NO: 1779484 - RNA, 13 nt, Homo sapiens
ugaaaaaaguaua

SEQ ID NO: 1779485 - RNA, 18 nt, Homo sapiens
uguacaaaauaacucucc

SEQ ID NO: 1779486 - RNA, 15 nt, Homo sapiens
aauuacugugaauug

SEQ ID NO: 1779487 - RNA, 14 nt, Homo sapiens
cacaauaaauguau

SEQ ID NO: 1779488 - RNA, 14 nt, Homo sapiens
accuaccacauuca

SEQ ID NO: 1779489 - RNA, 19 nt, Homo sapiens
ggcaucaggucugggcaag

SEQ ID NO: 1779490 - RNA, 19 nt, Homo sapiens
auaccuuccccacaucuga

SEQ ID NO: 1779491 - RNA, 14 nt, Homo sapiens
cguggagagugcac

SEQ ID NO: 1779492 - RNA, 15 nt, Homo sapiens
gacaaaacauacauu

SEQ ID NO: 1779493 - RNA, 14 nt, Homo sapiens
aaagaaauuaucuu

SEQ ID NO: 1779494 - RNA, 13 nt, Homo sapiens
uuauuuccacuua

SEQ ID NO: 1779495 - RNA, 22 nt, Homo sapiens
uaagaagaaauacccacuaaca

SEQ ID NO: 1779496 - RNA, 12 nt, Homo sapiens
uugagggccaaa

SEQ ID NO: 1779497 - RNA, 15 nt, Homo sapiens
acagguuacaugaga

SEQ ID NO: 1779498 - RNA, 14 nt, Homo sapiens
agcagguggcagaa

SEQ ID NO: 1779499 - RNA, 21 nt, Homo sapiens
cgaaaccugggauucaggaau

SEQ ID NO: 1779500 - RNA, 18 nt, Homo sapiens
uggcuucgucauuugcaa

SEQ ID NO: 1779501 - RNA, 20 nt, Homo sapiens
agaaaacaggcucacagaga

SEQ ID NO: 1779502 - RNA, 12 nt, Homo sapiens
cguuaccagaga

SEQ ID NO: 1779503 - RNA, 17 nt, Homo sapiens
cagccuagugaacugca

SEQ ID NO: 1779504 - RNA, 17 nt, Homo sapiens
aauguuuacaguggaau

SEQ ID NO: 1779505 - RNA, 19 nt, Homo sapiens
aaaauccacugacgaucau

SEQ ID NO: 1779506 - RNA, 22 nt, Homo sapiens
ucaagcuaauaaaauaucauuc

SEQ ID NO: 1779507 - RNA, 16 nt, Homo sapiens
gacuccagcugugaag

SEQ ID NO: 1779508 - RNA, 14 nt, Homo sapiens
cugcaccuugugaa

SEQ ID NO: 1779509 - RNA, 22 nt, Homo sapiens
gcagaagugcaauccagcccau

SEQ ID NO: 1779510 - RNA, 23 nt, Homo sapiens
cuagugagcaaaauaugccccuu

SEQ ID NO: 1779511 - RNA, 19 nt, Homo sapiens
uccaaccagauugucagcu

SEQ ID NO: 1779512 - RNA, 19 nt, Homo sapiens
uauuuaacuggagcagaga

SEQ ID NO: 1779513 - RNA, 18 nt, Homo sapiens
ccuugacuugccaugaag

SEQ ID NO: 1779514 - RNA, 19 nt, Homo sapiens
ggaccaucugcugcaguua

SEQ ID NO: 1779515 - RNA, 15 nt, Homo sapiens
ucccugauuauuuau

SEQ ID NO: 1779516 - RNA, 19 nt, Homo sapiens
uucagugccaaaaacaaca

SEQ ID NO: 1779517 - RNA, 22 nt, Homo sapiens
gcagucagggugggaagaaaga

SEQ ID NO: 1779518 - RNA, 19 nt, Homo sapiens
auuucagaucauauuucac

SEQ ID NO: 1779519 - RNA, 10 nt, Homo sapiens
gcagcauucc

SEQ ID NO: 1779520 - RNA, 20 nt, Homo sapiens
aucucgcaguacauguuacu

SEQ ID NO: 1779521 - RNA, 22 nt, Homo sapiens
uauguucaacuggagacacuau

SEQ ID NO: 1779522 - RNA, 14 nt, Homo sapiens
aagaaaacauuuug

SEQ ID NO: 1779523 - RNA, 12 nt, Homo sapiens
uauagccuuuaa

SEQ ID NO: 1779524 - RNA, 20 nt, Homo sapiens
acagggucucacucugucgc

SEQ ID NO: 1779525 - RNA, 21 nt, Homo sapiens
uccccaauccaacccaugcau

SEQ ID NO: 1779526 - RNA, 13 nt, Homo sapiens
cucuauguaugca

SEQ ID NO: 1779527 - RNA, 15 nt, Homo sapiens
acauaccaugugcca

SEQ ID NO: 1779528 - RNA, 15 nt, Homo sapiens
caauucuucuucuca

SEQ ID NO: 1779529 - RNA, 13 nt, Homo sapiens
uuggagugagaug

SEQ ID NO: 1779530 - RNA, 16 nt, Homo sapiens
ccugggcagugcuccu

SEQ ID NO: 1779531 - RNA, 16 nt, Homo sapiens
ugcuaggaacaugugg

SEQ ID NO: 1779532 - RNA, 15 nt, Homo sapiens
ccuaaaucccaagaa

SEQ ID NO: 1779533 - RNA, 19 nt, Homo sapiens
gauuaaagguggugccaau

SEQ ID NO: 1779534 - RNA, 16 nt, Homo sapiens
agccagaagucacauu

SEQ ID NO: 1779535 - RNA, 18 nt, Homo sapiens
ucagaagccuucuugcug

SEQ ID NO: 1779536 - RNA, 12 nt, Homo sapiens
aauauuugcuca

SEQ ID NO: 1779537 - RNA, 17 nt, Homo sapiens
auuccugcuuaauguca

SEQ ID NO: 1779538 - RNA, 20 nt, Homo sapiens
cugguauauguaaguguuca

SEQ ID NO: 1779539 - RNA, 14 nt, Homo sapiens
cuugacggcauugc

SEQ ID NO: 1779540 - RNA, 16 nt, Homo sapiens
agcugaauucacuuaa

SEQ ID NO: 1779541 - RNA, 21 nt, Homo sapiens
ugagacccucgccacggggag

SEQ ID NO: 1779542 - RNA, 11 nt, Homo sapiens
uuaucugcuag

SEQ ID NO: 1779543 - RNA, 19 nt, Homo sapiens
acacugcagaacagcauca

SEQ ID NO: 1779544 - RNA, 19 nt, Homo sapiens
ugacuuccccacugcucuc

SEQ ID NO: 1779545 - RNA, 13 nt, Homo sapiens
cuggauggcacca

SEQ ID NO: 1779546 - RNA, 20 nt, Homo sapiens
cccagaaaaggcggugcuca

SEQ ID NO: 1779547 - RNA, 13 nt, Homo sapiens
uccuaaugcuuuu

SEQ ID NO: 1779548 - RNA, 14 nt, Homo sapiens
agcaccaaagggaa

SEQ ID NO: 1779549 - RNA, 14 nt, Homo sapiens
gccuccugcaaagu

SEQ ID NO: 1779550 - RNA, 15 nt, Homo sapiens
gccccacugcacucc

SEQ ID NO: 1779551 - RNA, 13 nt, Homo sapiens
gccuguccaggaa

SEQ ID NO: 1779552 - RNA, 23 nt, Homo sapiens
cugcaugcugcuggacaguauca

SEQ ID NO: 1779553 - RNA, 15 nt, Homo sapiens
gccccacgugcuccc

SEQ ID NO: 1779554 - RNA, 14 nt, Homo sapiens
cucaggugcugucc

SEQ ID NO: 1779555 - RNA, 18 nt, Homo sapiens
caaugucugccacacaaa

SEQ ID NO: 1779556 - RNA, 21 nt, Homo sapiens
uucuuucuaauacaagcauau

SEQ ID NO: 1779557 - RNA, 19 nt, Homo sapiens
gccacauacaccacaaaaa

SEQ ID NO: 1779558 - RNA, 21 nt, Homo sapiens
ggauggggcagucucugccca

SEQ ID NO: 1779559 - RNA, 18 nt, Homo sapiens
ccacauuugguucuaaga

SEQ ID NO: 1779560 - RNA, 14 nt, Homo sapiens
gagguuugcaaauc

SEQ ID NO: 1779561 - RNA, 15 nt, Homo sapiens
uagaauugauuucca

SEQ ID NO: 1779562 - RNA, 12 nt, Homo sapiens
uuuccuuaccau

SEQ ID NO: 1779563 - RNA, 15 nt, Homo sapiens
cuauuccauucccuu

SEQ ID NO: 1779564 - RNA, 17 nt, Homo sapiens
acgaauauggacauauc

SEQ ID NO: 1779565 - RNA, 12 nt, Homo sapiens
aggcuggcuugu

SEQ ID NO: 1779566 - RNA, 16 nt, Homo sapiens
uugcaguuuuuuccua

SEQ ID NO: 1779567 - RNA, 15 nt, Homo sapiens
augcuggccuugcca

SEQ ID NO: 1779568 - RNA, 23 nt, Homo sapiens
ucagaccucggugggcauucaca

SEQ ID NO: 1779569 - RNA, 17 nt, Homo sapiens
agacauggagguucuaa

SEQ ID NO: 1779570 - RNA, 22 nt, Homo sapiens
aacuuaaaaaaaaaauucugcc

SEQ ID NO: 1779571 - RNA, 16 nt, Homo sapiens
cuuugcccccuugccc

SEQ ID NO: 1779572 - RNA, 16 nt, Homo sapiens
ccgacccacugaccca

SEQ ID NO: 1779573 - RNA, 16 nt, Homo sapiens
auuuguguacuugugu

SEQ ID NO: 1779574 - RNA, 18 nt, Homo sapiens
acuagaguauguguaugu

SEQ ID NO: 1779575 - RNA, 18 nt, Homo sapiens
gcuugaaugugagugugu

SEQ ID NO: 1779576 - RNA, 22 nt, Homo sapiens
caaaguagggaugcggauccug

SEQ ID NO: 1779577 - RNA, 18 nt, Homo sapiens
caauaugaugacucccuu

SEQ ID NO: 1779578 - RNA, 12 nt, Homo sapiens
acauguguaccu

SEQ ID NO: 1779579 - RNA, 18 nt, Homo sapiens
gcugaguuccggggugca

SEQ ID NO: 1779580 - RNA, 13 nt, Homo sapiens
cagaauuuuccau

SEQ ID NO: 1779581 - RNA, 16 nt, Homo sapiens
auaauuuucacaugaa

SEQ ID NO: 1779582 - RNA, 21 nt, Homo sapiens
aacagugcuaaaaaugggacu

SEQ ID NO: 1779583 - RNA, 16 nt, Homo sapiens
gaagcaccuaaaugau

SEQ ID NO: 1779584 - RNA, 23 nt, Homo sapiens
cugguaacguggcuccaccuuga

SEQ ID NO: 1779585 - RNA, 16 nt, Homo sapiens
uuaauuaugcuaacaa

SEQ ID NO: 1779586 - RNA, 15 nt, Homo sapiens
gugcccgaguagcau

SEQ ID NO: 1779587 - RNA, 17 nt, Homo sapiens
ccacugauggugacagg

SEQ ID NO: 1779588 - RNA, 23 nt, Homo sapiens
ggccaauaacuuuucaccaauga

SEQ ID NO: 1779589 - RNA, 12 nt, Homo sapiens
acuuuauucuug

SEQ ID NO: 1779590 - RNA, 14 nt, Homo sapiens
ggcaaccacauguc

SEQ ID NO: 1779591 - RNA, 18 nt, Homo sapiens
uugcaauggaucagccaa

SEQ ID NO: 1779592 - RNA, 17 nt, Homo sapiens
uauuacucagcacagag

SEQ ID NO: 1779593 - RNA, 17 nt, Homo sapiens
cuggauggcccauagac

SEQ ID NO: 1779594 - RNA, 20 nt, Homo sapiens
ucuuuugacauaacuaucuu

SEQ ID NO: 1779595 - RNA, 20 nt, Homo sapiens
cucccuugcucagugccucc

SEQ ID NO: 1779596 - RNA, 23 nt, Homo sapiens
cuccuggaaaggcucagucucag

SEQ ID NO: 1779597 - RNA, 16 nt, Homo sapiens
cuuuuacuaagcacug

SEQ ID NO: 1779598 - RNA, 17 nt, Homo sapiens
gguccugugaucuuauu

SEQ ID NO: 1779599 - RNA, 17 nt, Homo sapiens
cauuucaauuccuguga

SEQ ID NO: 1779600 - RNA, 22 nt, Homo sapiens
ggcgcuugcaccacuuccgucc

SEQ ID NO: 1779601 - RNA, 21 nt, Homo sapiens
ucaggacacccuacacaaaau

SEQ ID NO: 1779602 - RNA, 18 nt, Homo sapiens
aaaccuauuccacuuaca

SEQ ID NO: 1779603 - RNA, 17 nt, Homo sapiens
auaaaagguuguguaca

SEQ ID NO: 1779604 - RNA, 14 nt, Homo sapiens
cuagaacauuccau

SEQ ID NO: 1779605 - RNA, 12 nt, Homo sapiens
ugccuucaccuu

SEQ ID NO: 1779606 - RNA, 23 nt, Homo sapiens
uacauagccuauauuuacaguga

SEQ ID NO: 1779607 - RNA, 19 nt, Homo sapiens
ugccugaugggaguaggcu

SEQ ID NO: 1779608 - RNA, 18 nt, Homo sapiens
ucuccacggccugcccag

SEQ ID NO: 1779609 - RNA, 20 nt, Homo sapiens
gagggaaguuuaaaacccaa

SEQ ID NO: 1779610 - RNA, 18 nt, Homo sapiens
cuuucuucaaaaagcauu

SEQ ID NO: 1779611 - RNA, 20 nt, Homo sapiens
caacccucagauuugaugau

SEQ ID NO: 1779612 - RNA, 19 nt, Homo sapiens
uggggagggagguguuuaa

SEQ ID NO: 1779613 - RNA, 14 nt, Homo sapiens
cacucaucacuaaa

SEQ ID NO: 1779614 - RNA, 15 nt, Homo sapiens
auaaucaaagcucau

SEQ ID NO: 1779615 - RNA, 17 nt, Homo sapiens
uucugaaccauuacugu

SEQ ID NO: 1779616 - RNA, 22 nt, Homo sapiens
gcucgccauucacugauuggaa

SEQ ID NO: 1779617 - RNA, 18 nt, Homo sapiens
uguuaaaggucauaugca

SEQ ID NO: 1779618 - RNA, 16 nt, Homo sapiens
auaguuauuuacuuga

SEQ ID NO: 1779619 - RNA, 14 nt, Homo sapiens
gaccccuguccagg

SEQ ID NO: 1779620 - RNA, 18 nt, Homo sapiens
ucguauccccaagccaca

SEQ ID NO: 1779621 - RNA, 18 nt, Homo sapiens
aagaacuaaaauguucua

SEQ ID NO: 1779622 - RNA, 15 nt, Homo sapiens
uacaaagaacucuca

SEQ ID NO: 1779623 - RNA, 20 nt, Homo sapiens
uccaagacagccauacuucc

SEQ ID NO: 1779624 - RNA, 17 nt, Homo sapiens
uaaauucuaagccauau

SEQ ID NO: 1779625 - RNA, 13 nt, Homo sapiens
acucuacuauuaa

SEQ ID NO: 1779626 - RNA, 21 nt, Homo sapiens
gguuggaaagaguugccauaa

SEQ ID NO: 1779627 - RNA, 20 nt, Homo sapiens
gauauaauuuaacuguguuu

SEQ ID NO: 1779628 - RNA, 17 nt, Homo sapiens
aaagaacguggucagag

SEQ ID NO: 1779629 - RNA, 16 nt, Homo sapiens
aacugaaugacuugac

SEQ ID NO: 1779630 - RNA, 23 nt, Homo sapiens
ugggaucaaagcuaggaaaggca

SEQ ID NO: 1779631 - RNA, 19 nt, Homo sapiens
aggguguaauggagcauca

SEQ ID NO: 1779632 - RNA, 22 nt, Homo sapiens
cuucugugaaaaaccugaugca

SEQ ID NO: 1779633 - RNA, 22 nt, Homo sapiens
gcuuccugaaauaaacacuggu

SEQ ID NO: 1779634 - RNA, 19 nt, Homo sapiens
agggacacccacacaggug

SEQ ID NO: 1779635 - RNA, 18 nt, Homo sapiens
ccagaaaucuaaucucug

SEQ ID NO: 1779636 - RNA, 16 nt, Homo sapiens
uccugccccuguucuc

SEQ ID NO: 1779637 - RNA, 19 nt, Homo sapiens
cagaauugcuuguuugcuu

SEQ ID NO: 1779638 - RNA, 21 nt, Homo sapiens
cucccaucucuaccccaaaga

SEQ ID NO: 1779639 - RNA, 14 nt, Homo sapiens
uacagcagcacugu

SEQ ID NO: 1779640 - RNA, 20 nt, Homo sapiens
agaaugggggcuuucgggga

SEQ ID NO: 1779641 - RNA, 23 nt, Homo sapiens
ucaccccagguucucaccucagg

SEQ ID NO: 1779642 - RNA, 14 nt, Homo sapiens
uacucugugggcaa

SEQ ID NO: 1779643 - RNA, 18 nt, Homo sapiens
agccagugaggaugacag

SEQ ID NO: 1779644 - RNA, 12 nt, Homo sapiens
ggcgccaagacu

SEQ ID NO: 1779645 - RNA, 12 nt, Homo sapiens
caagaugccuga

SEQ ID NO: 1779646 - RNA, 13 nt, Homo sapiens
uuuagucaucgaa

SEQ ID NO: 1779647 - RNA, 17 nt, Homo sapiens
guaaagaucuacaugaa

SEQ ID NO: 1779648 - RNA, 19 nt, Homo sapiens
cacugucccccguuugccu

SEQ ID NO: 1779649 - RNA, 21 nt, Homo sapiens
agucuucucauagcauuaacu

SEQ ID NO: 1779650 - RNA, 14 nt, Homo sapiens
aagucaacacucuu

SEQ ID NO: 1779651 - RNA, 16 nt, Homo sapiens
cacuguauauuuugca

SEQ ID NO: 1779652 - RNA, 23 nt, Homo sapiens
aggcugucaggauucuucaagga

SEQ ID NO: 1779653 - RNA, 17 nt, Homo sapiens
caggauuaaaagccaug

SEQ ID NO: 1779654 - RNA, 16 nt, Homo sapiens
gaaacacucaacaaua

SEQ ID NO: 1779655 - RNA, 12 nt, Homo sapiens
aacuagugaugu

SEQ ID NO: 1779656 - RNA, 21 nt, Homo sapiens
auucagucucuucuaagcaaa

SEQ ID NO: 1779657 - RNA, 15 nt, Homo sapiens
gugugagauccucuu

SEQ ID NO: 1779658 - RNA, 15 nt, Homo sapiens
cuacuuuaaauccua

SEQ ID NO: 1779659 - RNA, 22 nt, Homo sapiens
aagaguucccuugaaacuuugg

SEQ ID NO: 1779660 - RNA, 22 nt, Homo sapiens
gauguuugcuguguuucaaacc

SEQ ID NO: 1779661 - RNA, 12 nt, Homo sapiens
cuguacacugcc

SEQ ID NO: 1779662 - RNA, 18 nt, Homo sapiens
cagauaaaggaaggagau

SEQ ID NO: 1779663 - RNA, 23 nt, Homo sapiens
cuguugaaugaaucaacaaacca

SEQ ID NO: 1779664 - RNA, 22 nt, Homo sapiens
ccaaagaccugccugugugcuc

SEQ ID NO: 1779665 - RNA, 19 nt, Homo sapiens
aaccagccacaguacauau

SEQ ID NO: 1779666 - RNA, 23 nt, Homo sapiens
agguccugcuugaacugcugcca

SEQ ID NO: 1779667 - RNA, 23 nt, Homo sapiens
aaguaaacaacucaagggcacau

SEQ ID NO: 1779668 - RNA, 16 nt, Homo sapiens
ucuuguaaacauugcc

SEQ ID NO: 1779669 - RNA, 21 nt, Homo sapiens
auacuagccuagaaauauaga

SEQ ID NO: 1779670 - RNA, 22 nt, Homo sapiens
ugccccacccaguuucuggaaa

SEQ ID NO: 1779671 - RNA, 19 nt, Homo sapiens
uugcccacugucugcuacc

SEQ ID NO: 1779672 - RNA, 23 nt, Homo sapiens
augccucuggaggccucuggccc

SEQ ID NO: 1779673 - RNA, 12 nt, Homo sapiens
cucuaccagucu

SEQ ID NO: 1779674 - RNA, 23 nt, Homo sapiens
acauauaugugucccauaaucug

SEQ ID NO: 1779675 - RNA, 20 nt, Homo sapiens
uccaccuccuggguucaagc

SEQ ID NO: 1779676 - RNA, 20 nt, Homo sapiens
gccauguauaaaugugauau

SEQ ID NO: 1779677 - RNA, 23 nt, Homo sapiens
cacauucuuaaaggaaaagucaa

SEQ ID NO: 1779678 - RNA, 22 nt, Homo sapiens
uccaaugucuuuuuaagcuuau

SEQ ID NO: 1779679 - RNA, 13 nt, Homo sapiens
aucacuacaagcu

SEQ ID NO: 1779680 - RNA, 16 nt, Homo sapiens
gcugagacugugcugu

SEQ ID NO: 1779681 - RNA, 15 nt, Homo sapiens
cuuuuuuaaaggcac

SEQ ID NO: 1779682 - RNA, 12 nt, Homo sapiens
gagacaagcaug

SEQ ID NO: 1779683 - RNA, 15 nt, Homo sapiens
uguauccacaaauca

SEQ ID NO: 1779684 - RNA, 13 nt, Homo sapiens
agcucacugcaag

SEQ ID NO: 1779685 - RNA, 20 nt, Homo sapiens
aaggauauuuucaacaauua

SEQ ID NO: 1779686 - RNA, 20 nt, Homo sapiens
gacuuguuuuaaacuugccu

SEQ ID NO: 1779687 - RNA, 19 nt, Homo sapiens
aagccaggguccugagugg

SEQ ID NO: 1779688 - RNA, 17 nt, Homo sapiens
ggaaauugagguccaug

SEQ ID NO: 1779689 - RNA, 22 nt, Homo sapiens
gcccagacccuucuccuuagaa

SEQ ID NO: 1779690 - RNA, 18 nt, Homo sapiens
guuugauuugcuuuugaa

SEQ ID NO: 1779691 - RNA, 18 nt, Homo sapiens
acugaccgccgcuuccag

SEQ ID NO: 1779692 - RNA, 19 nt, Homo sapiens
agugagaaagacaucugag

SEQ ID NO: 1779693 - RNA, 14 nt, Homo sapiens
ucugggcauugagc

SEQ ID NO: 1779694 - RNA, 14 nt, Homo sapiens
cugacccaccugcg

SEQ ID NO: 1779695 - RNA, 12 nt, Homo sapiens
cacagcugccau

SEQ ID NO: 1779696 - RNA, 20 nt, Homo sapiens
uauuccuaggcaacuauuaa

SEQ ID NO: 1779697 - RNA, 22 nt, Homo sapiens
aguaguaccuuguuuugccaug

SEQ ID NO: 1779698 - RNA, 20 nt, Homo sapiens
aaguaucucaacaacauguc

SEQ ID NO: 1779699 - RNA, 21 nt, Homo sapiens
agagagcuucaacuacuucuc

SEQ ID NO: 1779700 - RNA, 22 nt, Homo sapiens
ugcuggcuuaaaauguaauuaa

SEQ ID NO: 1779701 - RNA, 16 nt, Homo sapiens
gucacucaccuagaca

SEQ ID NO: 1779702 - RNA, 21 nt, Homo sapiens
ucacuacaaucgcuaccugac

SEQ ID NO: 1779703 - RNA, 23 nt, Homo sapiens
aaacgccuuuuauucuauuuaca

SEQ ID NO: 1779704 - RNA, 19 nt, Homo sapiens
ccagagguggauguuauga

SEQ ID NO: 1779705 - RNA, 14 nt, Homo sapiens
uugagaaauucuga

SEQ ID NO: 1779706 - RNA, 14 nt, Homo sapiens
uggugaaaugcaga

SEQ ID NO: 1779707 - RNA, 14 nt, Homo sapiens
uauaguagcauuuc

SEQ ID NO: 1779708 - RNA, 15 nt, Homo sapiens
ugcacaaaaucugua

SEQ ID NO: 1779709 - RNA, 21 nt, Homo sapiens
ucugauuaguugacaguauua

SEQ ID NO: 1779710 - RNA, 14 nt, Homo sapiens
auuuggccaaacaa

SEQ ID NO: 1779711 - RNA, 16 nt, Homo sapiens
uuagaagcccauucau

SEQ ID NO: 1779712 - RNA, 19 nt, Homo sapiens
uauaguccuauaguuuuac

SEQ ID NO: 1779713 - RNA, 13 nt, Homo sapiens
agagcucaccugu

SEQ ID NO: 1779714 - RNA, 18 nt, Homo sapiens
uaaaauacuauucucauu

SEQ ID NO: 1779715 - RNA, 19 nt, Homo sapiens
gacuauacugcugaguucu

SEQ ID NO: 1779716 - RNA, 17 nt, Homo sapiens
agauaacagauuauuug

SEQ ID NO: 1779717 - RNA, 17 nt, Homo sapiens
acuucugcaaccccagg

SEQ ID NO: 1779718 - RNA, 23 nt, Homo sapiens
acaaagcgugguggacaugcaca

SEQ ID NO: 1779719 - RNA, 20 nt, Homo sapiens
ucagugggacucggugagcc

SEQ ID NO: 1779720 - RNA, 15 nt, Homo sapiens
cagugagcucuggau

SEQ ID NO: 1779721 - RNA, 15 nt, Homo sapiens
ugguaugcacugguu

SEQ ID NO: 1779722 - RNA, 13 nt, Homo sapiens
ccacaugcauguc

SEQ ID NO: 1779723 - RNA, 18 nt, Homo sapiens
cuuugcagccccacagac

SEQ ID NO: 1779724 - RNA, 15 nt, Homo sapiens
cagacaagugacugu

SEQ ID NO: 1779725 - RNA, 19 nt, Homo sapiens
acugcucguggacugugcu

SEQ ID NO: 1779726 - RNA, 23 nt, Homo sapiens
aacccccucgccuccuacucuga

SEQ ID NO: 1779727 - RNA, 16 nt, Homo sapiens
ucugacgcagccugag

SEQ ID NO: 1779728 - RNA, 13 nt, Homo sapiens
gagaauuaucuca

SEQ ID NO: 1779729 - RNA, 18 nt, Homo sapiens
ugggacgcacagugcagu

SEQ ID NO: 1779730 - RNA, 19 nt, Homo sapiens
ccggccacaacuacaccac

SEQ ID NO: 1779731 - RNA, 16 nt, Homo sapiens
augucuucacucuaua

SEQ ID NO: 1779732 - RNA, 15 nt, Homo sapiens
gggcaccuacugaga

SEQ ID NO: 1779733 - RNA, 16 nt, Homo sapiens
ccucagggagugcaga

SEQ ID NO: 1779734 - RNA, 13 nt, Homo sapiens
ugaggcugacaca

SEQ ID NO: 1779735 - RNA, 17 nt, Homo sapiens
auccucccuacuuccaa

SEQ ID NO: 1779736 - RNA, 17 nt, Homo sapiens
aggggaggaacagggaa

SEQ ID NO: 1779737 - RNA, 14 nt, Homo sapiens
aaggcaccuucuua

SEQ ID NO: 1779738 - RNA, 21 nt, Homo sapiens
gcagcaaaagaccaaaucuca

SEQ ID NO: 1779739 - RNA, 20 nt, Homo sapiens
cuuagaaaaggguuucuuga

SEQ ID NO: 1779740 - RNA, 21 nt, Homo sapiens
ggccaagaaagagucaggccu

SEQ ID NO: 1779741 - RNA, 17 nt, Homo sapiens
agaccagccugccaggc

SEQ ID NO: 1779742 - RNA, 18 nt, Homo sapiens
agcuaucccgggcaucca

SEQ ID NO: 1779743 - RNA, 22 nt, Homo sapiens
aaauauauagugaaaaauguca

SEQ ID NO: 1779744 - RNA, 14 nt, Homo sapiens
ugagaaaggauuaa

SEQ ID NO: 1779745 - RNA, 20 nt, Homo sapiens
ugaaaccccaucucuacuaa

SEQ ID NO: 1779746 - RNA, 20 nt, Homo sapiens
ugccuuuccauaaucacuca

SEQ ID NO: 1779747 - RNA, 18 nt, Homo sapiens
cugugauuuaucuuucaa

SEQ ID NO: 1779748 - RNA, 14 nt, Homo sapiens
gcaaggugugaugg

SEQ ID NO: 1779749 - RNA, 14 nt, Homo sapiens
ugggugcuacuggg

SEQ ID NO: 1779750 - RNA, 17 nt, Homo sapiens
gagagccuggugcugcu

SEQ ID NO: 1779751 - RNA, 16 nt, Homo sapiens
ggucagccuccucucc

SEQ ID NO: 1779752 - RNA, 18 nt, Homo sapiens
uugagggacugagccaga

SEQ ID NO: 1779753 - RNA, 23 nt, Homo sapiens
caaaugaagggacggcuguggga

SEQ ID NO: 1779754 - RNA, 17 nt, Homo sapiens
caaaaccagguccaaug

SEQ ID NO: 1779755 - RNA, 20 nt, Homo sapiens
ggcccuucucugcagucaag

SEQ ID NO: 1779756 - RNA, 23 nt, Homo sapiens
augaaugaaagaauaagugagua

SEQ ID NO: 1779757 - RNA, 21 nt, Homo sapiens
aauccaauuaaucaaaccacu

SEQ ID NO: 1779758 - RNA, 18 nt, Homo sapiens
gaauguggagaacuaaag

SEQ ID NO: 1779759 - RNA, 22 nt, Homo sapiens
uuaaaauaaauuuguaugcuca

SEQ ID NO: 1779760 - RNA, 21 nt, Homo sapiens
auagagauagcuacaguguaa

SEQ ID NO: 1779761 - RNA, 14 nt, Homo sapiens
ccauugcuuaccuu

SEQ ID NO: 1779762 - RNA, 14 nt, Homo sapiens
aggaacucaaauaa

SEQ ID NO: 1779763 - RNA, 16 nt, Homo sapiens
agcaagugugaauacu

SEQ ID NO: 1779764 - RNA, 17 nt, Homo sapiens
agcccucugucuaccug

SEQ ID NO: 1779765 - RNA, 19 nt, Homo sapiens
aaguuucuuuuuacauuca

SEQ ID NO: 1779766 - RNA, 22 nt, Homo sapiens
acuugaauaaaguacuacauca

SEQ ID NO: 1779767 - RNA, 19 nt, Homo sapiens
uuaagguaacuacugcuaa

SEQ ID NO: 1779768 - RNA, 23 nt, Homo sapiens
gaguaaucaauacagacaagguu

SEQ ID NO: 1779769 - RNA, 21 nt, Homo sapiens
aauuuauuuauauuucaagaa

SEQ ID NO: 1779770 - RNA, 11 nt, Homo sapiens
accccuuccaa

SEQ ID NO: 1779771 - RNA, 15 nt, Homo sapiens
ccuauacaguucuau

SEQ ID NO: 1779772 - RNA, 14 nt, Homo sapiens
ucuucccugaccuc

SEQ ID NO: 1779773 - RNA, 19 nt, Homo sapiens
aauacugcauuuacagugu

SEQ ID NO: 1779774 - RNA, 16 nt, Homo sapiens
gucaagagccaagaca

SEQ ID NO: 1779775 - RNA, 15 nt, Homo sapiens
ccuccuaauuugauc

SEQ ID NO: 1779776 - RNA, 20 nt, Homo sapiens
gcaaaaaaauuaaauuauuu

SEQ ID NO: 1779777 - RNA, 13 nt, Homo sapiens
cccugaugcucca

SEQ ID NO: 1779778 - RNA, 20 nt, Homo sapiens
gcucacgccuguaauuccag

SEQ ID NO: 1779779 - RNA, 20 nt, Homo sapiens
gcucacgucuguaaucccag

SEQ ID NO: 1779780 - RNA, 13 nt, Homo sapiens
cucacgccuguaa

SEQ ID NO: 1779781 - RNA, 20 nt, Homo sapiens
cuguggccugugucccauga

SEQ ID NO: 1779782 - RNA, 17 nt, Homo sapiens
ccccucagugguuuccu

SEQ ID NO: 1779783 - RNA, 17 nt, Homo sapiens
agggucauaagugggga

SEQ ID NO: 1779784 - RNA, 17 nt, Homo sapiens
gauuuauucugccaaac

SEQ ID NO: 1779785 - RNA, 13 nt, Homo sapiens
ucuuacacacugg

SEQ ID NO: 1779786 - RNA, 13 nt, Homo sapiens
aggugcacuggga

SEQ ID NO: 1779787 - RNA, 16 nt, Homo sapiens
cgcaccauaaugagau

SEQ ID NO: 1779788 - RNA, 17 nt, Homo sapiens
ucuuguaaaacugugac

SEQ ID NO: 1779789 - RNA, 17 nt, Homo sapiens
aauuaauaccacuaccc

SEQ ID NO: 1779790 - RNA, 12 nt, Homo sapiens
auuuuacuguac

SEQ ID NO: 1779791 - RNA, 12 nt, Homo sapiens
caccugcaucug

SEQ ID NO: 1779792 - RNA, 20 nt, Homo sapiens
cucaggauauucacucugug

SEQ ID NO: 1779793 - RNA, 13 nt, Homo sapiens
caaagaccaccuc

SEQ ID NO: 1779794 - RNA, 19 nt, Homo sapiens
uuccccaagccuggcaggg

SEQ ID NO: 1779795 - RNA, 12 nt, Homo sapiens
acugaugcugcc

SEQ ID NO: 1779796 - RNA, 14 nt, Homo sapiens
cauuugcucaugga

SEQ ID NO: 1779797 - RNA, 15 nt, Homo sapiens
acagaagcagacuuu

SEQ ID NO: 1779798 - RNA, 17 nt, Homo sapiens
ggugcugcuuucuuguu

SEQ ID NO: 1779799 - RNA, 14 nt, Homo sapiens
aaguaaucaucuaa

SEQ ID NO: 1779800 - RNA, 14 nt, Homo sapiens
uuguuuucuacuuu

SEQ ID NO: 1779801 - RNA, 21 nt, Homo sapiens
uuggccuccguucaccccacc

SEQ ID NO: 1779802 - RNA, 23 nt, Homo sapiens
uagaaggggaggacacugguggu

SEQ ID NO: 1779803 - RNA, 14 nt, Homo sapiens
gacuaggagcccag

SEQ ID NO: 1779804 - RNA, 17 nt, Homo sapiens
cuccagugguugcuguu

SEQ ID NO: 1779805 - RNA, 14 nt, Homo sapiens
gccuguuccaugaa

SEQ ID NO: 1779806 - RNA, 13 nt, Homo sapiens
aagagauuccuga

SEQ ID NO: 1779807 - RNA, 21 nt, Homo sapiens
uuaauccucacaccuacugua

SEQ ID NO: 1779808 - RNA, 13 nt, Homo sapiens
agaaguacuaucu

SEQ ID NO: 1779809 - RNA, 18 nt, Homo sapiens
auccaauggaacaguagc

SEQ ID NO: 1779810 - RNA, 22 nt, Homo sapiens
cccagacucaaacucaagguca

SEQ ID NO: 1779811 - RNA, 22 nt, Homo sapiens
agaugaaggaaggacuaugaca

SEQ ID NO: 1779812 - RNA, 18 nt, Homo sapiens
cuggccagauuuccucac

SEQ ID NO: 1779813 - RNA, 19 nt, Homo sapiens
gaugaaggaaggacuauga

SEQ ID NO: 1779814 - RNA, 19 nt, Homo sapiens
gcgagacuccgucucaaaa

SEQ ID NO: 1779815 - RNA, 24 nt, Homo sapiens
uauuaauuuuuaaggauguugcca

SEQ ID NO: 1779816 - RNA, 21 nt, Homo sapiens
ugagaaguugaagccgucuca

SEQ ID NO: 1779817 - RNA, 20 nt, Homo sapiens
ggggaguguuuuuguaucac

SEQ ID NO: 1779818 - RNA, 16 nt, Homo sapiens
gaagcaccaucauucc

SEQ ID NO: 1779819 - RNA, 19 nt, Homo sapiens
ggaaaaaagcacauacauu

SEQ ID NO: 1779820 - RNA, 16 nt, Homo sapiens
acggaugguugaauga

SEQ ID NO: 1779821 - RNA, 21 nt, Homo sapiens
agucccucaugcaaaucaauu

SEQ ID NO: 1779822 - RNA, 17 nt, Homo sapiens
uguauuuuuacuuuuaa

SEQ ID NO: 1779823 - RNA, 22 nt, Homo sapiens
uccagccacuuauuuccaugga

SEQ ID NO: 1779824 - RNA, 23 nt, Homo sapiens
acagcagcaccuccuccaugcag

SEQ ID NO: 1779825 - RNA, 19 nt, Homo sapiens
agagcgagauuccgucuca

SEQ ID NO: 1779826 - RNA, 22 nt, Homo sapiens
aucacaaaggaaagauuugcca

SEQ ID NO: 1779827 - RNA, 16 nt, Homo sapiens
aggcucugaaauggaa

SEQ ID NO: 1779828 - RNA, 23 nt, Homo sapiens
cuaagugaggaugaaaaaauaac

SEQ ID NO: 1779829 - RNA, 18 nt, Homo sapiens
agccugggucacagagug

SEQ ID NO: 1779830 - RNA, 16 nt, Homo sapiens
augugugguacuuugc

SEQ ID NO: 1779831 - RNA, 13 nt, Homo sapiens
gcacagugcaguu

SEQ ID NO: 1779832 - RNA, 14 nt, Homo sapiens
gguauguugcacgu

SEQ ID NO: 1779833 - RNA, 19 nt, Homo sapiens
uaaaggccaggacgggcca

SEQ ID NO: 1779834 - RNA, 17 nt, Homo sapiens
gauuguuuacagucauu

SEQ ID NO: 1779835 - RNA, 19 nt, Homo sapiens
uaauuuaaucuuccaugga

SEQ ID NO: 1779836 - RNA, 20 nt, Homo sapiens
cuuuguguaaagaagggaag

SEQ ID NO: 1779837 - RNA, 18 nt, Homo sapiens
uuuuaaaagaaugauuau

SEQ ID NO: 1779838 - RNA, 21 nt, Homo sapiens
uagcccucccccucaaccuca

SEQ ID NO: 1779839 - RNA, 16 nt, Homo sapiens
ugucuuuucaaaagga

SEQ ID NO: 1779840 - RNA, 14 nt, Homo sapiens
uucuuaugguauaa

SEQ ID NO: 1779841 - RNA, 20 nt, Homo sapiens
uuuugcaguucccacauuaa

SEQ ID NO: 1779842 - RNA, 12 nt, Homo sapiens
aagauucuuggu

SEQ ID NO: 1779843 - RNA, 15 nt, Homo sapiens
gaaauaaacagucua

SEQ ID NO: 1779844 - RNA, 22 nt, Homo sapiens
agcauuacgaucccccaagugu

SEQ ID NO: 1779845 - RNA, 11 nt, Homo sapiens
caaacuccucu

SEQ ID NO: 1779846 - RNA, 20 nt, Homo sapiens
gucaguuccccuguuugccu

SEQ ID NO: 1779847 - RNA, 17 nt, Homo sapiens
cugggaaaggugcucaa

SEQ ID NO: 1779848 - RNA, 22 nt, Homo sapiens
uggggacaccagccaucaugug

SEQ ID NO: 1779849 - RNA, 17 nt, Homo sapiens
acaauacaguacucagg

SEQ ID NO: 1779850 - RNA, 14 nt, Homo sapiens
auaucagagcucuu

SEQ ID NO: 1779851 - RNA, 15 nt, Homo sapiens
aaaacacucucacua

SEQ ID NO: 1779852 - RNA, 18 nt, Homo sapiens
ugggccuaggaugggacg

SEQ ID NO: 1779853 - RNA, 16 nt, Homo sapiens
uugccuggaagcacau

SEQ ID NO: 1779854 - RNA, 16 nt, Homo sapiens
cucucaccuacuuccu

SEQ ID NO: 1779855 - RNA, 18 nt, Homo sapiens
guagcauuucuugauguu

SEQ ID NO: 1779856 - RNA, 21 nt, Homo sapiens
gcagugaggaauuaaucuugc

SEQ ID NO: 1779857 - RNA, 20 nt, Homo sapiens
uacagcugcuuugagcuaca

SEQ ID NO: 1779858 - RNA, 13 nt, Homo sapiens
cuaaagguggcca

SEQ ID NO: 1779859 - RNA, 23 nt, Homo sapiens
uuguuugugauauuucguguacu

SEQ ID NO: 1779860 - RNA, 18 nt, Homo sapiens
gugaacaccuccuagcca

SEQ ID NO: 1779861 - RNA, 20 nt, Homo sapiens
gaaucaugucaggccaucaa

SEQ ID NO: 1779862 - RNA, 17 nt, Homo sapiens
cuacaggcucaugccau

SEQ ID NO: 1779863 - RNA, 14 nt, Homo sapiens
uuaugcaaauggag

SEQ ID NO: 1779864 - RNA, 13 nt, Homo sapiens
ccuauuuccccac

SEQ ID NO: 1779865 - RNA, 19 nt, Homo sapiens
uggaaauaaaagauuguau

SEQ ID NO: 1779866 - RNA, 22 nt, Homo sapiens
ugggaguucaggaacuguguuu

SEQ ID NO: 1779867 - RNA, 17 nt, Homo sapiens
aguccggugccuuccac

SEQ ID NO: 1779868 - RNA, 22 nt, Homo sapiens
agcuucuuuacuacugcaaguu

SEQ ID NO: 1779869 - RNA, 17 nt, Homo sapiens
ugguccccagcauugca

SEQ ID NO: 1779870 - RNA, 13 nt, Homo sapiens
ggccucugucaau

SEQ ID NO: 1779871 - RNA, 21 nt, Homo sapiens
caggccaggacaaaaugcaga

SEQ ID NO: 1779872 - RNA, 12 nt, Homo sapiens
cugggcuuugau

SEQ ID NO: 1779873 - RNA, 19 nt, Homo sapiens
uaagcauuguauacauuga

SEQ ID NO: 1779874 - RNA, 23 nt, Homo sapiens
cuuuugcgauuucacaguuggca

SEQ ID NO: 1779875 - RNA, 13 nt, Homo sapiens
uaagacauuugaa

SEQ ID NO: 1779876 - RNA, 13 nt, Homo sapiens
aguaaaagccauc

SEQ ID NO: 1779877 - RNA, 23 nt, Homo sapiens
auuuccaauagaacaguuuacuu

SEQ ID NO: 1779878 - RNA, 21 nt, Homo sapiens
aauccaaaaggucuuuuuaca

SEQ ID NO: 1779879 - RNA, 13 nt, Homo sapiens
acuccuuccauca

SEQ ID NO: 1779880 - RNA, 16 nt, Homo sapiens
uuccaagccugggcca

SEQ ID NO: 1779881 - RNA, 21 nt, Homo sapiens
uagagcagccacaaccaaaaa

SEQ ID NO: 1779882 - RNA, 14 nt, Homo sapiens
agccugcuggucac

SEQ ID NO: 1779883 - RNA, 22 nt, Homo sapiens
aaugauuuaaauagaacuugau

SEQ ID NO: 1779884 - RNA, 12 nt, Homo sapiens
augagcuuaaug

SEQ ID NO: 1779885 - RNA, 14 nt, Homo sapiens
uccuuccucaagaa

SEQ ID NO: 1779886 - RNA, 21 nt, Homo sapiens
acauaaucuguacaaugaacc

SEQ ID NO: 1779887 - RNA, 23 nt, Homo sapiens
cuuaaacuguguggacugugaug

SEQ ID NO: 1779888 - RNA, 18 nt, Homo sapiens
auaugaagaacuauuaua

SEQ ID NO: 1779889 - RNA, 19 nt, Homo sapiens
uucugaaugugcugaucau

SEQ ID NO: 1779890 - RNA, 17 nt, Homo sapiens
acauuaaaagacaaaua

SEQ ID NO: 1779891 - RNA, 22 nt, Homo sapiens
gaggguggcuuugcuguuguug

SEQ ID NO: 1779892 - RNA, 23 nt, Homo sapiens
cuaucuccugacagaaggugcca

SEQ ID NO: 1779893 - RNA, 14 nt, Homo sapiens
ucuaucauggaaua

SEQ ID NO: 1779894 - RNA, 16 nt, Homo sapiens
cuuucuggaaaagagg

SEQ ID NO: 1779895 - RNA, 16 nt, Homo sapiens
aagaugaaacagggca

SEQ ID NO: 1779896 - RNA, 21 nt, Homo sapiens
uauacaaauuguuucuggaau

SEQ ID NO: 1779897 - RNA, 20 nt, Homo sapiens
aaacauuguuuuguguaaca

SEQ ID NO: 1779898 - RNA, 17 nt, Homo sapiens
gacgguaaguguucuca

SEQ ID NO: 1779899 - RNA, 18 nt, Homo sapiens
aauauaauuggcacagaa

SEQ ID NO: 1779900 - RNA, 16 nt, Homo sapiens
gcccauuuacacuuuu

SEQ ID NO: 1779901 - RNA, 15 nt, Homo sapiens
aaaucugauuuacac

SEQ ID NO: 1779902 - RNA, 12 nt, Homo sapiens
aauuaacuugag

SEQ ID NO: 1779903 - RNA, 22 nt, Homo sapiens
caugcguaagacguucugugua

SEQ ID NO: 1779904 - RNA, 21 nt, Homo sapiens
auccuauagagucaaccacca

SEQ ID NO: 1779905 - RNA, 14 nt, Homo sapiens
aaauacacaaugaa

SEQ ID NO: 1779906 - RNA, 19 nt, Homo sapiens
cccucugugaaauuuguaa

SEQ ID NO: 1779907 - RNA, 15 nt, Homo sapiens
auuugggcagacccu

SEQ ID NO: 1779908 - RNA, 17 nt, Homo sapiens
ggaggcgggaguggagu

SEQ ID NO: 1779909 - RNA, 22 nt, Homo sapiens
gcaguguguacuucuucaucca

SEQ ID NO: 1779910 - RNA, 14 nt, Homo sapiens
gcagcuaaaaccua

SEQ ID NO: 1779911 - RNA, 18 nt, Homo sapiens
ggauggaaauguagugcu

SEQ ID NO: 1779912 - RNA, 13 nt, Homo sapiens
gcugagauuacag

SEQ ID NO: 1779913 - RNA, 20 nt, Homo sapiens
aggaauauagaaugaaagac

SEQ ID NO: 1779914 - RNA, 23 nt, Homo sapiens
ugcuucccuggggccccauuugc

SEQ ID NO: 1779915 - RNA, 13 nt, Homo sapiens
uagacaucugccc

SEQ ID NO: 1779916 - RNA, 22 nt, Homo sapiens
guccaaaggguuuuaagccagg

SEQ ID NO: 1779917 - RNA, 19 nt, Homo sapiens
uccaccauucacauuugau

SEQ ID NO: 1779918 - RNA, 15 nt, Homo sapiens
gccugguugugugca

SEQ ID NO: 1779919 - RNA, 23 nt, Homo sapiens
cucuccugccugcccugccucag

SEQ ID NO: 1779920 - RNA, 13 nt, Homo sapiens
uuacuauugcaaa

SEQ ID NO: 1779921 - RNA, 15 nt, Homo sapiens
auauuuaugcuuaua

SEQ ID NO: 1779922 - RNA, 18 nt, Homo sapiens
ccuaugugggugggacca

SEQ ID NO: 1779923 - RNA, 13 nt, Homo sapiens
gaauuugccuaau

SEQ ID NO: 1779924 - RNA, 13 nt, Homo sapiens
guaugugccaaag

SEQ ID NO: 1779925 - RNA, 13 nt, Homo sapiens
ccaggaggcugca

SEQ ID NO: 1779926 - RNA, 18 nt, Homo sapiens
auaagcccaguucaucac

SEQ ID NO: 1779927 - RNA, 12 nt, Homo sapiens
gucacuguaguu

SEQ ID NO: 1779928 - RNA, 15 nt, Homo sapiens
aaauagagcaauacu

SEQ ID NO: 1779929 - RNA, 19 nt, Homo sapiens
uguuucuuuuguauguaaa

SEQ ID NO: 1779930 - RNA, 19 nt, Homo sapiens
guugcauuuaugaugcagu

SEQ ID NO: 1779931 - RNA, 14 nt, Homo sapiens
auuaaaaaacuuca

SEQ ID NO: 1779932 - RNA, 20 nt, Homo sapiens
cugcacccguacccccgugg

SEQ ID NO: 1779933 - RNA, 19 nt, Homo sapiens
ugucuguaaaagagccuag

SEQ ID NO: 1779934 - RNA, 23 nt, Homo sapiens
agaugauaaucccauacucucaa

SEQ ID NO: 1779935 - RNA, 17 nt, Homo sapiens
acuugauuaacuccucc

SEQ ID NO: 1779936 - RNA, 19 nt, Homo sapiens
caccacugcucuccagccu

SEQ ID NO: 1779937 - RNA, 21 nt, Homo sapiens
uuccuuuaaaaauacauagca

SEQ ID NO: 1779938 - RNA, 21 nt, Homo sapiens
accugcacguugugcacaugu

SEQ ID NO: 1779939 - RNA, 23 nt, Homo sapiens
aaggcuuagacccucaugcugcc

SEQ ID NO: 1779940 - RNA, 20 nt, Homo sapiens
cucagcuagacauugcaauu

SEQ ID NO: 1779941 - RNA, 20 nt, Homo sapiens
ccugccgacggagccacugg

SEQ ID NO: 1779942 - RNA, 19 nt, Homo sapiens
uaaugcagacucuucuuaa

SEQ ID NO: 1779943 - RNA, 18 nt, Homo sapiens
accuucaaaauguucuau

SEQ ID NO: 1779944 - RNA, 15 nt, Homo sapiens
gcuacagaguaacaa

SEQ ID NO: 1779945 - RNA, 12 nt, Homo sapiens
uucuauuuaaca

SEQ ID NO: 1779946 - RNA, 13 nt, Homo sapiens
auuagcuuugugu

SEQ ID NO: 1779947 - RNA, 18 nt, Homo sapiens
accgcgugauaaaacugg

SEQ ID NO: 1779948 - RNA, 13 nt, Homo sapiens
caauucuagcauu

SEQ ID NO: 1779949 - RNA, 18 nt, Homo sapiens
cuggauaaacuugcuuca

SEQ ID NO: 1779950 - RNA, 14 nt, Homo sapiens
guuuaacauuugcc

SEQ ID NO: 1779951 - RNA, 17 nt, Homo sapiens
acaucucaggggccaga

SEQ ID NO: 1779952 - RNA, 21 nt, Homo sapiens
uugagcugauauaaauucugu

SEQ ID NO: 1779953 - RNA, 17 nt, Homo sapiens
agcccuuccucccauuu

SEQ ID NO: 1779954 - RNA, 16 nt, Homo sapiens
uuuccagaaaccaaac

SEQ ID NO: 1779955 - RNA, 17 nt, Homo sapiens
aggcaggagaauggcgu

SEQ ID NO: 1779956 - RNA, 14 nt, Homo sapiens
cagccuugccagag

SEQ ID NO: 1779957 - RNA, 22 nt, Homo sapiens
caggccugaacccguccauuca

SEQ ID NO: 1779958 - RNA, 21 nt, Homo sapiens
acaaauuucauugcacuuucc

SEQ ID NO: 1779959 - RNA, 18 nt, Homo sapiens
cuucagauacaaacugca

SEQ ID NO: 1779960 - RNA, 22 nt, Homo sapiens
ucauuucacuuuacacgcucau

SEQ ID NO: 1779961 - RNA, 16 nt, Homo sapiens
uacauggccacaaagg

SEQ ID NO: 1779962 - RNA, 13 nt, Homo sapiens
aaaagucaaguuu

SEQ ID NO: 1779963 - RNA, 13 nt, Homo sapiens
cauaaagcauugg

SEQ ID NO: 1779964 - RNA, 18 nt, Homo sapiens
aaagaucuucucuaacaa

SEQ ID NO: 1779965 - RNA, 15 nt, Homo sapiens
aaucuuaagaacuuu

SEQ ID NO: 1779966 - RNA, 18 nt, Homo sapiens
ggauguugcuauagugac

SEQ ID NO: 1779967 - RNA, 15 nt, Homo sapiens
auuguaaugaauauc

SEQ ID NO: 1779968 - RNA, 18 nt, Homo sapiens
agaagggaauccuccucc

SEQ ID NO: 1779969 - RNA, 19 nt, Homo sapiens
gaacccacauaaaagcccc

SEQ ID NO: 1779970 - RNA, 14 nt, Homo sapiens
ugagcuccagcucc

SEQ ID NO: 1779971 - RNA, 19 nt, Homo sapiens
acauucucgcuucccugaa

SEQ ID NO: 1779972 - RNA, 21 nt, Homo sapiens
aucaauuuuucccaguauuuu

SEQ ID NO: 1779973 - RNA, 22 nt, Homo sapiens
gcacauaaacucuuuuaucucc

SEQ ID NO: 1779974 - RNA, 12 nt, Homo sapiens
gacauacauuua

SEQ ID NO: 1779975 - RNA, 20 nt, Homo sapiens
caggguccagugggaacuga

SEQ ID NO: 1779976 - RNA, 14 nt, Homo sapiens
caggcccaagagau

SEQ ID NO: 1779977 - RNA, 20 nt, Homo sapiens
caugcuggaugaccccaugc

SEQ ID NO: 1779978 - RNA, 23 nt, Homo sapiens
aaccgagaauauucaaaauucca

SEQ ID NO: 1779979 - RNA, 21 nt, Homo sapiens
ugaccugccaggcacacugag

SEQ ID NO: 1779980 - RNA, 14 nt, Homo sapiens
gcuccuaucugugu

SEQ ID NO: 1779981 - RNA, 21 nt, Homo sapiens
agggguccagcccagcacugg

SEQ ID NO: 1779982 - RNA, 22 nt, Homo sapiens
ugcugaaccguuugugauugcc

SEQ ID NO: 1779983 - RNA, 18 nt, Homo sapiens
ugcccggccuguguacaa

SEQ ID NO: 1779984 - RNA, 17 nt, Homo sapiens
gcaacccgguuuaccag

SEQ ID NO: 1779985 - RNA, 17 nt, Homo sapiens
cgaagucaucauuccuc

SEQ ID NO: 1779986 - RNA, 12 nt, Homo sapiens
aaggacugguaa

SEQ ID NO: 1779987 - RNA, 14 nt, Homo sapiens
uauuugaauaucau

SEQ ID NO: 1779988 - RNA, 21 nt, Homo sapiens
agcccacccugggaugggcca

SEQ ID NO: 1779989 - RNA, 14 nt, Homo sapiens
cccagaagguugug

SEQ ID NO: 1779990 - RNA, 17 nt, Homo sapiens
acccugcucuccgacca

SEQ ID NO: 1779991 - RNA, 15 nt, Homo sapiens
ccugguuugcaaaga

SEQ ID NO: 1779992 - RNA, 15 nt, Homo sapiens
uuuaagguacacugu

SEQ ID NO: 1779993 - RNA, 17 nt, Homo sapiens
ggaaaagaaaccugggg

SEQ ID NO: 1779994 - RNA, 21 nt, Homo sapiens
auggcuacuaccggggcuccg

SEQ ID NO: 1779995 - RNA, 16 nt, Homo sapiens
uuccaaguuuauugcc

SEQ ID NO: 1779996 - RNA, 14 nt, Homo sapiens
ucacgacucuuccu

SEQ ID NO: 1779997 - RNA, 19 nt, Homo sapiens
ucugugaagacagguacca

SEQ ID NO: 1779998 - RNA, 11 nt, Homo sapiens
uauugauacug

SEQ ID NO: 1779999 - RNA, 13 nt, Homo sapiens
gccaugggggccc

SEQ ID NO: 1780000 - RNA, 18 nt, Homo sapiens
uuucucucacacuuuugc

SEQ ID NO: 1780001 - RNA, 14 nt, Homo sapiens
ccucaccuucccua

SEQ ID NO: 1780002 - RNA, 18 nt, Homo sapiens
cccaaggcucaugguccu

SEQ ID NO: 1780003 - RNA, 10 nt, Homo sapiens
ucagugucca

SEQ ID NO: 1780004 - RNA, 14 nt, Homo sapiens
cgagcccuggagag

SEQ ID NO: 1780005 - RNA, 14 nt, Homo sapiens
ugugcccacuuacc

SEQ ID NO: 1780006 - RNA, 10 nt, Homo sapiens
uuaaugccaa

SEQ ID NO: 1780007 - RNA, 15 nt, Homo sapiens
guaucacaguguuuu

SEQ ID NO: 1780008 - RNA, 20 nt, Homo sapiens
caacccucucaggugaccaa

SEQ ID NO: 1780009 - RNA, 17 nt, Homo sapiens
gcaaaugucuuccaggu

SEQ ID NO: 1780010 - RNA, 15 nt, Homo sapiens
auuaaaacuauucau

SEQ ID NO: 1780011 - RNA, 16 nt, Homo sapiens
aaacuccugaccucag

SEQ ID NO: 1780012 - RNA, 21 nt, Homo sapiens
cagcuuuuuuugucuuuuuaa

SEQ ID NO: 1780013 - RNA, 22 nt, Homo sapiens
cauucuugcuugacucuacuau

SEQ ID NO: 1780014 - RNA, 15 nt, Homo sapiens
agggagagccaucac

SEQ ID NO: 1780015 - RNA, 15 nt, Homo sapiens
ggcugcuggggcaug

SEQ ID NO: 1780016 - RNA, 16 nt, Homo sapiens
auaacuaauaugguuu

SEQ ID NO: 1780017 - RNA, 18 nt, Homo sapiens
gccuuauuuugcuucuug

SEQ ID NO: 1780018 - RNA, 16 nt, Homo sapiens
aggagcauccucugcu

SEQ ID NO: 1780019 - RNA, 12 nt, Homo sapiens
acugcauuuuac

SEQ ID NO: 1780020 - RNA, 22 nt, Homo sapiens
cacuguugcaaacucagugcaa

SEQ ID NO: 1780021 - RNA, 19 nt, Homo sapiens
gggcucaaggaaagggggu

SEQ ID NO: 1780022 - RNA, 20 nt, Homo sapiens
ccuuguugaugaagcacauu

SEQ ID NO: 1780023 - RNA, 13 nt, Homo sapiens
cuuuuuaguuuac

SEQ ID NO: 1780024 - RNA, 12 nt, Homo sapiens
aucuugccucau

SEQ ID NO: 1780025 - RNA, 18 nt, Homo sapiens
cugaaugacuccacuguu

SEQ ID NO: 1780026 - RNA, 17 nt, Homo sapiens
aucauggagaacagcau

SEQ ID NO: 1780027 - RNA, 14 nt, Homo sapiens
cccccuggagagaa

SEQ ID NO: 1780028 - RNA, 17 nt, Homo sapiens
caauccuuaaacugcca

SEQ ID NO: 1780029 - RNA, 22 nt, Homo sapiens
cuuaauucccaaucccauuccu

SEQ ID NO: 1780030 - RNA, 14 nt, Homo sapiens
auuaaacucaaagc

SEQ ID NO: 1780031 - RNA, 15 nt, Homo sapiens
agaacguggugaccu

SEQ ID NO: 1780032 - RNA, 17 nt, Homo sapiens
cugcccccaacacucca

SEQ ID NO: 1780033 - RNA, 14 nt, Homo sapiens
ccacagugagcuga

SEQ ID NO: 1780034 - RNA, 18 nt, Homo sapiens
ucaguauaauuuaacuuc

SEQ ID NO: 1780035 - RNA, 17 nt, Homo sapiens
aggacaaaaaaccucag

SEQ ID NO: 1780036 - RNA, 17 nt, Homo sapiens
gcagggcccagugacaa

SEQ ID NO: 1780037 - RNA, 15 nt, Homo sapiens
caguuugugaucugu

SEQ ID NO: 1780038 - RNA, 18 nt, Homo sapiens
ugccuguaaucccaacac

SEQ ID NO: 1780039 - RNA, 14 nt, Homo sapiens
cuaugucucaggag

SEQ ID NO: 1780040 - RNA, 14 nt, Homo sapiens
uuguccccagcucc

SEQ ID NO: 1780041 - RNA, 17 nt, Homo sapiens
cuagaccucaguuauuu

SEQ ID NO: 1780042 - RNA, 18 nt, Homo sapiens
cacgagaaacauccugcc

SEQ ID NO: 1780043 - RNA, 17 nt, Homo sapiens
ucaugcaauccuuccaa

SEQ ID NO: 1780044 - RNA, 19 nt, Homo sapiens
uuagacuuauaguccuccu

SEQ ID NO: 1780045 - RNA, 19 nt, Homo sapiens
gccaagagggcugcaaaag

SEQ ID NO: 1780046 - RNA, 23 nt, Homo sapiens
cuucugacuuaagugugcaaaau

SEQ ID NO: 1780047 - RNA, 19 nt, Homo sapiens
ugaggcuccuuaguuuauu

SEQ ID NO: 1780048 - RNA, 17 nt, Homo sapiens
uucuuaaagcaaaguca

SEQ ID NO: 1780049 - RNA, 18 nt, Homo sapiens
cuggcucaagcccugaau

SEQ ID NO: 1780050 - RNA, 17 nt, Homo sapiens
cuccuuccacauguaca

SEQ ID NO: 1780051 - RNA, 21 nt, Homo sapiens
aauaagaucuagucuguuaca

SEQ ID NO: 1780052 - RNA, 15 nt, Homo sapiens
uucccacacugucca

SEQ ID NO: 1780053 - RNA, 13 nt, Homo sapiens
cauuggugacuca

SEQ ID NO: 1780054 - RNA, 13 nt, Homo sapiens
gaaauaagccccc

SEQ ID NO: 1780055 - RNA, 21 nt, Homo sapiens
ugcugccagagagaccugcug

SEQ ID NO: 1780056 - RNA, 15 nt, Homo sapiens
auaggauauacugua

SEQ ID NO: 1780057 - RNA, 21 nt, Homo sapiens
acagcuuucaaaagcaagaac

SEQ ID NO: 1780058 - RNA, 17 nt, Homo sapiens
aaguacuaucuuugugu

SEQ ID NO: 1780059 - RNA, 16 nt, Homo sapiens
ggaagccagucagggc

SEQ ID NO: 1780060 - RNA, 20 nt, Homo sapiens
agucuaagaaaaugaucuua

SEQ ID NO: 1780061 - RNA, 19 nt, Homo sapiens
gauugagcagaacccagac

SEQ ID NO: 1780062 - RNA, 16 nt, Homo sapiens
gauucuucacuguguu

SEQ ID NO: 1780063 - RNA, 22 nt, Homo sapiens
uauauuugcauaauaugcauau

SEQ ID NO: 1780064 - RNA, 10 nt, Homo sapiens
cgcaugccaa

SEQ ID NO: 1780065 - RNA, 23 nt, Homo sapiens
cagccuccaaaaauggcagugac

SEQ ID NO: 1780066 - RNA, 18 nt, Homo sapiens
gccgggugugguggcaca

SEQ ID NO: 1780067 - RNA, 23 nt, Homo sapiens
aaugcauuuugcuagacaguuaa

SEQ ID NO: 1780068 - RNA, 17 nt, Homo sapiens
gaugugcugcagcgcuu

SEQ ID NO: 1780069 - RNA, 14 nt, Homo sapiens
cguccccaguugcc

SEQ ID NO: 1780070 - RNA, 14 nt, Homo sapiens
ccgaagaauggaga

SEQ ID NO: 1780071 - RNA, 14 nt, Homo sapiens
aaagcacaccucau

SEQ ID NO: 1780072 - RNA, 23 nt, Homo sapiens
ccaaacuauuuucugaagugacu

SEQ ID NO: 1780073 - RNA, 13 nt, Homo sapiens
cucuaacauuucc

SEQ ID NO: 1780074 - RNA, 22 nt, Homo sapiens
uaccagcauacgcucaccuuac

SEQ ID NO: 1780075 - RNA, 21 nt, Homo sapiens
gcugaucaguuuuuucaccug

SEQ ID NO: 1780076 - RNA, 21 nt, Homo sapiens
agcacuagugcugccauuaau

SEQ ID NO: 1780077 - RNA, 14 nt, Homo sapiens
gaccaagcacaaaa

SEQ ID NO: 1780078 - RNA, 22 nt, Homo sapiens
aaauuuuguaauuuucuugaug

SEQ ID NO: 1780079 - RNA, 22 nt, Homo sapiens
agcuccuccccugcuaccugcu

SEQ ID NO: 1780080 - RNA, 21 nt, Homo sapiens
auguucaugauagugugauuu

SEQ ID NO: 1780081 - RNA, 14 nt, Homo sapiens
aaucuaguugucaa

SEQ ID NO: 1780082 - RNA, 12 nt, Homo sapiens
ccuccacugacu

SEQ ID NO: 1780083 - RNA, 17 nt, Homo sapiens
ucccgugggcaucucaa

SEQ ID NO: 1780084 - RNA, 23 nt, Homo sapiens
auuuuauccauggaagaaacaca

SEQ ID NO: 1780085 - RNA, 22 nt, Homo sapiens
auccaggaacacaugcacacac

SEQ ID NO: 1780086 - RNA, 23 nt, Homo sapiens
acauguuuccaucauuucugucu

SEQ ID NO: 1780087 - RNA, 20 nt, Homo sapiens
cuugaacucuugaccucagg

SEQ ID NO: 1780088 - RNA, 16 nt, Homo sapiens
ccgcucacugaacucc

SEQ ID NO: 1780089 - RNA, 14 nt, Homo sapiens
agacucccauggaa

SEQ ID NO: 1780090 - RNA, 11 nt, Homo sapiens
ugucagucaug

SEQ ID NO: 1780091 - RNA, 21 nt, Homo sapiens
uguaaagcaggugcccaggaa

SEQ ID NO: 1780092 - RNA, 23 nt, Homo sapiens
acuuguguaguccuaugcaauaa

SEQ ID NO: 1780093 - RNA, 17 nt, Homo sapiens
cauuuauuuaagacacu

SEQ ID NO: 1780094 - RNA, 23 nt, Homo sapiens
uucccugcagucuagcaccucua

SEQ ID NO: 1780095 - RNA, 15 nt, Homo sapiens
aucucucuaccucca

SEQ ID NO: 1780096 - RNA, 15 nt, Homo sapiens
uagcagauauguauu

SEQ ID NO: 1780097 - RNA, 13 nt, Homo sapiens
augcccacucuaa

SEQ ID NO: 1780098 - RNA, 15 nt, Homo sapiens
aucaaaacagagaaa

SEQ ID NO: 1780099 - RNA, 14 nt, Homo sapiens
caauaaagugcuuu

SEQ ID NO: 1780100 - RNA, 15 nt, Homo sapiens
gucgcacccacugug

SEQ ID NO: 1780101 - RNA, 19 nt, Homo sapiens
uaguuuuuccugugcaaaa

SEQ ID NO: 1780102 - RNA, 21 nt, Homo sapiens
cuguuguuccuucacauuuaa

SEQ ID NO: 1780103 - RNA, 15 nt, Homo sapiens
gugcugugcagcucu

SEQ ID NO: 1780104 - RNA, 18 nt, Homo sapiens
aucaugucagccucaugc

SEQ ID NO: 1780105 - RNA, 16 nt, Homo sapiens
gcuuaaaggcaguauu

SEQ ID NO: 1780106 - RNA, 20 nt, Homo sapiens
ugugguuuaugucaucauac

SEQ ID NO: 1780107 - RNA, 14 nt, Homo sapiens
accaguccagguag

SEQ ID NO: 1780108 - RNA, 20 nt, Homo sapiens
uuaauauuuuuccacuuaaa

SEQ ID NO: 1780109 - RNA, 15 nt, Homo sapiens
agggagggacuggga

SEQ ID NO: 1780110 - RNA, 18 nt, Homo sapiens
auuaaggauguagcuuuu

SEQ ID NO: 1780111 - RNA, 15 nt, Homo sapiens
gucuuggaccagggc

SEQ ID NO: 1780112 - RNA, 13 nt, Homo sapiens
ugcccuccagaag

SEQ ID NO: 1780113 - RNA, 17 nt, Homo sapiens
acucuuguuaucuuuug

SEQ ID NO: 1780114 - RNA, 22 nt, Homo sapiens
cccuuuauuacaagaaggaaca

SEQ ID NO: 1780115 - RNA, 15 nt, Homo sapiens
uguccuuuaugaucc

SEQ ID NO: 1780116 - RNA, 22 nt, Homo sapiens
auacaccagaagacaaacaaua

SEQ ID NO: 1780117 - RNA, 21 nt, Homo sapiens
gguaucucuggcaccacacua

SEQ ID NO: 1780118 - RNA, 21 nt, Homo sapiens
cauauggcacuaaaugcacaa

SEQ ID NO: 1780119 - RNA, 16 nt, Homo sapiens
aacagagcuaagaaau

SEQ ID NO: 1780120 - RNA, 20 nt, Homo sapiens
acccaaaacugccgauuuca

SEQ ID NO: 1780121 - RNA, 14 nt, Homo sapiens
cuguggauaacauu

SEQ ID NO: 1780122 - RNA, 16 nt, Homo sapiens
gccuugagagacccag

SEQ ID NO: 1780123 - RNA, 11 nt, Homo sapiens
gcuagaaccug

SEQ ID NO: 1780124 - RNA, 12 nt, Homo sapiens
ugauacacagua

SEQ ID NO: 1780125 - RNA, 13 nt, Homo sapiens
aggcucuuagcag

SEQ ID NO: 1780126 - RNA, 23 nt, Homo sapiens
aggugcugagaaauuccacacau

SEQ ID NO: 1780127 - RNA, 21 nt, Homo sapiens
gcaucaguagcugagugcacu

SEQ ID NO: 1780128 - RNA, 23 nt, Homo sapiens
caaccccuggaccccagccucaa

SEQ ID NO: 1780129 - RNA, 21 nt, Homo sapiens
uacuucuguguugugauuccc

SEQ ID NO: 1780130 - RNA, 18 nt, Homo sapiens
cccaggaguucugcucau

SEQ ID NO: 1780131 - RNA, 20 nt, Homo sapiens
cucccugcaucugaccagca

SEQ ID NO: 1780132 - RNA, 17 nt, Homo sapiens
ucccuucucccagucca

SEQ ID NO: 1780133 - RNA, 15 nt, Homo sapiens
uaauaugucuucaua

SEQ ID NO: 1780134 - RNA, 23 nt, Homo sapiens
uaaccaguuuagcuuuuuccuua

SEQ ID NO: 1780135 - RNA, 22 nt, Homo sapiens
uccaaugaagauaaaugcuuua

SEQ ID NO: 1780136 - RNA, 21 nt, Homo sapiens
aaauaagucaaaauaaucuga

SEQ ID NO: 1780137 - RNA, 19 nt, Homo sapiens
aaagagccuaacaucucca

SEQ ID NO: 1780138 - RNA, 18 nt, Homo sapiens
ucugugacccaucuguag

SEQ ID NO: 1780139 - RNA, 14 nt, Homo sapiens
guuacuuuggaaca

SEQ ID NO: 1780140 - RNA, 13 nt, Homo sapiens
auuggcuuuucau

SEQ ID NO: 1780141 - RNA, 19 nt, Homo sapiens
caacugaaguucuauuuau

SEQ ID NO: 1780142 - RNA, 18 nt, Homo sapiens
aaucaaaauaaaaauuaa

SEQ ID NO: 1780143 - RNA, 18 nt, Homo sapiens
gaggcugagacgcaagga

SEQ ID NO: 1780144 - RNA, 21 nt, Homo sapiens
cccagcaucgcacucuggcag

SEQ ID NO: 1780145 - RNA, 12 nt, Homo sapiens
ccccuccacugu

SEQ ID NO: 1780146 - RNA, 14 nt, Homo sapiens
ggcagguccagcuc

SEQ ID NO: 1780147 - RNA, 14 nt, Homo sapiens
gcuuugcuuuucaa

SEQ ID NO: 1780148 - RNA, 15 nt, Homo sapiens
uuaugcaaauacaau

SEQ ID NO: 1780149 - RNA, 14 nt, Homo sapiens
uauuauuccucaaa

SEQ ID NO: 1780150 - RNA, 16 nt, Homo sapiens
ugaaguguccuaaaua

SEQ ID NO: 1780151 - RNA, 18 nt, Homo sapiens
augcuuuuagaguugcaa

SEQ ID NO: 1780152 - RNA, 19 nt, Homo sapiens
cucaacugccuacuccaaa

SEQ ID NO: 1780153 - RNA, 14 nt, Homo sapiens
ugucagcaguuccc

SEQ ID NO: 1780154 - RNA, 17 nt, Homo sapiens
acuuugguacauggcca

SEQ ID NO: 1780155 - RNA, 15 nt, Homo sapiens
acuguugaguucuga

SEQ ID NO: 1780156 - RNA, 15 nt, Homo sapiens
guaguuauaaaccaa

SEQ ID NO: 1780157 - RNA, 19 nt, Homo sapiens
cauuucuuuauuucugucu

SEQ ID NO: 1780158 - RNA, 14 nt, Homo sapiens
uucauaguguucau

SEQ ID NO: 1780159 - RNA, 15 nt, Homo sapiens
guuaaauacaagucu

SEQ ID NO: 1780160 - RNA, 19 nt, Homo sapiens
uaaugauuuuuuuacuaau

SEQ ID NO: 1780161 - RNA, 18 nt, Homo sapiens
gucacuuauccucuugga

SEQ ID NO: 1780162 - RNA, 22 nt, Homo sapiens
caaaagcccauucauuccauuc

SEQ ID NO: 1780163 - RNA, 16 nt, Homo sapiens
uuucuaaaacugccuu

SEQ ID NO: 1780164 - RNA, 18 nt, Homo sapiens
uacaucagaaguuugcau

SEQ ID NO: 1780165 - RNA, 17 nt, Homo sapiens
gcaugccaaauguucca

SEQ ID NO: 1780166 - RNA, 14 nt, Homo sapiens
uacuuauucauugu

SEQ ID NO: 1780167 - RNA, 14 nt, Homo sapiens
ucuauguguaugca

SEQ ID NO: 1780168 - RNA, 23 nt, Homo sapiens
aauauauuuuaaguaucagaggu

SEQ ID NO: 1780169 - RNA, 22 nt, Homo sapiens
aaggcuuggaaacagaacugga

SEQ ID NO: 1780170 - RNA, 13 nt, Homo sapiens
ugaucgaugauuc

SEQ ID NO: 1780171 - RNA, 16 nt, Homo sapiens
aguaacuggugauaua

SEQ ID NO: 1780172 - RNA, 22 nt, Homo sapiens
ccuagaaugucagauuucuggu

SEQ ID NO: 1780173 - RNA, 16 nt, Homo sapiens
agcuucggcauuugau

SEQ ID NO: 1780174 - RNA, 17 nt, Homo sapiens
ugucuaaaaugucagug

SEQ ID NO: 1780175 - RNA, 18 nt, Homo sapiens
gcccaggccaucaccaca

SEQ ID NO: 1780176 - RNA, 23 nt, Homo sapiens
cucgauaaaucuaacaguuacuc

SEQ ID NO: 1780177 - RNA, 21 nt, Homo sapiens
uuugcuguuguuucuaaacaa

SEQ ID NO: 1780178 - RNA, 21 nt, Homo sapiens
cauguaugucagaagugcaga

SEQ ID NO: 1780179 - RNA, 22 nt, Homo sapiens
cuuucucccuggggaugugcuu

SEQ ID NO: 1780180 - RNA, 17 nt, Homo sapiens
uccuacaagacacagug

SEQ ID NO: 1780181 - RNA, 14 nt, Homo sapiens
ugaaggaauaucuc

SEQ ID NO: 1780182 - RNA, 11 nt, Homo sapiens
ccgacaugccu

SEQ ID NO: 1780183 - RNA, 18 nt, Homo sapiens
gcaauaucuacauucuau

SEQ ID NO: 1780184 - RNA, 22 nt, Homo sapiens
cgacguuugacuagccaucuca

SEQ ID NO: 1780185 - RNA, 15 nt, Homo sapiens
aguuuggauguugua

SEQ ID NO: 1780186 - RNA, 23 nt, Homo sapiens
agcacucucgcacacacagugau

SEQ ID NO: 1780187 - RNA, 22 nt, Homo sapiens
ucagaagagguugggcuuccau

SEQ ID NO: 1780188 - RNA, 13 nt, Homo sapiens
caccaacuuguag

SEQ ID NO: 1780189 - RNA, 13 nt, Homo sapiens
ucugccuuugguu

SEQ ID NO: 1780190 - RNA, 21 nt, Homo sapiens
ucaugagccguugcuaaugcc

SEQ ID NO: 1780191 - RNA, 18 nt, Homo sapiens
gcucacuguucuauucau

SEQ ID NO: 1780192 - RNA, 16 nt, Homo sapiens
ugggccacuguagggg

SEQ ID NO: 1780193 - RNA, 22 nt, Homo sapiens
ggacagccaccaagaaguggcu

SEQ ID NO: 1780194 - RNA, 13 nt, Homo sapiens
guggagucauuau

SEQ ID NO: 1780195 - RNA, 21 nt, Homo sapiens
uggugaaguaaauuaggcagu

SEQ ID NO: 1780196 - RNA, 14 nt, Homo sapiens
acaacuccuuccau

SEQ ID NO: 1780197 - RNA, 15 nt, Homo sapiens
ugaaaaauauugcua

SEQ ID NO: 1780198 - RNA, 20 nt, Homo sapiens
cagcucccaggaccacaggc

SEQ ID NO: 1780199 - RNA, 18 nt, Homo sapiens
ccauuaagucauguguga

SEQ ID NO: 1780200 - RNA, 21 nt, Homo sapiens
aaaugucugccauuugcugcu

SEQ ID NO: 1780201 - RNA, 18 nt, Homo sapiens
acaauuguaauugacagg

SEQ ID NO: 1780202 - RNA, 16 nt, Homo sapiens
aggcuggagugcagaa

SEQ ID NO: 1780203 - RNA, 17 nt, Homo sapiens
caggagcuuaaacagcu

SEQ ID NO: 1780204 - RNA, 23 nt, Homo sapiens
ccaaauuagggcaauuggaacaa

SEQ ID NO: 1780205 - RNA, 13 nt, Homo sapiens
cauuaacucaggc

SEQ ID NO: 1780206 - RNA, 21 nt, Homo sapiens
acccauuuacuuguugaugac

SEQ ID NO: 1780207 - RNA, 14 nt, Homo sapiens
ucucucucugugcu

SEQ ID NO: 1780208 - RNA, 20 nt, Homo sapiens
gagggaugccauaccuugag

SEQ ID NO: 1780209 - RNA, 13 nt, Homo sapiens
ugccaugccucaa

SEQ ID NO: 1780210 - RNA, 14 nt, Homo sapiens
uaucaggggugcau

SEQ ID NO: 1780211 - RNA, 18 nt, Homo sapiens
auuucaaaccauugcucu

SEQ ID NO: 1780212 - RNA, 14 nt, Homo sapiens
ccuuaaaccugcaa

SEQ ID NO: 1780213 - RNA, 17 nt, Homo sapiens
gccucugccccacccau

SEQ ID NO: 1780214 - RNA, 14 nt, Homo sapiens
aacugagaugcuga

SEQ ID NO: 1780215 - RNA, 14 nt, Homo sapiens
uggggagaaaggga

SEQ ID NO: 1780216 - RNA, 15 nt, Homo sapiens
aaucccacaucccag

SEQ ID NO: 1780217 - RNA, 16 nt, Homo sapiens
cugcaauccaaugcac

SEQ ID NO: 1780218 - RNA, 12 nt, Homo sapiens
agugauggagcu

SEQ ID NO: 1780219 - RNA, 12 nt, Homo sapiens
aucuauggauug

SEQ ID NO: 1780220 - RNA, 15 nt, Homo sapiens
ugcauagagcaauua

SEQ ID NO: 1780221 - RNA, 22 nt, Homo sapiens
guacuuggaagcauucacaaag

SEQ ID NO: 1780222 - RNA, 21 nt, Homo sapiens
ugaccucuugcugucucugcu

SEQ ID NO: 1780223 - RNA, 14 nt, Homo sapiens
aauuuagaggacaa

SEQ ID NO: 1780224 - RNA, 22 nt, Homo sapiens
cauauuauuauuaauuuugcca

SEQ ID NO: 1780225 - RNA, 16 nt, Homo sapiens
uccacaugcucugaga

SEQ ID NO: 1780226 - RNA, 21 nt, Homo sapiens
ugucuuguuucccagauuuca

SEQ ID NO: 1780227 - RNA, 22 nt, Homo sapiens
caaaauuacauguuaauuucca

SEQ ID NO: 1780228 - RNA, 20 nt, Homo sapiens
acauugcuaccucagugcuc

SEQ ID NO: 1780229 - RNA, 16 nt, Homo sapiens
aacccuagaccauguc

SEQ ID NO: 1780230 - RNA, 18 nt, Homo sapiens
auuccauggauugauuca

SEQ ID NO: 1780231 - RNA, 18 nt, Homo sapiens
aaucuuuuacaacugccu

SEQ ID NO: 1780232 - RNA, 20 nt, Homo sapiens
cuggaacacuagacaagcca

SEQ ID NO: 1780233 - RNA, 17 nt, Homo sapiens
ugccguauaggauguca

SEQ ID NO: 1780234 - RNA, 18 nt, Homo sapiens
guggucuuacaauggaca

SEQ ID NO: 1780235 - RNA, 14 nt, Homo sapiens
acauguauggacgu

SEQ ID NO: 1780236 - RNA, 16 nt, Homo sapiens
acuugaagcacuuaag

SEQ ID NO: 1780237 - RNA, 22 nt, Homo sapiens
ugcaggaucugucugugcacau

SEQ ID NO: 1780238 - RNA, 21 nt, Homo sapiens
uguucccgacauaacauugua

SEQ ID NO: 1780239 - RNA, 17 nt, Homo sapiens
aaucuugucaaccagug

SEQ ID NO: 1780240 - RNA, 18 nt, Homo sapiens
ccucccaguuugcugggu

SEQ ID NO: 1780241 - RNA, 21 nt, Homo sapiens
cacugaaaauuagacauuuau

SEQ ID NO: 1780242 - RNA, 16 nt, Homo sapiens
uagucauggauaacua

SEQ ID NO: 1780243 - RNA, 20 nt, Homo sapiens
cauucagacguuuuuucugc

SEQ ID NO: 1780244 - RNA, 18 nt, Homo sapiens
gaacuugauauauuucau

SEQ ID NO: 1780245 - RNA, 13 nt, Homo sapiens
cggccuggagcuc

SEQ ID NO: 1780246 - RNA, 19 nt, Homo sapiens
agguuggccuuacuguuga

SEQ ID NO: 1780247 - RNA, 15 nt, Homo sapiens
ucagucaucaucuca

SEQ ID NO: 1780248 - RNA, 15 nt, Homo sapiens
agcuccucuccugga

SEQ ID NO: 1780249 - RNA, 19 nt, Homo sapiens
ccuccugggcuauauuccu

SEQ ID NO: 1780250 - RNA, 18 nt, Homo sapiens
ggcuacuauagguccaga

SEQ ID NO: 1780251 - RNA, 22 nt, Homo sapiens
cacagauuauguuccugcugua

SEQ ID NO: 1780252 - RNA, 21 nt, Homo sapiens
cuccauguagaagccacuauu

SEQ ID NO: 1780253 - RNA, 20 nt, Homo sapiens
cuuucucugccagugacaga

SEQ ID NO: 1780254 - RNA, 13 nt, Homo sapiens
gaugauucaggag

SEQ ID NO: 1780255 - RNA, 17 nt, Homo sapiens
accacuuuuugcagcuu

SEQ ID NO: 1780256 - RNA, 18 nt, Homo sapiens
aggcagagguugcaguga

SEQ ID NO: 1780257 - RNA, 21 nt, Homo sapiens
auuuuuggacuggcagacuca

SEQ ID NO: 1780258 - RNA, 15 nt, Homo sapiens
uauguguucaaugaa

SEQ ID NO: 1780259 - RNA, 19 nt, Homo sapiens
aauuguuucuugacaagcu

SEQ ID NO: 1780260 - RNA, 12 nt, Homo sapiens
cugcagguugaa

SEQ ID NO: 1780261 - RNA, 16 nt, Homo sapiens
ucuaacccacccucac

SEQ ID NO: 1780262 - RNA, 17 nt, Homo sapiens
augggagaguccaggcc

SEQ ID NO: 1780263 - RNA, 21 nt, Homo sapiens
gccuuugcuucuugcacccag

SEQ ID NO: 1780264 - RNA, 15 nt, Homo sapiens
gacuauuuucuuuca

SEQ ID NO: 1780265 - RNA, 18 nt, Homo sapiens
gaccuguuuuuguguuuu

SEQ ID NO: 1780266 - RNA, 18 nt, Homo sapiens
aucccuauguugcuauaa

SEQ ID NO: 1780267 - RNA, 17 nt, Homo sapiens
ggaaaaugcuucuuggc

SEQ ID NO: 1780268 - RNA, 14 nt, Homo sapiens
aauaaacugugcaa

SEQ ID NO: 1780269 - RNA, 23 nt, Homo sapiens
agaccaacagaacuucacaguga

SEQ ID NO: 1780270 - RNA, 13 nt, Homo sapiens
uugccuuuuacuu

SEQ ID NO: 1780271 - RNA, 17 nt, Homo sapiens
ccagguuucuucucugg

SEQ ID NO: 1780272 - RNA, 16 nt, Homo sapiens
uagcucuguaguggaa

SEQ ID NO: 1780273 - RNA, 20 nt, Homo sapiens
agauguacuauaacauagaa

SEQ ID NO: 1780274 - RNA, 11 nt, Homo sapiens
gcaugugccag

SEQ ID NO: 1780275 - RNA, 16 nt, Homo sapiens
acuuaacacccaguga

SEQ ID NO: 1780276 - RNA, 17 nt, Homo sapiens
cuacaagugauccucag

SEQ ID NO: 1780277 - RNA, 20 nt, Homo sapiens
gcagauaaagacagcugaca

SEQ ID NO: 1780278 - RNA, 15 nt, Homo sapiens
cucuaaauagcacuu

SEQ ID NO: 1780279 - RNA, 14 nt, Homo sapiens
aggaaugauccaua

SEQ ID NO: 1780280 - RNA, 14 nt, Homo sapiens
acauaauaauagca

SEQ ID NO: 1780281 - RNA, 19 nt, Homo sapiens
caucuccuauaaucuguca

SEQ ID NO: 1780282 - RNA, 17 nt, Homo sapiens
accuacccuccacaggc

SEQ ID NO: 1780283 - RNA, 15 nt, Homo sapiens
auuacccuuuugcag

SEQ ID NO: 1780284 - RNA, 14 nt, Homo sapiens
accuacauauucca

SEQ ID NO: 1780285 - RNA, 23 nt, Homo sapiens
ccagcauuuuuauaaacuaccaa

SEQ ID NO: 1780286 - RNA, 22 nt, Homo sapiens
agcuaauguaauaacugugaag

SEQ ID NO: 1780287 - RNA, 23 nt, Homo sapiens
gauaucauucagcaucuacucua

SEQ ID NO: 1780288 - RNA, 23 nt, Homo sapiens
guuaaaauaaagcuuacauaguu

SEQ ID NO: 1780289 - RNA, 15 nt, Homo sapiens
ucccaguaaaaggca

SEQ ID NO: 1780290 - RNA, 13 nt, Homo sapiens
uuuaaaacacaug

SEQ ID NO: 1780291 - RNA, 20 nt, Homo sapiens
acauucuacacacagugccu

SEQ ID NO: 1780292 - RNA, 20 nt, Homo sapiens
ucaaaacaaccacuuucuca

SEQ ID NO: 1780293 - RNA, 18 nt, Homo sapiens
ccggaggaaaauuugaca

SEQ ID NO: 1780294 - RNA, 18 nt, Homo sapiens
augucuguaccuugauac

SEQ ID NO: 1780295 - RNA, 16 nt, Homo sapiens
cacccgacuccucaaa

SEQ ID NO: 1780296 - RNA, 20 nt, Homo sapiens
ugaaacaucucaacaaccug

SEQ ID NO: 1780297 - RNA, 21 nt, Homo sapiens
cucuucuagcauuucuuccaa

SEQ ID NO: 1780298 - RNA, 16 nt, Homo sapiens
ucacccuguauguuag

SEQ ID NO: 1780299 - RNA, 20 nt, Homo sapiens
ucauuagaacuucaagcucu

SEQ ID NO: 1780300 - RNA, 22 nt, Homo sapiens
agccauuccuguucccaugaga

SEQ ID NO: 1780301 - RNA, 23 nt, Homo sapiens
aaauguuuguuauuuacacuggu

SEQ ID NO: 1780302 - RNA, 14 nt, Homo sapiens
gcguuaacacagua

SEQ ID NO: 1780303 - RNA, 14 nt, Homo sapiens
aucaacuccagucu

SEQ ID NO: 1780304 - RNA, 17 nt, Homo sapiens
uuuauaaccugaugcca

SEQ ID NO: 1780305 - RNA, 17 nt, Homo sapiens
ccuuaagacacugugag

SEQ ID NO: 1780306 - RNA, 17 nt, Homo sapiens
augcaaauccuauguga

SEQ ID NO: 1780307 - RNA, 19 nt, Homo sapiens
gcuuggguggagaagccau

SEQ ID NO: 1780308 - RNA, 16 nt, Homo sapiens
uguuuuuuuucagcca

SEQ ID NO: 1780309 - RNA, 17 nt, Homo sapiens
cccuccccucagcgcag

SEQ ID NO: 1780310 - RNA, 17 nt, Homo sapiens
auuaaggguuaccccac

SEQ ID NO: 1780311 - RNA, 15 nt, Homo sapiens
cucuuacauguauaa

SEQ ID NO: 1780312 - RNA, 15 nt, Homo sapiens
gaaaaacuaaugugu

SEQ ID NO: 1780313 - RNA, 23 nt, Homo sapiens
guacacuucgcgcaccuucucac

SEQ ID NO: 1780314 - RNA, 19 nt, Homo sapiens
aaaacauugauuauaagca

SEQ ID NO: 1780315 - RNA, 16 nt, Homo sapiens
caccagacgaacagug

SEQ ID NO: 1780316 - RNA, 19 nt, Homo sapiens
uucaagugauaggauaaag

SEQ ID NO: 1780317 - RNA, 19 nt, Homo sapiens
aaaaguucuuuuugcucua

SEQ ID NO: 1780318 - RNA, 23 nt, Homo sapiens
acagguaauauaaaaagcuucca

SEQ ID NO: 1780319 - RNA, 12 nt, Homo sapiens
cacuuaauagca

SEQ ID NO: 1780320 - RNA, 19 nt, Homo sapiens
ucauugucgcucagcaaua

SEQ ID NO: 1780321 - RNA, 17 nt, Homo sapiens
cccaaaacugucauccu

SEQ ID NO: 1780322 - RNA, 16 nt, Homo sapiens
cuucccugacacuguc

SEQ ID NO: 1780323 - RNA, 19 nt, Homo sapiens
cuugccuaagacuugccca

SEQ ID NO: 1780324 - RNA, 22 nt, Homo sapiens
accuccuuuucuucuagcuuug

SEQ ID NO: 1780325 - RNA, 17 nt, Homo sapiens
aacuagcauuacauuau

SEQ ID NO: 1780326 - RNA, 17 nt, Homo sapiens
uuaauuaaacuuaggua

SEQ ID NO: 1780327 - RNA, 14 nt, Homo sapiens
gugugggggguccu

SEQ ID NO: 1780328 - RNA, 23 nt, Homo sapiens
uacacucaaacuauagugauaua

SEQ ID NO: 1780329 - RNA, 14 nt, Homo sapiens
uggcaaaaaugcaa

SEQ ID NO: 1780330 - RNA, 14 nt, Homo sapiens
aggcaaaauugcaa

SEQ ID NO: 1780331 - RNA, 12 nt, Homo sapiens
aacucugugagg

SEQ ID NO: 1780332 - RNA, 17 nt, Homo sapiens
aaugucugugaauuuca

SEQ ID NO: 1780333 - RNA, 15 nt, Homo sapiens
augugcuucacauaa

SEQ ID NO: 1780334 - RNA, 14 nt, Homo sapiens
cucccaucuucagg

SEQ ID NO: 1780335 - RNA, 16 nt, Homo sapiens
guuugauuuuugacca

SEQ ID NO: 1780336 - RNA, 16 nt, Homo sapiens
ucugaacugcuugcua

SEQ ID NO: 1780337 - RNA, 12 nt, Homo sapiens
uucauacuuuga

SEQ ID NO: 1780338 - RNA, 12 nt, Homo sapiens
uucuuacuuugu

SEQ ID NO: 1780339 - RNA, 18 nt, Homo sapiens
guuucuuccccccagaua

SEQ ID NO: 1780340 - RNA, 17 nt, Homo sapiens
augugaaacauguuucu

SEQ ID NO: 1780341 - RNA, 17 nt, Homo sapiens
ugggagccucauaaaga

SEQ ID NO: 1780342 - RNA, 18 nt, Homo sapiens
aggggugugauuggagug

SEQ ID NO: 1780343 - RNA, 20 nt, Homo sapiens
uucccuaucaaaacauauca

SEQ ID NO: 1780344 - RNA, 18 nt, Homo sapiens
ucaguaaauaccuugaaa

SEQ ID NO: 1780345 - RNA, 18 nt, Homo sapiens
aaauggugccuggagcua

SEQ ID NO: 1780346 - RNA, 16 nt, Homo sapiens
gccugagcccagggag

SEQ ID NO: 1780347 - RNA, 22 nt, Homo sapiens
guaguuuguuuuagaaccagcc

SEQ ID NO: 1780348 - RNA, 22 nt, Homo sapiens
auucccaugguagacugugaca

SEQ ID NO: 1780349 - RNA, 19 nt, Homo sapiens
gaugaaacuggaaaacuac

SEQ ID NO: 1780350 - RNA, 15 nt, Homo sapiens
acucccuccccagau

SEQ ID NO: 1780351 - RNA, 23 nt, Homo sapiens
aguaccagcauguuaacuuuauu

SEQ ID NO: 1780352 - RNA, 17 nt, Homo sapiens
gaaaauauaaaacaaau

SEQ ID NO: 1780353 - RNA, 17 nt, Homo sapiens
auguauuuuugucauag

SEQ ID NO: 1780354 - RNA, 13 nt, Homo sapiens
gcaaaaucacuua

SEQ ID NO: 1780355 - RNA, 14 nt, Homo sapiens
auuaaauaaucucu

SEQ ID NO: 1780356 - RNA, 22 nt, Homo sapiens
ugaaauuaauuugugaauuugc

SEQ ID NO: 1780357 - RNA, 18 nt, Homo sapiens
acuuauggaacagggaug

SEQ ID NO: 1780358 - RNA, 18 nt, Homo sapiens
cugcucuccugggagaca

SEQ ID NO: 1780359 - RNA, 19 nt, Homo sapiens
cuaauuggcaugaaggugu

SEQ ID NO: 1780360 - RNA, 17 nt, Homo sapiens
uaaugugcugugugaca

SEQ ID NO: 1780361 - RNA, 21 nt, Homo sapiens
acacacaaaccuacugcccac

SEQ ID NO: 1780362 - RNA, 17 nt, Homo sapiens
guuaugcaucauuucag

SEQ ID NO: 1780363 - RNA, 17 nt, Homo sapiens
ggcaacaucuugcaaaa

SEQ ID NO: 1780364 - RNA, 12 nt, Homo sapiens
uccucugcugac

SEQ ID NO: 1780365 - RNA, 21 nt, Homo sapiens
ucaagcaggcgccaagugcua

SEQ ID NO: 1780366 - RNA, 16 nt, Homo sapiens
ugcauucuauugccuu

SEQ ID NO: 1780367 - RNA, 15 nt, Homo sapiens
aaagacaaacaguag

SEQ ID NO: 1780368 - RNA, 18 nt, Homo sapiens
uuaucugucacaccugug

SEQ ID NO: 1780369 - RNA, 19 nt, Homo sapiens
aucugugaaguaguucugu

SEQ ID NO: 1780370 - RNA, 16 nt, Homo sapiens
accauucccaagccau

SEQ ID NO: 1780371 - RNA, 18 nt, Homo sapiens
ugugacugcugccauuuu

SEQ ID NO: 1780372 - RNA, 15 nt, Homo sapiens
acagaaaaucuuucc

SEQ ID NO: 1780373 - RNA, 17 nt, Homo sapiens
uccacagucucccauuc

SEQ ID NO: 1780374 - RNA, 20 nt, Homo sapiens
uucagcccaccagccaccuc

SEQ ID NO: 1780375 - RNA, 22 nt, Homo sapiens
cugggaggccaggauggcacug

SEQ ID NO: 1780376 - RNA, 13 nt, Homo sapiens
gcuuuguaccaaa

SEQ ID NO: 1780377 - RNA, 19 nt, Homo sapiens
acuugucacugacacaaag

SEQ ID NO: 1780378 - RNA, 22 nt, Homo sapiens
cauaaauuacagucaucugucu

SEQ ID NO: 1780379 - RNA, 18 nt, Homo sapiens
agggaaaacauuccaucc

SEQ ID NO: 1780380 - RNA, 19 nt, Homo sapiens
acccacaacgaaugaauga

SEQ ID NO: 1780381 - RNA, 17 nt, Homo sapiens
auccauccugcucagga

SEQ ID NO: 1780382 - RNA, 22 nt, Homo sapiens
caaucuuauguuuccaagagaa

SEQ ID NO: 1780383 - RNA, 19 nt, Homo sapiens
aucucggcuguuccugaga

SEQ ID NO: 1780384 - RNA, 13 nt, Homo sapiens
uuaauaaauggau

SEQ ID NO: 1780385 - RNA, 13 nt, Homo sapiens
aucccauuccugg

SEQ ID NO: 1780386 - RNA, 19 nt, Homo sapiens
auguggagcuacugaugaa

SEQ ID NO: 1780387 - RNA, 15 nt, Homo sapiens
uauacgcaucuauaa

SEQ ID NO: 1780388 - RNA, 18 nt, Homo sapiens
uuaauguuaacaagacaa

SEQ ID NO: 1780389 - RNA, 14 nt, Homo sapiens
acuaccaauuuccc

SEQ ID NO: 1780390 - RNA, 22 nt, Homo sapiens
uaugcauuauaaauaaauacca

SEQ ID NO: 1780391 - RNA, 19 nt, Homo sapiens
cacauuuacaaguagugaa

SEQ ID NO: 1780392 - RNA, 21 nt, Homo sapiens
ugaaaccuuauuuuuucccaa

SEQ ID NO: 1780393 - RNA, 17 nt, Homo sapiens
guacaaauguauuuuga

SEQ ID NO: 1780394 - RNA, 14 nt, Homo sapiens
caagugacuuucua

SEQ ID NO: 1780395 - RNA, 17 nt, Homo sapiens
aguccaguaaagccuua

SEQ ID NO: 1780396 - RNA, 17 nt, Homo sapiens
uuccuaaaucuuaagaa

SEQ ID NO: 1780397 - RNA, 18 nt, Homo sapiens
caggaaguagcacaggcu

SEQ ID NO: 1780398 - RNA, 13 nt, Homo sapiens
ccauuuguaauaa

SEQ ID NO: 1780399 - RNA, 15 nt, Homo sapiens
gaagcuuccauucca

SEQ ID NO: 1780400 - RNA, 19 nt, Homo sapiens
cgguuuuauaaaagccuug

SEQ ID NO: 1780401 - RNA, 20 nt, Homo sapiens
cuguucucuuguauagcuga

SEQ ID NO: 1780402 - RNA, 23 nt, Homo sapiens
gcuccugauggugucauucugcc

SEQ ID NO: 1780403 - RNA, 17 nt, Homo sapiens
ugucugucaccagcuau

SEQ ID NO: 1780404 - RNA, 19 nt, Homo sapiens
ccagugugacacugcuuua

SEQ ID NO: 1780405 - RNA, 16 nt, Homo sapiens
gucccaccccuaccuc

SEQ ID NO: 1780406 - RNA, 15 nt, Homo sapiens
ucaacagcuccccau

SEQ ID NO: 1780407 - RNA, 13 nt, Homo sapiens
aucuacacccacc

SEQ ID NO: 1780408 - RNA, 21 nt, Homo sapiens
augccuagacuucccaacagc

SEQ ID NO: 1780409 - RNA, 18 nt, Homo sapiens
gucuggcugguguuaaca

SEQ ID NO: 1780410 - RNA, 15 nt, Homo sapiens
gcuuuaggugguguu

SEQ ID NO: 1780411 - RNA, 21 nt, Homo sapiens
auagcuuccccaccagcuuua

SEQ ID NO: 1780412 - RNA, 22 nt, Homo sapiens
caaaacaucuuuucacaacuua

SEQ ID NO: 1780413 - RNA, 11 nt, Homo sapiens
uuugagccaug

SEQ ID NO: 1780414 - RNA, 20 nt, Homo sapiens
aaucuuucugcagaaacaga

SEQ ID NO: 1780415 - RNA, 14 nt, Homo sapiens
aggaucugcuccaa

SEQ ID NO: 1780416 - RNA, 12 nt, Homo sapiens
augaugaugauu

SEQ ID NO: 1780417 - RNA, 14 nt, Homo sapiens
uuaguuaacugaau

SEQ ID NO: 1780418 - RNA, 23 nt, Homo sapiens
agcaaggguuggguuguguucgu

SEQ ID NO: 1780419 - RNA, 19 nt, Homo sapiens
gaaguagauuaagagccau

SEQ ID NO: 1780420 - RNA, 19 nt, Homo sapiens
gcacuucguggaugaccuc

SEQ ID NO: 1780421 - RNA, 13 nt, Homo sapiens
ccccucaucucau

SEQ ID NO: 1780422 - RNA, 20 nt, Homo sapiens
gugaauaggcugaugggcaa

SEQ ID NO: 1780423 - RNA, 20 nt, Homo sapiens
ggcuguuaggacagcaaagc

SEQ ID NO: 1780424 - RNA, 20 nt, Homo sapiens
aacuaaaaggaagucaucca

SEQ ID NO: 1780425 - RNA, 16 nt, Homo sapiens
auuuacaaagugugua

SEQ ID NO: 1780426 - RNA, 14 nt, Homo sapiens
cuucuuacucuccu

SEQ ID NO: 1780427 - RNA, 17 nt, Homo sapiens
uuggucacaaagcuauu

SEQ ID NO: 1780428 - RNA, 18 nt, Homo sapiens
ugcauauuuuguaacuuc

SEQ ID NO: 1780429 - RNA, 20 nt, Homo sapiens
uguucuguagcuuucuggaa

SEQ ID NO: 1780430 - RNA, 16 nt, Homo sapiens
uagaaaagaaagcaaa

SEQ ID NO: 1780431 - RNA, 20 nt, Homo sapiens
ugaagaguuuacugaagcaa

SEQ ID NO: 1780432 - RNA, 19 nt, Homo sapiens
acauccacaugcucugcag

SEQ ID NO: 1780433 - RNA, 19 nt, Homo sapiens
uaacaauucccaguacuau

SEQ ID NO: 1780434 - RNA, 19 nt, Homo sapiens
cugugccauuucucaggga

SEQ ID NO: 1780435 - RNA, 21 nt, Homo sapiens
acccccuucaaaccuaaaaau

SEQ ID NO: 1780436 - RNA, 21 nt, Homo sapiens
gggagaucuuggggugcagca

SEQ ID NO: 1780437 - RNA, 22 nt, Homo sapiens
aaacucuuucauucuucucaca

SEQ ID NO: 1780438 - RNA, 16 nt, Homo sapiens
ccucuucucuccucag

SEQ ID NO: 1780439 - RNA, 21 nt, Homo sapiens
aauaauuuuuaauugcuuaua

SEQ ID NO: 1780440 - RNA, 22 nt, Homo sapiens
acaguuuuccaaacugugucac

SEQ ID NO: 1780441 - RNA, 14 nt, Homo sapiens
uaccuccauccauc

SEQ ID NO: 1780442 - RNA, 14 nt, Homo sapiens
acaaaacaaaacaa

SEQ ID NO: 1780443 - RNA, 13 nt, Homo sapiens
agccacacagagc

SEQ ID NO: 1780444 - RNA, 18 nt, Homo sapiens
ccagugcccugagccagg

SEQ ID NO: 1780445 - RNA, 20 nt, Homo sapiens
uugaggcaaauuaacuguau

SEQ ID NO: 1780446 - RNA, 21 nt, Homo sapiens
cauauaaaucucaaugaauuc

SEQ ID NO: 1780447 - RNA, 21 nt, Homo sapiens
acagagucuggcucugucacc

SEQ ID NO: 1780448 - RNA, 23 nt, Homo sapiens
agccccaugugugacccuuguca

SEQ ID NO: 1780449 - RNA, 20 nt, Homo sapiens
uugacuuuauuucugagcaa

SEQ ID NO: 1780450 - RNA, 16 nt, Homo sapiens
auauuguaaagcccau

SEQ ID NO: 1780451 - RNA, 20 nt, Homo sapiens
aaauaaguuacaucuacaaa

SEQ ID NO: 1780452 - RNA, 21 nt, Homo sapiens
cccuacauuaaacaugacucc

SEQ ID NO: 1780453 - RNA, 18 nt, Homo sapiens
uaaaaccuuaagaguucu

SEQ ID NO: 1780454 - RNA, 21 nt, Homo sapiens
auucacuguuuguuacuaugu

SEQ ID NO: 1780455 - RNA, 14 nt, Homo sapiens
gaaaacccagauaa

SEQ ID NO: 1780456 - RNA, 12 nt, Homo sapiens
cuaaacauuuca

SEQ ID NO: 1780457 - RNA, 16 nt, Homo sapiens
ggaggcugcagugagc

SEQ ID NO: 1780458 - RNA, 15 nt, Homo sapiens
cauauaauuauaugu

SEQ ID NO: 1780459 - RNA, 13 nt, Homo sapiens
guaguuuugccaa

SEQ ID NO: 1780460 - RNA, 14 nt, Homo sapiens
acccgugugcacac

SEQ ID NO: 1780461 - RNA, 15 nt, Homo sapiens
auaaagcaagacaga

SEQ ID NO: 1780462 - RNA, 16 nt, Homo sapiens
gucucuacuaaaaaua

SEQ ID NO: 1780463 - RNA, 15 nt, Homo sapiens
aaauggaggccuguc

SEQ ID NO: 1780464 - RNA, 16 nt, Homo sapiens
caauuauugauauaua

SEQ ID NO: 1780465 - RNA, 16 nt, Homo sapiens
aaaagggaacugaaca

SEQ ID NO: 1780466 - RNA, 16 nt, Homo sapiens
cccaaacccuucagug

SEQ ID NO: 1780467 - RNA, 15 nt, Homo sapiens
ucccacauuagcuug

SEQ ID NO: 1780468 - RNA, 14 nt, Homo sapiens
cccacucaggggac

SEQ ID NO: 1780469 - RNA, 14 nt, Homo sapiens
accuaaguacuuaa

SEQ ID NO: 1780470 - RNA, 14 nt, Homo sapiens
cuuucugucucucu

SEQ ID NO: 1780471 - RNA, 20 nt, Homo sapiens
uauaucauaacuauacuuga

SEQ ID NO: 1780472 - RNA, 22 nt, Homo sapiens
caaaauuuugcuccccagugaa

SEQ ID NO: 1780473 - RNA, 16 nt, Homo sapiens
agccaggcgugguggu

SEQ ID NO: 1780474 - RNA, 18 nt, Homo sapiens
aaaccaugagaauuugca

SEQ ID NO: 1780475 - RNA, 16 nt, Homo sapiens
auugcuaauuuagaga

SEQ ID NO: 1780476 - RNA, 17 nt, Homo sapiens
guggacucagcagugac

SEQ ID NO: 1780477 - RNA, 21 nt, Homo sapiens
agccucccugacgucugccac

SEQ ID NO: 1780478 - RNA, 22 nt, Homo sapiens
aguggccccaucauagccugca

SEQ ID NO: 1780479 - RNA, 16 nt, Homo sapiens
gagagcgccacccgcc

SEQ ID NO: 1780480 - RNA, 12 nt, Homo sapiens
uaucacuguugc

SEQ ID NO: 1780481 - RNA, 24 nt, Homo sapiens
uuaauuuacagaaaucaaugguag

SEQ ID NO: 1780482 - RNA, 14 nt, Homo sapiens
cucacuuccagugc

SEQ ID NO: 1780483 - RNA, 20 nt, Homo sapiens
uuauacgacuuuuaagcaaa

SEQ ID NO: 1780484 - RNA, 22 nt, Homo sapiens
gcccaggucucucaacuucauc

SEQ ID NO: 1780485 - RNA, 11 nt, Homo sapiens
gcugggaacau

SEQ ID NO: 1780486 - RNA, 22 nt, Homo sapiens
acuaaauacuguaacacuguau

SEQ ID NO: 1780487 - RNA, 20 nt, Homo sapiens
cuuuaauauuuccaauguga

SEQ ID NO: 1780488 - RNA, 19 nt, Homo sapiens
auaaccuaacacuaucaua

SEQ ID NO: 1780489 - RNA, 11 nt, Homo sapiens
agcugcucccc

SEQ ID NO: 1780490 - RNA, 21 nt, Homo sapiens
uaaagugaauaaccacuuaaa

SEQ ID NO: 1780491 - RNA, 23 nt, Homo sapiens
gaaaugguuuccaucuguacuuu

SEQ ID NO: 1780492 - RNA, 13 nt, Homo sapiens
acaaacucaucca

SEQ ID NO: 1780493 - RNA, 23 nt, Homo sapiens
uuucaaaauucaaaaaaaaaagc

SEQ ID NO: 1780494 - RNA, 14 nt, Homo sapiens
ccauuaaaagccau

SEQ ID NO: 1780495 - RNA, 21 nt, Homo sapiens
ucaggccugggcaggacccug

SEQ ID NO: 1780496 - RNA, 16 nt, Homo sapiens
agggugaccacaccuu

SEQ ID NO: 1780497 - RNA, 19 nt, Homo sapiens
ucaaaaccaaguaucacac

SEQ ID NO: 1780498 - RNA, 16 nt, Homo sapiens
cccaagcuguggcagc

SEQ ID NO: 1780499 - RNA, 12 nt, Homo sapiens
uguagaauuaua

SEQ ID NO: 1780500 - RNA, 19 nt, Homo sapiens
ugucauuccuaaaacaccc

SEQ ID NO: 1780501 - RNA, 16 nt, Homo sapiens
cuucacuuucuucaaa

SEQ ID NO: 1780502 - RNA, 18 nt, Homo sapiens
cguaggguggcacuggga

SEQ ID NO: 1780503 - RNA, 12 nt, Homo sapiens
cacucugcaggg

SEQ ID NO: 1780504 - RNA, 15 nt, Homo sapiens
ucuuuggacagaagc

SEQ ID NO: 1780505 - RNA, 22 nt, Homo sapiens
ccucuuguugcagagauuuccu

SEQ ID NO: 1780506 - RNA, 16 nt, Homo sapiens
aaccaggucaccaucc

SEQ ID NO: 1780507 - RNA, 11 nt, Homo sapiens
gaaaaucugaa

SEQ ID NO: 1780508 - RNA, 15 nt, Homo sapiens
gccucauuugaaugu

SEQ ID NO: 1780509 - RNA, 23 nt, Homo sapiens
ccacagaacacagcaauuccuca

SEQ ID NO: 1780510 - RNA, 17 nt, Homo sapiens
cugcacguauacaccca

SEQ ID NO: 1780511 - RNA, 17 nt, Homo sapiens
uucaagggucaggguga

SEQ ID NO: 1780512 - RNA, 14 nt, Homo sapiens
augccacuaugaaa

SEQ ID NO: 1780513 - RNA, 15 nt, Homo sapiens
acuuguccuagcaca

SEQ ID NO: 1780514 - RNA, 12 nt, Homo sapiens
uuaccucugaua

SEQ ID NO: 1780515 - RNA, 17 nt, Homo sapiens
ugcaagcuggaugccug

SEQ ID NO: 1780516 - RNA, 19 nt, Homo sapiens
ggagaauacugccaaaaca

SEQ ID NO: 1780517 - RNA, 15 nt, Homo sapiens
ugcccuaucacccaa

SEQ ID NO: 1780518 - RNA, 16 nt, Homo sapiens
guguuuggagcucuau

SEQ ID NO: 1780519 - RNA, 14 nt, Homo sapiens
uguucucugaucug

SEQ ID NO: 1780520 - RNA, 14 nt, Homo sapiens
caacccuucccuca

SEQ ID NO: 1780521 - RNA, 16 nt, Homo sapiens
gcauagaaacugagga

SEQ ID NO: 1780522 - RNA, 14 nt, Homo sapiens
cuccaucaccagcc

SEQ ID NO: 1780523 - RNA, 19 nt, Homo sapiens
caguguaacccaagcauuu

SEQ ID NO: 1780524 - RNA, 12 nt, Homo sapiens
auccaagacaaa

SEQ ID NO: 1780525 - RNA, 20 nt, Homo sapiens
guauaaagcucucaaaugug

SEQ ID NO: 1780526 - RNA, 20 nt, Homo sapiens
uuugcuuaggaaauugcuca

SEQ ID NO: 1780527 - RNA, 13 nt, Homo sapiens
gauguuuuacgca

SEQ ID NO: 1780528 - RNA, 17 nt, Homo sapiens
uauugcaaaauacauga

SEQ ID NO: 1780529 - RNA, 19 nt, Homo sapiens
auuaaugaaauaucuguau

SEQ ID NO: 1780530 - RNA, 15 nt, Homo sapiens
uccccauucagugac

SEQ ID NO: 1780531 - RNA, 13 nt, Homo sapiens
ugaaaaagcaugu

SEQ ID NO: 1780532 - RNA, 21 nt, Homo sapiens
acuaaggaguaaucuguguac

SEQ ID NO: 1780533 - RNA, 13 nt, Homo sapiens
cuucuaguuuuau

SEQ ID NO: 1780534 - RNA, 16 nt, Homo sapiens
accuguaguuuuacau

SEQ ID NO: 1780535 - RNA, 17 nt, Homo sapiens
cccagaaagaggcagug

SEQ ID NO: 1780536 - RNA, 19 nt, Homo sapiens
ugcuaaggcagcugaucca

SEQ ID NO: 1780537 - RNA, 21 nt, Homo sapiens
cuuccagcccggggccagcuu

SEQ ID NO: 1780538 - RNA, 24 nt, Homo sapiens
uuacuguaauuggugacaauguca

SEQ ID NO: 1780539 - RNA, 16 nt, Homo sapiens
cucccagaaucccagc

SEQ ID NO: 1780540 - RNA, 17 nt, Homo sapiens
acugaagggguucucac

SEQ ID NO: 1780541 - RNA, 19 nt, Homo sapiens
cuaagagacaguucucugu

SEQ ID NO: 1780542 - RNA, 19 nt, Homo sapiens
ugcucagcagccagucuca

SEQ ID NO: 1780543 - RNA, 22 nt, Homo sapiens
ucaaacuugugagguguuugca

SEQ ID NO: 1780544 - RNA, 16 nt, Homo sapiens
cauccccacucacgaa

SEQ ID NO: 1780545 - RNA, 13 nt, Homo sapiens
cuguguuaggggu

SEQ ID NO: 1780546 - RNA, 14 nt, Homo sapiens
uuggugcauaagca

SEQ ID NO: 1780547 - RNA, 14 nt, Homo sapiens
uaccuguguucaga

SEQ ID NO: 1780548 - RNA, 22 nt, Homo sapiens
uagggguuaacuuggucagagc

SEQ ID NO: 1780549 - RNA, 15 nt, Homo sapiens
aggagggcucaggga

SEQ ID NO: 1780550 - RNA, 12 nt, Homo sapiens
ugggagcuuucc

SEQ ID NO: 1780551 - RNA, 16 nt, Homo sapiens
ugaucaggucuuuacu

SEQ ID NO: 1780552 - RNA, 21 nt, Homo sapiens
acuaacuccuaggaaaauacu

SEQ ID NO: 1780553 - RNA, 22 nt, Homo sapiens
ggcaggaggaucacagugaccu

SEQ ID NO: 1780554 - RNA, 22 nt, Homo sapiens
cuccuccaccccugucauucac

SEQ ID NO: 1780555 - RNA, 14 nt, Homo sapiens
acucagccuuccuc

SEQ ID NO: 1780556 - RNA, 15 nt, Homo sapiens
auuucccccagggaa

SEQ ID NO: 1780557 - RNA, 20 nt, Homo sapiens
aagaagaaacgucuaugugu

SEQ ID NO: 1780558 - RNA, 22 nt, Homo sapiens
aggagaggacugggccugaugg

SEQ ID NO: 1780559 - RNA, 15 nt, Homo sapiens
ucucugccagugaca

SEQ ID NO: 1780560 - RNA, 20 nt, Homo sapiens
gcauaggccauauaauguua

SEQ ID NO: 1780561 - RNA, 18 nt, Homo sapiens
acaguggcucaugccugu

SEQ ID NO: 1780562 - RNA, 15 nt, Homo sapiens
aggagggagugcugu

SEQ ID NO: 1780563 - RNA, 16 nt, Homo sapiens
gacaaugaugaugaua

SEQ ID NO: 1780564 - RNA, 18 nt, Homo sapiens
uauauaauaaaagugccu

SEQ ID NO: 1780565 - RNA, 24 nt, Homo sapiens
ucacuacugguguucuguuucaau

SEQ ID NO: 1780566 - RNA, 17 nt, Homo sapiens
uccauaaaaguccuguc

SEQ ID NO: 1780567 - RNA, 17 nt, Homo sapiens
ucuaucccagaguacaa

SEQ ID NO: 1780568 - RNA, 14 nt, Homo sapiens
acucgagagugggc

SEQ ID NO: 1780569 - RNA, 18 nt, Homo sapiens
uuuaucuguuuccugaca

SEQ ID NO: 1780570 - RNA, 13 nt, Homo sapiens
cugaccagacugu

SEQ ID NO: 1780571 - RNA, 11 nt, Homo sapiens
gaaauuacuuc

SEQ ID NO: 1780572 - RNA, 13 nt, Homo sapiens
aauuugacauaca

SEQ ID NO: 1780573 - RNA, 14 nt, Homo sapiens
augagcacaucucu

SEQ ID NO: 1780574 - RNA, 15 nt, Homo sapiens
ggcacauuggcagug

SEQ ID NO: 1780575 - RNA, 18 nt, Homo sapiens
gcagcgagcugagaucac

SEQ ID NO: 1780576 - RNA, 22 nt, Homo sapiens
guguccauagauauaaagccau

SEQ ID NO: 1780577 - RNA, 23 nt, Homo sapiens
cuuuuauuuuuuaagguaacaaa

SEQ ID NO: 1780578 - RNA, 17 nt, Homo sapiens
cagcagccagcucucag

SEQ ID NO: 1780579 - RNA, 16 nt, Homo sapiens
gcucucucuucuuauu

SEQ ID NO: 1780580 - RNA, 18 nt, Homo sapiens
aagaucugaguugagacc

SEQ ID NO: 1780581 - RNA, 18 nt, Homo sapiens
aucugcuuguauuuucca

SEQ ID NO: 1780582 - RNA, 18 nt, Homo sapiens
agccauaagaaagcacua

SEQ ID NO: 1780583 - RNA, 16 nt, Homo sapiens
agccauugcuucuccc

SEQ ID NO: 1780584 - RNA, 22 nt, Homo sapiens
uaguagacauguguguguguga

SEQ ID NO: 1780585 - RNA, 14 nt, Homo sapiens
aggucugaaggauu

SEQ ID NO: 1780586 - RNA, 16 nt, Homo sapiens
uucaguguacauggaa

SEQ ID NO: 1780587 - RNA, 17 nt, Homo sapiens
ucagaucauauuucaca

SEQ ID NO: 1780588 - RNA, 19 nt, Homo sapiens
cuccagaauggaacucaag

SEQ ID NO: 1780589 - RNA, 21 nt, Homo sapiens
aaggagauucaaacucaauga

SEQ ID NO: 1780590 - RNA, 20 nt, Homo sapiens
uuaaagugccuuaucaaaua

SEQ ID NO: 1780591 - RNA, 14 nt, Homo sapiens
auuacagacaugaa

SEQ ID NO: 1780592 - RNA, 18 nt, Homo sapiens
accccuuguugcacugcc

SEQ ID NO: 1780593 - RNA, 15 nt, Homo sapiens
acaucacucugcugc

SEQ ID NO: 1780594 - RNA, 15 nt, Homo sapiens
accaggucaaaauag

SEQ ID NO: 1780595 - RNA, 13 nt, Homo sapiens
cagagaagucagu

SEQ ID NO: 1780596 - RNA, 19 nt, Homo sapiens
ccaccucguauuucaccuc

SEQ ID NO: 1780597 - RNA, 19 nt, Homo sapiens
cacgcggaugccgccucaa

SEQ ID NO: 1780598 - RNA, 19 nt, Homo sapiens
ccugaaccuggagcacuua

SEQ ID NO: 1780599 - RNA, 16 nt, Homo sapiens
uugacuggcucaagaa

SEQ ID NO: 1780600 - RNA, 12 nt, Homo sapiens
auaaaagaaucu

SEQ ID NO: 1780601 - RNA, 16 nt, Homo sapiens
uagauaaacucagaaa

SEQ ID NO: 1780602 - RNA, 14 nt, Homo sapiens
auuaaagagccagu

SEQ ID NO: 1780603 - RNA, 18 nt, Homo sapiens
cgauauaaauugggauaa

SEQ ID NO: 1780604 - RNA, 14 nt, Homo sapiens
aguuuaugauuuaa

SEQ ID NO: 1780605 - RNA, 12 nt, Homo sapiens
ucgacagacagc

SEQ ID NO: 1780606 - RNA, 15 nt, Homo sapiens
uguacauugugggau

SEQ ID NO: 1780607 - RNA, 15 nt, Homo sapiens
aaagcagauaccuca

SEQ ID NO: 1780608 - RNA, 19 nt, Homo sapiens
acauuuaaaagacagacau

SEQ ID NO: 1780609 - RNA, 19 nt, Homo sapiens
cucucuuuaaaaugcaaaa

SEQ ID NO: 1780610 - RNA, 22 nt, Homo sapiens
gcuccucggacucugcuuuaug

SEQ ID NO: 1780611 - RNA, 13 nt, Homo sapiens
acugauguuacua

SEQ ID NO: 1780612 - RNA, 13 nt, Homo sapiens
ucaguaaucuguc

SEQ ID NO: 1780613 - RNA, 22 nt, Homo sapiens
cugcacuguccugaccaucgca

SEQ ID NO: 1780614 - RNA, 16 nt, Homo sapiens
aguagguagacacaaa

SEQ ID NO: 1780615 - RNA, 19 nt, Homo sapiens
ccgcaagcaccauccccuc

SEQ ID NO: 1780616 - RNA, 16 nt, Homo sapiens
gagucacaauaaagau

SEQ ID NO: 1780617 - RNA, 22 nt, Homo sapiens
aggacuuuaucuaauaccucug

SEQ ID NO: 1780618 - RNA, 15 nt, Homo sapiens
uuaaccauugcuaau

SEQ ID NO: 1780619 - RNA, 19 nt, Homo sapiens
agccucgguggccaugcuu

SEQ ID NO: 1780620 - RNA, 15 nt, Homo sapiens
caaaucaaagauuug

SEQ ID NO: 1780621 - RNA, 15 nt, Homo sapiens
aucagaccugcauug

SEQ ID NO: 1780622 - RNA, 15 nt, Homo sapiens
ugugauguauauugu

SEQ ID NO: 1780623 - RNA, 23 nt, Homo sapiens
aggcugguuucuuucaugcuccu

SEQ ID NO: 1780624 - RNA, 17 nt, Homo sapiens
caaagcugcugcacagc

SEQ ID NO: 1780625 - RNA, 15 nt, Homo sapiens
gaauaaauucccaac

SEQ ID NO: 1780626 - RNA, 14 nt, Homo sapiens
ucauagcaggauau

SEQ ID NO: 1780627 - RNA, 15 nt, Homo sapiens
cacugaggugaggcu

SEQ ID NO: 1780628 - RNA, 14 nt, Homo sapiens
ugccucacaucucc

SEQ ID NO: 1780629 - RNA, 19 nt, Homo sapiens
uggcucgggugcagaguuc

SEQ ID NO: 1780630 - RNA, 22 nt, Homo sapiens
agccaugugucauguaauacug

SEQ ID NO: 1780631 - RNA, 16 nt, Homo sapiens
augcuggcagccaugg

SEQ ID NO: 1780632 - RNA, 18 nt, Homo sapiens
cucuuaagcuaagacuga

SEQ ID NO: 1780633 - RNA, 14 nt, Homo sapiens
cacaaaauacacac

SEQ ID NO: 1780634 - RNA, 20 nt, Homo sapiens
agaccauuuaucugggauua

SEQ ID NO: 1780635 - RNA, 18 nt, Homo sapiens
cuauuuggaaagcacugg

SEQ ID NO: 1780636 - RNA, 14 nt, Homo sapiens
gccaaacaauaugc

SEQ ID NO: 1780637 - RNA, 21 nt, Homo sapiens
aaauggcagggauacccagug

SEQ ID NO: 1780638 - RNA, 16 nt, Homo sapiens
aaaggugaccaaugau

SEQ ID NO: 1780639 - RNA, 18 nt, Homo sapiens
aauuggagaaaagcacuu

SEQ ID NO: 1780640 - RNA, 15 nt, Homo sapiens
auuuuggaaccuaau

SEQ ID NO: 1780641 - RNA, 15 nt, Homo sapiens
cucacuuguuuuucu

SEQ ID NO: 1780642 - RNA, 11 nt, Homo sapiens
agccugugcug

SEQ ID NO: 1780643 - RNA, 20 nt, Homo sapiens
gacuucauugucccucuuca

SEQ ID NO: 1780644 - RNA, 13 nt, Homo sapiens
uaacacagugcag

SEQ ID NO: 1780645 - RNA, 15 nt, Homo sapiens
cuucuggcugucagu

SEQ ID NO: 1780646 - RNA, 13 nt, Homo sapiens
cauuaaugcaaug

SEQ ID NO: 1780647 - RNA, 13 nt, Homo sapiens
ugaagauguguaa

SEQ ID NO: 1780648 - RNA, 17 nt, Homo sapiens
aacuuguacaccaaugu

SEQ ID NO: 1780649 - RNA, 21 nt, Homo sapiens
cacccucaaaugucagagcua

SEQ ID NO: 1780650 - RNA, 20 nt, Homo sapiens
gguucuacguggaugauuuc

SEQ ID NO: 1780651 - RNA, 19 nt, Homo sapiens
caaugcaaagauucacaua

SEQ ID NO: 1780652 - RNA, 23 nt, Homo sapiens
aggagguccuuaggccucugaga

SEQ ID NO: 1780653 - RNA, 14 nt, Homo sapiens
uggaagcacagcuu

SEQ ID NO: 1780654 - RNA, 21 nt, Homo sapiens
ugacacagaaaugaaugcaca

SEQ ID NO: 1780655 - RNA, 18 nt, Homo sapiens
aagcccccuacugagaaa

SEQ ID NO: 1780656 - RNA, 20 nt, Homo sapiens
acaaucuaagggucucucau

SEQ ID NO: 1780657 - RNA, 14 nt, Homo sapiens
aacauguaugugca

SEQ ID NO: 1780658 - RNA, 16 nt, Homo sapiens
cccucucuguggcucc

SEQ ID NO: 1780659 - RNA, 20 nt, Homo sapiens
gagaaguuggucuuacuuug

SEQ ID NO: 1780660 - RNA, 15 nt, Homo sapiens
uagagacuguagauu

SEQ ID NO: 1780661 - RNA, 15 nt, Homo sapiens
agaagaaacuuugcc

SEQ ID NO: 1780662 - RNA, 15 nt, Homo sapiens
gaagaggaggaggug

SEQ ID NO: 1780663 - RNA, 16 nt, Homo sapiens
gccacagaagccagga

SEQ ID NO: 1780664 - RNA, 14 nt, Homo sapiens
agccuucagaucuu

SEQ ID NO: 1780665 - RNA, 20 nt, Homo sapiens
acuccuguucuuugggcuca

SEQ ID NO: 1780666 - RNA, 18 nt, Homo sapiens
ccucuggggccuucggga

SEQ ID NO: 1780667 - RNA, 19 nt, Homo sapiens
aagaaacuacuaaucucaa

SEQ ID NO: 1780668 - RNA, 18 nt, Homo sapiens
uuugauuuuccucucuca

SEQ ID NO: 1780669 - RNA, 15 nt, Homo sapiens
uaacaaaggcagcug

SEQ ID NO: 1780670 - RNA, 11 nt, Homo sapiens
aagggacacac

SEQ ID NO: 1780671 - RNA, 13 nt, Homo sapiens
agcagaacaugug

SEQ ID NO: 1780672 - RNA, 21 nt, Homo sapiens
ugaacaugggggaacaaugag

SEQ ID NO: 1780673 - RNA, 14 nt, Homo sapiens
cucuaaguuuagaa

SEQ ID NO: 1780674 - RNA, 16 nt, Homo sapiens
gcaccugcccuaccug

SEQ ID NO: 1780675 - RNA, 13 nt, Homo sapiens
gaacguccuuccu

SEQ ID NO: 1780676 - RNA, 21 nt, Homo sapiens
gcagaagaauugaacccagga

SEQ ID NO: 1780677 - RNA, 22 nt, Homo sapiens
ugaaaccagaaggauauuuacu

SEQ ID NO: 1780678 - RNA, 16 nt, Homo sapiens
uccccaccugucuuca

SEQ ID NO: 1780679 - RNA, 12 nt, Homo sapiens
gagguggcugcg

SEQ ID NO: 1780680 - RNA, 14 nt, Homo sapiens
ugagggggagcuga

SEQ ID NO: 1780681 - RNA, 19 nt, Homo sapiens
acuucaagagccucuggca

SEQ ID NO: 1780682 - RNA, 13 nt, Homo sapiens
aucuauggcaagc

SEQ ID NO: 1780683 - RNA, 22 nt, Homo sapiens
caacuacagaauuucauucauu

SEQ ID NO: 1780684 - RNA, 13 nt, Homo sapiens
ucuauaaauucaa

SEQ ID NO: 1780685 - RNA, 18 nt, Homo sapiens
gacuuuagagucuaagaa

SEQ ID NO: 1780686 - RNA, 13 nt, Homo sapiens
aagagcugaccca

SEQ ID NO: 1780687 - RNA, 23 nt, Homo sapiens
ugcacacauuuuuuaaaugcacc

SEQ ID NO: 1780688 - RNA, 22 nt, Homo sapiens
uuucugauuagagugcaaaagu

SEQ ID NO: 1780689 - RNA, 21 nt, Homo sapiens
cagaguuagguugucuccagg

SEQ ID NO: 1780690 - RNA, 17 nt, Homo sapiens
gcugcacacacucaccu

SEQ ID NO: 1780691 - RNA, 22 nt, Homo sapiens
aagaauacccaggaagacuuug

SEQ ID NO: 1780692 - RNA, 17 nt, Homo sapiens
aguugcaauugaauuaa

SEQ ID NO: 1780693 - RNA, 20 nt, Homo sapiens
gugaucuauaccaccuucaa

SEQ ID NO: 1780694 - RNA, 21 nt, Homo sapiens
agagcaaaccuaacaggagaa

SEQ ID NO: 1780695 - RNA, 15 nt, Homo sapiens
gagaagauagggaac

SEQ ID NO: 1780696 - RNA, 16 nt, Homo sapiens
uuuaaaaagaaacaag

SEQ ID NO: 1780697 - RNA, 15 nt, Homo sapiens
uggcccugggggucu

SEQ ID NO: 1780698 - RNA, 12 nt, Homo sapiens
guccaaacuguu

SEQ ID NO: 1780699 - RNA, 13 nt, Homo sapiens
agaauagugugau

SEQ ID NO: 1780700 - RNA, 20 nt, Homo sapiens
cauuaucagccugugccacg

SEQ ID NO: 1780701 - RNA, 15 nt, Homo sapiens
cccuaaaccaaaaac

SEQ ID NO: 1780702 - RNA, 14 nt, Homo sapiens
aauauaaacacuau

SEQ ID NO: 1780703 - RNA, 16 nt, Homo sapiens
uaacaaugacuuguac

SEQ ID NO: 1780704 - RNA, 20 nt, Homo sapiens
cuggggucacccucuccagc

SEQ ID NO: 1780705 - RNA, 21 nt, Homo sapiens
guccacaacacacagauuuga

SEQ ID NO: 1780706 - RNA, 23 nt, Homo sapiens
uuugacuagaaaauuuaaaacau

SEQ ID NO: 1780707 - RNA, 16 nt, Homo sapiens
auuuuccuaaccacaa

SEQ ID NO: 1780708 - RNA, 16 nt, Homo sapiens
ccacaggagcguguac

SEQ ID NO: 1780709 - RNA, 13 nt, Homo sapiens
auugagucuucca

SEQ ID NO: 1780710 - RNA, 14 nt, Homo sapiens
aggcaacugugagu

SEQ ID NO: 1780711 - RNA, 15 nt, Homo sapiens
cuucuuuccuguaua

SEQ ID NO: 1780712 - RNA, 22 nt, Homo sapiens
ggaacauguaaaacaguuacaa

SEQ ID NO: 1780713 - RNA, 16 nt, Homo sapiens
cuaacaaaugaucuag

SEQ ID NO: 1780714 - RNA, 16 nt, Homo sapiens
ucuccaaaaacaguga

SEQ ID NO: 1780715 - RNA, 18 nt, Homo sapiens
gaggcccuccugugcugg

SEQ ID NO: 1780716 - RNA, 16 nt, Homo sapiens
gccuucuccacuuugg

SEQ ID NO: 1780717 - RNA, 15 nt, Homo sapiens
ucuaauuugcugcug

SEQ ID NO: 1780718 - RNA, 17 nt, Homo sapiens
auuugacucagcacugu

SEQ ID NO: 1780719 - RNA, 23 nt, Homo sapiens
gagaccuuugaugaauucuuccu

SEQ ID NO: 1780720 - RNA, 16 nt, Homo sapiens
auagugacaugcaguu

SEQ ID NO: 1780721 - RNA, 15 nt, Homo sapiens
gggccggaaggaaug

SEQ ID NO: 1780722 - RNA, 14 nt, Homo sapiens
ugcaaugucuaaaa

SEQ ID NO: 1780723 - RNA, 17 nt, Homo sapiens
cugucuuagucauacca

SEQ ID NO: 1780724 - RNA, 14 nt, Homo sapiens
auuuacuaaaucaa

SEQ ID NO: 1780725 - RNA, 14 nt, Homo sapiens
uugcuguaccacaa

SEQ ID NO: 1780726 - RNA, 22 nt, Homo sapiens
caguuguaacauucuauuucaa

SEQ ID NO: 1780727 - RNA, 21 nt, Homo sapiens
uaaaaguccugucaccaagga

SEQ ID NO: 1780728 - RNA, 20 nt, Homo sapiens
uagugguacuucagguuuua

SEQ ID NO: 1780729 - RNA, 17 nt, Homo sapiens
cucaaaaauaaugcaua

SEQ ID NO: 1780730 - RNA, 14 nt, Homo sapiens
gggcccugagcuga

SEQ ID NO: 1780731 - RNA, 16 nt, Homo sapiens
ugcagccccugggacc

SEQ ID NO: 1780732 - RNA, 18 nt, Homo sapiens
cacaaaccuucuuuucaa

SEQ ID NO: 1780733 - RNA, 21 nt, Homo sapiens
uggcuaggauaguuucaccag

SEQ ID NO: 1780734 - RNA, 14 nt, Homo sapiens
guggcucacaccug

SEQ ID NO: 1780735 - RNA, 11 nt, Homo sapiens
aagcaggcaaa

SEQ ID NO: 1780736 - RNA, 12 nt, Homo sapiens
acuaaagcuuua

SEQ ID NO: 1780737 - RNA, 12 nt, Homo sapiens
uuagaagcacag

SEQ ID NO: 1780738 - RNA, 22 nt, Homo sapiens
cugggcaagggggaacaaauca

SEQ ID NO: 1780739 - RNA, 13 nt, Homo sapiens
cucagauguugaa

SEQ ID NO: 1780740 - RNA, 16 nt, Homo sapiens
agcccauccagucucc

SEQ ID NO: 1780741 - RNA, 22 nt, Homo sapiens
ccugcccuccucucccgucucg

SEQ ID NO: 1780742 - RNA, 22 nt, Homo sapiens
ugugguauuguaauaggcauuu

SEQ ID NO: 1780743 - RNA, 15 nt, Homo sapiens
guccuuugugaauau

SEQ ID NO: 1780744 - RNA, 17 nt, Homo sapiens
cauagaaaaugugagua

SEQ ID NO: 1780745 - RNA, 21 nt, Homo sapiens
ugcccacauguguccauccca

SEQ ID NO: 1780746 - RNA, 19 nt, Homo sapiens
ucauguccucuauaccugu

SEQ ID NO: 1780747 - RNA, 21 nt, Homo sapiens
agguuucuugaauaucugccc

SEQ ID NO: 1780748 - RNA, 13 nt, Homo sapiens
gcccugccuugaa

SEQ ID NO: 1780749 - RNA, 17 nt, Homo sapiens
uuagaaaaaaguuuaca

SEQ ID NO: 1780750 - RNA, 23 nt, Homo sapiens
gcuucagaguguuaauuuaugaa

SEQ ID NO: 1780751 - RNA, 23 nt, Homo sapiens
aauuucugugucuaaauuucuuc

SEQ ID NO: 1780752 - RNA, 21 nt, Homo sapiens
gaauggcugcaccuuuuugca

SEQ ID NO: 1780753 - RNA, 16 nt, Homo sapiens
uuacagaguucuggga

SEQ ID NO: 1780754 - RNA, 16 nt, Homo sapiens
agaugagaagccaaag

SEQ ID NO: 1780755 - RNA, 18 nt, Homo sapiens
uggguauguguugccaaa

SEQ ID NO: 1780756 - RNA, 14 nt, Homo sapiens
uuaaaauucauauu

SEQ ID NO: 1780757 - RNA, 22 nt, Homo sapiens
aauauuauuagucugcaugguu

SEQ ID NO: 1780758 - RNA, 24 nt, Homo sapiens
cugucucacauacauaagcagcau

SEQ ID NO: 1780759 - RNA, 20 nt, Homo sapiens
agcacauuuaguccaaugaa

SEQ ID NO: 1780760 - RNA, 18 nt, Homo sapiens
ucacacuaugugcaaaaa

SEQ ID NO: 1780761 - RNA, 15 nt, Homo sapiens
uauggauguguucuc

SEQ ID NO: 1780762 - RNA, 22 nt, Homo sapiens
auucugggaacccugugcaauu

SEQ ID NO: 1780763 - RNA, 13 nt, Homo sapiens
auuuccugacaga

SEQ ID NO: 1780764 - RNA, 17 nt, Homo sapiens
caugagggcaggcacau

SEQ ID NO: 1780765 - RNA, 18 nt, Homo sapiens
aagacuagaggcuugcau

SEQ ID NO: 1780766 - RNA, 16 nt, Homo sapiens
auuugcccaauuccag

SEQ ID NO: 1780767 - RNA, 20 nt, Homo sapiens
cugucauccucaugcugcuc

SEQ ID NO: 1780768 - RNA, 20 nt, Homo sapiens
cggaagccucugggugacaa

SEQ ID NO: 1780769 - RNA, 18 nt, Homo sapiens
cccagcccucaguuuuca

SEQ ID NO: 1780770 - RNA, 19 nt, Homo sapiens
cagggaacaagcauucucc

SEQ ID NO: 1780771 - RNA, 12 nt, Homo sapiens
auuuuuggugca

SEQ ID NO: 1780772 - RNA, 15 nt, Homo sapiens
gagagggcacaucuc

SEQ ID NO: 1780773 - RNA, 12 nt, Homo sapiens
cugcagaccuca

SEQ ID NO: 1780774 - RNA, 14 nt, Homo sapiens
cacagcccaucacc

SEQ ID NO: 1780775 - RNA, 23 nt, Homo sapiens
ccccuccaucuguacuuggucca

SEQ ID NO: 1780776 - RNA, 15 nt, Homo sapiens
auguacagcauuaaa

SEQ ID NO: 1780777 - RNA, 18 nt, Homo sapiens
acauggugaaacccuguc

SEQ ID NO: 1780778 - RNA, 20 nt, Homo sapiens
ggccaugaagaggaugcugu

SEQ ID NO: 1780779 - RNA, 15 nt, Homo sapiens
uucugcccaugggaa

SEQ ID NO: 1780780 - RNA, 21 nt, Homo sapiens
uguugcggacaucauucugca

SEQ ID NO: 1780781 - RNA, 23 nt, Homo sapiens
uaauaaagacauuuccuaccugc

SEQ ID NO: 1780782 - RNA, 21 nt, Homo sapiens
aggagcccccagcugccaaag

SEQ ID NO: 1780783 - RNA, 20 nt, Homo sapiens
aggugguaagcaccaggacg

SEQ ID NO: 1780784 - RNA, 18 nt, Homo sapiens
uagagcuagcuaaucucu

SEQ ID NO: 1780785 - RNA, 20 nt, Homo sapiens
agaaaacauugacuguggcu

SEQ ID NO: 1780786 - RNA, 20 nt, Homo sapiens
uuggaagugaaaacuuugua

SEQ ID NO: 1780787 - RNA, 19 nt, Homo sapiens
aaccuaguccgcugaagau

SEQ ID NO: 1780788 - RNA, 19 nt, Homo sapiens
aacugugaaauuuacaaau

SEQ ID NO: 1780789 - RNA, 22 nt, Homo sapiens
auaccauguacauaauucuugc

SEQ ID NO: 1780790 - RNA, 21 nt, Homo sapiens
guuaauaguaccuaaaauugc

SEQ ID NO: 1780791 - RNA, 22 nt, Homo sapiens
cugagggucugaaaagggcauc

SEQ ID NO: 1780792 - RNA, 20 nt, Homo sapiens
aaaucagcagacacaggugu

SEQ ID NO: 1780793 - RNA, 22 nt, Homo sapiens
cacaauaggucuuucucucagu

SEQ ID NO: 1780794 - RNA, 15 nt, Homo sapiens
gaaauuaaaacucau

SEQ ID NO: 1780795 - RNA, 23 nt, Homo sapiens
gucuugccuugcugaacucccuc

SEQ ID NO: 1780796 - RNA, 14 nt, Homo sapiens
ucuguggcugccau

SEQ ID NO: 1780797 - RNA, 18 nt, Homo sapiens
gugccuguacaagcugau

SEQ ID NO: 1780798 - RNA, 22 nt, Homo sapiens
cauaauuuguacauauguaaaa

SEQ ID NO: 1780799 - RNA, 18 nt, Homo sapiens
agcccagcuugccaaugg

SEQ ID NO: 1780800 - RNA, 19 nt, Homo sapiens
gguuucaccguguuagcca

SEQ ID NO: 1780801 - RNA, 12 nt, Homo sapiens
uacagugguuuu

SEQ ID NO: 1780802 - RNA, 16 nt, Homo sapiens
ccauuucccugaacag

SEQ ID NO: 1780803 - RNA, 13 nt, Homo sapiens
aagcgauccuccu

SEQ ID NO: 1780804 - RNA, 16 nt, Homo sapiens
ucacacucauaacuca

SEQ ID NO: 1780805 - RNA, 15 nt, Homo sapiens
cagggcaaucaucua

SEQ ID NO: 1780806 - RNA, 18 nt, Homo sapiens
agagagaauagagcugcc

SEQ ID NO: 1780807 - RNA, 22 nt, Homo sapiens
uaucaccucauucugaacccuu

SEQ ID NO: 1780808 - RNA, 14 nt, Homo sapiens
gaacccaaauccaa

SEQ ID NO: 1780809 - RNA, 14 nt, Homo sapiens
cucacuccacugua

SEQ ID NO: 1780810 - RNA, 19 nt, Homo sapiens
uaaaauguacucagcuauc

SEQ ID NO: 1780811 - RNA, 19 nt, Homo sapiens
augguggagggcacuucag

SEQ ID NO: 1780812 - RNA, 22 nt, Homo sapiens
cuccuuaaacugacgcuaguca

SEQ ID NO: 1780813 - RNA, 14 nt, Homo sapiens
ccccuucuguguca

SEQ ID NO: 1780814 - RNA, 15 nt, Homo sapiens
cauagaauagcgaca

SEQ ID NO: 1780815 - RNA, 12 nt, Homo sapiens
uggguuccagag

SEQ ID NO: 1780816 - RNA, 23 nt, Homo sapiens
ccuuccacgggggcuguggcucu

SEQ ID NO: 1780817 - RNA, 21 nt, Homo sapiens
aagagaaaagggagucaugca

SEQ ID NO: 1780818 - RNA, 20 nt, Homo sapiens
aggagaggcccggugcagcu

SEQ ID NO: 1780819 - RNA, 18 nt, Homo sapiens
cuccauaucccuuugcag

SEQ ID NO: 1780820 - RNA, 20 nt, Homo sapiens
aauaugcgggacaugaugcu

SEQ ID NO: 1780821 - RNA, 14 nt, Homo sapiens
ucuugucacccagg

SEQ ID NO: 1780822 - RNA, 11 nt, Homo sapiens
ugacacagcca

SEQ ID NO: 1780823 - RNA, 12 nt, Homo sapiens
gggagugccacu

SEQ ID NO: 1780824 - RNA, 19 nt, Homo sapiens
caguguuucugugaauaga

SEQ ID NO: 1780825 - RNA, 19 nt, Homo sapiens
gcaccauugcacuccagcu

SEQ ID NO: 1780826 - RNA, 17 nt, Homo sapiens
cuucucauacuauuuaa

SEQ ID NO: 1780827 - RNA, 17 nt, Homo sapiens
acagagucuuggucugu

SEQ ID NO: 1780828 - RNA, 17 nt, Homo sapiens
aaggaauccucugggag

SEQ ID NO: 1780829 - RNA, 11 nt, Homo sapiens
gacagacaccg

SEQ ID NO: 1780830 - RNA, 15 nt, Homo sapiens
agacuggaagcacag

SEQ ID NO: 1780831 - RNA, 12 nt, Homo sapiens
ugcuagccucug

SEQ ID NO: 1780832 - RNA, 13 nt, Homo sapiens
cugggcacuccuc

SEQ ID NO: 1780833 - RNA, 17 nt, Homo sapiens
gcaccaguugcugcuuc

SEQ ID NO: 1780834 - RNA, 15 nt, Homo sapiens
auugaauaguuuauu

SEQ ID NO: 1780835 - RNA, 15 nt, Homo sapiens
guauaaaaauagaua

SEQ ID NO: 1780836 - RNA, 14 nt, Homo sapiens
gucuuucaguggaa

SEQ ID NO: 1780837 - RNA, 17 nt, Homo sapiens
aacuaaacaauaagcaa

SEQ ID NO: 1780838 - RNA, 21 nt, Homo sapiens
guugcaggaaguuaguuuuag

SEQ ID NO: 1780839 - RNA, 21 nt, Homo sapiens
aaggugccacuccagugccca

SEQ ID NO: 1780840 - RNA, 21 nt, Homo sapiens
gaaauggugcucaccaugcuu

SEQ ID NO: 1780841 - RNA, 20 nt, Homo sapiens
cccagagcuuuacagugcca

SEQ ID NO: 1780842 - RNA, 20 nt, Homo sapiens
ugagaaucgaccucacuguc

SEQ ID NO: 1780843 - RNA, 21 nt, Homo sapiens
auuuguaccucuaaguacaua

SEQ ID NO: 1780844 - RNA, 19 nt, Homo sapiens
cuucaaaucaaucuguaaa

SEQ ID NO: 1780845 - RNA, 23 nt, Homo sapiens
aacucacuacggaggagaauuaa

SEQ ID NO: 1780846 - RNA, 13 nt, Homo sapiens
cggccaaccuccc

SEQ ID NO: 1780847 - RNA, 21 nt, Homo sapiens
gggaagaguggucuugagggg

SEQ ID NO: 1780848 - RNA, 14 nt, Homo sapiens
ucuugagagcugcu

SEQ ID NO: 1780849 - RNA, 18 nt, Homo sapiens
aggucauuauuuuuuaca

SEQ ID NO: 1780850 - RNA, 20 nt, Homo sapiens
agccugauuauccuauaggc

SEQ ID NO: 1780851 - RNA, 15 nt, Homo sapiens
gggucagugcccagg

SEQ ID NO: 1780852 - RNA, 19 nt, Homo sapiens
caaggggucaaugucauaa

SEQ ID NO: 1780853 - RNA, 11 nt, Homo sapiens
uggaaucucau

SEQ ID NO: 1780854 - RNA, 11 nt, Homo sapiens
uguaaucucag

SEQ ID NO: 1780855 - RNA, 16 nt, Homo sapiens
uccgagauccaccaga

SEQ ID NO: 1780856 - RNA, 18 nt, Homo sapiens
cagagggccuuugcuaca

SEQ ID NO: 1780857 - RNA, 19 nt, Homo sapiens
cuugaugaauaaacacuuu

SEQ ID NO: 1780858 - RNA, 14 nt, Homo sapiens
agauggggcacuga

SEQ ID NO: 1780859 - RNA, 17 nt, Homo sapiens
uuuuacauguggcccaa

SEQ ID NO: 1780860 - RNA, 14 nt, Homo sapiens
guuggcuucuuugc

SEQ ID NO: 1780861 - RNA, 14 nt, Homo sapiens
ccuguauugcuuua

SEQ ID NO: 1780862 - RNA, 18 nt, Homo sapiens
auguguuccuugguugua

SEQ ID NO: 1780863 - RNA, 15 nt, Homo sapiens
cuagugauuucauua

SEQ ID NO: 1780864 - RNA, 18 nt, Homo sapiens
cugcuuagauuucuagca

SEQ ID NO: 1780865 - RNA, 15 nt, Homo sapiens
ccugccaggaagcca

SEQ ID NO: 1780866 - RNA, 12 nt, Homo sapiens
cuuaguucucac

SEQ ID NO: 1780867 - RNA, 20 nt, Homo sapiens
cuuuccucucuuuguucuca

SEQ ID NO: 1780868 - RNA, 14 nt, Homo sapiens
gucaugacuuucag

SEQ ID NO: 1780869 - RNA, 21 nt, Homo sapiens
caugaccacugggccugcuag

SEQ ID NO: 1780870 - RNA, 15 nt, Homo sapiens
ugacuguguggagcu

SEQ ID NO: 1780871 - RNA, 20 nt, Homo sapiens
ccauccucacaugugacaaa

SEQ ID NO: 1780872 - RNA, 14 nt, Homo sapiens
cuagaaucacuuga

SEQ ID NO: 1780873 - RNA, 15 nt, Homo sapiens
agaucagcaaaggga

SEQ ID NO: 1780874 - RNA, 13 nt, Homo sapiens
cuugucccugugg

SEQ ID NO: 1780875 - RNA, 20 nt, Homo sapiens
guucuucuugagcugaccca

SEQ ID NO: 1780876 - RNA, 21 nt, Homo sapiens
augacugagucuggcaaacau

SEQ ID NO: 1780877 - RNA, 14 nt, Homo sapiens
cagggaaaauauag

SEQ ID NO: 1780878 - RNA, 18 nt, Homo sapiens
auuuaaaaaaaaagucag

SEQ ID NO: 1780879 - RNA, 15 nt, Homo sapiens
agucucugaaugaag

SEQ ID NO: 1780880 - RNA, 19 nt, Homo sapiens
cuagcugggacuacaggug

SEQ ID NO: 1780881 - RNA, 16 nt, Homo sapiens
ucccccaccagcugca

SEQ ID NO: 1780882 - RNA, 14 nt, Homo sapiens
ucugugaaaguaca

SEQ ID NO: 1780883 - RNA, 20 nt, Homo sapiens
acugcaucaagaugugacau

SEQ ID NO: 1780884 - RNA, 20 nt, Homo sapiens
ggagauauaccuaauguuaa

SEQ ID NO: 1780885 - RNA, 14 nt, Homo sapiens
ugcaggaaaacuga

SEQ ID NO: 1780886 - RNA, 15 nt, Homo sapiens
auguagacauuaucu

SEQ ID NO: 1780887 - RNA, 14 nt, Homo sapiens
guccuccaccaugc

SEQ ID NO: 1780888 - RNA, 19 nt, Homo sapiens
aauugaaacuugcauuuua

SEQ ID NO: 1780889 - RNA, 19 nt, Homo sapiens
aaaaauguuaagcaucuaa

SEQ ID NO: 1780890 - RNA, 19 nt, Homo sapiens
gcagauuugcaacagcaaa

SEQ ID NO: 1780891 - RNA, 21 nt, Homo sapiens
aaacugccuuucugguggcuu

SEQ ID NO: 1780892 - RNA, 20 nt, Homo sapiens
cuggguuuggaccccagcug

SEQ ID NO: 1780893 - RNA, 14 nt, Homo sapiens
caccuuucccacuu

SEQ ID NO: 1780894 - RNA, 20 nt, Homo sapiens
uggggcagcuugaggguugg

SEQ ID NO: 1780895 - RNA, 14 nt, Homo sapiens
gccugccucuucca

SEQ ID NO: 1780896 - RNA, 22 nt, Homo sapiens
cccaagugaggagugccagcuc

SEQ ID NO: 1780897 - RNA, 17 nt, Homo sapiens
caaaaccaagucacuua

SEQ ID NO: 1780898 - RNA, 15 nt, Homo sapiens
gcucaggcacauaca

SEQ ID NO: 1780899 - RNA, 22 nt, Homo sapiens
ccucuguauuuuuuaaaacauc

SEQ ID NO: 1780900 - RNA, 17 nt, Homo sapiens
agacuggggacccugga

SEQ ID NO: 1780901 - RNA, 16 nt, Homo sapiens
aucacagacacugcac

SEQ ID NO: 1780902 - RNA, 19 nt, Homo sapiens
gaaaggugaggagggcagu

SEQ ID NO: 1780903 - RNA, 22 nt, Homo sapiens
auaucaucuugaguauagcaau

SEQ ID NO: 1780904 - RNA, 15 nt, Homo sapiens
cuuuguacuuugugc

SEQ ID NO: 1780905 - RNA, 20 nt, Homo sapiens
acaaauugaaaacacacuca

SEQ ID NO: 1780906 - RNA, 21 nt, Homo sapiens
gaacaagaagguggaaggcag

SEQ ID NO: 1780907 - RNA, 19 nt, Homo sapiens
ucagaaguuucucagcucc

SEQ ID NO: 1780908 - RNA, 23 nt, Homo sapiens
ugucucgugguaggacuguagaa

SEQ ID NO: 1780909 - RNA, 18 nt, Homo sapiens
cuuucccuuggauaccua

SEQ ID NO: 1780910 - RNA, 18 nt, Homo sapiens
gugacaaugguuucacca

SEQ ID NO: 1780911 - RNA, 13 nt, Homo sapiens
cugcacacagaau

SEQ ID NO: 1780912 - RNA, 19 nt, Homo sapiens
acaggcacauaccacugca

SEQ ID NO: 1780913 - RNA, 19 nt, Homo sapiens
cauucagcagucagucccc

SEQ ID NO: 1780914 - RNA, 11 nt, Homo sapiens
augcauuuuaa

SEQ ID NO: 1780915 - RNA, 17 nt, Homo sapiens
ugucauugauacaugca

SEQ ID NO: 1780916 - RNA, 14 nt, Homo sapiens
ugugauauaugcau

SEQ ID NO: 1780917 - RNA, 15 nt, Homo sapiens
guugacauagccuuu

SEQ ID NO: 1780918 - RNA, 14 nt, Homo sapiens
ggcaaaaccaacuc

SEQ ID NO: 1780919 - RNA, 21 nt, Homo sapiens
guuacugcuugaccaaagagc

SEQ ID NO: 1780920 - RNA, 13 nt, Homo sapiens
ugaccauaugacc

SEQ ID NO: 1780921 - RNA, 22 nt, Homo sapiens
ucagcacguaguuugcauucca

SEQ ID NO: 1780922 - RNA, 19 nt, Homo sapiens
aaauauaugucuauauaca

SEQ ID NO: 1780923 - RNA, 16 nt, Homo sapiens
cuguuaaaauugcuca

SEQ ID NO: 1780924 - RNA, 15 nt, Homo sapiens
auuguacacuaucua

SEQ ID NO: 1780925 - RNA, 22 nt, Homo sapiens
ccucaccaauacacggacacaa

SEQ ID NO: 1780926 - RNA, 21 nt, Homo sapiens
ccucuguauacaaaacccuuu

SEQ ID NO: 1780927 - RNA, 16 nt, Homo sapiens
cauuucaugaagcaag

SEQ ID NO: 1780928 - RNA, 22 nt, Homo sapiens
ucucagcaaguguacaguauuu

SEQ ID NO: 1780929 - RNA, 20 nt, Homo sapiens
cuuaaugaaugaaugaauuc

SEQ ID NO: 1780930 - RNA, 20 nt, Homo sapiens
ccucccgaguagcugggauu

SEQ ID NO: 1780931 - RNA, 17 nt, Homo sapiens
uggaggaaguucuccag

SEQ ID NO: 1780932 - RNA, 19 nt, Homo sapiens
ggcaagugugggggguccu

SEQ ID NO: 1780933 - RNA, 23 nt, Homo sapiens
aguuuucgugcuuccuccugaca

SEQ ID NO: 1780934 - RNA, 15 nt, Homo sapiens
ucucucaaaucucau

SEQ ID NO: 1780935 - RNA, 19 nt, Homo sapiens
caaucuaaagauacagugu

SEQ ID NO: 1780936 - RNA, 20 nt, Homo sapiens
cagugggguugggaccucag

SEQ ID NO: 1780937 - RNA, 22 nt, Homo sapiens
ggaaguucagucuugucuuuga

SEQ ID NO: 1780938 - RNA, 16 nt, Homo sapiens
gaagcagccucagagu

SEQ ID NO: 1780939 - RNA, 20 nt, Homo sapiens
aggccguugauucacuucac

SEQ ID NO: 1780940 - RNA, 16 nt, Homo sapiens
auguuguagcagugau

SEQ ID NO: 1780941 - RNA, 20 nt, Homo sapiens
aauguacucuccuuuuaugu

SEQ ID NO: 1780942 - RNA, 13 nt, Homo sapiens
agucauauugccc

SEQ ID NO: 1780943 - RNA, 17 nt, Homo sapiens
cuuagcuuagcuuucug

SEQ ID NO: 1780944 - RNA, 18 nt, Homo sapiens
aaaccucauuguucugua

SEQ ID NO: 1780945 - RNA, 14 nt, Homo sapiens
aucaucauucucau

SEQ ID NO: 1780946 - RNA, 22 nt, Homo sapiens
caggggcaaagaacugccccau

SEQ ID NO: 1780947 - RNA, 18 nt, Homo sapiens
gagucucuucuccacugg

SEQ ID NO: 1780948 - RNA, 18 nt, Homo sapiens
acccaggaauaguggaca

SEQ ID NO: 1780949 - RNA, 21 nt, Homo sapiens
ccugggguagccuccuaucca

SEQ ID NO: 1780950 - RNA, 20 nt, Homo sapiens
aggcggcggcggaggggcug

SEQ ID NO: 1780951 - RNA, 19 nt, Homo sapiens
ucacuuucucaguuuucau

SEQ ID NO: 1780952 - RNA, 19 nt, Homo sapiens
cacucuggagaguaaucug

SEQ ID NO: 1780953 - RNA, 18 nt, Homo sapiens
aguuuuguaaagggcaag

SEQ ID NO: 1780954 - RNA, 13 nt, Homo sapiens
aagagaguaccau

SEQ ID NO: 1780955 - RNA, 15 nt, Homo sapiens
aaaacuguuaccuaa

SEQ ID NO: 1780956 - RNA, 15 nt, Homo sapiens
cagucuggaugacag

SEQ ID NO: 1780957 - RNA, 16 nt, Homo sapiens
cauccagcaguacaau

SEQ ID NO: 1780958 - RNA, 24 nt, Homo sapiens
auggagagguuugucaacacaaag

SEQ ID NO: 1780959 - RNA, 20 nt, Homo sapiens
uacaaaaccacuggaaaguu

SEQ ID NO: 1780960 - RNA, 15 nt, Homo sapiens
gcggcgucccuucca

SEQ ID NO: 1780961 - RNA, 16 nt, Homo sapiens
ugggaggguucugggu

SEQ ID NO: 1780962 - RNA, 16 nt, Homo sapiens
acucacacuggccaca

SEQ ID NO: 1780963 - RNA, 11 nt, Homo sapiens
ugccaugucug

SEQ ID NO: 1780964 - RNA, 23 nt, Homo sapiens
agaaugauuuugcugacuuccca

SEQ ID NO: 1780965 - RNA, 22 nt, Homo sapiens
auuauuugcuauggcaggauaa

SEQ ID NO: 1780966 - RNA, 19 nt, Homo sapiens
cacacaaaauaaugcaguu

SEQ ID NO: 1780967 - RNA, 17 nt, Homo sapiens
caguauugacacugacu

SEQ ID NO: 1780968 - RNA, 15 nt, Homo sapiens
uaguuaacauuucaa

SEQ ID NO: 1780969 - RNA, 16 nt, Homo sapiens
cuuuuuccuuccugcc

SEQ ID NO: 1780970 - RNA, 13 nt, Homo sapiens
uucauacuacauu

SEQ ID NO: 1780971 - RNA, 18 nt, Homo sapiens
agcucaggacugccauug

SEQ ID NO: 1780972 - RNA, 13 nt, Homo sapiens
gcucacaguacag

SEQ ID NO: 1780973 - RNA, 18 nt, Homo sapiens
gcuucuccaagcuuucag

SEQ ID NO: 1780974 - RNA, 17 nt, Homo sapiens
acagacuucacacagca

SEQ ID NO: 1780975 - RNA, 18 nt, Homo sapiens
cauuuguauauuguggau

SEQ ID NO: 1780976 - RNA, 12 nt, Homo sapiens
caaguuuuuaca

SEQ ID NO: 1780977 - RNA, 23 nt, Homo sapiens
uucagaggcagcaccaccacaca

SEQ ID NO: 1780978 - RNA, 18 nt, Homo sapiens
aucaguuuuggaaucuaa

SEQ ID NO: 1780979 - RNA, 16 nt, Homo sapiens
ucacccacugcugcac

SEQ ID NO: 1780980 - RNA, 15 nt, Homo sapiens
auuuuuugguacaaa

SEQ ID NO: 1780981 - RNA, 22 nt, Homo sapiens
agucuuggguggcgcuggugca

SEQ ID NO: 1780982 - RNA, 14 nt, Homo sapiens
cuccuuccaccaca

SEQ ID NO: 1780983 - RNA, 17 nt, Homo sapiens
aaugggaauugcgcuca

SEQ ID NO: 1780984 - RNA, 13 nt, Homo sapiens
guaacuaugcugu

SEQ ID NO: 1780985 - RNA, 13 nt, Homo sapiens
caagaacagcagg

SEQ ID NO: 1780986 - RNA, 17 nt, Homo sapiens
ucauuucauguauaguu

SEQ ID NO: 1780987 - RNA, 16 nt, Homo sapiens
agcaccgcuuaucccc

SEQ ID NO: 1780988 - RNA, 18 nt, Homo sapiens
guacuaguacuauugcua

SEQ ID NO: 1780989 - RNA, 17 nt, Homo sapiens
gagaaaugccagugugc

SEQ ID NO: 1780990 - RNA, 19 nt, Homo sapiens
aggaauugucaaaugauga

SEQ ID NO: 1780991 - RNA, 12 nt, Homo sapiens
cacacucaguga

SEQ ID NO: 1780992 - RNA, 18 nt, Homo sapiens
caggagagagagagagaa

SEQ ID NO: 1780993 - RNA, 17 nt, Homo sapiens
ccccaggauugaccucu

SEQ ID NO: 1780994 - RNA, 13 nt, Homo sapiens
uccccuacuacac

SEQ ID NO: 1780995 - RNA, 17 nt, Homo sapiens
agauaaaagauguacuu

SEQ ID NO: 1780996 - RNA, 14 nt, Homo sapiens
aguggugcaaucac

SEQ ID NO: 1780997 - RNA, 14 nt, Homo sapiens
gagcagucugagga

SEQ ID NO: 1780998 - RNA, 17 nt, Homo sapiens
cuggaccagugaccaaa

SEQ ID NO: 1780999 - RNA, 20 nt, Homo sapiens
acccaaguuggagugcagug

SEQ ID NO: 1781000 - RNA, 21 nt, Homo sapiens
guggcagcugcuuuugucuau

SEQ ID NO: 1781001 - RNA, 20 nt, Homo sapiens
agccagaucccucuccagug

SEQ ID NO: 1781002 - RNA, 12 nt, Homo sapiens
aggcacugaagc

SEQ ID NO: 1781003 - RNA, 19 nt, Homo sapiens
cuuucuccccgcuaaggaa

SEQ ID NO: 1781004 - RNA, 21 nt, Homo sapiens
gaugucccuauucugccaugg

SEQ ID NO: 1781005 - RNA, 13 nt, Homo sapiens
acgugacuccuca

SEQ ID NO: 1781006 - RNA, 15 nt, Homo sapiens
aaauucagcauuuga

SEQ ID NO: 1781007 - RNA, 21 nt, Homo sapiens
accagcuuguccaacaacucc

SEQ ID NO: 1781008 - RNA, 13 nt, Homo sapiens
aaaugcacuguga

SEQ ID NO: 1781009 - RNA, 22 nt, Homo sapiens
accgacuagccaggaaguacuu

SEQ ID NO: 1781010 - RNA, 20 nt, Homo sapiens
ccuccugaguagcugggauu

SEQ ID NO: 1781011 - RNA, 19 nt, Homo sapiens
cagaagauuaagacagaga

SEQ ID NO: 1781012 - RNA, 24 nt, Homo sapiens
uaagacugcugguugacaucagac

SEQ ID NO: 1781013 - RNA, 14 nt, Homo sapiens
cuauaucuuaggua

SEQ ID NO: 1781014 - RNA, 12 nt, Homo sapiens
uuaaugugaugg

SEQ ID NO: 1781015 - RNA, 16 nt, Homo sapiens
uuaaagucuguuccaa

SEQ ID NO: 1781016 - RNA, 21 nt, Homo sapiens
aaagugcuggaauuacaggcg

SEQ ID NO: 1781017 - RNA, 14 nt, Homo sapiens
auucacagugcucu

SEQ ID NO: 1781018 - RNA, 14 nt, Homo sapiens
caagauacacuugu

SEQ ID NO: 1781019 - RNA, 16 nt, Homo sapiens
cuuuggcaugagaugg

SEQ ID NO: 1781020 - RNA, 12 nt, Homo sapiens
cuagagccucac

SEQ ID NO: 1781021 - RNA, 15 nt, Homo sapiens
ugagccucagaauaa

SEQ ID NO: 1781022 - RNA, 21 nt, Homo sapiens
cauccccaaaggucaaaaaca

SEQ ID NO: 1781023 - RNA, 18 nt, Homo sapiens
uucuacugacccaacugg

SEQ ID NO: 1781024 - RNA, 18 nt, Homo sapiens
cuacucauuccccggggc

SEQ ID NO: 1781025 - RNA, 22 nt, Homo sapiens
gaaugaguuuccagcuaagccu

SEQ ID NO: 1781026 - RNA, 17 nt, Homo sapiens
cgcaccauuucugucac

SEQ ID NO: 1781027 - RNA, 23 nt, Homo sapiens
agauaaacaguuuagcccaucuc

SEQ ID NO: 1781028 - RNA, 19 nt, Homo sapiens
uucagcacccccacccacc

SEQ ID NO: 1781029 - RNA, 12 nt, Homo sapiens
aagcuccuagca

SEQ ID NO: 1781030 - RNA, 15 nt, Homo sapiens
ugaagacuagaaaau

SEQ ID NO: 1781031 - RNA, 20 nt, Homo sapiens
gcuggagggcaguggcacga

SEQ ID NO: 1781032 - RNA, 13 nt, Homo sapiens
uuguugugcuauu

SEQ ID NO: 1781033 - RNA, 22 nt, Homo sapiens
cacccaguccuugaguccccac

SEQ ID NO: 1781034 - RNA, 14 nt, Homo sapiens
gcgucuccccaugc

SEQ ID NO: 1781035 - RNA, 23 nt, Homo sapiens
guguguaugugcgugugugcaag

SEQ ID NO: 1781036 - RNA, 22 nt, Homo sapiens
gugggaucauccagaggagcug

SEQ ID NO: 1781037 - RNA, 15 nt, Homo sapiens
cuuaccugccaggaa

SEQ ID NO: 1781038 - RNA, 13 nt, Homo sapiens
ucuugaguuccuc

SEQ ID NO: 1781039 - RNA, 13 nt, Homo sapiens
gccaagccagcug

SEQ ID NO: 1781040 - RNA, 21 nt, Homo sapiens
ccuuucuuucugaaauaguca

SEQ ID NO: 1781041 - RNA, 20 nt, Homo sapiens
cagagugggaccaaguccaa

SEQ ID NO: 1781042 - RNA, 21 nt, Homo sapiens
cagugcaguuucuaagcaugu

SEQ ID NO: 1781043 - RNA, 18 nt, Homo sapiens
uccagcuuaguucaaguc

SEQ ID NO: 1781044 - RNA, 16 nt, Homo sapiens
gcuucucucucuaaaa

SEQ ID NO: 1781045 - RNA, 14 nt, Homo sapiens
gcacaggcagaugu

SEQ ID NO: 1781046 - RNA, 13 nt, Homo sapiens
ugggccuccucac

SEQ ID NO: 1781047 - RNA, 20 nt, Homo sapiens
ucuguagcaagggggaauau

SEQ ID NO: 1781048 - RNA, 22 nt, Homo sapiens
agaagugccuuuaauuugcuac

SEQ ID NO: 1781049 - RNA, 18 nt, Homo sapiens
aagagccccccacugcag

SEQ ID NO: 1781050 - RNA, 17 nt, Homo sapiens
accaggacuauagccca

SEQ ID NO: 1781051 - RNA, 21 nt, Homo sapiens
uccuggggccugugcacuguu

SEQ ID NO: 1781052 - RNA, 14 nt, Homo sapiens
uccuauauccugug

SEQ ID NO: 1781053 - RNA, 18 nt, Homo sapiens
gccuaauugucacaucaa

SEQ ID NO: 1781054 - RNA, 23 nt, Homo sapiens
aucucauaggaagagccaggaca

SEQ ID NO: 1781055 - RNA, 13 nt, Homo sapiens
ugucuuucuccaa

SEQ ID NO: 1781056 - RNA, 12 nt, Homo sapiens
aagaacuuaccc

SEQ ID NO: 1781057 - RNA, 19 nt, Homo sapiens
uguacuguuacugugucag

SEQ ID NO: 1781058 - RNA, 14 nt, Homo sapiens
ugugucuucaauuu

SEQ ID NO: 1781059 - RNA, 16 nt, Homo sapiens
ucaacugggauacauu

SEQ ID NO: 1781060 - RNA, 14 nt, Homo sapiens
uaauacugucuuac

SEQ ID NO: 1781061 - RNA, 18 nt, Homo sapiens
ucaagggcacugugauac

SEQ ID NO: 1781062 - RNA, 21 nt, Homo sapiens
ccuagcucuuccccaucucac

SEQ ID NO: 1781063 - RNA, 21 nt, Homo sapiens
agaucuaaaaugauacugugu

SEQ ID NO: 1781064 - RNA, 15 nt, Homo sapiens
uuaguauuguugucc

SEQ ID NO: 1781065 - RNA, 16 nt, Homo sapiens
uguaaauuauuucaua

SEQ ID NO: 1781066 - RNA, 13 nt, Homo sapiens
gucuuuacuccuc

SEQ ID NO: 1781067 - RNA, 19 nt, Homo sapiens
aucaguuccuuugaucucg

SEQ ID NO: 1781068 - RNA, 16 nt, Homo sapiens
uggaguauaauauuca

SEQ ID NO: 1781069 - RNA, 17 nt, Homo sapiens
uugauuucuuuucuucc

SEQ ID NO: 1781070 - RNA, 17 nt, Homo sapiens
acucugggcuccucaac

SEQ ID NO: 1781071 - RNA, 17 nt, Homo sapiens
gucccagggcugaugcu

SEQ ID NO: 1781072 - RNA, 16 nt, Homo sapiens
gcacccuggacaaaga

SEQ ID NO: 1781073 - RNA, 21 nt, Homo sapiens
uacccccaguccucccuagcu

SEQ ID NO: 1781074 - RNA, 15 nt, Homo sapiens
ccccuuagcaauaag

SEQ ID NO: 1781075 - RNA, 18 nt, Homo sapiens
uagaaguuccuagugaug

SEQ ID NO: 1781076 - RNA, 19 nt, Homo sapiens
uucccucucaugacuugca

SEQ ID NO: 1781077 - RNA, 15 nt, Homo sapiens
ugugcccagcaggcc

SEQ ID NO: 1781078 - RNA, 19 nt, Homo sapiens
auuguagaugaacaucucu

SEQ ID NO: 1781079 - RNA, 13 nt, Homo sapiens
ccugccaggcaca

SEQ ID NO: 1781080 - RNA, 19 nt, Homo sapiens
aacaggauaacagcaauug

SEQ ID NO: 1781081 - RNA, 16 nt, Homo sapiens
ccucccagguugacac

SEQ ID NO: 1781082 - RNA, 18 nt, Homo sapiens
gaggcucugucacugagc

SEQ ID NO: 1781083 - RNA, 17 nt, Homo sapiens
uagcaugagcuuuccag

SEQ ID NO: 1781084 - RNA, 20 nt, Homo sapiens
gauguucugacccugcuuca

SEQ ID NO: 1781085 - RNA, 16 nt, Homo sapiens
cuuuaguggagccagg

SEQ ID NO: 1781086 - RNA, 16 nt, Homo sapiens
agggaagcaucugucu

SEQ ID NO: 1781087 - RNA, 21 nt, Homo sapiens
auguggucuaagguucagccu

SEQ ID NO: 1781088 - RNA, 20 nt, Homo sapiens
acuaaaguaugguacaucua

SEQ ID NO: 1781089 - RNA, 17 nt, Homo sapiens
auguuaauuuuaauuuc

SEQ ID NO: 1781090 - RNA, 18 nt, Homo sapiens
acucuagggggacuuucu

SEQ ID NO: 1781091 - RNA, 13 nt, Homo sapiens
auguuugucagau

SEQ ID NO: 1781092 - RNA, 13 nt, Homo sapiens
auguaugucagaa

SEQ ID NO: 1781093 - RNA, 13 nt, Homo sapiens
aucugaacacagu

SEQ ID NO: 1781094 - RNA, 12 nt, Homo sapiens
cuuuuuguacuu

SEQ ID NO: 1781095 - RNA, 13 nt, Homo sapiens
gacaggguuucac

SEQ ID NO: 1781096 - RNA, 15 nt, Homo sapiens
gauagggauacaugc

SEQ ID NO: 1781097 - RNA, 18 nt, Homo sapiens
gcaucaugccaacuugug

SEQ ID NO: 1781098 - RNA, 20 nt, Homo sapiens
aggagggacaugauggggaa

SEQ ID NO: 1781099 - RNA, 15 nt, Homo sapiens
uggaugcagcucuug

SEQ ID NO: 1781100 - RNA, 23 nt, Homo sapiens
ucauuuggaaugaauacagcauu

SEQ ID NO: 1781101 - RNA, 17 nt, Homo sapiens
ucagcaacaaccaucuc

SEQ ID NO: 1781102 - RNA, 14 nt, Homo sapiens
aggaacuaagucag

SEQ ID NO: 1781103 - RNA, 14 nt, Homo sapiens
gaaagugacuacca

SEQ ID NO: 1781104 - RNA, 20 nt, Homo sapiens
uaaaaagaucuacauacaaa

SEQ ID NO: 1781105 - RNA, 18 nt, Homo sapiens
caaaaccugauguuaaaa

SEQ ID NO: 1781106 - RNA, 16 nt, Homo sapiens
gauccucccaccucag

SEQ ID NO: 1781107 - RNA, 17 nt, Homo sapiens
caucagagugacaucca

SEQ ID NO: 1781108 - RNA, 22 nt, Homo sapiens
guuacuaagaugaaauugccaa

SEQ ID NO: 1781109 - RNA, 19 nt, Homo sapiens
uguguuaucagagugcauu

SEQ ID NO: 1781110 - RNA, 14 nt, Homo sapiens
ugcauaagcuuuuu

SEQ ID NO: 1781111 - RNA, 19 nt, Homo sapiens
aguacucacuuuucacuug

SEQ ID NO: 1781112 - RNA, 13 nt, Homo sapiens
ucaccuucugcca

SEQ ID NO: 1781113 - RNA, 14 nt, Homo sapiens
agacacagcccuga

SEQ ID NO: 1781114 - RNA, 13 nt, Homo sapiens
aggucaacaucua

SEQ ID NO: 1781115 - RNA, 18 nt, Homo sapiens
gcccaagaggacugagac

SEQ ID NO: 1781116 - RNA, 15 nt, Homo sapiens
gagugcaaugaauga

SEQ ID NO: 1781117 - RNA, 14 nt, Homo sapiens
ugcaugcagaggag

SEQ ID NO: 1781118 - RNA, 23 nt, Homo sapiens
ggcucaccccucucccccgccca

SEQ ID NO: 1781119 - RNA, 16 nt, Homo sapiens
auauuuugauucucau

SEQ ID NO: 1781120 - RNA, 21 nt, Homo sapiens
cagcuucauuuccgugaaggg

SEQ ID NO: 1781121 - RNA, 19 nt, Homo sapiens
ucacucacuuuucuuuauu

SEQ ID NO: 1781122 - RNA, 16 nt, Homo sapiens
acagcccuuccuccca

SEQ ID NO: 1781123 - RNA, 21 nt, Homo sapiens
cugguuuuuguagccuuccuc

SEQ ID NO: 1781124 - RNA, 19 nt, Homo sapiens
gccucaccuuggggccuug

SEQ ID NO: 1781125 - RNA, 16 nt, Homo sapiens
ucacuucucuuccuug

SEQ ID NO: 1781126 - RNA, 13 nt, Homo sapiens
agaugccacugcc

SEQ ID NO: 1781127 - RNA, 20 nt, Homo sapiens
uguuuaccuaaacuauaugc

SEQ ID NO: 1781128 - RNA, 17 nt, Homo sapiens
uauugauaacagcacug

SEQ ID NO: 1781129 - RNA, 16 nt, Homo sapiens
cuuuucauagugcuca

SEQ ID NO: 1781130 - RNA, 15 nt, Homo sapiens
ucacuucugcuguac

SEQ ID NO: 1781131 - RNA, 22 nt, Homo sapiens
aaccuccaaggaccucucucaa

SEQ ID NO: 1781132 - RNA, 14 nt, Homo sapiens
aaugcuucuuucau

SEQ ID NO: 1781133 - RNA, 14 nt, Homo sapiens
acggaaaaugccaa

SEQ ID NO: 1781134 - RNA, 19 nt, Homo sapiens
cauugugacuauccaguga

SEQ ID NO: 1781135 - RNA, 14 nt, Homo sapiens
agacacagacuggc

SEQ ID NO: 1781136 - RNA, 19 nt, Homo sapiens
acagcacauccacccaggu

SEQ ID NO: 1781137 - RNA, 16 nt, Homo sapiens
uacuaguuuugcugaa

SEQ ID NO: 1781138 - RNA, 23 nt, Homo sapiens
ccucacaugugacaaagggccag

SEQ ID NO: 1781139 - RNA, 18 nt, Homo sapiens
ucauguaucuuauaguca

SEQ ID NO: 1781140 - RNA, 15 nt, Homo sapiens
agccuaccucuccac

SEQ ID NO: 1781141 - RNA, 16 nt, Homo sapiens
aaagauguuccaguga

SEQ ID NO: 1781142 - RNA, 17 nt, Homo sapiens
aggcaggagaaucucuu

SEQ ID NO: 1781143 - RNA, 20 nt, Homo sapiens
gaguguacuaguaguuaaga

SEQ ID NO: 1781144 - RNA, 18 nt, Homo sapiens
aacccaagugcugcacaa

SEQ ID NO: 1781145 - RNA, 20 nt, Homo sapiens
aagugauuccuucuugcuca

SEQ ID NO: 1781146 - RNA, 17 nt, Homo sapiens
augaggcagauagcacu

SEQ ID NO: 1781147 - RNA, 13 nt, Homo sapiens
gugguaugugaca

SEQ ID NO: 1781148 - RNA, 16 nt, Homo sapiens
aauuuaaaaaaacaga

SEQ ID NO: 1781149 - RNA, 23 nt, Homo sapiens
agggccgucaaggaaagggcagu

SEQ ID NO: 1781150 - RNA, 13 nt, Homo sapiens
agcugacagagcc

SEQ ID NO: 1781151 - RNA, 14 nt, Homo sapiens
gcagaaagccacaa

SEQ ID NO: 1781152 - RNA, 20 nt, Homo sapiens
aacauuucucuucagugugu

SEQ ID NO: 1781153 - RNA, 16 nt, Homo sapiens
aaguaaaacagucauc

SEQ ID NO: 1781154 - RNA, 17 nt, Homo sapiens
cuacagcacuacugggu

SEQ ID NO: 1781155 - RNA, 15 nt, Homo sapiens
caaauuauucuaguc

SEQ ID NO: 1781156 - RNA, 19 nt, Homo sapiens
cugccuuggacaacuuuuc

SEQ ID NO: 1781157 - RNA, 19 nt, Homo sapiens
agaccaauucuaacagcaa

SEQ ID NO: 1781158 - RNA, 15 nt, Homo sapiens
cugcucccaucauuc

SEQ ID NO: 1781159 - RNA, 23 nt, Homo sapiens
aaaaggauuuggacugcauuuaa

SEQ ID NO: 1781160 - RNA, 17 nt, Homo sapiens
ccuaagaagaaggccag

SEQ ID NO: 1781161 - RNA, 17 nt, Homo sapiens
caaaucaauaaauuuca

SEQ ID NO: 1781162 - RNA, 19 nt, Homo sapiens
uuuaccucaggugugccug

SEQ ID NO: 1781163 - RNA, 19 nt, Homo sapiens
aauuccgacuuucucagca

SEQ ID NO: 1781164 - RNA, 19 nt, Homo sapiens
aguugcugcauuccuaaac

SEQ ID NO: 1781165 - RNA, 18 nt, Homo sapiens
gagacccacaauaaacuc

SEQ ID NO: 1781166 - RNA, 21 nt, Homo sapiens
ucaacagagaggggcagggaa

SEQ ID NO: 1781167 - RNA, 12 nt, Homo sapiens
caggauucucug

SEQ ID NO: 1781168 - RNA, 18 nt, Homo sapiens
cuguuucaaugaccugua

SEQ ID NO: 1781169 - RNA, 15 nt, Homo sapiens
aaggaugcccaaaga

SEQ ID NO: 1781170 - RNA, 17 nt, Homo sapiens
gcauuagaaacugaaaa

SEQ ID NO: 1781171 - RNA, 18 nt, Homo sapiens
uucugagggaaagugcau

SEQ ID NO: 1781172 - RNA, 15 nt, Homo sapiens
aggccuagacucugu

SEQ ID NO: 1781173 - RNA, 18 nt, Homo sapiens
acccguacaggcaauucc

SEQ ID NO: 1781174 - RNA, 13 nt, Homo sapiens
ggacuauugcaau

SEQ ID NO: 1781175 - RNA, 17 nt, Homo sapiens
gccaaauugacugucac

SEQ ID NO: 1781176 - RNA, 17 nt, Homo sapiens
cugggcuuccugagcca

SEQ ID NO: 1781177 - RNA, 15 nt, Homo sapiens
ugaguugcccaucau

SEQ ID NO: 1781178 - RNA, 23 nt, Homo sapiens
gauaugccaccagcgaacucuca

SEQ ID NO: 1781179 - RNA, 14 nt, Homo sapiens
gcauuaauguaucu

SEQ ID NO: 1781180 - RNA, 15 nt, Homo sapiens
aauauauagcuggca

SEQ ID NO: 1781181 - RNA, 13 nt, Homo sapiens
ccaguaaaaucaa

SEQ ID NO: 1781182 - RNA, 20 nt, Homo sapiens
uaagagaauccacauaaaag

SEQ ID NO: 1781183 - RNA, 11 nt, Homo sapiens
ccuccccaugg

SEQ ID NO: 1781184 - RNA, 16 nt, Homo sapiens
uguauagacaguuugu

SEQ ID NO: 1781185 - RNA, 18 nt, Homo sapiens
cuggcaagauaaacacuu

SEQ ID NO: 1781186 - RNA, 22 nt, Homo sapiens
cagaagagggaaugagcuucca

SEQ ID NO: 1781187 - RNA, 15 nt, Homo sapiens
ucacaauuugcaaau

SEQ ID NO: 1781188 - RNA, 22 nt, Homo sapiens
ccaaagcacaaagcaguuuuuc

SEQ ID NO: 1781189 - RNA, 19 nt, Homo sapiens
caugucuacaugccaugac

SEQ ID NO: 1781190 - RNA, 16 nt, Homo sapiens
auccaugcacuuuaau

SEQ ID NO: 1781191 - RNA, 19 nt, Homo sapiens
guuuucguuguuguuaaca

SEQ ID NO: 1781192 - RNA, 13 nt, Homo sapiens
auaugaagcacuu

SEQ ID NO: 1781193 - RNA, 16 nt, Homo sapiens
acaacuuaguguaaua

SEQ ID NO: 1781194 - RNA, 22 nt, Homo sapiens
gacaaagugacauuccugaguc

SEQ ID NO: 1781195 - RNA, 16 nt, Homo sapiens
ucauguuguaaacauu

SEQ ID NO: 1781196 - RNA, 11 nt, Homo sapiens
gggcuugcccu

SEQ ID NO: 1781197 - RNA, 16 nt, Homo sapiens
ugugauggcaaagaag

SEQ ID NO: 1781198 - RNA, 21 nt, Homo sapiens
guauuguucuguuuguguuau

SEQ ID NO: 1781199 - RNA, 21 nt, Homo sapiens
caugucugccuaugcacugaa

SEQ ID NO: 1781200 - RNA, 14 nt, Homo sapiens
gugcacuaaugugu

SEQ ID NO: 1781201 - RNA, 14 nt, Homo sapiens
agaaagaagccaua

SEQ ID NO: 1781202 - RNA, 19 nt, Homo sapiens
cugugcaacggucuccuga

SEQ ID NO: 1781203 - RNA, 15 nt, Homo sapiens
caguuucccuaucuc

SEQ ID NO: 1781204 - RNA, 23 nt, Homo sapiens
gaugaaaacauagcaucucagga

SEQ ID NO: 1781205 - RNA, 22 nt, Homo sapiens
cugcaaccaacuacaaccaagc

SEQ ID NO: 1781206 - RNA, 18 nt, Homo sapiens
auauuuuguuaccuuuua

SEQ ID NO: 1781207 - RNA, 18 nt, Homo sapiens
uaaucucuuuauuaaaac

SEQ ID NO: 1781208 - RNA, 23 nt, Homo sapiens
caugaaaaguuauuuaugcuaua

SEQ ID NO: 1781209 - RNA, 18 nt, Homo sapiens
aacuccugaguucaagca

SEQ ID NO: 1781210 - RNA, 16 nt, Homo sapiens
aaauugacauaaccaa

SEQ ID NO: 1781211 - RNA, 14 nt, Homo sapiens
gcaguucaaaaaca

SEQ ID NO: 1781212 - RNA, 19 nt, Homo sapiens
aaacauuuugaaggaaaau

SEQ ID NO: 1781213 - RNA, 11 nt, Homo sapiens
uugagacagaa

SEQ ID NO: 1781214 - RNA, 18 nt, Homo sapiens
gacaccgucccucaguga

SEQ ID NO: 1781215 - RNA, 22 nt, Homo sapiens
ugaauucugcccuuuucucuca

SEQ ID NO: 1781216 - RNA, 16 nt, Homo sapiens
ucacaagggcucucaa

SEQ ID NO: 1781217 - RNA, 21 nt, Homo sapiens
acagcagaguaaaauuacaga

SEQ ID NO: 1781218 - RNA, 18 nt, Homo sapiens
agggcaguacaaugugac

SEQ ID NO: 1781219 - RNA, 20 nt, Homo sapiens
aagaggcauucccagaauuu

SEQ ID NO: 1781220 - RNA, 21 nt, Homo sapiens
caguugagcugacauauacug

SEQ ID NO: 1781221 - RNA, 18 nt, Homo sapiens
ucugcaaggucuuugguu

SEQ ID NO: 1781222 - RNA, 18 nt, Homo sapiens
accuuuuugaacauguau

SEQ ID NO: 1781223 - RNA, 19 nt, Homo sapiens
acccuagcccuugcugcca

SEQ ID NO: 1781224 - RNA, 16 nt, Homo sapiens
gcaccaccaagccaag

SEQ ID NO: 1781225 - RNA, 12 nt, Homo sapiens
uacagccuuccg

SEQ ID NO: 1781226 - RNA, 21 nt, Homo sapiens
uucuuaaucuuuucacaaaua

SEQ ID NO: 1781227 - RNA, 14 nt, Homo sapiens
cuguucacuuugua

SEQ ID NO: 1781228 - RNA, 15 nt, Homo sapiens
gcaaucuacuggaaa

SEQ ID NO: 1781229 - RNA, 19 nt, Homo sapiens
uauuugaagucacacugua

SEQ ID NO: 1781230 - RNA, 19 nt, Homo sapiens
ugagcugaagaaauuauac

SEQ ID NO: 1781231 - RNA, 22 nt, Homo sapiens
gugcaugcaugcccucucugag

SEQ ID NO: 1781232 - RNA, 21 nt, Homo sapiens
ggcucucuggucuaccugaga

SEQ ID NO: 1781233 - RNA, 18 nt, Homo sapiens
cagagaugaacaacuuug

SEQ ID NO: 1781234 - RNA, 19 nt, Homo sapiens
ucaucauuguuguguauaa

SEQ ID NO: 1781235 - RNA, 15 nt, Homo sapiens
agccacaggcacugu

SEQ ID NO: 1781236 - RNA, 21 nt, Homo sapiens
gcuguguuacuaaugaucacu

SEQ ID NO: 1781237 - RNA, 21 nt, Homo sapiens
acacuguguuuuauuguggua

SEQ ID NO: 1781238 - RNA, 15 nt, Homo sapiens
gagcacaucugggag

SEQ ID NO: 1781239 - RNA, 13 nt, Homo sapiens
caguaaguuuccc

SEQ ID NO: 1781240 - RNA, 13 nt, Homo sapiens
agagauacugaag

SEQ ID NO: 1781241 - RNA, 18 nt, Homo sapiens
agccagcagccagcucuc

SEQ ID NO: 1781242 - RNA, 16 nt, Homo sapiens
cuuuugaaaagcuuuu

SEQ ID NO: 1781243 - RNA, 17 nt, Homo sapiens
gauaucuuugcugcuuu

SEQ ID NO: 1781244 - RNA, 15 nt, Homo sapiens
ucacuuuauuguaga

SEQ ID NO: 1781245 - RNA, 16 nt, Homo sapiens
uaauuguauugucaga

SEQ ID NO: 1781246 - RNA, 16 nt, Homo sapiens
cccauuugucccagac

SEQ ID NO: 1781247 - RNA, 22 nt, Homo sapiens
ucagccuguuccuuccugcaga

SEQ ID NO: 1781248 - RNA, 17 nt, Homo sapiens
ggauugaccuuugcacg

SEQ ID NO: 1781249 - RNA, 15 nt, Homo sapiens
ugacauaauaaagua

SEQ ID NO: 1781250 - RNA, 15 nt, Homo sapiens
uacagaaaugccaaa

SEQ ID NO: 1781251 - RNA, 22 nt, Homo sapiens
ggccaaauaugcacuuucccua

SEQ ID NO: 1781252 - RNA, 21 nt, Homo sapiens
acugcuauucuagagcuuuua

SEQ ID NO: 1781253 - RNA, 15 nt, Homo sapiens
accuaucuguggaaa

SEQ ID NO: 1781254 - RNA, 17 nt, Homo sapiens
uuccugaauacaagccu

SEQ ID NO: 1781255 - RNA, 21 nt, Homo sapiens
cugacagcuguccugagcuaa

SEQ ID NO: 1781256 - RNA, 13 nt, Homo sapiens
guuuuccuuaacu

SEQ ID NO: 1781257 - RNA, 16 nt, Homo sapiens
ggaccagugaccaaac

SEQ ID NO: 1781258 - RNA, 23 nt, Homo sapiens
ccacacccaccucugccacucuu

SEQ ID NO: 1781259 - RNA, 23 nt, Homo sapiens
uucaccaauauuucucagacauc

SEQ ID NO: 1781260 - RNA, 19 nt, Homo sapiens
guuagauaugauaguauaa

SEQ ID NO: 1781261 - RNA, 18 nt, Homo sapiens
cugagaauguuaccagac

SEQ ID NO: 1781262 - RNA, 21 nt, Homo sapiens
ugucaagcuaguucacacucu

SEQ ID NO: 1781263 - RNA, 20 nt, Homo sapiens
cccucccaccuccgcuggga

SEQ ID NO: 1781264 - RNA, 22 nt, Homo sapiens
cuggcauuacaggugugagcca

SEQ ID NO: 1781265 - RNA, 16 nt, Homo sapiens
uuccagagaacacagg

SEQ ID NO: 1781266 - RNA, 13 nt, Homo sapiens
aauuauacuuacu

SEQ ID NO: 1781267 - RNA, 21 nt, Homo sapiens
acucaguaacacagugcagua

SEQ ID NO: 1781268 - RNA, 14 nt, Homo sapiens
uauuaacuucacag

SEQ ID NO: 1781269 - RNA, 20 nt, Homo sapiens
aaaccuuccuucccuggcua

SEQ ID NO: 1781270 - RNA, 15 nt, Homo sapiens
aacgaguuguuggcu

SEQ ID NO: 1781271 - RNA, 21 nt, Homo sapiens
ugagcaacucccucucagcua

SEQ ID NO: 1781272 - RNA, 15 nt, Homo sapiens
auugacugaagcaca

SEQ ID NO: 1781273 - RNA, 17 nt, Homo sapiens
ggccaccccgugccacc

SEQ ID NO: 1781274 - RNA, 12 nt, Homo sapiens
acauuaugugga

SEQ ID NO: 1781275 - RNA, 15 nt, Homo sapiens
ggcaucucacuuuau

SEQ ID NO: 1781276 - RNA, 13 nt, Homo sapiens
guacagacacucc

SEQ ID NO: 1781277 - RNA, 18 nt, Homo sapiens
caggagccuggccaggca

SEQ ID NO: 1781278 - RNA, 23 nt, Homo sapiens
cuuugaaacuccaugcaaaccau

SEQ ID NO: 1781279 - RNA, 15 nt, Homo sapiens
aaguuaugcuaauau

SEQ ID NO: 1781280 - RNA, 18 nt, Homo sapiens
cauccugugcugugcaca

SEQ ID NO: 1781281 - RNA, 14 nt, Homo sapiens
cucuuacugcagua

SEQ ID NO: 1781282 - RNA, 14 nt, Homo sapiens
uauuuuaagaucca

SEQ ID NO: 1781283 - RNA, 23 nt, Homo sapiens
cuuaauugaaaugaaaauuuaau

SEQ ID NO: 1781284 - RNA, 21 nt, Homo sapiens
aucccacgacauaagcuggua

SEQ ID NO: 1781285 - RNA, 23 nt, Homo sapiens
auucaccaaccaaagggggacag

SEQ ID NO: 1781286 - RNA, 21 nt, Homo sapiens
caguaacauuuggagugugua

SEQ ID NO: 1781287 - RNA, 14 nt, Homo sapiens
uaaauucaaguuua

SEQ ID NO: 1781288 - RNA, 17 nt, Homo sapiens
cugggaucagcuggugu

SEQ ID NO: 1781289 - RNA, 23 nt, Homo sapiens
uggaugucccuauucugccaugg

SEQ ID NO: 1781290 - RNA, 19 nt, Homo sapiens
ugucucuuugugcucuaaa

SEQ ID NO: 1781291 - RNA, 14 nt, Homo sapiens
cacugcaaugucaa

SEQ ID NO: 1781292 - RNA, 18 nt, Homo sapiens
ucaguaaucacuuuucag

SEQ ID NO: 1781293 - RNA, 14 nt, Homo sapiens
cauuucaccuguga

SEQ ID NO: 1781294 - RNA, 22 nt, Homo sapiens
ccugcccuccccagagcacugg

SEQ ID NO: 1781295 - RNA, 20 nt, Homo sapiens
agagagcacagugaucacca

SEQ ID NO: 1781296 - RNA, 15 nt, Homo sapiens
aaggaagauccugaa

SEQ ID NO: 1781297 - RNA, 23 nt, Homo sapiens
ccaucaauauucagcaaaaugau

SEQ ID NO: 1781298 - RNA, 15 nt, Homo sapiens
cuggcacaguuuucu

SEQ ID NO: 1781299 - RNA, 14 nt, Homo sapiens
ugggggaugcuuca

SEQ ID NO: 1781300 - RNA, 15 nt, Homo sapiens
cacaaaacauccuga

SEQ ID NO: 1781301 - RNA, 14 nt, Homo sapiens
gauccagacuguaa

SEQ ID NO: 1781302 - RNA, 21 nt, Homo sapiens
uauaauucacccaccagacuu

SEQ ID NO: 1781303 - RNA, 21 nt, Homo sapiens
gcuggaauuacaggcacacac

SEQ ID NO: 1781304 - RNA, 15 nt, Homo sapiens
agccuguuuccccaa

SEQ ID NO: 1781305 - RNA, 15 nt, Homo sapiens
ugcuuuuacuucucu

SEQ ID NO: 1781306 - RNA, 16 nt, Homo sapiens
ucuacgugauuuggcu

SEQ ID NO: 1781307 - RNA, 18 nt, Homo sapiens
uuuaauggaaaguuguau

SEQ ID NO: 1781308 - RNA, 13 nt, Homo sapiens
ggagccacugcca

SEQ ID NO: 1781309 - RNA, 21 nt, Homo sapiens
ugcaauaaaacucccuuccuu

SEQ ID NO: 1781310 - RNA, 20 nt, Homo sapiens
cuaaauaaauuucccaguua

SEQ ID NO: 1781311 - RNA, 16 nt, Homo sapiens
cacuugcugaggccaa

SEQ ID NO: 1781312 - RNA, 14 nt, Homo sapiens
aauauguaagucag

SEQ ID NO: 1781313 - RNA, 20 nt, Homo sapiens
auaaacugugucugucccag

SEQ ID NO: 1781314 - RNA, 16 nt, Homo sapiens
gcuccauucacuccca

SEQ ID NO: 1781315 - RNA, 16 nt, Homo sapiens
gacccauuccuuccca

SEQ ID NO: 1781316 - RNA, 22 nt, Homo sapiens
ugccacauggugucucccaaca

SEQ ID NO: 1781317 - RNA, 12 nt, Homo sapiens
ucaggucacaag

SEQ ID NO: 1781318 - RNA, 13 nt, Homo sapiens
uggaaauacuuua

SEQ ID NO: 1781319 - RNA, 15 nt, Homo sapiens
ugaaaaaaaugcauu

SEQ ID NO: 1781320 - RNA, 16 nt, Homo sapiens
auaauaauuacuuaau

SEQ ID NO: 1781321 - RNA, 13 nt, Homo sapiens
guaauaagcaauc

SEQ ID NO: 1781322 - RNA, 18 nt, Homo sapiens
ucaagcuucuugccaguu

SEQ ID NO: 1781323 - RNA, 22 nt, Homo sapiens
cauuucauuaagguuccaguua

SEQ ID NO: 1781324 - RNA, 20 nt, Homo sapiens
cccacguagggcggcacuca

SEQ ID NO: 1781325 - RNA, 20 nt, Homo sapiens
ccuggccaacaugaugaaac

SEQ ID NO: 1781326 - RNA, 22 nt, Homo sapiens
ccuguggguguucuuuccugcc

SEQ ID NO: 1781327 - RNA, 22 nt, Homo sapiens
agcaggaccucugaaacccugg

SEQ ID NO: 1781328 - RNA, 20 nt, Homo sapiens
auugagggcuaaaucccaag

SEQ ID NO: 1781329 - RNA, 20 nt, Homo sapiens
gacacuucaccaaagagcau

SEQ ID NO: 1781330 - RNA, 15 nt, Homo sapiens
acauuuggccacaaa

SEQ ID NO: 1781331 - RNA, 21 nt, Homo sapiens
ccaaacacuguaagcuuuuaa

SEQ ID NO: 1781332 - RNA, 21 nt, Homo sapiens
gaaaucuuuauuaauguuuag

SEQ ID NO: 1781333 - RNA, 15 nt, Homo sapiens
auaagcccugcauaa

SEQ ID NO: 1781334 - RNA, 16 nt, Homo sapiens
cccccacccaccucca

SEQ ID NO: 1781335 - RNA, 13 nt, Homo sapiens
guucuauccaaac

SEQ ID NO: 1781336 - RNA, 15 nt, Homo sapiens
cacccccagugcagc

SEQ ID NO: 1781337 - RNA, 23 nt, Homo sapiens
ggugauugucauguaaggcuuaa

SEQ ID NO: 1781338 - RNA, 13 nt, Homo sapiens
cagcuguacugag

SEQ ID NO: 1781339 - RNA, 18 nt, Homo sapiens
uccaaaccgcaggcaaac

SEQ ID NO: 1781340 - RNA, 14 nt, Homo sapiens
cuggcucagccuca

SEQ ID NO: 1781341 - RNA, 21 nt, Homo sapiens
cagccuggcuauacagugcau

SEQ ID NO: 1781342 - RNA, 16 nt, Homo sapiens
uucuuuccuuguucag

SEQ ID NO: 1781343 - RNA, 16 nt, Homo sapiens
uggcucagugccuucc

SEQ ID NO: 1781344 - RNA, 13 nt, Homo sapiens
auaggacucugga

SEQ ID NO: 1781345 - RNA, 15 nt, Homo sapiens
gcgcccgccccugca

SEQ ID NO: 1781346 - RNA, 15 nt, Homo sapiens
aaagcuuuuacugug

SEQ ID NO: 1781347 - RNA, 13 nt, Homo sapiens
aaaaucacucuca

SEQ ID NO: 1781348 - RNA, 22 nt, Homo sapiens
ggcugcgucccugcucagccca

SEQ ID NO: 1781349 - RNA, 15 nt, Homo sapiens
aacauuuuacaguaa

SEQ ID NO: 1781350 - RNA, 20 nt, Homo sapiens
cugauguuuauguacuguaa

SEQ ID NO: 1781351 - RNA, 19 nt, Homo sapiens
ccuuuuuauucagcuagaa

SEQ ID NO: 1781352 - RNA, 22 nt, Homo sapiens
caaaaaacugcaguuugaucaa

SEQ ID NO: 1781353 - RNA, 22 nt, Homo sapiens
uguagucuuuuuauagguuuua

SEQ ID NO: 1781354 - RNA, 17 nt, Homo sapiens
ccuuguggcuugggaca

SEQ ID NO: 1781355 - RNA, 13 nt, Homo sapiens
ugcuuccuccuca

SEQ ID NO: 1781356 - RNA, 22 nt, Homo sapiens
aacucugggcacuuuugaacuc

SEQ ID NO: 1781357 - RNA, 20 nt, Homo sapiens
uccuauuuaugaaaaccaua

SEQ ID NO: 1781358 - RNA, 14 nt, Homo sapiens
uugcauugcuggac

SEQ ID NO: 1781359 - RNA, 20 nt, Homo sapiens
auuucagacauauccaaagg

SEQ ID NO: 1781360 - RNA, 21 nt, Homo sapiens
acagacgucucaagacugaaa

SEQ ID NO: 1781361 - RNA, 17 nt, Homo sapiens
agaagugugacuagaua

SEQ ID NO: 1781362 - RNA, 22 nt, Homo sapiens
uaacucaccagccccacugcca

SEQ ID NO: 1781363 - RNA, 14 nt, Homo sapiens
gacacuuauuuauu

SEQ ID NO: 1781364 - RNA, 18 nt, Homo sapiens
ggagaggggaagggccag

SEQ ID NO: 1781365 - RNA, 15 nt, Homo sapiens
aagauggcaacugua

SEQ ID NO: 1781366 - RNA, 13 nt, Homo sapiens
auuguuguugcca

SEQ ID NO: 1781367 - RNA, 23 nt, Homo sapiens
aggguagaaaaaggagcuuaccu

SEQ ID NO: 1781368 - RNA, 19 nt, Homo sapiens
acccuucuacuuugcagau

SEQ ID NO: 1781369 - RNA, 15 nt, Homo sapiens
agagauucugguaca

SEQ ID NO: 1781370 - RNA, 21 nt, Homo sapiens
uccacucaggucuguuuuccg

SEQ ID NO: 1781371 - RNA, 13 nt, Homo sapiens
uaccagugaauuu

SEQ ID NO: 1781372 - RNA, 13 nt, Homo sapiens
agggacagaauua

SEQ ID NO: 1781373 - RNA, 23 nt, Homo sapiens
agacucauggauuggucugaggg

SEQ ID NO: 1781374 - RNA, 16 nt, Homo sapiens
cucagcuggcuguaug

SEQ ID NO: 1781375 - RNA, 18 nt, Homo sapiens
aacuuacgaucucuugac

SEQ ID NO: 1781376 - RNA, 23 nt, Homo sapiens
gacagcuugacucuacucccagc

SEQ ID NO: 1781377 - RNA, 17 nt, Homo sapiens
auucugcagguaaaaga

SEQ ID NO: 1781378 - RNA, 17 nt, Homo sapiens
ugccuccucuccaggcc

SEQ ID NO: 1781379 - RNA, 21 nt, Homo sapiens
cugucaaacaaagccagaagc

SEQ ID NO: 1781380 - RNA, 19 nt, Homo sapiens
auacuuuuacucugccuac

SEQ ID NO: 1781381 - RNA, 20 nt, Homo sapiens
gaccuaccucccucccucuc

SEQ ID NO: 1781382 - RNA, 13 nt, Homo sapiens
accucaucagccu

SEQ ID NO: 1781383 - RNA, 16 nt, Homo sapiens
ccagcugcugucuucu

SEQ ID NO: 1781384 - RNA, 20 nt, Homo sapiens
aguuuuaacagaaccagagg

SEQ ID NO: 1781385 - RNA, 13 nt, Homo sapiens
auguauuccugua

SEQ ID NO: 1781386 - RNA, 13 nt, Homo sapiens
ccuuuuucacuuu

SEQ ID NO: 1781387 - RNA, 13 nt, Homo sapiens
cucaauucaucaa

SEQ ID NO: 1781388 - RNA, 17 nt, Homo sapiens
ucccaugaacacacugu

SEQ ID NO: 1781389 - RNA, 16 nt, Homo sapiens
ucagacacuaccccau

SEQ ID NO: 1781390 - RNA, 12 nt, Homo sapiens
agcuucaaauaa

SEQ ID NO: 1781391 - RNA, 18 nt, Homo sapiens
ccaggcguggugacucac

SEQ ID NO: 1781392 - RNA, 12 nt, Homo sapiens
cacacaucucau

SEQ ID NO: 1781393 - RNA, 16 nt, Homo sapiens
gcaccccccauugggg

SEQ ID NO: 1781394 - RNA, 16 nt, Homo sapiens
caauucaugguucaag

SEQ ID NO: 1781395 - RNA, 21 nt, Homo sapiens
gcuccucggacggcuccggac

SEQ ID NO: 1781396 - RNA, 20 nt, Homo sapiens
ucagaaucugauaccaaaga

SEQ ID NO: 1781397 - RNA, 22 nt, Homo sapiens
uuaaaauucacccccauccaca

SEQ ID NO: 1781398 - RNA, 21 nt, Homo sapiens
gaaggaggggguucuuccuca

SEQ ID NO: 1781399 - RNA, 16 nt, Homo sapiens
aaauguacgaaacugu

SEQ ID NO: 1781400 - RNA, 21 nt, Homo sapiens
cucuguugaaucacaguauca

SEQ ID NO: 1781401 - RNA, 19 nt, Homo sapiens
acucuggucaagaagcauc

SEQ ID NO: 1781402 - RNA, 19 nt, Homo sapiens
caggugggccgcaggcggg

SEQ ID NO: 1781403 - RNA, 21 nt, Homo sapiens
agaugguaccgugcaucgcac

SEQ ID NO: 1781404 - RNA, 20 nt, Homo sapiens
gaacuagaagaaagggcaag

SEQ ID NO: 1781405 - RNA, 16 nt, Homo sapiens
guucauugcacuuuga

SEQ ID NO: 1781406 - RNA, 12 nt, Homo sapiens
augcccacugcc

SEQ ID NO: 1781407 - RNA, 15 nt, Homo sapiens
agagacuguuugaau

SEQ ID NO: 1781408 - RNA, 13 nt, Homo sapiens
uggagucauucuc

SEQ ID NO: 1781409 - RNA, 20 nt, Homo sapiens
cuguuuucugggccagugag

SEQ ID NO: 1781410 - RNA, 18 nt, Homo sapiens
aaaucauccuauuacuua

SEQ ID NO: 1781411 - RNA, 20 nt, Homo sapiens
gaaaaagaguuaagcaguuc

SEQ ID NO: 1781412 - RNA, 19 nt, Homo sapiens
agcucccauuucuacucuu

SEQ ID NO: 1781413 - RNA, 15 nt, Homo sapiens
guuauccugugcuac

SEQ ID NO: 1781414 - RNA, 20 nt, Homo sapiens
uaaauuuggcuucuguuguc

SEQ ID NO: 1781415 - RNA, 23 nt, Homo sapiens
aauuuucccuugauaaccauaua

SEQ ID NO: 1781416 - RNA, 12 nt, Homo sapiens
ugccucugcaaa

SEQ ID NO: 1781417 - RNA, 16 nt, Homo sapiens
ugacaauauacuucac

SEQ ID NO: 1781418 - RNA, 22 nt, Homo sapiens
ugacuugcaaagaccuaccucc

SEQ ID NO: 1781419 - RNA, 16 nt, Homo sapiens
ccuucccaauccagug

SEQ ID NO: 1781420 - RNA, 13 nt, Homo sapiens
cuaagaugcauuu

SEQ ID NO: 1781421 - RNA, 15 nt, Homo sapiens
aggugcagucuuuga

SEQ ID NO: 1781422 - RNA, 15 nt, Homo sapiens
ugaaccuugagcaaa

SEQ ID NO: 1781423 - RNA, 13 nt, Homo sapiens
gcucucuguggug

SEQ ID NO: 1781424 - RNA, 23 nt, Homo sapiens
cauggggggagcacccugagggc

SEQ ID NO: 1781425 - RNA, 23 nt, Homo sapiens
ccucgaacuccuggucucaagca

SEQ ID NO: 1781426 - RNA, 15 nt, Homo sapiens
auauauacacacagu

SEQ ID NO: 1781427 - RNA, 23 nt, Homo sapiens
auuuugcacaguuaccugcacac

SEQ ID NO: 1781428 - RNA, 14 nt, Homo sapiens
auucagcaugucca

SEQ ID NO: 1781429 - RNA, 13 nt, Homo sapiens
ggccacagcgugc

SEQ ID NO: 1781430 - RNA, 21 nt, Homo sapiens
acccaugccagcgcagcgcca

SEQ ID NO: 1781431 - RNA, 19 nt, Homo sapiens
uuguuuuuuuccugaugaa

SEQ ID NO: 1781432 - RNA, 15 nt, Homo sapiens
aguuccuucagcuuc

SEQ ID NO: 1781433 - RNA, 21 nt, Homo sapiens
gcuugccccaggacucuggca

SEQ ID NO: 1781434 - RNA, 17 nt, Homo sapiens
gauccucagaacucuuu

SEQ ID NO: 1781435 - RNA, 13 nt, Homo sapiens
uuacuacagugac

SEQ ID NO: 1781436 - RNA, 20 nt, Homo sapiens
acgccccgaaccucaccuga

SEQ ID NO: 1781437 - RNA, 17 nt, Homo sapiens
gcaugugugacuuucag

SEQ ID NO: 1781438 - RNA, 15 nt, Homo sapiens
cuacuuccuccuagc

SEQ ID NO: 1781439 - RNA, 17 nt, Homo sapiens
guauucuuucaccucuu

SEQ ID NO: 1781440 - RNA, 21 nt, Homo sapiens
guuccagaaggauccaagaca

SEQ ID NO: 1781441 - RNA, 24 nt, Homo sapiens
aguuucagauaaaucaugggcauu

SEQ ID NO: 1781442 - RNA, 18 nt, Homo sapiens
ccagcauauauaguauuu

SEQ ID NO: 1781443 - RNA, 14 nt, Homo sapiens
ugacaaucugccuu

SEQ ID NO: 1781444 - RNA, 16 nt, Homo sapiens
ccaaacccaccugcua

SEQ ID NO: 1781445 - RNA, 17 nt, Homo sapiens
uucccaagcccugguga

SEQ ID NO: 1781446 - RNA, 18 nt, Homo sapiens
uggugugagccacugugu

SEQ ID NO: 1781447 - RNA, 14 nt, Homo sapiens
uggcuuucauccaa

SEQ ID NO: 1781448 - RNA, 21 nt, Homo sapiens
gaaaagggcaaaaagaccaag

SEQ ID NO: 1781449 - RNA, 14 nt, Homo sapiens
ugcagccuccgccu

SEQ ID NO: 1781450 - RNA, 17 nt, Homo sapiens
agacugaacagccaaau

SEQ ID NO: 1781451 - RNA, 20 nt, Homo sapiens
aaggauuaagauacacuccu

SEQ ID NO: 1781452 - RNA, 16 nt, Homo sapiens
cuggacaguaucccac

SEQ ID NO: 1781453 - RNA, 13 nt, Homo sapiens
agaggccaugaag

SEQ ID NO: 1781454 - RNA, 15 nt, Homo sapiens
auucaauuuauuuga

SEQ ID NO: 1781455 - RNA, 12 nt, Homo sapiens
uuuuuauccaug

SEQ ID NO: 1781456 - RNA, 14 nt, Homo sapiens
ucuccuuuguccau

SEQ ID NO: 1781457 - RNA, 16 nt, Homo sapiens
cccucgucauuuucuu

SEQ ID NO: 1781458 - RNA, 20 nt, Homo sapiens
cuuaaagaaacagcuuucaa

SEQ ID NO: 1781459 - RNA, 14 nt, Homo sapiens
gcaaauugucacag

SEQ ID NO: 1781460 - RNA, 11 nt, Homo sapiens
uuaugaaguua

SEQ ID NO: 1781461 - RNA, 16 nt, Homo sapiens
cagaauuuuccauuua

SEQ ID NO: 1781462 - RNA, 17 nt, Homo sapiens
ugaaaaccucacaugca

SEQ ID NO: 1781463 - RNA, 16 nt, Homo sapiens
cacuuccauaugucau

SEQ ID NO: 1781464 - RNA, 13 nt, Homo sapiens
agauauuaauaga

SEQ ID NO: 1781465 - RNA, 22 nt, Homo sapiens
caaguagcugggauuacaggca

SEQ ID NO: 1781466 - RNA, 15 nt, Homo sapiens
guaccugcugggugu

SEQ ID NO: 1781467 - RNA, 18 nt, Homo sapiens
cauacagguuaaccugca

SEQ ID NO: 1781468 - RNA, 19 nt, Homo sapiens
cccucaugauauguccuca

SEQ ID NO: 1781469 - RNA, 14 nt, Homo sapiens
ucuaaacagacuca

SEQ ID NO: 1781470 - RNA, 20 nt, Homo sapiens
cuccugaguagaugggacua

SEQ ID NO: 1781471 - RNA, 17 nt, Homo sapiens
ugcagguacuuccucag

SEQ ID NO: 1781472 - RNA, 16 nt, Homo sapiens
auagguuuaauuucaa

SEQ ID NO: 1781473 - RNA, 16 nt, Homo sapiens
cccugcagcuggggaa

SEQ ID NO: 1781474 - RNA, 22 nt, Homo sapiens
guguccuucgggggcgugcgug

SEQ ID NO: 1781475 - RNA, 16 nt, Homo sapiens
aaauaaauggacugaa

SEQ ID NO: 1781476 - RNA, 18 nt, Homo sapiens
uauaaauuuguguucuca

SEQ ID NO: 1781477 - RNA, 13 nt, Homo sapiens
gucucaugcagaa

SEQ ID NO: 1781478 - RNA, 22 nt, Homo sapiens
cccuguuuaacauuucacccca

SEQ ID NO: 1781479 - RNA, 10 nt, Homo sapiens
uaauucccaa

SEQ ID NO: 1781480 - RNA, 16 nt, Homo sapiens
agcauuuccucagucu

SEQ ID NO: 1781481 - RNA, 18 nt, Homo sapiens
guagauuuuaaagacaaa

SEQ ID NO: 1781482 - RNA, 18 nt, Homo sapiens
uacuaugcucuagagaaa

SEQ ID NO: 1781483 - RNA, 15 nt, Homo sapiens
auuguuguugccaaa

SEQ ID NO: 1781484 - RNA, 20 nt, Homo sapiens
gggaggucaaggcugcagug

SEQ ID NO: 1781485 - RNA, 15 nt, Homo sapiens
cuaauuuucucaaaa

SEQ ID NO: 1781486 - RNA, 17 nt, Homo sapiens
acaagcuauucccucaa

SEQ ID NO: 1781487 - RNA, 23 nt, Homo sapiens
agccugugguggccuggugcaca

SEQ ID NO: 1781488 - RNA, 18 nt, Homo sapiens
aaguccaggacacccagu

SEQ ID NO: 1781489 - RNA, 17 nt, Homo sapiens
guacggcugguguguca

SEQ ID NO: 1781490 - RNA, 15 nt, Homo sapiens
ccuaccaauaacgua

SEQ ID NO: 1781491 - RNA, 13 nt, Homo sapiens
gacccagcacuga

SEQ ID NO: 1781492 - RNA, 19 nt, Homo sapiens
cacuugcaagucccaugau

SEQ ID NO: 1781493 - RNA, 18 nt, Homo sapiens
aggagggcagaucacuuc

SEQ ID NO: 1781494 - RNA, 12 nt, Homo sapiens
agauagccagag

SEQ ID NO: 1781495 - RNA, 16 nt, Homo sapiens
uacaccaaacauuucu

SEQ ID NO: 1781496 - RNA, 15 nt, Homo sapiens
gaaauaaaauuugaa

SEQ ID NO: 1781497 - RNA, 15 nt, Homo sapiens
aaaauauaguuugau

SEQ ID NO: 1781498 - RNA, 16 nt, Homo sapiens
auuuggcaaugccauc

SEQ ID NO: 1781499 - RNA, 17 nt, Homo sapiens
ugaauuaaugaugagga

SEQ ID NO: 1781500 - RNA, 15 nt, Homo sapiens
uacuuguucauuugg

SEQ ID NO: 1781501 - RNA, 23 nt, Homo sapiens
acuguguugggcaagaccucuuc

SEQ ID NO: 1781502 - RNA, 20 nt, Homo sapiens
aacacuuugcuaggagauac

SEQ ID NO: 1781503 - RNA, 16 nt, Homo sapiens
uacaaagcgugcacaa

SEQ ID NO: 1781504 - RNA, 14 nt, Homo sapiens
caaacuugcuuuau

SEQ ID NO: 1781505 - RNA, 23 nt, Homo sapiens
guugucaccucucucugaggaca

SEQ ID NO: 1781506 - RNA, 17 nt, Homo sapiens
cuugaggcagggucuca

SEQ ID NO: 1781507 - RNA, 17 nt, Homo sapiens
cuugcugcccacaacgu

SEQ ID NO: 1781508 - RNA, 20 nt, Homo sapiens
guuuaaagauuucaagaaga

SEQ ID NO: 1781509 - RNA, 19 nt, Homo sapiens
gacucugucuggccaggga

SEQ ID NO: 1781510 - RNA, 18 nt, Homo sapiens
auugaaguuuuggcaauu

SEQ ID NO: 1781511 - RNA, 18 nt, Homo sapiens
cagugagacuguacauaa

SEQ ID NO: 1781512 - RNA, 14 nt, Homo sapiens
cugccuucucaggg

SEQ ID NO: 1781513 - RNA, 17 nt, Homo sapiens
ggaagaagauagaucca

SEQ ID NO: 1781514 - RNA, 23 nt, Homo sapiens
uuugauuuuucuaaccuugaaug

SEQ ID NO: 1781515 - RNA, 16 nt, Homo sapiens
guccugcucucuucag

SEQ ID NO: 1781516 - RNA, 15 nt, Homo sapiens
uauuugugacaaaaa

SEQ ID NO: 1781517 - RNA, 18 nt, Homo sapiens
uaaacguguaaauugcac

SEQ ID NO: 1781518 - RNA, 18 nt, Homo sapiens
uguagaguuguuucuuaa

SEQ ID NO: 1781519 - RNA, 16 nt, Homo sapiens
uagauguaugcacaca

SEQ ID NO: 1781520 - RNA, 20 nt, Homo sapiens
cuguaauauuuagcuguaaa

SEQ ID NO: 1781521 - RNA, 16 nt, Homo sapiens
cauggaaaaucaguga

SEQ ID NO: 1781522 - RNA, 14 nt, Homo sapiens
accauaacuguuuc

SEQ ID NO: 1781523 - RNA, 16 nt, Homo sapiens
gcaggugacauuugcu

SEQ ID NO: 1781524 - RNA, 15 nt, Homo sapiens
gaaacuuaagcauaa

SEQ ID NO: 1781525 - RNA, 21 nt, Homo sapiens
ugcauuucaagcagcugaaga

SEQ ID NO: 1781526 - RNA, 15 nt, Homo sapiens
aaugacauguauagu

SEQ ID NO: 1781527 - RNA, 17 nt, Homo sapiens
ccgcccagaucaugccg

SEQ ID NO: 1781528 - RNA, 20 nt, Homo sapiens
uuacaaaaccaucauuucaa

SEQ ID NO: 1781529 - RNA, 12 nt, Homo sapiens
uuggcauacaaa

SEQ ID NO: 1781530 - RNA, 23 nt, Homo sapiens
aauaaaguaccacacauauugca

SEQ ID NO: 1781531 - RNA, 22 nt, Homo sapiens
ugagaaggcaaaagaaagaacc

SEQ ID NO: 1781532 - RNA, 20 nt, Homo sapiens
cauauauaagguaugugcua

SEQ ID NO: 1781533 - RNA, 18 nt, Homo sapiens
caguaucccacauccaac

SEQ ID NO: 1781534 - RNA, 12 nt, Homo sapiens
cacacucaucca

SEQ ID NO: 1781535 - RNA, 23 nt, Homo sapiens
cucuucccgccgcccagcccacc

SEQ ID NO: 1781536 - RNA, 18 nt, Homo sapiens
agcugucacauacaacuu

SEQ ID NO: 1781537 - RNA, 22 nt, Homo sapiens
gaaucagcauuuagucuugcca

SEQ ID NO: 1781538 - RNA, 12 nt, Homo sapiens
ccuaacauauau

SEQ ID NO: 1781539 - RNA, 16 nt, Homo sapiens
auauucuaagucaccu

SEQ ID NO: 1781540 - RNA, 14 nt, Homo sapiens
acucaagugucuca

SEQ ID NO: 1781541 - RNA, 13 nt, Homo sapiens
acagucucaggaa

SEQ ID NO: 1781542 - RNA, 19 nt, Homo sapiens
gaauacuauacagccauaa

SEQ ID NO: 1781543 - RNA, 11 nt, Homo sapiens
uugaugacugu

SEQ ID NO: 1781544 - RNA, 22 nt, Homo sapiens
acaaacauaaggcacauugugu

SEQ ID NO: 1781545 - RNA, 14 nt, Homo sapiens
cuuggagugccacg

SEQ ID NO: 1781546 - RNA, 15 nt, Homo sapiens
uccagccccagacaa

SEQ ID NO: 1781547 - RNA, 19 nt, Homo sapiens
guagaggugcaugccuaau

SEQ ID NO: 1781548 - RNA, 13 nt, Homo sapiens
acugcuccagugg

SEQ ID NO: 1781549 - RNA, 16 nt, Homo sapiens
ucacauuaucaucuga

SEQ ID NO: 1781550 - RNA, 19 nt, Homo sapiens
uaauguuagggguauuuaa

SEQ ID NO: 1781551 - RNA, 21 nt, Homo sapiens
gacaauaaacccucagagccu

SEQ ID NO: 1781552 - RNA, 16 nt, Homo sapiens
guaaguauuaagaaua

SEQ ID NO: 1781553 - RNA, 17 nt, Homo sapiens
cauuuuuguaauaacau

SEQ ID NO: 1781554 - RNA, 15 nt, Homo sapiens
gacuuuauugcaucu

SEQ ID NO: 1781555 - RNA, 24 nt, Homo sapiens
cgauugauugauguacagaacaca

SEQ ID NO: 1781556 - RNA, 15 nt, Homo sapiens
uccacccgucucucu

SEQ ID NO: 1781557 - RNA, 20 nt, Homo sapiens
uguuuuuagcugguggcaau

SEQ ID NO: 1781558 - RNA, 20 nt, Homo sapiens
ggaaauuuuucagacuuuaa

SEQ ID NO: 1781559 - RNA, 23 nt, Homo sapiens
aacaggugcugaacugugcauca

SEQ ID NO: 1781560 - RNA, 21 nt, Homo sapiens
agcugauccuucaacucugug

SEQ ID NO: 1781561 - RNA, 18 nt, Homo sapiens
uguuuggaauauuccacu

SEQ ID NO: 1781562 - RNA, 15 nt, Homo sapiens
uguaaauauguuuca

SEQ ID NO: 1781563 - RNA, 17 nt, Homo sapiens
auaaaaucaaacagaga

SEQ ID NO: 1781564 - RNA, 15 nt, Homo sapiens
cugccugacacugag

SEQ ID NO: 1781565 - RNA, 13 nt, Homo sapiens
aaagaacauuuaa

SEQ ID NO: 1781566 - RNA, 13 nt, Homo sapiens
cccagcuugggca

SEQ ID NO: 1781567 - RNA, 22 nt, Homo sapiens
auuucuccugggaaaccugccu

SEQ ID NO: 1781568 - RNA, 18 nt, Homo sapiens
uucacaaaucaugguaau

SEQ ID NO: 1781569 - RNA, 15 nt, Homo sapiens
uauugaaaacacuua

SEQ ID NO: 1781570 - RNA, 15 nt, Homo sapiens
uaucuaaaacaugua

SEQ ID NO: 1781571 - RNA, 13 nt, Homo sapiens
agcaaaaugucuc

SEQ ID NO: 1781572 - RNA, 20 nt, Homo sapiens
cuauucugcuaagagaucac

SEQ ID NO: 1781573 - RNA, 15 nt, Homo sapiens
aggggauccagcuca

SEQ ID NO: 1781574 - RNA, 15 nt, Homo sapiens
aagcucccagaguuu

SEQ ID NO: 1781575 - RNA, 17 nt, Homo sapiens
aacuauaggcuucuucc

SEQ ID NO: 1781576 - RNA, 15 nt, Homo sapiens
aucaaaauccaaaau

SEQ ID NO: 1781577 - RNA, 20 nt, Homo sapiens
gggucuuguuucacauuugu

SEQ ID NO: 1781578 - RNA, 23 nt, Homo sapiens
auauccaaagggaauacucacau

SEQ ID NO: 1781579 - RNA, 12 nt, Homo sapiens
cccaggccagga

SEQ ID NO: 1781580 - RNA, 19 nt, Homo sapiens
guaccucccagcaggguga

SEQ ID NO: 1781581 - RNA, 17 nt, Homo sapiens
aauccuucuaacuaaac

SEQ ID NO: 1781582 - RNA, 16 nt, Homo sapiens
cuucuaagagauauaa

SEQ ID NO: 1781583 - RNA, 13 nt, Homo sapiens
ugaauauguagcu

SEQ ID NO: 1781584 - RNA, 15 nt, Homo sapiens
cgggacaccuaggcu

SEQ ID NO: 1781585 - RNA, 20 nt, Homo sapiens
uuauggcaugauuuauauau

SEQ ID NO: 1781586 - RNA, 20 nt, Homo sapiens
ccucauuuaagaaaaaucau

SEQ ID NO: 1781587 - RNA, 22 nt, Homo sapiens
uacucaguaacacagugcagua

SEQ ID NO: 1781588 - RNA, 21 nt, Homo sapiens
agccuucuuuuguacuuuuca

SEQ ID NO: 1781589 - RNA, 23 nt, Homo sapiens
ccaugguagaaaaugcaccaaau

SEQ ID NO: 1781590 - RNA, 14 nt, Homo sapiens
ucaccuccauguca

SEQ ID NO: 1781591 - RNA, 12 nt, Homo sapiens
cacacuauggca

SEQ ID NO: 1781592 - RNA, 14 nt, Homo sapiens
gucaauaauacauu

SEQ ID NO: 1781593 - RNA, 20 nt, Homo sapiens
ggaaaauaaaucaaugcuau

SEQ ID NO: 1781594 - RNA, 21 nt, Homo sapiens
ggcaggggaauuuucucucca

SEQ ID NO: 1781595 - RNA, 20 nt, Homo sapiens
uauguacaggacauguacug

SEQ ID NO: 1781596 - RNA, 12 nt, Homo sapiens
acauuccagggg

SEQ ID NO: 1781597 - RNA, 22 nt, Homo sapiens
aguacuguaacugugucaugau

SEQ ID NO: 1781598 - RNA, 21 nt, Homo sapiens
agcaaagacaguuucuugcaa

SEQ ID NO: 1781599 - RNA, 19 nt, Homo sapiens
uuagaacucugcuuacuaa

SEQ ID NO: 1781600 - RNA, 16 nt, Homo sapiens
cagccccagugcccac

SEQ ID NO: 1781601 - RNA, 19 nt, Homo sapiens
aacauauauuuuauuuuca

SEQ ID NO: 1781602 - RNA, 20 nt, Homo sapiens
ugagacauauuuacaaccua

SEQ ID NO: 1781603 - RNA, 18 nt, Homo sapiens
ugucgccgcccaggauug

SEQ ID NO: 1781604 - RNA, 23 nt, Homo sapiens
aagacuuuuuuuuaacacuuugg

SEQ ID NO: 1781605 - RNA, 16 nt, Homo sapiens
ggaaguuuuccuacac

SEQ ID NO: 1781606 - RNA, 22 nt, Homo sapiens
uggcucuggagacagccccaga

SEQ ID NO: 1781607 - RNA, 11 nt, Homo sapiens
gucaccagagg

SEQ ID NO: 1781608 - RNA, 13 nt, Homo sapiens
uccuuuucuuccc

SEQ ID NO: 1781609 - RNA, 23 nt, Homo sapiens
aagcagcauggaaaaaugguuga

SEQ ID NO: 1781610 - RNA, 14 nt, Homo sapiens
cacacucuccugug

SEQ ID NO: 1781611 - RNA, 18 nt, Homo sapiens
guacuuccuguguacucu

SEQ ID NO: 1781612 - RNA, 22 nt, Homo sapiens
aggccagugugccgaccucucu

SEQ ID NO: 1781613 - RNA, 14 nt, Homo sapiens
ugaaauguguuucc

SEQ ID NO: 1781614 - RNA, 23 nt, Homo sapiens
cuggcacagcuuuuguauagaaa

SEQ ID NO: 1781615 - RNA, 14 nt, Homo sapiens
ccaggcuguucucc

SEQ ID NO: 1781616 - RNA, 19 nt, Homo sapiens
gaagaauauucaggacuua

SEQ ID NO: 1781617 - RNA, 15 nt, Homo sapiens
agcagcccugucacg

SEQ ID NO: 1781618 - RNA, 13 nt, Homo sapiens
caaacacaccucu

SEQ ID NO: 1781619 - RNA, 15 nt, Homo sapiens
agaaauaucuuucuc

SEQ ID NO: 1781620 - RNA, 19 nt, Homo sapiens
auuuaauacagacaucuaa

SEQ ID NO: 1781621 - RNA, 15 nt, Homo sapiens
aggccagugccagga

SEQ ID NO: 1781622 - RNA, 20 nt, Homo sapiens
ugcauggauaugugccaggc

SEQ ID NO: 1781623 - RNA, 11 nt, Homo sapiens
cccaagacauu

SEQ ID NO: 1781624 - RNA, 14 nt, Homo sapiens
ucaucccacaaucu

SEQ ID NO: 1781625 - RNA, 19 nt, Homo sapiens
acaucagauccugggcaca

SEQ ID NO: 1781626 - RNA, 22 nt, Homo sapiens
agacaugccaacucgggagcau

SEQ ID NO: 1781627 - RNA, 20 nt, Homo sapiens
aagauacgguugucuagagg

SEQ ID NO: 1781628 - RNA, 23 nt, Homo sapiens
uuccaggacagggaagggagcag

SEQ ID NO: 1781629 - RNA, 17 nt, Homo sapiens
aguguucacaaccugga

SEQ ID NO: 1781630 - RNA, 12 nt, Homo sapiens
uaaaacugugac

SEQ ID NO: 1781631 - RNA, 21 nt, Homo sapiens
ugguaaagaaauacacaggga

SEQ ID NO: 1781632 - RNA, 19 nt, Homo sapiens
ucuuuaucagugauggucu

SEQ ID NO: 1781633 - RNA, 17 nt, Homo sapiens
agaccugaauaccacuu

SEQ ID NO: 1781634 - RNA, 15 nt, Homo sapiens
cuuuccaagucauuu

SEQ ID NO: 1781635 - RNA, 23 nt, Homo sapiens
caagaacauuaucuuaguggaag

SEQ ID NO: 1781636 - RNA, 19 nt, Homo sapiens
cugagcccaccuucuugcu

SEQ ID NO: 1781637 - RNA, 19 nt, Homo sapiens
agccacaaacccugccucu

SEQ ID NO: 1781638 - RNA, 13 nt, Homo sapiens
uuccuguugucaa

SEQ ID NO: 1781639 - RNA, 18 nt, Homo sapiens
cccccuuuccucuugggc

SEQ ID NO: 1781640 - RNA, 17 nt, Homo sapiens
aauugacugggccucau

SEQ ID NO: 1781641 - RNA, 17 nt, Homo sapiens
cacccccaggaccucuu

SEQ ID NO: 1781642 - RNA, 17 nt, Homo sapiens
auagugucacuuccaca

SEQ ID NO: 1781643 - RNA, 20 nt, Homo sapiens
ucaucaggaguuccagugcu

SEQ ID NO: 1781644 - RNA, 21 nt, Homo sapiens
cucagaguucuauacuguaaa

SEQ ID NO: 1781645 - RNA, 14 nt, Homo sapiens
cucuuauugccuca

SEQ ID NO: 1781646 - RNA, 14 nt, Homo sapiens
agggacuccuccug

SEQ ID NO: 1781647 - RNA, 15 nt, Homo sapiens
guugguaaaggguua

SEQ ID NO: 1781648 - RNA, 15 nt, Homo sapiens
gcaccuacaguguac

SEQ ID NO: 1781649 - RNA, 14 nt, Homo sapiens
ugggcaagaggaaa

SEQ ID NO: 1781650 - RNA, 13 nt, Homo sapiens
cccugucaggaca

SEQ ID NO: 1781651 - RNA, 16 nt, Homo sapiens
cacacgauaaagggau

SEQ ID NO: 1781652 - RNA, 23 nt, Homo sapiens
uugcacuuauauagcaccuuuca

SEQ ID NO: 1781653 - RNA, 19 nt, Homo sapiens
uauccaaaagagacaggga

SEQ ID NO: 1781654 - RNA, 23 nt, Homo sapiens
gcugcaugcgauuaucuacccac

SEQ ID NO: 1781655 - RNA, 22 nt, Homo sapiens
ccuuagauguucuaagucuuuc

SEQ ID NO: 1781656 - RNA, 14 nt, Homo sapiens
agaugccuucccuu

SEQ ID NO: 1781657 - RNA, 14 nt, Homo sapiens
uggaaguuuccuca

SEQ ID NO: 1781658 - RNA, 12 nt, Homo sapiens
ucagaacagccu

SEQ ID NO: 1781659 - RNA, 14 nt, Homo sapiens
gugcugguauacua

SEQ ID NO: 1781660 - RNA, 15 nt, Homo sapiens
gaacugcaacacugg

SEQ ID NO: 1781661 - RNA, 23 nt, Homo sapiens
gcuuaaacaagccaacauaugaa

SEQ ID NO: 1781662 - RNA, 21 nt, Homo sapiens
uggaucaaaaagaaacuuugu

SEQ ID NO: 1781663 - RNA, 23 nt, Homo sapiens
cuagcauuaaguaaagugaaguc

SEQ ID NO: 1781664 - RNA, 18 nt, Homo sapiens
ccaucugugcacgcagug

SEQ ID NO: 1781665 - RNA, 18 nt, Homo sapiens
cugcugacccagccuguu

SEQ ID NO: 1781666 - RNA, 22 nt, Homo sapiens
uggcucaagucugcacagagca

SEQ ID NO: 1781667 - RNA, 15 nt, Homo sapiens
uacuauuaagggaaa

SEQ ID NO: 1781668 - RNA, 23 nt, Homo sapiens
uccccugggcaccccucacuuuc

SEQ ID NO: 1781669 - RNA, 15 nt, Homo sapiens
cccucccugcugcca

SEQ ID NO: 1781670 - RNA, 14 nt, Homo sapiens
uuuaauuacaacag

SEQ ID NO: 1781671 - RNA, 18 nt, Homo sapiens
uggggccgcugggguccg

SEQ ID NO: 1781672 - RNA, 20 nt, Homo sapiens
cuuuucuuuuuuaauuucca

SEQ ID NO: 1781673 - RNA, 13 nt, Homo sapiens
aagaaaacuugua

SEQ ID NO: 1781674 - RNA, 14 nt, Homo sapiens
aaaauaagcuuuau

SEQ ID NO: 1781675 - RNA, 13 nt, Homo sapiens
cagauuuuaguuu

SEQ ID NO: 1781676 - RNA, 19 nt, Homo sapiens
ccagugauccauguccuga

SEQ ID NO: 1781677 - RNA, 21 nt, Homo sapiens
ucuagaguaauuaucugugau

SEQ ID NO: 1781678 - RNA, 23 nt, Homo sapiens
uggagagucagaucuuucuccuu

SEQ ID NO: 1781679 - RNA, 15 nt, Homo sapiens
aaggagaaauagcug

SEQ ID NO: 1781680 - RNA, 21 nt, Homo sapiens
uuaauuccuucagcacuuuag

SEQ ID NO: 1781681 - RNA, 18 nt, Homo sapiens
acacucauauugcccuaa

SEQ ID NO: 1781682 - RNA, 18 nt, Homo sapiens
aagauucccauuggcucc

SEQ ID NO: 1781683 - RNA, 19 nt, Homo sapiens
caauuucuuuuauguuaac

SEQ ID NO: 1781684 - RNA, 15 nt, Homo sapiens
ucacauagcacagaa

SEQ ID NO: 1781685 - RNA, 13 nt, Homo sapiens
acuuugcugcuaa

SEQ ID NO: 1781686 - RNA, 22 nt, Homo sapiens
uaccuccacccugcauuuuccu

SEQ ID NO: 1781687 - RNA, 19 nt, Homo sapiens
uuuuuuaaaaaauagcagc

SEQ ID NO: 1781688 - RNA, 18 nt, Homo sapiens
cucaacagccaaguguga

SEQ ID NO: 1781689 - RNA, 15 nt, Homo sapiens
ccacaguuuaccuca

SEQ ID NO: 1781690 - RNA, 16 nt, Homo sapiens
uggggaugaagcucac

SEQ ID NO: 1781691 - RNA, 22 nt, Homo sapiens
aucuuguuuugaaaauaaccua

SEQ ID NO: 1781692 - RNA, 20 nt, Homo sapiens
acaagcauuccuuagcagcu

SEQ ID NO: 1781693 - RNA, 22 nt, Homo sapiens
ucucaguuauucagauugacaa

SEQ ID NO: 1781694 - RNA, 23 nt, Homo sapiens
ggacucgcgcuacaagaggccac

SEQ ID NO: 1781695 - RNA, 20 nt, Homo sapiens
ugacucuccagaaagcucau

SEQ ID NO: 1781696 - RNA, 13 nt, Homo sapiens
cuguauaaacaca

SEQ ID NO: 1781697 - RNA, 22 nt, Homo sapiens
gcaaucacaaaggcugacauuc

SEQ ID NO: 1781698 - RNA, 22 nt, Homo sapiens
uguaagcccugcuuagcucauc

SEQ ID NO: 1781699 - RNA, 17 nt, Homo sapiens
guaaggugcaucuguuu

SEQ ID NO: 1781700 - RNA, 14 nt, Homo sapiens
aauacaagaaccaa

SEQ ID NO: 1781701 - RNA, 21 nt, Homo sapiens
gucaaugaauuuugcuuggug

SEQ ID NO: 1781702 - RNA, 21 nt, Homo sapiens
uaacacagccguguguucaaa

SEQ ID NO: 1781703 - RNA, 16 nt, Homo sapiens
aauuucuugcaauuug

SEQ ID NO: 1781704 - RNA, 12 nt, Homo sapiens
aauaauccagua

SEQ ID NO: 1781705 - RNA, 13 nt, Homo sapiens
cuuaauaaacuca

SEQ ID NO: 1781706 - RNA, 12 nt, Homo sapiens
uucagguggaac

SEQ ID NO: 1781707 - RNA, 13 nt, Homo sapiens
aguauguuuucaa

SEQ ID NO: 1781708 - RNA, 20 nt, Homo sapiens
caagagcaaaacucagucuc

SEQ ID NO: 1781709 - RNA, 16 nt, Homo sapiens
cgugaaagcagaugag

SEQ ID NO: 1781710 - RNA, 16 nt, Homo sapiens
aguguggaaagaaaga

SEQ ID NO: 1781711 - RNA, 18 nt, Homo sapiens
aggcagucuucuaccaaa

SEQ ID NO: 1781712 - RNA, 23 nt, Homo sapiens
cuucuuggcguauuuauacucac

SEQ ID NO: 1781713 - RNA, 19 nt, Homo sapiens
uucugacuuugaauuuaua

SEQ ID NO: 1781714 - RNA, 23 nt, Homo sapiens
agauugcaccacugcacuccagc

SEQ ID NO: 1781715 - RNA, 15 nt, Homo sapiens
aacuugcuacuuauc

SEQ ID NO: 1781716 - RNA, 13 nt, Homo sapiens
ugccacacuauuu

SEQ ID NO: 1781717 - RNA, 13 nt, Homo sapiens
uauuacacugccu

SEQ ID NO: 1781718 - RNA, 18 nt, Homo sapiens
cggccaggcucccugacc

SEQ ID NO: 1781719 - RNA, 20 nt, Homo sapiens
gaauuuauuauuuaccguug

SEQ ID NO: 1781720 - RNA, 14 nt, Homo sapiens
uaaugaguucacua

SEQ ID NO: 1781721 - RNA, 19 nt, Homo sapiens
acuaauuuuccauaagcua

SEQ ID NO: 1781722 - RNA, 23 nt, Homo sapiens
ugucuccccgaaagggacacaau

SEQ ID NO: 1781723 - RNA, 11 nt, Homo sapiens
aaccucagggc

SEQ ID NO: 1781724 - RNA, 11 nt, Homo sapiens
aaacucaggga

SEQ ID NO: 1781725 - RNA, 14 nt, Homo sapiens
auuucucacccucu

SEQ ID NO: 1781726 - RNA, 19 nt, Homo sapiens
agaaaccuaaauguucaag

SEQ ID NO: 1781727 - RNA, 20 nt, Homo sapiens
aaugacaucucaggggccag

SEQ ID NO: 1781728 - RNA, 20 nt, Homo sapiens
gaagugacuugaauguacaa

SEQ ID NO: 1781729 - RNA, 23 nt, Homo sapiens
gaauguauuuuucaaaacauaca

SEQ ID NO: 1781730 - RNA, 23 nt, Homo sapiens
ucaccaugcugaauguacacuga

SEQ ID NO: 1781731 - RNA, 16 nt, Homo sapiens
caguuacuccaguaua

SEQ ID NO: 1781732 - RNA, 14 nt, Homo sapiens
aaaaaauccacuca

SEQ ID NO: 1781733 - RNA, 18 nt, Homo sapiens
uaccccacauaugcaaug

SEQ ID NO: 1781734 - RNA, 16 nt, Homo sapiens
agaugaccguguacaa

SEQ ID NO: 1781735 - RNA, 18 nt, Homo sapiens
acuagaaugcuuuuguua

SEQ ID NO: 1781736 - RNA, 13 nt, Homo sapiens
aggaaaaccauuc

SEQ ID NO: 1781737 - RNA, 13 nt, Homo sapiens
cuagaugagccca

SEQ ID NO: 1781738 - RNA, 18 nt, Homo sapiens
auugcggggcccaccuua

SEQ ID NO: 1781739 - RNA, 19 nt, Homo sapiens
ucccaaagugcugagauua

SEQ ID NO: 1781740 - RNA, 20 nt, Homo sapiens
agaugcuuugacacugaaua

SEQ ID NO: 1781741 - RNA, 14 nt, Homo sapiens
uaccauacaauaua

SEQ ID NO: 1781742 - RNA, 15 nt, Homo sapiens
gcucagaaaggaaau

SEQ ID NO: 1781743 - RNA, 19 nt, Homo sapiens
uaauaaaccacgccaugag

SEQ ID NO: 1781744 - RNA, 23 nt, Homo sapiens
augggagaguacacccuuuccag

SEQ ID NO: 1781745 - RNA, 17 nt, Homo sapiens
caacacucaagucuauu

SEQ ID NO: 1781746 - RNA, 22 nt, Homo sapiens
auuuagguugcacauucacuga

SEQ ID NO: 1781747 - RNA, 19 nt, Homo sapiens
ucauguauaaaacuaggaa

SEQ ID NO: 1781748 - RNA, 20 nt, Homo sapiens
uuucaaauuuuuacugagaa

SEQ ID NO: 1781749 - RNA, 17 nt, Homo sapiens
aggugggcagcagcuca

SEQ ID NO: 1781750 - RNA, 15 nt, Homo sapiens
ucccggggugcauuu

SEQ ID NO: 1781751 - RNA, 11 nt, Homo sapiens
aaaccuaccaa

SEQ ID NO: 1781752 - RNA, 17 nt, Homo sapiens
gauuauaugaaugccua

SEQ ID NO: 1781753 - RNA, 15 nt, Homo sapiens
gucuuaauguacaca

SEQ ID NO: 1781754 - RNA, 22 nt, Homo sapiens
ggaaaggagggggcucaggcca

SEQ ID NO: 1781755 - RNA, 18 nt, Homo sapiens
cuaaagccuuaacuaaga

SEQ ID NO: 1781756 - RNA, 14 nt, Homo sapiens
acuucaccaaggaa

SEQ ID NO: 1781757 - RNA, 15 nt, Homo sapiens
ucuguuaaucaugua

SEQ ID NO: 1781758 - RNA, 15 nt, Homo sapiens
gcauggaagcuguga

SEQ ID NO: 1781759 - RNA, 22 nt, Homo sapiens
caggagaggggcagaacagccg

SEQ ID NO: 1781760 - RNA, 13 nt, Homo sapiens
acaaagugccaaa

SEQ ID NO: 1781761 - RNA, 12 nt, Homo sapiens
aaauacagauuu

SEQ ID NO: 1781762 - RNA, 12 nt, Homo sapiens
uuagacaguaug

SEQ ID NO: 1781763 - RNA, 22 nt, Homo sapiens
auauuuguaugauccuaaugaa

SEQ ID NO: 1781764 - RNA, 22 nt, Homo sapiens
guaaaugaaacuuaagaauuga

SEQ ID NO: 1781765 - RNA, 16 nt, Homo sapiens
uauuauaacagugugg

SEQ ID NO: 1781766 - RNA, 22 nt, Homo sapiens
ucaaucugagaagacaauaugu

SEQ ID NO: 1781767 - RNA, 13 nt, Homo sapiens
ugguguuuacaca

SEQ ID NO: 1781768 - RNA, 21 nt, Homo sapiens
caaagccgcggggacaccggg

SEQ ID NO: 1781769 - RNA, 18 nt, Homo sapiens
cucugcuuugucaugcca

SEQ ID NO: 1781770 - RNA, 18 nt, Homo sapiens
uaaaaacuuuuaagccau

SEQ ID NO: 1781771 - RNA, 22 nt, Homo sapiens
augggaggagaggacaagggaa

SEQ ID NO: 1781772 - RNA, 21 nt, Homo sapiens
cucaauguuuagcagauuuaa

SEQ ID NO: 1781773 - RNA, 21 nt, Homo sapiens
gucaaaaaugauuuaguacuu

SEQ ID NO: 1781774 - RNA, 20 nt, Homo sapiens
cuaccaacgaaagacgugau

SEQ ID NO: 1781775 - RNA, 21 nt, Homo sapiens
guucuuuugacuuaaucucau

SEQ ID NO: 1781776 - RNA, 20 nt, Homo sapiens
gccuaauauucaugcugccu

SEQ ID NO: 1781777 - RNA, 13 nt, Homo sapiens
ggaauauuuccau

SEQ ID NO: 1781778 - RNA, 14 nt, Homo sapiens
ugcuggagcuggcu

SEQ ID NO: 1781779 - RNA, 16 nt, Homo sapiens
aaaauacagcuaugaa

SEQ ID NO: 1781780 - RNA, 14 nt, Homo sapiens
auucauccauauug

SEQ ID NO: 1781781 - RNA, 21 nt, Homo sapiens
caggaauaggcauuugccuaa

SEQ ID NO: 1781782 - RNA, 19 nt, Homo sapiens
gcccuugucgagggaaaga

SEQ ID NO: 1781783 - RNA, 14 nt, Homo sapiens
gcaaguaaggcuuu

SEQ ID NO: 1781784 - RNA, 15 nt, Homo sapiens
ccacaauguuuauaa

SEQ ID NO: 1781785 - RNA, 17 nt, Homo sapiens
ugcagucacucuaguca

SEQ ID NO: 1781786 - RNA, 19 nt, Homo sapiens
agaaaucucccaugugcau

SEQ ID NO: 1781787 - RNA, 16 nt, Homo sapiens
acacaacagccaacag

SEQ ID NO: 1781788 - RNA, 17 nt, Homo sapiens
cuccuccagaccauuca

SEQ ID NO: 1781789 - RNA, 19 nt, Homo sapiens
auauuuauuuaacuauuca

SEQ ID NO: 1781790 - RNA, 16 nt, Homo sapiens
gcaacuaaggacaaau

SEQ ID NO: 1781791 - RNA, 16 nt, Homo sapiens
uggcugucucucagag

SEQ ID NO: 1781792 - RNA, 14 nt, Homo sapiens
gacaacuguuuaau

SEQ ID NO: 1781793 - RNA, 22 nt, Homo sapiens
agcugccaccucuccauccugc

SEQ ID NO: 1781794 - RNA, 16 nt, Homo sapiens
acauuuuaaaaaccag

SEQ ID NO: 1781795 - RNA, 19 nt, Homo sapiens
ggcagacugugaacuugac

SEQ ID NO: 1781796 - RNA, 18 nt, Homo sapiens
cacuguaauauguacaca

SEQ ID NO: 1781797 - RNA, 21 nt, Homo sapiens
ugaaaacauauaaagcacuau

SEQ ID NO: 1781798 - RNA, 15 nt, Homo sapiens
cagcugagcagcuuu

SEQ ID NO: 1781799 - RNA, 19 nt, Homo sapiens
ggauguugcuuuugcaccu

SEQ ID NO: 1781800 - RNA, 18 nt, Homo sapiens
gagcauucagaaugucaa

SEQ ID NO: 1781801 - RNA, 14 nt, Homo sapiens
gaauucaccugugg

SEQ ID NO: 1781802 - RNA, 17 nt, Homo sapiens
ggaagaggcuacagggc

SEQ ID NO: 1781803 - RNA, 13 nt, Homo sapiens
gaaaccacaaccu

SEQ ID NO: 1781804 - RNA, 13 nt, Homo sapiens
gaucgcugugaaa

SEQ ID NO: 1781805 - RNA, 22 nt, Homo sapiens
ugagugguucaagcacacugga

SEQ ID NO: 1781806 - RNA, 13 nt, Homo sapiens
ccucucuuucaca

SEQ ID NO: 1781807 - RNA, 18 nt, Homo sapiens
aacagcugguacugaugu

SEQ ID NO: 1781808 - RNA, 12 nt, Homo sapiens
cauuuucacuuu

SEQ ID NO: 1781809 - RNA, 16 nt, Homo sapiens
uugguacacauguguu

SEQ ID NO: 1781810 - RNA, 14 nt, Homo sapiens
cucggucugagaag

SEQ ID NO: 1781811 - RNA, 17 nt, Homo sapiens
auuaauuauaccagugu

SEQ ID NO: 1781812 - RNA, 22 nt, Homo sapiens
aagagcuagucuaucagcaucu

SEQ ID NO: 1781813 - RNA, 21 nt, Homo sapiens
cuaaguuauuuuaugacauga

SEQ ID NO: 1781814 - RNA, 23 nt, Homo sapiens
guggaauauaaggaaagcaauaa

SEQ ID NO: 1781815 - RNA, 14 nt, Homo sapiens
uuauucugauucca

SEQ ID NO: 1781816 - RNA, 18 nt, Homo sapiens
aauuggcaguuccuggca

SEQ ID NO: 1781817 - RNA, 18 nt, Homo sapiens
gcuugggcuccauuccca

SEQ ID NO: 1781818 - RNA, 18 nt, Homo sapiens
acagcuuauggcaucuca

SEQ ID NO: 1781819 - RNA, 20 nt, Homo sapiens
cugucugggauuaagggcaa

SEQ ID NO: 1781820 - RNA, 21 nt, Homo sapiens
gugccauuuuaagaguuacuu

SEQ ID NO: 1781821 - RNA, 14 nt, Homo sapiens
agggaccauggcuu

SEQ ID NO: 1781822 - RNA, 20 nt, Homo sapiens
aaggaaaagacugaaucuac

SEQ ID NO: 1781823 - RNA, 23 nt, Homo sapiens
uuccguguguguacugauucaag

SEQ ID NO: 1781824 - RNA, 14 nt, Homo sapiens
gguggcucuugccu

SEQ ID NO: 1781825 - RNA, 13 nt, Homo sapiens
uuuauccaugcca

SEQ ID NO: 1781826 - RNA, 20 nt, Homo sapiens
ccuuuggaaacaacauuuaa

SEQ ID NO: 1781827 - RNA, 17 nt, Homo sapiens
uacaauggcgugaucuc

SEQ ID NO: 1781828 - RNA, 22 nt, Homo sapiens
ucuaacucacaggcauagagug

SEQ ID NO: 1781829 - RNA, 17 nt, Homo sapiens
aggucaguuuagcaaga

SEQ ID NO: 1781830 - RNA, 22 nt, Homo sapiens
uggugggauuugcuccuggguu

SEQ ID NO: 1781831 - RNA, 15 nt, Homo sapiens
aacaucuagcccuuu

SEQ ID NO: 1781832 - RNA, 16 nt, Homo sapiens
uuucuccaggaccaau

SEQ ID NO: 1781833 - RNA, 22 nt, Homo sapiens
cucucuagcuuaaguguaaaug

SEQ ID NO: 1781834 - RNA, 22 nt, Homo sapiens
accccuccugccccucucucuc

SEQ ID NO: 1781835 - RNA, 15 nt, Homo sapiens
auggaugcaugcccu

SEQ ID NO: 1781836 - RNA, 20 nt, Homo sapiens
gagguggagcuugcagugag

SEQ ID NO: 1781837 - RNA, 16 nt, Homo sapiens
cugaagagauacccac

SEQ ID NO: 1781838 - RNA, 15 nt, Homo sapiens
acacccuuucaucuc

SEQ ID NO: 1781839 - RNA, 14 nt, Homo sapiens
aaguccacagacau

SEQ ID NO: 1781840 - RNA, 13 nt, Homo sapiens
gaaacacauucuu

SEQ ID NO: 1781841 - RNA, 21 nt, Homo sapiens
cucacaggcgccuaaagucau

SEQ ID NO: 1781842 - RNA, 22 nt, Homo sapiens
uuauuaaaagaugucucugcaa

SEQ ID NO: 1781843 - RNA, 21 nt, Homo sapiens
auuacauauuuuuuguauauu

SEQ ID NO: 1781844 - RNA, 18 nt, Homo sapiens
gcuuucaguauuguaaag

SEQ ID NO: 1781845 - RNA, 16 nt, Homo sapiens
cuguaguggcaaaaaa

SEQ ID NO: 1781846 - RNA, 24 nt, Homo sapiens
aaccuuaaguaaucaucuaaguca

SEQ ID NO: 1781847 - RNA, 19 nt, Homo sapiens
ccugcccugacaugcacac

SEQ ID NO: 1781848 - RNA, 16 nt, Homo sapiens
ucuuaggugcgcagug

SEQ ID NO: 1781849 - RNA, 18 nt, Homo sapiens
augugaaacucaucucau

SEQ ID NO: 1781850 - RNA, 14 nt, Homo sapiens
cuucagcacaaaga

SEQ ID NO: 1781851 - RNA, 21 nt, Homo sapiens
uuuuuucccccuaucaguuga

SEQ ID NO: 1781852 - RNA, 22 nt, Homo sapiens
aucacaugugcccucugccagg

SEQ ID NO: 1781853 - RNA, 13 nt, Homo sapiens
cuucaugaaaugc

SEQ ID NO: 1781854 - RNA, 22 nt, Homo sapiens
acacucaaggaaaagaugugcu

SEQ ID NO: 1781855 - RNA, 22 nt, Homo sapiens
agcccugcucuuucucugagaa

SEQ ID NO: 1781856 - RNA, 15 nt, Homo sapiens
cuaccagcacauuaa

SEQ ID NO: 1781857 - RNA, 24 nt, Homo sapiens
cugcacauaugcaagccauuugca

SEQ ID NO: 1781858 - RNA, 11 nt, Homo sapiens
cuaaagggcag

SEQ ID NO: 1781859 - RNA, 19 nt, Homo sapiens
aaugucuuaaucaugagau

SEQ ID NO: 1781860 - RNA, 22 nt, Homo sapiens
uucuuuccuucugaucugagaa

SEQ ID NO: 1781861 - RNA, 16 nt, Homo sapiens
aauaaaauucuuucag

SEQ ID NO: 1781862 - RNA, 23 nt, Homo sapiens
uucaauauccccaagcaguguga

SEQ ID NO: 1781863 - RNA, 22 nt, Homo sapiens
uggacagccaagggcagaucac

SEQ ID NO: 1781864 - RNA, 23 nt, Homo sapiens
agcagggaguacccagugccuac

SEQ ID NO: 1781865 - RNA, 21 nt, Homo sapiens
aggugaggcguucuccugcuu

SEQ ID NO: 1781866 - RNA, 20 nt, Homo sapiens
gaugacaggcgugcaccugg

SEQ ID NO: 1781867 - RNA, 14 nt, Homo sapiens
cugcccaaagccau

SEQ ID NO: 1781868 - RNA, 20 nt, Homo sapiens
ucuguaaauggaacaaacaa

SEQ ID NO: 1781869 - RNA, 14 nt, Homo sapiens
accagaauucccuu

SEQ ID NO: 1781870 - RNA, 21 nt, Homo sapiens
cuucauucuuuacugcacuca

SEQ ID NO: 1781871 - RNA, 14 nt, Homo sapiens
uucuuauaauauua

SEQ ID NO: 1781872 - RNA, 23 nt, Homo sapiens
cuuuuguaaauauucuuguccac

SEQ ID NO: 1781873 - RNA, 18 nt, Homo sapiens
acagcaaauaacagucug

SEQ ID NO: 1781874 - RNA, 20 nt, Homo sapiens
cuggauuugggagcucugcu

SEQ ID NO: 1781875 - RNA, 12 nt, Homo sapiens
cuucaccaaaga

SEQ ID NO: 1781876 - RNA, 22 nt, Homo sapiens
ccuccugucuuagccucccaaa

SEQ ID NO: 1781877 - RNA, 22 nt, Homo sapiens
gcucauuuuuucuucuccuaaa

SEQ ID NO: 1781878 - RNA, 19 nt, Homo sapiens
uuacuuuuuggaaaagaau

SEQ ID NO: 1781879 - RNA, 21 nt, Homo sapiens
ccuugauaaccauauaaauuc

SEQ ID NO: 1781880 - RNA, 17 nt, Homo sapiens
gaauauguaaauagaaa

SEQ ID NO: 1781881 - RNA, 15 nt, Homo sapiens
uuccuuucuugucuu

SEQ ID NO: 1781882 - RNA, 19 nt, Homo sapiens
aagcaucugagcuaacuua

SEQ ID NO: 1781883 - RNA, 12 nt, Homo sapiens
uugccaggugac

SEQ ID NO: 1781884 - RNA, 23 nt, Homo sapiens
aagggaauacugugcauaagcca

SEQ ID NO: 1781885 - RNA, 18 nt, Homo sapiens
agugaaaaaaacaaccua

SEQ ID NO: 1781886 - RNA, 17 nt, Homo sapiens
ugugaccccacugccaa

SEQ ID NO: 1781887 - RNA, 19 nt, Homo sapiens
agauuagggcggggagaag

SEQ ID NO: 1781888 - RNA, 12 nt, Homo sapiens
uuaaaucaauaa

SEQ ID NO: 1781889 - RNA, 14 nt, Homo sapiens
cuaccugaauggag

SEQ ID NO: 1781890 - RNA, 18 nt, Homo sapiens
agcaauuaguaagccaug

SEQ ID NO: 1781891 - RNA, 23 nt, Homo sapiens
caucuccuucccccagcccaaua

SEQ ID NO: 1781892 - RNA, 17 nt, Homo sapiens
ugcuguccuuggguaga

SEQ ID NO: 1781893 - RNA, 19 nt, Homo sapiens
accuuuaaugcaaugcaua

SEQ ID NO: 1781894 - RNA, 13 nt, Homo sapiens
uaaaacuuaacuu

SEQ ID NO: 1781895 - RNA, 21 nt, Homo sapiens
gagaaucugagacaucuugcc

SEQ ID NO: 1781896 - RNA, 16 nt, Homo sapiens
cagaguaugaucucag

SEQ ID NO: 1781897 - RNA, 15 nt, Homo sapiens
uuaacucuccaguua

SEQ ID NO: 1781898 - RNA, 18 nt, Homo sapiens
gguggcgguggaccaaag

SEQ ID NO: 1781899 - RNA, 20 nt, Homo sapiens
gaaaacuuuuguaaauuauu

SEQ ID NO: 1781900 - RNA, 19 nt, Homo sapiens
acgacuguggugugcagug

SEQ ID NO: 1781901 - RNA, 17 nt, Homo sapiens
agagagacccugucuca

SEQ ID NO: 1781902 - RNA, 14 nt, Homo sapiens
cuucucauuacuug

SEQ ID NO: 1781903 - RNA, 15 nt, Homo sapiens
cauuuucauucuguu

SEQ ID NO: 1781904 - RNA, 15 nt, Homo sapiens
augacaucucagggg

SEQ ID NO: 1781905 - RNA, 14 nt, Homo sapiens
caaguauccaguca

SEQ ID NO: 1781906 - RNA, 18 nt, Homo sapiens
aagccaggacuauucccu

SEQ ID NO: 1781907 - RNA, 21 nt, Homo sapiens
aaagaugcagaguaaguauua

SEQ ID NO: 1781908 - RNA, 16 nt, Homo sapiens
ugacaccuggugcuuu

SEQ ID NO: 1781909 - RNA, 13 nt, Homo sapiens
auuguaucucaua

SEQ ID NO: 1781910 - RNA, 13 nt, Homo sapiens
auuuauucugcuc

SEQ ID NO: 1781911 - RNA, 22 nt, Homo sapiens
gcaacugggaccugagucaaug

SEQ ID NO: 1781912 - RNA, 16 nt, Homo sapiens
acaccuuagucuuucc

SEQ ID NO: 1781913 - RNA, 15 nt, Homo sapiens
ugacuuuuaucugua

SEQ ID NO: 1781914 - RNA, 20 nt, Homo sapiens
guaauguuuuauacuguuua

SEQ ID NO: 1781915 - RNA, 18 nt, Homo sapiens
uccgaguagcugggauua

SEQ ID NO: 1781916 - RNA, 18 nt, Homo sapiens
cuguacauugugagcucu

SEQ ID NO: 1781917 - RNA, 21 nt, Homo sapiens
uacugggguuuuucuaagaaa

SEQ ID NO: 1781918 - RNA, 16 nt, Homo sapiens
ucccagucugugaagu

SEQ ID NO: 1781919 - RNA, 11 nt, Homo sapiens
gagaucucuau

SEQ ID NO: 1781920 - RNA, 16 nt, Homo sapiens
uacccccaugaccaac

SEQ ID NO: 1781921 - RNA, 14 nt, Homo sapiens
uacaagcgugagcc

SEQ ID NO: 1781922 - RNA, 23 nt, Homo sapiens
augugcuuuuaaaaaaaaauacu

SEQ ID NO: 1781923 - RNA, 20 nt, Homo sapiens
cucuaauagaaguccaugag

SEQ ID NO: 1781924 - RNA, 22 nt, Homo sapiens
agucugaaauggggcuacuguu

SEQ ID NO: 1781925 - RNA, 22 nt, Homo sapiens
gauaacaacccaaggcaaugau

SEQ ID NO: 1781926 - RNA, 21 nt, Homo sapiens
gucaguuacugaugcuccuga

SEQ ID NO: 1781927 - RNA, 23 nt, Homo sapiens
cacauucuuaacacauguccuug

SEQ ID NO: 1781928 - RNA, 20 nt, Homo sapiens
uccguagcucugcugcugau

SEQ ID NO: 1781929 - RNA, 16 nt, Homo sapiens
caccagaagugccaug

SEQ ID NO: 1781930 - RNA, 20 nt, Homo sapiens
cuguaguaauuguuacaauu

SEQ ID NO: 1781931 - RNA, 20 nt, Homo sapiens
auguccucgguuucccauuu

SEQ ID NO: 1781932 - RNA, 17 nt, Homo sapiens
cugagaaggaacaggga

SEQ ID NO: 1781933 - RNA, 21 nt, Homo sapiens
cuaccacaugccaagcacugu

SEQ ID NO: 1781934 - RNA, 15 nt, Homo sapiens
cuuuccugcaacuca

SEQ ID NO: 1781935 - RNA, 17 nt, Homo sapiens
cagaacuaagcucagua

SEQ ID NO: 1781936 - RNA, 15 nt, Homo sapiens
gaaaauggaugacaa

SEQ ID NO: 1781937 - RNA, 16 nt, Homo sapiens
cugggagaaaagccag

SEQ ID NO: 1781938 - RNA, 14 nt, Homo sapiens
uaccuuugucucac

SEQ ID NO: 1781939 - RNA, 20 nt, Homo sapiens
gaaaauuguauaaauuacuu

SEQ ID NO: 1781940 - RNA, 18 nt, Homo sapiens
cagaguuugccuuccuuu

SEQ ID NO: 1781941 - RNA, 19 nt, Homo sapiens
cagugucuuguaacaacua

SEQ ID NO: 1781942 - RNA, 18 nt, Homo sapiens
auacaaaggcuugcuaag

SEQ ID NO: 1781943 - RNA, 21 nt, Homo sapiens
caaagaaccccucugucuuca

SEQ ID NO: 1781944 - RNA, 12 nt, Homo sapiens
cuuuaaaugccu

SEQ ID NO: 1781945 - RNA, 22 nt, Homo sapiens
aagaccucgagcagaugaugcc

SEQ ID NO: 1781946 - RNA, 17 nt, Homo sapiens
agcccgucaucuucccu

SEQ ID NO: 1781947 - RNA, 17 nt, Homo sapiens
aauggaaaaaaugaugu

SEQ ID NO: 1781948 - RNA, 14 nt, Homo sapiens
augcaagucuguga

SEQ ID NO: 1781949 - RNA, 22 nt, Homo sapiens
aaugccuuacuuuguaugauau

SEQ ID NO: 1781950 - RNA, 16 nt, Homo sapiens
cuggacauucgaggaa

SEQ ID NO: 1781951 - RNA, 14 nt, Homo sapiens
ugaaauaaaagccu

SEQ ID NO: 1781952 - RNA, 14 nt, Homo sapiens
uauucaaaaaauca

SEQ ID NO: 1781953 - RNA, 15 nt, Homo sapiens
cugagguccugagca

SEQ ID NO: 1781954 - RNA, 23 nt, Homo sapiens
ggagcccacagcgagccugugcc

SEQ ID NO: 1781955 - RNA, 21 nt, Homo sapiens
acugggagagcugguggugca

SEQ ID NO: 1781956 - RNA, 17 nt, Homo sapiens
aagccauaaaccaauaa

SEQ ID NO: 1781957 - RNA, 16 nt, Homo sapiens
uggugaaaauguacug

SEQ ID NO: 1781958 - RNA, 19 nt, Homo sapiens
auguauaucuuugcacuga

SEQ ID NO: 1781959 - RNA, 18 nt, Homo sapiens
gccacagcccccuugccc

SEQ ID NO: 1781960 - RNA, 14 nt, Homo sapiens
agagugacucacua

SEQ ID NO: 1781961 - RNA, 18 nt, Homo sapiens
agcagcccagcauuuccc

SEQ ID NO: 1781962 - RNA, 12 nt, Homo sapiens
aguauagcuuua

SEQ ID NO: 1781963 - RNA, 11 nt, Homo sapiens
ccccacaccca

SEQ ID NO: 1781964 - RNA, 12 nt, Homo sapiens
caaaagcacuua

SEQ ID NO: 1781965 - RNA, 12 nt, Homo sapiens
guucagcagaac

SEQ ID NO: 1781966 - RNA, 12 nt, Homo sapiens
gaauagcaguuu

SEQ ID NO: 1781967 - RNA, 15 nt, Homo sapiens
caguaaagcaaugca

SEQ ID NO: 1781968 - RNA, 23 nt, Homo sapiens
caaucaaauaauaaaucuauucu

SEQ ID NO: 1781969 - RNA, 18 nt, Homo sapiens
acuggcaaccugcuuuca

SEQ ID NO: 1781970 - RNA, 12 nt, Homo sapiens
aauaaagugugu

SEQ ID NO: 1781971 - RNA, 20 nt, Homo sapiens
uacccaaaugucccugcaag

SEQ ID NO: 1781972 - RNA, 18 nt, Homo sapiens
cagaaauaaagaucucag

SEQ ID NO: 1781973 - RNA, 12 nt, Homo sapiens
aaauaccauuga

SEQ ID NO: 1781974 - RNA, 18 nt, Homo sapiens
guauuaugacacucccag

SEQ ID NO: 1781975 - RNA, 21 nt, Homo sapiens
cucaaaagcugggcagguugg

SEQ ID NO: 1781976 - RNA, 15 nt, Homo sapiens
agggcagaaagguuc

SEQ ID NO: 1781977 - RNA, 21 nt, Homo sapiens
ucauuacccuucccugcacua

SEQ ID NO: 1781978 - RNA, 17 nt, Homo sapiens
acacauuaagccuucca

SEQ ID NO: 1781979 - RNA, 15 nt, Homo sapiens
uaaagaucauguaaa

SEQ ID NO: 1781980 - RNA, 12 nt, Homo sapiens
aauauugaucug

SEQ ID NO: 1781981 - RNA, 16 nt, Homo sapiens
gaaguaggggcaagcu

SEQ ID NO: 1781982 - RNA, 15 nt, Homo sapiens
uaucuuaacacugaa

SEQ ID NO: 1781983 - RNA, 21 nt, Homo sapiens
guagaaccacuuggcugcuca

SEQ ID NO: 1781984 - RNA, 12 nt, Homo sapiens
ggagcuuugcaa

SEQ ID NO: 1781985 - RNA, 22 nt, Homo sapiens
agcucuggcaggaagggacugc

SEQ ID NO: 1781986 - RNA, 21 nt, Homo sapiens
cacagugcuauuugcauuucu

SEQ ID NO: 1781987 - RNA, 23 nt, Homo sapiens
gugcaauagacacauacauguca

SEQ ID NO: 1781988 - RNA, 17 nt, Homo sapiens
aagcggauuuccaggga

SEQ ID NO: 1781989 - RNA, 21 nt, Homo sapiens
aacucuccaucuuauuuucau

SEQ ID NO: 1781990 - RNA, 15 nt, Homo sapiens
gaacacaaggucauu

SEQ ID NO: 1781991 - RNA, 20 nt, Homo sapiens
aauuuucauuaauacuguag

SEQ ID NO: 1781992 - RNA, 13 nt, Homo sapiens
aaaauagaaacau

SEQ ID NO: 1781993 - RNA, 23 nt, Homo sapiens
cuguucuguuuccugugucucca

SEQ ID NO: 1781994 - RNA, 23 nt, Homo sapiens
gucugcacacauaacacacauca

SEQ ID NO: 1781995 - RNA, 23 nt, Homo sapiens
cugcacuaauuugauguuuacag

SEQ ID NO: 1781996 - RNA, 18 nt, Homo sapiens
caacaaaaagaacaaauc

SEQ ID NO: 1781997 - RNA, 20 nt, Homo sapiens
acuugguuuguggugcacag

SEQ ID NO: 1781998 - RNA, 18 nt, Homo sapiens
uccuuagcccaucuuuca

SEQ ID NO: 1781999 - RNA, 12 nt, Homo sapiens
aaacaggugcua

SEQ ID NO: 1782000 - RNA, 13 nt, Homo sapiens
gggcuacugccac

SEQ ID NO: 1782001 - RNA, 13 nt, Homo sapiens
caacaaaccaagc

SEQ ID NO: 1782002 - RNA, 14 nt, Homo sapiens
cuguucuuucuggc

SEQ ID NO: 1782003 - RNA, 12 nt, Homo sapiens
agcucccaugua

SEQ ID NO: 1782004 - RNA, 13 nt, Homo sapiens
agcuauacaggaa

SEQ ID NO: 1782005 - RNA, 13 nt, Homo sapiens
cugucuaccucac

SEQ ID NO: 1782006 - RNA, 21 nt, Homo sapiens
aaugcuguugguaaagcacau

SEQ ID NO: 1782007 - RNA, 14 nt, Homo sapiens
uuaaguauugucac

SEQ ID NO: 1782008 - RNA, 19 nt, Homo sapiens
gccaccuggcaaaggaccc

SEQ ID NO: 1782009 - RNA, 12 nt, Homo sapiens
caggaguucaag

SEQ ID NO: 1782010 - RNA, 15 nt, Homo sapiens
ccucugggagccuga

SEQ ID NO: 1782011 - RNA, 15 nt, Homo sapiens
uagaaugaaagacug

SEQ ID NO: 1782012 - RNA, 15 nt, Homo sapiens
ugauaaaaagaucaa

SEQ ID NO: 1782013 - RNA, 22 nt, Homo sapiens
gcagucauuaugagaggcaaug

SEQ ID NO: 1782014 - RNA, 16 nt, Homo sapiens
auauacaaaacuuuau

SEQ ID NO: 1782015 - RNA, 16 nt, Homo sapiens
uaaaucuuuucaauua

SEQ ID NO: 1782016 - RNA, 16 nt, Homo sapiens
ugucauaaaugucaca

SEQ ID NO: 1782017 - RNA, 12 nt, Homo sapiens
augcaagucaug

SEQ ID NO: 1782018 - RNA, 15 nt, Homo sapiens
ugagggccagugaug

SEQ ID NO: 1782019 - RNA, 19 nt, Homo sapiens
acaaauggaaggaguuccu

SEQ ID NO: 1782020 - RNA, 19 nt, Homo sapiens
cguuucuaugacacaugca

SEQ ID NO: 1782021 - RNA, 19 nt, Homo sapiens
auaguuuaaguugauuaaa

SEQ ID NO: 1782022 - RNA, 12 nt, Homo sapiens
aaaguaaugccu

SEQ ID NO: 1782023 - RNA, 20 nt, Homo sapiens
acccaccuuucugcacauaa

SEQ ID NO: 1782024 - RNA, 16 nt, Homo sapiens
cucacccccaccacca

SEQ ID NO: 1782025 - RNA, 18 nt, Homo sapiens
uuguguggcuccugguaa

SEQ ID NO: 1782026 - RNA, 23 nt, Homo sapiens
ucugacauauuucauaagcacau

SEQ ID NO: 1782027 - RNA, 12 nt, Homo sapiens
ugugugugcaug

SEQ ID NO: 1782028 - RNA, 14 nt, Homo sapiens
uugagaaucccaaa

SEQ ID NO: 1782029 - RNA, 20 nt, Homo sapiens
agcaguaaauacuugcaguu

SEQ ID NO: 1782030 - RNA, 22 nt, Homo sapiens
cagaagacccgcucuccaucuu

SEQ ID NO: 1782031 - RNA, 18 nt, Homo sapiens
cauauguguaaaagcuua

SEQ ID NO: 1782032 - RNA, 20 nt, Homo sapiens
uuugcugcucuauauuacaa

SEQ ID NO: 1782033 - RNA, 19 nt, Homo sapiens
auuuacauaaagacugugc

SEQ ID NO: 1782034 - RNA, 16 nt, Homo sapiens
uuucuuacacaagagc

SEQ ID NO: 1782035 - RNA, 13 nt, Homo sapiens
aacucuggcucca

SEQ ID NO: 1782036 - RNA, 17 nt, Homo sapiens
uaacacuaauaauagua

SEQ ID NO: 1782037 - RNA, 21 nt, Homo sapiens
uuauucucaauauauuuuugc

SEQ ID NO: 1782038 - RNA, 17 nt, Homo sapiens
auggagggcaacauucc

SEQ ID NO: 1782039 - RNA, 12 nt, Homo sapiens
cccaguucugcu

SEQ ID NO: 1782040 - RNA, 16 nt, Homo sapiens
cagcuuuucagugaau

SEQ ID NO: 1782041 - RNA, 18 nt, Homo sapiens
cagccaaucuagaggcaa

SEQ ID NO: 1782042 - RNA, 22 nt, Homo sapiens
uaaacggcucagacaggcagau

SEQ ID NO: 1782043 - RNA, 17 nt, Homo sapiens
uguauuucaaaaucacc

SEQ ID NO: 1782044 - RNA, 15 nt, Homo sapiens
ccucccaaccccagg

SEQ ID NO: 1782045 - RNA, 18 nt, Homo sapiens
uacauuuuauaucuggau

SEQ ID NO: 1782046 - RNA, 13 nt, Homo sapiens
cuaauccaugugc

SEQ ID NO: 1782047 - RNA, 17 nt, Homo sapiens
aaagaacccaucuggaa

SEQ ID NO: 1782048 - RNA, 14 nt, Homo sapiens
gaaugcuauuuuca

SEQ ID NO: 1782049 - RNA, 14 nt, Homo sapiens
cugggcaccaccuc

SEQ ID NO: 1782050 - RNA, 17 nt, Homo sapiens
uacagagaagccaucac

SEQ ID NO: 1782051 - RNA, 19 nt, Homo sapiens
uuguuuuggguuuucuucc

SEQ ID NO: 1782052 - RNA, 15 nt, Homo sapiens
auagcuuuuacucug

SEQ ID NO: 1782053 - RNA, 17 nt, Homo sapiens
uuauaagaggauagcua

SEQ ID NO: 1782054 - RNA, 23 nt, Homo sapiens
aguuuuguuuguucacacuccua

SEQ ID NO: 1782055 - RNA, 18 nt, Homo sapiens
gucacuuuccucuuccac

SEQ ID NO: 1782056 - RNA, 15 nt, Homo sapiens
cccaaagcacuugcu

SEQ ID NO: 1782057 - RNA, 13 nt, Homo sapiens
ccauucacaauaa

SEQ ID NO: 1782058 - RNA, 15 nt, Homo sapiens
agcugugcaggcaug

SEQ ID NO: 1782059 - RNA, 16 nt, Homo sapiens
ucuguuuggaucuaua

SEQ ID NO: 1782060 - RNA, 17 nt, Homo sapiens
uaaaucugcucaggaga

SEQ ID NO: 1782061 - RNA, 15 nt, Homo sapiens
agacagauaccucca

SEQ ID NO: 1782062 - RNA, 20 nt, Homo sapiens
guugccaggcuggagugcag

SEQ ID NO: 1782063 - RNA, 16 nt, Homo sapiens
ccaugugugugcaagu

SEQ ID NO: 1782064 - RNA, 14 nt, Homo sapiens
uaaugcuuucugug

SEQ ID NO: 1782065 - RNA, 17 nt, Homo sapiens
gaacacaggcagcuuuc

SEQ ID NO: 1782066 - RNA, 16 nt, Homo sapiens
accuguagucccagcu

SEQ ID NO: 1782067 - RNA, 17 nt, Homo sapiens
cuguccuuuaugauccc

SEQ ID NO: 1782068 - RNA, 13 nt, Homo sapiens
agcaaggcauaau

SEQ ID NO: 1782069 - RNA, 14 nt, Homo sapiens
agaauucacugucu

SEQ ID NO: 1782070 - RNA, 15 nt, Homo sapiens
cccucugaguuugaa

SEQ ID NO: 1782071 - RNA, 21 nt, Homo sapiens
uacuaaauuacaaaugcaauu

SEQ ID NO: 1782072 - RNA, 14 nt, Homo sapiens
ccucggagcugcca

SEQ ID NO: 1782073 - RNA, 18 nt, Homo sapiens
uacacauguaucuaugca

SEQ ID NO: 1782074 - RNA, 17 nt, Homo sapiens
ucucgauggacaaugaa

SEQ ID NO: 1782075 - RNA, 13 nt, Homo sapiens
ccaggggugggag

SEQ ID NO: 1782076 - RNA, 19 nt, Homo sapiens
ucccaauuugaauucaauu

SEQ ID NO: 1782077 - RNA, 14 nt, Homo sapiens
ucaauacagauaua

SEQ ID NO: 1782078 - RNA, 14 nt, Homo sapiens
ucacaacagaucaa

SEQ ID NO: 1782079 - RNA, 13 nt, Homo sapiens
ccucacuauucaa

SEQ ID NO: 1782080 - RNA, 21 nt, Homo sapiens
aucucagcaaucacaagccaa

SEQ ID NO: 1782081 - RNA, 17 nt, Homo sapiens
cugucccuauacacuag

SEQ ID NO: 1782082 - RNA, 12 nt, Homo sapiens
uuuuaaugugcu

SEQ ID NO: 1782083 - RNA, 13 nt, Homo sapiens
uuugccaguucaa

SEQ ID NO: 1782084 - RNA, 16 nt, Homo sapiens
uaaauccucucuauca

SEQ ID NO: 1782085 - RNA, 15 nt, Homo sapiens
caacagcgaagccag

SEQ ID NO: 1782086 - RNA, 15 nt, Homo sapiens
ccagugaccagucac

SEQ ID NO: 1782087 - RNA, 23 nt, Homo sapiens
accuauggcccagccacugcagc

SEQ ID NO: 1782088 - RNA, 22 nt, Homo sapiens
augcagccacugugcugaauuc

SEQ ID NO: 1782089 - RNA, 19 nt, Homo sapiens
cuuaauucccaaucccauu

SEQ ID NO: 1782090 - RNA, 20 nt, Homo sapiens
ucugugucugucaccacauc

SEQ ID NO: 1782091 - RNA, 22 nt, Homo sapiens
uauuuaauauaguaacacacuu

SEQ ID NO: 1782092 - RNA, 15 nt, Homo sapiens
ugggaagacuguugu

SEQ ID NO: 1782093 - RNA, 22 nt, Homo sapiens
ggucucugauagguagcauuuu

SEQ ID NO: 1782094 - RNA, 20 nt, Homo sapiens
auagacccacaagaggcagu

SEQ ID NO: 1782095 - RNA, 18 nt, Homo sapiens
cggagucuguaaaaccag

SEQ ID NO: 1782096 - RNA, 13 nt, Homo sapiens
aucacuuaccacu

SEQ ID NO: 1782097 - RNA, 12 nt, Homo sapiens
gaaguuccucaa

SEQ ID NO: 1782098 - RNA, 19 nt, Homo sapiens
ccaguggugaagaaaacuc

SEQ ID NO: 1782099 - RNA, 16 nt, Homo sapiens
uauuaaaacacagcuu

SEQ ID NO: 1782100 - RNA, 21 nt, Homo sapiens
caggaggagggcgcaugugug

SEQ ID NO: 1782101 - RNA, 22 nt, Homo sapiens
ccugaaguaagcaaagacuuuc

SEQ ID NO: 1782102 - RNA, 23 nt, Homo sapiens
auagagauuaauuuuaacuuaaa

SEQ ID NO: 1782103 - RNA, 21 nt, Homo sapiens
ccuagaaaggaacugcaauaa

SEQ ID NO: 1782104 - RNA, 20 nt, Homo sapiens
cuaaaccuccuucagaucuc

SEQ ID NO: 1782105 - RNA, 18 nt, Homo sapiens
aggaaucaaauuuugcca

SEQ ID NO: 1782106 - RNA, 23 nt, Homo sapiens
gccgcccugcugcugacccagcc

SEQ ID NO: 1782107 - RNA, 14 nt, Homo sapiens
cugguaaauugcca

SEQ ID NO: 1782108 - RNA, 15 nt, Homo sapiens
ucauacagauuugca

SEQ ID NO: 1782109 - RNA, 15 nt, Homo sapiens
aaucugcccauucau

SEQ ID NO: 1782110 - RNA, 18 nt, Homo sapiens
cgcugugucagcauagaa

SEQ ID NO: 1782111 - RNA, 12 nt, Homo sapiens
aguccaguguga

SEQ ID NO: 1782112 - RNA, 17 nt, Homo sapiens
ccaggagagagaucuag

SEQ ID NO: 1782113 - RNA, 14 nt, Homo sapiens
ggauagaagccaac

SEQ ID NO: 1782114 - RNA, 16 nt, Homo sapiens
aaaucacuuuaccugc

SEQ ID NO: 1782115 - RNA, 14 nt, Homo sapiens
agaggacaguauuu

SEQ ID NO: 1782116 - RNA, 13 nt, Homo sapiens
gaaauuacuuuaa

SEQ ID NO: 1782117 - RNA, 14 nt, Homo sapiens
augcacacauauau

SEQ ID NO: 1782118 - RNA, 14 nt, Homo sapiens
aggcucacagauuu

SEQ ID NO: 1782119 - RNA, 14 nt, Homo sapiens
auacacacauguau

SEQ ID NO: 1782120 - RNA, 15 nt, Homo sapiens
cgugcccuaccacac

SEQ ID NO: 1782121 - RNA, 15 nt, Homo sapiens
aaugauuucauucaa

SEQ ID NO: 1782122 - RNA, 13 nt, Homo sapiens
agccaagggcuga

SEQ ID NO: 1782123 - RNA, 23 nt, Homo sapiens
accauggggaagaaaucuggucu

SEQ ID NO: 1782124 - RNA, 17 nt, Homo sapiens
gaaaccggguggcagcg

SEQ ID NO: 1782125 - RNA, 21 nt, Homo sapiens
agaaucaccuaauuaauuuca

SEQ ID NO: 1782126 - RNA, 22 nt, Homo sapiens
ccacgguguggggggugcccca

SEQ ID NO: 1782127 - RNA, 23 nt, Homo sapiens
accaaauauaaagaggacuugaa

SEQ ID NO: 1782128 - RNA, 21 nt, Homo sapiens
cagugguagagucauguuugc

SEQ ID NO: 1782129 - RNA, 19 nt, Homo sapiens
aacguacuuucuguuauca

SEQ ID NO: 1782130 - RNA, 15 nt, Homo sapiens
ugccagcaacgcuca

SEQ ID NO: 1782131 - RNA, 19 nt, Homo sapiens
gggcaucucaauggcaugg

SEQ ID NO: 1782132 - RNA, 21 nt, Homo sapiens
acacggaugacuuaacugcau

SEQ ID NO: 1782133 - RNA, 19 nt, Homo sapiens
acuuaauugccagcaaaua

SEQ ID NO: 1782134 - RNA, 21 nt, Homo sapiens
ugugccugcucagcagccagu

SEQ ID NO: 1782135 - RNA, 19 nt, Homo sapiens
aauguuucuggaauucuuc

SEQ ID NO: 1782136 - RNA, 10 nt, Homo sapiens
ccaugcucuu

SEQ ID NO: 1782137 - RNA, 19 nt, Homo sapiens
caggggugcuccugugcuc

SEQ ID NO: 1782138 - RNA, 17 nt, Homo sapiens
uuauauugauaagaucu

SEQ ID NO: 1782139 - RNA, 21 nt, Homo sapiens
cugggcuggggccaccauccc

SEQ ID NO: 1782140 - RNA, 13 nt, Homo sapiens
uagucaggagaag

SEQ ID NO: 1782141 - RNA, 19 nt, Homo sapiens
gcugcauugaguccagcuu

SEQ ID NO: 1782142 - RNA, 15 nt, Homo sapiens
uccauuucaacucca

SEQ ID NO: 1782143 - RNA, 16 nt, Homo sapiens
ccauuaggucacuuaa

SEQ ID NO: 1782144 - RNA, 18 nt, Homo sapiens
aguuugaccucacaguga

SEQ ID NO: 1782145 - RNA, 18 nt, Homo sapiens
cuuucguuuugguuuuca

SEQ ID NO: 1782146 - RNA, 17 nt, Homo sapiens
cuaucccgggcauccag

SEQ ID NO: 1782147 - RNA, 22 nt, Homo sapiens
gccaggacacaacgcugcugcc

SEQ ID NO: 1782148 - RNA, 19 nt, Homo sapiens
gagcccuaagcauugacuu

SEQ ID NO: 1782149 - RNA, 22 nt, Homo sapiens
cugugaauguaaaacagagcca

SEQ ID NO: 1782150 - RNA, 14 nt, Homo sapiens
uggccaggggccag

SEQ ID NO: 1782151 - RNA, 12 nt, Homo sapiens
gauguuugccau

SEQ ID NO: 1782152 - RNA, 15 nt, Homo sapiens
acccuaauguggcag

SEQ ID NO: 1782153 - RNA, 21 nt, Homo sapiens
acauaaugguuuuguuagauu

SEQ ID NO: 1782154 - RNA, 18 nt, Homo sapiens
agaucaacagaccuaaga

SEQ ID NO: 1782155 - RNA, 13 nt, Homo sapiens
uaguuauauugaa

SEQ ID NO: 1782156 - RNA, 11 nt, Homo sapiens
uuucaaaacau

SEQ ID NO: 1782157 - RNA, 14 nt, Homo sapiens
gccuccaagccagg

SEQ ID NO: 1782158 - RNA, 17 nt, Homo sapiens
cuaccaccagcuguguc

SEQ ID NO: 1782159 - RNA, 20 nt, Homo sapiens
uuaacugacuuaaguggcau

SEQ ID NO: 1782160 - RNA, 16 nt, Homo sapiens
gaauguagcagauccc

SEQ ID NO: 1782161 - RNA, 18 nt, Homo sapiens
cccagaaccccaacuccc

SEQ ID NO: 1782162 - RNA, 23 nt, Homo sapiens
uucgggaagagaggaguucaaug

SEQ ID NO: 1782163 - RNA, 14 nt, Homo sapiens
uaucauucacccaa

SEQ ID NO: 1782164 - RNA, 14 nt, Homo sapiens
ccugaacuggccac

SEQ ID NO: 1782165 - RNA, 18 nt, Homo sapiens
uccgacucuaagcugugu

SEQ ID NO: 1782166 - RNA, 13 nt, Homo sapiens
uaugucacuggga

SEQ ID NO: 1782167 - RNA, 16 nt, Homo sapiens
cuugcaugugcugcag

SEQ ID NO: 1782168 - RNA, 17 nt, Homo sapiens
aaacauuuaacucagac

SEQ ID NO: 1782169 - RNA, 21 nt, Homo sapiens
ucaauaaaaguaaagacugua

SEQ ID NO: 1782170 - RNA, 14 nt, Homo sapiens
cuucaaaucagaag

SEQ ID NO: 1782171 - RNA, 20 nt, Homo sapiens
ucccgauaacuuugugaugu

SEQ ID NO: 1782172 - RNA, 17 nt, Homo sapiens
aaaccuuuagcugugaa

SEQ ID NO: 1782173 - RNA, 13 nt, Homo sapiens
uagucaauaucaa

SEQ ID NO: 1782174 - RNA, 16 nt, Homo sapiens
cuccuuuggaagguga

SEQ ID NO: 1782175 - RNA, 20 nt, Homo sapiens
cacuacccuccuguaaaaua

SEQ ID NO: 1782176 - RNA, 12 nt, Homo sapiens
uacugcugugaa

SEQ ID NO: 1782177 - RNA, 12 nt, Homo sapiens
ugcugcuguaaa

SEQ ID NO: 1782178 - RNA, 12 nt, Homo sapiens
ugaugcuguaca

SEQ ID NO: 1782179 - RNA, 11 nt, Homo sapiens
ucccaaagugc

SEQ ID NO: 1782180 - RNA, 22 nt, Homo sapiens
agggauuuaauacguacuuuag

SEQ ID NO: 1782181 - RNA, 13 nt, Homo sapiens
cuuuucugaauua

SEQ ID NO: 1782182 - RNA, 19 nt, Homo sapiens
gccugccaacaagcugaaa

SEQ ID NO: 1782183 - RNA, 13 nt, Homo sapiens
uagcccacugccu

SEQ ID NO: 1782184 - RNA, 14 nt, Homo sapiens
gcugcagucaucua

SEQ ID NO: 1782185 - RNA, 15 nt, Homo sapiens
cuugcccucccuuuc

SEQ ID NO: 1782186 - RNA, 14 nt, Homo sapiens
gaaccuguccaguu

SEQ ID NO: 1782187 - RNA, 15 nt, Homo sapiens
gagcagccacaacca

SEQ ID NO: 1782188 - RNA, 13 nt, Homo sapiens
aacagacuugaau

SEQ ID NO: 1782189 - RNA, 14 nt, Homo sapiens
ugcuggccccaaaa

SEQ ID NO: 1782190 - RNA, 16 nt, Homo sapiens
ucccuugcuguuuuca

SEQ ID NO: 1782191 - RNA, 14 nt, Homo sapiens
cauucccuuucaug

SEQ ID NO: 1782192 - RNA, 20 nt, Homo sapiens
ucuaucugacucucgcugug

SEQ ID NO: 1782193 - RNA, 17 nt, Homo sapiens
uggagugacgcaucucc

SEQ ID NO: 1782194 - RNA, 12 nt, Homo sapiens
ccaacaauguug

SEQ ID NO: 1782195 - RNA, 20 nt, Homo sapiens
guccaggcuggagugcaaug

SEQ ID NO: 1782196 - RNA, 15 nt, Homo sapiens
cuucaaaagcaacaa

SEQ ID NO: 1782197 - RNA, 18 nt, Homo sapiens
ccagggcccuuguacaac

SEQ ID NO: 1782198 - RNA, 20 nt, Homo sapiens
cuauaaguuguaccaaaaca

SEQ ID NO: 1782199 - RNA, 17 nt, Homo sapiens
ucaugcucugcaaaagg

SEQ ID NO: 1782200 - RNA, 19 nt, Homo sapiens
auccuguaaucacaacuca

SEQ ID NO: 1782201 - RNA, 21 nt, Homo sapiens
ugcuugagcuuucugugcaug

SEQ ID NO: 1782202 - RNA, 21 nt, Homo sapiens
gucuauuuacggaacucaaau

SEQ ID NO: 1782203 - RNA, 20 nt, Homo sapiens
aaggcuugaaguaaccuuau

SEQ ID NO: 1782204 - RNA, 16 nt, Homo sapiens
acagcuuugucuccaa

SEQ ID NO: 1782205 - RNA, 15 nt, Homo sapiens
agcccuugaaccagc

SEQ ID NO: 1782206 - RNA, 23 nt, Homo sapiens
ccccaaggccuuuccuacaugcc

SEQ ID NO: 1782207 - RNA, 14 nt, Homo sapiens
uaucugcuacuuug

SEQ ID NO: 1782208 - RNA, 14 nt, Homo sapiens
accuuccuuaccuc

SEQ ID NO: 1782209 - RNA, 13 nt, Homo sapiens
caucuucucucau

SEQ ID NO: 1782210 - RNA, 14 nt, Homo sapiens
cuggguaucucaaa

SEQ ID NO: 1782211 - RNA, 16 nt, Homo sapiens
cauggguccacugcac

SEQ ID NO: 1782212 - RNA, 16 nt, Homo sapiens
ugugcuagacuguaag

SEQ ID NO: 1782213 - RNA, 15 nt, Homo sapiens
gucuauagguuugug

SEQ ID NO: 1782214 - RNA, 13 nt, Homo sapiens
guaaaccuugaag

SEQ ID NO: 1782215 - RNA, 20 nt, Homo sapiens
ucuacaaaaaauaaaaacac

SEQ ID NO: 1782216 - RNA, 22 nt, Homo sapiens
gcucauuugugacaacauuuca

SEQ ID NO: 1782217 - RNA, 18 nt, Homo sapiens
gacagucguucccagugu

SEQ ID NO: 1782218 - RNA, 21 nt, Homo sapiens
acaacaugaaauauaguugca

SEQ ID NO: 1782219 - RNA, 18 nt, Homo sapiens
ucuccucuuuuucugugu

SEQ ID NO: 1782220 - RNA, 15 nt, Homo sapiens
gcugguggugcugca

SEQ ID NO: 1782221 - RNA, 16 nt, Homo sapiens
ugguuucucucuacag

SEQ ID NO: 1782222 - RNA, 14 nt, Homo sapiens
cucagccucaggga

SEQ ID NO: 1782223 - RNA, 16 nt, Homo sapiens
uuagaaccccagguga

SEQ ID NO: 1782224 - RNA, 21 nt, Homo sapiens
uauugcaucuggguagcugua

SEQ ID NO: 1782225 - RNA, 22 nt, Homo sapiens
cugucagcuccuugaccuauga

SEQ ID NO: 1782226 - RNA, 16 nt, Homo sapiens
uuucuauuucacuaau

SEQ ID NO: 1782227 - RNA, 21 nt, Homo sapiens
uuuaugcccuugccucucugg

SEQ ID NO: 1782228 - RNA, 17 nt, Homo sapiens
cuugaguccaaggcaga

SEQ ID NO: 1782229 - RNA, 19 nt, Homo sapiens
acuuaucacgccuacuuaa

SEQ ID NO: 1782230 - RNA, 20 nt, Homo sapiens
ugggaacuucuaaacacuuc

SEQ ID NO: 1782231 - RNA, 12 nt, Homo sapiens
ggugcugagucu

SEQ ID NO: 1782232 - RNA, 17 nt, Homo sapiens
uagaaagggccuugaca

SEQ ID NO: 1782233 - RNA, 20 nt, Homo sapiens
caauggcaccuucauucucc

SEQ ID NO: 1782234 - RNA, 13 nt, Homo sapiens
uuauggcaaagau

SEQ ID NO: 1782235 - RNA, 13 nt, Homo sapiens
uaacccucucuug

SEQ ID NO: 1782236 - RNA, 21 nt, Homo sapiens
ccccaccugaaggguggaugu

SEQ ID NO: 1782237 - RNA, 15 nt, Homo sapiens
auauagcaucuuuca

SEQ ID NO: 1782238 - RNA, 14 nt, Homo sapiens
uguccacaaauguc

SEQ ID NO: 1782239 - RNA, 21 nt, Homo sapiens
cucggagggauggagaaagaa

SEQ ID NO: 1782240 - RNA, 16 nt, Homo sapiens
uuuguaacaugacaca

SEQ ID NO: 1782241 - RNA, 12 nt, Homo sapiens
uagaacuugauu

SEQ ID NO: 1782242 - RNA, 18 nt, Homo sapiens
uacuugccuaucugacuu

SEQ ID NO: 1782243 - RNA, 23 nt, Homo sapiens
ucaaagcuaaaauauauaauaua

SEQ ID NO: 1782244 - RNA, 12 nt, Homo sapiens
uaacaguugugu

SEQ ID NO: 1782245 - RNA, 15 nt, Homo sapiens
auaauaaaaccaaag

SEQ ID NO: 1782246 - RNA, 18 nt, Homo sapiens
augcacacaggugcacag

SEQ ID NO: 1782247 - RNA, 23 nt, Homo sapiens
uuuccaccuggagggaaaggggg

SEQ ID NO: 1782248 - RNA, 18 nt, Homo sapiens
ugguguuuacccaguauu

SEQ ID NO: 1782249 - RNA, 20 nt, Homo sapiens
agucuugaaaugaaagggaa

SEQ ID NO: 1782250 - RNA, 14 nt, Homo sapiens
uuggugcuuuccag

SEQ ID NO: 1782251 - RNA, 14 nt, Homo sapiens
cucacccguaggca

SEQ ID NO: 1782252 - RNA, 19 nt, Homo sapiens
auucuguuuaucaagccau

SEQ ID NO: 1782253 - RNA, 14 nt, Homo sapiens
cccagauacccauc

SEQ ID NO: 1782254 - RNA, 21 nt, Homo sapiens
uuuacuggugcagaugguuga

SEQ ID NO: 1782255 - RNA, 19 nt, Homo sapiens
guuccuuucgaaagcaaug

SEQ ID NO: 1782256 - RNA, 13 nt, Homo sapiens
aaguaucuuggac

SEQ ID NO: 1782257 - RNA, 14 nt, Homo sapiens
cagaauuacaugaa

SEQ ID NO: 1782258 - RNA, 21 nt, Homo sapiens
aacuguauacauuacaaucau

SEQ ID NO: 1782259 - RNA, 12 nt, Homo sapiens
gcacuaaaugca

SEQ ID NO: 1782260 - RNA, 20 nt, Homo sapiens
uagagacgggguuucacugu

SEQ ID NO: 1782261 - RNA, 18 nt, Homo sapiens
uucugaucauguaugcau

SEQ ID NO: 1782262 - RNA, 18 nt, Homo sapiens
aacugauuuuguauguaa

SEQ ID NO: 1782263 - RNA, 17 nt, Homo sapiens
uuaacauugcaucauga

SEQ ID NO: 1782264 - RNA, 14 nt, Homo sapiens
augaaacagcagcu

SEQ ID NO: 1782265 - RNA, 14 nt, Homo sapiens
augacucagcagaa

SEQ ID NO: 1782266 - RNA, 21 nt, Homo sapiens
cuggauucuacaaaaaaccag

SEQ ID NO: 1782267 - RNA, 18 nt, Homo sapiens
uggcaucaagggagacac

SEQ ID NO: 1782268 - RNA, 16 nt, Homo sapiens
aucuucauagcccaaa

SEQ ID NO: 1782269 - RNA, 23 nt, Homo sapiens
aaagaggaacgggcuuggaagaa

SEQ ID NO: 1782270 - RNA, 19 nt, Homo sapiens
auaacuuggccauguucuc

SEQ ID NO: 1782271 - RNA, 21 nt, Homo sapiens
aauagcucacagcacauuugu

SEQ ID NO: 1782272 - RNA, 18 nt, Homo sapiens
uucccuuuaccacugugg

SEQ ID NO: 1782273 - RNA, 21 nt, Homo sapiens
cagggauuaaccucugcacua

SEQ ID NO: 1782274 - RNA, 22 nt, Homo sapiens
ucaacuuaaugaagaaauacag

SEQ ID NO: 1782275 - RNA, 22 nt, Homo sapiens
cuucucagaaggcaaaugacuu

SEQ ID NO: 1782276 - RNA, 16 nt, Homo sapiens
aaucaagaugagauau

SEQ ID NO: 1782277 - RNA, 20 nt, Homo sapiens
acugcuagcuuucuccuuac

SEQ ID NO: 1782278 - RNA, 18 nt, Homo sapiens
gacucguucuucugggaa

SEQ ID NO: 1782279 - RNA, 13 nt, Homo sapiens
ucagacacagcuc

SEQ ID NO: 1782280 - RNA, 20 nt, Homo sapiens
aagcaaaaaaugaaugucua

SEQ ID NO: 1782281 - RNA, 21 nt, Homo sapiens
gggcuuaugacugcaccaaca

SEQ ID NO: 1782282 - RNA, 21 nt, Homo sapiens
ggaggucugguccgagucuca

SEQ ID NO: 1782283 - RNA, 23 nt, Homo sapiens
ucuaguuaaccaaucgcaaagca

SEQ ID NO: 1782284 - RNA, 13 nt, Homo sapiens
acauuuucccaau

SEQ ID NO: 1782285 - RNA, 14 nt, Homo sapiens
ucugcaauauuauu

SEQ ID NO: 1782286 - RNA, 20 nt, Homo sapiens
ugcacaugccuuaagccagu

SEQ ID NO: 1782287 - RNA, 21 nt, Homo sapiens
ucuggauuauauuaugaagcu

SEQ ID NO: 1782288 - RNA, 14 nt, Homo sapiens
agcaaccacacgga

SEQ ID NO: 1782289 - RNA, 20 nt, Homo sapiens
aaauuagaauuguguguuaa

SEQ ID NO: 1782290 - RNA, 16 nt, Homo sapiens
caacauuucucacuga

SEQ ID NO: 1782291 - RNA, 20 nt, Homo sapiens
caauucucaaaagaaaaggc

SEQ ID NO: 1782292 - RNA, 18 nt, Homo sapiens
gauuuguuuugcauuccu

SEQ ID NO: 1782293 - RNA, 14 nt, Homo sapiens
aaagaaaagccaga

SEQ ID NO: 1782294 - RNA, 20 nt, Homo sapiens
uguuggauaucauacuucca

SEQ ID NO: 1782295 - RNA, 22 nt, Homo sapiens
gaaucucaccugcuggggaccu

SEQ ID NO: 1782296 - RNA, 11 nt, Homo sapiens
ugaaaccaaag

SEQ ID NO: 1782297 - RNA, 14 nt, Homo sapiens
cucucucucuccau

SEQ ID NO: 1782298 - RNA, 23 nt, Homo sapiens
cugaacuggccacuccccagugc

SEQ ID NO: 1782299 - RNA, 13 nt, Homo sapiens
ccucccaaagugc

SEQ ID NO: 1782300 - RNA, 10 nt, Homo sapiens
auccauguga

SEQ ID NO: 1782301 - RNA, 13 nt, Homo sapiens
cagcaugccuuca

SEQ ID NO: 1782302 - RNA, 13 nt, Homo sapiens
cuuaaugccagaa

SEQ ID NO: 1782303 - RNA, 20 nt, Homo sapiens
aauaaauuauuauuugacaa

SEQ ID NO: 1782304 - RNA, 17 nt, Homo sapiens
ugcugagccagccaucu

SEQ ID NO: 1782305 - RNA, 16 nt, Homo sapiens
auaaaaccaaacaugc

SEQ ID NO: 1782306 - RNA, 14 nt, Homo sapiens
cagcauuuccacac

SEQ ID NO: 1782307 - RNA, 15 nt, Homo sapiens
auaaauggccagugc

SEQ ID NO: 1782308 - RNA, 16 nt, Homo sapiens
guaaaauaagguauua

SEQ ID NO: 1782309 - RNA, 17 nt, Homo sapiens
gagaguaauggguuuca

SEQ ID NO: 1782310 - RNA, 15 nt, Homo sapiens
ccaccccaccagaag

SEQ ID NO: 1782311 - RNA, 18 nt, Homo sapiens
guuuguaauggugcuuau

SEQ ID NO: 1782312 - RNA, 20 nt, Homo sapiens
uguaagcaacuugcuucuaa

SEQ ID NO: 1782313 - RNA, 23 nt, Homo sapiens
acucaauguauaguuagcuuuau

SEQ ID NO: 1782314 - RNA, 12 nt, Homo sapiens
agccucaagucu

SEQ ID NO: 1782315 - RNA, 18 nt, Homo sapiens
uuccaaugcuuugauccc

SEQ ID NO: 1782316 - RNA, 22 nt, Homo sapiens
gcuauuuaacauuuuacaguaa

SEQ ID NO: 1782317 - RNA, 15 nt, Homo sapiens
ccacccucaugcugu

SEQ ID NO: 1782318 - RNA, 17 nt, Homo sapiens
gacuugauuagugccuu

SEQ ID NO: 1782319 - RNA, 18 nt, Homo sapiens
agccacccuuggucucau

SEQ ID NO: 1782320 - RNA, 15 nt, Homo sapiens
uggggagauggaguu

SEQ ID NO: 1782321 - RNA, 14 nt, Homo sapiens
uaaugaucacauuc

SEQ ID NO: 1782322 - RNA, 17 nt, Homo sapiens
acucucagucaguguca

SEQ ID NO: 1782323 - RNA, 19 nt, Homo sapiens
ccacccaucuccaguagga

SEQ ID NO: 1782324 - RNA, 15 nt, Homo sapiens
uacaauacaguacuc

SEQ ID NO: 1782325 - RNA, 18 nt, Homo sapiens
uaauuauugguauggaca

SEQ ID NO: 1782326 - RNA, 19 nt, Homo sapiens
caguaaaauacuauugccu

SEQ ID NO: 1782327 - RNA, 11 nt, Homo sapiens
ucccagugugc

SEQ ID NO: 1782328 - RNA, 18 nt, Homo sapiens
cugagggacuuggcagua

SEQ ID NO: 1782329 - RNA, 18 nt, Homo sapiens
auccuagcugugugcagu

SEQ ID NO: 1782330 - RNA, 16 nt, Homo sapiens
cagcuuggcccaggga

SEQ ID NO: 1782331 - RNA, 12 nt, Homo sapiens
cauacugucaua

SEQ ID NO: 1782332 - RNA, 12 nt, Homo sapiens
aaaucuguaaau

SEQ ID NO: 1782333 - RNA, 14 nt, Homo sapiens
aaaguacaaccaua

SEQ ID NO: 1782334 - RNA, 23 nt, Homo sapiens
uauaccuccuauauguccauuua

SEQ ID NO: 1782335 - RNA, 19 nt, Homo sapiens
aacguguuauauuccauac

SEQ ID NO: 1782336 - RNA, 18 nt, Homo sapiens
ggauauuaaauguugcuu

SEQ ID NO: 1782337 - RNA, 16 nt, Homo sapiens
aaugcuuucucaugca

SEQ ID NO: 1782338 - RNA, 15 nt, Homo sapiens
uuauggcuucacauu

SEQ ID NO: 1782339 - RNA, 15 nt, Homo sapiens
ugaucacuagccugu

SEQ ID NO: 1782340 - RNA, 16 nt, Homo sapiens
gugaccagugcugcug

SEQ ID NO: 1782341 - RNA, 17 nt, Homo sapiens
augacagccucuauccu

SEQ ID NO: 1782342 - RNA, 16 nt, Homo sapiens
ggccuugccugggaua

SEQ ID NO: 1782343 - RNA, 22 nt, Homo sapiens
uguauuauuauuauugcugcca

SEQ ID NO: 1782344 - RNA, 18 nt, Homo sapiens
cacuggcaucuuugcuau

SEQ ID NO: 1782345 - RNA, 22 nt, Homo sapiens
uaagucccuuuuaguuugauca

SEQ ID NO: 1782346 - RNA, 14 nt, Homo sapiens
ccacuacacuccag

SEQ ID NO: 1782347 - RNA, 17 nt, Homo sapiens
acaaauuagccauuuca

SEQ ID NO: 1782348 - RNA, 22 nt, Homo sapiens
uguuauuuguuuuuauuauuac

SEQ ID NO: 1782349 - RNA, 18 nt, Homo sapiens
aaggcccauaucugugaa

SEQ ID NO: 1782350 - RNA, 23 nt, Homo sapiens
caguuuauuaacuugagcuucac

SEQ ID NO: 1782351 - RNA, 13 nt, Homo sapiens
aaagcuugugaaa

SEQ ID NO: 1782352 - RNA, 18 nt, Homo sapiens
cuugggcaauaaaggcac

SEQ ID NO: 1782353 - RNA, 20 nt, Homo sapiens
uccucuggaucacagacacu

SEQ ID NO: 1782354 - RNA, 23 nt, Homo sapiens
agcaucagagagacuguuaucag

SEQ ID NO: 1782355 - RNA, 19 nt, Homo sapiens
uggagacaauaaacagcug

SEQ ID NO: 1782356 - RNA, 19 nt, Homo sapiens
uucagccauugcccuguga

SEQ ID NO: 1782357 - RNA, 22 nt, Homo sapiens
ccccaaaguaccacacugaguu

SEQ ID NO: 1782358 - RNA, 12 nt, Homo sapiens
uguguacugugg

SEQ ID NO: 1782359 - RNA, 13 nt, Homo sapiens
agccuuuccagaa

SEQ ID NO: 1782360 - RNA, 22 nt, Homo sapiens
gaugggcaaacccuggugcuuu

SEQ ID NO: 1782361 - RNA, 20 nt, Homo sapiens
gccccaccaucuugcugaca

SEQ ID NO: 1782362 - RNA, 17 nt, Homo sapiens
gggcuaucccuuuccaa

SEQ ID NO: 1782363 - RNA, 21 nt, Homo sapiens
uuccugcgcauauagacugua

SEQ ID NO: 1782364 - RNA, 20 nt, Homo sapiens
cugccauuauuuucugucag

SEQ ID NO: 1782365 - RNA, 15 nt, Homo sapiens
cugcagaaacagugc

SEQ ID NO: 1782366 - RNA, 22 nt, Homo sapiens
auccugggggacccaauguagg

SEQ ID NO: 1782367 - RNA, 17 nt, Homo sapiens
cuguuucuugaugggag

SEQ ID NO: 1782368 - RNA, 14 nt, Homo sapiens
uaagaaaaaucaua

SEQ ID NO: 1782369 - RNA, 19 nt, Homo sapiens
acauagugugagaacuucc

SEQ ID NO: 1782370 - RNA, 15 nt, Homo sapiens
cucaccucuugccuu

SEQ ID NO: 1782371 - RNA, 17 nt, Homo sapiens
ucacauagagugaucuu

SEQ ID NO: 1782372 - RNA, 20 nt, Homo sapiens
augcccuauggccuaugugc

SEQ ID NO: 1782373 - RNA, 16 nt, Homo sapiens
aaaugcaguccaguga

SEQ ID NO: 1782374 - RNA, 11 nt, Homo sapiens
aguugcacaaa

SEQ ID NO: 1782375 - RNA, 21 nt, Homo sapiens
ggaacagagggugaaagggac

SEQ ID NO: 1782376 - RNA, 23 nt, Homo sapiens
gauguauaaugaaaaaggauaau

SEQ ID NO: 1782377 - RNA, 14 nt, Homo sapiens
cucucuuacauuga

SEQ ID NO: 1782378 - RNA, 20 nt, Homo sapiens
cugugaauaaaaacccugua

SEQ ID NO: 1782379 - RNA, 21 nt, Homo sapiens
ugcaggagcuaguucucagcu

SEQ ID NO: 1782380 - RNA, 17 nt, Homo sapiens
uugucuugagacagggu

SEQ ID NO: 1782381 - RNA, 13 nt, Homo sapiens
uuuccauuuacua

SEQ ID NO: 1782382 - RNA, 15 nt, Homo sapiens
uaauuaaaugcucau

SEQ ID NO: 1782383 - RNA, 23 nt, Homo sapiens
cucuagacaucuagucucagugc

SEQ ID NO: 1782384 - RNA, 15 nt, Homo sapiens
ucuucauguaccugc

SEQ ID NO: 1782385 - RNA, 14 nt, Homo sapiens
auguuuucuuaagc

SEQ ID NO: 1782386 - RNA, 18 nt, Homo sapiens
agcccuuaggaagaauuu

SEQ ID NO: 1782387 - RNA, 13 nt, Homo sapiens
cauuuaaggagca

SEQ ID NO: 1782388 - RNA, 12 nt, Homo sapiens
acaccugaauaa

SEQ ID NO: 1782389 - RNA, 20 nt, Homo sapiens
uauaaaaauauuaagacaau

SEQ ID NO: 1782390 - RNA, 14 nt, Homo sapiens
guacagagcacauu

SEQ ID NO: 1782391 - RNA, 20 nt, Homo sapiens
cucuugguucuacguggaug

SEQ ID NO: 1782392 - RNA, 22 nt, Homo sapiens
agaacuggucuuccauuuugcc

SEQ ID NO: 1782393 - RNA, 17 nt, Homo sapiens
gcuuugauuguucauau

SEQ ID NO: 1782394 - RNA, 15 nt, Homo sapiens
ccugcauggugggag

SEQ ID NO: 1782395 - RNA, 22 nt, Homo sapiens
cucuuccugauuccccacucaa

SEQ ID NO: 1782396 - RNA, 13 nt, Homo sapiens
cuucccucgggga

SEQ ID NO: 1782397 - RNA, 17 nt, Homo sapiens
caucacgucagugcuca

SEQ ID NO: 1782398 - RNA, 19 nt, Homo sapiens
ggaaacauaggaagcccuc

SEQ ID NO: 1782399 - RNA, 14 nt, Homo sapiens
uaaacaaauguaug

SEQ ID NO: 1782400 - RNA, 21 nt, Homo sapiens
uugagauuauucuuuguuucc

SEQ ID NO: 1782401 - RNA, 24 nt, Homo sapiens
uuuucccuguccugacaccaggca

SEQ ID NO: 1782402 - RNA, 17 nt, Homo sapiens
gccagacaaaauuugag

SEQ ID NO: 1782403 - RNA, 19 nt, Homo sapiens
auuuuuaaaacaaaccaau

SEQ ID NO: 1782404 - RNA, 18 nt, Homo sapiens
ccugacaucacagcagcc

SEQ ID NO: 1782405 - RNA, 11 nt, Homo sapiens
guggggccagc

SEQ ID NO: 1782406 - RNA, 15 nt, Homo sapiens
auaccuuaugcuaca

SEQ ID NO: 1782407 - RNA, 20 nt, Homo sapiens
aacauuauuuggauaucaaa

SEQ ID NO: 1782408 - RNA, 13 nt, Homo sapiens
cccauuucuguaa

SEQ ID NO: 1782409 - RNA, 13 nt, Homo sapiens
agaaucagaauuu

SEQ ID NO: 1782410 - RNA, 19 nt, Homo sapiens
cagaggcauuugagcagcu

SEQ ID NO: 1782411 - RNA, 21 nt, Homo sapiens
auacaguagcuugaaauugau

SEQ ID NO: 1782412 - RNA, 22 nt, Homo sapiens
cuuggccucccaaagugcuagu

SEQ ID NO: 1782413 - RNA, 18 nt, Homo sapiens
aucauagcaagaccucau

SEQ ID NO: 1782414 - RNA, 19 nt, Homo sapiens
aggccugagcgagugucca

SEQ ID NO: 1782415 - RNA, 16 nt, Homo sapiens
aucuaaaaugauacug

SEQ ID NO: 1782416 - RNA, 15 nt, Homo sapiens
cuugcccugagcuuu

SEQ ID NO: 1782417 - RNA, 18 nt, Homo sapiens
uccauagugcacuagcau

SEQ ID NO: 1782418 - RNA, 22 nt, Homo sapiens
gauuuauuuccccucucaaagg

SEQ ID NO: 1782419 - RNA, 15 nt, Homo sapiens
ucuugacccugucac

SEQ ID NO: 1782420 - RNA, 20 nt, Homo sapiens
cguuugacuagccaucucaa

SEQ ID NO: 1782421 - RNA, 15 nt, Homo sapiens
guguaugcacagggu

SEQ ID NO: 1782422 - RNA, 13 nt, Homo sapiens
aagaauggcuuuc

SEQ ID NO: 1782423 - RNA, 15 nt, Homo sapiens
cuauuuugagcauua

SEQ ID NO: 1782424 - RNA, 14 nt, Homo sapiens
ugcaguuugaaauu

SEQ ID NO: 1782425 - RNA, 21 nt, Homo sapiens
auccuugugaaccccaaagug

SEQ ID NO: 1782426 - RNA, 13 nt, Homo sapiens
uuuuauacugcac

SEQ ID NO: 1782427 - RNA, 13 nt, Homo sapiens
uauuuuugccaaa

SEQ ID NO: 1782428 - RNA, 19 nt, Homo sapiens
aagacaggcuccugagaaa

SEQ ID NO: 1782429 - RNA, 15 nt, Homo sapiens
uuuacaucuauccca

SEQ ID NO: 1782430 - RNA, 18 nt, Homo sapiens
aguuauguaauaaccaaa

SEQ ID NO: 1782431 - RNA, 17 nt, Homo sapiens
cuaugcuggcuuuucac

SEQ ID NO: 1782432 - RNA, 14 nt, Homo sapiens
ccacuuugcugguu

SEQ ID NO: 1782433 - RNA, 22 nt, Homo sapiens
augccacguggucacugugcac

SEQ ID NO: 1782434 - RNA, 20 nt, Homo sapiens
gcugcucuccaucucuugua

SEQ ID NO: 1782435 - RNA, 17 nt, Homo sapiens
cuuaauacuuuaugaug

SEQ ID NO: 1782436 - RNA, 14 nt, Homo sapiens
uagucccauuugac

SEQ ID NO: 1782437 - RNA, 20 nt, Homo sapiens
uuggauacauacaccagcau

SEQ ID NO: 1782438 - RNA, 21 nt, Homo sapiens
aaauccaacuuucacagugaa

SEQ ID NO: 1782439 - RNA, 13 nt, Homo sapiens
agcuccugcacaa

SEQ ID NO: 1782440 - RNA, 13 nt, Homo sapiens
augaggugcuuug

SEQ ID NO: 1782441 - RNA, 14 nt, Homo sapiens
cacgugcuguucca

SEQ ID NO: 1782442 - RNA, 17 nt, Homo sapiens
cagcauuucagcuguga

SEQ ID NO: 1782443 - RNA, 17 nt, Homo sapiens
acugugguacugaugga

SEQ ID NO: 1782444 - RNA, 20 nt, Homo sapiens
cugggccucuuggaaaaagu

SEQ ID NO: 1782445 - RNA, 16 nt, Homo sapiens
accucagugcacgagc

SEQ ID NO: 1782446 - RNA, 22 nt, Homo sapiens
agaaacuuuggaagcacuuuuu

SEQ ID NO: 1782447 - RNA, 13 nt, Homo sapiens
uauaaaacaguca

SEQ ID NO: 1782448 - RNA, 18 nt, Homo sapiens
ugauucauuuauuugaca

SEQ ID NO: 1782449 - RNA, 16 nt, Homo sapiens
guaucaacacuguuac

SEQ ID NO: 1782450 - RNA, 22 nt, Homo sapiens
uggacaugggccagguuuuuca

SEQ ID NO: 1782451 - RNA, 17 nt, Homo sapiens
auugauuuuaaccaaug

SEQ ID NO: 1782452 - RNA, 15 nt, Homo sapiens
cauaauacaaaaggc

SEQ ID NO: 1782453 - RNA, 15 nt, Homo sapiens
acaugagacuuuccg

SEQ ID NO: 1782454 - RNA, 15 nt, Homo sapiens
ccaaccuggacuugu

SEQ ID NO: 1782455 - RNA, 13 nt, Homo sapiens
agauuccaaaaag

SEQ ID NO: 1782456 - RNA, 17 nt, Homo sapiens
guaucucuucagucucu

SEQ ID NO: 1782457 - RNA, 16 nt, Homo sapiens
cuugaauauuugcuua

SEQ ID NO: 1782458 - RNA, 14 nt, Homo sapiens
auauguauacauau

SEQ ID NO: 1782459 - RNA, 18 nt, Homo sapiens
aucaaacgcagacacugu

SEQ ID NO: 1782460 - RNA, 14 nt, Homo sapiens
acuuaaauauuuga

SEQ ID NO: 1782461 - RNA, 20 nt, Homo sapiens
cucaauucaaauccauagau

SEQ ID NO: 1782462 - RNA, 19 nt, Homo sapiens
cccacacgugcauagaggu

SEQ ID NO: 1782463 - RNA, 15 nt, Homo sapiens
cccagcagugucacu

SEQ ID NO: 1782464 - RNA, 21 nt, Homo sapiens
ccaaacuggaaugagcagcuu

SEQ ID NO: 1782465 - RNA, 18 nt, Homo sapiens
ugagaacaaucucaaaaa

SEQ ID NO: 1782466 - RNA, 21 nt, Homo sapiens
ccccuccccucgcugcugggc

SEQ ID NO: 1782467 - RNA, 13 nt, Homo sapiens
guuugaacacaga

SEQ ID NO: 1782468 - RNA, 18 nt, Homo sapiens
cgguuugaagccuggaac

SEQ ID NO: 1782469 - RNA, 18 nt, Homo sapiens
cuuccucacuaugacacu

SEQ ID NO: 1782470 - RNA, 15 nt, Homo sapiens
gcaguuugcacuuaa

SEQ ID NO: 1782471 - RNA, 16 nt, Homo sapiens
cuauaaaaaaaugcau

SEQ ID NO: 1782472 - RNA, 13 nt, Homo sapiens
ugacuauggggaa

SEQ ID NO: 1782473 - RNA, 20 nt, Homo sapiens
ccuuuccccggaguaccuau

SEQ ID NO: 1782474 - RNA, 15 nt, Homo sapiens
ccacauuccaugacg

SEQ ID NO: 1782475 - RNA, 22 nt, Homo sapiens
cugcucuggaaaaugugaccca

SEQ ID NO: 1782476 - RNA, 23 nt, Homo sapiens
agcaggcggccuuuguugcucag

SEQ ID NO: 1782477 - RNA, 21 nt, Homo sapiens
accuuauaguguuaauaucuu

SEQ ID NO: 1782478 - RNA, 18 nt, Homo sapiens
acaucuguaauccuagcu

SEQ ID NO: 1782479 - RNA, 19 nt, Homo sapiens
gcaggcuucugugugcugc

SEQ ID NO: 1782480 - RNA, 18 nt, Homo sapiens
uuguguggaugaccacau

SEQ ID NO: 1782481 - RNA, 16 nt, Homo sapiens
cuccagcugauccaga

SEQ ID NO: 1782482 - RNA, 13 nt, Homo sapiens
acagugcagacag

SEQ ID NO: 1782483 - RNA, 18 nt, Homo sapiens
gccacugcagcacaggag

SEQ ID NO: 1782484 - RNA, 15 nt, Homo sapiens
uagaagauauggaag

SEQ ID NO: 1782485 - RNA, 15 nt, Homo sapiens
cagcagcagcucaca

SEQ ID NO: 1782486 - RNA, 18 nt, Homo sapiens
aaagacuugugcaucccu

SEQ ID NO: 1782487 - RNA, 17 nt, Homo sapiens
gaggaguaccgccagca

SEQ ID NO: 1782488 - RNA, 19 nt, Homo sapiens
auauguguauauauauaug

SEQ ID NO: 1782489 - RNA, 21 nt, Homo sapiens
cagcuggucaaacaaacucuc

SEQ ID NO: 1782490 - RNA, 15 nt, Homo sapiens
gcggcccagacccac

SEQ ID NO: 1782491 - RNA, 21 nt, Homo sapiens
gcucugaauuggauccagggg

SEQ ID NO: 1782492 - RNA, 14 nt, Homo sapiens
gucugggaugaagg

SEQ ID NO: 1782493 - RNA, 22 nt, Homo sapiens
uccuuuuuucaauaugcaagca

SEQ ID NO: 1782494 - RNA, 19 nt, Homo sapiens
aauugaagauguaaggaau

SEQ ID NO: 1782495 - RNA, 22 nt, Homo sapiens
cuccaaaguuuuaaaccuguua

SEQ ID NO: 1782496 - RNA, 21 nt, Homo sapiens
caagugagcagagauguacug

SEQ ID NO: 1782497 - RNA, 17 nt, Homo sapiens
uccuggcaugacacucu

SEQ ID NO: 1782498 - RNA, 14 nt, Homo sapiens
auucuaagucacag

SEQ ID NO: 1782499 - RNA, 19 nt, Homo sapiens
uucuuggcccgcacagagc

SEQ ID NO: 1782500 - RNA, 19 nt, Homo sapiens
caacaaacucuacuaucca

SEQ ID NO: 1782501 - RNA, 19 nt, Homo sapiens
cuacccuguccuuugcaau

SEQ ID NO: 1782502 - RNA, 16 nt, Homo sapiens
augucuauuauuauga

SEQ ID NO: 1782503 - RNA, 18 nt, Homo sapiens
ucuggccccugucauccu

SEQ ID NO: 1782504 - RNA, 17 nt, Homo sapiens
uuaugccccugcacuga

SEQ ID NO: 1782505 - RNA, 22 nt, Homo sapiens
cugguaccagcacuccgcggcg

SEQ ID NO: 1782506 - RNA, 14 nt, Homo sapiens
auacaaaacccuuu

SEQ ID NO: 1782507 - RNA, 15 nt, Homo sapiens
gacucaaugugcucu

SEQ ID NO: 1782508 - RNA, 17 nt, Homo sapiens
uccuccguccauaucag

SEQ ID NO: 1782509 - RNA, 17 nt, Homo sapiens
auucauggaacuuucau

SEQ ID NO: 1782510 - RNA, 21 nt, Homo sapiens
ugaauagaaacagauggaauu

SEQ ID NO: 1782511 - RNA, 19 nt, Homo sapiens
gaacucuaaccaguguaca

SEQ ID NO: 1782512 - RNA, 16 nt, Homo sapiens
aauccuagcacuuugg

SEQ ID NO: 1782513 - RNA, 21 nt, Homo sapiens
ccugccuuuagaguuccauga

SEQ ID NO: 1782514 - RNA, 19 nt, Homo sapiens
uugaugaauaaaaugaagg

SEQ ID NO: 1782515 - RNA, 18 nt, Homo sapiens
ccugugcuggaccagcug

SEQ ID NO: 1782516 - RNA, 15 nt, Homo sapiens
accugcuguccugca

SEQ ID NO: 1782517 - RNA, 23 nt, Homo sapiens
gaaauuuuuucaugcacacuguu

SEQ ID NO: 1782518 - RNA, 14 nt, Homo sapiens
gauguguguugaua

SEQ ID NO: 1782519 - RNA, 22 nt, Homo sapiens
gauuuauuuacucuugcuggau

SEQ ID NO: 1782520 - RNA, 16 nt, Homo sapiens
agaaaaucaguugugu

SEQ ID NO: 1782521 - RNA, 14 nt, Homo sapiens
gcuagagggacaaa

SEQ ID NO: 1782522 - RNA, 17 nt, Homo sapiens
ugggauuugcccacgua

SEQ ID NO: 1782523 - RNA, 17 nt, Homo sapiens
aauaguacuauugcuag

SEQ ID NO: 1782524 - RNA, 18 nt, Homo sapiens
auuaaaauguaugcaugu

SEQ ID NO: 1782525 - RNA, 15 nt, Homo sapiens
uuaucuggcuucaaa

SEQ ID NO: 1782526 - RNA, 13 nt, Homo sapiens
caccaccacugug

SEQ ID NO: 1782527 - RNA, 18 nt, Homo sapiens
auuuagaaaucaagcaua

SEQ ID NO: 1782528 - RNA, 16 nt, Homo sapiens
aaguuauuuacuuuua

SEQ ID NO: 1782529 - RNA, 13 nt, Homo sapiens
uguugaaugccug

SEQ ID NO: 1782530 - RNA, 15 nt, Homo sapiens
uuugaaacagauucu

SEQ ID NO: 1782531 - RNA, 14 nt, Homo sapiens
acacccugcuucuc

SEQ ID NO: 1782532 - RNA, 20 nt, Homo sapiens
cagccugggcaacagagcaa

SEQ ID NO: 1782533 - RNA, 17 nt, Homo sapiens
gaccucugagaccaaaa

SEQ ID NO: 1782534 - RNA, 23 nt, Homo sapiens
agcugggauuacaggcacaugca

SEQ ID NO: 1782535 - RNA, 19 nt, Homo sapiens
ucugacagcagccugugag

SEQ ID NO: 1782536 - RNA, 18 nt, Homo sapiens
caaucaagccauguauaa

SEQ ID NO: 1782537 - RNA, 13 nt, Homo sapiens
ugucucagccucc

SEQ ID NO: 1782538 - RNA, 22 nt, Homo sapiens
uuaaaaugugcuauuugcaaac

SEQ ID NO: 1782539 - RNA, 13 nt, Homo sapiens
cccuccagugcuu

SEQ ID NO: 1782540 - RNA, 20 nt, Homo sapiens
ccucuaguuuuaagacugaa

SEQ ID NO: 1782541 - RNA, 21 nt, Homo sapiens
ugaauauuuguuauguagaua

SEQ ID NO: 1782542 - RNA, 19 nt, Homo sapiens
cauggcucuggacucuaaa

SEQ ID NO: 1782543 - RNA, 21 nt, Homo sapiens
aacaauguuuuuuauacuuca

SEQ ID NO: 1782544 - RNA, 13 nt, Homo sapiens
uuagggaggacca

SEQ ID NO: 1782545 - RNA, 19 nt, Homo sapiens
uuuuagacccuauugcugc

SEQ ID NO: 1782546 - RNA, 23 nt, Homo sapiens
aaugauuucccacucagggcugg

SEQ ID NO: 1782547 - RNA, 14 nt, Homo sapiens
gaucccaggccagg

SEQ ID NO: 1782548 - RNA, 23 nt, Homo sapiens
ccuuagauguucuaagucuuucc

SEQ ID NO: 1782549 - RNA, 15 nt, Homo sapiens
auuauuucuucccag

SEQ ID NO: 1782550 - RNA, 15 nt, Homo sapiens
uuuaauacaggguag

SEQ ID NO: 1782551 - RNA, 21 nt, Homo sapiens
ccaccaaccccccaccuccac

SEQ ID NO: 1782552 - RNA, 18 nt, Homo sapiens
aaauaaagcguccucuca

SEQ ID NO: 1782553 - RNA, 11 nt, Homo sapiens
uuaauaacaua

SEQ ID NO: 1782554 - RNA, 20 nt, Homo sapiens
gccaaggaggaaauguggaa

SEQ ID NO: 1782555 - RNA, 14 nt, Homo sapiens
ugggauauucccaa

SEQ ID NO: 1782556 - RNA, 20 nt, Homo sapiens
ccaacccaauaaaacugaug

SEQ ID NO: 1782557 - RNA, 11 nt, Homo sapiens
aaagcuuaaug

SEQ ID NO: 1782558 - RNA, 20 nt, Homo sapiens
agcuuauacaauucagagaa

SEQ ID NO: 1782559 - RNA, 15 nt, Homo sapiens
cuuacucugagcuca

SEQ ID NO: 1782560 - RNA, 18 nt, Homo sapiens
cuuguucuaaucuuguca

SEQ ID NO: 1782561 - RNA, 12 nt, Homo sapiens
gaccugcaguga

SEQ ID NO: 1782562 - RNA, 16 nt, Homo sapiens
auaucaaaacauccca

SEQ ID NO: 1782563 - RNA, 20 nt, Homo sapiens
agcccuccgccauucucaag

SEQ ID NO: 1782564 - RNA, 15 nt, Homo sapiens
augugcccacaggga

SEQ ID NO: 1782565 - RNA, 17 nt, Homo sapiens
cucauaguaauaagaug

SEQ ID NO: 1782566 - RNA, 20 nt, Homo sapiens
cuuccuggauuauucaaaau

SEQ ID NO: 1782567 - RNA, 17 nt, Homo sapiens
auggaggacuccaggca

SEQ ID NO: 1782568 - RNA, 15 nt, Homo sapiens
ucuuuccuuguucag

SEQ ID NO: 1782569 - RNA, 14 nt, Homo sapiens
ugaauagaaacaga

SEQ ID NO: 1782570 - RNA, 18 nt, Homo sapiens
ucuucagaggagaaagaa

SEQ ID NO: 1782571 - RNA, 14 nt, Homo sapiens
aagauuuaaucuca

SEQ ID NO: 1782572 - RNA, 18 nt, Homo sapiens
uucguccuaacauaacac

SEQ ID NO: 1782573 - RNA, 14 nt, Homo sapiens
acaccaauugauuu

SEQ ID NO: 1782574 - RNA, 17 nt, Homo sapiens
agccaugugcagccacc

SEQ ID NO: 1782575 - RNA, 15 nt, Homo sapiens
acaccugcucucucc

SEQ ID NO: 1782576 - RNA, 14 nt, Homo sapiens
cugagaaaaggcaa

SEQ ID NO: 1782577 - RNA, 11 nt, Homo sapiens
aaguucacagu

SEQ ID NO: 1782578 - RNA, 13 nt, Homo sapiens
cuaucugccugac

SEQ ID NO: 1782579 - RNA, 12 nt, Homo sapiens
ccagggccagug

SEQ ID NO: 1782580 - RNA, 19 nt, Homo sapiens
cucacaccuguaaucccag

SEQ ID NO: 1782581 - RNA, 19 nt, Homo sapiens
cuccuucgcccucuuguag

SEQ ID NO: 1782582 - RNA, 20 nt, Homo sapiens
uccccaccaccaauugccaa

SEQ ID NO: 1782583 - RNA, 23 nt, Homo sapiens
ccagggcccacuagcauccacug

SEQ ID NO: 1782584 - RNA, 23 nt, Homo sapiens
uuucuuaguguuguggacacugc

SEQ ID NO: 1782585 - RNA, 19 nt, Homo sapiens
ugacaauuuuuuccacuua

SEQ ID NO: 1782586 - RNA, 21 nt, Homo sapiens
uauuuaaauaaaaucauauug

SEQ ID NO: 1782587 - RNA, 22 nt, Homo sapiens
acccugucaaguuaacaaggaa

SEQ ID NO: 1782588 - RNA, 20 nt, Homo sapiens
ggcacuuaagugcacuuuuu

SEQ ID NO: 1782589 - RNA, 15 nt, Homo sapiens
ccaaaggaagcuuuc

SEQ ID NO: 1782590 - RNA, 16 nt, Homo sapiens
agaauggaauuuugcu

SEQ ID NO: 1782591 - RNA, 20 nt, Homo sapiens
uaaaaucacaaacucaucca

SEQ ID NO: 1782592 - RNA, 16 nt, Homo sapiens
agacgcauguggcaaa

SEQ ID NO: 1782593 - RNA, 15 nt, Homo sapiens
cuacugaaaaugcau

SEQ ID NO: 1782594 - RNA, 13 nt, Homo sapiens
aacccaagcuccu

SEQ ID NO: 1782595 - RNA, 19 nt, Homo sapiens
guguaaggaaggugcucac

SEQ ID NO: 1782596 - RNA, 14 nt, Homo sapiens
ccuuaacacacugg

SEQ ID NO: 1782597 - RNA, 20 nt, Homo sapiens
uaaauacagcauacuucaaa

SEQ ID NO: 1782598 - RNA, 23 nt, Homo sapiens
ggcuuccucaaauacaugcacag

SEQ ID NO: 1782599 - RNA, 16 nt, Homo sapiens
uuuccugcagggccag

SEQ ID NO: 1782600 - RNA, 20 nt, Homo sapiens
cugacuuguuugucuuccau

SEQ ID NO: 1782601 - RNA, 18 nt, Homo sapiens
uuuccacuggaguucacu

SEQ ID NO: 1782602 - RNA, 20 nt, Homo sapiens
accugagucugcaugugcac

SEQ ID NO: 1782603 - RNA, 17 nt, Homo sapiens
auggauucucuauucaa

SEQ ID NO: 1782604 - RNA, 14 nt, Homo sapiens
ugcgauaacugaga

SEQ ID NO: 1782605 - RNA, 20 nt, Homo sapiens
uugagggacgaggucaagga

SEQ ID NO: 1782606 - RNA, 14 nt, Homo sapiens
auggauaugcugcu

SEQ ID NO: 1782607 - RNA, 20 nt, Homo sapiens
cuucuuuauacaaugaccac

SEQ ID NO: 1782608 - RNA, 23 nt, Homo sapiens
uccuucccgcagcaccagccuga

SEQ ID NO: 1782609 - RNA, 18 nt, Homo sapiens
gcauaucaaaaaguauua

SEQ ID NO: 1782610 - RNA, 16 nt, Homo sapiens
ugagacagacauucac

SEQ ID NO: 1782611 - RNA, 21 nt, Homo sapiens
gugugagaagaucauugccau

SEQ ID NO: 1782612 - RNA, 14 nt, Homo sapiens
ccagcuagcaaaau

SEQ ID NO: 1782613 - RNA, 12 nt, Homo sapiens
cuggcccugugc

SEQ ID NO: 1782614 - RNA, 12 nt, Homo sapiens
cugccccugugg

SEQ ID NO: 1782615 - RNA, 24 nt, Homo sapiens
cauccaucuuuccauccauuaccu

SEQ ID NO: 1782616 - RNA, 17 nt, Homo sapiens
gcccuagcccagacucu

SEQ ID NO: 1782617 - RNA, 16 nt, Homo sapiens
uugggccuugcugcug

SEQ ID NO: 1782618 - RNA, 17 nt, Homo sapiens
accugauuaacugaggc

SEQ ID NO: 1782619 - RNA, 12 nt, Homo sapiens
uuauagcuauga

SEQ ID NO: 1782620 - RNA, 20 nt, Homo sapiens
ggggagccuucugugcugug

SEQ ID NO: 1782621 - RNA, 22 nt, Homo sapiens
cagaccaaggcgaguuucccca

SEQ ID NO: 1782622 - RNA, 15 nt, Homo sapiens
auacauuugauaaag

SEQ ID NO: 1782623 - RNA, 15 nt, Homo sapiens
uaugaaaagucauuc

SEQ ID NO: 1782624 - RNA, 22 nt, Homo sapiens
ccucugcggaccccagcuguga

SEQ ID NO: 1782625 - RNA, 16 nt, Homo sapiens
cacugcuacaugugcu

SEQ ID NO: 1782626 - RNA, 20 nt, Homo sapiens
ugacccucugacccuagcuc

SEQ ID NO: 1782627 - RNA, 15 nt, Homo sapiens
agcaaccuacugucu

SEQ ID NO: 1782628 - RNA, 14 nt, Homo sapiens
gucuuuugaugaau

SEQ ID NO: 1782629 - RNA, 13 nt, Homo sapiens
aaaaaaaagagag

SEQ ID NO: 1782630 - RNA, 14 nt, Homo sapiens
cugaaccaguccag

SEQ ID NO: 1782631 - RNA, 15 nt, Homo sapiens
aaugaaaucuuccca

SEQ ID NO: 1782632 - RNA, 13 nt, Homo sapiens
cucuguuaccaca

SEQ ID NO: 1782633 - RNA, 22 nt, Homo sapiens
ugauuucaguucaucaaaucau

SEQ ID NO: 1782634 - RNA, 17 nt, Homo sapiens
acagaguugcuuaauga

SEQ ID NO: 1782635 - RNA, 19 nt, Homo sapiens
agcucacacccuaccuucc

SEQ ID NO: 1782636 - RNA, 22 nt, Homo sapiens
ugcagaagcaaacaagcuugau

SEQ ID NO: 1782637 - RNA, 21 nt, Homo sapiens
agaguuucaaaagcaaaacau

SEQ ID NO: 1782638 - RNA, 20 nt, Homo sapiens
gaaauaguacuuacaaauga

SEQ ID NO: 1782639 - RNA, 18 nt, Homo sapiens
uucucuacaugcauaaca

SEQ ID NO: 1782640 - RNA, 17 nt, Homo sapiens
ucaagaaaaauucacag

SEQ ID NO: 1782641 - RNA, 15 nt, Homo sapiens
aguccacaggcaugg

SEQ ID NO: 1782642 - RNA, 14 nt, Homo sapiens
aacucacugccuag

SEQ ID NO: 1782643 - RNA, 19 nt, Homo sapiens
uggaaagaaaacacacucc

SEQ ID NO: 1782644 - RNA, 17 nt, Homo sapiens
ucugucagucacagcca

SEQ ID NO: 1782645 - RNA, 13 nt, Homo sapiens
aucauagggauaa

SEQ ID NO: 1782646 - RNA, 15 nt, Homo sapiens
aaauacacugugaag

SEQ ID NO: 1782647 - RNA, 15 nt, Homo sapiens
uauuaaucauuccau

SEQ ID NO: 1782648 - RNA, 15 nt, Homo sapiens
ugaucccaauccuua

SEQ ID NO: 1782649 - RNA, 19 nt, Homo sapiens
auuuggaggagugaacauc

SEQ ID NO: 1782650 - RNA, 14 nt, Homo sapiens
uacugcuguaaaua

SEQ ID NO: 1782651 - RNA, 22 nt, Homo sapiens
cuaaaguuaaauaggauauuaa

SEQ ID NO: 1782652 - RNA, 13 nt, Homo sapiens
uccagacagucac

SEQ ID NO: 1782653 - RNA, 17 nt, Homo sapiens
aaaauguccugccuuuu

SEQ ID NO: 1782654 - RNA, 18 nt, Homo sapiens
gcugcuauuucaucuggu

SEQ ID NO: 1782655 - RNA, 14 nt, Homo sapiens
cucuauuuacuucu

SEQ ID NO: 1782656 - RNA, 17 nt, Homo sapiens
gcugcauucccaugagc

SEQ ID NO: 1782657 - RNA, 18 nt, Homo sapiens
aauggaaaaaaaaaacuu

SEQ ID NO: 1782658 - RNA, 19 nt, Homo sapiens
gccucgauuuugcacuuuu

SEQ ID NO: 1782659 - RNA, 15 nt, Homo sapiens
auguuuuccacugag

SEQ ID NO: 1782660 - RNA, 18 nt, Homo sapiens
aguccuccgguugcauac

SEQ ID NO: 1782661 - RNA, 16 nt, Homo sapiens
ccaggcccuccagugg

SEQ ID NO: 1782662 - RNA, 17 nt, Homo sapiens
aaaucaugaauauuuca

SEQ ID NO: 1782663 - RNA, 19 nt, Homo sapiens
gcccugcagcccaccagac

SEQ ID NO: 1782664 - RNA, 21 nt, Homo sapiens
caacaauccaucucucaagua

SEQ ID NO: 1782665 - RNA, 14 nt, Homo sapiens
cuuguuuugccaug

SEQ ID NO: 1782666 - RNA, 12 nt, Homo sapiens
gaauucccucac

SEQ ID NO: 1782667 - RNA, 14 nt, Homo sapiens
cagggugucccaga

SEQ ID NO: 1782668 - RNA, 23 nt, Homo sapiens
ggaguuuacuaccuggggacccc

SEQ ID NO: 1782669 - RNA, 18 nt, Homo sapiens
gcccagucuggcaugcag

SEQ ID NO: 1782670 - RNA, 22 nt, Homo sapiens
gauauauaaguguacauaugug

SEQ ID NO: 1782671 - RNA, 19 nt, Homo sapiens
cccacugcacacagggugg

SEQ ID NO: 1782672 - RNA, 15 nt, Homo sapiens
ugguguuacugcagu

SEQ ID NO: 1782673 - RNA, 18 nt, Homo sapiens
accugggcuuaaguuuua

SEQ ID NO: 1782674 - RNA, 16 nt, Homo sapiens
caugcagaaacuugga

SEQ ID NO: 1782675 - RNA, 19 nt, Homo sapiens
aguguucugauuccuucaa

SEQ ID NO: 1782676 - RNA, 17 nt, Homo sapiens
gacaucuacgaagccac

SEQ ID NO: 1782677 - RNA, 16 nt, Homo sapiens
ccccgacuucauccca

SEQ ID NO: 1782678 - RNA, 20 nt, Homo sapiens
ggaauccaagccuccacagc

SEQ ID NO: 1782679 - RNA, 19 nt, Homo sapiens
uaaacacuaaaaaggcaug

SEQ ID NO: 1782680 - RNA, 14 nt, Homo sapiens
uaaucuaugaauuc

SEQ ID NO: 1782681 - RNA, 14 nt, Homo sapiens
cuucauagcccaaa

SEQ ID NO: 1782682 - RNA, 16 nt, Homo sapiens
cuggccucagacucau

SEQ ID NO: 1782683 - RNA, 19 nt, Homo sapiens
aaucggcuggggacugcua

SEQ ID NO: 1782684 - RNA, 22 nt, Homo sapiens
uuuugcauuugaauaaagccug

SEQ ID NO: 1782685 - RNA, 14 nt, Homo sapiens
acaggcuucgucuc

SEQ ID NO: 1782686 - RNA, 19 nt, Homo sapiens
uccccugaugggcccugac

SEQ ID NO: 1782687 - RNA, 12 nt, Homo sapiens
gggaugggcucu

SEQ ID NO: 1782688 - RNA, 11 nt, Homo sapiens
agcaggcaugg

SEQ ID NO: 1782689 - RNA, 23 nt, Homo sapiens
ucacugguuugguucuggacuaa

SEQ ID NO: 1782690 - RNA, 18 nt, Homo sapiens
uugcucucggugcuucca

SEQ ID NO: 1782691 - RNA, 20 nt, Homo sapiens
auauuaaaagauuauaggaa

SEQ ID NO: 1782692 - RNA, 21 nt, Homo sapiens
aguggcuugugauucugggau

SEQ ID NO: 1782693 - RNA, 21 nt, Homo sapiens
gaccaggccuggagggcacuu

SEQ ID NO: 1782694 - RNA, 14 nt, Homo sapiens
auggcacaugucau

SEQ ID NO: 1782695 - RNA, 21 nt, Homo sapiens
uauacauaggcaucauuucac

SEQ ID NO: 1782696 - RNA, 18 nt, Homo sapiens
agaaaugagcugcacucc

SEQ ID NO: 1782697 - RNA, 22 nt, Homo sapiens
augcaaacugggaugaaacuaa

SEQ ID NO: 1782698 - RNA, 19 nt, Homo sapiens
uuuuaauuacugcuauaaa

SEQ ID NO: 1782699 - RNA, 12 nt, Homo sapiens
aaaccugugauc

SEQ ID NO: 1782700 - RNA, 12 nt, Homo sapiens
auuacuguguaa

SEQ ID NO: 1782701 - RNA, 17 nt, Homo sapiens
agagaggguggugaccu

SEQ ID NO: 1782702 - RNA, 19 nt, Homo sapiens
cugacacaccaggcgcuaa

SEQ ID NO: 1782703 - RNA, 21 nt, Homo sapiens
augugauuuaauaguguuaau

SEQ ID NO: 1782704 - RNA, 20 nt, Homo sapiens
uuuacuaucuuuucaucuca

SEQ ID NO: 1782705 - RNA, 15 nt, Homo sapiens
uggacuuucuugcaa

SEQ ID NO: 1782706 - RNA, 22 nt, Homo sapiens
uagccauuuuucaaagcaauug

SEQ ID NO: 1782707 - RNA, 19 nt, Homo sapiens
gaccaggauugcacugaca

SEQ ID NO: 1782708 - RNA, 15 nt, Homo sapiens
gaugggaccugauga

SEQ ID NO: 1782709 - RNA, 21 nt, Homo sapiens
uuacagaaucacagcccucau

SEQ ID NO: 1782710 - RNA, 18 nt, Homo sapiens
gauauucaggcuacucau

SEQ ID NO: 1782711 - RNA, 19 nt, Homo sapiens
augcuuauuguacuuguua

SEQ ID NO: 1782712 - RNA, 15 nt, Homo sapiens
aguaagauaucucaa

SEQ ID NO: 1782713 - RNA, 13 nt, Homo sapiens
ugagauaaaguca

SEQ ID NO: 1782714 - RNA, 17 nt, Homo sapiens
ccuuguaaaugcucuaa

SEQ ID NO: 1782715 - RNA, 20 nt, Homo sapiens
uauucagaacuuguaacuaa

SEQ ID NO: 1782716 - RNA, 17 nt, Homo sapiens
cggggauagaccaaaga

SEQ ID NO: 1782717 - RNA, 19 nt, Homo sapiens
ccugcagaggucugugcug

SEQ ID NO: 1782718 - RNA, 17 nt, Homo sapiens
uugaguagccagaugaa

SEQ ID NO: 1782719 - RNA, 15 nt, Homo sapiens
gccuuacacugaaaa

SEQ ID NO: 1782720 - RNA, 20 nt, Homo sapiens
acccaugagcguccagguga

SEQ ID NO: 1782721 - RNA, 13 nt, Homo sapiens
guacaaguggcuc

SEQ ID NO: 1782722 - RNA, 20 nt, Homo sapiens
aguuuuguuugcugcugugu

SEQ ID NO: 1782723 - RNA, 22 nt, Homo sapiens
uccucguugggccgcucugauu

SEQ ID NO: 1782724 - RNA, 21 nt, Homo sapiens
gccugcuuugugcaggguccu

SEQ ID NO: 1782725 - RNA, 18 nt, Homo sapiens
acagaaaacaucccacug

SEQ ID NO: 1782726 - RNA, 15 nt, Homo sapiens
ugggccacaacuguc

SEQ ID NO: 1782727 - RNA, 15 nt, Homo sapiens
uggaguuagaucucu

SEQ ID NO: 1782728 - RNA, 21 nt, Homo sapiens
acccuuuuacagucacauuca

SEQ ID NO: 1782729 - RNA, 19 nt, Homo sapiens
acauaauacauuaauacuu

SEQ ID NO: 1782730 - RNA, 17 nt, Homo sapiens
gacaacuucccaaagca

SEQ ID NO: 1782731 - RNA, 19 nt, Homo sapiens
auuuccuuuauuccuuuca

SEQ ID NO: 1782732 - RNA, 19 nt, Homo sapiens
aaauauauauauauauaca

SEQ ID NO: 1782733 - RNA, 19 nt, Homo sapiens
acccauggguccaugggaa

SEQ ID NO: 1782734 - RNA, 19 nt, Homo sapiens
accugagcagcaacugugu

SEQ ID NO: 1782735 - RNA, 20 nt, Homo sapiens
aauuucuggacuauccucuu

SEQ ID NO: 1782736 - RNA, 16 nt, Homo sapiens
augcaucuuguuucau

SEQ ID NO: 1782737 - RNA, 15 nt, Homo sapiens
gcuugacaacaucug

SEQ ID NO: 1782738 - RNA, 14 nt, Homo sapiens
aacugaagccacuu

SEQ ID NO: 1782739 - RNA, 14 nt, Homo sapiens
guuccugugaucuc

SEQ ID NO: 1782740 - RNA, 22 nt, Homo sapiens
gacaagugacuuauuugcucau

SEQ ID NO: 1782741 - RNA, 19 nt, Homo sapiens
agggagugugaugcaggaa

SEQ ID NO: 1782742 - RNA, 21 nt, Homo sapiens
uuccucaaauacaugcacagu

SEQ ID NO: 1782743 - RNA, 13 nt, Homo sapiens
agaagagauuucu

SEQ ID NO: 1782744 - RNA, 15 nt, Homo sapiens
cucuccuccucagcu

SEQ ID NO: 1782745 - RNA, 20 nt, Homo sapiens
gaugcugaggccacccacug

SEQ ID NO: 1782746 - RNA, 13 nt, Homo sapiens
ccuuguuuugcca

SEQ ID NO: 1782747 - RNA, 18 nt, Homo sapiens
uauuuuuauucaaacuac

SEQ ID NO: 1782748 - RNA, 18 nt, Homo sapiens
aauaaucauucuuauuuc

SEQ ID NO: 1782749 - RNA, 12 nt, Homo sapiens
cuggcuccaaac

SEQ ID NO: 1782750 - RNA, 15 nt, Homo sapiens
ggcuccggcacccac

SEQ ID NO: 1782751 - RNA, 14 nt, Homo sapiens
cucaaugcagucag

SEQ ID NO: 1782752 - RNA, 22 nt, Homo sapiens
ugaucaauucuuuaauuuugga

SEQ ID NO: 1782753 - RNA, 21 nt, Homo sapiens
caaauaggcaucaucaauaaa

SEQ ID NO: 1782754 - RNA, 20 nt, Homo sapiens
ggcuccaggagccucaucca

SEQ ID NO: 1782755 - RNA, 17 nt, Homo sapiens
aaaccguaauuuuauua

SEQ ID NO: 1782756 - RNA, 23 nt, Homo sapiens
gacuucagaauaacagcacguga

SEQ ID NO: 1782757 - RNA, 23 nt, Homo sapiens
cagucucuauaccaauaaaguga

SEQ ID NO: 1782758 - RNA, 19 nt, Homo sapiens
uugacaccugucuugaaua

SEQ ID NO: 1782759 - RNA, 14 nt, Homo sapiens
gaagucaucauucc

SEQ ID NO: 1782760 - RNA, 20 nt, Homo sapiens
ccccaggcacuuugcaucac

SEQ ID NO: 1782761 - RNA, 21 nt, Homo sapiens
augugcccaguuaaucuugcu

SEQ ID NO: 1782762 - RNA, 13 nt, Homo sapiens
uacauaaguaauu

SEQ ID NO: 1782763 - RNA, 16 nt, Homo sapiens
cagugagagacuccau

SEQ ID NO: 1782764 - RNA, 17 nt, Homo sapiens
auuacugcagacuauaa

SEQ ID NO: 1782765 - RNA, 17 nt, Homo sapiens
agcuacuauaaauauac

SEQ ID NO: 1782766 - RNA, 14 nt, Homo sapiens
acgggcugcguuua

SEQ ID NO: 1782767 - RNA, 13 nt, Homo sapiens
ugaacauuacauu

SEQ ID NO: 1782768 - RNA, 13 nt, Homo sapiens
accucauuugcau

SEQ ID NO: 1782769 - RNA, 19 nt, Homo sapiens
ccuaaguaaguuucuuccu

SEQ ID NO: 1782770 - RNA, 14 nt, Homo sapiens
gguaucuccaggau

SEQ ID NO: 1782771 - RNA, 15 nt, Homo sapiens
aaaguuccuuccuaa

SEQ ID NO: 1782772 - RNA, 14 nt, Homo sapiens
ccagauugcucugc

SEQ ID NO: 1782773 - RNA, 13 nt, Homo sapiens
acagaacuucaga

SEQ ID NO: 1782774 - RNA, 21 nt, Homo sapiens
cccugagcucuugcuaucucu

SEQ ID NO: 1782775 - RNA, 22 nt, Homo sapiens
agguuuuucaucugaaaagcag

SEQ ID NO: 1782776 - RNA, 18 nt, Homo sapiens
ggaacauuccaaauauuc

SEQ ID NO: 1782777 - RNA, 17 nt, Homo sapiens
uaauuagcuucaggaua

SEQ ID NO: 1782778 - RNA, 12 nt, Homo sapiens
agcucacaaaua

SEQ ID NO: 1782779 - RNA, 22 nt, Homo sapiens
aaguuuuccuuuuguuuuccac

SEQ ID NO: 1782780 - RNA, 18 nt, Homo sapiens
gcuuaccugaacaggaau

SEQ ID NO: 1782781 - RNA, 17 nt, Homo sapiens
acuaaauaaacaucuga

SEQ ID NO: 1782782 - RNA, 11 nt, Homo sapiens
agcacaguccc

SEQ ID NO: 1782783 - RNA, 13 nt, Homo sapiens
agcaauguaaaaa

SEQ ID NO: 1782784 - RNA, 13 nt, Homo sapiens
ugaaauguuacaa

SEQ ID NO: 1782785 - RNA, 14 nt, Homo sapiens
acaaauacaugugu

SEQ ID NO: 1782786 - RNA, 14 nt, Homo sapiens
ucaccaugaaagaa

SEQ ID NO: 1782787 - RNA, 18 nt, Homo sapiens
cagauaaauuaugguaaa

SEQ ID NO: 1782788 - RNA, 15 nt, Homo sapiens
cuuuuuucuaguaca

SEQ ID NO: 1782789 - RNA, 13 nt, Homo sapiens
ccaacacacagga

SEQ ID NO: 1782790 - RNA, 11 nt, Homo sapiens
uagaaaguaaa

SEQ ID NO: 1782791 - RNA, 12 nt, Homo sapiens
ugcuccuuccaa

SEQ ID NO: 1782792 - RNA, 16 nt, Homo sapiens
agccagccggugccug

SEQ ID NO: 1782793 - RNA, 23 nt, Homo sapiens
auaaggggucaaaauuugcugcc

SEQ ID NO: 1782794 - RNA, 18 nt, Homo sapiens
cugauagccuaguuaaau

SEQ ID NO: 1782795 - RNA, 14 nt, Homo sapiens
aaaauguacauguu

SEQ ID NO: 1782796 - RNA, 10 nt, Homo sapiens
gcuuccucua

SEQ ID NO: 1782797 - RNA, 14 nt, Homo sapiens
cuccugaauucagu

SEQ ID NO: 1782798 - RNA, 18 nt, Homo sapiens
cagggcauucuguuggcc

SEQ ID NO: 1782799 - RNA, 15 nt, Homo sapiens
uuggugaauuucaca

SEQ ID NO: 1782800 - RNA, 20 nt, Homo sapiens
aagcaacccaguccccaacc

SEQ ID NO: 1782801 - RNA, 19 nt, Homo sapiens
auuuaagcaauaaaacugc

SEQ ID NO: 1782802 - RNA, 20 nt, Homo sapiens
cuuccagggcucuuccagau

SEQ ID NO: 1782803 - RNA, 18 nt, Homo sapiens
ccucugucucauccuccu

SEQ ID NO: 1782804 - RNA, 23 nt, Homo sapiens
ucuaaaacuaaauagcauguauu

SEQ ID NO: 1782805 - RNA, 21 nt, Homo sapiens
gagccuaaaaauaaagcacaa

SEQ ID NO: 1782806 - RNA, 13 nt, Homo sapiens
caugguaucucuu

SEQ ID NO: 1782807 - RNA, 12 nt, Homo sapiens
ucauugcaaagu

SEQ ID NO: 1782808 - RNA, 20 nt, Homo sapiens
aauuagaaauuuauauguca

SEQ ID NO: 1782809 - RNA, 17 nt, Homo sapiens
aaaacucucaagcagac

SEQ ID NO: 1782810 - RNA, 14 nt, Homo sapiens
cauaaaauguuaag

SEQ ID NO: 1782811 - RNA, 15 nt, Homo sapiens
cuuaaaaacuuccau

SEQ ID NO: 1782812 - RNA, 15 nt, Homo sapiens
uagaaauauagccaa

SEQ ID NO: 1782813 - RNA, 14 nt, Homo sapiens
ucccuugcuguaug

SEQ ID NO: 1782814 - RNA, 16 nt, Homo sapiens
ccucucgcauggugug

SEQ ID NO: 1782815 - RNA, 18 nt, Homo sapiens
cuaaaagaauugugacau

SEQ ID NO: 1782816 - RNA, 16 nt, Homo sapiens
ccauucccccaugugg

SEQ ID NO: 1782817 - RNA, 12 nt, Homo sapiens
auaaaacuauua

SEQ ID NO: 1782818 - RNA, 12 nt, Homo sapiens
uauaaacuuaaa

SEQ ID NO: 1782819 - RNA, 15 nt, Homo sapiens
cguuuugguuuucaa

SEQ ID NO: 1782820 - RNA, 19 nt, Homo sapiens
ccucccuguaaugcacucc

SEQ ID NO: 1782821 - RNA, 17 nt, Homo sapiens
gaaauuccucuguagaa

SEQ ID NO: 1782822 - RNA, 17 nt, Homo sapiens
cuuuuaaugcuucauuc

SEQ ID NO: 1782823 - RNA, 23 nt, Homo sapiens
guguuuuuaaagaaaagcauuca

SEQ ID NO: 1782824 - RNA, 20 nt, Homo sapiens
ugcuuuauaccccauuugau

SEQ ID NO: 1782825 - RNA, 12 nt, Homo sapiens
acuccuugccau

SEQ ID NO: 1782826 - RNA, 18 nt, Homo sapiens
aauuugcauugugucaga

SEQ ID NO: 1782827 - RNA, 14 nt, Homo sapiens
gugaggaccugaca

SEQ ID NO: 1782828 - RNA, 13 nt, Homo sapiens
uuuccacacagcc

SEQ ID NO: 1782829 - RNA, 17 nt, Homo sapiens
ucucagcuccgucaucu

SEQ ID NO: 1782830 - RNA, 23 nt, Homo sapiens
gacuuggcaggugccuguugaau

SEQ ID NO: 1782831 - RNA, 15 nt, Homo sapiens
ugaacugggcauuuc

SEQ ID NO: 1782832 - RNA, 22 nt, Homo sapiens
cuuccugcaaagggaacugaag

SEQ ID NO: 1782833 - RNA, 19 nt, Homo sapiens
uacauuaaagcagucacuu

SEQ ID NO: 1782834 - RNA, 15 nt, Homo sapiens
gaucuccccacucua

SEQ ID NO: 1782835 - RNA, 19 nt, Homo sapiens
ucacagcagugagacuggg

SEQ ID NO: 1782836 - RNA, 23 nt, Homo sapiens
uagacugccgugcauuagcacag

SEQ ID NO: 1782837 - RNA, 23 nt, Homo sapiens
ugcaagguuccacagaguaagac

SEQ ID NO: 1782838 - RNA, 16 nt, Homo sapiens
cugaaaacagucccag

SEQ ID NO: 1782839 - RNA, 23 nt, Homo sapiens
cuccuggaagugcuaauuuugaa

SEQ ID NO: 1782840 - RNA, 21 nt, Homo sapiens
cuucuuggucucagugucaau

SEQ ID NO: 1782841 - RNA, 17 nt, Homo sapiens
cuuuuaaaauaaauucu

SEQ ID NO: 1782842 - RNA, 18 nt, Homo sapiens
gaaguguaagaaacacac

SEQ ID NO: 1782843 - RNA, 16 nt, Homo sapiens
aacagcuggacacccc

SEQ ID NO: 1782844 - RNA, 15 nt, Homo sapiens
cugugaauaaagcca

SEQ ID NO: 1782845 - RNA, 21 nt, Homo sapiens
agggaccucuccaugauccca

SEQ ID NO: 1782846 - RNA, 22 nt, Homo sapiens
uugaucuuuugcuaaugcaauu

SEQ ID NO: 1782847 - RNA, 15 nt, Homo sapiens
acaguagaacugucu

SEQ ID NO: 1782848 - RNA, 11 nt, Homo sapiens
uuuaagcucaa

SEQ ID NO: 1782849 - RNA, 11 nt, Homo sapiens
caaaagcuuuu

SEQ ID NO: 1782850 - RNA, 15 nt, Homo sapiens
cuuucugcacauaag

SEQ ID NO: 1782851 - RNA, 23 nt, Homo sapiens
aauauuuucaaagagacuaugau

SEQ ID NO: 1782852 - RNA, 18 nt, Homo sapiens
cuugaucagugugcuaac

SEQ ID NO: 1782853 - RNA, 11 nt, Homo sapiens
uugaacacugc

SEQ ID NO: 1782854 - RNA, 17 nt, Homo sapiens
gccucagggccaggaag

SEQ ID NO: 1782855 - RNA, 13 nt, Homo sapiens
caucaggacucug

SEQ ID NO: 1782856 - RNA, 19 nt, Homo sapiens
cuuugcuuuacagcacugu

SEQ ID NO: 1782857 - RNA, 22 nt, Homo sapiens
ucaaaggagagucaacauaugu

SEQ ID NO: 1782858 - RNA, 20 nt, Homo sapiens
cuaacauccuuggacugaga

SEQ ID NO: 1782859 - RNA, 23 nt, Homo sapiens
ggacucaaugcacugacauuguu

SEQ ID NO: 1782860 - RNA, 19 nt, Homo sapiens
agccuuaaauccuuuacaa

SEQ ID NO: 1782861 - RNA, 16 nt, Homo sapiens
gaauauuccuggacuu

SEQ ID NO: 1782862 - RNA, 17 nt, Homo sapiens
uggcaccugcacacucc

SEQ ID NO: 1782863 - RNA, 16 nt, Homo sapiens
gcggcagcauggagcu

SEQ ID NO: 1782864 - RNA, 17 nt, Homo sapiens
ccgacuccucaaaagca

SEQ ID NO: 1782865 - RNA, 22 nt, Homo sapiens
cuccaccgaccaacugcccuaa

SEQ ID NO: 1782866 - RNA, 17 nt, Homo sapiens
ugcuuugggucauaaau

SEQ ID NO: 1782867 - RNA, 14 nt, Homo sapiens
ucucaucaguccau

SEQ ID NO: 1782868 - RNA, 19 nt, Homo sapiens
cauuuucagucuuguagug

SEQ ID NO: 1782869 - RNA, 13 nt, Homo sapiens
ucaauaagccagc

SEQ ID NO: 1782870 - RNA, 20 nt, Homo sapiens
auuggggguuggccauuuau

SEQ ID NO: 1782871 - RNA, 14 nt, Homo sapiens
cucccacuauggug

SEQ ID NO: 1782872 - RNA, 23 nt, Homo sapiens
uugugguugaaaaccacagucag

SEQ ID NO: 1782873 - RNA, 15 nt, Homo sapiens
ucuguaaacuuacua

SEQ ID NO: 1782874 - RNA, 20 nt, Homo sapiens
caucugcaguggagccugaa

SEQ ID NO: 1782875 - RNA, 14 nt, Homo sapiens
caguuggugcugcu

SEQ ID NO: 1782876 - RNA, 15 nt, Homo sapiens
cagcacugacuggaa

SEQ ID NO: 1782877 - RNA, 14 nt, Homo sapiens
uccaacccagccac

SEQ ID NO: 1782878 - RNA, 22 nt, Homo sapiens
gugauucuguuuauucuuccag

SEQ ID NO: 1782879 - RNA, 21 nt, Homo sapiens
aaggagugagugaaacuccca

SEQ ID NO: 1782880 - RNA, 17 nt, Homo sapiens
augaggaaacuacugaa

SEQ ID NO: 1782881 - RNA, 14 nt, Homo sapiens
gaaagaaguaggca

SEQ ID NO: 1782882 - RNA, 17 nt, Homo sapiens
aacuaugagcuugcuca

SEQ ID NO: 1782883 - RNA, 21 nt, Homo sapiens
caaauuuggguauagacaaua

SEQ ID NO: 1782884 - RNA, 14 nt, Homo sapiens
gucagcacauguug

SEQ ID NO: 1782885 - RNA, 9 nt, Homo sapiens
cgugcaaua

SEQ ID NO: 1782886 - RNA, 17 nt, Homo sapiens
cugcuuaaaaauguagc

SEQ ID NO: 1782887 - RNA, 14 nt, Homo sapiens
aggaccaaggagau

SEQ ID NO: 1782888 - RNA, 17 nt, Homo sapiens
uuucaagcuucacauuu

SEQ ID NO: 1782889 - RNA, 17 nt, Homo sapiens
ugggauuacaaauagaa

SEQ ID NO: 1782890 - RNA, 12 nt, Homo sapiens
gugccacuggua

SEQ ID NO: 1782891 - RNA, 18 nt, Homo sapiens
uauuaaaaauagauauau

SEQ ID NO: 1782892 - RNA, 18 nt, Homo sapiens
cuauuuuauuuguauuca

SEQ ID NO: 1782893 - RNA, 16 nt, Homo sapiens
cucugagaucaugagu

SEQ ID NO: 1782894 - RNA, 15 nt, Homo sapiens
ugccuggcaaggccu

SEQ ID NO: 1782895 - RNA, 17 nt, Homo sapiens
acucugagaucuaagga

SEQ ID NO: 1782896 - RNA, 23 nt, Homo sapiens
ccaccaaaggagacauaucacug

SEQ ID NO: 1782897 - RNA, 18 nt, Homo sapiens
ccaggcccgagaugugac

SEQ ID NO: 1782898 - RNA, 18 nt, Homo sapiens
ggaaagcagucuguucug

SEQ ID NO: 1782899 - RNA, 21 nt, Homo sapiens
cagcgggaucucguaucuuua

SEQ ID NO: 1782900 - RNA, 17 nt, Homo sapiens
aaauuccuuuucccgaa

SEQ ID NO: 1782901 - RNA, 21 nt, Homo sapiens
ggcagcaugcgaugucauauu

SEQ ID NO: 1782902 - RNA, 17 nt, Homo sapiens
aaccauaaacuguacaa

SEQ ID NO: 1782903 - RNA, 18 nt, Homo sapiens
ugcacaauaauaagucca

SEQ ID NO: 1782904 - RNA, 19 nt, Homo sapiens
aguaaguuuauccaaaucu

SEQ ID NO: 1782905 - RNA, 20 nt, Homo sapiens
caguguuaaaugugaugaau

SEQ ID NO: 1782906 - RNA, 11 nt, Homo sapiens
uugcugucaca

SEQ ID NO: 1782907 - RNA, 14 nt, Homo sapiens
aggcauuucuauca

SEQ ID NO: 1782908 - RNA, 19 nt, Homo sapiens
ucaggaaaggaagauguaa

SEQ ID NO: 1782909 - RNA, 22 nt, Homo sapiens
ucaugcccagcuuggagugcca

SEQ ID NO: 1782910 - RNA, 21 nt, Homo sapiens
caccccuucuccaucuuuggg

SEQ ID NO: 1782911 - RNA, 23 nt, Homo sapiens
uucuccucccuguuaucugcuag

SEQ ID NO: 1782912 - RNA, 14 nt, Homo sapiens
cuuuguaggugucu

SEQ ID NO: 1782913 - RNA, 14 nt, Homo sapiens
caaggaaagccagg

SEQ ID NO: 1782914 - RNA, 16 nt, Homo sapiens
auguaaggccuuucaa

SEQ ID NO: 1782915 - RNA, 15 nt, Homo sapiens
aaucuguagucacuu

SEQ ID NO: 1782916 - RNA, 15 nt, Homo sapiens
aucaggaaacucaaa

SEQ ID NO: 1782917 - RNA, 21 nt, Homo sapiens
caugaggccuuuccccagugu

SEQ ID NO: 1782918 - RNA, 19 nt, Homo sapiens
aaugguggaguguagccuc

SEQ ID NO: 1782919 - RNA, 13 nt, Homo sapiens
ggcggugagcaau

SEQ ID NO: 1782920 - RNA, 20 nt, Homo sapiens
ucgccaaccgcaucugcuca

SEQ ID NO: 1782921 - RNA, 13 nt, Homo sapiens
cucaacugaggau

SEQ ID NO: 1782922 - RNA, 13 nt, Homo sapiens
cugcucugagcca

SEQ ID NO: 1782923 - RNA, 18 nt, Homo sapiens
ucucucugccauggccuu

SEQ ID NO: 1782924 - RNA, 15 nt, Homo sapiens
gccaacccuguguca

SEQ ID NO: 1782925 - RNA, 24 nt, Homo sapiens
uagggagaccauuaacuaguuuau

SEQ ID NO: 1782926 - RNA, 20 nt, Homo sapiens
auuucuuaccaugcauuucu

SEQ ID NO: 1782927 - RNA, 19 nt, Homo sapiens
aagucuuccugaccaccuu

SEQ ID NO: 1782928 - RNA, 18 nt, Homo sapiens
cuuucaacagaauucacu

SEQ ID NO: 1782929 - RNA, 11 nt, Homo sapiens
aguauuuccau

SEQ ID NO: 1782930 - RNA, 13 nt, Homo sapiens
auuagaccaagcu

SEQ ID NO: 1782931 - RNA, 16 nt, Homo sapiens
uucaaucaacaucucu

SEQ ID NO: 1782932 - RNA, 12 nt, Homo sapiens
uuuugugucugu

SEQ ID NO: 1782933 - RNA, 18 nt, Homo sapiens
gugcagacagugucagag

SEQ ID NO: 1782934 - RNA, 15 nt, Homo sapiens
gacaauuaucaacca

SEQ ID NO: 1782935 - RNA, 20 nt, Homo sapiens
ggcaugagccacugugcuug

SEQ ID NO: 1782936 - RNA, 22 nt, Homo sapiens
aacgcagauugggcuggcucug

SEQ ID NO: 1782937 - RNA, 20 nt, Homo sapiens
uuucuucccccccaagauag

SEQ ID NO: 1782938 - RNA, 12 nt, Homo sapiens
caugaagcccaa

SEQ ID NO: 1782939 - RNA, 19 nt, Homo sapiens
auaaaggaaacccagcuca

SEQ ID NO: 1782940 - RNA, 20 nt, Homo sapiens
ugggguuuuaguauguguca

SEQ ID NO: 1782941 - RNA, 14 nt, Homo sapiens
acaacaaccuaugc

SEQ ID NO: 1782942 - RNA, 19 nt, Homo sapiens
uauaggcaccuaccaccac

SEQ ID NO: 1782943 - RNA, 19 nt, Homo sapiens
gaguguuccugugcuuaua

SEQ ID NO: 1782944 - RNA, 13 nt, Homo sapiens
agcuuagcuacaa

SEQ ID NO: 1782945 - RNA, 15 nt, Homo sapiens
gaaaaauguucuaua

SEQ ID NO: 1782946 - RNA, 13 nt, Homo sapiens
agaccaucuuugc

SEQ ID NO: 1782947 - RNA, 14 nt, Homo sapiens
gacugaauuacucu

SEQ ID NO: 1782948 - RNA, 20 nt, Homo sapiens
agcacguggagcucuuggcu

SEQ ID NO: 1782949 - RNA, 13 nt, Homo sapiens
ccaguggcugcug

SEQ ID NO: 1782950 - RNA, 22 nt, Homo sapiens
acagccaugauucuuuugccca

SEQ ID NO: 1782951 - RNA, 12 nt, Homo sapiens
caagaugaaaca

SEQ ID NO: 1782952 - RNA, 19 nt, Homo sapiens
uauguugcaaaauauauca

SEQ ID NO: 1782953 - RNA, 19 nt, Homo sapiens
gugaaagaugcaagcaccu

SEQ ID NO: 1782954 - RNA, 9 nt, Homo sapiens
uguaugugu

SEQ ID NO: 1782955 - RNA, 18 nt, Homo sapiens
uaaauaaaguaucaugca

SEQ ID NO: 1782956 - RNA, 20 nt, Homo sapiens
ccagcguucuucaggagaug

SEQ ID NO: 1782957 - RNA, 19 nt, Homo sapiens
gaacucagcugucuguggc

SEQ ID NO: 1782958 - RNA, 16 nt, Homo sapiens
caugguuugacucugg

SEQ ID NO: 1782959 - RNA, 13 nt, Homo sapiens
uccgccuaccuca

SEQ ID NO: 1782960 - RNA, 16 nt, Homo sapiens
aagggcaucauccuca

SEQ ID NO: 1782961 - RNA, 17 nt, Homo sapiens
ccaagugaggccauagc

SEQ ID NO: 1782962 - RNA, 20 nt, Homo sapiens
acaguaugauggaacaguga

SEQ ID NO: 1782963 - RNA, 17 nt, Homo sapiens
ucuguccccuucucuca

SEQ ID NO: 1782964 - RNA, 13 nt, Homo sapiens
gaagggcgcagga

SEQ ID NO: 1782965 - RNA, 14 nt, Homo sapiens
acgaucgcugugaa

SEQ ID NO: 1782966 - RNA, 14 nt, Homo sapiens
ggaucuccugucca

SEQ ID NO: 1782967 - RNA, 19 nt, Homo sapiens
accuugcagcuaaauguga

SEQ ID NO: 1782968 - RNA, 19 nt, Homo sapiens
cgcccuugagcuacuucaa

SEQ ID NO: 1782969 - RNA, 19 nt, Homo sapiens
ucaacacaaagacacagga

SEQ ID NO: 1782970 - RNA, 12 nt, Homo sapiens
uguaauaccaga

SEQ ID NO: 1782971 - RNA, 16 nt, Homo sapiens
ugcagucccacacugu

SEQ ID NO: 1782972 - RNA, 23 nt, Homo sapiens
aacgugaggaagcaagugacaag

SEQ ID NO: 1782973 - RNA, 14 nt, Homo sapiens
gcuaccugcugagc

SEQ ID NO: 1782974 - RNA, 16 nt, Homo sapiens
gugcgcucugccauuc

SEQ ID NO: 1782975 - RNA, 15 nt, Homo sapiens
ucaacaauuuaucca

SEQ ID NO: 1782976 - RNA, 16 nt, Homo sapiens
ggaucuggccacagac

SEQ ID NO: 1782977 - RNA, 12 nt, Homo sapiens
cucagaugucca

SEQ ID NO: 1782978 - RNA, 19 nt, Homo sapiens
aauaugagauaaugcaguc

SEQ ID NO: 1782979 - RNA, 13 nt, Homo sapiens
aaaaaugagcucg

SEQ ID NO: 1782980 - RNA, 15 nt, Homo sapiens
cugagaauguggaau

SEQ ID NO: 1782981 - RNA, 22 nt, Homo sapiens
cuggcuguuuagcagaacucau

SEQ ID NO: 1782982 - RNA, 17 nt, Homo sapiens
guggccuugaccuccaa

SEQ ID NO: 1782983 - RNA, 16 nt, Homo sapiens
auucucauuugucaca

SEQ ID NO: 1782984 - RNA, 19 nt, Homo sapiens
cacggccccggguccagga

SEQ ID NO: 1782985 - RNA, 20 nt, Homo sapiens
aaguacaaaaggaacuauga

SEQ ID NO: 1782986 - RNA, 18 nt, Homo sapiens
acaagugggugaaugugg

SEQ ID NO: 1782987 - RNA, 17 nt, Homo sapiens
aggaguguccugcccau

SEQ ID NO: 1782988 - RNA, 17 nt, Homo sapiens
cauuuuuuucacuggag

SEQ ID NO: 1782989 - RNA, 22 nt, Homo sapiens
uuggaacuugccugccuuucca

SEQ ID NO: 1782990 - RNA, 15 nt, Homo sapiens
gcacaauaugggcac

SEQ ID NO: 1782991 - RNA, 17 nt, Homo sapiens
ucuuaugccugucuuua

SEQ ID NO: 1782992 - RNA, 16 nt, Homo sapiens
uaggagacacagggaa

SEQ ID NO: 1782993 - RNA, 14 nt, Homo sapiens
agaaccaagcuuca

SEQ ID NO: 1782994 - RNA, 21 nt, Homo sapiens
ggcccugggccuccaccucug

SEQ ID NO: 1782995 - RNA, 18 nt, Homo sapiens
uaccaaagaagaguuuac

SEQ ID NO: 1782996 - RNA, 21 nt, Homo sapiens
aagagagaucuugauccacag

SEQ ID NO: 1782997 - RNA, 16 nt, Homo sapiens
cugggagacugaagac

SEQ ID NO: 1782998 - RNA, 19 nt, Homo sapiens
gagaucuauauauguauaa

SEQ ID NO: 1782999 - RNA, 23 nt, Homo sapiens
ggugcucauucauuuaacagagc

SEQ ID NO: 1783000 - RNA, 16 nt, Homo sapiens
aacuacugccauuuca

SEQ ID NO: 1783001 - RNA, 16 nt, Homo sapiens
ccuuauuugcacuuca

SEQ ID NO: 1783002 - RNA, 17 nt, Homo sapiens
aggcaagccccucagcc

SEQ ID NO: 1783003 - RNA, 11 nt, Homo sapiens
gugaugccuga

SEQ ID NO: 1783004 - RNA, 15 nt, Homo sapiens
cugccgcuaccuccc

SEQ ID NO: 1783005 - RNA, 16 nt, Homo sapiens
aaauaucuucacuugu

SEQ ID NO: 1783006 - RNA, 20 nt, Homo sapiens
ucacccaggcuggacugcaa

SEQ ID NO: 1783007 - RNA, 18 nt, Homo sapiens
ucuguuuaucaagccaua

SEQ ID NO: 1783008 - RNA, 9 nt, Homo sapiens
auguugaaa

SEQ ID NO: 1783009 - RNA, 23 nt, Homo sapiens
ccucuuuaaucaugaaacaccuu

SEQ ID NO: 1783010 - RNA, 21 nt, Homo sapiens
ugaccccauuccugaucccau

SEQ ID NO: 1783011 - RNA, 17 nt, Homo sapiens
agauuagaugugccaau

SEQ ID NO: 1783012 - RNA, 14 nt, Homo sapiens
ugguauccaaguua

SEQ ID NO: 1783013 - RNA, 12 nt, Homo sapiens
ugacaugugcuu

SEQ ID NO: 1783014 - RNA, 16 nt, Homo sapiens
agaagcucuggcccca

SEQ ID NO: 1783015 - RNA, 23 nt, Homo sapiens
auaucauucacccaaaacaaagu

SEQ ID NO: 1783016 - RNA, 19 nt, Homo sapiens
uccaauuauuugacuuuaa

SEQ ID NO: 1783017 - RNA, 20 nt, Homo sapiens
uacccuuggcaguguggcag

SEQ ID NO: 1783018 - RNA, 17 nt, Homo sapiens
agagacccucucagccc

SEQ ID NO: 1783019 - RNA, 15 nt, Homo sapiens
ucuugaauagucuca

SEQ ID NO: 1783020 - RNA, 19 nt, Homo sapiens
ggcauuagcuaaaaccuuc

SEQ ID NO: 1783021 - RNA, 17 nt, Homo sapiens
uuaaagguacuuugcag

SEQ ID NO: 1783022 - RNA, 20 nt, Homo sapiens
acugccuucgcuucuugccu

SEQ ID NO: 1783023 - RNA, 15 nt, Homo sapiens
cugucaaaacacugu

SEQ ID NO: 1783024 - RNA, 13 nt, Homo sapiens
aggcagcccagcu

SEQ ID NO: 1783025 - RNA, 23 nt, Homo sapiens
auuuagauauucauacuuuccaa

SEQ ID NO: 1783026 - RNA, 22 nt, Homo sapiens
aagggacaaaagguacugguga

SEQ ID NO: 1783027 - RNA, 19 nt, Homo sapiens
ugacccuggucaccagagg

SEQ ID NO: 1783028 - RNA, 16 nt, Homo sapiens
cauuugaguucaggag

SEQ ID NO: 1783029 - RNA, 14 nt, Homo sapiens
uccugugucagaaa

SEQ ID NO: 1783030 - RNA, 17 nt, Homo sapiens
cauucacccagacagcu

SEQ ID NO: 1783031 - RNA, 16 nt, Homo sapiens
ccagcgcagcgccagg

SEQ ID NO: 1783032 - RNA, 15 nt, Homo sapiens
uuucggaauuccugc

SEQ ID NO: 1783033 - RNA, 14 nt, Homo sapiens
uuagauucuguaug

SEQ ID NO: 1783034 - RNA, 18 nt, Homo sapiens
gucuuccuugaccaaagc

SEQ ID NO: 1783035 - RNA, 20 nt, Homo sapiens
acuuaguuauuucugccuau

SEQ ID NO: 1783036 - RNA, 18 nt, Homo sapiens
gagagguagguggaucca

SEQ ID NO: 1783037 - RNA, 17 nt, Homo sapiens
gggaugagcaugcuguu

SEQ ID NO: 1783038 - RNA, 17 nt, Homo sapiens
aauuggagcucauuuuc

SEQ ID NO: 1783039 - RNA, 22 nt, Homo sapiens
cugggauuacaggcaugugcca

SEQ ID NO: 1783040 - RNA, 22 nt, Homo sapiens
cagggauuacaggcaugagcca

SEQ ID NO: 1783041 - RNA, 13 nt, Homo sapiens
gcacuugaccuca

SEQ ID NO: 1783042 - RNA, 19 nt, Homo sapiens
augcaaaugagcucugaaa

SEQ ID NO: 1783043 - RNA, 20 nt, Homo sapiens
auucauguucaugugauuaa

SEQ ID NO: 1783044 - RNA, 23 nt, Homo sapiens
aauaaaugaucuagauauuuucc

SEQ ID NO: 1783045 - RNA, 18 nt, Homo sapiens
ccugaaaaggguguugcu

SEQ ID NO: 1783046 - RNA, 19 nt, Homo sapiens
uuaguucugcugucucccu

SEQ ID NO: 1783047 - RNA, 22 nt, Homo sapiens
uacugcugucauuguccaugcc

SEQ ID NO: 1783048 - RNA, 14 nt, Homo sapiens
gagaugaggugcuc

SEQ ID NO: 1783049 - RNA, 19 nt, Homo sapiens
agcagcuuuaaacucaggg

SEQ ID NO: 1783050 - RNA, 14 nt, Homo sapiens
cauccuuguaauac

SEQ ID NO: 1783051 - RNA, 12 nt, Homo sapiens
cacuagcauuuu

SEQ ID NO: 1783052 - RNA, 22 nt, Homo sapiens
uaaaauccccaugccuguggcu

SEQ ID NO: 1783053 - RNA, 12 nt, Homo sapiens
gagaacaggacu

SEQ ID NO: 1783054 - RNA, 22 nt, Homo sapiens
uaguuugauacucccagucuug

SEQ ID NO: 1783055 - RNA, 21 nt, Homo sapiens
cagcugguguagcuacagaga

SEQ ID NO: 1783056 - RNA, 16 nt, Homo sapiens
ugacauauacuaaaua

SEQ ID NO: 1783057 - RNA, 13 nt, Homo sapiens
augcugcagugag

SEQ ID NO: 1783058 - RNA, 18 nt, Homo sapiens
ucugcuucucuuucacaa

SEQ ID NO: 1783059 - RNA, 18 nt, Homo sapiens
guaaaaaaaccaccaaaa

SEQ ID NO: 1783060 - RNA, 13 nt, Homo sapiens
accaagagcaauu

SEQ ID NO: 1783061 - RNA, 16 nt, Homo sapiens
aggcuggagagcacug

SEQ ID NO: 1783062 - RNA, 17 nt, Homo sapiens
auuauugugacuucacu

SEQ ID NO: 1783063 - RNA, 20 nt, Homo sapiens
uaaaccuucagaagcuauuu

SEQ ID NO: 1783064 - RNA, 18 nt, Homo sapiens
ccucauaggcuucuggga

SEQ ID NO: 1783065 - RNA, 16 nt, Homo sapiens
cagccuucuccaggac

SEQ ID NO: 1783066 - RNA, 21 nt, Homo sapiens
ugcugccccuugcaagccaua

SEQ ID NO: 1783067 - RNA, 13 nt, Homo sapiens
aacagcuacaaac

SEQ ID NO: 1783068 - RNA, 22 nt, Homo sapiens
uggaaauggccaccaccauucu

SEQ ID NO: 1783069 - RNA, 20 nt, Homo sapiens
guuccucaacccucucaagu

SEQ ID NO: 1783070 - RNA, 16 nt, Homo sapiens
ugaaaccuguacauau

SEQ ID NO: 1783071 - RNA, 13 nt, Homo sapiens
agcccaccccuca

SEQ ID NO: 1783072 - RNA, 17 nt, Homo sapiens
cuuauugaacauucuag

SEQ ID NO: 1783073 - RNA, 17 nt, Homo sapiens
augcacagagauaugca

SEQ ID NO: 1783074 - RNA, 13 nt, Homo sapiens
caguccaaauggc

SEQ ID NO: 1783075 - RNA, 19 nt, Homo sapiens
auauuaguuaaucuccuca

SEQ ID NO: 1783076 - RNA, 20 nt, Homo sapiens
auaagccuuuuuaaccuucc

SEQ ID NO: 1783077 - RNA, 20 nt, Homo sapiens
cacgaguuuggauguuguaa

SEQ ID NO: 1783078 - RNA, 22 nt, Homo sapiens
ucacccggaucccuccucacuu

SEQ ID NO: 1783079 - RNA, 16 nt, Homo sapiens
ggaaucuacaacuguu

SEQ ID NO: 1783080 - RNA, 16 nt, Homo sapiens
gaaaguaacugugaga

SEQ ID NO: 1783081 - RNA, 16 nt, Homo sapiens
agagauuccugagcca

SEQ ID NO: 1783082 - RNA, 22 nt, Homo sapiens
guggcucaugccuguaauccca

SEQ ID NO: 1783083 - RNA, 15 nt, Homo sapiens
cgauucacuguauaa

SEQ ID NO: 1783084 - RNA, 14 nt, Homo sapiens
ccuggucaggguga

SEQ ID NO: 1783085 - RNA, 16 nt, Homo sapiens
gauggauuggccucca

SEQ ID NO: 1783086 - RNA, 19 nt, Homo sapiens
uuuauauguugcuauaaua

SEQ ID NO: 1783087 - RNA, 14 nt, Homo sapiens
aguuagguuuaaca

SEQ ID NO: 1783088 - RNA, 17 nt, Homo sapiens
ugaaaagggacugugag

SEQ ID NO: 1783089 - RNA, 14 nt, Homo sapiens
aucuuaagauucca

SEQ ID NO: 1783090 - RNA, 17 nt, Homo sapiens
gggcaacgacgguuuca

SEQ ID NO: 1783091 - RNA, 13 nt, Homo sapiens
gacucugaacaau

SEQ ID NO: 1783092 - RNA, 10 nt, Homo sapiens
ccaacagcac

SEQ ID NO: 1783093 - RNA, 12 nt, Homo sapiens
caacaguuccuu

SEQ ID NO: 1783094 - RNA, 13 nt, Homo sapiens
uauuuaagggugc

SEQ ID NO: 1783095 - RNA, 18 nt, Homo sapiens
ugagguuuuuaacaugua

SEQ ID NO: 1783096 - RNA, 24 nt, Homo sapiens
cugcaccgagagagauggaauaaa

SEQ ID NO: 1783097 - RNA, 17 nt, Homo sapiens
uaugcuuuagaacuuuu

SEQ ID NO: 1783098 - RNA, 14 nt, Homo sapiens
uauuacuugcucca

SEQ ID NO: 1783099 - RNA, 22 nt, Homo sapiens
uccucuuuaacaagggcugcaa

SEQ ID NO: 1783100 - RNA, 12 nt, Homo sapiens
agguauacaaaa

SEQ ID NO: 1783101 - RNA, 16 nt, Homo sapiens
acuguaauuugugaua

SEQ ID NO: 1783102 - RNA, 17 nt, Homo sapiens
uaauacuguauugcugu

SEQ ID NO: 1783103 - RNA, 16 nt, Homo sapiens
uccuuugaacuuugaa

SEQ ID NO: 1783104 - RNA, 13 nt, Homo sapiens
uccaaugagcuuu

SEQ ID NO: 1783105 - RNA, 18 nt, Homo sapiens
uuaucuagagaauacaaa

SEQ ID NO: 1783106 - RNA, 14 nt, Homo sapiens
acuuccccuugucu

SEQ ID NO: 1783107 - RNA, 21 nt, Homo sapiens
cccagggauuaggagcagcuc

SEQ ID NO: 1783108 - RNA, 21 nt, Homo sapiens
cucuuaauagcuauacauuaa

SEQ ID NO: 1783109 - RNA, 18 nt, Homo sapiens
ugagaaacucuacaugua

SEQ ID NO: 1783110 - RNA, 15 nt, Homo sapiens
uuccccaaccacaga

SEQ ID NO: 1783111 - RNA, 16 nt, Homo sapiens
ccauuacaaaauccaa

SEQ ID NO: 1783112 - RNA, 14 nt, Homo sapiens
ugauuuccagugag

SEQ ID NO: 1783113 - RNA, 17 nt, Homo sapiens
gaaaauaaaugguuuca

SEQ ID NO: 1783114 - RNA, 14 nt, Homo sapiens
gagauggccaugua

SEQ ID NO: 1783115 - RNA, 18 nt, Homo sapiens
aaaucuuugugaacauuc

SEQ ID NO: 1783116 - RNA, 15 nt, Homo sapiens
gcauuugauuuccau

SEQ ID NO: 1783117 - RNA, 13 nt, Homo sapiens
cccucugcuaaag

SEQ ID NO: 1783118 - RNA, 18 nt, Homo sapiens
guuguaggguuacagaga

SEQ ID NO: 1783119 - RNA, 13 nt, Homo sapiens
cccagauuucagg

SEQ ID NO: 1783120 - RNA, 12 nt, Homo sapiens
agauuagcuuuu

SEQ ID NO: 1783121 - RNA, 21 nt, Homo sapiens
cuggaucccgagguauggcag

SEQ ID NO: 1783122 - RNA, 19 nt, Homo sapiens
ggccuccagcccucucacu

SEQ ID NO: 1783123 - RNA, 17 nt, Homo sapiens
acauauaucaaagugag

SEQ ID NO: 1783124 - RNA, 11 nt, Homo sapiens
ugcaaaaucac

SEQ ID NO: 1783125 - RNA, 23 nt, Homo sapiens
agcuguauaauuaauugucauua

SEQ ID NO: 1783126 - RNA, 14 nt, Homo sapiens
uugucugugcagcu

SEQ ID NO: 1783127 - RNA, 17 nt, Homo sapiens
cagccugaccaacaugg

SEQ ID NO: 1783128 - RNA, 17 nt, Homo sapiens
cugauguagcuuauaca

SEQ ID NO: 1783129 - RNA, 16 nt, Homo sapiens
gcuagagccucugccu

SEQ ID NO: 1783130 - RNA, 19 nt, Homo sapiens
aauaagcguuuaaugguau

SEQ ID NO: 1783131 - RNA, 22 nt, Homo sapiens
uuccaguguccuuagaacauuu

SEQ ID NO: 1783132 - RNA, 21 nt, Homo sapiens
aaaacaaugguguggugaaug

SEQ ID NO: 1783133 - RNA, 14 nt, Homo sapiens
cuuauuucccucau

SEQ ID NO: 1783134 - RNA, 14 nt, Homo sapiens
acgcuuucaugaau

SEQ ID NO: 1783135 - RNA, 13 nt, Homo sapiens
agagaaaauaauu

SEQ ID NO: 1783136 - RNA, 18 nt, Homo sapiens
accuuaagauuuugcacc

SEQ ID NO: 1783137 - RNA, 16 nt, Homo sapiens
accauaugcuguggac

SEQ ID NO: 1783138 - RNA, 17 nt, Homo sapiens
uaaaguuagggcauuuu

SEQ ID NO: 1783139 - RNA, 11 nt, Homo sapiens
accuccuguca

SEQ ID NO: 1783140 - RNA, 15 nt, Homo sapiens
ucucaacagaauuaa

SEQ ID NO: 1783141 - RNA, 17 nt, Homo sapiens
acaaccgguaaccaaag

SEQ ID NO: 1783142 - RNA, 15 nt, Homo sapiens
uggaguucuuacuug

SEQ ID NO: 1783143 - RNA, 20 nt, Homo sapiens
aaaacucagaaugaaaauuc

SEQ ID NO: 1783144 - RNA, 15 nt, Homo sapiens
ggugcugccccauga

SEQ ID NO: 1783145 - RNA, 14 nt, Homo sapiens
aaaagcacaaagac

SEQ ID NO: 1783146 - RNA, 14 nt, Homo sapiens
ccagggacccaaag

SEQ ID NO: 1783147 - RNA, 16 nt, Homo sapiens
caguaguaucaaauga

SEQ ID NO: 1783148 - RNA, 18 nt, Homo sapiens
uaucacgggucacuugaa

SEQ ID NO: 1783149 - RNA, 22 nt, Homo sapiens
cagaaagccucagaguccugcc

SEQ ID NO: 1783150 - RNA, 19 nt, Homo sapiens
uucuucaggguccugagau

SEQ ID NO: 1783151 - RNA, 18 nt, Homo sapiens
ugccugcaggcaugaguc

SEQ ID NO: 1783152 - RNA, 20 nt, Homo sapiens
aggucaccuuuauucuggca

SEQ ID NO: 1783153 - RNA, 16 nt, Homo sapiens
uggcacugacagccug

SEQ ID NO: 1783154 - RNA, 22 nt, Homo sapiens
gcagaggauaauuagcaucuca

SEQ ID NO: 1783155 - RNA, 18 nt, Homo sapiens
ucccucaggggcaggugg

SEQ ID NO: 1783156 - RNA, 14 nt, Homo sapiens
uaugaccauaaaau

SEQ ID NO: 1783157 - RNA, 23 nt, Homo sapiens
agcuuuccuuguuagaaugcaag

SEQ ID NO: 1783158 - RNA, 14 nt, Homo sapiens
uggccgcugcccac

SEQ ID NO: 1783159 - RNA, 21 nt, Homo sapiens
agagguuugucaacacaaaga

SEQ ID NO: 1783160 - RNA, 17 nt, Homo sapiens
uucauuuuguggcaaaa

SEQ ID NO: 1783161 - RNA, 18 nt, Homo sapiens
caucaauuggguuuugau

SEQ ID NO: 1783162 - RNA, 16 nt, Homo sapiens
cucuccuuccucagaa

SEQ ID NO: 1783163 - RNA, 14 nt, Homo sapiens
agugcuguuucccg

SEQ ID NO: 1783164 - RNA, 22 nt, Homo sapiens
acagacaaagcgugguggacau

SEQ ID NO: 1783165 - RNA, 22 nt, Homo sapiens
aguacuuggguuugcaacagcu

SEQ ID NO: 1783166 - RNA, 14 nt, Homo sapiens
auaaauguauucaa

SEQ ID NO: 1783167 - RNA, 17 nt, Homo sapiens
uucauguaaagugucag

SEQ ID NO: 1783168 - RNA, 22 nt, Homo sapiens
gcccccacugucccccuaccca

SEQ ID NO: 1783169 - RNA, 17 nt, Homo sapiens
guucauuuuagugacug

SEQ ID NO: 1783170 - RNA, 12 nt, Homo sapiens
ccauuauacuuu

SEQ ID NO: 1783171 - RNA, 12 nt, Homo sapiens
ggagaugcuucu

SEQ ID NO: 1783172 - RNA, 16 nt, Homo sapiens
uuauuuccuaaucaaa

SEQ ID NO: 1783173 - RNA, 23 nt, Homo sapiens
gggccgaguaccuuaaucugcca

SEQ ID NO: 1783174 - RNA, 16 nt, Homo sapiens
uacacaaaccugaaaa

SEQ ID NO: 1783175 - RNA, 11 nt, Homo sapiens
ucucaaucucc

SEQ ID NO: 1783176 - RNA, 15 nt, Homo sapiens
cuuuucagauugugg

SEQ ID NO: 1783177 - RNA, 20 nt, Homo sapiens
acugcuguucauguuacuca

SEQ ID NO: 1783178 - RNA, 18 nt, Homo sapiens
gguaauuaguaacaugug

SEQ ID NO: 1783179 - RNA, 14 nt, Homo sapiens
ggaugguugaauga

SEQ ID NO: 1783180 - RNA, 19 nt, Homo sapiens
acauagauuaauggcacug

SEQ ID NO: 1783181 - RNA, 19 nt, Homo sapiens
uggagagaagcaagccagc

SEQ ID NO: 1783182 - RNA, 17 nt, Homo sapiens
cacaccuuuuauugaca

SEQ ID NO: 1783183 - RNA, 16 nt, Homo sapiens
ccagugccaaacuugg

SEQ ID NO: 1783184 - RNA, 13 nt, Homo sapiens
aauguugcaugac

SEQ ID NO: 1783185 - RNA, 16 nt, Homo sapiens
ugcugcuaaaugggac

SEQ ID NO: 1783186 - RNA, 11 nt, Homo sapiens
uuuauuacaaa

SEQ ID NO: 1783187 - RNA, 15 nt, Homo sapiens
augaggauauggcag

SEQ ID NO: 1783188 - RNA, 19 nt, Homo sapiens
ugccuggggccucaccugc

SEQ ID NO: 1783189 - RNA, 22 nt, Homo sapiens
cuggagggccaggggaguggag

SEQ ID NO: 1783190 - RNA, 22 nt, Homo sapiens
ggcaggaaaaggugauauccau

SEQ ID NO: 1783191 - RNA, 20 nt, Homo sapiens
agagggcaagccucuagugu

SEQ ID NO: 1783192 - RNA, 21 nt, Homo sapiens
gggggagggugugagcacgga

SEQ ID NO: 1783193 - RNA, 23 nt, Homo sapiens
ggaaucuagaagaaaugaaauuu

SEQ ID NO: 1783194 - RNA, 20 nt, Homo sapiens
ucucauguuugugcauguau

SEQ ID NO: 1783195 - RNA, 21 nt, Homo sapiens
cuaugauguugcuguucacag

SEQ ID NO: 1783196 - RNA, 22 nt, Homo sapiens
auuccaaucauuguuaaaguaa

SEQ ID NO: 1783197 - RNA, 15 nt, Homo sapiens
aggaugcccacuucc

SEQ ID NO: 1783198 - RNA, 16 nt, Homo sapiens
ccccaacauugagaug

SEQ ID NO: 1783199 - RNA, 23 nt, Homo sapiens
cuccaccuacaccccugugcucc

SEQ ID NO: 1783200 - RNA, 15 nt, Homo sapiens
augcagaacagugag

SEQ ID NO: 1783201 - RNA, 16 nt, Homo sapiens
augaaaauguucugaa

SEQ ID NO: 1783202 - RNA, 16 nt, Homo sapiens
cgucuuuagaugcuau

SEQ ID NO: 1783203 - RNA, 17 nt, Homo sapiens
agcagcugaaaauuuau

SEQ ID NO: 1783204 - RNA, 22 nt, Homo sapiens
aagcuuguguaucuugauuaau

SEQ ID NO: 1783205 - RNA, 23 nt, Homo sapiens
uuaucauggagaacagcaugaca

SEQ ID NO: 1783206 - RNA, 17 nt, Homo sapiens
auuuaguaaaguuuguu

SEQ ID NO: 1783207 - RNA, 20 nt, Homo sapiens
ugcuuucccauaucuugccu

SEQ ID NO: 1783208 - RNA, 14 nt, Homo sapiens
aaauuuaaguuuau

SEQ ID NO: 1783209 - RNA, 16 nt, Homo sapiens
cagucacauggcaugg

SEQ ID NO: 1783210 - RNA, 21 nt, Homo sapiens
ccugccugugcuauuuuacuu

SEQ ID NO: 1783211 - RNA, 11 nt, Homo sapiens
uccuugcaaau

SEQ ID NO: 1783212 - RNA, 14 nt, Homo sapiens
caugguuacauauc

SEQ ID NO: 1783213 - RNA, 19 nt, Homo sapiens
caaaaugauacuuacugaa

SEQ ID NO: 1783214 - RNA, 17 nt, Homo sapiens
cuacaggugcaagccac

SEQ ID NO: 1783215 - RNA, 22 nt, Homo sapiens
auacuugagcgcugcugaaaag

SEQ ID NO: 1783216 - RNA, 23 nt, Homo sapiens
gacaaugaugugaguacccagga

SEQ ID NO: 1783217 - RNA, 19 nt, Homo sapiens
aucgauggaugggaugcac

SEQ ID NO: 1783218 - RNA, 17 nt, Homo sapiens
uccuaauuuugaccugu

SEQ ID NO: 1783219 - RNA, 13 nt, Homo sapiens
cccuuuucagggc

SEQ ID NO: 1783220 - RNA, 18 nt, Homo sapiens
augaaguuuugauuuauu

SEQ ID NO: 1783221 - RNA, 18 nt, Homo sapiens
auuguguaauugauuuau

SEQ ID NO: 1783222 - RNA, 15 nt, Homo sapiens
auuucaauaacuuag

SEQ ID NO: 1783223 - RNA, 18 nt, Homo sapiens
aguucagacucuaacuuc

SEQ ID NO: 1783224 - RNA, 19 nt, Homo sapiens
ucaacugaaaaaaacauau

SEQ ID NO: 1783225 - RNA, 22 nt, Homo sapiens
gaacucuggggagccugagcca

SEQ ID NO: 1783226 - RNA, 14 nt, Homo sapiens
auagagugucucag

SEQ ID NO: 1783227 - RNA, 19 nt, Homo sapiens
caccaugacaccugccaua

SEQ ID NO: 1783228 - RNA, 21 nt, Homo sapiens
aggcggggaggaggagcugcc

SEQ ID NO: 1783229 - RNA, 21 nt, Homo sapiens
uuauuuuuucgugcacucugc

SEQ ID NO: 1783230 - RNA, 19 nt, Homo sapiens
uucuuuaaauuucaucuca

SEQ ID NO: 1783231 - RNA, 17 nt, Homo sapiens
caaagcauuucuagucc

SEQ ID NO: 1783232 - RNA, 15 nt, Homo sapiens
uuaaccugcaugcag

SEQ ID NO: 1783233 - RNA, 21 nt, Homo sapiens
ccaacaugaaaacaauucuua

SEQ ID NO: 1783234 - RNA, 16 nt, Homo sapiens
cacgagcccauucuca

SEQ ID NO: 1783235 - RNA, 22 nt, Homo sapiens
aggugcaggggaagaccaaagu

SEQ ID NO: 1783236 - RNA, 13 nt, Homo sapiens
uacauuaucucac

SEQ ID NO: 1783237 - RNA, 16 nt, Homo sapiens
agccaaacucugccag

SEQ ID NO: 1783238 - RNA, 22 nt, Homo sapiens
uaccugagugacggcaaccugc

SEQ ID NO: 1783239 - RNA, 15 nt, Homo sapiens
auauacaauaacaua

SEQ ID NO: 1783240 - RNA, 22 nt, Homo sapiens
cuucaaaagccauaacuugaaa

SEQ ID NO: 1783241 - RNA, 17 nt, Homo sapiens
cuuaaaucugugaagua

SEQ ID NO: 1783242 - RNA, 16 nt, Homo sapiens
caggccuuggggacaa

SEQ ID NO: 1783243 - RNA, 21 nt, Homo sapiens
ugcugggccucauucuagcac

SEQ ID NO: 1783244 - RNA, 18 nt, Homo sapiens
gacucacugggaagcucc

SEQ ID NO: 1783245 - RNA, 16 nt, Homo sapiens
caaagagcacauuuac

SEQ ID NO: 1783246 - RNA, 21 nt, Homo sapiens
uagucacugucucaacuacuc

SEQ ID NO: 1783247 - RNA, 14 nt, Homo sapiens
auucugaguauuca

SEQ ID NO: 1783248 - RNA, 17 nt, Homo sapiens
guaaaacuuauauuaaa

SEQ ID NO: 1783249 - RNA, 13 nt, Homo sapiens
guacuaccccagg

SEQ ID NO: 1783250 - RNA, 12 nt, Homo sapiens
acacuucugggc

SEQ ID NO: 1783251 - RNA, 22 nt, Homo sapiens
uugagcacacuuuacacaagaa

SEQ ID NO: 1783252 - RNA, 12 nt, Homo sapiens
uuuuggcuucug

SEQ ID NO: 1783253 - RNA, 12 nt, Homo sapiens
ccacgucuuccu

SEQ ID NO: 1783254 - RNA, 13 nt, Homo sapiens
uugucccaaugaa

SEQ ID NO: 1783255 - RNA, 12 nt, Homo sapiens
guguguguaaca

SEQ ID NO: 1783256 - RNA, 13 nt, Homo sapiens
gaacucagaucca

SEQ ID NO: 1783257 - RNA, 23 nt, Homo sapiens
uauauaguggguacaucaagucc

SEQ ID NO: 1783258 - RNA, 15 nt, Homo sapiens
uaaaaaagcauauau

SEQ ID NO: 1783259 - RNA, 23 nt, Homo sapiens
cauaguacuggcacaaaaacaca

SEQ ID NO: 1783260 - RNA, 13 nt, Homo sapiens
ccugggcucugga

SEQ ID NO: 1783261 - RNA, 13 nt, Homo sapiens
ucauaagauauuu

SEQ ID NO: 1783262 - RNA, 13 nt, Homo sapiens
accugccuucuac

SEQ ID NO: 1783263 - RNA, 14 nt, Homo sapiens
aucagcacaaagac

SEQ ID NO: 1783264 - RNA, 13 nt, Homo sapiens
aaaaaagauuucc

SEQ ID NO: 1783265 - RNA, 15 nt, Homo sapiens
auauguugacuuuau

SEQ ID NO: 1783266 - RNA, 20 nt, Homo sapiens
uggagcauuggcugagagac

SEQ ID NO: 1783267 - RNA, 23 nt, Homo sapiens
cuagacugacccugaucagucua

SEQ ID NO: 1783268 - RNA, 17 nt, Homo sapiens
ugauccucacugagaag

SEQ ID NO: 1783269 - RNA, 22 nt, Homo sapiens
auuaaaagcaaggcucaaggga

SEQ ID NO: 1783270 - RNA, 16 nt, Homo sapiens
gaaauguaacauacuc

SEQ ID NO: 1783271 - RNA, 19 nt, Homo sapiens
uaauaucaugugcacuuca

SEQ ID NO: 1783272 - RNA, 16 nt, Homo sapiens
aauacuuaacauugau

SEQ ID NO: 1783273 - RNA, 12 nt, Homo sapiens
uagcugucacau

SEQ ID NO: 1783274 - RNA, 15 nt, Homo sapiens
aagugagggcucacu

SEQ ID NO: 1783275 - RNA, 21 nt, Homo sapiens
caggaacagagacucuggaag

SEQ ID NO: 1783276 - RNA, 19 nt, Homo sapiens
uaguauacuuucaucuaaa

SEQ ID NO: 1783277 - RNA, 14 nt, Homo sapiens
gugcacucugcuaa

SEQ ID NO: 1783278 - RNA, 20 nt, Homo sapiens
auucuaaauccgacuugaau

SEQ ID NO: 1783279 - RNA, 23 nt, Homo sapiens
gccuaguaagggaacuauggaaa

SEQ ID NO: 1783280 - RNA, 20 nt, Homo sapiens
ccagugcauguugccaugag

SEQ ID NO: 1783281 - RNA, 23 nt, Homo sapiens
ggcgacuccccaacggcuacuac

SEQ ID NO: 1783282 - RNA, 20 nt, Homo sapiens
cuacuccccagaccucaggg

SEQ ID NO: 1783283 - RNA, 13 nt, Homo sapiens
gccucugugcaca

SEQ ID NO: 1783284 - RNA, 16 nt, Homo sapiens
caaggcaggugccucc

SEQ ID NO: 1783285 - RNA, 15 nt, Homo sapiens
ucuucauuucaggaa

SEQ ID NO: 1783286 - RNA, 22 nt, Homo sapiens
caagagcacuaggauugugaua

SEQ ID NO: 1783287 - RNA, 13 nt, Homo sapiens
gcaacaaacacau

SEQ ID NO: 1783288 - RNA, 23 nt, Homo sapiens
cauuucuaacauaaguaagacuu

SEQ ID NO: 1783289 - RNA, 21 nt, Homo sapiens
gcuucuggggacaccucagga

SEQ ID NO: 1783290 - RNA, 11 nt, Homo sapiens
aaauucuugag

SEQ ID NO: 1783291 - RNA, 15 nt, Homo sapiens
acacagugacuuccu

SEQ ID NO: 1783292 - RNA, 15 nt, Homo sapiens
aaauagagaauccca

SEQ ID NO: 1783293 - RNA, 22 nt, Homo sapiens
aaugaaacauccuaugaaauac

SEQ ID NO: 1783294 - RNA, 16 nt, Homo sapiens
cugugaauuagcucac

SEQ ID NO: 1783295 - RNA, 17 nt, Homo sapiens
accuuaaucugccauaa

SEQ ID NO: 1783296 - RNA, 17 nt, Homo sapiens
cacaaaagucucaaugu

SEQ ID NO: 1783297 - RNA, 18 nt, Homo sapiens
auccugcagauacuuuga

SEQ ID NO: 1783298 - RNA, 17 nt, Homo sapiens
ccucuuucuacagccua

SEQ ID NO: 1783299 - RNA, 16 nt, Homo sapiens
uccacaaaucaucugu

SEQ ID NO: 1783300 - RNA, 17 nt, Homo sapiens
aggacccauaugggaau

SEQ ID NO: 1783301 - RNA, 16 nt, Homo sapiens
uuaggauggggcuccc

SEQ ID NO: 1783302 - RNA, 16 nt, Homo sapiens
cuuaaccccucugagc

SEQ ID NO: 1783303 - RNA, 12 nt, Homo sapiens
ggcauacuuucu

SEQ ID NO: 1783304 - RNA, 17 nt, Homo sapiens
caaaucagucagugcaa

SEQ ID NO: 1783305 - RNA, 15 nt, Homo sapiens
gacacacggucaggg

SEQ ID NO: 1783306 - RNA, 16 nt, Homo sapiens
cugcugaggacaaugu

SEQ ID NO: 1783307 - RNA, 14 nt, Homo sapiens
ccuaccacauucac

SEQ ID NO: 1783308 - RNA, 19 nt, Homo sapiens
auuuauuagcagaaaugua

SEQ ID NO: 1783309 - RNA, 18 nt, Homo sapiens
ucaacccuggcuugucua

SEQ ID NO: 1783310 - RNA, 21 nt, Homo sapiens
uaauuucugaaaugugcagcu

SEQ ID NO: 1783311 - RNA, 17 nt, Homo sapiens
uauagacauucucacau

SEQ ID NO: 1783312 - RNA, 18 nt, Homo sapiens
cuuuaauuuuuauaaaua

SEQ ID NO: 1783313 - RNA, 23 nt, Homo sapiens
uugccuucugguuucuuccagcc

SEQ ID NO: 1783314 - RNA, 13 nt, Homo sapiens
augacaaagccau

SEQ ID NO: 1783315 - RNA, 19 nt, Homo sapiens
gugaguccccuacucccuc

SEQ ID NO: 1783316 - RNA, 22 nt, Homo sapiens
uuguaauacuuucuaugugaca

SEQ ID NO: 1783317 - RNA, 14 nt, Homo sapiens
uucuuuuacuguaa

SEQ ID NO: 1783318 - RNA, 16 nt, Homo sapiens
agauggggacagguga

SEQ ID NO: 1783319 - RNA, 10 nt, Homo sapiens
cacacugucu

SEQ ID NO: 1783320 - RNA, 20 nt, Homo sapiens
aggccagcuaucugccugac

SEQ ID NO: 1783321 - RNA, 18 nt, Homo sapiens
cugaaugugccuaaugga

SEQ ID NO: 1783322 - RNA, 22 nt, Homo sapiens
cugggcagaggaaagcaaagga

SEQ ID NO: 1783323 - RNA, 15 nt, Homo sapiens
uucuucccuagcuua

SEQ ID NO: 1783324 - RNA, 19 nt, Homo sapiens
auccaguuuaaucuucaca

SEQ ID NO: 1783325 - RNA, 20 nt, Homo sapiens
uaauuguugaccuaagaaua

SEQ ID NO: 1783326 - RNA, 16 nt, Homo sapiens
aaccauuuuuuccuac

SEQ ID NO: 1783327 - RNA, 22 nt, Homo sapiens
ucccagcacuuugggaggccaa

SEQ ID NO: 1783328 - RNA, 13 nt, Homo sapiens
ccagacccggcug

SEQ ID NO: 1783329 - RNA, 15 nt, Homo sapiens
aaggcugaugcauuc

SEQ ID NO: 1783330 - RNA, 20 nt, Homo sapiens
gguuuugcuuuagagugcaa

SEQ ID NO: 1783331 - RNA, 22 nt, Homo sapiens
agacugggcccaugaacacaga

SEQ ID NO: 1783332 - RNA, 14 nt, Homo sapiens
ccguuuccaaauac

SEQ ID NO: 1783333 - RNA, 12 nt, Homo sapiens
aaguuauagcuu

SEQ ID NO: 1783334 - RNA, 14 nt, Homo sapiens
aaguuuugcugucu

SEQ ID NO: 1783335 - RNA, 21 nt, Homo sapiens
cuguauguuauccacuacagg

SEQ ID NO: 1783336 - RNA, 16 nt, Homo sapiens
agauuaauggcacuga

SEQ ID NO: 1783337 - RNA, 13 nt, Homo sapiens
agucagcucucuc

SEQ ID NO: 1783338 - RNA, 13 nt, Homo sapiens
aauucuaugcaau

SEQ ID NO: 1783339 - RNA, 20 nt, Homo sapiens
uaaccuggagacaguaacau

SEQ ID NO: 1783340 - RNA, 14 nt, Homo sapiens
aaggauagaagcug

SEQ ID NO: 1783341 - RNA, 18 nt, Homo sapiens
gaaguaaaguuucugaua

SEQ ID NO: 1783342 - RNA, 23 nt, Homo sapiens
ucugaagacucaggcagagcagc

SEQ ID NO: 1783343 - RNA, 17 nt, Homo sapiens
augaaugcuauuuucaa

SEQ ID NO: 1783344 - RNA, 14 nt, Homo sapiens
uugguugugauuga

SEQ ID NO: 1783345 - RNA, 14 nt, Homo sapiens
cucuggguggggcu

SEQ ID NO: 1783346 - RNA, 16 nt, Homo sapiens
cuaguucuguagaaau

SEQ ID NO: 1783347 - RNA, 17 nt, Homo sapiens
ucacaaguagccucugg

SEQ ID NO: 1783348 - RNA, 21 nt, Homo sapiens
cuuccucugcagaauaaaauc

SEQ ID NO: 1783349 - RNA, 17 nt, Homo sapiens
uacugcccugagccuga

SEQ ID NO: 1783350 - RNA, 13 nt, Homo sapiens
aagacaaaugaca

SEQ ID NO: 1783351 - RNA, 14 nt, Homo sapiens
uuaggcagggauuu

SEQ ID NO: 1783352 - RNA, 19 nt, Homo sapiens
cacuguguacaccucugga

SEQ ID NO: 1783353 - RNA, 19 nt, Homo sapiens
ugcuacaaaaaaguagcaa

SEQ ID NO: 1783354 - RNA, 16 nt, Homo sapiens
uguauuaaaagauucc

SEQ ID NO: 1783355 - RNA, 23 nt, Homo sapiens
auccauuuguuuucacacugaua

SEQ ID NO: 1783356 - RNA, 16 nt, Homo sapiens
ggagggcgguggacaa

SEQ ID NO: 1783357 - RNA, 22 nt, Homo sapiens
agaagacagcagcaagugugcu

SEQ ID NO: 1783358 - RNA, 15 nt, Homo sapiens
aguuaguuccacuga

SEQ ID NO: 1783359 - RNA, 19 nt, Homo sapiens
uuguaauauuuuccauaaa

SEQ ID NO: 1783360 - RNA, 16 nt, Homo sapiens
cgggguugucugcagg

SEQ ID NO: 1783361 - RNA, 15 nt, Homo sapiens
ccaggcuggagugaa

SEQ ID NO: 1783362 - RNA, 16 nt, Homo sapiens
caaugcuccaucccaa

SEQ ID NO: 1783363 - RNA, 20 nt, Homo sapiens
cuuugaccuaaauuauuuac

SEQ ID NO: 1783364 - RNA, 21 nt, Homo sapiens
gggaccugcucuuaaccucaa

SEQ ID NO: 1783365 - RNA, 16 nt, Homo sapiens
uaagggagacaggccu

SEQ ID NO: 1783366 - RNA, 17 nt, Homo sapiens
cucagcuuuauaacaaa

SEQ ID NO: 1783367 - RNA, 19 nt, Homo sapiens
aagcaccuuuagaauauua

SEQ ID NO: 1783368 - RNA, 23 nt, Homo sapiens
auucaucuguugacaauuugcca

SEQ ID NO: 1783369 - RNA, 18 nt, Homo sapiens
aagaauucuguacuucca

SEQ ID NO: 1783370 - RNA, 15 nt, Homo sapiens
agaguuuagcuggaa

SEQ ID NO: 1783371 - RNA, 20 nt, Homo sapiens
gaaugugggcuauguaguca

SEQ ID NO: 1783372 - RNA, 21 nt, Homo sapiens
gagggaggcgcugcugguguu

SEQ ID NO: 1783373 - RNA, 23 nt, Homo sapiens
uggccuggcugcugcugugcagu

SEQ ID NO: 1783374 - RNA, 22 nt, Homo sapiens
ggaaguccuugcccacuuccca

SEQ ID NO: 1783375 - RNA, 20 nt, Homo sapiens
aacagaggcaggaguggcag

SEQ ID NO: 1783376 - RNA, 20 nt, Homo sapiens
uaagguugucuacgggggca

SEQ ID NO: 1783377 - RNA, 17 nt, Homo sapiens
aagugucaucacuuuua

SEQ ID NO: 1783378 - RNA, 19 nt, Homo sapiens
uauagcucaugugcauuau

SEQ ID NO: 1783379 - RNA, 22 nt, Homo sapiens
agauagcauuggggacauggga

SEQ ID NO: 1783380 - RNA, 19 nt, Homo sapiens
agaucuaccugcaacacaa

SEQ ID NO: 1783381 - RNA, 11 nt, Homo sapiens
ugcaguacuca

SEQ ID NO: 1783382 - RNA, 22 nt, Homo sapiens
guacugaaauaaugaucuugga

SEQ ID NO: 1783383 - RNA, 18 nt, Homo sapiens
cccaucacggagggucca

SEQ ID NO: 1783384 - RNA, 17 nt, Homo sapiens
guuccaaauacugcuua

SEQ ID NO: 1783385 - RNA, 15 nt, Homo sapiens
gaaagaaaaauggau

SEQ ID NO: 1783386 - RNA, 23 nt, Homo sapiens
ucugccucugcagcccacugccu

SEQ ID NO: 1783387 - RNA, 23 nt, Homo sapiens
uucaucucuuguuuacgauuuca

SEQ ID NO: 1783388 - RNA, 18 nt, Homo sapiens
gcaaaggcucucacucca

SEQ ID NO: 1783389 - RNA, 20 nt, Homo sapiens
uuacaauaauucuaugagau

SEQ ID NO: 1783390 - RNA, 22 nt, Homo sapiens
aauuggucacuuuccuauuaca

SEQ ID NO: 1783391 - RNA, 18 nt, Homo sapiens
ccauguaucaauauucac

SEQ ID NO: 1783392 - RNA, 18 nt, Homo sapiens
auguacuucagugcaccu

SEQ ID NO: 1783393 - RNA, 21 nt, Homo sapiens
gucccuuccuauucuccugcc

SEQ ID NO: 1783394 - RNA, 21 nt, Homo sapiens
uugagguuguucaaaguuuaa

SEQ ID NO: 1783395 - RNA, 15 nt, Homo sapiens
ugcaguucaguucuu

SEQ ID NO: 1783396 - RNA, 17 nt, Homo sapiens
acaccucugucccucaa

SEQ ID NO: 1783397 - RNA, 22 nt, Homo sapiens
ucuccuguauuuaacaaaaagu

SEQ ID NO: 1783398 - RNA, 14 nt, Homo sapiens
gagcucaaacuggc

SEQ ID NO: 1783399 - RNA, 23 nt, Homo sapiens
cucuguuacuccauuacugugau

SEQ ID NO: 1783400 - RNA, 18 nt, Homo sapiens
gcauuuccuggucagugg

SEQ ID NO: 1783401 - RNA, 14 nt, Homo sapiens
cuugcagagcauga

SEQ ID NO: 1783402 - RNA, 14 nt, Homo sapiens
gccuagcgaucucu

SEQ ID NO: 1783403 - RNA, 21 nt, Homo sapiens
acacaaauucagucucugaau

SEQ ID NO: 1783404 - RNA, 12 nt, Homo sapiens
aggaaacauauu

SEQ ID NO: 1783405 - RNA, 16 nt, Homo sapiens
aaugugguuggucaaa

SEQ ID NO: 1783406 - RNA, 21 nt, Homo sapiens
ucugaacaauauauacuuaua

SEQ ID NO: 1783407 - RNA, 18 nt, Homo sapiens
gggcccacccacaugacu

SEQ ID NO: 1783408 - RNA, 21 nt, Homo sapiens
cuagcucuccauacuuugaac

SEQ ID NO: 1783409 - RNA, 12 nt, Homo sapiens
cuagacuauaaa

SEQ ID NO: 1783410 - RNA, 21 nt, Homo sapiens
aguuacucccuacacugaugc

SEQ ID NO: 1783411 - RNA, 20 nt, Homo sapiens
cucacacuacuguauuucau

SEQ ID NO: 1783412 - RNA, 15 nt, Homo sapiens
ccauggcccaucacu

SEQ ID NO: 1783413 - RNA, 23 nt, Homo sapiens
gggagaccgaguguggagcugcu

SEQ ID NO: 1783414 - RNA, 13 nt, Homo sapiens
ggauaagccacug

SEQ ID NO: 1783415 - RNA, 21 nt, Homo sapiens
uccaggguauggccauggagu

SEQ ID NO: 1783416 - RNA, 18 nt, Homo sapiens
ccuguaagucaaaugugu

SEQ ID NO: 1783417 - RNA, 19 nt, Homo sapiens
cuauuuuuguagaugcuau

SEQ ID NO: 1783418 - RNA, 12 nt, Homo sapiens
uuugugaucugu

SEQ ID NO: 1783419 - RNA, 16 nt, Homo sapiens
cuucagauugaacuua

SEQ ID NO: 1783420 - RNA, 16 nt, Homo sapiens
cuacaugccaugccua

SEQ ID NO: 1783421 - RNA, 15 nt, Homo sapiens
guaaaauaacaucag

SEQ ID NO: 1783422 - RNA, 20 nt, Homo sapiens
gcccacugccgaugcccaau

SEQ ID NO: 1783423 - RNA, 12 nt, Homo sapiens
ugcuccaucuca

SEQ ID NO: 1783424 - RNA, 17 nt, Homo sapiens
aagugaguuuguaaaua

SEQ ID NO: 1783425 - RNA, 12 nt, Homo sapiens
auuuucuaugcu

SEQ ID NO: 1783426 - RNA, 23 nt, Homo sapiens
gcugaugucaaugcuauggacug

SEQ ID NO: 1783427 - RNA, 14 nt, Homo sapiens
uuuaaaaagucaau

SEQ ID NO: 1783428 - RNA, 16 nt, Homo sapiens
cacugcaaaguuuucu

SEQ ID NO: 1783429 - RNA, 13 nt, Homo sapiens
gcgcuucugggaa

SEQ ID NO: 1783430 - RNA, 14 nt, Homo sapiens
ucacuggagucucc

SEQ ID NO: 1783431 - RNA, 17 nt, Homo sapiens
acuuuuuacccagaaca

SEQ ID NO: 1783432 - RNA, 19 nt, Homo sapiens
gcaauaaaaccaagugcuu

SEQ ID NO: 1783433 - RNA, 20 nt, Homo sapiens
auugcagauucgagucacgu

SEQ ID NO: 1783434 - RNA, 12 nt, Homo sapiens
gaacagagcaag

SEQ ID NO: 1783435 - RNA, 21 nt, Homo sapiens
accaugucguaguuacucuca

SEQ ID NO: 1783436 - RNA, 13 nt, Homo sapiens
caguugauuucca

SEQ ID NO: 1783437 - RNA, 15 nt, Homo sapiens
uagguuggacuggaa

SEQ ID NO: 1783438 - RNA, 20 nt, Homo sapiens
cauagcaauuccccuacauc

SEQ ID NO: 1783439 - RNA, 17 nt, Homo sapiens
gaauguuuacacucuuu

SEQ ID NO: 1783440 - RNA, 16 nt, Homo sapiens
ggaguucuuuggcucu

SEQ ID NO: 1783441 - RNA, 13 nt, Homo sapiens
ucaaugggaccug

SEQ ID NO: 1783442 - RNA, 14 nt, Homo sapiens
auuuggacaaucug

SEQ ID NO: 1783443 - RNA, 15 nt, Homo sapiens
uguuccagacauucu

SEQ ID NO: 1783444 - RNA, 14 nt, Homo sapiens
auuucaauaacuua

SEQ ID NO: 1783445 - RNA, 19 nt, Homo sapiens
auaaacacauacauugcca

SEQ ID NO: 1783446 - RNA, 22 nt, Homo sapiens
cuaaggagaagcuaauaugauu

SEQ ID NO: 1783447 - RNA, 17 nt, Homo sapiens
caacauggcccuaccag

SEQ ID NO: 1783448 - RNA, 14 nt, Homo sapiens
aaaugccaagcacu

SEQ ID NO: 1783449 - RNA, 15 nt, Homo sapiens
aguuaaguaguacua

SEQ ID NO: 1783450 - RNA, 20 nt, Homo sapiens
ucccagccccaggggugccu

SEQ ID NO: 1783451 - RNA, 20 nt, Homo sapiens
uaaagaaaaaugccugucuc

SEQ ID NO: 1783452 - RNA, 20 nt, Homo sapiens
auguguugccuggaagcaca

SEQ ID NO: 1783453 - RNA, 13 nt, Homo sapiens
agcugacccagug

SEQ ID NO: 1783454 - RNA, 18 nt, Homo sapiens
aauaaacccucagagccu

SEQ ID NO: 1783455 - RNA, 13 nt, Homo sapiens
uauuugcacugaa

SEQ ID NO: 1783456 - RNA, 20 nt, Homo sapiens
auggccucaagaucaaugaa

SEQ ID NO: 1783457 - RNA, 22 nt, Homo sapiens
cuggauguacuauccaaucugu

SEQ ID NO: 1783458 - RNA, 12 nt, Homo sapiens
gauacauuucau

SEQ ID NO: 1783459 - RNA, 12 nt, Homo sapiens
auauauacacau

SEQ ID NO: 1783460 - RNA, 23 nt, Homo sapiens
accaccaacauucuguguucaca

SEQ ID NO: 1783461 - RNA, 23 nt, Homo sapiens
ugcaucuguuuauucuauaguua

SEQ ID NO: 1783462 - RNA, 14 nt, Homo sapiens
cuucauuaccucag

SEQ ID NO: 1783463 - RNA, 21 nt, Homo sapiens
cacacccaauuccacucugau

SEQ ID NO: 1783464 - RNA, 21 nt, Homo sapiens
augcacaauuuauaauuacaa

SEQ ID NO: 1783465 - RNA, 14 nt, Homo sapiens
gugauguaacuacu

SEQ ID NO: 1783466 - RNA, 17 nt, Homo sapiens
ucccagagacccgggga

SEQ ID NO: 1783467 - RNA, 22 nt, Homo sapiens
cagagcauuuuuuaugauauca

SEQ ID NO: 1783468 - RNA, 14 nt, Homo sapiens
uuggaaaaucaaga

SEQ ID NO: 1783469 - RNA, 23 nt, Homo sapiens
guacuuacaucuuuguuuaccau

SEQ ID NO: 1783470 - RNA, 18 nt, Homo sapiens
gagcccgaggcaccagug

SEQ ID NO: 1783471 - RNA, 18 nt, Homo sapiens
aauauuucacauccugua

SEQ ID NO: 1783472 - RNA, 11 nt, Homo sapiens
guguggcugcu

SEQ ID NO: 1783473 - RNA, 14 nt, Homo sapiens
gacagugcauuugc

SEQ ID NO: 1783474 - RNA, 13 nt, Homo sapiens
aaccuacuagaca

SEQ ID NO: 1783475 - RNA, 19 nt, Homo sapiens
uaaaucauuuuaugucaag

SEQ ID NO: 1783476 - RNA, 20 nt, Homo sapiens
cuugagccuuugacugauaa

SEQ ID NO: 1783477 - RNA, 13 nt, Homo sapiens
aacccauuugucu

SEQ ID NO: 1783478 - RNA, 13 nt, Homo sapiens
aguuuauuuacuc

SEQ ID NO: 1783479 - RNA, 16 nt, Homo sapiens
augguacggacuuccu

SEQ ID NO: 1783480 - RNA, 12 nt, Homo sapiens
acuguccaugaa

SEQ ID NO: 1783481 - RNA, 18 nt, Homo sapiens
gaccuccguguagugucu

SEQ ID NO: 1783482 - RNA, 13 nt, Homo sapiens
acaaauauguucu

SEQ ID NO: 1783483 - RNA, 13 nt, Homo sapiens
caugccucuguag

SEQ ID NO: 1783484 - RNA, 19 nt, Homo sapiens
uguggacuuauucauuccu

SEQ ID NO: 1783485 - RNA, 20 nt, Homo sapiens
agucgucuggcaucucccac

SEQ ID NO: 1783486 - RNA, 15 nt, Homo sapiens
uuaguguacuuugaa

SEQ ID NO: 1783487 - RNA, 22 nt, Homo sapiens
uacauucugcaagcacaucugc

SEQ ID NO: 1783488 - RNA, 13 nt, Homo sapiens
aguucagaaggaa

SEQ ID NO: 1783489 - RNA, 14 nt, Homo sapiens
caaguaaguaugaa

SEQ ID NO: 1783490 - RNA, 18 nt, Homo sapiens
acugagccaaaaacaaua

SEQ ID NO: 1783491 - RNA, 21 nt, Homo sapiens
cugggguggggucaugcccuc

SEQ ID NO: 1783492 - RNA, 13 nt, Homo sapiens
uccuggccucaca

SEQ ID NO: 1783493 - RNA, 23 nt, Homo sapiens
gcacuaaaaaguggcuaauucaa

SEQ ID NO: 1783494 - RNA, 17 nt, Homo sapiens
aagcaauacuguacaua

SEQ ID NO: 1783495 - RNA, 18 nt, Homo sapiens
uucuuucagauguuuauu

SEQ ID NO: 1783496 - RNA, 13 nt, Homo sapiens
ggacccucgagag

SEQ ID NO: 1783497 - RNA, 13 nt, Homo sapiens
aagcgcucagaac

SEQ ID NO: 1783498 - RNA, 23 nt, Homo sapiens
gaaccaucauuggaaaugaaacu

SEQ ID NO: 1783499 - RNA, 19 nt, Homo sapiens
uuuagcuucucugccaagc

SEQ ID NO: 1783500 - RNA, 19 nt, Homo sapiens
gcauccccuuggcugugag

SEQ ID NO: 1783501 - RNA, 20 nt, Homo sapiens
ugcaucaguucacugcugca

SEQ ID NO: 1783502 - RNA, 22 nt, Homo sapiens
auuucaugcucgacacuuacca

SEQ ID NO: 1783503 - RNA, 21 nt, Homo sapiens
cagcagggucuugcuguaacu

SEQ ID NO: 1783504 - RNA, 23 nt, Homo sapiens
accucauuggccagcucauaaaa

SEQ ID NO: 1783505 - RNA, 15 nt, Homo sapiens
cauuggcugccuuau

SEQ ID NO: 1783506 - RNA, 22 nt, Homo sapiens
ccucagcagccucacugcaucu

SEQ ID NO: 1783507 - RNA, 13 nt, Homo sapiens
acugcauaauucu

SEQ ID NO: 1783508 - RNA, 16 nt, Homo sapiens
aauaaagcauuuugca

SEQ ID NO: 1783509 - RNA, 22 nt, Homo sapiens
agaacauucuuauauuuuauca

SEQ ID NO: 1783510 - RNA, 18 nt, Homo sapiens
guaacaguguaguacuca

SEQ ID NO: 1783511 - RNA, 15 nt, Homo sapiens
auguccauacuauga

SEQ ID NO: 1783512 - RNA, 13 nt, Homo sapiens
aggcaugacaaaa

SEQ ID NO: 1783513 - RNA, 21 nt, Homo sapiens
ugugccaagagcuacucccac

SEQ ID NO: 1783514 - RNA, 18 nt, Homo sapiens
uuguuagugauuugcuau

SEQ ID NO: 1783515 - RNA, 13 nt, Homo sapiens
aaugucacugcca

SEQ ID NO: 1783516 - RNA, 20 nt, Homo sapiens
gcaaccagaccauugucuca

SEQ ID NO: 1783517 - RNA, 14 nt, Homo sapiens
uaucuucacuuuua

SEQ ID NO: 1783518 - RNA, 15 nt, Homo sapiens
accacuuaaaaugau

SEQ ID NO: 1783519 - RNA, 17 nt, Homo sapiens
gaaguuaagaauugagc

SEQ ID NO: 1783520 - RNA, 18 nt, Homo sapiens
cuguucugucucauauga

SEQ ID NO: 1783521 - RNA, 16 nt, Homo sapiens
uuaauuguuaagauau

SEQ ID NO: 1783522 - RNA, 24 nt, Homo sapiens
agugugugccaagagcuacuccca

SEQ ID NO: 1783523 - RNA, 20 nt, Homo sapiens
cuauuacaccuuuaucucaa

SEQ ID NO: 1783524 - RNA, 15 nt, Homo sapiens
uuuuauuaugcauua

SEQ ID NO: 1783525 - RNA, 17 nt, Homo sapiens
caaaaaacaacugacca

SEQ ID NO: 1783526 - RNA, 13 nt, Homo sapiens
cauggaaccaugg

SEQ ID NO: 1783527 - RNA, 13 nt, Homo sapiens
ucccaaacuccca

SEQ ID NO: 1783528 - RNA, 13 nt, Homo sapiens
auauuaacauauu

SEQ ID NO: 1783529 - RNA, 13 nt, Homo sapiens
uuaaaaacuuaaa

SEQ ID NO: 1783530 - RNA, 13 nt, Homo sapiens
auaaaaacauaaa

SEQ ID NO: 1783531 - RNA, 13 nt, Homo sapiens
agaucaacagauc

SEQ ID NO: 1783532 - RNA, 15 nt, Homo sapiens
ugauuucaguucacu

SEQ ID NO: 1783533 - RNA, 21 nt, Homo sapiens
acuaggaucagaauaucacag

SEQ ID NO: 1783534 - RNA, 11 nt, Homo sapiens
gaaauuuugcc

SEQ ID NO: 1783535 - RNA, 13 nt, Homo sapiens
accaaccuguuac

SEQ ID NO: 1783536 - RNA, 14 nt, Homo sapiens
gaacaccuccucaa

SEQ ID NO: 1783537 - RNA, 14 nt, Homo sapiens
gaugaccuccagaa

SEQ ID NO: 1783538 - RNA, 15 nt, Homo sapiens
uauucuugugcuuuu

SEQ ID NO: 1783539 - RNA, 13 nt, Homo sapiens
cuagaaauccugg

SEQ ID NO: 1783540 - RNA, 13 nt, Homo sapiens
cuuagaauccaaa

SEQ ID NO: 1783541 - RNA, 15 nt, Homo sapiens
uagguuaaaggccag

SEQ ID NO: 1783542 - RNA, 22 nt, Homo sapiens
aagcaaauaauuuuucacuuca

SEQ ID NO: 1783543 - RNA, 22 nt, Homo sapiens
ugcacauauauuuuuuacaaac

SEQ ID NO: 1783544 - RNA, 23 nt, Homo sapiens
uuucuuuugugguuucucuggcc

SEQ ID NO: 1783545 - RNA, 14 nt, Homo sapiens
acuagaagcacagg

SEQ ID NO: 1783546 - RNA, 20 nt, Homo sapiens
uuucucagaacaagguaaaa

SEQ ID NO: 1783547 - RNA, 23 nt, Homo sapiens
acuuaaaaaaaaauaggcccuuu

SEQ ID NO: 1783548 - RNA, 17 nt, Homo sapiens
uucccugacuugcuuua

SEQ ID NO: 1783549 - RNA, 18 nt, Homo sapiens
caaccggcuuuguggcac

SEQ ID NO: 1783550 - RNA, 17 nt, Homo sapiens
ugaaacuugugcuauag

SEQ ID NO: 1783551 - RNA, 14 nt, Homo sapiens
acguuaacagcgug

SEQ ID NO: 1783552 - RNA, 18 nt, Homo sapiens
aucugugaacauguuaag

SEQ ID NO: 1783553 - RNA, 17 nt, Homo sapiens
cauugcacaaggcagaa

SEQ ID NO: 1783554 - RNA, 11 nt, Homo sapiens
ugcuaacuggg

SEQ ID NO: 1783555 - RNA, 14 nt, Homo sapiens
ugaggacuauggaa

SEQ ID NO: 1783556 - RNA, 17 nt, Homo sapiens
cuuuucugugaagcccu

SEQ ID NO: 1783557 - RNA, 20 nt, Homo sapiens
ucucuugccucagcuucccc

SEQ ID NO: 1783558 - RNA, 20 nt, Homo sapiens
gggcugagccccuccucucc

SEQ ID NO: 1783559 - RNA, 19 nt, Homo sapiens
gcucagagcagaaccaaag

SEQ ID NO: 1783560 - RNA, 13 nt, Homo sapiens
ggcauggcaccug

SEQ ID NO: 1783561 - RNA, 19 nt, Homo sapiens
ggugggccauaugccuaca

SEQ ID NO: 1783562 - RNA, 15 nt, Homo sapiens
cuugauuaacuccuc

SEQ ID NO: 1783563 - RNA, 12 nt, Homo sapiens
gcggccucaggg

SEQ ID NO: 1783564 - RNA, 12 nt, Homo sapiens
gcuuccucaguu

SEQ ID NO: 1783565 - RNA, 23 nt, Homo sapiens
uccaguuauaagcguauuuagac

SEQ ID NO: 1783566 - RNA, 14 nt, Homo sapiens
gaauaaaauugcac

SEQ ID NO: 1783567 - RNA, 22 nt, Homo sapiens
uaacagucaaauaucauuuacu

SEQ ID NO: 1783568 - RNA, 14 nt, Homo sapiens
uaccauacauuuaa

SEQ ID NO: 1783569 - RNA, 19 nt, Homo sapiens
cugggguuuugacuugcca

SEQ ID NO: 1783570 - RNA, 19 nt, Homo sapiens
aauacuugaaaacuucuca

SEQ ID NO: 1783571 - RNA, 17 nt, Homo sapiens
cauggaguugggcguua

SEQ ID NO: 1783572 - RNA, 17 nt, Homo sapiens
auuucuaguaccuguga

SEQ ID NO: 1783573 - RNA, 11 nt, Homo sapiens
aaucacugcag

SEQ ID NO: 1783574 - RNA, 15 nt, Homo sapiens
gucuuuacuuccauc

SEQ ID NO: 1783575 - RNA, 23 nt, Homo sapiens
aacuucauuguuuggaccugcau

SEQ ID NO: 1783576 - RNA, 15 nt, Homo sapiens
cugguaggaauagca

SEQ ID NO: 1783577 - RNA, 17 nt, Homo sapiens
auucuacuggccuguaa

SEQ ID NO: 1783578 - RNA, 12 nt, Homo sapiens
uucuuccuuauu

SEQ ID NO: 1783579 - RNA, 11 nt, Homo sapiens
ugcuccaggga

SEQ ID NO: 1783580 - RNA, 13 nt, Homo sapiens
auaccuuccucuu

SEQ ID NO: 1783581 - RNA, 17 nt, Homo sapiens
cagauaaugauaguguu

SEQ ID NO: 1783582 - RNA, 13 nt, Homo sapiens
uggccuguggcac

SEQ ID NO: 1783583 - RNA, 22 nt, Homo sapiens
aaaauauuuuuaugugcaauaa

SEQ ID NO: 1783584 - RNA, 16 nt, Homo sapiens
guagagggcacugggu

SEQ ID NO: 1783585 - RNA, 19 nt, Homo sapiens
aguaaacaugugggaaaaa

SEQ ID NO: 1783586 - RNA, 19 nt, Homo sapiens
acugugggcaaaguccucc

SEQ ID NO: 1783587 - RNA, 15 nt, Homo sapiens
auauccacuuaccug

SEQ ID NO: 1783588 - RNA, 15 nt, Homo sapiens
uaaagcauauuggug

SEQ ID NO: 1783589 - RNA, 14 nt, Homo sapiens
aacaaagacaacca

SEQ ID NO: 1783590 - RNA, 21 nt, Homo sapiens
gguuggcaugacugucugugc

SEQ ID NO: 1783591 - RNA, 14 nt, Homo sapiens
acagccuugcccac

SEQ ID NO: 1783592 - RNA, 19 nt, Homo sapiens
agcaaugccccaaacuuuc

SEQ ID NO: 1783593 - RNA, 15 nt, Homo sapiens
guaaugaccaugaaa

SEQ ID NO: 1783594 - RNA, 15 nt, Homo sapiens
gauuacccucugggu

SEQ ID NO: 1783595 - RNA, 21 nt, Homo sapiens
cacccuagcccuugcugccac

SEQ ID NO: 1783596 - RNA, 14 nt, Homo sapiens
ucaucugauaugca

SEQ ID NO: 1783597 - RNA, 24 nt, Homo sapiens
auguccucaacugucaucauucua

SEQ ID NO: 1783598 - RNA, 15 nt, Homo sapiens
acaaaaagcuacuua

SEQ ID NO: 1783599 - RNA, 14 nt, Homo sapiens
ccacaguuuccuca

SEQ ID NO: 1783600 - RNA, 12 nt, Homo sapiens
uaaauacaguca

SEQ ID NO: 1783601 - RNA, 14 nt, Homo sapiens
cugcugcuaaggcu

SEQ ID NO: 1783602 - RNA, 16 nt, Homo sapiens
auuauuuacaagaaga

SEQ ID NO: 1783603 - RNA, 17 nt, Homo sapiens
cugagaaaacuaaguca

SEQ ID NO: 1783604 - RNA, 18 nt, Homo sapiens
gaguuuguauuauuacaa

SEQ ID NO: 1783605 - RNA, 18 nt, Homo sapiens
ccagaggucuggcccuau

SEQ ID NO: 1783606 - RNA, 17 nt, Homo sapiens
aacugggcucaagugau

SEQ ID NO: 1783607 - RNA, 17 nt, Homo sapiens
aaaauaaaaaacauaua

SEQ ID NO: 1783608 - RNA, 17 nt, Homo sapiens
cucagaauucaucugaa

SEQ ID NO: 1783609 - RNA, 20 nt, Homo sapiens
aaauacaucaaaaaugggua

SEQ ID NO: 1783610 - RNA, 18 nt, Homo sapiens
cuaaucauccaaugcuca

SEQ ID NO: 1783611 - RNA, 22 nt, Homo sapiens
ucuauggaccaaauguaaaaua

SEQ ID NO: 1783612 - RNA, 15 nt, Homo sapiens
ggugggauuccacuc

SEQ ID NO: 1783613 - RNA, 17 nt, Homo sapiens
ggagucuuguguucacc

SEQ ID NO: 1783614 - RNA, 20 nt, Homo sapiens
agacagggucucgcucuguu

SEQ ID NO: 1783615 - RNA, 22 nt, Homo sapiens
cuuaccccagucacuucugggg

SEQ ID NO: 1783616 - RNA, 22 nt, Homo sapiens
ugcaggcccuuugaagccucag

SEQ ID NO: 1783617 - RNA, 15 nt, Homo sapiens
cguggcuuuuagaca

SEQ ID NO: 1783618 - RNA, 20 nt, Homo sapiens
acuugagacagcacuaugua

SEQ ID NO: 1783619 - RNA, 13 nt, Homo sapiens
guucgauggcuca

SEQ ID NO: 1783620 - RNA, 12 nt, Homo sapiens
uagaugacaaau

SEQ ID NO: 1783621 - RNA, 15 nt, Homo sapiens
cucaacaccaugauu

SEQ ID NO: 1783622 - RNA, 16 nt, Homo sapiens
agcaaagggaaugggu

SEQ ID NO: 1783623 - RNA, 19 nt, Homo sapiens
uucagacauuccaugguga

SEQ ID NO: 1783624 - RNA, 12 nt, Homo sapiens
aaucucauacaa

SEQ ID NO: 1783625 - RNA, 17 nt, Homo sapiens
guagauauuauguauag

SEQ ID NO: 1783626 - RNA, 23 nt, Homo sapiens
gguauucaccacccugggacccc

SEQ ID NO: 1783627 - RNA, 17 nt, Homo sapiens
agcuggaaagugugaau

SEQ ID NO: 1783628 - RNA, 17 nt, Homo sapiens
ucuggugccccuuugcc

SEQ ID NO: 1783629 - RNA, 18 nt, Homo sapiens
ugggggagggaagaccag

SEQ ID NO: 1783630 - RNA, 14 nt, Homo sapiens
cuuccugcuucugg

SEQ ID NO: 1783631 - RNA, 23 nt, Homo sapiens
ucacauuuuaagugcuucacauu

SEQ ID NO: 1783632 - RNA, 21 nt, Homo sapiens
ugcaacacuggucugcuguuc

SEQ ID NO: 1783633 - RNA, 21 nt, Homo sapiens
agguaccaagaucacaaauag

SEQ ID NO: 1783634 - RNA, 20 nt, Homo sapiens
acaaucagaccacauuugaa

SEQ ID NO: 1783635 - RNA, 20 nt, Homo sapiens
ucuaggcuggggaaguccuc

SEQ ID NO: 1783636 - RNA, 17 nt, Homo sapiens
uuaaaaauaaacucugc

SEQ ID NO: 1783637 - RNA, 20 nt, Homo sapiens
guaugucugucuacaggaaa

SEQ ID NO: 1783638 - RNA, 18 nt, Homo sapiens
auugacccagaaauguau

SEQ ID NO: 1783639 - RNA, 12 nt, Homo sapiens
cacaugugccag

SEQ ID NO: 1783640 - RNA, 14 nt, Homo sapiens
caaguaagggcaca

SEQ ID NO: 1783641 - RNA, 12 nt, Homo sapiens
cagccccugacc

SEQ ID NO: 1783642 - RNA, 16 nt, Homo sapiens
aucagaaaaccaaagg

SEQ ID NO: 1783643 - RNA, 20 nt, Homo sapiens
cccaagugaggagugccagc

SEQ ID NO: 1783644 - RNA, 18 nt, Homo sapiens
cucuucacuuggccaguu

SEQ ID NO: 1783645 - RNA, 18 nt, Homo sapiens
ccaucugcuugguuggcu

SEQ ID NO: 1783646 - RNA, 15 nt, Homo sapiens
cacugccugcuccca

SEQ ID NO: 1783647 - RNA, 15 nt, Homo sapiens
uuagcagcagccuuu

SEQ ID NO: 1783648 - RNA, 16 nt, Homo sapiens
cuugaguugaguauua

SEQ ID NO: 1783649 - RNA, 14 nt, Homo sapiens
ccauggaagggugg

SEQ ID NO: 1783650 - RNA, 22 nt, Homo sapiens
guaauagcugaaccuguucaaa

SEQ ID NO: 1783651 - RNA, 16 nt, Homo sapiens
uacauuagugauucca

SEQ ID NO: 1783652 - RNA, 17 nt, Homo sapiens
gcgcgaucucagcucac

SEQ ID NO: 1783653 - RNA, 23 nt, Homo sapiens
uacauaccccgaaggucuaggaa

SEQ ID NO: 1783654 - RNA, 13 nt, Homo sapiens
augguuuguguca

SEQ ID NO: 1783655 - RNA, 17 nt, Homo sapiens
uacuggccgagcugcug

SEQ ID NO: 1783656 - RNA, 16 nt, Homo sapiens
gucuucuuaaucugaa

SEQ ID NO: 1783657 - RNA, 15 nt, Homo sapiens
uguuuuugcaccaga

SEQ ID NO: 1783658 - RNA, 16 nt, Homo sapiens
aggcaugaaguuuccu

SEQ ID NO: 1783659 - RNA, 16 nt, Homo sapiens
uugccuccaguccagu

SEQ ID NO: 1783660 - RNA, 13 nt, Homo sapiens
agugcagccaaag

SEQ ID NO: 1783661 - RNA, 17 nt, Homo sapiens
cuaauguguaagacaaa

SEQ ID NO: 1783662 - RNA, 19 nt, Homo sapiens
auaagguaaaaugccauga

SEQ ID NO: 1783663 - RNA, 17 nt, Homo sapiens
uaagcagaaauaaaguu

SEQ ID NO: 1783664 - RNA, 20 nt, Homo sapiens
ccuagucuuuuaaacaguuu

SEQ ID NO: 1783665 - RNA, 19 nt, Homo sapiens
cgccccccccuccccaugc

SEQ ID NO: 1783666 - RNA, 20 nt, Homo sapiens
gccagagcccaagugccauc

SEQ ID NO: 1783667 - RNA, 14 nt, Homo sapiens
uccuuucccagaaa

SEQ ID NO: 1783668 - RNA, 20 nt, Homo sapiens
aggauaggugguauggagcu

SEQ ID NO: 1783669 - RNA, 22 nt, Homo sapiens
agcugggagcacaggcacugca

SEQ ID NO: 1783670 - RNA, 15 nt, Homo sapiens
accaauuuuuuacag

SEQ ID NO: 1783671 - RNA, 20 nt, Homo sapiens
aaagugcugagauuacaggu

SEQ ID NO: 1783672 - RNA, 21 nt, Homo sapiens
ugguucaguacugucuaucaa

SEQ ID NO: 1783673 - RNA, 15 nt, Homo sapiens
caucacagaacaucc

SEQ ID NO: 1783674 - RNA, 19 nt, Homo sapiens
ugcuugguccgacaugccu

SEQ ID NO: 1783675 - RNA, 20 nt, Homo sapiens
ccugucagcuccuugaccua

SEQ ID NO: 1783676 - RNA, 21 nt, Homo sapiens
cauagauguaucauuaaugua

SEQ ID NO: 1783677 - RNA, 12 nt, Homo sapiens
ugcccagccaau

SEQ ID NO: 1783678 - RNA, 13 nt, Homo sapiens
ucuuaagacguga

SEQ ID NO: 1783679 - RNA, 22 nt, Homo sapiens
uccuaucccuggacgcaugcag

SEQ ID NO: 1783680 - RNA, 18 nt, Homo sapiens
cuaaaucagagacaaaau

SEQ ID NO: 1783681 - RNA, 15 nt, Homo sapiens
acaacggaugaaugu

SEQ ID NO: 1783682 - RNA, 20 nt, Homo sapiens
agaccguccuggagcuggag

SEQ ID NO: 1783683 - RNA, 20 nt, Homo sapiens
uaagauugcgccugagauac

SEQ ID NO: 1783684 - RNA, 20 nt, Homo sapiens
uuauugcaauaaaguauaau

SEQ ID NO: 1783685 - RNA, 21 nt, Homo sapiens
acuuccuugcccccauuucac

SEQ ID NO: 1783686 - RNA, 21 nt, Homo sapiens
cgcaguuuggagucacuguag

SEQ ID NO: 1783687 - RNA, 14 nt, Homo sapiens
caggcuguucucag

SEQ ID NO: 1783688 - RNA, 18 nt, Homo sapiens
acucaccuugcucugcca

SEQ ID NO: 1783689 - RNA, 21 nt, Homo sapiens
uuuacaucuguguucuaugca

SEQ ID NO: 1783690 - RNA, 23 nt, Homo sapiens
cuggucccaagacagugagacag

SEQ ID NO: 1783691 - RNA, 19 nt, Homo sapiens
gaguuccauguuuguacuc

SEQ ID NO: 1783692 - RNA, 21 nt, Homo sapiens
aagaugcuuuguuucuuucau

SEQ ID NO: 1783693 - RNA, 14 nt, Homo sapiens
gggaaaucaguguu

SEQ ID NO: 1783694 - RNA, 19 nt, Homo sapiens
ccauuucugccucgcucac

SEQ ID NO: 1783695 - RNA, 18 nt, Homo sapiens
cuuuucuauggagcaaaa

SEQ ID NO: 1783696 - RNA, 17 nt, Homo sapiens
auacuuuguauacaagu

SEQ ID NO: 1783697 - RNA, 16 nt, Homo sapiens
ggcaggcacugccugc

SEQ ID NO: 1783698 - RNA, 20 nt, Homo sapiens
uauaaagaaaaugauacagc

SEQ ID NO: 1783699 - RNA, 20 nt, Homo sapiens
cacagccuccucugucugcc

SEQ ID NO: 1783700 - RNA, 20 nt, Homo sapiens
gaacuggacccuguugcuaa

SEQ ID NO: 1783701 - RNA, 20 nt, Homo sapiens
aggggcuccccgggucucuc

SEQ ID NO: 1783702 - RNA, 16 nt, Homo sapiens
uugcacuugaccucau

SEQ ID NO: 1783703 - RNA, 12 nt, Homo sapiens
gggcuggcagau

SEQ ID NO: 1783704 - RNA, 16 nt, Homo sapiens
cagaaaagcccugcuu

SEQ ID NO: 1783705 - RNA, 11 nt, Homo sapiens
uggaccugcau

SEQ ID NO: 1783706 - RNA, 22 nt, Homo sapiens
ucuagagaugguuucuacuggc

SEQ ID NO: 1783707 - RNA, 15 nt, Homo sapiens
uaaggcugaacuugu

SEQ ID NO: 1783708 - RNA, 22 nt, Homo sapiens
ucacacacaccucaugugagaa

SEQ ID NO: 1783709 - RNA, 16 nt, Homo sapiens
aaauuauacugagaac

SEQ ID NO: 1783710 - RNA, 13 nt, Homo sapiens
gaacccagcccac

SEQ ID NO: 1783711 - RNA, 22 nt, Homo sapiens
uuguacuuuucauuuuggcuca

SEQ ID NO: 1783712 - RNA, 21 nt, Homo sapiens
acuuuagcaacaguuaucaca

SEQ ID NO: 1783713 - RNA, 15 nt, Homo sapiens
guugcagugagcuaa

SEQ ID NO: 1783714 - RNA, 22 nt, Homo sapiens
ccaccauggcacccugcaccag

SEQ ID NO: 1783715 - RNA, 16 nt, Homo sapiens
ccacugcacuuuccaa

SEQ ID NO: 1783716 - RNA, 19 nt, Homo sapiens
cucaauggagguuugcaaa

SEQ ID NO: 1783717 - RNA, 14 nt, Homo sapiens
gcaauaauccagua

SEQ ID NO: 1783718 - RNA, 21 nt, Homo sapiens
ugucuguucuaaguccacuua

SEQ ID NO: 1783719 - RNA, 16 nt, Homo sapiens
cgugcacuccccgugu

SEQ ID NO: 1783720 - RNA, 20 nt, Homo sapiens
cucccaagcaccugggauua

SEQ ID NO: 1783721 - RNA, 19 nt, Homo sapiens
cagugaugaaaauuugccu

SEQ ID NO: 1783722 - RNA, 14 nt, Homo sapiens
auguaacuacagga

SEQ ID NO: 1783723 - RNA, 23 nt, Homo sapiens
ugguggcagaguggauucuugaa

SEQ ID NO: 1783724 - RNA, 16 nt, Homo sapiens
ggaagucccucagagg

SEQ ID NO: 1783725 - RNA, 20 nt, Homo sapiens
ccagccuucugucagcagug

SEQ ID NO: 1783726 - RNA, 14 nt, Homo sapiens
agaauaaacuggca

SEQ ID NO: 1783727 - RNA, 19 nt, Homo sapiens
augggaucuugagggacca

SEQ ID NO: 1783728 - RNA, 14 nt, Homo sapiens
ucugcuuccaacau

SEQ ID NO: 1783729 - RNA, 17 nt, Homo sapiens
agagcgggacucugucc

SEQ ID NO: 1783730 - RNA, 14 nt, Homo sapiens
gcagcucaacgaga

SEQ ID NO: 1783731 - RNA, 16 nt, Homo sapiens
uaucaaaaaguauuaa

SEQ ID NO: 1783732 - RNA, 22 nt, Homo sapiens
gcuacucucuugccagcauuuu

SEQ ID NO: 1783733 - RNA, 20 nt, Homo sapiens
agaggauuuggcucgcugug

SEQ ID NO: 1783734 - RNA, 16 nt, Homo sapiens
ccucugcgucuauccu

SEQ ID NO: 1783735 - RNA, 12 nt, Homo sapiens
gaccucaaguga

SEQ ID NO: 1783736 - RNA, 23 nt, Homo sapiens
uacaugaaugcaaaacauuucau

SEQ ID NO: 1783737 - RNA, 23 nt, Homo sapiens
ggcuggagugcaguggugcaauc

SEQ ID NO: 1783738 - RNA, 22 nt, Homo sapiens
ucgaauccagagagcagugugg

SEQ ID NO: 1783739 - RNA, 21 nt, Homo sapiens
acuugaugauuuuuaacuuuu

SEQ ID NO: 1783740 - RNA, 22 nt, Homo sapiens
cauguaauauaaagauguuaaa

SEQ ID NO: 1783741 - RNA, 17 nt, Homo sapiens
cuuuacuacugcaaguu

SEQ ID NO: 1783742 - RNA, 18 nt, Homo sapiens
aaucccucuuccuccaaa

SEQ ID NO: 1783743 - RNA, 12 nt, Homo sapiens
agcuccaggaca

SEQ ID NO: 1783744 - RNA, 19 nt, Homo sapiens
uuaucugauccuuguggca

SEQ ID NO: 1783745 - RNA, 23 nt, Homo sapiens
guuagcacagaggauggcuuccc

SEQ ID NO: 1783746 - RNA, 19 nt, Homo sapiens
gcaccugcaugugcuguca

SEQ ID NO: 1783747 - RNA, 18 nt, Homo sapiens
aaagcccccacuucucuc

SEQ ID NO: 1783748 - RNA, 16 nt, Homo sapiens
gugccacacaauggau

SEQ ID NO: 1783749 - RNA, 18 nt, Homo sapiens
ucguagccuaaaagacaa

SEQ ID NO: 1783750 - RNA, 20 nt, Homo sapiens
caccccuuguuuagcauaua

SEQ ID NO: 1783751 - RNA, 19 nt, Homo sapiens
uaguucagaggaagcacau

SEQ ID NO: 1783752 - RNA, 18 nt, Homo sapiens
agagugaauuucaguaua

SEQ ID NO: 1783753 - RNA, 12 nt, Homo sapiens
aaagacugucaa

SEQ ID NO: 1783754 - RNA, 13 nt, Homo sapiens
uuuguuugcauga

SEQ ID NO: 1783755 - RNA, 20 nt, Homo sapiens
ugaagggguuuucuugauaa

SEQ ID NO: 1783756 - RNA, 16 nt, Homo sapiens
ucuauuuccuccccca

SEQ ID NO: 1783757 - RNA, 13 nt, Homo sapiens
gcuuaugugacau

SEQ ID NO: 1783758 - RNA, 22 nt, Homo sapiens
auacuuuuugcauauguaagga

SEQ ID NO: 1783759 - RNA, 14 nt, Homo sapiens
ugccugguacagua

SEQ ID NO: 1783760 - RNA, 23 nt, Homo sapiens
acuguguucccacgggugccaug

SEQ ID NO: 1783761 - RNA, 12 nt, Homo sapiens
augacaaaccau

SEQ ID NO: 1783762 - RNA, 21 nt, Homo sapiens
gacaaagucaagccacauggu

SEQ ID NO: 1783763 - RNA, 17 nt, Homo sapiens
auauccuuucaagacag

SEQ ID NO: 1783764 - RNA, 19 nt, Homo sapiens
ucacccaggcuggagugca

SEQ ID NO: 1783765 - RNA, 17 nt, Homo sapiens
uuucaucucauuaauuc

SEQ ID NO: 1783766 - RNA, 14 nt, Homo sapiens
ccagcugugacuga

SEQ ID NO: 1783767 - RNA, 22 nt, Homo sapiens
cccaugcaaguagcuggcugua

SEQ ID NO: 1783768 - RNA, 22 nt, Homo sapiens
cccaguguguguuuaacauuca

SEQ ID NO: 1783769 - RNA, 13 nt, Homo sapiens
ugugguagccuca

SEQ ID NO: 1783770 - RNA, 15 nt, Homo sapiens
gaagaaauaacaaau

SEQ ID NO: 1783771 - RNA, 19 nt, Homo sapiens
gugcuugccaccaccagau

SEQ ID NO: 1783772 - RNA, 13 nt, Homo sapiens
caucaagcuccac

SEQ ID NO: 1783773 - RNA, 18 nt, Homo sapiens
uccauuguuuggagacau

SEQ ID NO: 1783774 - RNA, 21 nt, Homo sapiens
ccaccgauggagcccccagau

SEQ ID NO: 1783775 - RNA, 16 nt, Homo sapiens
guuuccugaguaccag

SEQ ID NO: 1783776 - RNA, 12 nt, Homo sapiens
aucuuacuguac

SEQ ID NO: 1783777 - RNA, 17 nt, Homo sapiens
uuagaauccgaagggaa

SEQ ID NO: 1783778 - RNA, 14 nt, Homo sapiens
ucucuccagccuga

SEQ ID NO: 1783779 - RNA, 16 nt, Homo sapiens
uguugcagguucaugg

SEQ ID NO: 1783780 - RNA, 17 nt, Homo sapiens
uaaauuuuuuguugaca

SEQ ID NO: 1783781 - RNA, 17 nt, Homo sapiens
caaaugaucuguuuuca

SEQ ID NO: 1783782 - RNA, 13 nt, Homo sapiens
uggcgcccagugg

SEQ ID NO: 1783783 - RNA, 13 nt, Homo sapiens
agaugacugucca

SEQ ID NO: 1783784 - RNA, 19 nt, Homo sapiens
aaguugauucauauugcau

SEQ ID NO: 1783785 - RNA, 22 nt, Homo sapiens
ccuccuaggaguacaagugccu

SEQ ID NO: 1783786 - RNA, 20 nt, Homo sapiens
caaaaauuauauuuugaaca

SEQ ID NO: 1783787 - RNA, 21 nt, Homo sapiens
accacggccacauuugguucu

SEQ ID NO: 1783788 - RNA, 20 nt, Homo sapiens
ucaaucucguuuagugccaa

SEQ ID NO: 1783789 - RNA, 20 nt, Homo sapiens
uugcccaggcuagagugcaa

SEQ ID NO: 1783790 - RNA, 20 nt, Homo sapiens
ucugagaguauuagucacaa

SEQ ID NO: 1783791 - RNA, 23 nt, Homo sapiens
cccauggagacagaaaguagaau

SEQ ID NO: 1783792 - RNA, 22 nt, Homo sapiens
uucaccuccagguucaagugau

SEQ ID NO: 1783793 - RNA, 17 nt, Homo sapiens
gaacuucaaguucucuu

SEQ ID NO: 1783794 - RNA, 23 nt, Homo sapiens
guuuaaaugccuaaaaguuuuga

SEQ ID NO: 1783795 - RNA, 18 nt, Homo sapiens
uggaaaaacaggaaagga

SEQ ID NO: 1783796 - RNA, 22 nt, Homo sapiens
auucccacaccuccacaguuca

SEQ ID NO: 1783797 - RNA, 19 nt, Homo sapiens
aacaugauuguuuacagcu

SEQ ID NO: 1783798 - RNA, 22 nt, Homo sapiens
ugcaaugucacaaccucucuga

SEQ ID NO: 1783799 - RNA, 23 nt, Homo sapiens
caugggaagggcucccagccaca

SEQ ID NO: 1783800 - RNA, 17 nt, Homo sapiens
aauauuagcuugcuuaa

SEQ ID NO: 1783801 - RNA, 23 nt, Homo sapiens
gaaacauucauuuuuaccuugug

SEQ ID NO: 1783802 - RNA, 19 nt, Homo sapiens
ggauucuagaacugugaau

SEQ ID NO: 1783803 - RNA, 23 nt, Homo sapiens
gccaaggaagucugugucuacca

SEQ ID NO: 1783804 - RNA, 23 nt, Homo sapiens
ccucaucuugcccccucaucuca

SEQ ID NO: 1783805 - RNA, 20 nt, Homo sapiens
aaaaugauggcgacuuguau

SEQ ID NO: 1783806 - RNA, 16 nt, Homo sapiens
uuucaagcugcacuga

SEQ ID NO: 1783807 - RNA, 17 nt, Homo sapiens
ugaggcugacacagcca

SEQ ID NO: 1783808 - RNA, 19 nt, Homo sapiens
acuauauuuauacuguaua

SEQ ID NO: 1783809 - RNA, 17 nt, Homo sapiens
gaaugagaagaaugacu

SEQ ID NO: 1783810 - RNA, 16 nt, Homo sapiens
cugggcccuaggcaua

SEQ ID NO: 1783811 - RNA, 16 nt, Homo sapiens
cuccagcucaccagcc

SEQ ID NO: 1783812 - RNA, 19 nt, Homo sapiens
cacggcuaggaagcagcug

SEQ ID NO: 1783813 - RNA, 14 nt, Homo sapiens
gcuuugccugcuug

SEQ ID NO: 1783814 - RNA, 12 nt, Homo sapiens
auaaaggacaug

SEQ ID NO: 1783815 - RNA, 14 nt, Homo sapiens
gcuuuucuggaauu

SEQ ID NO: 1783816 - RNA, 13 nt, Homo sapiens
cuaccaguuggca

SEQ ID NO: 1783817 - RNA, 21 nt, Homo sapiens
acuuucuugaaaagaagcaag

SEQ ID NO: 1783818 - RNA, 21 nt, Homo sapiens
uaaauauuagaagccugcaga

SEQ ID NO: 1783819 - RNA, 13 nt, Homo sapiens
aucgguaggcaaa

SEQ ID NO: 1783820 - RNA, 18 nt, Homo sapiens
agucaggaguccaagacc

SEQ ID NO: 1783821 - RNA, 22 nt, Homo sapiens
ggacuaaauauuuaagugcagu

SEQ ID NO: 1783822 - RNA, 19 nt, Homo sapiens
cuccugaguagcuggauua

SEQ ID NO: 1783823 - RNA, 12 nt, Homo sapiens
gagggaaggaug

SEQ ID NO: 1783824 - RNA, 21 nt, Homo sapiens
uaccaaaguguuuggucauuu

SEQ ID NO: 1783825 - RNA, 17 nt, Homo sapiens
aucauguuaauagacag

SEQ ID NO: 1783826 - RNA, 14 nt, Homo sapiens
uuaaaaaaauaaca

SEQ ID NO: 1783827 - RNA, 21 nt, Homo sapiens
uaagguggacagcagacaaga

SEQ ID NO: 1783828 - RNA, 13 nt, Homo sapiens
ccuugucuuggca

SEQ ID NO: 1783829 - RNA, 15 nt, Homo sapiens
gacucaacauuacau

SEQ ID NO: 1783830 - RNA, 17 nt, Homo sapiens
aaccaacugcacaauca

SEQ ID NO: 1783831 - RNA, 21 nt, Homo sapiens
gaguggcuuggccucaagaga

SEQ ID NO: 1783832 - RNA, 12 nt, Homo sapiens
cagaaaugugcu

SEQ ID NO: 1783833 - RNA, 19 nt, Homo sapiens
gaaugggcaugaauggaga

SEQ ID NO: 1783834 - RNA, 22 nt, Homo sapiens
aggucaaggcuucagugagcca

SEQ ID NO: 1783835 - RNA, 16 nt, Homo sapiens
auaaauguaccagaga

SEQ ID NO: 1783836 - RNA, 20 nt, Homo sapiens
ccagccugggcagccaggcu

SEQ ID NO: 1783837 - RNA, 16 nt, Homo sapiens
ucuucuggacugcaca

SEQ ID NO: 1783838 - RNA, 16 nt, Homo sapiens
gcucauagaucagcaa

SEQ ID NO: 1783839 - RNA, 20 nt, Homo sapiens
uuguaccccaucccuuccuc

SEQ ID NO: 1783840 - RNA, 15 nt, Homo sapiens
uaugguugacacuag

SEQ ID NO: 1783841 - RNA, 19 nt, Homo sapiens
cuaauauauuccaacguaa

SEQ ID NO: 1783842 - RNA, 21 nt, Homo sapiens
uuuucuaagguucucauagga

SEQ ID NO: 1783843 - RNA, 14 nt, Homo sapiens
guccuggcugugaa

SEQ ID NO: 1783844 - RNA, 14 nt, Homo sapiens
gcugcuuugacaag

SEQ ID NO: 1783845 - RNA, 12 nt, Homo sapiens
cccagacugucu

SEQ ID NO: 1783846 - RNA, 14 nt, Homo sapiens
gaagccaaagccaa

SEQ ID NO: 1783847 - RNA, 16 nt, Homo sapiens
cuuuggaaauacacag

SEQ ID NO: 1783848 - RNA, 20 nt, Homo sapiens
aggcuggagauccuaacuga

SEQ ID NO: 1783849 - RNA, 19 nt, Homo sapiens
uucugagagugaaaccaug

SEQ ID NO: 1783850 - RNA, 11 nt, Homo sapiens
cuggaccugcu

SEQ ID NO: 1783851 - RNA, 19 nt, Homo sapiens
cuggagcugaggaaucuaa

SEQ ID NO: 1783852 - RNA, 15 nt, Homo sapiens
cagagaaccaaaggg

SEQ ID NO: 1783853 - RNA, 15 nt, Homo sapiens
ccaggggcccgggaa

SEQ ID NO: 1783854 - RNA, 12 nt, Homo sapiens
acucucuguuca

SEQ ID NO: 1783855 - RNA, 22 nt, Homo sapiens
uaguuuuuaccuaccacagugu

SEQ ID NO: 1783856 - RNA, 17 nt, Homo sapiens
cgucccccaaacauguu

SEQ ID NO: 1783857 - RNA, 18 nt, Homo sapiens
aucacucauuuauuucca

SEQ ID NO: 1783858 - RNA, 10 nt, Homo sapiens
uuucagggcu

SEQ ID NO: 1783859 - RNA, 10 nt, Homo sapiens
uaucagggca

SEQ ID NO: 1783860 - RNA, 18 nt, Homo sapiens
aagaacguggauugugaa

SEQ ID NO: 1783861 - RNA, 21 nt, Homo sapiens
ugcacacagcacgggggccaa

SEQ ID NO: 1783862 - RNA, 16 nt, Homo sapiens
gacuugucaagccugu

SEQ ID NO: 1783863 - RNA, 16 nt, Homo sapiens
ugcaaaauccugguga

SEQ ID NO: 1783864 - RNA, 13 nt, Homo sapiens
ugcggcaucagau

SEQ ID NO: 1783865 - RNA, 15 nt, Homo sapiens
ucaaaugagccccuu

SEQ ID NO: 1783866 - RNA, 16 nt, Homo sapiens
ggucagucuuugcuca

SEQ ID NO: 1783867 - RNA, 17 nt, Homo sapiens
aucugaaacccacagau

SEQ ID NO: 1783868 - RNA, 19 nt, Homo sapiens
aucacauguuuucucugga

SEQ ID NO: 1783869 - RNA, 14 nt, Homo sapiens
ugaauucugcucua

SEQ ID NO: 1783870 - RNA, 15 nt, Homo sapiens
cgacaggagcacugc

SEQ ID NO: 1783871 - RNA, 15 nt, Homo sapiens
auacauguaccuaua

SEQ ID NO: 1783872 - RNA, 15 nt, Homo sapiens
cuuccuguacuugaa

SEQ ID NO: 1783873 - RNA, 15 nt, Homo sapiens
gaagcugggguucau

SEQ ID NO: 1783874 - RNA, 23 nt, Homo sapiens
acaaaccacaacugacacaggaa

SEQ ID NO: 1783875 - RNA, 14 nt, Homo sapiens
uuacauaaguuccu

SEQ ID NO: 1783876 - RNA, 21 nt, Homo sapiens
ccugaguuuagggucaaggac

SEQ ID NO: 1783877 - RNA, 18 nt, Homo sapiens
cuccacuacuuuacuguu

SEQ ID NO: 1783878 - RNA, 19 nt, Homo sapiens
aauugaccccuuccuccag

SEQ ID NO: 1783879 - RNA, 22 nt, Homo sapiens
ucucugggaaucaacagcauau

SEQ ID NO: 1783880 - RNA, 23 nt, Homo sapiens
uuucacaaauguuuuaaacucau

SEQ ID NO: 1783881 - RNA, 16 nt, Homo sapiens
ugcuuuacagcacugu

SEQ ID NO: 1783882 - RNA, 15 nt, Homo sapiens
cauuagucacuuuga

SEQ ID NO: 1783883 - RNA, 22 nt, Homo sapiens
auaacagcaggguaccugaaag

SEQ ID NO: 1783884 - RNA, 14 nt, Homo sapiens
agaggaguagcaug

SEQ ID NO: 1783885 - RNA, 14 nt, Homo sapiens
gccagagugcagug

SEQ ID NO: 1783886 - RNA, 13 nt, Homo sapiens
gaauggagcugua

SEQ ID NO: 1783887 - RNA, 17 nt, Homo sapiens
aucgaugcagugcuucc

SEQ ID NO: 1783888 - RNA, 22 nt, Homo sapiens
aauaauaugaugccacuuugca

SEQ ID NO: 1783889 - RNA, 14 nt, Homo sapiens
cuguuauagagggu

SEQ ID NO: 1783890 - RNA, 20 nt, Homo sapiens
uaaugugcuucuaguaggca

SEQ ID NO: 1783891 - RNA, 13 nt, Homo sapiens
cacaguaggcacu

SEQ ID NO: 1783892 - RNA, 16 nt, Homo sapiens
caagcaauaaacacaa

SEQ ID NO: 1783893 - RNA, 21 nt, Homo sapiens
cucaugcaagacuucacugca

SEQ ID NO: 1783894 - RNA, 23 nt, Homo sapiens
auaucuucuguuucauaaugcag

SEQ ID NO: 1783895 - RNA, 21 nt, Homo sapiens
uagcaaaucuacugucaauuu

SEQ ID NO: 1783896 - RNA, 17 nt, Homo sapiens
cuggccuccagccuuug

SEQ ID NO: 1783897 - RNA, 13 nt, Homo sapiens
aagcuguguucau

SEQ ID NO: 1783898 - RNA, 18 nt, Homo sapiens
ccaucuucccuacccuuc

SEQ ID NO: 1783899 - RNA, 15 nt, Homo sapiens
agcuccgaccucucu

SEQ ID NO: 1783900 - RNA, 13 nt, Homo sapiens
ggcuacacaggga

SEQ ID NO: 1783901 - RNA, 24 nt, Homo sapiens
acuugacaagucaggagacacugu

SEQ ID NO: 1783902 - RNA, 15 nt, Homo sapiens
uuacgauuaguauau

SEQ ID NO: 1783903 - RNA, 23 nt, Homo sapiens
uguaggauucucaccguggggcu

SEQ ID NO: 1783904 - RNA, 22 nt, Homo sapiens
cacauuucauugucuuagucaa

SEQ ID NO: 1783905 - RNA, 14 nt, Homo sapiens
accuuuggaaguca

SEQ ID NO: 1783906 - RNA, 19 nt, Homo sapiens
cuaaacgcaaugucauuuu

SEQ ID NO: 1783907 - RNA, 12 nt, Homo sapiens
uaaaaaugacaa

SEQ ID NO: 1783908 - RNA, 12 nt, Homo sapiens
aaaaaaugucaa

SEQ ID NO: 1783909 - RNA, 23 nt, Homo sapiens
aauuuuucugcacugagcagagu

SEQ ID NO: 1783910 - RNA, 20 nt, Homo sapiens
agaugccucuucuaccucuu

SEQ ID NO: 1783911 - RNA, 17 nt, Homo sapiens
aauggugauuucuugcu

SEQ ID NO: 1783912 - RNA, 16 nt, Homo sapiens
cagacacacacauaua

SEQ ID NO: 1783913 - RNA, 12 nt, Homo sapiens
agacguguacau

SEQ ID NO: 1783914 - RNA, 22 nt, Homo sapiens
agauccccuguguggucuccau

SEQ ID NO: 1783915 - RNA, 16 nt, Homo sapiens
auguacacgugcacag

SEQ ID NO: 1783916 - RNA, 21 nt, Homo sapiens
aagaaccccagaccucugaau

SEQ ID NO: 1783917 - RNA, 23 nt, Homo sapiens
acuuggucugugagaugcuagaa

SEQ ID NO: 1783918 - RNA, 13 nt, Homo sapiens
gaagaucuugaga

SEQ ID NO: 1783919 - RNA, 21 nt, Homo sapiens
ugacuugaggcacaaaucacu

SEQ ID NO: 1783920 - RNA, 16 nt, Homo sapiens
uuucaucucuauuuag

SEQ ID NO: 1783921 - RNA, 22 nt, Homo sapiens
cuucgaauuaguuugcacuucc

SEQ ID NO: 1783922 - RNA, 13 nt, Homo sapiens
uucauacaauggc

SEQ ID NO: 1783923 - RNA, 18 nt, Homo sapiens
cccuuuuacauacugcug

SEQ ID NO: 1783924 - RNA, 23 nt, Homo sapiens
gucagcacagaacacacugagac

SEQ ID NO: 1783925 - RNA, 24 nt, Homo sapiens
cacccugaguugcuuuucagcuga

SEQ ID NO: 1783926 - RNA, 21 nt, Homo sapiens
cuucacuauucagaacuugua

SEQ ID NO: 1783927 - RNA, 13 nt, Homo sapiens
guugguaucugca

SEQ ID NO: 1783928 - RNA, 22 nt, Homo sapiens
cuagaaauguagcagcagccua

SEQ ID NO: 1783929 - RNA, 20 nt, Homo sapiens
uacacacacguugacgggcc

SEQ ID NO: 1783930 - RNA, 21 nt, Homo sapiens
accacauccuaccuagggaca

SEQ ID NO: 1783931 - RNA, 17 nt, Homo sapiens
uuaaaaaacaugaaugu

SEQ ID NO: 1783932 - RNA, 21 nt, Homo sapiens
uucacuuuguucacuaccugu

SEQ ID NO: 1783933 - RNA, 16 nt, Homo sapiens
aauauaacuaggcaaa

SEQ ID NO: 1783934 - RNA, 13 nt, Homo sapiens
gauuaagauuuua

SEQ ID NO: 1783935 - RNA, 19 nt, Homo sapiens
guauauuaagaagcaauaa

SEQ ID NO: 1783936 - RNA, 16 nt, Homo sapiens
gccugucugaagccaa

SEQ ID NO: 1783937 - RNA, 15 nt, Homo sapiens
aggagcccgucaggc

SEQ ID NO: 1783938 - RNA, 19 nt, Homo sapiens
gugagcaugcacacugaga

SEQ ID NO: 1783939 - RNA, 21 nt, Homo sapiens
gucucaaacuccugaccucaa

SEQ ID NO: 1783940 - RNA, 16 nt, Homo sapiens
ucugucaaaacacugu

SEQ ID NO: 1783941 - RNA, 16 nt, Homo sapiens
augcaacuccaugccu

SEQ ID NO: 1783942 - RNA, 13 nt, Homo sapiens
gauaucuaugacu

SEQ ID NO: 1783943 - RNA, 19 nt, Homo sapiens
cacccagcgcccucuaccu

SEQ ID NO: 1783944 - RNA, 15 nt, Homo sapiens
uccaauugcugcuug

SEQ ID NO: 1783945 - RNA, 22 nt, Homo sapiens
ucucucccaccccggccuccac

SEQ ID NO: 1783946 - RNA, 16 nt, Homo sapiens
aaggugucauacagau

SEQ ID NO: 1783947 - RNA, 11 nt, Homo sapiens
cuacaacagcc

SEQ ID NO: 1783948 - RNA, 17 nt, Homo sapiens
ucuuaaaaugugcuauu

SEQ ID NO: 1783949 - RNA, 19 nt, Homo sapiens
aaugaucucggaugaccaa

SEQ ID NO: 1783950 - RNA, 16 nt, Homo sapiens
cuucacaaaccagaga

SEQ ID NO: 1783951 - RNA, 23 nt, Homo sapiens
uagaugaagaaagagacuguggg

SEQ ID NO: 1783952 - RNA, 21 nt, Homo sapiens
caagcuugucaaugauuucaa

SEQ ID NO: 1783953 - RNA, 18 nt, Homo sapiens
ccuauaaggagaguucaa

SEQ ID NO: 1783954 - RNA, 15 nt, Homo sapiens
agccauuuugugaau

SEQ ID NO: 1783955 - RNA, 15 nt, Homo sapiens
ggggguuggauuuga

SEQ ID NO: 1783956 - RNA, 13 nt, Homo sapiens
caaucacugaaac

SEQ ID NO: 1783957 - RNA, 15 nt, Homo sapiens
ccagaccugcuuccu

SEQ ID NO: 1783958 - RNA, 16 nt, Homo sapiens
ucgaaacugacaguau

SEQ ID NO: 1783959 - RNA, 17 nt, Homo sapiens
gccaaucagaacuggcu

SEQ ID NO: 1783960 - RNA, 20 nt, Homo sapiens
guauuauuucaccagcagca

SEQ ID NO: 1783961 - RNA, 19 nt, Homo sapiens
uguauuuuuuuauucgcca

SEQ ID NO: 1783962 - RNA, 21 nt, Homo sapiens
aaaauucuauuacaguauguc

SEQ ID NO: 1783963 - RNA, 22 nt, Homo sapiens
aauucuauaugauccugaaaaa

SEQ ID NO: 1783964 - RNA, 17 nt, Homo sapiens
caauuauuuauuucaug

SEQ ID NO: 1783965 - RNA, 17 nt, Homo sapiens
caauaaauuugcaaauu

SEQ ID NO: 1783966 - RNA, 14 nt, Homo sapiens
agcagagccuggag

SEQ ID NO: 1783967 - RNA, 21 nt, Homo sapiens
gagguauucaauauccuuugc

SEQ ID NO: 1783968 - RNA, 18 nt, Homo sapiens
cagaaaagguacacuuug

SEQ ID NO: 1783969 - RNA, 20 nt, Homo sapiens
ugcuggguuuccacacagcc

SEQ ID NO: 1783970 - RNA, 15 nt, Homo sapiens
ggaaaccacagcugc

SEQ ID NO: 1783971 - RNA, 17 nt, Homo sapiens
aaauugauugaauuaaa

SEQ ID NO: 1783972 - RNA, 18 nt, Homo sapiens
aggugugugccuagugau

SEQ ID NO: 1783973 - RNA, 18 nt, Homo sapiens
caccugcagccuguugaa

SEQ ID NO: 1783974 - RNA, 12 nt, Homo sapiens
ucaucucagcuc

SEQ ID NO: 1783975 - RNA, 19 nt, Homo sapiens
guauuugccuucuccacuu

SEQ ID NO: 1783976 - RNA, 14 nt, Homo sapiens
ccugccccagagaa

SEQ ID NO: 1783977 - RNA, 18 nt, Homo sapiens
agcaaauagaucaugcau

SEQ ID NO: 1783978 - RNA, 21 nt, Homo sapiens
cuaguuauuuuauaaucaaug

SEQ ID NO: 1783979 - RNA, 14 nt, Homo sapiens
uugaugacucauca

SEQ ID NO: 1783980 - RNA, 16 nt, Homo sapiens
agaucggccacagggc

SEQ ID NO: 1783981 - RNA, 22 nt, Homo sapiens
gaagugaguguuucuaugagug

SEQ ID NO: 1783982 - RNA, 17 nt, Homo sapiens
cucauacaucaagccaa

SEQ ID NO: 1783983 - RNA, 17 nt, Homo sapiens
aagugccuuauucucac

SEQ ID NO: 1783984 - RNA, 21 nt, Homo sapiens
aaugagacuuucuaaaucaaa

SEQ ID NO: 1783985 - RNA, 17 nt, Homo sapiens
cacugggugaccagcug

SEQ ID NO: 1783986 - RNA, 13 nt, Homo sapiens
ugagacacaagau

SEQ ID NO: 1783987 - RNA, 19 nt, Homo sapiens
uuaaugaagacccagugua

SEQ ID NO: 1783988 - RNA, 16 nt, Homo sapiens
cagguaccgugcucau

SEQ ID NO: 1783989 - RNA, 20 nt, Homo sapiens
agcuaguugaauacuugaac

SEQ ID NO: 1783990 - RNA, 21 nt, Homo sapiens
aauugcuguugaaagcaaaaa

SEQ ID NO: 1783991 - RNA, 15 nt, Homo sapiens
uuuucugcaucucca

SEQ ID NO: 1783992 - RNA, 16 nt, Homo sapiens
ugacucugucugccag

SEQ ID NO: 1783993 - RNA, 16 nt, Homo sapiens
gccugaacaugccccu

SEQ ID NO: 1783994 - RNA, 23 nt, Homo sapiens
aacccuagauugggguagaggga

SEQ ID NO: 1783995 - RNA, 22 nt, Homo sapiens
uuagcugugcgcaauugcucau

SEQ ID NO: 1783996 - RNA, 23 nt, Homo sapiens
ugcauucugagguaaccucauua

SEQ ID NO: 1783997 - RNA, 21 nt, Homo sapiens
uaauaaaucuauucugcugag

SEQ ID NO: 1783998 - RNA, 22 nt, Homo sapiens
caguggccgaaccccccacucc

SEQ ID NO: 1783999 - RNA, 18 nt, Homo sapiens
cuccccagaaucaagcuu

SEQ ID NO: 1784000 - RNA, 16 nt, Homo sapiens
gggagagacugugagg

SEQ ID NO: 1784001 - RNA, 14 nt, Homo sapiens
aacacggugcucau

SEQ ID NO: 1784002 - RNA, 15 nt, Homo sapiens
gccuggcuauguccu

SEQ ID NO: 1784003 - RNA, 14 nt, Homo sapiens
uguaauauaagaca

SEQ ID NO: 1784004 - RNA, 19 nt, Homo sapiens
agccguccuucuaaugaag

SEQ ID NO: 1784005 - RNA, 22 nt, Homo sapiens
cauguggccugcccagccucaa

SEQ ID NO: 1784006 - RNA, 18 nt, Homo sapiens
cugcagauagcccaggag

SEQ ID NO: 1784007 - RNA, 15 nt, Homo sapiens
gcaggaagugucuag

SEQ ID NO: 1784008 - RNA, 23 nt, Homo sapiens
aagagagucgcaucucagugcag

SEQ ID NO: 1784009 - RNA, 16 nt, Homo sapiens
uggccaaggaagaucc

SEQ ID NO: 1784010 - RNA, 16 nt, Homo sapiens
gcauaguauuggcaau

SEQ ID NO: 1784011 - RNA, 15 nt, Homo sapiens
aguaaaaagacauuu

SEQ ID NO: 1784012 - RNA, 14 nt, Homo sapiens
uauaaauuacaugc

SEQ ID NO: 1784013 - RNA, 23 nt, Homo sapiens
acuuggaagggggagacaggaag

SEQ ID NO: 1784014 - RNA, 19 nt, Homo sapiens
cauuaccuucuguuccuua

SEQ ID NO: 1784015 - RNA, 23 nt, Homo sapiens
uucugccacgcuuuaugcccuug

SEQ ID NO: 1784016 - RNA, 11 nt, Homo sapiens
ccggcugugau

SEQ ID NO: 1784017 - RNA, 15 nt, Homo sapiens
aaaggacccugugag

SEQ ID NO: 1784018 - RNA, 19 nt, Homo sapiens
cccauggcuuugugcugcu

SEQ ID NO: 1784019 - RNA, 12 nt, Homo sapiens
uggcucaccugg

SEQ ID NO: 1784020 - RNA, 20 nt, Homo sapiens
cagaccuagugcucccuucc

SEQ ID NO: 1784021 - RNA, 21 nt, Homo sapiens
ggcagaaacacucaaguugau

SEQ ID NO: 1784022 - RNA, 13 nt, Homo sapiens
uucagccaaguga

SEQ ID NO: 1784023 - RNA, 19 nt, Homo sapiens
cccaguaagccacugccac

SEQ ID NO: 1784024 - RNA, 19 nt, Homo sapiens
uucuuucccuaaagaacau

SEQ ID NO: 1784025 - RNA, 17 nt, Homo sapiens
auuaucuuuucauacau

SEQ ID NO: 1784026 - RNA, 15 nt, Homo sapiens
ucacccccacucugc

SEQ ID NO: 1784027 - RNA, 10 nt, Homo sapiens
acuacagggu

SEQ ID NO: 1784028 - RNA, 16 nt, Homo sapiens
auguauguguaccuaa

SEQ ID NO: 1784029 - RNA, 14 nt, Homo sapiens
uggacacugugcua

SEQ ID NO: 1784030 - RNA, 14 nt, Homo sapiens
uggacgcugugcug

SEQ ID NO: 1784031 - RNA, 14 nt, Homo sapiens
uggccucugugauu

SEQ ID NO: 1784032 - RNA, 11 nt, Homo sapiens
ugccuguguac

SEQ ID NO: 1784033 - RNA, 16 nt, Homo sapiens
gcuguuggucaugugg

SEQ ID NO: 1784034 - RNA, 16 nt, Homo sapiens
gacaagacacugagga

SEQ ID NO: 1784035 - RNA, 18 nt, Homo sapiens
acacaaguagaugccuga

SEQ ID NO: 1784036 - RNA, 13 nt, Homo sapiens
auccuacuucucu

SEQ ID NO: 1784037 - RNA, 12 nt, Homo sapiens
aauacaugccuu

SEQ ID NO: 1784038 - RNA, 13 nt, Homo sapiens
ucauacaaugaua

SEQ ID NO: 1784039 - RNA, 17 nt, Homo sapiens
agcacgcgacuucucag

SEQ ID NO: 1784040 - RNA, 11 nt, Homo sapiens
cuuccauguca

SEQ ID NO: 1784041 - RNA, 17 nt, Homo sapiens
aauucuuuauucuuccu

SEQ ID NO: 1784042 - RNA, 18 nt, Homo sapiens
uuccuauuucuuucagca

SEQ ID NO: 1784043 - RNA, 18 nt, Homo sapiens
aagaauggggaucacaga

SEQ ID NO: 1784044 - RNA, 22 nt, Homo sapiens
cuuuauaaauuuuuauaauuca

SEQ ID NO: 1784045 - RNA, 19 nt, Homo sapiens
cugccucugucucacugaa

SEQ ID NO: 1784046 - RNA, 14 nt, Homo sapiens
cagaauuacauaaa

SEQ ID NO: 1784047 - RNA, 14 nt, Homo sapiens
cugaaauacuuaau

SEQ ID NO: 1784048 - RNA, 11 nt, Homo sapiens
auaauuuugca

SEQ ID NO: 1784049 - RNA, 21 nt, Homo sapiens
guuguguuauagggcacacau

SEQ ID NO: 1784050 - RNA, 23 nt, Homo sapiens
uugagaccgugaagauacuuugu

SEQ ID NO: 1784051 - RNA, 16 nt, Homo sapiens
ccauaucuacccagaa

SEQ ID NO: 1784052 - RNA, 13 nt, Homo sapiens
uagugucaucacu

SEQ ID NO: 1784053 - RNA, 12 nt, Homo sapiens
guuuguuucauu

SEQ ID NO: 1784054 - RNA, 21 nt, Homo sapiens
auggacauauucuuuuuggaa

SEQ ID NO: 1784055 - RNA, 15 nt, Homo sapiens
cccucaggaccaaag

SEQ ID NO: 1784056 - RNA, 22 nt, Homo sapiens
aggcauaaagacuaauuagcaa

SEQ ID NO: 1784057 - RNA, 22 nt, Homo sapiens
cauuuuuauuacccuucuuucc

SEQ ID NO: 1784058 - RNA, 22 nt, Homo sapiens
uaucuugcuuuuuuucaccaau

SEQ ID NO: 1784059 - RNA, 12 nt, Homo sapiens
aauccuucaugu

SEQ ID NO: 1784060 - RNA, 12 nt, Homo sapiens
aauucuucaugc

SEQ ID NO: 1784061 - RNA, 16 nt, Homo sapiens
aauauauacauauuca

SEQ ID NO: 1784062 - RNA, 16 nt, Homo sapiens
ccauguuaacaugaca

SEQ ID NO: 1784063 - RNA, 16 nt, Homo sapiens
aaucaacucaucauuu

SEQ ID NO: 1784064 - RNA, 14 nt, Homo sapiens
uacagucacauuca

SEQ ID NO: 1784065 - RNA, 16 nt, Homo sapiens
uaugcaaaagcaagcu

SEQ ID NO: 1784066 - RNA, 18 nt, Homo sapiens
caagaauguuucuuuaua

SEQ ID NO: 1784067 - RNA, 19 nt, Homo sapiens
auaagaaucauagugccau

SEQ ID NO: 1784068 - RNA, 15 nt, Homo sapiens
ugacauaggauccga

SEQ ID NO: 1784069 - RNA, 23 nt, Homo sapiens
caucugggaaaauaccccaucau

SEQ ID NO: 1784070 - RNA, 18 nt, Homo sapiens
aaccagauggaacacugg

SEQ ID NO: 1784071 - RNA, 14 nt, Homo sapiens
accuuuauauuugg

SEQ ID NO: 1784072 - RNA, 14 nt, Homo sapiens
aacaagaaugcauu

SEQ ID NO: 1784073 - RNA, 15 nt, Homo sapiens
cuggaaucacauucu

SEQ ID NO: 1784074 - RNA, 14 nt, Homo sapiens
ugcuuugcugugaa

SEQ ID NO: 1784075 - RNA, 20 nt, Homo sapiens
gccagcaagagggaacaaaa

SEQ ID NO: 1784076 - RNA, 13 nt, Homo sapiens
aucacacaauaua

SEQ ID NO: 1784077 - RNA, 15 nt, Homo sapiens
uacacauacauauau

SEQ ID NO: 1784078 - RNA, 15 nt, Homo sapiens
ugcacacacguauac

SEQ ID NO: 1784079 - RNA, 20 nt, Homo sapiens
cucacccgccccacucccuc

SEQ ID NO: 1784080 - RNA, 12 nt, Homo sapiens
ucucccaccagc

SEQ ID NO: 1784081 - RNA, 23 nt, Homo sapiens
ccaggagguuugcagggagcuca

SEQ ID NO: 1784082 - RNA, 24 nt, Homo sapiens
aaagaaguugcuaagugugcuuag

SEQ ID NO: 1784083 - RNA, 13 nt, Homo sapiens
cacaacuucagga

SEQ ID NO: 1784084 - RNA, 15 nt, Homo sapiens
guuuugcuacauucu

SEQ ID NO: 1784085 - RNA, 21 nt, Homo sapiens
guuuaauucuguuaacugaag

SEQ ID NO: 1784086 - RNA, 18 nt, Homo sapiens
cuauuacaccuuuaucuc

SEQ ID NO: 1784087 - RNA, 18 nt, Homo sapiens
uacggggaaaaugcauuu

SEQ ID NO: 1784088 - RNA, 17 nt, Homo sapiens
uagcuucugcaauguuu

SEQ ID NO: 1784089 - RNA, 23 nt, Homo sapiens
aacuguacauacugcagugugaa

SEQ ID NO: 1784090 - RNA, 19 nt, Homo sapiens
aaucauauagaccaauuga

SEQ ID NO: 1784091 - RNA, 15 nt, Homo sapiens
auguauuaauacuua

SEQ ID NO: 1784092 - RNA, 16 nt, Homo sapiens
uaccauggcacugaca

SEQ ID NO: 1784093 - RNA, 21 nt, Homo sapiens
uacuuguuugguuugguauua

SEQ ID NO: 1784094 - RNA, 22 nt, Homo sapiens
cacuuuuuguugggcaauauga

SEQ ID NO: 1784095 - RNA, 17 nt, Homo sapiens
uaccugaaagcacugua

SEQ ID NO: 1784096 - RNA, 15 nt, Homo sapiens
cuuucccuggagcug

SEQ ID NO: 1784097 - RNA, 17 nt, Homo sapiens
gcuaugggaaaugcaaa

SEQ ID NO: 1784098 - RNA, 14 nt, Homo sapiens
ggcuucuaguuugc

SEQ ID NO: 1784099 - RNA, 18 nt, Homo sapiens
ucuggaaaaacaggauac

SEQ ID NO: 1784100 - RNA, 14 nt, Homo sapiens
aggagacauugcuc

SEQ ID NO: 1784101 - RNA, 17 nt, Homo sapiens
gagcccacacaugggau

SEQ ID NO: 1784102 - RNA, 21 nt, Homo sapiens
auugguggggcuggguaccaa

SEQ ID NO: 1784103 - RNA, 15 nt, Homo sapiens
cuugauuucagguca

SEQ ID NO: 1784104 - RNA, 19 nt, Homo sapiens
ccuaugccacccugcaaua

SEQ ID NO: 1784105 - RNA, 21 nt, Homo sapiens
cccaacuccaaacaauucuga

SEQ ID NO: 1784106 - RNA, 22 nt, Homo sapiens
uucacucagcuggacugcauug

SEQ ID NO: 1784107 - RNA, 22 nt, Homo sapiens
ugggggcagggcugugcuugaa

SEQ ID NO: 1784108 - RNA, 15 nt, Homo sapiens
uaucaugaugugcaa

SEQ ID NO: 1784109 - RNA, 20 nt, Homo sapiens
uagugaaacauguacuuuga

SEQ ID NO: 1784110 - RNA, 22 nt, Homo sapiens
acugcuccaagggacagguggg

SEQ ID NO: 1784111 - RNA, 21 nt, Homo sapiens
agagacaggguuucacugugu

SEQ ID NO: 1784112 - RNA, 21 nt, Homo sapiens
agccuuccacacucaccucua

SEQ ID NO: 1784113 - RNA, 13 nt, Homo sapiens
ugacauguagcuu

SEQ ID NO: 1784114 - RNA, 13 nt, Homo sapiens
cucugcugaucuc

SEQ ID NO: 1784115 - RNA, 13 nt, Homo sapiens
cccugcugaccuc

SEQ ID NO: 1784116 - RNA, 15 nt, Homo sapiens
acucagagcagauga

SEQ ID NO: 1784117 - RNA, 12 nt, Homo sapiens
ccaacagcaccc

SEQ ID NO: 1784118 - RNA, 13 nt, Homo sapiens
ccacacacugagu

SEQ ID NO: 1784119 - RNA, 23 nt, Homo sapiens
ucuccccuccugcacacagggca

SEQ ID NO: 1784120 - RNA, 19 nt, Homo sapiens
gacuuuguccccacuuaca

SEQ ID NO: 1784121 - RNA, 19 nt, Homo sapiens
gaacgcgacuuccacaaac

SEQ ID NO: 1784122 - RNA, 12 nt, Homo sapiens
cugcuguauacu

SEQ ID NO: 1784123 - RNA, 14 nt, Homo sapiens
uacaaggcuuuauc

SEQ ID NO: 1784124 - RNA, 13 nt, Homo sapiens
acauuugucauuu

SEQ ID NO: 1784125 - RNA, 21 nt, Homo sapiens
cuauaguuauauagauaaaga

SEQ ID NO: 1784126 - RNA, 19 nt, Homo sapiens
cugccugggacagccacug

SEQ ID NO: 1784127 - RNA, 19 nt, Homo sapiens
acaaagcacauaacuggau

SEQ ID NO: 1784128 - RNA, 17 nt, Homo sapiens
uugggcuccacauugca

SEQ ID NO: 1784129 - RNA, 23 nt, Homo sapiens
ccagcagugugucaggugcugca

SEQ ID NO: 1784130 - RNA, 21 nt, Homo sapiens
auacaaguacuagguugucca

SEQ ID NO: 1784131 - RNA, 19 nt, Homo sapiens
auuucccaggacccugaag

SEQ ID NO: 1784132 - RNA, 14 nt, Homo sapiens
ucuaauauggccac

SEQ ID NO: 1784133 - RNA, 17 nt, Homo sapiens
ucagccaacauugccuu

SEQ ID NO: 1784134 - RNA, 19 nt, Homo sapiens
cuaaucacauccacaaaac

SEQ ID NO: 1784135 - RNA, 17 nt, Homo sapiens
cugcaacucugaagggu

SEQ ID NO: 1784136 - RNA, 15 nt, Homo sapiens
aagaacuugcaauac

SEQ ID NO: 1784137 - RNA, 20 nt, Homo sapiens
gguggagugcaguggugcga

SEQ ID NO: 1784138 - RNA, 21 nt, Homo sapiens
gcuauggaggguccuccucca

SEQ ID NO: 1784139 - RNA, 15 nt, Homo sapiens
gggccuugaugguga

SEQ ID NO: 1784140 - RNA, 19 nt, Homo sapiens
cuuuggaggggaaaugggg

SEQ ID NO: 1784141 - RNA, 15 nt, Homo sapiens
aauacuacagcauaa

SEQ ID NO: 1784142 - RNA, 15 nt, Homo sapiens
uacuuuucuguucau

SEQ ID NO: 1784143 - RNA, 23 nt, Homo sapiens
cucagagaaaagagauugagaug

SEQ ID NO: 1784144 - RNA, 20 nt, Homo sapiens
uuccuguuugcugggagcuu

SEQ ID NO: 1784145 - RNA, 21 nt, Homo sapiens
aagcauuauccuuuuaucuca

SEQ ID NO: 1784146 - RNA, 20 nt, Homo sapiens
agcaggacugaugucuccua

SEQ ID NO: 1784147 - RNA, 17 nt, Homo sapiens
gcucuccauacuuugaa

SEQ ID NO: 1784148 - RNA, 14 nt, Homo sapiens
uaaaggucacuuuu

SEQ ID NO: 1784149 - RNA, 14 nt, Homo sapiens
aauaucuagcaugu

SEQ ID NO: 1784150 - RNA, 13 nt, Homo sapiens
uacagacuagcag

SEQ ID NO: 1784151 - RNA, 22 nt, Homo sapiens
gccagcugaagaguaaaggaaa

SEQ ID NO: 1784152 - RNA, 18 nt, Homo sapiens
caucugcuuuacucugga

SEQ ID NO: 1784153 - RNA, 20 nt, Homo sapiens
guuuagugaaaaacugcugu

SEQ ID NO: 1784154 - RNA, 21 nt, Homo sapiens
gccagccuccggcggggaccc

SEQ ID NO: 1784155 - RNA, 16 nt, Homo sapiens
aguccacuucugcucu

SEQ ID NO: 1784156 - RNA, 18 nt, Homo sapiens
gguuaccaccagccuuuc

SEQ ID NO: 1784157 - RNA, 23 nt, Homo sapiens
uggggagaggagugggaaauuga

SEQ ID NO: 1784158 - RNA, 12 nt, Homo sapiens
auagaacugucc

SEQ ID NO: 1784159 - RNA, 13 nt, Homo sapiens
caaaacagcauag

SEQ ID NO: 1784160 - RNA, 24 nt, Homo sapiens
uuaguaaauagggaaaauaaucuc

SEQ ID NO: 1784161 - RNA, 21 nt, Homo sapiens
ggcuccacuuggcuccucuca

SEQ ID NO: 1784162 - RNA, 17 nt, Homo sapiens
gacaccuuacuuuccca

SEQ ID NO: 1784163 - RNA, 12 nt, Homo sapiens
gagauuuccucc

SEQ ID NO: 1784164 - RNA, 21 nt, Homo sapiens
agccaugaucgagccacugca

SEQ ID NO: 1784165 - RNA, 13 nt, Homo sapiens
uacaaaaugcuaa

SEQ ID NO: 1784166 - RNA, 17 nt, Homo sapiens
ugccacacuagcuuccc

SEQ ID NO: 1784167 - RNA, 17 nt, Homo sapiens
auaugcacacacacgga

SEQ ID NO: 1784168 - RNA, 20 nt, Homo sapiens
gcugucuauguggcuguauc

SEQ ID NO: 1784169 - RNA, 20 nt, Homo sapiens
cgucccaaacagagggccac

SEQ ID NO: 1784170 - RNA, 22 nt, Homo sapiens
caaacuguacaguuucuucccc

SEQ ID NO: 1784171 - RNA, 15 nt, Homo sapiens
ugaggugacacucca

SEQ ID NO: 1784172 - RNA, 16 nt, Homo sapiens
aaauguacagacauau

SEQ ID NO: 1784173 - RNA, 18 nt, Homo sapiens
ccaaggagucacugagac

SEQ ID NO: 1784174 - RNA, 20 nt, Homo sapiens
cugcucgucuaucaccagga

SEQ ID NO: 1784175 - RNA, 17 nt, Homo sapiens
aguaaauauauauguca

SEQ ID NO: 1784176 - RNA, 21 nt, Homo sapiens
accacggccucacccaggcau

SEQ ID NO: 1784177 - RNA, 17 nt, Homo sapiens
aagcucaauucaaguga

SEQ ID NO: 1784178 - RNA, 13 nt, Homo sapiens
augauauucucau

SEQ ID NO: 1784179 - RNA, 14 nt, Homo sapiens
guaucaaaaucacu

SEQ ID NO: 1784180 - RNA, 22 nt, Homo sapiens
gcaaagauuuucaaacaaaaua

SEQ ID NO: 1784181 - RNA, 18 nt, Homo sapiens
gaaauugaauguaccuua

SEQ ID NO: 1784182 - RNA, 17 nt, Homo sapiens
gaaggggacgcuuugaa

SEQ ID NO: 1784183 - RNA, 16 nt, Homo sapiens
ccuagauucuacauau

SEQ ID NO: 1784184 - RNA, 18 nt, Homo sapiens
uguuguguauuccacuua

SEQ ID NO: 1784185 - RNA, 23 nt, Homo sapiens
ccuggucaauaaaccacuguucc

SEQ ID NO: 1784186 - RNA, 15 nt, Homo sapiens
ucagauacacaagga

SEQ ID NO: 1784187 - RNA, 21 nt, Homo sapiens
gcaagcacaaauuucaucucc

SEQ ID NO: 1784188 - RNA, 23 nt, Homo sapiens
cugagcgggaggcagaguuugcc

SEQ ID NO: 1784189 - RNA, 17 nt, Homo sapiens
ccaaacucaaacuugag

SEQ ID NO: 1784190 - RNA, 12 nt, Homo sapiens
agccauaugcag

SEQ ID NO: 1784191 - RNA, 21 nt, Homo sapiens
cuggaacuuuuuagauuauuc

SEQ ID NO: 1784192 - RNA, 21 nt, Homo sapiens
caggaacccuccagaccuccc

SEQ ID NO: 1784193 - RNA, 13 nt, Homo sapiens
guccuauguauau

SEQ ID NO: 1784194 - RNA, 22 nt, Homo sapiens
gcccauuaggucuggcaugccc

SEQ ID NO: 1784195 - RNA, 16 nt, Homo sapiens
uuuucccaaagcacuu

SEQ ID NO: 1784196 - RNA, 13 nt, Homo sapiens
gacugccugaaca

SEQ ID NO: 1784197 - RNA, 14 nt, Homo sapiens
auuucuaacauaag

SEQ ID NO: 1784198 - RNA, 21 nt, Homo sapiens
ucuguguagcaagcuauucaa

SEQ ID NO: 1784199 - RNA, 22 nt, Homo sapiens
agagaaaauuugaaaauguccu

SEQ ID NO: 1784200 - RNA, 18 nt, Homo sapiens
ugggugcaggacacuggu

SEQ ID NO: 1784201 - RNA, 16 nt, Homo sapiens
gccuggccuccugccu

SEQ ID NO: 1784202 - RNA, 12 nt, Homo sapiens
uuuaaaacacac

SEQ ID NO: 1784203 - RNA, 20 nt, Homo sapiens
gcuggagugcaguggcacca

SEQ ID NO: 1784204 - RNA, 21 nt, Homo sapiens
gucaauccaagagucugauga

SEQ ID NO: 1784205 - RNA, 15 nt, Homo sapiens
uggugcccacucccg

SEQ ID NO: 1784206 - RNA, 22 nt, Homo sapiens
uaauugauuugacccacucaca

SEQ ID NO: 1784207 - RNA, 21 nt, Homo sapiens
ccccugaccucaccuuugcaa

SEQ ID NO: 1784208 - RNA, 22 nt, Homo sapiens
acuguuccuucccccuuucccc

SEQ ID NO: 1784209 - RNA, 19 nt, Homo sapiens
uccacaaaugauguuuuca

SEQ ID NO: 1784210 - RNA, 17 nt, Homo sapiens
guagcuugcucccugug

SEQ ID NO: 1784211 - RNA, 13 nt, Homo sapiens
ugcgaggggccag

SEQ ID NO: 1784212 - RNA, 16 nt, Homo sapiens
ugcccucuguggugau

SEQ ID NO: 1784213 - RNA, 12 nt, Homo sapiens
auaauaaucaug

SEQ ID NO: 1784214 - RNA, 18 nt, Homo sapiens
uaccgaaaaucauauaau

SEQ ID NO: 1784215 - RNA, 19 nt, Homo sapiens
caggcugcuggagugcagu

SEQ ID NO: 1784216 - RNA, 23 nt, Homo sapiens
caaauacccaaaugucccugcaa

SEQ ID NO: 1784217 - RNA, 15 nt, Homo sapiens
aggagcuugcaagaa

SEQ ID NO: 1784218 - RNA, 14 nt, Homo sapiens
auauuucaauguua

SEQ ID NO: 1784219 - RNA, 14 nt, Homo sapiens
auuugcacaaguuc

SEQ ID NO: 1784220 - RNA, 18 nt, Homo sapiens
guucuuuaaaggcaucua

SEQ ID NO: 1784221 - RNA, 14 nt, Homo sapiens
aguacagacuuuuu

SEQ ID NO: 1784222 - RNA, 18 nt, Homo sapiens
ccuuucaagacagaaaga

SEQ ID NO: 1784223 - RNA, 16 nt, Homo sapiens
gaaucaaaaauugaag

SEQ ID NO: 1784224 - RNA, 19 nt, Homo sapiens
gaaaucuggcuucuggcca

SEQ ID NO: 1784225 - RNA, 12 nt, Homo sapiens
ccuaacugugaa

SEQ ID NO: 1784226 - RNA, 20 nt, Homo sapiens
cugucuuccaaggagaccaa

SEQ ID NO: 1784227 - RNA, 15 nt, Homo sapiens
ggccugguugugugc

SEQ ID NO: 1784228 - RNA, 16 nt, Homo sapiens
ccaccuccuccuccau

SEQ ID NO: 1784229 - RNA, 15 nt, Homo sapiens
cucauguauacuuca

SEQ ID NO: 1784230 - RNA, 14 nt, Homo sapiens
gagcaaagggccag

SEQ ID NO: 1784231 - RNA, 15 nt, Homo sapiens
acggauaguagacag

SEQ ID NO: 1784232 - RNA, 23 nt, Homo sapiens
uagaucaauuauacuacuucuaa

SEQ ID NO: 1784233 - RNA, 23 nt, Homo sapiens
auuaaacgaggcaaugacuguga

SEQ ID NO: 1784234 - RNA, 19 nt, Homo sapiens
aggaaaucagccuuucauc

SEQ ID NO: 1784235 - RNA, 15 nt, Homo sapiens
ucuuuacuggugauu

SEQ ID NO: 1784236 - RNA, 19 nt, Homo sapiens
guuaaaagggaacacaaaa

SEQ ID NO: 1784237 - RNA, 12 nt, Homo sapiens
gagaggacucug

SEQ ID NO: 1784238 - RNA, 14 nt, Homo sapiens
caaggacuuugcag

SEQ ID NO: 1784239 - RNA, 18 nt, Homo sapiens
uaauaaaaauuauuacca

SEQ ID NO: 1784240 - RNA, 17 nt, Homo sapiens
caucaaaaacacuacuc

SEQ ID NO: 1784241 - RNA, 13 nt, Homo sapiens
cuccuccagggaa

SEQ ID NO: 1784242 - RNA, 21 nt, Homo sapiens
aagcagucuuucuauccuguu

SEQ ID NO: 1784243 - RNA, 22 nt, Homo sapiens
auuuucacugcugcuccucuuu

SEQ ID NO: 1784244 - RNA, 20 nt, Homo sapiens
uccaguagcgagagacggca

SEQ ID NO: 1784245 - RNA, 20 nt, Homo sapiens
ccaggcuggagugcaauggc

SEQ ID NO: 1784246 - RNA, 20 nt, Homo sapiens
ccaggcuagagugcaguggc

SEQ ID NO: 1784247 - RNA, 14 nt, Homo sapiens
uuauguugcuccag

SEQ ID NO: 1784248 - RNA, 23 nt, Homo sapiens
aguugaaagaguccuauuugcac

SEQ ID NO: 1784249 - RNA, 22 nt, Homo sapiens
aacuacgggcugcucuacugcu

SEQ ID NO: 1784250 - RNA, 19 nt, Homo sapiens
cugccagcaguuacuguga

SEQ ID NO: 1784251 - RNA, 21 nt, Homo sapiens
uccauaaacacccaugaauca

SEQ ID NO: 1784252 - RNA, 16 nt, Homo sapiens
agaccaucaguucuuu

SEQ ID NO: 1784253 - RNA, 22 nt, Homo sapiens
cgcaccagcccagaagugcaga

SEQ ID NO: 1784254 - RNA, 16 nt, Homo sapiens
gugcugggcauuuuua

SEQ ID NO: 1784255 - RNA, 16 nt, Homo sapiens
cugccagggaggccau

SEQ ID NO: 1784256 - RNA, 16 nt, Homo sapiens
auuuacgcuacaugug

SEQ ID NO: 1784257 - RNA, 15 nt, Homo sapiens
aacacaagcauuuca

SEQ ID NO: 1784258 - RNA, 16 nt, Homo sapiens
gcugguggguggccca

SEQ ID NO: 1784259 - RNA, 23 nt, Homo sapiens
cugaucccccauagguggcugag

SEQ ID NO: 1784260 - RNA, 16 nt, Homo sapiens
accuuaaaaaguaauu

SEQ ID NO: 1784261 - RNA, 13 nt, Homo sapiens
cgacaccguguca

SEQ ID NO: 1784262 - RNA, 21 nt, Homo sapiens
aacucuaaaaaagaagcacca

SEQ ID NO: 1784263 - RNA, 16 nt, Homo sapiens
gucacccaaacacuuc

SEQ ID NO: 1784264 - RNA, 13 nt, Homo sapiens
agacauacauuuc

SEQ ID NO: 1784265 - RNA, 18 nt, Homo sapiens
gcccugucccuagcucac

SEQ ID NO: 1784266 - RNA, 21 nt, Homo sapiens
aauauuuuuguggacaugcau

SEQ ID NO: 1784267 - RNA, 14 nt, Homo sapiens
ggguucucacagug

SEQ ID NO: 1784268 - RNA, 22 nt, Homo sapiens
uaaaaaggaauaugaaagucuu

SEQ ID NO: 1784269 - RNA, 22 nt, Homo sapiens
acacucagcugcuucuuugguc

SEQ ID NO: 1784270 - RNA, 16 nt, Homo sapiens
agucccacacuguggc

SEQ ID NO: 1784271 - RNA, 14 nt, Homo sapiens
ucgggcagcugcag

SEQ ID NO: 1784272 - RNA, 17 nt, Homo sapiens
agucuuuagcuauuacu

SEQ ID NO: 1784273 - RNA, 13 nt, Homo sapiens
uauuucaaaggga

SEQ ID NO: 1784274 - RNA, 12 nt, Homo sapiens
aacuccuuacag

SEQ ID NO: 1784275 - RNA, 13 nt, Homo sapiens
aagccagugacac

SEQ ID NO: 1784276 - RNA, 16 nt, Homo sapiens
augacaaaggcacuga

SEQ ID NO: 1784277 - RNA, 12 nt, Homo sapiens
uuuaaucugcac

SEQ ID NO: 1784278 - RNA, 17 nt, Homo sapiens
guccugcagugugagau

SEQ ID NO: 1784279 - RNA, 17 nt, Homo sapiens
augugaguuuccugcua

SEQ ID NO: 1784280 - RNA, 20 nt, Homo sapiens
uggggaaacggcccaccaag

SEQ ID NO: 1784281 - RNA, 13 nt, Homo sapiens
agccccucuaccu

SEQ ID NO: 1784282 - RNA, 21 nt, Homo sapiens
ggcugggaugcugguggcucu

SEQ ID NO: 1784283 - RNA, 17 nt, Homo sapiens
aauucugguguuuacac

SEQ ID NO: 1784284 - RNA, 14 nt, Homo sapiens
aacacuugaaccug

SEQ ID NO: 1784285 - RNA, 23 nt, Homo sapiens
aggauauuucaaaugauuaugau

SEQ ID NO: 1784286 - RNA, 18 nt, Homo sapiens
ucaaaccucacauuugug

SEQ ID NO: 1784287 - RNA, 19 nt, Homo sapiens
uuguaaauaugugacauuc

SEQ ID NO: 1784288 - RNA, 21 nt, Homo sapiens
ucuucuaguuuugacauuuua

SEQ ID NO: 1784289 - RNA, 15 nt, Homo sapiens
aacgccgagugcacu

SEQ ID NO: 1784290 - RNA, 15 nt, Homo sapiens
ugagguugaggaaua

SEQ ID NO: 1784291 - RNA, 16 nt, Homo sapiens
aggcgagcuccuugaa

SEQ ID NO: 1784292 - RNA, 15 nt, Homo sapiens
gaaguucaagaucaa

SEQ ID NO: 1784293 - RNA, 18 nt, Homo sapiens
auaaauaucuagaaauga

SEQ ID NO: 1784294 - RNA, 20 nt, Homo sapiens
gcaaccagggagcugcaggg

SEQ ID NO: 1784295 - RNA, 14 nt, Homo sapiens
gccaucucugaacu

SEQ ID NO: 1784296 - RNA, 18 nt, Homo sapiens
caauauaacuaggcaaaa

SEQ ID NO: 1784297 - RNA, 17 nt, Homo sapiens
acauggucuguccugac

SEQ ID NO: 1784298 - RNA, 22 nt, Homo sapiens
agauugaaaaguguccucuggc

SEQ ID NO: 1784299 - RNA, 18 nt, Homo sapiens
acgugcgugucucugcca

SEQ ID NO: 1784300 - RNA, 14 nt, Homo sapiens
uccaaaucuguccu

SEQ ID NO: 1784301 - RNA, 15 nt, Homo sapiens
accuuggcagugugg

SEQ ID NO: 1784302 - RNA, 20 nt, Homo sapiens
ccauuggcuacugacuguau

SEQ ID NO: 1784303 - RNA, 13 nt, Homo sapiens
caccccucaaaaa

SEQ ID NO: 1784304 - RNA, 15 nt, Homo sapiens
aagauccucuugcca

SEQ ID NO: 1784305 - RNA, 16 nt, Homo sapiens
gggaggcuguagccag

SEQ ID NO: 1784306 - RNA, 17 nt, Homo sapiens
ccagagguuaucugccu

SEQ ID NO: 1784307 - RNA, 21 nt, Homo sapiens
uaaaacauaagaucacugcca

SEQ ID NO: 1784308 - RNA, 14 nt, Homo sapiens
agcaagguggagug

SEQ ID NO: 1784309 - RNA, 12 nt, Homo sapiens
agaccucaaggg

SEQ ID NO: 1784310 - RNA, 22 nt, Homo sapiens
ugggaaaaauguuggaauggga

SEQ ID NO: 1784311 - RNA, 16 nt, Homo sapiens
ucaaucugcaguuuaa

SEQ ID NO: 1784312 - RNA, 18 nt, Homo sapiens
ugauauaaagaaauaccu

SEQ ID NO: 1784313 - RNA, 21 nt, Homo sapiens
aucgacuuguuuuugcacaug

SEQ ID NO: 1784314 - RNA, 17 nt, Homo sapiens
agaggcuuccagucuca

SEQ ID NO: 1784315 - RNA, 16 nt, Homo sapiens
uagacaagcuugucca

SEQ ID NO: 1784316 - RNA, 14 nt, Homo sapiens
guucugcacacagc

SEQ ID NO: 1784317 - RNA, 10 nt, Homo sapiens
ugcugcucac

SEQ ID NO: 1784318 - RNA, 15 nt, Homo sapiens
ccaugugugacucca

SEQ ID NO: 1784319 - RNA, 14 nt, Homo sapiens
uugcauguacuuga

SEQ ID NO: 1784320 - RNA, 14 nt, Homo sapiens
cccaggaacaauaa

SEQ ID NO: 1784321 - RNA, 19 nt, Homo sapiens
cucuuuccccagcugauua

SEQ ID NO: 1784322 - RNA, 21 nt, Homo sapiens
acaugcacucagcucuuggcu

SEQ ID NO: 1784323 - RNA, 17 nt, Homo sapiens
ggaugauucaagccauu

SEQ ID NO: 1784324 - RNA, 18 nt, Homo sapiens
agagcacguccagccgcc

SEQ ID NO: 1784325 - RNA, 19 nt, Homo sapiens
auugaucgacuugccaaau

SEQ ID NO: 1784326 - RNA, 22 nt, Homo sapiens
gcaaugcuucuguagcuucuaa

SEQ ID NO: 1784327 - RNA, 17 nt, Homo sapiens
uucauacauuaucucac

SEQ ID NO: 1784328 - RNA, 19 nt, Homo sapiens
ugacuucuaguccaaauau

SEQ ID NO: 1784329 - RNA, 16 nt, Homo sapiens
aguagaggcuauggac

SEQ ID NO: 1784330 - RNA, 14 nt, Homo sapiens
gccacuacauugag

SEQ ID NO: 1784331 - RNA, 18 nt, Homo sapiens
cacugaugcccuuuggaa

SEQ ID NO: 1784332 - RNA, 18 nt, Homo sapiens
aacaauguuaaaugcaau

SEQ ID NO: 1784333 - RNA, 15 nt, Homo sapiens
cuggugagugccacg

SEQ ID NO: 1784334 - RNA, 22 nt, Homo sapiens
gcaugaggugagagaaagccac

SEQ ID NO: 1784335 - RNA, 22 nt, Homo sapiens
gcugauugaagacacacucagc

SEQ ID NO: 1784336 - RNA, 20 nt, Homo sapiens
cuuugggccagacaugccac

SEQ ID NO: 1784337 - RNA, 22 nt, Homo sapiens
agcuaaugucacaauuaugugc

SEQ ID NO: 1784338 - RNA, 21 nt, Homo sapiens
uggaacaggcucagaucucau

SEQ ID NO: 1784339 - RNA, 17 nt, Homo sapiens
augccuauuuacuggaa

SEQ ID NO: 1784340 - RNA, 13 nt, Homo sapiens
gugagcuaugcaa

SEQ ID NO: 1784341 - RNA, 16 nt, Homo sapiens
cuauucagacaagcaa

SEQ ID NO: 1784342 - RNA, 20 nt, Homo sapiens
cugugaaagaaccaaaagag

SEQ ID NO: 1784343 - RNA, 17 nt, Homo sapiens
gaugucagcagacacac

SEQ ID NO: 1784344 - RNA, 22 nt, Homo sapiens
uguguaaauggcuggggggcca

SEQ ID NO: 1784345 - RNA, 14 nt, Homo sapiens
auuuuauagcuacu

SEQ ID NO: 1784346 - RNA, 22 nt, Homo sapiens
agcugaagaaaaugaagcccua

SEQ ID NO: 1784347 - RNA, 20 nt, Homo sapiens
ugggucucugggcugucagc

SEQ ID NO: 1784348 - RNA, 18 nt, Homo sapiens
cccucaugaaaacacaca

SEQ ID NO: 1784349 - RNA, 12 nt, Homo sapiens
ccagcuaugaau

SEQ ID NO: 1784350 - RNA, 15 nt, Homo sapiens
ccugcucccagacau

SEQ ID NO: 1784351 - RNA, 18 nt, Homo sapiens
uagagggccuugcuucuc

SEQ ID NO: 1784352 - RNA, 14 nt, Homo sapiens
agcuucacugucau

SEQ ID NO: 1784353 - RNA, 19 nt, Homo sapiens
uauaggccuguguguauag

SEQ ID NO: 1784354 - RNA, 13 nt, Homo sapiens
uauacaaacaggu

SEQ ID NO: 1784355 - RNA, 21 nt, Homo sapiens
uucuaguaccugugacucuua

SEQ ID NO: 1784356 - RNA, 18 nt, Homo sapiens
auagaggugaugcugcua

SEQ ID NO: 1784357 - RNA, 13 nt, Homo sapiens
gaagguuaaguca

SEQ ID NO: 1784358 - RNA, 13 nt, Homo sapiens
uauggaguagcca

SEQ ID NO: 1784359 - RNA, 15 nt, Homo sapiens
ucucaaauuagaaag

SEQ ID NO: 1784360 - RNA, 13 nt, Homo sapiens
gcauuuggaacaa

SEQ ID NO: 1784361 - RNA, 12 nt, Homo sapiens
aaccucacugcc

SEQ ID NO: 1784362 - RNA, 16 nt, Homo sapiens
ugauuauauaagcaaa

SEQ ID NO: 1784363 - RNA, 18 nt, Homo sapiens
agauauuaauaauuccaa

SEQ ID NO: 1784364 - RNA, 15 nt, Homo sapiens
uucacgaacuguuca

SEQ ID NO: 1784365 - RNA, 22 nt, Homo sapiens
uuauaguuucagauauauauca

SEQ ID NO: 1784366 - RNA, 23 nt, Homo sapiens
uggagggcaacauuccacagcug

SEQ ID NO: 1784367 - RNA, 18 nt, Homo sapiens
cccuggaaggacauccau

SEQ ID NO: 1784368 - RNA, 21 nt, Homo sapiens
aguauuuuccuccaggcaaaa

SEQ ID NO: 1784369 - RNA, 12 nt, Homo sapiens
ucuagaauuugg

SEQ ID NO: 1784370 - RNA, 22 nt, Homo sapiens
uacccacugaagcccauuucuc

SEQ ID NO: 1784371 - RNA, 21 nt, Homo sapiens
uauauaaaagguuguguacaa

SEQ ID NO: 1784372 - RNA, 20 nt, Homo sapiens
uacaaccugugaucaagcaa

SEQ ID NO: 1784373 - RNA, 22 nt, Homo sapiens
gacaguaguaccaaaugcuuua

SEQ ID NO: 1784374 - RNA, 18 nt, Homo sapiens
gcagaccugggacuuuag

SEQ ID NO: 1784375 - RNA, 20 nt, Homo sapiens
accugcuuugugagccagca

SEQ ID NO: 1784376 - RNA, 18 nt, Homo sapiens
uuuugccuaccuggguca

SEQ ID NO: 1784377 - RNA, 21 nt, Homo sapiens
ucucccugccaagucucagaa

SEQ ID NO: 1784378 - RNA, 14 nt, Homo sapiens
auuaguauccuguu

SEQ ID NO: 1784379 - RNA, 15 nt, Homo sapiens
uaacucccuccacca

SEQ ID NO: 1784380 - RNA, 14 nt, Homo sapiens
cuuagaauacugua

SEQ ID NO: 1784381 - RNA, 20 nt, Homo sapiens
aaggaaaaaugcugcuucuc

SEQ ID NO: 1784382 - RNA, 13 nt, Homo sapiens
cuccaaaacccau

SEQ ID NO: 1784383 - RNA, 17 nt, Homo sapiens
acaguuuuaacugugga

SEQ ID NO: 1784384 - RNA, 23 nt, Homo sapiens
uugaagcccuccaaaagcacuua

SEQ ID NO: 1784385 - RNA, 21 nt, Homo sapiens
aaacucuggaugauucuucca

SEQ ID NO: 1784386 - RNA, 13 nt, Homo sapiens
uccaugagcugcu

SEQ ID NO: 1784387 - RNA, 12 nt, Homo sapiens
uguaagauuuca

SEQ ID NO: 1784388 - RNA, 22 nt, Homo sapiens
caaaccuuuuguucuguaaaac

SEQ ID NO: 1784389 - RNA, 23 nt, Homo sapiens
ccaguguccccuccacugucaca

SEQ ID NO: 1784390 - RNA, 19 nt, Homo sapiens
uucaaguacuguaacugug

SEQ ID NO: 1784391 - RNA, 14 nt, Homo sapiens
cagcaggcucucag

SEQ ID NO: 1784392 - RNA, 19 nt, Homo sapiens
cacugcagcaugcccagug

SEQ ID NO: 1784393 - RNA, 16 nt, Homo sapiens
agagauaaugaggcaa

SEQ ID NO: 1784394 - RNA, 18 nt, Homo sapiens
gaugguaaucugaggcaa

SEQ ID NO: 1784395 - RNA, 20 nt, Homo sapiens
cuaaacucuuucauccccug

SEQ ID NO: 1784396 - RNA, 13 nt, Homo sapiens
auccaucaucugc

SEQ ID NO: 1784397 - RNA, 20 nt, Homo sapiens
cauauuauuuuaguguguaa

SEQ ID NO: 1784398 - RNA, 13 nt, Homo sapiens
uaaucuguagggc

SEQ ID NO: 1784399 - RNA, 18 nt, Homo sapiens
caugagucagucugauga

SEQ ID NO: 1784400 - RNA, 13 nt, Homo sapiens
guuccuguuugcu

SEQ ID NO: 1784401 - RNA, 18 nt, Homo sapiens
gagaugacccaaucugcc

SEQ ID NO: 1784402 - RNA, 15 nt, Homo sapiens
ugcaccaccaugcca

SEQ ID NO: 1784403 - RNA, 14 nt, Homo sapiens
cuucucauagcauu

SEQ ID NO: 1784404 - RNA, 22 nt, Homo sapiens
cauagguuacuaccuauacaau

SEQ ID NO: 1784405 - RNA, 13 nt, Homo sapiens
aaccugcaguuuu

SEQ ID NO: 1784406 - RNA, 17 nt, Homo sapiens
aauuaucaagcuaauaa

SEQ ID NO: 1784407 - RNA, 21 nt, Homo sapiens
gcaggggagacaggagccuag

SEQ ID NO: 1784408 - RNA, 16 nt, Homo sapiens
uacguugugcauuugg

SEQ ID NO: 1784409 - RNA, 18 nt, Homo sapiens
caaggaaaaaaauucugu

SEQ ID NO: 1784410 - RNA, 13 nt, Homo sapiens
guaauugucucaa

SEQ ID NO: 1784411 - RNA, 22 nt, Homo sapiens
agacaggguuucaccauguuag

SEQ ID NO: 1784412 - RNA, 23 nt, Homo sapiens
uggagccccuggggcggugcugg

SEQ ID NO: 1784413 - RNA, 15 nt, Homo sapiens
uucaacaucuaguga

SEQ ID NO: 1784414 - RNA, 20 nt, Homo sapiens
aaucaagucagcaacagagc

SEQ ID NO: 1784415 - RNA, 16 nt, Homo sapiens
uuaaaaaucaguuugu

SEQ ID NO: 1784416 - RNA, 22 nt, Homo sapiens
augccaaccagcuucccuacuc

SEQ ID NO: 1784417 - RNA, 12 nt, Homo sapiens
guucaagcaauu

SEQ ID NO: 1784418 - RNA, 16 nt, Homo sapiens
aucaucucuuccucac

SEQ ID NO: 1784419 - RNA, 16 nt, Homo sapiens
uucugcuagagcagac

SEQ ID NO: 1784420 - RNA, 18 nt, Homo sapiens
aggagcugauacuuugac

SEQ ID NO: 1784421 - RNA, 20 nt, Homo sapiens
ccuuagcugccaagccccau

SEQ ID NO: 1784422 - RNA, 21 nt, Homo sapiens
aaauuagggcucuaauuuccu

SEQ ID NO: 1784423 - RNA, 13 nt, Homo sapiens
cuauucuuuucaa

SEQ ID NO: 1784424 - RNA, 17 nt, Homo sapiens
acugcuacacuucugau

SEQ ID NO: 1784425 - RNA, 18 nt, Homo sapiens
ugaucuguggagaaugua

SEQ ID NO: 1784426 - RNA, 22 nt, Homo sapiens
ggccuugaugaaauaacacagc

SEQ ID NO: 1784427 - RNA, 15 nt, Homo sapiens
acuuaacaacugacu

SEQ ID NO: 1784428 - RNA, 23 nt, Homo sapiens
ccaaagcaaaacaucacauucca

SEQ ID NO: 1784429 - RNA, 23 nt, Homo sapiens
agcugcaggcuuugccauuguga

SEQ ID NO: 1784430 - RNA, 20 nt, Homo sapiens
guaguggaauuaacaggaaa

SEQ ID NO: 1784431 - RNA, 17 nt, Homo sapiens
gagguggcucaugccug

SEQ ID NO: 1784432 - RNA, 14 nt, Homo sapiens
uccucuccuacuuu

SEQ ID NO: 1784433 - RNA, 11 nt, Homo sapiens
auuaacauguc

SEQ ID NO: 1784434 - RNA, 18 nt, Homo sapiens
uauugaugagagggaaaa

SEQ ID NO: 1784435 - RNA, 19 nt, Homo sapiens
caaggcugccggcugcacc

SEQ ID NO: 1784436 - RNA, 22 nt, Homo sapiens
aagauccacauccucuacaggu

SEQ ID NO: 1784437 - RNA, 22 nt, Homo sapiens
caaucauguacugggaaggcaa

SEQ ID NO: 1784438 - RNA, 18 nt, Homo sapiens
uccuuaaagguagucaag

SEQ ID NO: 1784439 - RNA, 20 nt, Homo sapiens
ccaguucagcuuggugggag

SEQ ID NO: 1784440 - RNA, 15 nt, Homo sapiens
cagaguagaaacuca

SEQ ID NO: 1784441 - RNA, 12 nt, Homo sapiens
uuauaaucaaaa

SEQ ID NO: 1784442 - RNA, 12 nt, Homo sapiens
caagaaccugcu

SEQ ID NO: 1784443 - RNA, 15 nt, Homo sapiens
ccuacugaaugcucu

SEQ ID NO: 1784444 - RNA, 22 nt, Homo sapiens
ugugggcuggugccccacagcu

SEQ ID NO: 1784445 - RNA, 20 nt, Homo sapiens
uagagaaggcugugagccaa

SEQ ID NO: 1784446 - RNA, 20 nt, Homo sapiens
acugacccugauacaggcau

SEQ ID NO: 1784447 - RNA, 15 nt, Homo sapiens
uauugcagcuuauau

SEQ ID NO: 1784448 - RNA, 20 nt, Homo sapiens
auauauaauguggggugaaa

SEQ ID NO: 1784449 - RNA, 14 nt, Homo sapiens
aaaagguccuugac

SEQ ID NO: 1784450 - RNA, 22 nt, Homo sapiens
uccaacugucagaucuggaucg

SEQ ID NO: 1784451 - RNA, 18 nt, Homo sapiens
cccaacaagauugcuuaa

SEQ ID NO: 1784452 - RNA, 14 nt, Homo sapiens
aaacaaaagcucau

SEQ ID NO: 1784453 - RNA, 22 nt, Homo sapiens
ucuguguuuugaaugguguugu

SEQ ID NO: 1784454 - RNA, 21 nt, Homo sapiens
cucuccaaccuaacuggcuua

SEQ ID NO: 1784455 - RNA, 14 nt, Homo sapiens
gaccucagccugug

SEQ ID NO: 1784456 - RNA, 22 nt, Homo sapiens
uauagauuaaaucauacuccua

SEQ ID NO: 1784457 - RNA, 20 nt, Homo sapiens
cagaugccagcgccaugcuu

SEQ ID NO: 1784458 - RNA, 19 nt, Homo sapiens
uaugugggugggaccacag

SEQ ID NO: 1784459 - RNA, 22 nt, Homo sapiens
ccuucaaaauguucuauuuaac

SEQ ID NO: 1784460 - RNA, 20 nt, Homo sapiens
uggggacagaaaugccacuc

SEQ ID NO: 1784461 - RNA, 15 nt, Homo sapiens
aaauuuuuacaucaa

SEQ ID NO: 1784462 - RNA, 19 nt, Homo sapiens
agcccuaaaucuagacuca

SEQ ID NO: 1784463 - RNA, 22 nt, Homo sapiens
gcaaucccccaucguuacccau

SEQ ID NO: 1784464 - RNA, 10 nt, Homo sapiens
gccuaugaaa

SEQ ID NO: 1784465 - RNA, 18 nt, Homo sapiens
agaugaaauuuauuucca

SEQ ID NO: 1784466 - RNA, 23 nt, Homo sapiens
ggauggcacuccggccaccuccu

SEQ ID NO: 1784467 - RNA, 22 nt, Homo sapiens
ugauuuccccuuuugcauucuc

SEQ ID NO: 1784468 - RNA, 20 nt, Homo sapiens
gagaaggcaaccuugacucu

SEQ ID NO: 1784469 - RNA, 14 nt, Homo sapiens
gcaucuuguuucau

SEQ ID NO: 1784470 - RNA, 15 nt, Homo sapiens
cagccacuuuaguga

SEQ ID NO: 1784471 - RNA, 15 nt, Homo sapiens
ugcugucuugcccca

SEQ ID NO: 1784472 - RNA, 23 nt, Homo sapiens
caggagccggacacuucucagga

SEQ ID NO: 1784473 - RNA, 22 nt, Homo sapiens
ucucggagcccucagacaucuc

SEQ ID NO: 1784474 - RNA, 18 nt, Homo sapiens
augucuaaauggcuuuaa

SEQ ID NO: 1784475 - RNA, 21 nt, Homo sapiens
agaucaucuccaaaucuugcc

SEQ ID NO: 1784476 - RNA, 15 nt, Homo sapiens
aaaucauacuccuau

SEQ ID NO: 1784477 - RNA, 20 nt, Homo sapiens
agucgggaccucccaggaca

SEQ ID NO: 1784478 - RNA, 15 nt, Homo sapiens
acgcugucuccagac

SEQ ID NO: 1784479 - RNA, 22 nt, Homo sapiens
uuuagcuaccucacuaugcugc

SEQ ID NO: 1784480 - RNA, 14 nt, Homo sapiens
accucuccaugauc

SEQ ID NO: 1784481 - RNA, 15 nt, Homo sapiens
aauuuacacauucau

SEQ ID NO: 1784482 - RNA, 21 nt, Homo sapiens
gacagcacugggaaccuagcu

SEQ ID NO: 1784483 - RNA, 14 nt, Homo sapiens
aaauuauaguuuca

SEQ ID NO: 1784484 - RNA, 20 nt, Homo sapiens
aaggggaaguaucaaacuac

SEQ ID NO: 1784485 - RNA, 18 nt, Homo sapiens
ugacaucucaguucacug

SEQ ID NO: 1784486 - RNA, 19 nt, Homo sapiens
ccaggagagagcuacggca

SEQ ID NO: 1784487 - RNA, 18 nt, Homo sapiens
cuauucugagaaaacaag

SEQ ID NO: 1784488 - RNA, 15 nt, Homo sapiens
gucaacaacuuacac

SEQ ID NO: 1784489 - RNA, 12 nt, Homo sapiens
ucaugaugcuag

SEQ ID NO: 1784490 - RNA, 13 nt, Homo sapiens
cagagaagccagg

SEQ ID NO: 1784491 - RNA, 21 nt, Homo sapiens
uucuuaauucauccuagcaaa

SEQ ID NO: 1784492 - RNA, 18 nt, Homo sapiens
ucugucaccaacugaagu

SEQ ID NO: 1784493 - RNA, 19 nt, Homo sapiens
acccuaaugcuaguuucau

SEQ ID NO: 1784494 - RNA, 22 nt, Homo sapiens
guuuuucugcuuuagacuugaa

SEQ ID NO: 1784495 - RNA, 16 nt, Homo sapiens
guuaagugacugagaa

SEQ ID NO: 1784496 - RNA, 13 nt, Homo sapiens
uggccgggacccc

SEQ ID NO: 1784497 - RNA, 14 nt, Homo sapiens
aacuuuacuuucag

SEQ ID NO: 1784498 - RNA, 16 nt, Homo sapiens
uuucccugcaccacuc

SEQ ID NO: 1784499 - RNA, 22 nt, Homo sapiens
aacagugcuauucugagugaaa

SEQ ID NO: 1784500 - RNA, 13 nt, Homo sapiens
gaucuuugcaaag

SEQ ID NO: 1784501 - RNA, 14 nt, Homo sapiens
uuguagacaugccc

SEQ ID NO: 1784502 - RNA, 14 nt, Homo sapiens
cagcagcacuggaa

SEQ ID NO: 1784503 - RNA, 14 nt, Homo sapiens
cauucccaagccau

SEQ ID NO: 1784504 - RNA, 19 nt, Homo sapiens
aucuguuuuggauguugcu

SEQ ID NO: 1784505 - RNA, 13 nt, Homo sapiens
cuccccauuccua

SEQ ID NO: 1784506 - RNA, 15 nt, Homo sapiens
uuagaauguugaaaa

SEQ ID NO: 1784507 - RNA, 23 nt, Homo sapiens
aaagugccuucagccaagaccau

SEQ ID NO: 1784508 - RNA, 16 nt, Homo sapiens
ugucuacuaagugaug

SEQ ID NO: 1784509 - RNA, 23 nt, Homo sapiens
uuugcuggggaacuggcgccauc

SEQ ID NO: 1784510 - RNA, 13 nt, Homo sapiens
ccugucuccuuau

SEQ ID NO: 1784511 - RNA, 20 nt, Homo sapiens
acacuucugcuuucacuuaa

SEQ ID NO: 1784512 - RNA, 21 nt, Homo sapiens
cucuuuaccauagcuuaagaa

SEQ ID NO: 1784513 - RNA, 21 nt, Homo sapiens
uauuaaaagaaaccuaaaugu

SEQ ID NO: 1784514 - RNA, 13 nt, Homo sapiens
caucacaguuuug

SEQ ID NO: 1784515 - RNA, 15 nt, Homo sapiens
cacaguuguguuccu

SEQ ID NO: 1784516 - RNA, 21 nt, Homo sapiens
uagcaggccauggcucauggg

SEQ ID NO: 1784517 - RNA, 16 nt, Homo sapiens
aucaaaaucacuaucu

SEQ ID NO: 1784518 - RNA, 15 nt, Homo sapiens
augagaaaugaugaa

SEQ ID NO: 1784519 - RNA, 15 nt, Homo sapiens
augugcuaugaagcu

SEQ ID NO: 1784520 - RNA, 15 nt, Homo sapiens
cauucaguuaucacu

SEQ ID NO: 1784521 - RNA, 15 nt, Homo sapiens
ucauacguccaccau

SEQ ID NO: 1784522 - RNA, 17 nt, Homo sapiens
aauaaaauccuaagaca

SEQ ID NO: 1784523 - RNA, 13 nt, Homo sapiens
uaacacuauccaa

SEQ ID NO: 1784524 - RNA, 14 nt, Homo sapiens
gagaccguccucac

SEQ ID NO: 1784525 - RNA, 20 nt, Homo sapiens
cugaguuaaauaauugcucc

SEQ ID NO: 1784526 - RNA, 16 nt, Homo sapiens
uuaagugaauacauua

SEQ ID NO: 1784527 - RNA, 21 nt, Homo sapiens
gggcacagggccuggcccaug

SEQ ID NO: 1784528 - RNA, 17 nt, Homo sapiens
uccuuucacuucuuucc

SEQ ID NO: 1784529 - RNA, 15 nt, Homo sapiens
aaagaauguuuggca

SEQ ID NO: 1784530 - RNA, 13 nt, Homo sapiens
aaaaugacauuaa

SEQ ID NO: 1784531 - RNA, 23 nt, Homo sapiens
gcucaauuuaauuuugcaggauu

SEQ ID NO: 1784532 - RNA, 21 nt, Homo sapiens
acagcuauuauauaaauauau

SEQ ID NO: 1784533 - RNA, 15 nt, Homo sapiens
acacugaaaccaaaa

SEQ ID NO: 1784534 - RNA, 20 nt, Homo sapiens
agaucggauccaguuuccca

SEQ ID NO: 1784535 - RNA, 15 nt, Homo sapiens
guauuuuaugaucuu

SEQ ID NO: 1784536 - RNA, 13 nt, Homo sapiens
guguuaccauccc

SEQ ID NO: 1784537 - RNA, 21 nt, Homo sapiens
cagagcugcugcacacacuca

SEQ ID NO: 1784538 - RNA, 14 nt, Homo sapiens
ugacaccagccuuu

SEQ ID NO: 1784539 - RNA, 23 nt, Homo sapiens
acugaggaacucacaauuccaaa

SEQ ID NO: 1784540 - RNA, 13 nt, Homo sapiens
gcaugcgcagcgg

SEQ ID NO: 1784541 - RNA, 18 nt, Homo sapiens
ugugcaguuaauacuuaa

SEQ ID NO: 1784542 - RNA, 16 nt, Homo sapiens
ucuaccaggugaucua

SEQ ID NO: 1784543 - RNA, 11 nt, Homo sapiens
ucuuauacuuc

SEQ ID NO: 1784544 - RNA, 20 nt, Homo sapiens
uguaaugcuuguacaguuga

SEQ ID NO: 1784545 - RNA, 20 nt, Homo sapiens
gagcaggcccugggccucca

SEQ ID NO: 1784546 - RNA, 19 nt, Homo sapiens
ugcuggagaggaacccaga

SEQ ID NO: 1784547 - RNA, 18 nt, Homo sapiens
ccagaaauccaguuauuu

SEQ ID NO: 1784548 - RNA, 14 nt, Homo sapiens
guuuucuucauuca

SEQ ID NO: 1784549 - RNA, 14 nt, Homo sapiens
augauccauuugaa

SEQ ID NO: 1784550 - RNA, 22 nt, Homo sapiens
ugccucacaauuaugcugugaa

SEQ ID NO: 1784551 - RNA, 23 nt, Homo sapiens
cacaagugguguuuauugcaaua

SEQ ID NO: 1784552 - RNA, 18 nt, Homo sapiens
uuucuggauggcaucuag

SEQ ID NO: 1784553 - RNA, 17 nt, Homo sapiens
gccgcccagaucaugcc

SEQ ID NO: 1784554 - RNA, 14 nt, Homo sapiens
ugguaaaugccaca

SEQ ID NO: 1784555 - RNA, 16 nt, Homo sapiens
auguuagcugcugaaa

SEQ ID NO: 1784556 - RNA, 14 nt, Homo sapiens
guguauuguguaug

SEQ ID NO: 1784557 - RNA, 13 nt, Homo sapiens
uguaggagcugga

SEQ ID NO: 1784558 - RNA, 14 nt, Homo sapiens
gcaaaucagacaca

SEQ ID NO: 1784559 - RNA, 14 nt, Homo sapiens
caccaucaccacca

SEQ ID NO: 1784560 - RNA, 14 nt, Homo sapiens
uaaaucucuuuaag

SEQ ID NO: 1784561 - RNA, 12 nt, Homo sapiens
ucgggagcugca

SEQ ID NO: 1784562 - RNA, 22 nt, Homo sapiens
uuaucgaacacauucagugaua

SEQ ID NO: 1784563 - RNA, 14 nt, Homo sapiens
augaaaucugagga

SEQ ID NO: 1784564 - RNA, 18 nt, Homo sapiens
ugaaagcugaauccuucc

SEQ ID NO: 1784565 - RNA, 13 nt, Homo sapiens
auacauacuauga

SEQ ID NO: 1784566 - RNA, 16 nt, Homo sapiens
acuucaucaaucaaau

SEQ ID NO: 1784567 - RNA, 15 nt, Homo sapiens
auaagaccccacugg

SEQ ID NO: 1784568 - RNA, 19 nt, Homo sapiens
cucaguggcugauucugaa

SEQ ID NO: 1784569 - RNA, 18 nt, Homo sapiens
acgccagaacugcuuuau

SEQ ID NO: 1784570 - RNA, 12 nt, Homo sapiens
agauacauuucc

SEQ ID NO: 1784571 - RNA, 18 nt, Homo sapiens
ccuuccaaaccucaauaa

SEQ ID NO: 1784572 - RNA, 12 nt, Homo sapiens
cagaacuccaua

SEQ ID NO: 1784573 - RNA, 13 nt, Homo sapiens
uucuucuuuaggc

SEQ ID NO: 1784574 - RNA, 20 nt, Homo sapiens
cucuucuguuugcacaccca

SEQ ID NO: 1784575 - RNA, 18 nt, Homo sapiens
ugaugaauaaaaugaagg

SEQ ID NO: 1784576 - RNA, 17 nt, Homo sapiens
gacacuuacuccaguaa

SEQ ID NO: 1784577 - RNA, 18 nt, Homo sapiens
auuaaacucuccuuugau

SEQ ID NO: 1784578 - RNA, 20 nt, Homo sapiens
cguuaucauggagaacagca

SEQ ID NO: 1784579 - RNA, 17 nt, Homo sapiens
ccuguuccugacuguuc

SEQ ID NO: 1784580 - RNA, 20 nt, Homo sapiens
caaugcaaccaacuauccaa

SEQ ID NO: 1784581 - RNA, 17 nt, Homo sapiens
cacuaaacuucuuaacg

SEQ ID NO: 1784582 - RNA, 23 nt, Homo sapiens
gucuugaaaguggcaccagaggu

SEQ ID NO: 1784583 - RNA, 16 nt, Homo sapiens
auguaaucaacauucc

SEQ ID NO: 1784584 - RNA, 15 nt, Homo sapiens
auuaucaccaugaca

SEQ ID NO: 1784585 - RNA, 17 nt, Homo sapiens
guauacagaccagguga

SEQ ID NO: 1784586 - RNA, 13 nt, Homo sapiens
ccugaaaauaugu

SEQ ID NO: 1784587 - RNA, 13 nt, Homo sapiens
gacagcuugagaa

SEQ ID NO: 1784588 - RNA, 17 nt, Homo sapiens
ucucaaaggaaauaagg

SEQ ID NO: 1784589 - RNA, 18 nt, Homo sapiens
gacugaccaucaugcccu

SEQ ID NO: 1784590 - RNA, 18 nt, Homo sapiens
guaauuuuucuaagcaua

SEQ ID NO: 1784591 - RNA, 11 nt, Homo sapiens
ucaaaacugaa

SEQ ID NO: 1784592 - RNA, 19 nt, Homo sapiens
agagagccuggugcugcug

SEQ ID NO: 1784593 - RNA, 19 nt, Homo sapiens
cagcccuccccaccugcuc

SEQ ID NO: 1784594 - RNA, 12 nt, Homo sapiens
gaaaacaauucu

SEQ ID NO: 1784595 - RNA, 20 nt, Homo sapiens
uccagaugagaguacacccc

SEQ ID NO: 1784596 - RNA, 16 nt, Homo sapiens
ucccaggaggugcaga

SEQ ID NO: 1784597 - RNA, 12 nt, Homo sapiens
uguuuugacaca

SEQ ID NO: 1784598 - RNA, 20 nt, Homo sapiens
caucucguauaauauucaca

SEQ ID NO: 1784599 - RNA, 17 nt, Homo sapiens
cuucggaguuucuuagu

SEQ ID NO: 1784600 - RNA, 18 nt, Homo sapiens
uaaaauauguccagaaga

SEQ ID NO: 1784601 - RNA, 19 nt, Homo sapiens
auuuguaauagccaaaaag

SEQ ID NO: 1784602 - RNA, 18 nt, Homo sapiens
ucuugcuauguugcccag

SEQ ID NO: 1784603 - RNA, 14 nt, Homo sapiens
aggguccucugaga

SEQ ID NO: 1784604 - RNA, 22 nt, Homo sapiens
aauggcuucccucuuucaucuc

SEQ ID NO: 1784605 - RNA, 22 nt, Homo sapiens
cacuccugggggagaaccacug

SEQ ID NO: 1784606 - RNA, 12 nt, Homo sapiens
ccuuaagcacaa

SEQ ID NO: 1784607 - RNA, 12 nt, Homo sapiens
ccaaaagcacuu

SEQ ID NO: 1784608 - RNA, 22 nt, Homo sapiens
ccauucauacccacacacccag

SEQ ID NO: 1784609 - RNA, 12 nt, Homo sapiens
gauugcugugaa

SEQ ID NO: 1784610 - RNA, 20 nt, Homo sapiens
aacuucacagugacacugga

SEQ ID NO: 1784611 - RNA, 17 nt, Homo sapiens
ccucgcccuaugcaagc

SEQ ID NO: 1784612 - RNA, 14 nt, Homo sapiens
gcaccucacacucc

SEQ ID NO: 1784613 - RNA, 15 nt, Homo sapiens
cggccagaggcuggg

SEQ ID NO: 1784614 - RNA, 15 nt, Homo sapiens
cacucugguuguuua

SEQ ID NO: 1784615 - RNA, 19 nt, Homo sapiens
augugcagguuuugaaaau

SEQ ID NO: 1784616 - RNA, 16 nt, Homo sapiens
caguauaaauuacaug

SEQ ID NO: 1784617 - RNA, 13 nt, Homo sapiens
auagcaagacaca

SEQ ID NO: 1784618 - RNA, 18 nt, Homo sapiens
gcaucacagaaugugaua

SEQ ID NO: 1784619 - RNA, 21 nt, Homo sapiens
caacguuucuucacuuuugca

SEQ ID NO: 1784620 - RNA, 17 nt, Homo sapiens
ggaccaagaugggcaca

SEQ ID NO: 1784621 - RNA, 19 nt, Homo sapiens
cagccagugaggaugacag

SEQ ID NO: 1784622 - RNA, 20 nt, Homo sapiens
guucuucuuggucucagugu

SEQ ID NO: 1784623 - RNA, 18 nt, Homo sapiens
gcauuugaugauagcaga

SEQ ID NO: 1784624 - RNA, 17 nt, Homo sapiens
caaaggccacaggcagu

SEQ ID NO: 1784625 - RNA, 19 nt, Homo sapiens
aucacuaggccucugacca

SEQ ID NO: 1784626 - RNA, 19 nt, Homo sapiens
gaauuaauacaaaacaguu

SEQ ID NO: 1784627 - RNA, 18 nt, Homo sapiens
ucaggaaaacuacaggug

SEQ ID NO: 1784628 - RNA, 16 nt, Homo sapiens
agaacauuuuaauuca

SEQ ID NO: 1784629 - RNA, 19 nt, Homo sapiens
uuaauuuaguaaaccaauc

SEQ ID NO: 1784630 - RNA, 23 nt, Homo sapiens
gaacucgaagcccuuccaguggu

SEQ ID NO: 1784631 - RNA, 13 nt, Homo sapiens
gguuggcauuugc

SEQ ID NO: 1784632 - RNA, 14 nt, Homo sapiens
aaugaccaauauua

SEQ ID NO: 1784633 - RNA, 19 nt, Homo sapiens
uagaauuccucuuuggcca

SEQ ID NO: 1784634 - RNA, 13 nt, Homo sapiens
caugugcugcaaa

SEQ ID NO: 1784635 - RNA, 20 nt, Homo sapiens
gaggcugacacagccacugc

SEQ ID NO: 1784636 - RNA, 17 nt, Homo sapiens
agacuauucaaacaguc

SEQ ID NO: 1784637 - RNA, 22 nt, Homo sapiens
auacaagauauuauguauaaaa

SEQ ID NO: 1784638 - RNA, 18 nt, Homo sapiens
caguccaaggaaaccaca

SEQ ID NO: 1784639 - RNA, 16 nt, Homo sapiens
cuaccuagaugcuccu

SEQ ID NO: 1784640 - RNA, 19 nt, Homo sapiens
cccuucaaggccuccccaa

SEQ ID NO: 1784641 - RNA, 17 nt, Homo sapiens
augaaucaaagacaugg

SEQ ID NO: 1784642 - RNA, 16 nt, Homo sapiens
gaugucggucuugcaa

SEQ ID NO: 1784643 - RNA, 14 nt, Homo sapiens
ugagccgcugugag

SEQ ID NO: 1784644 - RNA, 20 nt, Homo sapiens
uggcagugcagcaaccagag

SEQ ID NO: 1784645 - RNA, 22 nt, Homo sapiens
gccauuccaagucaacacucuu

SEQ ID NO: 1784646 - RNA, 14 nt, Homo sapiens
caaauacacuuuau

SEQ ID NO: 1784647 - RNA, 14 nt, Homo sapiens
uauaaucauuauua

SEQ ID NO: 1784648 - RNA, 15 nt, Homo sapiens
caaugagccacagca

SEQ ID NO: 1784649 - RNA, 13 nt, Homo sapiens
agaaccacuccug

SEQ ID NO: 1784650 - RNA, 21 nt, Homo sapiens
ccccaguuuccuggggcacaa

SEQ ID NO: 1784651 - RNA, 15 nt, Homo sapiens
ccuagaaugcagcug

SEQ ID NO: 1784652 - RNA, 15 nt, Homo sapiens
uaaauccgacuugaa

SEQ ID NO: 1784653 - RNA, 14 nt, Homo sapiens
cguucuuucaaugc

SEQ ID NO: 1784654 - RNA, 16 nt, Homo sapiens
auagacacuugaguua

SEQ ID NO: 1784655 - RNA, 14 nt, Homo sapiens
guaggaucugucaa

SEQ ID NO: 1784656 - RNA, 19 nt, Homo sapiens
cgugcaccuggcagcuuuu

SEQ ID NO: 1784657 - RNA, 20 nt, Homo sapiens
cacgcugcaccuaaagccua

SEQ ID NO: 1784658 - RNA, 12 nt, Homo sapiens
gagauugugcuc

SEQ ID NO: 1784659 - RNA, 21 nt, Homo sapiens
cucgucuuccucucucucacc

SEQ ID NO: 1784660 - RNA, 22 nt, Homo sapiens
cacuucaccaaggaagucucag

SEQ ID NO: 1784661 - RNA, 13 nt, Homo sapiens
caaaaugcuuuuu

SEQ ID NO: 1784662 - RNA, 15 nt, Homo sapiens
aggaacaaucuuugc

SEQ ID NO: 1784663 - RNA, 21 nt, Homo sapiens
cccagggcaacuugaggucug

SEQ ID NO: 1784664 - RNA, 21 nt, Homo sapiens
ccucucuggcacuuugaguua

SEQ ID NO: 1784665 - RNA, 17 nt, Homo sapiens
ggcagcaggguagagag

SEQ ID NO: 1784666 - RNA, 22 nt, Homo sapiens
aacauccuaagugggaagugaa

SEQ ID NO: 1784667 - RNA, 19 nt, Homo sapiens
ggggcaagugagacaauca

SEQ ID NO: 1784668 - RNA, 12 nt, Homo sapiens
uaaacugauuaa

SEQ ID NO: 1784669 - RNA, 22 nt, Homo sapiens
aacauauaauauauguuuuaaa

SEQ ID NO: 1784670 - RNA, 21 nt, Homo sapiens
ggaccaauuagcauuccauca

SEQ ID NO: 1784671 - RNA, 16 nt, Homo sapiens
gucagcacagaacaca

SEQ ID NO: 1784672 - RNA, 16 nt, Homo sapiens
agaguuuucugugcaa

SEQ ID NO: 1784673 - RNA, 22 nt, Homo sapiens
cacugugaaggguacagauuag

SEQ ID NO: 1784674 - RNA, 13 nt, Homo sapiens
uuaccuguucaaa

SEQ ID NO: 1784675 - RNA, 12 nt, Homo sapiens
caccuccaugug

SEQ ID NO: 1784676 - RNA, 21 nt, Homo sapiens
uguuauccuguuuuugcaaaa

SEQ ID NO: 1784677 - RNA, 16 nt, Homo sapiens
aagguaagaucauuua

SEQ ID NO: 1784678 - RNA, 14 nt, Homo sapiens
uaaaauuugugcug

SEQ ID NO: 1784679 - RNA, 22 nt, Homo sapiens
auuuauacuuugcaauccaaau

SEQ ID NO: 1784680 - RNA, 19 nt, Homo sapiens
agugacuguacaguuauca

SEQ ID NO: 1784681 - RNA, 19 nt, Homo sapiens
ccucaucucugccugacaa

SEQ ID NO: 1784682 - RNA, 18 nt, Homo sapiens
auuuagacccugcauuua

SEQ ID NO: 1784683 - RNA, 20 nt, Homo sapiens
gucccaucaauucuuagaau

SEQ ID NO: 1784684 - RNA, 17 nt, Homo sapiens
gugccuggcgcccagug

SEQ ID NO: 1784685 - RNA, 18 nt, Homo sapiens
ucagaaaccauuguucag

SEQ ID NO: 1784686 - RNA, 23 nt, Homo sapiens
aaagaagugccuuuaauuugcua

SEQ ID NO: 1784687 - RNA, 19 nt, Homo sapiens
aauucauugucucagugaa

SEQ ID NO: 1784688 - RNA, 13 nt, Homo sapiens
uucaaaguuaaaa

SEQ ID NO: 1784689 - RNA, 14 nt, Homo sapiens
ggauggcuauggag

SEQ ID NO: 1784690 - RNA, 19 nt, Homo sapiens
ccacauucaccaaccaaag

SEQ ID NO: 1784691 - RNA, 16 nt, Homo sapiens
caagagucucuccagc

SEQ ID NO: 1784692 - RNA, 21 nt, Homo sapiens
acuaaugaaguauuacaugau

SEQ ID NO: 1784693 - RNA, 14 nt, Homo sapiens
ucaaucagccuuua

SEQ ID NO: 1784694 - RNA, 14 nt, Homo sapiens
acuuucuguccuaa

SEQ ID NO: 1784695 - RNA, 23 nt, Homo sapiens
aauuuuuuaguauaaguacauua

SEQ ID NO: 1784696 - RNA, 18 nt, Homo sapiens
aaccuauguguccucuaa

SEQ ID NO: 1784697 - RNA, 22 nt, Homo sapiens
aguggcguuguugcauguuuga

SEQ ID NO: 1784698 - RNA, 18 nt, Homo sapiens
aaagaccaaauuccuugg

SEQ ID NO: 1784699 - RNA, 16 nt, Homo sapiens
ugauacggcuccccag

SEQ ID NO: 1784700 - RNA, 15 nt, Homo sapiens
cccaucugugcagua

SEQ ID NO: 1784701 - RNA, 17 nt, Homo sapiens
aaggauccucuccacuc

SEQ ID NO: 1784702 - RNA, 16 nt, Homo sapiens
auaccaauaaagugac

SEQ ID NO: 1784703 - RNA, 14 nt, Homo sapiens
aauuaacuaacuca

SEQ ID NO: 1784704 - RNA, 17 nt, Homo sapiens
gaucagacauucagaga

SEQ ID NO: 1784705 - RNA, 17 nt, Homo sapiens
ccucagaaaaaacaggc

SEQ ID NO: 1784706 - RNA, 13 nt, Homo sapiens
gaauuaauggaau

SEQ ID NO: 1784707 - RNA, 16 nt, Homo sapiens
gaauuaaaacagcugc

SEQ ID NO: 1784708 - RNA, 15 nt, Homo sapiens
acuucuucucauacu

SEQ ID NO: 1784709 - RNA, 22 nt, Homo sapiens
cucucaccaugugacacacugg

SEQ ID NO: 1784710 - RNA, 22 nt, Homo sapiens
augcaagccagcuuccugugca

SEQ ID NO: 1784711 - RNA, 14 nt, Homo sapiens
ugccaaaaccaaac

SEQ ID NO: 1784712 - RNA, 23 nt, Homo sapiens
uuacugugaaacuggcacugaau

SEQ ID NO: 1784713 - RNA, 21 nt, Homo sapiens
ccugcugccagccccuuugcc

SEQ ID NO: 1784714 - RNA, 18 nt, Homo sapiens
cccaagccagcccggccg

SEQ ID NO: 1784715 - RNA, 15 nt, Homo sapiens
cuugaagacagagca

SEQ ID NO: 1784716 - RNA, 16 nt, Homo sapiens
gcagauagcacugggu

SEQ ID NO: 1784717 - RNA, 19 nt, Homo sapiens
ccagaaccacagauguguc

SEQ ID NO: 1784718 - RNA, 21 nt, Homo sapiens
aucccugaggaaaaguccaca

SEQ ID NO: 1784719 - RNA, 12 nt, Homo sapiens
uacacaacaugu

SEQ ID NO: 1784720 - RNA, 22 nt, Homo sapiens
auugguacccacuugcuuuuaa

SEQ ID NO: 1784721 - RNA, 16 nt, Homo sapiens
uaaguucuauaaacag

SEQ ID NO: 1784722 - RNA, 14 nt, Homo sapiens
acacaaauguguac

SEQ ID NO: 1784723 - RNA, 21 nt, Homo sapiens
cuggccccuaggcugcugcug

SEQ ID NO: 1784724 - RNA, 14 nt, Homo sapiens
aacguggcacuggu

SEQ ID NO: 1784725 - RNA, 19 nt, Homo sapiens
cuguuaaauggggagacaa

SEQ ID NO: 1784726 - RNA, 13 nt, Homo sapiens
cacuucuaugcaa

SEQ ID NO: 1784727 - RNA, 21 nt, Homo sapiens
gugguuccucccucuccugaa

SEQ ID NO: 1784728 - RNA, 20 nt, Homo sapiens
cuucaaaucagagcagugau

SEQ ID NO: 1784729 - RNA, 12 nt, Homo sapiens
cauuuucaauga

SEQ ID NO: 1784730 - RNA, 23 nt, Homo sapiens
cuggcacacuagauuaguaguaa

SEQ ID NO: 1784731 - RNA, 14 nt, Homo sapiens
cagcaucuaaguaa

SEQ ID NO: 1784732 - RNA, 16 nt, Homo sapiens
guaacauacauauucc

SEQ ID NO: 1784733 - RNA, 15 nt, Homo sapiens
uaccagcaaauggau

SEQ ID NO: 1784734 - RNA, 19 nt, Homo sapiens
ggguaagaagaaagcaaaa

SEQ ID NO: 1784735 - RNA, 19 nt, Homo sapiens
acagagugaacacucuacu

SEQ ID NO: 1784736 - RNA, 22 nt, Homo sapiens
aauucacuccagucaacagauu

SEQ ID NO: 1784737 - RNA, 18 nt, Homo sapiens
aaaucaauucauugugua

SEQ ID NO: 1784738 - RNA, 16 nt, Homo sapiens
ccauaaucauguaaau

SEQ ID NO: 1784739 - RNA, 13 nt, Homo sapiens
acccauucuacac

SEQ ID NO: 1784740 - RNA, 13 nt, Homo sapiens
aaaacuucucaca

SEQ ID NO: 1784741 - RNA, 13 nt, Homo sapiens
uauacuucacuca

SEQ ID NO: 1784742 - RNA, 23 nt, Homo sapiens
uccggcagguaagggacuaccaa

SEQ ID NO: 1784743 - RNA, 13 nt, Homo sapiens
caggaggggaaac

SEQ ID NO: 1784744 - RNA, 16 nt, Homo sapiens
cggcaucccuguguua

SEQ ID NO: 1784745 - RNA, 21 nt, Homo sapiens
cagucucugagcaccagggag

SEQ ID NO: 1784746 - RNA, 17 nt, Homo sapiens
acugcuuucccaaaggc

SEQ ID NO: 1784747 - RNA, 19 nt, Homo sapiens
aucauucagcaucuacucu

SEQ ID NO: 1784748 - RNA, 20 nt, Homo sapiens
auggaucccgaagaauggag

SEQ ID NO: 1784749 - RNA, 18 nt, Homo sapiens
caagugcggcacugcaaa

SEQ ID NO: 1784750 - RNA, 22 nt, Homo sapiens
aaagaagcuucaugccagguua

SEQ ID NO: 1784751 - RNA, 22 nt, Homo sapiens
auaauugguuagaaccuccuau

SEQ ID NO: 1784752 - RNA, 17 nt, Homo sapiens
gaugaaguuaucuggcu

SEQ ID NO: 1784753 - RNA, 19 nt, Homo sapiens
gauguauucagagccaccc

SEQ ID NO: 1784754 - RNA, 21 nt, Homo sapiens
gacaucaagcucaaggcaaug

SEQ ID NO: 1784755 - RNA, 23 nt, Homo sapiens
ugggcacuggagcaugcagagga

SEQ ID NO: 1784756 - RNA, 17 nt, Homo sapiens
guaauagauguuugaua

SEQ ID NO: 1784757 - RNA, 22 nt, Homo sapiens
uuguaauaauaaaaccaaagaa

SEQ ID NO: 1784758 - RNA, 14 nt, Homo sapiens
aaccucaucuuucu

SEQ ID NO: 1784759 - RNA, 9 nt, Homo sapiens
gugugagug

SEQ ID NO: 1784760 - RNA, 18 nt, Homo sapiens
cugcucuggaaaauguga

SEQ ID NO: 1784761 - RNA, 13 nt, Homo sapiens
ugaaggugguggg

SEQ ID NO: 1784762 - RNA, 19 nt, Homo sapiens
cuccagaagaugccagcuu

SEQ ID NO: 1784763 - RNA, 16 nt, Homo sapiens
guuacaccagaaccug

SEQ ID NO: 1784764 - RNA, 19 nt, Homo sapiens
ggcggcagauccugcccug

SEQ ID NO: 1784765 - RNA, 22 nt, Homo sapiens
uagaugcccuacuuaaagagaa

SEQ ID NO: 1784766 - RNA, 18 nt, Homo sapiens
cuucuucauguucaauua

SEQ ID NO: 1784767 - RNA, 19 nt, Homo sapiens
ugucaucugggccaccagc

SEQ ID NO: 1784768 - RNA, 20 nt, Homo sapiens
guuauuguggaaagaugaau

SEQ ID NO: 1784769 - RNA, 17 nt, Homo sapiens
aguacugacuuucugau

SEQ ID NO: 1784770 - RNA, 14 nt, Homo sapiens
gaccaacuuccugu

SEQ ID NO: 1784771 - RNA, 16 nt, Homo sapiens
ucugacaacagacuuc

SEQ ID NO: 1784772 - RNA, 21 nt, Homo sapiens
ucaccucaaccuccgccuccc

SEQ ID NO: 1784773 - RNA, 17 nt, Homo sapiens
aacaccucacuuuugaa

SEQ ID NO: 1784774 - RNA, 15 nt, Homo sapiens
ugcgugugggacccg

SEQ ID NO: 1784775 - RNA, 17 nt, Homo sapiens
acauguuuucuagccuu

SEQ ID NO: 1784776 - RNA, 22 nt, Homo sapiens
cuaggacauaguaaaugauuca

SEQ ID NO: 1784777 - RNA, 21 nt, Homo sapiens
caacaucgugaaaccccaucu

SEQ ID NO: 1784778 - RNA, 12 nt, Homo sapiens
gugguacuugau

SEQ ID NO: 1784779 - RNA, 22 nt, Homo sapiens
gagcugcucaacuuagagugaa

SEQ ID NO: 1784780 - RNA, 14 nt, Homo sapiens
gcaucccaucucag

SEQ ID NO: 1784781 - RNA, 14 nt, Homo sapiens
uucacagccaggag

SEQ ID NO: 1784782 - RNA, 13 nt, Homo sapiens
aaaguacaauuca

SEQ ID NO: 1784783 - RNA, 19 nt, Homo sapiens
caguuaugcagaauccaaa

SEQ ID NO: 1784784 - RNA, 15 nt, Homo sapiens
ucuugccaccguccc

SEQ ID NO: 1784785 - RNA, 17 nt, Homo sapiens
aaaacugggacguguau

SEQ ID NO: 1784786 - RNA, 11 nt, Homo sapiens
cccaaucugcc

SEQ ID NO: 1784787 - RNA, 14 nt, Homo sapiens
cacuugugucaauc

SEQ ID NO: 1784788 - RNA, 13 nt, Homo sapiens
aauuuugaccaaa

SEQ ID NO: 1784789 - RNA, 16 nt, Homo sapiens
auuauaucauggcauu

SEQ ID NO: 1784790 - RNA, 23 nt, Homo sapiens
ugaaacaggggcucucugugcaa

SEQ ID NO: 1784791 - RNA, 18 nt, Homo sapiens
cuaccuggcagauacuca

SEQ ID NO: 1784792 - RNA, 17 nt, Homo sapiens
uggagugguaacagcuc

SEQ ID NO: 1784793 - RNA, 22 nt, Homo sapiens
aaggcugugcagggacgucuca

SEQ ID NO: 1784794 - RNA, 14 nt, Homo sapiens
ccuccugaccucaa

SEQ ID NO: 1784795 - RNA, 16 nt, Homo sapiens
guaaaacaguuucauc

SEQ ID NO: 1784796 - RNA, 21 nt, Homo sapiens
gauuagguagacuuugcuuag

SEQ ID NO: 1784797 - RNA, 14 nt, Homo sapiens
uaagaacugcuuuc

SEQ ID NO: 1784798 - RNA, 13 nt, Homo sapiens
gcuauagcacaca

SEQ ID NO: 1784799 - RNA, 19 nt, Homo sapiens
acaauugucuuaaaaccag

SEQ ID NO: 1784800 - RNA, 14 nt, Homo sapiens
uucgauaaaggaua

SEQ ID NO: 1784801 - RNA, 13 nt, Homo sapiens
cuuaguaucucau

SEQ ID NO: 1784802 - RNA, 14 nt, Homo sapiens
uggcuagaggacau

SEQ ID NO: 1784803 - RNA, 21 nt, Homo sapiens
aucaucuuagcuuagcuuucu

SEQ ID NO: 1784804 - RNA, 19 nt, Homo sapiens
ugagcacggacucucccag

SEQ ID NO: 1784805 - RNA, 19 nt, Homo sapiens
uaucaggguauaaauuaua

SEQ ID NO: 1784806 - RNA, 17 nt, Homo sapiens
uggacucucugacaaag

SEQ ID NO: 1784807 - RNA, 17 nt, Homo sapiens
ucccaagccacauucau

SEQ ID NO: 1784808 - RNA, 19 nt, Homo sapiens
caaauaguaggcuaaaaac

SEQ ID NO: 1784809 - RNA, 16 nt, Homo sapiens
uguauuuucauaguga

SEQ ID NO: 1784810 - RNA, 15 nt, Homo sapiens
uuagcuggccaagga

SEQ ID NO: 1784811 - RNA, 15 nt, Homo sapiens
uggugccaagcuucu

SEQ ID NO: 1784812 - RNA, 20 nt, Homo sapiens
ugcaccacuuccgucccauc

SEQ ID NO: 1784813 - RNA, 17 nt, Homo sapiens
aaucuaaaauuucauaa

SEQ ID NO: 1784814 - RNA, 17 nt, Homo sapiens
agauguaauacaccaaa

SEQ ID NO: 1784815 - RNA, 22 nt, Homo sapiens
cuguguauuuucagucaaaacu

SEQ ID NO: 1784816 - RNA, 20 nt, Homo sapiens
auuuucacacguaagcacau

SEQ ID NO: 1784817 - RNA, 19 nt, Homo sapiens
gagccgcaccuugucaugu

SEQ ID NO: 1784818 - RNA, 16 nt, Homo sapiens
ugccucaacagcagga

SEQ ID NO: 1784819 - RNA, 20 nt, Homo sapiens
acccuuuggggguugaauag

SEQ ID NO: 1784820 - RNA, 22 nt, Homo sapiens
uguuuucuuaggcacugaggga

SEQ ID NO: 1784821 - RNA, 15 nt, Homo sapiens
caguaaucagaguua

SEQ ID NO: 1784822 - RNA, 22 nt, Homo sapiens
uuuucgcaccuaccaucaggga

SEQ ID NO: 1784823 - RNA, 14 nt, Homo sapiens
aauggguacuccag

SEQ ID NO: 1784824 - RNA, 19 nt, Homo sapiens
aaagaaaaauuaucuugaa

SEQ ID NO: 1784825 - RNA, 18 nt, Homo sapiens
ucuggagagagagcaaga

SEQ ID NO: 1784826 - RNA, 13 nt, Homo sapiens
gcagacagucaca

SEQ ID NO: 1784827 - RNA, 20 nt, Homo sapiens
acaggguuuuuaccugucac

SEQ ID NO: 1784828 - RNA, 14 nt, Homo sapiens
acgacucugaccuc

SEQ ID NO: 1784829 - RNA, 15 nt, Homo sapiens
gugugugugcuuaug

SEQ ID NO: 1784830 - RNA, 12 nt, Homo sapiens
augauguuacau

SEQ ID NO: 1784831 - RNA, 23 nt, Homo sapiens
uaccuccauguuucuaaguaaua

SEQ ID NO: 1784832 - RNA, 20 nt, Homo sapiens
agcuuccuguccucccagcu

SEQ ID NO: 1784833 - RNA, 16 nt, Homo sapiens
gucccggguguguaca

SEQ ID NO: 1784834 - RNA, 11 nt, Homo sapiens
gguagccacug

SEQ ID NO: 1784835 - RNA, 15 nt, Homo sapiens
uaaaaguucauaaca

SEQ ID NO: 1784836 - RNA, 11 nt, Homo sapiens
uaucugggaac

SEQ ID NO: 1784837 - RNA, 19 nt, Homo sapiens
uggccuccgucacuaccug

SEQ ID NO: 1784838 - RNA, 21 nt, Homo sapiens
uuaaauaagauuuaauucaca

SEQ ID NO: 1784839 - RNA, 18 nt, Homo sapiens
uaaggcauguggccuuua

SEQ ID NO: 1784840 - RNA, 19 nt, Homo sapiens
aagcacuacauaaacugac

SEQ ID NO: 1784841 - RNA, 14 nt, Homo sapiens
cagugauccugcaa

SEQ ID NO: 1784842 - RNA, 14 nt, Homo sapiens
ccacugccagacau

SEQ ID NO: 1784843 - RNA, 21 nt, Homo sapiens
ccucccuguuccccacagguc

SEQ ID NO: 1784844 - RNA, 17 nt, Homo sapiens
uuacacugugucauucu

SEQ ID NO: 1784845 - RNA, 21 nt, Homo sapiens
ugcaucuuuguuacuuccuua

SEQ ID NO: 1784846 - RNA, 21 nt, Homo sapiens
uaucuacauaccuacaccuau

SEQ ID NO: 1784847 - RNA, 19 nt, Homo sapiens
uguaacuugaaccuaugaa

SEQ ID NO: 1784848 - RNA, 16 nt, Homo sapiens
uucuauuauagauaua

SEQ ID NO: 1784849 - RNA, 19 nt, Homo sapiens
cuuaugauuuuauuacaga

SEQ ID NO: 1784850 - RNA, 19 nt, Homo sapiens
ggagguggaggcugcagug

SEQ ID NO: 1784851 - RNA, 15 nt, Homo sapiens
ucucccgugagccag

SEQ ID NO: 1784852 - RNA, 18 nt, Homo sapiens
gaugcacucucagaccaa

SEQ ID NO: 1784853 - RNA, 16 nt, Homo sapiens
ugggacuccuuugcau

SEQ ID NO: 1784854 - RNA, 17 nt, Homo sapiens
augucucugagcauuag

SEQ ID NO: 1784855 - RNA, 20 nt, Homo sapiens
aauccaaauggcgucuggaa

SEQ ID NO: 1784856 - RNA, 22 nt, Homo sapiens
ccaggcagagaucaggugggca

SEQ ID NO: 1784857 - RNA, 19 nt, Homo sapiens
auaaaugcccaucagauau

SEQ ID NO: 1784858 - RNA, 15 nt, Homo sapiens
ugauugaaaaguaaa

SEQ ID NO: 1784859 - RNA, 12 nt, Homo sapiens
acuaaaguuaac

SEQ ID NO: 1784860 - RNA, 12 nt, Homo sapiens
uaucaaguacaa

SEQ ID NO: 1784861 - RNA, 12 nt, Homo sapiens
cuguacuguuac

SEQ ID NO: 1784862 - RNA, 16 nt, Homo sapiens
caaaaugucuguuuua

SEQ ID NO: 1784863 - RNA, 23 nt, Homo sapiens
ccacucaccuuucuccacugggu

SEQ ID NO: 1784864 - RNA, 15 nt, Homo sapiens
ucguauuucaccucu

SEQ ID NO: 1784865 - RNA, 17 nt, Homo sapiens
cuaacuucaaggcccau

SEQ ID NO: 1784866 - RNA, 20 nt, Homo sapiens
aucuccaucauaugccugac

SEQ ID NO: 1784867 - RNA, 16 nt, Homo sapiens
ggagccaauacugagu

SEQ ID NO: 1784868 - RNA, 22 nt, Homo sapiens
uuguacacugcuguacccagau

SEQ ID NO: 1784869 - RNA, 16 nt, Homo sapiens
uccaccuuaguacuuu

SEQ ID NO: 1784870 - RNA, 12 nt, Homo sapiens
agaaaauaaacc

SEQ ID NO: 1784871 - RNA, 13 nt, Homo sapiens
uaaacccucagag

SEQ ID NO: 1784872 - RNA, 23 nt, Homo sapiens
gucuaucaaacccagacuugcuu

SEQ ID NO: 1784873 - RNA, 23 nt, Homo sapiens
agccucagccacaaaacucuguc

SEQ ID NO: 1784874 - RNA, 21 nt, Homo sapiens
cugacauaaacccaucuguaa

SEQ ID NO: 1784875 - RNA, 18 nt, Homo sapiens
aguggucccagaaccuau

SEQ ID NO: 1784876 - RNA, 16 nt, Homo sapiens
ugguccauauuuacau

SEQ ID NO: 1784877 - RNA, 15 nt, Homo sapiens
acccgccucuugccc

SEQ ID NO: 1784878 - RNA, 16 nt, Homo sapiens
gcagccacaaccaaaa

SEQ ID NO: 1784879 - RNA, 12 nt, Homo sapiens
aagggcauuucc

SEQ ID NO: 1784880 - RNA, 16 nt, Homo sapiens
agcaacuguuuaaccu

SEQ ID NO: 1784881 - RNA, 15 nt, Homo sapiens
uguugggaaccagag

SEQ ID NO: 1784882 - RNA, 13 nt, Homo sapiens
agaggccaaacag

SEQ ID NO: 1784883 - RNA, 18 nt, Homo sapiens
cugucuaaaaaugauucu

SEQ ID NO: 1784884 - RNA, 21 nt, Homo sapiens
uuauuccucccucaugagcac

SEQ ID NO: 1784885 - RNA, 21 nt, Homo sapiens
uuccugacugacacaggccag

SEQ ID NO: 1784886 - RNA, 22 nt, Homo sapiens
gacccuuuuaagcaugugaugu

SEQ ID NO: 1784887 - RNA, 21 nt, Homo sapiens
cuugagaggaguguucccuga

SEQ ID NO: 1784888 - RNA, 13 nt, Homo sapiens
aacaaaaggacuu

SEQ ID NO: 1784889 - RNA, 14 nt, Homo sapiens
cugauuugcaaaug

SEQ ID NO: 1784890 - RNA, 16 nt, Homo sapiens
guuugcaaugucacaa

SEQ ID NO: 1784891 - RNA, 16 nt, Homo sapiens
ugguggcagugcagca

SEQ ID NO: 1784892 - RNA, 23 nt, Homo sapiens
cagaagauuagcaugaaagcagu

SEQ ID NO: 1784893 - RNA, 14 nt, Homo sapiens
guacaugugcacau

SEQ ID NO: 1784894 - RNA, 22 nt, Homo sapiens
accuggugggagcaccugccag

SEQ ID NO: 1784895 - RNA, 15 nt, Homo sapiens
aagaugcaucaucuc

SEQ ID NO: 1784896 - RNA, 14 nt, Homo sapiens
ugccuaccccaaga

SEQ ID NO: 1784897 - RNA, 18 nt, Homo sapiens
gacucaagauucccagga

SEQ ID NO: 1784898 - RNA, 20 nt, Homo sapiens
gcccaggcugggaacucauc

SEQ ID NO: 1784899 - RNA, 22 nt, Homo sapiens
auucuugagggacaaugccaau

SEQ ID NO: 1784900 - RNA, 13 nt, Homo sapiens
aaaggagauuuac

SEQ ID NO: 1784901 - RNA, 11 nt, Homo sapiens
ugaccuacccc

SEQ ID NO: 1784902 - RNA, 16 nt, Homo sapiens
aaaaugcaccaaucag

SEQ ID NO: 1784903 - RNA, 23 nt, Homo sapiens
ugguggacucgccuguaaucuca

SEQ ID NO: 1784904 - RNA, 20 nt, Homo sapiens
acuguuaggaacagcagugu

SEQ ID NO: 1784905 - RNA, 15 nt, Homo sapiens
gugcgcacacacaga

SEQ ID NO: 1784906 - RNA, 13 nt, Homo sapiens
cagucacuuugac

SEQ ID NO: 1784907 - RNA, 19 nt, Homo sapiens
acagacauuuugugugaga

SEQ ID NO: 1784908 - RNA, 23 nt, Homo sapiens
uaaggaaaaauauuuugcacaga

SEQ ID NO: 1784909 - RNA, 16 nt, Homo sapiens
caaggaccugagaccu

SEQ ID NO: 1784910 - RNA, 21 nt, Homo sapiens
ugcuuggguggagaagccauu

SEQ ID NO: 1784911 - RNA, 21 nt, Homo sapiens
agaugcaugacuuguguguga

SEQ ID NO: 1784912 - RNA, 19 nt, Homo sapiens
ccuaagucaacuuagcauu

SEQ ID NO: 1784913 - RNA, 17 nt, Homo sapiens
ggcugcuggccaugaau

SEQ ID NO: 1784914 - RNA, 14 nt, Homo sapiens
ugcgcucugccauu

SEQ ID NO: 1784915 - RNA, 14 nt, Homo sapiens
cauaggccaugaaa

SEQ ID NO: 1784916 - RNA, 17 nt, Homo sapiens
gaagccugggugucaag

SEQ ID NO: 1784917 - RNA, 22 nt, Homo sapiens
cucuagagagaugagaagccag

SEQ ID NO: 1784918 - RNA, 17 nt, Homo sapiens
cugcagccuccucugug

SEQ ID NO: 1784919 - RNA, 21 nt, Homo sapiens
uaagccauuuaacuggagcuc

SEQ ID NO: 1784920 - RNA, 15 nt, Homo sapiens
gagacagcacaggca

SEQ ID NO: 1784921 - RNA, 22 nt, Homo sapiens
uguauuugcugccagacacuga

SEQ ID NO: 1784922 - RNA, 23 nt, Homo sapiens
cacaaauuugggagggugagaca

SEQ ID NO: 1784923 - RNA, 14 nt, Homo sapiens
uagaauaggcaaac

SEQ ID NO: 1784924 - RNA, 20 nt, Homo sapiens
gagaagucugcaagauguca

SEQ ID NO: 1784925 - RNA, 13 nt, Homo sapiens
gaagaaaaaggau

SEQ ID NO: 1784926 - RNA, 12 nt, Homo sapiens
cagagaagccag

SEQ ID NO: 1784927 - RNA, 12 nt, Homo sapiens
aaaacaauguuu

SEQ ID NO: 1784928 - RNA, 18 nt, Homo sapiens
ugucuuguguuuccacag

SEQ ID NO: 1784929 - RNA, 21 nt, Homo sapiens
ugaaauaucaagagagguuaa

SEQ ID NO: 1784930 - RNA, 14 nt, Homo sapiens
acaucagcuagcaa

SEQ ID NO: 1784931 - RNA, 16 nt, Homo sapiens
agaaguauaaggugcu

SEQ ID NO: 1784932 - RNA, 21 nt, Homo sapiens
uaacagggagacugcaucuca

SEQ ID NO: 1784933 - RNA, 21 nt, Homo sapiens
acugauuuuguaaaguugccu

SEQ ID NO: 1784934 - RNA, 19 nt, Homo sapiens
ucugcacguugcugaaggu

SEQ ID NO: 1784935 - RNA, 23 nt, Homo sapiens
cccuuuccuggcagucucagucc

SEQ ID NO: 1784936 - RNA, 13 nt, Homo sapiens
gcugggucagggg

SEQ ID NO: 1784937 - RNA, 13 nt, Homo sapiens
ugcagcugucacc

SEQ ID NO: 1784938 - RNA, 19 nt, Homo sapiens
ccuuuggccccacuuugaa

SEQ ID NO: 1784939 - RNA, 12 nt, Homo sapiens
cauuugaugaua

SEQ ID NO: 1784940 - RNA, 13 nt, Homo sapiens
aauuaagcagcuc

SEQ ID NO: 1784941 - RNA, 20 nt, Homo sapiens
aauccugaauaaaccaguau

SEQ ID NO: 1784942 - RNA, 21 nt, Homo sapiens
aaccuguauaacccuguuaca

SEQ ID NO: 1784943 - RNA, 18 nt, Homo sapiens
cacugcgccacugccauc

SEQ ID NO: 1784944 - RNA, 20 nt, Homo sapiens
uggcaacaugaagaaugcau

SEQ ID NO: 1784945 - RNA, 13 nt, Homo sapiens
cuggaccauucca

SEQ ID NO: 1784946 - RNA, 18 nt, Homo sapiens
aucaucacucaucugcca

SEQ ID NO: 1784947 - RNA, 14 nt, Homo sapiens
auuugagaagaaau

SEQ ID NO: 1784948 - RNA, 13 nt, Homo sapiens
uuuaaaggacaaa

SEQ ID NO: 1784949 - RNA, 17 nt, Homo sapiens
caccaauaucaguccuc

SEQ ID NO: 1784950 - RNA, 16 nt, Homo sapiens
auuuagcugugcucag

SEQ ID NO: 1784951 - RNA, 18 nt, Homo sapiens
ucccugcgcuucaucuca

SEQ ID NO: 1784952 - RNA, 24 nt, Homo sapiens
agggguugagggaagguucuucau

SEQ ID NO: 1784953 - RNA, 23 nt, Homo sapiens
gaugaaccugacaaaaacaagca

SEQ ID NO: 1784954 - RNA, 16 nt, Homo sapiens
aaaucagcacauuccu

SEQ ID NO: 1784955 - RNA, 21 nt, Homo sapiens
acauuuuaagcauuuucuaca

SEQ ID NO: 1784956 - RNA, 15 nt, Homo sapiens
uacugcuuuucauua

SEQ ID NO: 1784957 - RNA, 22 nt, Homo sapiens
gcugugcccucccauagcacug

SEQ ID NO: 1784958 - RNA, 12 nt, Homo sapiens
uguuaugugauc

SEQ ID NO: 1784959 - RNA, 19 nt, Homo sapiens
uuugguauucaauuugauu

SEQ ID NO: 1784960 - RNA, 13 nt, Homo sapiens
uggcuaguacugu

SEQ ID NO: 1784961 - RNA, 17 nt, Homo sapiens
ggccaccacaccugacu

SEQ ID NO: 1784962 - RNA, 15 nt, Homo sapiens
gccaggcacuguggc

SEQ ID NO: 1784963 - RNA, 10 nt, Homo sapiens
cuguguuuca

SEQ ID NO: 1784964 - RNA, 22 nt, Homo sapiens
aaaacaccacuaauuguguaca

SEQ ID NO: 1784965 - RNA, 19 nt, Homo sapiens
ugcacagaauauguaugua

SEQ ID NO: 1784966 - RNA, 22 nt, Homo sapiens
ggguuaaagcagacagucacac

SEQ ID NO: 1784967 - RNA, 18 nt, Homo sapiens
aacguccuuccacuucag

SEQ ID NO: 1784968 - RNA, 19 nt, Homo sapiens
aauccaucaaagugaugau

SEQ ID NO: 1784969 - RNA, 16 nt, Homo sapiens
gcacagagauaugcac

SEQ ID NO: 1784970 - RNA, 16 nt, Homo sapiens
gccaagggauggacau

SEQ ID NO: 1784971 - RNA, 17 nt, Homo sapiens
ccuguccuaagcacuuu

SEQ ID NO: 1784972 - RNA, 19 nt, Homo sapiens
aacuuaucuuacaaagugu

SEQ ID NO: 1784973 - RNA, 12 nt, Homo sapiens
uuuuccacguua

SEQ ID NO: 1784974 - RNA, 11 nt, Homo sapiens
ugcaucuggca

SEQ ID NO: 1784975 - RNA, 11 nt, Homo sapiens
augauuuccca

SEQ ID NO: 1784976 - RNA, 18 nt, Homo sapiens
aauccaaauuucucaugu

SEQ ID NO: 1784977 - RNA, 21 nt, Homo sapiens
cuugauuuuuuucauuuugcc

SEQ ID NO: 1784978 - RNA, 21 nt, Homo sapiens
gucagcccuuggcuucugcuu

SEQ ID NO: 1784979 - RNA, 23 nt, Homo sapiens
ggggcagcccugccugcggggga

SEQ ID NO: 1784980 - RNA, 13 nt, Homo sapiens
cagaaacaucuga

SEQ ID NO: 1784981 - RNA, 21 nt, Homo sapiens
caaugauaggaaaaauccauu

SEQ ID NO: 1784982 - RNA, 12 nt, Homo sapiens
gccugugaagca

SEQ ID NO: 1784983 - RNA, 16 nt, Homo sapiens
aauaaugauaccuccc

SEQ ID NO: 1784984 - RNA, 12 nt, Homo sapiens
agaguacuuugg

SEQ ID NO: 1784985 - RNA, 12 nt, Homo sapiens
augauacuugaa

SEQ ID NO: 1784986 - RNA, 19 nt, Homo sapiens
aggcaugcuaucauggaau

SEQ ID NO: 1784987 - RNA, 16 nt, Homo sapiens
gcacucugguggcagg

SEQ ID NO: 1784988 - RNA, 20 nt, Homo sapiens
agagugagacucccucucaa

SEQ ID NO: 1784989 - RNA, 20 nt, Homo sapiens
agagccagacucugucucaa

SEQ ID NO: 1784990 - RNA, 22 nt, Homo sapiens
cuuaauggaugggcagucauuu

SEQ ID NO: 1784991 - RNA, 15 nt, Homo sapiens
uucucaccacagagc

SEQ ID NO: 1784992 - RNA, 23 nt, Homo sapiens
caggcgugaccugccaggcacac

SEQ ID NO: 1784993 - RNA, 15 nt, Homo sapiens
gagacgcacacagcu

SEQ ID NO: 1784994 - RNA, 14 nt, Homo sapiens
uaggguucagagaa

SEQ ID NO: 1784995 - RNA, 11 nt, Homo sapiens
uuccaaaaaga

SEQ ID NO: 1784996 - RNA, 17 nt, Homo sapiens
acuuauggaacagggau

SEQ ID NO: 1784997 - RNA, 22 nt, Homo sapiens
auuauuuucagaagcugaugag

SEQ ID NO: 1784998 - RNA, 17 nt, Homo sapiens
uuuguuaagaauuucaa

SEQ ID NO: 1784999 - RNA, 20 nt, Homo sapiens
cauccaucaggguuugcaaa

SEQ ID NO: 1785000 - RNA, 20 nt, Homo sapiens
aauguccuugugaugugcac

SEQ ID NO: 1785001 - RNA, 16 nt, Homo sapiens
agauuuuuuauugcua

SEQ ID NO: 1785002 - RNA, 18 nt, Homo sapiens
aaauuacugauccucgca

SEQ ID NO: 1785003 - RNA, 11 nt, Homo sapiens
uaaaagacuca

SEQ ID NO: 1785004 - RNA, 20 nt, Homo sapiens
gaucucguuuacuccauguu

SEQ ID NO: 1785005 - RNA, 23 nt, Homo sapiens
uccauaguccugguccccagaaa

SEQ ID NO: 1785006 - RNA, 18 nt, Homo sapiens
aaaugccucaauucacau

SEQ ID NO: 1785007 - RNA, 16 nt, Homo sapiens
uggaggcugagcugca

SEQ ID NO: 1785008 - RNA, 19 nt, Homo sapiens
aaaugucuuaaucaugaga

SEQ ID NO: 1785009 - RNA, 13 nt, Homo sapiens
cuuguuagcuguu

SEQ ID NO: 1785010 - RNA, 14 nt, Homo sapiens
cacaggcuauucua

SEQ ID NO: 1785011 - RNA, 23 nt, Homo sapiens
aaucaucacugguuccuccuuaa

SEQ ID NO: 1785012 - RNA, 15 nt, Homo sapiens
uucucuuucccuuca

SEQ ID NO: 1785013 - RNA, 16 nt, Homo sapiens
uuaaaauuucuugauu

SEQ ID NO: 1785014 - RNA, 19 nt, Homo sapiens
agcuccauaauugcaaggg

SEQ ID NO: 1785015 - RNA, 20 nt, Homo sapiens
ccucaccuggcuucccagga

SEQ ID NO: 1785016 - RNA, 22 nt, Homo sapiens
agaaggcaugaaauugucuagc

SEQ ID NO: 1785017 - RNA, 18 nt, Homo sapiens
cauugcagauucgaguca

SEQ ID NO: 1785018 - RNA, 14 nt, Homo sapiens
auggauccuuguca

SEQ ID NO: 1785019 - RNA, 20 nt, Homo sapiens
aaagagguaaaaaacuguca

SEQ ID NO: 1785020 - RNA, 15 nt, Homo sapiens
acccccaggcaucug

SEQ ID NO: 1785021 - RNA, 21 nt, Homo sapiens
gccagugccauuccacuccac

SEQ ID NO: 1785022 - RNA, 20 nt, Homo sapiens
uaguaguuaauucugucacu

SEQ ID NO: 1785023 - RNA, 15 nt, Homo sapiens
gacacugcaaaggcg

SEQ ID NO: 1785024 - RNA, 20 nt, Homo sapiens
ugucuauuuuuuucaguuua

SEQ ID NO: 1785025 - RNA, 19 nt, Homo sapiens
aacuacccagguauuacac

SEQ ID NO: 1785026 - RNA, 19 nt, Homo sapiens
ucuaucaccaaggagccaa

SEQ ID NO: 1785027 - RNA, 18 nt, Homo sapiens
agccugcccucacucccu

SEQ ID NO: 1785028 - RNA, 19 nt, Homo sapiens
uagcuaaacggauuccaaa

SEQ ID NO: 1785029 - RNA, 19 nt, Homo sapiens
gcacuaagucucuagccuc

SEQ ID NO: 1785030 - RNA, 19 nt, Homo sapiens
gaccuccagcuuuccugua

SEQ ID NO: 1785031 - RNA, 13 nt, Homo sapiens
aacacacacaaaa

SEQ ID NO: 1785032 - RNA, 19 nt, Homo sapiens
gcaaccucggggagugcca

SEQ ID NO: 1785033 - RNA, 16 nt, Homo sapiens
ccaggcaugguggcuc

SEQ ID NO: 1785034 - RNA, 17 nt, Homo sapiens
ucaaccaggaacaugua

SEQ ID NO: 1785035 - RNA, 21 nt, Homo sapiens
agguguugugcauuuguucag

SEQ ID NO: 1785036 - RNA, 20 nt, Homo sapiens
augugcaggcuccuccucuc

SEQ ID NO: 1785037 - RNA, 17 nt, Homo sapiens
uguagcuccucaacuca

SEQ ID NO: 1785038 - RNA, 14 nt, Homo sapiens
uucccagcuaggaa

SEQ ID NO: 1785039 - RNA, 14 nt, Homo sapiens
ucugggagccugac

SEQ ID NO: 1785040 - RNA, 20 nt, Homo sapiens
ucugucauaauuaaaucaua

SEQ ID NO: 1785041 - RNA, 19 nt, Homo sapiens
auuaauauuuguuuaguuc

SEQ ID NO: 1785042 - RNA, 19 nt, Homo sapiens
gacgcaccuugcugcagug

SEQ ID NO: 1785043 - RNA, 18 nt, Homo sapiens
cagcccucucuugccaaa

SEQ ID NO: 1785044 - RNA, 23 nt, Homo sapiens
ugaccuguuauuaccauuagcau

SEQ ID NO: 1785045 - RNA, 14 nt, Homo sapiens
gccuugcauugccu

SEQ ID NO: 1785046 - RNA, 13 nt, Homo sapiens
aacauuugcugaa

SEQ ID NO: 1785047 - RNA, 22 nt, Homo sapiens
caaucuccuuacuguguuucag

SEQ ID NO: 1785048 - RNA, 22 nt, Homo sapiens
cgccggauguuucugugacaca

SEQ ID NO: 1785049 - RNA, 17 nt, Homo sapiens
aauuuuauuuacauucu

SEQ ID NO: 1785050 - RNA, 23 nt, Homo sapiens
cugacccggccccuaccagccac

SEQ ID NO: 1785051 - RNA, 21 nt, Homo sapiens
ucacagagcacuguagcacuu

SEQ ID NO: 1785052 - RNA, 14 nt, Homo sapiens
aagcaauccaccuu

SEQ ID NO: 1785053 - RNA, 23 nt, Homo sapiens
gcacugagcccccccaacacugu

SEQ ID NO: 1785054 - RNA, 23 nt, Homo sapiens
acuuagcuauauucugagacuuu

SEQ ID NO: 1785055 - RNA, 16 nt, Homo sapiens
auuuucaagcagcaau

SEQ ID NO: 1785056 - RNA, 17 nt, Homo sapiens
uucuccuuugcacuguu

SEQ ID NO: 1785057 - RNA, 19 nt, Homo sapiens
uugguaaaaugcaucaaaa

SEQ ID NO: 1785058 - RNA, 21 nt, Homo sapiens
aagauaccagcuuuuucucuc

SEQ ID NO: 1785059 - RNA, 16 nt, Homo sapiens
ucugaccuuccagagc

SEQ ID NO: 1785060 - RNA, 18 nt, Homo sapiens
aaaaggcuuugggccugg

SEQ ID NO: 1785061 - RNA, 14 nt, Homo sapiens
augugcauguuuua

SEQ ID NO: 1785062 - RNA, 19 nt, Homo sapiens
uguagaccaccuaauauca

SEQ ID NO: 1785063 - RNA, 15 nt, Homo sapiens
cucuggggcauuauc

SEQ ID NO: 1785064 - RNA, 15 nt, Homo sapiens
agaacucauucauag

SEQ ID NO: 1785065 - RNA, 15 nt, Homo sapiens
agauuucauucucag

SEQ ID NO: 1785066 - RNA, 12 nt, Homo sapiens
cuagagugcagu

SEQ ID NO: 1785067 - RNA, 19 nt, Homo sapiens
cuaaguguguauccagaag

SEQ ID NO: 1785068 - RNA, 10 nt, Homo sapiens
aaacugguag

SEQ ID NO: 1785069 - RNA, 14 nt, Homo sapiens
agcaucuccagugc

SEQ ID NO: 1785070 - RNA, 19 nt, Homo sapiens
gucuuccuugaccaaagcu

SEQ ID NO: 1785071 - RNA, 22 nt, Homo sapiens
cacugccccaggacugucauuu

SEQ ID NO: 1785072 - RNA, 20 nt, Homo sapiens
cuguucuaaggcugugccau

SEQ ID NO: 1785073 - RNA, 15 nt, Homo sapiens
guuuugaaaucccau

SEQ ID NO: 1785074 - RNA, 15 nt, Homo sapiens
gaucugaaaacucau

SEQ ID NO: 1785075 - RNA, 15 nt, Homo sapiens
ucaauuauuugcaua

SEQ ID NO: 1785076 - RNA, 22 nt, Homo sapiens
agguugaagaaaggaaccuggg

SEQ ID NO: 1785077 - RNA, 18 nt, Homo sapiens
ucaaguuugaacucugua

SEQ ID NO: 1785078 - RNA, 11 nt, Homo sapiens
ccuaaccucua

SEQ ID NO: 1785079 - RNA, 17 nt, Homo sapiens
auaagugcuauugcaga

SEQ ID NO: 1785080 - RNA, 14 nt, Homo sapiens
ggaggagcagcagc

SEQ ID NO: 1785081 - RNA, 16 nt, Homo sapiens
caucucaagcaaguuu

SEQ ID NO: 1785082 - RNA, 14 nt, Homo sapiens
auaauuauauacuc

SEQ ID NO: 1785083 - RNA, 13 nt, Homo sapiens
cuuuugucuuuga

SEQ ID NO: 1785084 - RNA, 22 nt, Homo sapiens
cauaaaaggacucucagccucu

SEQ ID NO: 1785085 - RNA, 15 nt, Homo sapiens
cuuauaccacugugu

SEQ ID NO: 1785086 - RNA, 14 nt, Homo sapiens
caaccauaugaauu

SEQ ID NO: 1785087 - RNA, 23 nt, Homo sapiens
aaagcaucucacugcaagucaca

SEQ ID NO: 1785088 - RNA, 16 nt, Homo sapiens
cuugcaaauccacuag

SEQ ID NO: 1785089 - RNA, 22 nt, Homo sapiens
gcucuggcaccacuaggguccu

SEQ ID NO: 1785090 - RNA, 10 nt, Homo sapiens
gaaguggaag

SEQ ID NO: 1785091 - RNA, 22 nt, Homo sapiens
ucuuuuauauugauaacagcac

SEQ ID NO: 1785092 - RNA, 16 nt, Homo sapiens
agaccuacugcacuga

SEQ ID NO: 1785093 - RNA, 16 nt, Homo sapiens
uggguggcucacucag

SEQ ID NO: 1785094 - RNA, 12 nt, Homo sapiens
gaaagacaguga

SEQ ID NO: 1785095 - RNA, 12 nt, Homo sapiens
cugagacacaaa

SEQ ID NO: 1785096 - RNA, 18 nt, Homo sapiens
auaaaaauuggagcucau

SEQ ID NO: 1785097 - RNA, 16 nt, Homo sapiens
aauugcaugacuugua

SEQ ID NO: 1785098 - RNA, 16 nt, Homo sapiens
agggcagauucaagag

SEQ ID NO: 1785099 - RNA, 19 nt, Homo sapiens
acacauugaaugcgcuuua

SEQ ID NO: 1785100 - RNA, 21 nt, Homo sapiens
cugcugccucuuucccuagga

SEQ ID NO: 1785101 - RNA, 18 nt, Homo sapiens
gagaguggcuuugucagu

SEQ ID NO: 1785102 - RNA, 18 nt, Homo sapiens
aaaucaaggauaaauauc

SEQ ID NO: 1785103 - RNA, 23 nt, Homo sapiens
ugauucuccugccucagccucuu

SEQ ID NO: 1785104 - RNA, 13 nt, Homo sapiens
aaaauuuuacuuc

SEQ ID NO: 1785105 - RNA, 15 nt, Homo sapiens
cugcccaugcaccuu

SEQ ID NO: 1785106 - RNA, 17 nt, Homo sapiens
ucucuggcccugagaau

SEQ ID NO: 1785107 - RNA, 12 nt, Homo sapiens
agguugacucau

SEQ ID NO: 1785108 - RNA, 15 nt, Homo sapiens
aggggacuccaaagc

SEQ ID NO: 1785109 - RNA, 20 nt, Homo sapiens
cuucacucugcucucaggag

SEQ ID NO: 1785110 - RNA, 16 nt, Homo sapiens
uggaauacuucuacca

SEQ ID NO: 1785111 - RNA, 19 nt, Homo sapiens
uucagaacagaggcauuua

SEQ ID NO: 1785112 - RNA, 19 nt, Homo sapiens
aaacucuaucggagaacau

SEQ ID NO: 1785113 - RNA, 19 nt, Homo sapiens
cagaagguaucaguuauau

SEQ ID NO: 1785114 - RNA, 23 nt, Homo sapiens
aguuucccuaacaaaaaagcuaa

SEQ ID NO: 1785115 - RNA, 17 nt, Homo sapiens
ccuugagggcugcaguu

SEQ ID NO: 1785116 - RNA, 22 nt, Homo sapiens
gcguacauacgguucuguuaua

SEQ ID NO: 1785117 - RNA, 21 nt, Homo sapiens
agaagcugucugcguuuacuc

SEQ ID NO: 1785118 - RNA, 13 nt, Homo sapiens
cugacagcacucc

SEQ ID NO: 1785119 - RNA, 21 nt, Homo sapiens
auucccaauuaaaaguaugca

SEQ ID NO: 1785120 - RNA, 22 nt, Homo sapiens
cuguucuuagaguguagcugua

SEQ ID NO: 1785121 - RNA, 17 nt, Homo sapiens
acuauaaagcuguuauu

SEQ ID NO: 1785122 - RNA, 20 nt, Homo sapiens
ugaaaguuguauucucauau

SEQ ID NO: 1785123 - RNA, 17 nt, Homo sapiens
guaaacaaauucuuuca

SEQ ID NO: 1785124 - RNA, 22 nt, Homo sapiens
agcucccugccagcuuccuguc

SEQ ID NO: 1785125 - RNA, 20 nt, Homo sapiens
aauauugauauuuucuacaa

SEQ ID NO: 1785126 - RNA, 12 nt, Homo sapiens
gucacugccaac

SEQ ID NO: 1785127 - RNA, 17 nt, Homo sapiens
guguuugggaugaccag

SEQ ID NO: 1785128 - RNA, 19 nt, Homo sapiens
acuguugcaaacucagugc

SEQ ID NO: 1785129 - RNA, 11 nt, Homo sapiens
ccuaagucaac

SEQ ID NO: 1785130 - RNA, 14 nt, Homo sapiens
uccuuuaaaccauc

SEQ ID NO: 1785131 - RNA, 14 nt, Homo sapiens
aaaguacagguacu

SEQ ID NO: 1785132 - RNA, 22 nt, Homo sapiens
gaaagugcauuaaacugaauca

SEQ ID NO: 1785133 - RNA, 21 nt, Homo sapiens
uacgugcauuuaaacucugcc

SEQ ID NO: 1785134 - RNA, 15 nt, Homo sapiens
gcaugguaaugaagg

SEQ ID NO: 1785135 - RNA, 21 nt, Homo sapiens
ucuagacuguuugcugauccc

SEQ ID NO: 1785136 - RNA, 15 nt, Homo sapiens
cuguccaguuuccaa

SEQ ID NO: 1785137 - RNA, 23 nt, Homo sapiens
guuuucuuucuaaugagauauua

SEQ ID NO: 1785138 - RNA, 16 nt, Homo sapiens
uguaaaugcucaaaga

SEQ ID NO: 1785139 - RNA, 21 nt, Homo sapiens
gcagacugcaaaucugccuga

SEQ ID NO: 1785140 - RNA, 21 nt, Homo sapiens
uggaugucccuauucugccau

SEQ ID NO: 1785141 - RNA, 19 nt, Homo sapiens
aacucccagccaucuguau

SEQ ID NO: 1785142 - RNA, 20 nt, Homo sapiens
ggacuuccuuuaggaucuca

SEQ ID NO: 1785143 - RNA, 21 nt, Homo sapiens
caguguggcaagcaagagcuc

SEQ ID NO: 1785144 - RNA, 15 nt, Homo sapiens
uuuggcgaaucucaa

SEQ ID NO: 1785145 - RNA, 22 nt, Homo sapiens
ggaaaaagaauauauugccaaa

SEQ ID NO: 1785146 - RNA, 20 nt, Homo sapiens
cuggggguggggagguguca

SEQ ID NO: 1785147 - RNA, 22 nt, Homo sapiens
cuucaccaguguuuuucuucau

SEQ ID NO: 1785148 - RNA, 18 nt, Homo sapiens
ugggaaaaaaacauacac

SEQ ID NO: 1785149 - RNA, 19 nt, Homo sapiens
agagggagaagacugugcg

SEQ ID NO: 1785150 - RNA, 17 nt, Homo sapiens
acuggcugucaguauga

SEQ ID NO: 1785151 - RNA, 23 nt, Homo sapiens
uuuauuaguuaggugugccaaac

SEQ ID NO: 1785152 - RNA, 23 nt, Homo sapiens
gaccaggcuucuuccuacaucuu

SEQ ID NO: 1785153 - RNA, 19 nt, Homo sapiens
gaaagacaguaaagaccau

SEQ ID NO: 1785154 - RNA, 16 nt, Homo sapiens
aaauacaaauuggaca

SEQ ID NO: 1785155 - RNA, 14 nt, Homo sapiens
aaauauauacucaa

SEQ ID NO: 1785156 - RNA, 14 nt, Homo sapiens
acauuuauaaucua

SEQ ID NO: 1785157 - RNA, 12 nt, Homo sapiens
gcuuaaucugag

SEQ ID NO: 1785158 - RNA, 13 nt, Homo sapiens
cagauaaaugaca

SEQ ID NO: 1785159 - RNA, 14 nt, Homo sapiens
uacacauucuugcu

SEQ ID NO: 1785160 - RNA, 21 nt, Homo sapiens
uccaagaaggccuucauggcc

SEQ ID NO: 1785161 - RNA, 13 nt, Homo sapiens
ggcucagggcagu

SEQ ID NO: 1785162 - RNA, 16 nt, Homo sapiens
agugacgcaucuccaa

SEQ ID NO: 1785163 - RNA, 15 nt, Homo sapiens
cgagaacccugagca

SEQ ID NO: 1785164 - RNA, 14 nt, Homo sapiens
cgccaugcaugaug

SEQ ID NO: 1785165 - RNA, 21 nt, Homo sapiens
agagguaaaagugugagcagu

SEQ ID NO: 1785166 - RNA, 21 nt, Homo sapiens
uauuuugaucuauuaagggau

SEQ ID NO: 1785167 - RNA, 17 nt, Homo sapiens
caaggagggcaccaucu

SEQ ID NO: 1785168 - RNA, 22 nt, Homo sapiens
auugcuucuucuucaagauuua

SEQ ID NO: 1785169 - RNA, 17 nt, Homo sapiens
cugcacccaccuacuua

SEQ ID NO: 1785170 - RNA, 12 nt, Homo sapiens
cacaugucauug

SEQ ID NO: 1785171 - RNA, 16 nt, Homo sapiens
caaacuugcaguuuaa

SEQ ID NO: 1785172 - RNA, 23 nt, Homo sapiens
aacuaaucugauguuaaccaaug

SEQ ID NO: 1785173 - RNA, 23 nt, Homo sapiens
guauauuugauugaauaaugcca

SEQ ID NO: 1785174 - RNA, 19 nt, Homo sapiens
aaauuuaauauacugcaua

SEQ ID NO: 1785175 - RNA, 15 nt, Homo sapiens
uuuuuaaugaucucg

SEQ ID NO: 1785176 - RNA, 13 nt, Homo sapiens
auggaagugucug

SEQ ID NO: 1785177 - RNA, 14 nt, Homo sapiens
uuccaugauucuau

SEQ ID NO: 1785178 - RNA, 20 nt, Homo sapiens
acaucauuggaauacaggaa

SEQ ID NO: 1785179 - RNA, 17 nt, Homo sapiens
ccucucuagacaguaga

SEQ ID NO: 1785180 - RNA, 23 nt, Homo sapiens
acagccucccacccccaucucuc

SEQ ID NO: 1785181 - RNA, 17 nt, Homo sapiens
cugggcugccaccagcc

SEQ ID NO: 1785182 - RNA, 16 nt, Homo sapiens
caccagugcgugcucc

SEQ ID NO: 1785183 - RNA, 13 nt, Homo sapiens
ccugugauugcuc

SEQ ID NO: 1785184 - RNA, 22 nt, Homo sapiens
ccccaggcccagugggguggcc

SEQ ID NO: 1785185 - RNA, 18 nt, Homo sapiens
aucgcuuuugauaaucaa

SEQ ID NO: 1785186 - RNA, 19 nt, Homo sapiens
agagauuuucaacauuuca

SEQ ID NO: 1785187 - RNA, 17 nt, Homo sapiens
aaagauuuaaaauaauu

SEQ ID NO: 1785188 - RNA, 16 nt, Homo sapiens
cuggguguggggacac

SEQ ID NO: 1785189 - RNA, 12 nt, Homo sapiens
caaguacaugug

SEQ ID NO: 1785190 - RNA, 15 nt, Homo sapiens
ugaauaaagccacau

SEQ ID NO: 1785191 - RNA, 22 nt, Homo sapiens
agaaagacuuaucaacauuugu

SEQ ID NO: 1785192 - RNA, 20 nt, Homo sapiens
ucuaaaggaaaucaaaugaa

SEQ ID NO: 1785193 - RNA, 17 nt, Homo sapiens
aggucauagcagugcuu

SEQ ID NO: 1785194 - RNA, 19 nt, Homo sapiens
cuuauugugugcgcugccu

SEQ ID NO: 1785195 - RNA, 16 nt, Homo sapiens
uucguuacaucuugua

SEQ ID NO: 1785196 - RNA, 17 nt, Homo sapiens
uacaaauuuugcacuuu

SEQ ID NO: 1785197 - RNA, 17 nt, Homo sapiens
uucaaaaaaagcacaaa

SEQ ID NO: 1785198 - RNA, 20 nt, Homo sapiens
aaacauacagaauguucuau

SEQ ID NO: 1785199 - RNA, 15 nt, Homo sapiens
acuaucccaaucaaa

SEQ ID NO: 1785200 - RNA, 22 nt, Homo sapiens
auuccaggguugaaucuugucc

SEQ ID NO: 1785201 - RNA, 17 nt, Homo sapiens
guuaaagguucacaggg

SEQ ID NO: 1785202 - RNA, 14 nt, Homo sapiens
gacaacgcugcuua

SEQ ID NO: 1785203 - RNA, 17 nt, Homo sapiens
aaaguuaaaaaaaagcc

SEQ ID NO: 1785204 - RNA, 17 nt, Homo sapiens
aaagauaccaaauagaa

SEQ ID NO: 1785205 - RNA, 23 nt, Homo sapiens
ccaacugcuuggacagcagccag

SEQ ID NO: 1785206 - RNA, 12 nt, Homo sapiens
acaugugcacac

SEQ ID NO: 1785207 - RNA, 14 nt, Homo sapiens
ccccuaacuuucuu

SEQ ID NO: 1785208 - RNA, 16 nt, Homo sapiens
ucuggaccccaggcca

SEQ ID NO: 1785209 - RNA, 14 nt, Homo sapiens
ucauuauaaaaugg

SEQ ID NO: 1785210 - RNA, 12 nt, Homo sapiens
cauugcuuugcc

SEQ ID NO: 1785211 - RNA, 16 nt, Homo sapiens
acguccugucuguuuc

SEQ ID NO: 1785212 - RNA, 16 nt, Homo sapiens
gggaaugagcccagag

SEQ ID NO: 1785213 - RNA, 21 nt, Homo sapiens
aacuauguauguauuaugcau

SEQ ID NO: 1785214 - RNA, 22 nt, Homo sapiens
auguuccccaggauucagcuau

SEQ ID NO: 1785215 - RNA, 21 nt, Homo sapiens
cagcccauuggccgagcuccu

SEQ ID NO: 1785216 - RNA, 18 nt, Homo sapiens
cccauggucaaugcaguu

SEQ ID NO: 1785217 - RNA, 13 nt, Homo sapiens
auuuauacuguau

SEQ ID NO: 1785218 - RNA, 14 nt, Homo sapiens
ggcucuuuccuugc

SEQ ID NO: 1785219 - RNA, 16 nt, Homo sapiens
uccaguuguguugaca

SEQ ID NO: 1785220 - RNA, 20 nt, Homo sapiens
aaaaauuuauuuauauuuca

SEQ ID NO: 1785221 - RNA, 20 nt, Homo sapiens
uaaaauucuauuauacuaca

SEQ ID NO: 1785222 - RNA, 17 nt, Homo sapiens
aaaacugucauccuaac

SEQ ID NO: 1785223 - RNA, 18 nt, Homo sapiens
cagccuugaucagugaca

SEQ ID NO: 1785224 - RNA, 14 nt, Homo sapiens
gauuguuuugccac

SEQ ID NO: 1785225 - RNA, 15 nt, Homo sapiens
auuguuugugauauu

SEQ ID NO: 1785226 - RNA, 14 nt, Homo sapiens
uuaauccuaccuca

SEQ ID NO: 1785227 - RNA, 13 nt, Homo sapiens
augcacuaagaca

SEQ ID NO: 1785228 - RNA, 17 nt, Homo sapiens
guuugagaccgaccagc

SEQ ID NO: 1785229 - RNA, 23 nt, Homo sapiens
cucaagaccagagacccaacagc

SEQ ID NO: 1785230 - RNA, 21 nt, Homo sapiens
caggaaagggcaaaguagggc

SEQ ID NO: 1785231 - RNA, 20 nt, Homo sapiens
ggacauguauucccauugca

SEQ ID NO: 1785232 - RNA, 12 nt, Homo sapiens
cucccuaccuga

SEQ ID NO: 1785233 - RNA, 15 nt, Homo sapiens
agccaucuugguaaa

SEQ ID NO: 1785234 - RNA, 18 nt, Homo sapiens
gagcuagugucaccugca

SEQ ID NO: 1785235 - RNA, 14 nt, Homo sapiens
gaugcugagccaua

SEQ ID NO: 1785236 - RNA, 19 nt, Homo sapiens
cggcugggugagcugagau

SEQ ID NO: 1785237 - RNA, 14 nt, Homo sapiens
cacagaugggauca

SEQ ID NO: 1785238 - RNA, 14 nt, Homo sapiens
auggggucugggug

SEQ ID NO: 1785239 - RNA, 16 nt, Homo sapiens
agccagaggcaucuga

SEQ ID NO: 1785240 - RNA, 17 nt, Homo sapiens
auauuuccugacuugag

SEQ ID NO: 1785241 - RNA, 17 nt, Homo sapiens
caccaacucucucugcc

SEQ ID NO: 1785242 - RNA, 15 nt, Homo sapiens
uuuaaaugaaccaaa

SEQ ID NO: 1785243 - RNA, 16 nt, Homo sapiens
auuuuaaguaauuuca

SEQ ID NO: 1785244 - RNA, 21 nt, Homo sapiens
auuuccccuucaaacaaauaa

SEQ ID NO: 1785245 - RNA, 12 nt, Homo sapiens
cacugccuucac

SEQ ID NO: 1785246 - RNA, 15 nt, Homo sapiens
ucuguaccuuucuaa

SEQ ID NO: 1785247 - RNA, 15 nt, Homo sapiens
uggccucugccuuug

SEQ ID NO: 1785248 - RNA, 14 nt, Homo sapiens
ugaauaaaccaaga

SEQ ID NO: 1785249 - RNA, 18 nt, Homo sapiens
agggggucauuguucucc

SEQ ID NO: 1785250 - RNA, 21 nt, Homo sapiens
gcaauuuaauauuuugcacag

SEQ ID NO: 1785251 - RNA, 15 nt, Homo sapiens
aauaagucacugaca

SEQ ID NO: 1785252 - RNA, 12 nt, Homo sapiens
caugcucaacua

SEQ ID NO: 1785253 - RNA, 14 nt, Homo sapiens
uagauuuagcuauu

SEQ ID NO: 1785254 - RNA, 20 nt, Homo sapiens
ugugguccacugagcuauaa

SEQ ID NO: 1785255 - RNA, 23 nt, Homo sapiens
cauaagccacaggccccaguuau

SEQ ID NO: 1785256 - RNA, 15 nt, Homo sapiens
gagaagggagggugg

SEQ ID NO: 1785257 - RNA, 16 nt, Homo sapiens
aggacagcugcuucug

SEQ ID NO: 1785258 - RNA, 23 nt, Homo sapiens
gcggggccgccgccagcuccccc

SEQ ID NO: 1785259 - RNA, 17 nt, Homo sapiens
augaguacauacucaag

SEQ ID NO: 1785260 - RNA, 12 nt, Homo sapiens
uggggccagugc

SEQ ID NO: 1785261 - RNA, 18 nt, Homo sapiens
ucaggaguucgagaccag

SEQ ID NO: 1785262 - RNA, 21 nt, Homo sapiens
ugaaagcuauaucaaucucuc

SEQ ID NO: 1785263 - RNA, 22 nt, Homo sapiens
caguguggcucccacaggucuu

SEQ ID NO: 1785264 - RNA, 15 nt, Homo sapiens
agccuccccgugcca

SEQ ID NO: 1785265 - RNA, 20 nt, Homo sapiens
cuggauuguguuugugccau

SEQ ID NO: 1785266 - RNA, 14 nt, Homo sapiens
ggguagacuuggag

SEQ ID NO: 1785267 - RNA, 23 nt, Homo sapiens
cccaagauuauuaaaagaugucu

SEQ ID NO: 1785268 - RNA, 16 nt, Homo sapiens
auuguaaaguuuauuu

SEQ ID NO: 1785269 - RNA, 16 nt, Homo sapiens
uuugcuguugcauugu

SEQ ID NO: 1785270 - RNA, 19 nt, Homo sapiens
accagaguuggagacucag

SEQ ID NO: 1785271 - RNA, 14 nt, Homo sapiens
agguaaaacagggc

SEQ ID NO: 1785272 - RNA, 12 nt, Homo sapiens
ugauggcugaag

SEQ ID NO: 1785273 - RNA, 19 nt, Homo sapiens
cucuauguccggcuuuaac

SEQ ID NO: 1785274 - RNA, 22 nt, Homo sapiens
gaggaaaaguaaggugcaguuc

SEQ ID NO: 1785275 - RNA, 18 nt, Homo sapiens
aucaguaugucacucugg

SEQ ID NO: 1785276 - RNA, 22 nt, Homo sapiens
acauccaaccccccaccugcca

SEQ ID NO: 1785277 - RNA, 15 nt, Homo sapiens
aauggagucauuuga

SEQ ID NO: 1785278 - RNA, 12 nt, Homo sapiens
gggcuggcugcu

SEQ ID NO: 1785279 - RNA, 24 nt, Homo sapiens
uccacugaggugggagcaucucca

SEQ ID NO: 1785280 - RNA, 14 nt, Homo sapiens
ugaaggaucuugcc

SEQ ID NO: 1785281 - RNA, 19 nt, Homo sapiens
cuuuaaagucagguccaau

SEQ ID NO: 1785282 - RNA, 20 nt, Homo sapiens
gccacacagcacaugcacac

SEQ ID NO: 1785283 - RNA, 14 nt, Homo sapiens
cagugcaugccagg

SEQ ID NO: 1785284 - RNA, 19 nt, Homo sapiens
ugauacuuuuuugaaauca

SEQ ID NO: 1785285 - RNA, 15 nt, Homo sapiens
cccugucucuagcca

SEQ ID NO: 1785286 - RNA, 19 nt, Homo sapiens
uaggcuuacguacuacuug

SEQ ID NO: 1785287 - RNA, 18 nt, Homo sapiens
ucucaggugcgugccaca

SEQ ID NO: 1785288 - RNA, 20 nt, Homo sapiens
ucugucuucuccagaaggca

SEQ ID NO: 1785289 - RNA, 23 nt, Homo sapiens
uccuaccuugugcuuagcuuuca

SEQ ID NO: 1785290 - RNA, 13 nt, Homo sapiens
caacuucugaaua

SEQ ID NO: 1785291 - RNA, 20 nt, Homo sapiens
acagaggaccagcacacucc

SEQ ID NO: 1785292 - RNA, 13 nt, Homo sapiens
caauacagucuag

SEQ ID NO: 1785293 - RNA, 14 nt, Homo sapiens
uguuuccagcacua

SEQ ID NO: 1785294 - RNA, 15 nt, Homo sapiens
aaaauuaagaauguc

SEQ ID NO: 1785295 - RNA, 21 nt, Homo sapiens
cuuuaugccggaugugcuuuu

SEQ ID NO: 1785296 - RNA, 15 nt, Homo sapiens
uugccccaugagaca

SEQ ID NO: 1785297 - RNA, 17 nt, Homo sapiens
gguuauagcuucaggag

SEQ ID NO: 1785298 - RNA, 21 nt, Homo sapiens
cuuauuaacaauuaggcagac

SEQ ID NO: 1785299 - RNA, 15 nt, Homo sapiens
uguccucuauaccug

SEQ ID NO: 1785300 - RNA, 17 nt, Homo sapiens
cucccaugagacugccc

SEQ ID NO: 1785301 - RNA, 16 nt, Homo sapiens
cauguccuauuacuga

SEQ ID NO: 1785302 - RNA, 19 nt, Homo sapiens
uuuuagaaaucacaacaaa

SEQ ID NO: 1785303 - RNA, 21 nt, Homo sapiens
guacacuuaagcagagcagaa

SEQ ID NO: 1785304 - RNA, 16 nt, Homo sapiens
cuaccaaccuguucaa

SEQ ID NO: 1785305 - RNA, 16 nt, Homo sapiens
agugguuucagcaaua

SEQ ID NO: 1785306 - RNA, 23 nt, Homo sapiens
guacacuguacuucugugugcaa

SEQ ID NO: 1785307 - RNA, 22 nt, Homo sapiens
ugaggaugucccugaagugcca

SEQ ID NO: 1785308 - RNA, 16 nt, Homo sapiens
uuauccucuugcuaua

SEQ ID NO: 1785309 - RNA, 17 nt, Homo sapiens
gauguugaaacuuugaa

SEQ ID NO: 1785310 - RNA, 22 nt, Homo sapiens
augguguccauuuuauuuagca

SEQ ID NO: 1785311 - RNA, 12 nt, Homo sapiens
ccaaauuuccag

SEQ ID NO: 1785312 - RNA, 18 nt, Homo sapiens
auuccagucacaguuuuu

SEQ ID NO: 1785313 - RNA, 20 nt, Homo sapiens
auuuuacagagcgcaccuca

SEQ ID NO: 1785314 - RNA, 19 nt, Homo sapiens
uggccauggagaaagcuga

SEQ ID NO: 1785315 - RNA, 14 nt, Homo sapiens
uuuaagcagcucua

SEQ ID NO: 1785316 - RNA, 13 nt, Homo sapiens
aggacaccaguga

SEQ ID NO: 1785317 - RNA, 21 nt, Homo sapiens
uagaagaagcccauaucacau

SEQ ID NO: 1785318 - RNA, 15 nt, Homo sapiens
uucuuagacuuaucu

SEQ ID NO: 1785319 - RNA, 11 nt, Homo sapiens
aaaaacaggga

SEQ ID NO: 1785320 - RNA, 14 nt, Homo sapiens
cucugugaccaaug

SEQ ID NO: 1785321 - RNA, 14 nt, Homo sapiens
uggccacugagcug

SEQ ID NO: 1785322 - RNA, 15 nt, Homo sapiens
aauugaaaaugcauu

SEQ ID NO: 1785323 - RNA, 20 nt, Homo sapiens
caggccucugcagaagccaa

SEQ ID NO: 1785324 - RNA, 14 nt, Homo sapiens
guaccuuucuucac

SEQ ID NO: 1785325 - RNA, 17 nt, Homo sapiens
ucugcuuuugcacaccu

SEQ ID NO: 1785326 - RNA, 22 nt, Homo sapiens
caauaaaguacugcaaaaugcu

SEQ ID NO: 1785327 - RNA, 17 nt, Homo sapiens
aacagccuauuccugaa

SEQ ID NO: 1785328 - RNA, 15 nt, Homo sapiens
ugaaugccugucacg

SEQ ID NO: 1785329 - RNA, 21 nt, Homo sapiens
guacuacugcugcaaagugca

SEQ ID NO: 1785330 - RNA, 18 nt, Homo sapiens
uugacaauugggagcugc

SEQ ID NO: 1785331 - RNA, 22 nt, Homo sapiens
aagccauuuccacuacagugag

SEQ ID NO: 1785332 - RNA, 13 nt, Homo sapiens
gucucauugccag

SEQ ID NO: 1785333 - RNA, 11 nt, Homo sapiens
cagucuucuca

SEQ ID NO: 1785334 - RNA, 17 nt, Homo sapiens
uagcugagacuacaggu

SEQ ID NO: 1785335 - RNA, 14 nt, Homo sapiens
gaaaaauacuuuaa

SEQ ID NO: 1785336 - RNA, 19 nt, Homo sapiens
uuaaaucugugaugauccu

SEQ ID NO: 1785337 - RNA, 15 nt, Homo sapiens
gauccaaaguccugu

SEQ ID NO: 1785338 - RNA, 18 nt, Homo sapiens
cagaggagaaaguggaaa

SEQ ID NO: 1785339 - RNA, 12 nt, Homo sapiens
acuaaacuccau

SEQ ID NO: 1785340 - RNA, 18 nt, Homo sapiens
ggacuauguaaaccacau

SEQ ID NO: 1785341 - RNA, 14 nt, Homo sapiens
ugagugaauguuaa

SEQ ID NO: 1785342 - RNA, 13 nt, Homo sapiens
ucuccgacucugc

SEQ ID NO: 1785343 - RNA, 18 nt, Homo sapiens
caccagcccugagccaug

SEQ ID NO: 1785344 - RNA, 16 nt, Homo sapiens
ggaguuuugcucucug

SEQ ID NO: 1785345 - RNA, 15 nt, Homo sapiens
ucaaaaucacaauga

SEQ ID NO: 1785346 - RNA, 11 nt, Homo sapiens
ugcacagugaa

SEQ ID NO: 1785347 - RNA, 17 nt, Homo sapiens
guucauugaagcuuugu

SEQ ID NO: 1785348 - RNA, 16 nt, Homo sapiens
auguuaccauuaauca

SEQ ID NO: 1785349 - RNA, 15 nt, Homo sapiens
uuacaggcacaaaau

SEQ ID NO: 1785350 - RNA, 20 nt, Homo sapiens
accaaggucucacacuccuc

SEQ ID NO: 1785351 - RNA, 19 nt, Homo sapiens
cuugccuuccuaagccugu

SEQ ID NO: 1785352 - RNA, 17 nt, Homo sapiens
ucaaaagaauguccaau

SEQ ID NO: 1785353 - RNA, 22 nt, Homo sapiens
aagcucaccagcccugcgccac

SEQ ID NO: 1785354 - RNA, 23 nt, Homo sapiens
cugucuuggcauuaaaccacauc

SEQ ID NO: 1785355 - RNA, 15 nt, Homo sapiens
agauaaacuacauag

SEQ ID NO: 1785356 - RNA, 15 nt, Homo sapiens
acauaaaauagauuu

SEQ ID NO: 1785357 - RNA, 11 nt, Homo sapiens
ccaacauggca

SEQ ID NO: 1785358 - RNA, 12 nt, Homo sapiens
cacaugacucuc

SEQ ID NO: 1785359 - RNA, 23 nt, Homo sapiens
gaaugaaucucaagauucaguag

SEQ ID NO: 1785360 - RNA, 21 nt, Homo sapiens
uuuaggaccgugggucaugca

SEQ ID NO: 1785361 - RNA, 12 nt, Homo sapiens
auaacuguuauu

SEQ ID NO: 1785362 - RNA, 18 nt, Homo sapiens
gcuucuguaguacuccuu

SEQ ID NO: 1785363 - RNA, 23 nt, Homo sapiens
cuuccaaaaauuacuuaguauug

SEQ ID NO: 1785364 - RNA, 12 nt, Homo sapiens
guacacuguguu

SEQ ID NO: 1785365 - RNA, 14 nt, Homo sapiens
caguaccuccugcc

SEQ ID NO: 1785366 - RNA, 20 nt, Homo sapiens
acauggugaaaccucaucuc

SEQ ID NO: 1785367 - RNA, 13 nt, Homo sapiens
uggcagucacuga

SEQ ID NO: 1785368 - RNA, 17 nt, Homo sapiens
cacugauaaucacacug

SEQ ID NO: 1785369 - RNA, 23 nt, Homo sapiens
cugcuugaacccaggagguggag

SEQ ID NO: 1785370 - RNA, 14 nt, Homo sapiens
uaagccgcagagac

SEQ ID NO: 1785371 - RNA, 17 nt, Homo sapiens
acugcaagucacauaaa

SEQ ID NO: 1785372 - RNA, 21 nt, Homo sapiens
uuccagguggcgugagaggca

SEQ ID NO: 1785373 - RNA, 15 nt, Homo sapiens
gcccuggccaagcuu

SEQ ID NO: 1785374 - RNA, 14 nt, Homo sapiens
aggaccaauagcau

SEQ ID NO: 1785375 - RNA, 22 nt, Homo sapiens
guccugucuaaaaaugauucuc

SEQ ID NO: 1785376 - RNA, 17 nt, Homo sapiens
uggugcacugagcugca

SEQ ID NO: 1785377 - RNA, 22 nt, Homo sapiens
cgccuggcccucuguggucaca

SEQ ID NO: 1785378 - RNA, 17 nt, Homo sapiens
caagugagaaagacauc

SEQ ID NO: 1785379 - RNA, 19 nt, Homo sapiens
cucccaaggcucugagcaa

SEQ ID NO: 1785380 - RNA, 20 nt, Homo sapiens
gcuuccugcguuccgugcaa

SEQ ID NO: 1785381 - RNA, 16 nt, Homo sapiens
aucccacugaccuacu

SEQ ID NO: 1785382 - RNA, 19 nt, Homo sapiens
guuuaccuggugcucucaa

SEQ ID NO: 1785383 - RNA, 19 nt, Homo sapiens
ccacugcacccagcuaauu

SEQ ID NO: 1785384 - RNA, 16 nt, Homo sapiens
auguugaccaugucua

SEQ ID NO: 1785385 - RNA, 15 nt, Homo sapiens
acuuuaacucaggag

SEQ ID NO: 1785386 - RNA, 16 nt, Homo sapiens
aaagccucgggccaca

SEQ ID NO: 1785387 - RNA, 21 nt, Homo sapiens
ugaauagcgcccucaacccug

SEQ ID NO: 1785388 - RNA, 15 nt, Homo sapiens
accugaggauaacuc

SEQ ID NO: 1785389 - RNA, 17 nt, Homo sapiens
aaguuugggccagugaa

SEQ ID NO: 1785390 - RNA, 19 nt, Homo sapiens
auucauucugaacccucca

SEQ ID NO: 1785391 - RNA, 17 nt, Homo sapiens
aaauuaaccuggucaau

SEQ ID NO: 1785392 - RNA, 16 nt, Homo sapiens
gauugcugagagccau

SEQ ID NO: 1785393 - RNA, 13 nt, Homo sapiens
ccauagaaacaug

SEQ ID NO: 1785394 - RNA, 20 nt, Homo sapiens
gugaccuugggaccaaaggg

SEQ ID NO: 1785395 - RNA, 22 nt, Homo sapiens
uucuucaccuaagucucuguga

SEQ ID NO: 1785396 - RNA, 12 nt, Homo sapiens
ucuucauuaccu

SEQ ID NO: 1785397 - RNA, 12 nt, Homo sapiens
acuccauuuccc

SEQ ID NO: 1785398 - RNA, 15 nt, Homo sapiens
uggguuaaguauuau

SEQ ID NO: 1785399 - RNA, 15 nt, Homo sapiens
uggaugggaugcacu

SEQ ID NO: 1785400 - RNA, 22 nt, Homo sapiens
aucaacauggcaauugcacuca

SEQ ID NO: 1785401 - RNA, 23 nt, Homo sapiens
ugcuggagaaaaaacacacuccu

SEQ ID NO: 1785402 - RNA, 20 nt, Homo sapiens
uuaucaccucugauggcuga

SEQ ID NO: 1785403 - RNA, 20 nt, Homo sapiens
ggaagugacaggacuuucau

SEQ ID NO: 1785404 - RNA, 17 nt, Homo sapiens
aauaagaaagugcgagu

SEQ ID NO: 1785405 - RNA, 23 nt, Homo sapiens
uuacauauguuaauaaacugcaa

SEQ ID NO: 1785406 - RNA, 18 nt, Homo sapiens
acuguaauaauaccucaa

SEQ ID NO: 1785407 - RNA, 15 nt, Homo sapiens
ugaccugcacaccgc

SEQ ID NO: 1785408 - RNA, 20 nt, Homo sapiens
aaaagaaggcucacagauuu

SEQ ID NO: 1785409 - RNA, 15 nt, Homo sapiens
cacccgggaacuuuu

SEQ ID NO: 1785410 - RNA, 17 nt, Homo sapiens
cuggggacggagcacug

SEQ ID NO: 1785411 - RNA, 17 nt, Homo sapiens
augucccuauucugcca

SEQ ID NO: 1785412 - RNA, 16 nt, Homo sapiens
auggugaaacccuguc

SEQ ID NO: 1785413 - RNA, 19 nt, Homo sapiens
aggagcagcuggcacugac

SEQ ID NO: 1785414 - RNA, 17 nt, Homo sapiens
uuuaauccaaagaaaga

SEQ ID NO: 1785415 - RNA, 22 nt, Homo sapiens
accggaaggaggccaaccagcc

SEQ ID NO: 1785416 - RNA, 14 nt, Homo sapiens
caaccaacugcaaa

SEQ ID NO: 1785417 - RNA, 18 nt, Homo sapiens
caucuccagugugccaga

SEQ ID NO: 1785418 - RNA, 20 nt, Homo sapiens
acucuugugaauuauucuga

SEQ ID NO: 1785419 - RNA, 18 nt, Homo sapiens
auggccacaaaccugccc

SEQ ID NO: 1785420 - RNA, 14 nt, Homo sapiens
gccaacacccaucu

SEQ ID NO: 1785421 - RNA, 23 nt, Homo sapiens
ccaaucucuucuaaaaaaaaaca

SEQ ID NO: 1785422 - RNA, 14 nt, Homo sapiens
acuccugccauagu

SEQ ID NO: 1785423 - RNA, 14 nt, Homo sapiens
gucccuauucugcc

SEQ ID NO: 1785424 - RNA, 13 nt, Homo sapiens
agugauucuugcu

SEQ ID NO: 1785425 - RNA, 13 nt, Homo sapiens
ggagacccauugc

SEQ ID NO: 1785426 - RNA, 14 nt, Homo sapiens
ucugcccagaauuc

SEQ ID NO: 1785427 - RNA, 16 nt, Homo sapiens
ccaccugacaauggca

SEQ ID NO: 1785428 - RNA, 14 nt, Homo sapiens
uccuuccaccucag

SEQ ID NO: 1785429 - RNA, 13 nt, Homo sapiens
uucaaagacugug

SEQ ID NO: 1785430 - RNA, 12 nt, Homo sapiens
uucccuccugca

SEQ ID NO: 1785431 - RNA, 19 nt, Homo sapiens
cuucccaucucaaccagga

SEQ ID NO: 1785432 - RNA, 14 nt, Homo sapiens
cucuugcauuucac

SEQ ID NO: 1785433 - RNA, 16 nt, Homo sapiens
auggggccaucugggc

SEQ ID NO: 1785434 - RNA, 22 nt, Homo sapiens
uccacaggaacaacagcaucuu

SEQ ID NO: 1785435 - RNA, 17 nt, Homo sapiens
aguccuuuuugucaugc

SEQ ID NO: 1785436 - RNA, 18 nt, Homo sapiens
guuuuugucuaugaauau

SEQ ID NO: 1785437 - RNA, 15 nt, Homo sapiens
aaauucauugacuua

SEQ ID NO: 1785438 - RNA, 13 nt, Homo sapiens
ccaaauccauccu

SEQ ID NO: 1785439 - RNA, 14 nt, Homo sapiens
gagugugggccagg

SEQ ID NO: 1785440 - RNA, 20 nt, Homo sapiens
gacuucucugccaccaucaa

SEQ ID NO: 1785441 - RNA, 23 nt, Homo sapiens
aaccucagugauuggcucugugg

SEQ ID NO: 1785442 - RNA, 16 nt, Homo sapiens
uuaaauguucauguca

SEQ ID NO: 1785443 - RNA, 16 nt, Homo sapiens
cauuggguucaaggaa

SEQ ID NO: 1785444 - RNA, 16 nt, Homo sapiens
cucugacucccaaaga

SEQ ID NO: 1785445 - RNA, 15 nt, Homo sapiens
uucauaguuggaaaa

SEQ ID NO: 1785446 - RNA, 22 nt, Homo sapiens
aaaccucuuucggaaaugauug

SEQ ID NO: 1785447 - RNA, 20 nt, Homo sapiens
ugcuaaucuucuuaugcaau

SEQ ID NO: 1785448 - RNA, 15 nt, Homo sapiens
accugcaaacuccuu

SEQ ID NO: 1785449 - RNA, 17 nt, Homo sapiens
accuugggggaagacuu

SEQ ID NO: 1785450 - RNA, 13 nt, Homo sapiens
cacccucacaucc

SEQ ID NO: 1785451 - RNA, 13 nt, Homo sapiens
ccucuagaacagc

SEQ ID NO: 1785452 - RNA, 18 nt, Homo sapiens
ccugaaugguuccaugcc

SEQ ID NO: 1785453 - RNA, 22 nt, Homo sapiens
caacagcccucaggucagggug

SEQ ID NO: 1785454 - RNA, 21 nt, Homo sapiens
gcugcagagcagcagcaccuu

SEQ ID NO: 1785455 - RNA, 20 nt, Homo sapiens
ucaggccuggccucaucuca

SEQ ID NO: 1785456 - RNA, 19 nt, Homo sapiens
ccugaaauuuaaacugcaa

SEQ ID NO: 1785457 - RNA, 17 nt, Homo sapiens
uucaaacugcaugauuc

SEQ ID NO: 1785458 - RNA, 19 nt, Homo sapiens
aaucuuuggguaacuucaa

SEQ ID NO: 1785459 - RNA, 17 nt, Homo sapiens
agugacugugcauuuga

SEQ ID NO: 1785460 - RNA, 16 nt, Homo sapiens
agccaccaguucucau

SEQ ID NO: 1785461 - RNA, 22 nt, Homo sapiens
uggcucugaacugcacaaugca

SEQ ID NO: 1785462 - RNA, 21 nt, Homo sapiens
auucuggaagcaaauggcaaa

SEQ ID NO: 1785463 - RNA, 18 nt, Homo sapiens
cuuugguuaauguugauu

SEQ ID NO: 1785464 - RNA, 18 nt, Homo sapiens
gcaauaaaaaucauagua

SEQ ID NO: 1785465 - RNA, 17 nt, Homo sapiens
aaccguggggaggccau

SEQ ID NO: 1785466 - RNA, 22 nt, Homo sapiens
aucauucauccaggacugagau

SEQ ID NO: 1785467 - RNA, 15 nt, Homo sapiens
ggaacccuccagacc

SEQ ID NO: 1785468 - RNA, 21 nt, Homo sapiens
gccccaucaggacucuuguga

SEQ ID NO: 1785469 - RNA, 15 nt, Homo sapiens
acuguaucaagucau

SEQ ID NO: 1785470 - RNA, 20 nt, Homo sapiens
ugccucuaugugcaacugac

SEQ ID NO: 1785471 - RNA, 15 nt, Homo sapiens
aggccaucaucagug

SEQ ID NO: 1785472 - RNA, 12 nt, Homo sapiens
cugccagcuucc

SEQ ID NO: 1785473 - RNA, 17 nt, Homo sapiens
ugucucuagccacuuug

SEQ ID NO: 1785474 - RNA, 21 nt, Homo sapiens
cucauuggugguagccaucaa

SEQ ID NO: 1785475 - RNA, 19 nt, Homo sapiens
augcuuagucccucaugca

SEQ ID NO: 1785476 - RNA, 21 nt, Homo sapiens
cugugcggugucaccaugagc

SEQ ID NO: 1785477 - RNA, 14 nt, Homo sapiens
cacucccuuuccaa

SEQ ID NO: 1785478 - RNA, 17 nt, Homo sapiens
gagggaggguggccuaa

SEQ ID NO: 1785479 - RNA, 18 nt, Homo sapiens
cuuggugacaaaauucau

SEQ ID NO: 1785480 - RNA, 14 nt, Homo sapiens
cuagccaggucucc

SEQ ID NO: 1785481 - RNA, 23 nt, Homo sapiens
accaugcagugccccuagcuuag

SEQ ID NO: 1785482 - RNA, 18 nt, Homo sapiens
aaaauucuagaagcagaa

SEQ ID NO: 1785483 - RNA, 18 nt, Homo sapiens
ugccugucccucucaggc

SEQ ID NO: 1785484 - RNA, 12 nt, Homo sapiens
cacuuugacagg

SEQ ID NO: 1785485 - RNA, 14 nt, Homo sapiens
ucagagcagcacug

SEQ ID NO: 1785486 - RNA, 14 nt, Homo sapiens
auaauuucuaaugu

SEQ ID NO: 1785487 - RNA, 15 nt, Homo sapiens
aacauguuaaaccau

SEQ ID NO: 1785488 - RNA, 15 nt, Homo sapiens
acccauuucuuacca

SEQ ID NO: 1785489 - RNA, 13 nt, Homo sapiens
cauaccauuccca

SEQ ID NO: 1785490 - RNA, 14 nt, Homo sapiens
ugagaaaugcauag

SEQ ID NO: 1785491 - RNA, 16 nt, Homo sapiens
gucuguucuuuaccaa

SEQ ID NO: 1785492 - RNA, 15 nt, Homo sapiens
uggucaguugccaaa

SEQ ID NO: 1785493 - RNA, 11 nt, Homo sapiens
cgucacaaaga

SEQ ID NO: 1785494 - RNA, 22 nt, Homo sapiens
gaacuguuuuguaagugcugcu

SEQ ID NO: 1785495 - RNA, 13 nt, Homo sapiens
uagaacauuccau

SEQ ID NO: 1785496 - RNA, 16 nt, Homo sapiens
uaucauuucauauaaa

SEQ ID NO: 1785497 - RNA, 17 nt, Homo sapiens
uaccaucucuccagcua

SEQ ID NO: 1785498 - RNA, 13 nt, Homo sapiens
gcagggcagagga

SEQ ID NO: 1785499 - RNA, 14 nt, Homo sapiens
cauucacagcccag

SEQ ID NO: 1785500 - RNA, 22 nt, Homo sapiens
gacagaagccuaaaaaaagcua

SEQ ID NO: 1785501 - RNA, 19 nt, Homo sapiens
cauguggccuuuaucucaa

SEQ ID NO: 1785502 - RNA, 23 nt, Homo sapiens
augaugccaugaggaacaaggca

SEQ ID NO: 1785503 - RNA, 14 nt, Homo sapiens
uuuacuagugugug

SEQ ID NO: 1785504 - RNA, 14 nt, Homo sapiens
gaaggaaagcacua

SEQ ID NO: 1785505 - RNA, 19 nt, Homo sapiens
gcggggcuuuccugcacau

SEQ ID NO: 1785506 - RNA, 20 nt, Homo sapiens
cuguucaagagcacacuugg

SEQ ID NO: 1785507 - RNA, 13 nt, Homo sapiens
aaggaccagguua

SEQ ID NO: 1785508 - RNA, 17 nt, Homo sapiens
ugaugaucgucaucauc

SEQ ID NO: 1785509 - RNA, 22 nt, Homo sapiens
uucacugcuacaugugcuggaa

SEQ ID NO: 1785510 - RNA, 19 nt, Homo sapiens
aguaaucccauuucccaaa

SEQ ID NO: 1785511 - RNA, 23 nt, Homo sapiens
cuaagagggagggagggcuccag

SEQ ID NO: 1785512 - RNA, 22 nt, Homo sapiens
aguguuuuuccuguguauuaaa

SEQ ID NO: 1785513 - RNA, 13 nt, Homo sapiens
acgucagccagcu

SEQ ID NO: 1785514 - RNA, 12 nt, Homo sapiens
ucugagcaccua

SEQ ID NO: 1785515 - RNA, 15 nt, Homo sapiens
uacugcuauguguca

SEQ ID NO: 1785516 - RNA, 18 nt, Homo sapiens
ugcacagagauaugcaca

SEQ ID NO: 1785517 - RNA, 17 nt, Homo sapiens
cccaagcagcugggauu

SEQ ID NO: 1785518 - RNA, 22 nt, Homo sapiens
cuacagucuaaaauugcuucuu

SEQ ID NO: 1785519 - RNA, 20 nt, Homo sapiens
cacugauuugauaccauggc

SEQ ID NO: 1785520 - RNA, 13 nt, Homo sapiens
acccccaugaucc

SEQ ID NO: 1785521 - RNA, 19 nt, Homo sapiens
agggaaguaguccuuggca

SEQ ID NO: 1785522 - RNA, 19 nt, Homo sapiens
augcucugauuuaucugag

SEQ ID NO: 1785523 - RNA, 15 nt, Homo sapiens
guauaccaaggcaaa

SEQ ID NO: 1785524 - RNA, 19 nt, Homo sapiens
uagagcagccacaaccaaa

SEQ ID NO: 1785525 - RNA, 16 nt, Homo sapiens
ucagccucacccugca

SEQ ID NO: 1785526 - RNA, 19 nt, Homo sapiens
agaguguucaacugugagu

SEQ ID NO: 1785527 - RNA, 17 nt, Homo sapiens
cggggcauggcugcuga

SEQ ID NO: 1785528 - RNA, 16 nt, Homo sapiens
cagucacauugaugua

SEQ ID NO: 1785529 - RNA, 16 nt, Homo sapiens
auuuuuaugugcagcg

SEQ ID NO: 1785530 - RNA, 19 nt, Homo sapiens
cccugaccuguccagguga

SEQ ID NO: 1785531 - RNA, 20 nt, Homo sapiens
gggagacuuggggccagcgc

SEQ ID NO: 1785532 - RNA, 14 nt, Homo sapiens
aaggcacagugaag

SEQ ID NO: 1785533 - RNA, 20 nt, Homo sapiens
ugucaguuuuaucuucagaa

SEQ ID NO: 1785534 - RNA, 14 nt, Homo sapiens
uuugagcacacuuu

SEQ ID NO: 1785535 - RNA, 16 nt, Homo sapiens
cuguugugugccugac

SEQ ID NO: 1785536 - RNA, 14 nt, Homo sapiens
agaguucauggaau

SEQ ID NO: 1785537 - RNA, 19 nt, Homo sapiens
caaaaauggauauuauuag

SEQ ID NO: 1785538 - RNA, 18 nt, Homo sapiens
acaauauuuauguccuau

SEQ ID NO: 1785539 - RNA, 20 nt, Homo sapiens
aguacaauguuaacccuaaa

SEQ ID NO: 1785540 - RNA, 16 nt, Homo sapiens
accaaucuuacuuugu

SEQ ID NO: 1785541 - RNA, 17 nt, Homo sapiens
ugcuauacacacacaca

SEQ ID NO: 1785542 - RNA, 17 nt, Homo sapiens
agccuuaaaacaucauu

SEQ ID NO: 1785543 - RNA, 20 nt, Homo sapiens
cuggcuucaggagggagcau

SEQ ID NO: 1785544 - RNA, 19 nt, Homo sapiens
acaggccucaucuuuuugg

SEQ ID NO: 1785545 - RNA, 14 nt, Homo sapiens
aaaauaaacaugua

SEQ ID NO: 1785546 - RNA, 13 nt, Homo sapiens
uauauguaccgua

SEQ ID NO: 1785547 - RNA, 19 nt, Homo sapiens
cucugcagucgcuugccaa

SEQ ID NO: 1785548 - RNA, 17 nt, Homo sapiens
augucacaauccugucc

SEQ ID NO: 1785549 - RNA, 14 nt, Homo sapiens
ucucaauucuuccc

SEQ ID NO: 1785550 - RNA, 14 nt, Homo sapiens
aaagacaacauaac

SEQ ID NO: 1785551 - RNA, 19 nt, Homo sapiens
acugaccagccuccaugcu

SEQ ID NO: 1785552 - RNA, 17 nt, Homo sapiens
gccuuugguaagggaag

SEQ ID NO: 1785553 - RNA, 20 nt, Homo sapiens
gaggagucucaacauguguu

SEQ ID NO: 1785554 - RNA, 23 nt, Homo sapiens
aaggaagggacaagacaaaacca

SEQ ID NO: 1785555 - RNA, 17 nt, Homo sapiens
ccagagcccaagugcca

SEQ ID NO: 1785556 - RNA, 18 nt, Homo sapiens
caugaaaaaaaugauccc

SEQ ID NO: 1785557 - RNA, 11 nt, Homo sapiens
uuuucugcuaa

SEQ ID NO: 1785558 - RNA, 16 nt, Homo sapiens
gccaucuaaacaucau

SEQ ID NO: 1785559 - RNA, 17 nt, Homo sapiens
cuucaaguuguaaaaau

SEQ ID NO: 1785560 - RNA, 24 nt, Homo sapiens
gagcaucuugcauccaaaccugua

SEQ ID NO: 1785561 - RNA, 16 nt, Homo sapiens
ccuugcuggaugcugc

SEQ ID NO: 1785562 - RNA, 15 nt, Homo sapiens
acugucagcgagcug

SEQ ID NO: 1785563 - RNA, 19 nt, Homo sapiens
aacagcuguuccuguguuc

SEQ ID NO: 1785564 - RNA, 14 nt, Homo sapiens
cugacuguucucuu

SEQ ID NO: 1785565 - RNA, 18 nt, Homo sapiens
cugcacaaugcauugaac

SEQ ID NO: 1785566 - RNA, 20 nt, Homo sapiens
accuccuccacucacuccag

SEQ ID NO: 1785567 - RNA, 14 nt, Homo sapiens
agaaucacuugaac

SEQ ID NO: 1785568 - RNA, 23 nt, Homo sapiens
ucacauggccuaugcacauaugg

SEQ ID NO: 1785569 - RNA, 20 nt, Homo sapiens
ucuuucucagauuccaugca

SEQ ID NO: 1785570 - RNA, 17 nt, Homo sapiens
uuacgacccaggacaau

SEQ ID NO: 1785571 - RNA, 15 nt, Homo sapiens
aacagaagugacuga

SEQ ID NO: 1785572 - RNA, 16 nt, Homo sapiens
cccuggugggacaaca

SEQ ID NO: 1785573 - RNA, 16 nt, Homo sapiens
uuuagcuaagcacaga

SEQ ID NO: 1785574 - RNA, 18 nt, Homo sapiens
aacaugacauccagagau

SEQ ID NO: 1785575 - RNA, 22 nt, Homo sapiens
aauucugugacauacauauuau

SEQ ID NO: 1785576 - RNA, 13 nt, Homo sapiens
cuggaguguagug

SEQ ID NO: 1785577 - RNA, 15 nt, Homo sapiens
cuuagacgaagaagc

SEQ ID NO: 1785578 - RNA, 11 nt, Homo sapiens
aacugcaguga

SEQ ID NO: 1785579 - RNA, 20 nt, Homo sapiens
cugcagcucccgaagccuga

SEQ ID NO: 1785580 - RNA, 17 nt, Homo sapiens
gcacccugcccaccaag

SEQ ID NO: 1785581 - RNA, 20 nt, Homo sapiens
caauaaaaugucuucuccca

SEQ ID NO: 1785582 - RNA, 19 nt, Homo sapiens
auucugauguuacugagau

SEQ ID NO: 1785583 - RNA, 13 nt, Homo sapiens
uuggagugcagug

SEQ ID NO: 1785584 - RNA, 19 nt, Homo sapiens
aaagugcuaguauuauggg

SEQ ID NO: 1785585 - RNA, 21 nt, Homo sapiens
acacaacuuagaaaccaaauu

SEQ ID NO: 1785586 - RNA, 23 nt, Homo sapiens
aggggcugggggugaggggccag

SEQ ID NO: 1785587 - RNA, 12 nt, Homo sapiens
uacgaagcaaua

SEQ ID NO: 1785588 - RNA, 14 nt, Homo sapiens
augugguugcauaa

SEQ ID NO: 1785589 - RNA, 17 nt, Homo sapiens
ugcaauagaacagagaa

SEQ ID NO: 1785590 - RNA, 22 nt, Homo sapiens
aaucuuagcugccaaguaaaua

SEQ ID NO: 1785591 - RNA, 16 nt, Homo sapiens
uuuuauucuacuacuu

SEQ ID NO: 1785592 - RNA, 14 nt, Homo sapiens
aggaagccacugcc

SEQ ID NO: 1785593 - RNA, 16 nt, Homo sapiens
ucaugcauuacuuacu

SEQ ID NO: 1785594 - RNA, 15 nt, Homo sapiens
aaguuuucugcugua

SEQ ID NO: 1785595 - RNA, 17 nt, Homo sapiens
aaaggcccuuuucaggg

SEQ ID NO: 1785596 - RNA, 23 nt, Homo sapiens
agugagaguuccucuuugcccug

SEQ ID NO: 1785597 - RNA, 20 nt, Homo sapiens
ucuaccucaggcagcucaag

SEQ ID NO: 1785598 - RNA, 15 nt, Homo sapiens
aaugcucacuuaugu

SEQ ID NO: 1785599 - RNA, 13 nt, Homo sapiens
uguugggucagug

SEQ ID NO: 1785600 - RNA, 15 nt, Homo sapiens
uuuccaacuacuaau

SEQ ID NO: 1785601 - RNA, 16 nt, Homo sapiens
uuauacaugucuauca

SEQ ID NO: 1785602 - RNA, 16 nt, Homo sapiens
gcaaugguuucacaug

SEQ ID NO: 1785603 - RNA, 16 nt, Homo sapiens
cucagaauccaaagau

SEQ ID NO: 1785604 - RNA, 22 nt, Homo sapiens
cauuuaaaaauaucugaauaua

SEQ ID NO: 1785605 - RNA, 18 nt, Homo sapiens
cagagaaagaaaaggcaa

SEQ ID NO: 1785606 - RNA, 16 nt, Homo sapiens
ccuccuugucuuggca

SEQ ID NO: 1785607 - RNA, 16 nt, Homo sapiens
augaaaggcaaugaca

SEQ ID NO: 1785608 - RNA, 17 nt, Homo sapiens
cccucuaccuccuggag

SEQ ID NO: 1785609 - RNA, 20 nt, Homo sapiens
gcccaggcuggacugcagug

SEQ ID NO: 1785610 - RNA, 15 nt, Homo sapiens
aaaaaaaagugucuc

SEQ ID NO: 1785611 - RNA, 19 nt, Homo sapiens
gucucacucugucgcucag

SEQ ID NO: 1785612 - RNA, 15 nt, Homo sapiens
cugccuuaacugaug

SEQ ID NO: 1785613 - RNA, 22 nt, Homo sapiens
agagucuauuuacggaacucaa

SEQ ID NO: 1785614 - RNA, 13 nt, Homo sapiens
ucaaauccuugaa

SEQ ID NO: 1785615 - RNA, 13 nt, Homo sapiens
uugccuccucacc

SEQ ID NO: 1785616 - RNA, 18 nt, Homo sapiens
uaaugaagacccagugua

SEQ ID NO: 1785617 - RNA, 19 nt, Homo sapiens
ucaaguuuucucagaugau

SEQ ID NO: 1785618 - RNA, 22 nt, Homo sapiens
ucagcauugauauuugugcauu

SEQ ID NO: 1785619 - RNA, 11 nt, Homo sapiens
gucaacacaaa

SEQ ID NO: 1785620 - RNA, 20 nt, Homo sapiens
cacugucaugcuucaucauu

SEQ ID NO: 1785621 - RNA, 15 nt, Homo sapiens
gaaaauaaaugucac

SEQ ID NO: 1785622 - RNA, 23 nt, Homo sapiens
uggccagagagccuggugcugcu

SEQ ID NO: 1785623 - RNA, 19 nt, Homo sapiens
auaaacucacaacucucug

SEQ ID NO: 1785624 - RNA, 15 nt, Homo sapiens
aaaugcagcuuuaaa

SEQ ID NO: 1785625 - RNA, 16 nt, Homo sapiens
ugaagaacugcacuuu

SEQ ID NO: 1785626 - RNA, 17 nt, Homo sapiens
caguggaauuggugauu

SEQ ID NO: 1785627 - RNA, 18 nt, Homo sapiens
ggaacugcuugugcacug

SEQ ID NO: 1785628 - RNA, 15 nt, Homo sapiens
ccccuggccuuugag

SEQ ID NO: 1785629 - RNA, 14 nt, Homo sapiens
agucucaguucucu

SEQ ID NO: 1785630 - RNA, 18 nt, Homo sapiens
aaacccccgcuccagauc

SEQ ID NO: 1785631 - RNA, 19 nt, Homo sapiens
ccagcucuggcuuccugcu

SEQ ID NO: 1785632 - RNA, 16 nt, Homo sapiens
ccacuggagucucucu

SEQ ID NO: 1785633 - RNA, 16 nt, Homo sapiens
aaccuuugcuauguaa

SEQ ID NO: 1785634 - RNA, 19 nt, Homo sapiens
auuaauuuuccaaugcaca

SEQ ID NO: 1785635 - RNA, 12 nt, Homo sapiens
gguuucauucug

SEQ ID NO: 1785636 - RNA, 18 nt, Homo sapiens
ugaaccugcuuccuggcu

SEQ ID NO: 1785637 - RNA, 21 nt, Homo sapiens
gccacaaccuuuuacauauuu

SEQ ID NO: 1785638 - RNA, 22 nt, Homo sapiens
ggaugaaagagccagacucugu

SEQ ID NO: 1785639 - RNA, 24 nt, Homo sapiens
caccuaccuuacagugagggcuau

SEQ ID NO: 1785640 - RNA, 19 nt, Homo sapiens
cugauuuuggccaucagga

SEQ ID NO: 1785641 - RNA, 13 nt, Homo sapiens
cccaggcacuguu

SEQ ID NO: 1785642 - RNA, 17 nt, Homo sapiens
cgggaaagccuuaaaaa

SEQ ID NO: 1785643 - RNA, 20 nt, Homo sapiens
gugucccuggaugugaagcu

SEQ ID NO: 1785644 - RNA, 17 nt, Homo sapiens
caaucauaauaccugcu

SEQ ID NO: 1785645 - RNA, 19 nt, Homo sapiens
uaaugugugguggccucag

SEQ ID NO: 1785646 - RNA, 18 nt, Homo sapiens
gagaucgcuuuucucaga

SEQ ID NO: 1785647 - RNA, 14 nt, Homo sapiens
gucuuucucucuca

SEQ ID NO: 1785648 - RNA, 14 nt, Homo sapiens
cuacugagccuuca

SEQ ID NO: 1785649 - RNA, 14 nt, Homo sapiens
uugauauguaagag

SEQ ID NO: 1785650 - RNA, 17 nt, Homo sapiens
cucugugccuugccaca

SEQ ID NO: 1785651 - RNA, 12 nt, Homo sapiens
gcuguaugaccc

SEQ ID NO: 1785652 - RNA, 20 nt, Homo sapiens
uauacaggccucaaggggaa

SEQ ID NO: 1785653 - RNA, 22 nt, Homo sapiens
auguuuugucccauuuccuugg

SEQ ID NO: 1785654 - RNA, 17 nt, Homo sapiens
augcugagcgcuguguu

SEQ ID NO: 1785655 - RNA, 14 nt, Homo sapiens
cuauuucuguauca

SEQ ID NO: 1785656 - RNA, 23 nt, Homo sapiens
accagccugcacuacucccucaa

SEQ ID NO: 1785657 - RNA, 19 nt, Homo sapiens
aggccaggauggcacuguu

SEQ ID NO: 1785658 - RNA, 14 nt, Homo sapiens
uuccuacaguuucu

SEQ ID NO: 1785659 - RNA, 14 nt, Homo sapiens
ucucuucucugcca

SEQ ID NO: 1785660 - RNA, 20 nt, Homo sapiens
agagccccuacugugggcaa

SEQ ID NO: 1785661 - RNA, 16 nt, Homo sapiens
augcaguggcucaugc

SEQ ID NO: 1785662 - RNA, 17 nt, Homo sapiens
gacaagaccacacuuug

SEQ ID NO: 1785663 - RNA, 18 nt, Homo sapiens
gcaugagaaucacuugaa

SEQ ID NO: 1785664 - RNA, 13 nt, Homo sapiens
aauugcaauacau

SEQ ID NO: 1785665 - RNA, 15 nt, Homo sapiens
ugaccuaacauaccg

SEQ ID NO: 1785666 - RNA, 16 nt, Homo sapiens
uugagguacuaccuau

SEQ ID NO: 1785667 - RNA, 21 nt, Homo sapiens
cuaggaaaaucacuugccaaa

SEQ ID NO: 1785668 - RNA, 11 nt, Homo sapiens
cguguuugcuu

SEQ ID NO: 1785669 - RNA, 20 nt, Homo sapiens
aucuuuggacagaagcagcu

SEQ ID NO: 1785670 - RNA, 22 nt, Homo sapiens
agcacuuucccucuuggugccu

SEQ ID NO: 1785671 - RNA, 15 nt, Homo sapiens
uuauaauaaaaggaa

SEQ ID NO: 1785672 - RNA, 22 nt, Homo sapiens
ucgcugccagaugauuguucaa

SEQ ID NO: 1785673 - RNA, 19 nt, Homo sapiens
gcucuguagugcuacaggg

SEQ ID NO: 1785674 - RNA, 20 nt, Homo sapiens
gggaaaugacuucuccaggc

SEQ ID NO: 1785675 - RNA, 22 nt, Homo sapiens
accggggccagcaccacuuccu

SEQ ID NO: 1785676 - RNA, 15 nt, Homo sapiens
augaaucuuacuccu

SEQ ID NO: 1785677 - RNA, 12 nt, Homo sapiens
agcuacuugaug

SEQ ID NO: 1785678 - RNA, 14 nt, Homo sapiens
gcuccaggcuuccu

SEQ ID NO: 1785679 - RNA, 23 nt, Homo sapiens
cucuuaagucccaguauaccuca

SEQ ID NO: 1785680 - RNA, 12 nt, Homo sapiens
aaggaaagccaa

SEQ ID NO: 1785681 - RNA, 22 nt, Homo sapiens
cccugagagcucacaguacaau

SEQ ID NO: 1785682 - RNA, 17 nt, Homo sapiens
caugguugaaucugaaa

SEQ ID NO: 1785683 - RNA, 18 nt, Homo sapiens
auuuuuauacagugauaa

SEQ ID NO: 1785684 - RNA, 19 nt, Homo sapiens
uuaaaauaucuuuugaccu

SEQ ID NO: 1785685 - RNA, 15 nt, Homo sapiens
gauugccacagcuca

SEQ ID NO: 1785686 - RNA, 15 nt, Homo sapiens
uauccuuucaagaca

SEQ ID NO: 1785687 - RNA, 19 nt, Homo sapiens
auguagccuggcccuggaa

SEQ ID NO: 1785688 - RNA, 11 nt, Homo sapiens
uuuuagcucau

SEQ ID NO: 1785689 - RNA, 14 nt, Homo sapiens
gcccucucacuuga

SEQ ID NO: 1785690 - RNA, 21 nt, Homo sapiens
uggcuuguucaucauccagau

SEQ ID NO: 1785691 - RNA, 19 nt, Homo sapiens
gaaauuaacacccaaaaga

SEQ ID NO: 1785692 - RNA, 19 nt, Homo sapiens
agggugugggccaccagag

SEQ ID NO: 1785693 - RNA, 20 nt, Homo sapiens
agguccaggccagugggccu

SEQ ID NO: 1785694 - RNA, 14 nt, Homo sapiens
aagagcagcacagg

SEQ ID NO: 1785695 - RNA, 13 nt, Homo sapiens
uaaauguucaagu

SEQ ID NO: 1785696 - RNA, 18 nt, Homo sapiens
gcauaauaagcuaaagag

SEQ ID NO: 1785697 - RNA, 19 nt, Homo sapiens
aucaauaaaggacaggcug

SEQ ID NO: 1785698 - RNA, 18 nt, Homo sapiens
gccuuuagaugugagcuu

SEQ ID NO: 1785699 - RNA, 21 nt, Homo sapiens
auauuccagcagugaaacuug

SEQ ID NO: 1785700 - RNA, 17 nt, Homo sapiens
ggagauccuuguguuua

SEQ ID NO: 1785701 - RNA, 14 nt, Homo sapiens
cugaagaccuccac

SEQ ID NO: 1785702 - RNA, 18 nt, Homo sapiens
uagaacaacgccugucac

SEQ ID NO: 1785703 - RNA, 12 nt, Homo sapiens
accccauuugau

SEQ ID NO: 1785704 - RNA, 21 nt, Homo sapiens
gcaugccggugaucccuagcu

SEQ ID NO: 1785705 - RNA, 13 nt, Homo sapiens
auguaguuuucuu

SEQ ID NO: 1785706 - RNA, 23 nt, Homo sapiens
agaugggcgucacuacugcuacc

SEQ ID NO: 1785707 - RNA, 18 nt, Homo sapiens
gcgaugaggggacauuuu

SEQ ID NO: 1785708 - RNA, 16 nt, Homo sapiens
uggaaaaaaaggaaga

SEQ ID NO: 1785709 - RNA, 18 nt, Homo sapiens
ggaccaggacugcagcuc

SEQ ID NO: 1785710 - RNA, 16 nt, Homo sapiens
cagaugccaaaaaaga

SEQ ID NO: 1785711 - RNA, 21 nt, Homo sapiens
uaaagcaguguuuucaccuca

SEQ ID NO: 1785712 - RNA, 17 nt, Homo sapiens
caauagugucauccuca

SEQ ID NO: 1785713 - RNA, 18 nt, Homo sapiens
accucaucagcugccuaa

SEQ ID NO: 1785714 - RNA, 17 nt, Homo sapiens
uacuaaauuacaaaugc

SEQ ID NO: 1785715 - RNA, 12 nt, Homo sapiens
ggaaugggagac

SEQ ID NO: 1785716 - RNA, 14 nt, Homo sapiens
auuuuuguauguca

SEQ ID NO: 1785717 - RNA, 17 nt, Homo sapiens
cuggggccugggacaac

SEQ ID NO: 1785718 - RNA, 23 nt, Homo sapiens
ugacuucccuggucaccaaggca

SEQ ID NO: 1785719 - RNA, 22 nt, Homo sapiens
aacaauaaaaugucuucuccca

SEQ ID NO: 1785720 - RNA, 17 nt, Homo sapiens
cauuccuaaaacacccu

SEQ ID NO: 1785721 - RNA, 14 nt, Homo sapiens
accaaaacauuccg

SEQ ID NO: 1785722 - RNA, 18 nt, Homo sapiens
gcuuugucuucagccucu

SEQ ID NO: 1785723 - RNA, 18 nt, Homo sapiens
cauacugcaugcucagga

SEQ ID NO: 1785724 - RNA, 17 nt, Homo sapiens
auguaucuacaauacau

SEQ ID NO: 1785725 - RNA, 16 nt, Homo sapiens
cugagugucucugccu

SEQ ID NO: 1785726 - RNA, 13 nt, Homo sapiens
ccacuaaaguaua

SEQ ID NO: 1785727 - RNA, 18 nt, Homo sapiens
gaauacacuuaacauaga

SEQ ID NO: 1785728 - RNA, 17 nt, Homo sapiens
gagccauggaagggugg

SEQ ID NO: 1785729 - RNA, 13 nt, Homo sapiens
uaaagaaacuggu

SEQ ID NO: 1785730 - RNA, 18 nt, Homo sapiens
ggugcuucucacacugga

SEQ ID NO: 1785731 - RNA, 17 nt, Homo sapiens
aguagacaggguuucac

SEQ ID NO: 1785732 - RNA, 19 nt, Homo sapiens
aaugcuacaaacauaucaa

SEQ ID NO: 1785733 - RNA, 16 nt, Homo sapiens
gugaguguauguauac

SEQ ID NO: 1785734 - RNA, 15 nt, Homo sapiens
caagcagcaggaaac

SEQ ID NO: 1785735 - RNA, 10 nt, Homo sapiens
accucuugcg

SEQ ID NO: 1785736 - RNA, 22 nt, Homo sapiens
guguuuuaaacucuccuaguca

SEQ ID NO: 1785737 - RNA, 14 nt, Homo sapiens
ucauuucugauuuc

SEQ ID NO: 1785738 - RNA, 15 nt, Homo sapiens
auagacuucucuuac

SEQ ID NO: 1785739 - RNA, 22 nt, Homo sapiens
cauuagcuuuaauuaagcucuc

SEQ ID NO: 1785740 - RNA, 23 nt, Homo sapiens
cuccugcucuuucuacaugacug

SEQ ID NO: 1785741 - RNA, 15 nt, Homo sapiens
acaauagaaaccugu

SEQ ID NO: 1785742 - RNA, 14 nt, Homo sapiens
acacauggcuuccu

SEQ ID NO: 1785743 - RNA, 18 nt, Homo sapiens
uacugaguuacauuguca

SEQ ID NO: 1785744 - RNA, 19 nt, Homo sapiens
aacuccaaaguccacacaa

SEQ ID NO: 1785745 - RNA, 13 nt, Homo sapiens
gccuugcugugaa

SEQ ID NO: 1785746 - RNA, 19 nt, Homo sapiens
gaccccaaaggaacacuga

SEQ ID NO: 1785747 - RNA, 14 nt, Homo sapiens
aguagcugggacua

SEQ ID NO: 1785748 - RNA, 15 nt, Homo sapiens
ggcuucuacacuggg

SEQ ID NO: 1785749 - RNA, 22 nt, Homo sapiens
cacugugucacccagacuggaa

SEQ ID NO: 1785750 - RNA, 23 nt, Homo sapiens
gauaugcacuugaaaugauggua

SEQ ID NO: 1785751 - RNA, 20 nt, Homo sapiens
uaaauaaugaauaaacugaa

SEQ ID NO: 1785752 - RNA, 15 nt, Homo sapiens
agaccucaucugccu

SEQ ID NO: 1785753 - RNA, 15 nt, Homo sapiens
uuuuggaacuguccu

SEQ ID NO: 1785754 - RNA, 18 nt, Homo sapiens
uggagcuaaaacuggccc

SEQ ID NO: 1785755 - RNA, 20 nt, Homo sapiens
ucaccuccucccagacuuuc

SEQ ID NO: 1785756 - RNA, 17 nt, Homo sapiens
cuaagaucacaccacua

SEQ ID NO: 1785757 - RNA, 20 nt, Homo sapiens
auguuuguaacuuuuuacau

SEQ ID NO: 1785758 - RNA, 12 nt, Homo sapiens
ucaauacuaugg

SEQ ID NO: 1785759 - RNA, 14 nt, Homo sapiens
cucacaaagagaua

SEQ ID NO: 1785760 - RNA, 21 nt, Homo sapiens
aaagucacggcugcgcacugu

SEQ ID NO: 1785761 - RNA, 20 nt, Homo sapiens
ucaggucaccgcgaggccua

SEQ ID NO: 1785762 - RNA, 17 nt, Homo sapiens
augcacaaaacuacuuu

SEQ ID NO: 1785763 - RNA, 21 nt, Homo sapiens
ugauggacacuccagggacac

SEQ ID NO: 1785764 - RNA, 24 nt, Homo sapiens
aacucuaucugucauacauccuag

SEQ ID NO: 1785765 - RNA, 21 nt, Homo sapiens
aucauuaaccacuuaucagug

SEQ ID NO: 1785766 - RNA, 15 nt, Homo sapiens
caguaugcuugcucu

SEQ ID NO: 1785767 - RNA, 13 nt, Homo sapiens
gucucauuuagaa

SEQ ID NO: 1785768 - RNA, 14 nt, Homo sapiens
auucauuucacugu

SEQ ID NO: 1785769 - RNA, 21 nt, Homo sapiens
cacugagcccuucccaggcug

SEQ ID NO: 1785770 - RNA, 21 nt, Homo sapiens
ucugaacugcuugcuaccaau

SEQ ID NO: 1785771 - RNA, 15 nt, Homo sapiens
ccuguuuuugcaaaa

SEQ ID NO: 1785772 - RNA, 21 nt, Homo sapiens
auuggaauggaacuacuguac

SEQ ID NO: 1785773 - RNA, 13 nt, Homo sapiens
uuaccaaaggaua

SEQ ID NO: 1785774 - RNA, 17 nt, Homo sapiens
ugcacuucuaagacuuu

SEQ ID NO: 1785775 - RNA, 14 nt, Homo sapiens
acagaucaaugaca

SEQ ID NO: 1785776 - RNA, 15 nt, Homo sapiens
cuuccaaaugagcca

SEQ ID NO: 1785777 - RNA, 20 nt, Homo sapiens
uuguaucaaaugugacauua

SEQ ID NO: 1785778 - RNA, 16 nt, Homo sapiens
ggagucaccaugcaag

SEQ ID NO: 1785779 - RNA, 16 nt, Homo sapiens
auaucauguaccucag

SEQ ID NO: 1785780 - RNA, 22 nt, Homo sapiens
gcugugggugcagcugucacag

SEQ ID NO: 1785781 - RNA, 15 nt, Homo sapiens
ggggugcuguggaca

SEQ ID NO: 1785782 - RNA, 15 nt, Homo sapiens
uauagcaucuucuca

SEQ ID NO: 1785783 - RNA, 20 nt, Homo sapiens
ccacugcaaauaaagccuuu

SEQ ID NO: 1785784 - RNA, 17 nt, Homo sapiens
aacgugucagaauccuu

SEQ ID NO: 1785785 - RNA, 14 nt, Homo sapiens
uuucccccaaagau

SEQ ID NO: 1785786 - RNA, 23 nt, Homo sapiens
agccucccacacugaaaccaaaa

SEQ ID NO: 1785787 - RNA, 21 nt, Homo sapiens
uccauuuuuccucuguucaca

SEQ ID NO: 1785788 - RNA, 15 nt, Homo sapiens
gucuuuuagaagaua

SEQ ID NO: 1785789 - RNA, 17 nt, Homo sapiens
gcuggccaaauagcaaa

SEQ ID NO: 1785790 - RNA, 13 nt, Homo sapiens
uaggagcuuccag

SEQ ID NO: 1785791 - RNA, 13 nt, Homo sapiens
agcuguguucaca

SEQ ID NO: 1785792 - RNA, 18 nt, Homo sapiens
auuuugcuuuaauauuca

SEQ ID NO: 1785793 - RNA, 13 nt, Homo sapiens
uucugaacaaaga

SEQ ID NO: 1785794 - RNA, 14 nt, Homo sapiens
aauauauccacaca

SEQ ID NO: 1785795 - RNA, 16 nt, Homo sapiens
caauauacaagcuuuu

SEQ ID NO: 1785796 - RNA, 12 nt, Homo sapiens
cuaaugaucacu

SEQ ID NO: 1785797 - RNA, 14 nt, Homo sapiens
ccuuuaucaccuca

SEQ ID NO: 1785798 - RNA, 23 nt, Homo sapiens
cugaaaaaugguaauuguugcua

SEQ ID NO: 1785799 - RNA, 21 nt, Homo sapiens
accuugaacauuuuacaagaa

SEQ ID NO: 1785800 - RNA, 23 nt, Homo sapiens
aaguuucuaacuuacaaacuggu

SEQ ID NO: 1785801 - RNA, 23 nt, Homo sapiens
aaagaacagcugaggcugucauu

SEQ ID NO: 1785802 - RNA, 13 nt, Homo sapiens
ggcuugcccaguc

SEQ ID NO: 1785803 - RNA, 16 nt, Homo sapiens
uaacacacacaccucu

SEQ ID NO: 1785804 - RNA, 14 nt, Homo sapiens
cagcuauacuguau

SEQ ID NO: 1785805 - RNA, 15 nt, Homo sapiens
gaaauugguuuucca

SEQ ID NO: 1785806 - RNA, 13 nt, Homo sapiens
uacgaaccaugcc

SEQ ID NO: 1785807 - RNA, 18 nt, Homo sapiens
caacaacuuuucccucac

SEQ ID NO: 1785808 - RNA, 13 nt, Homo sapiens
cuccaagcagcuu

SEQ ID NO: 1785809 - RNA, 22 nt, Homo sapiens
aacuugagcgugaaucuguauc

SEQ ID NO: 1785810 - RNA, 14 nt, Homo sapiens
acugcacuccaguc

SEQ ID NO: 1785811 - RNA, 22 nt, Homo sapiens
acacauucccccaccagcugca

SEQ ID NO: 1785812 - RNA, 14 nt, Homo sapiens
aacucacaauucca

SEQ ID NO: 1785813 - RNA, 15 nt, Homo sapiens
agguugggagccaaa

SEQ ID NO: 1785814 - RNA, 23 nt, Homo sapiens
augccacuccugcuucucugggg

SEQ ID NO: 1785815 - RNA, 22 nt, Homo sapiens
cauuuacucaccauauuugaau

SEQ ID NO: 1785816 - RNA, 13 nt, Homo sapiens
uguggcacacacc

SEQ ID NO: 1785817 - RNA, 19 nt, Homo sapiens
cugucuaugaacuugcaaa

SEQ ID NO: 1785818 - RNA, 19 nt, Homo sapiens
cucuuuuuuugagugacag

SEQ ID NO: 1785819 - RNA, 21 nt, Homo sapiens
uaauauaauaaaaguuauuac

SEQ ID NO: 1785820 - RNA, 16 nt, Homo sapiens
uaauaggccauguuua

SEQ ID NO: 1785821 - RNA, 14 nt, Homo sapiens
ccugaaacacugga

SEQ ID NO: 1785822 - RNA, 15 nt, Homo sapiens
cuaugggggcacuga

SEQ ID NO: 1785823 - RNA, 14 nt, Homo sapiens
acagcagauuccac

SEQ ID NO: 1785824 - RNA, 21 nt, Homo sapiens
uggguauugugugagugcaug

SEQ ID NO: 1785825 - RNA, 21 nt, Homo sapiens
uccugugucccuuguaaauag

SEQ ID NO: 1785826 - RNA, 14 nt, Homo sapiens
caaaauacaaaagu

SEQ ID NO: 1785827 - RNA, 22 nt, Homo sapiens
cugcacagugacuucugagauc

SEQ ID NO: 1785828 - RNA, 23 nt, Homo sapiens
cagcgugcacaucugcugugguc

SEQ ID NO: 1785829 - RNA, 13 nt, Homo sapiens
gccacuaccuuug

SEQ ID NO: 1785830 - RNA, 18 nt, Homo sapiens
ggaaaaaaauggggaaaa

SEQ ID NO: 1785831 - RNA, 16 nt, Homo sapiens
uacauugagcauuuga

SEQ ID NO: 1785832 - RNA, 14 nt, Homo sapiens
aaauuaaaugccac

SEQ ID NO: 1785833 - RNA, 17 nt, Homo sapiens
uguggacacuguggaaa

SEQ ID NO: 1785834 - RNA, 17 nt, Homo sapiens
aagcaaugcaauuccuc

SEQ ID NO: 1785835 - RNA, 15 nt, Homo sapiens
gcugcacauugccug

SEQ ID NO: 1785836 - RNA, 20 nt, Homo sapiens
gucauuggccgacaucacag

SEQ ID NO: 1785837 - RNA, 13 nt, Homo sapiens
agcaucaauacaa

SEQ ID NO: 1785838 - RNA, 20 nt, Homo sapiens
cuuggaaguguuucaaaaaa

SEQ ID NO: 1785839 - RNA, 15 nt, Homo sapiens
gugccugaucugcac

SEQ ID NO: 1785840 - RNA, 21 nt, Homo sapiens
ccugcucuucuaccauuugaa

SEQ ID NO: 1785841 - RNA, 11 nt, Homo sapiens
gcgacugagaa

SEQ ID NO: 1785842 - RNA, 22 nt, Homo sapiens
cucuuccccagagaggcacuca

SEQ ID NO: 1785843 - RNA, 23 nt, Homo sapiens
ccacucccagauggcucuuucua

SEQ ID NO: 1785844 - RNA, 23 nt, Homo sapiens
uaagguuuguuuuccauccauuc

SEQ ID NO: 1785845 - RNA, 22 nt, Homo sapiens
cuauguauggaauacaguguua

SEQ ID NO: 1785846 - RNA, 17 nt, Homo sapiens
ggucaauuaaauugacu

SEQ ID NO: 1785847 - RNA, 11 nt, Homo sapiens
gcaacugagag

SEQ ID NO: 1785848 - RNA, 12 nt, Homo sapiens
cccugugggugu

SEQ ID NO: 1785849 - RNA, 21 nt, Homo sapiens
acagcucaccaacuacagaaa

SEQ ID NO: 1785850 - RNA, 12 nt, Homo sapiens
accagauuugcu

SEQ ID NO: 1785851 - RNA, 16 nt, Homo sapiens
cuccuccccauguacc

SEQ ID NO: 1785852 - RNA, 18 nt, Homo sapiens
ccacugccagacaugcca

SEQ ID NO: 1785853 - RNA, 17 nt, Homo sapiens
cagccuccaauguacaa

SEQ ID NO: 1785854 - RNA, 21 nt, Homo sapiens
ugcuacagcaauuucuaauuu

SEQ ID NO: 1785855 - RNA, 10 nt, Homo sapiens
aaagugcaac

SEQ ID NO: 1785856 - RNA, 16 nt, Homo sapiens
acuuccuggucuuccu

SEQ ID NO: 1785857 - RNA, 17 nt, Homo sapiens
cucaccauuucauccau

SEQ ID NO: 1785858 - RNA, 13 nt, Homo sapiens
acaucugcuaaua

SEQ ID NO: 1785859 - RNA, 17 nt, Homo sapiens
uuuuuccagguuccuga

SEQ ID NO: 1785860 - RNA, 22 nt, Homo sapiens
aauccuuucugccccccagggc

SEQ ID NO: 1785861 - RNA, 18 nt, Homo sapiens
auuuucuguucagauuaa

SEQ ID NO: 1785862 - RNA, 21 nt, Homo sapiens
aaaucacaaggauuucucuaa

SEQ ID NO: 1785863 - RNA, 21 nt, Homo sapiens
aggugacuuuccuaugacacu

SEQ ID NO: 1785864 - RNA, 15 nt, Homo sapiens
aaauguauacuauag

SEQ ID NO: 1785865 - RNA, 22 nt, Homo sapiens
ggcucgcccauacccgugacag

SEQ ID NO: 1785866 - RNA, 18 nt, Homo sapiens
ucauacacaugugcacac

SEQ ID NO: 1785867 - RNA, 20 nt, Homo sapiens
cucacaugauuccagccauc

SEQ ID NO: 1785868 - RNA, 11 nt, Homo sapiens
cagcuuuucaa

SEQ ID NO: 1785869 - RNA, 19 nt, Homo sapiens
ucuuccuggauuauucaaa

SEQ ID NO: 1785870 - RNA, 21 nt, Homo sapiens
gccuggcucugucaccgccau

SEQ ID NO: 1785871 - RNA, 17 nt, Homo sapiens
cuuuuugguuugcagau

SEQ ID NO: 1785872 - RNA, 16 nt, Homo sapiens
aucucugcuuaguucu

SEQ ID NO: 1785873 - RNA, 19 nt, Homo sapiens
gaccuacugggcugcauuc

SEQ ID NO: 1785874 - RNA, 15 nt, Homo sapiens
uccuguuacaaaaga

SEQ ID NO: 1785875 - RNA, 22 nt, Homo sapiens
aagccucuggaaaacucaggau

SEQ ID NO: 1785876 - RNA, 15 nt, Homo sapiens
ugucacuguuucacu

SEQ ID NO: 1785877 - RNA, 17 nt, Homo sapiens
ucuugugaaaccacagg

SEQ ID NO: 1785878 - RNA, 18 nt, Homo sapiens
ugggaacuagacucccaa

SEQ ID NO: 1785879 - RNA, 17 nt, Homo sapiens
aauuucaacuuuugaca

SEQ ID NO: 1785880 - RNA, 22 nt, Homo sapiens
uaacuuguuugguaguuagcca

SEQ ID NO: 1785881 - RNA, 14 nt, Homo sapiens
ugguucaacaucua

SEQ ID NO: 1785882 - RNA, 14 nt, Homo sapiens
uacaagguauuuac

SEQ ID NO: 1785883 - RNA, 12 nt, Homo sapiens
aguacaaaaagg

SEQ ID NO: 1785884 - RNA, 20 nt, Homo sapiens
cuuggaaaaagaaagaaaca

SEQ ID NO: 1785885 - RNA, 12 nt, Homo sapiens
uuuacaacuggg

SEQ ID NO: 1785886 - RNA, 15 nt, Homo sapiens
auuuccccagccaca

SEQ ID NO: 1785887 - RNA, 17 nt, Homo sapiens
ugcuaacaaagacaaaa

SEQ ID NO: 1785888 - RNA, 21 nt, Homo sapiens
ucuccucugauuucaguucac

SEQ ID NO: 1785889 - RNA, 16 nt, Homo sapiens
gacaagauuauuccau

SEQ ID NO: 1785890 - RNA, 19 nt, Homo sapiens
cagauacgggggcugugac

SEQ ID NO: 1785891 - RNA, 18 nt, Homo sapiens
guaauagugaacauaugg

SEQ ID NO: 1785892 - RNA, 12 nt, Homo sapiens
auuugcugaaua

SEQ ID NO: 1785893 - RNA, 20 nt, Homo sapiens
uuaauuuaauauuuacucua

SEQ ID NO: 1785894 - RNA, 14 nt, Homo sapiens
uuuacaugaguuca

SEQ ID NO: 1785895 - RNA, 17 nt, Homo sapiens
agcuuugcuucucucuc

SEQ ID NO: 1785896 - RNA, 17 nt, Homo sapiens
uauccacuuaccuagau

SEQ ID NO: 1785897 - RNA, 21 nt, Homo sapiens
agcucagagaggcuagaugau

SEQ ID NO: 1785898 - RNA, 19 nt, Homo sapiens
ccacgcagagccccggagc

SEQ ID NO: 1785899 - RNA, 15 nt, Homo sapiens
ucucccuucuccuga

SEQ ID NO: 1785900 - RNA, 18 nt, Homo sapiens
ugugagugugugcaagua

SEQ ID NO: 1785901 - RNA, 13 nt, Homo sapiens
gcacacagguguu

SEQ ID NO: 1785902 - RNA, 20 nt, Homo sapiens
ggucagcuuuuguuguuuau

SEQ ID NO: 1785903 - RNA, 20 nt, Homo sapiens
gaacuguauucuaguggcug

SEQ ID NO: 1785904 - RNA, 15 nt, Homo sapiens
cacagcgugggaacu

SEQ ID NO: 1785905 - RNA, 21 nt, Homo sapiens
gacuuuuuaguacuaagcuua

SEQ ID NO: 1785906 - RNA, 13 nt, Homo sapiens
cauguacuugaag

SEQ ID NO: 1785907 - RNA, 16 nt, Homo sapiens
cugugucucaggugug

SEQ ID NO: 1785908 - RNA, 16 nt, Homo sapiens
ugcuuccacucagggc

SEQ ID NO: 1785909 - RNA, 19 nt, Homo sapiens
uacccacuuaggcuuugua

SEQ ID NO: 1785910 - RNA, 22 nt, Homo sapiens
uaaaggacaggccacaccacag

SEQ ID NO: 1785911 - RNA, 18 nt, Homo sapiens
cuuagaaaaggugauaaa

SEQ ID NO: 1785912 - RNA, 19 nt, Homo sapiens
ugcuuaccuuuuccuauuc

SEQ ID NO: 1785913 - RNA, 15 nt, Homo sapiens
ggcacugucaugccc

SEQ ID NO: 1785914 - RNA, 13 nt, Homo sapiens
uaaaauguuuuca

SEQ ID NO: 1785915 - RNA, 22 nt, Homo sapiens
aaugcccugucccuagcucaca

SEQ ID NO: 1785916 - RNA, 13 nt, Homo sapiens
aauaauguauaca

SEQ ID NO: 1785917 - RNA, 20 nt, Homo sapiens
guggcugggugcccucucag

SEQ ID NO: 1785918 - RNA, 12 nt, Homo sapiens
gaacagcauuua

SEQ ID NO: 1785919 - RNA, 16 nt, Homo sapiens
accuucaaaagcacug

SEQ ID NO: 1785920 - RNA, 12 nt, Homo sapiens
ucauacucuuaa

SEQ ID NO: 1785921 - RNA, 18 nt, Homo sapiens
gaugagcaagacauacuu

SEQ ID NO: 1785922 - RNA, 15 nt, Homo sapiens
auuuguauuccauug

SEQ ID NO: 1785923 - RNA, 14 nt, Homo sapiens
aaacaguuuuccaa

SEQ ID NO: 1785924 - RNA, 17 nt, Homo sapiens
aggcaaugauauggcau

SEQ ID NO: 1785925 - RNA, 18 nt, Homo sapiens
uuccucuuucacuucuua

SEQ ID NO: 1785926 - RNA, 14 nt, Homo sapiens
gaaagaugagaaau

SEQ ID NO: 1785927 - RNA, 16 nt, Homo sapiens
uguccacagaugccuc

SEQ ID NO: 1785928 - RNA, 13 nt, Homo sapiens
cuuggucacaugu

SEQ ID NO: 1785929 - RNA, 15 nt, Homo sapiens
auucuugucacaaua

SEQ ID NO: 1785930 - RNA, 16 nt, Homo sapiens
uuugugaugcaaauaa

SEQ ID NO: 1785931 - RNA, 22 nt, Homo sapiens
aucacccuuuccggcacacugc

SEQ ID NO: 1785932 - RNA, 17 nt, Homo sapiens
agcacuagaagcacagg

SEQ ID NO: 1785933 - RNA, 18 nt, Homo sapiens
aguuuggcuuaagcaaca

SEQ ID NO: 1785934 - RNA, 23 nt, Homo sapiens
auguauguugucuucuucaauac

SEQ ID NO: 1785935 - RNA, 15 nt, Homo sapiens
agaaccuacaaaagc

SEQ ID NO: 1785936 - RNA, 12 nt, Homo sapiens
ccaaauaccuca

SEQ ID NO: 1785937 - RNA, 20 nt, Homo sapiens
gcaguuuccucaucugucac

SEQ ID NO: 1785938 - RNA, 21 nt, Homo sapiens
uuaggaugcggcuuucucugc

SEQ ID NO: 1785939 - RNA, 16 nt, Homo sapiens
augcauugagcugccu

SEQ ID NO: 1785940 - RNA, 11 nt, Homo sapiens
guauccuucag

SEQ ID NO: 1785941 - RNA, 21 nt, Homo sapiens
aagaaaaaaugacaccaucuu

SEQ ID NO: 1785942 - RNA, 11 nt, Homo sapiens
caaugccauug

SEQ ID NO: 1785943 - RNA, 14 nt, Homo sapiens
gcaaacccaaagau

SEQ ID NO: 1785944 - RNA, 15 nt, Homo sapiens
agaaccacaagagau

SEQ ID NO: 1785945 - RNA, 23 nt, Homo sapiens
uaucaguucugcugacacuuugg

SEQ ID NO: 1785946 - RNA, 17 nt, Homo sapiens
aaaguuccccugugaca

SEQ ID NO: 1785947 - RNA, 19 nt, Homo sapiens
uuuucccgagcaaagucua

SEQ ID NO: 1785948 - RNA, 22 nt, Homo sapiens
acacugugauaaguucuuuuac

SEQ ID NO: 1785949 - RNA, 22 nt, Homo sapiens
ugcaagauuccuuuccacucca

SEQ ID NO: 1785950 - RNA, 13 nt, Homo sapiens
aaugaauacuuuc

SEQ ID NO: 1785951 - RNA, 22 nt, Homo sapiens
gauugggacgcacagugcaguu

SEQ ID NO: 1785952 - RNA, 19 nt, Homo sapiens
acagucagcucuucaucug

SEQ ID NO: 1785953 - RNA, 22 nt, Homo sapiens
caaugggcagaaagcuguggga

SEQ ID NO: 1785954 - RNA, 13 nt, Homo sapiens
aggggaaagagag

SEQ ID NO: 1785955 - RNA, 22 nt, Homo sapiens
gauuugaauguaaaacaggaaa

SEQ ID NO: 1785956 - RNA, 14 nt, Homo sapiens
uuugcuagcacaau

SEQ ID NO: 1785957 - RNA, 16 nt, Homo sapiens
uaccaaaugagcauua

SEQ ID NO: 1785958 - RNA, 23 nt, Homo sapiens
cugcaaucuucucagaaggcaaa

SEQ ID NO: 1785959 - RNA, 12 nt, Homo sapiens
caauucuagugu

SEQ ID NO: 1785960 - RNA, 22 nt, Homo sapiens
acauaauggaaaacauuuacau

SEQ ID NO: 1785961 - RNA, 21 nt, Homo sapiens
uucacccugaggugagcauca

SEQ ID NO: 1785962 - RNA, 18 nt, Homo sapiens
ucccaauggauaaaucag

SEQ ID NO: 1785963 - RNA, 21 nt, Homo sapiens
ucaaaucaggguccaguggga

SEQ ID NO: 1785964 - RNA, 14 nt, Homo sapiens
uuuacagaagugaa

SEQ ID NO: 1785965 - RNA, 22 nt, Homo sapiens
caaucuuuuagcacauguguaa

SEQ ID NO: 1785966 - RNA, 12 nt, Homo sapiens
uucucuaauaau

SEQ ID NO: 1785967 - RNA, 22 nt, Homo sapiens
agauacaucuuauaaacugacu

SEQ ID NO: 1785968 - RNA, 17 nt, Homo sapiens
agcugggagggaaccug

SEQ ID NO: 1785969 - RNA, 19 nt, Homo sapiens
gacaaugaagaugaugcua

SEQ ID NO: 1785970 - RNA, 19 nt, Homo sapiens
uucauauuuauugauuaaa

SEQ ID NO: 1785971 - RNA, 19 nt, Homo sapiens
gagccagccagcauggcca

SEQ ID NO: 1785972 - RNA, 18 nt, Homo sapiens
gaaaauuaugcaaaagca

SEQ ID NO: 1785973 - RNA, 12 nt, Homo sapiens
aaauuaugugga

SEQ ID NO: 1785974 - RNA, 17 nt, Homo sapiens
cucacugaaaauuacag

SEQ ID NO: 1785975 - RNA, 14 nt, Homo sapiens
cauauauuuagccc

SEQ ID NO: 1785976 - RNA, 14 nt, Homo sapiens
guggcaucaggaaa

SEQ ID NO: 1785977 - RNA, 23 nt, Homo sapiens
uacuggaaaccuguuaugccaaa

SEQ ID NO: 1785978 - RNA, 16 nt, Homo sapiens
ugcaccccugagccag

SEQ ID NO: 1785979 - RNA, 11 nt, Homo sapiens
caaaaccaaau

SEQ ID NO: 1785980 - RNA, 23 nt, Homo sapiens
agcacccaguguuggucuguguc

SEQ ID NO: 1785981 - RNA, 20 nt, Homo sapiens
cucccaaagugcagggauua

SEQ ID NO: 1785982 - RNA, 14 nt, Homo sapiens
agcagcacccagug

SEQ ID NO: 1785983 - RNA, 13 nt, Homo sapiens
cacugucaugccc

SEQ ID NO: 1785984 - RNA, 19 nt, Homo sapiens
ucagccucccuuugccagc

SEQ ID NO: 1785985 - RNA, 18 nt, Homo sapiens
uaaaacugccugacaauu

SEQ ID NO: 1785986 - RNA, 21 nt, Homo sapiens
aggccuucagaaaagacacuu

SEQ ID NO: 1785987 - RNA, 23 nt, Homo sapiens
ccauagaggucaagaacaugcaa

SEQ ID NO: 1785988 - RNA, 18 nt, Homo sapiens
cucucugaaauagccgaa

SEQ ID NO: 1785989 - RNA, 18 nt, Homo sapiens
ucaaagcacuuggacucu

SEQ ID NO: 1785990 - RNA, 13 nt, Homo sapiens
ugccugagcugca

SEQ ID NO: 1785991 - RNA, 15 nt, Homo sapiens
caagaauaaaggcag

SEQ ID NO: 1785992 - RNA, 18 nt, Homo sapiens
ggagcagggacagaucau

SEQ ID NO: 1785993 - RNA, 16 nt, Homo sapiens
ccuccuccaucaccug

SEQ ID NO: 1785994 - RNA, 22 nt, Homo sapiens
agaggugagaacuaaugccuag

SEQ ID NO: 1785995 - RNA, 10 nt, Homo sapiens
acaucacuuu

SEQ ID NO: 1785996 - RNA, 15 nt, Homo sapiens
uuuccuuuccauugu

SEQ ID NO: 1785997 - RNA, 14 nt, Homo sapiens
ugcucuguuaccca

SEQ ID NO: 1785998 - RNA, 22 nt, Homo sapiens
uggcaucucccacacaagaccc

SEQ ID NO: 1785999 - RNA, 18 nt, Homo sapiens
ccuucagccaagaccauc

SEQ ID NO: 1786000 - RNA, 15 nt, Homo sapiens
aaacuccgagugaac

SEQ ID NO: 1786001 - RNA, 13 nt, Homo sapiens
uuucuccaugagu

SEQ ID NO: 1786002 - RNA, 13 nt, Homo sapiens
uugaagucugaua

SEQ ID NO: 1786003 - RNA, 14 nt, Homo sapiens
agauuauguucaau

SEQ ID NO: 1786004 - RNA, 11 nt, Homo sapiens
ccaggacccag

SEQ ID NO: 1786005 - RNA, 18 nt, Homo sapiens
auuguucuuguaagcuuu

SEQ ID NO: 1786006 - RNA, 21 nt, Homo sapiens
ugaaaaaguuuggaagcacug

SEQ ID NO: 1786007 - RNA, 21 nt, Homo sapiens
acagguauuuuuuuaaaucaa

SEQ ID NO: 1786008 - RNA, 20 nt, Homo sapiens
aagaugcauuaucuaugaua

SEQ ID NO: 1786009 - RNA, 13 nt, Homo sapiens
gagaccugagucu

SEQ ID NO: 1786010 - RNA, 15 nt, Homo sapiens
cucuccaucucccaa

SEQ ID NO: 1786011 - RNA, 14 nt, Homo sapiens
gcugccaaaugcgu

SEQ ID NO: 1786012 - RNA, 16 nt, Homo sapiens
uuccuaucaaaguguc

SEQ ID NO: 1786013 - RNA, 13 nt, Homo sapiens
aaucguuccugac

SEQ ID NO: 1786014 - RNA, 19 nt, Homo sapiens
acuguaggcacacuuugca

SEQ ID NO: 1786015 - RNA, 15 nt, Homo sapiens
uguaaucuaccagug

SEQ ID NO: 1786016 - RNA, 17 nt, Homo sapiens
cacugccauggggccau

SEQ ID NO: 1786017 - RNA, 13 nt, Homo sapiens
auccugcaguggg

SEQ ID NO: 1786018 - RNA, 18 nt, Homo sapiens
auuuccauagucaaugau

SEQ ID NO: 1786019 - RNA, 14 nt, Homo sapiens
gaaaucgcuuauau

SEQ ID NO: 1786020 - RNA, 19 nt, Homo sapiens
ugaaauauugugacucugg

SEQ ID NO: 1786021 - RNA, 15 nt, Homo sapiens
ggcagaucacuggag

SEQ ID NO: 1786022 - RNA, 18 nt, Homo sapiens
aaccacagaacacugggu

SEQ ID NO: 1786023 - RNA, 19 nt, Homo sapiens
ccuaaguuuuauacuugau

SEQ ID NO: 1786024 - RNA, 15 nt, Homo sapiens
ucgcagccuagauau

SEQ ID NO: 1786025 - RNA, 23 nt, Homo sapiens
aaugccuaucugaccaaacugga

SEQ ID NO: 1786026 - RNA, 16 nt, Homo sapiens
uagagcuuagauuucc

SEQ ID NO: 1786027 - RNA, 16 nt, Homo sapiens
gccaggcuggagugca

SEQ ID NO: 1786028 - RNA, 13 nt, Homo sapiens
ucacagcuaccaa

SEQ ID NO: 1786029 - RNA, 16 nt, Homo sapiens
ggauccagcucaaggg

SEQ ID NO: 1786030 - RNA, 18 nt, Homo sapiens
aucaaaauuucagcauua

SEQ ID NO: 1786031 - RNA, 20 nt, Homo sapiens
uuaauaaauauuacagugaa

SEQ ID NO: 1786032 - RNA, 14 nt, Homo sapiens
uggacugucugauc

SEQ ID NO: 1786033 - RNA, 12 nt, Homo sapiens
ccagccauuccu

SEQ ID NO: 1786034 - RNA, 15 nt, Homo sapiens
auauccuuucacucu

SEQ ID NO: 1786035 - RNA, 16 nt, Homo sapiens
gaugcuaaaaauguca

SEQ ID NO: 1786036 - RNA, 22 nt, Homo sapiens
uguggcaguguuuaaaugcucu

SEQ ID NO: 1786037 - RNA, 18 nt, Homo sapiens
ggugucaagugccugcac

SEQ ID NO: 1786038 - RNA, 15 nt, Homo sapiens
auagaaacugaggag

SEQ ID NO: 1786039 - RNA, 16 nt, Homo sapiens
ugcacaggaugcuggc

SEQ ID NO: 1786040 - RNA, 19 nt, Homo sapiens
aguaacuuggcuuucauua

SEQ ID NO: 1786041 - RNA, 18 nt, Homo sapiens
uccuccaguucugaugag

SEQ ID NO: 1786042 - RNA, 23 nt, Homo sapiens
gucuccuuugcacugagggccac

SEQ ID NO: 1786043 - RNA, 21 nt, Homo sapiens
ccccuggcugguaagggccaa

SEQ ID NO: 1786044 - RNA, 23 nt, Homo sapiens
uaggacuggguuccccacaguga

SEQ ID NO: 1786045 - RNA, 18 nt, Homo sapiens
acuugcacgcccaugugu

SEQ ID NO: 1786046 - RNA, 19 nt, Homo sapiens
aaugugaaacugagaccaa

SEQ ID NO: 1786047 - RNA, 19 nt, Homo sapiens
cauggacaaggaugaucua

SEQ ID NO: 1786048 - RNA, 12 nt, Homo sapiens
agcucagguguc

SEQ ID NO: 1786049 - RNA, 15 nt, Homo sapiens
cauuuuagacauuca

SEQ ID NO: 1786050 - RNA, 14 nt, Homo sapiens
gauauugucauauc

SEQ ID NO: 1786051 - RNA, 18 nt, Homo sapiens
caaaggacagaguaugaa

SEQ ID NO: 1786052 - RNA, 18 nt, Homo sapiens
caauaaaguuauucagaa

SEQ ID NO: 1786053 - RNA, 23 nt, Homo sapiens
uauaaauaucaugcacaacuaua

SEQ ID NO: 1786054 - RNA, 15 nt, Homo sapiens
uuuccagucauuuca

SEQ ID NO: 1786055 - RNA, 20 nt, Homo sapiens
gcggcaaaauuaauggacac

SEQ ID NO: 1786056 - RNA, 15 nt, Homo sapiens
caggauguucaggga

SEQ ID NO: 1786057 - RNA, 14 nt, Homo sapiens
uaggauaagccacu

SEQ ID NO: 1786058 - RNA, 15 nt, Homo sapiens
uuuucagucaucuca

SEQ ID NO: 1786059 - RNA, 13 nt, Homo sapiens
gagguaagaauag

SEQ ID NO: 1786060 - RNA, 18 nt, Homo sapiens
ccaugcuuccuauacagu

SEQ ID NO: 1786061 - RNA, 13 nt, Homo sapiens
ugucagcaucuga

SEQ ID NO: 1786062 - RNA, 20 nt, Homo sapiens
gcagagguaaaagugugagc

SEQ ID NO: 1786063 - RNA, 21 nt, Homo sapiens
cugugacgcacagcacuccug

SEQ ID NO: 1786064 - RNA, 12 nt, Homo sapiens
guauuuuuggca

SEQ ID NO: 1786065 - RNA, 21 nt, Homo sapiens
uccagaguaggugggucuugg

SEQ ID NO: 1786066 - RNA, 12 nt, Homo sapiens
uggacuuguccc

SEQ ID NO: 1786067 - RNA, 19 nt, Homo sapiens
caaacagccccucuggaca

SEQ ID NO: 1786068 - RNA, 12 nt, Homo sapiens
auccaccucucc

SEQ ID NO: 1786069 - RNA, 21 nt, Homo sapiens
accuuggaauucgcuuucuaa

SEQ ID NO: 1786070 - RNA, 18 nt, Homo sapiens
acuccaugcugccagccu

SEQ ID NO: 1786071 - RNA, 20 nt, Homo sapiens
ggcaggagaaucucuugaac

SEQ ID NO: 1786072 - RNA, 19 nt, Homo sapiens
accaagcaggcaaggcaag

SEQ ID NO: 1786073 - RNA, 18 nt, Homo sapiens
ccucuagagccuucagcc

SEQ ID NO: 1786074 - RNA, 15 nt, Homo sapiens
gacuccucaaaagca

SEQ ID NO: 1786075 - RNA, 18 nt, Homo sapiens
ugagacccuggugccugg

SEQ ID NO: 1786076 - RNA, 18 nt, Homo sapiens
uuaccaauugaaguaaaa

SEQ ID NO: 1786077 - RNA, 20 nt, Homo sapiens
ucuggggggacccagugcag

SEQ ID NO: 1786078 - RNA, 16 nt, Homo sapiens
agacccaggucuucca

SEQ ID NO: 1786079 - RNA, 22 nt, Homo sapiens
accaccuggggagagccugcuu

SEQ ID NO: 1786080 - RNA, 19 nt, Homo sapiens
aaauuuucuuuuaagcauu

SEQ ID NO: 1786081 - RNA, 15 nt, Homo sapiens
gccagugagaucaau

SEQ ID NO: 1786082 - RNA, 13 nt, Homo sapiens
augcagggacaaa

SEQ ID NO: 1786083 - RNA, 22 nt, Homo sapiens
gggcuuccgcagcuucagggga

SEQ ID NO: 1786084 - RNA, 21 nt, Homo sapiens
uaaguuugaaggaaacaguua

SEQ ID NO: 1786085 - RNA, 16 nt, Homo sapiens
aacuagugaaauguuc

SEQ ID NO: 1786086 - RNA, 17 nt, Homo sapiens
uauuccuauagcauuua

SEQ ID NO: 1786087 - RNA, 21 nt, Homo sapiens
guacuuuuuggcauaacauaa

SEQ ID NO: 1786088 - RNA, 15 nt, Homo sapiens
auucccagaagucca

SEQ ID NO: 1786089 - RNA, 22 nt, Homo sapiens
aagcccaggguccacugaaggg

SEQ ID NO: 1786090 - RNA, 14 nt, Homo sapiens
auucuuuuguucua

SEQ ID NO: 1786091 - RNA, 22 nt, Homo sapiens
ucucuucguacucgguuauuaa

SEQ ID NO: 1786092 - RNA, 19 nt, Homo sapiens
gccccuggggcuuccaucc

SEQ ID NO: 1786093 - RNA, 21 nt, Homo sapiens
cuuuucucagacucaccaacu

SEQ ID NO: 1786094 - RNA, 15 nt, Homo sapiens
uugggcucgcacugc

SEQ ID NO: 1786095 - RNA, 18 nt, Homo sapiens
ggccuguguagcugugac

SEQ ID NO: 1786096 - RNA, 20 nt, Homo sapiens
gacgagaugacgguguuauu

SEQ ID NO: 1786097 - RNA, 13 nt, Homo sapiens
ccucagacauccc

SEQ ID NO: 1786098 - RNA, 15 nt, Homo sapiens
ucacucacucauucc

SEQ ID NO: 1786099 - RNA, 22 nt, Homo sapiens
auucuuucaauccacaguauug

SEQ ID NO: 1786100 - RNA, 14 nt, Homo sapiens
guacccaagugaag

SEQ ID NO: 1786101 - RNA, 19 nt, Homo sapiens
guuguauuuucuuacugaa

SEQ ID NO: 1786102 - RNA, 19 nt, Homo sapiens
uguuucgaguaaacuugaa

SEQ ID NO: 1786103 - RNA, 17 nt, Homo sapiens
cugccucccaugccugg

SEQ ID NO: 1786104 - RNA, 17 nt, Homo sapiens
ugggcaggaacugcagu

SEQ ID NO: 1786105 - RNA, 18 nt, Homo sapiens
agccaggaccacagagcu

SEQ ID NO: 1786106 - RNA, 15 nt, Homo sapiens
cugccucugccacag

SEQ ID NO: 1786107 - RNA, 20 nt, Homo sapiens
uuugaggaauuaucauggga

SEQ ID NO: 1786108 - RNA, 11 nt, Homo sapiens
uuucacaucuc

SEQ ID NO: 1786109 - RNA, 14 nt, Homo sapiens
ccacucuacagguc

SEQ ID NO: 1786110 - RNA, 19 nt, Homo sapiens
auaagcuuuauauaccucu

SEQ ID NO: 1786111 - RNA, 16 nt, Homo sapiens
gaugucuaccucagaa

SEQ ID NO: 1786112 - RNA, 17 nt, Homo sapiens
ccuuuuccuauccuuau

SEQ ID NO: 1786113 - RNA, 23 nt, Homo sapiens
aagucuaaaguuuacaguaaaua

SEQ ID NO: 1786114 - RNA, 19 nt, Homo sapiens
auauacugcugaucuugca

SEQ ID NO: 1786115 - RNA, 15 nt, Homo sapiens
aaacccagugcugcu

SEQ ID NO: 1786116 - RNA, 21 nt, Homo sapiens
aggggagccagaaaugggcag

SEQ ID NO: 1786117 - RNA, 20 nt, Homo sapiens
uugggggggaacaucuguaa

SEQ ID NO: 1786118 - RNA, 21 nt, Homo sapiens
ugauuggccacacacugaguu

SEQ ID NO: 1786119 - RNA, 21 nt, Homo sapiens
auggagauauuuacaugaauu

SEQ ID NO: 1786120 - RNA, 20 nt, Homo sapiens
uggaggucauacaugcauac

SEQ ID NO: 1786121 - RNA, 19 nt, Homo sapiens
aaaacaacccuugcugaaa

SEQ ID NO: 1786122 - RNA, 17 nt, Homo sapiens
ccucaauccuaucacag

SEQ ID NO: 1786123 - RNA, 19 nt, Homo sapiens
ccacgugggcaaacaggca

SEQ ID NO: 1786124 - RNA, 15 nt, Homo sapiens
uauucagaaaugacu

SEQ ID NO: 1786125 - RNA, 13 nt, Homo sapiens
uuucaaacuauug

SEQ ID NO: 1786126 - RNA, 12 nt, Homo sapiens
aaaccaacaaaa

SEQ ID NO: 1786127 - RNA, 14 nt, Homo sapiens
ugcacguauuuuaa

SEQ ID NO: 1786128 - RNA, 19 nt, Homo sapiens
aacagcugggaccacaggu

SEQ ID NO: 1786129 - RNA, 18 nt, Homo sapiens
ucuccucuuuuguaccca

SEQ ID NO: 1786130 - RNA, 20 nt, Homo sapiens
guuuccuugugauuagucaa

SEQ ID NO: 1786131 - RNA, 16 nt, Homo sapiens
agguucugagaccagu

SEQ ID NO: 1786132 - RNA, 19 nt, Homo sapiens
ugagaggccacagugcaau

SEQ ID NO: 1786133 - RNA, 12 nt, Homo sapiens
auguacauacau

SEQ ID NO: 1786134 - RNA, 14 nt, Homo sapiens
cacaucuugcucug

SEQ ID NO: 1786135 - RNA, 22 nt, Homo sapiens
ccuagcaggaacuucuagcuca

SEQ ID NO: 1786136 - RNA, 23 nt, Homo sapiens
aacuguugccaggagauggaaua

SEQ ID NO: 1786137 - RNA, 19 nt, Homo sapiens
cucagcuucauuuccguga

SEQ ID NO: 1786138 - RNA, 23 nt, Homo sapiens
aagcccuggccaaauuuugaucc

SEQ ID NO: 1786139 - RNA, 11 nt, Homo sapiens
auagugcuugc

SEQ ID NO: 1786140 - RNA, 16 nt, Homo sapiens
gaggcugcaugcucug

SEQ ID NO: 1786141 - RNA, 19 nt, Homo sapiens
caacuucgccagccuccaa

SEQ ID NO: 1786142 - RNA, 17 nt, Homo sapiens
gacccucguggccuucc

SEQ ID NO: 1786143 - RNA, 18 nt, Homo sapiens
ggucuccauuuuucccag

SEQ ID NO: 1786144 - RNA, 19 nt, Homo sapiens
acuccaucauggcugcuug

SEQ ID NO: 1786145 - RNA, 15 nt, Homo sapiens
ggcuuaucuagccaa

SEQ ID NO: 1786146 - RNA, 13 nt, Homo sapiens
agcccugcagcua

SEQ ID NO: 1786147 - RNA, 20 nt, Homo sapiens
cucuggacuggaaagcacaa

SEQ ID NO: 1786148 - RNA, 20 nt, Homo sapiens
cccagacuggaaugcaguga

SEQ ID NO: 1786149 - RNA, 20 nt, Homo sapiens
gaaacacuauuugugacuuu

SEQ ID NO: 1786150 - RNA, 17 nt, Homo sapiens
gaucucaguauuuugaa

SEQ ID NO: 1786151 - RNA, 19 nt, Homo sapiens
aucuguguucgauggcuca

SEQ ID NO: 1786152 - RNA, 16 nt, Homo sapiens
cugaguugcuuuucag

SEQ ID NO: 1786153 - RNA, 19 nt, Homo sapiens
gacgggguuucaccauguu

SEQ ID NO: 1786154 - RNA, 12 nt, Homo sapiens
gggguacacaga

SEQ ID NO: 1786155 - RNA, 19 nt, Homo sapiens
uauaagaaguccuaucuca

SEQ ID NO: 1786156 - RNA, 19 nt, Homo sapiens
gcccugggcucaucagccu

SEQ ID NO: 1786157 - RNA, 14 nt, Homo sapiens
aaugugaguuauca

SEQ ID NO: 1786158 - RNA, 19 nt, Homo sapiens
gcaucuccccucagauucc

SEQ ID NO: 1786159 - RNA, 15 nt, Homo sapiens
gagaaggccaggaaa

SEQ ID NO: 1786160 - RNA, 22 nt, Homo sapiens
gggugcuaauccaggacagcau

SEQ ID NO: 1786161 - RNA, 19 nt, Homo sapiens
acacuuuucagcaaaaaua

SEQ ID NO: 1786162 - RNA, 15 nt, Homo sapiens
accuuccucagcuca

SEQ ID NO: 1786163 - RNA, 21 nt, Homo sapiens
ugaacacaauacauguuuuca

SEQ ID NO: 1786164 - RNA, 17 nt, Homo sapiens
cuaaaccacuucucugc

SEQ ID NO: 1786165 - RNA, 22 nt, Homo sapiens
caccaggacuuggggucaggaa

SEQ ID NO: 1786166 - RNA, 24 nt, Homo sapiens
accugcccugacaugcacaccucc

SEQ ID NO: 1786167 - RNA, 14 nt, Homo sapiens
cuaacucuauuaau

SEQ ID NO: 1786168 - RNA, 24 nt, Homo sapiens
aucuugccugucuggcucaggguc

SEQ ID NO: 1786169 - RNA, 14 nt, Homo sapiens
aauacucaacauua

SEQ ID NO: 1786170 - RNA, 22 nt, Homo sapiens
caguacacuuccugugccaugu

SEQ ID NO: 1786171 - RNA, 17 nt, Homo sapiens
aagaaacaccaguguua

SEQ ID NO: 1786172 - RNA, 22 nt, Homo sapiens
caggucugcagcuccagguaca

SEQ ID NO: 1786173 - RNA, 16 nt, Homo sapiens
cggguccaccaugagg

SEQ ID NO: 1786174 - RNA, 16 nt, Homo sapiens
uacugaaaaucuggug

SEQ ID NO: 1786175 - RNA, 21 nt, Homo sapiens
ugugacaaccuuuguguaaua

SEQ ID NO: 1786176 - RNA, 16 nt, Homo sapiens
agaaucucauuacugc

SEQ ID NO: 1786177 - RNA, 14 nt, Homo sapiens
gcuccaagagaauu

SEQ ID NO: 1786178 - RNA, 18 nt, Homo sapiens
auaacuaucucacuucca

SEQ ID NO: 1786179 - RNA, 20 nt, Homo sapiens
uaugaagaaucugcucugaa

SEQ ID NO: 1786180 - RNA, 15 nt, Homo sapiens
accuaaaacccaaag

SEQ ID NO: 1786181 - RNA, 19 nt, Homo sapiens
caccugcauucuucccuua

SEQ ID NO: 1786182 - RNA, 15 nt, Homo sapiens
aggcuacauauacau

SEQ ID NO: 1786183 - RNA, 17 nt, Homo sapiens
cuuggccucccaaucuu

SEQ ID NO: 1786184 - RNA, 11 nt, Homo sapiens
aaaaugcagac

SEQ ID NO: 1786185 - RNA, 13 nt, Homo sapiens
ccauugugaagca

SEQ ID NO: 1786186 - RNA, 23 nt, Homo sapiens
ucagggugggguggucucugaua

SEQ ID NO: 1786187 - RNA, 16 nt, Homo sapiens
cauggagggugcccag

SEQ ID NO: 1786188 - RNA, 15 nt, Homo sapiens
cccaggcuguucucc

SEQ ID NO: 1786189 - RNA, 18 nt, Homo sapiens
aucugaguugagaccuuu

SEQ ID NO: 1786190 - RNA, 12 nt, Homo sapiens
acggugaauauu

SEQ ID NO: 1786191 - RNA, 12 nt, Homo sapiens
aaaugccuuagu

SEQ ID NO: 1786192 - RNA, 18 nt, Homo sapiens
auacaaucagcccagugc

SEQ ID NO: 1786193 - RNA, 17 nt, Homo sapiens
auaauuuuacaagggag

SEQ ID NO: 1786194 - RNA, 14 nt, Homo sapiens
ugggggugaagucu

SEQ ID NO: 1786195 - RNA, 12 nt, Homo sapiens
cugcuugccauc

SEQ ID NO: 1786196 - RNA, 16 nt, Homo sapiens
cugaagcugaaaugca

SEQ ID NO: 1786197 - RNA, 22 nt, Homo sapiens
cagccucugggucugagucaug

SEQ ID NO: 1786198 - RNA, 23 nt, Homo sapiens
agacucagugcacauuuugaaau

SEQ ID NO: 1786199 - RNA, 15 nt, Homo sapiens
uguuuauacagcuca

SEQ ID NO: 1786200 - RNA, 14 nt, Homo sapiens
uccuuacuggugcu

SEQ ID NO: 1786201 - RNA, 15 nt, Homo sapiens
cuguuaacuuuugua

SEQ ID NO: 1786202 - RNA, 20 nt, Homo sapiens
caaauaaacggacucagugg

SEQ ID NO: 1786203 - RNA, 15 nt, Homo sapiens
uagaguuccauauau

SEQ ID NO: 1786204 - RNA, 16 nt, Homo sapiens
caguuaacuauugcau

SEQ ID NO: 1786205 - RNA, 18 nt, Homo sapiens
aucccacccccacuucau

SEQ ID NO: 1786206 - RNA, 22 nt, Homo sapiens
aguaaauaaaaggacugugauu

SEQ ID NO: 1786207 - RNA, 16 nt, Homo sapiens
gacaugugaagcuauu

SEQ ID NO: 1786208 - RNA, 17 nt, Homo sapiens
acuggucccaaguagua

SEQ ID NO: 1786209 - RNA, 23 nt, Homo sapiens
ccuguauucucaaacacaguuac

SEQ ID NO: 1786210 - RNA, 16 nt, Homo sapiens
uuaacuccugcuagaa

SEQ ID NO: 1786211 - RNA, 15 nt, Homo sapiens
uccccuggacauauu

SEQ ID NO: 1786212 - RNA, 18 nt, Homo sapiens
uagcagacauuguuacaa

SEQ ID NO: 1786213 - RNA, 19 nt, Homo sapiens
caaacgggcugcccugcca

SEQ ID NO: 1786214 - RNA, 12 nt, Homo sapiens
gcggaccuuccc

SEQ ID NO: 1786215 - RNA, 13 nt, Homo sapiens
gugugucauguca

SEQ ID NO: 1786216 - RNA, 14 nt, Homo sapiens
agucacaucucuuc

SEQ ID NO: 1786217 - RNA, 19 nt, Homo sapiens
cucgauucgcugaauugcc

SEQ ID NO: 1786218 - RNA, 16 nt, Homo sapiens
cacccuugcccggcug

SEQ ID NO: 1786219 - RNA, 16 nt, Homo sapiens
uaagaaagcaagccaa

SEQ ID NO: 1786220 - RNA, 19 nt, Homo sapiens
cugcaccuacccacaugca

SEQ ID NO: 1786221 - RNA, 17 nt, Homo sapiens
ggccagccccagcaccu

SEQ ID NO: 1786222 - RNA, 21 nt, Homo sapiens
ugucagggucuuucugaugac

SEQ ID NO: 1786223 - RNA, 15 nt, Homo sapiens
uaagcaaauguuaaa

SEQ ID NO: 1786224 - RNA, 19 nt, Homo sapiens
ugcaaauggcuacuaagca

SEQ ID NO: 1786225 - RNA, 13 nt, Homo sapiens
auuugaggggugg

SEQ ID NO: 1786226 - RNA, 16 nt, Homo sapiens
gugauucuguuugccu

SEQ ID NO: 1786227 - RNA, 19 nt, Homo sapiens
aaaccuguucaucuugcca

SEQ ID NO: 1786228 - RNA, 23 nt, Homo sapiens
caccauggagaugaaaugccuuu

SEQ ID NO: 1786229 - RNA, 13 nt, Homo sapiens
uccgggugcucaa

SEQ ID NO: 1786230 - RNA, 14 nt, Homo sapiens
auaauaaagcaauc

SEQ ID NO: 1786231 - RNA, 16 nt, Homo sapiens
uuuauaaaauugcuau

SEQ ID NO: 1786232 - RNA, 13 nt, Homo sapiens
uugaacuguuguc

SEQ ID NO: 1786233 - RNA, 17 nt, Homo sapiens
ccgggcaugguggugca

SEQ ID NO: 1786234 - RNA, 20 nt, Homo sapiens
ggaccagccucuccacucau

SEQ ID NO: 1786235 - RNA, 22 nt, Homo sapiens
aaaaacuuccuucaaucuucau

SEQ ID NO: 1786236 - RNA, 17 nt, Homo sapiens
ccgggugugguggcaca

SEQ ID NO: 1786237 - RNA, 18 nt, Homo sapiens
gccaaguaagaaagugaa

SEQ ID NO: 1786238 - RNA, 18 nt, Homo sapiens
gccauugggcuacuguag

SEQ ID NO: 1786239 - RNA, 18 nt, Homo sapiens
aagcacuacaccuugccu

SEQ ID NO: 1786240 - RNA, 13 nt, Homo sapiens
cagaaaacauguu

SEQ ID NO: 1786241 - RNA, 22 nt, Homo sapiens
auucuuguuggagacaugggau

SEQ ID NO: 1786242 - RNA, 20 nt, Homo sapiens
guuuaacauugauuggauaa

SEQ ID NO: 1786243 - RNA, 21 nt, Homo sapiens
acacagagguuuuaaacaguc

SEQ ID NO: 1786244 - RNA, 16 nt, Homo sapiens
aguuuagggucaagga

SEQ ID NO: 1786245 - RNA, 16 nt, Homo sapiens
agcccuacucugugua

SEQ ID NO: 1786246 - RNA, 15 nt, Homo sapiens
caaugaccuggagca

SEQ ID NO: 1786247 - RNA, 20 nt, Homo sapiens
aguuggcccuucugcccuua

SEQ ID NO: 1786248 - RNA, 10 nt, Homo sapiens
uggcucucaa

SEQ ID NO: 1786249 - RNA, 21 nt, Homo sapiens
ggcaccuccuacgucaaacau

SEQ ID NO: 1786250 - RNA, 19 nt, Homo sapiens
acaacaucaccagugccac

SEQ ID NO: 1786251 - RNA, 17 nt, Homo sapiens
gccccuccacccaucca

SEQ ID NO: 1786252 - RNA, 21 nt, Homo sapiens
augaaauacuccagcaccugu

SEQ ID NO: 1786253 - RNA, 15 nt, Homo sapiens
cucccuggccucacg

SEQ ID NO: 1786254 - RNA, 16 nt, Homo sapiens
cugcuucaugugaaca

SEQ ID NO: 1786255 - RNA, 18 nt, Homo sapiens
gacaccacaaggcagccu

SEQ ID NO: 1786256 - RNA, 18 nt, Homo sapiens
cauuuaauccuugugaga

SEQ ID NO: 1786257 - RNA, 16 nt, Homo sapiens
ugcuguccaggcagcu

SEQ ID NO: 1786258 - RNA, 19 nt, Homo sapiens
caaacuguaaaagauuaaa

SEQ ID NO: 1786259 - RNA, 16 nt, Homo sapiens
cagaguguccugcuac

SEQ ID NO: 1786260 - RNA, 21 nt, Homo sapiens
cccucuagaggcugccugggc

SEQ ID NO: 1786261 - RNA, 20 nt, Homo sapiens
cucaguaagacagugcagug

SEQ ID NO: 1786262 - RNA, 15 nt, Homo sapiens
gaauaaguucauaca

SEQ ID NO: 1786263 - RNA, 21 nt, Homo sapiens
ucagccaggcugcuaaccugg

SEQ ID NO: 1786264 - RNA, 20 nt, Homo sapiens
gcuuuauucugcaagcaaua

SEQ ID NO: 1786265 - RNA, 16 nt, Homo sapiens
aaugggcaagcaagga

SEQ ID NO: 1786266 - RNA, 17 nt, Homo sapiens
agaucagggacuugaau

SEQ ID NO: 1786267 - RNA, 15 nt, Homo sapiens
gacuuugaaugugag

SEQ ID NO: 1786268 - RNA, 17 nt, Homo sapiens
ugauccauccaucucuc

SEQ ID NO: 1786269 - RNA, 21 nt, Homo sapiens
gcuggagugaaguggugugau

SEQ ID NO: 1786270 - RNA, 17 nt, Homo sapiens
caaaauaaaaucucggu

SEQ ID NO: 1786271 - RNA, 14 nt, Homo sapiens
uaaaauuaagcaca

SEQ ID NO: 1786272 - RNA, 19 nt, Homo sapiens
cagaauggaaugcucuggu

SEQ ID NO: 1786273 - RNA, 21 nt, Homo sapiens
cagcuucuucuuucauucuaa

SEQ ID NO: 1786274 - RNA, 18 nt, Homo sapiens
aagcaaaacucacuaagu

SEQ ID NO: 1786275 - RNA, 15 nt, Homo sapiens
auuccuuucagcaau

SEQ ID NO: 1786276 - RNA, 14 nt, Homo sapiens
uaauccauucuuug

SEQ ID NO: 1786277 - RNA, 15 nt, Homo sapiens
aaaccaaccaugaau

SEQ ID NO: 1786278 - RNA, 13 nt, Homo sapiens
agcaccaccuaca

SEQ ID NO: 1786279 - RNA, 18 nt, Homo sapiens
agcugggccccaccuacu

SEQ ID NO: 1786280 - RNA, 15 nt, Homo sapiens
aaaaggaggcucuuc

SEQ ID NO: 1786281 - RNA, 14 nt, Homo sapiens
ucccucagcucucu

SEQ ID NO: 1786282 - RNA, 17 nt, Homo sapiens
cuucuaaugacccagau

SEQ ID NO: 1786283 - RNA, 13 nt, Homo sapiens
uugaggugcaagg

SEQ ID NO: 1786284 - RNA, 22 nt, Homo sapiens
cccuuaucccugcucuggauuu

SEQ ID NO: 1786285 - RNA, 18 nt, Homo sapiens
acuuaacuacuuaucucu

SEQ ID NO: 1786286 - RNA, 18 nt, Homo sapiens
aaaauacucuaauucuaa

SEQ ID NO: 1786287 - RNA, 19 nt, Homo sapiens
cuaguggcuugaaaaucug

SEQ ID NO: 1786288 - RNA, 17 nt, Homo sapiens
gguauccugggggaccc

SEQ ID NO: 1786289 - RNA, 17 nt, Homo sapiens
gccugugcccacucccu

SEQ ID NO: 1786290 - RNA, 22 nt, Homo sapiens
caucuguauuuuuaaauucugc

SEQ ID NO: 1786291 - RNA, 14 nt, Homo sapiens
gccccuuaaauuuc

SEQ ID NO: 1786292 - RNA, 23 nt, Homo sapiens
ccuugcugcggcugcaucuucca

SEQ ID NO: 1786293 - RNA, 20 nt, Homo sapiens
cauuuauuuaagacacuguu

SEQ ID NO: 1786294 - RNA, 11 nt, Homo sapiens
agauucaccug

SEQ ID NO: 1786295 - RNA, 16 nt, Homo sapiens
aauaucuuugugauaa

SEQ ID NO: 1786296 - RNA, 24 nt, Homo sapiens
uauuuagggcaaucgugucgcuaa

SEQ ID NO: 1786297 - RNA, 17 nt, Homo sapiens
cagacuguccacucggg

SEQ ID NO: 1786298 - RNA, 18 nt, Homo sapiens
uccagcauccacucuccc

SEQ ID NO: 1786299 - RNA, 16 nt, Homo sapiens
aggcaaugacugugag

SEQ ID NO: 1786300 - RNA, 21 nt, Homo sapiens
cccuuaaaggggagaccucag

SEQ ID NO: 1786301 - RNA, 17 nt, Homo sapiens
cgugccgccugcuccuc

SEQ ID NO: 1786302 - RNA, 22 nt, Homo sapiens
ggaagcuaccaggggaggcagu

SEQ ID NO: 1786303 - RNA, 18 nt, Homo sapiens
aaagacagaaugucacca

SEQ ID NO: 1786304 - RNA, 23 nt, Homo sapiens
auaaacauuaauuuugugcauuc

SEQ ID NO: 1786305 - RNA, 19 nt, Homo sapiens
ccuuuaugcagagccacag

SEQ ID NO: 1786306 - RNA, 14 nt, Homo sapiens
aagaaggaaugggg

SEQ ID NO: 1786307 - RNA, 12 nt, Homo sapiens
aaauuccuguag

SEQ ID NO: 1786308 - RNA, 22 nt, Homo sapiens
guggguauugagugugauuuga

SEQ ID NO: 1786309 - RNA, 18 nt, Homo sapiens
caacagugagucugucag

SEQ ID NO: 1786310 - RNA, 16 nt, Homo sapiens
ugcugcagcgcuuguu

SEQ ID NO: 1786311 - RNA, 14 nt, Homo sapiens
aggcaguaaccaug

SEQ ID NO: 1786312 - RNA, 17 nt, Homo sapiens
cuuaaagggucuuauga

SEQ ID NO: 1786313 - RNA, 14 nt, Homo sapiens
gucuggaauugugg

SEQ ID NO: 1786314 - RNA, 21 nt, Homo sapiens
gaaagauuagauaaagagaaa

SEQ ID NO: 1786315 - RNA, 23 nt, Homo sapiens
cugccuggguuuucuaacuguaa

SEQ ID NO: 1786316 - RNA, 21 nt, Homo sapiens
gaaauauaacaagugggugaa

SEQ ID NO: 1786317 - RNA, 15 nt, Homo sapiens
acugaagacugcaca

SEQ ID NO: 1786318 - RNA, 18 nt, Homo sapiens
acaaaagcagcacaagga

SEQ ID NO: 1786319 - RNA, 21 nt, Homo sapiens
auuagcuagaaugcacaccaa

SEQ ID NO: 1786320 - RNA, 23 nt, Homo sapiens
aucagaggugaaagcuauaucaa

SEQ ID NO: 1786321 - RNA, 21 nt, Homo sapiens
aacucauaauagacuucccac

SEQ ID NO: 1786322 - RNA, 14 nt, Homo sapiens
aaauuuagccaaua

SEQ ID NO: 1786323 - RNA, 13 nt, Homo sapiens
ccagaccuuuuau

SEQ ID NO: 1786324 - RNA, 13 nt, Homo sapiens
cuccuucaaugca

SEQ ID NO: 1786325 - RNA, 13 nt, Homo sapiens
aaccaucacagcu

SEQ ID NO: 1786326 - RNA, 21 nt, Homo sapiens
ugcuauaaaugccagagccaa

SEQ ID NO: 1786327 - RNA, 16 nt, Homo sapiens
cccaguuagcucucaa

SEQ ID NO: 1786328 - RNA, 13 nt, Homo sapiens
gcccuggguccug

SEQ ID NO: 1786329 - RNA, 20 nt, Homo sapiens
ccagggugcaggcgcgcacc

SEQ ID NO: 1786330 - RNA, 19 nt, Homo sapiens
agcccaacaucuccagcug

SEQ ID NO: 1786331 - RNA, 15 nt, Homo sapiens
gccuucuucacccag

SEQ ID NO: 1786332 - RNA, 16 nt, Homo sapiens
agaaauagugcacucc

SEQ ID NO: 1786333 - RNA, 19 nt, Homo sapiens
uuacucuugagacuacuuc

SEQ ID NO: 1786334 - RNA, 21 nt, Homo sapiens
cucagagggauccucccacac

SEQ ID NO: 1786335 - RNA, 12 nt, Homo sapiens
uauuucugauga

SEQ ID NO: 1786336 - RNA, 18 nt, Homo sapiens
auacaacagaaaccagaa

SEQ ID NO: 1786337 - RNA, 13 nt, Homo sapiens
ccucuucuacuca

SEQ ID NO: 1786338 - RNA, 22 nt, Homo sapiens
ucugcugucuuuucuuugccau

SEQ ID NO: 1786339 - RNA, 22 nt, Homo sapiens
cccacuuucgccuccuccagcu

SEQ ID NO: 1786340 - RNA, 16 nt, Homo sapiens
aagucaucaucuccaa

SEQ ID NO: 1786341 - RNA, 20 nt, Homo sapiens
uauuacuguugcauuuacuu

SEQ ID NO: 1786342 - RNA, 13 nt, Homo sapiens
cacugugcuccua

SEQ ID NO: 1786343 - RNA, 13 nt, Homo sapiens
uccugugccacua

SEQ ID NO: 1786344 - RNA, 19 nt, Homo sapiens
uuauagcuuccagauuaca

SEQ ID NO: 1786345 - RNA, 14 nt, Homo sapiens
gggggcugugccaa

SEQ ID NO: 1786346 - RNA, 18 nt, Homo sapiens
ccagcuuuuccugggaca

SEQ ID NO: 1786347 - RNA, 21 nt, Homo sapiens
caaagacuacuaaugacuuug

SEQ ID NO: 1786348 - RNA, 19 nt, Homo sapiens
cagagaggggacauuuccc

SEQ ID NO: 1786349 - RNA, 22 nt, Homo sapiens
caaauggcccugggucccagga

SEQ ID NO: 1786350 - RNA, 17 nt, Homo sapiens
aggccaggugggcggac

SEQ ID NO: 1786351 - RNA, 16 nt, Homo sapiens
cugaauaugcugcuca

SEQ ID NO: 1786352 - RNA, 17 nt, Homo sapiens
uaccugcccucucucag

SEQ ID NO: 1786353 - RNA, 19 nt, Homo sapiens
uagauguuagcccaagaca

SEQ ID NO: 1786354 - RNA, 13 nt, Homo sapiens
uccucaccacagu

SEQ ID NO: 1786355 - RNA, 18 nt, Homo sapiens
aauuauuuaacuaauuaa

SEQ ID NO: 1786356 - RNA, 16 nt, Homo sapiens
ucaccucugaaaacgg

SEQ ID NO: 1786357 - RNA, 21 nt, Homo sapiens
aaugggaagguuguucuuggc

SEQ ID NO: 1786358 - RNA, 11 nt, Homo sapiens
gggagugccac

SEQ ID NO: 1786359 - RNA, 23 nt, Homo sapiens
ucaacaagauuuccuugugcaaa

SEQ ID NO: 1786360 - RNA, 16 nt, Homo sapiens
cuuuucuugucucuga

SEQ ID NO: 1786361 - RNA, 14 nt, Homo sapiens
gaagacgaggccaa

SEQ ID NO: 1786362 - RNA, 14 nt, Homo sapiens
agccagguauggug

SEQ ID NO: 1786363 - RNA, 14 nt, Homo sapiens
uaauauacaaucua

SEQ ID NO: 1786364 - RNA, 20 nt, Homo sapiens
accuguguuucguguauaug

SEQ ID NO: 1786365 - RNA, 22 nt, Homo sapiens
uggagacggguguugucgggga

SEQ ID NO: 1786366 - RNA, 15 nt, Homo sapiens
ucacugagagcugcc

SEQ ID NO: 1786367 - RNA, 13 nt, Homo sapiens
cugaguugcacau

SEQ ID NO: 1786368 - RNA, 17 nt, Homo sapiens
acuguuguacaagcuca

SEQ ID NO: 1786369 - RNA, 17 nt, Homo sapiens
gaucccgcccugaccca

SEQ ID NO: 1786370 - RNA, 17 nt, Homo sapiens
ugugggugcagcuguca

SEQ ID NO: 1786371 - RNA, 20 nt, Homo sapiens
gcuggcgccagggccugccg

SEQ ID NO: 1786372 - RNA, 17 nt, Homo sapiens
cugucucauccaaaaag

SEQ ID NO: 1786373 - RNA, 22 nt, Homo sapiens
cuugcucauccaaggauuaaau

SEQ ID NO: 1786374 - RNA, 17 nt, Homo sapiens
aaaauacauagcauuaa

SEQ ID NO: 1786375 - RNA, 16 nt, Homo sapiens
ugucacuugccaguca

SEQ ID NO: 1786376 - RNA, 21 nt, Homo sapiens
auugugagcgaauuagcaaua

SEQ ID NO: 1786377 - RNA, 13 nt, Homo sapiens
aauaaagugaucu

SEQ ID NO: 1786378 - RNA, 20 nt, Homo sapiens
gcucugacuuuacacucggc

SEQ ID NO: 1786379 - RNA, 19 nt, Homo sapiens
agauuuuaucugggggaaa

SEQ ID NO: 1786380 - RNA, 17 nt, Homo sapiens
gacuauggccacauuca

SEQ ID NO: 1786381 - RNA, 21 nt, Homo sapiens
gcuuaauuauugauguuuuca

SEQ ID NO: 1786382 - RNA, 13 nt, Homo sapiens
cauuuagaacuug

SEQ ID NO: 1786383 - RNA, 22 nt, Homo sapiens
uagccacugcauaccaaccugg

SEQ ID NO: 1786384 - RNA, 15 nt, Homo sapiens
accuguuauugccaa

SEQ ID NO: 1786385 - RNA, 15 nt, Homo sapiens
cuggggcaaugggag

SEQ ID NO: 1786386 - RNA, 15 nt, Homo sapiens
cuucacccugaaugg

SEQ ID NO: 1786387 - RNA, 23 nt, Homo sapiens
guauuaacucuguaaaagugucu

SEQ ID NO: 1786388 - RNA, 15 nt, Homo sapiens
acaauaaaguacuuu

SEQ ID NO: 1786389 - RNA, 14 nt, Homo sapiens
ugguccuagaacuu

SEQ ID NO: 1786390 - RNA, 19 nt, Homo sapiens
ucuucuccacuuucuagcc

SEQ ID NO: 1786391 - RNA, 17 nt, Homo sapiens
auucaagcaaacaucaa

SEQ ID NO: 1786392 - RNA, 15 nt, Homo sapiens
uccuuaaacugccaa

SEQ ID NO: 1786393 - RNA, 23 nt, Homo sapiens
ugaaacugagaugugaacacauc

SEQ ID NO: 1786394 - RNA, 22 nt, Homo sapiens
cuaggugagaacccuugcacua

SEQ ID NO: 1786395 - RNA, 14 nt, Homo sapiens
acccuugcauuaga

SEQ ID NO: 1786396 - RNA, 16 nt, Homo sapiens
uuguuuaacuugucuu

SEQ ID NO: 1786397 - RNA, 19 nt, Homo sapiens
uauuacaaguugugcaugc

SEQ ID NO: 1786398 - RNA, 16 nt, Homo sapiens
uugguaccuauuugac

SEQ ID NO: 1786399 - RNA, 19 nt, Homo sapiens
aucuuucaugucuugucau

SEQ ID NO: 1786400 - RNA, 14 nt, Homo sapiens
uuauauuaaucucu

SEQ ID NO: 1786401 - RNA, 15 nt, Homo sapiens
uauuuuaaagcacuu

SEQ ID NO: 1786402 - RNA, 22 nt, Homo sapiens
cagccuggucucaaacucccca

SEQ ID NO: 1786403 - RNA, 21 nt, Homo sapiens
uccaauacuucauuaauuuca

SEQ ID NO: 1786404 - RNA, 14 nt, Homo sapiens
uauaaaacagucau

SEQ ID NO: 1786405 - RNA, 18 nt, Homo sapiens
aacugaaacaaaugcucc

SEQ ID NO: 1786406 - RNA, 18 nt, Homo sapiens
cugccucuguuugacaaa

SEQ ID NO: 1786407 - RNA, 15 nt, Homo sapiens
agggaagcuuucacc

SEQ ID NO: 1786408 - RNA, 12 nt, Homo sapiens
ugaaggugcuga

SEQ ID NO: 1786409 - RNA, 20 nt, Homo sapiens
ugauaacagcuaccaugaca

SEQ ID NO: 1786410 - RNA, 17 nt, Homo sapiens
uucgauguacagucuca

SEQ ID NO: 1786411 - RNA, 15 nt, Homo sapiens
aaaaaugggaaaaau

SEQ ID NO: 1786412 - RNA, 19 nt, Homo sapiens
cugccgcccccuccugaac

SEQ ID NO: 1786413 - RNA, 16 nt, Homo sapiens
gaaauucggagcuaua

SEQ ID NO: 1786414 - RNA, 23 nt, Homo sapiens
uuugcuguuaaaauaagaacaaa

SEQ ID NO: 1786415 - RNA, 17 nt, Homo sapiens
ccagaaaucacugugaa

SEQ ID NO: 1786416 - RNA, 19 nt, Homo sapiens
cauuuuuuuuucaaucaac

SEQ ID NO: 1786417 - RNA, 13 nt, Homo sapiens
accugugcuuuga

SEQ ID NO: 1786418 - RNA, 16 nt, Homo sapiens
ggucguuuuccaaaga

SEQ ID NO: 1786419 - RNA, 19 nt, Homo sapiens
uuaaaaaagguaguuuuuc

SEQ ID NO: 1786420 - RNA, 16 nt, Homo sapiens
cgacuuguucuugaua

SEQ ID NO: 1786421 - RNA, 21 nt, Homo sapiens
auacaggaugaugacuaugga

SEQ ID NO: 1786422 - RNA, 15 nt, Homo sapiens
gcuauaauaaagaag

SEQ ID NO: 1786423 - RNA, 23 nt, Homo sapiens
agucuguccugcguccucugucc

SEQ ID NO: 1786424 - RNA, 21 nt, Homo sapiens
caugauggccuuacacugaaa

SEQ ID NO: 1786425 - RNA, 12 nt, Homo sapiens
aaguagugcuua

SEQ ID NO: 1786426 - RNA, 19 nt, Homo sapiens
ucauaacagguaucauuaa

SEQ ID NO: 1786427 - RNA, 13 nt, Homo sapiens
agacuagugccgu

SEQ ID NO: 1786428 - RNA, 13 nt, Homo sapiens
agccaagugcaga

SEQ ID NO: 1786429 - RNA, 21 nt, Homo sapiens
gcuauaauuccgaaacauaca

SEQ ID NO: 1786430 - RNA, 18 nt, Homo sapiens
cuagaaaucuguccugug

SEQ ID NO: 1786431 - RNA, 20 nt, Homo sapiens
ucuuugagauaauacauucc

SEQ ID NO: 1786432 - RNA, 19 nt, Homo sapiens
aacugcaauaacuucugac

SEQ ID NO: 1786433 - RNA, 13 nt, Homo sapiens
acacucucacuau

SEQ ID NO: 1786434 - RNA, 13 nt, Homo sapiens
agaaucucagucu

SEQ ID NO: 1786435 - RNA, 21 nt, Homo sapiens
aacccaucuuccuggaccuga

SEQ ID NO: 1786436 - RNA, 15 nt, Homo sapiens
auugugaauaaugau

SEQ ID NO: 1786437 - RNA, 20 nt, Homo sapiens
agacaaaauuguaagccaga

SEQ ID NO: 1786438 - RNA, 19 nt, Homo sapiens
caaaucuguaaucagcaau

SEQ ID NO: 1786439 - RNA, 16 nt, Homo sapiens
ugagacccagugcacu

SEQ ID NO: 1786440 - RNA, 21 nt, Homo sapiens
ccaggaacagcaaaugcaaaa

SEQ ID NO: 1786441 - RNA, 16 nt, Homo sapiens
uauaucaguaucugag

SEQ ID NO: 1786442 - RNA, 11 nt, Homo sapiens
ugaggggcccc

SEQ ID NO: 1786443 - RNA, 15 nt, Homo sapiens
cacccuaucaucagu

SEQ ID NO: 1786444 - RNA, 22 nt, Homo sapiens
ucuuugcugccagccacuucau

SEQ ID NO: 1786445 - RNA, 14 nt, Homo sapiens
aaaccugucacuug

SEQ ID NO: 1786446 - RNA, 24 nt, Homo sapiens
ucuugcacagucacugcucuucag

SEQ ID NO: 1786447 - RNA, 23 nt, Homo sapiens
ucccaugcuuuguaggugucuca

SEQ ID NO: 1786448 - RNA, 16 nt, Homo sapiens
uuacauuuaaaagaca

SEQ ID NO: 1786449 - RNA, 19 nt, Homo sapiens
ccaguuuuuguuuuugcau

SEQ ID NO: 1786450 - RNA, 23 nt, Homo sapiens
aucucccgugggcaucucaagcc

SEQ ID NO: 1786451 - RNA, 21 nt, Homo sapiens
uguuaaaauagacuaaccucu

SEQ ID NO: 1786452 - RNA, 21 nt, Homo sapiens
caguguuuccugaguagcagu

SEQ ID NO: 1786453 - RNA, 17 nt, Homo sapiens
aacuaucucuacugaau

SEQ ID NO: 1786454 - RNA, 18 nt, Homo sapiens
agcauuuguucuuugcca

SEQ ID NO: 1786455 - RNA, 18 nt, Homo sapiens
aaacaguaaaccuuaaca

SEQ ID NO: 1786456 - RNA, 13 nt, Homo sapiens
ugcuaugacugua

SEQ ID NO: 1786457 - RNA, 18 nt, Homo sapiens
cccaguucaguguugcau

SEQ ID NO: 1786458 - RNA, 22 nt, Homo sapiens
ggugucugcgucgucaccaaau

SEQ ID NO: 1786459 - RNA, 15 nt, Homo sapiens
cuuaauacucaugca

SEQ ID NO: 1786460 - RNA, 13 nt, Homo sapiens
aacuauccugacu

SEQ ID NO: 1786461 - RNA, 16 nt, Homo sapiens
caagugagacaaaaag

SEQ ID NO: 1786462 - RNA, 22 nt, Homo sapiens
cagguucaugccaccauggcca

SEQ ID NO: 1786463 - RNA, 17 nt, Homo sapiens
auaaaaagaggagcuuu

SEQ ID NO: 1786464 - RNA, 13 nt, Homo sapiens
ggcagccuuuacg

SEQ ID NO: 1786465 - RNA, 10 nt, Homo sapiens
ucucucucag

SEQ ID NO: 1786466 - RNA, 14 nt, Homo sapiens
agcaauacaaagac

SEQ ID NO: 1786467 - RNA, 17 nt, Homo sapiens
cccacccacaugugaca

SEQ ID NO: 1786468 - RNA, 23 nt, Homo sapiens
uauuucugucccucgugaaguca

SEQ ID NO: 1786469 - RNA, 20 nt, Homo sapiens
gaaaucuugaggacuuuguu

SEQ ID NO: 1786470 - RNA, 22 nt, Homo sapiens
cuauugggaguuuauaccaaga

SEQ ID NO: 1786471 - RNA, 18 nt, Homo sapiens
uaucuacaauacauauau

SEQ ID NO: 1786472 - RNA, 15 nt, Homo sapiens
agccauuugccauca

SEQ ID NO: 1786473 - RNA, 19 nt, Homo sapiens
gaaugguuaauaaaacugc

SEQ ID NO: 1786474 - RNA, 22 nt, Homo sapiens
aauacaagauauuauguauaaa

SEQ ID NO: 1786475 - RNA, 14 nt, Homo sapiens
cauucaguuaucac

SEQ ID NO: 1786476 - RNA, 14 nt, Homo sapiens
ucaagaagcuguga

SEQ ID NO: 1786477 - RNA, 17 nt, Homo sapiens
gccugggcuuaugcccu

SEQ ID NO: 1786478 - RNA, 20 nt, Homo sapiens
auacaucuucauuaauacug

SEQ ID NO: 1786479 - RNA, 22 nt, Homo sapiens
agcuugcucacaucuuggcaca

SEQ ID NO: 1786480 - RNA, 23 nt, Homo sapiens
aaagacgcauguuauggugcuaa

SEQ ID NO: 1786481 - RNA, 23 nt, Homo sapiens
aaaucuuaaaaguguuguuauca

SEQ ID NO: 1786482 - RNA, 23 nt, Homo sapiens
cucagccuuagcacuauggacau

SEQ ID NO: 1786483 - RNA, 17 nt, Homo sapiens
acaaacccuuuucaucc

SEQ ID NO: 1786484 - RNA, 21 nt, Homo sapiens
ccgucacuauucaucaaugaa

SEQ ID NO: 1786485 - RNA, 17 nt, Homo sapiens
accccacaagcaccacu

SEQ ID NO: 1786486 - RNA, 16 nt, Homo sapiens
cccaauaaaauucuga

SEQ ID NO: 1786487 - RNA, 16 nt, Homo sapiens
gcuucccagggcugcc

SEQ ID NO: 1786488 - RNA, 17 nt, Homo sapiens
cugguguugacuggacu

SEQ ID NO: 1786489 - RNA, 13 nt, Homo sapiens
cgaaucaucucaa

SEQ ID NO: 1786490 - RNA, 11 nt, Homo sapiens
acaugugacuc

SEQ ID NO: 1786491 - RNA, 16 nt, Homo sapiens
caaagaccgauugcau

SEQ ID NO: 1786492 - RNA, 22 nt, Homo sapiens
cagauuacagucauuuccuacc

SEQ ID NO: 1786493 - RNA, 15 nt, Homo sapiens
cauggcuaaauacaa

SEQ ID NO: 1786494 - RNA, 15 nt, Homo sapiens
ucuagaauccugcuu

SEQ ID NO: 1786495 - RNA, 13 nt, Homo sapiens
gagacauugccuc

SEQ ID NO: 1786496 - RNA, 22 nt, Homo sapiens
cuuggcugccccacaggccaca

SEQ ID NO: 1786497 - RNA, 20 nt, Homo sapiens
agcucaguaauuccuguuac

SEQ ID NO: 1786498 - RNA, 17 nt, Homo sapiens
ugccgacuggcugugag

SEQ ID NO: 1786499 - RNA, 23 nt, Homo sapiens
ugacagagcgagauuccgucuca

SEQ ID NO: 1786500 - RNA, 15 nt, Homo sapiens
agccuuccucaagau

SEQ ID NO: 1786501 - RNA, 23 nt, Homo sapiens
caaucccuacagggugucuguca

SEQ ID NO: 1786502 - RNA, 16 nt, Homo sapiens
agucuuaacaacagcu

SEQ ID NO: 1786503 - RNA, 14 nt, Homo sapiens
ggauuauucauuua

SEQ ID NO: 1786504 - RNA, 12 nt, Homo sapiens
acuaagcucucu

SEQ ID NO: 1786505 - RNA, 17 nt, Homo sapiens
cuuuuggcucugaagaa

SEQ ID NO: 1786506 - RNA, 12 nt, Homo sapiens
ucucuugccuua

SEQ ID NO: 1786507 - RNA, 20 nt, Homo sapiens
gccuggaguguaugacugca

SEQ ID NO: 1786508 - RNA, 13 nt, Homo sapiens
uagagcccucucc

SEQ ID NO: 1786509 - RNA, 14 nt, Homo sapiens
uggggaaguuuauu

SEQ ID NO: 1786510 - RNA, 13 nt, Homo sapiens
cgucagccagcuc

SEQ ID NO: 1786511 - RNA, 20 nt, Homo sapiens
ucaucgcgccacuaagccaa

SEQ ID NO: 1786512 - RNA, 19 nt, Homo sapiens
cccugaccgugcuaacugu

SEQ ID NO: 1786513 - RNA, 21 nt, Homo sapiens
agggaauccugagaaacaauc

SEQ ID NO: 1786514 - RNA, 22 nt, Homo sapiens
gcugccauccaugugcuaguca

SEQ ID NO: 1786515 - RNA, 17 nt, Homo sapiens
cuggaugacuugagaug

SEQ ID NO: 1786516 - RNA, 20 nt, Homo sapiens
guaccuggcagcccugggcc

SEQ ID NO: 1786517 - RNA, 15 nt, Homo sapiens
cacuacauugugcaa

SEQ ID NO: 1786518 - RNA, 20 nt, Homo sapiens
uauccgaacuuuaauuucag

SEQ ID NO: 1786519 - RNA, 13 nt, Homo sapiens
aauccuggaccaa

SEQ ID NO: 1786520 - RNA, 13 nt, Homo sapiens
ugacuucacugua

SEQ ID NO: 1786521 - RNA, 19 nt, Homo sapiens
ucauccacauaagcacucc

SEQ ID NO: 1786522 - RNA, 19 nt, Homo sapiens
uaaugguguagaacacuaa

SEQ ID NO: 1786523 - RNA, 16 nt, Homo sapiens
ugaacauccccuccca

SEQ ID NO: 1786524 - RNA, 17 nt, Homo sapiens
gcgugcacuccccgugu

SEQ ID NO: 1786525 - RNA, 17 nt, Homo sapiens
ggccucccacagugacu

SEQ ID NO: 1786526 - RNA, 14 nt, Homo sapiens
aaaugccagugugc

SEQ ID NO: 1786527 - RNA, 16 nt, Homo sapiens
uaaaaagaagccacag

SEQ ID NO: 1786528 - RNA, 9 nt, Homo sapiens
auguugaau

SEQ ID NO: 1786529 - RNA, 14 nt, Homo sapiens
cccaucggucaccu

SEQ ID NO: 1786530 - RNA, 23 nt, Homo sapiens
uaaaagguaccuuugucugccau

SEQ ID NO: 1786531 - RNA, 20 nt, Homo sapiens
uaauuuagaccccauacaag

SEQ ID NO: 1786532 - RNA, 20 nt, Homo sapiens
aaaucuggggaggacaaagg

SEQ ID NO: 1786533 - RNA, 21 nt, Homo sapiens
acuguucuaccaagaacugaa

SEQ ID NO: 1786534 - RNA, 18 nt, Homo sapiens
gcagcauagcaagacaca

SEQ ID NO: 1786535 - RNA, 16 nt, Homo sapiens
auuuuguaaaauguau

SEQ ID NO: 1786536 - RNA, 19 nt, Homo sapiens
ugaugucagaaacaaugac

SEQ ID NO: 1786537 - RNA, 22 nt, Homo sapiens
agcgucacucuaccuaaugucu

SEQ ID NO: 1786538 - RNA, 15 nt, Homo sapiens
cccaucgcccagcac

SEQ ID NO: 1786539 - RNA, 22 nt, Homo sapiens
aagcaucuagguuuuugauaau

SEQ ID NO: 1786540 - RNA, 22 nt, Homo sapiens
ccuguagccuucuguaggaauu

SEQ ID NO: 1786541 - RNA, 13 nt, Homo sapiens
accaaagaucugc

SEQ ID NO: 1786542 - RNA, 17 nt, Homo sapiens
acaugugauguggugcg

SEQ ID NO: 1786543 - RNA, 15 nt, Homo sapiens
gccauucuucagguc

SEQ ID NO: 1786544 - RNA, 15 nt, Homo sapiens
ggaaaaaaagcaaaa

SEQ ID NO: 1786545 - RNA, 15 nt, Homo sapiens
gccuuuuaacauuuu

SEQ ID NO: 1786546 - RNA, 19 nt, Homo sapiens
cagugucuugagcucuaaa

SEQ ID NO: 1786547 - RNA, 20 nt, Homo sapiens
ugaagucccugcagcccuuu

SEQ ID NO: 1786548 - RNA, 19 nt, Homo sapiens
ccuuugggccaauuuacug

SEQ ID NO: 1786549 - RNA, 15 nt, Homo sapiens
uugaggaagcucucc

SEQ ID NO: 1786550 - RNA, 16 nt, Homo sapiens
ggcuggcauccucaca

SEQ ID NO: 1786551 - RNA, 22 nt, Homo sapiens
acauuuuuaaaaauugucauuu

SEQ ID NO: 1786552 - RNA, 16 nt, Homo sapiens
uagagagagcuguauu

SEQ ID NO: 1786553 - RNA, 23 nt, Homo sapiens
uacauaauaaaaaauuaugacaa

SEQ ID NO: 1786554 - RNA, 15 nt, Homo sapiens
agaaauggcaucauu

SEQ ID NO: 1786555 - RNA, 14 nt, Homo sapiens
uuggacuguaacau

SEQ ID NO: 1786556 - RNA, 15 nt, Homo sapiens
ccaagaagcaugcag

SEQ ID NO: 1786557 - RNA, 13 nt, Homo sapiens
acaauuacuuuga

SEQ ID NO: 1786558 - RNA, 17 nt, Homo sapiens
gauaagaaauaagaaua

SEQ ID NO: 1786559 - RNA, 15 nt, Homo sapiens
acuuucuaaauuuca

SEQ ID NO: 1786560 - RNA, 15 nt, Homo sapiens
uacacauauccacaa

SEQ ID NO: 1786561 - RNA, 16 nt, Homo sapiens
gcccccuuucagaugu

SEQ ID NO: 1786562 - RNA, 18 nt, Homo sapiens
caaccccaggcuacugag

SEQ ID NO: 1786563 - RNA, 16 nt, Homo sapiens
cuggcucagccucaaa

SEQ ID NO: 1786564 - RNA, 13 nt, Homo sapiens
uccacuacugcua

SEQ ID NO: 1786565 - RNA, 13 nt, Homo sapiens
guaaacuuuguca

SEQ ID NO: 1786566 - RNA, 20 nt, Homo sapiens
ugguacucccaaacugacaa

SEQ ID NO: 1786567 - RNA, 12 nt, Homo sapiens
ugacuaaagcua

SEQ ID NO: 1786568 - RNA, 15 nt, Homo sapiens
guccaguuucccaaa

SEQ ID NO: 1786569 - RNA, 22 nt, Homo sapiens
uagccauguaaucagauuuauu

SEQ ID NO: 1786570 - RNA, 21 nt, Homo sapiens
ggcugaauccgugguggcacc

SEQ ID NO: 1786571 - RNA, 20 nt, Homo sapiens
ugcucaucugguaacucaac

SEQ ID NO: 1786572 - RNA, 18 nt, Homo sapiens
uaacuguuccccuuggua

SEQ ID NO: 1786573 - RNA, 20 nt, Homo sapiens
acuauguucuaggucagucu

SEQ ID NO: 1786574 - RNA, 21 nt, Homo sapiens
uuucaccuguuuuuaagcugu

SEQ ID NO: 1786575 - RNA, 15 nt, Homo sapiens
uccgacucaacacca

SEQ ID NO: 1786576 - RNA, 20 nt, Homo sapiens
gucacccaacucaaggacag

SEQ ID NO: 1786577 - RNA, 16 nt, Homo sapiens
agcaguaaacuuucuc

SEQ ID NO: 1786578 - RNA, 22 nt, Homo sapiens
ugcccuuuuaaauggcaugaca

SEQ ID NO: 1786579 - RNA, 14 nt, Homo sapiens
ucuaacauaccuug

SEQ ID NO: 1786580 - RNA, 17 nt, Homo sapiens
gggaggcugcacuggag

SEQ ID NO: 1786581 - RNA, 20 nt, Homo sapiens
aacugggaugaaacuaaagc

SEQ ID NO: 1786582 - RNA, 14 nt, Homo sapiens
cagcuucuuugcca

SEQ ID NO: 1786583 - RNA, 14 nt, Homo sapiens
ugccuucacccaua

SEQ ID NO: 1786584 - RNA, 15 nt, Homo sapiens
uaaaucuuccaaagu

SEQ ID NO: 1786585 - RNA, 19 nt, Homo sapiens
cccauucuuguucagauua

SEQ ID NO: 1786586 - RNA, 16 nt, Homo sapiens
uaauauuugucugugu

SEQ ID NO: 1786587 - RNA, 19 nt, Homo sapiens
cuggcucaggugugggugg

SEQ ID NO: 1786588 - RNA, 19 nt, Homo sapiens
ucagaguuucagcuuucuu

SEQ ID NO: 1786589 - RNA, 21 nt, Homo sapiens
guauuauuuuuuuauguucau

SEQ ID NO: 1786590 - RNA, 21 nt, Homo sapiens
uggcaccuguagucccagcua

SEQ ID NO: 1786591 - RNA, 16 nt, Homo sapiens
cuuaaucuccacuguu

SEQ ID NO: 1786592 - RNA, 23 nt, Homo sapiens
gaacaagauggauggaaagggag

SEQ ID NO: 1786593 - RNA, 14 nt, Homo sapiens
acaaauugaacucu

SEQ ID NO: 1786594 - RNA, 14 nt, Homo sapiens
caacagacaaaaag

SEQ ID NO: 1786595 - RNA, 14 nt, Homo sapiens
aauacacauaucua

SEQ ID NO: 1786596 - RNA, 18 nt, Homo sapiens
uccaacgaguaccagcug

SEQ ID NO: 1786597 - RNA, 14 nt, Homo sapiens
caugacacauuuga

SEQ ID NO: 1786598 - RNA, 22 nt, Homo sapiens
aaccucugggucaucucucaca

SEQ ID NO: 1786599 - RNA, 14 nt, Homo sapiens
gaacucauuugaau

SEQ ID NO: 1786600 - RNA, 17 nt, Homo sapiens
gguuccuugguauucac

SEQ ID NO: 1786601 - RNA, 16 nt, Homo sapiens
cuugaaaagaagcaag

SEQ ID NO: 1786602 - RNA, 14 nt, Homo sapiens
cacauaucuagauu

SEQ ID NO: 1786603 - RNA, 21 nt, Homo sapiens
aauauuuuuuuaaccuaauau

SEQ ID NO: 1786604 - RNA, 21 nt, Homo sapiens
cagaaccuuggcgguuuauag

SEQ ID NO: 1786605 - RNA, 20 nt, Homo sapiens
cuucgauagcaagucccauc

SEQ ID NO: 1786606 - RNA, 18 nt, Homo sapiens
uagccugcauaucauuca

SEQ ID NO: 1786607 - RNA, 19 nt, Homo sapiens
gauccagggaaugaugaca

SEQ ID NO: 1786608 - RNA, 19 nt, Homo sapiens
uccagguauuuuauaauuc

SEQ ID NO: 1786609 - RNA, 16 nt, Homo sapiens
aggcuccccaucuucu

SEQ ID NO: 1786610 - RNA, 14 nt, Homo sapiens
auugagcugcagaa

SEQ ID NO: 1786611 - RNA, 15 nt, Homo sapiens
cuuuguuuauuguaa

SEQ ID NO: 1786612 - RNA, 23 nt, Homo sapiens
ucucacuuaauacagauguauca

SEQ ID NO: 1786613 - RNA, 15 nt, Homo sapiens
gcgucgguccuggug

SEQ ID NO: 1786614 - RNA, 15 nt, Homo sapiens
guuaagauucuuggu

SEQ ID NO: 1786615 - RNA, 12 nt, Homo sapiens
gaugcccagaag

SEQ ID NO: 1786616 - RNA, 13 nt, Homo sapiens
aauuaugcuucca

SEQ ID NO: 1786617 - RNA, 20 nt, Homo sapiens
uuagcauaaauuuaauguag

SEQ ID NO: 1786618 - RNA, 21 nt, Homo sapiens
uugccucucuugccccuuguc

SEQ ID NO: 1786619 - RNA, 17 nt, Homo sapiens
caaggccuggggagccu

SEQ ID NO: 1786620 - RNA, 18 nt, Homo sapiens
aacucugugaucuugcuc

SEQ ID NO: 1786621 - RNA, 17 nt, Homo sapiens
aaaugaacauaaugaac

SEQ ID NO: 1786622 - RNA, 15 nt, Homo sapiens
gcagagaccggacaa

SEQ ID NO: 1786623 - RNA, 22 nt, Homo sapiens
ugucuuauagguuuccacugcc

SEQ ID NO: 1786624 - RNA, 22 nt, Homo sapiens
guuguaaaaagcccagcacuug

SEQ ID NO: 1786625 - RNA, 24 nt, Homo sapiens
acccaugaaggcuggaaggcagca

SEQ ID NO: 1786626 - RNA, 16 nt, Homo sapiens
aacuauuuuugcacau

SEQ ID NO: 1786627 - RNA, 12 nt, Homo sapiens
aggccaagcccc

SEQ ID NO: 1786628 - RNA, 17 nt, Homo sapiens
agguuugucaacacaaa

SEQ ID NO: 1786629 - RNA, 18 nt, Homo sapiens
uuggacaacugacaauau

SEQ ID NO: 1786630 - RNA, 20 nt, Homo sapiens
ccucagaauauuaagcacau

SEQ ID NO: 1786631 - RNA, 16 nt, Homo sapiens
uugugccucuggcugc

SEQ ID NO: 1786632 - RNA, 12 nt, Homo sapiens
uauucauuugcu

SEQ ID NO: 1786633 - RNA, 18 nt, Homo sapiens
uccaaaacuguccagggc

SEQ ID NO: 1786634 - RNA, 21 nt, Homo sapiens
gcugcaacagguuuguucuca

SEQ ID NO: 1786635 - RNA, 14 nt, Homo sapiens
auguugaguuauua

SEQ ID NO: 1786636 - RNA, 15 nt, Homo sapiens
uggacuggaugcaug

SEQ ID NO: 1786637 - RNA, 22 nt, Homo sapiens
agaaccuuaaugacaacacuua

SEQ ID NO: 1786638 - RNA, 22 nt, Homo sapiens
acccuuucauaaagucuugccu

SEQ ID NO: 1786639 - RNA, 18 nt, Homo sapiens
caggauuuuguauugcca

SEQ ID NO: 1786640 - RNA, 13 nt, Homo sapiens
uccugaccucagg

SEQ ID NO: 1786641 - RNA, 24 nt, Homo sapiens
gcucugaacaaacacugaaucaug

SEQ ID NO: 1786642 - RNA, 12 nt, Homo sapiens
acaucagcacuu

SEQ ID NO: 1786643 - RNA, 14 nt, Homo sapiens
agaacaacuugcua

SEQ ID NO: 1786644 - RNA, 23 nt, Homo sapiens
aaaauguacucagcuaucagcuc

SEQ ID NO: 1786645 - RNA, 12 nt, Homo sapiens
gugcaccaucuc

SEQ ID NO: 1786646 - RNA, 16 nt, Homo sapiens
auauacuauuuagucu

SEQ ID NO: 1786647 - RNA, 21 nt, Homo sapiens
aagccuuuacugacccugggg

SEQ ID NO: 1786648 - RNA, 16 nt, Homo sapiens
aucccguguugccaug

SEQ ID NO: 1786649 - RNA, 15 nt, Homo sapiens
aagaaaaguaaaaaa

SEQ ID NO: 1786650 - RNA, 13 nt, Homo sapiens
uaccaaucauuuu

SEQ ID NO: 1786651 - RNA, 21 nt, Homo sapiens
aagauggcugugccucugccu

SEQ ID NO: 1786652 - RNA, 20 nt, Homo sapiens
ugucaagcugaaaacaaaca

SEQ ID NO: 1786653 - RNA, 17 nt, Homo sapiens
cugaaaugacauuucac

SEQ ID NO: 1786654 - RNA, 22 nt, Homo sapiens
acccaaaagaaacugacaugcc

SEQ ID NO: 1786655 - RNA, 14 nt, Homo sapiens
agcccagagccacc

SEQ ID NO: 1786656 - RNA, 22 nt, Homo sapiens
cuauccaaucaaucuugcaugu

SEQ ID NO: 1786657 - RNA, 21 nt, Homo sapiens
auugguacuuacccuucuaca

SEQ ID NO: 1786658 - RNA, 19 nt, Homo sapiens
caagcuaauaaaauaucau

SEQ ID NO: 1786659 - RNA, 17 nt, Homo sapiens
augaggaucaacuguac

SEQ ID NO: 1786660 - RNA, 21 nt, Homo sapiens
gaaaucuuaaaaaccugccuc

SEQ ID NO: 1786661 - RNA, 15 nt, Homo sapiens
uucccggagcagaag

SEQ ID NO: 1786662 - RNA, 20 nt, Homo sapiens
aguaggauauuggcauuugu

SEQ ID NO: 1786663 - RNA, 15 nt, Homo sapiens
uccucaaaaugggag

SEQ ID NO: 1786664 - RNA, 18 nt, Homo sapiens
aucgucauuugcugugaa

SEQ ID NO: 1786665 - RNA, 11 nt, Homo sapiens
agcacugacua

SEQ ID NO: 1786666 - RNA, 21 nt, Homo sapiens
cuugauuccugguuugacuca

SEQ ID NO: 1786667 - RNA, 12 nt, Homo sapiens
auauugcuccau

SEQ ID NO: 1786668 - RNA, 15 nt, Homo sapiens
ccccuaguaagugcc

SEQ ID NO: 1786669 - RNA, 13 nt, Homo sapiens
auguaaagccaug

SEQ ID NO: 1786670 - RNA, 20 nt, Homo sapiens
ccguggagagggacuggcag

SEQ ID NO: 1786671 - RNA, 21 nt, Homo sapiens
uccugagucugccucuguuca

SEQ ID NO: 1786672 - RNA, 23 nt, Homo sapiens
cugcaacaugccagccacuguga

SEQ ID NO: 1786673 - RNA, 17 nt, Homo sapiens
ucagugggacauagcca

SEQ ID NO: 1786674 - RNA, 21 nt, Homo sapiens
aagcacuuuaacacagugucu

SEQ ID NO: 1786675 - RNA, 20 nt, Homo sapiens
ucuagcaagauagucuucag

SEQ ID NO: 1786676 - RNA, 20 nt, Homo sapiens
uauacuucucuauuaucuca

SEQ ID NO: 1786677 - RNA, 18 nt, Homo sapiens
ugcccuugcuccagccug

SEQ ID NO: 1786678 - RNA, 19 nt, Homo sapiens
agagcaaucuugcugugaa

SEQ ID NO: 1786679 - RNA, 17 nt, Homo sapiens
cccaagucugacagcca

SEQ ID NO: 1786680 - RNA, 22 nt, Homo sapiens
aaacacaucuggccuaauguuc

SEQ ID NO: 1786681 - RNA, 16 nt, Homo sapiens
uauuucuuuucaggga

SEQ ID NO: 1786682 - RNA, 15 nt, Homo sapiens
ccaccuuaguacuuu

SEQ ID NO: 1786683 - RNA, 21 nt, Homo sapiens
uuuucuagaaauguuuagguu

SEQ ID NO: 1786684 - RNA, 17 nt, Homo sapiens
agaaaaaucaaucauuu

SEQ ID NO: 1786685 - RNA, 19 nt, Homo sapiens
gcaagguggguuccaggga

SEQ ID NO: 1786686 - RNA, 21 nt, Homo sapiens
cuccagacacagagacauggg

SEQ ID NO: 1786687 - RNA, 18 nt, Homo sapiens
ugucuccuacuccugacu

SEQ ID NO: 1786688 - RNA, 13 nt, Homo sapiens
ugauaaugcucac

SEQ ID NO: 1786689 - RNA, 17 nt, Homo sapiens
caaaagcagauacuuga

SEQ ID NO: 1786690 - RNA, 15 nt, Homo sapiens
gugcuggucauacau

SEQ ID NO: 1786691 - RNA, 23 nt, Homo sapiens
uugcugggagcuucucugcugcu

SEQ ID NO: 1786692 - RNA, 17 nt, Homo sapiens
uguauguaugagacaga

SEQ ID NO: 1786693 - RNA, 17 nt, Homo sapiens
guacugcgcaugcaaga

SEQ ID NO: 1786694 - RNA, 17 nt, Homo sapiens
cacugggacuugcaaaa

SEQ ID NO: 1786695 - RNA, 16 nt, Homo sapiens
uagcucacagcacauu

SEQ ID NO: 1786696 - RNA, 15 nt, Homo sapiens
uauaaccauguucua

SEQ ID NO: 1786697 - RNA, 23 nt, Homo sapiens
aagcaaauagaucaugcauuuaa

SEQ ID NO: 1786698 - RNA, 14 nt, Homo sapiens
auauuguuuuacaa

SEQ ID NO: 1786699 - RNA, 20 nt, Homo sapiens
uaaauuccauguuuagcaga

SEQ ID NO: 1786700 - RNA, 13 nt, Homo sapiens
aaauuaugcugca

SEQ ID NO: 1786701 - RNA, 15 nt, Homo sapiens
gccacuucacuuuuu

SEQ ID NO: 1786702 - RNA, 12 nt, Homo sapiens
uauuaccagcaa

SEQ ID NO: 1786703 - RNA, 15 nt, Homo sapiens
auucugcuaagagau

SEQ ID NO: 1786704 - RNA, 13 nt, Homo sapiens
auuuaauucuuaa

SEQ ID NO: 1786705 - RNA, 22 nt, Homo sapiens
augucauugcuaauccucgcaa

SEQ ID NO: 1786706 - RNA, 18 nt, Homo sapiens
auuuuauugaauacuguc

SEQ ID NO: 1786707 - RNA, 18 nt, Homo sapiens
caguuaauucaaugugaa

SEQ ID NO: 1786708 - RNA, 14 nt, Homo sapiens
caaucugcacacuc

SEQ ID NO: 1786709 - RNA, 14 nt, Homo sapiens
auuuccacuaaaaa

SEQ ID NO: 1786710 - RNA, 20 nt, Homo sapiens
cuaccugagaucacuaaaua

SEQ ID NO: 1786711 - RNA, 20 nt, Homo sapiens
uuccauaguguuaacuguca

SEQ ID NO: 1786712 - RNA, 13 nt, Homo sapiens
uuucacgaacugu

SEQ ID NO: 1786713 - RNA, 12 nt, Homo sapiens
cagcacuuuaga

SEQ ID NO: 1786714 - RNA, 22 nt, Homo sapiens
cauauguauuuugucauaugua

SEQ ID NO: 1786715 - RNA, 19 nt, Homo sapiens
aacagaauggauugccagu

SEQ ID NO: 1786716 - RNA, 17 nt, Homo sapiens
gccugggaauggauuag

SEQ ID NO: 1786717 - RNA, 18 nt, Homo sapiens
gaaaagcacagcuguaua

SEQ ID NO: 1786718 - RNA, 14 nt, Homo sapiens
agacucugguguuc

SEQ ID NO: 1786719 - RNA, 14 nt, Homo sapiens
ugagggguauccuc

SEQ ID NO: 1786720 - RNA, 12 nt, Homo sapiens
ugacuuguucau

SEQ ID NO: 1786721 - RNA, 14 nt, Homo sapiens
uacauguuacuugu

SEQ ID NO: 1786722 - RNA, 22 nt, Homo sapiens
uguaaucaaggccagugcuaaa

SEQ ID NO: 1786723 - RNA, 20 nt, Homo sapiens
aggcagggucucacucuguu

SEQ ID NO: 1786724 - RNA, 14 nt, Homo sapiens
gcuggggaccucac

SEQ ID NO: 1786725 - RNA, 17 nt, Homo sapiens
auggcacauggcuggca

SEQ ID NO: 1786726 - RNA, 18 nt, Homo sapiens
ucaggaccacccugccaa

SEQ ID NO: 1786727 - RNA, 18 nt, Homo sapiens
cuguauccagaagccagu

SEQ ID NO: 1786728 - RNA, 19 nt, Homo sapiens
uccuuuuuucaauaugcaa

SEQ ID NO: 1786729 - RNA, 22 nt, Homo sapiens
auguuuugcuuaaacuaaugaa

SEQ ID NO: 1786730 - RNA, 19 nt, Homo sapiens
auacauaacuucagugcaa

SEQ ID NO: 1786731 - RNA, 21 nt, Homo sapiens
cucugggccaagucaaagaca

SEQ ID NO: 1786732 - RNA, 16 nt, Homo sapiens
gcgucacggccaagug

SEQ ID NO: 1786733 - RNA, 15 nt, Homo sapiens
cauggggguauugua

SEQ ID NO: 1786734 - RNA, 15 nt, Homo sapiens
ggcaggaccacuagc

SEQ ID NO: 1786735 - RNA, 16 nt, Homo sapiens
gccgggagaccagugu

SEQ ID NO: 1786736 - RNA, 16 nt, Homo sapiens
ugauagaaaagugugg

SEQ ID NO: 1786737 - RNA, 23 nt, Homo sapiens
uaaugugaaguagaauccuaaau

SEQ ID NO: 1786738 - RNA, 23 nt, Homo sapiens
auuuccucuaguaucacuuuugc

SEQ ID NO: 1786739 - RNA, 15 nt, Homo sapiens
uguaggugaaagugu

SEQ ID NO: 1786740 - RNA, 20 nt, Homo sapiens
agcagguuaccacucuggca

SEQ ID NO: 1786741 - RNA, 13 nt, Homo sapiens
ggcaccaacucca

SEQ ID NO: 1786742 - RNA, 16 nt, Homo sapiens
caucuagcuccauaau

SEQ ID NO: 1786743 - RNA, 15 nt, Homo sapiens
uccuugcuacccaga

SEQ ID NO: 1786744 - RNA, 19 nt, Homo sapiens
acaagacuguaaauuccaa

SEQ ID NO: 1786745 - RNA, 15 nt, Homo sapiens
ucauuacuacccucc

SEQ ID NO: 1786746 - RNA, 18 nt, Homo sapiens
auuuauuuuuucuaagug

SEQ ID NO: 1786747 - RNA, 14 nt, Homo sapiens
gagaaaagccucuc

SEQ ID NO: 1786748 - RNA, 21 nt, Homo sapiens
cagucucuauuugauuugcaa

SEQ ID NO: 1786749 - RNA, 12 nt, Homo sapiens
cuccacccugag

SEQ ID NO: 1786750 - RNA, 19 nt, Homo sapiens
uacugcacacugcacauuu

SEQ ID NO: 1786751 - RNA, 22 nt, Homo sapiens
acaagagcuuugguaaucucug

SEQ ID NO: 1786752 - RNA, 18 nt, Homo sapiens
cucuuguauaugaugauc

SEQ ID NO: 1786753 - RNA, 22 nt, Homo sapiens
uuuagaguaugcaagaagaaua

SEQ ID NO: 1786754 - RNA, 16 nt, Homo sapiens
cccccaaauuaguaca

SEQ ID NO: 1786755 - RNA, 13 nt, Homo sapiens
gugcuaacauaaa

SEQ ID NO: 1786756 - RNA, 18 nt, Homo sapiens
gguuacaaucauugcuga

SEQ ID NO: 1786757 - RNA, 16 nt, Homo sapiens
aagacagcugcugggu

SEQ ID NO: 1786758 - RNA, 15 nt, Homo sapiens
ugggguucgaaauca

SEQ ID NO: 1786759 - RNA, 22 nt, Homo sapiens
aauuaaagugaauuguugacaa

SEQ ID NO: 1786760 - RNA, 21 nt, Homo sapiens
uuucaacuuuguuccuaaaua

SEQ ID NO: 1786761 - RNA, 21 nt, Homo sapiens
gagauuacuaacuguggacaa

SEQ ID NO: 1786762 - RNA, 20 nt, Homo sapiens
ccucaaagcccccacuucuc

SEQ ID NO: 1786763 - RNA, 21 nt, Homo sapiens
agcauaccaauuacccauaaa

SEQ ID NO: 1786764 - RNA, 19 nt, Homo sapiens
uggaacagauucacacugu

SEQ ID NO: 1786765 - RNA, 19 nt, Homo sapiens
aacucaugucuuucucaga

SEQ ID NO: 1786766 - RNA, 20 nt, Homo sapiens
auuccuuagcuuagaccuca

SEQ ID NO: 1786767 - RNA, 16 nt, Homo sapiens
aggcucuagaucauaa

SEQ ID NO: 1786768 - RNA, 16 nt, Homo sapiens
uuucaaaggauaugca

SEQ ID NO: 1786769 - RNA, 20 nt, Homo sapiens
agagaaccauucccaagcca

SEQ ID NO: 1786770 - RNA, 21 nt, Homo sapiens
ggagggcccuccgaccacuuc

SEQ ID NO: 1786771 - RNA, 16 nt, Homo sapiens
caucucagugaagaau

SEQ ID NO: 1786772 - RNA, 21 nt, Homo sapiens
aaccagauggaacacuggaac

SEQ ID NO: 1786773 - RNA, 15 nt, Homo sapiens
ccaaauuauggcaaa

SEQ ID NO: 1786774 - RNA, 15 nt, Homo sapiens
ccucuaggaggagcu

SEQ ID NO: 1786775 - RNA, 17 nt, Homo sapiens
gggauccguacauucaa

SEQ ID NO: 1786776 - RNA, 20 nt, Homo sapiens
cucaccuucccuaguucuuu

SEQ ID NO: 1786777 - RNA, 20 nt, Homo sapiens
ucuuguuuccaaaaaccaug

SEQ ID NO: 1786778 - RNA, 21 nt, Homo sapiens
ucugaaguacuuaaacuucca

SEQ ID NO: 1786779 - RNA, 18 nt, Homo sapiens
cuggugacaccagccuuu

SEQ ID NO: 1786780 - RNA, 11 nt, Homo sapiens
uuuuuccuuag

SEQ ID NO: 1786781 - RNA, 15 nt, Homo sapiens
cccuaaacucaggag

SEQ ID NO: 1786782 - RNA, 16 nt, Homo sapiens
aguuguaguguuauca

SEQ ID NO: 1786783 - RNA, 12 nt, Homo sapiens
uaaaugcuuguu

SEQ ID NO: 1786784 - RNA, 14 nt, Homo sapiens
caccagaauguaua

SEQ ID NO: 1786785 - RNA, 12 nt, Homo sapiens
ugcuuugcugac

SEQ ID NO: 1786786 - RNA, 12 nt, Homo sapiens
aaaauguucucu

SEQ ID NO: 1786787 - RNA, 14 nt, Homo sapiens
agccauggggagca

SEQ ID NO: 1786788 - RNA, 21 nt, Homo sapiens
gcgguucauacgcaucccauc

SEQ ID NO: 1786789 - RNA, 15 nt, Homo sapiens
gauuaauguuuugua

SEQ ID NO: 1786790 - RNA, 23 nt, Homo sapiens
gcaccccaauugggaaugcaaua

SEQ ID NO: 1786791 - RNA, 15 nt, Homo sapiens
ucaagcuccccucac

SEQ ID NO: 1786792 - RNA, 15 nt, Homo sapiens
uggaagcucugaagu

SEQ ID NO: 1786793 - RNA, 14 nt, Homo sapiens
cuuuaaacuuggaa

SEQ ID NO: 1786794 - RNA, 12 nt, Homo sapiens
caguugugauac

SEQ ID NO: 1786795 - RNA, 22 nt, Homo sapiens
ccuagagaaggcugugagccaa

SEQ ID NO: 1786796 - RNA, 22 nt, Homo sapiens
agccauguaccacauaacaaca

SEQ ID NO: 1786797 - RNA, 18 nt, Homo sapiens
gaccuggggggagggaca

SEQ ID NO: 1786798 - RNA, 19 nt, Homo sapiens
gcaccacugcacuccagcu

SEQ ID NO: 1786799 - RNA, 20 nt, Homo sapiens
acccccggaacaagccuaaa

SEQ ID NO: 1786800 - RNA, 11 nt, Homo sapiens
ugggagcaaac

SEQ ID NO: 1786801 - RNA, 17 nt, Homo sapiens
ugggccccuggcacucu

SEQ ID NO: 1786802 - RNA, 20 nt, Homo sapiens
aagaaauauuaauauguacu

SEQ ID NO: 1786803 - RNA, 13 nt, Homo sapiens
aaaucacugucaa

SEQ ID NO: 1786804 - RNA, 14 nt, Homo sapiens
cuucauguguccca

SEQ ID NO: 1786805 - RNA, 13 nt, Homo sapiens
gcugaguacucag

SEQ ID NO: 1786806 - RNA, 23 nt, Homo sapiens
uggaagagauaaacgaccaaacu

SEQ ID NO: 1786807 - RNA, 20 nt, Homo sapiens
acauuaaaauaacuaagcaa

SEQ ID NO: 1786808 - RNA, 13 nt, Homo sapiens
ugauagaauacaa

SEQ ID NO: 1786809 - RNA, 14 nt, Homo sapiens
uuacgaaaccaaaa

SEQ ID NO: 1786810 - RNA, 18 nt, Homo sapiens
augcauuuugaguguuua

SEQ ID NO: 1786811 - RNA, 14 nt, Homo sapiens
gaagggcaggaaau

SEQ ID NO: 1786812 - RNA, 17 nt, Homo sapiens
aacuucuaguugcucuu

SEQ ID NO: 1786813 - RNA, 19 nt, Homo sapiens
auucgcuacuaugauuuaa

SEQ ID NO: 1786814 - RNA, 13 nt, Homo sapiens
caaaguaagccau

SEQ ID NO: 1786815 - RNA, 21 nt, Homo sapiens
agucacccagggacacuccaa

SEQ ID NO: 1786816 - RNA, 20 nt, Homo sapiens
gagaagaaacagcggcucca

SEQ ID NO: 1786817 - RNA, 15 nt, Homo sapiens
ggucaggcgcagugg

SEQ ID NO: 1786818 - RNA, 18 nt, Homo sapiens
aagugguaggaaagccuc

SEQ ID NO: 1786819 - RNA, 18 nt, Homo sapiens
aaaaucacaggacauuaa

SEQ ID NO: 1786820 - RNA, 21 nt, Homo sapiens
ugagugcugggcacugcucca

SEQ ID NO: 1786821 - RNA, 15 nt, Homo sapiens
agaucacccacuccu

SEQ ID NO: 1786822 - RNA, 20 nt, Homo sapiens
aagggccacaucccacugcc

SEQ ID NO: 1786823 - RNA, 18 nt, Homo sapiens
aggcaguauuuugugucc

SEQ ID NO: 1786824 - RNA, 17 nt, Homo sapiens
cacuuccccacagguga

SEQ ID NO: 1786825 - RNA, 13 nt, Homo sapiens
ccccaccacugau

SEQ ID NO: 1786826 - RNA, 18 nt, Homo sapiens
uuaacuuccaauuuacau

SEQ ID NO: 1786827 - RNA, 21 nt, Homo sapiens
auagagggagaggaagcacac

SEQ ID NO: 1786828 - RNA, 14 nt, Homo sapiens
agacugcuguguuu

SEQ ID NO: 1786829 - RNA, 17 nt, Homo sapiens
gugaagcaggucuuuca

SEQ ID NO: 1786830 - RNA, 20 nt, Homo sapiens
uuuucuacaugaugcccugc

SEQ ID NO: 1786831 - RNA, 12 nt, Homo sapiens
acauugcccaag

SEQ ID NO: 1786832 - RNA, 17 nt, Homo sapiens
uccucacacucacccaa

SEQ ID NO: 1786833 - RNA, 18 nt, Homo sapiens
uaugaaaagaggggacca

SEQ ID NO: 1786834 - RNA, 21 nt, Homo sapiens
aguuuacuuggaaauuguuaa

SEQ ID NO: 1786835 - RNA, 16 nt, Homo sapiens
uccuauugucauuaaa

SEQ ID NO: 1786836 - RNA, 19 nt, Homo sapiens
ccccgagcccaggcagcua

SEQ ID NO: 1786837 - RNA, 16 nt, Homo sapiens
aggcauauacaaauaa

SEQ ID NO: 1786838 - RNA, 12 nt, Homo sapiens
gugcuaccucuc

SEQ ID NO: 1786839 - RNA, 16 nt, Homo sapiens
cuauguguaugcagaa

SEQ ID NO: 1786840 - RNA, 14 nt, Homo sapiens
agccaccucaccaa

SEQ ID NO: 1786841 - RNA, 13 nt, Homo sapiens
guggaacuguaca

SEQ ID NO: 1786842 - RNA, 14 nt, Homo sapiens
cuucuaaucaaagc

SEQ ID NO: 1786843 - RNA, 14 nt, Homo sapiens
gcaucugcaacaaa

SEQ ID NO: 1786844 - RNA, 16 nt, Homo sapiens
aguugcaauguuuuag

SEQ ID NO: 1786845 - RNA, 22 nt, Homo sapiens
caguaaaucagugcaguacuca

SEQ ID NO: 1786846 - RNA, 16 nt, Homo sapiens
cuuguuaugcaucauu

SEQ ID NO: 1786847 - RNA, 18 nt, Homo sapiens
gguggcaaccccagaccc

SEQ ID NO: 1786848 - RNA, 23 nt, Homo sapiens
gccacuugguuuuuggcucuuuc

SEQ ID NO: 1786849 - RNA, 21 nt, Homo sapiens
aaauaccuuuucucacaaaaa

SEQ ID NO: 1786850 - RNA, 19 nt, Homo sapiens
ggagcuggaaauaaaccug

SEQ ID NO: 1786851 - RNA, 15 nt, Homo sapiens
acaguguacucuaua

SEQ ID NO: 1786852 - RNA, 20 nt, Homo sapiens
gcagcgucacucuaccuaau

SEQ ID NO: 1786853 - RNA, 18 nt, Homo sapiens
uucccugauugaccugcu

SEQ ID NO: 1786854 - RNA, 14 nt, Homo sapiens
uuucagcauugaua

SEQ ID NO: 1786855 - RNA, 14 nt, Homo sapiens
caggacacaggccu

SEQ ID NO: 1786856 - RNA, 19 nt, Homo sapiens
gagaagggauccuaauccc

SEQ ID NO: 1786857 - RNA, 15 nt, Homo sapiens
ugaauuaacuaucau

SEQ ID NO: 1786858 - RNA, 20 nt, Homo sapiens
ugguauccuuacuagauuca

SEQ ID NO: 1786859 - RNA, 14 nt, Homo sapiens
agugcuggucagag

SEQ ID NO: 1786860 - RNA, 14 nt, Homo sapiens
auuguucacuucua

SEQ ID NO: 1786861 - RNA, 15 nt, Homo sapiens
gcucuaaguaccuuu

SEQ ID NO: 1786862 - RNA, 18 nt, Homo sapiens
caggaugggucuccauuc

SEQ ID NO: 1786863 - RNA, 18 nt, Homo sapiens
ucucuauucuuuccauga

SEQ ID NO: 1786864 - RNA, 14 nt, Homo sapiens
gacagaaaaccuca

SEQ ID NO: 1786865 - RNA, 17 nt, Homo sapiens
guaaacauauaucuuac

SEQ ID NO: 1786866 - RNA, 14 nt, Homo sapiens
aaacuaagcacaaa

SEQ ID NO: 1786867 - RNA, 14 nt, Homo sapiens
accaacagccacuc

SEQ ID NO: 1786868 - RNA, 15 nt, Homo sapiens
aggcucugagacuaa

SEQ ID NO: 1786869 - RNA, 21 nt, Homo sapiens
cauguucuuguuuuguuauau

SEQ ID NO: 1786870 - RNA, 15 nt, Homo sapiens
ucuuacauuagcagu

SEQ ID NO: 1786871 - RNA, 19 nt, Homo sapiens
ccgaaacccuugacuguua

SEQ ID NO: 1786872 - RNA, 19 nt, Homo sapiens
caaguauguugagaguugc

SEQ ID NO: 1786873 - RNA, 23 nt, Homo sapiens
gcuuccugaaauaaacacuggug

SEQ ID NO: 1786874 - RNA, 18 nt, Homo sapiens
gcugcaggggcaugggaa

SEQ ID NO: 1786875 - RNA, 14 nt, Homo sapiens
aguguguaugugcg

SEQ ID NO: 1786876 - RNA, 21 nt, Homo sapiens
cacccugucuaggcacaugug

SEQ ID NO: 1786877 - RNA, 18 nt, Homo sapiens
ugaccccgaccucagaga

SEQ ID NO: 1786878 - RNA, 18 nt, Homo sapiens
cgacauggagaccaucua

SEQ ID NO: 1786879 - RNA, 22 nt, Homo sapiens
agaauccaguuugcaauuacuu

SEQ ID NO: 1786880 - RNA, 18 nt, Homo sapiens
cuugggugggugaaggcc

SEQ ID NO: 1786881 - RNA, 13 nt, Homo sapiens
ucaguccuggaag

SEQ ID NO: 1786882 - RNA, 23 nt, Homo sapiens
agcuauggacagcauugccagua

SEQ ID NO: 1786883 - RNA, 17 nt, Homo sapiens
ugaggagugaugggcaa

SEQ ID NO: 1786884 - RNA, 18 nt, Homo sapiens
ggcuccucucacuuccca

SEQ ID NO: 1786885 - RNA, 16 nt, Homo sapiens
acucauggccuugucu

SEQ ID NO: 1786886 - RNA, 21 nt, Homo sapiens
augugaauuauugacacugaa

SEQ ID NO: 1786887 - RNA, 16 nt, Homo sapiens
ugggucucaauccuua

SEQ ID NO: 1786888 - RNA, 17 nt, Homo sapiens
ucccagaucacacauca

SEQ ID NO: 1786889 - RNA, 14 nt, Homo sapiens
aaaauucugaguga

SEQ ID NO: 1786890 - RNA, 17 nt, Homo sapiens
auguuuuaagcugcuaa

SEQ ID NO: 1786891 - RNA, 16 nt, Homo sapiens
gcaacuggcucaaaga

SEQ ID NO: 1786892 - RNA, 18 nt, Homo sapiens
uccagucuccaccaggaa

SEQ ID NO: 1786893 - RNA, 21 nt, Homo sapiens
agaaucccuaagccuagcugg

SEQ ID NO: 1786894 - RNA, 21 nt, Homo sapiens
agacucccaccccagggauug

SEQ ID NO: 1786895 - RNA, 22 nt, Homo sapiens
acaggaccaccuccucugccag

SEQ ID NO: 1786896 - RNA, 23 nt, Homo sapiens
caggaaauauauaugugugugua

SEQ ID NO: 1786897 - RNA, 16 nt, Homo sapiens
ucauugcacugaucuu

SEQ ID NO: 1786898 - RNA, 18 nt, Homo sapiens
ccagcaugguaguggcaa

SEQ ID NO: 1786899 - RNA, 20 nt, Homo sapiens
uaaaaugaaauuacuacaaa

SEQ ID NO: 1786900 - RNA, 14 nt, Homo sapiens
aaguaccagcaugu

SEQ ID NO: 1786901 - RNA, 20 nt, Homo sapiens
ucuauauuagaucaaauagu

SEQ ID NO: 1786902 - RNA, 21 nt, Homo sapiens
aaaauaaucuaaacaccaaaa

SEQ ID NO: 1786903 - RNA, 13 nt, Homo sapiens
cacuggcuugaag

SEQ ID NO: 1786904 - RNA, 23 nt, Homo sapiens
gacaguacucuuaacuccuagcc

SEQ ID NO: 1786905 - RNA, 15 nt, Homo sapiens
caaagauuacaacuu

SEQ ID NO: 1786906 - RNA, 14 nt, Homo sapiens
aucucuauguauau

SEQ ID NO: 1786907 - RNA, 19 nt, Homo sapiens
gcaccauuucugucacuca

SEQ ID NO: 1786908 - RNA, 22 nt, Homo sapiens
aauuuaaaagacacuguuuaca

SEQ ID NO: 1786909 - RNA, 24 nt, Homo sapiens
guguugauaagcugcacaugacua

SEQ ID NO: 1786910 - RNA, 22 nt, Homo sapiens
caccuuugcuacgcaaggaaau

SEQ ID NO: 1786911 - RNA, 19 nt, Homo sapiens
augggagucugaaaugggg

SEQ ID NO: 1786912 - RNA, 21 nt, Homo sapiens
aggagguagcucccagcacuc

SEQ ID NO: 1786913 - RNA, 13 nt, Homo sapiens
cguaucucuagaa

SEQ ID NO: 1786914 - RNA, 15 nt, Homo sapiens
agcgugucaggcugu

SEQ ID NO: 1786915 - RNA, 14 nt, Homo sapiens
guggaaauaugcaa

SEQ ID NO: 1786916 - RNA, 13 nt, Homo sapiens
uucaauacuucau

SEQ ID NO: 1786917 - RNA, 13 nt, Homo sapiens
uuuguuacuuuga

SEQ ID NO: 1786918 - RNA, 12 nt, Homo sapiens
aaagacuauuaa

SEQ ID NO: 1786919 - RNA, 17 nt, Homo sapiens
uaaacacuguauuguaa

SEQ ID NO: 1786920 - RNA, 22 nt, Homo sapiens
caguauuuuccaaacuaccuuc

SEQ ID NO: 1786921 - RNA, 17 nt, Homo sapiens
uugggaacaggcugugu

SEQ ID NO: 1786922 - RNA, 16 nt, Homo sapiens
aguaaccagaauccaa

SEQ ID NO: 1786923 - RNA, 15 nt, Homo sapiens
ucugugguaauucca

SEQ ID NO: 1786924 - RNA, 23 nt, Homo sapiens
cauuauuucaaccgcuugccaua

SEQ ID NO: 1786925 - RNA, 21 nt, Homo sapiens
cugucucuaagucaauuccac

SEQ ID NO: 1786926 - RNA, 21 nt, Homo sapiens
uacccuccacacaaaccuaaa

SEQ ID NO: 1786927 - RNA, 16 nt, Homo sapiens
caucagccauuugcca

SEQ ID NO: 1786928 - RNA, 17 nt, Homo sapiens
augaaucuucccuguca

SEQ ID NO: 1786929 - RNA, 20 nt, Homo sapiens
uaugcaauuagccucauagu

SEQ ID NO: 1786930 - RNA, 16 nt, Homo sapiens
aaauguuacacauuaa

SEQ ID NO: 1786931 - RNA, 22 nt, Homo sapiens
ccugucacggagggauugaucu

SEQ ID NO: 1786932 - RNA, 13 nt, Homo sapiens
gaauuggguuucu

SEQ ID NO: 1786933 - RNA, 18 nt, Homo sapiens
aauggcucaucaacaauc

SEQ ID NO: 1786934 - RNA, 23 nt, Homo sapiens
uaaauauuacacaucaagcgaug

SEQ ID NO: 1786935 - RNA, 14 nt, Homo sapiens
cauaucauuaaaca

SEQ ID NO: 1786936 - RNA, 22 nt, Homo sapiens
agcuuggaguucucuauacuca

SEQ ID NO: 1786937 - RNA, 13 nt, Homo sapiens
ccucuauucaauu

SEQ ID NO: 1786938 - RNA, 18 nt, Homo sapiens
ggaaaggugacaguauua

SEQ ID NO: 1786939 - RNA, 15 nt, Homo sapiens
ucuucaauaugaagg

SEQ ID NO: 1786940 - RNA, 23 nt, Homo sapiens
cuaguccccagccugcucccuag

SEQ ID NO: 1786941 - RNA, 21 nt, Homo sapiens
ugaagggaugcugcaauguag

SEQ ID NO: 1786942 - RNA, 14 nt, Homo sapiens
uucaauaacaaagg

SEQ ID NO: 1786943 - RNA, 16 nt, Homo sapiens
guugagacuuagauaa

SEQ ID NO: 1786944 - RNA, 20 nt, Homo sapiens
augagcacacacacaccaau

SEQ ID NO: 1786945 - RNA, 18 nt, Homo sapiens
cacucagguggugccccu

SEQ ID NO: 1786946 - RNA, 21 nt, Homo sapiens
gcccaaggcccccaccucugu

SEQ ID NO: 1786947 - RNA, 18 nt, Homo sapiens
auggcugccaaugggagc

SEQ ID NO: 1786948 - RNA, 15 nt, Homo sapiens
caaugccuauaaaau

SEQ ID NO: 1786949 - RNA, 18 nt, Homo sapiens
caucagugcucuguaaaa

SEQ ID NO: 1786950 - RNA, 21 nt, Homo sapiens
ucccacgggaaaggagcugcu

SEQ ID NO: 1786951 - RNA, 19 nt, Homo sapiens
uugaauauuuguauacaca

SEQ ID NO: 1786952 - RNA, 11 nt, Homo sapiens
gagcuugacuu

SEQ ID NO: 1786953 - RNA, 13 nt, Homo sapiens
gcucugccucaga

SEQ ID NO: 1786954 - RNA, 23 nt, Homo sapiens
cauauuuggaagaaaaaaaucuu

SEQ ID NO: 1786955 - RNA, 19 nt, Homo sapiens
ugauauguaaguacuucca

SEQ ID NO: 1786956 - RNA, 13 nt, Homo sapiens
caagagagaugua

SEQ ID NO: 1786957 - RNA, 20 nt, Homo sapiens
ucacuacauugugcaauuga

SEQ ID NO: 1786958 - RNA, 16 nt, Homo sapiens
ugucgccaccacuucc

SEQ ID NO: 1786959 - RNA, 20 nt, Homo sapiens
cgggguuucaccauguuggc

SEQ ID NO: 1786960 - RNA, 21 nt, Homo sapiens
aaugugagucauuauguagcu

SEQ ID NO: 1786961 - RNA, 20 nt, Homo sapiens
uaccagugacuaauuuugcc

SEQ ID NO: 1786962 - RNA, 20 nt, Homo sapiens
acugcacacacagcuccucu

SEQ ID NO: 1786963 - RNA, 17 nt, Homo sapiens
ggcucacgccuguaauc

SEQ ID NO: 1786964 - RNA, 15 nt, Homo sapiens
ucugaauuugcaaag

SEQ ID NO: 1786965 - RNA, 16 nt, Homo sapiens
aacccaucagacaggu

SEQ ID NO: 1786966 - RNA, 23 nt, Homo sapiens
gguaggcucacuucucuuucccu

SEQ ID NO: 1786967 - RNA, 23 nt, Homo sapiens
uuuuaaauaaaaauaaguguaca

SEQ ID NO: 1786968 - RNA, 13 nt, Homo sapiens
gaaggacauuuua

SEQ ID NO: 1786969 - RNA, 14 nt, Homo sapiens
guaguugcucuuuc

SEQ ID NO: 1786970 - RNA, 22 nt, Homo sapiens
gcccagagggucugggggcaca

SEQ ID NO: 1786971 - RNA, 20 nt, Homo sapiens
aggcuaaaaaacggauuucc

SEQ ID NO: 1786972 - RNA, 19 nt, Homo sapiens
uuggguggcucacuacuga

SEQ ID NO: 1786973 - RNA, 20 nt, Homo sapiens
gggacccugcccagagcuga

SEQ ID NO: 1786974 - RNA, 19 nt, Homo sapiens
aacaccgagugaggccaua

SEQ ID NO: 1786975 - RNA, 23 nt, Homo sapiens
uuaguuuguuuuacaaauuuuuc

SEQ ID NO: 1786976 - RNA, 19 nt, Homo sapiens
ugcauuucuggaccuugag

SEQ ID NO: 1786977 - RNA, 15 nt, Homo sapiens
uguggccaucacuca

SEQ ID NO: 1786978 - RNA, 14 nt, Homo sapiens
aggucaacaucuaa

SEQ ID NO: 1786979 - RNA, 16 nt, Homo sapiens
uccugucccucaucca

SEQ ID NO: 1786980 - RNA, 17 nt, Homo sapiens
cagugcaucauuacugu

SEQ ID NO: 1786981 - RNA, 18 nt, Homo sapiens
uccuggccucaagggauc

SEQ ID NO: 1786982 - RNA, 21 nt, Homo sapiens
cauguucugugcauauagugu

SEQ ID NO: 1786983 - RNA, 19 nt, Homo sapiens
aagggaauguaacugcuga

SEQ ID NO: 1786984 - RNA, 16 nt, Homo sapiens
caccauguuagccuua

SEQ ID NO: 1786985 - RNA, 16 nt, Homo sapiens
acccccuccugucacc

SEQ ID NO: 1786986 - RNA, 21 nt, Homo sapiens
gagcccauuucaauucucaaa

SEQ ID NO: 1786987 - RNA, 13 nt, Homo sapiens
acaaaaaccaaac

SEQ ID NO: 1786988 - RNA, 13 nt, Homo sapiens
caagcaacacaga

SEQ ID NO: 1786989 - RNA, 21 nt, Homo sapiens
aagaguucuuaaggauuguga

SEQ ID NO: 1786990 - RNA, 15 nt, Homo sapiens
auacuauuuauauac

SEQ ID NO: 1786991 - RNA, 21 nt, Homo sapiens
agcuacuauguacugccuuag

SEQ ID NO: 1786992 - RNA, 19 nt, Homo sapiens
aaggaagcuccacugucac

SEQ ID NO: 1786993 - RNA, 18 nt, Homo sapiens
gugauauaaaagcugcau

SEQ ID NO: 1786994 - RNA, 16 nt, Homo sapiens
uguacuaguacugugu

SEQ ID NO: 1786995 - RNA, 22 nt, Homo sapiens
cuuugaaaacaccagcuguaua

SEQ ID NO: 1786996 - RNA, 15 nt, Homo sapiens
aaauuugaaugacaa

SEQ ID NO: 1786997 - RNA, 23 nt, Homo sapiens
ugaaaaggguguuagcuaaagga

SEQ ID NO: 1786998 - RNA, 20 nt, Homo sapiens
ugaacucagccaagcacagu

SEQ ID NO: 1786999 - RNA, 23 nt, Homo sapiens
ugccagacgcucauucagcaucu

SEQ ID NO: 1787000 - RNA, 17 nt, Homo sapiens
aaauugaaagcuuccau

SEQ ID NO: 1787001 - RNA, 19 nt, Homo sapiens
aaagacauuuguucuccca

SEQ ID NO: 1787002 - RNA, 22 nt, Homo sapiens
ugcccacagggaacacauuccu

SEQ ID NO: 1787003 - RNA, 17 nt, Homo sapiens
auucuagaaacaggaaa

SEQ ID NO: 1787004 - RNA, 17 nt, Homo sapiens
uuucaguugacaaaaua

SEQ ID NO: 1787005 - RNA, 20 nt, Homo sapiens
agacagugggcacuaagggu

SEQ ID NO: 1787006 - RNA, 15 nt, Homo sapiens
agagcgagacuccau

SEQ ID NO: 1787007 - RNA, 13 nt, Homo sapiens
uccuugaaucuuc

SEQ ID NO: 1787008 - RNA, 19 nt, Homo sapiens
auaaggccagaaacuccuu

SEQ ID NO: 1787009 - RNA, 17 nt, Homo sapiens
cuaagugacaguaucac

SEQ ID NO: 1787010 - RNA, 17 nt, Homo sapiens
auucggauguaugaucu

SEQ ID NO: 1787011 - RNA, 13 nt, Homo sapiens
cuaauuaaacaca

SEQ ID NO: 1787012 - RNA, 23 nt, Homo sapiens
aaagcaauucuaguguaaaucau

SEQ ID NO: 1787013 - RNA, 14 nt, Homo sapiens
gcuucucuuucuaa

SEQ ID NO: 1787014 - RNA, 20 nt, Homo sapiens
aaccucggcuccuggacuca

SEQ ID NO: 1787015 - RNA, 13 nt, Homo sapiens
ucaauuacuaauu

SEQ ID NO: 1787016 - RNA, 13 nt, Homo sapiens
uauuauacucuaa

SEQ ID NO: 1787017 - RNA, 20 nt, Homo sapiens
gccucuuuuaccugcugcuu

SEQ ID NO: 1787018 - RNA, 13 nt, Homo sapiens
gaagugaacacuu

SEQ ID NO: 1787019 - RNA, 17 nt, Homo sapiens
aggcagggcaaaugaca

SEQ ID NO: 1787020 - RNA, 14 nt, Homo sapiens
auccaaaaguucaa

SEQ ID NO: 1787021 - RNA, 15 nt, Homo sapiens
auucucguuuaaaca

SEQ ID NO: 1787022 - RNA, 18 nt, Homo sapiens
gcugccgccacccugcga

SEQ ID NO: 1787023 - RNA, 23 nt, Homo sapiens
guauguuagugcaaauugucaca

SEQ ID NO: 1787024 - RNA, 21 nt, Homo sapiens
caaaaaugaaagcaugucuca

SEQ ID NO: 1787025 - RNA, 21 nt, Homo sapiens
cccaggaaagguuuuccuuau

SEQ ID NO: 1787026 - RNA, 16 nt, Homo sapiens
gcuacuccauccugaa

SEQ ID NO: 1787027 - RNA, 17 nt, Homo sapiens
aaugaaccaauaugaac

SEQ ID NO: 1787028 - RNA, 18 nt, Homo sapiens
ugggaacuucuaaacacu

SEQ ID NO: 1787029 - RNA, 22 nt, Homo sapiens
ucucgggugcccugcauucaca

SEQ ID NO: 1787030 - RNA, 16 nt, Homo sapiens
aacgguuuuuagucuc

SEQ ID NO: 1787031 - RNA, 20 nt, Homo sapiens
acugcaccauugcugcuccu

SEQ ID NO: 1787032 - RNA, 12 nt, Homo sapiens
aucuucuuccau

SEQ ID NO: 1787033 - RNA, 17 nt, Homo sapiens
uagaauguaaaugucuc

SEQ ID NO: 1787034 - RNA, 19 nt, Homo sapiens
ugaauuucuccgaauguca

SEQ ID NO: 1787035 - RNA, 23 nt, Homo sapiens
gacacauuuuuaaaaugcaacau

SEQ ID NO: 1787036 - RNA, 12 nt, Homo sapiens
ugugcagaauaa

SEQ ID NO: 1787037 - RNA, 11 nt, Homo sapiens
acuucuaguuu

SEQ ID NO: 1787038 - RNA, 16 nt, Homo sapiens
ccucuggguuccagca

SEQ ID NO: 1787039 - RNA, 20 nt, Homo sapiens
cugaaauuuaacugccuaaa

SEQ ID NO: 1787040 - RNA, 17 nt, Homo sapiens
augguguggguguccug

SEQ ID NO: 1787041 - RNA, 17 nt, Homo sapiens
gauggugcccuguucuc

SEQ ID NO: 1787042 - RNA, 15 nt, Homo sapiens
agcccagaaggccag

SEQ ID NO: 1787043 - RNA, 19 nt, Homo sapiens
aacuuuuuucuuacugucu

SEQ ID NO: 1787044 - RNA, 21 nt, Homo sapiens
aggauucagggaauauuccag

SEQ ID NO: 1787045 - RNA, 19 nt, Homo sapiens
aaagcgugguggacaugca

SEQ ID NO: 1787046 - RNA, 18 nt, Homo sapiens
agauaaucagugugucua

SEQ ID NO: 1787047 - RNA, 21 nt, Homo sapiens
gaaauaguacuuacaaaugac

SEQ ID NO: 1787048 - RNA, 15 nt, Homo sapiens
uauaucuauauguac

SEQ ID NO: 1787049 - RNA, 18 nt, Homo sapiens
aagaagcuucaugccagg

SEQ ID NO: 1787050 - RNA, 14 nt, Homo sapiens
cucugacacauuag

SEQ ID NO: 1787051 - RNA, 15 nt, Homo sapiens
uucacugguguacau

SEQ ID NO: 1787052 - RNA, 20 nt, Homo sapiens
guggcagcggggcaagcaaa

SEQ ID NO: 1787053 - RNA, 14 nt, Homo sapiens
cucuauguaugcau

SEQ ID NO: 1787054 - RNA, 20 nt, Homo sapiens
caaaauucacuaaucuugaa

SEQ ID NO: 1787055 - RNA, 20 nt, Homo sapiens
cuaauuuuuaugaugcaaau

SEQ ID NO: 1787056 - RNA, 12 nt, Homo sapiens
agaauagcuuau

SEQ ID NO: 1787057 - RNA, 21 nt, Homo sapiens
caucucagguggcauuugcag

SEQ ID NO: 1787058 - RNA, 19 nt, Homo sapiens
guaacuggaaucucaaaag

SEQ ID NO: 1787059 - RNA, 22 nt, Homo sapiens
cugcuuggcaauaguuaaguca

SEQ ID NO: 1787060 - RNA, 20 nt, Homo sapiens
cauauuucuuuucuaucuca

SEQ ID NO: 1787061 - RNA, 18 nt, Homo sapiens
uagcagaaaaaccaacau

SEQ ID NO: 1787062 - RNA, 19 nt, Homo sapiens
ugcuauagaaaacaauaca

SEQ ID NO: 1787063 - RNA, 21 nt, Homo sapiens
caaugcuucuguugaucucag

SEQ ID NO: 1787064 - RNA, 16 nt, Homo sapiens
gaguauuuauugucag

SEQ ID NO: 1787065 - RNA, 18 nt, Homo sapiens
gauguacuauaacauaga

SEQ ID NO: 1787066 - RNA, 21 nt, Homo sapiens
acgagacacccuaacucuugc

SEQ ID NO: 1787067 - RNA, 19 nt, Homo sapiens
cuuguagcuguuacugcaa

SEQ ID NO: 1787068 - RNA, 21 nt, Homo sapiens
gguaauaauuuuuuugucagu

SEQ ID NO: 1787069 - RNA, 15 nt, Homo sapiens
uauaaauguacuaca

SEQ ID NO: 1787070 - RNA, 15 nt, Homo sapiens
accuccuugcacaaa

SEQ ID NO: 1787071 - RNA, 16 nt, Homo sapiens
uacuucauuucuagag

SEQ ID NO: 1787072 - RNA, 18 nt, Homo sapiens
uuaugauggagcaacuga

SEQ ID NO: 1787073 - RNA, 17 nt, Homo sapiens
agcgcuuuuccuuggca

SEQ ID NO: 1787074 - RNA, 19 nt, Homo sapiens
aaaaguacuaauagaacuu

SEQ ID NO: 1787075 - RNA, 20 nt, Homo sapiens
ucagcuccgugaacuuguga

SEQ ID NO: 1787076 - RNA, 23 nt, Homo sapiens
ugagacucagacaggaaagggaa

SEQ ID NO: 1787077 - RNA, 19 nt, Homo sapiens
acugugaaggaacucugca

SEQ ID NO: 1787078 - RNA, 22 nt, Homo sapiens
aguccacuuguucuguacuugu

SEQ ID NO: 1787079 - RNA, 17 nt, Homo sapiens
gccucaagucacuccca

SEQ ID NO: 1787080 - RNA, 15 nt, Homo sapiens
gaagggucacuuuaa

SEQ ID NO: 1787081 - RNA, 18 nt, Homo sapiens
guuuuauauguaguacua

SEQ ID NO: 1787082 - RNA, 17 nt, Homo sapiens
gccacgggcacaagacc

SEQ ID NO: 1787083 - RNA, 18 nt, Homo sapiens
gcaguuuggagucacugu

SEQ ID NO: 1787084 - RNA, 18 nt, Homo sapiens
aguggcaucaucucagcu

SEQ ID NO: 1787085 - RNA, 22 nt, Homo sapiens
uaaccgucaauaggcaaagggg

SEQ ID NO: 1787086 - RNA, 13 nt, Homo sapiens
cugggcccuaggc

SEQ ID NO: 1787087 - RNA, 16 nt, Homo sapiens
agaaguugcaagacuc

SEQ ID NO: 1787088 - RNA, 17 nt, Homo sapiens
guaacuggaacacacuu

SEQ ID NO: 1787089 - RNA, 20 nt, Homo sapiens
aagccacagcagguccucca

SEQ ID NO: 1787090 - RNA, 18 nt, Homo sapiens
ugacgacugcaaagccag

SEQ ID NO: 1787091 - RNA, 16 nt, Homo sapiens
agggagguaacgggug

SEQ ID NO: 1787092 - RNA, 14 nt, Homo sapiens
ugaggcaaaggcca

SEQ ID NO: 1787093 - RNA, 12 nt, Homo sapiens
cuuuaauguugu

SEQ ID NO: 1787094 - RNA, 17 nt, Homo sapiens
gugguuucccaucucca

SEQ ID NO: 1787095 - RNA, 12 nt, Homo sapiens
agaauugcacau

SEQ ID NO: 1787096 - RNA, 17 nt, Homo sapiens
ggaaaugagaacauucc

SEQ ID NO: 1787097 - RNA, 21 nt, Homo sapiens
ccuccaaaguagcugggauua

SEQ ID NO: 1787098 - RNA, 21 nt, Homo sapiens
auccccaccccagcuguuacc

SEQ ID NO: 1787099 - RNA, 17 nt, Homo sapiens
uagccaggcgugguggu

SEQ ID NO: 1787100 - RNA, 20 nt, Homo sapiens
aggggaccuggagcugccag

SEQ ID NO: 1787101 - RNA, 23 nt, Homo sapiens
auacaguauaccuggcaauucac

SEQ ID NO: 1787102 - RNA, 15 nt, Homo sapiens
acaggcguucucagc

SEQ ID NO: 1787103 - RNA, 21 nt, Homo sapiens
gaacacacagacuuucuguga

SEQ ID NO: 1787104 - RNA, 12 nt, Homo sapiens
cuggagcugcca

SEQ ID NO: 1787105 - RNA, 15 nt, Homo sapiens
guucuucagggccag

SEQ ID NO: 1787106 - RNA, 23 nt, Homo sapiens
uacaggcacccaccaccaugccc

SEQ ID NO: 1787107 - RNA, 20 nt, Homo sapiens
auuuuauaugaugggggaaa

SEQ ID NO: 1787108 - RNA, 18 nt, Homo sapiens
uguucggguuaagugaug

SEQ ID NO: 1787109 - RNA, 16 nt, Homo sapiens
uacuuucuaugugaca

SEQ ID NO: 1787110 - RNA, 15 nt, Homo sapiens
gaagcuuccauaaca

SEQ ID NO: 1787111 - RNA, 18 nt, Homo sapiens
accguguggcccaagacc

SEQ ID NO: 1787112 - RNA, 17 nt, Homo sapiens
aaaugggagacagccuc

SEQ ID NO: 1787113 - RNA, 21 nt, Homo sapiens
caagauggggcgagccaggac

SEQ ID NO: 1787114 - RNA, 15 nt, Homo sapiens
ggcaaaugcccuuca

SEQ ID NO: 1787115 - RNA, 17 nt, Homo sapiens
aaauuuuaauguuaacu

SEQ ID NO: 1787116 - RNA, 21 nt, Homo sapiens
aaucagugaagccaaagggac

SEQ ID NO: 1787117 - RNA, 13 nt, Homo sapiens
caguaaacauaaa

SEQ ID NO: 1787118 - RNA, 22 nt, Homo sapiens
uuuguuuauuuaaaaugccuau

SEQ ID NO: 1787119 - RNA, 23 nt, Homo sapiens
uggaaccaaagcuggcccaguug

SEQ ID NO: 1787120 - RNA, 15 nt, Homo sapiens
ccugcacagugacuu

SEQ ID NO: 1787121 - RNA, 16 nt, Homo sapiens
cuggaagccagagaaa

SEQ ID NO: 1787122 - RNA, 17 nt, Homo sapiens
uauuccaccauucacau

SEQ ID NO: 1787123 - RNA, 15 nt, Homo sapiens
uuacaaaaugccaag

SEQ ID NO: 1787124 - RNA, 20 nt, Homo sapiens
cucucccacgggaccugggg

SEQ ID NO: 1787125 - RNA, 18 nt, Homo sapiens
cuaucauauauacuguau

SEQ ID NO: 1787126 - RNA, 19 nt, Homo sapiens
gauugucaccaugaucacu

SEQ ID NO: 1787127 - RNA, 16 nt, Homo sapiens
ucagccagccucgccc

SEQ ID NO: 1787128 - RNA, 21 nt, Homo sapiens
aaaggauaaugaauacuuuau

SEQ ID NO: 1787129 - RNA, 17 nt, Homo sapiens
ccuuuccugaugccccu

SEQ ID NO: 1787130 - RNA, 20 nt, Homo sapiens
uaagacauaaacaaagacau

SEQ ID NO: 1787131 - RNA, 18 nt, Homo sapiens
gaagagauuuuucaugau

SEQ ID NO: 1787132 - RNA, 21 nt, Homo sapiens
agaaccaagaacauaaacccu

SEQ ID NO: 1787133 - RNA, 15 nt, Homo sapiens
aaauugccuaaagag

SEQ ID NO: 1787134 - RNA, 18 nt, Homo sapiens
agcaggucugcaggccac

SEQ ID NO: 1787135 - RNA, 12 nt, Homo sapiens
auucuuugauau

SEQ ID NO: 1787136 - RNA, 16 nt, Homo sapiens
acucaggcuggaguac

SEQ ID NO: 1787137 - RNA, 18 nt, Homo sapiens
agagguuugucaacacaa

SEQ ID NO: 1787138 - RNA, 12 nt, Homo sapiens
auaaucuuucaa

SEQ ID NO: 1787139 - RNA, 14 nt, Homo sapiens
auuauuugugcuac

SEQ ID NO: 1787140 - RNA, 17 nt, Homo sapiens
ucgggcuggugucuuga

SEQ ID NO: 1787141 - RNA, 18 nt, Homo sapiens
uguaucuuuaaagacuug

SEQ ID NO: 1787142 - RNA, 18 nt, Homo sapiens
auugcaguucauacugaa

SEQ ID NO: 1787143 - RNA, 18 nt, Homo sapiens
agaaucuguguagacgaa

SEQ ID NO: 1787144 - RNA, 13 nt, Homo sapiens
uaaauaaugcaua

SEQ ID NO: 1787145 - RNA, 23 nt, Homo sapiens
auuucugaagaaguuaauucuua

SEQ ID NO: 1787146 - RNA, 19 nt, Homo sapiens
uacacauaugaacgcacaa

SEQ ID NO: 1787147 - RNA, 14 nt, Homo sapiens
uuuucagcaaaaau

SEQ ID NO: 1787148 - RNA, 15 nt, Homo sapiens
cucauggcacccagg

SEQ ID NO: 1787149 - RNA, 19 nt, Homo sapiens
ucaaaacuucagaugacaa

SEQ ID NO: 1787150 - RNA, 12 nt, Homo sapiens
gauccuccaggu

SEQ ID NO: 1787151 - RNA, 17 nt, Homo sapiens
ugaaaagaaaaagccac

SEQ ID NO: 1787152 - RNA, 14 nt, Homo sapiens
aaaauaaugcaaau

SEQ ID NO: 1787153 - RNA, 19 nt, Homo sapiens
cacugcauaccaaccuggg

SEQ ID NO: 1787154 - RNA, 15 nt, Homo sapiens
gcagccagcacccac

SEQ ID NO: 1787155 - RNA, 13 nt, Homo sapiens
cacuugcucuuug

SEQ ID NO: 1787156 - RNA, 19 nt, Homo sapiens
caugagauucauucaguua

SEQ ID NO: 1787157 - RNA, 19 nt, Homo sapiens
uuaauuuccuuuuugacac

SEQ ID NO: 1787158 - RNA, 21 nt, Homo sapiens
guuucuacuuccccauuucag

SEQ ID NO: 1787159 - RNA, 17 nt, Homo sapiens
gauuguggaaaauggag

SEQ ID NO: 1787160 - RNA, 15 nt, Homo sapiens
acuucaucaaucaaa

SEQ ID NO: 1787161 - RNA, 10 nt, Homo sapiens
aaauccacua

SEQ ID NO: 1787162 - RNA, 20 nt, Homo sapiens
agaauguguuucaaaaccau

SEQ ID NO: 1787163 - RNA, 12 nt, Homo sapiens
cuuuauaugcag

SEQ ID NO: 1787164 - RNA, 20 nt, Homo sapiens
ccuucccuuuuuuuguuauu

SEQ ID NO: 1787165 - RNA, 13 nt, Homo sapiens
cacccaccuccac

SEQ ID NO: 1787166 - RNA, 22 nt, Homo sapiens
acaguaauuauuauuuaacucu

SEQ ID NO: 1787167 - RNA, 16 nt, Homo sapiens
ucaccagcagacacug

SEQ ID NO: 1787168 - RNA, 22 nt, Homo sapiens
cagagcgccccucccuagugac

SEQ ID NO: 1787169 - RNA, 20 nt, Homo sapiens
gaaucacucauuuauuucca

SEQ ID NO: 1787170 - RNA, 22 nt, Homo sapiens
ugacaguuaauaaaccuuugca

SEQ ID NO: 1787171 - RNA, 20 nt, Homo sapiens
gaaggugcugacaaagauga

SEQ ID NO: 1787172 - RNA, 20 nt, Homo sapiens
aucccuacauguauugcaca

SEQ ID NO: 1787173 - RNA, 15 nt, Homo sapiens
ugcacugacagccuu

SEQ ID NO: 1787174 - RNA, 22 nt, Homo sapiens
auaagugaagugauacuaucca

SEQ ID NO: 1787175 - RNA, 17 nt, Homo sapiens
ccuuuuaccacucccag

SEQ ID NO: 1787176 - RNA, 12 nt, Homo sapiens
gacuugaauaac

SEQ ID NO: 1787177 - RNA, 15 nt, Homo sapiens
cggauacacacucga

SEQ ID NO: 1787178 - RNA, 20 nt, Homo sapiens
cucauuacuacucagccuuc

SEQ ID NO: 1787179 - RNA, 17 nt, Homo sapiens
gguuaugugaguguugu

SEQ ID NO: 1787180 - RNA, 17 nt, Homo sapiens
cagcccaacaucuccag

SEQ ID NO: 1787181 - RNA, 13 nt, Homo sapiens
agacuacuguuca

SEQ ID NO: 1787182 - RNA, 13 nt, Homo sapiens
caggcuacacuga

SEQ ID NO: 1787183 - RNA, 17 nt, Homo sapiens
aggcucuggagccagag

SEQ ID NO: 1787184 - RNA, 12 nt, Homo sapiens
ggagccaugaca

SEQ ID NO: 1787185 - RNA, 19 nt, Homo sapiens
auguauuacaaauggugaa

SEQ ID NO: 1787186 - RNA, 12 nt, Homo sapiens
ucacuugcacau

SEQ ID NO: 1787187 - RNA, 15 nt, Homo sapiens
uccaacagacagggc

SEQ ID NO: 1787188 - RNA, 14 nt, Homo sapiens
gaugacuguugaug

SEQ ID NO: 1787189 - RNA, 20 nt, Homo sapiens
agguuguggggccucaggcu

SEQ ID NO: 1787190 - RNA, 12 nt, Homo sapiens
acacagcaucag

SEQ ID NO: 1787191 - RNA, 22 nt, Homo sapiens
uauucuguuggccagugugaca

SEQ ID NO: 1787192 - RNA, 19 nt, Homo sapiens
aaggccacaugucaccgug

SEQ ID NO: 1787193 - RNA, 20 nt, Homo sapiens
ucccuuuaucauguguuucu

SEQ ID NO: 1787194 - RNA, 18 nt, Homo sapiens
agcaugugcaauaugcca

SEQ ID NO: 1787195 - RNA, 15 nt, Homo sapiens
cugcagugaugcaau

SEQ ID NO: 1787196 - RNA, 21 nt, Homo sapiens
acucagugauugcaauuugca

SEQ ID NO: 1787197 - RNA, 16 nt, Homo sapiens
aacacuauccaaugaa

SEQ ID NO: 1787198 - RNA, 22 nt, Homo sapiens
agcaugaucaguguaugcgaaa

SEQ ID NO: 1787199 - RNA, 21 nt, Homo sapiens
agcaaggagccccccaaagac

SEQ ID NO: 1787200 - RNA, 22 nt, Homo sapiens
uugucaagcaguagacaagcaa

SEQ ID NO: 1787201 - RNA, 17 nt, Homo sapiens
ucuucuuacuggugcua

SEQ ID NO: 1787202 - RNA, 12 nt, Homo sapiens
gucccucggagc

SEQ ID NO: 1787203 - RNA, 21 nt, Homo sapiens
uaacacacccugcuucauuga

SEQ ID NO: 1787204 - RNA, 13 nt, Homo sapiens
cugucggcugcuu

SEQ ID NO: 1787205 - RNA, 21 nt, Homo sapiens
uccuauuuagauggccaugaa

SEQ ID NO: 1787206 - RNA, 19 nt, Homo sapiens
cugauugcgcaaaacugaa

SEQ ID NO: 1787207 - RNA, 19 nt, Homo sapiens
aauuuuuaaaucauuucau

SEQ ID NO: 1787208 - RNA, 13 nt, Homo sapiens
aguguucuacacc

SEQ ID NO: 1787209 - RNA, 17 nt, Homo sapiens
agggguuaaugcagaug

SEQ ID NO: 1787210 - RNA, 18 nt, Homo sapiens
uagggccucauuugcucu

SEQ ID NO: 1787211 - RNA, 14 nt, Homo sapiens
uauauccuauauag

SEQ ID NO: 1787212 - RNA, 22 nt, Homo sapiens
ugccugaauaaaguaaugccuc

SEQ ID NO: 1787213 - RNA, 13 nt, Homo sapiens
uaaugcuuuuuga

SEQ ID NO: 1787214 - RNA, 18 nt, Homo sapiens
aacuguuuuagaccuaua

SEQ ID NO: 1787215 - RNA, 15 nt, Homo sapiens
caugcuuccuugccu

SEQ ID NO: 1787216 - RNA, 13 nt, Homo sapiens
cacagccauuuca

SEQ ID NO: 1787217 - RNA, 17 nt, Homo sapiens
guccugaaacaugaacc

SEQ ID NO: 1787218 - RNA, 15 nt, Homo sapiens
cugccagucacgagc

SEQ ID NO: 1787219 - RNA, 17 nt, Homo sapiens
acugacugaaugcuguu

SEQ ID NO: 1787220 - RNA, 13 nt, Homo sapiens
uuacuaaugaugc

SEQ ID NO: 1787221 - RNA, 15 nt, Homo sapiens
cagauucacacuguc

SEQ ID NO: 1787222 - RNA, 19 nt, Homo sapiens
aaacaggcuguaauuccau

SEQ ID NO: 1787223 - RNA, 22 nt, Homo sapiens
cugcacccuggauuugcauaca

SEQ ID NO: 1787224 - RNA, 15 nt, Homo sapiens
uacaagaaccugcua

SEQ ID NO: 1787225 - RNA, 13 nt, Homo sapiens
acuccccucaaaa

SEQ ID NO: 1787226 - RNA, 15 nt, Homo sapiens
ccuuuccccccucac

SEQ ID NO: 1787227 - RNA, 15 nt, Homo sapiens
cacuuaaccauucca

SEQ ID NO: 1787228 - RNA, 16 nt, Homo sapiens
acaaaacaccaaagaa

SEQ ID NO: 1787229 - RNA, 17 nt, Homo sapiens
ugaaucuauuauacugu

SEQ ID NO: 1787230 - RNA, 14 nt, Homo sapiens
accacuauucuuaa

SEQ ID NO: 1787231 - RNA, 13 nt, Homo sapiens
aagaaaaucauua

SEQ ID NO: 1787232 - RNA, 22 nt, Homo sapiens
ugacuguaagaaacugugcacc

SEQ ID NO: 1787233 - RNA, 15 nt, Homo sapiens
ucccaucugugaaag

SEQ ID NO: 1787234 - RNA, 16 nt, Homo sapiens
cacuacucagugcaua

SEQ ID NO: 1787235 - RNA, 19 nt, Homo sapiens
uccaauucgaaaacaaccg

SEQ ID NO: 1787236 - RNA, 20 nt, Homo sapiens
gaacucucagacaucucuuu

SEQ ID NO: 1787237 - RNA, 15 nt, Homo sapiens
ucauacugucuggga

SEQ ID NO: 1787238 - RNA, 20 nt, Homo sapiens
ugggguaggaggaugggcuc

SEQ ID NO: 1787239 - RNA, 22 nt, Homo sapiens
uaugacauaaaaacaacuuuau

SEQ ID NO: 1787240 - RNA, 17 nt, Homo sapiens
cuugggacauugcaauu

SEQ ID NO: 1787241 - RNA, 21 nt, Homo sapiens
gcugugaauauuccuaacuua

SEQ ID NO: 1787242 - RNA, 17 nt, Homo sapiens
guguccaugccuuccau

SEQ ID NO: 1787243 - RNA, 17 nt, Homo sapiens
gaaagggugagacucca

SEQ ID NO: 1787244 - RNA, 22 nt, Homo sapiens
cugccugggccucccaaagugc

SEQ ID NO: 1787245 - RNA, 19 nt, Homo sapiens
agaugggccugugugcacc

SEQ ID NO: 1787246 - RNA, 15 nt, Homo sapiens
uucagggagcucgca

SEQ ID NO: 1787247 - RNA, 16 nt, Homo sapiens
uucuuuccaauagcaa

SEQ ID NO: 1787248 - RNA, 15 nt, Homo sapiens
uuugaaucaauguau

SEQ ID NO: 1787249 - RNA, 20 nt, Homo sapiens
agcgugacaauauacuucac

SEQ ID NO: 1787250 - RNA, 18 nt, Homo sapiens
cccuaagcgcacauucau

SEQ ID NO: 1787251 - RNA, 18 nt, Homo sapiens
cugaaacaugaacccaaa

SEQ ID NO: 1787252 - RNA, 17 nt, Homo sapiens
gugcgugugcgugcaug

SEQ ID NO: 1787253 - RNA, 14 nt, Homo sapiens
aaauguucugucaa

SEQ ID NO: 1787254 - RNA, 13 nt, Homo sapiens
uuauaauuggaag

SEQ ID NO: 1787255 - RNA, 16 nt, Homo sapiens
uauacauuuacuguga

SEQ ID NO: 1787256 - RNA, 19 nt, Homo sapiens
gagugcugggcacugcucc

SEQ ID NO: 1787257 - RNA, 15 nt, Homo sapiens
cuguagguugcacac

SEQ ID NO: 1787258 - RNA, 18 nt, Homo sapiens
uuguucacuagacugugc

SEQ ID NO: 1787259 - RNA, 13 nt, Homo sapiens
ugacauaauaaua

SEQ ID NO: 1787260 - RNA, 23 nt, Homo sapiens
uaacauaaauuuaucaucucgac

SEQ ID NO: 1787261 - RNA, 22 nt, Homo sapiens
uguaaguuuaccuauguaacaa

SEQ ID NO: 1787262 - RNA, 17 nt, Homo sapiens
caccacaucucuaucug

SEQ ID NO: 1787263 - RNA, 17 nt, Homo sapiens
aauagaaaccauuuuca

SEQ ID NO: 1787264 - RNA, 21 nt, Homo sapiens
acucagcuauaccucauucac

SEQ ID NO: 1787265 - RNA, 19 nt, Homo sapiens
uauacaaguuguucuagua

SEQ ID NO: 1787266 - RNA, 20 nt, Homo sapiens
gaucacgccauuguacucca

SEQ ID NO: 1787267 - RNA, 20 nt, Homo sapiens
gaucgugccauuacacucca

SEQ ID NO: 1787268 - RNA, 12 nt, Homo sapiens
aaugcauagcau

SEQ ID NO: 1787269 - RNA, 14 nt, Homo sapiens
ccccaggggcgagu

SEQ ID NO: 1787270 - RNA, 20 nt, Homo sapiens
cuuugaaguggcaccuaaua

SEQ ID NO: 1787271 - RNA, 20 nt, Homo sapiens
aauucauuuuuuucacugga

SEQ ID NO: 1787272 - RNA, 15 nt, Homo sapiens
guucucuucuucauu

SEQ ID NO: 1787273 - RNA, 18 nt, Homo sapiens
acuaccauugcuguucua

SEQ ID NO: 1787274 - RNA, 23 nt, Homo sapiens
cuucucauguuaaauauuugucc

SEQ ID NO: 1787275 - RNA, 17 nt, Homo sapiens
ucuucacaaaacacuuc

SEQ ID NO: 1787276 - RNA, 21 nt, Homo sapiens
guuuuacaguguuucuggcuu

SEQ ID NO: 1787277 - RNA, 21 nt, Homo sapiens
acagucacucagccauuucua

SEQ ID NO: 1787278 - RNA, 20 nt, Homo sapiens
aauauaggauagacacugga

SEQ ID NO: 1787279 - RNA, 23 nt, Homo sapiens
cuuuucuccuccgccugugucca

SEQ ID NO: 1787280 - RNA, 22 nt, Homo sapiens
acaauuaaaaugacaagcacua

SEQ ID NO: 1787281 - RNA, 18 nt, Homo sapiens
guuuggggacaugugauu

SEQ ID NO: 1787282 - RNA, 16 nt, Homo sapiens
agaaaucaggccuugc

SEQ ID NO: 1787283 - RNA, 15 nt, Homo sapiens
cauaaagcauguuuc

SEQ ID NO: 1787284 - RNA, 17 nt, Homo sapiens
auaaagagacagugaua

SEQ ID NO: 1787285 - RNA, 17 nt, Homo sapiens
ugcaaaugcuauauugc

SEQ ID NO: 1787286 - RNA, 14 nt, Homo sapiens
augugaaacacuuu

SEQ ID NO: 1787287 - RNA, 18 nt, Homo sapiens
acagaaggcaaaguuuac

SEQ ID NO: 1787288 - RNA, 14 nt, Homo sapiens
gugagcaguggaca

SEQ ID NO: 1787289 - RNA, 20 nt, Homo sapiens
caaauccuugaauguucucu

SEQ ID NO: 1787290 - RNA, 20 nt, Homo sapiens
gcucuuggcuggacccagcc

SEQ ID NO: 1787291 - RNA, 15 nt, Homo sapiens
guuaccaacuaccua

SEQ ID NO: 1787292 - RNA, 20 nt, Homo sapiens
uugggucuguagcaccuugc

SEQ ID NO: 1787293 - RNA, 15 nt, Homo sapiens
aauugcucaaugcau

SEQ ID NO: 1787294 - RNA, 21 nt, Homo sapiens
ugcucuuugauucaaagcacu

SEQ ID NO: 1787295 - RNA, 14 nt, Homo sapiens
gaccaguuucuuga

SEQ ID NO: 1787296 - RNA, 17 nt, Homo sapiens
cucuagggccucagucu

SEQ ID NO: 1787297 - RNA, 19 nt, Homo sapiens
aagaugccuuaauccauuc

SEQ ID NO: 1787298 - RNA, 12 nt, Homo sapiens
uuucaaccauaa

SEQ ID NO: 1787299 - RNA, 23 nt, Homo sapiens
guuuuuggaauuaugucugcuga

SEQ ID NO: 1787300 - RNA, 23 nt, Homo sapiens
ucuaauuagaaauuuauauguca

SEQ ID NO: 1787301 - RNA, 23 nt, Homo sapiens
uucuaaagauggaaaaaccaccc

SEQ ID NO: 1787302 - RNA, 12 nt, Homo sapiens
ucauauguauuu

SEQ ID NO: 1787303 - RNA, 20 nt, Homo sapiens
agaguacuuaauauacucag

SEQ ID NO: 1787304 - RNA, 19 nt, Homo sapiens
caauacauauaucuacaca

SEQ ID NO: 1787305 - RNA, 16 nt, Homo sapiens
cugaguccugagcgaa

SEQ ID NO: 1787306 - RNA, 16 nt, Homo sapiens
gagauaagucuuucau

SEQ ID NO: 1787307 - RNA, 15 nt, Homo sapiens
aaucucuuuaccucc

SEQ ID NO: 1787308 - RNA, 19 nt, Homo sapiens
cauaaccuugaauaaugag

SEQ ID NO: 1787309 - RNA, 12 nt, Homo sapiens
aaagugcaauua

SEQ ID NO: 1787310 - RNA, 12 nt, Homo sapiens
aaaaugcaauug

SEQ ID NO: 1787311 - RNA, 16 nt, Homo sapiens
uuaugagcgucacugc

SEQ ID NO: 1787312 - RNA, 22 nt, Homo sapiens
cagcauuucuagacuuccacaa

SEQ ID NO: 1787313 - RNA, 16 nt, Homo sapiens
agugguuaagcauucc

SEQ ID NO: 1787314 - RNA, 16 nt, Homo sapiens
aaaguacaagcuguaa

SEQ ID NO: 1787315 - RNA, 14 nt, Homo sapiens
ucaaguuccagugc

SEQ ID NO: 1787316 - RNA, 19 nt, Homo sapiens
ugaaacuggaaaacuacaa

SEQ ID NO: 1787317 - RNA, 17 nt, Homo sapiens
uaaaaauuguuuuugga

SEQ ID NO: 1787318 - RNA, 16 nt, Homo sapiens
cuuuagaacagggaaa

SEQ ID NO: 1787319 - RNA, 15 nt, Homo sapiens
aggacagcucugggg

SEQ ID NO: 1787320 - RNA, 22 nt, Homo sapiens
ugacauaacagugcagggcaaa

SEQ ID NO: 1787321 - RNA, 21 nt, Homo sapiens
agccacugcauaccaaccugg

SEQ ID NO: 1787322 - RNA, 24 nt, Homo sapiens
augacuugacuucaaaagcaacaa

SEQ ID NO: 1787323 - RNA, 21 nt, Homo sapiens
gaaacugcuccagcuuuugca

SEQ ID NO: 1787324 - RNA, 17 nt, Homo sapiens
gaaagguaauggacuca

SEQ ID NO: 1787325 - RNA, 17 nt, Homo sapiens
auuaucaccuuugucag

SEQ ID NO: 1787326 - RNA, 23 nt, Homo sapiens
auuccuuuccucuggcccaguga

SEQ ID NO: 1787327 - RNA, 21 nt, Homo sapiens
uuccuauguuucacugugcaa

SEQ ID NO: 1787328 - RNA, 21 nt, Homo sapiens
caggggagauccuuguguuua

SEQ ID NO: 1787329 - RNA, 13 nt, Homo sapiens
cuacuauaugcau

SEQ ID NO: 1787330 - RNA, 23 nt, Homo sapiens
aauuucccuucuugcauccuucc

SEQ ID NO: 1787331 - RNA, 17 nt, Homo sapiens
aauauccaaagacugua

SEQ ID NO: 1787332 - RNA, 20 nt, Homo sapiens
uuuccaagaccaaccuacaa

SEQ ID NO: 1787333 - RNA, 16 nt, Homo sapiens
uccgggaaaacagcua

SEQ ID NO: 1787334 - RNA, 18 nt, Homo sapiens
agacuacacaggaugagg

SEQ ID NO: 1787335 - RNA, 19 nt, Homo sapiens
uaaggcugaggaaaggcca

SEQ ID NO: 1787336 - RNA, 12 nt, Homo sapiens
cccgcucugcac

SEQ ID NO: 1787337 - RNA, 21 nt, Homo sapiens
aguauaggccaggcacagugg

SEQ ID NO: 1787338 - RNA, 18 nt, Homo sapiens
cuuuccucuuaauuccca

SEQ ID NO: 1787339 - RNA, 16 nt, Homo sapiens
uaacaauccauucaca

SEQ ID NO: 1787340 - RNA, 18 nt, Homo sapiens
cuuuauugcacuaggaau

SEQ ID NO: 1787341 - RNA, 21 nt, Homo sapiens
cacugggugagagaggaauaa

SEQ ID NO: 1787342 - RNA, 15 nt, Homo sapiens
auguaaaauuuugcc

SEQ ID NO: 1787343 - RNA, 15 nt, Homo sapiens
caaugcuauggacug

SEQ ID NO: 1787344 - RNA, 23 nt, Homo sapiens
uaauguauuuuuuagacccucua

SEQ ID NO: 1787345 - RNA, 19 nt, Homo sapiens
caccgugcccaaccucacu

SEQ ID NO: 1787346 - RNA, 23 nt, Homo sapiens
ugggcucugccuuaaacacacau

SEQ ID NO: 1787347 - RNA, 16 nt, Homo sapiens
cuucccacggucaacu

SEQ ID NO: 1787348 - RNA, 23 nt, Homo sapiens
accaguguccccuccacugucac

SEQ ID NO: 1787349 - RNA, 21 nt, Homo sapiens
aucucauuuuuaagaacaagc

SEQ ID NO: 1787350 - RNA, 23 nt, Homo sapiens
acuacacuggggcccuucauccu

SEQ ID NO: 1787351 - RNA, 14 nt, Homo sapiens
ugugaaacacacaa

SEQ ID NO: 1787352 - RNA, 13 nt, Homo sapiens
guaaggagcacca

SEQ ID NO: 1787353 - RNA, 13 nt, Homo sapiens
uuuagauauucau

SEQ ID NO: 1787354 - RNA, 15 nt, Homo sapiens
uaauaguacauguca

SEQ ID NO: 1787355 - RNA, 19 nt, Homo sapiens
accagcuuguuugugaaac

SEQ ID NO: 1787356 - RNA, 15 nt, Homo sapiens
acacuuuugcuugaa

SEQ ID NO: 1787357 - RNA, 23 nt, Homo sapiens
gaacuuugcauagcagcugcuac

SEQ ID NO: 1787358 - RNA, 17 nt, Homo sapiens
augugaauugaagucau

SEQ ID NO: 1787359 - RNA, 17 nt, Homo sapiens
ccauaaacauuugccaa

SEQ ID NO: 1787360 - RNA, 22 nt, Homo sapiens
gaagcacaugccucucucaggc

SEQ ID NO: 1787361 - RNA, 17 nt, Homo sapiens
uccugugcuuucccuga

SEQ ID NO: 1787362 - RNA, 21 nt, Homo sapiens
cuggagugauagcuacuguag

SEQ ID NO: 1787363 - RNA, 18 nt, Homo sapiens
gaaagcauaugcagccaa

SEQ ID NO: 1787364 - RNA, 17 nt, Homo sapiens
uguggcagcugcaacag

SEQ ID NO: 1787365 - RNA, 14 nt, Homo sapiens
uuagacauaccucu

SEQ ID NO: 1787366 - RNA, 14 nt, Homo sapiens
caauguaugaauua

SEQ ID NO: 1787367 - RNA, 20 nt, Homo sapiens
ucaauugcuucugugcaaua

SEQ ID NO: 1787368 - RNA, 20 nt, Homo sapiens
aacugugaauacuugaacuc

SEQ ID NO: 1787369 - RNA, 16 nt, Homo sapiens
uggagguugcugguac

SEQ ID NO: 1787370 - RNA, 16 nt, Homo sapiens
uguccugcaucaucuu

SEQ ID NO: 1787371 - RNA, 20 nt, Homo sapiens
gaaaagagauggccugagaa

SEQ ID NO: 1787372 - RNA, 17 nt, Homo sapiens
gaaaauuuccuccacau

SEQ ID NO: 1787373 - RNA, 16 nt, Homo sapiens
uuauucgaaccacuga

SEQ ID NO: 1787374 - RNA, 17 nt, Homo sapiens
caugcugggauuuccaa

SEQ ID NO: 1787375 - RNA, 17 nt, Homo sapiens
cagcucuacuccaggcu

SEQ ID NO: 1787376 - RNA, 14 nt, Homo sapiens
uccaagacugaaga

SEQ ID NO: 1787377 - RNA, 14 nt, Homo sapiens
ccuauacaguucua

SEQ ID NO: 1787378 - RNA, 22 nt, Homo sapiens
caacguggaggaaagggagcag

SEQ ID NO: 1787379 - RNA, 14 nt, Homo sapiens
gauuauacaggaga

SEQ ID NO: 1787380 - RNA, 17 nt, Homo sapiens
ucucugagaucaugagu

SEQ ID NO: 1787381 - RNA, 23 nt, Homo sapiens
agccuccuauccaccacugcuua

SEQ ID NO: 1787382 - RNA, 21 nt, Homo sapiens
uuaacuaguguuucugcagag

SEQ ID NO: 1787383 - RNA, 21 nt, Homo sapiens
aauucuguuuuuaaugcuauu

SEQ ID NO: 1787384 - RNA, 16 nt, Homo sapiens
aucuguuauccugcua

SEQ ID NO: 1787385 - RNA, 20 nt, Homo sapiens
auggguuggcuguggggacc

SEQ ID NO: 1787386 - RNA, 19 nt, Homo sapiens
ugauuucaguucacuguuc

SEQ ID NO: 1787387 - RNA, 21 nt, Homo sapiens
ugggauguccuacuaucacug

SEQ ID NO: 1787388 - RNA, 12 nt, Homo sapiens
uacacuaauaaa

SEQ ID NO: 1787389 - RNA, 23 nt, Homo sapiens
aauguacaagacuuuaccauaca

SEQ ID NO: 1787390 - RNA, 16 nt, Homo sapiens
guagccuuacugugaa

SEQ ID NO: 1787391 - RNA, 21 nt, Homo sapiens
augcccucaggggacuugaau

SEQ ID NO: 1787392 - RNA, 17 nt, Homo sapiens
acgagcaggcauuucug

SEQ ID NO: 1787393 - RNA, 18 nt, Homo sapiens
cucugaacacacacgcca

SEQ ID NO: 1787394 - RNA, 16 nt, Homo sapiens
auuuuagccaugccug

SEQ ID NO: 1787395 - RNA, 23 nt, Homo sapiens
auauauuuuuuucaacugccaau

SEQ ID NO: 1787396 - RNA, 19 nt, Homo sapiens
ugacucuuuauugucugua

SEQ ID NO: 1787397 - RNA, 18 nt, Homo sapiens
cccagcagguuaccugga

SEQ ID NO: 1787398 - RNA, 14 nt, Homo sapiens
ugguccucuuacca

SEQ ID NO: 1787399 - RNA, 23 nt, Homo sapiens
gccccagauaccagccccuguau

SEQ ID NO: 1787400 - RNA, 22 nt, Homo sapiens
aauaaauuauuuaacuaauuaa

SEQ ID NO: 1787401 - RNA, 23 nt, Homo sapiens
cuggccaguagcugccaaaaaga

SEQ ID NO: 1787402 - RNA, 21 nt, Homo sapiens
cuucaagaacccugacuccuc

SEQ ID NO: 1787403 - RNA, 21 nt, Homo sapiens
caaagugcuagccacuggaaa

SEQ ID NO: 1787404 - RNA, 21 nt, Homo sapiens
caucucaauggaaacaucacu

SEQ ID NO: 1787405 - RNA, 17 nt, Homo sapiens
agaaguaauuccucuga

SEQ ID NO: 1787406 - RNA, 14 nt, Homo sapiens
ggcaaggaugucug

SEQ ID NO: 1787407 - RNA, 15 nt, Homo sapiens
cccacaugcaugucu

SEQ ID NO: 1787408 - RNA, 12 nt, Homo sapiens
cccuaauucuua

SEQ ID NO: 1787409 - RNA, 19 nt, Homo sapiens
aaagccccucacacugcaa

SEQ ID NO: 1787410 - RNA, 19 nt, Homo sapiens
uauauauuuuaaagaccaa

SEQ ID NO: 1787411 - RNA, 23 nt, Homo sapiens
gaacuccaucauucauccaggac

SEQ ID NO: 1787412 - RNA, 14 nt, Homo sapiens
gccugugacuuuca

SEQ ID NO: 1787413 - RNA, 18 nt, Homo sapiens
uaaauauuuuucacauaa

SEQ ID NO: 1787414 - RNA, 19 nt, Homo sapiens
uucauuaaaucaacuuuau

SEQ ID NO: 1787415 - RNA, 21 nt, Homo sapiens
augccccccucuucaccccac

SEQ ID NO: 1787416 - RNA, 18 nt, Homo sapiens
ugucauggauagauuuuc

SEQ ID NO: 1787417 - RNA, 21 nt, Homo sapiens
aucguuuaaaaacaaaggaau

SEQ ID NO: 1787418 - RNA, 11 nt, Homo sapiens
aaguacauauu

SEQ ID NO: 1787419 - RNA, 17 nt, Homo sapiens
ccuccuccccuagggaa

SEQ ID NO: 1787420 - RNA, 15 nt, Homo sapiens
aauuacagugcaguu

SEQ ID NO: 1787421 - RNA, 20 nt, Homo sapiens
agagauacauguugccucac

SEQ ID NO: 1787422 - RNA, 15 nt, Homo sapiens
aacuccaucucaauu

SEQ ID NO: 1787423 - RNA, 16 nt, Homo sapiens
ucugcccuuguucccu

SEQ ID NO: 1787424 - RNA, 22 nt, Homo sapiens
uguagucagaccucagcaauau

SEQ ID NO: 1787425 - RNA, 12 nt, Homo sapiens
ugccucucugca

SEQ ID NO: 1787426 - RNA, 22 nt, Homo sapiens
cggcaaaugcgcacgaccuaca

SEQ ID NO: 1787427 - RNA, 15 nt, Homo sapiens
ucauggcagucccaa

SEQ ID NO: 1787428 - RNA, 15 nt, Homo sapiens
agucccagcgguggg

SEQ ID NO: 1787429 - RNA, 13 nt, Homo sapiens
cuuuugcuugcaa

SEQ ID NO: 1787430 - RNA, 14 nt, Homo sapiens
uuugccuucugcac

SEQ ID NO: 1787431 - RNA, 12 nt, Homo sapiens
cagugaccacag

SEQ ID NO: 1787432 - RNA, 15 nt, Homo sapiens
aaauuaguugggcau

SEQ ID NO: 1787433 - RNA, 19 nt, Homo sapiens
auaaaagugucacuaagaa

SEQ ID NO: 1787434 - RNA, 22 nt, Homo sapiens
augcaguucaaaaacaagacag

SEQ ID NO: 1787435 - RNA, 16 nt, Homo sapiens
auggauuaaagacuua

SEQ ID NO: 1787436 - RNA, 22 nt, Homo sapiens
uucuggucuggcggcugugcau

SEQ ID NO: 1787437 - RNA, 20 nt, Homo sapiens
gguuuguccuggucaugcac

SEQ ID NO: 1787438 - RNA, 17 nt, Homo sapiens
gucccuugguccuggaa

SEQ ID NO: 1787439 - RNA, 13 nt, Homo sapiens
aacuuuguauuaa

SEQ ID NO: 1787440 - RNA, 19 nt, Homo sapiens
cauuccaaggguaugggaa

SEQ ID NO: 1787441 - RNA, 19 nt, Homo sapiens
ccuugcuccucuuccuccu

SEQ ID NO: 1787442 - RNA, 16 nt, Homo sapiens
acucaaugcaugauga

SEQ ID NO: 1787443 - RNA, 15 nt, Homo sapiens
cuaaauaaguuauaa

SEQ ID NO: 1787444 - RNA, 23 nt, Homo sapiens
agcccaaucugcaaggacauuuc

SEQ ID NO: 1787445 - RNA, 21 nt, Homo sapiens
agggaagcugucccucacugu

SEQ ID NO: 1787446 - RNA, 23 nt, Homo sapiens
agcuggaggacuagaaccuggag

SEQ ID NO: 1787447 - RNA, 23 nt, Homo sapiens
aagauggaaugcuugcagagcau

SEQ ID NO: 1787448 - RNA, 18 nt, Homo sapiens
uggacucuaaagaccaaa

SEQ ID NO: 1787449 - RNA, 13 nt, Homo sapiens
uauuugaggucag

SEQ ID NO: 1787450 - RNA, 21 nt, Homo sapiens
ucacgagcguucaaacugcug

SEQ ID NO: 1787451 - RNA, 17 nt, Homo sapiens
uguaugccucugagcag

SEQ ID NO: 1787452 - RNA, 21 nt, Homo sapiens
cagacuuuuuaaauuccugcu

SEQ ID NO: 1787453 - RNA, 18 nt, Homo sapiens
uuugcuggaguucaggga

SEQ ID NO: 1787454 - RNA, 21 nt, Homo sapiens
aaaaugauuuuaucugugaau

SEQ ID NO: 1787455 - RNA, 21 nt, Homo sapiens
uugaagauaguaacuguagau

SEQ ID NO: 1787456 - RNA, 15 nt, Homo sapiens
cauaguaaguacaga

SEQ ID NO: 1787457 - RNA, 16 nt, Homo sapiens
cugcaucccccaaagc

SEQ ID NO: 1787458 - RNA, 18 nt, Homo sapiens
auaggcauuugauuuugc

SEQ ID NO: 1787459 - RNA, 20 nt, Homo sapiens
gccaaggaaacccccagugu

SEQ ID NO: 1787460 - RNA, 17 nt, Homo sapiens
uuauuccuacaaguuua

SEQ ID NO: 1787461 - RNA, 14 nt, Homo sapiens
agaagguugcucua

SEQ ID NO: 1787462 - RNA, 15 nt, Homo sapiens
uaugaauaauugcau

SEQ ID NO: 1787463 - RNA, 16 nt, Homo sapiens
gaggaaucagcucaau

SEQ ID NO: 1787464 - RNA, 12 nt, Homo sapiens
uaaucacuuaaa

SEQ ID NO: 1787465 - RNA, 12 nt, Homo sapiens
cauucacucaua

SEQ ID NO: 1787466 - RNA, 21 nt, Homo sapiens
gagcugcucaggcuuggcgga

SEQ ID NO: 1787467 - RNA, 21 nt, Homo sapiens
aagaaggaauucuaggcaucc

SEQ ID NO: 1787468 - RNA, 14 nt, Homo sapiens
auggguuccagagg

SEQ ID NO: 1787469 - RNA, 15 nt, Homo sapiens
ucucaggggugcugg

SEQ ID NO: 1787470 - RNA, 15 nt, Homo sapiens
ucucaauggugcuau

SEQ ID NO: 1787471 - RNA, 16 nt, Homo sapiens
acuguuucacuugcuc

SEQ ID NO: 1787472 - RNA, 22 nt, Homo sapiens
cccaggguuggcaugacugucu

SEQ ID NO: 1787473 - RNA, 23 nt, Homo sapiens
ucccuacaaaggauaugaacuca

SEQ ID NO: 1787474 - RNA, 12 nt, Homo sapiens
uuguucaccuga

SEQ ID NO: 1787475 - RNA, 21 nt, Homo sapiens
aucauaaccacccuagcuuua

SEQ ID NO: 1787476 - RNA, 22 nt, Homo sapiens
ucaaaaagaacaacauaucuca

SEQ ID NO: 1787477 - RNA, 19 nt, Homo sapiens
acgaucccccaaguguccu

SEQ ID NO: 1787478 - RNA, 19 nt, Homo sapiens
ucaaaaguagaacuuugua

SEQ ID NO: 1787479 - RNA, 14 nt, Homo sapiens
gaugucacaaagau

SEQ ID NO: 1787480 - RNA, 15 nt, Homo sapiens
cuauuuaugugaucc

SEQ ID NO: 1787481 - RNA, 21 nt, Homo sapiens
ggacagagauuaagaucagca

SEQ ID NO: 1787482 - RNA, 16 nt, Homo sapiens
aagacauuucugcaca

SEQ ID NO: 1787483 - RNA, 18 nt, Homo sapiens
aaaaccagaacaguauga

SEQ ID NO: 1787484 - RNA, 14 nt, Homo sapiens
gagacucacaggaa

SEQ ID NO: 1787485 - RNA, 19 nt, Homo sapiens
cuccauacucaagcugucu

SEQ ID NO: 1787486 - RNA, 18 nt, Homo sapiens
ccgcaggugggugcugcc

SEQ ID NO: 1787487 - RNA, 19 nt, Homo sapiens
acaacaucaagccugugau

SEQ ID NO: 1787488 - RNA, 20 nt, Homo sapiens
guacauuucccugugcugac

SEQ ID NO: 1787489 - RNA, 15 nt, Homo sapiens
gcaauauauaauuga

SEQ ID NO: 1787490 - RNA, 13 nt, Homo sapiens
aagcaggaaccaa

SEQ ID NO: 1787491 - RNA, 16 nt, Homo sapiens
agugcuuggguggugg

SEQ ID NO: 1787492 - RNA, 21 nt, Homo sapiens
gaggacggcccugccugccuc

SEQ ID NO: 1787493 - RNA, 22 nt, Homo sapiens
caaaccaggagcauuuuguguc

SEQ ID NO: 1787494 - RNA, 22 nt, Homo sapiens
ucacagacacugcacagaccuu

SEQ ID NO: 1787495 - RNA, 12 nt, Homo sapiens
uauaaauuuugu

SEQ ID NO: 1787496 - RNA, 16 nt, Homo sapiens
uuggucuuuucuugcc

SEQ ID NO: 1787497 - RNA, 14 nt, Homo sapiens
ugaagaguuucaca

SEQ ID NO: 1787498 - RNA, 21 nt, Homo sapiens
caaauaaacggacucagugga

SEQ ID NO: 1787499 - RNA, 13 nt, Homo sapiens
ccugaguccuuaa

SEQ ID NO: 1787500 - RNA, 17 nt, Homo sapiens
caaacacccaagcacaa

SEQ ID NO: 1787501 - RNA, 14 nt, Homo sapiens
aaggguucagccca

SEQ ID NO: 1787502 - RNA, 16 nt, Homo sapiens
aagcaacgacuacuuu

SEQ ID NO: 1787503 - RNA, 12 nt, Homo sapiens
ccccucugggaa

SEQ ID NO: 1787504 - RNA, 22 nt, Homo sapiens
aaagaccuaccuagaugcuccu

SEQ ID NO: 1787505 - RNA, 20 nt, Homo sapiens
ccuggucccucugcagucuc

SEQ ID NO: 1787506 - RNA, 11 nt, Homo sapiens
acagugcauuu

SEQ ID NO: 1787507 - RNA, 17 nt, Homo sapiens
aacuguacagugucuuu

SEQ ID NO: 1787508 - RNA, 18 nt, Homo sapiens
aucaaauuugccaccacu

SEQ ID NO: 1787509 - RNA, 22 nt, Homo sapiens
ucguagagacgggguuucacca

SEQ ID NO: 1787510 - RNA, 17 nt, Homo sapiens
uugugagcaggcuguga

SEQ ID NO: 1787511 - RNA, 13 nt, Homo sapiens
ugagaacagcauu

SEQ ID NO: 1787512 - RNA, 17 nt, Homo sapiens
ggcguggccuccuccuc

SEQ ID NO: 1787513 - RNA, 18 nt, Homo sapiens
agaggugcuccauggagg

SEQ ID NO: 1787514 - RNA, 12 nt, Homo sapiens
gcccacacuugg

SEQ ID NO: 1787515 - RNA, 14 nt, Homo sapiens
ugauagagugcagu

SEQ ID NO: 1787516 - RNA, 15 nt, Homo sapiens
cauucccugccuugc

SEQ ID NO: 1787517 - RNA, 17 nt, Homo sapiens
uagaaguggcaucugaa

SEQ ID NO: 1787518 - RNA, 23 nt, Homo sapiens
guuuccccuuuuaagguuucaac

SEQ ID NO: 1787519 - RNA, 17 nt, Homo sapiens
agggucuuugcaagaau

SEQ ID NO: 1787520 - RNA, 19 nt, Homo sapiens
uucugcuuuuuuucaggga

SEQ ID NO: 1787521 - RNA, 19 nt, Homo sapiens
uagucauuuuuagcacugg

SEQ ID NO: 1787522 - RNA, 19 nt, Homo sapiens
cagauuuuuccuuuaacau

SEQ ID NO: 1787523 - RNA, 13 nt, Homo sapiens
uugcuucacuuug

SEQ ID NO: 1787524 - RNA, 13 nt, Homo sapiens
uaccgagcacugu

SEQ ID NO: 1787525 - RNA, 21 nt, Homo sapiens
aggggcuggggccagggagca

SEQ ID NO: 1787526 - RNA, 22 nt, Homo sapiens
cucucuucugcugucucuccua

SEQ ID NO: 1787527 - RNA, 21 nt, Homo sapiens
gacuugaaugugcaccugagg

SEQ ID NO: 1787528 - RNA, 16 nt, Homo sapiens
ccuacguauccugcag

SEQ ID NO: 1787529 - RNA, 22 nt, Homo sapiens
ccagauagucccagcagccucc

SEQ ID NO: 1787530 - RNA, 13 nt, Homo sapiens
agcugugacauau

SEQ ID NO: 1787531 - RNA, 21 nt, Homo sapiens
gccagcucaccccaucauccc

SEQ ID NO: 1787532 - RNA, 20 nt, Homo sapiens
ggaacagauucacacugucu

SEQ ID NO: 1787533 - RNA, 20 nt, Homo sapiens
cuggcagagaagagaccaag

SEQ ID NO: 1787534 - RNA, 21 nt, Homo sapiens
agcggaaacuucucgagcucc

SEQ ID NO: 1787535 - RNA, 22 nt, Homo sapiens
caggccucugguguuugcaaag

SEQ ID NO: 1787536 - RNA, 12 nt, Homo sapiens
uaaaauucaggu

SEQ ID NO: 1787537 - RNA, 20 nt, Homo sapiens
augucugaaguuugccccag

SEQ ID NO: 1787538 - RNA, 22 nt, Homo sapiens
acacugaggcgcucgcucccau

SEQ ID NO: 1787539 - RNA, 23 nt, Homo sapiens
auuuagaagccaacuaugauuau

SEQ ID NO: 1787540 - RNA, 19 nt, Homo sapiens
gcagccacaaccaaaaaau

SEQ ID NO: 1787541 - RNA, 22 nt, Homo sapiens
uacaggggagaaggaaaugcag

SEQ ID NO: 1787542 - RNA, 18 nt, Homo sapiens
ugaccugaggaagcguga

SEQ ID NO: 1787543 - RNA, 23 nt, Homo sapiens
ggaaggcagcagagggucuccaa

SEQ ID NO: 1787544 - RNA, 20 nt, Homo sapiens
ucaucacauuucuaugccaa

SEQ ID NO: 1787545 - RNA, 21 nt, Homo sapiens
gcuccuucacugaacaugccu

SEQ ID NO: 1787546 - RNA, 19 nt, Homo sapiens
guauaaaaauuaucaaaaa

SEQ ID NO: 1787547 - RNA, 14 nt, Homo sapiens
aguaccucugcuau

SEQ ID NO: 1787548 - RNA, 15 nt, Homo sapiens
ugaagacacugaaau

SEQ ID NO: 1787549 - RNA, 21 nt, Homo sapiens
ccucaaauacauaccuacuga

SEQ ID NO: 1787550 - RNA, 23 nt, Homo sapiens
cugccuccggccugcacuccccc

SEQ ID NO: 1787551 - RNA, 15 nt, Homo sapiens
uuaagaaugaaacua

SEQ ID NO: 1787552 - RNA, 23 nt, Homo sapiens
agaccuugcuuugagacuccuca

SEQ ID NO: 1787553 - RNA, 23 nt, Homo sapiens
uccacucaugugacucuuuccaa

SEQ ID NO: 1787554 - RNA, 14 nt, Homo sapiens
cagggucauagcau

SEQ ID NO: 1787555 - RNA, 16 nt, Homo sapiens
aguguagauguagcau

SEQ ID NO: 1787556 - RNA, 19 nt, Homo sapiens
aggcagcuggaugagacuu

SEQ ID NO: 1787557 - RNA, 20 nt, Homo sapiens
ggucaggacucagaacaguc

SEQ ID NO: 1787558 - RNA, 20 nt, Homo sapiens
auagauggcugaacaucagg

SEQ ID NO: 1787559 - RNA, 14 nt, Homo sapiens
auggugcacuggaa

SEQ ID NO: 1787560 - RNA, 15 nt, Homo sapiens
uugggagagugcagu

SEQ ID NO: 1787561 - RNA, 16 nt, Homo sapiens
ucccagaugggccacg

SEQ ID NO: 1787562 - RNA, 14 nt, Homo sapiens
uaccagggacccug

SEQ ID NO: 1787563 - RNA, 13 nt, Homo sapiens
cuuaagaauacac

SEQ ID NO: 1787564 - RNA, 16 nt, Homo sapiens
ccuguuugaaaccaag

SEQ ID NO: 1787565 - RNA, 17 nt, Homo sapiens
ccugccucucugcucca

SEQ ID NO: 1787566 - RNA, 23 nt, Homo sapiens
auauuucaguauugagcuuugca

SEQ ID NO: 1787567 - RNA, 15 nt, Homo sapiens
uauccacccucugca

SEQ ID NO: 1787568 - RNA, 16 nt, Homo sapiens
acuucuauauauacaa

SEQ ID NO: 1787569 - RNA, 15 nt, Homo sapiens
cuucaggacucuaga

SEQ ID NO: 1787570 - RNA, 12 nt, Homo sapiens
ugaaaaccacag

SEQ ID NO: 1787571 - RNA, 13 nt, Homo sapiens
accagaacuuucu

SEQ ID NO: 1787572 - RNA, 23 nt, Homo sapiens
cauucuaaugauggcccauucua

SEQ ID NO: 1787573 - RNA, 14 nt, Homo sapiens
auuuagagccauua

SEQ ID NO: 1787574 - RNA, 14 nt, Homo sapiens
auuguaagccagag

SEQ ID NO: 1787575 - RNA, 16 nt, Homo sapiens
uauagcaguguucucu

SEQ ID NO: 1787576 - RNA, 21 nt, Homo sapiens
aagccagaaaaagaucuuuca

SEQ ID NO: 1787577 - RNA, 15 nt, Homo sapiens
ucagccuacauugau

SEQ ID NO: 1787578 - RNA, 17 nt, Homo sapiens
agcaucaccucaggcca

SEQ ID NO: 1787579 - RNA, 23 nt, Homo sapiens
cuugcagguuuucuucacugcca

SEQ ID NO: 1787580 - RNA, 16 nt, Homo sapiens
caggaggaucacuuga

SEQ ID NO: 1787581 - RNA, 12 nt, Homo sapiens
uuaacucuagaa

SEQ ID NO: 1787582 - RNA, 17 nt, Homo sapiens
cuucaauuguauuauau

SEQ ID NO: 1787583 - RNA, 18 nt, Homo sapiens
uaaccaucugauaucuau

SEQ ID NO: 1787584 - RNA, 20 nt, Homo sapiens
auauccaccuaccuauucau

SEQ ID NO: 1787585 - RNA, 21 nt, Homo sapiens
auaguaaugagugaguucuca

SEQ ID NO: 1787586 - RNA, 15 nt, Homo sapiens
ggggagguucaguga

SEQ ID NO: 1787587 - RNA, 18 nt, Homo sapiens
gacgugcgcgaugccugg

SEQ ID NO: 1787588 - RNA, 17 nt, Homo sapiens
uaauuuccauaguguga

SEQ ID NO: 1787589 - RNA, 15 nt, Homo sapiens
ucccagaucagucag

SEQ ID NO: 1787590 - RNA, 22 nt, Homo sapiens
auuuaauuuagugaucuuagca

SEQ ID NO: 1787591 - RNA, 22 nt, Homo sapiens
auagaacuggucuuccauuuug

SEQ ID NO: 1787592 - RNA, 13 nt, Homo sapiens
ugcaugaccugau

SEQ ID NO: 1787593 - RNA, 15 nt, Homo sapiens
aagcugauagccaga

SEQ ID NO: 1787594 - RNA, 17 nt, Homo sapiens
ugaaauuguagugcaaa

SEQ ID NO: 1787595 - RNA, 20 nt, Homo sapiens
aggggcaaggaaacucgaau

SEQ ID NO: 1787596 - RNA, 18 nt, Homo sapiens
ccgaggcuacagcuccac

SEQ ID NO: 1787597 - RNA, 20 nt, Homo sapiens
agaaagggagggcucugagg

SEQ ID NO: 1787598 - RNA, 20 nt, Homo sapiens
uguaauccuugcauuuugga

SEQ ID NO: 1787599 - RNA, 11 nt, Homo sapiens
gacagcaguuu

SEQ ID NO: 1787600 - RNA, 10 nt, Homo sapiens
ugaagcacaa

SEQ ID NO: 1787601 - RNA, 12 nt, Homo sapiens
cacagcugugag

SEQ ID NO: 1787602 - RNA, 13 nt, Homo sapiens
cugggaaggugac

SEQ ID NO: 1787603 - RNA, 17 nt, Homo sapiens
cagaucaagcugugaga

SEQ ID NO: 1787604 - RNA, 13 nt, Homo sapiens
aaucagagacaaa

SEQ ID NO: 1787605 - RNA, 23 nt, Homo sapiens
ccuccuaauuugaucacaguggc

SEQ ID NO: 1787606 - RNA, 15 nt, Homo sapiens
agggcccuuguacaa

SEQ ID NO: 1787607 - RNA, 14 nt, Homo sapiens
uggcagcgccuccc

SEQ ID NO: 1787608 - RNA, 21 nt, Homo sapiens
uaugccauugggguaguugug

SEQ ID NO: 1787609 - RNA, 20 nt, Homo sapiens
acuaucugugccagagguaa

SEQ ID NO: 1787610 - RNA, 19 nt, Homo sapiens
gcauacugacuccaggugu

SEQ ID NO: 1787611 - RNA, 12 nt, Homo sapiens
agaaacccaagu

SEQ ID NO: 1787612 - RNA, 18 nt, Homo sapiens
agaacauuccauuugcuu

SEQ ID NO: 1787613 - RNA, 12 nt, Homo sapiens
aucuacacagcc

SEQ ID NO: 1787614 - RNA, 23 nt, Homo sapiens
ggauuuaucccccgcaaagacau

SEQ ID NO: 1787615 - RNA, 16 nt, Homo sapiens
ugccauguuuugccac

SEQ ID NO: 1787616 - RNA, 23 nt, Homo sapiens
ccccaacagcuggacccugacca

SEQ ID NO: 1787617 - RNA, 14 nt, Homo sapiens
cugcauuacuauua

SEQ ID NO: 1787618 - RNA, 21 nt, Homo sapiens
ucccaccaaccuccaguguca

SEQ ID NO: 1787619 - RNA, 20 nt, Homo sapiens
cauuuaaaacaagcugauag

SEQ ID NO: 1787620 - RNA, 20 nt, Homo sapiens
acuucucugugaacuauuaa

SEQ ID NO: 1787621 - RNA, 18 nt, Homo sapiens
uauuacucagauuccaca

SEQ ID NO: 1787622 - RNA, 18 nt, Homo sapiens
uucccaauaucaugugau

SEQ ID NO: 1787623 - RNA, 18 nt, Homo sapiens
uugacgucucuauucugc

SEQ ID NO: 1787624 - RNA, 17 nt, Homo sapiens
agccuggcaacagagca

SEQ ID NO: 1787625 - RNA, 13 nt, Homo sapiens
agaggggacaggu

SEQ ID NO: 1787626 - RNA, 23 nt, Homo sapiens
cagcucuccgccaauuucucuca

SEQ ID NO: 1787627 - RNA, 20 nt, Homo sapiens
guaagguacugaauacuuaa

SEQ ID NO: 1787628 - RNA, 17 nt, Homo sapiens
uaguuaaaacagcuauu

SEQ ID NO: 1787629 - RNA, 19 nt, Homo sapiens
gacugcugugaacaugccu

SEQ ID NO: 1787630 - RNA, 19 nt, Homo sapiens
aguuuccacugcaugggcu

SEQ ID NO: 1787631 - RNA, 22 nt, Homo sapiens
ucagcagucuaguucuuuucau

SEQ ID NO: 1787632 - RNA, 16 nt, Homo sapiens
cgcugccugcucugcg

SEQ ID NO: 1787633 - RNA, 12 nt, Homo sapiens
gcagaguauuuc

SEQ ID NO: 1787634 - RNA, 18 nt, Homo sapiens
aguuugcaguuaugcaga

SEQ ID NO: 1787635 - RNA, 19 nt, Homo sapiens
uccacucccaagccacuag

SEQ ID NO: 1787636 - RNA, 14 nt, Homo sapiens
uggcugcuccauga

SEQ ID NO: 1787637 - RNA, 22 nt, Homo sapiens
agagaaacuagaaacaguuaaa

SEQ ID NO: 1787638 - RNA, 20 nt, Homo sapiens
uauagccuggggugggguca

SEQ ID NO: 1787639 - RNA, 13 nt, Homo sapiens
aauaauaaauuaa

SEQ ID NO: 1787640 - RNA, 18 nt, Homo sapiens
uauagcuuugccaugugg

SEQ ID NO: 1787641 - RNA, 18 nt, Homo sapiens
uuaaaauuuuaccucucu

SEQ ID NO: 1787642 - RNA, 18 nt, Homo sapiens
gcucuucaucccauucca

SEQ ID NO: 1787643 - RNA, 22 nt, Homo sapiens
ucagcugcuucuuuggucaucc

SEQ ID NO: 1787644 - RNA, 15 nt, Homo sapiens
ucugacccacugcuu

SEQ ID NO: 1787645 - RNA, 17 nt, Homo sapiens
agccauaugaaugucag

SEQ ID NO: 1787646 - RNA, 16 nt, Homo sapiens
gaacuucacgauuccu

SEQ ID NO: 1787647 - RNA, 19 nt, Homo sapiens
acucaugaagaaagaacac

SEQ ID NO: 1787648 - RNA, 14 nt, Homo sapiens
gugcaaaggugagc

SEQ ID NO: 1787649 - RNA, 21 nt, Homo sapiens
cccuagcagcccacccugcug

SEQ ID NO: 1787650 - RNA, 11 nt, Homo sapiens
ccuuacugugc

SEQ ID NO: 1787651 - RNA, 22 nt, Homo sapiens
ucuugccucauuuugcuuccca

SEQ ID NO: 1787652 - RNA, 20 nt, Homo sapiens
uacagacucaguagccauau

SEQ ID NO: 1787653 - RNA, 22 nt, Homo sapiens
auaauuaccaauaucuugccag

SEQ ID NO: 1787654 - RNA, 14 nt, Homo sapiens
guuugccucugaaa

SEQ ID NO: 1787655 - RNA, 22 nt, Homo sapiens
uugagauacuugaccuugcaug

SEQ ID NO: 1787656 - RNA, 13 nt, Homo sapiens
aaggaaaaauaau

SEQ ID NO: 1787657 - RNA, 17 nt, Homo sapiens
gccuuacaaauauuuca

SEQ ID NO: 1787658 - RNA, 14 nt, Homo sapiens
cugucacugagcaa

SEQ ID NO: 1787659 - RNA, 14 nt, Homo sapiens
aauaauugauuuca

SEQ ID NO: 1787660 - RNA, 11 nt, Homo sapiens
ucaugucauca

SEQ ID NO: 1787661 - RNA, 11 nt, Homo sapiens
cuuugucacuu

SEQ ID NO: 1787662 - RNA, 16 nt, Homo sapiens
ugucauagcuuauaua

SEQ ID NO: 1787663 - RNA, 14 nt, Homo sapiens
gcugacccagugug

SEQ ID NO: 1787664 - RNA, 15 nt, Homo sapiens
gaccgccccucacca

SEQ ID NO: 1787665 - RNA, 18 nt, Homo sapiens
ugaaaucugcucuguaca

SEQ ID NO: 1787666 - RNA, 23 nt, Homo sapiens
aaccagaccaaccgccugcagga

SEQ ID NO: 1787667 - RNA, 14 nt, Homo sapiens
ugacacuuaucuca

SEQ ID NO: 1787668 - RNA, 14 nt, Homo sapiens
ucugucacaccagc

SEQ ID NO: 1787669 - RNA, 13 nt, Homo sapiens
acccuaccagcuc

SEQ ID NO: 1787670 - RNA, 20 nt, Homo sapiens
acagcaguguucucacagug

SEQ ID NO: 1787671 - RNA, 20 nt, Homo sapiens
gcuuacacugaggacugugg

SEQ ID NO: 1787672 - RNA, 13 nt, Homo sapiens
gaguccuguucuc

SEQ ID NO: 1787673 - RNA, 16 nt, Homo sapiens
cugcuggagucuggcu

SEQ ID NO: 1787674 - RNA, 21 nt, Homo sapiens
gcugcugccuuguuucaccuu

SEQ ID NO: 1787675 - RNA, 20 nt, Homo sapiens
auaccacucaagcagugugc

SEQ ID NO: 1787676 - RNA, 13 nt, Homo sapiens
aucagagagggaa

SEQ ID NO: 1787677 - RNA, 14 nt, Homo sapiens
accagcccaaccau

SEQ ID NO: 1787678 - RNA, 17 nt, Homo sapiens
uugccaggacaugcaau

SEQ ID NO: 1787679 - RNA, 22 nt, Homo sapiens
gcuuuggguagugccauggcca

SEQ ID NO: 1787680 - RNA, 16 nt, Homo sapiens
uuacauccuacuaaga

SEQ ID NO: 1787681 - RNA, 14 nt, Homo sapiens
aagcuuaaugauuc

SEQ ID NO: 1787682 - RNA, 13 nt, Homo sapiens
cagggaucugccc

SEQ ID NO: 1787683 - RNA, 23 nt, Homo sapiens
ccucugccuuaucucauuucuca

SEQ ID NO: 1787684 - RNA, 19 nt, Homo sapiens
uuacgaccugucuguucuu

SEQ ID NO: 1787685 - RNA, 23 nt, Homo sapiens
auacagccaaagauaaucucuca

SEQ ID NO: 1787686 - RNA, 24 nt, Homo sapiens
gugcacaucuacaugccaugccua

SEQ ID NO: 1787687 - RNA, 18 nt, Homo sapiens
acuuugcccuucacuguu

SEQ ID NO: 1787688 - RNA, 23 nt, Homo sapiens
ggauguucuagcauggcugccaa

SEQ ID NO: 1787689 - RNA, 23 nt, Homo sapiens
agucaugucuuuccuauuugcac

SEQ ID NO: 1787690 - RNA, 13 nt, Homo sapiens
gcaucaaggucag

SEQ ID NO: 1787691 - RNA, 16 nt, Homo sapiens
uccaaaccaucagcug

SEQ ID NO: 1787692 - RNA, 22 nt, Homo sapiens
aauuuuuuuaaccaaaggugaa

SEQ ID NO: 1787693 - RNA, 14 nt, Homo sapiens
aaucaaacauauuc

SEQ ID NO: 1787694 - RNA, 22 nt, Homo sapiens
ccaggagacagaccacuugcca

SEQ ID NO: 1787695 - RNA, 16 nt, Homo sapiens
ggcccccagugggcau

SEQ ID NO: 1787696 - RNA, 21 nt, Homo sapiens
gagacagagucuuacucuguu

SEQ ID NO: 1787697 - RNA, 19 nt, Homo sapiens
cagaacaccaacuuaagaa

SEQ ID NO: 1787698 - RNA, 20 nt, Homo sapiens
aaugguaggucaaguaauaa

SEQ ID NO: 1787699 - RNA, 22 nt, Homo sapiens
cccccagggcauuguguucacu

SEQ ID NO: 1787700 - RNA, 19 nt, Homo sapiens
agggccuucccugacuuac

SEQ ID NO: 1787701 - RNA, 13 nt, Homo sapiens
gaguaacaauaca

SEQ ID NO: 1787702 - RNA, 19 nt, Homo sapiens
uaauuagaucaauuacuua

SEQ ID NO: 1787703 - RNA, 17 nt, Homo sapiens
guuuggaggagcaaagu

SEQ ID NO: 1787704 - RNA, 16 nt, Homo sapiens
gaaugaaauaauucaa

SEQ ID NO: 1787705 - RNA, 15 nt, Homo sapiens
uccauauuguugaau

SEQ ID NO: 1787706 - RNA, 23 nt, Homo sapiens
ucucccucucuccaacaaaugga

SEQ ID NO: 1787707 - RNA, 14 nt, Homo sapiens
ccggaagaaccaga

SEQ ID NO: 1787708 - RNA, 13 nt, Homo sapiens
gcuucagugccau

SEQ ID NO: 1787709 - RNA, 11 nt, Homo sapiens
aagucauucuc

SEQ ID NO: 1787710 - RNA, 22 nt, Homo sapiens
aaguucaccagcccugagccau

SEQ ID NO: 1787711 - RNA, 22 nt, Homo sapiens
uccuguacaaucaugaacagcu

SEQ ID NO: 1787712 - RNA, 16 nt, Homo sapiens
gucucauccaaaaagu

SEQ ID NO: 1787713 - RNA, 12 nt, Homo sapiens
ccggccagccuu

SEQ ID NO: 1787714 - RNA, 17 nt, Homo sapiens
uuucucuucccaugcaa

SEQ ID NO: 1787715 - RNA, 18 nt, Homo sapiens
acugcaagaaguacauga

SEQ ID NO: 1787716 - RNA, 23 nt, Homo sapiens
cccauccauuaggccagcaacgc

SEQ ID NO: 1787717 - RNA, 14 nt, Homo sapiens
uacgauucacuccu

SEQ ID NO: 1787718 - RNA, 16 nt, Homo sapiens
cgagaaaaacacacag

SEQ ID NO: 1787719 - RNA, 21 nt, Homo sapiens
ucauuccaaucuauugcuuca

SEQ ID NO: 1787720 - RNA, 21 nt, Homo sapiens
aauaccucuuacuuugcuuga

SEQ ID NO: 1787721 - RNA, 14 nt, Homo sapiens
acuggaagcacagc

SEQ ID NO: 1787722 - RNA, 15 nt, Homo sapiens
ccucuguugccaagg

SEQ ID NO: 1787723 - RNA, 14 nt, Homo sapiens
acagaacacugucu

SEQ ID NO: 1787724 - RNA, 22 nt, Homo sapiens
cacucuuaugaaaugggcuuua

SEQ ID NO: 1787725 - RNA, 21 nt, Homo sapiens
acagucaccacuccaugacau

SEQ ID NO: 1787726 - RNA, 16 nt, Homo sapiens
ccaauaacuagcuucu

SEQ ID NO: 1787727 - RNA, 14 nt, Homo sapiens
ugcuguauccacaa

SEQ ID NO: 1787728 - RNA, 21 nt, Homo sapiens
gccaccaaaggagacauauca

SEQ ID NO: 1787729 - RNA, 22 nt, Homo sapiens
ggaaaacagaggaaucuaccug

SEQ ID NO: 1787730 - RNA, 18 nt, Homo sapiens
uguuccuuaucaccugcc

SEQ ID NO: 1787731 - RNA, 19 nt, Homo sapiens
ugacagaacacagaucucu

SEQ ID NO: 1787732 - RNA, 11 nt, Homo sapiens
agucauugucc

SEQ ID NO: 1787733 - RNA, 16 nt, Homo sapiens
uauguaagagcaccuu

SEQ ID NO: 1787734 - RNA, 19 nt, Homo sapiens
aaaguguguuucuauguga

SEQ ID NO: 1787735 - RNA, 22 nt, Homo sapiens
ugaauaaaaaauagacauguag

SEQ ID NO: 1787736 - RNA, 15 nt, Homo sapiens
ucucauuugucacac

SEQ ID NO: 1787737 - RNA, 15 nt, Homo sapiens
agccaauguguggcu

SEQ ID NO: 1787738 - RNA, 18 nt, Homo sapiens
ugaaugugucacuacuca

SEQ ID NO: 1787739 - RNA, 15 nt, Homo sapiens
ucuguuuuguguacu

SEQ ID NO: 1787740 - RNA, 22 nt, Homo sapiens
ccauugcucuucuuuugaaaau

SEQ ID NO: 1787741 - RNA, 20 nt, Homo sapiens
cccagaccuucucacaccca

SEQ ID NO: 1787742 - RNA, 18 nt, Homo sapiens
auauccuacuuggcagaa

SEQ ID NO: 1787743 - RNA, 22 nt, Homo sapiens
auauaggcauuucacaaaaaca

SEQ ID NO: 1787744 - RNA, 16 nt, Homo sapiens
uugugcuccaaacaaa

SEQ ID NO: 1787745 - RNA, 22 nt, Homo sapiens
cguggggggagguggacagucc

SEQ ID NO: 1787746 - RNA, 21 nt, Homo sapiens
uaucagacucuguaauugaau

SEQ ID NO: 1787747 - RNA, 22 nt, Homo sapiens
uuguuugagaaauuaaguaucu

SEQ ID NO: 1787748 - RNA, 14 nt, Homo sapiens
ugcacgugugugca

SEQ ID NO: 1787749 - RNA, 19 nt, Homo sapiens
uggggccaagagucacuuc

SEQ ID NO: 1787750 - RNA, 16 nt, Homo sapiens
uccucucccaagucca

SEQ ID NO: 1787751 - RNA, 20 nt, Homo sapiens
acaauuaugauagcuuaugu

SEQ ID NO: 1787752 - RNA, 20 nt, Homo sapiens
cuuuggaaacaauaugcaau

SEQ ID NO: 1787753 - RNA, 19 nt, Homo sapiens
acgugggccuccagaguug

SEQ ID NO: 1787754 - RNA, 20 nt, Homo sapiens
aauguuugcugcucuauauu

SEQ ID NO: 1787755 - RNA, 13 nt, Homo sapiens
ggacuccacugga

SEQ ID NO: 1787756 - RNA, 22 nt, Homo sapiens
augcuggcgccaacaacuucuc

SEQ ID NO: 1787757 - RNA, 20 nt, Homo sapiens
gcuacaccuuucuccuuugu

SEQ ID NO: 1787758 - RNA, 21 nt, Homo sapiens
uuuaugguccuaaaagcaaaa

SEQ ID NO: 1787759 - RNA, 20 nt, Homo sapiens
ccacacacugaguugcacau

SEQ ID NO: 1787760 - RNA, 18 nt, Homo sapiens
cugcuuuccaaagccaau

SEQ ID NO: 1787761 - RNA, 15 nt, Homo sapiens
cauggagcaagagaa

SEQ ID NO: 1787762 - RNA, 17 nt, Homo sapiens
acaggugccuucccaga

SEQ ID NO: 1787763 - RNA, 15 nt, Homo sapiens
aaauaaugauuuaac

SEQ ID NO: 1787764 - RNA, 19 nt, Homo sapiens
cagccccgcgaccaugugg

SEQ ID NO: 1787765 - RNA, 19 nt, Homo sapiens
gccaagaaucaagcuagaa

SEQ ID NO: 1787766 - RNA, 15 nt, Homo sapiens
aucuguacuuugugu

SEQ ID NO: 1787767 - RNA, 16 nt, Homo sapiens
caucuggcucagcaua

SEQ ID NO: 1787768 - RNA, 14 nt, Homo sapiens
aauaaaacugcaca

SEQ ID NO: 1787769 - RNA, 14 nt, Homo sapiens
uaaacuaggaauuu

SEQ ID NO: 1787770 - RNA, 12 nt, Homo sapiens
gcagagccacca

SEQ ID NO: 1787771 - RNA, 13 nt, Homo sapiens
cgaauucuugcuu

SEQ ID NO: 1787772 - RNA, 23 nt, Homo sapiens
gcaucuacuacucugucuucacu

SEQ ID NO: 1787773 - RNA, 16 nt, Homo sapiens
aaugaguuuucaccug

SEQ ID NO: 1787774 - RNA, 22 nt, Homo sapiens
cuuuuacuuuuugccccuucca

SEQ ID NO: 1787775 - RNA, 18 nt, Homo sapiens
gcuggaguacgugaaaug

SEQ ID NO: 1787776 - RNA, 21 nt, Homo sapiens
aggccaguacuacugcucuca

SEQ ID NO: 1787777 - RNA, 22 nt, Homo sapiens
gccuccucgggagggagcgccu

SEQ ID NO: 1787778 - RNA, 15 nt, Homo sapiens
agguccagcucugga

SEQ ID NO: 1787779 - RNA, 22 nt, Homo sapiens
agaaaacccacacccacugucc

SEQ ID NO: 1787780 - RNA, 17 nt, Homo sapiens
cucaguaagacagugca

SEQ ID NO: 1787781 - RNA, 12 nt, Homo sapiens
caaauuccagaa

SEQ ID NO: 1787782 - RNA, 20 nt, Homo sapiens
auacuauauuuauacuguau

SEQ ID NO: 1787783 - RNA, 18 nt, Homo sapiens
agagagaaacagcuugau

SEQ ID NO: 1787784 - RNA, 19 nt, Homo sapiens
ucuuggggucccagggaag

SEQ ID NO: 1787785 - RNA, 20 nt, Homo sapiens
uuacagccaaguugugacag

SEQ ID NO: 1787786 - RNA, 12 nt, Homo sapiens
ccugugccucca

SEQ ID NO: 1787787 - RNA, 22 nt, Homo sapiens
cuuugaauauguaguaucuaua

SEQ ID NO: 1787788 - RNA, 15 nt, Homo sapiens
ucuguacauacuguu

SEQ ID NO: 1787789 - RNA, 19 nt, Homo sapiens
caaaacacucggcauuuca

SEQ ID NO: 1787790 - RNA, 19 nt, Homo sapiens
acuaguaguuccugcuaca

SEQ ID NO: 1787791 - RNA, 14 nt, Homo sapiens
aguuguaccacugc

SEQ ID NO: 1787792 - RNA, 23 nt, Homo sapiens
aaguuggugcuuuugagaaccaa

SEQ ID NO: 1787793 - RNA, 20 nt, Homo sapiens
ggccacagucaugguggcca

SEQ ID NO: 1787794 - RNA, 22 nt, Homo sapiens
ugacgcaaagaucaccagccau

SEQ ID NO: 1787795 - RNA, 22 nt, Homo sapiens
aucccugucuucuuuccauccc

SEQ ID NO: 1787796 - RNA, 15 nt, Homo sapiens
ucuauguaugcaucu

SEQ ID NO: 1787797 - RNA, 15 nt, Homo sapiens
agcagguaacuagcu

SEQ ID NO: 1787798 - RNA, 17 nt, Homo sapiens
cccccaaugucuucaag

SEQ ID NO: 1787799 - RNA, 17 nt, Homo sapiens
auuguguuugugccaua

SEQ ID NO: 1787800 - RNA, 21 nt, Homo sapiens
ggagaggauggcccaggguga

SEQ ID NO: 1787801 - RNA, 21 nt, Homo sapiens
cuugucucugggccacuugga

SEQ ID NO: 1787802 - RNA, 20 nt, Homo sapiens
gcuuuaauaaaggccacagg

SEQ ID NO: 1787803 - RNA, 17 nt, Homo sapiens
acacacgccaaugcaca

SEQ ID NO: 1787804 - RNA, 12 nt, Homo sapiens
ugcauaucauua

SEQ ID NO: 1787805 - RNA, 18 nt, Homo sapiens
guaucguuuguuuaugaa

SEQ ID NO: 1787806 - RNA, 19 nt, Homo sapiens
gaaguuuccagaaagaaga

SEQ ID NO: 1787807 - RNA, 20 nt, Homo sapiens
uucuuguccucauucuugcc

SEQ ID NO: 1787808 - RNA, 15 nt, Homo sapiens
ugcauucuauugccu

SEQ ID NO: 1787809 - RNA, 15 nt, Homo sapiens
cugcugcugcuaauc

SEQ ID NO: 1787810 - RNA, 20 nt, Homo sapiens
cucuauuuuaauuacugcua

SEQ ID NO: 1787811 - RNA, 23 nt, Homo sapiens
caaaaugggagaaaacgccagug

SEQ ID NO: 1787812 - RNA, 21 nt, Homo sapiens
gggaaugagaguuccuucuca

SEQ ID NO: 1787813 - RNA, 14 nt, Homo sapiens
ugcuuccaacucau

SEQ ID NO: 1787814 - RNA, 15 nt, Homo sapiens
agaaagccuauucca

SEQ ID NO: 1787815 - RNA, 22 nt, Homo sapiens
agauaugauaccaaagacacaa

SEQ ID NO: 1787816 - RNA, 17 nt, Homo sapiens
auuuguaaagcuauuua

SEQ ID NO: 1787817 - RNA, 18 nt, Homo sapiens
aaaguaaaagaaccacga

SEQ ID NO: 1787818 - RNA, 14 nt, Homo sapiens
ggcgcucccacuca

SEQ ID NO: 1787819 - RNA, 17 nt, Homo sapiens
aauguacagauaugcaa

SEQ ID NO: 1787820 - RNA, 15 nt, Homo sapiens
aaucucaauauuuca

SEQ ID NO: 1787821 - RNA, 19 nt, Homo sapiens
cuacuauguacugccuuag

SEQ ID NO: 1787822 - RNA, 15 nt, Homo sapiens
gaccuuggcagccca

SEQ ID NO: 1787823 - RNA, 16 nt, Homo sapiens
acaaaaccuaacuugc

SEQ ID NO: 1787824 - RNA, 16 nt, Homo sapiens
cuccuacuaaaucccu

SEQ ID NO: 1787825 - RNA, 13 nt, Homo sapiens
aauuaaaugcuca

SEQ ID NO: 1787826 - RNA, 15 nt, Homo sapiens
uaaaaaaauuacugu

SEQ ID NO: 1787827 - RNA, 21 nt, Homo sapiens
uaaaguauauuuaacucauaa

SEQ ID NO: 1787828 - RNA, 20 nt, Homo sapiens
uaagguaauuucuguguauu

SEQ ID NO: 1787829 - RNA, 22 nt, Homo sapiens
uuuguuuucuacauugauggaa

SEQ ID NO: 1787830 - RNA, 17 nt, Homo sapiens
cauauuuagcuuugcac

SEQ ID NO: 1787831 - RNA, 23 nt, Homo sapiens
uugggaguaggugcuaaccugga

SEQ ID NO: 1787832 - RNA, 15 nt, Homo sapiens
cuagaagaauuucaa

SEQ ID NO: 1787833 - RNA, 13 nt, Homo sapiens
auagagugcagug

SEQ ID NO: 1787834 - RNA, 14 nt, Homo sapiens
aaggaaacuagaca

SEQ ID NO: 1787835 - RNA, 22 nt, Homo sapiens
aauggcaacaaacugcacauga

SEQ ID NO: 1787836 - RNA, 18 nt, Homo sapiens
uaaagauauggcugcuuc

SEQ ID NO: 1787837 - RNA, 20 nt, Homo sapiens
aaacauucacuuuccugcag

SEQ ID NO: 1787838 - RNA, 13 nt, Homo sapiens
auuucacucucaa

SEQ ID NO: 1787839 - RNA, 20 nt, Homo sapiens
auauuuuccauauauuggca

SEQ ID NO: 1787840 - RNA, 20 nt, Homo sapiens
ugcugaauccccuaucccau

SEQ ID NO: 1787841 - RNA, 23 nt, Homo sapiens
caauagacuguacuuauuuucca

SEQ ID NO: 1787842 - RNA, 20 nt, Homo sapiens
uccccauuggugcuaccugg

SEQ ID NO: 1787843 - RNA, 20 nt, Homo sapiens
aaaucuaggugauuguucau

SEQ ID NO: 1787844 - RNA, 17 nt, Homo sapiens
uuucagccuacauugau

SEQ ID NO: 1787845 - RNA, 17 nt, Homo sapiens
guaagggaaacugccag

SEQ ID NO: 1787846 - RNA, 23 nt, Homo sapiens
agauuugugcaaacauggagaaa

SEQ ID NO: 1787847 - RNA, 21 nt, Homo sapiens
acugucugggauuaagggcaa

SEQ ID NO: 1787848 - RNA, 14 nt, Homo sapiens
cccggaccucugga

SEQ ID NO: 1787849 - RNA, 16 nt, Homo sapiens
auaauaugcugccaaa

SEQ ID NO: 1787850 - RNA, 20 nt, Homo sapiens
cuggaugggcuuggccaaaa

SEQ ID NO: 1787851 - RNA, 21 nt, Homo sapiens
aggaaaaccucaagcaguaau

SEQ ID NO: 1787852 - RNA, 22 nt, Homo sapiens
uuaauuuuuaaaagacuuugau

SEQ ID NO: 1787853 - RNA, 17 nt, Homo sapiens
uuccauguugcugccaa

SEQ ID NO: 1787854 - RNA, 13 nt, Homo sapiens
uugucauauguau

SEQ ID NO: 1787855 - RNA, 21 nt, Homo sapiens
aaaagcaauucugacugucca

SEQ ID NO: 1787856 - RNA, 16 nt, Homo sapiens
agguggaguaggugaa

SEQ ID NO: 1787857 - RNA, 16 nt, Homo sapiens
agcuggaguacgugaa

SEQ ID NO: 1787858 - RNA, 22 nt, Homo sapiens
uuuaauucaccccacacuagaa

SEQ ID NO: 1787859 - RNA, 15 nt, Homo sapiens
cuccugcaaaccuca

SEQ ID NO: 1787860 - RNA, 17 nt, Homo sapiens
ugccaccuccuggaagg

SEQ ID NO: 1787861 - RNA, 22 nt, Homo sapiens
accaccccccacccuccuccag

SEQ ID NO: 1787862 - RNA, 20 nt, Homo sapiens
ucauacauuaucucacuugu

SEQ ID NO: 1787863 - RNA, 21 nt, Homo sapiens
uggaauagaaacagugguuug

SEQ ID NO: 1787864 - RNA, 22 nt, Homo sapiens
ugagucccauuugccuugcaau

SEQ ID NO: 1787865 - RNA, 16 nt, Homo sapiens
aacauggagaggacuu

SEQ ID NO: 1787866 - RNA, 16 nt, Homo sapiens
uuuaaggggagcucuu

SEQ ID NO: 1787867 - RNA, 14 nt, Homo sapiens
ggagagaaaaaaga

SEQ ID NO: 1787868 - RNA, 13 nt, Homo sapiens
ucauagugagaac

SEQ ID NO: 1787869 - RNA, 19 nt, Homo sapiens
uaaaauucucauuacucuu

SEQ ID NO: 1787870 - RNA, 21 nt, Homo sapiens
ggcucgagagggcugguccuu

SEQ ID NO: 1787871 - RNA, 20 nt, Homo sapiens
uacaucuuuagauacguugu

SEQ ID NO: 1787872 - RNA, 15 nt, Homo sapiens
cuuuagagugcaagu

SEQ ID NO: 1787873 - RNA, 11 nt, Homo sapiens
uacagacucca

SEQ ID NO: 1787874 - RNA, 15 nt, Homo sapiens
uaguccaucuccagc

SEQ ID NO: 1787875 - RNA, 14 nt, Homo sapiens
gcauagauugauca

SEQ ID NO: 1787876 - RNA, 13 nt, Homo sapiens
aacugguccaggc

SEQ ID NO: 1787877 - RNA, 13 nt, Homo sapiens
caguauuaugcau

SEQ ID NO: 1787878 - RNA, 19 nt, Homo sapiens
aagcaaaucguauaccuua

SEQ ID NO: 1787879 - RNA, 16 nt, Homo sapiens
acugcagucacugcac

SEQ ID NO: 1787880 - RNA, 13 nt, Homo sapiens
ugggaaagcccag

SEQ ID NO: 1787881 - RNA, 22 nt, Homo sapiens
uguuauuugcacacugcacugu

SEQ ID NO: 1787882 - RNA, 16 nt, Homo sapiens
cuucccaacucacuuu

SEQ ID NO: 1787883 - RNA, 16 nt, Homo sapiens
acggacccauagacag

SEQ ID NO: 1787884 - RNA, 19 nt, Homo sapiens
cauguuugcaccugugcau

SEQ ID NO: 1787885 - RNA, 23 nt, Homo sapiens
uuuaucccccgcaaagacaucaa

SEQ ID NO: 1787886 - RNA, 18 nt, Homo sapiens
caaugcuggcuuucuccc

SEQ ID NO: 1787887 - RNA, 22 nt, Homo sapiens
gacaagcccuugagaagccaac

SEQ ID NO: 1787888 - RNA, 15 nt, Homo sapiens
agugaugaaucagca

SEQ ID NO: 1787889 - RNA, 21 nt, Homo sapiens
uguccacccaccuaugugcca

SEQ ID NO: 1787890 - RNA, 20 nt, Homo sapiens
gugcugggaauuacaggcgu

SEQ ID NO: 1787891 - RNA, 17 nt, Homo sapiens
aggaaaagcauguuaug

SEQ ID NO: 1787892 - RNA, 17 nt, Homo sapiens
gacccaagauaaaagaa

SEQ ID NO: 1787893 - RNA, 23 nt, Homo sapiens
gagagcuucuguugcugccucau

SEQ ID NO: 1787894 - RNA, 18 nt, Homo sapiens
aauccuggcccucugugu

SEQ ID NO: 1787895 - RNA, 14 nt, Homo sapiens
cuaaaugacuuuca

SEQ ID NO: 1787896 - RNA, 15 nt, Homo sapiens
uagucucagcuacuu

SEQ ID NO: 1787897 - RNA, 17 nt, Homo sapiens
ugagagcugugcaucag

SEQ ID NO: 1787898 - RNA, 22 nt, Homo sapiens
uacuggacacacuaaacucugg

SEQ ID NO: 1787899 - RNA, 17 nt, Homo sapiens
gacuccgagaacaacag

SEQ ID NO: 1787900 - RNA, 14 nt, Homo sapiens
caccuuuuaacuca

SEQ ID NO: 1787901 - RNA, 22 nt, Homo sapiens
uaaauuuuuuugauaauagaga

SEQ ID NO: 1787902 - RNA, 22 nt, Homo sapiens
accccagugcuuguuccucuca

SEQ ID NO: 1787903 - RNA, 17 nt, Homo sapiens
cuuggcuuuaugcaaau

SEQ ID NO: 1787904 - RNA, 19 nt, Homo sapiens
gcuaauuuugaaugcccuc

SEQ ID NO: 1787905 - RNA, 16 nt, Homo sapiens
uacacugacuugagac

SEQ ID NO: 1787906 - RNA, 22 nt, Homo sapiens
cucuuucccuuccccugugguc

SEQ ID NO: 1787907 - RNA, 17 nt, Homo sapiens
cuugagaaggugcuuug

SEQ ID NO: 1787908 - RNA, 17 nt, Homo sapiens
uagaauaaugcaagaua

SEQ ID NO: 1787909 - RNA, 18 nt, Homo sapiens
aguggagcuggucugcca

SEQ ID NO: 1787910 - RNA, 19 nt, Homo sapiens
caccucaaauacauaccua

SEQ ID NO: 1787911 - RNA, 15 nt, Homo sapiens
ggugcaggacacugg

SEQ ID NO: 1787912 - RNA, 21 nt, Homo sapiens
ccugcucauguaccucugauu

SEQ ID NO: 1787913 - RNA, 11 nt, Homo sapiens
cuugugacuag

SEQ ID NO: 1787914 - RNA, 17 nt, Homo sapiens
aaucaaaaucaaugcag

SEQ ID NO: 1787915 - RNA, 20 nt, Homo sapiens
auguguguguacaacacugg

SEQ ID NO: 1787916 - RNA, 16 nt, Homo sapiens
uauuuuaaaacauaag

SEQ ID NO: 1787917 - RNA, 16 nt, Homo sapiens
cacugauuugauacca

SEQ ID NO: 1787918 - RNA, 14 nt, Homo sapiens
ggaaggcuugcagu

SEQ ID NO: 1787919 - RNA, 15 nt, Homo sapiens
auccacaugcucugc

SEQ ID NO: 1787920 - RNA, 13 nt, Homo sapiens
aaacaggucuuug

SEQ ID NO: 1787921 - RNA, 21 nt, Homo sapiens
ggaccuuuucccuugcuguac

SEQ ID NO: 1787922 - RNA, 14 nt, Homo sapiens
caaaccuacuguau

SEQ ID NO: 1787923 - RNA, 22 nt, Homo sapiens
auagcuugccuaauggcuuuca

SEQ ID NO: 1787924 - RNA, 15 nt, Homo sapiens
aauguaucacauuga

SEQ ID NO: 1787925 - RNA, 23 nt, Homo sapiens
uuuaaggcagcaacaagaaaaga

SEQ ID NO: 1787926 - RNA, 23 nt, Homo sapiens
cucagccuacuuucacacuaaga

SEQ ID NO: 1787927 - RNA, 22 nt, Homo sapiens
ccucacuccuguuacuuaccua

SEQ ID NO: 1787928 - RNA, 20 nt, Homo sapiens
uccuggcuggcuguguccuc

SEQ ID NO: 1787929 - RNA, 15 nt, Homo sapiens
acccaugacugcccc

SEQ ID NO: 1787930 - RNA, 21 nt, Homo sapiens
agugccuuccucucucuacca

SEQ ID NO: 1787931 - RNA, 22 nt, Homo sapiens
ggaguucaagaccagccugucc

SEQ ID NO: 1787932 - RNA, 22 nt, Homo sapiens
aucugucauaagcauuacuuua

SEQ ID NO: 1787933 - RNA, 16 nt, Homo sapiens
cuccucgcugccagau

SEQ ID NO: 1787934 - RNA, 23 nt, Homo sapiens
agggaaaacaaauauuucacuua

SEQ ID NO: 1787935 - RNA, 14 nt, Homo sapiens
gguccuucauucuu

SEQ ID NO: 1787936 - RNA, 14 nt, Homo sapiens
uugcuaagcacucu

SEQ ID NO: 1787937 - RNA, 19 nt, Homo sapiens
uaaaugagucaaaguucaa

SEQ ID NO: 1787938 - RNA, 19 nt, Homo sapiens
acacgugagccacagggcu

SEQ ID NO: 1787939 - RNA, 14 nt, Homo sapiens
cacucauauugccc

SEQ ID NO: 1787940 - RNA, 14 nt, Homo sapiens
uaguuauacuccuc

SEQ ID NO: 1787941 - RNA, 14 nt, Homo sapiens
uugcgauacacugc

SEQ ID NO: 1787942 - RNA, 18 nt, Homo sapiens
auauguuaggaauacucu

SEQ ID NO: 1787943 - RNA, 17 nt, Homo sapiens
cuggacuuuccagagac

SEQ ID NO: 1787944 - RNA, 20 nt, Homo sapiens
uuacaccuccacucagcacu

SEQ ID NO: 1787945 - RNA, 14 nt, Homo sapiens
gaaagcuuucauga

SEQ ID NO: 1787946 - RNA, 20 nt, Homo sapiens
ccugcucacaguccucauuu

SEQ ID NO: 1787947 - RNA, 15 nt, Homo sapiens
uggagcuaaggccag

SEQ ID NO: 1787948 - RNA, 18 nt, Homo sapiens
guugcuagucuaguuucc

SEQ ID NO: 1787949 - RNA, 17 nt, Homo sapiens
ugcagagugcccagaac

SEQ ID NO: 1787950 - RNA, 20 nt, Homo sapiens
uguggcuuugcauuucaaau

SEQ ID NO: 1787951 - RNA, 20 nt, Homo sapiens
ucacaacauuuacuuaacag

SEQ ID NO: 1787952 - RNA, 14 nt, Homo sapiens
uugaagugagcuga

SEQ ID NO: 1787953 - RNA, 19 nt, Homo sapiens
cugguaauuuguaucugaa

SEQ ID NO: 1787954 - RNA, 22 nt, Homo sapiens
cuaucugaauccaagacagcca

SEQ ID NO: 1787955 - RNA, 16 nt, Homo sapiens
cuucuuuaccaaggau

SEQ ID NO: 1787956 - RNA, 20 nt, Homo sapiens
cccugcgcaugaaccuggac

SEQ ID NO: 1787957 - RNA, 17 nt, Homo sapiens
aguauucuguaccauag

SEQ ID NO: 1787958 - RNA, 19 nt, Homo sapiens
uaaauagaccucucaauuu

SEQ ID NO: 1787959 - RNA, 20 nt, Homo sapiens
aagucuuaaucauuugugac

SEQ ID NO: 1787960 - RNA, 16 nt, Homo sapiens
aauucaguaguaacag

SEQ ID NO: 1787961 - RNA, 17 nt, Homo sapiens
accuuggaaaugaccag

SEQ ID NO: 1787962 - RNA, 22 nt, Homo sapiens
uaccuggugcucucaacaggac

SEQ ID NO: 1787963 - RNA, 22 nt, Homo sapiens
ccaaggaacaaaaaaaccacaa

SEQ ID NO: 1787964 - RNA, 19 nt, Homo sapiens
uauaacacuuuccagccua

SEQ ID NO: 1787965 - RNA, 14 nt, Homo sapiens
cugccuuagccuac

SEQ ID NO: 1787966 - RNA, 18 nt, Homo sapiens
caagacaugaaguuuuau

SEQ ID NO: 1787967 - RNA, 17 nt, Homo sapiens
aaacucauuggcuuaaa

SEQ ID NO: 1787968 - RNA, 14 nt, Homo sapiens
caagaggugccugg

SEQ ID NO: 1787969 - RNA, 18 nt, Homo sapiens
cucucaggaaucaucucc

SEQ ID NO: 1787970 - RNA, 15 nt, Homo sapiens
ucaaucucucuuaga

SEQ ID NO: 1787971 - RNA, 23 nt, Homo sapiens
guauauguucagcagugugccca

SEQ ID NO: 1787972 - RNA, 18 nt, Homo sapiens
ucuguggacaccacugag

SEQ ID NO: 1787973 - RNA, 15 nt, Homo sapiens
uuuugcucaguucca

SEQ ID NO: 1787974 - RNA, 14 nt, Homo sapiens
uguacaacacuggu

SEQ ID NO: 1787975 - RNA, 18 nt, Homo sapiens
ccugguuccacucuggag

SEQ ID NO: 1787976 - RNA, 14 nt, Homo sapiens
uuaauccagggaag

SEQ ID NO: 1787977 - RNA, 23 nt, Homo sapiens
aagaucaggccaaccccaaagaa

SEQ ID NO: 1787978 - RNA, 19 nt, Homo sapiens
caugcgccaccaugcccua

SEQ ID NO: 1787979 - RNA, 14 nt, Homo sapiens
uguagcaacccagg

SEQ ID NO: 1787980 - RNA, 18 nt, Homo sapiens
ggccccccucugccuuug

SEQ ID NO: 1787981 - RNA, 23 nt, Homo sapiens
auucccggagggaaacugugaau

SEQ ID NO: 1787982 - RNA, 18 nt, Homo sapiens
uggugucuauuauaguga

SEQ ID NO: 1787983 - RNA, 17 nt, Homo sapiens
accccagguucucaccu

SEQ ID NO: 1787984 - RNA, 23 nt, Homo sapiens
aucaccagccucacaaucccaca

SEQ ID NO: 1787985 - RNA, 19 nt, Homo sapiens
acugguuugcagugaauuu

SEQ ID NO: 1787986 - RNA, 13 nt, Homo sapiens
aucugccuguauc

SEQ ID NO: 1787987 - RNA, 19 nt, Homo sapiens
gcauccaaguauauaugaa

SEQ ID NO: 1787988 - RNA, 20 nt, Homo sapiens
ucucuacuaaaaauacaaaa

SEQ ID NO: 1787989 - RNA, 16 nt, Homo sapiens
aaccagagcagcucac

SEQ ID NO: 1787990 - RNA, 18 nt, Homo sapiens
caaauacugacuuucaaa

SEQ ID NO: 1787991 - RNA, 19 nt, Homo sapiens
cccagauacagcacaucca

SEQ ID NO: 1787992 - RNA, 16 nt, Homo sapiens
acauuauacacaaaga

SEQ ID NO: 1787993 - RNA, 18 nt, Homo sapiens
gucggaucuacagaacaa

SEQ ID NO: 1787994 - RNA, 22 nt, Homo sapiens
ggaggaaaaggccccugcaaug

SEQ ID NO: 1787995 - RNA, 13 nt, Homo sapiens
uucagugcaccua

SEQ ID NO: 1787996 - RNA, 23 nt, Homo sapiens
auucaaauaacccugaaucagag

SEQ ID NO: 1787997 - RNA, 16 nt, Homo sapiens
ugaaaggauguggaag

SEQ ID NO: 1787998 - RNA, 14 nt, Homo sapiens
gcacuauugcacau

SEQ ID NO: 1787999 - RNA, 14 nt, Homo sapiens
caugauuucaugua

SEQ ID NO: 1788000 - RNA, 14 nt, Homo sapiens
gcgacauagcccau

SEQ ID NO: 1788001 - RNA, 18 nt, Homo sapiens
cacugugcaguggagcag

SEQ ID NO: 1788002 - RNA, 23 nt, Homo sapiens
gcccccaugugccucuccuggga

SEQ ID NO: 1788003 - RNA, 19 nt, Homo sapiens
auaauagcguucagcagca

SEQ ID NO: 1788004 - RNA, 15 nt, Homo sapiens
aucuugcaagcaaau

SEQ ID NO: 1788005 - RNA, 18 nt, Homo sapiens
aucugauaucagcacugg

SEQ ID NO: 1788006 - RNA, 14 nt, Homo sapiens
acuuuaaccuuaga

SEQ ID NO: 1788007 - RNA, 22 nt, Homo sapiens
uuccaaagagaaggccugguca

SEQ ID NO: 1788008 - RNA, 17 nt, Homo sapiens
uccuagucuuauggaaa

SEQ ID NO: 1788009 - RNA, 20 nt, Homo sapiens
ggaagaccagcuuugcagug

SEQ ID NO: 1788010 - RNA, 19 nt, Homo sapiens
ccuccacucugaggucuca

SEQ ID NO: 1788011 - RNA, 18 nt, Homo sapiens
auaauggcucugggcuau

SEQ ID NO: 1788012 - RNA, 23 nt, Homo sapiens
caaauucaaauaauccauuccaa

SEQ ID NO: 1788013 - RNA, 16 nt, Homo sapiens
uauuuacauuuuccaa

SEQ ID NO: 1788014 - RNA, 12 nt, Homo sapiens
uaauaacacuuc

SEQ ID NO: 1788015 - RNA, 14 nt, Homo sapiens
uuugcaaugucaca

SEQ ID NO: 1788016 - RNA, 18 nt, Homo sapiens
aggacaagaggagcauga

SEQ ID NO: 1788017 - RNA, 14 nt, Homo sapiens
cagcucagugccaa

SEQ ID NO: 1788018 - RNA, 19 nt, Homo sapiens
cugcgcccaguccuuccac

SEQ ID NO: 1788019 - RNA, 17 nt, Homo sapiens
uguaaugucuugagcuc

SEQ ID NO: 1788020 - RNA, 14 nt, Homo sapiens
ccagccucuagaac

SEQ ID NO: 1788021 - RNA, 13 nt, Homo sapiens
ccgcagaccugga

SEQ ID NO: 1788022 - RNA, 22 nt, Homo sapiens
uugcaagauuccaaguucucac

SEQ ID NO: 1788023 - RNA, 15 nt, Homo sapiens
cugccagacacugag

SEQ ID NO: 1788024 - RNA, 21 nt, Homo sapiens
cguuucauuuuuacaccaauu

SEQ ID NO: 1788025 - RNA, 15 nt, Homo sapiens
ggaagcacaggcaag

SEQ ID NO: 1788026 - RNA, 16 nt, Homo sapiens
aaaaagcaugaucuga

SEQ ID NO: 1788027 - RNA, 19 nt, Homo sapiens
agucauaaaauguaucuuc

SEQ ID NO: 1788028 - RNA, 11 nt, Homo sapiens
cugaaaaccaa

SEQ ID NO: 1788029 - RNA, 14 nt, Homo sapiens
aaacaugugcccuc

SEQ ID NO: 1788030 - RNA, 17 nt, Homo sapiens
gcaacugaaugacuaau

SEQ ID NO: 1788031 - RNA, 16 nt, Homo sapiens
gucacuugaagccaaa

SEQ ID NO: 1788032 - RNA, 12 nt, Homo sapiens
agggcaugccug

SEQ ID NO: 1788033 - RNA, 18 nt, Homo sapiens
auaaagccacuuuccucu

SEQ ID NO: 1788034 - RNA, 21 nt, Homo sapiens
gcuggacgugcgcgaugccug

SEQ ID NO: 1788035 - RNA, 23 nt, Homo sapiens
uccugagggagcuccaacucaga

SEQ ID NO: 1788036 - RNA, 19 nt, Homo sapiens
agaucgcgccaaugcacuc

SEQ ID NO: 1788037 - RNA, 21 nt, Homo sapiens
gauuagcagaagaaaggaaca

SEQ ID NO: 1788038 - RNA, 16 nt, Homo sapiens
uaucaggcgucccaua

SEQ ID NO: 1788039 - RNA, 20 nt, Homo sapiens
cauaaaccucaaguuauuca

SEQ ID NO: 1788040 - RNA, 14 nt, Homo sapiens
aaaaacacacuccu

SEQ ID NO: 1788041 - RNA, 15 nt, Homo sapiens
uaaaaucaauaagag

SEQ ID NO: 1788042 - RNA, 17 nt, Homo sapiens
aucugcauuccccgcug

SEQ ID NO: 1788043 - RNA, 18 nt, Homo sapiens
gaaaugagcucaaauuga

SEQ ID NO: 1788044 - RNA, 20 nt, Homo sapiens
acuucaguuuauaccuugcc

SEQ ID NO: 1788045 - RNA, 20 nt, Homo sapiens
agaaaaaaaccaaaguacuu

SEQ ID NO: 1788046 - RNA, 23 nt, Homo sapiens
gugaauagucugugugcacaaug

SEQ ID NO: 1788047 - RNA, 16 nt, Homo sapiens
gccuuggagaucaaaa

SEQ ID NO: 1788048 - RNA, 13 nt, Homo sapiens
aaugacugugcua

SEQ ID NO: 1788049 - RNA, 14 nt, Homo sapiens
auuuuuccacuuaa

SEQ ID NO: 1788050 - RNA, 14 nt, Homo sapiens
caggugacagugag

SEQ ID NO: 1788051 - RNA, 17 nt, Homo sapiens
aucuccaacucucucug

SEQ ID NO: 1788052 - RNA, 17 nt, Homo sapiens
cuugcuauguugcccaa

SEQ ID NO: 1788053 - RNA, 21 nt, Homo sapiens
aauuaaauccaacuuucacag

SEQ ID NO: 1788054 - RNA, 19 nt, Homo sapiens
aacaggauuagacagucaa

SEQ ID NO: 1788055 - RNA, 23 nt, Homo sapiens
ggcccuuccucuccacugccuuc

SEQ ID NO: 1788056 - RNA, 15 nt, Homo sapiens
gcccagggagcaaug

SEQ ID NO: 1788057 - RNA, 20 nt, Homo sapiens
gccaccuggccuaaugcugu

SEQ ID NO: 1788058 - RNA, 15 nt, Homo sapiens
uccuagcuaucaaga

SEQ ID NO: 1788059 - RNA, 21 nt, Homo sapiens
aagagauucuucuagaucuca

SEQ ID NO: 1788060 - RNA, 15 nt, Homo sapiens
ucaucucagcucacu

SEQ ID NO: 1788061 - RNA, 23 nt, Homo sapiens
cuaggaaaagggauacuuugaua

SEQ ID NO: 1788062 - RNA, 17 nt, Homo sapiens
agcucuguugaaucaca

SEQ ID NO: 1788063 - RNA, 23 nt, Homo sapiens
acucuuugguuuuaucauuccau

SEQ ID NO: 1788064 - RNA, 15 nt, Homo sapiens
augaauaaaacacuc

SEQ ID NO: 1788065 - RNA, 15 nt, Homo sapiens
aucuaacaaagucaa

SEQ ID NO: 1788066 - RNA, 20 nt, Homo sapiens
uguccuaaucauacaccaga

SEQ ID NO: 1788067 - RNA, 19 nt, Homo sapiens
cuccaggacucagugaucc

SEQ ID NO: 1788068 - RNA, 18 nt, Homo sapiens
gauggcaucuccauguag

SEQ ID NO: 1788069 - RNA, 13 nt, Homo sapiens
aggaguucaagac

SEQ ID NO: 1788070 - RNA, 12 nt, Homo sapiens
ggccucucugac

SEQ ID NO: 1788071 - RNA, 14 nt, Homo sapiens
uuaaaugaagccaa

SEQ ID NO: 1788072 - RNA, 17 nt, Homo sapiens
acccugaaggggccaug

SEQ ID NO: 1788073 - RNA, 13 nt, Homo sapiens
gaaaccugaguga

SEQ ID NO: 1788074 - RNA, 22 nt, Homo sapiens
guucagaaagcaauaacuuugu

SEQ ID NO: 1788075 - RNA, 18 nt, Homo sapiens
caaauaaugucucuguga

SEQ ID NO: 1788076 - RNA, 16 nt, Homo sapiens
uuucuaucacauauuu

SEQ ID NO: 1788077 - RNA, 20 nt, Homo sapiens
auuuagaguucuagaccucu

SEQ ID NO: 1788078 - RNA, 14 nt, Homo sapiens
ucaaguaauggagg

SEQ ID NO: 1788079 - RNA, 22 nt, Homo sapiens
aagcacaucuuugaccacguca

SEQ ID NO: 1788080 - RNA, 19 nt, Homo sapiens
agugcaagagacucuggcc

SEQ ID NO: 1788081 - RNA, 19 nt, Homo sapiens
cacccaaggaugucugcca

SEQ ID NO: 1788082 - RNA, 16 nt, Homo sapiens
uaucuuaacacugaaa

SEQ ID NO: 1788083 - RNA, 15 nt, Homo sapiens
uacauuuaugugcug

SEQ ID NO: 1788084 - RNA, 15 nt, Homo sapiens
aggcuugaugaugau

SEQ ID NO: 1788085 - RNA, 11 nt, Homo sapiens
auuuugcucaa

SEQ ID NO: 1788086 - RNA, 13 nt, Homo sapiens
gcguagggccagg

SEQ ID NO: 1788087 - RNA, 21 nt, Homo sapiens
gguccuucccucucaugacuu

SEQ ID NO: 1788088 - RNA, 13 nt, Homo sapiens
uaaugccaaguua

SEQ ID NO: 1788089 - RNA, 12 nt, Homo sapiens
cuccacuauguu

SEQ ID NO: 1788090 - RNA, 21 nt, Homo sapiens
cuucccaugucuuucuccaaa

SEQ ID NO: 1788091 - RNA, 12 nt, Homo sapiens
ugugacuauaaa

SEQ ID NO: 1788092 - RNA, 22 nt, Homo sapiens
uuauucauccagcaguguugcu

SEQ ID NO: 1788093 - RNA, 19 nt, Homo sapiens
caaaacuuccugauuugau

SEQ ID NO: 1788094 - RNA, 16 nt, Homo sapiens
gccugggccccggaaa

SEQ ID NO: 1788095 - RNA, 16 nt, Homo sapiens
ccaccagccacuuuag

SEQ ID NO: 1788096 - RNA, 19 nt, Homo sapiens
aguucacggcaaaauguca

SEQ ID NO: 1788097 - RNA, 15 nt, Homo sapiens
agcagaaacccaugu

SEQ ID NO: 1788098 - RNA, 15 nt, Homo sapiens
gcagcuagugccuuu

SEQ ID NO: 1788099 - RNA, 14 nt, Homo sapiens
gauccauuaucuau

SEQ ID NO: 1788100 - RNA, 13 nt, Homo sapiens
caggaugagggaa

SEQ ID NO: 1788101 - RNA, 21 nt, Homo sapiens
ccaauuucuuucuaaaacaca

SEQ ID NO: 1788102 - RNA, 19 nt, Homo sapiens
auuauggggacuuugguuu

SEQ ID NO: 1788103 - RNA, 13 nt, Homo sapiens
aaaaauuacucaa

SEQ ID NO: 1788104 - RNA, 18 nt, Homo sapiens
guccacguguguguguga

SEQ ID NO: 1788105 - RNA, 22 nt, Homo sapiens
uuaucauuaaaaggaaagcaga

SEQ ID NO: 1788106 - RNA, 17 nt, Homo sapiens
gaaaacaaaagcccuuu

SEQ ID NO: 1788107 - RNA, 23 nt, Homo sapiens
cagccaucuguagaagguucuac

SEQ ID NO: 1788108 - RNA, 13 nt, Homo sapiens
aaagcauaaagcu

SEQ ID NO: 1788109 - RNA, 23 nt, Homo sapiens
aaucugaucuuuuuauacacaau

SEQ ID NO: 1788110 - RNA, 23 nt, Homo sapiens
agaaauuaaacauauucaaggag

SEQ ID NO: 1788111 - RNA, 18 nt, Homo sapiens
acaagugccugacacgca

SEQ ID NO: 1788112 - RNA, 23 nt, Homo sapiens
auucccuccucccuucuacugcu

SEQ ID NO: 1788113 - RNA, 15 nt, Homo sapiens
uaacucuuuggucau

SEQ ID NO: 1788114 - RNA, 19 nt, Homo sapiens
uguaaaccccaagaugaca

SEQ ID NO: 1788115 - RNA, 21 nt, Homo sapiens
cacauauacauuauuucugua

SEQ ID NO: 1788116 - RNA, 22 nt, Homo sapiens
cccaguguuggucuguguccau

SEQ ID NO: 1788117 - RNA, 21 nt, Homo sapiens
ugaaaaacuauuaacaacuug

SEQ ID NO: 1788118 - RNA, 12 nt, Homo sapiens
gguaugagcuga

SEQ ID NO: 1788119 - RNA, 17 nt, Homo sapiens
caucacacucaaggaca

SEQ ID NO: 1788120 - RNA, 16 nt, Homo sapiens
ucuuaaugccacggca

SEQ ID NO: 1788121 - RNA, 19 nt, Homo sapiens
auauuuuuucuuuugacau

SEQ ID NO: 1788122 - RNA, 13 nt, Homo sapiens
gcgacacucaggg

SEQ ID NO: 1788123 - RNA, 16 nt, Homo sapiens
uccuggaaugcauuca

SEQ ID NO: 1788124 - RNA, 18 nt, Homo sapiens
auaugauugcuccagagc

SEQ ID NO: 1788125 - RNA, 18 nt, Homo sapiens
caccugcuucugaacuca

SEQ ID NO: 1788126 - RNA, 21 nt, Homo sapiens
ugccaaggaaacccccagugu

SEQ ID NO: 1788127 - RNA, 20 nt, Homo sapiens
auguuaguuucuugguaaag

SEQ ID NO: 1788128 - RNA, 12 nt, Homo sapiens
ucuaacagauca

SEQ ID NO: 1788129 - RNA, 16 nt, Homo sapiens
uaugugcugaacauug

SEQ ID NO: 1788130 - RNA, 18 nt, Homo sapiens
agaagacucuaccagacu

SEQ ID NO: 1788131 - RNA, 20 nt, Homo sapiens
cugagcuaucuccuaacuuu

SEQ ID NO: 1788132 - RNA, 18 nt, Homo sapiens
auggcuuuccacaucccc

SEQ ID NO: 1788133 - RNA, 17 nt, Homo sapiens
uacuaaggaaucuuucu

SEQ ID NO: 1788134 - RNA, 15 nt, Homo sapiens
cggcuucaaguggca

SEQ ID NO: 1788135 - RNA, 20 nt, Homo sapiens
acaagccaacgacaaagcca

SEQ ID NO: 1788136 - RNA, 23 nt, Homo sapiens
acuugaggacacauguccagugg

SEQ ID NO: 1788137 - RNA, 14 nt, Homo sapiens
uggugaaugacacg

SEQ ID NO: 1788138 - RNA, 18 nt, Homo sapiens
cuucacuacguguucaca

SEQ ID NO: 1788139 - RNA, 17 nt, Homo sapiens
uaacagccucuugcccg

SEQ ID NO: 1788140 - RNA, 19 nt, Homo sapiens
ccuuuccuuccaucccuac

SEQ ID NO: 1788141 - RNA, 18 nt, Homo sapiens
cucuuauuucugaauuca

SEQ ID NO: 1788142 - RNA, 19 nt, Homo sapiens
cauuuuucccuauuuuccu

SEQ ID NO: 1788143 - RNA, 17 nt, Homo sapiens
gcccagagcccagcucc

SEQ ID NO: 1788144 - RNA, 22 nt, Homo sapiens
ugucuuccuaucaaaaagauau

SEQ ID NO: 1788145 - RNA, 14 nt, Homo sapiens
uggggacucuccag

SEQ ID NO: 1788146 - RNA, 16 nt, Homo sapiens
uggagcuggucugcca

SEQ ID NO: 1788147 - RNA, 20 nt, Homo sapiens
auacuuaacaaauacauuca

SEQ ID NO: 1788148 - RNA, 22 nt, Homo sapiens
uagaaaaugugaguaguacaau

SEQ ID NO: 1788149 - RNA, 17 nt, Homo sapiens
uuagccuugaacaacca

SEQ ID NO: 1788150 - RNA, 21 nt, Homo sapiens
cgaggcggcaaagauccagcg

SEQ ID NO: 1788151 - RNA, 18 nt, Homo sapiens
cagcgagacuccgucuca

SEQ ID NO: 1788152 - RNA, 21 nt, Homo sapiens
gugagcagggucaagccucuu

SEQ ID NO: 1788153 - RNA, 23 nt, Homo sapiens
aacucuccuuugcucucuggcca

SEQ ID NO: 1788154 - RNA, 13 nt, Homo sapiens
aaauaaacauguu

SEQ ID NO: 1788155 - RNA, 15 nt, Homo sapiens
aggccucugccccaa

SEQ ID NO: 1788156 - RNA, 18 nt, Homo sapiens
aauaaauaugaauggagu

SEQ ID NO: 1788157 - RNA, 18 nt, Homo sapiens
cuagacauggagguucua

SEQ ID NO: 1788158 - RNA, 14 nt, Homo sapiens
cauccuucaaauaa

SEQ ID NO: 1788159 - RNA, 21 nt, Homo sapiens
uuccugguggauacuguagaa

SEQ ID NO: 1788160 - RNA, 18 nt, Homo sapiens
gaguccugucagcuuccc

SEQ ID NO: 1788161 - RNA, 15 nt, Homo sapiens
agaucuacacucucg

SEQ ID NO: 1788162 - RNA, 13 nt, Homo sapiens
uuuaauuuugaca

SEQ ID NO: 1788163 - RNA, 16 nt, Homo sapiens
cuggaaaacagaacac

SEQ ID NO: 1788164 - RNA, 14 nt, Homo sapiens
gcuccccaaagggu

SEQ ID NO: 1788165 - RNA, 15 nt, Homo sapiens
ggcucagcaugcaga

SEQ ID NO: 1788166 - RNA, 22 nt, Homo sapiens
uaugugagugaaaguacuucag

SEQ ID NO: 1788167 - RNA, 14 nt, Homo sapiens
auaauaagcacuca

SEQ ID NO: 1788168 - RNA, 19 nt, Homo sapiens
auccaucccuccauucauc

SEQ ID NO: 1788169 - RNA, 23 nt, Homo sapiens
uaaaauacuauauuaaauucuga

SEQ ID NO: 1788170 - RNA, 15 nt, Homo sapiens
gcuccuggguuucau

SEQ ID NO: 1788171 - RNA, 13 nt, Homo sapiens
caucucugcaaaa

SEQ ID NO: 1788172 - RNA, 14 nt, Homo sapiens
uguaacugccuacc

SEQ ID NO: 1788173 - RNA, 18 nt, Homo sapiens
gauccuguuggacaccca

SEQ ID NO: 1788174 - RNA, 15 nt, Homo sapiens
guuagcagagcugga

SEQ ID NO: 1788175 - RNA, 18 nt, Homo sapiens
gaaaggacagcuuugaua

SEQ ID NO: 1788176 - RNA, 23 nt, Homo sapiens
cccuuggagggagagguggcagg

SEQ ID NO: 1788177 - RNA, 19 nt, Homo sapiens
cauggcuccucaccaccga

SEQ ID NO: 1788178 - RNA, 13 nt, Homo sapiens
aggugagcgcuuu

SEQ ID NO: 1788179 - RNA, 15 nt, Homo sapiens
aucagccagcaagag

SEQ ID NO: 1788180 - RNA, 18 nt, Homo sapiens
aauaccagugaaccaaag

SEQ ID NO: 1788181 - RNA, 14 nt, Homo sapiens
caaaguccuuaaca

SEQ ID NO: 1788182 - RNA, 18 nt, Homo sapiens
aucacuguuuagauuugc

SEQ ID NO: 1788183 - RNA, 18 nt, Homo sapiens
ccacuaaaauguggguga

SEQ ID NO: 1788184 - RNA, 17 nt, Homo sapiens
aucugagaggccacagu

SEQ ID NO: 1788185 - RNA, 23 nt, Homo sapiens
aaugcuucucucauagugucaua

SEQ ID NO: 1788186 - RNA, 17 nt, Homo sapiens
guauuccugauaugccu

SEQ ID NO: 1788187 - RNA, 14 nt, Homo sapiens
uugaaugugucagg

SEQ ID NO: 1788188 - RNA, 22 nt, Homo sapiens
acuuucagugcuuuuacuaucu

SEQ ID NO: 1788189 - RNA, 22 nt, Homo sapiens
accugucuucuggcucucucug

SEQ ID NO: 1788190 - RNA, 22 nt, Homo sapiens
guguuuuuaauaaagacagggu

SEQ ID NO: 1788191 - RNA, 23 nt, Homo sapiens
aaacucuuugcccaguucauccc

SEQ ID NO: 1788192 - RNA, 22 nt, Homo sapiens
ugggcccacccggugggacccc

SEQ ID NO: 1788193 - RNA, 17 nt, Homo sapiens
gcucuacccugcagcuu

SEQ ID NO: 1788194 - RNA, 14 nt, Homo sapiens
aucuggguaauuaa

SEQ ID NO: 1788195 - RNA, 12 nt, Homo sapiens
gguuaacagcug

SEQ ID NO: 1788196 - RNA, 16 nt, Homo sapiens
aaggcuuuuggugaaa

SEQ ID NO: 1788197 - RNA, 19 nt, Homo sapiens
aggccugaggccugugccu

SEQ ID NO: 1788198 - RNA, 21 nt, Homo sapiens
aacuacacgguucaaaccugu

SEQ ID NO: 1788199 - RNA, 17 nt, Homo sapiens
agcucuucccuugcuca

SEQ ID NO: 1788200 - RNA, 20 nt, Homo sapiens
cugaaauggaauucccaugc

SEQ ID NO: 1788201 - RNA, 18 nt, Homo sapiens
aaauuucgagcauaagaa

SEQ ID NO: 1788202 - RNA, 21 nt, Homo sapiens
gucuauuuucucagucauuuu

SEQ ID NO: 1788203 - RNA, 17 nt, Homo sapiens
cuucugagcagaaaugg

SEQ ID NO: 1788204 - RNA, 15 nt, Homo sapiens
uacaugcauugcucu

SEQ ID NO: 1788205 - RNA, 23 nt, Homo sapiens
augacugaaguacuggaauuuau

SEQ ID NO: 1788206 - RNA, 12 nt, Homo sapiens
cccgagucaauu

SEQ ID NO: 1788207 - RNA, 17 nt, Homo sapiens
ugggaauuaagcaaaau

SEQ ID NO: 1788208 - RNA, 15 nt, Homo sapiens
cuguuucugaaccau

SEQ ID NO: 1788209 - RNA, 15 nt, Homo sapiens
auuccagcgucuucu

SEQ ID NO: 1788210 - RNA, 22 nt, Homo sapiens
ccacaugggagcaguccaugca

SEQ ID NO: 1788211 - RNA, 17 nt, Homo sapiens
cccagcccugaacaaag

SEQ ID NO: 1788212 - RNA, 20 nt, Homo sapiens
aggcagcagaaaucauuuuc

SEQ ID NO: 1788213 - RNA, 22 nt, Homo sapiens
ugcaagguauuacacucuguaa

SEQ ID NO: 1788214 - RNA, 23 nt, Homo sapiens
cagcucauaaaauggaagcaauu

SEQ ID NO: 1788215 - RNA, 17 nt, Homo sapiens
ccagaaccuguccuugc

SEQ ID NO: 1788216 - RNA, 17 nt, Homo sapiens
ugagaaagggagaggaa

SEQ ID NO: 1788217 - RNA, 18 nt, Homo sapiens
ccugcauccucuccccca

SEQ ID NO: 1788218 - RNA, 19 nt, Homo sapiens
uucuaugcuaaacugugaa

SEQ ID NO: 1788219 - RNA, 17 nt, Homo sapiens
agcuuucucuaguucaa

SEQ ID NO: 1788220 - RNA, 18 nt, Homo sapiens
ccagaaugaaaacuguaa

SEQ ID NO: 1788221 - RNA, 19 nt, Homo sapiens
cauucacauuugauguaca

SEQ ID NO: 1788222 - RNA, 15 nt, Homo sapiens
ucuaaaaauugaacu

SEQ ID NO: 1788223 - RNA, 19 nt, Homo sapiens
uggggagcuccugggaccc

SEQ ID NO: 1788224 - RNA, 23 nt, Homo sapiens
cuuucguagccuaaaagacaauu

SEQ ID NO: 1788225 - RNA, 11 nt, Homo sapiens
ucagcugugaa

SEQ ID NO: 1788226 - RNA, 20 nt, Homo sapiens
agaaauuuucugaucucaga

SEQ ID NO: 1788227 - RNA, 16 nt, Homo sapiens
cacccuucucagggac

SEQ ID NO: 1788228 - RNA, 16 nt, Homo sapiens
ucucugccacuccuga

SEQ ID NO: 1788229 - RNA, 18 nt, Homo sapiens
cauuuucacaacauauca

SEQ ID NO: 1788230 - RNA, 22 nt, Homo sapiens
auccuuagagggacccuuccaa

SEQ ID NO: 1788231 - RNA, 17 nt, Homo sapiens
ccucggccucccaaaau

SEQ ID NO: 1788232 - RNA, 16 nt, Homo sapiens
aggaacccuuggucac

SEQ ID NO: 1788233 - RNA, 17 nt, Homo sapiens
uacauuuaugcacauuc

SEQ ID NO: 1788234 - RNA, 17 nt, Homo sapiens
uucuggugcuacuccau

SEQ ID NO: 1788235 - RNA, 17 nt, Homo sapiens
aauuggcuaaagugcau

SEQ ID NO: 1788236 - RNA, 21 nt, Homo sapiens
aauaaguauauaauccuguga

SEQ ID NO: 1788237 - RNA, 19 nt, Homo sapiens
cuuaguugcuggcucugcu

SEQ ID NO: 1788238 - RNA, 15 nt, Homo sapiens
uuacugaaucuucaa

SEQ ID NO: 1788239 - RNA, 20 nt, Homo sapiens
aaugcauguuuccugcucuu

SEQ ID NO: 1788240 - RNA, 15 nt, Homo sapiens
cacagugcaucucag

SEQ ID NO: 1788241 - RNA, 22 nt, Homo sapiens
ccacgagaaacauccugccagg

SEQ ID NO: 1788242 - RNA, 16 nt, Homo sapiens
aguguaggccuuccag

SEQ ID NO: 1788243 - RNA, 16 nt, Homo sapiens
ucgugagcucuuguga

SEQ ID NO: 1788244 - RNA, 20 nt, Homo sapiens
uuuaaaaauguuuuccccaa

SEQ ID NO: 1788245 - RNA, 18 nt, Homo sapiens
caggaguuacuggauuug

SEQ ID NO: 1788246 - RNA, 23 nt, Homo sapiens
cagagacacuuugucuaguguau

SEQ ID NO: 1788247 - RNA, 23 nt, Homo sapiens
uuucccccaaucagaaucaucau

SEQ ID NO: 1788248 - RNA, 23 nt, Homo sapiens
ugugcccuugggguaagccagag

SEQ ID NO: 1788249 - RNA, 15 nt, Homo sapiens
gaaagugaccauguu

SEQ ID NO: 1788250 - RNA, 15 nt, Homo sapiens
cauuuugagcuauuu

SEQ ID NO: 1788251 - RNA, 20 nt, Homo sapiens
cucuagcaggccuaagacau

SEQ ID NO: 1788252 - RNA, 12 nt, Homo sapiens
uauuuaugcaag

SEQ ID NO: 1788253 - RNA, 19 nt, Homo sapiens
gacucauacucaacucaac

SEQ ID NO: 1788254 - RNA, 17 nt, Homo sapiens
caacuuuucaaugugau

SEQ ID NO: 1788255 - RNA, 24 nt, Homo sapiens
gaucugaacauacagagcccacau

SEQ ID NO: 1788256 - RNA, 21 nt, Homo sapiens
aauuucccaguuaaagauuau

SEQ ID NO: 1788257 - RNA, 22 nt, Homo sapiens
uuagucccgauaggguauuuga

SEQ ID NO: 1788258 - RNA, 12 nt, Homo sapiens
uaugaucugcca

SEQ ID NO: 1788259 - RNA, 14 nt, Homo sapiens
cugugauacuugua

SEQ ID NO: 1788260 - RNA, 20 nt, Homo sapiens
cacccaucuguuuuuuguaa

SEQ ID NO: 1788261 - RNA, 21 nt, Homo sapiens
aaaauuagccgggcauggugg

SEQ ID NO: 1788262 - RNA, 16 nt, Homo sapiens
ucucugcccccauuga

SEQ ID NO: 1788263 - RNA, 18 nt, Homo sapiens
auucuguagccaacuuaa

SEQ ID NO: 1788264 - RNA, 14 nt, Homo sapiens
aaauuugaaugaca

SEQ ID NO: 1788265 - RNA, 17 nt, Homo sapiens
gccagcauauacugaag

SEQ ID NO: 1788266 - RNA, 16 nt, Homo sapiens
acagacacugcacaga

SEQ ID NO: 1788267 - RNA, 22 nt, Homo sapiens
gguccccccacagcuccaggac

SEQ ID NO: 1788268 - RNA, 16 nt, Homo sapiens
ucuguaucaagccccu

SEQ ID NO: 1788269 - RNA, 19 nt, Homo sapiens
aaguauuuccaacuuguca

SEQ ID NO: 1788270 - RNA, 20 nt, Homo sapiens
auugcucuuuaucugguuua

SEQ ID NO: 1788271 - RNA, 17 nt, Homo sapiens
cacugcucucuguggug

SEQ ID NO: 1788272 - RNA, 17 nt, Homo sapiens
ucuucuuuauugcacua

SEQ ID NO: 1788273 - RNA, 17 nt, Homo sapiens
agccuggccaacaugau

SEQ ID NO: 1788274 - RNA, 15 nt, Homo sapiens
ggguaccaugcugcc

SEQ ID NO: 1788275 - RNA, 13 nt, Homo sapiens
cauagacucacuc

SEQ ID NO: 1788276 - RNA, 20 nt, Homo sapiens
cagagcccaaggucagggag

SEQ ID NO: 1788277 - RNA, 19 nt, Homo sapiens
cauuguugagguggucuga

SEQ ID NO: 1788278 - RNA, 20 nt, Homo sapiens
gcuuuucuuuggacaacagg

SEQ ID NO: 1788279 - RNA, 14 nt, Homo sapiens
acuguauuuuccaa

SEQ ID NO: 1788280 - RNA, 18 nt, Homo sapiens
aauaccacagcucagcca

SEQ ID NO: 1788281 - RNA, 19 nt, Homo sapiens
agaaucccacauuagcuug

SEQ ID NO: 1788282 - RNA, 22 nt, Homo sapiens
aguuuuucagaaagcauuacau

SEQ ID NO: 1788283 - RNA, 16 nt, Homo sapiens
gcaaaggccagcagca

SEQ ID NO: 1788284 - RNA, 20 nt, Homo sapiens
agcucucuccuaauauucca

SEQ ID NO: 1788285 - RNA, 19 nt, Homo sapiens
aguguguugggaauugcau

SEQ ID NO: 1788286 - RNA, 22 nt, Homo sapiens
augcagagggugggguacugga

SEQ ID NO: 1788287 - RNA, 16 nt, Homo sapiens
uauuuagucugcauug

SEQ ID NO: 1788288 - RNA, 16 nt, Homo sapiens
cuccucucccagugac

SEQ ID NO: 1788289 - RNA, 15 nt, Homo sapiens
caucccagagccugg

SEQ ID NO: 1788290 - RNA, 19 nt, Homo sapiens
gacucauccugaacagcau

SEQ ID NO: 1788291 - RNA, 19 nt, Homo sapiens
aguuuuccuuuuguguaau

SEQ ID NO: 1788292 - RNA, 18 nt, Homo sapiens
acauccuguaagugcuua

SEQ ID NO: 1788293 - RNA, 21 nt, Homo sapiens
caacauggugaaaccccaucu

SEQ ID NO: 1788294 - RNA, 15 nt, Homo sapiens
caucuuccugagcua

SEQ ID NO: 1788295 - RNA, 13 nt, Homo sapiens
uuaacgacaauuu

SEQ ID NO: 1788296 - RNA, 15 nt, Homo sapiens
gcacugcuccagugg

SEQ ID NO: 1788297 - RNA, 21 nt, Homo sapiens
uuaucuuugucuuaucuacca

SEQ ID NO: 1788298 - RNA, 12 nt, Homo sapiens
cacacauacaga

SEQ ID NO: 1788299 - RNA, 23 nt, Homo sapiens
auaagaaugguuuguaaaaucca

SEQ ID NO: 1788300 - RNA, 21 nt, Homo sapiens
acaaaaucuguacaugucucc

SEQ ID NO: 1788301 - RNA, 22 nt, Homo sapiens
gaugcaaucucuugucucacau

SEQ ID NO: 1788302 - RNA, 14 nt, Homo sapiens
gaccgaacacugca

SEQ ID NO: 1788303 - RNA, 20 nt, Homo sapiens
uaggaugauagaucauaaca

SEQ ID NO: 1788304 - RNA, 20 nt, Homo sapiens
aaugaaaaauuccacucaaa

SEQ ID NO: 1788305 - RNA, 20 nt, Homo sapiens
gcauaaaugugguacaagca

SEQ ID NO: 1788306 - RNA, 19 nt, Homo sapiens
cugaucauugguuucuuaa

SEQ ID NO: 1788307 - RNA, 22 nt, Homo sapiens
cuagaggcuugcauaauaagcu

SEQ ID NO: 1788308 - RNA, 14 nt, Homo sapiens
cuguucuucacuuc

SEQ ID NO: 1788309 - RNA, 13 nt, Homo sapiens
cucugaacuggau

SEQ ID NO: 1788310 - RNA, 16 nt, Homo sapiens
uuugucuauucuccag

SEQ ID NO: 1788311 - RNA, 15 nt, Homo sapiens
cugguaaucuugcuc

SEQ ID NO: 1788312 - RNA, 19 nt, Homo sapiens
cucacccaccccugcacag

SEQ ID NO: 1788313 - RNA, 12 nt, Homo sapiens
ccucgauguccu

SEQ ID NO: 1788314 - RNA, 14 nt, Homo sapiens
acaaacccaagggc

SEQ ID NO: 1788315 - RNA, 23 nt, Homo sapiens
uagaagccaccauguauguggaa

SEQ ID NO: 1788316 - RNA, 16 nt, Homo sapiens
uugucggguucuccca

SEQ ID NO: 1788317 - RNA, 15 nt, Homo sapiens
uguuucuuaugccag

SEQ ID NO: 1788318 - RNA, 16 nt, Homo sapiens
cugaaaugagagauuu

SEQ ID NO: 1788319 - RNA, 17 nt, Homo sapiens
acucuucccucucucac

SEQ ID NO: 1788320 - RNA, 22 nt, Homo sapiens
cuacaugaaugcaaaacauuuc

SEQ ID NO: 1788321 - RNA, 21 nt, Homo sapiens
gcagagauuuucaacauuuca

SEQ ID NO: 1788322 - RNA, 14 nt, Homo sapiens
uauucccuguuaaa

SEQ ID NO: 1788323 - RNA, 13 nt, Homo sapiens
cgccacucgcuuc

SEQ ID NO: 1788324 - RNA, 19 nt, Homo sapiens
agucucuuguacagcguuu

SEQ ID NO: 1788325 - RNA, 15 nt, Homo sapiens
uagcuccccugcuga

SEQ ID NO: 1788326 - RNA, 18 nt, Homo sapiens
uuuagauuuucuuuugcc

SEQ ID NO: 1788327 - RNA, 14 nt, Homo sapiens
agucugucucugcu

SEQ ID NO: 1788328 - RNA, 22 nt, Homo sapiens
acauuugguauauuaccucaaa

SEQ ID NO: 1788329 - RNA, 13 nt, Homo sapiens
agauaauguugcu

SEQ ID NO: 1788330 - RNA, 21 nt, Homo sapiens
ucucacgauuccagugcagua

SEQ ID NO: 1788331 - RNA, 14 nt, Homo sapiens
auuucucaucugca

SEQ ID NO: 1788332 - RNA, 21 nt, Homo sapiens
augaauauuuuugucauuaaa

SEQ ID NO: 1788333 - RNA, 17 nt, Homo sapiens
gaagagauccuucugua

SEQ ID NO: 1788334 - RNA, 19 nt, Homo sapiens
uauuaugaaaucauaguau

SEQ ID NO: 1788335 - RNA, 11 nt, Homo sapiens
acucuugccaa

SEQ ID NO: 1788336 - RNA, 11 nt, Homo sapiens
uauacuuucag

SEQ ID NO: 1788337 - RNA, 22 nt, Homo sapiens
ccaccacugugucccagugucu

SEQ ID NO: 1788338 - RNA, 22 nt, Homo sapiens
uggcccauggcuguugguggga

SEQ ID NO: 1788339 - RNA, 13 nt, Homo sapiens
cucuggcuggaga

SEQ ID NO: 1788340 - RNA, 20 nt, Homo sapiens
gcuagaaggcaaagugcaca

SEQ ID NO: 1788341 - RNA, 20 nt, Homo sapiens
aaguuacuauccuggcuuug

SEQ ID NO: 1788342 - RNA, 17 nt, Homo sapiens
auugcagaccugucacc

SEQ ID NO: 1788343 - RNA, 19 nt, Homo sapiens
ugaaguggaaaaaggagag

SEQ ID NO: 1788344 - RNA, 17 nt, Homo sapiens
uuggacagcugauaaau

SEQ ID NO: 1788345 - RNA, 14 nt, Homo sapiens
cccaccacccugac

SEQ ID NO: 1788346 - RNA, 16 nt, Homo sapiens
auuauuuuugagacag

SEQ ID NO: 1788347 - RNA, 18 nt, Homo sapiens
cauaauacaaaggugcua

SEQ ID NO: 1788348 - RNA, 15 nt, Homo sapiens
aaaucccuuaaucua

SEQ ID NO: 1788349 - RNA, 23 nt, Homo sapiens
cacagauuaucuuguacagccuu

SEQ ID NO: 1788350 - RNA, 22 nt, Homo sapiens
auguccaaacccacucaugacu

SEQ ID NO: 1788351 - RNA, 14 nt, Homo sapiens
uggauuguguuugu

SEQ ID NO: 1788352 - RNA, 16 nt, Homo sapiens
acaauugaacuuaaau

SEQ ID NO: 1788353 - RNA, 15 nt, Homo sapiens
uggauuccaccaaca

SEQ ID NO: 1788354 - RNA, 16 nt, Homo sapiens
cuguccguucacaugu

SEQ ID NO: 1788355 - RNA, 13 nt, Homo sapiens
ccaucucacugca

SEQ ID NO: 1788356 - RNA, 12 nt, Homo sapiens
cuuauacagagc

SEQ ID NO: 1788357 - RNA, 21 nt, Homo sapiens
caggauuaaaagccaugaguu

SEQ ID NO: 1788358 - RNA, 16 nt, Homo sapiens
aauauaaaaacauuca

SEQ ID NO: 1788359 - RNA, 17 nt, Homo sapiens
aaagauguuaacaguau

SEQ ID NO: 1788360 - RNA, 14 nt, Homo sapiens
cacuuccaugagaa

SEQ ID NO: 1788361 - RNA, 13 nt, Homo sapiens
ccauguuucacaa

SEQ ID NO: 1788362 - RNA, 15 nt, Homo sapiens
gugcuggagacacuc

SEQ ID NO: 1788363 - RNA, 14 nt, Homo sapiens
aacuuagagaauaa

SEQ ID NO: 1788364 - RNA, 22 nt, Homo sapiens
aaauuccccaagcaccuucccc

SEQ ID NO: 1788365 - RNA, 13 nt, Homo sapiens
ugugcugcugucu

SEQ ID NO: 1788366 - RNA, 20 nt, Homo sapiens
ugcucuuuccugucuuccuu

SEQ ID NO: 1788367 - RNA, 20 nt, Homo sapiens
uagaaagaaggacccagaac

SEQ ID NO: 1788368 - RNA, 18 nt, Homo sapiens
ucugaaacucacacaacu

SEQ ID NO: 1788369 - RNA, 18 nt, Homo sapiens
caugaauaaaacacucau

SEQ ID NO: 1788370 - RNA, 14 nt, Homo sapiens
aucuguuugauaca

SEQ ID NO: 1788371 - RNA, 17 nt, Homo sapiens
cauucucaaagccucuu

SEQ ID NO: 1788372 - RNA, 18 nt, Homo sapiens
acucacaugccuucuaaa

SEQ ID NO: 1788373 - RNA, 21 nt, Homo sapiens
ccagucaaguucccuccugca

SEQ ID NO: 1788374 - RNA, 12 nt, Homo sapiens
ccagcagucagu

SEQ ID NO: 1788375 - RNA, 14 nt, Homo sapiens
uuagacauaacaaa

SEQ ID NO: 1788376 - RNA, 20 nt, Homo sapiens
ugaucucccaagcuaucuaa

SEQ ID NO: 1788377 - RNA, 19 nt, Homo sapiens
cugcuggauucaagugauc

SEQ ID NO: 1788378 - RNA, 21 nt, Homo sapiens
gcucuaaaaaguuuugcccuu

SEQ ID NO: 1788379 - RNA, 14 nt, Homo sapiens
acgacauacaugcu

SEQ ID NO: 1788380 - RNA, 23 nt, Homo sapiens
agcuccucugccuuugugcucug

SEQ ID NO: 1788381 - RNA, 23 nt, Homo sapiens
gggauuuguuacuuuagguuugu

SEQ ID NO: 1788382 - RNA, 11 nt, Homo sapiens
ugcuuccucuu

SEQ ID NO: 1788383 - RNA, 17 nt, Homo sapiens
aguaagaaccuugccug

SEQ ID NO: 1788384 - RNA, 14 nt, Homo sapiens
cuuaauacuaagga

SEQ ID NO: 1788385 - RNA, 15 nt, Homo sapiens
gcuuugaaaauucag

SEQ ID NO: 1788386 - RNA, 17 nt, Homo sapiens
aucaguaagucacaguu

SEQ ID NO: 1788387 - RNA, 19 nt, Homo sapiens
ugccucugaguagggcaau

SEQ ID NO: 1788388 - RNA, 14 nt, Homo sapiens
ugcgguaggugcug

SEQ ID NO: 1788389 - RNA, 15 nt, Homo sapiens
cagagucuuggucug

SEQ ID NO: 1788390 - RNA, 13 nt, Homo sapiens
cuaugucucuagc

SEQ ID NO: 1788391 - RNA, 15 nt, Homo sapiens
uugagaaaugcauag

SEQ ID NO: 1788392 - RNA, 15 nt, Homo sapiens
ggcagggagugauga

SEQ ID NO: 1788393 - RNA, 22 nt, Homo sapiens
cacagaugccuggguugcugcu

SEQ ID NO: 1788394 - RNA, 16 nt, Homo sapiens
aggggcucugcuuccu

SEQ ID NO: 1788395 - RNA, 14 nt, Homo sapiens
uaacagauugccau

SEQ ID NO: 1788396 - RNA, 14 nt, Homo sapiens
gcgcggugucucug

SEQ ID NO: 1788397 - RNA, 18 nt, Homo sapiens
agaugugcuuauaucauu

SEQ ID NO: 1788398 - RNA, 14 nt, Homo sapiens
ccauggugagcucu

SEQ ID NO: 1788399 - RNA, 23 nt, Homo sapiens
gccaaaauaaugcaccacuuuua

SEQ ID NO: 1788400 - RNA, 15 nt, Homo sapiens
ccaaggaugaccaca

SEQ ID NO: 1788401 - RNA, 15 nt, Homo sapiens
uuaugccuucacuuu

SEQ ID NO: 1788402 - RNA, 22 nt, Homo sapiens
auaugucugcuucuguccagga

SEQ ID NO: 1788403 - RNA, 15 nt, Homo sapiens
auauaacuaggcaaa

SEQ ID NO: 1788404 - RNA, 14 nt, Homo sapiens
cuugaguuggagua

SEQ ID NO: 1788405 - RNA, 20 nt, Homo sapiens
ggacgcccccaccagcucaa

SEQ ID NO: 1788406 - RNA, 16 nt, Homo sapiens
uaugacaucacuugua

SEQ ID NO: 1788407 - RNA, 16 nt, Homo sapiens
gucuuuugaaaacuca

SEQ ID NO: 1788408 - RNA, 12 nt, Homo sapiens
auaaaaugguca

SEQ ID NO: 1788409 - RNA, 14 nt, Homo sapiens
cucaaggacagcca

SEQ ID NO: 1788410 - RNA, 17 nt, Homo sapiens
cggaaccugaaggugcu

SEQ ID NO: 1788411 - RNA, 12 nt, Homo sapiens
ucaaaccaagaa

SEQ ID NO: 1788412 - RNA, 21 nt, Homo sapiens
gauuugaacccccgccauccu

SEQ ID NO: 1788413 - RNA, 19 nt, Homo sapiens
ggaacacaaacacauuguu

SEQ ID NO: 1788414 - RNA, 23 nt, Homo sapiens
agugaagcagccuuacuauucau

SEQ ID NO: 1788415 - RNA, 20 nt, Homo sapiens
auguuauacaauacagauca

SEQ ID NO: 1788416 - RNA, 20 nt, Homo sapiens
cuaaucaagucaaauggaga

SEQ ID NO: 1788417 - RNA, 12 nt, Homo sapiens
ugagcucucuca

SEQ ID NO: 1788418 - RNA, 14 nt, Homo sapiens
uuuuuauccaccuc

SEQ ID NO: 1788419 - RNA, 20 nt, Homo sapiens
gcacacacagaugcacacac

SEQ ID NO: 1788420 - RNA, 19 nt, Homo sapiens
guguaugagagggcccugc

SEQ ID NO: 1788421 - RNA, 17 nt, Homo sapiens
guuuguuucauauauac

SEQ ID NO: 1788422 - RNA, 14 nt, Homo sapiens
uuuaauaggacuuc

SEQ ID NO: 1788423 - RNA, 21 nt, Homo sapiens
acagcuauauuugauuaugua

SEQ ID NO: 1788424 - RNA, 13 nt, Homo sapiens
cuuagcacacuca

SEQ ID NO: 1788425 - RNA, 13 nt, Homo sapiens
aauuuugcacaga

SEQ ID NO: 1788426 - RNA, 16 nt, Homo sapiens
gccacuguuugucuca

SEQ ID NO: 1788427 - RNA, 21 nt, Homo sapiens
aauaaagcuguucucauuccu

SEQ ID NO: 1788428 - RNA, 19 nt, Homo sapiens
aaugcucuggagugugcau

SEQ ID NO: 1788429 - RNA, 21 nt, Homo sapiens
agggucugggggcagcugucc

SEQ ID NO: 1788430 - RNA, 19 nt, Homo sapiens
ccugaggcaggagggcaug

SEQ ID NO: 1788431 - RNA, 20 nt, Homo sapiens
uggaaggucacgcugaauga

SEQ ID NO: 1788432 - RNA, 13 nt, Homo sapiens
cugagaaacacua

SEQ ID NO: 1788433 - RNA, 20 nt, Homo sapiens
uuccacacucaccucuaaaa

SEQ ID NO: 1788434 - RNA, 18 nt, Homo sapiens
aacaaauuagguuuugua

SEQ ID NO: 1788435 - RNA, 20 nt, Homo sapiens
cgcggaugaagcccagccac

SEQ ID NO: 1788436 - RNA, 12 nt, Homo sapiens
caucaagacaga

SEQ ID NO: 1788437 - RNA, 15 nt, Homo sapiens
cccagguacauccau

SEQ ID NO: 1788438 - RNA, 20 nt, Homo sapiens
ugccagccaccccuccucua

SEQ ID NO: 1788439 - RNA, 18 nt, Homo sapiens
uggagucauuuuuacaau

SEQ ID NO: 1788440 - RNA, 15 nt, Homo sapiens
cuuuuuacagccaac

SEQ ID NO: 1788441 - RNA, 17 nt, Homo sapiens
gaaacgaaaaccacaaa

SEQ ID NO: 1788442 - RNA, 18 nt, Homo sapiens
aaugcacucagacuguau

SEQ ID NO: 1788443 - RNA, 19 nt, Homo sapiens
ucuuuuguucuccuauauc

SEQ ID NO: 1788444 - RNA, 14 nt, Homo sapiens
uauuauuugcacag

SEQ ID NO: 1788445 - RNA, 19 nt, Homo sapiens
uaaaagaaauguugcguaa

SEQ ID NO: 1788446 - RNA, 12 nt, Homo sapiens
aaagaagggaag

SEQ ID NO: 1788447 - RNA, 22 nt, Homo sapiens
uugaaggaagagggaccagggu

SEQ ID NO: 1788448 - RNA, 18 nt, Homo sapiens
agcuggaaaaaguguccu

SEQ ID NO: 1788449 - RNA, 20 nt, Homo sapiens
cuucccaccucacagugaug

SEQ ID NO: 1788450 - RNA, 15 nt, Homo sapiens
uaacuacaucugccu

SEQ ID NO: 1788451 - RNA, 18 nt, Homo sapiens
agcuuaaaccaacaauaa

SEQ ID NO: 1788452 - RNA, 19 nt, Homo sapiens
gugaaacgucccacacuuu

SEQ ID NO: 1788453 - RNA, 13 nt, Homo sapiens
agagaaaagggaa

SEQ ID NO: 1788454 - RNA, 15 nt, Homo sapiens
auauuaacacgcugc

SEQ ID NO: 1788455 - RNA, 16 nt, Homo sapiens
uggggugggcacauug

SEQ ID NO: 1788456 - RNA, 19 nt, Homo sapiens
uccuccguguggacugugc

SEQ ID NO: 1788457 - RNA, 13 nt, Homo sapiens
cacaacugcaguc

SEQ ID NO: 1788458 - RNA, 22 nt, Homo sapiens
agaauggaaagcuucagugcug

SEQ ID NO: 1788459 - RNA, 19 nt, Homo sapiens
auccccaccacugauauca

SEQ ID NO: 1788460 - RNA, 14 nt, Homo sapiens
acuucuuuaguauu

SEQ ID NO: 1788461 - RNA, 18 nt, Homo sapiens
gaucaauuaccuaacugu

SEQ ID NO: 1788462 - RNA, 18 nt, Homo sapiens
aucuugcaacucuguaaa

SEQ ID NO: 1788463 - RNA, 20 nt, Homo sapiens
acuccaagaccaccaggguc

SEQ ID NO: 1788464 - RNA, 13 nt, Homo sapiens
ggaugucuuucag

SEQ ID NO: 1788465 - RNA, 15 nt, Homo sapiens
aagcuggcauuguga

SEQ ID NO: 1788466 - RNA, 14 nt, Homo sapiens
accaaguacagccu

SEQ ID NO: 1788467 - RNA, 19 nt, Homo sapiens
gcuucuauuuccuuuccac

SEQ ID NO: 1788468 - RNA, 15 nt, Homo sapiens
auuuuauuguacaag

SEQ ID NO: 1788469 - RNA, 22 nt, Homo sapiens
gcacccuucuuuucucaugugu

SEQ ID NO: 1788470 - RNA, 17 nt, Homo sapiens
aaugguacucuaaucag

SEQ ID NO: 1788471 - RNA, 21 nt, Homo sapiens
ccuuggaggcugucuucucag

SEQ ID NO: 1788472 - RNA, 17 nt, Homo sapiens
cuuauaagaguucuaga

SEQ ID NO: 1788473 - RNA, 18 nt, Homo sapiens
uguuuacagacgugugca

SEQ ID NO: 1788474 - RNA, 20 nt, Homo sapiens
ccgaaaacuucacugugcuc

SEQ ID NO: 1788475 - RNA, 18 nt, Homo sapiens
ucauuugcagcugcuggu

SEQ ID NO: 1788476 - RNA, 22 nt, Homo sapiens
aucaaauaucccuccauacagu

SEQ ID NO: 1788477 - RNA, 16 nt, Homo sapiens
cacucugcucucagga

SEQ ID NO: 1788478 - RNA, 14 nt, Homo sapiens
caagaagaugaaug

SEQ ID NO: 1788479 - RNA, 22 nt, Homo sapiens
cugcuuucuuuguaacaugaca

SEQ ID NO: 1788480 - RNA, 15 nt, Homo sapiens
ccaggccucaccaaa

SEQ ID NO: 1788481 - RNA, 17 nt, Homo sapiens
agaucuaucuugucaau

SEQ ID NO: 1788482 - RNA, 19 nt, Homo sapiens
uuuuaucgccauuccaggg

SEQ ID NO: 1788483 - RNA, 14 nt, Homo sapiens
guccuggugcugcc

SEQ ID NO: 1788484 - RNA, 14 nt, Homo sapiens
aauccacacaucuu

SEQ ID NO: 1788485 - RNA, 14 nt, Homo sapiens
uuucucuuugccau

SEQ ID NO: 1788486 - RNA, 15 nt, Homo sapiens
aauuucaaaccacac

SEQ ID NO: 1788487 - RNA, 12 nt, Homo sapiens
ucuugucucaca

SEQ ID NO: 1788488 - RNA, 12 nt, Homo sapiens
ucagucagggac

SEQ ID NO: 1788489 - RNA, 15 nt, Homo sapiens
uauugccucuuucac

SEQ ID NO: 1788490 - RNA, 20 nt, Homo sapiens
uuacauuuuaaacacauuag

SEQ ID NO: 1788491 - RNA, 17 nt, Homo sapiens
acauuuauauauugucu

SEQ ID NO: 1788492 - RNA, 14 nt, Homo sapiens
ugauuaaaucugag

SEQ ID NO: 1788493 - RNA, 12 nt, Homo sapiens
uccacacccacc

SEQ ID NO: 1788494 - RNA, 19 nt, Homo sapiens
cccuuggucacaugugaca

SEQ ID NO: 1788495 - RNA, 23 nt, Homo sapiens
uggagggagaagcuagagcuuca

SEQ ID NO: 1788496 - RNA, 22 nt, Homo sapiens
ccuguccagcaggggucuccca

SEQ ID NO: 1788497 - RNA, 17 nt, Homo sapiens
ccagacucucauuccuu

SEQ ID NO: 1788498 - RNA, 17 nt, Homo sapiens
gaauccaagacagccac

SEQ ID NO: 1788499 - RNA, 19 nt, Homo sapiens
cagcaacaugauaccugga

SEQ ID NO: 1788500 - RNA, 20 nt, Homo sapiens
cuuuccagagaccaguauuc

SEQ ID NO: 1788501 - RNA, 18 nt, Homo sapiens
cacaaaugauguuuucag

SEQ ID NO: 1788502 - RNA, 22 nt, Homo sapiens
ucaauaaacaacagcugaagca

SEQ ID NO: 1788503 - RNA, 23 nt, Homo sapiens
cuggggcagacaauaaacccuca

SEQ ID NO: 1788504 - RNA, 19 nt, Homo sapiens
gacauuuugaucacucuuu

SEQ ID NO: 1788505 - RNA, 14 nt, Homo sapiens
aaugaaugugcaac

SEQ ID NO: 1788506 - RNA, 19 nt, Homo sapiens
uccagcacccccagugcag

SEQ ID NO: 1788507 - RNA, 10 nt, Homo sapiens
uuauuccagu

SEQ ID NO: 1788508 - RNA, 13 nt, Homo sapiens
aaaugugggugaa

SEQ ID NO: 1788509 - RNA, 12 nt, Homo sapiens
uaacaaucuuua

SEQ ID NO: 1788510 - RNA, 15 nt, Homo sapiens
ggccugugcacuguu

SEQ ID NO: 1788511 - RNA, 17 nt, Homo sapiens
cauggcgagauacugca

SEQ ID NO: 1788512 - RNA, 20 nt, Homo sapiens
aagguaggguguguauauau

SEQ ID NO: 1788513 - RNA, 14 nt, Homo sapiens
cggccccaccugcc

SEQ ID NO: 1788514 - RNA, 19 nt, Homo sapiens
auguaugcauucauccaac

SEQ ID NO: 1788515 - RNA, 18 nt, Homo sapiens
ugggcuucaaucacugua

SEQ ID NO: 1788516 - RNA, 18 nt, Homo sapiens
gcaaucccagcaccuuag

SEQ ID NO: 1788517 - RNA, 19 nt, Homo sapiens
caucccuuauuaguuacaa

SEQ ID NO: 1788518 - RNA, 18 nt, Homo sapiens
acuuggccaagcagggag

SEQ ID NO: 1788519 - RNA, 19 nt, Homo sapiens
gcaagaaacaucauucuac

SEQ ID NO: 1788520 - RNA, 22 nt, Homo sapiens
aacagcuuccuguuacugagau

SEQ ID NO: 1788521 - RNA, 19 nt, Homo sapiens
gcuuugacucaccuguuac

SEQ ID NO: 1788522 - RNA, 17 nt, Homo sapiens
aaauugcuuacugauau

SEQ ID NO: 1788523 - RNA, 15 nt, Homo sapiens
cuuggaacuguccca

SEQ ID NO: 1788524 - RNA, 23 nt, Homo sapiens
acacaucagcucaaaauuugcaa

SEQ ID NO: 1788525 - RNA, 16 nt, Homo sapiens
aagauuuuccucuugu

SEQ ID NO: 1788526 - RNA, 15 nt, Homo sapiens
uccccaggcauuugc

SEQ ID NO: 1788527 - RNA, 20 nt, Homo sapiens
cucaagauuguagaaacuca

SEQ ID NO: 1788528 - RNA, 13 nt, Homo sapiens
gcuggaccacaca

SEQ ID NO: 1788529 - RNA, 15 nt, Homo sapiens
aagaagagacuggga

SEQ ID NO: 1788530 - RNA, 18 nt, Homo sapiens
uaguaacaguauuuccau

SEQ ID NO: 1788531 - RNA, 18 nt, Homo sapiens
gcucuucuaccauuugaa

SEQ ID NO: 1788532 - RNA, 21 nt, Homo sapiens
agaagauaauguucuuuaaug

SEQ ID NO: 1788533 - RNA, 14 nt, Homo sapiens
guuugcaccgccug

SEQ ID NO: 1788534 - RNA, 14 nt, Homo sapiens
aggagcaauuugca

SEQ ID NO: 1788535 - RNA, 23 nt, Homo sapiens
cacaggccaggacaaaaugcaga

SEQ ID NO: 1788536 - RNA, 13 nt, Homo sapiens
cuuuucaaaagaa

SEQ ID NO: 1788537 - RNA, 21 nt, Homo sapiens
acccuguggcaaaugccagga

SEQ ID NO: 1788538 - RNA, 16 nt, Homo sapiens
gauuuguaccauuccu

SEQ ID NO: 1788539 - RNA, 15 nt, Homo sapiens
auuuaauuuccaggg

SEQ ID NO: 1788540 - RNA, 15 nt, Homo sapiens
cagggucuuaccucu

SEQ ID NO: 1788541 - RNA, 18 nt, Homo sapiens
gcaacucaucaucgguga

SEQ ID NO: 1788542 - RNA, 14 nt, Homo sapiens
agcuugcaguuuca

SEQ ID NO: 1788543 - RNA, 14 nt, Homo sapiens
guuaugcaagcaca

SEQ ID NO: 1788544 - RNA, 22 nt, Homo sapiens
ccagaguggaaauucaugagag

SEQ ID NO: 1788545 - RNA, 21 nt, Homo sapiens
uuggcucccaagucacaccca

SEQ ID NO: 1788546 - RNA, 17 nt, Homo sapiens
aaaguuugcaacucgaa

SEQ ID NO: 1788547 - RNA, 22 nt, Homo sapiens
uuuggacucuaaaaucucagca

SEQ ID NO: 1788548 - RNA, 21 nt, Homo sapiens
uacauuaggaagauaucauga

SEQ ID NO: 1788549 - RNA, 20 nt, Homo sapiens
gucuaaacuuuagaauuaau

SEQ ID NO: 1788550 - RNA, 20 nt, Homo sapiens
ggagggacacuuacccaagg

SEQ ID NO: 1788551 - RNA, 20 nt, Homo sapiens
cauaaguucauucaugccaa

SEQ ID NO: 1788552 - RNA, 22 nt, Homo sapiens
uaugcaucugcuacugugucag

SEQ ID NO: 1788553 - RNA, 16 nt, Homo sapiens
auacaccaaacauuuc

SEQ ID NO: 1788554 - RNA, 14 nt, Homo sapiens
caaugguuucacau

SEQ ID NO: 1788555 - RNA, 17 nt, Homo sapiens
cuguaauucuagcacuu

SEQ ID NO: 1788556 - RNA, 21 nt, Homo sapiens
ucugggaugaaggcuugucag

SEQ ID NO: 1788557 - RNA, 20 nt, Homo sapiens
cuuaaaaaagcccuuugcua

SEQ ID NO: 1788558 - RNA, 17 nt, Homo sapiens
aucaugaagcacaucaa

SEQ ID NO: 1788559 - RNA, 21 nt, Homo sapiens
ugaacuaaguuuuuuacuucc

SEQ ID NO: 1788560 - RNA, 14 nt, Homo sapiens
ugcuucauuccaaa

SEQ ID NO: 1788561 - RNA, 21 nt, Homo sapiens
ucaccaugacuugaggcacaa

SEQ ID NO: 1788562 - RNA, 20 nt, Homo sapiens
cauggucuaauuauuuacuc

SEQ ID NO: 1788563 - RNA, 19 nt, Homo sapiens
augauugaaaccaaguuga

SEQ ID NO: 1788564 - RNA, 22 nt, Homo sapiens
cugugucuggccagaaaaggca

SEQ ID NO: 1788565 - RNA, 15 nt, Homo sapiens
ucaccuaacuuucau

SEQ ID NO: 1788566 - RNA, 19 nt, Homo sapiens
aucuaugagcugacaucuc

SEQ ID NO: 1788567 - RNA, 20 nt, Homo sapiens
uuuuucucgaguccaaaauc

SEQ ID NO: 1788568 - RNA, 14 nt, Homo sapiens
gaagcaaauuugug

SEQ ID NO: 1788569 - RNA, 19 nt, Homo sapiens
ccaggcugcuggagugcag

SEQ ID NO: 1788570 - RNA, 18 nt, Homo sapiens
guccaggccuacuccugu

SEQ ID NO: 1788571 - RNA, 15 nt, Homo sapiens
gugccagcuggugaa

SEQ ID NO: 1788572 - RNA, 23 nt, Homo sapiens
ugcucugggagacuuacugcauu

SEQ ID NO: 1788573 - RNA, 22 nt, Homo sapiens
ccaugggaaacguaugugugca

SEQ ID NO: 1788574 - RNA, 15 nt, Homo sapiens
guccugacuguccua

SEQ ID NO: 1788575 - RNA, 13 nt, Homo sapiens
gccucuugcaaug

SEQ ID NO: 1788576 - RNA, 20 nt, Homo sapiens
aauguauuuuaaaauuucac

SEQ ID NO: 1788577 - RNA, 17 nt, Homo sapiens
acagaaaagacucugac

SEQ ID NO: 1788578 - RNA, 21 nt, Homo sapiens
cauggacacaucaggaaguua

SEQ ID NO: 1788579 - RNA, 20 nt, Homo sapiens
cagccugugguuacagugca

SEQ ID NO: 1788580 - RNA, 14 nt, Homo sapiens
ucugcuccagagag

SEQ ID NO: 1788581 - RNA, 21 nt, Homo sapiens
ucagagagcuucuuacuggau

SEQ ID NO: 1788582 - RNA, 19 nt, Homo sapiens
aagauaacaagagauuuaa

SEQ ID NO: 1788583 - RNA, 11 nt, Homo sapiens
cgucauguccu

SEQ ID NO: 1788584 - RNA, 23 nt, Homo sapiens
gccucucuacaagcagcaggaaa

SEQ ID NO: 1788585 - RNA, 19 nt, Homo sapiens
ucgguuguucuuuccucac

SEQ ID NO: 1788586 - RNA, 19 nt, Homo sapiens
guuaauuauuuugacaaau

SEQ ID NO: 1788587 - RNA, 14 nt, Homo sapiens
uuacacaaagggaa

SEQ ID NO: 1788588 - RNA, 15 nt, Homo sapiens
uacauaguugagauu

SEQ ID NO: 1788589 - RNA, 17 nt, Homo sapiens
uuaauaccacagcuuuu

SEQ ID NO: 1788590 - RNA, 17 nt, Homo sapiens
agccccaggccagcugc

SEQ ID NO: 1788591 - RNA, 20 nt, Homo sapiens
aucuuuauacuuaaacagcu

SEQ ID NO: 1788592 - RNA, 12 nt, Homo sapiens
uuaacaccagaa

SEQ ID NO: 1788593 - RNA, 23 nt, Homo sapiens
uuaauugguuugugccuuacauu

SEQ ID NO: 1788594 - RNA, 17 nt, Homo sapiens
agacccugaguccuugg

SEQ ID NO: 1788595 - RNA, 18 nt, Homo sapiens
ugucaccagcugccaaaa

SEQ ID NO: 1788596 - RNA, 13 nt, Homo sapiens
gcuuucacuuccu

SEQ ID NO: 1788597 - RNA, 14 nt, Homo sapiens
uucuauuaacuuua

SEQ ID NO: 1788598 - RNA, 21 nt, Homo sapiens
ugugugagcuaugcaaacaaa

SEQ ID NO: 1788599 - RNA, 22 nt, Homo sapiens
auugaguuguaucguguggugu

SEQ ID NO: 1788600 - RNA, 16 nt, Homo sapiens
cucucucccuuuucag

SEQ ID NO: 1788601 - RNA, 19 nt, Homo sapiens
ugaauuuucugcagcuguu

SEQ ID NO: 1788602 - RNA, 20 nt, Homo sapiens
ucugauuccuucaacuggcu

SEQ ID NO: 1788603 - RNA, 18 nt, Homo sapiens
ccucuuuauguuuagaua

SEQ ID NO: 1788604 - RNA, 21 nt, Homo sapiens
gccaggcccggccaaaauaau

SEQ ID NO: 1788605 - RNA, 20 nt, Homo sapiens
ccuggaccuuuugucucaca

SEQ ID NO: 1788606 - RNA, 13 nt, Homo sapiens
uacauuaaaucac

SEQ ID NO: 1788607 - RNA, 18 nt, Homo sapiens
caaggagucacugagacc

SEQ ID NO: 1788608 - RNA, 16 nt, Homo sapiens
ucuggaucuccugacc

SEQ ID NO: 1788609 - RNA, 12 nt, Homo sapiens
ugcugcauaaaa

SEQ ID NO: 1788610 - RNA, 12 nt, Homo sapiens
agcugcauuaaa

SEQ ID NO: 1788611 - RNA, 18 nt, Homo sapiens
cauacauuauauuccucu

SEQ ID NO: 1788612 - RNA, 14 nt, Homo sapiens
gguuuuccucagcu

SEQ ID NO: 1788613 - RNA, 15 nt, Homo sapiens
auugcuuuauccaaa

SEQ ID NO: 1788614 - RNA, 18 nt, Homo sapiens
gugggccaugaaccaaau

SEQ ID NO: 1788615 - RNA, 13 nt, Homo sapiens
gaacuuuuuccaa

SEQ ID NO: 1788616 - RNA, 15 nt, Homo sapiens
ggaugcuggccuuug

SEQ ID NO: 1788617 - RNA, 23 nt, Homo sapiens
ucaucagcuaucguuaguguauu

SEQ ID NO: 1788618 - RNA, 15 nt, Homo sapiens
auaaucucauuucaa

SEQ ID NO: 1788619 - RNA, 20 nt, Homo sapiens
agccccacccugcagaguau

SEQ ID NO: 1788620 - RNA, 13 nt, Homo sapiens
aagggaacuucca

SEQ ID NO: 1788621 - RNA, 21 nt, Homo sapiens
acagaguggucuuucuggaga

SEQ ID NO: 1788622 - RNA, 14 nt, Homo sapiens
auuuauaacuaaua

SEQ ID NO: 1788623 - RNA, 13 nt, Homo sapiens
cucugugacuccc

SEQ ID NO: 1788624 - RNA, 19 nt, Homo sapiens
aggguucuaaaugcaauaa

SEQ ID NO: 1788625 - RNA, 13 nt, Homo sapiens
uucucaucugcaa

SEQ ID NO: 1788626 - RNA, 16 nt, Homo sapiens
acuguauuucuaagaa

SEQ ID NO: 1788627 - RNA, 10 nt, Homo sapiens
uaacagagag

SEQ ID NO: 1788628 - RNA, 21 nt, Homo sapiens
acccugcagagcacacaggua

SEQ ID NO: 1788629 - RNA, 16 nt, Homo sapiens
uuauucugccuuccag

SEQ ID NO: 1788630 - RNA, 11 nt, Homo sapiens
uacaugcaucu

SEQ ID NO: 1788631 - RNA, 21 nt, Homo sapiens
acucuggggcuggcaccagca

SEQ ID NO: 1788632 - RNA, 14 nt, Homo sapiens
ucaauccugucaua

SEQ ID NO: 1788633 - RNA, 16 nt, Homo sapiens
aggaaggguggcuuug

SEQ ID NO: 1788634 - RNA, 15 nt, Homo sapiens
aaccauuauaaccuu

SEQ ID NO: 1788635 - RNA, 16 nt, Homo sapiens
auaauagcucacagca

SEQ ID NO: 1788636 - RNA, 23 nt, Homo sapiens
cuggaaccagcucucuccuaaua

SEQ ID NO: 1788637 - RNA, 14 nt, Homo sapiens
cuugcaaaccaucc

SEQ ID NO: 1788638 - RNA, 22 nt, Homo sapiens
auauuuuaauuuuuaaaugcag

SEQ ID NO: 1788639 - RNA, 15 nt, Homo sapiens
ggguaguuauggggu

SEQ ID NO: 1788640 - RNA, 12 nt, Homo sapiens
caggaaccaaaa

SEQ ID NO: 1788641 - RNA, 21 nt, Homo sapiens
ugaauuauaacuagacaucug

SEQ ID NO: 1788642 - RNA, 18 nt, Homo sapiens
uaaccaggcugggcucag

SEQ ID NO: 1788643 - RNA, 14 nt, Homo sapiens
caccaggcccacag

SEQ ID NO: 1788644 - RNA, 17 nt, Homo sapiens
gcauuccugaugaccaa

SEQ ID NO: 1788645 - RNA, 16 nt, Homo sapiens
aauguuugcauuuccu

SEQ ID NO: 1788646 - RNA, 20 nt, Homo sapiens
uucuucguacauagucuguu

SEQ ID NO: 1788647 - RNA, 18 nt, Homo sapiens
gggguaugagcugccaag

SEQ ID NO: 1788648 - RNA, 23 nt, Homo sapiens
cugcuagcaaauggcagaaccaa

SEQ ID NO: 1788649 - RNA, 22 nt, Homo sapiens
cagcacuacuuacuuagagaug

SEQ ID NO: 1788650 - RNA, 12 nt, Homo sapiens
cacugauucucu

SEQ ID NO: 1788651 - RNA, 16 nt, Homo sapiens
ugauauugacacuguc

SEQ ID NO: 1788652 - RNA, 16 nt, Homo sapiens
uaaaaacuuacacucu

SEQ ID NO: 1788653 - RNA, 22 nt, Homo sapiens
ccuguugucaagaauagcauug

SEQ ID NO: 1788654 - RNA, 23 nt, Homo sapiens
gugauuuccagcuguagcauuca

SEQ ID NO: 1788655 - RNA, 17 nt, Homo sapiens
gggaggaggaagccguu

SEQ ID NO: 1788656 - RNA, 15 nt, Homo sapiens
gcaauaacucucuac

SEQ ID NO: 1788657 - RNA, 21 nt, Homo sapiens
ccucagugaaagcagucaucu

SEQ ID NO: 1788658 - RNA, 19 nt, Homo sapiens
uauauaguauaccauacau

SEQ ID NO: 1788659 - RNA, 14 nt, Homo sapiens
accucuccaaagag

SEQ ID NO: 1788660 - RNA, 14 nt, Homo sapiens
cccugucucaaaaa

SEQ ID NO: 1788661 - RNA, 15 nt, Homo sapiens
gcuggugggcaccaa

SEQ ID NO: 1788662 - RNA, 23 nt, Homo sapiens
agugacaaaauagacaauuugca

SEQ ID NO: 1788663 - RNA, 20 nt, Homo sapiens
guuucaccaucagucaauga

SEQ ID NO: 1788664 - RNA, 12 nt, Homo sapiens
gccuguacccag

SEQ ID NO: 1788665 - RNA, 22 nt, Homo sapiens
gacucagcucugucugcucaau

SEQ ID NO: 1788666 - RNA, 21 nt, Homo sapiens
ggucccagcuacuugggaggc

SEQ ID NO: 1788667 - RNA, 16 nt, Homo sapiens
ccauccucacauguga

SEQ ID NO: 1788668 - RNA, 21 nt, Homo sapiens
gacacuacacccagcaauaga

SEQ ID NO: 1788669 - RNA, 16 nt, Homo sapiens
caauauuaaaugacuu

SEQ ID NO: 1788670 - RNA, 14 nt, Homo sapiens
agaaguuuaauuca

SEQ ID NO: 1788671 - RNA, 18 nt, Homo sapiens
cuaugcuggcuuuucacc

SEQ ID NO: 1788672 - RNA, 21 nt, Homo sapiens
aaggcucauaccuggcuugca

SEQ ID NO: 1788673 - RNA, 12 nt, Homo sapiens
aagugugugauc

SEQ ID NO: 1788674 - RNA, 13 nt, Homo sapiens
accaagacagugc

SEQ ID NO: 1788675 - RNA, 19 nt, Homo sapiens
cuguuaguauuaacuauua

SEQ ID NO: 1788676 - RNA, 19 nt, Homo sapiens
gcuuaaaauaaaguuaaac

SEQ ID NO: 1788677 - RNA, 14 nt, Homo sapiens
cuaucauguugaag

SEQ ID NO: 1788678 - RNA, 21 nt, Homo sapiens
cucccaggccaccucagucuc

SEQ ID NO: 1788679 - RNA, 16 nt, Homo sapiens
cugggaugcaauacua

SEQ ID NO: 1788680 - RNA, 18 nt, Homo sapiens
cagggaaauguaugugug

SEQ ID NO: 1788681 - RNA, 22 nt, Homo sapiens
uauuuguucagaucucauagau

SEQ ID NO: 1788682 - RNA, 15 nt, Homo sapiens
gaaagccaugugcua

SEQ ID NO: 1788683 - RNA, 18 nt, Homo sapiens
cucccagccagguucuga

SEQ ID NO: 1788684 - RNA, 22 nt, Homo sapiens
auccuacuguaauaaagaugau

SEQ ID NO: 1788685 - RNA, 21 nt, Homo sapiens
uuggaaucccacuaaugcaaa

SEQ ID NO: 1788686 - RNA, 18 nt, Homo sapiens
aagagaauuaagcccuaa

SEQ ID NO: 1788687 - RNA, 14 nt, Homo sapiens
guuuuucacuuugg

SEQ ID NO: 1788688 - RNA, 20 nt, Homo sapiens
acauuugacaaaacuaaccu

SEQ ID NO: 1788689 - RNA, 19 nt, Homo sapiens
guauucaguuccaauacuu

SEQ ID NO: 1788690 - RNA, 14 nt, Homo sapiens
aaccaguuuaucca

SEQ ID NO: 1788691 - RNA, 16 nt, Homo sapiens
ucccaugugugaugcu

SEQ ID NO: 1788692 - RNA, 23 nt, Homo sapiens
cuggggucggggggauuauguca

SEQ ID NO: 1788693 - RNA, 15 nt, Homo sapiens
ugauuaaagugccuu

SEQ ID NO: 1788694 - RNA, 22 nt, Homo sapiens
uuuaaauuuuuuuuuuaauugc

SEQ ID NO: 1788695 - RNA, 18 nt, Homo sapiens
agcccucuccacccagag

SEQ ID NO: 1788696 - RNA, 16 nt, Homo sapiens
cuaugccugccucaaa

SEQ ID NO: 1788697 - RNA, 17 nt, Homo sapiens
ggcccaccuaccuucaa

SEQ ID NO: 1788698 - RNA, 16 nt, Homo sapiens
ccucugcuacuagcca

SEQ ID NO: 1788699 - RNA, 19 nt, Homo sapiens
uuuccagguaauaugucuu

SEQ ID NO: 1788700 - RNA, 22 nt, Homo sapiens
agacacugucucuaccaaaaaa

SEQ ID NO: 1788701 - RNA, 22 nt, Homo sapiens
uuacaugaaugaaugaaccaug

SEQ ID NO: 1788702 - RNA, 22 nt, Homo sapiens
cccauugucaccuaacucugaa

SEQ ID NO: 1788703 - RNA, 14 nt, Homo sapiens
gacagaccuggaca

SEQ ID NO: 1788704 - RNA, 14 nt, Homo sapiens
ucacucuguugacc

SEQ ID NO: 1788705 - RNA, 13 nt, Homo sapiens
caaguacagccuu

SEQ ID NO: 1788706 - RNA, 16 nt, Homo sapiens
ucagggccaugccugc

SEQ ID NO: 1788707 - RNA, 20 nt, Homo sapiens
aaaacagcccccacuccagu

SEQ ID NO: 1788708 - RNA, 19 nt, Homo sapiens
gcacucagauuuaagccuu

SEQ ID NO: 1788709 - RNA, 14 nt, Homo sapiens
cggcucacugcaaa

SEQ ID NO: 1788710 - RNA, 16 nt, Homo sapiens
agugccaugggggcaa

SEQ ID NO: 1788711 - RNA, 19 nt, Homo sapiens
gcaaagaacccauuugcca

SEQ ID NO: 1788712 - RNA, 11 nt, Homo sapiens
ugucuuuaugu

SEQ ID NO: 1788713 - RNA, 19 nt, Homo sapiens
cuccugggcucaagcaauc

SEQ ID NO: 1788714 - RNA, 12 nt, Homo sapiens
uauuucugaaga

SEQ ID NO: 1788715 - RNA, 22 nt, Homo sapiens
aaauccacuuuaucuugaauaa

SEQ ID NO: 1788716 - RNA, 21 nt, Homo sapiens
ccagugaagugccacaugaca

SEQ ID NO: 1788717 - RNA, 15 nt, Homo sapiens
acaaauguaacacac

SEQ ID NO: 1788718 - RNA, 23 nt, Homo sapiens
gucuuccacaaaaaauacuuuau

SEQ ID NO: 1788719 - RNA, 10 nt, Homo sapiens
acacaaugcc

SEQ ID NO: 1788720 - RNA, 15 nt, Homo sapiens
ccugaucuuucuaga

SEQ ID NO: 1788721 - RNA, 16 nt, Homo sapiens
ccagcuccacuggccu

SEQ ID NO: 1788722 - RNA, 14 nt, Homo sapiens
gugagugaccucac

SEQ ID NO: 1788723 - RNA, 24 nt, Homo sapiens
ucuucuguaauauuuacaauguau

SEQ ID NO: 1788724 - RNA, 21 nt, Homo sapiens
agcugggccgggacccagggc

SEQ ID NO: 1788725 - RNA, 16 nt, Homo sapiens
uagugaagcuaauuaa

SEQ ID NO: 1788726 - RNA, 18 nt, Homo sapiens
gugccagggaggguggga

SEQ ID NO: 1788727 - RNA, 19 nt, Homo sapiens
uuagauuucccuauuguga

SEQ ID NO: 1788728 - RNA, 17 nt, Homo sapiens
uggagaaaaaaauugcu

SEQ ID NO: 1788729 - RNA, 11 nt, Homo sapiens
agucucugugc

SEQ ID NO: 1788730 - RNA, 17 nt, Homo sapiens
aacucuccugcccauga

SEQ ID NO: 1788731 - RNA, 13 nt, Homo sapiens
cuucucugugaau

SEQ ID NO: 1788732 - RNA, 19 nt, Homo sapiens
aaggggcacgccugcccag

SEQ ID NO: 1788733 - RNA, 18 nt, Homo sapiens
augcuucuguugaucuca

SEQ ID NO: 1788734 - RNA, 13 nt, Homo sapiens
agugacugacccc

SEQ ID NO: 1788735 - RNA, 14 nt, Homo sapiens
auucuguauuaaau

SEQ ID NO: 1788736 - RNA, 21 nt, Homo sapiens
aauugggggagucauggucag

SEQ ID NO: 1788737 - RNA, 17 nt, Homo sapiens
aaccacuggucaugccc

SEQ ID NO: 1788738 - RNA, 15 nt, Homo sapiens
aaguuaucauccuau

SEQ ID NO: 1788739 - RNA, 21 nt, Homo sapiens
agucuuucguuuccagccuuu

SEQ ID NO: 1788740 - RNA, 13 nt, Homo sapiens
auaaggacacuga

SEQ ID NO: 1788741 - RNA, 14 nt, Homo sapiens
cugaaaaccuacca

SEQ ID NO: 1788742 - RNA, 14 nt, Homo sapiens
aggacuacagacau

SEQ ID NO: 1788743 - RNA, 20 nt, Homo sapiens
auuuaauacacaaugcauca

SEQ ID NO: 1788744 - RNA, 17 nt, Homo sapiens
cagugugcccaggauug

SEQ ID NO: 1788745 - RNA, 18 nt, Homo sapiens
ccugguggagggugccca

SEQ ID NO: 1788746 - RNA, 23 nt, Homo sapiens
cugagcagguguucuucauuacc

SEQ ID NO: 1788747 - RNA, 20 nt, Homo sapiens
auucuucuaaguauuuugau

SEQ ID NO: 1788748 - RNA, 16 nt, Homo sapiens
ugggaucgcauugcau

SEQ ID NO: 1788749 - RNA, 14 nt, Homo sapiens
ccacaggcagucca

SEQ ID NO: 1788750 - RNA, 21 nt, Homo sapiens
acuguacugagacauuacagu

SEQ ID NO: 1788751 - RNA, 16 nt, Homo sapiens
cacuugacuuugccac

SEQ ID NO: 1788752 - RNA, 14 nt, Homo sapiens
agaaaacuggaaau

SEQ ID NO: 1788753 - RNA, 15 nt, Homo sapiens
ucuuuaauuuuggaa

SEQ ID NO: 1788754 - RNA, 18 nt, Homo sapiens
gacuauuugcuuauuuaa

SEQ ID NO: 1788755 - RNA, 15 nt, Homo sapiens
ugggcgcugguccuu

SEQ ID NO: 1788756 - RNA, 14 nt, Homo sapiens
gggccucugcauuu

SEQ ID NO: 1788757 - RNA, 20 nt, Homo sapiens
caauuuucuucacacuauca

SEQ ID NO: 1788758 - RNA, 20 nt, Homo sapiens
aaacaacagcucgauccaaa

SEQ ID NO: 1788759 - RNA, 23 nt, Homo sapiens
uugcaucucaguaugaauuauuc

SEQ ID NO: 1788760 - RNA, 21 nt, Homo sapiens
cucagucccuaaaaacacaga

SEQ ID NO: 1788761 - RNA, 18 nt, Homo sapiens
ggacuuccagugcucaga

SEQ ID NO: 1788762 - RNA, 22 nt, Homo sapiens
uggauaugcugcuuuaaacuug

SEQ ID NO: 1788763 - RNA, 18 nt, Homo sapiens
agcucagaaaaucaaaga

SEQ ID NO: 1788764 - RNA, 20 nt, Homo sapiens
uuaagaauguucuuauguug

SEQ ID NO: 1788765 - RNA, 18 nt, Homo sapiens
guggucucgaugcugcug

SEQ ID NO: 1788766 - RNA, 17 nt, Homo sapiens
ucuuuuccuucagugaa

SEQ ID NO: 1788767 - RNA, 13 nt, Homo sapiens
acaaaguuuuaaa

SEQ ID NO: 1788768 - RNA, 18 nt, Homo sapiens
auaaaacacaucaucaau

SEQ ID NO: 1788769 - RNA, 21 nt, Homo sapiens
gcccuaccugauuggugcaac

SEQ ID NO: 1788770 - RNA, 21 nt, Homo sapiens
cacucucccuuguacagccuu

SEQ ID NO: 1788771 - RNA, 13 nt, Homo sapiens
aaccguacuguau

SEQ ID NO: 1788772 - RNA, 23 nt, Homo sapiens
gugcuuuaccaauugaaguaaaa

SEQ ID NO: 1788773 - RNA, 11 nt, Homo sapiens
cuuugcacuga

SEQ ID NO: 1788774 - RNA, 17 nt, Homo sapiens
uuaaguaaaccaaaaag

SEQ ID NO: 1788775 - RNA, 13 nt, Homo sapiens
auacaaauaagga

SEQ ID NO: 1788776 - RNA, 17 nt, Homo sapiens
uaugcaguauucuugca

SEQ ID NO: 1788777 - RNA, 17 nt, Homo sapiens
aagccuugacacacugu

SEQ ID NO: 1788778 - RNA, 12 nt, Homo sapiens
cucggaugacac

SEQ ID NO: 1788779 - RNA, 20 nt, Homo sapiens
cuagccccagcgccaaagga

SEQ ID NO: 1788780 - RNA, 21 nt, Homo sapiens
auucugggaaaggugcucaaa

SEQ ID NO: 1788781 - RNA, 21 nt, Homo sapiens
ggcuugagggaaucaugggca

SEQ ID NO: 1788782 - RNA, 18 nt, Homo sapiens
cuuuugucucacacagca

SEQ ID NO: 1788783 - RNA, 20 nt, Homo sapiens
gcucuuuguuuugugucucu

SEQ ID NO: 1788784 - RNA, 18 nt, Homo sapiens
uagaaguugaaacucacu

SEQ ID NO: 1788785 - RNA, 21 nt, Homo sapiens
accaggcagugugccaguuua

SEQ ID NO: 1788786 - RNA, 19 nt, Homo sapiens
ugucaucauuaaaagcaag

SEQ ID NO: 1788787 - RNA, 13 nt, Homo sapiens
uaauuuacuguga

SEQ ID NO: 1788788 - RNA, 13 nt, Homo sapiens
uggaccauuccag

SEQ ID NO: 1788789 - RNA, 16 nt, Homo sapiens
agaauucaaauccucu

SEQ ID NO: 1788790 - RNA, 21 nt, Homo sapiens
accauauggaaugccaaaauu

SEQ ID NO: 1788791 - RNA, 14 nt, Homo sapiens
uugaggaauuauca

SEQ ID NO: 1788792 - RNA, 23 nt, Homo sapiens
gcccuuccccuucccacacuguc

SEQ ID NO: 1788793 - RNA, 16 nt, Homo sapiens
cuuuucauccuagucu

SEQ ID NO: 1788794 - RNA, 16 nt, Homo sapiens
cuacuacaugugacug

SEQ ID NO: 1788795 - RNA, 20 nt, Homo sapiens
gucugccacuugucaaagaa

SEQ ID NO: 1788796 - RNA, 21 nt, Homo sapiens
cauauauacccacauguacag

SEQ ID NO: 1788797 - RNA, 20 nt, Homo sapiens
gucacagcaguacuugcuca

SEQ ID NO: 1788798 - RNA, 19 nt, Homo sapiens
aguuuucugaccagcuuuu

SEQ ID NO: 1788799 - RNA, 14 nt, Homo sapiens
gcaaauuguuucag

SEQ ID NO: 1788800 - RNA, 14 nt, Homo sapiens
aagaagagaggcau

SEQ ID NO: 1788801 - RNA, 12 nt, Homo sapiens
aucuugaucauu

SEQ ID NO: 1788802 - RNA, 15 nt, Homo sapiens
caggcggguccgggu

SEQ ID NO: 1788803 - RNA, 18 nt, Homo sapiens
uuucuuuagcaugcuaca

SEQ ID NO: 1788804 - RNA, 15 nt, Homo sapiens
acuuuucauugcaaa

SEQ ID NO: 1788805 - RNA, 22 nt, Homo sapiens
ucagaaggcuucaucaccaaga

SEQ ID NO: 1788806 - RNA, 16 nt, Homo sapiens
caauauuuauuuccag

SEQ ID NO: 1788807 - RNA, 14 nt, Homo sapiens
gacggaaguggccu

SEQ ID NO: 1788808 - RNA, 15 nt, Homo sapiens
ugaaaaccugcauuu

SEQ ID NO: 1788809 - RNA, 14 nt, Homo sapiens
uaagacacauugac

SEQ ID NO: 1788810 - RNA, 22 nt, Homo sapiens
gcagugcaugggcgcuggucua

SEQ ID NO: 1788811 - RNA, 16 nt, Homo sapiens
aucagcucuaaagcag

SEQ ID NO: 1788812 - RNA, 19 nt, Homo sapiens
gcugucuccauaaugccac

SEQ ID NO: 1788813 - RNA, 12 nt, Homo sapiens
cagaugucccuu

SEQ ID NO: 1788814 - RNA, 21 nt, Homo sapiens
gcacagggcagcugggcccaa

SEQ ID NO: 1788815 - RNA, 12 nt, Homo sapiens
uucuggcacugu

SEQ ID NO: 1788816 - RNA, 15 nt, Homo sapiens
uaucuacauaaggau

SEQ ID NO: 1788817 - RNA, 18 nt, Homo sapiens
aauuguuuucacuuguau

SEQ ID NO: 1788818 - RNA, 16 nt, Homo sapiens
uacaauaaagcaaugu

SEQ ID NO: 1788819 - RNA, 15 nt, Homo sapiens
ccagaaguuccucaa

SEQ ID NO: 1788820 - RNA, 24 nt, Homo sapiens
ugcucagucccuacugaguacucu

SEQ ID NO: 1788821 - RNA, 22 nt, Homo sapiens
gagggagaagaaagaaacuuca

SEQ ID NO: 1788822 - RNA, 13 nt, Homo sapiens
agauguugacuaa

SEQ ID NO: 1788823 - RNA, 18 nt, Homo sapiens
aauaaaaaauacaauuca

SEQ ID NO: 1788824 - RNA, 23 nt, Homo sapiens
ccaaauugucugucugcucuuau

SEQ ID NO: 1788825 - RNA, 20 nt, Homo sapiens
cccuggugggacaacaaaga

SEQ ID NO: 1788826 - RNA, 19 nt, Homo sapiens
aaucugagaagacaauaug

SEQ ID NO: 1788827 - RNA, 11 nt, Homo sapiens
gcuggggcuuu

SEQ ID NO: 1788828 - RNA, 11 nt, Homo sapiens
gcgggggcuug

SEQ ID NO: 1788829 - RNA, 13 nt, Homo sapiens
cagacgugugacc

SEQ ID NO: 1788830 - RNA, 14 nt, Homo sapiens
ccuuuccugguccc

SEQ ID NO: 1788831 - RNA, 13 nt, Homo sapiens
ucaaaacauucca

SEQ ID NO: 1788832 - RNA, 14 nt, Homo sapiens
uaacucucuacagg

SEQ ID NO: 1788833 - RNA, 14 nt, Homo sapiens
uauuuaacauuaac

SEQ ID NO: 1788834 - RNA, 17 nt, Homo sapiens
auccagugauccucaaa

SEQ ID NO: 1788835 - RNA, 14 nt, Homo sapiens
gccaccaucuggag

SEQ ID NO: 1788836 - RNA, 19 nt, Homo sapiens
gagugccacccgcaggugu

SEQ ID NO: 1788837 - RNA, 19 nt, Homo sapiens
ugguuccaugccugcucuc

SEQ ID NO: 1788838 - RNA, 15 nt, Homo sapiens
auaaggaaacuuuau

SEQ ID NO: 1788839 - RNA, 14 nt, Homo sapiens
ucacuucucccacc

SEQ ID NO: 1788840 - RNA, 17 nt, Homo sapiens
aaauguagguaugaaua

SEQ ID NO: 1788841 - RNA, 13 nt, Homo sapiens
uaaccagugcaga

SEQ ID NO: 1788842 - RNA, 20 nt, Homo sapiens
gcccucaaaaugacagccau

SEQ ID NO: 1788843 - RNA, 15 nt, Homo sapiens
cauauaauuaaaaag

SEQ ID NO: 1788844 - RNA, 14 nt, Homo sapiens
gacucgcuagcacu

SEQ ID NO: 1788845 - RNA, 20 nt, Homo sapiens
gccagacuuaaaaaaaccau

SEQ ID NO: 1788846 - RNA, 19 nt, Homo sapiens
aagaacaaaucugggcauu

SEQ ID NO: 1788847 - RNA, 18 nt, Homo sapiens
gauuaagaguugccaaaa

SEQ ID NO: 1788848 - RNA, 21 nt, Homo sapiens
caaaaauugcucguguuauaa

SEQ ID NO: 1788849 - RNA, 23 nt, Homo sapiens
auaaagucauccucucacugcaa

SEQ ID NO: 1788850 - RNA, 22 nt, Homo sapiens
guucuaaaaacguaaguacucc

SEQ ID NO: 1788851 - RNA, 15 nt, Homo sapiens
cauuuccauggugcc

SEQ ID NO: 1788852 - RNA, 15 nt, Homo sapiens
ugcccuguccuccag

SEQ ID NO: 1788853 - RNA, 21 nt, Homo sapiens
ggugggcacuggauuaguuaa

SEQ ID NO: 1788854 - RNA, 18 nt, Homo sapiens
gagggccccgcccagugc

SEQ ID NO: 1788855 - RNA, 16 nt, Homo sapiens
auugauguaacugugu

SEQ ID NO: 1788856 - RNA, 13 nt, Homo sapiens
agcccacauauuc

SEQ ID NO: 1788857 - RNA, 20 nt, Homo sapiens
gaugcuggccagcauuuuca

SEQ ID NO: 1788858 - RNA, 12 nt, Homo sapiens
uuugaacagggc

SEQ ID NO: 1788859 - RNA, 14 nt, Homo sapiens
caugacccagugaa

SEQ ID NO: 1788860 - RNA, 15 nt, Homo sapiens
uaaacaauucuugua

SEQ ID NO: 1788861 - RNA, 17 nt, Homo sapiens
gucaucccagugcacau

SEQ ID NO: 1788862 - RNA, 17 nt, Homo sapiens
acaguugcacagcaucu

SEQ ID NO: 1788863 - RNA, 12 nt, Homo sapiens
uuuaagcuggug

SEQ ID NO: 1788864 - RNA, 18 nt, Homo sapiens
uuaaaaacuaccacaugu

SEQ ID NO: 1788865 - RNA, 13 nt, Homo sapiens
cccaaagugccuu

SEQ ID NO: 1788866 - RNA, 17 nt, Homo sapiens
uaagcccucgugcacac

SEQ ID NO: 1788867 - RNA, 14 nt, Homo sapiens
cccagcaacacaga

SEQ ID NO: 1788868 - RNA, 22 nt, Homo sapiens
uguucgcacaaucuacacugcc

SEQ ID NO: 1788869 - RNA, 22 nt, Homo sapiens
agccugggcgacagagccagac

SEQ ID NO: 1788870 - RNA, 20 nt, Homo sapiens
gcaacaaguagagaugaagu

SEQ ID NO: 1788871 - RNA, 15 nt, Homo sapiens
auauaugccuuugau

SEQ ID NO: 1788872 - RNA, 21 nt, Homo sapiens
aauucuguacauagccuauau

SEQ ID NO: 1788873 - RNA, 18 nt, Homo sapiens
uauguuaauaacuugucc

SEQ ID NO: 1788874 - RNA, 19 nt, Homo sapiens
uaaagcacagauuucaaca

SEQ ID NO: 1788875 - RNA, 19 nt, Homo sapiens
acagcaccaccuugcgauu

SEQ ID NO: 1788876 - RNA, 13 nt, Homo sapiens
gacuaaacuuaau

SEQ ID NO: 1788877 - RNA, 13 nt, Homo sapiens
acacccaacacuu

SEQ ID NO: 1788878 - RNA, 13 nt, Homo sapiens
gacaaaugcugcg

SEQ ID NO: 1788879 - RNA, 13 nt, Homo sapiens
cagaauuaaugca

SEQ ID NO: 1788880 - RNA, 21 nt, Homo sapiens
agugauaucccccagccucaa

SEQ ID NO: 1788881 - RNA, 14 nt, Homo sapiens
cauuaaucaguuca

SEQ ID NO: 1788882 - RNA, 14 nt, Homo sapiens
caggccucagggac

SEQ ID NO: 1788883 - RNA, 22 nt, Homo sapiens
uccuccucucuggacuuucucc

SEQ ID NO: 1788884 - RNA, 14 nt, Homo sapiens
ggcuuuaaagcuga

SEQ ID NO: 1788885 - RNA, 15 nt, Homo sapiens
accguucugugcaca

SEQ ID NO: 1788886 - RNA, 13 nt, Homo sapiens
caagcacuuuaau

SEQ ID NO: 1788887 - RNA, 15 nt, Homo sapiens
ucaaauccugaugcu

SEQ ID NO: 1788888 - RNA, 18 nt, Homo sapiens
aauuuucauucauucacu

SEQ ID NO: 1788889 - RNA, 16 nt, Homo sapiens
gagucacgagcugcug

SEQ ID NO: 1788890 - RNA, 20 nt, Homo sapiens
ucucauuaaaauccaguauu

SEQ ID NO: 1788891 - RNA, 19 nt, Homo sapiens
caggucauuauuuuuuaca

SEQ ID NO: 1788892 - RNA, 16 nt, Homo sapiens
cuucugaguugcacau

SEQ ID NO: 1788893 - RNA, 21 nt, Homo sapiens
uuugguuugcagaugacaaaa

SEQ ID NO: 1788894 - RNA, 12 nt, Homo sapiens
ccaauugaugua

SEQ ID NO: 1788895 - RNA, 13 nt, Homo sapiens
cucaucuauccag

SEQ ID NO: 1788896 - RNA, 17 nt, Homo sapiens
uaugaaaugccacuggg

SEQ ID NO: 1788897 - RNA, 22 nt, Homo sapiens
acuuuaagaacaaacucugaaa

SEQ ID NO: 1788898 - RNA, 17 nt, Homo sapiens
ccuccugucucuaaguc

SEQ ID NO: 1788899 - RNA, 15 nt, Homo sapiens
uaaagucacacggcu

SEQ ID NO: 1788900 - RNA, 18 nt, Homo sapiens
auuuuugaagacaucaaa

SEQ ID NO: 1788901 - RNA, 22 nt, Homo sapiens
cucccgccgcggcuguugcuca

SEQ ID NO: 1788902 - RNA, 18 nt, Homo sapiens
acacuccauuauuccucu

SEQ ID NO: 1788903 - RNA, 14 nt, Homo sapiens
uggccuugccacac

SEQ ID NO: 1788904 - RNA, 16 nt, Homo sapiens
gugaaaccccaucucu

SEQ ID NO: 1788905 - RNA, 14 nt, Homo sapiens
gagacuccaucuca

SEQ ID NO: 1788906 - RNA, 14 nt, Homo sapiens
aagacuccgucuca

SEQ ID NO: 1788907 - RNA, 17 nt, Homo sapiens
caguagacugugauucu

SEQ ID NO: 1788908 - RNA, 16 nt, Homo sapiens
caucaggccuguuuua

SEQ ID NO: 1788909 - RNA, 23 nt, Homo sapiens
aguacucuacaauuccucugaua

SEQ ID NO: 1788910 - RNA, 12 nt, Homo sapiens
ugacucuugccu

SEQ ID NO: 1788911 - RNA, 24 nt, Homo sapiens
ucacacugguuuggucaguuacaa

SEQ ID NO: 1788912 - RNA, 20 nt, Homo sapiens
uuaaaauugcuauguuacua

SEQ ID NO: 1788913 - RNA, 16 nt, Homo sapiens
caccuguguccaagaa

SEQ ID NO: 1788914 - RNA, 17 nt, Homo sapiens
cagguccucuguugcaa

SEQ ID NO: 1788915 - RNA, 17 nt, Homo sapiens
auugugaagauuucaug

SEQ ID NO: 1788916 - RNA, 20 nt, Homo sapiens
gcacuuuaagucagugacag

SEQ ID NO: 1788917 - RNA, 15 nt, Homo sapiens
cgucacuaauacaca

SEQ ID NO: 1788918 - RNA, 20 nt, Homo sapiens
auggacuuccacugccaucc

SEQ ID NO: 1788919 - RNA, 20 nt, Homo sapiens
cauaugcaaacauaacaaaa

SEQ ID NO: 1788920 - RNA, 23 nt, Homo sapiens
gauucuuauuaguuccccaaaua

SEQ ID NO: 1788921 - RNA, 13 nt, Homo sapiens
aauucccuugaau

SEQ ID NO: 1788922 - RNA, 21 nt, Homo sapiens
cugagaaauguuaaagguuca

SEQ ID NO: 1788923 - RNA, 16 nt, Homo sapiens
cugacacuacuaaagc

SEQ ID NO: 1788924 - RNA, 22 nt, Homo sapiens
agcuggcagcagaguguggccu

SEQ ID NO: 1788925 - RNA, 13 nt, Homo sapiens
gggcuguauuuau

SEQ ID NO: 1788926 - RNA, 19 nt, Homo sapiens
aaagaacucuucuuguaaa

SEQ ID NO: 1788927 - RNA, 13 nt, Homo sapiens
uuguuguugccaa

SEQ ID NO: 1788928 - RNA, 21 nt, Homo sapiens
aagugccaaaugcucucucaa

SEQ ID NO: 1788929 - RNA, 14 nt, Homo sapiens
cuuacugcaggcaa

SEQ ID NO: 1788930 - RNA, 16 nt, Homo sapiens
caagucaaauaccaca

SEQ ID NO: 1788931 - RNA, 14 nt, Homo sapiens
ccgggcaagacuuu

SEQ ID NO: 1788932 - RNA, 15 nt, Homo sapiens
cccuccugccucauc

SEQ ID NO: 1788933 - RNA, 13 nt, Homo sapiens
agauuuaucucug

SEQ ID NO: 1788934 - RNA, 16 nt, Homo sapiens
uuccaaccuuuggaag

SEQ ID NO: 1788935 - RNA, 22 nt, Homo sapiens
gcacauauggaauuuugcaaag

SEQ ID NO: 1788936 - RNA, 17 nt, Homo sapiens
ccaggccucgucuuuca

SEQ ID NO: 1788937 - RNA, 18 nt, Homo sapiens
uuucccaugagugugauc

SEQ ID NO: 1788938 - RNA, 17 nt, Homo sapiens
gccccggccuccucgga

SEQ ID NO: 1788939 - RNA, 14 nt, Homo sapiens
ccaaagugaccucc

SEQ ID NO: 1788940 - RNA, 19 nt, Homo sapiens
cccuguagacuagugccgu

SEQ ID NO: 1788941 - RNA, 20 nt, Homo sapiens
agcugcaugggugccugcug

SEQ ID NO: 1788942 - RNA, 14 nt, Homo sapiens
agaaauugccucca

SEQ ID NO: 1788943 - RNA, 20 nt, Homo sapiens
uuuagcaauuuauacaauau

SEQ ID NO: 1788944 - RNA, 18 nt, Homo sapiens
ucacucauggaacacuca

SEQ ID NO: 1788945 - RNA, 18 nt, Homo sapiens
uguauaagaugcugcuga

SEQ ID NO: 1788946 - RNA, 18 nt, Homo sapiens
aaaaccuucaagaucuca

SEQ ID NO: 1788947 - RNA, 14 nt, Homo sapiens
auaaaggucccuua

SEQ ID NO: 1788948 - RNA, 19 nt, Homo sapiens
ccccugaggucaugcauug

SEQ ID NO: 1788949 - RNA, 22 nt, Homo sapiens
gaaggucucaggagaagggaua

SEQ ID NO: 1788950 - RNA, 22 nt, Homo sapiens
ucaaaggagagucacagaacaa

SEQ ID NO: 1788951 - RNA, 20 nt, Homo sapiens
cuuccucugguuucugugug

SEQ ID NO: 1788952 - RNA, 21 nt, Homo sapiens
cguuuugccugugacuguaaa

SEQ ID NO: 1788953 - RNA, 15 nt, Homo sapiens
augcuaaaaauguca

SEQ ID NO: 1788954 - RNA, 19 nt, Homo sapiens
aaccaugggcaccaggcaa

SEQ ID NO: 1788955 - RNA, 22 nt, Homo sapiens
acuuguuuguaaaagagcuguu

SEQ ID NO: 1788956 - RNA, 18 nt, Homo sapiens
ccaaagaaacauugccuu

SEQ ID NO: 1788957 - RNA, 16 nt, Homo sapiens
auggccccaccugcuc

SEQ ID NO: 1788958 - RNA, 19 nt, Homo sapiens
ugugguggugggugccugu

SEQ ID NO: 1788959 - RNA, 16 nt, Homo sapiens
aaaaccugggugucag

SEQ ID NO: 1788960 - RNA, 19 nt, Homo sapiens
acuuuguuaaaaacacugc

SEQ ID NO: 1788961 - RNA, 19 nt, Homo sapiens
ggcuaccaggaagaaggac

SEQ ID NO: 1788962 - RNA, 19 nt, Homo sapiens
ucuacacccaccagaguga

SEQ ID NO: 1788963 - RNA, 18 nt, Homo sapiens
cuucagagggaaacucag

SEQ ID NO: 1788964 - RNA, 14 nt, Homo sapiens
guccauaugcaucu

SEQ ID NO: 1788965 - RNA, 16 nt, Homo sapiens
ccugguugugugcaca

SEQ ID NO: 1788966 - RNA, 13 nt, Homo sapiens
cucaaacuugaga

SEQ ID NO: 1788967 - RNA, 20 nt, Homo sapiens
ugcccggugccaucuuccau

SEQ ID NO: 1788968 - RNA, 20 nt, Homo sapiens
caugaggaggucagcccauu

SEQ ID NO: 1788969 - RNA, 14 nt, Homo sapiens
auguggugauacug

SEQ ID NO: 1788970 - RNA, 17 nt, Homo sapiens
uaaaauauugauuucau

SEQ ID NO: 1788971 - RNA, 16 nt, Homo sapiens
caccuucaagcagcug

SEQ ID NO: 1788972 - RNA, 16 nt, Homo sapiens
auuuuacugucuuaau

SEQ ID NO: 1788973 - RNA, 15 nt, Homo sapiens
ccggggccagcacuu

SEQ ID NO: 1788974 - RNA, 19 nt, Homo sapiens
ucugccacucuuaacacua

SEQ ID NO: 1788975 - RNA, 16 nt, Homo sapiens
cuuggugcugcugaau

SEQ ID NO: 1788976 - RNA, 12 nt, Homo sapiens
aggugggucuac

SEQ ID NO: 1788977 - RNA, 15 nt, Homo sapiens
ugccuagaaauaucu

SEQ ID NO: 1788978 - RNA, 21 nt, Homo sapiens
uuuauauuuuuuuaacuguga

SEQ ID NO: 1788979 - RNA, 21 nt, Homo sapiens
aaaaucuauuuuguaacuuuc

SEQ ID NO: 1788980 - RNA, 14 nt, Homo sapiens
gcucuggaccucag

SEQ ID NO: 1788981 - RNA, 18 nt, Homo sapiens
ugacaauuuucuaccacu

SEQ ID NO: 1788982 - RNA, 16 nt, Homo sapiens
ugcacucccuaagaaa

SEQ ID NO: 1788983 - RNA, 20 nt, Homo sapiens
cugagaccaggguggccaca

SEQ ID NO: 1788984 - RNA, 14 nt, Homo sapiens
aacagccuacugaa

SEQ ID NO: 1788985 - RNA, 21 nt, Homo sapiens
ugccucaacccaaggggauuu

SEQ ID NO: 1788986 - RNA, 20 nt, Homo sapiens
acagaugcagccgugcagga

SEQ ID NO: 1788987 - RNA, 23 nt, Homo sapiens
ucaacaaauuucauugcacuuuc

SEQ ID NO: 1788988 - RNA, 15 nt, Homo sapiens
uugaaagaugcagug

SEQ ID NO: 1788989 - RNA, 20 nt, Homo sapiens
accauggcacugacaauggg

SEQ ID NO: 1788990 - RNA, 17 nt, Homo sapiens
uauuuuaauuacugcua

SEQ ID NO: 1788991 - RNA, 21 nt, Homo sapiens
aaauuagagcaagaacauuca

SEQ ID NO: 1788992 - RNA, 15 nt, Homo sapiens
uagcugucugcucag

SEQ ID NO: 1788993 - RNA, 18 nt, Homo sapiens
ucagugccccauucucac

SEQ ID NO: 1788994 - RNA, 19 nt, Homo sapiens
aggaaggcuuguugugcuu

SEQ ID NO: 1788995 - RNA, 20 nt, Homo sapiens
aagauggaggggcugacuca

SEQ ID NO: 1788996 - RNA, 17 nt, Homo sapiens
uaacuccaugucucuga

SEQ ID NO: 1788997 - RNA, 17 nt, Homo sapiens
auugagggccagugaug

SEQ ID NO: 1788998 - RNA, 20 nt, Homo sapiens
cuaguucugccaggagacag

SEQ ID NO: 1788999 - RNA, 12 nt, Homo sapiens
cccaugagauuc

SEQ ID NO: 1789000 - RNA, 21 nt, Homo sapiens
uaaugcuuuuacuaagcacug

SEQ ID NO: 1789001 - RNA, 20 nt, Homo sapiens
cuuccgaguagcugggauua

SEQ ID NO: 1789002 - RNA, 12 nt, Homo sapiens
ugcaaugaucag

SEQ ID NO: 1789003 - RNA, 21 nt, Homo sapiens
uaaaauuuuucuuaagacaga

SEQ ID NO: 1789004 - RNA, 11 nt, Homo sapiens
auaaugcucac

SEQ ID NO: 1789005 - RNA, 16 nt, Homo sapiens
ccagcgugaaggaccu

SEQ ID NO: 1789006 - RNA, 14 nt, Homo sapiens
augggcacuugaga

SEQ ID NO: 1789007 - RNA, 21 nt, Homo sapiens
uagagccauuuaacauuuccu

SEQ ID NO: 1789008 - RNA, 15 nt, Homo sapiens
guuuuguaccaacac

SEQ ID NO: 1789009 - RNA, 23 nt, Homo sapiens
ucccaggugcgugugucucuguc

SEQ ID NO: 1789010 - RNA, 15 nt, Homo sapiens
guaacaguuguguca

SEQ ID NO: 1789011 - RNA, 22 nt, Homo sapiens
uuccugcuggccccuucugggg

SEQ ID NO: 1789012 - RNA, 21 nt, Homo sapiens
aaccaggcugggcucagcuca

SEQ ID NO: 1789013 - RNA, 12 nt, Homo sapiens
aggcagcucaag

SEQ ID NO: 1789014 - RNA, 12 nt, Homo sapiens
cucuucccacau

SEQ ID NO: 1789015 - RNA, 13 nt, Homo sapiens
uugacagcuuucu

SEQ ID NO: 1789016 - RNA, 17 nt, Homo sapiens
uaaucuauaacuacaua

SEQ ID NO: 1789017 - RNA, 16 nt, Homo sapiens
cuagaaaucugccaau

SEQ ID NO: 1789018 - RNA, 22 nt, Homo sapiens
agccugacaacagccugagaaa

SEQ ID NO: 1789019 - RNA, 13 nt, Homo sapiens
cccacaacuuuaa

SEQ ID NO: 1789020 - RNA, 16 nt, Homo sapiens
uccuagcuacuuggca

SEQ ID NO: 1789021 - RNA, 14 nt, Homo sapiens
agaugcuggcccag

SEQ ID NO: 1789022 - RNA, 14 nt, Homo sapiens
uauauccugugacu

SEQ ID NO: 1789023 - RNA, 18 nt, Homo sapiens
aguuuuauauacugugua

SEQ ID NO: 1789024 - RNA, 16 nt, Homo sapiens
ugauauuuuaugcaaa

SEQ ID NO: 1789025 - RNA, 17 nt, Homo sapiens
gccauucucccccucag

SEQ ID NO: 1789026 - RNA, 15 nt, Homo sapiens
accaggggugcucac

SEQ ID NO: 1789027 - RNA, 20 nt, Homo sapiens
gcugccucugggccaugcca

SEQ ID NO: 1789028 - RNA, 23 nt, Homo sapiens
agcuggaauuuaaggagggacaa

SEQ ID NO: 1789029 - RNA, 19 nt, Homo sapiens
agaaaaaaaaggcaguauu

SEQ ID NO: 1789030 - RNA, 15 nt, Homo sapiens
cucuagagaacaugc

SEQ ID NO: 1789031 - RNA, 16 nt, Homo sapiens
caugaugaacucaccu

SEQ ID NO: 1789032 - RNA, 13 nt, Homo sapiens
gaaauaugugaug

SEQ ID NO: 1789033 - RNA, 22 nt, Homo sapiens
cuuuauuuauuaagaaugucau

SEQ ID NO: 1789034 - RNA, 15 nt, Homo sapiens
caggccugagcugcu

SEQ ID NO: 1789035 - RNA, 23 nt, Homo sapiens
uaaucaucuucucuuuuuccaga

SEQ ID NO: 1789036 - RNA, 18 nt, Homo sapiens
uccuuucaccccauccac

SEQ ID NO: 1789037 - RNA, 12 nt, Homo sapiens
uggccacucugc

SEQ ID NO: 1789038 - RNA, 18 nt, Homo sapiens
gcuccaucccauucacuu

SEQ ID NO: 1789039 - RNA, 19 nt, Homo sapiens
aggaaaacguugucacuuu

SEQ ID NO: 1789040 - RNA, 14 nt, Homo sapiens
gguaaauguuaccu

SEQ ID NO: 1789041 - RNA, 14 nt, Homo sapiens
aucuguuuguuacu

SEQ ID NO: 1789042 - RNA, 13 nt, Homo sapiens
caaaaaccucacc

SEQ ID NO: 1789043 - RNA, 21 nt, Homo sapiens
agucucugucguggagccauu

SEQ ID NO: 1789044 - RNA, 13 nt, Homo sapiens
uagaaaucagcua

SEQ ID NO: 1789045 - RNA, 15 nt, Homo sapiens
cacaugguaccugga

SEQ ID NO: 1789046 - RNA, 13 nt, Homo sapiens
cacuugaagccaa

SEQ ID NO: 1789047 - RNA, 18 nt, Homo sapiens
aacaaaaaaaacaacaaa

SEQ ID NO: 1789048 - RNA, 19 nt, Homo sapiens
cuuaaugcugaaaacacag

SEQ ID NO: 1789049 - RNA, 20 nt, Homo sapiens
uggugcacaaguaacacauu

SEQ ID NO: 1789050 - RNA, 22 nt, Homo sapiens
aaguacagggcagaaccaagaa

SEQ ID NO: 1789051 - RNA, 20 nt, Homo sapiens
uugcuaaguguaugauguca

SEQ ID NO: 1789052 - RNA, 16 nt, Homo sapiens
agcugcucccaaauaa

SEQ ID NO: 1789053 - RNA, 20 nt, Homo sapiens
acaaggaaaaauacugaauu

SEQ ID NO: 1789054 - RNA, 24 nt, Homo sapiens
ccacugaugcuguucucuucuuca

SEQ ID NO: 1789055 - RNA, 13 nt, Homo sapiens
uugugcacuggau

SEQ ID NO: 1789056 - RNA, 18 nt, Homo sapiens
ccaggaaagagcagucag

SEQ ID NO: 1789057 - RNA, 16 nt, Homo sapiens
ucaaauaaacacugug

SEQ ID NO: 1789058 - RNA, 17 nt, Homo sapiens
acuaaaacacacaggug

SEQ ID NO: 1789059 - RNA, 12 nt, Homo sapiens
gaacauggagcu

SEQ ID NO: 1789060 - RNA, 14 nt, Homo sapiens
acucugcauauucu

SEQ ID NO: 1789061 - RNA, 19 nt, Homo sapiens
gaauuaauucagauguuuu

SEQ ID NO: 1789062 - RNA, 16 nt, Homo sapiens
augcuaaacugugaaa

SEQ ID NO: 1789063 - RNA, 19 nt, Homo sapiens
ccuaacucaugccauucca

SEQ ID NO: 1789064 - RNA, 14 nt, Homo sapiens
aauucuccauuaau

SEQ ID NO: 1789065 - RNA, 14 nt, Homo sapiens
aacaauccaucucu

SEQ ID NO: 1789066 - RNA, 12 nt, Homo sapiens
aauauuucacuu

SEQ ID NO: 1789067 - RNA, 22 nt, Homo sapiens
uguaaagaaaaaagcaccaaag

SEQ ID NO: 1789068 - RNA, 15 nt, Homo sapiens
gcuauagugaacucc

SEQ ID NO: 1789069 - RNA, 17 nt, Homo sapiens
gccaaccccauccucac

SEQ ID NO: 1789070 - RNA, 14 nt, Homo sapiens
agguucaagugauu

SEQ ID NO: 1789071 - RNA, 14 nt, Homo sapiens
auaccauccauccc

SEQ ID NO: 1789072 - RNA, 17 nt, Homo sapiens
agcuggaaaagggucuu

SEQ ID NO: 1789073 - RNA, 21 nt, Homo sapiens
augaaggaaggacuaugacaa

SEQ ID NO: 1789074 - RNA, 16 nt, Homo sapiens
gaauaguaaacuaaag

SEQ ID NO: 1789075 - RNA, 20 nt, Homo sapiens
caggaaugucuggaguggua

SEQ ID NO: 1789076 - RNA, 16 nt, Homo sapiens
ccacuggucugcuuaa

SEQ ID NO: 1789077 - RNA, 18 nt, Homo sapiens
ugugugacauuccagggg

SEQ ID NO: 1789078 - RNA, 17 nt, Homo sapiens
guguguacacgggacug

SEQ ID NO: 1789079 - RNA, 15 nt, Homo sapiens
auugcaagcauugac

SEQ ID NO: 1789080 - RNA, 23 nt, Homo sapiens
ugauuaucuugauuucccaaaaa

SEQ ID NO: 1789081 - RNA, 14 nt, Homo sapiens
augugucaaauaca

SEQ ID NO: 1789082 - RNA, 11 nt, Homo sapiens
cuacagggucc

SEQ ID NO: 1789083 - RNA, 14 nt, Homo sapiens
aaucacuugcacuc

SEQ ID NO: 1789084 - RNA, 14 nt, Homo sapiens
auucccuuaacucu

SEQ ID NO: 1789085 - RNA, 22 nt, Homo sapiens
uuuugugucaaaaggacauuua

SEQ ID NO: 1789086 - RNA, 20 nt, Homo sapiens
gagacucugugaucuaagca

SEQ ID NO: 1789087 - RNA, 13 nt, Homo sapiens
uaaagcauaaaaa

SEQ ID NO: 1789088 - RNA, 19 nt, Homo sapiens
guagacaagcaagugcaca

SEQ ID NO: 1789089 - RNA, 13 nt, Homo sapiens
aaauggcaugaca

SEQ ID NO: 1789090 - RNA, 15 nt, Homo sapiens
ugccugcaccccagg

SEQ ID NO: 1789091 - RNA, 14 nt, Homo sapiens
guggugucugugaa

SEQ ID NO: 1789092 - RNA, 18 nt, Homo sapiens
auuuuuaugaaauacugc

SEQ ID NO: 1789093 - RNA, 23 nt, Homo sapiens
gcaccuggugggugguguccuga

SEQ ID NO: 1789094 - RNA, 21 nt, Homo sapiens
uauuuucccccuuuucugcau

SEQ ID NO: 1789095 - RNA, 13 nt, Homo sapiens
gucuuagcaagaa

SEQ ID NO: 1789096 - RNA, 16 nt, Homo sapiens
gcccccugaccuucca

SEQ ID NO: 1789097 - RNA, 17 nt, Homo sapiens
gccacccuuugguuauu

SEQ ID NO: 1789098 - RNA, 15 nt, Homo sapiens
cuggcccagccuuug

SEQ ID NO: 1789099 - RNA, 19 nt, Homo sapiens
auuuaauuugauaucacag

SEQ ID NO: 1789100 - RNA, 22 nt, Homo sapiens
caaacacuugaagugagaagau

SEQ ID NO: 1789101 - RNA, 11 nt, Homo sapiens
uuguacuuuga

SEQ ID NO: 1789102 - RNA, 16 nt, Homo sapiens
cauuugugugugugca

SEQ ID NO: 1789103 - RNA, 15 nt, Homo sapiens
aucucauuacugcuu

SEQ ID NO: 1789104 - RNA, 17 nt, Homo sapiens
ucaccuagaacgugcau

SEQ ID NO: 1789105 - RNA, 16 nt, Homo sapiens
cagacucugcccaucc

SEQ ID NO: 1789106 - RNA, 15 nt, Homo sapiens
uaaccucacauaccc

SEQ ID NO: 1789107 - RNA, 22 nt, Homo sapiens
caucaaauuauuaaucugaaaa

SEQ ID NO: 1789108 - RNA, 15 nt, Homo sapiens
caccugcgcugugga

SEQ ID NO: 1789109 - RNA, 16 nt, Homo sapiens
uucauaaaaaucccuc

SEQ ID NO: 1789110 - RNA, 14 nt, Homo sapiens
uccuguucagugag

SEQ ID NO: 1789111 - RNA, 16 nt, Homo sapiens
ucccucuuucuuccca

SEQ ID NO: 1789112 - RNA, 16 nt, Homo sapiens
acccugagcacucuua

SEQ ID NO: 1789113 - RNA, 18 nt, Homo sapiens
auuuaagacaaguucaac

SEQ ID NO: 1789114 - RNA, 16 nt, Homo sapiens
gccgggaccacccuga

SEQ ID NO: 1789115 - RNA, 21 nt, Homo sapiens
caaagccuuggucccgugaaa

SEQ ID NO: 1789116 - RNA, 15 nt, Homo sapiens
aucugaacuguggaa

SEQ ID NO: 1789117 - RNA, 22 nt, Homo sapiens
accuuacuucuucucauacuau

SEQ ID NO: 1789118 - RNA, 21 nt, Homo sapiens
ggagaauuucauauuuuaccu

SEQ ID NO: 1789119 - RNA, 20 nt, Homo sapiens
guuccccuaguucuacauga

SEQ ID NO: 1789120 - RNA, 20 nt, Homo sapiens
gacuuaagcacacuugacau

SEQ ID NO: 1789121 - RNA, 21 nt, Homo sapiens
uucccagcucagugccaaaga

SEQ ID NO: 1789122 - RNA, 19 nt, Homo sapiens
ccuggcuaacacggugaaa

SEQ ID NO: 1789123 - RNA, 19 nt, Homo sapiens
uaaagaaauacacagggag

SEQ ID NO: 1789124 - RNA, 18 nt, Homo sapiens
ccuccuaaccuagagauu

SEQ ID NO: 1789125 - RNA, 16 nt, Homo sapiens
gcuccucugugaagca

SEQ ID NO: 1789126 - RNA, 20 nt, Homo sapiens
gcucccgaagccugagcuca

SEQ ID NO: 1789127 - RNA, 15 nt, Homo sapiens
uccuggacucagggu

SEQ ID NO: 1789128 - RNA, 12 nt, Homo sapiens
uccaauugaacu

SEQ ID NO: 1789129 - RNA, 12 nt, Homo sapiens
aaaaauugucau

SEQ ID NO: 1789130 - RNA, 20 nt, Homo sapiens
augcaaauaaauuaugcaau

SEQ ID NO: 1789131 - RNA, 17 nt, Homo sapiens
gccaaacacccaugccc

SEQ ID NO: 1789132 - RNA, 18 nt, Homo sapiens
cacauucccccaccagcu

SEQ ID NO: 1789133 - RNA, 23 nt, Homo sapiens
uugaguuuagaagugaguguaau

SEQ ID NO: 1789134 - RNA, 15 nt, Homo sapiens
ugaaugucaguguga

SEQ ID NO: 1789135 - RNA, 15 nt, Homo sapiens
cauuuuucugcagaa

SEQ ID NO: 1789136 - RNA, 18 nt, Homo sapiens
cucagugaucucacuuaa

SEQ ID NO: 1789137 - RNA, 15 nt, Homo sapiens
aguaaaaaucaauac

SEQ ID NO: 1789138 - RNA, 13 nt, Homo sapiens
gugagucuucacu

SEQ ID NO: 1789139 - RNA, 16 nt, Homo sapiens
guaacauuugcuguuu

SEQ ID NO: 1789140 - RNA, 16 nt, Homo sapiens
cacagugccacccaug

SEQ ID NO: 1789141 - RNA, 17 nt, Homo sapiens
guauagaccaugcacag

SEQ ID NO: 1789142 - RNA, 18 nt, Homo sapiens
cuguacaaauaauagcaa

SEQ ID NO: 1789143 - RNA, 19 nt, Homo sapiens
gcauaaagcauguuucauu

SEQ ID NO: 1789144 - RNA, 22 nt, Homo sapiens
uccacucagcuguccugcagca

SEQ ID NO: 1789145 - RNA, 20 nt, Homo sapiens
uccaccuaguggcuguccag

SEQ ID NO: 1789146 - RNA, 13 nt, Homo sapiens
gaccaugccagac

SEQ ID NO: 1789147 - RNA, 17 nt, Homo sapiens
cccuugaaccucauuaa

SEQ ID NO: 1789148 - RNA, 19 nt, Homo sapiens
acuuugagcacacuuuaca

SEQ ID NO: 1789149 - RNA, 21 nt, Homo sapiens
gugagcagggcccucagagga

SEQ ID NO: 1789150 - RNA, 15 nt, Homo sapiens
uuagcuggugucagc

SEQ ID NO: 1789151 - RNA, 14 nt, Homo sapiens
uauuucuucuuaca

SEQ ID NO: 1789152 - RNA, 14 nt, Homo sapiens
cuccagcccuaugg

SEQ ID NO: 1789153 - RNA, 14 nt, Homo sapiens
uucugaccuuacaa

SEQ ID NO: 1789154 - RNA, 13 nt, Homo sapiens
gcuggguuuacac

SEQ ID NO: 1789155 - RNA, 19 nt, Homo sapiens
uccagcagguaggggcaca

SEQ ID NO: 1789156 - RNA, 13 nt, Homo sapiens
uuuagaaccagcc

SEQ ID NO: 1789157 - RNA, 15 nt, Homo sapiens
ucugggccagugcac

SEQ ID NO: 1789158 - RNA, 14 nt, Homo sapiens
caggcacugagaau

SEQ ID NO: 1789159 - RNA, 16 nt, Homo sapiens
agaccucuacugccuu

SEQ ID NO: 1789160 - RNA, 16 nt, Homo sapiens
cacucggcauuucaaa

SEQ ID NO: 1789161 - RNA, 15 nt, Homo sapiens
acaguugauuuccaa

SEQ ID NO: 1789162 - RNA, 13 nt, Homo sapiens
uagugcugugaaa

SEQ ID NO: 1789163 - RNA, 15 nt, Homo sapiens
uauucuuuguuuccu

SEQ ID NO: 1789164 - RNA, 17 nt, Homo sapiens
agcacggccaccucuca

SEQ ID NO: 1789165 - RNA, 23 nt, Homo sapiens
ugcuauuuauuuuccuaaagaga

SEQ ID NO: 1789166 - RNA, 15 nt, Homo sapiens
uauauucaacucaua

SEQ ID NO: 1789167 - RNA, 17 nt, Homo sapiens
ucucuuauauaguauuc

SEQ ID NO: 1789168 - RNA, 20 nt, Homo sapiens
agcgugcaggagcaaggcug

SEQ ID NO: 1789169 - RNA, 22 nt, Homo sapiens
cucaauauauucaguaaugaag

SEQ ID NO: 1789170 - RNA, 16 nt, Homo sapiens
uuuauaucuggaauga

SEQ ID NO: 1789171 - RNA, 18 nt, Homo sapiens
auuauuuuuucugugguc

SEQ ID NO: 1789172 - RNA, 15 nt, Homo sapiens
cuuacuggcaaacau

SEQ ID NO: 1789173 - RNA, 20 nt, Homo sapiens
ugcuccgaggacccaggaaa

SEQ ID NO: 1789174 - RNA, 20 nt, Homo sapiens
cagaugugaaaauauacuug

SEQ ID NO: 1789175 - RNA, 15 nt, Homo sapiens
cacacacacagagau

SEQ ID NO: 1789176 - RNA, 14 nt, Homo sapiens
aggcagugagaugu

SEQ ID NO: 1789177 - RNA, 15 nt, Homo sapiens
ucagguucuuuacaa

SEQ ID NO: 1789178 - RNA, 20 nt, Homo sapiens
auggaaagucaugcaauccc

SEQ ID NO: 1789179 - RNA, 18 nt, Homo sapiens
agauaaccuguacuucaa

SEQ ID NO: 1789180 - RNA, 22 nt, Homo sapiens
gcuggucuuggugaacacacau

SEQ ID NO: 1789181 - RNA, 14 nt, Homo sapiens
gauugaaaagaccu

SEQ ID NO: 1789182 - RNA, 20 nt, Homo sapiens
caacaucuuuuuccucccuu

SEQ ID NO: 1789183 - RNA, 21 nt, Homo sapiens
agcucuacuccaggcuuccac

SEQ ID NO: 1789184 - RNA, 16 nt, Homo sapiens
accaucucacaccagu

SEQ ID NO: 1789185 - RNA, 22 nt, Homo sapiens
cuuuaacuugucuucuaguuua

SEQ ID NO: 1789186 - RNA, 16 nt, Homo sapiens
caacgaagugccagaa

SEQ ID NO: 1789187 - RNA, 13 nt, Homo sapiens
uuuggagcuauca

SEQ ID NO: 1789188 - RNA, 18 nt, Homo sapiens
auuuuguaauaauaaaga

SEQ ID NO: 1789189 - RNA, 16 nt, Homo sapiens
uauaaauauaagccuu

SEQ ID NO: 1789190 - RNA, 11 nt, Homo sapiens
gugucacuggc

SEQ ID NO: 1789191 - RNA, 17 nt, Homo sapiens
agcuccagaagaacaaa

SEQ ID NO: 1789192 - RNA, 20 nt, Homo sapiens
aauacugugcauaagccauu

SEQ ID NO: 1789193 - RNA, 17 nt, Homo sapiens
aguagagggcacugggu

SEQ ID NO: 1789194 - RNA, 17 nt, Homo sapiens
cuggggcaggaccacua

SEQ ID NO: 1789195 - RNA, 20 nt, Homo sapiens
guacuuugaguauaacauca

SEQ ID NO: 1789196 - RNA, 21 nt, Homo sapiens
cuguagaugacauggugaaaa

SEQ ID NO: 1789197 - RNA, 22 nt, Homo sapiens
cugacacucaauaaacagucac

SEQ ID NO: 1789198 - RNA, 18 nt, Homo sapiens
gccuuucuguaaccaaaa

SEQ ID NO: 1789199 - RNA, 22 nt, Homo sapiens
acauagaaacucgggcuugagu

SEQ ID NO: 1789200 - RNA, 18 nt, Homo sapiens
agccuuuaauaggcuugu

SEQ ID NO: 1789201 - RNA, 23 nt, Homo sapiens
ucugauaaaccugucuaagcaau

SEQ ID NO: 1789202 - RNA, 17 nt, Homo sapiens
gcccaccacaucauccu

SEQ ID NO: 1789203 - RNA, 15 nt, Homo sapiens
aaauccgacuugaau

SEQ ID NO: 1789204 - RNA, 10 nt, Homo sapiens
uuaacuguau

SEQ ID NO: 1789205 - RNA, 16 nt, Homo sapiens
aaaaucuucagcuggu

SEQ ID NO: 1789206 - RNA, 18 nt, Homo sapiens
uaacacuguaauaucuuu

SEQ ID NO: 1789207 - RNA, 16 nt, Homo sapiens
uaauaucuuucaguua

SEQ ID NO: 1789208 - RNA, 16 nt, Homo sapiens
uuauaucauacaguuu

SEQ ID NO: 1789209 - RNA, 12 nt, Homo sapiens
agucuuugcuca

SEQ ID NO: 1789210 - RNA, 19 nt, Homo sapiens
aaguuugaccagugcaguu

SEQ ID NO: 1789211 - RNA, 18 nt, Homo sapiens
caggaggcuuggaaagca

SEQ ID NO: 1789212 - RNA, 19 nt, Homo sapiens
agcgaugaggggacauuuu

SEQ ID NO: 1789213 - RNA, 21 nt, Homo sapiens
ucuucaacccccugacauuau

SEQ ID NO: 1789214 - RNA, 15 nt, Homo sapiens
acauucuuauugaca

SEQ ID NO: 1789215 - RNA, 17 nt, Homo sapiens
ugggccccaucauuaaa

SEQ ID NO: 1789216 - RNA, 18 nt, Homo sapiens
uccauuaccuccauccau

SEQ ID NO: 1789217 - RNA, 12 nt, Homo sapiens
gaagcaaccucc

SEQ ID NO: 1789218 - RNA, 13 nt, Homo sapiens
uuuuacuuuggca

SEQ ID NO: 1789219 - RNA, 22 nt, Homo sapiens
auuccagccacuggcugcuaac

SEQ ID NO: 1789220 - RNA, 23 nt, Homo sapiens
aauuucacauuaauauuugcuga

SEQ ID NO: 1789221 - RNA, 15 nt, Homo sapiens
gaccccaaaccagcc

SEQ ID NO: 1789222 - RNA, 21 nt, Homo sapiens
gcccagaacuggacucaggau

SEQ ID NO: 1789223 - RNA, 16 nt, Homo sapiens
caaauaauccauucca

SEQ ID NO: 1789224 - RNA, 17 nt, Homo sapiens
uuauugaauucauuuca

SEQ ID NO: 1789225 - RNA, 23 nt, Homo sapiens
gugauggcgcgggaggcaccagc

SEQ ID NO: 1789226 - RNA, 18 nt, Homo sapiens
gagccauauaaguuugaa

SEQ ID NO: 1789227 - RNA, 18 nt, Homo sapiens
agcuucauuaugcagcug

SEQ ID NO: 1789228 - RNA, 18 nt, Homo sapiens
ugccucccaagguccucu

SEQ ID NO: 1789229 - RNA, 19 nt, Homo sapiens
aucucaggaaaaucuguga

SEQ ID NO: 1789230 - RNA, 13 nt, Homo sapiens
cagcucuacucca

SEQ ID NO: 1789231 - RNA, 18 nt, Homo sapiens
cucaaacccccagccuca

SEQ ID NO: 1789232 - RNA, 22 nt, Homo sapiens
cucaggauuucgugggucuguu

SEQ ID NO: 1789233 - RNA, 20 nt, Homo sapiens
guguguauauauguguauau

SEQ ID NO: 1789234 - RNA, 15 nt, Homo sapiens
uacuaaaccaccuca

SEQ ID NO: 1789235 - RNA, 18 nt, Homo sapiens
aaaucagaccuggcugcu

SEQ ID NO: 1789236 - RNA, 19 nt, Homo sapiens
aggccagcagcugaugcug

SEQ ID NO: 1789237 - RNA, 12 nt, Homo sapiens
gcccccaguguc

SEQ ID NO: 1789238 - RNA, 12 nt, Homo sapiens
gugcuacagggg

SEQ ID NO: 1789239 - RNA, 15 nt, Homo sapiens
acccucacucugcca

SEQ ID NO: 1789240 - RNA, 17 nt, Homo sapiens
ggcaucgggccaucuca

SEQ ID NO: 1789241 - RNA, 20 nt, Homo sapiens
auauccuggcccccugggcu

SEQ ID NO: 1789242 - RNA, 14 nt, Homo sapiens
caauaugccagcuu

SEQ ID NO: 1789243 - RNA, 13 nt, Homo sapiens
ccucuacauauuu

SEQ ID NO: 1789244 - RNA, 23 nt, Homo sapiens
ggucauccgggaggacaaccaga

SEQ ID NO: 1789245 - RNA, 13 nt, Homo sapiens
uacuuaaucucac

SEQ ID NO: 1789246 - RNA, 15 nt, Homo sapiens
uaugauuuaagacua

SEQ ID NO: 1789247 - RNA, 20 nt, Homo sapiens
ccucagguggccccaguuca

SEQ ID NO: 1789248 - RNA, 21 nt, Homo sapiens
cugggcauuuggugagaguca

SEQ ID NO: 1789249 - RNA, 21 nt, Homo sapiens
aaauauuaguuacuugcuaua

SEQ ID NO: 1789250 - RNA, 20 nt, Homo sapiens
aggagcuccccuguuugcau

SEQ ID NO: 1789251 - RNA, 22 nt, Homo sapiens
gaauaaaugaaucuuacuccuu

SEQ ID NO: 1789252 - RNA, 20 nt, Homo sapiens
aagauggcacuuauaaccaa

SEQ ID NO: 1789253 - RNA, 21 nt, Homo sapiens
caggaggcugaggcaccagaa

SEQ ID NO: 1789254 - RNA, 14 nt, Homo sapiens
ccagugugcaaggg

SEQ ID NO: 1789255 - RNA, 19 nt, Homo sapiens
uuccauaaucuggacuccu

SEQ ID NO: 1789256 - RNA, 14 nt, Homo sapiens
uacuauguacugcc

SEQ ID NO: 1789257 - RNA, 18 nt, Homo sapiens
ccugaaguugcugcugug

SEQ ID NO: 1789258 - RNA, 15 nt, Homo sapiens
agauuagaauucugu

SEQ ID NO: 1789259 - RNA, 13 nt, Homo sapiens
ugacucugagcua

SEQ ID NO: 1789260 - RNA, 12 nt, Homo sapiens
gcuuugugauuc

SEQ ID NO: 1789261 - RNA, 17 nt, Homo sapiens
ucaaacauaauucucuc

SEQ ID NO: 1789262 - RNA, 20 nt, Homo sapiens
ugguuuauugaaugugauuu

SEQ ID NO: 1789263 - RNA, 22 nt, Homo sapiens
uugccaauuuuaaagacauucu

SEQ ID NO: 1789264 - RNA, 20 nt, Homo sapiens
aaucuucuugauccacuucu

SEQ ID NO: 1789265 - RNA, 18 nt, Homo sapiens
cauaguggagagaacuga

SEQ ID NO: 1789266 - RNA, 19 nt, Homo sapiens
ugucaccugcucacaggga

SEQ ID NO: 1789267 - RNA, 13 nt, Homo sapiens
ccuuuugccaucc

SEQ ID NO: 1789268 - RNA, 17 nt, Homo sapiens
aaauuaugagugauuaa

SEQ ID NO: 1789269 - RNA, 21 nt, Homo sapiens
cuagugucaccugcacagggc

SEQ ID NO: 1789270 - RNA, 16 nt, Homo sapiens
ccugauagaagugcau

SEQ ID NO: 1789271 - RNA, 22 nt, Homo sapiens
agcacuguguaaccagcaguca

SEQ ID NO: 1789272 - RNA, 12 nt, Homo sapiens
uggccaagcaga

SEQ ID NO: 1789273 - RNA, 17 nt, Homo sapiens
ggauugauugaggccaa

SEQ ID NO: 1789274 - RNA, 18 nt, Homo sapiens
ucagaaucaucauaucau

SEQ ID NO: 1789275 - RNA, 14 nt, Homo sapiens
augcagaagugcau

SEQ ID NO: 1789276 - RNA, 14 nt, Homo sapiens
aaacaagcguuuau

SEQ ID NO: 1789277 - RNA, 22 nt, Homo sapiens
auuuucccuucgauauaugacu

SEQ ID NO: 1789278 - RNA, 20 nt, Homo sapiens
gcuacugaaacuuaccugag

SEQ ID NO: 1789279 - RNA, 14 nt, Homo sapiens
uauugcuguuucag

SEQ ID NO: 1789280 - RNA, 19 nt, Homo sapiens
auacauuucuuccuucaaa

SEQ ID NO: 1789281 - RNA, 16 nt, Homo sapiens
acuuuaacugacuuaa

SEQ ID NO: 1789282 - RNA, 22 nt, Homo sapiens
cauguccauacacuuuguugca

SEQ ID NO: 1789283 - RNA, 21 nt, Homo sapiens
cucugagaguagagucacugg

SEQ ID NO: 1789284 - RNA, 22 nt, Homo sapiens
ggccccauucagaacucucaga

SEQ ID NO: 1789285 - RNA, 15 nt, Homo sapiens
uagugugugcaauuu

SEQ ID NO: 1789286 - RNA, 21 nt, Homo sapiens
gaaugcuucuagaaacuucca

SEQ ID NO: 1789287 - RNA, 14 nt, Homo sapiens
uuuggucacacucu

SEQ ID NO: 1789288 - RNA, 14 nt, Homo sapiens
uugagaucagucuu

SEQ ID NO: 1789289 - RNA, 15 nt, Homo sapiens
aacuccugaguucaa

SEQ ID NO: 1789290 - RNA, 17 nt, Homo sapiens
accccagucaagcuccu

SEQ ID NO: 1789291 - RNA, 22 nt, Homo sapiens
auauacagcucagaaguuucuu

SEQ ID NO: 1789292 - RNA, 22 nt, Homo sapiens
auucaaggagaggggaccaugc

SEQ ID NO: 1789293 - RNA, 21 nt, Homo sapiens
ccaacacugaaaacacuguga

SEQ ID NO: 1789294 - RNA, 21 nt, Homo sapiens
ggauaaagaaaagacauuuua

SEQ ID NO: 1789295 - RNA, 16 nt, Homo sapiens
ucaaagguaauucuga

SEQ ID NO: 1789296 - RNA, 23 nt, Homo sapiens
ugaaugggagccagaauucacua

SEQ ID NO: 1789297 - RNA, 20 nt, Homo sapiens
uagggacauaaguucauuca

SEQ ID NO: 1789298 - RNA, 21 nt, Homo sapiens
cuugcucccaagccccugacc

SEQ ID NO: 1789299 - RNA, 14 nt, Homo sapiens
ucuucucaaggaca

SEQ ID NO: 1789300 - RNA, 15 nt, Homo sapiens
uguacauacuuuuuc

SEQ ID NO: 1789301 - RNA, 19 nt, Homo sapiens
uacucgaguuacagacaaa

SEQ ID NO: 1789302 - RNA, 20 nt, Homo sapiens
gaacauguuuuucuucuccc

SEQ ID NO: 1789303 - RNA, 20 nt, Homo sapiens
ccuaacauacugcauuucac

SEQ ID NO: 1789304 - RNA, 13 nt, Homo sapiens
ucuauucuaagua

SEQ ID NO: 1789305 - RNA, 15 nt, Homo sapiens
ucucaacuacucagc

SEQ ID NO: 1789306 - RNA, 15 nt, Homo sapiens
uaaaaauuaaaaagu

SEQ ID NO: 1789307 - RNA, 16 nt, Homo sapiens
aaggcccacuguaaua

SEQ ID NO: 1789308 - RNA, 22 nt, Homo sapiens
ggacuccaucucucauccucca

SEQ ID NO: 1789309 - RNA, 21 nt, Homo sapiens
ugaagugccuuuuuccuagaa

SEQ ID NO: 1789310 - RNA, 21 nt, Homo sapiens
acucucaggggagaccaagaa

SEQ ID NO: 1789311 - RNA, 15 nt, Homo sapiens
ugaaguauacauuua

SEQ ID NO: 1789312 - RNA, 15 nt, Homo sapiens
ugaaguuuacauuuu

SEQ ID NO: 1789313 - RNA, 16 nt, Homo sapiens
auuuugccauuuagcg

SEQ ID NO: 1789314 - RNA, 17 nt, Homo sapiens
gcaacuucuauccuuuc

SEQ ID NO: 1789315 - RNA, 21 nt, Homo sapiens
acuuaauuuuuccugcuguau

SEQ ID NO: 1789316 - RNA, 19 nt, Homo sapiens
gcauaauaugaagccuuug

SEQ ID NO: 1789317 - RNA, 22 nt, Homo sapiens
gaccaucgcugccugccagcuu

SEQ ID NO: 1789318 - RNA, 13 nt, Homo sapiens
guucuaaauggaa

SEQ ID NO: 1789319 - RNA, 16 nt, Homo sapiens
agugugggcauagcau

SEQ ID NO: 1789320 - RNA, 15 nt, Homo sapiens
caagaucauagcuca

SEQ ID NO: 1789321 - RNA, 22 nt, Homo sapiens
aaccucacucuugccaaccugu

SEQ ID NO: 1789322 - RNA, 14 nt, Homo sapiens
uccuuuuaagaaag

SEQ ID NO: 1789323 - RNA, 20 nt, Homo sapiens
ggauccuauccuccuaccuc

SEQ ID NO: 1789324 - RNA, 16 nt, Homo sapiens
uagauguaacauuccu

SEQ ID NO: 1789325 - RNA, 22 nt, Homo sapiens
caugauuucauuucaacuguuu

SEQ ID NO: 1789326 - RNA, 19 nt, Homo sapiens
uuaugugugaggagcugcu

SEQ ID NO: 1789327 - RNA, 19 nt, Homo sapiens
gaaguuaaauucuccacuc

SEQ ID NO: 1789328 - RNA, 21 nt, Homo sapiens
aauuucuaguucacagacaua

SEQ ID NO: 1789329 - RNA, 17 nt, Homo sapiens
gucucucucacauuaag

SEQ ID NO: 1789330 - RNA, 14 nt, Homo sapiens
aagagagccaguaa

SEQ ID NO: 1789331 - RNA, 16 nt, Homo sapiens
caauuaauuccuucag

SEQ ID NO: 1789332 - RNA, 17 nt, Homo sapiens
ucccugccuucacugug

SEQ ID NO: 1789333 - RNA, 14 nt, Homo sapiens
cgugacaagugccu

SEQ ID NO: 1789334 - RNA, 23 nt, Homo sapiens
ggccaaggugggcggaucacuug

SEQ ID NO: 1789335 - RNA, 14 nt, Homo sapiens
aucagcaugacaaa

SEQ ID NO: 1789336 - RNA, 15 nt, Homo sapiens
uuguacauuuuucag

SEQ ID NO: 1789337 - RNA, 22 nt, Homo sapiens
ucgccaccacuuccagagccag

SEQ ID NO: 1789338 - RNA, 16 nt, Homo sapiens
auaugggaaagacaug

SEQ ID NO: 1789339 - RNA, 19 nt, Homo sapiens
aauucuaaauuacaaaggu

SEQ ID NO: 1789340 - RNA, 20 nt, Homo sapiens
uugucagccuugcuacuuga

SEQ ID NO: 1789341 - RNA, 14 nt, Homo sapiens
caguugcccuagcc

SEQ ID NO: 1789342 - RNA, 14 nt, Homo sapiens
aaugucacugccaa

SEQ ID NO: 1789343 - RNA, 14 nt, Homo sapiens
aagcaccugccuca

SEQ ID NO: 1789344 - RNA, 13 nt, Homo sapiens
uggaggguccauu

SEQ ID NO: 1789345 - RNA, 14 nt, Homo sapiens
aaaaauaauugcca

SEQ ID NO: 1789346 - RNA, 14 nt, Homo sapiens
ccuucagacuggcc

SEQ ID NO: 1789347 - RNA, 18 nt, Homo sapiens
cgaucuggguucacugca

SEQ ID NO: 1789348 - RNA, 21 nt, Homo sapiens
aguacaauggcgugaucucag

SEQ ID NO: 1789349 - RNA, 18 nt, Homo sapiens
ugugacaggaauucuccc

SEQ ID NO: 1789350 - RNA, 17 nt, Homo sapiens
aaaucuaguauacauug

SEQ ID NO: 1789351 - RNA, 18 nt, Homo sapiens
aggccaggggagacaucg

SEQ ID NO: 1789352 - RNA, 16 nt, Homo sapiens
agagaugccaugauau

SEQ ID NO: 1789353 - RNA, 17 nt, Homo sapiens
ugcaguggugaugccua

SEQ ID NO: 1789354 - RNA, 14 nt, Homo sapiens
ugaaagaacuuaag

SEQ ID NO: 1789355 - RNA, 12 nt, Homo sapiens
ugucccaugcag

SEQ ID NO: 1789356 - RNA, 21 nt, Homo sapiens
gccucugggaggggugcugcc

SEQ ID NO: 1789357 - RNA, 17 nt, Homo sapiens
cagaaugugauauccua

SEQ ID NO: 1789358 - RNA, 16 nt, Homo sapiens
auaccagaaagcucua

SEQ ID NO: 1789359 - RNA, 21 nt, Homo sapiens
gaccucccagcgaccacugca

SEQ ID NO: 1789360 - RNA, 15 nt, Homo sapiens
ccucgaauacugggg

SEQ ID NO: 1789361 - RNA, 15 nt, Homo sapiens
cugcagcggcacaaa

SEQ ID NO: 1789362 - RNA, 13 nt, Homo sapiens
acucgucugaugu

SEQ ID NO: 1789363 - RNA, 15 nt, Homo sapiens
uuuaaauaaauggaa

SEQ ID NO: 1789364 - RNA, 23 nt, Homo sapiens
uucaagcaaaaugcuuacagggc

SEQ ID NO: 1789365 - RNA, 13 nt, Homo sapiens
acccuccuucugu

SEQ ID NO: 1789366 - RNA, 14 nt, Homo sapiens
cuggaaugugucaa

SEQ ID NO: 1789367 - RNA, 18 nt, Homo sapiens
gagcaccuugcaguuccc

SEQ ID NO: 1789368 - RNA, 18 nt, Homo sapiens
cagagugagaccuaucua

SEQ ID NO: 1789369 - RNA, 14 nt, Homo sapiens
caguugcauuuagc

SEQ ID NO: 1789370 - RNA, 15 nt, Homo sapiens
agaacuuauucucug

SEQ ID NO: 1789371 - RNA, 22 nt, Homo sapiens
aaggaugcacagucaggaagac

SEQ ID NO: 1789372 - RNA, 14 nt, Homo sapiens
guuauugccucuac

SEQ ID NO: 1789373 - RNA, 12 nt, Homo sapiens
guguucauugca

SEQ ID NO: 1789374 - RNA, 21 nt, Homo sapiens
auccagugaccucucucucug

SEQ ID NO: 1789375 - RNA, 12 nt, Homo sapiens
uuugaacaacca

SEQ ID NO: 1789376 - RNA, 19 nt, Homo sapiens
ucuggaaugcaugggagcu

SEQ ID NO: 1789377 - RNA, 14 nt, Homo sapiens
cagaaggugccacu

SEQ ID NO: 1789378 - RNA, 10 nt, Homo sapiens
gcaaccagua

SEQ ID NO: 1789379 - RNA, 18 nt, Homo sapiens
aaucuagaaaaucagauc

SEQ ID NO: 1789380 - RNA, 20 nt, Homo sapiens
uggaauauuaaaaaacuuca

SEQ ID NO: 1789381 - RNA, 21 nt, Homo sapiens
uugaauagaucuuuauaaccu

SEQ ID NO: 1789382 - RNA, 21 nt, Homo sapiens
augaguucugcacauacagau

SEQ ID NO: 1789383 - RNA, 22 nt, Homo sapiens
agacgcagcccugggggccagc

SEQ ID NO: 1789384 - RNA, 19 nt, Homo sapiens
cgggcuuuuccaagcugcc

SEQ ID NO: 1789385 - RNA, 21 nt, Homo sapiens
agagacacugggacacuguca

SEQ ID NO: 1789386 - RNA, 14 nt, Homo sapiens
gucaaaauaaucug

SEQ ID NO: 1789387 - RNA, 19 nt, Homo sapiens
guuaagaauugagcaguuc

SEQ ID NO: 1789388 - RNA, 21 nt, Homo sapiens
cagcaucugaccucuaccuuc

SEQ ID NO: 1789389 - RNA, 20 nt, Homo sapiens
gcagcugcagcagcaguucc

SEQ ID NO: 1789390 - RNA, 16 nt, Homo sapiens
aucugcacucaccuca

SEQ ID NO: 1789391 - RNA, 16 nt, Homo sapiens
ugucuugguugccagu

SEQ ID NO: 1789392 - RNA, 18 nt, Homo sapiens
aggcugcuggagugcagu

SEQ ID NO: 1789393 - RNA, 14 nt, Homo sapiens
ccuucaccaaagau

SEQ ID NO: 1789394 - RNA, 17 nt, Homo sapiens
uguagccacuucacuuu

SEQ ID NO: 1789395 - RNA, 21 nt, Homo sapiens
accuggaccccugcauuggaa

SEQ ID NO: 1789396 - RNA, 15 nt, Homo sapiens
uagauuuaagugaau

SEQ ID NO: 1789397 - RNA, 21 nt, Homo sapiens
ccuccucuacaauuugccauu

SEQ ID NO: 1789398 - RNA, 20 nt, Homo sapiens
acuuuaaacuugucuuuuca

SEQ ID NO: 1789399 - RNA, 18 nt, Homo sapiens
cucauaaaggacacugga

SEQ ID NO: 1789400 - RNA, 13 nt, Homo sapiens
ugggauuacaggu

SEQ ID NO: 1789401 - RNA, 20 nt, Homo sapiens
cuguguuuuauugugguaau

SEQ ID NO: 1789402 - RNA, 16 nt, Homo sapiens
agagaaggugaaggua

SEQ ID NO: 1789403 - RNA, 15 nt, Homo sapiens
cuccauuguuuugcc

SEQ ID NO: 1789404 - RNA, 15 nt, Homo sapiens
auucagauaauuaga

SEQ ID NO: 1789405 - RNA, 15 nt, Homo sapiens
aucugcauaaccgca

SEQ ID NO: 1789406 - RNA, 23 nt, Homo sapiens
gguuuacaacaaacacugugaug

SEQ ID NO: 1789407 - RNA, 22 nt, Homo sapiens
agugguuguccccguaccacca

SEQ ID NO: 1789408 - RNA, 18 nt, Homo sapiens
uuucuuugcuagcacaau

SEQ ID NO: 1789409 - RNA, 19 nt, Homo sapiens
ggaugcuggccuuugcucu

SEQ ID NO: 1789410 - RNA, 21 nt, Homo sapiens
aagagacccagucaauuacau

SEQ ID NO: 1789411 - RNA, 21 nt, Homo sapiens
guuugccucccugcacuucau

SEQ ID NO: 1789412 - RNA, 17 nt, Homo sapiens
acuaagcacaugaaaaa

SEQ ID NO: 1789413 - RNA, 13 nt, Homo sapiens
ugaaguuugaaug

SEQ ID NO: 1789414 - RNA, 18 nt, Homo sapiens
uaggucucaucucuucag

SEQ ID NO: 1789415 - RNA, 16 nt, Homo sapiens
ccauuacagagguauu

SEQ ID NO: 1789416 - RNA, 22 nt, Homo sapiens
ugcucauauuaauguacuuaaa

SEQ ID NO: 1789417 - RNA, 18 nt, Homo sapiens
guagauguggccuuugaa

SEQ ID NO: 1789418 - RNA, 19 nt, Homo sapiens
ccuucaagcucugagggaa

SEQ ID NO: 1789419 - RNA, 22 nt, Homo sapiens
ugaagcagcucugccuucuuag

SEQ ID NO: 1789420 - RNA, 23 nt, Homo sapiens
ugucccacuaucugggugcauga

SEQ ID NO: 1789421 - RNA, 17 nt, Homo sapiens
cagacugaaaagacaaa

SEQ ID NO: 1789422 - RNA, 19 nt, Homo sapiens
guagaagccugcagcggca

SEQ ID NO: 1789423 - RNA, 23 nt, Homo sapiens
gaggauacgacaguacacuguca

SEQ ID NO: 1789424 - RNA, 20 nt, Homo sapiens
uggcauccccacguggacaa

SEQ ID NO: 1789425 - RNA, 15 nt, Homo sapiens
uuagugguacucuga

SEQ ID NO: 1789426 - RNA, 19 nt, Homo sapiens
ccuggauugggagccauuu

SEQ ID NO: 1789427 - RNA, 17 nt, Homo sapiens
ucaccugaagcaugaaa

SEQ ID NO: 1789428 - RNA, 21 nt, Homo sapiens
uaauauugccuugauguuucu

SEQ ID NO: 1789429 - RNA, 22 nt, Homo sapiens
ucagacaaaauggauacauaaa

SEQ ID NO: 1789430 - RNA, 20 nt, Homo sapiens
ucacagcagugcauaggcca

SEQ ID NO: 1789431 - RNA, 23 nt, Homo sapiens
ggcagaaaaccuaccacauucac

SEQ ID NO: 1789432 - RNA, 23 nt, Homo sapiens
ggcucccccuccagccagagaca

SEQ ID NO: 1789433 - RNA, 20 nt, Homo sapiens
ggucucagguccagcuuuac

SEQ ID NO: 1789434 - RNA, 13 nt, Homo sapiens
gcaccaugcugcu

SEQ ID NO: 1789435 - RNA, 15 nt, Homo sapiens
cauauagcagaccaa

SEQ ID NO: 1789436 - RNA, 20 nt, Homo sapiens
cacccaucguucucugcuaa

SEQ ID NO: 1789437 - RNA, 13 nt, Homo sapiens
gaggaauuuuucu

SEQ ID NO: 1789438 - RNA, 23 nt, Homo sapiens
gaaaccagaaggauauuuacuac

SEQ ID NO: 1789439 - RNA, 19 nt, Homo sapiens
gcuuuacaguuacaguuga

SEQ ID NO: 1789440 - RNA, 22 nt, Homo sapiens
aauccaagaaaauggccaguga

SEQ ID NO: 1789441 - RNA, 16 nt, Homo sapiens
cuguucugggggacag

SEQ ID NO: 1789442 - RNA, 15 nt, Homo sapiens
agcaaauaagucauc

SEQ ID NO: 1789443 - RNA, 15 nt, Homo sapiens
gcuccgggaucagca

SEQ ID NO: 1789444 - RNA, 18 nt, Homo sapiens
aaggucuaaucagugauu

SEQ ID NO: 1789445 - RNA, 17 nt, Homo sapiens
gaugcuccugguggcug

SEQ ID NO: 1789446 - RNA, 17 nt, Homo sapiens
acgcacaugccaaugca

SEQ ID NO: 1789447 - RNA, 21 nt, Homo sapiens
ugucugaguaagcccucagga

SEQ ID NO: 1789448 - RNA, 18 nt, Homo sapiens
uagaaaauuagacuguga

SEQ ID NO: 1789449 - RNA, 22 nt, Homo sapiens
gacaagagcagccuggggccaa

SEQ ID NO: 1789450 - RNA, 18 nt, Homo sapiens
gcuccuuggcuuaccuga

SEQ ID NO: 1789451 - RNA, 22 nt, Homo sapiens
ccggggguguaucugagucagc

SEQ ID NO: 1789452 - RNA, 20 nt, Homo sapiens
gccgaaaaggauaugcagua

SEQ ID NO: 1789453 - RNA, 21 nt, Homo sapiens
cagguaacagguguguaugua

SEQ ID NO: 1789454 - RNA, 12 nt, Homo sapiens
cgaacacugaga

SEQ ID NO: 1789455 - RNA, 14 nt, Homo sapiens
cccuugcuggaguc

SEQ ID NO: 1789456 - RNA, 17 nt, Homo sapiens
auagcauuggggacaug

SEQ ID NO: 1789457 - RNA, 17 nt, Homo sapiens
uaccacaagacauuucu

SEQ ID NO: 1789458 - RNA, 21 nt, Homo sapiens
aagcagaaaguucaacuucca

SEQ ID NO: 1789459 - RNA, 18 nt, Homo sapiens
aauuauuauauguaacug

SEQ ID NO: 1789460 - RNA, 20 nt, Homo sapiens
ggagacuccuggucugugaa

SEQ ID NO: 1789461 - RNA, 12 nt, Homo sapiens
uuggcaaugcau

SEQ ID NO: 1789462 - RNA, 15 nt, Homo sapiens
uuuuucuguggucuu

SEQ ID NO: 1789463 - RNA, 18 nt, Homo sapiens
uuggauucacacccagcu

SEQ ID NO: 1789464 - RNA, 15 nt, Homo sapiens
ggcagggucucugcu

SEQ ID NO: 1789465 - RNA, 21 nt, Homo sapiens
cuuuugucuaauuaaaacacu

SEQ ID NO: 1789466 - RNA, 23 nt, Homo sapiens
uuugggaaaauaaauacauucga

SEQ ID NO: 1789467 - RNA, 16 nt, Homo sapiens
uuuuccuuagcuguaa

SEQ ID NO: 1789468 - RNA, 15 nt, Homo sapiens
cauugccauugucau

SEQ ID NO: 1789469 - RNA, 15 nt, Homo sapiens
acagguggugcaaau

SEQ ID NO: 1789470 - RNA, 22 nt, Homo sapiens
cugccaagcgagaaugcaggcc

SEQ ID NO: 1789471 - RNA, 17 nt, Homo sapiens
cuuaauacaaaacugug

SEQ ID NO: 1789472 - RNA, 14 nt, Homo sapiens
guaccccccaaccc

SEQ ID NO: 1789473 - RNA, 16 nt, Homo sapiens
caauauuguacaguuu

SEQ ID NO: 1789474 - RNA, 15 nt, Homo sapiens
aaaauuggcauuaaa

SEQ ID NO: 1789475 - RNA, 17 nt, Homo sapiens
uaacuagacaucugcug

SEQ ID NO: 1789476 - RNA, 15 nt, Homo sapiens
aucuuuagggaauga

SEQ ID NO: 1789477 - RNA, 13 nt, Homo sapiens
ccggccauucucc

SEQ ID NO: 1789478 - RNA, 10 nt, Homo sapiens
ggcuuggaag

SEQ ID NO: 1789479 - RNA, 21 nt, Homo sapiens
guuaaguccuuggcuugccau

SEQ ID NO: 1789480 - RNA, 16 nt, Homo sapiens
ucagaauucggugugc

SEQ ID NO: 1789481 - RNA, 23 nt, Homo sapiens
uugggggcucggggaggcagaga

SEQ ID NO: 1789482 - RNA, 18 nt, Homo sapiens
uuaagccauguguuccaa

SEQ ID NO: 1789483 - RNA, 12 nt, Homo sapiens
ugucagugcucg

SEQ ID NO: 1789484 - RNA, 17 nt, Homo sapiens
uaaauauagcucaggua

SEQ ID NO: 1789485 - RNA, 22 nt, Homo sapiens
auaucaaaaaaccuuuacaguu

SEQ ID NO: 1789486 - RNA, 16 nt, Homo sapiens
uccaggaaaugugcac

SEQ ID NO: 1789487 - RNA, 17 nt, Homo sapiens
aaacuguaucuuccuuu

SEQ ID NO: 1789488 - RNA, 22 nt, Homo sapiens
aaggacagcugaaccccugggg

SEQ ID NO: 1789489 - RNA, 14 nt, Homo sapiens
acucaggacuccag

SEQ ID NO: 1789490 - RNA, 22 nt, Homo sapiens
accauagcgcccaagcucagcu

SEQ ID NO: 1789491 - RNA, 15 nt, Homo sapiens
uguuaauugauuaaa

SEQ ID NO: 1789492 - RNA, 12 nt, Homo sapiens
aauagauaugaa

SEQ ID NO: 1789493 - RNA, 20 nt, Homo sapiens
uauaggaaacauaauuuuga

SEQ ID NO: 1789494 - RNA, 16 nt, Homo sapiens
cucaggcuggcaccgc

SEQ ID NO: 1789495 - RNA, 17 nt, Homo sapiens
gcccaggccugccuguu

SEQ ID NO: 1789496 - RNA, 18 nt, Homo sapiens
acugccccacaugcaugu

SEQ ID NO: 1789497 - RNA, 16 nt, Homo sapiens
cguacacacucaguga

SEQ ID NO: 1789498 - RNA, 16 nt, Homo sapiens
gcauuuucacugcaau

SEQ ID NO: 1789499 - RNA, 22 nt, Homo sapiens
uuaucagacucuguaauugaau

SEQ ID NO: 1789500 - RNA, 19 nt, Homo sapiens
aaugagaguuccuucucac

SEQ ID NO: 1789501 - RNA, 23 nt, Homo sapiens
aaugguauaaaagguugccaaau

SEQ ID NO: 1789502 - RNA, 19 nt, Homo sapiens
uuugugagaaacaucucaa

SEQ ID NO: 1789503 - RNA, 16 nt, Homo sapiens
cccagacuugcacugg

SEQ ID NO: 1789504 - RNA, 13 nt, Homo sapiens
aagguauguguca

SEQ ID NO: 1789505 - RNA, 22 nt, Homo sapiens
uggauacuagaucuuacaucug

SEQ ID NO: 1789506 - RNA, 13 nt, Homo sapiens
ugugaaugaagcu

SEQ ID NO: 1789507 - RNA, 23 nt, Homo sapiens
ccauacuccucuccuucaaagaa

SEQ ID NO: 1789508 - RNA, 17 nt, Homo sapiens
aaauccugaacuuucuc

SEQ ID NO: 1789509 - RNA, 16 nt, Homo sapiens
aggaaagucacccaaa

SEQ ID NO: 1789510 - RNA, 15 nt, Homo sapiens
gaauauaaauguacu

SEQ ID NO: 1789511 - RNA, 14 nt, Homo sapiens
uaaaaauagaaaca

SEQ ID NO: 1789512 - RNA, 13 nt, Homo sapiens
aaaacugggacag

SEQ ID NO: 1789513 - RNA, 18 nt, Homo sapiens
guuuagcccugaacauuu

SEQ ID NO: 1789514 - RNA, 14 nt, Homo sapiens
augucaguccuuga

SEQ ID NO: 1789515 - RNA, 22 nt, Homo sapiens
guaccagcagcuggaaucugaa

SEQ ID NO: 1789516 - RNA, 14 nt, Homo sapiens
uuaaaugcuuuuau

SEQ ID NO: 1789517 - RNA, 14 nt, Homo sapiens
ugaacagcuguuca

SEQ ID NO: 1789518 - RNA, 19 nt, Homo sapiens
cagaagcaugaucacagcu

SEQ ID NO: 1789519 - RNA, 17 nt, Homo sapiens
caaaaauggcagugacu

SEQ ID NO: 1789520 - RNA, 21 nt, Homo sapiens
gcaaguucccaguuggagcuc

SEQ ID NO: 1789521 - RNA, 22 nt, Homo sapiens
ugaugccuuuauaaaucuuucu

SEQ ID NO: 1789522 - RNA, 23 nt, Homo sapiens
ucuuccuguugugacugccagga

SEQ ID NO: 1789523 - RNA, 21 nt, Homo sapiens
aaauaucccuccauacagugu

SEQ ID NO: 1789524 - RNA, 22 nt, Homo sapiens
auaaagcagucaugauuuacuu

SEQ ID NO: 1789525 - RNA, 14 nt, Homo sapiens
cacucacuacaggg

SEQ ID NO: 1789526 - RNA, 10 nt, Homo sapiens
aaaaccaaau

SEQ ID NO: 1789527 - RNA, 13 nt, Homo sapiens
gccccacaugucc

SEQ ID NO: 1789528 - RNA, 16 nt, Homo sapiens
cucggucacaucaggc

SEQ ID NO: 1789529 - RNA, 17 nt, Homo sapiens
guuucaaguuauucaaa

SEQ ID NO: 1789530 - RNA, 19 nt, Homo sapiens
auaaagacaccugguugcu

SEQ ID NO: 1789531 - RNA, 20 nt, Homo sapiens
uccaacccugccgucaccac

SEQ ID NO: 1789532 - RNA, 19 nt, Homo sapiens
caccuaugacauacaugga

SEQ ID NO: 1789533 - RNA, 20 nt, Homo sapiens
aaucacaacacagagcugcu

SEQ ID NO: 1789534 - RNA, 20 nt, Homo sapiens
ugagugguggaggaggacac

SEQ ID NO: 1789535 - RNA, 9 nt, Homo sapiens
ccaaaaagg

SEQ ID NO: 1789536 - RNA, 23 nt, Homo sapiens
cuauaguuauuaaguucuuuaaa

SEQ ID NO: 1789537 - RNA, 14 nt, Homo sapiens
auaaagcauguuca

SEQ ID NO: 1789538 - RNA, 13 nt, Homo sapiens
ucuaagccuuuga

SEQ ID NO: 1789539 - RNA, 13 nt, Homo sapiens
ucucucaugacca

SEQ ID NO: 1789540 - RNA, 12 nt, Homo sapiens
aucugagcaaaa

SEQ ID NO: 1789541 - RNA, 18 nt, Homo sapiens
ggggcuggccccaccccc

SEQ ID NO: 1789542 - RNA, 16 nt, Homo sapiens
uuucagaagcauucag

SEQ ID NO: 1789543 - RNA, 13 nt, Homo sapiens
uucagaccuggaa

SEQ ID NO: 1789544 - RNA, 15 nt, Homo sapiens
cauuuagucauguga

SEQ ID NO: 1789545 - RNA, 22 nt, Homo sapiens
aaagucaaacgacuaaccuauc

SEQ ID NO: 1789546 - RNA, 19 nt, Homo sapiens
aagacgcucaagaauccuc

SEQ ID NO: 1789547 - RNA, 20 nt, Homo sapiens
ucuguauugucuauuauuua

SEQ ID NO: 1789548 - RNA, 21 nt, Homo sapiens
auuccugucccuuuguuacca

SEQ ID NO: 1789549 - RNA, 14 nt, Homo sapiens
aaauagucuucuca

SEQ ID NO: 1789550 - RNA, 15 nt, Homo sapiens
uuacaagaucuugca

SEQ ID NO: 1789551 - RNA, 22 nt, Homo sapiens
uccagucuuccugacacuuuaa

SEQ ID NO: 1789552 - RNA, 19 nt, Homo sapiens
cuucgaggcuuuacagugu

SEQ ID NO: 1789553 - RNA, 20 nt, Homo sapiens
aaaugcccaaggaugccuua

SEQ ID NO: 1789554 - RNA, 16 nt, Homo sapiens
uguuacagcuucgcug

SEQ ID NO: 1789555 - RNA, 23 nt, Homo sapiens
cuguccuuuuccccuacagaauu

SEQ ID NO: 1789556 - RNA, 13 nt, Homo sapiens
caacuguuucuac

SEQ ID NO: 1789557 - RNA, 12 nt, Homo sapiens
uuauaaauccaa

SEQ ID NO: 1789558 - RNA, 19 nt, Homo sapiens
aaauauuuacauaugaaau

SEQ ID NO: 1789559 - RNA, 13 nt, Homo sapiens
guuaaacagugcc

SEQ ID NO: 1789560 - RNA, 20 nt, Homo sapiens
caauaaugacaaaugcccug

SEQ ID NO: 1789561 - RNA, 21 nt, Homo sapiens
ccaaguagcugggaccacaag

SEQ ID NO: 1789562 - RNA, 15 nt, Homo sapiens
aggucuuaguaccag

SEQ ID NO: 1789563 - RNA, 14 nt, Homo sapiens
cacgcacuggguug

SEQ ID NO: 1789564 - RNA, 16 nt, Homo sapiens
uggaaguaaagccuca

SEQ ID NO: 1789565 - RNA, 19 nt, Homo sapiens
ucugaucauguaugcaucc

SEQ ID NO: 1789566 - RNA, 14 nt, Homo sapiens
cugucuguccuucu

SEQ ID NO: 1789567 - RNA, 14 nt, Homo sapiens
ccugcagucuggca

SEQ ID NO: 1789568 - RNA, 16 nt, Homo sapiens
cucauucugcauuaau

SEQ ID NO: 1789569 - RNA, 11 nt, Homo sapiens
uuauacuguau

SEQ ID NO: 1789570 - RNA, 16 nt, Homo sapiens
aaaaacuguugcuauu

SEQ ID NO: 1789571 - RNA, 20 nt, Homo sapiens
gaguugaagacagcuuccca

SEQ ID NO: 1789572 - RNA, 22 nt, Homo sapiens
uugcagauaccauuucuguuga

SEQ ID NO: 1789573 - RNA, 16 nt, Homo sapiens
uagagugggacaguuc

SEQ ID NO: 1789574 - RNA, 15 nt, Homo sapiens
acaacgucucuucaa

SEQ ID NO: 1789575 - RNA, 22 nt, Homo sapiens
guaaacaguuugaaaagacaaa

SEQ ID NO: 1789576 - RNA, 18 nt, Homo sapiens
aacuaaugucucuacaau

SEQ ID NO: 1789577 - RNA, 20 nt, Homo sapiens
cgggcucccuccucuggcag

SEQ ID NO: 1789578 - RNA, 22 nt, Homo sapiens
ucccucaaaugcgcgugugcac

SEQ ID NO: 1789579 - RNA, 17 nt, Homo sapiens
aggcgaugugcaagugu

SEQ ID NO: 1789580 - RNA, 18 nt, Homo sapiens
ucuguucugggccagguc

SEQ ID NO: 1789581 - RNA, 20 nt, Homo sapiens
ugugccagaaacagugggag

SEQ ID NO: 1789582 - RNA, 20 nt, Homo sapiens
acaugcggugccaugaaggg

SEQ ID NO: 1789583 - RNA, 14 nt, Homo sapiens
gguucugagcaaau

SEQ ID NO: 1789584 - RNA, 18 nt, Homo sapiens
ugcuccccagugcuaccu

SEQ ID NO: 1789585 - RNA, 18 nt, Homo sapiens
acaggcacaaaaugugac

SEQ ID NO: 1789586 - RNA, 15 nt, Homo sapiens
caaagggauuacuag

SEQ ID NO: 1789587 - RNA, 15 nt, Homo sapiens
uuauuuaacuauuca

SEQ ID NO: 1789588 - RNA, 15 nt, Homo sapiens
aaugugcugaagcaa

SEQ ID NO: 1789589 - RNA, 15 nt, Homo sapiens
gauuuaugacauuac

SEQ ID NO: 1789590 - RNA, 15 nt, Homo sapiens
caggaccuacuagga

SEQ ID NO: 1789591 - RNA, 14 nt, Homo sapiens
aaauuguacuguug

SEQ ID NO: 1789592 - RNA, 16 nt, Homo sapiens
ugcagaaguacuccua

SEQ ID NO: 1789593 - RNA, 22 nt, Homo sapiens
gcauccuuuucaaaaccuaaaa

SEQ ID NO: 1789594 - RNA, 13 nt, Homo sapiens
augcuaguucauu

SEQ ID NO: 1789595 - RNA, 17 nt, Homo sapiens
cagggcuggcucugcac

SEQ ID NO: 1789596 - RNA, 13 nt, Homo sapiens
cucuugcagagaa

SEQ ID NO: 1789597 - RNA, 22 nt, Homo sapiens
uaaacacaauccuuuguucucc

SEQ ID NO: 1789598 - RNA, 22 nt, Homo sapiens
cucugggaauuuggagugacca

SEQ ID NO: 1789599 - RNA, 14 nt, Homo sapiens
auagcuuugcacuu

SEQ ID NO: 1789600 - RNA, 13 nt, Homo sapiens
gcccauggcauuu

SEQ ID NO: 1789601 - RNA, 13 nt, Homo sapiens
gccuauggcaucu

SEQ ID NO: 1789602 - RNA, 20 nt, Homo sapiens
gcacaauggcucacaccugu

SEQ ID NO: 1789603 - RNA, 13 nt, Homo sapiens
uaucuuguggcau

SEQ ID NO: 1789604 - RNA, 21 nt, Homo sapiens
uagaaaacuugacauguagcu

SEQ ID NO: 1789605 - RNA, 23 nt, Homo sapiens
aauugggguuguauuuggccauu

SEQ ID NO: 1789606 - RNA, 21 nt, Homo sapiens
accaaugcaacauuugugcag

SEQ ID NO: 1789607 - RNA, 21 nt, Homo sapiens
caucucuugaaaccuguuaaa

SEQ ID NO: 1789608 - RNA, 20 nt, Homo sapiens
ugugagcuuucugauacuua

SEQ ID NO: 1789609 - RNA, 15 nt, Homo sapiens
agacauuuguuucau

SEQ ID NO: 1789610 - RNA, 14 nt, Homo sapiens
acauuaaaagcuau

SEQ ID NO: 1789611 - RNA, 14 nt, Homo sapiens
gcccuuaaggacaa

SEQ ID NO: 1789612 - RNA, 23 nt, Homo sapiens
uaaauaccugcccugacaugcac

SEQ ID NO: 1789613 - RNA, 21 nt, Homo sapiens
guagucagacugacacuacua

SEQ ID NO: 1789614 - RNA, 24 nt, Homo sapiens
cuccaaaaacaguaaaaauaacca

SEQ ID NO: 1789615 - RNA, 21 nt, Homo sapiens
ccccuucuuuuuugucucaag

SEQ ID NO: 1789616 - RNA, 18 nt, Homo sapiens
uguguauauguagcaaaa

SEQ ID NO: 1789617 - RNA, 17 nt, Homo sapiens
acuucaugccagcuaua

SEQ ID NO: 1789618 - RNA, 15 nt, Homo sapiens
auuggaaaggcagcu

SEQ ID NO: 1789619 - RNA, 16 nt, Homo sapiens
auaucgggucacuguc

SEQ ID NO: 1789620 - RNA, 12 nt, Homo sapiens
gccccaucacug

SEQ ID NO: 1789621 - RNA, 22 nt, Homo sapiens
caggcaucuguaagaaguagag

SEQ ID NO: 1789622 - RNA, 21 nt, Homo sapiens
ugaagaagguugucagcugca

SEQ ID NO: 1789623 - RNA, 12 nt, Homo sapiens
gaccacccggca

SEQ ID NO: 1789624 - RNA, 17 nt, Homo sapiens
uuucuguggcuaaacag

SEQ ID NO: 1789625 - RNA, 20 nt, Homo sapiens
cucaaggccucccacaguga

SEQ ID NO: 1789626 - RNA, 15 nt, Homo sapiens
cucaauauauaguua

SEQ ID NO: 1789627 - RNA, 15 nt, Homo sapiens
ucauuaauacuguag

SEQ ID NO: 1789628 - RNA, 20 nt, Homo sapiens
cuauauucucaguguagggc

SEQ ID NO: 1789629 - RNA, 18 nt, Homo sapiens
auccuagaucaccacugg

SEQ ID NO: 1789630 - RNA, 16 nt, Homo sapiens
uaaguguucaguguug

SEQ ID NO: 1789631 - RNA, 21 nt, Homo sapiens
ucuuuguuaugacagugaaua

SEQ ID NO: 1789632 - RNA, 22 nt, Homo sapiens
accacuuucucaggcuucucau

SEQ ID NO: 1789633 - RNA, 18 nt, Homo sapiens
aucuguuuucuaccuccu

SEQ ID NO: 1789634 - RNA, 21 nt, Homo sapiens
auugaauugggggagucaugg

SEQ ID NO: 1789635 - RNA, 23 nt, Homo sapiens
agaaccugguggcuggaggcauu

SEQ ID NO: 1789636 - RNA, 18 nt, Homo sapiens
agggggcugcccucucca

SEQ ID NO: 1789637 - RNA, 21 nt, Homo sapiens
uuaucagugugcaauacugug

SEQ ID NO: 1789638 - RNA, 14 nt, Homo sapiens
acuccacagaguga

SEQ ID NO: 1789639 - RNA, 17 nt, Homo sapiens
ucugucuccaagaccuu

SEQ ID NO: 1789640 - RNA, 23 nt, Homo sapiens
cacauucuguuuaucaagccaua

SEQ ID NO: 1789641 - RNA, 14 nt, Homo sapiens
guuucugcuucauu

SEQ ID NO: 1789642 - RNA, 17 nt, Homo sapiens
ggaagggagccaaggga

SEQ ID NO: 1789643 - RNA, 22 nt, Homo sapiens
cugggcugcuacccagaaauca

SEQ ID NO: 1789644 - RNA, 18 nt, Homo sapiens
guacaaaugugugacugc

SEQ ID NO: 1789645 - RNA, 17 nt, Homo sapiens
uucaggcuacucauuca

SEQ ID NO: 1789646 - RNA, 21 nt, Homo sapiens
cagccgucccgcguucaagac

SEQ ID NO: 1789647 - RNA, 22 nt, Homo sapiens
cuuuuaaggcuaaaacuuaaca

SEQ ID NO: 1789648 - RNA, 12 nt, Homo sapiens
uugaacccuuuu

SEQ ID NO: 1789649 - RNA, 15 nt, Homo sapiens
cccaacacuuugaga

SEQ ID NO: 1789650 - RNA, 17 nt, Homo sapiens
acuuauuaccucaggug

SEQ ID NO: 1789651 - RNA, 19 nt, Homo sapiens
auagugucaccaauuccac

SEQ ID NO: 1789652 - RNA, 12 nt, Homo sapiens
agcuccuggaau

SEQ ID NO: 1789653 - RNA, 15 nt, Homo sapiens
uggaccuugagcauc

SEQ ID NO: 1789654 - RNA, 20 nt, Homo sapiens
cacuucuuugcagagccuuu

SEQ ID NO: 1789655 - RNA, 18 nt, Homo sapiens
caguggauuuuuuuuuaa

SEQ ID NO: 1789656 - RNA, 22 nt, Homo sapiens
guccugaguguucaugcuuugu

SEQ ID NO: 1789657 - RNA, 17 nt, Homo sapiens
auucauaauaaacuaga

SEQ ID NO: 1789658 - RNA, 17 nt, Homo sapiens
agguggacuuccagcuu

SEQ ID NO: 1789659 - RNA, 18 nt, Homo sapiens
uccuuuucuacaugaugc

SEQ ID NO: 1789660 - RNA, 23 nt, Homo sapiens
aagcaucuuucuguuacugaugu

SEQ ID NO: 1789661 - RNA, 22 nt, Homo sapiens
uagcguucccaacaacauccau

SEQ ID NO: 1789662 - RNA, 18 nt, Homo sapiens
gcagaggugagcagagga

SEQ ID NO: 1789663 - RNA, 22 nt, Homo sapiens
ucagaaggaauaagcauuccuu

SEQ ID NO: 1789664 - RNA, 21 nt, Homo sapiens
cccggcugacccugugcccca

SEQ ID NO: 1789665 - RNA, 13 nt, Homo sapiens
uuauuaaaucagu

SEQ ID NO: 1789666 - RNA, 19 nt, Homo sapiens
caauacaauguacaauuau

SEQ ID NO: 1789667 - RNA, 22 nt, Homo sapiens
caaggggaagccuccugucucc

SEQ ID NO: 1789668 - RNA, 15 nt, Homo sapiens
ucucaauaaaacaga

SEQ ID NO: 1789669 - RNA, 17 nt, Homo sapiens
gaggcagggguccugca

SEQ ID NO: 1789670 - RNA, 17 nt, Homo sapiens
agugagcccucuugccc

SEQ ID NO: 1789671 - RNA, 18 nt, Homo sapiens
ucugcaacagggggcaaa

SEQ ID NO: 1789672 - RNA, 16 nt, Homo sapiens
gugucaagacauuucu

SEQ ID NO: 1789673 - RNA, 22 nt, Homo sapiens
acaacguaaacuuccuaaugau

SEQ ID NO: 1789674 - RNA, 15 nt, Homo sapiens
uugacuagugcaauu

SEQ ID NO: 1789675 - RNA, 13 nt, Homo sapiens
cugcacagugaag

SEQ ID NO: 1789676 - RNA, 13 nt, Homo sapiens
uccugucugccag

SEQ ID NO: 1789677 - RNA, 13 nt, Homo sapiens
gccuuucuuccau

SEQ ID NO: 1789678 - RNA, 15 nt, Homo sapiens
agacucauucuucac

SEQ ID NO: 1789679 - RNA, 11 nt, Homo sapiens
uaaaugaacuu

SEQ ID NO: 1789680 - RNA, 11 nt, Homo sapiens
caaaugaauuu

SEQ ID NO: 1789681 - RNA, 15 nt, Homo sapiens
ucacuuuuauugaua

SEQ ID NO: 1789682 - RNA, 16 nt, Homo sapiens
ucucccccuaguuugu

SEQ ID NO: 1789683 - RNA, 15 nt, Homo sapiens
accccaaagcuuucc

SEQ ID NO: 1789684 - RNA, 21 nt, Homo sapiens
acaggaauccuuacugauauu

SEQ ID NO: 1789685 - RNA, 14 nt, Homo sapiens
gaacuaacugacag

SEQ ID NO: 1789686 - RNA, 13 nt, Homo sapiens
acuucagccuuua

SEQ ID NO: 1789687 - RNA, 17 nt, Homo sapiens
auuuggcucacuugccu

SEQ ID NO: 1789688 - RNA, 15 nt, Homo sapiens
ugcgcacacacagau

SEQ ID NO: 1789689 - RNA, 21 nt, Homo sapiens
gucuuuagacucaaaugcuua

SEQ ID NO: 1789690 - RNA, 18 nt, Homo sapiens
agaucauauacgugaaaa

SEQ ID NO: 1789691 - RNA, 15 nt, Homo sapiens
ccaguucuacagagu

SEQ ID NO: 1789692 - RNA, 17 nt, Homo sapiens
aucugugccuucucuau

SEQ ID NO: 1789693 - RNA, 15 nt, Homo sapiens
acccaggacagccac

SEQ ID NO: 1789694 - RNA, 16 nt, Homo sapiens
uccacauauagagcuc

SEQ ID NO: 1789695 - RNA, 21 nt, Homo sapiens
auagagguucuuuauugcuca

SEQ ID NO: 1789696 - RNA, 21 nt, Homo sapiens
auccuccccaggaccccuguc

SEQ ID NO: 1789697 - RNA, 16 nt, Homo sapiens
ugccuggcagccauuu

SEQ ID NO: 1789698 - RNA, 24 nt, Homo sapiens
cuugucacgaauuccaucuuguaa

SEQ ID NO: 1789699 - RNA, 23 nt, Homo sapiens
agcccugggggauuccugagcug

SEQ ID NO: 1789700 - RNA, 23 nt, Homo sapiens
uacagguguauauaccucuauau

SEQ ID NO: 1789701 - RNA, 17 nt, Homo sapiens
ucucagcuccaauuuca

SEQ ID NO: 1789702 - RNA, 23 nt, Homo sapiens
uucauugccuucucccucaugca

SEQ ID NO: 1789703 - RNA, 13 nt, Homo sapiens
auaagacauaacg

SEQ ID NO: 1789704 - RNA, 22 nt, Homo sapiens
ggcuuuuccucccucagccccu

SEQ ID NO: 1789705 - RNA, 13 nt, Homo sapiens
ccagacacagugc

SEQ ID NO: 1789706 - RNA, 14 nt, Homo sapiens
auuuguacauauua

SEQ ID NO: 1789707 - RNA, 15 nt, Homo sapiens
cgagaugaguuucug

SEQ ID NO: 1789708 - RNA, 18 nt, Homo sapiens
cacuggguacccaaguga

SEQ ID NO: 1789709 - RNA, 16 nt, Homo sapiens
uuccucaguccuggaa

SEQ ID NO: 1789710 - RNA, 19 nt, Homo sapiens
cccagccuggaugccaucc

SEQ ID NO: 1789711 - RNA, 15 nt, Homo sapiens
aguuuaaagacacuu

SEQ ID NO: 1789712 - RNA, 15 nt, Homo sapiens
aauucaaaggcauuu

SEQ ID NO: 1789713 - RNA, 15 nt, Homo sapiens
uuauauguacauaca

SEQ ID NO: 1789714 - RNA, 21 nt, Homo sapiens
uuaacaaaaaacggggagaaa

SEQ ID NO: 1789715 - RNA, 14 nt, Homo sapiens
auauuaaacaucca

SEQ ID NO: 1789716 - RNA, 16 nt, Homo sapiens
aagugggcauugccau

SEQ ID NO: 1789717 - RNA, 19 nt, Homo sapiens
ucccuucgauauaugacuu

SEQ ID NO: 1789718 - RNA, 19 nt, Homo sapiens
uuuaacauaaauuguacug

SEQ ID NO: 1789719 - RNA, 16 nt, Homo sapiens
ccucuacaauuugcca

SEQ ID NO: 1789720 - RNA, 17 nt, Homo sapiens
uaauuucgcacaaugca

SEQ ID NO: 1789721 - RNA, 17 nt, Homo sapiens
cggaagugaccacagaa

SEQ ID NO: 1789722 - RNA, 20 nt, Homo sapiens
guuuauccaaaucuugaauu

SEQ ID NO: 1789723 - RNA, 12 nt, Homo sapiens
gagccuuuucaa

SEQ ID NO: 1789724 - RNA, 23 nt, Homo sapiens
cagagguaaaagugugagcagug

SEQ ID NO: 1789725 - RNA, 15 nt, Homo sapiens
auuuuaauucuguga

SEQ ID NO: 1789726 - RNA, 12 nt, Homo sapiens
uggucacagggu

SEQ ID NO: 1789727 - RNA, 19 nt, Homo sapiens
gccuaaauuuaaugcugcc

SEQ ID NO: 1789728 - RNA, 18 nt, Homo sapiens
augcccugcagagcaaua

SEQ ID NO: 1789729 - RNA, 14 nt, Homo sapiens
aaugcuugcugcug

SEQ ID NO: 1789730 - RNA, 20 nt, Homo sapiens
acauuuugugugagacuuaa

SEQ ID NO: 1789731 - RNA, 20 nt, Homo sapiens
acagugccaccaagcucaca

SEQ ID NO: 1789732 - RNA, 16 nt, Homo sapiens
ucacugccauauacuc

SEQ ID NO: 1789733 - RNA, 15 nt, Homo sapiens
acacagagcaauggu

SEQ ID NO: 1789734 - RNA, 15 nt, Homo sapiens
aaacaaugccaugaa

SEQ ID NO: 1789735 - RNA, 22 nt, Homo sapiens
aacugugaaguuuacauuguaa

SEQ ID NO: 1789736 - RNA, 20 nt, Homo sapiens
aauuaaagaaaauugccaaa

SEQ ID NO: 1789737 - RNA, 20 nt, Homo sapiens
auagcaacagagcacuugag

SEQ ID NO: 1789738 - RNA, 14 nt, Homo sapiens
cagggcugauacau

SEQ ID NO: 1789739 - RNA, 17 nt, Homo sapiens
ccccagcaagagcacaa

SEQ ID NO: 1789740 - RNA, 20 nt, Homo sapiens
cauauguccauccauauaua

SEQ ID NO: 1789741 - RNA, 17 nt, Homo sapiens
uauauuuuaaagcacuu

SEQ ID NO: 1789742 - RNA, 13 nt, Homo sapiens
uaugaucagaaga

SEQ ID NO: 1789743 - RNA, 13 nt, Homo sapiens
gcaaaucaucuaa

SEQ ID NO: 1789744 - RNA, 17 nt, Homo sapiens
ugugaaggucuugccug

SEQ ID NO: 1789745 - RNA, 19 nt, Homo sapiens
ggauuuuuuugaugugccu

SEQ ID NO: 1789746 - RNA, 16 nt, Homo sapiens
agucauggacaugaag

SEQ ID NO: 1789747 - RNA, 14 nt, Homo sapiens
ucagaugaagucuu

SEQ ID NO: 1789748 - RNA, 15 nt, Homo sapiens
gcauucuagugcaga

SEQ ID NO: 1789749 - RNA, 14 nt, Homo sapiens
auuacugauuuugu

SEQ ID NO: 1789750 - RNA, 17 nt, Homo sapiens
caggugccucaagagaa

SEQ ID NO: 1789751 - RNA, 13 nt, Homo sapiens
augugcuuuucuc

SEQ ID NO: 1789752 - RNA, 11 nt, Homo sapiens
gagaagcugag

SEQ ID NO: 1789753 - RNA, 14 nt, Homo sapiens
uuucacccacagaa

SEQ ID NO: 1789754 - RNA, 14 nt, Homo sapiens
ucagaaccauucac

SEQ ID NO: 1789755 - RNA, 14 nt, Homo sapiens
cgccagauggggcc

SEQ ID NO: 1789756 - RNA, 18 nt, Homo sapiens
ugcaaccucugcuuccca

SEQ ID NO: 1789757 - RNA, 14 nt, Homo sapiens
uugaaugcugccag

SEQ ID NO: 1789758 - RNA, 18 nt, Homo sapiens
gcccugagaaagcccugu

SEQ ID NO: 1789759 - RNA, 15 nt, Homo sapiens
uaacccucucuuccc

SEQ ID NO: 1789760 - RNA, 14 nt, Homo sapiens
gcuauaacuaagca

SEQ ID NO: 1789761 - RNA, 22 nt, Homo sapiens
uaucucaggggccaacuaggca

SEQ ID NO: 1789762 - RNA, 17 nt, Homo sapiens
gcacaucugcugugguc

SEQ ID NO: 1789763 - RNA, 16 nt, Homo sapiens
ugcuugguagcacuuu

SEQ ID NO: 1789764 - RNA, 15 nt, Homo sapiens
uaaaaugcuguucuc

SEQ ID NO: 1789765 - RNA, 18 nt, Homo sapiens
aggggaaagacuuccauc

SEQ ID NO: 1789766 - RNA, 23 nt, Homo sapiens
ggaauaauuagcuuguuacaauu

SEQ ID NO: 1789767 - RNA, 20 nt, Homo sapiens
gacagagucuggcucuguca

SEQ ID NO: 1789768 - RNA, 12 nt, Homo sapiens
cccacggcaccu

SEQ ID NO: 1789769 - RNA, 22 nt, Homo sapiens
ccaaagagauauugauauugaa

SEQ ID NO: 1789770 - RNA, 15 nt, Homo sapiens
uccaacaugugcuca

SEQ ID NO: 1789771 - RNA, 15 nt, Homo sapiens
uagaaaagugaauug

SEQ ID NO: 1789772 - RNA, 15 nt, Homo sapiens
uagcuaggugacaua

SEQ ID NO: 1789773 - RNA, 20 nt, Homo sapiens
uuuuacccagacucaaggag

SEQ ID NO: 1789774 - RNA, 16 nt, Homo sapiens
cauguaaacugugcac

SEQ ID NO: 1789775 - RNA, 14 nt, Homo sapiens
auuauagucuguac

SEQ ID NO: 1789776 - RNA, 22 nt, Homo sapiens
gaaaacucagaaugaaaauuca

SEQ ID NO: 1789777 - RNA, 13 nt, Homo sapiens
auauggucaucca

SEQ ID NO: 1789778 - RNA, 18 nt, Homo sapiens
cccucccagcugcacuuu

SEQ ID NO: 1789779 - RNA, 12 nt, Homo sapiens
ggcauuagcacu

SEQ ID NO: 1789780 - RNA, 15 nt, Homo sapiens
cuuacuuuuaaaaua

SEQ ID NO: 1789781 - RNA, 23 nt, Homo sapiens
uuggcaacagaagugguuuccca

SEQ ID NO: 1789782 - RNA, 18 nt, Homo sapiens
auuucuauuuccuggaau

SEQ ID NO: 1789783 - RNA, 16 nt, Homo sapiens
uaauuugugaauuugc

SEQ ID NO: 1789784 - RNA, 17 nt, Homo sapiens
cacuuccuuaccuagug

SEQ ID NO: 1789785 - RNA, 11 nt, Homo sapiens
cagugugaguu

SEQ ID NO: 1789786 - RNA, 21 nt, Homo sapiens
uggaaaccuuccacccagugc

SEQ ID NO: 1789787 - RNA, 21 nt, Homo sapiens
uuuacgcggagcacuuucgag

SEQ ID NO: 1789788 - RNA, 15 nt, Homo sapiens
acccugcaaagggaa

SEQ ID NO: 1789789 - RNA, 13 nt, Homo sapiens
aacaucugagaca

SEQ ID NO: 1789790 - RNA, 11 nt, Homo sapiens
agugugcuugg

SEQ ID NO: 1789791 - RNA, 16 nt, Homo sapiens
ccacuguaugauucuc

SEQ ID NO: 1789792 - RNA, 15 nt, Homo sapiens
agugaaaccaugacu

SEQ ID NO: 1789793 - RNA, 13 nt, Homo sapiens
ucuccaaacaguc

SEQ ID NO: 1789794 - RNA, 17 nt, Homo sapiens
ucauuuuuaagacugua

SEQ ID NO: 1789795 - RNA, 20 nt, Homo sapiens
ucccugauaacaaccuggag

SEQ ID NO: 1789796 - RNA, 18 nt, Homo sapiens
ggucacauagcugggauu

SEQ ID NO: 1789797 - RNA, 21 nt, Homo sapiens
uccagccugcccucagcacag

SEQ ID NO: 1789798 - RNA, 12 nt, Homo sapiens
aucaagugcagu

SEQ ID NO: 1789799 - RNA, 23 nt, Homo sapiens
uauaccugccuuuuaaguuugaa

SEQ ID NO: 1789800 - RNA, 20 nt, Homo sapiens
uaaaacaauugugacagcag

SEQ ID NO: 1789801 - RNA, 12 nt, Homo sapiens
gcuuguguuucu

SEQ ID NO: 1789802 - RNA, 16 nt, Homo sapiens
uggugaauauaaauga

SEQ ID NO: 1789803 - RNA, 17 nt, Homo sapiens
cagauaacuucuuuagg

SEQ ID NO: 1789804 - RNA, 23 nt, Homo sapiens
gcagcguugcuuggugcacagau

SEQ ID NO: 1789805 - RNA, 15 nt, Homo sapiens
ucacacacaccucau

SEQ ID NO: 1789806 - RNA, 21 nt, Homo sapiens
cagacugccugucugcuugca

SEQ ID NO: 1789807 - RNA, 18 nt, Homo sapiens
ccuuuggccccacuuuga

SEQ ID NO: 1789808 - RNA, 11 nt, Homo sapiens
ugccaagagcc

SEQ ID NO: 1789809 - RNA, 16 nt, Homo sapiens
ucucuggagggacaaa

SEQ ID NO: 1789810 - RNA, 19 nt, Homo sapiens
uggguacccaaaacacauu

SEQ ID NO: 1789811 - RNA, 16 nt, Homo sapiens
gcagaaucucagagaa

SEQ ID NO: 1789812 - RNA, 16 nt, Homo sapiens
uggguauuuaauaaga

SEQ ID NO: 1789813 - RNA, 23 nt, Homo sapiens
cucacuggggccuacagcuuuga

SEQ ID NO: 1789814 - RNA, 23 nt, Homo sapiens
ccaauacugccaaccagagcagc

SEQ ID NO: 1789815 - RNA, 18 nt, Homo sapiens
uuagaguugugauacaga

SEQ ID NO: 1789816 - RNA, 18 nt, Homo sapiens
uuaccaucuuacuugagc

SEQ ID NO: 1789817 - RNA, 16 nt, Homo sapiens
uccucuccugcccagc

SEQ ID NO: 1789818 - RNA, 14 nt, Homo sapiens
cauugacagcaauu

SEQ ID NO: 1789819 - RNA, 22 nt, Homo sapiens
aaacgauucugagccauucaca

SEQ ID NO: 1789820 - RNA, 15 nt, Homo sapiens
uucucgcucccgcca

SEQ ID NO: 1789821 - RNA, 14 nt, Homo sapiens
cagacuggagacaa

SEQ ID NO: 1789822 - RNA, 17 nt, Homo sapiens
uccuuaaaaaauaugcu

SEQ ID NO: 1789823 - RNA, 13 nt, Homo sapiens
agugcauccaaag

SEQ ID NO: 1789824 - RNA, 19 nt, Homo sapiens
ugcacuccagucuggcaac

SEQ ID NO: 1789825 - RNA, 19 nt, Homo sapiens
ugcacuccagccuggcaau

SEQ ID NO: 1789826 - RNA, 22 nt, Homo sapiens
uacucucugaguacauugugcc

SEQ ID NO: 1789827 - RNA, 12 nt, Homo sapiens
guauuauucaaa

SEQ ID NO: 1789828 - RNA, 22 nt, Homo sapiens
ucuacauaaauuuuauaugcac

SEQ ID NO: 1789829 - RNA, 21 nt, Homo sapiens
auguuguuccuuuugaaagaa

SEQ ID NO: 1789830 - RNA, 19 nt, Homo sapiens
aagcugaacuuacugcuua

SEQ ID NO: 1789831 - RNA, 14 nt, Homo sapiens
ucgacagacagcca

SEQ ID NO: 1789832 - RNA, 17 nt, Homo sapiens
cucugaggcaaggccca

SEQ ID NO: 1789833 - RNA, 18 nt, Homo sapiens
cccugacauuaucuugga

SEQ ID NO: 1789834 - RNA, 11 nt, Homo sapiens
ggcauugcuga

SEQ ID NO: 1789835 - RNA, 22 nt, Homo sapiens
gccccuucuggggguggugggc

SEQ ID NO: 1789836 - RNA, 16 nt, Homo sapiens
uaaugaagacauagcc

SEQ ID NO: 1789837 - RNA, 17 nt, Homo sapiens
uaugagucaaugugcag

SEQ ID NO: 1789838 - RNA, 15 nt, Homo sapiens
ugguuucugcccuuu

SEQ ID NO: 1789839 - RNA, 17 nt, Homo sapiens
aauacauaaaaaaggga

SEQ ID NO: 1789840 - RNA, 21 nt, Homo sapiens
gaugcccccacccaccuguac

SEQ ID NO: 1789841 - RNA, 22 nt, Homo sapiens
caucauaacucacuaacaggga

SEQ ID NO: 1789842 - RNA, 14 nt, Homo sapiens
augugaggcacugu

SEQ ID NO: 1789843 - RNA, 19 nt, Homo sapiens
aacucagggacagagccau

SEQ ID NO: 1789844 - RNA, 14 nt, Homo sapiens
gauccggucugccu

SEQ ID NO: 1789845 - RNA, 14 nt, Homo sapiens
cacggcagcucucc

SEQ ID NO: 1789846 - RNA, 14 nt, Homo sapiens
gcaauguguguaua

SEQ ID NO: 1789847 - RNA, 16 nt, Homo sapiens
cucauccuccacugaa

SEQ ID NO: 1789848 - RNA, 18 nt, Homo sapiens
uaaagaucaccacuuccc

SEQ ID NO: 1789849 - RNA, 20 nt, Homo sapiens
uuguaacgaagacacagacu

SEQ ID NO: 1789850 - RNA, 13 nt, Homo sapiens
ucuacacauauau

SEQ ID NO: 1789851 - RNA, 16 nt, Homo sapiens
ugacuggggagucuga

SEQ ID NO: 1789852 - RNA, 17 nt, Homo sapiens
cuccaccuccuccagac

SEQ ID NO: 1789853 - RNA, 15 nt, Homo sapiens
guaaccucagucuac

SEQ ID NO: 1789854 - RNA, 19 nt, Homo sapiens
aaaaguaacacaguggacu

SEQ ID NO: 1789855 - RNA, 15 nt, Homo sapiens
uaacacuuaccccau

SEQ ID NO: 1789856 - RNA, 15 nt, Homo sapiens
aguaaaagugcuuuc

SEQ ID NO: 1789857 - RNA, 13 nt, Homo sapiens
uguuguuccaaau

SEQ ID NO: 1789858 - RNA, 15 nt, Homo sapiens
agggcccccacagga

SEQ ID NO: 1789859 - RNA, 23 nt, Homo sapiens
cauagaauugugcuggucauaca

SEQ ID NO: 1789860 - RNA, 13 nt, Homo sapiens
cagcugauccaga

SEQ ID NO: 1789861 - RNA, 14 nt, Homo sapiens
guguccugcuacaa

SEQ ID NO: 1789862 - RNA, 15 nt, Homo sapiens
ggcuaacauggugaa

SEQ ID NO: 1789863 - RNA, 19 nt, Homo sapiens
ugcuuuucuaaucuuguua

SEQ ID NO: 1789864 - RNA, 13 nt, Homo sapiens
uccgggucacugc

SEQ ID NO: 1789865 - RNA, 13 nt, Homo sapiens
ucuucauugcagu

SEQ ID NO: 1789866 - RNA, 18 nt, Homo sapiens
ggaggaacugcuugugca

SEQ ID NO: 1789867 - RNA, 11 nt, Homo sapiens
gaccacugucc

SEQ ID NO: 1789868 - RNA, 16 nt, Homo sapiens
uggucccaagacauga

SEQ ID NO: 1789869 - RNA, 15 nt, Homo sapiens
aauugucuacauuca

SEQ ID NO: 1789870 - RNA, 20 nt, Homo sapiens
caaugacucguuaccugccg

SEQ ID NO: 1789871 - RNA, 15 nt, Homo sapiens
aaagaaaaguagaaa

SEQ ID NO: 1789872 - RNA, 18 nt, Homo sapiens
ccgggaaacauagccuca

SEQ ID NO: 1789873 - RNA, 16 nt, Homo sapiens
ccauuaggcaugccua

SEQ ID NO: 1789874 - RNA, 14 nt, Homo sapiens
agcuuggcaugacc

SEQ ID NO: 1789875 - RNA, 21 nt, Homo sapiens
guauuucacagagcacgccug

SEQ ID NO: 1789876 - RNA, 16 nt, Homo sapiens
aguuuuggacuggaua

SEQ ID NO: 1789877 - RNA, 18 nt, Homo sapiens
ucuacuucauagcuccuu

SEQ ID NO: 1789878 - RNA, 18 nt, Homo sapiens
ugggcacaagcagggcac

SEQ ID NO: 1789879 - RNA, 20 nt, Homo sapiens
caaaagcugcuugacuauca

SEQ ID NO: 1789880 - RNA, 19 nt, Homo sapiens
cacgaagcugugaacucag

SEQ ID NO: 1789881 - RNA, 21 nt, Homo sapiens
auuuugugaaagaaggagcaa

SEQ ID NO: 1789882 - RNA, 22 nt, Homo sapiens
agggaauuccuagcuguaaaua

SEQ ID NO: 1789883 - RNA, 18 nt, Homo sapiens
gagcacuuuccacuucca

SEQ ID NO: 1789884 - RNA, 21 nt, Homo sapiens
cuuccugaaauaaacacuggu

SEQ ID NO: 1789885 - RNA, 13 nt, Homo sapiens
agaagguguucaa

SEQ ID NO: 1789886 - RNA, 15 nt, Homo sapiens
accugcuuccuucag

SEQ ID NO: 1789887 - RNA, 17 nt, Homo sapiens
ugccuuuguaaguuauu

SEQ ID NO: 1789888 - RNA, 17 nt, Homo sapiens
gcucugggauagcugac

SEQ ID NO: 1789889 - RNA, 17 nt, Homo sapiens
agccuuagagcaucucu

SEQ ID NO: 1789890 - RNA, 15 nt, Homo sapiens
acuucuggcuccuca

SEQ ID NO: 1789891 - RNA, 20 nt, Homo sapiens
ucagggggcaugaagcacau

SEQ ID NO: 1789892 - RNA, 14 nt, Homo sapiens
gcaaggacaccaua

SEQ ID NO: 1789893 - RNA, 14 nt, Homo sapiens
aaauguccucuuga

SEQ ID NO: 1789894 - RNA, 14 nt, Homo sapiens
ucuaaaccaaaaau

SEQ ID NO: 1789895 - RNA, 13 nt, Homo sapiens
augaaaauaccau

SEQ ID NO: 1789896 - RNA, 10 nt, Homo sapiens
guuuuacuaa

SEQ ID NO: 1789897 - RNA, 23 nt, Homo sapiens
gaagccauguacucaaguaccac

SEQ ID NO: 1789898 - RNA, 15 nt, Homo sapiens
auaaaaauaaaucag

SEQ ID NO: 1789899 - RNA, 16 nt, Homo sapiens
cugagacugaagacca

SEQ ID NO: 1789900 - RNA, 11 nt, Homo sapiens
cuuaacaaaga

SEQ ID NO: 1789901 - RNA, 16 nt, Homo sapiens
ccagugccugcacauc

SEQ ID NO: 1789902 - RNA, 15 nt, Homo sapiens
caacccuuugcccca

SEQ ID NO: 1789903 - RNA, 20 nt, Homo sapiens
cuuccagugcaacacugaag

SEQ ID NO: 1789904 - RNA, 14 nt, Homo sapiens
aaauuguagcuuuu

SEQ ID NO: 1789905 - RNA, 17 nt, Homo sapiens
aucaugcacaacuauaa

SEQ ID NO: 1789906 - RNA, 22 nt, Homo sapiens
agugaaauaauagaaugagcac

SEQ ID NO: 1789907 - RNA, 12 nt, Homo sapiens
agaccugaggga

SEQ ID NO: 1789908 - RNA, 14 nt, Homo sapiens
cuccucuuccagag

SEQ ID NO: 1789909 - RNA, 18 nt, Homo sapiens
agccggggcgaguggcac

SEQ ID NO: 1789910 - RNA, 21 nt, Homo sapiens
auucucuuaauagcuauacau

SEQ ID NO: 1789911 - RNA, 21 nt, Homo sapiens
cccuugugcgugggugaagcc

SEQ ID NO: 1789912 - RNA, 22 nt, Homo sapiens
caucaaucuuguuacugcugau

SEQ ID NO: 1789913 - RNA, 13 nt, Homo sapiens
guccagugacuuu

SEQ ID NO: 1789914 - RNA, 16 nt, Homo sapiens
gaucuuuuaaguuucc

SEQ ID NO: 1789915 - RNA, 23 nt, Homo sapiens
aguaauguugacuguauuuucca

SEQ ID NO: 1789916 - RNA, 13 nt, Homo sapiens
aauucugccuugg

SEQ ID NO: 1789917 - RNA, 15 nt, Homo sapiens
uuagcuuguuccacu

SEQ ID NO: 1789918 - RNA, 17 nt, Homo sapiens
aacaugcagcucugcag

SEQ ID NO: 1789919 - RNA, 15 nt, Homo sapiens
aaucuauaacuacau

SEQ ID NO: 1789920 - RNA, 18 nt, Homo sapiens
ugucuggaaaagcacuuu

SEQ ID NO: 1789921 - RNA, 21 nt, Homo sapiens
ugcuccucuuuuuucuuguca

SEQ ID NO: 1789922 - RNA, 14 nt, Homo sapiens
caugaauucuguca

SEQ ID NO: 1789923 - RNA, 15 nt, Homo sapiens
cauuggacuuccucc

SEQ ID NO: 1789924 - RNA, 19 nt, Homo sapiens
ucaguucauuuaaaaaaga

SEQ ID NO: 1789925 - RNA, 16 nt, Homo sapiens
acuguuugcccagugu

SEQ ID NO: 1789926 - RNA, 19 nt, Homo sapiens
gacaauguuguaguguccc

SEQ ID NO: 1789927 - RNA, 20 nt, Homo sapiens
ccccagaugccuccucuguc

SEQ ID NO: 1789928 - RNA, 16 nt, Homo sapiens
ccauuugaacacauua

SEQ ID NO: 1789929 - RNA, 16 nt, Homo sapiens
aggcggggcuugccuu

SEQ ID NO: 1789930 - RNA, 19 nt, Homo sapiens
ugaggcaguuccaggagua

SEQ ID NO: 1789931 - RNA, 13 nt, Homo sapiens
caaaacuguaacu

SEQ ID NO: 1789932 - RNA, 21 nt, Homo sapiens
aguaagguuauaacuguggcu

SEQ ID NO: 1789933 - RNA, 15 nt, Homo sapiens
auuaauacuucuuaa

SEQ ID NO: 1789934 - RNA, 14 nt, Homo sapiens
uccuaacaaaagaa

SEQ ID NO: 1789935 - RNA, 14 nt, Homo sapiens
gcagauaacaaaau

SEQ ID NO: 1789936 - RNA, 15 nt, Homo sapiens
ccagcccagcacugg

SEQ ID NO: 1789937 - RNA, 21 nt, Homo sapiens
uccacgugggccucacauucc

SEQ ID NO: 1789938 - RNA, 15 nt, Homo sapiens
aacuauuuaacauuc

SEQ ID NO: 1789939 - RNA, 14 nt, Homo sapiens
cucagaccagagaa

SEQ ID NO: 1789940 - RNA, 15 nt, Homo sapiens
ugaaaugcuuuagca

SEQ ID NO: 1789941 - RNA, 20 nt, Homo sapiens
uuaaggauuuuaugcuuuaa

SEQ ID NO: 1789942 - RNA, 20 nt, Homo sapiens
ugacccccgcaaguuugcac

SEQ ID NO: 1789943 - RNA, 18 nt, Homo sapiens
cuuguuuucuacuuugcc

SEQ ID NO: 1789944 - RNA, 18 nt, Homo sapiens
acuguuugaaacuuuuca

SEQ ID NO: 1789945 - RNA, 21 nt, Homo sapiens
ccggaggccuucccacuccua

SEQ ID NO: 1789946 - RNA, 18 nt, Homo sapiens
ucagaauaggaagauaug

SEQ ID NO: 1789947 - RNA, 13 nt, Homo sapiens
gcaucggcagcug

SEQ ID NO: 1789948 - RNA, 20 nt, Homo sapiens
cuuaauuuaauugcuuugaa

SEQ ID NO: 1789949 - RNA, 18 nt, Homo sapiens
uuaggugugccaaacuac

SEQ ID NO: 1789950 - RNA, 14 nt, Homo sapiens
gaccuugcauguaa

SEQ ID NO: 1789951 - RNA, 16 nt, Homo sapiens
cagggcaccccagcug

SEQ ID NO: 1789952 - RNA, 17 nt, Homo sapiens
guaaauaauuugcacug

SEQ ID NO: 1789953 - RNA, 15 nt, Homo sapiens
aggaauccacucucc

SEQ ID NO: 1789954 - RNA, 18 nt, Homo sapiens
uaacagaugggcuggaag

SEQ ID NO: 1789955 - RNA, 21 nt, Homo sapiens
gccugaugugaguguguggca

SEQ ID NO: 1789956 - RNA, 14 nt, Homo sapiens
cacagaauuugcua

SEQ ID NO: 1789957 - RNA, 18 nt, Homo sapiens
ccugggcaacagagugag

SEQ ID NO: 1789958 - RNA, 22 nt, Homo sapiens
gugugcucauagaaacugcuuu

SEQ ID NO: 1789959 - RNA, 18 nt, Homo sapiens
gggcuccacuucauccag

SEQ ID NO: 1789960 - RNA, 23 nt, Homo sapiens
ugaacagcuguucaguugcacuu

SEQ ID NO: 1789961 - RNA, 18 nt, Homo sapiens
cuuugucucacgauucca

SEQ ID NO: 1789962 - RNA, 21 nt, Homo sapiens
aucacugucuagcuguuucaa

SEQ ID NO: 1789963 - RNA, 19 nt, Homo sapiens
ucagaagaccccugacuca

SEQ ID NO: 1789964 - RNA, 12 nt, Homo sapiens
cugccaccaccc

SEQ ID NO: 1789965 - RNA, 21 nt, Homo sapiens
gucuuuucaaaauauuacuca

SEQ ID NO: 1789966 - RNA, 10 nt, Homo sapiens
acucuugacu

SEQ ID NO: 1789967 - RNA, 16 nt, Homo sapiens
acugccuuaaugagaa

SEQ ID NO: 1789968 - RNA, 12 nt, Homo sapiens
aggacuccuuaa

SEQ ID NO: 1789969 - RNA, 13 nt, Homo sapiens
gaguggaaaagcu

SEQ ID NO: 1789970 - RNA, 16 nt, Homo sapiens
acaggacuguaaagau

SEQ ID NO: 1789971 - RNA, 22 nt, Homo sapiens
uccacaggucucagaaucuuuc

SEQ ID NO: 1789972 - RNA, 13 nt, Homo sapiens
caagacugaaaca

SEQ ID NO: 1789973 - RNA, 15 nt, Homo sapiens
cuguccccuaccccc

SEQ ID NO: 1789974 - RNA, 19 nt, Homo sapiens
auucagaacugauuccuga

SEQ ID NO: 1789975 - RNA, 20 nt, Homo sapiens
auccucucuaucacaucccc

SEQ ID NO: 1789976 - RNA, 10 nt, Homo sapiens
ucucucugcc

SEQ ID NO: 1789977 - RNA, 19 nt, Homo sapiens
cuuggcagaggcagggaag

SEQ ID NO: 1789978 - RNA, 11 nt, Homo sapiens
ugucugagaac

SEQ ID NO: 1789979 - RNA, 18 nt, Homo sapiens
ccugcuaauaauuugcca

SEQ ID NO: 1789980 - RNA, 20 nt, Homo sapiens
uguauccucugaccuacaua

SEQ ID NO: 1789981 - RNA, 22 nt, Homo sapiens
ucuugcuguaacucagacauuc

SEQ ID NO: 1789982 - RNA, 22 nt, Homo sapiens
guccugugaauggaagcaaagu

SEQ ID NO: 1789983 - RNA, 16 nt, Homo sapiens
ucuucuguguauguga

SEQ ID NO: 1789984 - RNA, 19 nt, Homo sapiens
cggggaagagauccaaaga

SEQ ID NO: 1789985 - RNA, 18 nt, Homo sapiens
agccaucugcacacaccu

SEQ ID NO: 1789986 - RNA, 21 nt, Homo sapiens
augaaugaacaaaccugugau

SEQ ID NO: 1789987 - RNA, 12 nt, Homo sapiens
uuauucucaaga

SEQ ID NO: 1789988 - RNA, 15 nt, Homo sapiens
cagccacauugagac

SEQ ID NO: 1789989 - RNA, 19 nt, Homo sapiens
acauuuuaaaagugccauu

SEQ ID NO: 1789990 - RNA, 14 nt, Homo sapiens
guaauaagcacuug

SEQ ID NO: 1789991 - RNA, 14 nt, Homo sapiens
cugguggaggagcu

SEQ ID NO: 1789992 - RNA, 17 nt, Homo sapiens
caaacuugauugugcau

SEQ ID NO: 1789993 - RNA, 16 nt, Homo sapiens
agccuaccaauguaga

SEQ ID NO: 1789994 - RNA, 18 nt, Homo sapiens
ugaaacacgaaacuuguu

SEQ ID NO: 1789995 - RNA, 16 nt, Homo sapiens
aaaaucaaaugugcau

SEQ ID NO: 1789996 - RNA, 14 nt, Homo sapiens
ugccaaaaccaaga

SEQ ID NO: 1789997 - RNA, 15 nt, Homo sapiens
ggcucagccuaguga

SEQ ID NO: 1789998 - RNA, 21 nt, Homo sapiens
guauuugcagugccgaugaua

SEQ ID NO: 1789999 - RNA, 18 nt, Homo sapiens
acagccccuuauuugcac

SEQ ID NO: 1790000 - RNA, 13 nt, Homo sapiens
uaaaauagaaacu

SEQ ID NO: 1790001 - RNA, 20 nt, Homo sapiens
gaauaaagcuucucucugag

SEQ ID NO: 1790002 - RNA, 22 nt, Homo sapiens
uggaaugcauaucgcugggcuc

SEQ ID NO: 1790003 - RNA, 21 nt, Homo sapiens
uucucuugaaaaguucaggga

SEQ ID NO: 1790004 - RNA, 15 nt, Homo sapiens
ucaccauucaaacag

SEQ ID NO: 1790005 - RNA, 16 nt, Homo sapiens
agcucacuuccuccag

SEQ ID NO: 1790006 - RNA, 22 nt, Homo sapiens
aaccuuuagaauaucuuuucaa

SEQ ID NO: 1790007 - RNA, 17 nt, Homo sapiens
guugaauucuuuugcca

SEQ ID NO: 1790008 - RNA, 21 nt, Homo sapiens
cacagcugccaucgaccugga

SEQ ID NO: 1790009 - RNA, 16 nt, Homo sapiens
auagaugugaucacug

SEQ ID NO: 1790010 - RNA, 20 nt, Homo sapiens
agccacaucacuacaguaca

SEQ ID NO: 1790011 - RNA, 18 nt, Homo sapiens
auuauuucuaccauuaaa

SEQ ID NO: 1790012 - RNA, 13 nt, Homo sapiens
uaagcuguaaaaa

SEQ ID NO: 1790013 - RNA, 20 nt, Homo sapiens
auuuaaucuguacuauccag

SEQ ID NO: 1790014 - RNA, 17 nt, Homo sapiens
uuggaacuuacauacau

SEQ ID NO: 1790015 - RNA, 13 nt, Homo sapiens
ugccugggaccug

SEQ ID NO: 1790016 - RNA, 23 nt, Homo sapiens
caguuuuaccucuucucucucag

SEQ ID NO: 1790017 - RNA, 18 nt, Homo sapiens
ugcaaaaagguaccaaaa

SEQ ID NO: 1790018 - RNA, 14 nt, Homo sapiens
aauaacugaucuca

SEQ ID NO: 1790019 - RNA, 12 nt, Homo sapiens
acauuugcccaa

SEQ ID NO: 1790020 - RNA, 22 nt, Homo sapiens
ggccaucuccucccaccagugg

SEQ ID NO: 1790021 - RNA, 20 nt, Homo sapiens
acgugacuguggcacacgcc

SEQ ID NO: 1790022 - RNA, 17 nt, Homo sapiens
gcuccucccacuucuca

SEQ ID NO: 1790023 - RNA, 13 nt, Homo sapiens
uggacuaagcaau

SEQ ID NO: 1790024 - RNA, 13 nt, Homo sapiens
accuaacugugaa

SEQ ID NO: 1790025 - RNA, 13 nt, Homo sapiens
accucacugugac

SEQ ID NO: 1790026 - RNA, 18 nt, Homo sapiens
ugucauguucugugcaua

SEQ ID NO: 1790027 - RNA, 20 nt, Homo sapiens
uagcuacauucacacacuca

SEQ ID NO: 1790028 - RNA, 20 nt, Homo sapiens
gaaaaaaaaaaaaaagccuu

SEQ ID NO: 1790029 - RNA, 13 nt, Homo sapiens
accuggugcacuu

SEQ ID NO: 1790030 - RNA, 22 nt, Homo sapiens
agucugcauaaacuucaucuuc

SEQ ID NO: 1790031 - RNA, 17 nt, Homo sapiens
cugcuaaggcugccuca

SEQ ID NO: 1790032 - RNA, 15 nt, Homo sapiens
gucaaguucccuccu

SEQ ID NO: 1790033 - RNA, 19 nt, Homo sapiens
uuacuauacagcauaccac

SEQ ID NO: 1790034 - RNA, 21 nt, Homo sapiens
cccuccauaaguuuaacuuua

SEQ ID NO: 1790035 - RNA, 19 nt, Homo sapiens
ucuacuauauaugacugga

SEQ ID NO: 1790036 - RNA, 21 nt, Homo sapiens
uucaggagaguguauaugaau

SEQ ID NO: 1790037 - RNA, 16 nt, Homo sapiens
uagaauucuagugcug

SEQ ID NO: 1790038 - RNA, 17 nt, Homo sapiens
cugaaccgcacagcuca

SEQ ID NO: 1790039 - RNA, 13 nt, Homo sapiens
auuuaucccucaa

SEQ ID NO: 1790040 - RNA, 16 nt, Homo sapiens
guaagagucuguguua

SEQ ID NO: 1790041 - RNA, 15 nt, Homo sapiens
uugauggauuuucaa

SEQ ID NO: 1790042 - RNA, 17 nt, Homo sapiens
uaaaaacucuucagugc

SEQ ID NO: 1790043 - RNA, 15 nt, Homo sapiens
aaagccaagcacuuu

SEQ ID NO: 1790044 - RNA, 22 nt, Homo sapiens
auugggaagcugggggaagggu

SEQ ID NO: 1790045 - RNA, 13 nt, Homo sapiens
ucaccauguugcc

SEQ ID NO: 1790046 - RNA, 15 nt, Homo sapiens
cagccaacaaacaua

SEQ ID NO: 1790047 - RNA, 16 nt, Homo sapiens
cgggauguuguuugcu

SEQ ID NO: 1790048 - RNA, 20 nt, Homo sapiens
acucaaacaaucaugaguca

SEQ ID NO: 1790049 - RNA, 20 nt, Homo sapiens
uccccacuuacagaucuauc

SEQ ID NO: 1790050 - RNA, 18 nt, Homo sapiens
uaugacaauaagccacga

SEQ ID NO: 1790051 - RNA, 13 nt, Homo sapiens
agauguuuggaca

SEQ ID NO: 1790052 - RNA, 12 nt, Homo sapiens
ugaaaaugugug

SEQ ID NO: 1790053 - RNA, 12 nt, Homo sapiens
uaagaauguaua

SEQ ID NO: 1790054 - RNA, 19 nt, Homo sapiens
ucacaacuccuuccauccu

SEQ ID NO: 1790055 - RNA, 14 nt, Homo sapiens
aucaggacugugac

SEQ ID NO: 1790056 - RNA, 14 nt, Homo sapiens
cuuuuguaucuuaa

SEQ ID NO: 1790057 - RNA, 18 nt, Homo sapiens
caagccaugugcuuuagc

SEQ ID NO: 1790058 - RNA, 16 nt, Homo sapiens
gauccucccucauggc

SEQ ID NO: 1790059 - RNA, 14 nt, Homo sapiens
aggccuggacuuuc

SEQ ID NO: 1790060 - RNA, 15 nt, Homo sapiens
agacuuuuaucaaaa

SEQ ID NO: 1790061 - RNA, 16 nt, Homo sapiens
aaauauaagacauuug

SEQ ID NO: 1790062 - RNA, 12 nt, Homo sapiens
ugaaaacauuca

SEQ ID NO: 1790063 - RNA, 21 nt, Homo sapiens
gaguacuuugaagaugucauc

SEQ ID NO: 1790064 - RNA, 20 nt, Homo sapiens
cuguuggacacccagugcca

SEQ ID NO: 1790065 - RNA, 22 nt, Homo sapiens
cagccacccguggggugcugcc

SEQ ID NO: 1790066 - RNA, 20 nt, Homo sapiens
aguaauuuauauagauguca

SEQ ID NO: 1790067 - RNA, 19 nt, Homo sapiens
accugauucucacagcaac

SEQ ID NO: 1790068 - RNA, 21 nt, Homo sapiens
uuuugucuuucuauucagcaa

SEQ ID NO: 1790069 - RNA, 15 nt, Homo sapiens
aagaggagaaaaaga

SEQ ID NO: 1790070 - RNA, 19 nt, Homo sapiens
ccacuuugacuacaaagau

SEQ ID NO: 1790071 - RNA, 14 nt, Homo sapiens
uuggguucacagaa

SEQ ID NO: 1790072 - RNA, 15 nt, Homo sapiens
ccagcucagcacugc

SEQ ID NO: 1790073 - RNA, 19 nt, Homo sapiens
caccaaugaaaacauguac

SEQ ID NO: 1790074 - RNA, 23 nt, Homo sapiens
gcuuaguucaaguccugccucuu

SEQ ID NO: 1790075 - RNA, 13 nt, Homo sapiens
uaaagaacauacc

SEQ ID NO: 1790076 - RNA, 23 nt, Homo sapiens
gcauuucuacauguuuuagacag

SEQ ID NO: 1790077 - RNA, 19 nt, Homo sapiens
ggugacuguguaacuuucu

SEQ ID NO: 1790078 - RNA, 13 nt, Homo sapiens
uguaaaagggcuc

SEQ ID NO: 1790079 - RNA, 17 nt, Homo sapiens
aggcuuagagaggaaaa

SEQ ID NO: 1790080 - RNA, 19 nt, Homo sapiens
uccaaaccuccacugcugc

SEQ ID NO: 1790081 - RNA, 19 nt, Homo sapiens
gaauaaagcuucucucuga

SEQ ID NO: 1790082 - RNA, 23 nt, Homo sapiens
augcaugguuucagcacuagcca

SEQ ID NO: 1790083 - RNA, 19 nt, Homo sapiens
uauagaauuuccuguaaua

SEQ ID NO: 1790084 - RNA, 17 nt, Homo sapiens
ugaugaagaccaaagac

SEQ ID NO: 1790085 - RNA, 14 nt, Homo sapiens
uucaaaaguggagu

SEQ ID NO: 1790086 - RNA, 14 nt, Homo sapiens
guugcgaugccuua

SEQ ID NO: 1790087 - RNA, 19 nt, Homo sapiens
ucacaaagaccuugcugau

SEQ ID NO: 1790088 - RNA, 20 nt, Homo sapiens
uauaucuuagguaagacaua

SEQ ID NO: 1790089 - RNA, 17 nt, Homo sapiens
gaguaaagauaaaagga

SEQ ID NO: 1790090 - RNA, 17 nt, Homo sapiens
uuucgugcacucugcua

SEQ ID NO: 1790091 - RNA, 21 nt, Homo sapiens
acugagcaucuccagcauucu

SEQ ID NO: 1790092 - RNA, 16 nt, Homo sapiens
ugcucuucagccauag

SEQ ID NO: 1790093 - RNA, 22 nt, Homo sapiens
uauugacaaaauguuauuuccc

SEQ ID NO: 1790094 - RNA, 23 nt, Homo sapiens
uggagccacugggauucauggcu

SEQ ID NO: 1790095 - RNA, 13 nt, Homo sapiens
ugagacaagcccu

SEQ ID NO: 1790096 - RNA, 14 nt, Homo sapiens
ccucuaguaguaua

SEQ ID NO: 1790097 - RNA, 14 nt, Homo sapiens
gaacuuuaacuuuu

SEQ ID NO: 1790098 - RNA, 23 nt, Homo sapiens
cacuaaugggaagaccaaaauua

SEQ ID NO: 1790099 - RNA, 21 nt, Homo sapiens
ucauaugauugugcacauacu

SEQ ID NO: 1790100 - RNA, 14 nt, Homo sapiens
cacugcaaccucca

SEQ ID NO: 1790101 - RNA, 16 nt, Homo sapiens
auuccaggaugcugcu

SEQ ID NO: 1790102 - RNA, 19 nt, Homo sapiens
cuuacauagccaccuguca

SEQ ID NO: 1790103 - RNA, 16 nt, Homo sapiens
auacuucuacaacuuu

SEQ ID NO: 1790104 - RNA, 17 nt, Homo sapiens
caugguuucagcacuag

SEQ ID NO: 1790105 - RNA, 21 nt, Homo sapiens
uuauccuaaagauuauuaccu

SEQ ID NO: 1790106 - RNA, 22 nt, Homo sapiens
gccagaaacguaacugugugca

SEQ ID NO: 1790107 - RNA, 17 nt, Homo sapiens
auaacuacuuccauccc

SEQ ID NO: 1790108 - RNA, 14 nt, Homo sapiens
cgaaacacacaaac

SEQ ID NO: 1790109 - RNA, 20 nt, Homo sapiens
ugugagcacucuacugcaag

SEQ ID NO: 1790110 - RNA, 15 nt, Homo sapiens
caaacuccugaccuc

SEQ ID NO: 1790111 - RNA, 16 nt, Homo sapiens
uuuuugagacaaaguc

SEQ ID NO: 1790112 - RNA, 16 nt, Homo sapiens
cauggccgugaacuuu

SEQ ID NO: 1790113 - RNA, 17 nt, Homo sapiens
ugacuauggcuaccaaa

SEQ ID NO: 1790114 - RNA, 11 nt, Homo sapiens
uccuuguacuu

SEQ ID NO: 1790115 - RNA, 17 nt, Homo sapiens
agcgcuacccaccucca

SEQ ID NO: 1790116 - RNA, 17 nt, Homo sapiens
uaucacaaacuuaacau

SEQ ID NO: 1790117 - RNA, 16 nt, Homo sapiens
agccaaccacuuucac

SEQ ID NO: 1790118 - RNA, 22 nt, Homo sapiens
acccacagacugguuuugcaac

SEQ ID NO: 1790119 - RNA, 16 nt, Homo sapiens
auugcuggucuuguaa

SEQ ID NO: 1790120 - RNA, 18 nt, Homo sapiens
uaugcauuugcauuugcu

SEQ ID NO: 1790121 - RNA, 14 nt, Homo sapiens
uucaugugacacag

SEQ ID NO: 1790122 - RNA, 15 nt, Homo sapiens
uuaacggugcuaaaa

SEQ ID NO: 1790123 - RNA, 21 nt, Homo sapiens
agcugaugacucaagauuccc

SEQ ID NO: 1790124 - RNA, 20 nt, Homo sapiens
gaggacucucccuuggugac

SEQ ID NO: 1790125 - RNA, 18 nt, Homo sapiens
ccacccucccacugccaa

SEQ ID NO: 1790126 - RNA, 20 nt, Homo sapiens
aucagauuuggugauggaaa

SEQ ID NO: 1790127 - RNA, 13 nt, Homo sapiens
uuggaaacagaga

SEQ ID NO: 1790128 - RNA, 13 nt, Homo sapiens
auagcucuucacu

SEQ ID NO: 1790129 - RNA, 15 nt, Homo sapiens
uuuucauucugccaa

SEQ ID NO: 1790130 - RNA, 10 nt, Homo sapiens
ccagccacag

SEQ ID NO: 1790131 - RNA, 13 nt, Homo sapiens
agaacuugcaaua

SEQ ID NO: 1790132 - RNA, 23 nt, Homo sapiens
gcacugcuccaagggacaggugg

SEQ ID NO: 1790133 - RNA, 22 nt, Homo sapiens
ucuaaggaauaugagcuuuaug

SEQ ID NO: 1790134 - RNA, 14 nt, Homo sapiens
aggaauuacuuuau

SEQ ID NO: 1790135 - RNA, 18 nt, Homo sapiens
ccucugggucaguggucc

SEQ ID NO: 1790136 - RNA, 21 nt, Homo sapiens
gaauauguguguccuuuuaau

SEQ ID NO: 1790137 - RNA, 20 nt, Homo sapiens
agagaagaccacaccaagga

SEQ ID NO: 1790138 - RNA, 17 nt, Homo sapiens
acuacaacgaacacaag

SEQ ID NO: 1790139 - RNA, 23 nt, Homo sapiens
ugggaaagggcgaacgaggauua

SEQ ID NO: 1790140 - RNA, 23 nt, Homo sapiens
aaaauuucaggauuaacuaaaga

SEQ ID NO: 1790141 - RNA, 19 nt, Homo sapiens
ggacacuccaugagugucu

SEQ ID NO: 1790142 - RNA, 14 nt, Homo sapiens
ucauuugagcucau

SEQ ID NO: 1790143 - RNA, 20 nt, Homo sapiens
ugagaagugucuaaaaacac

SEQ ID NO: 1790144 - RNA, 22 nt, Homo sapiens
cuaauaaaagucagagcucagg

SEQ ID NO: 1790145 - RNA, 16 nt, Homo sapiens
aacgggaacaccugcu

SEQ ID NO: 1790146 - RNA, 23 nt, Homo sapiens
ccaggcaugaaauucuuccuaau

SEQ ID NO: 1790147 - RNA, 15 nt, Homo sapiens
acacauacauaggau

SEQ ID NO: 1790148 - RNA, 23 nt, Homo sapiens
aagacaauuuuaauguuuacaac

SEQ ID NO: 1790149 - RNA, 18 nt, Homo sapiens
aggugggaucgacuguaa

SEQ ID NO: 1790150 - RNA, 16 nt, Homo sapiens
caggcagaaggcagua

SEQ ID NO: 1790151 - RNA, 17 nt, Homo sapiens
guaucucaagauauuca

SEQ ID NO: 1790152 - RNA, 12 nt, Homo sapiens
acaacugugguc

SEQ ID NO: 1790153 - RNA, 12 nt, Homo sapiens
agaacugugcuc

SEQ ID NO: 1790154 - RNA, 13 nt, Homo sapiens
cuuucugagugac

SEQ ID NO: 1790155 - RNA, 17 nt, Homo sapiens
aaaguguuuuuacauau

SEQ ID NO: 1790156 - RNA, 20 nt, Homo sapiens
agcaguucugaaaaaugcag

SEQ ID NO: 1790157 - RNA, 17 nt, Homo sapiens
uaaauuuggccaugaaa

SEQ ID NO: 1790158 - RNA, 15 nt, Homo sapiens
cuuggaaaaugggac

SEQ ID NO: 1790159 - RNA, 19 nt, Homo sapiens
cagcuaagggaagacauuu

SEQ ID NO: 1790160 - RNA, 16 nt, Homo sapiens
auuuaaauuccacaga

SEQ ID NO: 1790161 - RNA, 16 nt, Homo sapiens
acacauaaaucugucu

SEQ ID NO: 1790162 - RNA, 22 nt, Homo sapiens
aagagagcgagacccugucuca

SEQ ID NO: 1790163 - RNA, 22 nt, Homo sapiens
cuuugaagaauauuuguaguua

SEQ ID NO: 1790164 - RNA, 19 nt, Homo sapiens
gaagcacuacaccuugccu

SEQ ID NO: 1790165 - RNA, 13 nt, Homo sapiens
aggcaagcccuuc

SEQ ID NO: 1790166 - RNA, 19 nt, Homo sapiens
guaaucccagcacuuggag

SEQ ID NO: 1790167 - RNA, 20 nt, Homo sapiens
uggcaucacgucagugcuca

SEQ ID NO: 1790168 - RNA, 20 nt, Homo sapiens
uggagaggaaaagcaucaga

SEQ ID NO: 1790169 - RNA, 21 nt, Homo sapiens
acucagaaagccaacaugugg

SEQ ID NO: 1790170 - RNA, 17 nt, Homo sapiens
aaacagugacaccugca

SEQ ID NO: 1790171 - RNA, 20 nt, Homo sapiens
cuggcuucucuugagucaca

SEQ ID NO: 1790172 - RNA, 20 nt, Homo sapiens
cuacaaacacaauauucaau

SEQ ID NO: 1790173 - RNA, 18 nt, Homo sapiens
gagacuuaaaaaauacuu

SEQ ID NO: 1790174 - RNA, 15 nt, Homo sapiens
gacaggagcacugca

SEQ ID NO: 1790175 - RNA, 16 nt, Homo sapiens
ucagcucacacccuaa

SEQ ID NO: 1790176 - RNA, 15 nt, Homo sapiens
auacaguacggauuu

SEQ ID NO: 1790177 - RNA, 13 nt, Homo sapiens
auccacuccuucc

SEQ ID NO: 1790178 - RNA, 18 nt, Homo sapiens
guucuuaggaacagacuc

SEQ ID NO: 1790179 - RNA, 23 nt, Homo sapiens
aggcugucgugagcuaugauuau

SEQ ID NO: 1790180 - RNA, 20 nt, Homo sapiens
aaugcagggacaaaugccac

SEQ ID NO: 1790181 - RNA, 16 nt, Homo sapiens
ugaaauuuaagcacaa

SEQ ID NO: 1790182 - RNA, 18 nt, Homo sapiens
aggauugagaagggacaa

SEQ ID NO: 1790183 - RNA, 23 nt, Homo sapiens
agaacaaaucugggcauugagca

SEQ ID NO: 1790184 - RNA, 17 nt, Homo sapiens
ugguuaaauaauugaca

SEQ ID NO: 1790185 - RNA, 17 nt, Homo sapiens
agggagaaaaagaaaca

SEQ ID NO: 1790186 - RNA, 19 nt, Homo sapiens
caguuuuuggcaaaaaaca

SEQ ID NO: 1790187 - RNA, 22 nt, Homo sapiens
acaaagggauguucacuguaug

SEQ ID NO: 1790188 - RNA, 16 nt, Homo sapiens
ugcagaguccauuucc

SEQ ID NO: 1790189 - RNA, 20 nt, Homo sapiens
ccuccgccuuccggguucaa

SEQ ID NO: 1790190 - RNA, 16 nt, Homo sapiens
caagcgauucucaugc

SEQ ID NO: 1790191 - RNA, 16 nt, Homo sapiens
caagagauucuccugc

SEQ ID NO: 1790192 - RNA, 17 nt, Homo sapiens
cucaaaguacugggauu

SEQ ID NO: 1790193 - RNA, 17 nt, Homo sapiens
caauuugucaguguaua

SEQ ID NO: 1790194 - RNA, 14 nt, Homo sapiens
gaggagcccucauc

SEQ ID NO: 1790195 - RNA, 19 nt, Homo sapiens
guuaguggauuacugccau

SEQ ID NO: 1790196 - RNA, 16 nt, Homo sapiens
uaaaagcaacaucguc

SEQ ID NO: 1790197 - RNA, 22 nt, Homo sapiens
uuguauauauggaucagaggag

SEQ ID NO: 1790198 - RNA, 13 nt, Homo sapiens
aaugaccugguga

SEQ ID NO: 1790199 - RNA, 23 nt, Homo sapiens
uaaaaauaugcuuguugaugcug

SEQ ID NO: 1790200 - RNA, 15 nt, Homo sapiens
aggugccagaaggaa

SEQ ID NO: 1790201 - RNA, 13 nt, Homo sapiens
uaaaucaccagaa

SEQ ID NO: 1790202 - RNA, 18 nt, Homo sapiens
aagauaucuaugacugug

SEQ ID NO: 1790203 - RNA, 13 nt, Homo sapiens
aaacucaaaauau

SEQ ID NO: 1790204 - RNA, 15 nt, Homo sapiens
acuauuguaaugcca

SEQ ID NO: 1790205 - RNA, 19 nt, Homo sapiens
cauccagaacugcuaccuu

SEQ ID NO: 1790206 - RNA, 22 nt, Homo sapiens
auuacacugaucuuauguguua

SEQ ID NO: 1790207 - RNA, 20 nt, Homo sapiens
auaaaucauucuuacuaaaa

SEQ ID NO: 1790208 - RNA, 19 nt, Homo sapiens
guguugucccagggcugau

SEQ ID NO: 1790209 - RNA, 15 nt, Homo sapiens
ucuuaccauuucaca

SEQ ID NO: 1790210 - RNA, 13 nt, Homo sapiens
acacaagaaucua

SEQ ID NO: 1790211 - RNA, 12 nt, Homo sapiens
aaugaacuguga

SEQ ID NO: 1790212 - RNA, 18 nt, Homo sapiens
caugcaggaucagcucca

SEQ ID NO: 1790213 - RNA, 19 nt, Homo sapiens
uccuaggcaucugcuguaa

SEQ ID NO: 1790214 - RNA, 19 nt, Homo sapiens
auuucuguuccagucacau

SEQ ID NO: 1790215 - RNA, 13 nt, Homo sapiens
ccagcccagcugg

SEQ ID NO: 1790216 - RNA, 13 nt, Homo sapiens
gugaaaguggcug

SEQ ID NO: 1790217 - RNA, 18 nt, Homo sapiens
ucuggaagaucauuuuga

SEQ ID NO: 1790218 - RNA, 22 nt, Homo sapiens
guagagcaaaggagacaaagca

SEQ ID NO: 1790219 - RNA, 13 nt, Homo sapiens
aaccccucugagc

SEQ ID NO: 1790220 - RNA, 13 nt, Homo sapiens
ugaauuuucuuca

SEQ ID NO: 1790221 - RNA, 12 nt, Homo sapiens
ccauuaccaaaa

SEQ ID NO: 1790222 - RNA, 23 nt, Homo sapiens
ucacauaaugcucauacuuaucu

SEQ ID NO: 1790223 - RNA, 15 nt, Homo sapiens
cagaucuaguucucu

SEQ ID NO: 1790224 - RNA, 17 nt, Homo sapiens
gccauguuuagauucca

SEQ ID NO: 1790225 - RNA, 22 nt, Homo sapiens
uccaucagguuccaucccgaaa

SEQ ID NO: 1790226 - RNA, 20 nt, Homo sapiens
uaaaaaaugagcuuccauua

SEQ ID NO: 1790227 - RNA, 13 nt, Homo sapiens
agaauguuuucaa

SEQ ID NO: 1790228 - RNA, 12 nt, Homo sapiens
cuggaggaacuu

SEQ ID NO: 1790229 - RNA, 20 nt, Homo sapiens
uaccuaggcaacauggugaa

SEQ ID NO: 1790230 - RNA, 16 nt, Homo sapiens
uuucaccccacucugu

SEQ ID NO: 1790231 - RNA, 15 nt, Homo sapiens
aauucaugccuuuca

SEQ ID NO: 1790232 - RNA, 18 nt, Homo sapiens
gcccaauaucagcucuuu

SEQ ID NO: 1790233 - RNA, 19 nt, Homo sapiens
uuauauuuggcucucagau

SEQ ID NO: 1790234 - RNA, 17 nt, Homo sapiens
cuuuccucaaaucaaaa

SEQ ID NO: 1790235 - RNA, 15 nt, Homo sapiens
aaauuuaacugcaua

SEQ ID NO: 1790236 - RNA, 17 nt, Homo sapiens
ugugcucuucugucugc

SEQ ID NO: 1790237 - RNA, 16 nt, Homo sapiens
acagaacuccacugca

SEQ ID NO: 1790238 - RNA, 12 nt, Homo sapiens
aaacaucacuug

SEQ ID NO: 1790239 - RNA, 21 nt, Homo sapiens
cucccauccccuggacuggga

SEQ ID NO: 1790240 - RNA, 13 nt, Homo sapiens
auacuugccauca

SEQ ID NO: 1790241 - RNA, 22 nt, Homo sapiens
ccuucuagaacaccugccuucu

SEQ ID NO: 1790242 - RNA, 20 nt, Homo sapiens
aggacaugcaugacacuucc

SEQ ID NO: 1790243 - RNA, 18 nt, Homo sapiens
auucauccucacaugugg

SEQ ID NO: 1790244 - RNA, 22 nt, Homo sapiens
uuagcaguuuugugauaaguuc

SEQ ID NO: 1790245 - RNA, 13 nt, Homo sapiens
gacuccugugcaa

SEQ ID NO: 1790246 - RNA, 18 nt, Homo sapiens
ccuccugaaccagcacua

SEQ ID NO: 1790247 - RNA, 14 nt, Homo sapiens
accagcagcgccuu

SEQ ID NO: 1790248 - RNA, 17 nt, Homo sapiens
cauuuuaacaucugaga

SEQ ID NO: 1790249 - RNA, 15 nt, Homo sapiens
agaagcccauaucac

SEQ ID NO: 1790250 - RNA, 19 nt, Homo sapiens
auugaauuaaaacagcugc

SEQ ID NO: 1790251 - RNA, 16 nt, Homo sapiens
gccucuuggcuucuca

SEQ ID NO: 1790252 - RNA, 12 nt, Homo sapiens
ccccucaucuca

SEQ ID NO: 1790253 - RNA, 20 nt, Homo sapiens
aaauuuuaccagcagaagga

SEQ ID NO: 1790254 - RNA, 18 nt, Homo sapiens
aacugagagucauauaca

SEQ ID NO: 1790255 - RNA, 22 nt, Homo sapiens
guccuuggauagauucagcucc

SEQ ID NO: 1790256 - RNA, 17 nt, Homo sapiens
ugcuccaguauaaauua

SEQ ID NO: 1790257 - RNA, 12 nt, Homo sapiens
auaauuguugaa

SEQ ID NO: 1790258 - RNA, 15 nt, Homo sapiens
augaagugauucuaa

SEQ ID NO: 1790259 - RNA, 16 nt, Homo sapiens
auauuaaaaucugaug

SEQ ID NO: 1790260 - RNA, 21 nt, Homo sapiens
uuuugaaaaggcgguacuagu

SEQ ID NO: 1790261 - RNA, 17 nt, Homo sapiens
uucaccucccaaaccca

SEQ ID NO: 1790262 - RNA, 19 nt, Homo sapiens
ucccuaucucgaacaugga

SEQ ID NO: 1790263 - RNA, 11 nt, Homo sapiens
ccuaccucucg

SEQ ID NO: 1790264 - RNA, 23 nt, Homo sapiens
aacacaaauugugaagauuucau

SEQ ID NO: 1790265 - RNA, 16 nt, Homo sapiens
uucccaggcccacugu

SEQ ID NO: 1790266 - RNA, 23 nt, Homo sapiens
uuauuccuuuguuacuucucuaa

SEQ ID NO: 1790267 - RNA, 15 nt, Homo sapiens
acagcagacuaguua

SEQ ID NO: 1790268 - RNA, 10 nt, Homo sapiens
aagcauucuu

SEQ ID NO: 1790269 - RNA, 17 nt, Homo sapiens
caaucagcccagugcaa

SEQ ID NO: 1790270 - RNA, 15 nt, Homo sapiens
aaugauguagacauu

SEQ ID NO: 1790271 - RNA, 14 nt, Homo sapiens
ggaguggcugccau

SEQ ID NO: 1790272 - RNA, 21 nt, Homo sapiens
uaacugcaaagugaaguugcu

SEQ ID NO: 1790273 - RNA, 18 nt, Homo sapiens
gacaccgucgaccaggaa

SEQ ID NO: 1790274 - RNA, 13 nt, Homo sapiens
cuauaauugagaa

SEQ ID NO: 1790275 - RNA, 17 nt, Homo sapiens
ucucucaggcucucuga

SEQ ID NO: 1790276 - RNA, 13 nt, Homo sapiens
augacuucaucaa

SEQ ID NO: 1790277 - RNA, 13 nt, Homo sapiens
uaaagaauccaua

SEQ ID NO: 1790278 - RNA, 23 nt, Homo sapiens
cuccaagauuuaaccugcaaguu

SEQ ID NO: 1790279 - RNA, 22 nt, Homo sapiens
gcagcacuccgcaucaccucac

SEQ ID NO: 1790280 - RNA, 21 nt, Homo sapiens
ugugacgugcacugugaaucc

SEQ ID NO: 1790281 - RNA, 14 nt, Homo sapiens
caauggagagauuc

SEQ ID NO: 1790282 - RNA, 19 nt, Homo sapiens
auuuuccuucuucagcuca

SEQ ID NO: 1790283 - RNA, 19 nt, Homo sapiens
acuugaggaucauaugaau

SEQ ID NO: 1790284 - RNA, 21 nt, Homo sapiens
aaauucaaauaauccauucca

SEQ ID NO: 1790285 - RNA, 12 nt, Homo sapiens
uaaaugcuuuaa

SEQ ID NO: 1790286 - RNA, 15 nt, Homo sapiens
aucagguuugcccac

SEQ ID NO: 1790287 - RNA, 19 nt, Homo sapiens
gccaagggaaccugugucc

SEQ ID NO: 1790288 - RNA, 13 nt, Homo sapiens
uuauccacaagca

SEQ ID NO: 1790289 - RNA, 22 nt, Homo sapiens
ucucagcucacuacaaccuccg

SEQ ID NO: 1790290 - RNA, 15 nt, Homo sapiens
ucuuuuaaaguauuu

SEQ ID NO: 1790291 - RNA, 20 nt, Homo sapiens
gcugccauccagggaugcca

SEQ ID NO: 1790292 - RNA, 23 nt, Homo sapiens
gacccaggaaaggcaggauugaa

SEQ ID NO: 1790293 - RNA, 19 nt, Homo sapiens
uaaaugaggggccucaggu

SEQ ID NO: 1790294 - RNA, 12 nt, Homo sapiens
acacccaaaaau

SEQ ID NO: 1790295 - RNA, 19 nt, Homo sapiens
cagacuaucguaaccuggu

SEQ ID NO: 1790296 - RNA, 23 nt, Homo sapiens
ugcuggggagccaaaggcaucca

SEQ ID NO: 1790297 - RNA, 23 nt, Homo sapiens
uaggggauggggaggaagagaga

SEQ ID NO: 1790298 - RNA, 15 nt, Homo sapiens
cauagucuguuccuu

SEQ ID NO: 1790299 - RNA, 11 nt, Homo sapiens
accacacaaag

SEQ ID NO: 1790300 - RNA, 15 nt, Homo sapiens
uguugauggcaaaaa

SEQ ID NO: 1790301 - RNA, 19 nt, Homo sapiens
aagccuagcccuucucuca

SEQ ID NO: 1790302 - RNA, 18 nt, Homo sapiens
aggcccuuaacuaucacc

SEQ ID NO: 1790303 - RNA, 20 nt, Homo sapiens
gucaacuuucuuagcucaag

SEQ ID NO: 1790304 - RNA, 20 nt, Homo sapiens
ccugggccucagcaagccau

SEQ ID NO: 1790305 - RNA, 21 nt, Homo sapiens
cauuccaaaauacaauguuau

SEQ ID NO: 1790306 - RNA, 16 nt, Homo sapiens
aaugcaaaacauuuca

SEQ ID NO: 1790307 - RNA, 15 nt, Homo sapiens
agugcacagcugucc

SEQ ID NO: 1790308 - RNA, 22 nt, Homo sapiens
ucaaccaccuaggcaaugaaga

SEQ ID NO: 1790309 - RNA, 17 nt, Homo sapiens
augaaaaccauuaccug

SEQ ID NO: 1790310 - RNA, 16 nt, Homo sapiens
aagacagagcugggau

SEQ ID NO: 1790311 - RNA, 18 nt, Homo sapiens
guuggaccagagugaugu

SEQ ID NO: 1790312 - RNA, 15 nt, Homo sapiens
uauaauuucuguuca

SEQ ID NO: 1790313 - RNA, 20 nt, Homo sapiens
aagaucaagaaaugucucug

SEQ ID NO: 1790314 - RNA, 17 nt, Homo sapiens
gaggucagcacacauua

SEQ ID NO: 1790315 - RNA, 13 nt, Homo sapiens
auuccagcaauaa

SEQ ID NO: 1790316 - RNA, 23 nt, Homo sapiens
aguuuaauuuuugaaaacuggcu

SEQ ID NO: 1790317 - RNA, 17 nt, Homo sapiens
aaaguguugaccacaga

SEQ ID NO: 1790318 - RNA, 14 nt, Homo sapiens
ugauuuuguaaaag

SEQ ID NO: 1790319 - RNA, 14 nt, Homo sapiens
cuaucuacaaugug

SEQ ID NO: 1790320 - RNA, 23 nt, Homo sapiens
gaagguuuccugguccaucucau

SEQ ID NO: 1790321 - RNA, 9 nt, Homo sapiens
ucccagugc

SEQ ID NO: 1790322 - RNA, 20 nt, Homo sapiens
cuaacaugacaguauuccau

SEQ ID NO: 1790323 - RNA, 13 nt, Homo sapiens
gacaagacaauga

SEQ ID NO: 1790324 - RNA, 17 nt, Homo sapiens
gccuggcaggccagugu

SEQ ID NO: 1790325 - RNA, 17 nt, Homo sapiens
aacugcccagagccaca

SEQ ID NO: 1790326 - RNA, 14 nt, Homo sapiens
agccaaacaaaggc

SEQ ID NO: 1790327 - RNA, 13 nt, Homo sapiens
gccaaacccagcc

SEQ ID NO: 1790328 - RNA, 18 nt, Homo sapiens
caaacaugcauccauuua

SEQ ID NO: 1790329 - RNA, 14 nt, Homo sapiens
uguaaaacauucac

SEQ ID NO: 1790330 - RNA, 13 nt, Homo sapiens
uguaaaccaaaua

SEQ ID NO: 1790331 - RNA, 12 nt, Homo sapiens
gacaaaugugaa

SEQ ID NO: 1790332 - RNA, 12 nt, Homo sapiens
ugccaauggaac

SEQ ID NO: 1790333 - RNA, 20 nt, Homo sapiens
uagaauugugguucccuaaa

SEQ ID NO: 1790334 - RNA, 23 nt, Homo sapiens
caagaauucuguuuccuaggcaa

SEQ ID NO: 1790335 - RNA, 13 nt, Homo sapiens
gccucacuggggc

SEQ ID NO: 1790336 - RNA, 16 nt, Homo sapiens
uucucauccuuugcca

SEQ ID NO: 1790337 - RNA, 20 nt, Homo sapiens
uagaauugaauuuacauaua

SEQ ID NO: 1790338 - RNA, 16 nt, Homo sapiens
ccacaguaauugguca

SEQ ID NO: 1790339 - RNA, 18 nt, Homo sapiens
agacagauuaccaaagaa

SEQ ID NO: 1790340 - RNA, 22 nt, Homo sapiens
uggaaacauucaggagcuuccu

SEQ ID NO: 1790341 - RNA, 21 nt, Homo sapiens
uccccagccccuccucccuca

SEQ ID NO: 1790342 - RNA, 18 nt, Homo sapiens
accauauucagcauuuga

SEQ ID NO: 1790343 - RNA, 18 nt, Homo sapiens
aaucugagagucauucag

SEQ ID NO: 1790344 - RNA, 15 nt, Homo sapiens
augaauguaugugca

SEQ ID NO: 1790345 - RNA, 21 nt, Homo sapiens
ccuggacaaccagaggagaua

SEQ ID NO: 1790346 - RNA, 19 nt, Homo sapiens
gacagaugccacacaagga

SEQ ID NO: 1790347 - RNA, 19 nt, Homo sapiens
uagagcaaagacuuaauca

SEQ ID NO: 1790348 - RNA, 15 nt, Homo sapiens
aagcgaccaaggaug

SEQ ID NO: 1790349 - RNA, 23 nt, Homo sapiens
ugugccaggaggcggcagcucuu

SEQ ID NO: 1790350 - RNA, 13 nt, Homo sapiens
ggcaaucuuugcc

SEQ ID NO: 1790351 - RNA, 13 nt, Homo sapiens
uuggaggcuccaa

SEQ ID NO: 1790352 - RNA, 22 nt, Homo sapiens
cucaaccuccugggcuaaguga

SEQ ID NO: 1790353 - RNA, 20 nt, Homo sapiens
ugacuaaugaggcauuacaa

SEQ ID NO: 1790354 - RNA, 18 nt, Homo sapiens
agcuucuagcagcuaagg

SEQ ID NO: 1790355 - RNA, 18 nt, Homo sapiens
ccaauaucccuuacuuua

SEQ ID NO: 1790356 - RNA, 11 nt, Homo sapiens
gaaguguaauu

SEQ ID NO: 1790357 - RNA, 20 nt, Homo sapiens
aggcuuuggguggcucacua

SEQ ID NO: 1790358 - RNA, 12 nt, Homo sapiens
aaagaaaacugg

SEQ ID NO: 1790359 - RNA, 23 nt, Homo sapiens
cuucccaagcccuggugaccaga

SEQ ID NO: 1790360 - RNA, 20 nt, Homo sapiens
uggcuauugaccaugugguu

SEQ ID NO: 1790361 - RNA, 18 nt, Homo sapiens
uucacuaccaagcagcuc

SEQ ID NO: 1790362 - RNA, 14 nt, Homo sapiens
ucccuaaauauaca

SEQ ID NO: 1790363 - RNA, 13 nt, Homo sapiens
ugagcaugugaug

SEQ ID NO: 1790364 - RNA, 15 nt, Homo sapiens
augccccaucccaug

SEQ ID NO: 1790365 - RNA, 13 nt, Homo sapiens
auuuagagaugau

SEQ ID NO: 1790366 - RNA, 22 nt, Homo sapiens
aagcgaacaaaaaguaauguau

SEQ ID NO: 1790367 - RNA, 16 nt, Homo sapiens
gucauuauaagagaaa

SEQ ID NO: 1790368 - RNA, 16 nt, Homo sapiens
auaguuuacugagaau

SEQ ID NO: 1790369 - RNA, 14 nt, Homo sapiens
cuggaaaauuccag

SEQ ID NO: 1790370 - RNA, 22 nt, Homo sapiens
uguaguccguuaacacuacuua

SEQ ID NO: 1790371 - RNA, 19 nt, Homo sapiens
aaucaagagugaacaugua

SEQ ID NO: 1790372 - RNA, 19 nt, Homo sapiens
ggcuaaacaagggcaguga

SEQ ID NO: 1790373 - RNA, 14 nt, Homo sapiens
augagccaaagaac

SEQ ID NO: 1790374 - RNA, 21 nt, Homo sapiens
ggaggaguuuaaacugaauga

SEQ ID NO: 1790375 - RNA, 15 nt, Homo sapiens
gcugagagaaccuca

SEQ ID NO: 1790376 - RNA, 22 nt, Homo sapiens
ugccuuuuuuucucugcauuua

SEQ ID NO: 1790377 - RNA, 15 nt, Homo sapiens
ggaccccaucuguga

SEQ ID NO: 1790378 - RNA, 14 nt, Homo sapiens
agcccagagaccuu

SEQ ID NO: 1790379 - RNA, 18 nt, Homo sapiens
cuucacagugacacugga

SEQ ID NO: 1790380 - RNA, 18 nt, Homo sapiens
aucugccaagcuccucaa

SEQ ID NO: 1790381 - RNA, 23 nt, Homo sapiens
cagucaauauguuggaggcaugc

SEQ ID NO: 1790382 - RNA, 15 nt, Homo sapiens
acaucuuaccucuca

SEQ ID NO: 1790383 - RNA, 18 nt, Homo sapiens
caggaaaugugcacaaaa

SEQ ID NO: 1790384 - RNA, 16 nt, Homo sapiens
ucuccuuacagucacu

SEQ ID NO: 1790385 - RNA, 22 nt, Homo sapiens
gcaauugcucuucuccacgucu

SEQ ID NO: 1790386 - RNA, 19 nt, Homo sapiens
gaacucugguggcacagga

SEQ ID NO: 1790387 - RNA, 16 nt, Homo sapiens
aaugagccuuucugcc

SEQ ID NO: 1790388 - RNA, 16 nt, Homo sapiens
uugguccuaagcaccu

SEQ ID NO: 1790389 - RNA, 20 nt, Homo sapiens
ucugcuuaaucugagaauca

SEQ ID NO: 1790390 - RNA, 23 nt, Homo sapiens
aaguuuuuauggcuuuugugcau

SEQ ID NO: 1790391 - RNA, 15 nt, Homo sapiens
gucuuaucauuugaa

SEQ ID NO: 1790392 - RNA, 18 nt, Homo sapiens
cuacacagcacaccagcc

SEQ ID NO: 1790393 - RNA, 20 nt, Homo sapiens
gcaacuuuaguuuguguuau

SEQ ID NO: 1790394 - RNA, 23 nt, Homo sapiens
gcauaccuggauuuccuuggcuu

SEQ ID NO: 1790395 - RNA, 20 nt, Homo sapiens
gguauauuucuggguucuca

SEQ ID NO: 1790396 - RNA, 21 nt, Homo sapiens
uugcccacacuugggagcaaa

SEQ ID NO: 1790397 - RNA, 20 nt, Homo sapiens
ugagccuuggcccacacuga

SEQ ID NO: 1790398 - RNA, 20 nt, Homo sapiens
cugaugugggagcugaacca

SEQ ID NO: 1790399 - RNA, 16 nt, Homo sapiens
gaacuaacugccaugu

SEQ ID NO: 1790400 - RNA, 17 nt, Homo sapiens
aacuagcaaugccugag

SEQ ID NO: 1790401 - RNA, 17 nt, Homo sapiens
agucucuuucucugaca

SEQ ID NO: 1790402 - RNA, 21 nt, Homo sapiens
acugccucauggcaucaucca

SEQ ID NO: 1790403 - RNA, 22 nt, Homo sapiens
gauuagugccuucugcccuccc

SEQ ID NO: 1790404 - RNA, 13 nt, Homo sapiens
uacucugugcaag

SEQ ID NO: 1790405 - RNA, 19 nt, Homo sapiens
cuuaaaagguuaaauuuca

SEQ ID NO: 1790406 - RNA, 21 nt, Homo sapiens
ggagaaaggaguuuugcaaag

SEQ ID NO: 1790407 - RNA, 14 nt, Homo sapiens
accagucacugucc

SEQ ID NO: 1790408 - RNA, 14 nt, Homo sapiens
aauaaacucaguca

SEQ ID NO: 1790409 - RNA, 14 nt, Homo sapiens
aauuaacucagaca

SEQ ID NO: 1790410 - RNA, 14 nt, Homo sapiens
auuacacucuguaa

SEQ ID NO: 1790411 - RNA, 19 nt, Homo sapiens
uacaugccucagugaagga

SEQ ID NO: 1790412 - RNA, 14 nt, Homo sapiens
ggcaccaaacacug

SEQ ID NO: 1790413 - RNA, 13 nt, Homo sapiens
ggcaugcuuuauu

SEQ ID NO: 1790414 - RNA, 15 nt, Homo sapiens
uaagugguuacuuug

SEQ ID NO: 1790415 - RNA, 11 nt, Homo sapiens
agacuguugaa

SEQ ID NO: 1790416 - RNA, 19 nt, Homo sapiens
uagaaaaaaacaugaauuu

SEQ ID NO: 1790417 - RNA, 20 nt, Homo sapiens
agacacacacauauauacau

SEQ ID NO: 1790418 - RNA, 17 nt, Homo sapiens
cuugcaguugcucugac

SEQ ID NO: 1790419 - RNA, 19 nt, Homo sapiens
uugugugcuuuacuacaca

SEQ ID NO: 1790420 - RNA, 16 nt, Homo sapiens
gcugagccucagucuc

SEQ ID NO: 1790421 - RNA, 15 nt, Homo sapiens
guugcugcaucuccc

SEQ ID NO: 1790422 - RNA, 14 nt, Homo sapiens
auuccaaguguaua

SEQ ID NO: 1790423 - RNA, 13 nt, Homo sapiens
uagguuaacaaua

SEQ ID NO: 1790424 - RNA, 17 nt, Homo sapiens
uguaggaagguacugua

SEQ ID NO: 1790425 - RNA, 18 nt, Homo sapiens
gaccaguuuuguaucaaa

SEQ ID NO: 1790426 - RNA, 18 nt, Homo sapiens
ugaauccucucucugugu

SEQ ID NO: 1790427 - RNA, 23 nt, Homo sapiens
aguggcucacaccuguaauccca

SEQ ID NO: 1790428 - RNA, 22 nt, Homo sapiens
cacugucugagaauuuccaaaa

SEQ ID NO: 1790429 - RNA, 21 nt, Homo sapiens
gcacauauccaggcaccagga

SEQ ID NO: 1790430 - RNA, 15 nt, Homo sapiens
gggcucagccuagug

SEQ ID NO: 1790431 - RNA, 20 nt, Homo sapiens
ugacuaaaccauugugcauu

SEQ ID NO: 1790432 - RNA, 14 nt, Homo sapiens
uuugcugguuucau

SEQ ID NO: 1790433 - RNA, 16 nt, Homo sapiens
uuaaauagcuucagaa

SEQ ID NO: 1790434 - RNA, 16 nt, Homo sapiens
accuggggagagccug

SEQ ID NO: 1790435 - RNA, 18 nt, Homo sapiens
ucugacgcagccugagaa

SEQ ID NO: 1790436 - RNA, 13 nt, Homo sapiens
uguuucagagcau

SEQ ID NO: 1790437 - RNA, 16 nt, Homo sapiens
uuucugaggaguaaaa

SEQ ID NO: 1790438 - RNA, 19 nt, Homo sapiens
gggaccgaaagcaaagguu

SEQ ID NO: 1790439 - RNA, 18 nt, Homo sapiens
guccacagggcagccuga

SEQ ID NO: 1790440 - RNA, 15 nt, Homo sapiens
ccugcacgccaccgc

SEQ ID NO: 1790441 - RNA, 21 nt, Homo sapiens
cauaucuggagccugaugucu

SEQ ID NO: 1790442 - RNA, 21 nt, Homo sapiens
gccccuguucucuuccacucu

SEQ ID NO: 1790443 - RNA, 15 nt, Homo sapiens
aagaauuacuugugu

SEQ ID NO: 1790444 - RNA, 20 nt, Homo sapiens
acagagguggcugcugugcu

SEQ ID NO: 1790445 - RNA, 20 nt, Homo sapiens
gugugccauagaguuuaaca

SEQ ID NO: 1790446 - RNA, 20 nt, Homo sapiens
guaaacuucugaagacugag

SEQ ID NO: 1790447 - RNA, 20 nt, Homo sapiens
cauuguaaacaaacugugua

SEQ ID NO: 1790448 - RNA, 20 nt, Homo sapiens
gccauagaggcccaggcacc

SEQ ID NO: 1790449 - RNA, 19 nt, Homo sapiens
auggauuugaaguuugcca

SEQ ID NO: 1790450 - RNA, 15 nt, Homo sapiens
ggcugucugugccau

SEQ ID NO: 1790451 - RNA, 11 nt, Homo sapiens
acaugugaugu

SEQ ID NO: 1790452 - RNA, 14 nt, Homo sapiens
gcugagugaguuca

SEQ ID NO: 1790453 - RNA, 15 nt, Homo sapiens
uaggcauauaucacu

SEQ ID NO: 1790454 - RNA, 17 nt, Homo sapiens
caguuaccacacaucua

SEQ ID NO: 1790455 - RNA, 14 nt, Homo sapiens
gcugccacugggca

SEQ ID NO: 1790456 - RNA, 16 nt, Homo sapiens
augagguugagcuaug

SEQ ID NO: 1790457 - RNA, 18 nt, Homo sapiens
acuguuucuugcacugaa

SEQ ID NO: 1790458 - RNA, 16 nt, Homo sapiens
ccucacccacuuuggc

SEQ ID NO: 1790459 - RNA, 20 nt, Homo sapiens
uuacuugaggaucauaugaa

SEQ ID NO: 1790460 - RNA, 15 nt, Homo sapiens
cucgugggacaguca

SEQ ID NO: 1790461 - RNA, 20 nt, Homo sapiens
ucccucuaagcacauuccaa

SEQ ID NO: 1790462 - RNA, 14 nt, Homo sapiens
aauuugauacauaa

SEQ ID NO: 1790463 - RNA, 15 nt, Homo sapiens
aacaucuacaaucag

SEQ ID NO: 1790464 - RNA, 13 nt, Homo sapiens
gugauaagucauu

SEQ ID NO: 1790465 - RNA, 19 nt, Homo sapiens
ucuaggccaccccaaccuc

SEQ ID NO: 1790466 - RNA, 21 nt, Homo sapiens
cuaauuauaugggaaccagaa

SEQ ID NO: 1790467 - RNA, 17 nt, Homo sapiens
ggugcccucucacuuga

SEQ ID NO: 1790468 - RNA, 14 nt, Homo sapiens
cacagcagcaauug

SEQ ID NO: 1790469 - RNA, 14 nt, Homo sapiens
uagauuaggauuaa

SEQ ID NO: 1790470 - RNA, 17 nt, Homo sapiens
auugaagaaaagcacuu

SEQ ID NO: 1790471 - RNA, 14 nt, Homo sapiens
aguccuuucaggaa

SEQ ID NO: 1790472 - RNA, 22 nt, Homo sapiens
accuagagggcccccuacuugu

SEQ ID NO: 1790473 - RNA, 18 nt, Homo sapiens
ugaacaaucaaagcacuu

SEQ ID NO: 1790474 - RNA, 16 nt, Homo sapiens
uaguaacauagacaaa

SEQ ID NO: 1790475 - RNA, 16 nt, Homo sapiens
agaaauaaagaucuca

SEQ ID NO: 1790476 - RNA, 14 nt, Homo sapiens
ucauuugaguuuag

SEQ ID NO: 1790477 - RNA, 22 nt, Homo sapiens
gcccaaucucugccauaucagu

SEQ ID NO: 1790478 - RNA, 20 nt, Homo sapiens
agccgguggugcccgugccc

SEQ ID NO: 1790479 - RNA, 18 nt, Homo sapiens
auaaaccaguugaaucau

SEQ ID NO: 1790480 - RNA, 22 nt, Homo sapiens
ucugacagaaagcagauaccuc

SEQ ID NO: 1790481 - RNA, 16 nt, Homo sapiens
ggagccaccuguccca

SEQ ID NO: 1790482 - RNA, 23 nt, Homo sapiens
aaagugcugggauuacaggugug

SEQ ID NO: 1790483 - RNA, 18 nt, Homo sapiens
acccaugauacuccacuc

SEQ ID NO: 1790484 - RNA, 19 nt, Homo sapiens
gaaucaucucaaauccuug

SEQ ID NO: 1790485 - RNA, 23 nt, Homo sapiens
ugauacgacagcucucugugcac

SEQ ID NO: 1790486 - RNA, 19 nt, Homo sapiens
gcagagacgggguuugcca

SEQ ID NO: 1790487 - RNA, 11 nt, Homo sapiens
gaacauaaaaa

SEQ ID NO: 1790488 - RNA, 23 nt, Homo sapiens
cuccuagauauauauucaacaga

SEQ ID NO: 1790489 - RNA, 14 nt, Homo sapiens
aaagugggcuugau

SEQ ID NO: 1790490 - RNA, 17 nt, Homo sapiens
aagacaacaggcauuuu

SEQ ID NO: 1790491 - RNA, 20 nt, Homo sapiens
gaauguuagauuccucuugc

SEQ ID NO: 1790492 - RNA, 22 nt, Homo sapiens
aggaauauauggcagaguugua

SEQ ID NO: 1790493 - RNA, 13 nt, Homo sapiens
caagaacuauaua

SEQ ID NO: 1790494 - RNA, 12 nt, Homo sapiens
caaagagacagc

SEQ ID NO: 1790495 - RNA, 14 nt, Homo sapiens
gaaauugaaccugg

SEQ ID NO: 1790496 - RNA, 19 nt, Homo sapiens
auaaaaagauaaucucagu

SEQ ID NO: 1790497 - RNA, 19 nt, Homo sapiens
gucacacucuacacggacu

SEQ ID NO: 1790498 - RNA, 16 nt, Homo sapiens
uaguugggucugaaag

SEQ ID NO: 1790499 - RNA, 19 nt, Homo sapiens
agcccggacugaccaaauc

SEQ ID NO: 1790500 - RNA, 19 nt, Homo sapiens
ggcuaaaugaaguguguua

SEQ ID NO: 1790501 - RNA, 23 nt, Homo sapiens
caaaauccaugugaccauucugc

SEQ ID NO: 1790502 - RNA, 20 nt, Homo sapiens
auccuguguucauggaucag

SEQ ID NO: 1790503 - RNA, 23 nt, Homo sapiens
guacaacuucugggccucucuug

SEQ ID NO: 1790504 - RNA, 22 nt, Homo sapiens
caugguggugagcaccuguaau

SEQ ID NO: 1790505 - RNA, 21 nt, Homo sapiens
caaaauaaaaggacucuggaa

SEQ ID NO: 1790506 - RNA, 24 nt, Homo sapiens
ugcagcccccugcuucucccgcca

SEQ ID NO: 1790507 - RNA, 15 nt, Homo sapiens
agggagacugcaucu

SEQ ID NO: 1790508 - RNA, 20 nt, Homo sapiens
cacugaaaccucuguucuca

SEQ ID NO: 1790509 - RNA, 15 nt, Homo sapiens
ucuuucccaccaaac

SEQ ID NO: 1790510 - RNA, 19 nt, Homo sapiens
aaauauugugcuuacucaa

SEQ ID NO: 1790511 - RNA, 12 nt, Homo sapiens
aaucucuugucu

SEQ ID NO: 1790512 - RNA, 12 nt, Homo sapiens
ccuggcacugga

SEQ ID NO: 1790513 - RNA, 19 nt, Homo sapiens
ucuccaggccccaggucau

SEQ ID NO: 1790514 - RNA, 20 nt, Homo sapiens
ucaaagacaaucacugaaac

SEQ ID NO: 1790515 - RNA, 18 nt, Homo sapiens
gccuccucccuggcugca

SEQ ID NO: 1790516 - RNA, 22 nt, Homo sapiens
cauuuuggauucuuauggacaa

SEQ ID NO: 1790517 - RNA, 17 nt, Homo sapiens
ccuaaagaaaacaaaca

SEQ ID NO: 1790518 - RNA, 22 nt, Homo sapiens
agggagaccccaaaaagagaga

SEQ ID NO: 1790519 - RNA, 16 nt, Homo sapiens
gaaauaacauugcacu

SEQ ID NO: 1790520 - RNA, 16 nt, Homo sapiens
cugaaagcacaugaau

SEQ ID NO: 1790521 - RNA, 16 nt, Homo sapiens
uauugauaaguucaua

SEQ ID NO: 1790522 - RNA, 16 nt, Homo sapiens
uguggcuaaaugccua

SEQ ID NO: 1790523 - RNA, 14 nt, Homo sapiens
uaaaauaaguucuu

SEQ ID NO: 1790524 - RNA, 13 nt, Homo sapiens
uggagacagggca

SEQ ID NO: 1790525 - RNA, 17 nt, Homo sapiens
uaaagguccuggcaaag

SEQ ID NO: 1790526 - RNA, 23 nt, Homo sapiens
auccauuuccaaaccuccacugc

SEQ ID NO: 1790527 - RNA, 16 nt, Homo sapiens
ggcacugccaugcagg

SEQ ID NO: 1790528 - RNA, 15 nt, Homo sapiens
cacagucauguguca

SEQ ID NO: 1790529 - RNA, 23 nt, Homo sapiens
cacacaauguggacgugcacuga

SEQ ID NO: 1790530 - RNA, 19 nt, Homo sapiens
gccaccccggugucauccc

SEQ ID NO: 1790531 - RNA, 21 nt, Homo sapiens
cuauuuauaaguugaagaaag

SEQ ID NO: 1790532 - RNA, 13 nt, Homo sapiens
cagggaaaugccu

SEQ ID NO: 1790533 - RNA, 20 nt, Homo sapiens
ucaucccagucugauauuca

SEQ ID NO: 1790534 - RNA, 22 nt, Homo sapiens
gccuucugggaagggagagggc

SEQ ID NO: 1790535 - RNA, 15 nt, Homo sapiens
cuguaauuccagcua

SEQ ID NO: 1790536 - RNA, 16 nt, Homo sapiens
aacuggcagcuuugaa

SEQ ID NO: 1790537 - RNA, 16 nt, Homo sapiens
uggcacaggagacucc

SEQ ID NO: 1790538 - RNA, 16 nt, Homo sapiens
aaugguaauuguugcu

SEQ ID NO: 1790539 - RNA, 17 nt, Homo sapiens
cuccaacccugccguca

SEQ ID NO: 1790540 - RNA, 21 nt, Homo sapiens
agcacaucuuugaccacguca

SEQ ID NO: 1790541 - RNA, 14 nt, Homo sapiens
uggugccaaaugaa

SEQ ID NO: 1790542 - RNA, 11 nt, Homo sapiens
ggcccacugug

SEQ ID NO: 1790543 - RNA, 11 nt, Homo sapiens
ugcccacuuug

SEQ ID NO: 1790544 - RNA, 16 nt, Homo sapiens
cccauauggucaucca

SEQ ID NO: 1790545 - RNA, 20 nt, Homo sapiens
uggauuugcauacauucuuc

SEQ ID NO: 1790546 - RNA, 18 nt, Homo sapiens
cugccccacaugcauguc

SEQ ID NO: 1790547 - RNA, 15 nt, Homo sapiens
ggccuuuuuugccag

SEQ ID NO: 1790548 - RNA, 14 nt, Homo sapiens
agggcgcaaagggc

SEQ ID NO: 1790549 - RNA, 14 nt, Homo sapiens
agaaggcaaaaacc

SEQ ID NO: 1790550 - RNA, 21 nt, Homo sapiens
uaagaagccuuaccacgcagu

SEQ ID NO: 1790551 - RNA, 21 nt, Homo sapiens
aaggauuuucauguugaugac

SEQ ID NO: 1790552 - RNA, 18 nt, Homo sapiens
aagggcauuuuguacaau

SEQ ID NO: 1790553 - RNA, 17 nt, Homo sapiens
auuaauaaauuuuaaca

SEQ ID NO: 1790554 - RNA, 16 nt, Homo sapiens
cuuccuccccauguca

SEQ ID NO: 1790555 - RNA, 14 nt, Homo sapiens
ugcaaaaguucuca

SEQ ID NO: 1790556 - RNA, 17 nt, Homo sapiens
ucaccauguuagccuua

SEQ ID NO: 1790557 - RNA, 19 nt, Homo sapiens
ccauggaaguuuauuucca

SEQ ID NO: 1790558 - RNA, 13 nt, Homo sapiens
guauaucagcucu

SEQ ID NO: 1790559 - RNA, 19 nt, Homo sapiens
cucucccgaaggagaucuc

SEQ ID NO: 1790560 - RNA, 16 nt, Homo sapiens
uagagccccuacugug

SEQ ID NO: 1790561 - RNA, 18 nt, Homo sapiens
cccagccgaaaagcuuuu

SEQ ID NO: 1790562 - RNA, 20 nt, Homo sapiens
aaggaauguguccaagacac

SEQ ID NO: 1790563 - RNA, 13 nt, Homo sapiens
caagggacaguga

SEQ ID NO: 1790564 - RNA, 14 nt, Homo sapiens
uccagugacuuuca

SEQ ID NO: 1790565 - RNA, 17 nt, Homo sapiens
uaaagaaaaaagcacca

SEQ ID NO: 1790566 - RNA, 18 nt, Homo sapiens
uguuaauuuuuuuuacua

SEQ ID NO: 1790567 - RNA, 17 nt, Homo sapiens
uacugcuugaccaaaga

SEQ ID NO: 1790568 - RNA, 22 nt, Homo sapiens
auggcggcccccccagcuguca

SEQ ID NO: 1790569 - RNA, 20 nt, Homo sapiens
ucuggcugaacccugugcug

SEQ ID NO: 1790570 - RNA, 18 nt, Homo sapiens
uccuaaugcuugcugcug

SEQ ID NO: 1790571 - RNA, 15 nt, Homo sapiens
auugguguugccagu

SEQ ID NO: 1790572 - RNA, 16 nt, Homo sapiens
ucauguucugugcaua

SEQ ID NO: 1790573 - RNA, 16 nt, Homo sapiens
cucagauggcagcuuu

SEQ ID NO: 1790574 - RNA, 14 nt, Homo sapiens
caagccccacugag

SEQ ID NO: 1790575 - RNA, 12 nt, Homo sapiens
aagacauuugaa

SEQ ID NO: 1790576 - RNA, 21 nt, Homo sapiens
gaacucaaggaaaucuguguc

SEQ ID NO: 1790577 - RNA, 19 nt, Homo sapiens
cauuuucuuucccagaagc

SEQ ID NO: 1790578 - RNA, 15 nt, Homo sapiens
aggaaauaauugcca

SEQ ID NO: 1790579 - RNA, 24 nt, Homo sapiens
gggagaaacaggcgcggggucuca

SEQ ID NO: 1790580 - RNA, 14 nt, Homo sapiens
auaaaguuccuuaa

SEQ ID NO: 1790581 - RNA, 17 nt, Homo sapiens
gugccacuggaccucag

SEQ ID NO: 1790582 - RNA, 21 nt, Homo sapiens
aacuucaacguaagacugugu

SEQ ID NO: 1790583 - RNA, 21 nt, Homo sapiens
uggccacacugugacacacua

SEQ ID NO: 1790584 - RNA, 23 nt, Homo sapiens
caaaccuguucaucuugccaaga

SEQ ID NO: 1790585 - RNA, 18 nt, Homo sapiens
cuuagcccacaguucucc

SEQ ID NO: 1790586 - RNA, 14 nt, Homo sapiens
acuguuccaaagcc

SEQ ID NO: 1790587 - RNA, 15 nt, Homo sapiens
uccuuuaaucacugc

SEQ ID NO: 1790588 - RNA, 20 nt, Homo sapiens
augccaugaggaacaaggca

SEQ ID NO: 1790589 - RNA, 16 nt, Homo sapiens
uucugauaaugcauua

SEQ ID NO: 1790590 - RNA, 17 nt, Homo sapiens
acaaaagccugugcagg

SEQ ID NO: 1790591 - RNA, 22 nt, Homo sapiens
uacagauccgcaugugucugua

SEQ ID NO: 1790592 - RNA, 11 nt, Homo sapiens
agggugacuga

SEQ ID NO: 1790593 - RNA, 20 nt, Homo sapiens
acaucccucucugcuggacg

SEQ ID NO: 1790594 - RNA, 14 nt, Homo sapiens
ggcggcccggccag

SEQ ID NO: 1790595 - RNA, 18 nt, Homo sapiens
uuuacugcuugcuuucca

SEQ ID NO: 1790596 - RNA, 21 nt, Homo sapiens
agaaugauuuuacggagauau

SEQ ID NO: 1790597 - RNA, 17 nt, Homo sapiens
uuguaccaaaagaucuc

SEQ ID NO: 1790598 - RNA, 17 nt, Homo sapiens
guuugaagacuacauga

SEQ ID NO: 1790599 - RNA, 16 nt, Homo sapiens
uccaucaacacugcgc

SEQ ID NO: 1790600 - RNA, 21 nt, Homo sapiens
ugaaucagauguguguucuca

SEQ ID NO: 1790601 - RNA, 18 nt, Homo sapiens
uugcagcuuuauguucau

SEQ ID NO: 1790602 - RNA, 17 nt, Homo sapiens
gcaucauuaguacaucu

SEQ ID NO: 1790603 - RNA, 23 nt, Homo sapiens
cuccccgggggcagacaccugug

SEQ ID NO: 1790604 - RNA, 16 nt, Homo sapiens
cccacaaguauugccc

SEQ ID NO: 1790605 - RNA, 18 nt, Homo sapiens
ucaucccuuaauaaaaua

SEQ ID NO: 1790606 - RNA, 21 nt, Homo sapiens
auucuguguucacaugugugg

SEQ ID NO: 1790607 - RNA, 18 nt, Homo sapiens
aacaugaaaaacagguga

SEQ ID NO: 1790608 - RNA, 14 nt, Homo sapiens
acuuaaagcacuga

SEQ ID NO: 1790609 - RNA, 17 nt, Homo sapiens
ugcuguccaugcuucuc

SEQ ID NO: 1790610 - RNA, 15 nt, Homo sapiens
cucaugcgcaaugag

SEQ ID NO: 1790611 - RNA, 18 nt, Homo sapiens
aguauugcgaaugugcag

SEQ ID NO: 1790612 - RNA, 20 nt, Homo sapiens
uaaguggacuggugucauaa

SEQ ID NO: 1790613 - RNA, 14 nt, Homo sapiens
uaucuuaucuugcu

SEQ ID NO: 1790614 - RNA, 21 nt, Homo sapiens
uacuuuaaauccuaccaaagu

SEQ ID NO: 1790615 - RNA, 19 nt, Homo sapiens
ugcucagcuccuaccucug

SEQ ID NO: 1790616 - RNA, 17 nt, Homo sapiens
ccauuucuuaccaugca

SEQ ID NO: 1790617 - RNA, 20 nt, Homo sapiens
aguccccagccugcucccua

SEQ ID NO: 1790618 - RNA, 22 nt, Homo sapiens
uggccuccccugccaccaggcc

SEQ ID NO: 1790619 - RNA, 16 nt, Homo sapiens
gcuuucccugccacau

SEQ ID NO: 1790620 - RNA, 15 nt, Homo sapiens
cgagccgagcucucc

SEQ ID NO: 1790621 - RNA, 14 nt, Homo sapiens
acugugcuccucac

SEQ ID NO: 1790622 - RNA, 20 nt, Homo sapiens
ugguuuggaguuuauuugag

SEQ ID NO: 1790623 - RNA, 12 nt, Homo sapiens
uacucaaauggu

SEQ ID NO: 1790624 - RNA, 22 nt, Homo sapiens
aggaacccagccagaguuugcc

SEQ ID NO: 1790625 - RNA, 17 nt, Homo sapiens
ucccuggaaagcaggca

SEQ ID NO: 1790626 - RNA, 21 nt, Homo sapiens
acaauaauauuucaagugccu

SEQ ID NO: 1790627 - RNA, 22 nt, Homo sapiens
auccgucuaguuaacauuucaa

SEQ ID NO: 1790628 - RNA, 20 nt, Homo sapiens
agaggaaacugaaguucuga

SEQ ID NO: 1790629 - RNA, 13 nt, Homo sapiens
acaagacacagug

SEQ ID NO: 1790630 - RNA, 20 nt, Homo sapiens
ugaaccgaggggcucaggaa

SEQ ID NO: 1790631 - RNA, 23 nt, Homo sapiens
uccagccuggcucuaucuuccuc

SEQ ID NO: 1790632 - RNA, 22 nt, Homo sapiens
acucucacccauaaacaguaau

SEQ ID NO: 1790633 - RNA, 22 nt, Homo sapiens
cuucuguuucuucucuugguga

SEQ ID NO: 1790634 - RNA, 17 nt, Homo sapiens
ugcaugcacuucuuaca

SEQ ID NO: 1790635 - RNA, 17 nt, Homo sapiens
caagcuuaauaugugcu

SEQ ID NO: 1790636 - RNA, 21 nt, Homo sapiens
ucaguaccccugguaaaccaa

SEQ ID NO: 1790637 - RNA, 13 nt, Homo sapiens
gaaauuuugcacc

SEQ ID NO: 1790638 - RNA, 22 nt, Homo sapiens
cugagucugugaauaaagccac

SEQ ID NO: 1790639 - RNA, 14 nt, Homo sapiens
uuuaggaaacucac

SEQ ID NO: 1790640 - RNA, 13 nt, Homo sapiens
gccugcagccucc

SEQ ID NO: 1790641 - RNA, 17 nt, Homo sapiens
gggugggccccacagug

SEQ ID NO: 1790642 - RNA, 22 nt, Homo sapiens
uugccugaaacccauuuacuua

SEQ ID NO: 1790643 - RNA, 15 nt, Homo sapiens
ugagagcccagucau

SEQ ID NO: 1790644 - RNA, 22 nt, Homo sapiens
uuaacagcgugucaacuuucau

SEQ ID NO: 1790645 - RNA, 16 nt, Homo sapiens
aguuaauaaaaaucuc

SEQ ID NO: 1790646 - RNA, 21 nt, Homo sapiens
gcaagguauuacacucuguaa

SEQ ID NO: 1790647 - RNA, 15 nt, Homo sapiens
auuaauagcauucga

SEQ ID NO: 1790648 - RNA, 19 nt, Homo sapiens
uuugucacuaaacucucau

SEQ ID NO: 1790649 - RNA, 19 nt, Homo sapiens
uuuuggcccaaucucugcc

SEQ ID NO: 1790650 - RNA, 15 nt, Homo sapiens
guuucacugccaacu

SEQ ID NO: 1790651 - RNA, 12 nt, Homo sapiens
cugagagaucug

SEQ ID NO: 1790652 - RNA, 20 nt, Homo sapiens
ugccucgaggggcccaggga

SEQ ID NO: 1790653 - RNA, 15 nt, Homo sapiens
aauauguuaagggcu

SEQ ID NO: 1790654 - RNA, 14 nt, Homo sapiens
gcaggcagccccac

SEQ ID NO: 1790655 - RNA, 13 nt, Homo sapiens
gguaauaagccaa

SEQ ID NO: 1790656 - RNA, 21 nt, Homo sapiens
cccuuguguuccuucugugaa

SEQ ID NO: 1790657 - RNA, 16 nt, Homo sapiens
ccugguacucaagccc

SEQ ID NO: 1790658 - RNA, 16 nt, Homo sapiens
uugggccuugcuaaau

SEQ ID NO: 1790659 - RNA, 15 nt, Homo sapiens
uauacguauaaauau

SEQ ID NO: 1790660 - RNA, 20 nt, Homo sapiens
auuuugcacuguagauuuaa

SEQ ID NO: 1790661 - RNA, 19 nt, Homo sapiens
gcaauuacaauacaucuaa

SEQ ID NO: 1790662 - RNA, 16 nt, Homo sapiens
guauucacuuauaugu

SEQ ID NO: 1790663 - RNA, 15 nt, Homo sapiens
uguaucugacaaaag

SEQ ID NO: 1790664 - RNA, 19 nt, Homo sapiens
ucacuuucauucaauuugc

SEQ ID NO: 1790665 - RNA, 13 nt, Homo sapiens
acauugugaaaag

SEQ ID NO: 1790666 - RNA, 13 nt, Homo sapiens
cacaugugcccug

SEQ ID NO: 1790667 - RNA, 20 nt, Homo sapiens
aaacagggcaccccagcuga

SEQ ID NO: 1790668 - RNA, 21 nt, Homo sapiens
uccaaaacuuuaaugaacuaa

SEQ ID NO: 1790669 - RNA, 22 nt, Homo sapiens
gccucagaauaaaagaugauuu

SEQ ID NO: 1790670 - RNA, 18 nt, Homo sapiens
aagcacuccacaacucaa

SEQ ID NO: 1790671 - RNA, 15 nt, Homo sapiens
auuuuuccacuuaaa

SEQ ID NO: 1790672 - RNA, 16 nt, Homo sapiens
ucacgggaacucucca

SEQ ID NO: 1790673 - RNA, 14 nt, Homo sapiens
cagcccauaauuca

SEQ ID NO: 1790674 - RNA, 15 nt, Homo sapiens
cuguaauuccagcca

SEQ ID NO: 1790675 - RNA, 19 nt, Homo sapiens
acgggguuggcuguuccag

SEQ ID NO: 1790676 - RNA, 15 nt, Homo sapiens
caucgauugauaugc

SEQ ID NO: 1790677 - RNA, 19 nt, Homo sapiens
acguccuccguccauauca

SEQ ID NO: 1790678 - RNA, 14 nt, Homo sapiens
caaaagaaggucaa

SEQ ID NO: 1790679 - RNA, 18 nt, Homo sapiens
acaaucugcaaaauggag

SEQ ID NO: 1790680 - RNA, 14 nt, Homo sapiens
aucucaaccuaccu

SEQ ID NO: 1790681 - RNA, 19 nt, Homo sapiens
uucaaaaauggcuaggaag

SEQ ID NO: 1790682 - RNA, 17 nt, Homo sapiens
gggagguauucaguuga

SEQ ID NO: 1790683 - RNA, 15 nt, Homo sapiens
caaacacugcaggca

SEQ ID NO: 1790684 - RNA, 12 nt, Homo sapiens
gaaauacuuuug

SEQ ID NO: 1790685 - RNA, 21 nt, Homo sapiens
cccggccacgucugugcucug

SEQ ID NO: 1790686 - RNA, 12 nt, Homo sapiens
acagccaaaaca

SEQ ID NO: 1790687 - RNA, 15 nt, Homo sapiens
uuuuaauacagggac

SEQ ID NO: 1790688 - RNA, 14 nt, Homo sapiens
uaauaguccaauau

SEQ ID NO: 1790689 - RNA, 18 nt, Homo sapiens
uuugacaugagucuccag

SEQ ID NO: 1790690 - RNA, 20 nt, Homo sapiens
ucuucugggaacuuccucag

SEQ ID NO: 1790691 - RNA, 16 nt, Homo sapiens
cagcugcugacccucu

SEQ ID NO: 1790692 - RNA, 12 nt, Homo sapiens
cuuaguaaaauu

SEQ ID NO: 1790693 - RNA, 18 nt, Homo sapiens
gaaucucguugaggccaa

SEQ ID NO: 1790694 - RNA, 17 nt, Homo sapiens
cucaaugccauugugca

SEQ ID NO: 1790695 - RNA, 17 nt, Homo sapiens
cagcucuaagucucaac

SEQ ID NO: 1790696 - RNA, 15 nt, Homo sapiens
acaaugcugagguua

SEQ ID NO: 1790697 - RNA, 17 nt, Homo sapiens
gccccggucccccagag

SEQ ID NO: 1790698 - RNA, 16 nt, Homo sapiens
ccaucggcuuccauau

SEQ ID NO: 1790699 - RNA, 23 nt, Homo sapiens
gggacuguuccaaagccagugaa

SEQ ID NO: 1790700 - RNA, 23 nt, Homo sapiens
ucaguacuuguuucuaugcagau

SEQ ID NO: 1790701 - RNA, 19 nt, Homo sapiens
gaaucauauguuguaggaa

SEQ ID NO: 1790702 - RNA, 19 nt, Homo sapiens
ugccuggaacaccagcagc

SEQ ID NO: 1790703 - RNA, 19 nt, Homo sapiens
ccagcuggcccagugggua

SEQ ID NO: 1790704 - RNA, 17 nt, Homo sapiens
auugcaagcuccaucuc

SEQ ID NO: 1790705 - RNA, 14 nt, Homo sapiens
guuuccaaugccaa

SEQ ID NO: 1790706 - RNA, 13 nt, Homo sapiens
cugugucacuguc

SEQ ID NO: 1790707 - RNA, 16 nt, Homo sapiens
ugcaauugauauugcc

SEQ ID NO: 1790708 - RNA, 20 nt, Homo sapiens
cuccaguuuccaaguuccug

SEQ ID NO: 1790709 - RNA, 13 nt, Homo sapiens
gcucaucacugga

SEQ ID NO: 1790710 - RNA, 19 nt, Homo sapiens
auucacuuuauuauuuugc

SEQ ID NO: 1790711 - RNA, 18 nt, Homo sapiens
acuguugacauccaagcu

SEQ ID NO: 1790712 - RNA, 22 nt, Homo sapiens
uccuguaagaccuucgggucaa

SEQ ID NO: 1790713 - RNA, 15 nt, Homo sapiens
acccucacucucuac

SEQ ID NO: 1790714 - RNA, 15 nt, Homo sapiens
cagagcuucccugac

SEQ ID NO: 1790715 - RNA, 13 nt, Homo sapiens
ggggguuccguga

SEQ ID NO: 1790716 - RNA, 15 nt, Homo sapiens
uccaaaucuugccau

SEQ ID NO: 1790717 - RNA, 12 nt, Homo sapiens
uuuucuacacag

SEQ ID NO: 1790718 - RNA, 21 nt, Homo sapiens
auuuaaagggugauguacaca

SEQ ID NO: 1790719 - RNA, 18 nt, Homo sapiens
agagcugauggagaagga

SEQ ID NO: 1790720 - RNA, 15 nt, Homo sapiens
cauuccaacuaucuc

SEQ ID NO: 1790721 - RNA, 14 nt, Homo sapiens
cugcuucagccucc

SEQ ID NO: 1790722 - RNA, 14 nt, Homo sapiens
cugcuccagccucu

SEQ ID NO: 1790723 - RNA, 22 nt, Homo sapiens
caggcugcagaugaucagggau

SEQ ID NO: 1790724 - RNA, 22 nt, Homo sapiens
gauucaugauuuauaaaugcca

SEQ ID NO: 1790725 - RNA, 15 nt, Homo sapiens
ugacuuccuuacuaa

SEQ ID NO: 1790726 - RNA, 15 nt, Homo sapiens
ugcccuccuucccaa

SEQ ID NO: 1790727 - RNA, 17 nt, Homo sapiens
gcugauugggcaccuga

SEQ ID NO: 1790728 - RNA, 18 nt, Homo sapiens
gaaagauaauucacugua

SEQ ID NO: 1790729 - RNA, 22 nt, Homo sapiens
aauuucccucugauaugucuag

SEQ ID NO: 1790730 - RNA, 15 nt, Homo sapiens
gggggcucuggccaa

SEQ ID NO: 1790731 - RNA, 13 nt, Homo sapiens
acacacagcagcu

SEQ ID NO: 1790732 - RNA, 20 nt, Homo sapiens
ccgcucaggggccuggaggu

SEQ ID NO: 1790733 - RNA, 14 nt, Homo sapiens
guuccccacaguga

SEQ ID NO: 1790734 - RNA, 18 nt, Homo sapiens
guuuucccauugcaguug

SEQ ID NO: 1790735 - RNA, 19 nt, Homo sapiens
cugucuucacauguaugga

SEQ ID NO: 1790736 - RNA, 16 nt, Homo sapiens
gcagauuuucuucuag

SEQ ID NO: 1790737 - RNA, 23 nt, Homo sapiens
ugucccacccccagcagcucacc

SEQ ID NO: 1790738 - RNA, 23 nt, Homo sapiens
aaagaucuuuuccagaguaugca

SEQ ID NO: 1790739 - RNA, 13 nt, Homo sapiens
ccaaacucaggcu

SEQ ID NO: 1790740 - RNA, 16 nt, Homo sapiens
cauacuuaaugcauau

SEQ ID NO: 1790741 - RNA, 11 nt, Homo sapiens
cucaaucugca

SEQ ID NO: 1790742 - RNA, 22 nt, Homo sapiens
cccaaggaaaauggacauauuc

SEQ ID NO: 1790743 - RNA, 19 nt, Homo sapiens
agugacaugggugugccag

SEQ ID NO: 1790744 - RNA, 20 nt, Homo sapiens
gcacagggcucccaggccag

SEQ ID NO: 1790745 - RNA, 20 nt, Homo sapiens
gacagaauuguacacaauca

SEQ ID NO: 1790746 - RNA, 22 nt, Homo sapiens
cguguguauuagaaugcaugua

SEQ ID NO: 1790747 - RNA, 19 nt, Homo sapiens
cggcaaugcccugugcaug

SEQ ID NO: 1790748 - RNA, 22 nt, Homo sapiens
cugcauuugguaggaagccuga

SEQ ID NO: 1790749 - RNA, 18 nt, Homo sapiens
ucaucuccaaaucuugcc

SEQ ID NO: 1790750 - RNA, 23 nt, Homo sapiens
accccagccuccugccuacccca

SEQ ID NO: 1790751 - RNA, 11 nt, Homo sapiens
aaauguuagcu

SEQ ID NO: 1790752 - RNA, 21 nt, Homo sapiens
ucuggaugggcuuggccaaaa

SEQ ID NO: 1790753 - RNA, 22 nt, Homo sapiens
ccagagcggaaggagggagcuc

SEQ ID NO: 1790754 - RNA, 15 nt, Homo sapiens
aagggagaaagggag

SEQ ID NO: 1790755 - RNA, 15 nt, Homo sapiens
agcccagaagcccag

SEQ ID NO: 1790756 - RNA, 15 nt, Homo sapiens
ugugugcaugugugc

SEQ ID NO: 1790757 - RNA, 15 nt, Homo sapiens
auggauuaauggauu

SEQ ID NO: 1790758 - RNA, 15 nt, Homo sapiens
ccaaagaaccaaaga

SEQ ID NO: 1790759 - RNA, 15 nt, Homo sapiens
ugcacacaugcacac

SEQ ID NO: 1790760 - RNA, 19 nt, Homo sapiens
aucgcaccacugcucucca

SEQ ID NO: 1790761 - RNA, 22 nt, Homo sapiens
uaguuacaaaguuauauucaca

SEQ ID NO: 1790762 - RNA, 17 nt, Homo sapiens
cccuucauguacaucca

SEQ ID NO: 1790763 - RNA, 22 nt, Homo sapiens
cagauuccuuuggccacuguau

SEQ ID NO: 1790764 - RNA, 13 nt, Homo sapiens
gauaaaaccuccu

SEQ ID NO: 1790765 - RNA, 14 nt, Homo sapiens
caaaaaggcaaaua

SEQ ID NO: 1790766 - RNA, 17 nt, Homo sapiens
accuacaaacuccuuaa

SEQ ID NO: 1790767 - RNA, 18 nt, Homo sapiens
aagaacucugggcugcua

SEQ ID NO: 1790768 - RNA, 18 nt, Homo sapiens
aagaccuucuccuucacc

SEQ ID NO: 1790769 - RNA, 15 nt, Homo sapiens
cuaugauaaguucca

SEQ ID NO: 1790770 - RNA, 21 nt, Homo sapiens
uucugauguccauuuguccca

SEQ ID NO: 1790771 - RNA, 11 nt, Homo sapiens
auauaccaaau

SEQ ID NO: 1790772 - RNA, 19 nt, Homo sapiens
uuugaccuguggugcaaaa

SEQ ID NO: 1790773 - RNA, 21 nt, Homo sapiens
uuacagacuccuaacuacagg

SEQ ID NO: 1790774 - RNA, 13 nt, Homo sapiens
cuucacaacuagg

SEQ ID NO: 1790775 - RNA, 15 nt, Homo sapiens
agugaauacauuuug

SEQ ID NO: 1790776 - RNA, 15 nt, Homo sapiens
agugcaaagugcccu

SEQ ID NO: 1790777 - RNA, 17 nt, Homo sapiens
ugauucauauugcauca

SEQ ID NO: 1790778 - RNA, 20 nt, Homo sapiens
cucugcaggccuaggugcag

SEQ ID NO: 1790779 - RNA, 23 nt, Homo sapiens
cuuuguucuggggggacccagug

SEQ ID NO: 1790780 - RNA, 23 nt, Homo sapiens
gcucaguaaacgggaacaugccc

SEQ ID NO: 1790781 - RNA, 17 nt, Homo sapiens
cauauuuuguaacuucc

SEQ ID NO: 1790782 - RNA, 15 nt, Homo sapiens
caugaauaaaacacu

SEQ ID NO: 1790783 - RNA, 15 nt, Homo sapiens
acucaacaccagacc

SEQ ID NO: 1790784 - RNA, 21 nt, Homo sapiens
agagcagcuucggugugcaga

SEQ ID NO: 1790785 - RNA, 19 nt, Homo sapiens
ucagugaauaugccuguaa

SEQ ID NO: 1790786 - RNA, 18 nt, Homo sapiens
acacacuccauagauccc

SEQ ID NO: 1790787 - RNA, 16 nt, Homo sapiens
aaaguauaacaugucg

SEQ ID NO: 1790788 - RNA, 18 nt, Homo sapiens
guccccgagacacaggca

SEQ ID NO: 1790789 - RNA, 23 nt, Homo sapiens
uugaaaggagaaaaaaaaagcca

SEQ ID NO: 1790790 - RNA, 18 nt, Homo sapiens
gcaggacacugcagaaca

SEQ ID NO: 1790791 - RNA, 14 nt, Homo sapiens
cuuccuccagggaa

SEQ ID NO: 1790792 - RNA, 22 nt, Homo sapiens
ucguguguguuuuaaacuggua

SEQ ID NO: 1790793 - RNA, 15 nt, Homo sapiens
ugauggagaggacag

SEQ ID NO: 1790794 - RNA, 15 nt, Homo sapiens
ucuaguugucaauaa

SEQ ID NO: 1790795 - RNA, 22 nt, Homo sapiens
agaucucaugagaagucacuca

SEQ ID NO: 1790796 - RNA, 13 nt, Homo sapiens
ccaaaguguuaau

SEQ ID NO: 1790797 - RNA, 23 nt, Homo sapiens
cagccugccagcaguuacuguga

SEQ ID NO: 1790798 - RNA, 22 nt, Homo sapiens
agaacaaaugaucuguuuucau

SEQ ID NO: 1790799 - RNA, 14 nt, Homo sapiens
aagcaugcuucuau

SEQ ID NO: 1790800 - RNA, 17 nt, Homo sapiens
uugcaucuuuucuacuu

SEQ ID NO: 1790801 - RNA, 17 nt, Homo sapiens
uagauguuucaacugug

SEQ ID NO: 1790802 - RNA, 15 nt, Homo sapiens
uccugugucacugaa

SEQ ID NO: 1790803 - RNA, 22 nt, Homo sapiens
aaaggggcaagagcagcuccuu

SEQ ID NO: 1790804 - RNA, 15 nt, Homo sapiens
ccagcuacucaggag

SEQ ID NO: 1790805 - RNA, 17 nt, Homo sapiens
cuaaccagccuggucaa

SEQ ID NO: 1790806 - RNA, 21 nt, Homo sapiens
uaguguggaagcauagugaac

SEQ ID NO: 1790807 - RNA, 20 nt, Homo sapiens
cuauagacuguaagcuccau

SEQ ID NO: 1790808 - RNA, 19 nt, Homo sapiens
cucugcaucuccugucuuu

SEQ ID NO: 1790809 - RNA, 20 nt, Homo sapiens
uauaaaagauuccugaaugu

SEQ ID NO: 1790810 - RNA, 21 nt, Homo sapiens
ccugaucacucccagcacucc

SEQ ID NO: 1790811 - RNA, 21 nt, Homo sapiens
aacagagaaaggguccaugaa

SEQ ID NO: 1790812 - RNA, 14 nt, Homo sapiens
ugguugugcugaua

SEQ ID NO: 1790813 - RNA, 22 nt, Homo sapiens
ugcuuucuccugaaaacuuuag

SEQ ID NO: 1790814 - RNA, 18 nt, Homo sapiens
uaggaacaguaaaaucca

SEQ ID NO: 1790815 - RNA, 21 nt, Homo sapiens
caaaaguagccaucauuccuu

SEQ ID NO: 1790816 - RNA, 16 nt, Homo sapiens
gcagaccagcacuuca

SEQ ID NO: 1790817 - RNA, 16 nt, Homo sapiens
aucacccaagccacaa

SEQ ID NO: 1790818 - RNA, 16 nt, Homo sapiens
uaacagaaaaaugaaa

SEQ ID NO: 1790819 - RNA, 13 nt, Homo sapiens
uaacugauuucca

SEQ ID NO: 1790820 - RNA, 21 nt, Homo sapiens
guaaacaauaaaaguguccau

SEQ ID NO: 1790821 - RNA, 19 nt, Homo sapiens
accuccaacccugccguca

SEQ ID NO: 1790822 - RNA, 17 nt, Homo sapiens
gaugguccgugcccagg

SEQ ID NO: 1790823 - RNA, 15 nt, Homo sapiens
auuaguaacugcaca

SEQ ID NO: 1790824 - RNA, 20 nt, Homo sapiens
aauaggcggggcacgguggc

SEQ ID NO: 1790825 - RNA, 13 nt, Homo sapiens
ugcagugcuucca

SEQ ID NO: 1790826 - RNA, 14 nt, Homo sapiens
guacuacacaccgc

SEQ ID NO: 1790827 - RNA, 15 nt, Homo sapiens
gguccccacagcccg

SEQ ID NO: 1790828 - RNA, 15 nt, Homo sapiens
agaccaccuucccuu

SEQ ID NO: 1790829 - RNA, 22 nt, Homo sapiens
caaaaacaaaucgcagccagcu

SEQ ID NO: 1790830 - RNA, 16 nt, Homo sapiens
cagugccagcaccugc

SEQ ID NO: 1790831 - RNA, 13 nt, Homo sapiens
aaauaauugccac

SEQ ID NO: 1790832 - RNA, 20 nt, Homo sapiens
ccaaaaaaugcuugcuucaa

SEQ ID NO: 1790833 - RNA, 13 nt, Homo sapiens
aagggcugugcug

SEQ ID NO: 1790834 - RNA, 17 nt, Homo sapiens
auaugaaagaaaacacc

SEQ ID NO: 1790835 - RNA, 13 nt, Homo sapiens
gagcaagacucca

SEQ ID NO: 1790836 - RNA, 21 nt, Homo sapiens
ccuggcaaagaacucauuuga

SEQ ID NO: 1790837 - RNA, 22 nt, Homo sapiens
uggcugggaagacuauggugcu

SEQ ID NO: 1790838 - RNA, 20 nt, Homo sapiens
uacaguuugagacuuccaaa

SEQ ID NO: 1790839 - RNA, 19 nt, Homo sapiens
acauugaauggaucaauac

SEQ ID NO: 1790840 - RNA, 19 nt, Homo sapiens
ucagccucccgaauagcug

SEQ ID NO: 1790841 - RNA, 22 nt, Homo sapiens
cguuugguuuacuugucuguca

SEQ ID NO: 1790842 - RNA, 14 nt, Homo sapiens
auuucuacacugag

SEQ ID NO: 1790843 - RNA, 13 nt, Homo sapiens
cuugagauuuugu

SEQ ID NO: 1790844 - RNA, 16 nt, Homo sapiens
uggacucaguuuucuu

SEQ ID NO: 1790845 - RNA, 20 nt, Homo sapiens
gcaccuuaagauuuugcacc

SEQ ID NO: 1790846 - RNA, 18 nt, Homo sapiens
ucaggaguccaagaccag

SEQ ID NO: 1790847 - RNA, 17 nt, Homo sapiens
guuccagguuucuucca

SEQ ID NO: 1790848 - RNA, 17 nt, Homo sapiens
auuccauacuucucuca

SEQ ID NO: 1790849 - RNA, 16 nt, Homo sapiens
uacaaucuucauuuaa

SEQ ID NO: 1790850 - RNA, 21 nt, Homo sapiens
uaauugugaauuagacuugua

SEQ ID NO: 1790851 - RNA, 15 nt, Homo sapiens
acucaucuguuaucc

SEQ ID NO: 1790852 - RNA, 18 nt, Homo sapiens
uagcucacugcagccuca

SEQ ID NO: 1790853 - RNA, 20 nt, Homo sapiens
gaugacacaacugcacucca

SEQ ID NO: 1790854 - RNA, 19 nt, Homo sapiens
gagaacuggacaguggcag

SEQ ID NO: 1790855 - RNA, 16 nt, Homo sapiens
gauacugucuuugcau

SEQ ID NO: 1790856 - RNA, 14 nt, Homo sapiens
uugugguaacuuga

SEQ ID NO: 1790857 - RNA, 13 nt, Homo sapiens
uugaaaagacauc

SEQ ID NO: 1790858 - RNA, 15 nt, Homo sapiens
gccugcagacucacu

SEQ ID NO: 1790859 - RNA, 15 nt, Homo sapiens
uguuuucaccauuca

SEQ ID NO: 1790860 - RNA, 18 nt, Homo sapiens
ggcagcauagcaagacac

SEQ ID NO: 1790861 - RNA, 12 nt, Homo sapiens
cauagcccaaaa

SEQ ID NO: 1790862 - RNA, 12 nt, Homo sapiens
uauguaguauua

SEQ ID NO: 1790863 - RNA, 18 nt, Homo sapiens
aagagucauauugcccag

SEQ ID NO: 1790864 - RNA, 17 nt, Homo sapiens
acacugcuuuuuugaua

SEQ ID NO: 1790865 - RNA, 16 nt, Homo sapiens
acuuuggguacuuaua

SEQ ID NO: 1790866 - RNA, 19 nt, Homo sapiens
ucccacugcccacuggccg

SEQ ID NO: 1790867 - RNA, 16 nt, Homo sapiens
ccaauggcuuccagcu

SEQ ID NO: 1790868 - RNA, 22 nt, Homo sapiens
cccaaccuccccugguccugca

SEQ ID NO: 1790869 - RNA, 17 nt, Homo sapiens
cuucuccgccagccucc

SEQ ID NO: 1790870 - RNA, 16 nt, Homo sapiens
cugucucccgggacua

SEQ ID NO: 1790871 - RNA, 20 nt, Homo sapiens
uggacuuuugaaaagcuuuu

SEQ ID NO: 1790872 - RNA, 19 nt, Homo sapiens
ccaggugugguggugcaca

SEQ ID NO: 1790873 - RNA, 20 nt, Homo sapiens
aggaagcuuuuguuauguau

SEQ ID NO: 1790874 - RNA, 14 nt, Homo sapiens
cucucgaugccacu

SEQ ID NO: 1790875 - RNA, 15 nt, Homo sapiens
acuauuauuugcuau

SEQ ID NO: 1790876 - RNA, 20 nt, Homo sapiens
cugcugugggcugcucacug

SEQ ID NO: 1790877 - RNA, 17 nt, Homo sapiens
gugguuccucugcucac

SEQ ID NO: 1790878 - RNA, 15 nt, Homo sapiens
gcaucagcucagggc

SEQ ID NO: 1790879 - RNA, 13 nt, Homo sapiens
gcaggagcuugug

SEQ ID NO: 1790880 - RNA, 13 nt, Homo sapiens
cuuuacuccucac

SEQ ID NO: 1790881 - RNA, 15 nt, Homo sapiens
cccauggacacucca

SEQ ID NO: 1790882 - RNA, 21 nt, Homo sapiens
cgagauggcgcuauugcacuc

SEQ ID NO: 1790883 - RNA, 13 nt, Homo sapiens
aaaaugccaugaa

SEQ ID NO: 1790884 - RNA, 22 nt, Homo sapiens
uaguggcuuuuuuccuccugug

SEQ ID NO: 1790885 - RNA, 14 nt, Homo sapiens
uccagagaaaagag

SEQ ID NO: 1790886 - RNA, 15 nt, Homo sapiens
caacaaagucaccca

SEQ ID NO: 1790887 - RNA, 23 nt, Homo sapiens
auucucauaagcuacugaugaga

SEQ ID NO: 1790888 - RNA, 22 nt, Homo sapiens
ugaauaaagcauccaaguauau

SEQ ID NO: 1790889 - RNA, 21 nt, Homo sapiens
ugaggaagacaagugaugcua

SEQ ID NO: 1790890 - RNA, 20 nt, Homo sapiens
agagagccugcaggaucuca

SEQ ID NO: 1790891 - RNA, 14 nt, Homo sapiens
ggcucacauuucau

SEQ ID NO: 1790892 - RNA, 16 nt, Homo sapiens
cuccaaaccugaaguu

SEQ ID NO: 1790893 - RNA, 10 nt, Homo sapiens
caacugacca

SEQ ID NO: 1790894 - RNA, 18 nt, Homo sapiens
aguccagaugccuuccug

SEQ ID NO: 1790895 - RNA, 18 nt, Homo sapiens
aauuuuaaaaagcagcug

SEQ ID NO: 1790896 - RNA, 19 nt, Homo sapiens
ugagaaguaauuccucuga

SEQ ID NO: 1790897 - RNA, 18 nt, Homo sapiens
gucaagaaacagccagca

SEQ ID NO: 1790898 - RNA, 18 nt, Homo sapiens
ggccccugcacacucagu

SEQ ID NO: 1790899 - RNA, 10 nt, Homo sapiens
aacauuccau

SEQ ID NO: 1790900 - RNA, 23 nt, Homo sapiens
cucugcuuuucuucccagcaaag

SEQ ID NO: 1790901 - RNA, 12 nt, Homo sapiens
uauaugacugga

SEQ ID NO: 1790902 - RNA, 16 nt, Homo sapiens
acagucguucccagug

SEQ ID NO: 1790903 - RNA, 22 nt, Homo sapiens
uauuauaaacuguaugcucaca

SEQ ID NO: 1790904 - RNA, 17 nt, Homo sapiens
aaccugcuguccuccag

SEQ ID NO: 1790905 - RNA, 16 nt, Homo sapiens
aucuugugacccucca

SEQ ID NO: 1790906 - RNA, 23 nt, Homo sapiens
aagcaugaucuuguuacugugau

SEQ ID NO: 1790907 - RNA, 20 nt, Homo sapiens
aauagaggucuugaucuuug

SEQ ID NO: 1790908 - RNA, 15 nt, Homo sapiens
uacaguucugucaua

SEQ ID NO: 1790909 - RNA, 23 nt, Homo sapiens
uugguagcaauuggcagcccuau

SEQ ID NO: 1790910 - RNA, 16 nt, Homo sapiens
uuuuuaaagcuuuuga

SEQ ID NO: 1790911 - RNA, 16 nt, Homo sapiens
uauuuuuuaaagucua

SEQ ID NO: 1790912 - RNA, 18 nt, Homo sapiens
uauuaauucuucaccugu

SEQ ID NO: 1790913 - RNA, 20 nt, Homo sapiens
cacuuuaauucucaugugau

SEQ ID NO: 1790914 - RNA, 13 nt, Homo sapiens
gcuccuuccagac

SEQ ID NO: 1790915 - RNA, 15 nt, Homo sapiens
uuaguauucuaauaa

SEQ ID NO: 1790916 - RNA, 20 nt, Homo sapiens
auaaaaacauaaauaauacc

SEQ ID NO: 1790917 - RNA, 14 nt, Homo sapiens
agcaauaaguugaa

SEQ ID NO: 1790918 - RNA, 14 nt, Homo sapiens
caaauuacaaaagg

SEQ ID NO: 1790919 - RNA, 17 nt, Homo sapiens
cgaaagagagagaaaca

SEQ ID NO: 1790920 - RNA, 22 nt, Homo sapiens
cauuugcuuuuugugauaugca

SEQ ID NO: 1790921 - RNA, 18 nt, Homo sapiens
ucuccacacccacuuugu

SEQ ID NO: 1790922 - RNA, 16 nt, Homo sapiens
ugguccuggcugcacu

SEQ ID NO: 1790923 - RNA, 21 nt, Homo sapiens
uuuaaugaacuaccaucugau

SEQ ID NO: 1790924 - RNA, 18 nt, Homo sapiens
auaagcauaccauugaaa

SEQ ID NO: 1790925 - RNA, 19 nt, Homo sapiens
auuaugguuagcugucaca

SEQ ID NO: 1790926 - RNA, 20 nt, Homo sapiens
agcacugccaggagggacaa

SEQ ID NO: 1790927 - RNA, 11 nt, Homo sapiens
gugucugcaac

SEQ ID NO: 1790928 - RNA, 22 nt, Homo sapiens
acuacuucacaguaaguaguaa

SEQ ID NO: 1790929 - RNA, 21 nt, Homo sapiens
gagaaucccaaauuugauuga

SEQ ID NO: 1790930 - RNA, 22 nt, Homo sapiens
ccgaauuugguacacauguguu

SEQ ID NO: 1790931 - RNA, 14 nt, Homo sapiens
gccaagaacgcagg

SEQ ID NO: 1790932 - RNA, 16 nt, Homo sapiens
ucccaggaggugcagu

SEQ ID NO: 1790933 - RNA, 14 nt, Homo sapiens
gggucccagggaag

SEQ ID NO: 1790934 - RNA, 17 nt, Homo sapiens
aaaaagcuaaugugcag

SEQ ID NO: 1790935 - RNA, 21 nt, Homo sapiens
cuucugacuuaagugugcaaa

SEQ ID NO: 1790936 - RNA, 12 nt, Homo sapiens
ugcaaaaucacu

SEQ ID NO: 1790937 - RNA, 22 nt, Homo sapiens
gggagccuucugugcugugagu

SEQ ID NO: 1790938 - RNA, 19 nt, Homo sapiens
uaagcuuuggacccaagga

SEQ ID NO: 1790939 - RNA, 16 nt, Homo sapiens
cgacuugacuuuuuaa

SEQ ID NO: 1790940 - RNA, 14 nt, Homo sapiens
gcuagcaguggcag

SEQ ID NO: 1790941 - RNA, 23 nt, Homo sapiens
aacuucagcaggggauggcgcua

SEQ ID NO: 1790942 - RNA, 16 nt, Homo sapiens
agggccagguccucac

SEQ ID NO: 1790943 - RNA, 17 nt, Homo sapiens
uugacugcuucucugca

SEQ ID NO: 1790944 - RNA, 18 nt, Homo sapiens
ccucauuuuuauaaccug

SEQ ID NO: 1790945 - RNA, 22 nt, Homo sapiens
ccccguguccucucccugccaa

SEQ ID NO: 1790946 - RNA, 19 nt, Homo sapiens
uaacucguugcagucugua

SEQ ID NO: 1790947 - RNA, 18 nt, Homo sapiens
agggggaagaagcagaga

SEQ ID NO: 1790948 - RNA, 19 nt, Homo sapiens
caagggagaagaaauccau

SEQ ID NO: 1790949 - RNA, 17 nt, Homo sapiens
ucauccuauuacuuaug

SEQ ID NO: 1790950 - RNA, 21 nt, Homo sapiens
agccagggauugaaguuuauu

SEQ ID NO: 1790951 - RNA, 18 nt, Homo sapiens
gccagugccucucacccc

SEQ ID NO: 1790952 - RNA, 18 nt, Homo sapiens
guaagacuaaaucuguaa

SEQ ID NO: 1790953 - RNA, 19 nt, Homo sapiens
agugacuugaauguacaaa

SEQ ID NO: 1790954 - RNA, 18 nt, Homo sapiens
aguaccacagaaguucaa

SEQ ID NO: 1790955 - RNA, 18 nt, Homo sapiens
ugaagcuuguaucugaua

SEQ ID NO: 1790956 - RNA, 19 nt, Homo sapiens
acuugaacguucugaccag

SEQ ID NO: 1790957 - RNA, 18 nt, Homo sapiens
augggggcuuuccaaaga

SEQ ID NO: 1790958 - RNA, 17 nt, Homo sapiens
uguaaauaauacauuau

SEQ ID NO: 1790959 - RNA, 20 nt, Homo sapiens
cuucugacgcagccugagaa

SEQ ID NO: 1790960 - RNA, 23 nt, Homo sapiens
uuuuugacucugccuacuucuga

SEQ ID NO: 1790961 - RNA, 22 nt, Homo sapiens
ccuaccauuucuagccucuauu

SEQ ID NO: 1790962 - RNA, 17 nt, Homo sapiens
cauuacaaaaaaacacg

SEQ ID NO: 1790963 - RNA, 17 nt, Homo sapiens
gcuacugaccaucugca

SEQ ID NO: 1790964 - RNA, 16 nt, Homo sapiens
uccugaaacaacuugg

SEQ ID NO: 1790965 - RNA, 15 nt, Homo sapiens
uguaugcucauacuu

SEQ ID NO: 1790966 - RNA, 21 nt, Homo sapiens
uccagaaggauccaagacaaa

SEQ ID NO: 1790967 - RNA, 14 nt, Homo sapiens
augacaaagaguag

SEQ ID NO: 1790968 - RNA, 15 nt, Homo sapiens
agacagagggucaca

SEQ ID NO: 1790969 - RNA, 16 nt, Homo sapiens
cuccuuuaauuaaugg

SEQ ID NO: 1790970 - RNA, 20 nt, Homo sapiens
uaaaguaacccauaaucugc

SEQ ID NO: 1790971 - RNA, 20 nt, Homo sapiens
guuaaaauacucagugcuaa

SEQ ID NO: 1790972 - RNA, 16 nt, Homo sapiens
guugcuuguacagugu

SEQ ID NO: 1790973 - RNA, 22 nt, Homo sapiens
cucacauaaaaaagaagcacuu

SEQ ID NO: 1790974 - RNA, 20 nt, Homo sapiens
gcccauauggucauccaaau

SEQ ID NO: 1790975 - RNA, 11 nt, Homo sapiens
acccugagaac

SEQ ID NO: 1790976 - RNA, 17 nt, Homo sapiens
aguuccucccccaguuc

SEQ ID NO: 1790977 - RNA, 19 nt, Homo sapiens
uucuuuccuucugaucuga

SEQ ID NO: 1790978 - RNA, 11 nt, Homo sapiens
gcgucuugccc

SEQ ID NO: 1790979 - RNA, 19 nt, Homo sapiens
cucuggauuccacacugca

SEQ ID NO: 1790980 - RNA, 16 nt, Homo sapiens
guuccuuaucaccugc

SEQ ID NO: 1790981 - RNA, 19 nt, Homo sapiens
ugacaaccuuuguguaaua

SEQ ID NO: 1790982 - RNA, 21 nt, Homo sapiens
aguauguccccauaagacaaa

SEQ ID NO: 1790983 - RNA, 15 nt, Homo sapiens
uccagccaccaccua

SEQ ID NO: 1790984 - RNA, 21 nt, Homo sapiens
agaaaauauuuuuaaauggac

SEQ ID NO: 1790985 - RNA, 14 nt, Homo sapiens
auccacauccucua

SEQ ID NO: 1790986 - RNA, 14 nt, Homo sapiens
cucuuagugauuga

SEQ ID NO: 1790987 - RNA, 15 nt, Homo sapiens
acacuggagucuugc

SEQ ID NO: 1790988 - RNA, 23 nt, Homo sapiens
gaaauuagugaguuuccuucuac

SEQ ID NO: 1790989 - RNA, 17 nt, Homo sapiens
aucacugaacuuuucaa

SEQ ID NO: 1790990 - RNA, 19 nt, Homo sapiens
agcucaccccagguucuca

SEQ ID NO: 1790991 - RNA, 24 nt, Homo sapiens
acauggcaaaaccccaucucuacu

SEQ ID NO: 1790992 - RNA, 21 nt, Homo sapiens
aguggugaggggccacugggc

SEQ ID NO: 1790993 - RNA, 19 nt, Homo sapiens
gaaacaugaacccaaaaag

SEQ ID NO: 1790994 - RNA, 21 nt, Homo sapiens
ucccauaucauauaaaauuuc

SEQ ID NO: 1790995 - RNA, 18 nt, Homo sapiens
agguguuggacaggggau

SEQ ID NO: 1790996 - RNA, 14 nt, Homo sapiens
auggcuguccuugu

SEQ ID NO: 1790997 - RNA, 15 nt, Homo sapiens
caacgcuuaaaggug

SEQ ID NO: 1790998 - RNA, 17 nt, Homo sapiens
agaguagaacagauaau

SEQ ID NO: 1790999 - RNA, 20 nt, Homo sapiens
ucccaggggagccagcugcu

SEQ ID NO: 1791000 - RNA, 20 nt, Homo sapiens
aacaccaucgaucaugaugu

SEQ ID NO: 1791001 - RNA, 19 nt, Homo sapiens
gagaccacaguuuaccuca

SEQ ID NO: 1791002 - RNA, 16 nt, Homo sapiens
cacuuuguugcaagau

SEQ ID NO: 1791003 - RNA, 15 nt, Homo sapiens
agcucuguuuuacaa

SEQ ID NO: 1791004 - RNA, 13 nt, Homo sapiens
ucaugaagcccuu

SEQ ID NO: 1791005 - RNA, 16 nt, Homo sapiens
ugugauguuuguccug

SEQ ID NO: 1791006 - RNA, 16 nt, Homo sapiens
uuguacuuugugcugg

SEQ ID NO: 1791007 - RNA, 20 nt, Homo sapiens
agccgagaucacaccacugu

SEQ ID NO: 1791008 - RNA, 20 nt, Homo sapiens
agcugagaucacaccacugc

SEQ ID NO: 1791009 - RNA, 17 nt, Homo sapiens
guguuuugcaagggaau

SEQ ID NO: 1791010 - RNA, 13 nt, Homo sapiens
aacgguccaugaa

SEQ ID NO: 1791011 - RNA, 23 nt, Homo sapiens
ggaccgcugauaagcauugacuu

SEQ ID NO: 1791012 - RNA, 13 nt, Homo sapiens
cugaauggucuca

SEQ ID NO: 1791013 - RNA, 12 nt, Homo sapiens
uaaccucaggga

SEQ ID NO: 1791014 - RNA, 21 nt, Homo sapiens
aaucgcuccaccuugcagcuc

SEQ ID NO: 1791015 - RNA, 17 nt, Homo sapiens
ggcaggugccuguugaa

SEQ ID NO: 1791016 - RNA, 16 nt, Homo sapiens
ucacuuuauuaucccu

SEQ ID NO: 1791017 - RNA, 23 nt, Homo sapiens
aacaagagcaaaaugaugcuuuc

SEQ ID NO: 1791018 - RNA, 14 nt, Homo sapiens
ggauuugcagguga

SEQ ID NO: 1791019 - RNA, 15 nt, Homo sapiens
auuuuuaguagagaa

SEQ ID NO: 1791020 - RNA, 12 nt, Homo sapiens
uuccccaggugg

SEQ ID NO: 1791021 - RNA, 17 nt, Homo sapiens
uacaggcgccugccaca

SEQ ID NO: 1791022 - RNA, 19 nt, Homo sapiens
guaacuguuaaauugcugu

SEQ ID NO: 1791023 - RNA, 17 nt, Homo sapiens
ucacugccccucucuca

SEQ ID NO: 1791024 - RNA, 23 nt, Homo sapiens
ucacaucuugguauguggccaua

SEQ ID NO: 1791025 - RNA, 14 nt, Homo sapiens
caaagaccaccucc

SEQ ID NO: 1791026 - RNA, 13 nt, Homo sapiens
ugcaguuuugaca

SEQ ID NO: 1791027 - RNA, 21 nt, Homo sapiens
auuucuagacaguauugccac

SEQ ID NO: 1791028 - RNA, 20 nt, Homo sapiens
cuauggcccagccacugcag

SEQ ID NO: 1791029 - RNA, 21 nt, Homo sapiens
cgguggugcaugccuguaauc

SEQ ID NO: 1791030 - RNA, 16 nt, Homo sapiens
ccauucaacucggaaa

SEQ ID NO: 1791031 - RNA, 17 nt, Homo sapiens
acuuaagucuuccuuaa

SEQ ID NO: 1791032 - RNA, 14 nt, Homo sapiens
ggaagcauacaauu

SEQ ID NO: 1791033 - RNA, 12 nt, Homo sapiens
ccggugcucugg

SEQ ID NO: 1791034 - RNA, 12 nt, Homo sapiens
cuugugcuccug

SEQ ID NO: 1791035 - RNA, 14 nt, Homo sapiens
cuauguuuguguau

SEQ ID NO: 1791036 - RNA, 14 nt, Homo sapiens
gcucaaccauggcu

SEQ ID NO: 1791037 - RNA, 12 nt, Homo sapiens
agcaauauguca

SEQ ID NO: 1791038 - RNA, 18 nt, Homo sapiens
ccaauccucaggauuuca

SEQ ID NO: 1791039 - RNA, 21 nt, Homo sapiens
cuuccuccggcuggaccuggg

SEQ ID NO: 1791040 - RNA, 14 nt, Homo sapiens
ggccacacccagag

SEQ ID NO: 1791041 - RNA, 15 nt, Homo sapiens
aaacauguacuuuga

SEQ ID NO: 1791042 - RNA, 16 nt, Homo sapiens
cauagcgagacuccac

SEQ ID NO: 1791043 - RNA, 22 nt, Homo sapiens
auagucaucaucaagaauuuaa

SEQ ID NO: 1791044 - RNA, 22 nt, Homo sapiens
agcaaaguuuucagauuguaaa

SEQ ID NO: 1791045 - RNA, 14 nt, Homo sapiens
gccagggaugggca

SEQ ID NO: 1791046 - RNA, 22 nt, Homo sapiens
ggcaggguuuauaugcacuuuc

SEQ ID NO: 1791047 - RNA, 21 nt, Homo sapiens
aaagugcauaugaaauccuug

SEQ ID NO: 1791048 - RNA, 14 nt, Homo sapiens
auuucaccacugaa

SEQ ID NO: 1791049 - RNA, 12 nt, Homo sapiens
uacacuaugaag

SEQ ID NO: 1791050 - RNA, 20 nt, Homo sapiens
uuaugucucuugagcaucaa

SEQ ID NO: 1791051 - RNA, 18 nt, Homo sapiens
ucugauucacagucucau

SEQ ID NO: 1791052 - RNA, 21 nt, Homo sapiens
cagcacaagauacacgucaca

SEQ ID NO: 1791053 - RNA, 23 nt, Homo sapiens
uuuaagacucucgcaucuuccca

SEQ ID NO: 1791054 - RNA, 20 nt, Homo sapiens
ugguaaauuuuauaauguca

SEQ ID NO: 1791055 - RNA, 22 nt, Homo sapiens
aggggugaaaggggggaaccag

SEQ ID NO: 1791056 - RNA, 20 nt, Homo sapiens
cugggcagcugucauggaaa

SEQ ID NO: 1791057 - RNA, 23 nt, Homo sapiens
gcacacauugaagguauaugcca

SEQ ID NO: 1791058 - RNA, 18 nt, Homo sapiens
cacuagccagacacucug

SEQ ID NO: 1791059 - RNA, 16 nt, Homo sapiens
ugcuguuaacuguuaa

SEQ ID NO: 1791060 - RNA, 13 nt, Homo sapiens
uccuaacagcuuu

SEQ ID NO: 1791061 - RNA, 19 nt, Homo sapiens
uuccuuuuugacacugaaa

SEQ ID NO: 1791062 - RNA, 19 nt, Homo sapiens
cuuaguuaucaguccuguc

SEQ ID NO: 1791063 - RNA, 16 nt, Homo sapiens
guagcugagauuacag

SEQ ID NO: 1791064 - RNA, 12 nt, Homo sapiens
caacauaucauu

SEQ ID NO: 1791065 - RNA, 17 nt, Homo sapiens
gccaugauuuuggccac

SEQ ID NO: 1791066 - RNA, 19 nt, Homo sapiens
aucagaucaauacaaucuu

SEQ ID NO: 1791067 - RNA, 15 nt, Homo sapiens
ccugacucugugcug

SEQ ID NO: 1791068 - RNA, 12 nt, Homo sapiens
ucccaacucgau

SEQ ID NO: 1791069 - RNA, 13 nt, Homo sapiens
uuaaguaaauaca

SEQ ID NO: 1791070 - RNA, 13 nt, Homo sapiens
cccuggggcacuu

SEQ ID NO: 1791071 - RNA, 21 nt, Homo sapiens
agucagauccuguuacuugcu

SEQ ID NO: 1791072 - RNA, 20 nt, Homo sapiens
cccaaugcacauccauuccc

SEQ ID NO: 1791073 - RNA, 12 nt, Homo sapiens
cccagcacuguc

SEQ ID NO: 1791074 - RNA, 20 nt, Homo sapiens
gcacucggcuucccaauguu

SEQ ID NO: 1791075 - RNA, 17 nt, Homo sapiens
agcucacacccuaccuu

SEQ ID NO: 1791076 - RNA, 12 nt, Homo sapiens
aaauauucacuc

SEQ ID NO: 1791077 - RNA, 17 nt, Homo sapiens
accagucugacccuuac

SEQ ID NO: 1791078 - RNA, 19 nt, Homo sapiens
gaagggcugaguggucuga

SEQ ID NO: 1791079 - RNA, 20 nt, Homo sapiens
caugcacuuggcugcauaaa

SEQ ID NO: 1791080 - RNA, 12 nt, Homo sapiens
uccuggaaccaa

SEQ ID NO: 1791081 - RNA, 18 nt, Homo sapiens
cccugaggaaugaaaaag

SEQ ID NO: 1791082 - RNA, 15 nt, Homo sapiens
caucucuguaaaaag

SEQ ID NO: 1791083 - RNA, 18 nt, Homo sapiens
gcugaucgggaagcccuu

SEQ ID NO: 1791084 - RNA, 14 nt, Homo sapiens
cuccgccauugaga

SEQ ID NO: 1791085 - RNA, 14 nt, Homo sapiens
cugaaccauuccaa

SEQ ID NO: 1791086 - RNA, 19 nt, Homo sapiens
acucagaggcugacacuga

SEQ ID NO: 1791087 - RNA, 16 nt, Homo sapiens
agcauggccacccuca

SEQ ID NO: 1791088 - RNA, 21 nt, Homo sapiens
auucaaguugcuucucaugga

SEQ ID NO: 1791089 - RNA, 20 nt, Homo sapiens
caaaggcucucacuccagga

SEQ ID NO: 1791090 - RNA, 13 nt, Homo sapiens
ccaguaaaaaucc

SEQ ID NO: 1791091 - RNA, 20 nt, Homo sapiens
uuugaaggcaaaauugcaaa

SEQ ID NO: 1791092 - RNA, 17 nt, Homo sapiens
cucugagggucugaaaa

SEQ ID NO: 1791093 - RNA, 23 nt, Homo sapiens
auauuuuaagaaagagaaugaac

SEQ ID NO: 1791094 - RNA, 17 nt, Homo sapiens
uccugucuaauuugcac

SEQ ID NO: 1791095 - RNA, 18 nt, Homo sapiens
uccucuguaaugaucaga

SEQ ID NO: 1791096 - RNA, 20 nt, Homo sapiens
aguucuuugauucuguaaua

SEQ ID NO: 1791097 - RNA, 20 nt, Homo sapiens
ucccagagagacgcugugau

SEQ ID NO: 1791098 - RNA, 12 nt, Homo sapiens
uacaugcaccuu

SEQ ID NO: 1791099 - RNA, 18 nt, Homo sapiens
ccuugcaacuucauguca

SEQ ID NO: 1791100 - RNA, 12 nt, Homo sapiens
ugguggccucug

SEQ ID NO: 1791101 - RNA, 22 nt, Homo sapiens
aaggguuaggacucuccacuca

SEQ ID NO: 1791102 - RNA, 17 nt, Homo sapiens
ccagcugugacugaggg

SEQ ID NO: 1791103 - RNA, 17 nt, Homo sapiens
ccugggcagagggccug

SEQ ID NO: 1791104 - RNA, 18 nt, Homo sapiens
caguguuuauccuuucau

SEQ ID NO: 1791105 - RNA, 16 nt, Homo sapiens
cacuagcauccacuga

SEQ ID NO: 1791106 - RNA, 15 nt, Homo sapiens
caacauguuauuugu

SEQ ID NO: 1791107 - RNA, 17 nt, Homo sapiens
ucccauucaagauuccc

SEQ ID NO: 1791108 - RNA, 17 nt, Homo sapiens
cggcaacggcaaccccc

SEQ ID NO: 1791109 - RNA, 21 nt, Homo sapiens
caagacccaggaggcccagcu

SEQ ID NO: 1791110 - RNA, 15 nt, Homo sapiens
caacuuccugaggga

SEQ ID NO: 1791111 - RNA, 15 nt, Homo sapiens
cacugauaaaaccau

SEQ ID NO: 1791112 - RNA, 19 nt, Homo sapiens
auaaguagcauucauguaa

SEQ ID NO: 1791113 - RNA, 20 nt, Homo sapiens
guucaaguuauagauucaau

SEQ ID NO: 1791114 - RNA, 17 nt, Homo sapiens
acuuaaauaaacaugac

SEQ ID NO: 1791115 - RNA, 18 nt, Homo sapiens
uuaccucauccaugcacu

SEQ ID NO: 1791116 - RNA, 18 nt, Homo sapiens
ugcccugugagggcucac

SEQ ID NO: 1791117 - RNA, 22 nt, Homo sapiens
uaauuucacucucugcauugac

SEQ ID NO: 1791118 - RNA, 17 nt, Homo sapiens
augagagaagagaguau

SEQ ID NO: 1791119 - RNA, 19 nt, Homo sapiens
aggucuucuuguguccuga

SEQ ID NO: 1791120 - RNA, 19 nt, Homo sapiens
uucaccuuucuuuuguaaa

SEQ ID NO: 1791121 - RNA, 19 nt, Homo sapiens
uagcucucaucacuaccuu

SEQ ID NO: 1791122 - RNA, 23 nt, Homo sapiens
uggggcccugugcgucucagugu

SEQ ID NO: 1791123 - RNA, 18 nt, Homo sapiens
aauagcuauauccaugua

SEQ ID NO: 1791124 - RNA, 19 nt, Homo sapiens
gcaguguauagaaaaacca

SEQ ID NO: 1791125 - RNA, 18 nt, Homo sapiens
cauacacacacacacaua

SEQ ID NO: 1791126 - RNA, 20 nt, Homo sapiens
aguuuucugcuuuaauuuca

SEQ ID NO: 1791127 - RNA, 19 nt, Homo sapiens
cacaaaaagugucucugcc

SEQ ID NO: 1791128 - RNA, 13 nt, Homo sapiens
agaggaagcacau

SEQ ID NO: 1791129 - RNA, 21 nt, Homo sapiens
cugaaagggcacagugucagu

SEQ ID NO: 1791130 - RNA, 20 nt, Homo sapiens
gugucucccagaacuauucu

SEQ ID NO: 1791131 - RNA, 14 nt, Homo sapiens
cuggagugcagugg

SEQ ID NO: 1791132 - RNA, 15 nt, Homo sapiens
aauuugcacuguuua

SEQ ID NO: 1791133 - RNA, 19 nt, Homo sapiens
caauggguuuauagacauu

SEQ ID NO: 1791134 - RNA, 14 nt, Homo sapiens
ccaaguccagugug

SEQ ID NO: 1791135 - RNA, 22 nt, Homo sapiens
aaugucucaauggugcuauaau

SEQ ID NO: 1791136 - RNA, 15 nt, Homo sapiens
aacauuaauguugau

SEQ ID NO: 1791137 - RNA, 20 nt, Homo sapiens
uuuuguuccaaaagagucca

SEQ ID NO: 1791138 - RNA, 16 nt, Homo sapiens
gaaggauaaagccacu

SEQ ID NO: 1791139 - RNA, 21 nt, Homo sapiens
gaaggcuugucagcacuucca

SEQ ID NO: 1791140 - RNA, 19 nt, Homo sapiens
aagcauucugagcugggcu

SEQ ID NO: 1791141 - RNA, 23 nt, Homo sapiens
aagccuuuccuuuuagugauaaa

SEQ ID NO: 1791142 - RNA, 13 nt, Homo sapiens
ucuaaacauuuca

SEQ ID NO: 1791143 - RNA, 19 nt, Homo sapiens
aaagcuaguguaccuccuc

SEQ ID NO: 1791144 - RNA, 21 nt, Homo sapiens
gugcacugacagccuugccca

SEQ ID NO: 1791145 - RNA, 14 nt, Homo sapiens
auagucacaagagc

SEQ ID NO: 1791146 - RNA, 14 nt, Homo sapiens
cuggguaccaaauu

SEQ ID NO: 1791147 - RNA, 15 nt, Homo sapiens
uuucuccucuccauc

SEQ ID NO: 1791148 - RNA, 22 nt, Homo sapiens
ggaauacucuuggucaccucaa

SEQ ID NO: 1791149 - RNA, 21 nt, Homo sapiens
ugcauuuccagcugugcagca

SEQ ID NO: 1791150 - RNA, 11 nt, Homo sapiens
uccucugacau

SEQ ID NO: 1791151 - RNA, 21 nt, Homo sapiens
gauucagcgaagucucauggg

SEQ ID NO: 1791152 - RNA, 21 nt, Homo sapiens
agaacaguggcucguauccca

SEQ ID NO: 1791153 - RNA, 21 nt, Homo sapiens
uggaggcugcuguggggacca

SEQ ID NO: 1791154 - RNA, 15 nt, Homo sapiens
cauuuaccaaucaua

SEQ ID NO: 1791155 - RNA, 20 nt, Homo sapiens
gugaucuugcucuaucucac

SEQ ID NO: 1791156 - RNA, 22 nt, Homo sapiens
gcugcaaaauuaaaucuagaca

SEQ ID NO: 1791157 - RNA, 23 nt, Homo sapiens
agaacuguuaaaggucauaugca

SEQ ID NO: 1791158 - RNA, 20 nt, Homo sapiens
agcauucucuccauuucacu

SEQ ID NO: 1791159 - RNA, 15 nt, Homo sapiens
ccaaacucaccugcc

SEQ ID NO: 1791160 - RNA, 21 nt, Homo sapiens
aaggcucuuacccccuuuuaa

SEQ ID NO: 1791161 - RNA, 20 nt, Homo sapiens
ucugugccagacauugcucu

SEQ ID NO: 1791162 - RNA, 15 nt, Homo sapiens
caguaccuuguugca

SEQ ID NO: 1791163 - RNA, 23 nt, Homo sapiens
aacaacuugucuauuaccuguua

SEQ ID NO: 1791164 - RNA, 12 nt, Homo sapiens
aggaagacauuu

SEQ ID NO: 1791165 - RNA, 19 nt, Homo sapiens
caguaaauguuugugaugu

SEQ ID NO: 1791166 - RNA, 22 nt, Homo sapiens
acuugaaauaccagugaaccaa

SEQ ID NO: 1791167 - RNA, 14 nt, Homo sapiens
ugacaaagacuccu

SEQ ID NO: 1791168 - RNA, 15 nt, Homo sapiens
ugaaagacuucacua

SEQ ID NO: 1791169 - RNA, 22 nt, Homo sapiens
aaccuuggaccacuccuguccc

SEQ ID NO: 1791170 - RNA, 15 nt, Homo sapiens
uaucuacuucuacau

SEQ ID NO: 1791171 - RNA, 18 nt, Homo sapiens
uguaauagccaaacccac

SEQ ID NO: 1791172 - RNA, 16 nt, Homo sapiens
acccacagcucugggc

SEQ ID NO: 1791173 - RNA, 21 nt, Homo sapiens
agcgcuucugcaccaacucac

SEQ ID NO: 1791174 - RNA, 13 nt, Homo sapiens
uagucucugugag

SEQ ID NO: 1791175 - RNA, 23 nt, Homo sapiens
uaaaaguuggcucaggagucuua

SEQ ID NO: 1791176 - RNA, 19 nt, Homo sapiens
aguccucgcggcucuccag

SEQ ID NO: 1791177 - RNA, 14 nt, Homo sapiens
uuaguucucaggca

SEQ ID NO: 1791178 - RNA, 15 nt, Homo sapiens
aucuuucucuuccca

SEQ ID NO: 1791179 - RNA, 14 nt, Homo sapiens
acucuugaacacaa

SEQ ID NO: 1791180 - RNA, 17 nt, Homo sapiens
auugugacuucacugua

SEQ ID NO: 1791181 - RNA, 18 nt, Homo sapiens
ugcaucccagcauucugu

SEQ ID NO: 1791182 - RNA, 23 nt, Homo sapiens
caccagcucuauucuuugccuua

SEQ ID NO: 1791183 - RNA, 16 nt, Homo sapiens
ccugucugaagccaua

SEQ ID NO: 1791184 - RNA, 21 nt, Homo sapiens
cugggcagggggcaugaugcg

SEQ ID NO: 1791185 - RNA, 12 nt, Homo sapiens
caagaugacagc

SEQ ID NO: 1791186 - RNA, 21 nt, Homo sapiens
cagaugaguuuuauugacuca

SEQ ID NO: 1791187 - RNA, 22 nt, Homo sapiens
gacucaacauuacauuugaacu

SEQ ID NO: 1791188 - RNA, 11 nt, Homo sapiens
ccuccaucucu

SEQ ID NO: 1791189 - RNA, 11 nt, Homo sapiens
cccccaucucc

SEQ ID NO: 1791190 - RNA, 13 nt, Homo sapiens
ugaagcugagcua

SEQ ID NO: 1791191 - RNA, 21 nt, Homo sapiens
ccucacucucgccaucuggca

SEQ ID NO: 1791192 - RNA, 19 nt, Homo sapiens
uuauuguuguugccaaaga

SEQ ID NO: 1791193 - RNA, 17 nt, Homo sapiens
cuuuggaagucaugagc

SEQ ID NO: 1791194 - RNA, 16 nt, Homo sapiens
acauaaacacauacau

SEQ ID NO: 1791195 - RNA, 17 nt, Homo sapiens
caccucuuccuugaugu

SEQ ID NO: 1791196 - RNA, 19 nt, Homo sapiens
gcuauguucugucuuccca

SEQ ID NO: 1791197 - RNA, 15 nt, Homo sapiens
uauccuauacugguu

SEQ ID NO: 1791198 - RNA, 21 nt, Homo sapiens
ucaaagagggagugcauuuau

SEQ ID NO: 1791199 - RNA, 22 nt, Homo sapiens
ccuuccuuaugccauauacaaa

SEQ ID NO: 1791200 - RNA, 12 nt, Homo sapiens
aggaacacugca

SEQ ID NO: 1791201 - RNA, 18 nt, Homo sapiens
acugggcagguuccuggg

SEQ ID NO: 1791202 - RNA, 15 nt, Homo sapiens
aucacaaauuucacu

SEQ ID NO: 1791203 - RNA, 16 nt, Homo sapiens
acucuuacagagccuu

SEQ ID NO: 1791204 - RNA, 19 nt, Homo sapiens
cagugauguuggcuagccc

SEQ ID NO: 1791205 - RNA, 13 nt, Homo sapiens
aagauuuaaguaa

SEQ ID NO: 1791206 - RNA, 12 nt, Homo sapiens
gcacaaggaaau

SEQ ID NO: 1791207 - RNA, 15 nt, Homo sapiens
ugaaauagacuguga

SEQ ID NO: 1791208 - RNA, 22 nt, Homo sapiens
agccaccucuugggcaugcuca

SEQ ID NO: 1791209 - RNA, 17 nt, Homo sapiens
auuaugcauaaagccaa

SEQ ID NO: 1791210 - RNA, 20 nt, Homo sapiens
guugaauaaauguaucugaa

SEQ ID NO: 1791211 - RNA, 12 nt, Homo sapiens
aauggauccuca

SEQ ID NO: 1791212 - RNA, 15 nt, Homo sapiens
gaaggauccgcauaa

SEQ ID NO: 1791213 - RNA, 19 nt, Homo sapiens
uuguucaauaauuacugua

SEQ ID NO: 1791214 - RNA, 20 nt, Homo sapiens
accauaucaggagaccuggg

SEQ ID NO: 1791215 - RNA, 14 nt, Homo sapiens
aguuccucuggguu

SEQ ID NO: 1791216 - RNA, 15 nt, Homo sapiens
caagcaggagacgac

SEQ ID NO: 1791217 - RNA, 22 nt, Homo sapiens
acugccagcccacccccuuuga

SEQ ID NO: 1791218 - RNA, 13 nt, Homo sapiens
auuuaagucuguc

SEQ ID NO: 1791219 - RNA, 22 nt, Homo sapiens
aagcugggacucauucacauuu

SEQ ID NO: 1791220 - RNA, 19 nt, Homo sapiens
ccacuuagaaauugcauuu

SEQ ID NO: 1791221 - RNA, 16 nt, Homo sapiens
uggauuaaaaccuuaa

SEQ ID NO: 1791222 - RNA, 14 nt, Homo sapiens
uuaauuacuuuuga

SEQ ID NO: 1791223 - RNA, 17 nt, Homo sapiens
ugguccaucucugaaaa

SEQ ID NO: 1791224 - RNA, 23 nt, Homo sapiens
ucccugaaguaagcaaagacuuu

SEQ ID NO: 1791225 - RNA, 18 nt, Homo sapiens
cugguugugggcacuggc

SEQ ID NO: 1791226 - RNA, 23 nt, Homo sapiens
gauggugacuuuugaagaacaaa

SEQ ID NO: 1791227 - RNA, 16 nt, Homo sapiens
acguauuggaccugcc

SEQ ID NO: 1791228 - RNA, 16 nt, Homo sapiens
ucguaaguucugugca

SEQ ID NO: 1791229 - RNA, 19 nt, Homo sapiens
agggucuucuuacaugcau

SEQ ID NO: 1791230 - RNA, 12 nt, Homo sapiens
caaaaugucuca

SEQ ID NO: 1791231 - RNA, 21 nt, Homo sapiens
aguccugcuccuuucugccca

SEQ ID NO: 1791232 - RNA, 17 nt, Homo sapiens
aaaugugucugcaacau

SEQ ID NO: 1791233 - RNA, 23 nt, Homo sapiens
agagcagcuuuaaacucagggac

SEQ ID NO: 1791234 - RNA, 18 nt, Homo sapiens
cuauuuuaaagacaaugu

SEQ ID NO: 1791235 - RNA, 16 nt, Homo sapiens
cauagucuguuccuuu

SEQ ID NO: 1791236 - RNA, 15 nt, Homo sapiens
cuaucugaacuaauu

SEQ ID NO: 1791237 - RNA, 18 nt, Homo sapiens
aaacaggaaguggacauu

SEQ ID NO: 1791238 - RNA, 17 nt, Homo sapiens
acuuauuggaacucugc

SEQ ID NO: 1791239 - RNA, 16 nt, Homo sapiens
acgaugugacugccau

SEQ ID NO: 1791240 - RNA, 17 nt, Homo sapiens
uguuuuagcuccuugac

SEQ ID NO: 1791241 - RNA, 15 nt, Homo sapiens
aauuaaugacaacaa

SEQ ID NO: 1791242 - RNA, 12 nt, Homo sapiens
ccugcugccauc

SEQ ID NO: 1791243 - RNA, 12 nt, Homo sapiens
ccuccugccaug

SEQ ID NO: 1791244 - RNA, 19 nt, Homo sapiens
agcaccuguugugugccug

SEQ ID NO: 1791245 - RNA, 17 nt, Homo sapiens
gcagaugccugcagugc

SEQ ID NO: 1791246 - RNA, 18 nt, Homo sapiens
augcauucuuucuucucu

SEQ ID NO: 1791247 - RNA, 20 nt, Homo sapiens
cucuuucucccagcuucaaa

SEQ ID NO: 1791248 - RNA, 14 nt, Homo sapiens
cauugacaccagaa

SEQ ID NO: 1791249 - RNA, 15 nt, Homo sapiens
auuuacaguuuccag

SEQ ID NO: 1791250 - RNA, 20 nt, Homo sapiens
ucccugggccuuagguuuga

SEQ ID NO: 1791251 - RNA, 18 nt, Homo sapiens
ccagugauccauguccug

SEQ ID NO: 1791252 - RNA, 21 nt, Homo sapiens
uggaggcacugaagugcuuag

SEQ ID NO: 1791253 - RNA, 13 nt, Homo sapiens
aagcuuaggucaa

SEQ ID NO: 1791254 - RNA, 20 nt, Homo sapiens
uaauugcuuuuucacaguca

SEQ ID NO: 1791255 - RNA, 16 nt, Homo sapiens
uguccuuaugcuuuua

SEQ ID NO: 1791256 - RNA, 13 nt, Homo sapiens
ugcaaaauggaga

SEQ ID NO: 1791257 - RNA, 23 nt, Homo sapiens
aaaccauguaguuuuaacagaac

SEQ ID NO: 1791258 - RNA, 13 nt, Homo sapiens
aggacuguagaaa

SEQ ID NO: 1791259 - RNA, 20 nt, Homo sapiens
uccagcgugacggagcccac

SEQ ID NO: 1791260 - RNA, 15 nt, Homo sapiens
uccaaacccacucau

SEQ ID NO: 1791261 - RNA, 16 nt, Homo sapiens
cuauggcacccaugca

SEQ ID NO: 1791262 - RNA, 19 nt, Homo sapiens
cccagucuccccacuccac

SEQ ID NO: 1791263 - RNA, 15 nt, Homo sapiens
guucccuguucuucc

SEQ ID NO: 1791264 - RNA, 17 nt, Homo sapiens
augauggugcugaccuc

SEQ ID NO: 1791265 - RNA, 15 nt, Homo sapiens
ccacgaggugcaaca

SEQ ID NO: 1791266 - RNA, 23 nt, Homo sapiens
ccuucccccgcucccccaaaaau

SEQ ID NO: 1791267 - RNA, 13 nt, Homo sapiens
uggauggccucug

SEQ ID NO: 1791268 - RNA, 15 nt, Homo sapiens
cugauccuuguggca

SEQ ID NO: 1791269 - RNA, 18 nt, Homo sapiens
cuuuuaacagaacagaca

SEQ ID NO: 1791270 - RNA, 19 nt, Homo sapiens
ugccaggcaccaucugcca

SEQ ID NO: 1791271 - RNA, 18 nt, Homo sapiens
gaauauucaaaauuccaa

SEQ ID NO: 1791272 - RNA, 15 nt, Homo sapiens
ggugaauaagauuaa

SEQ ID NO: 1791273 - RNA, 13 nt, Homo sapiens
cuacccugccucc

SEQ ID NO: 1791274 - RNA, 17 nt, Homo sapiens
cuucuaaucaaagcuuu

SEQ ID NO: 1791275 - RNA, 16 nt, Homo sapiens
gucuugccaugugcug

SEQ ID NO: 1791276 - RNA, 22 nt, Homo sapiens
caucuugcucugcugacagaca

SEQ ID NO: 1791277 - RNA, 21 nt, Homo sapiens
aaacuggguuugggcuuugcu

SEQ ID NO: 1791278 - RNA, 15 nt, Homo sapiens
auuagagaguggcaa

SEQ ID NO: 1791279 - RNA, 19 nt, Homo sapiens
caauaauauuguuguauaa

SEQ ID NO: 1791280 - RNA, 23 nt, Homo sapiens
agaagugaguuuguaaauauucu

SEQ ID NO: 1791281 - RNA, 18 nt, Homo sapiens
aaaucuguuuauaugaca

SEQ ID NO: 1791282 - RNA, 15 nt, Homo sapiens
aaugcauugucaaua

SEQ ID NO: 1791283 - RNA, 18 nt, Homo sapiens
cucacuugugcaguguug

SEQ ID NO: 1791284 - RNA, 19 nt, Homo sapiens
aaaaugaauaauacauuga

SEQ ID NO: 1791285 - RNA, 21 nt, Homo sapiens
cagaaaccaagucuacuucac

SEQ ID NO: 1791286 - RNA, 17 nt, Homo sapiens
cgggggggacccuccaa

SEQ ID NO: 1791287 - RNA, 13 nt, Homo sapiens
aauacuacaauag

SEQ ID NO: 1791288 - RNA, 13 nt, Homo sapiens
ccagcuacccagg

SEQ ID NO: 1791289 - RNA, 14 nt, Homo sapiens
gcugucuugucauc

SEQ ID NO: 1791290 - RNA, 14 nt, Homo sapiens
cauuacauguaaau

SEQ ID NO: 1791291 - RNA, 16 nt, Homo sapiens
uaaaagucacauaaaa

SEQ ID NO: 1791292 - RNA, 21 nt, Homo sapiens
ccgacacugagcugugaccca

SEQ ID NO: 1791293 - RNA, 18 nt, Homo sapiens
aggauauuggaaugcaca

SEQ ID NO: 1791294 - RNA, 19 nt, Homo sapiens
ccaugcauacguacauucc

SEQ ID NO: 1791295 - RNA, 16 nt, Homo sapiens
aaccuaccagccagag

SEQ ID NO: 1791296 - RNA, 20 nt, Homo sapiens
uugcuuuugacuccaggaac

SEQ ID NO: 1791297 - RNA, 16 nt, Homo sapiens
ggucaagaacaugcaa

SEQ ID NO: 1791298 - RNA, 16 nt, Homo sapiens
gacaacagcauaacua

SEQ ID NO: 1791299 - RNA, 21 nt, Homo sapiens
acacaccaccaugcucaacua

SEQ ID NO: 1791300 - RNA, 16 nt, Homo sapiens
aauaaaugugccuuca

SEQ ID NO: 1791301 - RNA, 13 nt, Homo sapiens
auaucucuccagc

SEQ ID NO: 1791302 - RNA, 13 nt, Homo sapiens
aguuacacuaaaa

SEQ ID NO: 1791303 - RNA, 16 nt, Homo sapiens
aagaagaguuucuccu

SEQ ID NO: 1791304 - RNA, 19 nt, Homo sapiens
uuauuccccccuacuugag

SEQ ID NO: 1791305 - RNA, 13 nt, Homo sapiens
accugucugcucc

SEQ ID NO: 1791306 - RNA, 15 nt, Homo sapiens
ccagaggcaccucaa

SEQ ID NO: 1791307 - RNA, 19 nt, Homo sapiens
uacaugggccucugaugga

SEQ ID NO: 1791308 - RNA, 17 nt, Homo sapiens
cagugacaaggcccuga

SEQ ID NO: 1791309 - RNA, 16 nt, Homo sapiens
augcuguuagguugcg

SEQ ID NO: 1791310 - RNA, 21 nt, Homo sapiens
ccucuucugggcuacugccac

SEQ ID NO: 1791311 - RNA, 16 nt, Homo sapiens
guggacaggacuaaca

SEQ ID NO: 1791312 - RNA, 16 nt, Homo sapiens
uuaauuuucaaaacaa

SEQ ID NO: 1791313 - RNA, 18 nt, Homo sapiens
ugaaaauaaaaguuuccu

SEQ ID NO: 1791314 - RNA, 22 nt, Homo sapiens
uacaguauuguggcugcacuug

SEQ ID NO: 1791315 - RNA, 13 nt, Homo sapiens
cucaagacuggca

SEQ ID NO: 1791316 - RNA, 19 nt, Homo sapiens
ggacagacuggccgggcag

SEQ ID NO: 1791317 - RNA, 19 nt, Homo sapiens
cuuauuuuuguucauauua

SEQ ID NO: 1791318 - RNA, 22 nt, Homo sapiens
ugaaagaaagcugagaagaaug

SEQ ID NO: 1791319 - RNA, 19 nt, Homo sapiens
gucaagccugugcaaaaaa

SEQ ID NO: 1791320 - RNA, 16 nt, Homo sapiens
uugcaguuuacaguau

SEQ ID NO: 1791321 - RNA, 20 nt, Homo sapiens
cuuagaguuaccacacccca

SEQ ID NO: 1791322 - RNA, 21 nt, Homo sapiens
aaacccagauugaagcuaaaa

SEQ ID NO: 1791323 - RNA, 22 nt, Homo sapiens
guccaacauuuuuucccaguga

SEQ ID NO: 1791324 - RNA, 16 nt, Homo sapiens
aucacuguaaagacaa

SEQ ID NO: 1791325 - RNA, 18 nt, Homo sapiens
acccaguaggguuugaca

SEQ ID NO: 1791326 - RNA, 17 nt, Homo sapiens
cuguguccgcuuucaug

SEQ ID NO: 1791327 - RNA, 12 nt, Homo sapiens
cucucucugugu

SEQ ID NO: 1791328 - RNA, 18 nt, Homo sapiens
guauugugucuuuugcau

SEQ ID NO: 1791329 - RNA, 17 nt, Homo sapiens
caaauaacugaugaagg

SEQ ID NO: 1791330 - RNA, 16 nt, Homo sapiens
aguuucauaccaaaua

SEQ ID NO: 1791331 - RNA, 19 nt, Homo sapiens
aagcuggcuuuucccauuu

SEQ ID NO: 1791332 - RNA, 23 nt, Homo sapiens
gucugcuggcuucuacacugggu

SEQ ID NO: 1791333 - RNA, 17 nt, Homo sapiens
uuugugaauauuuucaa

SEQ ID NO: 1791334 - RNA, 16 nt, Homo sapiens
uuauacaaauuuaacu

SEQ ID NO: 1791335 - RNA, 18 nt, Homo sapiens
caggcgcacaccaccacg

SEQ ID NO: 1791336 - RNA, 21 nt, Homo sapiens
cuuaagcacacuugacaucaa

SEQ ID NO: 1791337 - RNA, 15 nt, Homo sapiens
guaccuuucugacaa

SEQ ID NO: 1791338 - RNA, 21 nt, Homo sapiens
aaguucuauuuauuugugaga

SEQ ID NO: 1791339 - RNA, 16 nt, Homo sapiens
cacagaugugugauuc

SEQ ID NO: 1791340 - RNA, 18 nt, Homo sapiens
uuguaaaguuucuagaau

SEQ ID NO: 1791341 - RNA, 18 nt, Homo sapiens
aagccauuuuccagugac

SEQ ID NO: 1791342 - RNA, 15 nt, Homo sapiens
cuuuggaauggugua

SEQ ID NO: 1791343 - RNA, 23 nt, Homo sapiens
cuuaucgggcuccagccaucuca

SEQ ID NO: 1791344 - RNA, 19 nt, Homo sapiens
gaguuguuuaaacagucaa

SEQ ID NO: 1791345 - RNA, 20 nt, Homo sapiens
cuucauaugaaaggugccau

SEQ ID NO: 1791346 - RNA, 20 nt, Homo sapiens
ggguuuccauggcuucccag

SEQ ID NO: 1791347 - RNA, 15 nt, Homo sapiens
ugacuuuugcaauuc

SEQ ID NO: 1791348 - RNA, 21 nt, Homo sapiens
gaaaucuuugguggccaaaga

SEQ ID NO: 1791349 - RNA, 20 nt, Homo sapiens
cacauagcaggggcaccuuc

SEQ ID NO: 1791350 - RNA, 17 nt, Homo sapiens
ugucuuguucacugcag

SEQ ID NO: 1791351 - RNA, 22 nt, Homo sapiens
aguuuguguguauuuguauuaa

SEQ ID NO: 1791352 - RNA, 18 nt, Homo sapiens
ugugcaugugugugcuca

SEQ ID NO: 1791353 - RNA, 20 nt, Homo sapiens
uauuuuauacucauggaaga

SEQ ID NO: 1791354 - RNA, 18 nt, Homo sapiens
cauucagucaagugaggu

SEQ ID NO: 1791355 - RNA, 17 nt, Homo sapiens
ugccaucgggugccaaa

SEQ ID NO: 1791356 - RNA, 20 nt, Homo sapiens
aauuucaguaaacaaugaau

SEQ ID NO: 1791357 - RNA, 12 nt, Homo sapiens
uucuggcugaga

SEQ ID NO: 1791358 - RNA, 23 nt, Homo sapiens
caacauaauuuuuauuuuuggca

SEQ ID NO: 1791359 - RNA, 14 nt, Homo sapiens
aaugucugccacac

SEQ ID NO: 1791360 - RNA, 18 nt, Homo sapiens
cuacccuggcccagauga

SEQ ID NO: 1791361 - RNA, 20 nt, Homo sapiens
gacuuggaguaaaacuguau

SEQ ID NO: 1791362 - RNA, 22 nt, Homo sapiens
caaaucauguuuuuucugcaau

SEQ ID NO: 1791363 - RNA, 21 nt, Homo sapiens
aauccaggcuuuauguacaaa

SEQ ID NO: 1791364 - RNA, 22 nt, Homo sapiens
cgacccucggugcagagugcag

SEQ ID NO: 1791365 - RNA, 13 nt, Homo sapiens
ccaaaaacauuug

SEQ ID NO: 1791366 - RNA, 22 nt, Homo sapiens
agcuccaccuuacuucuucuca

SEQ ID NO: 1791367 - RNA, 17 nt, Homo sapiens
ugacauuucacuaaaag

SEQ ID NO: 1791368 - RNA, 22 nt, Homo sapiens
cucuguagggaacucugggguc

SEQ ID NO: 1791369 - RNA, 16 nt, Homo sapiens
cuucaugaagcagauu

SEQ ID NO: 1791370 - RNA, 22 nt, Homo sapiens
gugcucuacaccuuagugcagc

SEQ ID NO: 1791371 - RNA, 14 nt, Homo sapiens
aauuuggucaagaa

SEQ ID NO: 1791372 - RNA, 22 nt, Homo sapiens
uugaaacccguggcgcuuucug

SEQ ID NO: 1791373 - RNA, 11 nt, Homo sapiens
cuucacugagc

SEQ ID NO: 1791374 - RNA, 17 nt, Homo sapiens
auucucauggcuuuguu

SEQ ID NO: 1791375 - RNA, 12 nt, Homo sapiens
ggcguuauuuau

SEQ ID NO: 1791376 - RNA, 15 nt, Homo sapiens
guggugucugugaag

SEQ ID NO: 1791377 - RNA, 15 nt, Homo sapiens
acuuuccucagugac

SEQ ID NO: 1791378 - RNA, 14 nt, Homo sapiens
uuuacccaagagaa

SEQ ID NO: 1791379 - RNA, 14 nt, Homo sapiens
aagguagugaguaa

SEQ ID NO: 1791380 - RNA, 18 nt, Homo sapiens
agcauucucuccauuuca

SEQ ID NO: 1791381 - RNA, 12 nt, Homo sapiens
aaggcuguguca

SEQ ID NO: 1791382 - RNA, 19 nt, Homo sapiens
caauugaccuucucccuca

SEQ ID NO: 1791383 - RNA, 14 nt, Homo sapiens
auaaagacugagac

SEQ ID NO: 1791384 - RNA, 17 nt, Homo sapiens
cagcgucacaucugcag

SEQ ID NO: 1791385 - RNA, 14 nt, Homo sapiens
gauagagacauaga

SEQ ID NO: 1791386 - RNA, 17 nt, Homo sapiens
aaauuaacaguccuaac

SEQ ID NO: 1791387 - RNA, 16 nt, Homo sapiens
uugagccaguggugcu

SEQ ID NO: 1791388 - RNA, 16 nt, Homo sapiens
accaugcucaaugaaa

SEQ ID NO: 1791389 - RNA, 19 nt, Homo sapiens
cuuccugcccuaacucugc

SEQ ID NO: 1791390 - RNA, 21 nt, Homo sapiens
ucuagagggagaagacugugc

SEQ ID NO: 1791391 - RNA, 15 nt, Homo sapiens
cucagauagaccugu

SEQ ID NO: 1791392 - RNA, 22 nt, Homo sapiens
uuuucuccaacuuggucuuuca

SEQ ID NO: 1791393 - RNA, 19 nt, Homo sapiens
aagagucuacccgacauaa

SEQ ID NO: 1791394 - RNA, 15 nt, Homo sapiens
aggagagaaaacugc

SEQ ID NO: 1791395 - RNA, 23 nt, Homo sapiens
cccaacugaguguuauuugcaca

SEQ ID NO: 1791396 - RNA, 15 nt, Homo sapiens
uaucaguacaugccu

SEQ ID NO: 1791397 - RNA, 12 nt, Homo sapiens
cuagacuugaaa

SEQ ID NO: 1791398 - RNA, 16 nt, Homo sapiens
agaagacaccaccauu

SEQ ID NO: 1791399 - RNA, 14 nt, Homo sapiens
uagagcacaacaua

SEQ ID NO: 1791400 - RNA, 18 nt, Homo sapiens
agugcucuguaaaacaca

SEQ ID NO: 1791401 - RNA, 20 nt, Homo sapiens
aggccgaggaauccucagag

SEQ ID NO: 1791402 - RNA, 14 nt, Homo sapiens
cagcggugggaccu

SEQ ID NO: 1791403 - RNA, 15 nt, Homo sapiens
gugcagcaaccagag

SEQ ID NO: 1791404 - RNA, 13 nt, Homo sapiens
ccucugugcagac

SEQ ID NO: 1791405 - RNA, 14 nt, Homo sapiens
guaaagcuguucaa

SEQ ID NO: 1791406 - RNA, 12 nt, Homo sapiens
gcacuguucaau

SEQ ID NO: 1791407 - RNA, 21 nt, Homo sapiens
cugcagaugccacccuagcca

SEQ ID NO: 1791408 - RNA, 13 nt, Homo sapiens
cgagggccaggca

SEQ ID NO: 1791409 - RNA, 18 nt, Homo sapiens
aauaggcaccauugcuua

SEQ ID NO: 1791410 - RNA, 20 nt, Homo sapiens
agaaaaugcuuucucaugca

SEQ ID NO: 1791411 - RNA, 16 nt, Homo sapiens
uuuuaucuugcacuua

SEQ ID NO: 1791412 - RNA, 18 nt, Homo sapiens
ccugaaguuggagugagu

SEQ ID NO: 1791413 - RNA, 17 nt, Homo sapiens
aucuauuauaaaaccau

SEQ ID NO: 1791414 - RNA, 14 nt, Homo sapiens
gauucuaacauauu

SEQ ID NO: 1791415 - RNA, 23 nt, Homo sapiens
uacuucuugugcuuuacucugaa

SEQ ID NO: 1791416 - RNA, 19 nt, Homo sapiens
gaauuccaaagcaaaacca

SEQ ID NO: 1791417 - RNA, 16 nt, Homo sapiens
aggguuaaggccugaa

SEQ ID NO: 1791418 - RNA, 16 nt, Homo sapiens
cccagaccugagcucc

SEQ ID NO: 1791419 - RNA, 16 nt, Homo sapiens
uguuuauuuuuguaca

SEQ ID NO: 1791420 - RNA, 16 nt, Homo sapiens
uuguaauuugggaaca

SEQ ID NO: 1791421 - RNA, 15 nt, Homo sapiens
cacagucauacaagu

SEQ ID NO: 1791422 - RNA, 14 nt, Homo sapiens
aaaacagaugucag

SEQ ID NO: 1791423 - RNA, 23 nt, Homo sapiens
ggaacugcuauuuuccuguucua

SEQ ID NO: 1791424 - RNA, 13 nt, Homo sapiens
gagagcucaccau

SEQ ID NO: 1791425 - RNA, 13 nt, Homo sapiens
gggauauguuaac

SEQ ID NO: 1791426 - RNA, 15 nt, Homo sapiens
ugcccugaucccaga

SEQ ID NO: 1791427 - RNA, 16 nt, Homo sapiens
acccagccucuaggga

SEQ ID NO: 1791428 - RNA, 17 nt, Homo sapiens
cuacacaggagucuuca

SEQ ID NO: 1791429 - RNA, 15 nt, Homo sapiens
gaguacaaacacagg

SEQ ID NO: 1791430 - RNA, 16 nt, Homo sapiens
gccuaaggugucugag

SEQ ID NO: 1791431 - RNA, 21 nt, Homo sapiens
ccuuagggugcugagugccug

SEQ ID NO: 1791432 - RNA, 21 nt, Homo sapiens
cuucuccagggaauucuuaca

SEQ ID NO: 1791433 - RNA, 17 nt, Homo sapiens
auacuguacugauacua

SEQ ID NO: 1791434 - RNA, 19 nt, Homo sapiens
aguguaccauucucaggug

SEQ ID NO: 1791435 - RNA, 13 nt, Homo sapiens
uguuacagauuaa

SEQ ID NO: 1791436 - RNA, 20 nt, Homo sapiens
accucccgcccucaccugca

SEQ ID NO: 1791437 - RNA, 20 nt, Homo sapiens
uuccagaaauacuacugugu

SEQ ID NO: 1791438 - RNA, 19 nt, Homo sapiens
agcugaagugccuugugaa

SEQ ID NO: 1791439 - RNA, 22 nt, Homo sapiens
gcaguggcgugaucucagcuca

SEQ ID NO: 1791440 - RNA, 16 nt, Homo sapiens
gagguccugagcacug

SEQ ID NO: 1791441 - RNA, 22 nt, Homo sapiens
caaccccuguacccagcuccuu

SEQ ID NO: 1791442 - RNA, 18 nt, Homo sapiens
cagaggccuggugcccug

SEQ ID NO: 1791443 - RNA, 16 nt, Homo sapiens
auaaacaugucugccc

SEQ ID NO: 1791444 - RNA, 20 nt, Homo sapiens
ccaaaguucucccugccauc

SEQ ID NO: 1791445 - RNA, 13 nt, Homo sapiens
gauuuauaucuau

SEQ ID NO: 1791446 - RNA, 20 nt, Homo sapiens
acgugguaugaaaugucuga

SEQ ID NO: 1791447 - RNA, 13 nt, Homo sapiens
gagucagauggca

SEQ ID NO: 1791448 - RNA, 14 nt, Homo sapiens
accucuuagcuuuu

SEQ ID NO: 1791449 - RNA, 22 nt, Homo sapiens
ugcauauuauaaaggauaaaga

SEQ ID NO: 1791450 - RNA, 20 nt, Homo sapiens
aggggcuguguuuccaucuc

SEQ ID NO: 1791451 - RNA, 19 nt, Homo sapiens
caggcuacuguucuugaca

SEQ ID NO: 1791452 - RNA, 22 nt, Homo sapiens
cucuucaccccuacacugugaa

SEQ ID NO: 1791453 - RNA, 17 nt, Homo sapiens
cucuagcuacacuauug

SEQ ID NO: 1791454 - RNA, 18 nt, Homo sapiens
aagaccaugccuaggaac

SEQ ID NO: 1791455 - RNA, 12 nt, Homo sapiens
auagaggcuucu

SEQ ID NO: 1791456 - RNA, 19 nt, Homo sapiens
gagacaugcugacuuucau

SEQ ID NO: 1791457 - RNA, 17 nt, Homo sapiens
cucuggacaagucaucu

SEQ ID NO: 1791458 - RNA, 18 nt, Homo sapiens
aggcaaucaagucucaca

SEQ ID NO: 1791459 - RNA, 18 nt, Homo sapiens
aaauaaaggugacuggga

SEQ ID NO: 1791460 - RNA, 13 nt, Homo sapiens
caaccuccugggu

SEQ ID NO: 1791461 - RNA, 16 nt, Homo sapiens
cauaugcagaacguau

SEQ ID NO: 1791462 - RNA, 17 nt, Homo sapiens
gaaaguuuuguucugua

SEQ ID NO: 1791463 - RNA, 14 nt, Homo sapiens
ccuggccucaagug

SEQ ID NO: 1791464 - RNA, 16 nt, Homo sapiens
gauauuagucauagaa

SEQ ID NO: 1791465 - RNA, 22 nt, Homo sapiens
aauguuugucuggauuggcuau

SEQ ID NO: 1791466 - RNA, 15 nt, Homo sapiens
uaauaagaacauuaa

SEQ ID NO: 1791467 - RNA, 15 nt, Homo sapiens
ucuggaggcaaucaa

SEQ ID NO: 1791468 - RNA, 15 nt, Homo sapiens
aggguugccuuggca

SEQ ID NO: 1791469 - RNA, 21 nt, Homo sapiens
ugcucacaaaggauacuuuua

SEQ ID NO: 1791470 - RNA, 15 nt, Homo sapiens
gucuguccaccccau

SEQ ID NO: 1791471 - RNA, 21 nt, Homo sapiens
gcagguuccuuaucugucaca

SEQ ID NO: 1791472 - RNA, 22 nt, Homo sapiens
uugggaggaagcccaguagcca

SEQ ID NO: 1791473 - RNA, 16 nt, Homo sapiens
aaaacuauuugggaua

SEQ ID NO: 1791474 - RNA, 21 nt, Homo sapiens
caucuccagacucuaccacuu

SEQ ID NO: 1791475 - RNA, 16 nt, Homo sapiens
ucuucucaaguucuaa

SEQ ID NO: 1791476 - RNA, 16 nt, Homo sapiens
ccugccuuccagccac

SEQ ID NO: 1791477 - RNA, 13 nt, Homo sapiens
cuaacuucaucau

SEQ ID NO: 1791478 - RNA, 13 nt, Homo sapiens
uuuuaauguacaa

SEQ ID NO: 1791479 - RNA, 13 nt, Homo sapiens
auuuuaugaacau

SEQ ID NO: 1791480 - RNA, 22 nt, Homo sapiens
acaaacucgcacaaccaugacg

SEQ ID NO: 1791481 - RNA, 19 nt, Homo sapiens
gagcaguggcugguccagg

SEQ ID NO: 1791482 - RNA, 20 nt, Homo sapiens
ucuggccuaugacccugugc

SEQ ID NO: 1791483 - RNA, 13 nt, Homo sapiens
gagguacucuccu

SEQ ID NO: 1791484 - RNA, 14 nt, Homo sapiens
aacccucugugaaa

SEQ ID NO: 1791485 - RNA, 18 nt, Homo sapiens
gauauuuauuacuuccuc

SEQ ID NO: 1791486 - RNA, 21 nt, Homo sapiens
aaaagaaagcaaacuuaagaa

SEQ ID NO: 1791487 - RNA, 20 nt, Homo sapiens
aaguuuauuuuuucuacaca

SEQ ID NO: 1791488 - RNA, 21 nt, Homo sapiens
aaaaguuuuguaaauuucucu

SEQ ID NO: 1791489 - RNA, 19 nt, Homo sapiens
ccuggaggccaaggugugg

SEQ ID NO: 1791490 - RNA, 23 nt, Homo sapiens
agcaaaauaguauugcugaacuc

SEQ ID NO: 1791491 - RNA, 22 nt, Homo sapiens
cugauguuuauguacuguaaac

SEQ ID NO: 1791492 - RNA, 14 nt, Homo sapiens
cuacucugagacaa

SEQ ID NO: 1791493 - RNA, 17 nt, Homo sapiens
auuuaagaaaaaucaua

SEQ ID NO: 1791494 - RNA, 18 nt, Homo sapiens
caugagaugagaugacca

SEQ ID NO: 1791495 - RNA, 15 nt, Homo sapiens
caaauaugcacuuuc

SEQ ID NO: 1791496 - RNA, 15 nt, Homo sapiens
uuauuuuguucauac

SEQ ID NO: 1791497 - RNA, 16 nt, Homo sapiens
accacugugguuuuga

SEQ ID NO: 1791498 - RNA, 20 nt, Homo sapiens
uuaggaagaaaucacuuaaa

SEQ ID NO: 1791499 - RNA, 13 nt, Homo sapiens
uugucuacacucu

SEQ ID NO: 1791500 - RNA, 21 nt, Homo sapiens
gcgcaaucuuaacucauugca

SEQ ID NO: 1791501 - RNA, 16 nt, Homo sapiens
ucuccaauguccaaaa

SEQ ID NO: 1791502 - RNA, 19 nt, Homo sapiens
cacagaccccuagggauuu

SEQ ID NO: 1791503 - RNA, 19 nt, Homo sapiens
aacgauaaaauuacaaaag

SEQ ID NO: 1791504 - RNA, 20 nt, Homo sapiens
caguggacagugcuguugaa

SEQ ID NO: 1791505 - RNA, 22 nt, Homo sapiens
cugagauauugggacacacauc

SEQ ID NO: 1791506 - RNA, 21 nt, Homo sapiens
cugaagggaaggcaaaggcag

SEQ ID NO: 1791507 - RNA, 13 nt, Homo sapiens
cuccagugcaguc

SEQ ID NO: 1791508 - RNA, 15 nt, Homo sapiens
aauaaggcugagacc

SEQ ID NO: 1791509 - RNA, 16 nt, Homo sapiens
uugguuuuguacugga

SEQ ID NO: 1791510 - RNA, 18 nt, Homo sapiens
ggcaaggauccugugcug

SEQ ID NO: 1791511 - RNA, 16 nt, Homo sapiens
ugaguucaagucaaau

SEQ ID NO: 1791512 - RNA, 19 nt, Homo sapiens
ggauaaaugucuuuccaaa

SEQ ID NO: 1791513 - RNA, 16 nt, Homo sapiens
ggccccagaucugccu

SEQ ID NO: 1791514 - RNA, 15 nt, Homo sapiens
aaauguuugaguauu

SEQ ID NO: 1791515 - RNA, 14 nt, Homo sapiens
auacugaauauuga

SEQ ID NO: 1791516 - RNA, 19 nt, Homo sapiens
caugucugccuaugcacug

SEQ ID NO: 1791517 - RNA, 21 nt, Homo sapiens
ucugaaucuucugaaaccaaa

SEQ ID NO: 1791518 - RNA, 22 nt, Homo sapiens
aaucucuugccugcuccaucuc

SEQ ID NO: 1791519 - RNA, 15 nt, Homo sapiens
accccaaaucccaca

SEQ ID NO: 1791520 - RNA, 19 nt, Homo sapiens
gugaguccgggaaucucuu

SEQ ID NO: 1791521 - RNA, 19 nt, Homo sapiens
ccaggaguucugaagcuga

SEQ ID NO: 1791522 - RNA, 17 nt, Homo sapiens
agaucuacuacauccca

SEQ ID NO: 1791523 - RNA, 14 nt, Homo sapiens
aaguauuaauguac

SEQ ID NO: 1791524 - RNA, 15 nt, Homo sapiens
ucaguucccuccugc

SEQ ID NO: 1791525 - RNA, 15 nt, Homo sapiens
uaacacggugcucau

SEQ ID NO: 1791526 - RNA, 15 nt, Homo sapiens
cagccuacacugcca

SEQ ID NO: 1791527 - RNA, 18 nt, Homo sapiens
uccaagcauuucaugaaa

SEQ ID NO: 1791528 - RNA, 16 nt, Homo sapiens
uccaagcuuggcuguc

SEQ ID NO: 1791529 - RNA, 13 nt, Homo sapiens
acaauauugcucc

SEQ ID NO: 1791530 - RNA, 15 nt, Homo sapiens
ugaaaugguugucac

SEQ ID NO: 1791531 - RNA, 16 nt, Homo sapiens
gcccgcauagcacuug

SEQ ID NO: 1791532 - RNA, 22 nt, Homo sapiens
aaacagccuucuagcacacuuu

SEQ ID NO: 1791533 - RNA, 18 nt, Homo sapiens
augguucccaagcgucau

SEQ ID NO: 1791534 - RNA, 14 nt, Homo sapiens
uuugcuaucaaaau

SEQ ID NO: 1791535 - RNA, 17 nt, Homo sapiens
uagaauugagucuucca

SEQ ID NO: 1791536 - RNA, 20 nt, Homo sapiens
uccuacuuugcuucucucca

SEQ ID NO: 1791537 - RNA, 20 nt, Homo sapiens
auuuuaaaaaauaacauauu

SEQ ID NO: 1791538 - RNA, 20 nt, Homo sapiens
acucuauaagauuccaaaaa

SEQ ID NO: 1791539 - RNA, 11 nt, Homo sapiens
uguauauccaa

SEQ ID NO: 1791540 - RNA, 13 nt, Homo sapiens
uucgcacaaugca

SEQ ID NO: 1791541 - RNA, 13 nt, Homo sapiens
aaggaacauaccc

SEQ ID NO: 1791542 - RNA, 15 nt, Homo sapiens
gcuuccagcuucagg

SEQ ID NO: 1791543 - RNA, 19 nt, Homo sapiens
aagaaguggcugccaaaga

SEQ ID NO: 1791544 - RNA, 14 nt, Homo sapiens
ccuuguaaaagaca

SEQ ID NO: 1791545 - RNA, 16 nt, Homo sapiens
aaggagacacauucac

SEQ ID NO: 1791546 - RNA, 16 nt, Homo sapiens
cuugccugcuccaucu

SEQ ID NO: 1791547 - RNA, 14 nt, Homo sapiens
aucccacaaucuua

SEQ ID NO: 1791548 - RNA, 14 nt, Homo sapiens
gagucccagagcuc

SEQ ID NO: 1791549 - RNA, 14 nt, Homo sapiens
caucuucacauucu

SEQ ID NO: 1791550 - RNA, 21 nt, Homo sapiens
guagaccuagggaggaccuua

SEQ ID NO: 1791551 - RNA, 12 nt, Homo sapiens
agaacauucaau

SEQ ID NO: 1791552 - RNA, 14 nt, Homo sapiens
aguuaacaaugaua

SEQ ID NO: 1791553 - RNA, 21 nt, Homo sapiens
gccaaggagggugagugcaag

SEQ ID NO: 1791554 - RNA, 22 nt, Homo sapiens
ucagccuggccagacacaggcc

SEQ ID NO: 1791555 - RNA, 13 nt, Homo sapiens
uguaacagucuga

SEQ ID NO: 1791556 - RNA, 23 nt, Homo sapiens
cauuuagauuuugauaccaguga

SEQ ID NO: 1791557 - RNA, 16 nt, Homo sapiens
ucucuuuauagagcuc

SEQ ID NO: 1791558 - RNA, 19 nt, Homo sapiens
uaaagaauuuuaugucaua

SEQ ID NO: 1791559 - RNA, 22 nt, Homo sapiens
cccaagcugaauguucuugaau

SEQ ID NO: 1791560 - RNA, 14 nt, Homo sapiens
uuaggagaugucau

SEQ ID NO: 1791561 - RNA, 19 nt, Homo sapiens
agucuuccugacacuuuaa

SEQ ID NO: 1791562 - RNA, 23 nt, Homo sapiens
gcuuguagcagaaggcaagcacc

SEQ ID NO: 1791563 - RNA, 16 nt, Homo sapiens
uggaacauccuuugca

SEQ ID NO: 1791564 - RNA, 13 nt, Homo sapiens
gggaacucuccaa

SEQ ID NO: 1791565 - RNA, 16 nt, Homo sapiens
cuguucuaacauguaa

SEQ ID NO: 1791566 - RNA, 22 nt, Homo sapiens
gacccuugguguuucccuuccu

SEQ ID NO: 1791567 - RNA, 18 nt, Homo sapiens
agaaauaccugucuagga

SEQ ID NO: 1791568 - RNA, 20 nt, Homo sapiens
gaccuaccuagaugcuccuu

SEQ ID NO: 1791569 - RNA, 23 nt, Homo sapiens
gcugcaaauagccuuccugaccu

SEQ ID NO: 1791570 - RNA, 18 nt, Homo sapiens
acauaacuaaauuugaua

SEQ ID NO: 1791571 - RNA, 15 nt, Homo sapiens
cagccacccugagaa

SEQ ID NO: 1791572 - RNA, 17 nt, Homo sapiens
uuuacauccuucacugc

SEQ ID NO: 1791573 - RNA, 17 nt, Homo sapiens
auuaggcaaaguacaaa

SEQ ID NO: 1791574 - RNA, 22 nt, Homo sapiens
uaauccccaucauuacugguaa

SEQ ID NO: 1791575 - RNA, 12 nt, Homo sapiens
auaucucccuuu

SEQ ID NO: 1791576 - RNA, 17 nt, Homo sapiens
auguaacuauaaucucu

SEQ ID NO: 1791577 - RNA, 15 nt, Homo sapiens
cuuugucagcaauac

SEQ ID NO: 1791578 - RNA, 14 nt, Homo sapiens
uucugaaaugugca

SEQ ID NO: 1791579 - RNA, 17 nt, Homo sapiens
cuucuauucaaaugaag

SEQ ID NO: 1791580 - RNA, 20 nt, Homo sapiens
uauugccaggaauguuucag

SEQ ID NO: 1791581 - RNA, 19 nt, Homo sapiens
uggcugagccuggcuggag

SEQ ID NO: 1791582 - RNA, 18 nt, Homo sapiens
cccuggagacagaaguca

SEQ ID NO: 1791583 - RNA, 18 nt, Homo sapiens
guggaccgcccuuuuccc

SEQ ID NO: 1791584 - RNA, 20 nt, Homo sapiens
gagaaaggggaaguggucca

SEQ ID NO: 1791585 - RNA, 15 nt, Homo sapiens
acaacugauaauauu

SEQ ID NO: 1791586 - RNA, 15 nt, Homo sapiens
uaaacugaacauauu

SEQ ID NO: 1791587 - RNA, 21 nt, Homo sapiens
aauuucugugaaaccugugaa

SEQ ID NO: 1791588 - RNA, 13 nt, Homo sapiens
gugcuccaucucc

SEQ ID NO: 1791589 - RNA, 13 nt, Homo sapiens
cagucauccugca

SEQ ID NO: 1791590 - RNA, 17 nt, Homo sapiens
aggcggcuacaugccuc

SEQ ID NO: 1791591 - RNA, 16 nt, Homo sapiens
caucccuuuuuuuaca

SEQ ID NO: 1791592 - RNA, 16 nt, Homo sapiens
acaucuucuguuauug

SEQ ID NO: 1791593 - RNA, 22 nt, Homo sapiens
agaccucagagauggcuuccuu

SEQ ID NO: 1791594 - RNA, 22 nt, Homo sapiens
uagcgcuaucucccugccuccu

SEQ ID NO: 1791595 - RNA, 22 nt, Homo sapiens
ucagaacacccuguaccaucca

SEQ ID NO: 1791596 - RNA, 16 nt, Homo sapiens
uagugcuaguggauuu

SEQ ID NO: 1791597 - RNA, 13 nt, Homo sapiens
uuacacaaaacaa

SEQ ID NO: 1791598 - RNA, 13 nt, Homo sapiens
aaaaacaauucca

SEQ ID NO: 1791599 - RNA, 12 nt, Homo sapiens
ugagccagucau

SEQ ID NO: 1791600 - RNA, 20 nt, Homo sapiens
auaauaugcacacagugcuu

SEQ ID NO: 1791601 - RNA, 14 nt, Homo sapiens
guaaaagacugggg

SEQ ID NO: 1791602 - RNA, 15 nt, Homo sapiens
augcacucaucacaa

SEQ ID NO: 1791603 - RNA, 17 nt, Homo sapiens
gagaucacugaacuuuu

SEQ ID NO: 1791604 - RNA, 20 nt, Homo sapiens
guuucauauccagcugagug

SEQ ID NO: 1791605 - RNA, 16 nt, Homo sapiens
cuucucacaggcccaa

SEQ ID NO: 1791606 - RNA, 20 nt, Homo sapiens
ugaucuuagggaacuuugau

SEQ ID NO: 1791607 - RNA, 20 nt, Homo sapiens
ggauucuagaacugugaauu

SEQ ID NO: 1791608 - RNA, 15 nt, Homo sapiens
aucagugcacacgga

SEQ ID NO: 1791609 - RNA, 17 nt, Homo sapiens
uuuucuuugagucuguu

SEQ ID NO: 1791610 - RNA, 19 nt, Homo sapiens
aguugguuuagcuuuggaa

SEQ ID NO: 1791611 - RNA, 21 nt, Homo sapiens
uauuuaaauagaugacauuga

SEQ ID NO: 1791612 - RNA, 15 nt, Homo sapiens
cacaauccuccccac

SEQ ID NO: 1791613 - RNA, 16 nt, Homo sapiens
gcuaucacacaguggg

SEQ ID NO: 1791614 - RNA, 19 nt, Homo sapiens
auuuuacccaaauacucaa

SEQ ID NO: 1791615 - RNA, 18 nt, Homo sapiens
cugauguuaaaauuccau

SEQ ID NO: 1791616 - RNA, 18 nt, Homo sapiens
ggaauauaucaguaccuc

SEQ ID NO: 1791617 - RNA, 18 nt, Homo sapiens
uaaaugccauguuuauca

SEQ ID NO: 1791618 - RNA, 18 nt, Homo sapiens
caacaccguguccaaaaa

SEQ ID NO: 1791619 - RNA, 15 nt, Homo sapiens
aaaugucucauguca

SEQ ID NO: 1791620 - RNA, 16 nt, Homo sapiens
uaccuggaugccauug

SEQ ID NO: 1791621 - RNA, 16 nt, Homo sapiens
ugcacuucuguuccag

SEQ ID NO: 1791622 - RNA, 11 nt, Homo sapiens
uuuguaccauu

SEQ ID NO: 1791623 - RNA, 16 nt, Homo sapiens
aucuuuuauaacaccu

SEQ ID NO: 1791624 - RNA, 14 nt, Homo sapiens
gaaucccccaaaga

SEQ ID NO: 1791625 - RNA, 14 nt, Homo sapiens
cugagagaccaucu

SEQ ID NO: 1791626 - RNA, 18 nt, Homo sapiens
ugcccagcucagugccac

SEQ ID NO: 1791627 - RNA, 21 nt, Homo sapiens
auaccuugccuguaguccagu

SEQ ID NO: 1791628 - RNA, 20 nt, Homo sapiens
cagccugggcaacauaguga

SEQ ID NO: 1791629 - RNA, 17 nt, Homo sapiens
auaagugcagagauuaa

SEQ ID NO: 1791630 - RNA, 17 nt, Homo sapiens
gucagaacccugccaug

SEQ ID NO: 1791631 - RNA, 14 nt, Homo sapiens
auuauguuuccuaa

SEQ ID NO: 1791632 - RNA, 22 nt, Homo sapiens
gcauuuaaaauaccacuguaau

SEQ ID NO: 1791633 - RNA, 18 nt, Homo sapiens
ugcuugauugagugcucc

SEQ ID NO: 1791634 - RNA, 20 nt, Homo sapiens
aauaauguuguaauucaugc

SEQ ID NO: 1791635 - RNA, 21 nt, Homo sapiens
caggagggugacgcccagcuc

SEQ ID NO: 1791636 - RNA, 19 nt, Homo sapiens
gauugaaucaacaugcuuu

SEQ ID NO: 1791637 - RNA, 19 nt, Homo sapiens
uuguagccacaagccugaa

SEQ ID NO: 1791638 - RNA, 18 nt, Homo sapiens
agacaccagccuagccug

SEQ ID NO: 1791639 - RNA, 20 nt, Homo sapiens
gucuccuuugcucuugccaa

SEQ ID NO: 1791640 - RNA, 14 nt, Homo sapiens
acaugagucaagag

SEQ ID NO: 1791641 - RNA, 16 nt, Homo sapiens
cuccacuccaccucca

SEQ ID NO: 1791642 - RNA, 16 nt, Homo sapiens
cagcuguccugcagca

SEQ ID NO: 1791643 - RNA, 18 nt, Homo sapiens
cuuaggccuggaggccaa

SEQ ID NO: 1791644 - RNA, 13 nt, Homo sapiens
auaggagccacaa

SEQ ID NO: 1791645 - RNA, 18 nt, Homo sapiens
ucagcuuucccugccaca

SEQ ID NO: 1791646 - RNA, 18 nt, Homo sapiens
ccugggggcuuuugccac

SEQ ID NO: 1791647 - RNA, 16 nt, Homo sapiens
caucgcuuuugaccca

SEQ ID NO: 1791648 - RNA, 20 nt, Homo sapiens
gagggcagggacuuuggucu

SEQ ID NO: 1791649 - RNA, 16 nt, Homo sapiens
uguugucacaccugaa

SEQ ID NO: 1791650 - RNA, 18 nt, Homo sapiens
cugccuguugggccagga

SEQ ID NO: 1791651 - RNA, 20 nt, Homo sapiens
auggucccaggaagcaggga

SEQ ID NO: 1791652 - RNA, 17 nt, Homo sapiens
uggacagacacuguugc

SEQ ID NO: 1791653 - RNA, 20 nt, Homo sapiens
cgguggaagagcucaaggga

SEQ ID NO: 1791654 - RNA, 15 nt, Homo sapiens
ccuccacccauccag

SEQ ID NO: 1791655 - RNA, 15 nt, Homo sapiens
uccccaccuacccag

SEQ ID NO: 1791656 - RNA, 15 nt, Homo sapiens
auccuggaauaucuc

SEQ ID NO: 1791657 - RNA, 18 nt, Homo sapiens
ccuccuuagaccugaggg

SEQ ID NO: 1791658 - RNA, 14 nt, Homo sapiens
gcugucgcaucuca

SEQ ID NO: 1791659 - RNA, 20 nt, Homo sapiens
acuucugggucuccagggag

SEQ ID NO: 1791660 - RNA, 14 nt, Homo sapiens
aaagggacuaccuc

SEQ ID NO: 1791661 - RNA, 18 nt, Homo sapiens
ugucuacgggggcacuug

SEQ ID NO: 1791662 - RNA, 16 nt, Homo sapiens
aaaguacugcaaaaug

SEQ ID NO: 1791663 - RNA, 13 nt, Homo sapiens
ggcacugucaugc

SEQ ID NO: 1791664 - RNA, 13 nt, Homo sapiens
auggugcuuaaaa

SEQ ID NO: 1791665 - RNA, 15 nt, Homo sapiens
ucugacccugggcuu

SEQ ID NO: 1791666 - RNA, 17 nt, Homo sapiens
auagacaucaguauucu

SEQ ID NO: 1791667 - RNA, 17 nt, Homo sapiens
gccccuccugugacgca

SEQ ID NO: 1791668 - RNA, 14 nt, Homo sapiens
cuugauaaccauau

SEQ ID NO: 1791669 - RNA, 11 nt, Homo sapiens
accacugacag

SEQ ID NO: 1791670 - RNA, 20 nt, Homo sapiens
ccgagcaaaagacgagugau

SEQ ID NO: 1791671 - RNA, 18 nt, Homo sapiens
cucccaacacucuugggg

SEQ ID NO: 1791672 - RNA, 15 nt, Homo sapiens
gaugaauuauccugu

SEQ ID NO: 1791673 - RNA, 13 nt, Homo sapiens
auaaaaugcauuu

SEQ ID NO: 1791674 - RNA, 12 nt, Homo sapiens
uuguuacuguga

SEQ ID NO: 1791675 - RNA, 12 nt, Homo sapiens
uuaauacuguau

SEQ ID NO: 1791676 - RNA, 22 nt, Homo sapiens
aucugagauuacagagaucuca

SEQ ID NO: 1791677 - RNA, 18 nt, Homo sapiens
uuaauagggaauauaucu

SEQ ID NO: 1791678 - RNA, 19 nt, Homo sapiens
cagaaggggcugcuugcuu

SEQ ID NO: 1791679 - RNA, 23 nt, Homo sapiens
cucuauucgccacacaguauuuu

SEQ ID NO: 1791680 - RNA, 13 nt, Homo sapiens
aucaugaauuaua

SEQ ID NO: 1791681 - RNA, 13 nt, Homo sapiens
ugaaagaaagcuu

SEQ ID NO: 1791682 - RNA, 22 nt, Homo sapiens
gucugguaauaaaugugacuca

SEQ ID NO: 1791683 - RNA, 16 nt, Homo sapiens
aaauaaugcacuuccu

SEQ ID NO: 1791684 - RNA, 13 nt, Homo sapiens
gacccagcacugc

SEQ ID NO: 1791685 - RNA, 18 nt, Homo sapiens
gauuauaagaguaauaua

SEQ ID NO: 1791686 - RNA, 14 nt, Homo sapiens
cuuaacacauucaa

SEQ ID NO: 1791687 - RNA, 19 nt, Homo sapiens
uuagaaucuccacuacuua

SEQ ID NO: 1791688 - RNA, 14 nt, Homo sapiens
agccaccuuccagu

SEQ ID NO: 1791689 - RNA, 16 nt, Homo sapiens
accucccauuggccaa

SEQ ID NO: 1791690 - RNA, 20 nt, Homo sapiens
acuguuuauuaccagauuca

SEQ ID NO: 1791691 - RNA, 20 nt, Homo sapiens
cgugcauuuuuggaucauuu

SEQ ID NO: 1791692 - RNA, 20 nt, Homo sapiens
aauguauuguaaucuuucau

SEQ ID NO: 1791693 - RNA, 13 nt, Homo sapiens
aucaacauuucuc

SEQ ID NO: 1791694 - RNA, 21 nt, Homo sapiens
ugggauuucagagcuggaaau

SEQ ID NO: 1791695 - RNA, 23 nt, Homo sapiens
cuuacauguuuguuucuguagaa

SEQ ID NO: 1791696 - RNA, 23 nt, Homo sapiens
cgaugaggaccaagggcaccugg

SEQ ID NO: 1791697 - RNA, 18 nt, Homo sapiens
aguagccuuuccugauga

SEQ ID NO: 1791698 - RNA, 21 nt, Homo sapiens
cuggggguggaggccugccug

SEQ ID NO: 1791699 - RNA, 18 nt, Homo sapiens
acgugcaggacagcucuu

SEQ ID NO: 1791700 - RNA, 12 nt, Homo sapiens
ccauccagcugg

SEQ ID NO: 1791701 - RNA, 15 nt, Homo sapiens
guaaagugauguuug

SEQ ID NO: 1791702 - RNA, 18 nt, Homo sapiens
uaaaaucauguacauuuc

SEQ ID NO: 1791703 - RNA, 11 nt, Homo sapiens
ggcaugaauau

SEQ ID NO: 1791704 - RNA, 23 nt, Homo sapiens
cuuaucaaacguguuauauucca

SEQ ID NO: 1791705 - RNA, 22 nt, Homo sapiens
gggaacaaggguggcaucccag

SEQ ID NO: 1791706 - RNA, 21 nt, Homo sapiens
gggaccaugaagagacucucu

SEQ ID NO: 1791707 - RNA, 20 nt, Homo sapiens
agcccuggcccaucaugggg

SEQ ID NO: 1791708 - RNA, 23 nt, Homo sapiens
agaauugcuccugcaugcaacua

SEQ ID NO: 1791709 - RNA, 21 nt, Homo sapiens
acugucuucuucaugucauca

SEQ ID NO: 1791710 - RNA, 16 nt, Homo sapiens
cuaauuuaguagaaag

SEQ ID NO: 1791711 - RNA, 23 nt, Homo sapiens
ggucagcacaagauacacgucac

SEQ ID NO: 1791712 - RNA, 19 nt, Homo sapiens
guuccuguuugaacccagg

SEQ ID NO: 1791713 - RNA, 16 nt, Homo sapiens
cagcauugacucugug

SEQ ID NO: 1791714 - RNA, 24 nt, Homo sapiens
augcaaaauuguuuucacuuguau

SEQ ID NO: 1791715 - RNA, 19 nt, Homo sapiens
uggcaaacuucagacugaa

SEQ ID NO: 1791716 - RNA, 15 nt, Homo sapiens
cucguccccauugcu

SEQ ID NO: 1791717 - RNA, 22 nt, Homo sapiens
cccacaggagcguguacuaccc

SEQ ID NO: 1791718 - RNA, 18 nt, Homo sapiens
agagaaucaacagaucaa

SEQ ID NO: 1791719 - RNA, 14 nt, Homo sapiens
uuaggugauccacu

SEQ ID NO: 1791720 - RNA, 13 nt, Homo sapiens
augcuauauaucu

SEQ ID NO: 1791721 - RNA, 16 nt, Homo sapiens
ucuuagcuuacaggaa

SEQ ID NO: 1791722 - RNA, 20 nt, Homo sapiens
cauaugaggcaaaguguagu

SEQ ID NO: 1791723 - RNA, 12 nt, Homo sapiens
cgacacauuuac

SEQ ID NO: 1791724 - RNA, 20 nt, Homo sapiens
uuggaugucacugccugaca

SEQ ID NO: 1791725 - RNA, 21 nt, Homo sapiens
ccuaaucuuagaguuaucaaa

SEQ ID NO: 1791726 - RNA, 19 nt, Homo sapiens
uaaagaauccuuaucuaua

SEQ ID NO: 1791727 - RNA, 16 nt, Homo sapiens
aaauaggauugcuuca

SEQ ID NO: 1791728 - RNA, 18 nt, Homo sapiens
gcgagcaugaacuggccc

SEQ ID NO: 1791729 - RNA, 19 nt, Homo sapiens
augaguagcuuauacaauu

SEQ ID NO: 1791730 - RNA, 16 nt, Homo sapiens
aaguuaaucuucaugg

SEQ ID NO: 1791731 - RNA, 18 nt, Homo sapiens
ucuaagcccaggaucucu

SEQ ID NO: 1791732 - RNA, 19 nt, Homo sapiens
gguuaaguuucucuucacc

SEQ ID NO: 1791733 - RNA, 19 nt, Homo sapiens
caucucccagccaagucca

SEQ ID NO: 1791734 - RNA, 18 nt, Homo sapiens
uuuaacugugaaccugga

SEQ ID NO: 1791735 - RNA, 19 nt, Homo sapiens
aguccauaacuuaccucug

SEQ ID NO: 1791736 - RNA, 17 nt, Homo sapiens
gucagagggacugucag

SEQ ID NO: 1791737 - RNA, 15 nt, Homo sapiens
acugugccuuugagu

SEQ ID NO: 1791738 - RNA, 13 nt, Homo sapiens
uugcacaaaaagg

SEQ ID NO: 1791739 - RNA, 19 nt, Homo sapiens
ucagauggaaccgcaggaa

SEQ ID NO: 1791740 - RNA, 15 nt, Homo sapiens
agaacccuugcacua

SEQ ID NO: 1791741 - RNA, 23 nt, Homo sapiens
cccaaaacgucuuauugugguag

SEQ ID NO: 1791742 - RNA, 18 nt, Homo sapiens
uaaauuauuugcuaagca

SEQ ID NO: 1791743 - RNA, 21 nt, Homo sapiens
aaacacccgacgucauguauu

SEQ ID NO: 1791744 - RNA, 11 nt, Homo sapiens
uuacagacaga

SEQ ID NO: 1791745 - RNA, 14 nt, Homo sapiens
uguuccuacuggag

SEQ ID NO: 1791746 - RNA, 16 nt, Homo sapiens
ccaccuggauucccug

SEQ ID NO: 1791747 - RNA, 22 nt, Homo sapiens
ccaccuggccccuucuccagca

SEQ ID NO: 1791748 - RNA, 17 nt, Homo sapiens
auccaacaugugcucag

SEQ ID NO: 1791749 - RNA, 22 nt, Homo sapiens
ugucauauaauaaaaaaauuag

SEQ ID NO: 1791750 - RNA, 16 nt, Homo sapiens
cuuuuuauuagagcuc

SEQ ID NO: 1791751 - RNA, 16 nt, Homo sapiens
gccccagucggcccca

SEQ ID NO: 1791752 - RNA, 20 nt, Homo sapiens
uaggaacagacucgaugcaa

SEQ ID NO: 1791753 - RNA, 19 nt, Homo sapiens
cuaaagagcugcacagcaa

SEQ ID NO: 1791754 - RNA, 17 nt, Homo sapiens
aaugauaugucuuuaaa

SEQ ID NO: 1791755 - RNA, 19 nt, Homo sapiens
ugggcugggcucgccacau

SEQ ID NO: 1791756 - RNA, 20 nt, Homo sapiens
gccaugcaggaagaggccca

SEQ ID NO: 1791757 - RNA, 15 nt, Homo sapiens
aaagugaaagcaaau

SEQ ID NO: 1791758 - RNA, 17 nt, Homo sapiens
aguacuacugcucucaa

SEQ ID NO: 1791759 - RNA, 18 nt, Homo sapiens
aguguucagacaguuuau

SEQ ID NO: 1791760 - RNA, 14 nt, Homo sapiens
gugcuuaccuguga

SEQ ID NO: 1791761 - RNA, 22 nt, Homo sapiens
ccaccuguuaaaauguacacug

SEQ ID NO: 1791762 - RNA, 18 nt, Homo sapiens
guucacacuuugcccuau

SEQ ID NO: 1791763 - RNA, 20 nt, Homo sapiens
guucugucccccaugcucug

SEQ ID NO: 1791764 - RNA, 18 nt, Homo sapiens
aggcaucuccucucccca

SEQ ID NO: 1791765 - RNA, 22 nt, Homo sapiens
gcacaagggcacgugaagucau

SEQ ID NO: 1791766 - RNA, 19 nt, Homo sapiens
gcgcccagccuacauucac

SEQ ID NO: 1791767 - RNA, 14 nt, Homo sapiens
aagagacacugcuu

SEQ ID NO: 1791768 - RNA, 18 nt, Homo sapiens
auuuguaauagccaaaaa

SEQ ID NO: 1791769 - RNA, 17 nt, Homo sapiens
gcagcccccacugaccu

SEQ ID NO: 1791770 - RNA, 21 nt, Homo sapiens
gagcaaaucaucugcauuccu

SEQ ID NO: 1791771 - RNA, 20 nt, Homo sapiens
gggggcugcagcauguugcu

SEQ ID NO: 1791772 - RNA, 16 nt, Homo sapiens
acugacaaccucaucc

SEQ ID NO: 1791773 - RNA, 20 nt, Homo sapiens
ggauuugaugcuguuugaca

SEQ ID NO: 1791774 - RNA, 19 nt, Homo sapiens
cuguugcuugaauagcaau

SEQ ID NO: 1791775 - RNA, 22 nt, Homo sapiens
accuaguucaaugugcuuuuaa

SEQ ID NO: 1791776 - RNA, 14 nt, Homo sapiens
uggaguuccugcuc

SEQ ID NO: 1791777 - RNA, 17 nt, Homo sapiens
ucucccccugggcucug

SEQ ID NO: 1791778 - RNA, 23 nt, Homo sapiens
aaggaauggccuuucaccuucuc

SEQ ID NO: 1791779 - RNA, 16 nt, Homo sapiens
ggaguucagauguuuu

SEQ ID NO: 1791780 - RNA, 21 nt, Homo sapiens
cugaccuccuggacuguagga

SEQ ID NO: 1791781 - RNA, 14 nt, Homo sapiens
gcucuaucugcaau

SEQ ID NO: 1791782 - RNA, 22 nt, Homo sapiens
gugaagucacgucacacagggg

SEQ ID NO: 1791783 - RNA, 17 nt, Homo sapiens
ccaggaagaauggugug

SEQ ID NO: 1791784 - RNA, 22 nt, Homo sapiens
ucagcagcgugcacaucugcug

SEQ ID NO: 1791785 - RNA, 21 nt, Homo sapiens
guuccacauccacacagccaa

SEQ ID NO: 1791786 - RNA, 16 nt, Homo sapiens
gcaggaacucuaagac

SEQ ID NO: 1791787 - RNA, 19 nt, Homo sapiens
aggggccacacuaugccug

SEQ ID NO: 1791788 - RNA, 18 nt, Homo sapiens
aagccaagagucauguca

SEQ ID NO: 1791789 - RNA, 19 nt, Homo sapiens
aauaaucucuauguagaaa

SEQ ID NO: 1791790 - RNA, 15 nt, Homo sapiens
agcucaugacacugu

SEQ ID NO: 1791791 - RNA, 14 nt, Homo sapiens
caaagacauuauuu

SEQ ID NO: 1791792 - RNA, 14 nt, Homo sapiens
acaggaauucuccc

SEQ ID NO: 1791793 - RNA, 15 nt, Homo sapiens
aaaugauaauuugcu

SEQ ID NO: 1791794 - RNA, 15 nt, Homo sapiens
uuagccaauaugcaa

SEQ ID NO: 1791795 - RNA, 13 nt, Homo sapiens
acauuucucaccc

SEQ ID NO: 1791796 - RNA, 17 nt, Homo sapiens
acaagacuucagauucc

SEQ ID NO: 1791797 - RNA, 20 nt, Homo sapiens
aaaauccugaacuuucuccc

SEQ ID NO: 1791798 - RNA, 17 nt, Homo sapiens
aggcaugaagaagccac

SEQ ID NO: 1791799 - RNA, 18 nt, Homo sapiens
ucccaagcuagacugugu

SEQ ID NO: 1791800 - RNA, 16 nt, Homo sapiens
guaacauauucuguau

SEQ ID NO: 1791801 - RNA, 22 nt, Homo sapiens
aaccuugaaauggaaagucaug

SEQ ID NO: 1791802 - RNA, 19 nt, Homo sapiens
uggggcuccucacauagcu

SEQ ID NO: 1791803 - RNA, 21 nt, Homo sapiens
ggcugagggguggccaucucc

SEQ ID NO: 1791804 - RNA, 21 nt, Homo sapiens
acuuaaguuuuagaaaugaga

SEQ ID NO: 1791805 - RNA, 18 nt, Homo sapiens
uaccaugugcuacagggg

SEQ ID NO: 1791806 - RNA, 16 nt, Homo sapiens
cauugccagugucuuu

SEQ ID NO: 1791807 - RNA, 13 nt, Homo sapiens
aucuuuaacuuag

SEQ ID NO: 1791808 - RNA, 10 nt, Homo sapiens
gccuuccuuu

SEQ ID NO: 1791809 - RNA, 19 nt, Homo sapiens
aaaucuggguaucuuucca

SEQ ID NO: 1791810 - RNA, 13 nt, Homo sapiens
agaagguagggga

SEQ ID NO: 1791811 - RNA, 18 nt, Homo sapiens
ucuccagacuuuuaccua

SEQ ID NO: 1791812 - RNA, 21 nt, Homo sapiens
cccaacucuguaucuccagcc

SEQ ID NO: 1791813 - RNA, 13 nt, Homo sapiens
ccucucacuccag

SEQ ID NO: 1791814 - RNA, 13 nt, Homo sapiens
gcagacgggcaca

SEQ ID NO: 1791815 - RNA, 17 nt, Homo sapiens
acaccccucccugccac

SEQ ID NO: 1791816 - RNA, 20 nt, Homo sapiens
acuggauuguguuugugcca

SEQ ID NO: 1791817 - RNA, 19 nt, Homo sapiens
acccaauauuuaccagacc

SEQ ID NO: 1791818 - RNA, 18 nt, Homo sapiens
uuacaggaaagaugcauu

SEQ ID NO: 1791819 - RNA, 22 nt, Homo sapiens
aaauacaguauaucuaauaacu

SEQ ID NO: 1791820 - RNA, 20 nt, Homo sapiens
uuuggaaguccagagcugga

SEQ ID NO: 1791821 - RNA, 16 nt, Homo sapiens
gagccaggacccagga

SEQ ID NO: 1791822 - RNA, 18 nt, Homo sapiens
cugacuuugagacggugu

SEQ ID NO: 1791823 - RNA, 21 nt, Homo sapiens
gcuagucuauggucaguugag

SEQ ID NO: 1791824 - RNA, 19 nt, Homo sapiens
uaucauuuggccgagucag

SEQ ID NO: 1791825 - RNA, 21 nt, Homo sapiens
aaagcagcucaagaacacaug

SEQ ID NO: 1791826 - RNA, 21 nt, Homo sapiens
uccucaggggccugcccagug

SEQ ID NO: 1791827 - RNA, 16 nt, Homo sapiens
ugaagcuuuaagcaaa

SEQ ID NO: 1791828 - RNA, 23 nt, Homo sapiens
gaaaagaaagaaguuauuuucca

SEQ ID NO: 1791829 - RNA, 19 nt, Homo sapiens
ccaaagauguggguggcaa

SEQ ID NO: 1791830 - RNA, 21 nt, Homo sapiens
ucuaggcccugugagcacaaa

SEQ ID NO: 1791831 - RNA, 14 nt, Homo sapiens
caugaagcacacac

SEQ ID NO: 1791832 - RNA, 13 nt, Homo sapiens
augaaauaugcau

SEQ ID NO: 1791833 - RNA, 21 nt, Homo sapiens
cacccgaccuggcugccccuc

SEQ ID NO: 1791834 - RNA, 17 nt, Homo sapiens
gaccccaucuuccagcc

SEQ ID NO: 1791835 - RNA, 14 nt, Homo sapiens
auauauugcugcug

SEQ ID NO: 1791836 - RNA, 13 nt, Homo sapiens
aaugucaccaugc

SEQ ID NO: 1791837 - RNA, 19 nt, Homo sapiens
agugauucucaugccucag

SEQ ID NO: 1791838 - RNA, 14 nt, Homo sapiens
acuguggagcucag

SEQ ID NO: 1791839 - RNA, 22 nt, Homo sapiens
caucuuuagugcuuucuuguca

SEQ ID NO: 1791840 - RNA, 22 nt, Homo sapiens
uucacuggguucccauucugag

SEQ ID NO: 1791841 - RNA, 21 nt, Homo sapiens
ucacuaguugucagcuucucu

SEQ ID NO: 1791842 - RNA, 22 nt, Homo sapiens
agcauauguuuuuguaaguuua

SEQ ID NO: 1791843 - RNA, 19 nt, Homo sapiens
uuccacuaguuuuuggacu

SEQ ID NO: 1791844 - RNA, 16 nt, Homo sapiens
uacagucauaaugugu

SEQ ID NO: 1791845 - RNA, 14 nt, Homo sapiens
cccaugaacacaga

SEQ ID NO: 1791846 - RNA, 17 nt, Homo sapiens
acaaucaccgaugcaaa

SEQ ID NO: 1791847 - RNA, 13 nt, Homo sapiens
auuuaacagagcu

SEQ ID NO: 1791848 - RNA, 18 nt, Homo sapiens
cugcccccaucaccucua

SEQ ID NO: 1791849 - RNA, 22 nt, Homo sapiens
auugaauguuuaaaauauuaau

SEQ ID NO: 1791850 - RNA, 13 nt, Homo sapiens
uaaguaauuauuc

SEQ ID NO: 1791851 - RNA, 13 nt, Homo sapiens
cacccaaagcauu

SEQ ID NO: 1791852 - RNA, 20 nt, Homo sapiens
aggaggucaaggcuucagug

SEQ ID NO: 1791853 - RNA, 22 nt, Homo sapiens
ggaccugccccccacucugcac

SEQ ID NO: 1791854 - RNA, 14 nt, Homo sapiens
caacaccacaaacc

SEQ ID NO: 1791855 - RNA, 19 nt, Homo sapiens
uacaucuuccaucuuacuu

SEQ ID NO: 1791856 - RNA, 21 nt, Homo sapiens
agacaaguauggcuccuccau

SEQ ID NO: 1791857 - RNA, 15 nt, Homo sapiens
aacacccgacgucau

SEQ ID NO: 1791858 - RNA, 13 nt, Homo sapiens
aaauauucaguaa

SEQ ID NO: 1791859 - RNA, 21 nt, Homo sapiens
cuuucuucucccaauucaucc

SEQ ID NO: 1791860 - RNA, 24 nt, Homo sapiens
gauggauuaacauauagccuuugu

SEQ ID NO: 1791861 - RNA, 13 nt, Homo sapiens
auguuaagugcca

SEQ ID NO: 1791862 - RNA, 19 nt, Homo sapiens
agcccaccugcacccaggu

SEQ ID NO: 1791863 - RNA, 21 nt, Homo sapiens
uuugauugggauaguaguuag

SEQ ID NO: 1791864 - RNA, 16 nt, Homo sapiens
aauucuuauaguaccu

SEQ ID NO: 1791865 - RNA, 21 nt, Homo sapiens
gauuaauuaaaacacaacauc

SEQ ID NO: 1791866 - RNA, 17 nt, Homo sapiens
acugcuuguagguaugu

SEQ ID NO: 1791867 - RNA, 20 nt, Homo sapiens
aacugagcugcaaucgcuuu

SEQ ID NO: 1791868 - RNA, 15 nt, Homo sapiens
cauaccuacauucaa

SEQ ID NO: 1791869 - RNA, 22 nt, Homo sapiens
ucagaucccccuucucuccugc

SEQ ID NO: 1791870 - RNA, 13 nt, Homo sapiens
ucuaagggaguca

SEQ ID NO: 1791871 - RNA, 18 nt, Homo sapiens
acuuguucauucugugac

SEQ ID NO: 1791872 - RNA, 18 nt, Homo sapiens
guccuggggccugugcac

SEQ ID NO: 1791873 - RNA, 11 nt, Homo sapiens
accucugccac

SEQ ID NO: 1791874 - RNA, 15 nt, Homo sapiens
auuuuccuguuuacu

SEQ ID NO: 1791875 - RNA, 14 nt, Homo sapiens
acuugacuggcaca

SEQ ID NO: 1791876 - RNA, 13 nt, Homo sapiens
gugugcgugcaug

SEQ ID NO: 1791877 - RNA, 17 nt, Homo sapiens
gcacauccauucccaag

SEQ ID NO: 1791878 - RNA, 11 nt, Homo sapiens
aacauggccau

SEQ ID NO: 1791879 - RNA, 14 nt, Homo sapiens
uuaacuguacugaa

SEQ ID NO: 1791880 - RNA, 23 nt, Homo sapiens
gaggaaaagagaaggaaagugau

SEQ ID NO: 1791881 - RNA, 23 nt, Homo sapiens
caaauuauuuauuacuugugcac

SEQ ID NO: 1791882 - RNA, 22 nt, Homo sapiens
gcaggaggcccuugucguggga

SEQ ID NO: 1791883 - RNA, 13 nt, Homo sapiens
gugaaugaucucu

SEQ ID NO: 1791884 - RNA, 13 nt, Homo sapiens
cauccuucaucug

SEQ ID NO: 1791885 - RNA, 11 nt, Homo sapiens
uguaagccaga

SEQ ID NO: 1791886 - RNA, 11 nt, Homo sapiens
uuuaagccaua

SEQ ID NO: 1791887 - RNA, 11 nt, Homo sapiens
auaaagccuuu

SEQ ID NO: 1791888 - RNA, 15 nt, Homo sapiens
aaaagaaacucuaug

SEQ ID NO: 1791889 - RNA, 16 nt, Homo sapiens
gauggagaaugccagc

SEQ ID NO: 1791890 - RNA, 19 nt, Homo sapiens
uaccauucaggacauaggc

SEQ ID NO: 1791891 - RNA, 14 nt, Homo sapiens
cacucccacuggaa

SEQ ID NO: 1791892 - RNA, 22 nt, Homo sapiens
uaagaaaauuggacuguaauca

SEQ ID NO: 1791893 - RNA, 15 nt, Homo sapiens
cauaccccuuacaaa

SEQ ID NO: 1791894 - RNA, 21 nt, Homo sapiens
gauuuguuuuuaaacuguaca

SEQ ID NO: 1791895 - RNA, 16 nt, Homo sapiens
ccagccagggcugcua

SEQ ID NO: 1791896 - RNA, 22 nt, Homo sapiens
uguucccagcucagugccaaag

SEQ ID NO: 1791897 - RNA, 20 nt, Homo sapiens
aggaggcagagguugcagug

SEQ ID NO: 1791898 - RNA, 19 nt, Homo sapiens
ucuucuccauccuaccaca

SEQ ID NO: 1791899 - RNA, 19 nt, Homo sapiens
uggucccucugcagucucu

SEQ ID NO: 1791900 - RNA, 12 nt, Homo sapiens
ucacucuuggag

SEQ ID NO: 1791901 - RNA, 22 nt, Homo sapiens
agccaguggagcuggucugcca

SEQ ID NO: 1791902 - RNA, 20 nt, Homo sapiens
uaaauuucucuacugucuca

SEQ ID NO: 1791903 - RNA, 17 nt, Homo sapiens
gccucccuuucugggag

SEQ ID NO: 1791904 - RNA, 19 nt, Homo sapiens
caaauguggcuguauccac

SEQ ID NO: 1791905 - RNA, 19 nt, Homo sapiens
cuuuuuuaggcuacagugu

SEQ ID NO: 1791906 - RNA, 13 nt, Homo sapiens
uuguauaacccau

SEQ ID NO: 1791907 - RNA, 18 nt, Homo sapiens
ugcacuguuuauguuaca

SEQ ID NO: 1791908 - RNA, 18 nt, Homo sapiens
agauauucauacuuucca

SEQ ID NO: 1791909 - RNA, 14 nt, Homo sapiens
uacugagacaaugu

SEQ ID NO: 1791910 - RNA, 12 nt, Homo sapiens
ggcagagaagaa

SEQ ID NO: 1791911 - RNA, 21 nt, Homo sapiens
uuuagaaggacucaguauuau

SEQ ID NO: 1791912 - RNA, 16 nt, Homo sapiens
aagagauuuuucauga

SEQ ID NO: 1791913 - RNA, 19 nt, Homo sapiens
ccugugucugucacaggcu

SEQ ID NO: 1791914 - RNA, 22 nt, Homo sapiens
auuggagccugggcauccucag

SEQ ID NO: 1791915 - RNA, 16 nt, Homo sapiens
agaagcucaaccaugg

SEQ ID NO: 1791916 - RNA, 14 nt, Homo sapiens
caagcaacccaaac

SEQ ID NO: 1791917 - RNA, 19 nt, Homo sapiens
aauccauccaaucuauuau

SEQ ID NO: 1791918 - RNA, 18 nt, Homo sapiens
ccaaagggggacagugau

SEQ ID NO: 1791919 - RNA, 20 nt, Homo sapiens
gcuguuuuggaugaaugcag

SEQ ID NO: 1791920 - RNA, 21 nt, Homo sapiens
ccgcacugucccaguagccaa

SEQ ID NO: 1791921 - RNA, 23 nt, Homo sapiens
cuuuuugucauguuaugcaguga

SEQ ID NO: 1791922 - RNA, 21 nt, Homo sapiens
aaguauuauucaaaccaauuu

SEQ ID NO: 1791923 - RNA, 14 nt, Homo sapiens
gcaaugccaucagc

SEQ ID NO: 1791924 - RNA, 15 nt, Homo sapiens
cugcauggcacugac

SEQ ID NO: 1791925 - RNA, 13 nt, Homo sapiens
agugccaacugug

SEQ ID NO: 1791926 - RNA, 23 nt, Homo sapiens
cucagcuaugcccggaccuccau

SEQ ID NO: 1791927 - RNA, 19 nt, Homo sapiens
uagacuuuugacacuuuua

SEQ ID NO: 1791928 - RNA, 22 nt, Homo sapiens
cuggguccccuucgcaguguuu

SEQ ID NO: 1791929 - RNA, 19 nt, Homo sapiens
uucggaagggguuccucaa

SEQ ID NO: 1791930 - RNA, 16 nt, Homo sapiens
cuauuuuuguaugaaa

SEQ ID NO: 1791931 - RNA, 14 nt, Homo sapiens
guauuggcaaagau

SEQ ID NO: 1791932 - RNA, 21 nt, Homo sapiens
gcggaaagccuguaagccugc

SEQ ID NO: 1791933 - RNA, 15 nt, Homo sapiens
acuugaauacucuca

SEQ ID NO: 1791934 - RNA, 21 nt, Homo sapiens
caaccgaaucucaauguacau

SEQ ID NO: 1791935 - RNA, 17 nt, Homo sapiens
auuauauuugugcuaua

SEQ ID NO: 1791936 - RNA, 20 nt, Homo sapiens
augauuaaauaagauucuaa

SEQ ID NO: 1791937 - RNA, 14 nt, Homo sapiens
acaucucacuuugc

SEQ ID NO: 1791938 - RNA, 20 nt, Homo sapiens
uucaaacaguuccauaccaa

SEQ ID NO: 1791939 - RNA, 14 nt, Homo sapiens
cugagccugaagag

SEQ ID NO: 1791940 - RNA, 14 nt, Homo sapiens
aagugaucagcaau

SEQ ID NO: 1791941 - RNA, 20 nt, Homo sapiens
agcuggugguuucacggugc

SEQ ID NO: 1791942 - RNA, 18 nt, Homo sapiens
ccacuuccuaaaucuuaa

SEQ ID NO: 1791943 - RNA, 16 nt, Homo sapiens
cugauaggaaugugaa

SEQ ID NO: 1791944 - RNA, 16 nt, Homo sapiens
gcaggaggaucacuug

SEQ ID NO: 1791945 - RNA, 11 nt, Homo sapiens
ccuacugcuga

SEQ ID NO: 1791946 - RNA, 21 nt, Homo sapiens
caaugggagggggcuccaugg

SEQ ID NO: 1791947 - RNA, 19 nt, Homo sapiens
aacacugucacuagucuca

SEQ ID NO: 1791948 - RNA, 21 nt, Homo sapiens
aaaugcagcagggaugcccug

SEQ ID NO: 1791949 - RNA, 14 nt, Homo sapiens
auucuuuguuacag

SEQ ID NO: 1791950 - RNA, 22 nt, Homo sapiens
uacaaugaaagcccucaugugc

SEQ ID NO: 1791951 - RNA, 17 nt, Homo sapiens
ugagaaaauaucuugcu

SEQ ID NO: 1791952 - RNA, 12 nt, Homo sapiens
uagcuucacuca

SEQ ID NO: 1791953 - RNA, 15 nt, Homo sapiens
uaaauauuuagucug

SEQ ID NO: 1791954 - RNA, 19 nt, Homo sapiens
gagagaaucaacagaucaa

SEQ ID NO: 1791955 - RNA, 15 nt, Homo sapiens
acccguaagauuccu

SEQ ID NO: 1791956 - RNA, 17 nt, Homo sapiens
auuuauauggguuuauu

SEQ ID NO: 1791957 - RNA, 23 nt, Homo sapiens
accccaacuacuguguuaugcaa

SEQ ID NO: 1791958 - RNA, 16 nt, Homo sapiens
uuguugcaaaugugau

SEQ ID NO: 1791959 - RNA, 19 nt, Homo sapiens
ccuguucagagcacucauu

SEQ ID NO: 1791960 - RNA, 23 nt, Homo sapiens
agcucugcagcacucuuaucuac

SEQ ID NO: 1791961 - RNA, 20 nt, Homo sapiens
uucuacaucaauaucauccc

SEQ ID NO: 1791962 - RNA, 14 nt, Homo sapiens
cagagggccuagga

SEQ ID NO: 1791963 - RNA, 13 nt, Homo sapiens
cccuggugucaca

SEQ ID NO: 1791964 - RNA, 14 nt, Homo sapiens
gcugcaugcccucu

SEQ ID NO: 1791965 - RNA, 21 nt, Homo sapiens
cuugccuaaggccagccauuu

SEQ ID NO: 1791966 - RNA, 14 nt, Homo sapiens
guucaacuacaugu

SEQ ID NO: 1791967 - RNA, 12 nt, Homo sapiens
cacuuccagugu

SEQ ID NO: 1791968 - RNA, 14 nt, Homo sapiens
cucuuuucuuucaa

SEQ ID NO: 1791969 - RNA, 22 nt, Homo sapiens
uacagcuucacuagaguucuuu

SEQ ID NO: 1791970 - RNA, 17 nt, Homo sapiens
agggaacaccuggcauu

SEQ ID NO: 1791971 - RNA, 18 nt, Homo sapiens
ucucuacuuuucccugua

SEQ ID NO: 1791972 - RNA, 20 nt, Homo sapiens
cuuuucucccaccuccuucc

SEQ ID NO: 1791973 - RNA, 15 nt, Homo sapiens
aguagaaugguggcu

SEQ ID NO: 1791974 - RNA, 15 nt, Homo sapiens
uggaaaacuguguug

SEQ ID NO: 1791975 - RNA, 13 nt, Homo sapiens
augauuucucaaa

SEQ ID NO: 1791976 - RNA, 19 nt, Homo sapiens
uagaugcacguggggccca

SEQ ID NO: 1791977 - RNA, 16 nt, Homo sapiens
ucuauuuuugugugcu

SEQ ID NO: 1791978 - RNA, 19 nt, Homo sapiens
uucaccuccaagcauuuca

SEQ ID NO: 1791979 - RNA, 22 nt, Homo sapiens
aauaauuuagacuucaagcaug

SEQ ID NO: 1791980 - RNA, 17 nt, Homo sapiens
uacaguucugugguuuc

SEQ ID NO: 1791981 - RNA, 21 nt, Homo sapiens
acggcaccauccagcaccucc

SEQ ID NO: 1791982 - RNA, 11 nt, Homo sapiens
cggaugacagc

SEQ ID NO: 1791983 - RNA, 14 nt, Homo sapiens
cucccucccuagcc

SEQ ID NO: 1791984 - RNA, 15 nt, Homo sapiens
cuuaaccucagggag

SEQ ID NO: 1791985 - RNA, 20 nt, Homo sapiens
agggcggggguugcgucuca

SEQ ID NO: 1791986 - RNA, 16 nt, Homo sapiens
aauuuuauguguuaua

SEQ ID NO: 1791987 - RNA, 23 nt, Homo sapiens
ucaaaacagaagggcaaauggaa

SEQ ID NO: 1791988 - RNA, 24 nt, Homo sapiens
cuuggcacauuuaagagacaguca

SEQ ID NO: 1791989 - RNA, 21 nt, Homo sapiens
ucucccacuaaaacugcauuu

SEQ ID NO: 1791990 - RNA, 16 nt, Homo sapiens
cccaacccgugccccu

SEQ ID NO: 1791991 - RNA, 23 nt, Homo sapiens
augcuuuguuuccauucuugucc

SEQ ID NO: 1791992 - RNA, 18 nt, Homo sapiens
uuaugaguuuuucaauua

SEQ ID NO: 1791993 - RNA, 15 nt, Homo sapiens
aacucacugugcucc

SEQ ID NO: 1791994 - RNA, 16 nt, Homo sapiens
caugauacaaauucca

SEQ ID NO: 1791995 - RNA, 18 nt, Homo sapiens
augguauauauuuugaaa

SEQ ID NO: 1791996 - RNA, 16 nt, Homo sapiens
augcucugaugcagug

SEQ ID NO: 1791997 - RNA, 16 nt, Homo sapiens
gccaacuugccauguu

SEQ ID NO: 1791998 - RNA, 17 nt, Homo sapiens
aaacugagacacauugg

SEQ ID NO: 1791999 - RNA, 14 nt, Homo sapiens
guuuuugcuguuaa

SEQ ID NO: 1792000 - RNA, 15 nt, Homo sapiens
cagccccugcagauu

SEQ ID NO: 1792001 - RNA, 11 nt, Homo sapiens
aucacugagag

SEQ ID NO: 1792002 - RNA, 21 nt, Homo sapiens
ugcacaaauugggccaaagaa

SEQ ID NO: 1792003 - RNA, 18 nt, Homo sapiens
caugugugagugugugca

SEQ ID NO: 1792004 - RNA, 16 nt, Homo sapiens
uugaacuucuuuagua

SEQ ID NO: 1792005 - RNA, 13 nt, Homo sapiens
ccauaaucaugua

SEQ ID NO: 1792006 - RNA, 23 nt, Homo sapiens
cuuaaauguuuaauaaacacuga

SEQ ID NO: 1792007 - RNA, 16 nt, Homo sapiens
acaccuuggacuguua

SEQ ID NO: 1792008 - RNA, 21 nt, Homo sapiens
ugauaacucugagcaguuuca

SEQ ID NO: 1792009 - RNA, 19 nt, Homo sapiens
uggcccuguuucuccccac

SEQ ID NO: 1792010 - RNA, 20 nt, Homo sapiens
ugcauggaacccccagaaua

SEQ ID NO: 1792011 - RNA, 18 nt, Homo sapiens
cuagagugagggccugag

SEQ ID NO: 1792012 - RNA, 17 nt, Homo sapiens
ucucccauccaagagaa

SEQ ID NO: 1792013 - RNA, 20 nt, Homo sapiens
gggauuguagauaacacuga

SEQ ID NO: 1792014 - RNA, 18 nt, Homo sapiens
caagugaaaaacauccag

SEQ ID NO: 1792015 - RNA, 13 nt, Homo sapiens
ucuccaaagggag

SEQ ID NO: 1792016 - RNA, 13 nt, Homo sapiens
uucauacugugaa

SEQ ID NO: 1792017 - RNA, 20 nt, Homo sapiens
ccagccugggugacagagca

SEQ ID NO: 1792018 - RNA, 21 nt, Homo sapiens
auuguauuuuuaacaccagaa

SEQ ID NO: 1792019 - RNA, 19 nt, Homo sapiens
ugcaauaccaauguucuaa

SEQ ID NO: 1792020 - RNA, 22 nt, Homo sapiens
guaaaugaucacuccaggauau

SEQ ID NO: 1792021 - RNA, 23 nt, Homo sapiens
ggcugaccccgguggcggcccca

SEQ ID NO: 1792022 - RNA, 20 nt, Homo sapiens
gccaggcugggcucugggau

SEQ ID NO: 1792023 - RNA, 20 nt, Homo sapiens
uguuaacuauuuauucccug

SEQ ID NO: 1792024 - RNA, 18 nt, Homo sapiens
acucuucuuuaagccaua

SEQ ID NO: 1792025 - RNA, 17 nt, Homo sapiens
uuaaugcuuauaagaca

SEQ ID NO: 1792026 - RNA, 21 nt, Homo sapiens
cuacccaguaaaaauccacua

SEQ ID NO: 1792027 - RNA, 12 nt, Homo sapiens
ucggaguccaaa

SEQ ID NO: 1792028 - RNA, 17 nt, Homo sapiens
ccagucaugugcuggua

SEQ ID NO: 1792029 - RNA, 15 nt, Homo sapiens
cacacagcacaugca

SEQ ID NO: 1792030 - RNA, 20 nt, Homo sapiens
cucauaaaaaucuagcacac

SEQ ID NO: 1792031 - RNA, 13 nt, Homo sapiens
cggcccuccccca

SEQ ID NO: 1792032 - RNA, 21 nt, Homo sapiens
uuaagugccauuacuacugua

SEQ ID NO: 1792033 - RNA, 21 nt, Homo sapiens
gauaaguugaggaaagaaaua

SEQ ID NO: 1792034 - RNA, 17 nt, Homo sapiens
uagucaucaaugcaaua

SEQ ID NO: 1792035 - RNA, 15 nt, Homo sapiens
auuggagauuacuaa

SEQ ID NO: 1792036 - RNA, 16 nt, Homo sapiens
cucaaccaugaccuca

SEQ ID NO: 1792037 - RNA, 17 nt, Homo sapiens
acuguacauugugagcu

SEQ ID NO: 1792038 - RNA, 16 nt, Homo sapiens
cagcauuagugggaaa

SEQ ID NO: 1792039 - RNA, 13 nt, Homo sapiens
uagagcucuuuau

SEQ ID NO: 1792040 - RNA, 23 nt, Homo sapiens
cccaugucuacacagauguucac

SEQ ID NO: 1792041 - RNA, 24 nt, Homo sapiens
ugaacuaaauuuaagcuuaagcca

SEQ ID NO: 1792042 - RNA, 17 nt, Homo sapiens
uccaggaggcaguggac

SEQ ID NO: 1792043 - RNA, 15 nt, Homo sapiens
uagcagacaugccac

SEQ ID NO: 1792044 - RNA, 18 nt, Homo sapiens
ugcagccacaucacggca

SEQ ID NO: 1792045 - RNA, 14 nt, Homo sapiens
gacugcagggacac

SEQ ID NO: 1792046 - RNA, 17 nt, Homo sapiens
uccucguuccuuucucc

SEQ ID NO: 1792047 - RNA, 20 nt, Homo sapiens
agaugugaguccuguugaag

SEQ ID NO: 1792048 - RNA, 19 nt, Homo sapiens
uccaagugguccacaagcu

SEQ ID NO: 1792049 - RNA, 14 nt, Homo sapiens
acaggcaaauuccu

SEQ ID NO: 1792050 - RNA, 18 nt, Homo sapiens
uaaagccugaaaauucca

SEQ ID NO: 1792051 - RNA, 19 nt, Homo sapiens
gcaccuuuuauaccagaga

SEQ ID NO: 1792052 - RNA, 22 nt, Homo sapiens
cugacauuagauugaugugcac

SEQ ID NO: 1792053 - RNA, 23 nt, Homo sapiens
uacuucccgcuguuccucgccac

SEQ ID NO: 1792054 - RNA, 18 nt, Homo sapiens
aauagcaauauucuugga

SEQ ID NO: 1792055 - RNA, 22 nt, Homo sapiens
ugcuuuuuaaacugauguauag

SEQ ID NO: 1792056 - RNA, 22 nt, Homo sapiens
ugauagccuaguuaaauauuuc

SEQ ID NO: 1792057 - RNA, 14 nt, Homo sapiens
caaucuuguccaca

SEQ ID NO: 1792058 - RNA, 16 nt, Homo sapiens
cccgggagacucaaag

SEQ ID NO: 1792059 - RNA, 22 nt, Homo sapiens
caaggaaacucgaauaaaggau

SEQ ID NO: 1792060 - RNA, 16 nt, Homo sapiens
guguaaacucaucuga

SEQ ID NO: 1792061 - RNA, 17 nt, Homo sapiens
ugacaucagcacugcca

SEQ ID NO: 1792062 - RNA, 13 nt, Homo sapiens
uuauaacaguguu

SEQ ID NO: 1792063 - RNA, 18 nt, Homo sapiens
aaagcaucuaugugagac

SEQ ID NO: 1792064 - RNA, 21 nt, Homo sapiens
cugaggccaggggagacaucg

SEQ ID NO: 1792065 - RNA, 18 nt, Homo sapiens
auucuaacuuuuuugcua

SEQ ID NO: 1792066 - RNA, 20 nt, Homo sapiens
gccagcagcagcuacaacau

SEQ ID NO: 1792067 - RNA, 22 nt, Homo sapiens
cuuaauagguucaaaagcaauc

SEQ ID NO: 1792068 - RNA, 16 nt, Homo sapiens
aggaaggccacagugc

SEQ ID NO: 1792069 - RNA, 21 nt, Homo sapiens
accuaauguuuaugagccaga

SEQ ID NO: 1792070 - RNA, 15 nt, Homo sapiens
ggccuggacaguauc

SEQ ID NO: 1792071 - RNA, 12 nt, Homo sapiens
acagucagugac

SEQ ID NO: 1792072 - RNA, 12 nt, Homo sapiens
uccccaauucau

SEQ ID NO: 1792073 - RNA, 13 nt, Homo sapiens
gcgagcacuguga

SEQ ID NO: 1792074 - RNA, 17 nt, Homo sapiens
agcaucugucuugucau

SEQ ID NO: 1792075 - RNA, 14 nt, Homo sapiens
ggguggcauccagg

SEQ ID NO: 1792076 - RNA, 15 nt, Homo sapiens
gaaugcuuaauucaa

SEQ ID NO: 1792077 - RNA, 14 nt, Homo sapiens
cugcacagagcaag

SEQ ID NO: 1792078 - RNA, 20 nt, Homo sapiens
cuuaaaaaguaguuagccaa

SEQ ID NO: 1792079 - RNA, 12 nt, Homo sapiens
gcugaaagcuca

SEQ ID NO: 1792080 - RNA, 21 nt, Homo sapiens
guacaauaaagcaauguggua

SEQ ID NO: 1792081 - RNA, 23 nt, Homo sapiens
auguagucuuacucugucaccca

SEQ ID NO: 1792082 - RNA, 20 nt, Homo sapiens
auuacugguauuaguuaaaa

SEQ ID NO: 1792083 - RNA, 22 nt, Homo sapiens
gaagaugaauggucuggcaaua

SEQ ID NO: 1792084 - RNA, 14 nt, Homo sapiens
cccccgugccaaau

SEQ ID NO: 1792085 - RNA, 23 nt, Homo sapiens
gcuggggccaccaucccugaugg

SEQ ID NO: 1792086 - RNA, 23 nt, Homo sapiens
ugggcugcccaccuggcugccaa

SEQ ID NO: 1792087 - RNA, 19 nt, Homo sapiens
auuuuaaaguaaaagucua

SEQ ID NO: 1792088 - RNA, 15 nt, Homo sapiens
uagagguacuuucca

SEQ ID NO: 1792089 - RNA, 15 nt, Homo sapiens
gcugggauuugaacc

SEQ ID NO: 1792090 - RNA, 15 nt, Homo sapiens
caugcgggugcacac

SEQ ID NO: 1792091 - RNA, 13 nt, Homo sapiens
uuaaaacauuuca

SEQ ID NO: 1792092 - RNA, 12 nt, Homo sapiens
acacuguccaug

SEQ ID NO: 1792093 - RNA, 20 nt, Homo sapiens
uuaacucauccguuugccaa

SEQ ID NO: 1792094 - RNA, 15 nt, Homo sapiens
ggggcuuccagcuca

SEQ ID NO: 1792095 - RNA, 23 nt, Homo sapiens
gagcaucaggcuaagacccugug

SEQ ID NO: 1792096 - RNA, 18 nt, Homo sapiens
uggcaaaaucaucuuaca

SEQ ID NO: 1792097 - RNA, 17 nt, Homo sapiens
uacugcugagauacaua

SEQ ID NO: 1792098 - RNA, 21 nt, Homo sapiens
aaaugugguuuguacauauca

SEQ ID NO: 1792099 - RNA, 23 nt, Homo sapiens
aaagcagucgaccgcacuuaugg

SEQ ID NO: 1792100 - RNA, 16 nt, Homo sapiens
uguucauccucauugc

SEQ ID NO: 1792101 - RNA, 18 nt, Homo sapiens
uggcaaacugaagcugca

SEQ ID NO: 1792102 - RNA, 18 nt, Homo sapiens
cuguguagacuauuugcu

SEQ ID NO: 1792103 - RNA, 20 nt, Homo sapiens
aguucaccuacccugaguga

SEQ ID NO: 1792104 - RNA, 12 nt, Homo sapiens
aauaaaucaauu

SEQ ID NO: 1792105 - RNA, 22 nt, Homo sapiens
ccugccucuuccugcagccuca

SEQ ID NO: 1792106 - RNA, 14 nt, Homo sapiens
ucucagcccagaag

SEQ ID NO: 1792107 - RNA, 23 nt, Homo sapiens
ccaacgaaaagcacauccaggca

SEQ ID NO: 1792108 - RNA, 15 nt, Homo sapiens
ccuggacucaggguc

SEQ ID NO: 1792109 - RNA, 17 nt, Homo sapiens
uguguauccgacucuaa

SEQ ID NO: 1792110 - RNA, 21 nt, Homo sapiens
uggaauuuucagucaucucau

SEQ ID NO: 1792111 - RNA, 18 nt, Homo sapiens
ccuugggccuuucaugcc

SEQ ID NO: 1792112 - RNA, 13 nt, Homo sapiens
augcaucaucagc

SEQ ID NO: 1792113 - RNA, 19 nt, Homo sapiens
aggcauaugcuucuuuaaa

SEQ ID NO: 1792114 - RNA, 14 nt, Homo sapiens
uguucugugccugc

SEQ ID NO: 1792115 - RNA, 16 nt, Homo sapiens
cgauguacaguaucag

SEQ ID NO: 1792116 - RNA, 19 nt, Homo sapiens
ccaugugugagugugugca

SEQ ID NO: 1792117 - RNA, 19 nt, Homo sapiens
agugugagagugugagcag

SEQ ID NO: 1792118 - RNA, 19 nt, Homo sapiens
ugucugaacggcugaauau

SEQ ID NO: 1792119 - RNA, 17 nt, Homo sapiens
gagauggacacacuggu

SEQ ID NO: 1792120 - RNA, 21 nt, Homo sapiens
aauauauaucaaauauauuca

SEQ ID NO: 1792121 - RNA, 19 nt, Homo sapiens
uagccaugauaacugcaau

SEQ ID NO: 1792122 - RNA, 16 nt, Homo sapiens
gccagcugugcacuuu

SEQ ID NO: 1792123 - RNA, 21 nt, Homo sapiens
aaacagcgagagggagaccca

SEQ ID NO: 1792124 - RNA, 10 nt, Homo sapiens
aauucccaau

SEQ ID NO: 1792125 - RNA, 12 nt, Homo sapiens
auuacaauuucu

SEQ ID NO: 1792126 - RNA, 19 nt, Homo sapiens
uugaccaaauaaaguacca

SEQ ID NO: 1792127 - RNA, 22 nt, Homo sapiens
gcuccaucccaaccaggcaccu

SEQ ID NO: 1792128 - RNA, 22 nt, Homo sapiens
cucuccuuuuauguggucucuu

SEQ ID NO: 1792129 - RNA, 20 nt, Homo sapiens
cuuuaaaaguauccagagau

SEQ ID NO: 1792130 - RNA, 13 nt, Homo sapiens
ucucuauuccuga

SEQ ID NO: 1792131 - RNA, 18 nt, Homo sapiens
cagcuggacccugaccag

SEQ ID NO: 1792132 - RNA, 13 nt, Homo sapiens
aaccucacuuccc

SEQ ID NO: 1792133 - RNA, 13 nt, Homo sapiens
aucuccacuacuu

SEQ ID NO: 1792134 - RNA, 13 nt, Homo sapiens
auuuccacuauuu

SEQ ID NO: 1792135 - RNA, 13 nt, Homo sapiens
aaccccacuuccu

SEQ ID NO: 1792136 - RNA, 21 nt, Homo sapiens
gaaggaagucagcaugccucu

SEQ ID NO: 1792137 - RNA, 16 nt, Homo sapiens
acaaagacaaccacug

SEQ ID NO: 1792138 - RNA, 23 nt, Homo sapiens
cuaauaaaauuaaguuguaucau

SEQ ID NO: 1792139 - RNA, 16 nt, Homo sapiens
caaugcacgcacacau

SEQ ID NO: 1792140 - RNA, 16 nt, Homo sapiens
ucaaguugcacacuca

SEQ ID NO: 1792141 - RNA, 22 nt, Homo sapiens
acagugaucuccauauguuaca

SEQ ID NO: 1792142 - RNA, 12 nt, Homo sapiens
auugaacuuucc

SEQ ID NO: 1792143 - RNA, 18 nt, Homo sapiens
uccaggguccacaggaag

SEQ ID NO: 1792144 - RNA, 21 nt, Homo sapiens
cugaauucuuuccccaaagac

SEQ ID NO: 1792145 - RNA, 20 nt, Homo sapiens
gcacaccgugugccauagaa

SEQ ID NO: 1792146 - RNA, 13 nt, Homo sapiens
agcuuguaauugc

SEQ ID NO: 1792147 - RNA, 18 nt, Homo sapiens
uguugucuauuugucucu

SEQ ID NO: 1792148 - RNA, 13 nt, Homo sapiens
ugugccaccaccc

SEQ ID NO: 1792149 - RNA, 14 nt, Homo sapiens
ugauauauugcugu

SEQ ID NO: 1792150 - RNA, 12 nt, Homo sapiens
uagaguggaaua

SEQ ID NO: 1792151 - RNA, 16 nt, Homo sapiens
acagaaggaugaauga

SEQ ID NO: 1792152 - RNA, 19 nt, Homo sapiens
guauuuucucuuucuuccu

SEQ ID NO: 1792153 - RNA, 23 nt, Homo sapiens
uccaugggggcagggcaugacuu

SEQ ID NO: 1792154 - RNA, 18 nt, Homo sapiens
cuuuccagggucuuuacu

SEQ ID NO: 1792155 - RNA, 16 nt, Homo sapiens
auacaauuagccaggu

SEQ ID NO: 1792156 - RNA, 23 nt, Homo sapiens
gugcuggcuguggagcaaaggcu

SEQ ID NO: 1792157 - RNA, 22 nt, Homo sapiens
cuccagccugggcaacagagca

SEQ ID NO: 1792158 - RNA, 15 nt, Homo sapiens
ggccucugacucuga

SEQ ID NO: 1792159 - RNA, 14 nt, Homo sapiens
caacugccaaauaa

SEQ ID NO: 1792160 - RNA, 14 nt, Homo sapiens
ucauguuacuugag

SEQ ID NO: 1792161 - RNA, 12 nt, Homo sapiens
uuucagcauaca

SEQ ID NO: 1792162 - RNA, 23 nt, Homo sapiens
uugucucucuaaacccaaauaaa

SEQ ID NO: 1792163 - RNA, 14 nt, Homo sapiens
aacagcaugaauaa

SEQ ID NO: 1792164 - RNA, 18 nt, Homo sapiens
auuucugaucuauacaaa

SEQ ID NO: 1792165 - RNA, 21 nt, Homo sapiens
aauguuggacaccuuuagguu

SEQ ID NO: 1792166 - RNA, 23 nt, Homo sapiens
cagcagaccagugggggauggcu

SEQ ID NO: 1792167 - RNA, 12 nt, Homo sapiens
ccuuuugcugcg

SEQ ID NO: 1792168 - RNA, 22 nt, Homo sapiens
aguaccauuaaaaccagaaagg

SEQ ID NO: 1792169 - RNA, 13 nt, Homo sapiens
ucuucuuccugaa

SEQ ID NO: 1792170 - RNA, 18 nt, Homo sapiens
uaguuagauucacuuuga

SEQ ID NO: 1792171 - RNA, 23 nt, Homo sapiens
cugcgaguggcuaguuuucacau

SEQ ID NO: 1792172 - RNA, 14 nt, Homo sapiens
gacggucaguccau

SEQ ID NO: 1792173 - RNA, 21 nt, Homo sapiens
aggaacacaggcgcugaguau

SEQ ID NO: 1792174 - RNA, 16 nt, Homo sapiens
aaacaaaaaacugccu

SEQ ID NO: 1792175 - RNA, 20 nt, Homo sapiens
acaaguggcucaucaucaag

SEQ ID NO: 1792176 - RNA, 12 nt, Homo sapiens
uuuccuucccua

SEQ ID NO: 1792177 - RNA, 21 nt, Homo sapiens
uuggggaaaauggccaugcag

SEQ ID NO: 1792178 - RNA, 12 nt, Homo sapiens
aauuuauauuca

SEQ ID NO: 1792179 - RNA, 14 nt, Homo sapiens
gccuucacauuugg

SEQ ID NO: 1792180 - RNA, 22 nt, Homo sapiens
guccugguugggaucacaccca

SEQ ID NO: 1792181 - RNA, 16 nt, Homo sapiens
ccuuugggcaaaggcc

SEQ ID NO: 1792182 - RNA, 22 nt, Homo sapiens
ggcuagguggguugaaagccaa

SEQ ID NO: 1792183 - RNA, 18 nt, Homo sapiens
aagcuggcaauauuacaa

SEQ ID NO: 1792184 - RNA, 14 nt, Homo sapiens
ucuguuauugcacu

SEQ ID NO: 1792185 - RNA, 22 nt, Homo sapiens
cauagaaggaaguguguuugcc

SEQ ID NO: 1792186 - RNA, 16 nt, Homo sapiens
acacagccuagcacag

SEQ ID NO: 1792187 - RNA, 12 nt, Homo sapiens
accaccacaagc

SEQ ID NO: 1792188 - RNA, 21 nt, Homo sapiens
uucccuauuuugccaguggga

SEQ ID NO: 1792189 - RNA, 12 nt, Homo sapiens
uaccuacuggug

SEQ ID NO: 1792190 - RNA, 20 nt, Homo sapiens
cccaggagcacccaggcaug

SEQ ID NO: 1792191 - RNA, 14 nt, Homo sapiens
cuuaagauuugcuc

SEQ ID NO: 1792192 - RNA, 17 nt, Homo sapiens
gcacuguaauauguaca

SEQ ID NO: 1792193 - RNA, 20 nt, Homo sapiens
uccagugugggcuugaccag

SEQ ID NO: 1792194 - RNA, 18 nt, Homo sapiens
ggaugucuuugcugcagu

SEQ ID NO: 1792195 - RNA, 15 nt, Homo sapiens
ccuacccuucccgcc

SEQ ID NO: 1792196 - RNA, 22 nt, Homo sapiens
acuacagggagaaaauccaggu

SEQ ID NO: 1792197 - RNA, 17 nt, Homo sapiens
gagcuuugucacuugcc

SEQ ID NO: 1792198 - RNA, 20 nt, Homo sapiens
auaguguucacaaacuguga

SEQ ID NO: 1792199 - RNA, 15 nt, Homo sapiens
aaucuccucacugaa

SEQ ID NO: 1792200 - RNA, 15 nt, Homo sapiens
caagccuccacuucc

SEQ ID NO: 1792201 - RNA, 21 nt, Homo sapiens
aagacaaaugggccugccaaa

SEQ ID NO: 1792202 - RNA, 20 nt, Homo sapiens
agcaaaaaaauuauuuucuc

SEQ ID NO: 1792203 - RNA, 12 nt, Homo sapiens
gguggacaugca

SEQ ID NO: 1792204 - RNA, 16 nt, Homo sapiens
ucacuuggccaguuuc

SEQ ID NO: 1792205 - RNA, 15 nt, Homo sapiens
cucuugcuguuaaau

SEQ ID NO: 1792206 - RNA, 15 nt, Homo sapiens
uuuauauauaugaug

SEQ ID NO: 1792207 - RNA, 12 nt, Homo sapiens
ccaagaccucag

SEQ ID NO: 1792208 - RNA, 23 nt, Homo sapiens
cuggaucuuuugguggagucagg

SEQ ID NO: 1792209 - RNA, 15 nt, Homo sapiens
cuggagcccacagcg

SEQ ID NO: 1792210 - RNA, 16 nt, Homo sapiens
gcaaucuguccagaca

SEQ ID NO: 1792211 - RNA, 12 nt, Homo sapiens
gguauuuacugc

SEQ ID NO: 1792212 - RNA, 14 nt, Homo sapiens
aguucagagcugcc

SEQ ID NO: 1792213 - RNA, 11 nt, Homo sapiens
cugcaucucau

SEQ ID NO: 1792214 - RNA, 20 nt, Homo sapiens
cugagcugaacacauuugcc

SEQ ID NO: 1792215 - RNA, 15 nt, Homo sapiens
caaauuucauugcac

SEQ ID NO: 1792216 - RNA, 22 nt, Homo sapiens
aucuuuaacuuaguauuuuacc

SEQ ID NO: 1792217 - RNA, 20 nt, Homo sapiens
ugaauaaauuugcccaaaau

SEQ ID NO: 1792218 - RNA, 14 nt, Homo sapiens
agaacacauuucaa

SEQ ID NO: 1792219 - RNA, 14 nt, Homo sapiens
ugauucuauguaac

SEQ ID NO: 1792220 - RNA, 16 nt, Homo sapiens
gccaacugaaaauccu

SEQ ID NO: 1792221 - RNA, 17 nt, Homo sapiens
aagauuauaggaacuga

SEQ ID NO: 1792222 - RNA, 13 nt, Homo sapiens
uccucaagccugu

SEQ ID NO: 1792223 - RNA, 20 nt, Homo sapiens
agaugaggcuccuuaguuua

SEQ ID NO: 1792224 - RNA, 12 nt, Homo sapiens
ugaaaacuucaa

SEQ ID NO: 1792225 - RNA, 15 nt, Homo sapiens
gaaucucuaugcccu

SEQ ID NO: 1792226 - RNA, 14 nt, Homo sapiens
uccaucacugagag

SEQ ID NO: 1792227 - RNA, 16 nt, Homo sapiens
cauggauuccacugaa

SEQ ID NO: 1792228 - RNA, 20 nt, Homo sapiens
uuguuucucccuccaggcca

SEQ ID NO: 1792229 - RNA, 22 nt, Homo sapiens
aaaauauuauguuaacauguaa

SEQ ID NO: 1792230 - RNA, 17 nt, Homo sapiens
cguaauuguacaagcag

SEQ ID NO: 1792231 - RNA, 14 nt, Homo sapiens
auacaucuguggac

SEQ ID NO: 1792232 - RNA, 22 nt, Homo sapiens
uggccaauaacuuuucaccaau

SEQ ID NO: 1792233 - RNA, 13 nt, Homo sapiens
ucuguuuguuuaa

SEQ ID NO: 1792234 - RNA, 12 nt, Homo sapiens
ugacagugccaa

SEQ ID NO: 1792235 - RNA, 15 nt, Homo sapiens
aucccagcuacucag

SEQ ID NO: 1792236 - RNA, 15 nt, Homo sapiens
gagacuuggaccugg

SEQ ID NO: 1792237 - RNA, 13 nt, Homo sapiens
acuugauuccuug

SEQ ID NO: 1792238 - RNA, 13 nt, Homo sapiens
aaaagauucaaag

SEQ ID NO: 1792239 - RNA, 13 nt, Homo sapiens
auguuauucuguu

SEQ ID NO: 1792240 - RNA, 20 nt, Homo sapiens
cgaugaauguguugauuuga

SEQ ID NO: 1792241 - RNA, 17 nt, Homo sapiens
agaauccguauugaauu

SEQ ID NO: 1792242 - RNA, 19 nt, Homo sapiens
ucaacuguuuuugucuaca

SEQ ID NO: 1792243 - RNA, 23 nt, Homo sapiens
caucagaaccagaggcuuggucc

SEQ ID NO: 1792244 - RNA, 14 nt, Homo sapiens
agaggucugugcug

SEQ ID NO: 1792245 - RNA, 15 nt, Homo sapiens
agucuucaaauuuga

SEQ ID NO: 1792246 - RNA, 12 nt, Homo sapiens
uaggacuccauu

SEQ ID NO: 1792247 - RNA, 17 nt, Homo sapiens
guggaagaacugugaua

SEQ ID NO: 1792248 - RNA, 14 nt, Homo sapiens
cacuaaauucacau

SEQ ID NO: 1792249 - RNA, 18 nt, Homo sapiens
cauacaaguauccaguca

SEQ ID NO: 1792250 - RNA, 16 nt, Homo sapiens
augccucugagcagag

SEQ ID NO: 1792251 - RNA, 13 nt, Homo sapiens
aaugaaaucuggg

SEQ ID NO: 1792252 - RNA, 12 nt, Homo sapiens
uccagcucucag

SEQ ID NO: 1792253 - RNA, 21 nt, Homo sapiens
gaaggacacuagccugugcac

SEQ ID NO: 1792254 - RNA, 15 nt, Homo sapiens
aagagcuacucccac

SEQ ID NO: 1792255 - RNA, 16 nt, Homo sapiens
cgugaauuuauaguua

SEQ ID NO: 1792256 - RNA, 22 nt, Homo sapiens
cacauuaggauggugaaccagc

SEQ ID NO: 1792257 - RNA, 23 nt, Homo sapiens
augacuucugccccagcuuuauc

SEQ ID NO: 1792258 - RNA, 22 nt, Homo sapiens
uauuccugggaggacucugaug

SEQ ID NO: 1792259 - RNA, 22 nt, Homo sapiens
caggaaaggggugagagugauu

SEQ ID NO: 1792260 - RNA, 14 nt, Homo sapiens
uauguggcuguauc

SEQ ID NO: 1792261 - RNA, 12 nt, Homo sapiens
aacaaaaugauc

SEQ ID NO: 1792262 - RNA, 13 nt, Homo sapiens
aguucucugccaa

SEQ ID NO: 1792263 - RNA, 17 nt, Homo sapiens
guguccaguugcagcug

SEQ ID NO: 1792264 - RNA, 13 nt, Homo sapiens
ugugugugugcaa

SEQ ID NO: 1792265 - RNA, 13 nt, Homo sapiens
auuuagcacauac

SEQ ID NO: 1792266 - RNA, 14 nt, Homo sapiens
uauccuauguuaaa

SEQ ID NO: 1792267 - RNA, 13 nt, Homo sapiens
aaggcaguggaaa

SEQ ID NO: 1792268 - RNA, 14 nt, Homo sapiens
aauucauguuuuca

SEQ ID NO: 1792269 - RNA, 14 nt, Homo sapiens
aucaguuguacagu

SEQ ID NO: 1792270 - RNA, 12 nt, Homo sapiens
cuucagcacuuu

SEQ ID NO: 1792271 - RNA, 21 nt, Homo sapiens
gaaaaauguaaauacucauga

SEQ ID NO: 1792272 - RNA, 15 nt, Homo sapiens
agugaucaccugcca

SEQ ID NO: 1792273 - RNA, 20 nt, Homo sapiens
ccagcccccacccaugccag

SEQ ID NO: 1792274 - RNA, 19 nt, Homo sapiens
cacuugcuuagguugucuu

SEQ ID NO: 1792275 - RNA, 16 nt, Homo sapiens
aacacugccugcucuu

SEQ ID NO: 1792276 - RNA, 18 nt, Homo sapiens
uggggcugaucucaggga

SEQ ID NO: 1792277 - RNA, 16 nt, Homo sapiens
uuguuaucaguacaau

SEQ ID NO: 1792278 - RNA, 13 nt, Homo sapiens
caggagacuggca

SEQ ID NO: 1792279 - RNA, 22 nt, Homo sapiens
uaaagauuuuuuaauaauuuag

SEQ ID NO: 1792280 - RNA, 14 nt, Homo sapiens
agcacuuuaaacuu

SEQ ID NO: 1792281 - RNA, 16 nt, Homo sapiens
cuagggccaagcccag

SEQ ID NO: 1792282 - RNA, 12 nt, Homo sapiens
cucuuguagcca

SEQ ID NO: 1792283 - RNA, 12 nt, Homo sapiens
cucauguagccu

SEQ ID NO: 1792284 - RNA, 17 nt, Homo sapiens
cagcccaagaugcuuua

SEQ ID NO: 1792285 - RNA, 13 nt, Homo sapiens
uauuucacuuuag

SEQ ID NO: 1792286 - RNA, 13 nt, Homo sapiens
uauugcacuuuau

SEQ ID NO: 1792287 - RNA, 23 nt, Homo sapiens
ucaugcccagcuuggagugccac

SEQ ID NO: 1792288 - RNA, 22 nt, Homo sapiens
ccuccauaauguaagaagcuuu

SEQ ID NO: 1792289 - RNA, 20 nt, Homo sapiens
agucaugcguuuaaucacau

SEQ ID NO: 1792290 - RNA, 15 nt, Homo sapiens
aucuuuucauucuca

SEQ ID NO: 1792291 - RNA, 15 nt, Homo sapiens
auuuaauuacuacua

SEQ ID NO: 1792292 - RNA, 14 nt, Homo sapiens
gcaauuaacucugg

SEQ ID NO: 1792293 - RNA, 20 nt, Homo sapiens
uucucuauuagacuuuagaa

SEQ ID NO: 1792294 - RNA, 23 nt, Homo sapiens
uacaccauaguuuacaauauuau

SEQ ID NO: 1792295 - RNA, 21 nt, Homo sapiens
uaugagucggauacccuggag

SEQ ID NO: 1792296 - RNA, 16 nt, Homo sapiens
auucaaaaagccaaaa

SEQ ID NO: 1792297 - RNA, 17 nt, Homo sapiens
augugaaaauauacuug

SEQ ID NO: 1792298 - RNA, 14 nt, Homo sapiens
uuugaaaguauaau

SEQ ID NO: 1792299 - RNA, 19 nt, Homo sapiens
gaauaauaagcuacuugcc

SEQ ID NO: 1792300 - RNA, 19 nt, Homo sapiens
aauuucucuuuaaaaccau

SEQ ID NO: 1792301 - RNA, 23 nt, Homo sapiens
ucacuuugcagaggcuggaagac

SEQ ID NO: 1792302 - RNA, 20 nt, Homo sapiens
agaacccugcguggggacag

SEQ ID NO: 1792303 - RNA, 16 nt, Homo sapiens
ucugggaacuugucac

SEQ ID NO: 1792304 - RNA, 20 nt, Homo sapiens
uauauuuauucaucugggag

SEQ ID NO: 1792305 - RNA, 12 nt, Homo sapiens
uuucaaagugua

SEQ ID NO: 1792306 - RNA, 19 nt, Homo sapiens
gugggucuguguggcagga

SEQ ID NO: 1792307 - RNA, 11 nt, Homo sapiens
caccaguucuc

SEQ ID NO: 1792308 - RNA, 18 nt, Homo sapiens
aauuaauggaauauguaa

SEQ ID NO: 1792309 - RNA, 14 nt, Homo sapiens
cuccccaccugcuc

SEQ ID NO: 1792310 - RNA, 23 nt, Homo sapiens
ggccucccucugcuacuccaucc

SEQ ID NO: 1792311 - RNA, 13 nt, Homo sapiens
guuguuugggaga

SEQ ID NO: 1792312 - RNA, 13 nt, Homo sapiens
gaagugucaugca

SEQ ID NO: 1792313 - RNA, 13 nt, Homo sapiens
augcccuaugugu

SEQ ID NO: 1792314 - RNA, 12 nt, Homo sapiens
ucacuuugcaua

SEQ ID NO: 1792315 - RNA, 21 nt, Homo sapiens
uaacuugugaagacaaugaaa

SEQ ID NO: 1792316 - RNA, 14 nt, Homo sapiens
aacuaccaccucag

SEQ ID NO: 1792317 - RNA, 19 nt, Homo sapiens
cagaaggaaaaauguguaa

SEQ ID NO: 1792318 - RNA, 17 nt, Homo sapiens
uuuuauggcucuaucuu

SEQ ID NO: 1792319 - RNA, 18 nt, Homo sapiens
ucauacauuagugccaua

SEQ ID NO: 1792320 - RNA, 16 nt, Homo sapiens
uaagaaacacugacuc

SEQ ID NO: 1792321 - RNA, 13 nt, Homo sapiens
aucauccugucac

SEQ ID NO: 1792322 - RNA, 21 nt, Homo sapiens
cccaggaaucugugugguaca

SEQ ID NO: 1792323 - RNA, 22 nt, Homo sapiens
ccugucugccagccagcagcca

SEQ ID NO: 1792324 - RNA, 17 nt, Homo sapiens
ugggaagaagcaguuua

SEQ ID NO: 1792325 - RNA, 22 nt, Homo sapiens
caggagaaugugcagugucuug

SEQ ID NO: 1792326 - RNA, 15 nt, Homo sapiens
gucuaagaacucuuu

SEQ ID NO: 1792327 - RNA, 13 nt, Homo sapiens
ccuaagaguggag

SEQ ID NO: 1792328 - RNA, 23 nt, Homo sapiens
aacccacuuuaaaauaucuacau

SEQ ID NO: 1792329 - RNA, 20 nt, Homo sapiens
ucuuuacaaaacuacaugag

SEQ ID NO: 1792330 - RNA, 21 nt, Homo sapiens
ucuaugccuaaaaaguaucau

SEQ ID NO: 1792331 - RNA, 19 nt, Homo sapiens
agagcaaaacucagucuca

SEQ ID NO: 1792332 - RNA, 11 nt, Homo sapiens
aaauacacuua

SEQ ID NO: 1792333 - RNA, 20 nt, Homo sapiens
agggaauggcacagcccaaa

SEQ ID NO: 1792334 - RNA, 14 nt, Homo sapiens
gagguugugucacu

SEQ ID NO: 1792335 - RNA, 20 nt, Homo sapiens
aaauuacugcccacuuguca

SEQ ID NO: 1792336 - RNA, 21 nt, Homo sapiens
ggcauuggguaagggacucca

SEQ ID NO: 1792337 - RNA, 21 nt, Homo sapiens
gauaagauguuaucaaugaca

SEQ ID NO: 1792338 - RNA, 17 nt, Homo sapiens
ugcagcccuugugaugu

SEQ ID NO: 1792339 - RNA, 15 nt, Homo sapiens
ugccauuugagcucu

SEQ ID NO: 1792340 - RNA, 23 nt, Homo sapiens
aagucuuuauuauuuacuuugca

SEQ ID NO: 1792341 - RNA, 14 nt, Homo sapiens
aaaaccuacauauu

SEQ ID NO: 1792342 - RNA, 22 nt, Homo sapiens
ugcucagaauucaucugaagag

SEQ ID NO: 1792343 - RNA, 17 nt, Homo sapiens
agaagggggccaugagg

SEQ ID NO: 1792344 - RNA, 13 nt, Homo sapiens
aguccacugagca

SEQ ID NO: 1792345 - RNA, 16 nt, Homo sapiens
aaagccagcaaagccu

SEQ ID NO: 1792346 - RNA, 19 nt, Homo sapiens
uccagcccccagugcgcuc

SEQ ID NO: 1792347 - RNA, 22 nt, Homo sapiens
uauccugcgaccuugcaaccuc

SEQ ID NO: 1792348 - RNA, 15 nt, Homo sapiens
aacucuuuaucccau

SEQ ID NO: 1792349 - RNA, 18 nt, Homo sapiens
gagaggagccaggacugu

SEQ ID NO: 1792350 - RNA, 22 nt, Homo sapiens
auucccucaccugucgcuuccu

SEQ ID NO: 1792351 - RNA, 14 nt, Homo sapiens
caguagcauuugcu

SEQ ID NO: 1792352 - RNA, 20 nt, Homo sapiens
caaggaaagccccagcacua

SEQ ID NO: 1792353 - RNA, 21 nt, Homo sapiens
caggugacuuuccuaugacac

SEQ ID NO: 1792354 - RNA, 13 nt, Homo sapiens
aaaaaugcuguuc

SEQ ID NO: 1792355 - RNA, 18 nt, Homo sapiens
gggguuggguuccagaca

SEQ ID NO: 1792356 - RNA, 18 nt, Homo sapiens
auccugguuucaaugacg

SEQ ID NO: 1792357 - RNA, 20 nt, Homo sapiens
cccagaucaaauucuauuaa

SEQ ID NO: 1792358 - RNA, 23 nt, Homo sapiens
gcaggguggggggccauguuccc

SEQ ID NO: 1792359 - RNA, 21 nt, Homo sapiens
cucaucuacaagcauuugccc

SEQ ID NO: 1792360 - RNA, 20 nt, Homo sapiens
uauaucaauuuccucauauc

SEQ ID NO: 1792361 - RNA, 22 nt, Homo sapiens
gcucauugcuaaccacugucug

SEQ ID NO: 1792362 - RNA, 20 nt, Homo sapiens
agaaaaggccuucuucccaa

SEQ ID NO: 1792363 - RNA, 18 nt, Homo sapiens
ucuugggacauccuguca

SEQ ID NO: 1792364 - RNA, 21 nt, Homo sapiens
auuucucuuuuauucuguuau

SEQ ID NO: 1792365 - RNA, 19 nt, Homo sapiens
gcugauucagcagugccua

SEQ ID NO: 1792366 - RNA, 18 nt, Homo sapiens
gccccuggacgaaggucu

SEQ ID NO: 1792367 - RNA, 19 nt, Homo sapiens
cagagucugggccucugac

SEQ ID NO: 1792368 - RNA, 17 nt, Homo sapiens
cagugccagcaaugaca

SEQ ID NO: 1792369 - RNA, 16 nt, Homo sapiens
cccagccucacuccau

SEQ ID NO: 1792370 - RNA, 15 nt, Homo sapiens
cagcaucacucccca

SEQ ID NO: 1792371 - RNA, 12 nt, Homo sapiens
auuaaauguuuc

SEQ ID NO: 1792372 - RNA, 22 nt, Homo sapiens
aaauuugugguccacugagcua

SEQ ID NO: 1792373 - RNA, 20 nt, Homo sapiens
uuaggucccaucaauucuua

SEQ ID NO: 1792374 - RNA, 14 nt, Homo sapiens
ucauuuaaaacagg

SEQ ID NO: 1792375 - RNA, 14 nt, Homo sapiens
gggaagaagggaua

SEQ ID NO: 1792376 - RNA, 15 nt, Homo sapiens
uagacuuuucccaag

SEQ ID NO: 1792377 - RNA, 22 nt, Homo sapiens
ugaaaguguuuugcccuauaua

SEQ ID NO: 1792378 - RNA, 14 nt, Homo sapiens
uaucugugaacuga

SEQ ID NO: 1792379 - RNA, 17 nt, Homo sapiens
uuuuuucugccuaauag

SEQ ID NO: 1792380 - RNA, 13 nt, Homo sapiens
uuuuuaugaaaua

SEQ ID NO: 1792381 - RNA, 12 nt, Homo sapiens
agguugagccaa

SEQ ID NO: 1792382 - RNA, 23 nt, Homo sapiens
acauaucauucagaaugugcaaa

SEQ ID NO: 1792383 - RNA, 12 nt, Homo sapiens
acuaagcucuuu

SEQ ID NO: 1792384 - RNA, 14 nt, Homo sapiens
uggaggaacaguau

SEQ ID NO: 1792385 - RNA, 15 nt, Homo sapiens
ucuaaaaugcuuuua

SEQ ID NO: 1792386 - RNA, 21 nt, Homo sapiens
agagagauuguguucuuccuc

SEQ ID NO: 1792387 - RNA, 16 nt, Homo sapiens
aucccaaacugugaug

SEQ ID NO: 1792388 - RNA, 14 nt, Homo sapiens
uggccaauuucacc

SEQ ID NO: 1792389 - RNA, 15 nt, Homo sapiens
guaugggaagccaua

SEQ ID NO: 1792390 - RNA, 21 nt, Homo sapiens
uggcauugucuguaaugacaa

SEQ ID NO: 1792391 - RNA, 19 nt, Homo sapiens
gggugggaguagugcuuuc

SEQ ID NO: 1792392 - RNA, 15 nt, Homo sapiens
aacaaccuuucaugu

SEQ ID NO: 1792393 - RNA, 15 nt, Homo sapiens
auaguugauucuugc

SEQ ID NO: 1792394 - RNA, 13 nt, Homo sapiens
aacacaacaucuu

SEQ ID NO: 1792395 - RNA, 19 nt, Homo sapiens
aggaauauuucaagcucug

SEQ ID NO: 1792396 - RNA, 18 nt, Homo sapiens
auuuguccuuccuaagaa

SEQ ID NO: 1792397 - RNA, 17 nt, Homo sapiens
cucaccaugaugugaag

SEQ ID NO: 1792398 - RNA, 14 nt, Homo sapiens
guccacaucugccu

SEQ ID NO: 1792399 - RNA, 21 nt, Homo sapiens
uuuccuuguccccacacuccu

SEQ ID NO: 1792400 - RNA, 20 nt, Homo sapiens
aggucccggccagcucugga

SEQ ID NO: 1792401 - RNA, 19 nt, Homo sapiens
ggagcaagugacaugccau

SEQ ID NO: 1792402 - RNA, 13 nt, Homo sapiens
gaacugcugcugg

SEQ ID NO: 1792403 - RNA, 18 nt, Homo sapiens
cauuuucugguaagguuu

SEQ ID NO: 1792404 - RNA, 14 nt, Homo sapiens
uguuaaaggucaua

SEQ ID NO: 1792405 - RNA, 20 nt, Homo sapiens
aauucagaaugaucugcaag

SEQ ID NO: 1792406 - RNA, 20 nt, Homo sapiens
cucguccucacuggucuaca

SEQ ID NO: 1792407 - RNA, 17 nt, Homo sapiens
ugaccaaagagcccuca

SEQ ID NO: 1792408 - RNA, 22 nt, Homo sapiens
aauguauaauuaacuuaacuga

SEQ ID NO: 1792409 - RNA, 14 nt, Homo sapiens
ugugauguguccug

SEQ ID NO: 1792410 - RNA, 23 nt, Homo sapiens
uccaaggaccucucucaaugcca

SEQ ID NO: 1792411 - RNA, 18 nt, Homo sapiens
uccaauuccuugcacaua

SEQ ID NO: 1792412 - RNA, 22 nt, Homo sapiens
gucuccuuuaguuucagagugu

SEQ ID NO: 1792413 - RNA, 17 nt, Homo sapiens
ccugcccaaacccuuaa

SEQ ID NO: 1792414 - RNA, 20 nt, Homo sapiens
gcagauggcagaugcacaug

SEQ ID NO: 1792415 - RNA, 15 nt, Homo sapiens
ggcuaagacuuccua

SEQ ID NO: 1792416 - RNA, 16 nt, Homo sapiens
aguaaaauccaaagaa

SEQ ID NO: 1792417 - RNA, 17 nt, Homo sapiens
gcccagcaggcaggcac

SEQ ID NO: 1792418 - RNA, 22 nt, Homo sapiens
aacacuauauauuuuaugaucu

SEQ ID NO: 1792419 - RNA, 17 nt, Homo sapiens
ugcugaggagcucaggg

SEQ ID NO: 1792420 - RNA, 22 nt, Homo sapiens
auuuaguaaauaaacaagucaa

SEQ ID NO: 1792421 - RNA, 21 nt, Homo sapiens
acucucagucagugucaugaa

SEQ ID NO: 1792422 - RNA, 15 nt, Homo sapiens
auguguuacuucaag

SEQ ID NO: 1792423 - RNA, 16 nt, Homo sapiens
cuccuggcccacugca

SEQ ID NO: 1792424 - RNA, 20 nt, Homo sapiens
agagcuccugucccuaccca

SEQ ID NO: 1792425 - RNA, 23 nt, Homo sapiens
uguuuggugacauaaugccaagg

SEQ ID NO: 1792426 - RNA, 16 nt, Homo sapiens
ugaagggccacuggga

SEQ ID NO: 1792427 - RNA, 16 nt, Homo sapiens
ugaauaaccacuuaaa

SEQ ID NO: 1792428 - RNA, 14 nt, Homo sapiens
uaugaauguuacua

SEQ ID NO: 1792429 - RNA, 23 nt, Homo sapiens
uuuuaucccccaccaaaaacaca

SEQ ID NO: 1792430 - RNA, 20 nt, Homo sapiens
auucuugugucaucaaguag

SEQ ID NO: 1792431 - RNA, 18 nt, Homo sapiens
acagggucauguuugcag

SEQ ID NO: 1792432 - RNA, 17 nt, Homo sapiens
aauaacauuuuauacaa

SEQ ID NO: 1792433 - RNA, 15 nt, Homo sapiens
uaaccccauucuuug

SEQ ID NO: 1792434 - RNA, 18 nt, Homo sapiens
caugugcugauguuuaca

SEQ ID NO: 1792435 - RNA, 14 nt, Homo sapiens
gcucucauguuccu

SEQ ID NO: 1792436 - RNA, 17 nt, Homo sapiens
uguagauaaacucagaa

SEQ ID NO: 1792437 - RNA, 18 nt, Homo sapiens
cguguguguucacguguu

SEQ ID NO: 1792438 - RNA, 22 nt, Homo sapiens
ggugccuucucacaucugucca

SEQ ID NO: 1792439 - RNA, 15 nt, Homo sapiens
augguccagugucau

SEQ ID NO: 1792440 - RNA, 14 nt, Homo sapiens
ccuugugaugucau

SEQ ID NO: 1792441 - RNA, 15 nt, Homo sapiens
ucacaauacaguaag

SEQ ID NO: 1792442 - RNA, 21 nt, Homo sapiens
auuuuaagguauucgaaugaa

SEQ ID NO: 1792443 - RNA, 21 nt, Homo sapiens
ucaugaagcagauuugcacug

SEQ ID NO: 1792444 - RNA, 20 nt, Homo sapiens
augcaagugguuuccuggug

SEQ ID NO: 1792445 - RNA, 15 nt, Homo sapiens
gccacagagcuacau

SEQ ID NO: 1792446 - RNA, 17 nt, Homo sapiens
cuucuguaguacuccuu

SEQ ID NO: 1792447 - RNA, 18 nt, Homo sapiens
caacuuuuccuuugaauc

SEQ ID NO: 1792448 - RNA, 16 nt, Homo sapiens
auccauucucucugcc

SEQ ID NO: 1792449 - RNA, 14 nt, Homo sapiens
ucacaggacauuaa

SEQ ID NO: 1792450 - RNA, 21 nt, Homo sapiens
uguggugaccugauguaaaca

SEQ ID NO: 1792451 - RNA, 13 nt, Homo sapiens
cagcuaaguugca

SEQ ID NO: 1792452 - RNA, 18 nt, Homo sapiens
cagugaaacuccaucuca

SEQ ID NO: 1792453 - RNA, 20 nt, Homo sapiens
aagugauccacccaccucgg

SEQ ID NO: 1792454 - RNA, 19 nt, Homo sapiens
aagugggugggcacacuga

SEQ ID NO: 1792455 - RNA, 16 nt, Homo sapiens
cccccaucccucggga

SEQ ID NO: 1792456 - RNA, 13 nt, Homo sapiens
caccccaacaucu

SEQ ID NO: 1792457 - RNA, 21 nt, Homo sapiens
auagguuuguaaaaugcaccc

SEQ ID NO: 1792458 - RNA, 18 nt, Homo sapiens
caaagaggauugagauaa

SEQ ID NO: 1792459 - RNA, 21 nt, Homo sapiens
acugcaccuucugugccucag

SEQ ID NO: 1792460 - RNA, 23 nt, Homo sapiens
gcuugaagccuccacaccagcug

SEQ ID NO: 1792461 - RNA, 22 nt, Homo sapiens
uagccuuuauuuuuaaccugcc

SEQ ID NO: 1792462 - RNA, 17 nt, Homo sapiens
ucugaaacccuugagcu

SEQ ID NO: 1792463 - RNA, 22 nt, Homo sapiens
cagugugcuaaccucacugccu

SEQ ID NO: 1792464 - RNA, 20 nt, Homo sapiens
aggccccugcaaugugguga

SEQ ID NO: 1792465 - RNA, 17 nt, Homo sapiens
caugguggguccauggg

SEQ ID NO: 1792466 - RNA, 22 nt, Homo sapiens
ucuuccaaucuccaucaccuuu

SEQ ID NO: 1792467 - RNA, 19 nt, Homo sapiens
caggcacauaccacugcac

SEQ ID NO: 1792468 - RNA, 21 nt, Homo sapiens
acagaguggacuguucccuga

SEQ ID NO: 1792469 - RNA, 20 nt, Homo sapiens
uggguuccuguaugguggaa

SEQ ID NO: 1792470 - RNA, 16 nt, Homo sapiens
agaggguuuccauggg

SEQ ID NO: 1792471 - RNA, 20 nt, Homo sapiens
gcuuucucccucacccaagu

SEQ ID NO: 1792472 - RNA, 18 nt, Homo sapiens
uaaaaaaagaacauaaaa

SEQ ID NO: 1792473 - RNA, 20 nt, Homo sapiens
cagggacucaggccagucac

SEQ ID NO: 1792474 - RNA, 21 nt, Homo sapiens
aguuuuggcaaggcugacaga

SEQ ID NO: 1792475 - RNA, 16 nt, Homo sapiens
cagagagcagugcuuu

SEQ ID NO: 1792476 - RNA, 13 nt, Homo sapiens
ccaggcaccacca

SEQ ID NO: 1792477 - RNA, 18 nt, Homo sapiens
gcaaagauccccaaaaca

SEQ ID NO: 1792478 - RNA, 16 nt, Homo sapiens
ccugcucaacauuuaa

SEQ ID NO: 1792479 - RNA, 13 nt, Homo sapiens
gaaugaagcaugu

SEQ ID NO: 1792480 - RNA, 21 nt, Homo sapiens
ugaaaagcuagaauugagugu

SEQ ID NO: 1792481 - RNA, 23 nt, Homo sapiens
auguuuuuagaggacuauuacau

SEQ ID NO: 1792482 - RNA, 17 nt, Homo sapiens
cagggaggcaacacugc

SEQ ID NO: 1792483 - RNA, 18 nt, Homo sapiens
guuucaaaauguuaacaa

SEQ ID NO: 1792484 - RNA, 12 nt, Homo sapiens
gaagcacagcuu

SEQ ID NO: 1792485 - RNA, 12 nt, Homo sapiens
cauucacaccag

SEQ ID NO: 1792486 - RNA, 18 nt, Homo sapiens
ugagacuccucauaccuc

SEQ ID NO: 1792487 - RNA, 23 nt, Homo sapiens
ugugagacucgagaacuuucauu

SEQ ID NO: 1792488 - RNA, 18 nt, Homo sapiens
acucagagacaugcagag

SEQ ID NO: 1792489 - RNA, 12 nt, Homo sapiens
uacgauuucacu

SEQ ID NO: 1792490 - RNA, 11 nt, Homo sapiens
uuugugccaua

SEQ ID NO: 1792491 - RNA, 19 nt, Homo sapiens
uacaggaagguagaaauau

SEQ ID NO: 1792492 - RNA, 18 nt, Homo sapiens
aagaaagcaggugcaaca

SEQ ID NO: 1792493 - RNA, 17 nt, Homo sapiens
ugccagguccuugcccu

SEQ ID NO: 1792494 - RNA, 14 nt, Homo sapiens
agcugacaucucag

SEQ ID NO: 1792495 - RNA, 20 nt, Homo sapiens
aucaaaacuaaccaucugaa

SEQ ID NO: 1792496 - RNA, 14 nt, Homo sapiens
auauagaguggaau

SEQ ID NO: 1792497 - RNA, 14 nt, Homo sapiens
ugguauauuuccau

SEQ ID NO: 1792498 - RNA, 20 nt, Homo sapiens
acaggcacccaccaccaugc

SEQ ID NO: 1792499 - RNA, 17 nt, Homo sapiens
gcuacccgagguuugca

SEQ ID NO: 1792500 - RNA, 16 nt, Homo sapiens
uuaaaauuauauagca

SEQ ID NO: 1792501 - RNA, 19 nt, Homo sapiens
ccaguggucagcagguguc

SEQ ID NO: 1792502 - RNA, 18 nt, Homo sapiens
cauaaacuucaucuucaa

SEQ ID NO: 1792503 - RNA, 18 nt, Homo sapiens
uauggaaacagagcaaaa

SEQ ID NO: 1792504 - RNA, 18 nt, Homo sapiens
ucaggaaaaucugugauu

SEQ ID NO: 1792505 - RNA, 14 nt, Homo sapiens
cagaaauguguuau

SEQ ID NO: 1792506 - RNA, 20 nt, Homo sapiens
acaagacauuucgaagucau

SEQ ID NO: 1792507 - RNA, 19 nt, Homo sapiens
uuuauucuuccuugagcua

SEQ ID NO: 1792508 - RNA, 17 nt, Homo sapiens
auccuuugcuucauucc

SEQ ID NO: 1792509 - RNA, 19 nt, Homo sapiens
aggacuuagugcaucagau

SEQ ID NO: 1792510 - RNA, 23 nt, Homo sapiens
aucacaccguccuccacgccauu

SEQ ID NO: 1792511 - RNA, 22 nt, Homo sapiens
caauguccaaacccacucauga

SEQ ID NO: 1792512 - RNA, 18 nt, Homo sapiens
aggcugcuagaggugcuc

SEQ ID NO: 1792513 - RNA, 18 nt, Homo sapiens
ucaugccacugcacugca

SEQ ID NO: 1792514 - RNA, 19 nt, Homo sapiens
aucuaccugcccucucuca

SEQ ID NO: 1792515 - RNA, 12 nt, Homo sapiens
auuuucuguucc

SEQ ID NO: 1792516 - RNA, 13 nt, Homo sapiens
ccaguuacuugcu

SEQ ID NO: 1792517 - RNA, 19 nt, Homo sapiens
gcacaugacauagcacuug

SEQ ID NO: 1792518 - RNA, 22 nt, Homo sapiens
aauacauuucaauuauacuaaa

SEQ ID NO: 1792519 - RNA, 19 nt, Homo sapiens
agaagaccucccugugaga

SEQ ID NO: 1792520 - RNA, 22 nt, Homo sapiens
auuguuaccugucauuuugcac

SEQ ID NO: 1792521 - RNA, 22 nt, Homo sapiens
agcauccucucggggcagaccc

SEQ ID NO: 1792522 - RNA, 15 nt, Homo sapiens
gaaauggaugcaaag

SEQ ID NO: 1792523 - RNA, 22 nt, Homo sapiens
aaaaacauggccuuugcuugaa

SEQ ID NO: 1792524 - RNA, 20 nt, Homo sapiens
acucacauuggcaaguguaa

SEQ ID NO: 1792525 - RNA, 16 nt, Homo sapiens
accgcuugguuugcaa

SEQ ID NO: 1792526 - RNA, 13 nt, Homo sapiens
gaaagccugagaa

SEQ ID NO: 1792527 - RNA, 12 nt, Homo sapiens
auaaaacugugu

SEQ ID NO: 1792528 - RNA, 22 nt, Homo sapiens
ugccaaaaggauaaaugucuuu

SEQ ID NO: 1792529 - RNA, 13 nt, Homo sapiens
uucaccaauaagu

SEQ ID NO: 1792530 - RNA, 14 nt, Homo sapiens
uuuucuugucuaua

SEQ ID NO: 1792531 - RNA, 13 nt, Homo sapiens
cuguuucuguaua

SEQ ID NO: 1792532 - RNA, 15 nt, Homo sapiens
uaacaauaaaagaca

SEQ ID NO: 1792533 - RNA, 22 nt, Homo sapiens
uucucacaucccucuaaaagua

SEQ ID NO: 1792534 - RNA, 19 nt, Homo sapiens
ccauucugccgcccccucc

SEQ ID NO: 1792535 - RNA, 20 nt, Homo sapiens
agaagcccagguuacaaaga

SEQ ID NO: 1792536 - RNA, 16 nt, Homo sapiens
cugccgcugcaccugc

SEQ ID NO: 1792537 - RNA, 16 nt, Homo sapiens
uuagugugauugugaa

SEQ ID NO: 1792538 - RNA, 16 nt, Homo sapiens
cauuuuggugcaauau

SEQ ID NO: 1792539 - RNA, 21 nt, Homo sapiens
uggggaaaagugaauuucaca

SEQ ID NO: 1792540 - RNA, 20 nt, Homo sapiens
uccgcgccuugccuccucac

SEQ ID NO: 1792541 - RNA, 16 nt, Homo sapiens
ucugggcuaauauacu

SEQ ID NO: 1792542 - RNA, 20 nt, Homo sapiens
cuggagugcaguggugcaau

SEQ ID NO: 1792543 - RNA, 23 nt, Homo sapiens
cuauuagagcugccugugccuuu

SEQ ID NO: 1792544 - RNA, 20 nt, Homo sapiens
cagucuguacagaaugcuau

SEQ ID NO: 1792545 - RNA, 23 nt, Homo sapiens
cccugcgcgggaccaucuggaau

SEQ ID NO: 1792546 - RNA, 15 nt, Homo sapiens
ugcagcuuauauuca

SEQ ID NO: 1792547 - RNA, 16 nt, Homo sapiens
ugcaaacccuuucaua

SEQ ID NO: 1792548 - RNA, 23 nt, Homo sapiens
acuauggacggugcuccaggcag

SEQ ID NO: 1792549 - RNA, 21 nt, Homo sapiens
cucacuggaugaaauaacucc

SEQ ID NO: 1792550 - RNA, 16 nt, Homo sapiens
cuauaaaauagauaua

SEQ ID NO: 1792551 - RNA, 20 nt, Homo sapiens
cuauuucaucagaacagcug

SEQ ID NO: 1792552 - RNA, 13 nt, Homo sapiens
auuuuuugacuuu

SEQ ID NO: 1792553 - RNA, 13 nt, Homo sapiens
caacgugcaacug

SEQ ID NO: 1792554 - RNA, 22 nt, Homo sapiens
ugacagaacgagacuccaccuc

SEQ ID NO: 1792555 - RNA, 14 nt, Homo sapiens
acucuuacuucccc

SEQ ID NO: 1792556 - RNA, 19 nt, Homo sapiens
aaggagugagaugaaucaa

SEQ ID NO: 1792557 - RNA, 18 nt, Homo sapiens
gaagcugauccaguuucc

SEQ ID NO: 1792558 - RNA, 17 nt, Homo sapiens
agucaacaguucaaaga

SEQ ID NO: 1792559 - RNA, 17 nt, Homo sapiens
gcaugacugauguuggg

SEQ ID NO: 1792560 - RNA, 14 nt, Homo sapiens
auguauaccagccu

SEQ ID NO: 1792561 - RNA, 21 nt, Homo sapiens
gcagugagccgagaucgugcc

SEQ ID NO: 1792562 - RNA, 16 nt, Homo sapiens
ggcuauucuacuuuaa

SEQ ID NO: 1792563 - RNA, 15 nt, Homo sapiens
agccagguucugacu

SEQ ID NO: 1792564 - RNA, 15 nt, Homo sapiens
gccagaggcaccuca

SEQ ID NO: 1792565 - RNA, 18 nt, Homo sapiens
caguaacuugguuauaca

SEQ ID NO: 1792566 - RNA, 12 nt, Homo sapiens
agguaauggcau

SEQ ID NO: 1792567 - RNA, 12 nt, Homo sapiens
cuucacauccau

SEQ ID NO: 1792568 - RNA, 15 nt, Homo sapiens
ggagauugaacuuuc

SEQ ID NO: 1792569 - RNA, 13 nt, Homo sapiens
gauucaccaaaca

SEQ ID NO: 1792570 - RNA, 10 nt, Homo sapiens
guauaaucuc

SEQ ID NO: 1792571 - RNA, 16 nt, Homo sapiens
aaguggaaaaugcaau

SEQ ID NO: 1792572 - RNA, 16 nt, Homo sapiens
aagaauaauugaacaa

SEQ ID NO: 1792573 - RNA, 24 nt, Homo sapiens
uccaauccucaggauuucauugac

SEQ ID NO: 1792574 - RNA, 19 nt, Homo sapiens
aagaauuucccagugaaau

SEQ ID NO: 1792575 - RNA, 14 nt, Homo sapiens
gccccaggcugaga

SEQ ID NO: 1792576 - RNA, 12 nt, Homo sapiens
guaucuuuccag

SEQ ID NO: 1792577 - RNA, 14 nt, Homo sapiens
cugaucuguaccua

SEQ ID NO: 1792578 - RNA, 15 nt, Homo sapiens
ugcauuucacucugg

SEQ ID NO: 1792579 - RNA, 20 nt, Homo sapiens
ucuggcuaaauggacaucau

SEQ ID NO: 1792580 - RNA, 15 nt, Homo sapiens
uuuuugaacuuggua

SEQ ID NO: 1792581 - RNA, 18 nt, Homo sapiens
uucugcagacuggcaguc

SEQ ID NO: 1792582 - RNA, 19 nt, Homo sapiens
auguggcaggcuggaguua

SEQ ID NO: 1792583 - RNA, 17 nt, Homo sapiens
ggaaauuaaugcugaga

SEQ ID NO: 1792584 - RNA, 14 nt, Homo sapiens
agcugcugugaaca

SEQ ID NO: 1792585 - RNA, 22 nt, Homo sapiens
auuaucugugucaaaagccaga

SEQ ID NO: 1792586 - RNA, 16 nt, Homo sapiens
cugccgguggggccag

SEQ ID NO: 1792587 - RNA, 13 nt, Homo sapiens
uaaaguuguugca

SEQ ID NO: 1792588 - RNA, 14 nt, Homo sapiens
uuuugggaggucaa

SEQ ID NO: 1792589 - RNA, 20 nt, Homo sapiens
cauccuaccccuuugcacuu

SEQ ID NO: 1792590 - RNA, 19 nt, Homo sapiens
uccuaaaccauucaccaag

SEQ ID NO: 1792591 - RNA, 15 nt, Homo sapiens
acacacuuuugcaca

SEQ ID NO: 1792592 - RNA, 14 nt, Homo sapiens
uucuucaccucacu

SEQ ID NO: 1792593 - RNA, 15 nt, Homo sapiens
auuuccacuguauau

SEQ ID NO: 1792594 - RNA, 21 nt, Homo sapiens
uaagacgguuaaauacugugu

SEQ ID NO: 1792595 - RNA, 16 nt, Homo sapiens
gcaggcugcagucccu

SEQ ID NO: 1792596 - RNA, 19 nt, Homo sapiens
uaugucugugccauuucuc

SEQ ID NO: 1792597 - RNA, 13 nt, Homo sapiens
ugccaguggcuua

SEQ ID NO: 1792598 - RNA, 16 nt, Homo sapiens
cucuucauccagggaa

SEQ ID NO: 1792599 - RNA, 18 nt, Homo sapiens
gcucacacuacuugagaa

SEQ ID NO: 1792600 - RNA, 16 nt, Homo sapiens
uggggacuccucuuaa

SEQ ID NO: 1792601 - RNA, 20 nt, Homo sapiens
acguuggugcaagugugcau

SEQ ID NO: 1792602 - RNA, 12 nt, Homo sapiens
uguuuucaccuc

SEQ ID NO: 1792603 - RNA, 20 nt, Homo sapiens
uuuuuugcauuuucacaaau

SEQ ID NO: 1792604 - RNA, 16 nt, Homo sapiens
ccauaacagugccagc

SEQ ID NO: 1792605 - RNA, 13 nt, Homo sapiens
aucuucucugggu

SEQ ID NO: 1792606 - RNA, 21 nt, Homo sapiens
aaaagcuacuuauuguagcau

SEQ ID NO: 1792607 - RNA, 19 nt, Homo sapiens
uacauagggauaugcguau

SEQ ID NO: 1792608 - RNA, 16 nt, Homo sapiens
gacagaauauguuuca

SEQ ID NO: 1792609 - RNA, 23 nt, Homo sapiens
gaguuauuaauauguuauuauua

SEQ ID NO: 1792610 - RNA, 11 nt, Homo sapiens
ccccaccucag

SEQ ID NO: 1792611 - RNA, 19 nt, Homo sapiens
cagccucaccccuguggug

SEQ ID NO: 1792612 - RNA, 21 nt, Homo sapiens
ccugggucuuuaugcaugaag

SEQ ID NO: 1792613 - RNA, 15 nt, Homo sapiens
ggcaagcugcaaaag

SEQ ID NO: 1792614 - RNA, 19 nt, Homo sapiens
aagagugagacuccgucuc

SEQ ID NO: 1792615 - RNA, 18 nt, Homo sapiens
uaaauucucuccuaauga

SEQ ID NO: 1792616 - RNA, 22 nt, Homo sapiens
aacucugaaagagaaaucaaug

SEQ ID NO: 1792617 - RNA, 23 nt, Homo sapiens
uuugcaccccuuuccuccccaua

SEQ ID NO: 1792618 - RNA, 21 nt, Homo sapiens
gaccgcuucccagaggccagg

SEQ ID NO: 1792619 - RNA, 13 nt, Homo sapiens
auucuuucaugag

SEQ ID NO: 1792620 - RNA, 16 nt, Homo sapiens
aauguguucuuuucuc

SEQ ID NO: 1792621 - RNA, 22 nt, Homo sapiens
aauuauguucuacagaauauuc

SEQ ID NO: 1792622 - RNA, 21 nt, Homo sapiens
aguuggagugagaugaaggaa

SEQ ID NO: 1792623 - RNA, 21 nt, Homo sapiens
uagcaccauuccucaagauca

SEQ ID NO: 1792624 - RNA, 13 nt, Homo sapiens
cuuccucugguaa

SEQ ID NO: 1792625 - RNA, 19 nt, Homo sapiens
augcgacuguaaauuggua

SEQ ID NO: 1792626 - RNA, 17 nt, Homo sapiens
cugaggcccagugcaua

SEQ ID NO: 1792627 - RNA, 13 nt, Homo sapiens
gaaaaagacugau

SEQ ID NO: 1792628 - RNA, 13 nt, Homo sapiens
caaccagaccacu

SEQ ID NO: 1792629 - RNA, 18 nt, Homo sapiens
agaauacugccaaaacau

SEQ ID NO: 1792630 - RNA, 14 nt, Homo sapiens
augagcuccagacc

SEQ ID NO: 1792631 - RNA, 21 nt, Homo sapiens
cccuaaaauacuuauuaugua

SEQ ID NO: 1792632 - RNA, 17 nt, Homo sapiens
acauguauugcacauug

SEQ ID NO: 1792633 - RNA, 18 nt, Homo sapiens
auuuuuuccagucuuccu

SEQ ID NO: 1792634 - RNA, 19 nt, Homo sapiens
gaaggcagagguugcagug

SEQ ID NO: 1792635 - RNA, 15 nt, Homo sapiens
aaggaugucuuucag

SEQ ID NO: 1792636 - RNA, 13 nt, Homo sapiens
cugcacuuuggaa

SEQ ID NO: 1792637 - RNA, 20 nt, Homo sapiens
cauaaaugugguacaagcau

SEQ ID NO: 1792638 - RNA, 17 nt, Homo sapiens
ccaccauccagguggag

SEQ ID NO: 1792639 - RNA, 19 nt, Homo sapiens
uucuggucuucgcagccua

SEQ ID NO: 1792640 - RNA, 19 nt, Homo sapiens
aaagggagaacauggccaa

SEQ ID NO: 1792641 - RNA, 23 nt, Homo sapiens
aguacaggcauagccacuugcuc

SEQ ID NO: 1792642 - RNA, 15 nt, Homo sapiens
auccagcuccucuag

SEQ ID NO: 1792643 - RNA, 19 nt, Homo sapiens
auuucuucuucacauccau

SEQ ID NO: 1792644 - RNA, 23 nt, Homo sapiens
uauuaucagagacuauguagcaa

SEQ ID NO: 1792645 - RNA, 15 nt, Homo sapiens
ugaagaccacaucca

SEQ ID NO: 1792646 - RNA, 19 nt, Homo sapiens
gaugacaauggaccucuca

SEQ ID NO: 1792647 - RNA, 13 nt, Homo sapiens
cugggcucugggu

SEQ ID NO: 1792648 - RNA, 22 nt, Homo sapiens
caugauaaaauuuuacauuuga

SEQ ID NO: 1792649 - RNA, 19 nt, Homo sapiens
cauaacuaguggcucucag

SEQ ID NO: 1792650 - RNA, 15 nt, Homo sapiens
gaaacugaguugaau

SEQ ID NO: 1792651 - RNA, 17 nt, Homo sapiens
guccaguuugugcucua

SEQ ID NO: 1792652 - RNA, 17 nt, Homo sapiens
acguuuuggucacauau

SEQ ID NO: 1792653 - RNA, 18 nt, Homo sapiens
uuaaccccauguccucag

SEQ ID NO: 1792654 - RNA, 16 nt, Homo sapiens
cacuuuagauguaucu

SEQ ID NO: 1792655 - RNA, 18 nt, Homo sapiens
aauuuucuaaaagcuuuc

SEQ ID NO: 1792656 - RNA, 19 nt, Homo sapiens
gggauccuucgugcuucaa

SEQ ID NO: 1792657 - RNA, 20 nt, Homo sapiens
augguggcgcaugccuguag

SEQ ID NO: 1792658 - RNA, 19 nt, Homo sapiens
uugcacaguuaccugcaca

SEQ ID NO: 1792659 - RNA, 14 nt, Homo sapiens
gagugacucuccag

SEQ ID NO: 1792660 - RNA, 20 nt, Homo sapiens
cccuuaaggguugaaggcag

SEQ ID NO: 1792661 - RNA, 17 nt, Homo sapiens
agcaacccuaacaguaa

SEQ ID NO: 1792662 - RNA, 19 nt, Homo sapiens
ccucugcuggagaaagcca

SEQ ID NO: 1792663 - RNA, 20 nt, Homo sapiens
augcaaagaacucaccacaa

SEQ ID NO: 1792664 - RNA, 15 nt, Homo sapiens
auucaugauugccca

SEQ ID NO: 1792665 - RNA, 18 nt, Homo sapiens
gcccaggacuguggagug

SEQ ID NO: 1792666 - RNA, 14 nt, Homo sapiens
caucuccuccuugc

SEQ ID NO: 1792667 - RNA, 13 nt, Homo sapiens
uaaaaagugcagu

SEQ ID NO: 1792668 - RNA, 15 nt, Homo sapiens
accuguaggucagga

SEQ ID NO: 1792669 - RNA, 19 nt, Homo sapiens
gcugcgggggagccaguuc

SEQ ID NO: 1792670 - RNA, 21 nt, Homo sapiens
uuccaucugauugugauguga

SEQ ID NO: 1792671 - RNA, 17 nt, Homo sapiens
uuaguauugcagccaaa

SEQ ID NO: 1792672 - RNA, 16 nt, Homo sapiens
cauggucuuaugcaca

SEQ ID NO: 1792673 - RNA, 19 nt, Homo sapiens
aggguccucaguccacugc

SEQ ID NO: 1792674 - RNA, 22 nt, Homo sapiens
aaacauuucaaugucagccuuu

SEQ ID NO: 1792675 - RNA, 21 nt, Homo sapiens
ccaaagaaaauuauaguuuaa

SEQ ID NO: 1792676 - RNA, 22 nt, Homo sapiens
gguugaagaaaggaaccuggga

SEQ ID NO: 1792677 - RNA, 15 nt, Homo sapiens
auuugacucuuucaa

SEQ ID NO: 1792678 - RNA, 19 nt, Homo sapiens
gaggguagagugggcugcu

SEQ ID NO: 1792679 - RNA, 11 nt, Homo sapiens
ggcgccaagug

SEQ ID NO: 1792680 - RNA, 21 nt, Homo sapiens
caguguggggaagcccauucc

SEQ ID NO: 1792681 - RNA, 20 nt, Homo sapiens
gaaacccauuaggcaugccu

SEQ ID NO: 1792682 - RNA, 19 nt, Homo sapiens
cagggcagauuuuaguuuu

SEQ ID NO: 1792683 - RNA, 15 nt, Homo sapiens
ccaccuggcugccaa

SEQ ID NO: 1792684 - RNA, 18 nt, Homo sapiens
ugcugagacugaagacca

SEQ ID NO: 1792685 - RNA, 18 nt, Homo sapiens
uuucaaguacacugaauu

SEQ ID NO: 1792686 - RNA, 18 nt, Homo sapiens
gaaccaacccuccaggac

SEQ ID NO: 1792687 - RNA, 13 nt, Homo sapiens
cacaaaugacuuu

SEQ ID NO: 1792688 - RNA, 12 nt, Homo sapiens
aggcugggccau

SEQ ID NO: 1792689 - RNA, 20 nt, Homo sapiens
augguggcucacgccuguaa

SEQ ID NO: 1792690 - RNA, 14 nt, Homo sapiens
cuuucccacucuca

SEQ ID NO: 1792691 - RNA, 14 nt, Homo sapiens
cucccacacuuccc

SEQ ID NO: 1792692 - RNA, 19 nt, Homo sapiens
acuuuuuaaaguguaagaa

SEQ ID NO: 1792693 - RNA, 9 nt, Homo sapiens
ugucucucu

SEQ ID NO: 1792694 - RNA, 22 nt, Homo sapiens
ugacagaucauaggaaguggcu

SEQ ID NO: 1792695 - RNA, 15 nt, Homo sapiens
uucuuuacaauuuca

SEQ ID NO: 1792696 - RNA, 21 nt, Homo sapiens
agaagguuggugaauuucaca

SEQ ID NO: 1792697 - RNA, 18 nt, Homo sapiens
agcccuuccuugccagug

SEQ ID NO: 1792698 - RNA, 14 nt, Homo sapiens
uugguaacugccug

SEQ ID NO: 1792699 - RNA, 16 nt, Homo sapiens
ugcuuacaauggaguc

SEQ ID NO: 1792700 - RNA, 15 nt, Homo sapiens
caacucgaugggcac

SEQ ID NO: 1792701 - RNA, 13 nt, Homo sapiens
ugcuccaucucau

SEQ ID NO: 1792702 - RNA, 23 nt, Homo sapiens
uucaucccggagcgcaccugcuu

SEQ ID NO: 1792703 - RNA, 22 nt, Homo sapiens
caagcaugggggaccccuuccc

SEQ ID NO: 1792704 - RNA, 16 nt, Homo sapiens
caaggggccagcugcc

SEQ ID NO: 1792705 - RNA, 15 nt, Homo sapiens
gaucaguugccaaag

SEQ ID NO: 1792706 - RNA, 16 nt, Homo sapiens
ucgguugcgugcaugu

SEQ ID NO: 1792707 - RNA, 13 nt, Homo sapiens
acuuugaagacca

SEQ ID NO: 1792708 - RNA, 15 nt, Homo sapiens
cccuacacacaccca

SEQ ID NO: 1792709 - RNA, 22 nt, Homo sapiens
uugugauuuuuuguucuuguug

SEQ ID NO: 1792710 - RNA, 12 nt, Homo sapiens
ucuuuaaugcaa

SEQ ID NO: 1792711 - RNA, 19 nt, Homo sapiens
cagugcccuuuucaucucc

SEQ ID NO: 1792712 - RNA, 16 nt, Homo sapiens
cguuugaacucaggga

SEQ ID NO: 1792713 - RNA, 18 nt, Homo sapiens
acugcugagauacauaca

SEQ ID NO: 1792714 - RNA, 15 nt, Homo sapiens
cauccucaaacacug

SEQ ID NO: 1792715 - RNA, 22 nt, Homo sapiens
gcaaaacuucacggggucauac

SEQ ID NO: 1792716 - RNA, 21 nt, Homo sapiens
cuuuugcucauggugaauaua

SEQ ID NO: 1792717 - RNA, 20 nt, Homo sapiens
agauuggaccagacccugaa

SEQ ID NO: 1792718 - RNA, 18 nt, Homo sapiens
gccaggcucccacugccc

SEQ ID NO: 1792719 - RNA, 23 nt, Homo sapiens
cuucucagccugccuaacuguaa

SEQ ID NO: 1792720 - RNA, 23 nt, Homo sapiens
cuugcucagacgagacacccuaa

SEQ ID NO: 1792721 - RNA, 18 nt, Homo sapiens
uauuaaaaguuaagcaaa

SEQ ID NO: 1792722 - RNA, 13 nt, Homo sapiens
ggguucacugcaa

SEQ ID NO: 1792723 - RNA, 21 nt, Homo sapiens
cuuccggaagaaaaagagcca

SEQ ID NO: 1792724 - RNA, 19 nt, Homo sapiens
cuuuuuacacuuuauggua

SEQ ID NO: 1792725 - RNA, 15 nt, Homo sapiens
ccaaaucaucucuca

SEQ ID NO: 1792726 - RNA, 21 nt, Homo sapiens
aauuugaaaccaggacauuaa

SEQ ID NO: 1792727 - RNA, 19 nt, Homo sapiens
aguagucaaggugcucaau

SEQ ID NO: 1792728 - RNA, 14 nt, Homo sapiens
ucaccgaaguguga

SEQ ID NO: 1792729 - RNA, 12 nt, Homo sapiens
uucaauacucau

SEQ ID NO: 1792730 - RNA, 24 nt, Homo sapiens
aauacagcagugucaucagaagau

SEQ ID NO: 1792731 - RNA, 21 nt, Homo sapiens
ugagauacaagucauccaugc

SEQ ID NO: 1792732 - RNA, 18 nt, Homo sapiens
ugaaaaacaaaaauaaca

SEQ ID NO: 1792733 - RNA, 11 nt, Homo sapiens
aauaaauggaa

SEQ ID NO: 1792734 - RNA, 21 nt, Homo sapiens
agguguguugcccguggaucu

SEQ ID NO: 1792735 - RNA, 16 nt, Homo sapiens
aaaacaugcugucuua

SEQ ID NO: 1792736 - RNA, 22 nt, Homo sapiens
aauauucauauuggaaaaauca

SEQ ID NO: 1792737 - RNA, 13 nt, Homo sapiens
ccuuaguguuucu

SEQ ID NO: 1792738 - RNA, 17 nt, Homo sapiens
cgugcacacaccugcac

SEQ ID NO: 1792739 - RNA, 23 nt, Homo sapiens
cuagcacccuggagagugcacau

SEQ ID NO: 1792740 - RNA, 22 nt, Homo sapiens
ucucauaggcuaugccaugugc

SEQ ID NO: 1792741 - RNA, 15 nt, Homo sapiens
uaaagugcacugcca

SEQ ID NO: 1792742 - RNA, 21 nt, Homo sapiens
ugaccaaguaugacaaccucu

SEQ ID NO: 1792743 - RNA, 15 nt, Homo sapiens
ucucacgauuccagu

SEQ ID NO: 1792744 - RNA, 16 nt, Homo sapiens
ucuucccccucuccca

SEQ ID NO: 1792745 - RNA, 23 nt, Homo sapiens
cauauugagaaccuaaugcacuc

SEQ ID NO: 1792746 - RNA, 20 nt, Homo sapiens
aacuuuaauugacaguuuca

SEQ ID NO: 1792747 - RNA, 18 nt, Homo sapiens
cuguagccccagugacag

SEQ ID NO: 1792748 - RNA, 23 nt, Homo sapiens
uuauuaauccacaaauaugcuaa

SEQ ID NO: 1792749 - RNA, 13 nt, Homo sapiens
cauguucacugug

SEQ ID NO: 1792750 - RNA, 16 nt, Homo sapiens
ugcagccaccacaucc

SEQ ID NO: 1792751 - RNA, 15 nt, Homo sapiens
cccugcaaagggaau

SEQ ID NO: 1792752 - RNA, 16 nt, Homo sapiens
gccaaggagcugcuau

SEQ ID NO: 1792753 - RNA, 19 nt, Homo sapiens
uuugauaccauggcacuga

SEQ ID NO: 1792754 - RNA, 11 nt, Homo sapiens
ugaagcacuua

SEQ ID NO: 1792755 - RNA, 24 nt, Homo sapiens
caugacugaggaccaaugacguca

SEQ ID NO: 1792756 - RNA, 18 nt, Homo sapiens
cagaguguuuaccuggug

SEQ ID NO: 1792757 - RNA, 15 nt, Homo sapiens
agugcaguugugauu

SEQ ID NO: 1792758 - RNA, 16 nt, Homo sapiens
auggccaauaacuuuu

SEQ ID NO: 1792759 - RNA, 15 nt, Homo sapiens
uguacuccugugcug

SEQ ID NO: 1792760 - RNA, 13 nt, Homo sapiens
agggacugugagu

SEQ ID NO: 1792761 - RNA, 12 nt, Homo sapiens
uucacaguguga

SEQ ID NO: 1792762 - RNA, 20 nt, Homo sapiens
ucucugggauuuaugcucau

SEQ ID NO: 1792763 - RNA, 22 nt, Homo sapiens
agucugauugguuuuaauugaa

SEQ ID NO: 1792764 - RNA, 21 nt, Homo sapiens
aaguacuguaauaauaccuca

SEQ ID NO: 1792765 - RNA, 15 nt, Homo sapiens
acagggcaguccuua

SEQ ID NO: 1792766 - RNA, 13 nt, Homo sapiens
acaugguaaacuu

SEQ ID NO: 1792767 - RNA, 18 nt, Homo sapiens
ucugaguggcuucacucc

SEQ ID NO: 1792768 - RNA, 23 nt, Homo sapiens
agaagagccggagccuccagcug

SEQ ID NO: 1792769 - RNA, 22 nt, Homo sapiens
ccugacagugugggacaggcuc

SEQ ID NO: 1792770 - RNA, 13 nt, Homo sapiens
cugaaacuauaga

SEQ ID NO: 1792771 - RNA, 18 nt, Homo sapiens
agcccagagugaacacuc

SEQ ID NO: 1792772 - RNA, 18 nt, Homo sapiens
ucucugaguugcccugau

SEQ ID NO: 1792773 - RNA, 18 nt, Homo sapiens
guucaggaaaacuacuga

SEQ ID NO: 1792774 - RNA, 14 nt, Homo sapiens
uggaagucccucag

SEQ ID NO: 1792775 - RNA, 17 nt, Homo sapiens
cuuaauaacaacagauc

SEQ ID NO: 1792776 - RNA, 18 nt, Homo sapiens
gaauaucuaaacaucuuu

SEQ ID NO: 1792777 - RNA, 19 nt, Homo sapiens
caucuuucaagggaccucu

SEQ ID NO: 1792778 - RNA, 23 nt, Homo sapiens
ucaauggcuuguucaucauccag

SEQ ID NO: 1792779 - RNA, 16 nt, Homo sapiens
uccucgcccagaucuc

SEQ ID NO: 1792780 - RNA, 22 nt, Homo sapiens
gagauggagcuacgaaaggaug

SEQ ID NO: 1792781 - RNA, 13 nt, Homo sapiens
aaaaaaaagggaa

SEQ ID NO: 1792782 - RNA, 17 nt, Homo sapiens
gcugugaccacagcagu

SEQ ID NO: 1792783 - RNA, 19 nt, Homo sapiens
uugaaauaagaaagugcga

SEQ ID NO: 1792784 - RNA, 21 nt, Homo sapiens
cuuuuaggacccuucccuuga

SEQ ID NO: 1792785 - RNA, 19 nt, Homo sapiens
cauuuuuaagaacaagcag

SEQ ID NO: 1792786 - RNA, 17 nt, Homo sapiens
gcaucgcuccucuccag

SEQ ID NO: 1792787 - RNA, 16 nt, Homo sapiens
ccuccaaucaaaauca

SEQ ID NO: 1792788 - RNA, 20 nt, Homo sapiens
cacacuaguuuaugcuaccu

SEQ ID NO: 1792789 - RNA, 15 nt, Homo sapiens
aacauauguuugcuu

SEQ ID NO: 1792790 - RNA, 19 nt, Homo sapiens
cacugaucccccagaugca

SEQ ID NO: 1792791 - RNA, 19 nt, Homo sapiens
gggagaagaagucagagag

SEQ ID NO: 1792792 - RNA, 15 nt, Homo sapiens
gacccuccuguccag

SEQ ID NO: 1792793 - RNA, 18 nt, Homo sapiens
uuaagaaauucacuuccc

SEQ ID NO: 1792794 - RNA, 20 nt, Homo sapiens
cuccagcuugggcaacagag

SEQ ID NO: 1792795 - RNA, 16 nt, Homo sapiens
uaaagucccuauagua

SEQ ID NO: 1792796 - RNA, 18 nt, Homo sapiens
accguguaccucaguucc

SEQ ID NO: 1792797 - RNA, 20 nt, Homo sapiens
ccagccugguuugcaaagac

SEQ ID NO: 1792798 - RNA, 16 nt, Homo sapiens
caaugaagucucugaa

SEQ ID NO: 1792799 - RNA, 13 nt, Homo sapiens
gggcaugaaugag

SEQ ID NO: 1792800 - RNA, 19 nt, Homo sapiens
uagcagagaacugccuuaa

SEQ ID NO: 1792801 - RNA, 14 nt, Homo sapiens
ggaccaccaaugga

SEQ ID NO: 1792802 - RNA, 17 nt, Homo sapiens
ccggucaugguggugga

SEQ ID NO: 1792803 - RNA, 18 nt, Homo sapiens
cauuacucccuaugugcg

SEQ ID NO: 1792804 - RNA, 20 nt, Homo sapiens
acacgugcgugcgagcacac

SEQ ID NO: 1792805 - RNA, 19 nt, Homo sapiens
aggaaaccucugacuugcu

SEQ ID NO: 1792806 - RNA, 16 nt, Homo sapiens
caguguauaaauccaa

SEQ ID NO: 1792807 - RNA, 18 nt, Homo sapiens
gucuggcuccagcccuug

SEQ ID NO: 1792808 - RNA, 23 nt, Homo sapiens
caagagugaacauguacacaaag

SEQ ID NO: 1792809 - RNA, 20 nt, Homo sapiens
acaaauccauggaccuauga

SEQ ID NO: 1792810 - RNA, 16 nt, Homo sapiens
cucugauuacaauucu

SEQ ID NO: 1792811 - RNA, 12 nt, Homo sapiens
cagaacuuguaa

SEQ ID NO: 1792812 - RNA, 16 nt, Homo sapiens
agauguuuaaaacacc

SEQ ID NO: 1792813 - RNA, 20 nt, Homo sapiens
caaugucuggagaccaccag

SEQ ID NO: 1792814 - RNA, 20 nt, Homo sapiens
gcuaauuaggaagcuugauu

SEQ ID NO: 1792815 - RNA, 14 nt, Homo sapiens
uaaaaaagagacau

SEQ ID NO: 1792816 - RNA, 22 nt, Homo sapiens
ugauuccauuuuacuuccauga

SEQ ID NO: 1792817 - RNA, 19 nt, Homo sapiens
uuaucucaaguaaaacaaa

SEQ ID NO: 1792818 - RNA, 15 nt, Homo sapiens
uagcucagucaucaa

SEQ ID NO: 1792819 - RNA, 22 nt, Homo sapiens
ggcagaaaacacagccugugua

SEQ ID NO: 1792820 - RNA, 13 nt, Homo sapiens
caucuuuccugcc

SEQ ID NO: 1792821 - RNA, 15 nt, Homo sapiens
cgaaguccuauggaa

SEQ ID NO: 1792822 - RNA, 17 nt, Homo sapiens
augcaacucaucuucac

SEQ ID NO: 1792823 - RNA, 13 nt, Homo sapiens
gaugugauuuauu

SEQ ID NO: 1792824 - RNA, 19 nt, Homo sapiens
cgcaugagaacauuaacaa

SEQ ID NO: 1792825 - RNA, 20 nt, Homo sapiens
ccuuacccaucuugcuucca

SEQ ID NO: 1792826 - RNA, 16 nt, Homo sapiens
ccaagccccuguaaau

SEQ ID NO: 1792827 - RNA, 16 nt, Homo sapiens
cagaaacuccuguuca

SEQ ID NO: 1792828 - RNA, 19 nt, Homo sapiens
agccacaggaauaauaguu

SEQ ID NO: 1792829 - RNA, 16 nt, Homo sapiens
gagcugcauaaugucc

SEQ ID NO: 1792830 - RNA, 15 nt, Homo sapiens
uuuuaugaucaaggu

SEQ ID NO: 1792831 - RNA, 16 nt, Homo sapiens
gaaguuuuucuuugug

SEQ ID NO: 1792832 - RNA, 23 nt, Homo sapiens
uuacaguuugugcucuacuguua

SEQ ID NO: 1792833 - RNA, 15 nt, Homo sapiens
ccaugugugcuaaua

SEQ ID NO: 1792834 - RNA, 18 nt, Homo sapiens
ugauagguauuaucucca

SEQ ID NO: 1792835 - RNA, 22 nt, Homo sapiens
uaauuuguaguauaauucuugg

SEQ ID NO: 1792836 - RNA, 23 nt, Homo sapiens
uaaagcuacaauauucucucuua

SEQ ID NO: 1792837 - RNA, 18 nt, Homo sapiens
augacauaugacuugauc

SEQ ID NO: 1792838 - RNA, 16 nt, Homo sapiens
acaaaccuuauaaguc

SEQ ID NO: 1792839 - RNA, 13 nt, Homo sapiens
aguucucacucug

SEQ ID NO: 1792840 - RNA, 14 nt, Homo sapiens
ccauaccaggguga

SEQ ID NO: 1792841 - RNA, 22 nt, Homo sapiens
aguucaguggcagggcucagga

SEQ ID NO: 1792842 - RNA, 14 nt, Homo sapiens
auacaguaucucag

SEQ ID NO: 1792843 - RNA, 15 nt, Homo sapiens
gccaggcacuuugag

SEQ ID NO: 1792844 - RNA, 16 nt, Homo sapiens
cuuuaggugccuccug

SEQ ID NO: 1792845 - RNA, 21 nt, Homo sapiens
uucaggauuaacuaaagaaga

SEQ ID NO: 1792846 - RNA, 20 nt, Homo sapiens
caaaugcaugcuucuucuca

SEQ ID NO: 1792847 - RNA, 21 nt, Homo sapiens
gccuggcagaacugagcuccu

SEQ ID NO: 1792848 - RNA, 22 nt, Homo sapiens
cuugguaaaguccuuuucuugc

SEQ ID NO: 1792849 - RNA, 15 nt, Homo sapiens
uggcuuuugugcauu

SEQ ID NO: 1792850 - RNA, 15 nt, Homo sapiens
aagacuuugauccag

SEQ ID NO: 1792851 - RNA, 16 nt, Homo sapiens
agaauaaacuuucuca

SEQ ID NO: 1792852 - RNA, 16 nt, Homo sapiens
aaggugaugugauuca

SEQ ID NO: 1792853 - RNA, 17 nt, Homo sapiens
guaaaacauuuguuucc

SEQ ID NO: 1792854 - RNA, 11 nt, Homo sapiens
uauucaugagu

SEQ ID NO: 1792855 - RNA, 19 nt, Homo sapiens
ugggcuaugugucacagcu

SEQ ID NO: 1792856 - RNA, 23 nt, Homo sapiens
gagacacuauuuaucugugcaaa

SEQ ID NO: 1792857 - RNA, 11 nt, Homo sapiens
ggccucaggug

SEQ ID NO: 1792858 - RNA, 13 nt, Homo sapiens
uugugaauuguga

SEQ ID NO: 1792859 - RNA, 16 nt, Homo sapiens
cuaauuagcuucagga

SEQ ID NO: 1792860 - RNA, 22 nt, Homo sapiens
ucccuagccagcacuuguauau

SEQ ID NO: 1792861 - RNA, 19 nt, Homo sapiens
uguagaaugggaugugaua

SEQ ID NO: 1792862 - RNA, 20 nt, Homo sapiens
guaccuuucuaaaccucucu

SEQ ID NO: 1792863 - RNA, 18 nt, Homo sapiens
aagugaaugccugucacg

SEQ ID NO: 1792864 - RNA, 22 nt, Homo sapiens
cauguguugccuggaagcacau

SEQ ID NO: 1792865 - RNA, 13 nt, Homo sapiens
gauuccucucugu

SEQ ID NO: 1792866 - RNA, 21 nt, Homo sapiens
uggcgcgggaggcaccagcuc

SEQ ID NO: 1792867 - RNA, 19 nt, Homo sapiens
aauagcauuugccacuuag

SEQ ID NO: 1792868 - RNA, 18 nt, Homo sapiens
caucagcguggcagucac

SEQ ID NO: 1792869 - RNA, 15 nt, Homo sapiens
guaccauuccuucaa

SEQ ID NO: 1792870 - RNA, 18 nt, Homo sapiens
acuuucuaagaagauacc

SEQ ID NO: 1792871 - RNA, 16 nt, Homo sapiens
cuuucuucuagugcuu

SEQ ID NO: 1792872 - RNA, 19 nt, Homo sapiens
uuugaucacacagccacuu

SEQ ID NO: 1792873 - RNA, 22 nt, Homo sapiens
uuccuagaggugugcuauacca

SEQ ID NO: 1792874 - RNA, 13 nt, Homo sapiens
cugccucagcaau

SEQ ID NO: 1792875 - RNA, 18 nt, Homo sapiens
uguauauaaacauaucaa

SEQ ID NO: 1792876 - RNA, 11 nt, Homo sapiens
cccgagcagaa

SEQ ID NO: 1792877 - RNA, 12 nt, Homo sapiens
auuauacuugag

SEQ ID NO: 1792878 - RNA, 17 nt, Homo sapiens
acccagggccugcagga

SEQ ID NO: 1792879 - RNA, 15 nt, Homo sapiens
ggugggauggaugcu

SEQ ID NO: 1792880 - RNA, 16 nt, Homo sapiens
cuuacuagaccuguaa

SEQ ID NO: 1792881 - RNA, 21 nt, Homo sapiens
ccccuguauucucagcacuuu

SEQ ID NO: 1792882 - RNA, 18 nt, Homo sapiens
gauuaauuaaaacacaac

SEQ ID NO: 1792883 - RNA, 21 nt, Homo sapiens
uggcggcuuccuguccacucu

SEQ ID NO: 1792884 - RNA, 23 nt, Homo sapiens
cucuucccaccugucaaccugaa

SEQ ID NO: 1792885 - RNA, 22 nt, Homo sapiens
agaaaaugaucuuaauuuacuu

SEQ ID NO: 1792886 - RNA, 21 nt, Homo sapiens
aaaaguagcaaauguuuacug

SEQ ID NO: 1792887 - RNA, 13 nt, Homo sapiens
gccggcucugccu

SEQ ID NO: 1792888 - RNA, 19 nt, Homo sapiens
ucugaggcagaugagcuua

SEQ ID NO: 1792889 - RNA, 13 nt, Homo sapiens
caugaaugcacac

SEQ ID NO: 1792890 - RNA, 16 nt, Homo sapiens
cacuauggucaaaaag

SEQ ID NO: 1792891 - RNA, 22 nt, Homo sapiens
uccuuccccauuuccacuguau

SEQ ID NO: 1792892 - RNA, 17 nt, Homo sapiens
aucugugccccaugccu

SEQ ID NO: 1792893 - RNA, 21 nt, Homo sapiens
ucuaaauguaguucugcucca

SEQ ID NO: 1792894 - RNA, 21 nt, Homo sapiens
cugauaacucuguacgaggcu

SEQ ID NO: 1792895 - RNA, 22 nt, Homo sapiens
gcagaagagaaaggacucagug

SEQ ID NO: 1792896 - RNA, 16 nt, Homo sapiens
gaggcuccaggauuag

SEQ ID NO: 1792897 - RNA, 15 nt, Homo sapiens
auacauuagacacac

SEQ ID NO: 1792898 - RNA, 15 nt, Homo sapiens
ucaaugaucaucuca

SEQ ID NO: 1792899 - RNA, 15 nt, Homo sapiens
gcugggucaccagaa

SEQ ID NO: 1792900 - RNA, 21 nt, Homo sapiens
ucccaucccugaaacauugca

SEQ ID NO: 1792901 - RNA, 16 nt, Homo sapiens
accuggcaaggacaca

SEQ ID NO: 1792902 - RNA, 18 nt, Homo sapiens
uaaugucccauuucacga

SEQ ID NO: 1792903 - RNA, 18 nt, Homo sapiens
auaacuuccacagggucc

SEQ ID NO: 1792904 - RNA, 12 nt, Homo sapiens
uuguuaauuucu

SEQ ID NO: 1792905 - RNA, 12 nt, Homo sapiens
cagauaaucaca

SEQ ID NO: 1792906 - RNA, 16 nt, Homo sapiens
augugcugagcauuuu

SEQ ID NO: 1792907 - RNA, 15 nt, Homo sapiens
ugauaacagaaaaau

SEQ ID NO: 1792908 - RNA, 22 nt, Homo sapiens
gaggcuucuccuguuuuauaua

SEQ ID NO: 1792909 - RNA, 18 nt, Homo sapiens
agcaauuccucugaacaa

SEQ ID NO: 1792910 - RNA, 14 nt, Homo sapiens
uuuggaauuugaca

SEQ ID NO: 1792911 - RNA, 15 nt, Homo sapiens
uuuccccgauuuucc

SEQ ID NO: 1792912 - RNA, 14 nt, Homo sapiens
ggaaggacaaaggc

SEQ ID NO: 1792913 - RNA, 18 nt, Homo sapiens
cacagcuggagcucugag

SEQ ID NO: 1792914 - RNA, 23 nt, Homo sapiens
ugaagaccucuugggcaggggcu

SEQ ID NO: 1792915 - RNA, 22 nt, Homo sapiens
cuuaggcaugacuguagaauuu

SEQ ID NO: 1792916 - RNA, 22 nt, Homo sapiens
uaaacucuggaugauucuucca

SEQ ID NO: 1792917 - RNA, 14 nt, Homo sapiens
aagacucugucuca

SEQ ID NO: 1792918 - RNA, 17 nt, Homo sapiens
auaugccaaacacauua

SEQ ID NO: 1792919 - RNA, 21 nt, Homo sapiens
ccucugugcuucgacuacugc

SEQ ID NO: 1792920 - RNA, 23 nt, Homo sapiens
aggagggccagcgcuguggaccu

SEQ ID NO: 1792921 - RNA, 13 nt, Homo sapiens
acaagacaacuuc

SEQ ID NO: 1792922 - RNA, 19 nt, Homo sapiens
guauaaugguugacugggu

SEQ ID NO: 1792923 - RNA, 19 nt, Homo sapiens
ugguuuuucacauugcaaa

SEQ ID NO: 1792924 - RNA, 16 nt, Homo sapiens
caucccacugcucccc

SEQ ID NO: 1792925 - RNA, 15 nt, Homo sapiens
uacuucuguguucau

SEQ ID NO: 1792926 - RNA, 17 nt, Homo sapiens
uguauauaaaugaacaa

SEQ ID NO: 1792927 - RNA, 17 nt, Homo sapiens
gcaaaaucuaccagguc

SEQ ID NO: 1792928 - RNA, 19 nt, Homo sapiens
aggcuguuggcguguccca

SEQ ID NO: 1792929 - RNA, 18 nt, Homo sapiens
aacugugaaauaccacaa

SEQ ID NO: 1792930 - RNA, 14 nt, Homo sapiens
ugacauuccuucuc

SEQ ID NO: 1792931 - RNA, 17 nt, Homo sapiens
uuacaagagcuguucau

SEQ ID NO: 1792932 - RNA, 22 nt, Homo sapiens
acucaggggcuuggcccuaaga

SEQ ID NO: 1792933 - RNA, 13 nt, Homo sapiens
ugaaugacguguc

SEQ ID NO: 1792934 - RNA, 17 nt, Homo sapiens
gacaauaauuacauugg

SEQ ID NO: 1792935 - RNA, 22 nt, Homo sapiens
gcacaacucagucugugggagc

SEQ ID NO: 1792936 - RNA, 19 nt, Homo sapiens
aagcucccuugaagcaaga

SEQ ID NO: 1792937 - RNA, 21 nt, Homo sapiens
cuugguggcgcgcaccuguag

SEQ ID NO: 1792938 - RNA, 22 nt, Homo sapiens
ggaauuagaaaugaauuuggag

SEQ ID NO: 1792939 - RNA, 22 nt, Homo sapiens
ggccuuuugcccguugagguag

SEQ ID NO: 1792940 - RNA, 24 nt, Homo sapiens
ccucgcuccaacuccaacauccac

SEQ ID NO: 1792941 - RNA, 14 nt, Homo sapiens
auaaaaacccugua

SEQ ID NO: 1792942 - RNA, 15 nt, Homo sapiens
aggagacacagggaa

SEQ ID NO: 1792943 - RNA, 23 nt, Homo sapiens
uuuaccacuuuaaacacccccau

SEQ ID NO: 1792944 - RNA, 16 nt, Homo sapiens
cauauauuagcauuua

SEQ ID NO: 1792945 - RNA, 18 nt, Homo sapiens
uacagaccaccuuucaca

SEQ ID NO: 1792946 - RNA, 20 nt, Homo sapiens
uuuagaaucaagucugugaa

SEQ ID NO: 1792947 - RNA, 20 nt, Homo sapiens
ugggcucugaggaguggagu

SEQ ID NO: 1792948 - RNA, 13 nt, Homo sapiens
uuucaaauuuacu

SEQ ID NO: 1792949 - RNA, 19 nt, Homo sapiens
accagagaccguccucacc

SEQ ID NO: 1792950 - RNA, 21 nt, Homo sapiens
gucugaaauggggcuacuguu

SEQ ID NO: 1792951 - RNA, 15 nt, Homo sapiens
ggaaaacaggacuua

SEQ ID NO: 1792952 - RNA, 17 nt, Homo sapiens
aaauucugaauuugcaa

SEQ ID NO: 1792953 - RNA, 23 nt, Homo sapiens
ggcccucuaccccugaucugaca

SEQ ID NO: 1792954 - RNA, 17 nt, Homo sapiens
aaagaugccacauucaa

SEQ ID NO: 1792955 - RNA, 12 nt, Homo sapiens
uacgaaaagcca

SEQ ID NO: 1792956 - RNA, 13 nt, Homo sapiens
ucucugaccagaa

SEQ ID NO: 1792957 - RNA, 14 nt, Homo sapiens
cauccuaugcaaua

SEQ ID NO: 1792958 - RNA, 18 nt, Homo sapiens
ugguuuagucauugcaga

SEQ ID NO: 1792959 - RNA, 22 nt, Homo sapiens
aggggagaaagcuuauggcugg

SEQ ID NO: 1792960 - RNA, 15 nt, Homo sapiens
aggguucaucugucc

SEQ ID NO: 1792961 - RNA, 19 nt, Homo sapiens
aaauaggagccgauggauc

SEQ ID NO: 1792962 - RNA, 17 nt, Homo sapiens
guaauuuaauaaacuga

SEQ ID NO: 1792963 - RNA, 12 nt, Homo sapiens
cuguaauagugu

SEQ ID NO: 1792964 - RNA, 18 nt, Homo sapiens
uaaaagaaaacacuguca

SEQ ID NO: 1792965 - RNA, 20 nt, Homo sapiens
agacuggcauagcuggacau

SEQ ID NO: 1792966 - RNA, 14 nt, Homo sapiens
guggcacuuaccca

SEQ ID NO: 1792967 - RNA, 22 nt, Homo sapiens
acucucuauaaguguucagugu

SEQ ID NO: 1792968 - RNA, 21 nt, Homo sapiens
cucacgauuccagugcaguag

SEQ ID NO: 1792969 - RNA, 19 nt, Homo sapiens
aauaacacuguacugcaau

SEQ ID NO: 1792970 - RNA, 19 nt, Homo sapiens
acaaugacuuguacucuga

SEQ ID NO: 1792971 - RNA, 23 nt, Homo sapiens
guauguuucuucuuucuuuuaag

SEQ ID NO: 1792972 - RNA, 21 nt, Homo sapiens
ucagaggacuggacgugcuca

SEQ ID NO: 1792973 - RNA, 17 nt, Homo sapiens
agacccaacuugccaaa

SEQ ID NO: 1792974 - RNA, 16 nt, Homo sapiens
uguauuucaagaccuc

SEQ ID NO: 1792975 - RNA, 18 nt, Homo sapiens
ucaaugugcucuguaaca

SEQ ID NO: 1792976 - RNA, 20 nt, Homo sapiens
uggaaggugacuuuucaccu

SEQ ID NO: 1792977 - RNA, 19 nt, Homo sapiens
uaagguuaucuacuuuuac

SEQ ID NO: 1792978 - RNA, 23 nt, Homo sapiens
caaugugucuuucuuuuuggaca

SEQ ID NO: 1792979 - RNA, 18 nt, Homo sapiens
aucuuggauggugacauu

SEQ ID NO: 1792980 - RNA, 22 nt, Homo sapiens
accucacucuugccaaccugua

SEQ ID NO: 1792981 - RNA, 19 nt, Homo sapiens
gggcaaugaugugugcaag

SEQ ID NO: 1792982 - RNA, 13 nt, Homo sapiens
augugaagccaga

SEQ ID NO: 1792983 - RNA, 22 nt, Homo sapiens
uacaaaacaaacucauucauua

SEQ ID NO: 1792984 - RNA, 17 nt, Homo sapiens
caucaugaguggacuuu

SEQ ID NO: 1792985 - RNA, 20 nt, Homo sapiens
ggcugugcucucaccagcug

SEQ ID NO: 1792986 - RNA, 17 nt, Homo sapiens
gauaacccuuauuccau

SEQ ID NO: 1792987 - RNA, 16 nt, Homo sapiens
aacguauuaguugcca

SEQ ID NO: 1792988 - RNA, 22 nt, Homo sapiens
uuaagagaauauuuuaaguauu

SEQ ID NO: 1792989 - RNA, 19 nt, Homo sapiens
aaccaaaucuuaaaugaga

SEQ ID NO: 1792990 - RNA, 16 nt, Homo sapiens
accuccaaagaacaac

SEQ ID NO: 1792991 - RNA, 15 nt, Homo sapiens
gcagaagugcaugaa

SEQ ID NO: 1792992 - RNA, 21 nt, Homo sapiens
uccugcaggaaauauaaacuu

SEQ ID NO: 1792993 - RNA, 12 nt, Homo sapiens
agaaacacacag

SEQ ID NO: 1792994 - RNA, 21 nt, Homo sapiens
uuagcauuuucugcaucucca

SEQ ID NO: 1792995 - RNA, 13 nt, Homo sapiens
ucaauacuuacau

SEQ ID NO: 1792996 - RNA, 15 nt, Homo sapiens
cugaggccacccacu

SEQ ID NO: 1792997 - RNA, 17 nt, Homo sapiens
uuucuaagaaaagcauu

SEQ ID NO: 1792998 - RNA, 19 nt, Homo sapiens
gaggcuugguuccuuccca

SEQ ID NO: 1792999 - RNA, 22 nt, Homo sapiens
cuggagugaaguggugugaucc

SEQ ID NO: 1793000 - RNA, 16 nt, Homo sapiens
ucuauugauaguuuca

SEQ ID NO: 1793001 - RNA, 19 nt, Homo sapiens
uccucguauguguguuuac

SEQ ID NO: 1793002 - RNA, 19 nt, Homo sapiens
agagguggagguugcagug

SEQ ID NO: 1793003 - RNA, 15 nt, Homo sapiens
aggccauuaugccug

SEQ ID NO: 1793004 - RNA, 20 nt, Homo sapiens
aguugugacagucacugcau

SEQ ID NO: 1793005 - RNA, 14 nt, Homo sapiens
auucuacacauauc

SEQ ID NO: 1793006 - RNA, 21 nt, Homo sapiens
uaugaagugacucucacaaga

SEQ ID NO: 1793007 - RNA, 14 nt, Homo sapiens
cucccuuccucacc

SEQ ID NO: 1793008 - RNA, 17 nt, Homo sapiens
aucuccaggcuuucaau

SEQ ID NO: 1793009 - RNA, 23 nt, Homo sapiens
cuugaaauaccagugaaccaaag

SEQ ID NO: 1793010 - RNA, 14 nt, Homo sapiens
cucggagugccaca

SEQ ID NO: 1793011 - RNA, 19 nt, Homo sapiens
agcuagaggaaccaacccc

SEQ ID NO: 1793012 - RNA, 12 nt, Homo sapiens
uuuuaacugcau

SEQ ID NO: 1793013 - RNA, 21 nt, Homo sapiens
agguuuccugguccaucucau

SEQ ID NO: 1793014 - RNA, 23 nt, Homo sapiens
acuguguuuuaaaaggcaaguca

SEQ ID NO: 1793015 - RNA, 22 nt, Homo sapiens
auguacacaguuuaaacacauc

SEQ ID NO: 1793016 - RNA, 18 nt, Homo sapiens
ccauuucuggacaugacg

SEQ ID NO: 1793017 - RNA, 23 nt, Homo sapiens
uguuuaauaagcauaccauugaa

SEQ ID NO: 1793018 - RNA, 14 nt, Homo sapiens
uuucugccaaaaua

SEQ ID NO: 1793019 - RNA, 16 nt, Homo sapiens
gcuaggugacauauac

SEQ ID NO: 1793020 - RNA, 23 nt, Homo sapiens
caggucccaguugcugucacaaa

SEQ ID NO: 1793021 - RNA, 13 nt, Homo sapiens
agcaacucagaga

SEQ ID NO: 1793022 - RNA, 17 nt, Homo sapiens
aauggucgcccaggaga

SEQ ID NO: 1793023 - RNA, 18 nt, Homo sapiens
auaaaguuuuaugagaaa

SEQ ID NO: 1793024 - RNA, 13 nt, Homo sapiens
aagaccauggauu

SEQ ID NO: 1793025 - RNA, 21 nt, Homo sapiens
cacaccagucacaugaccuga

SEQ ID NO: 1793026 - RNA, 15 nt, Homo sapiens
gguaacuaacugcuu

SEQ ID NO: 1793027 - RNA, 18 nt, Homo sapiens
uguuuagcccaaaaccaa

SEQ ID NO: 1793028 - RNA, 23 nt, Homo sapiens
cagccuccgaaguagcugggauu

SEQ ID NO: 1793029 - RNA, 14 nt, Homo sapiens
ucaacaccuagguc

SEQ ID NO: 1793030 - RNA, 22 nt, Homo sapiens
cuugccuguaaucccagcacuu

SEQ ID NO: 1793031 - RNA, 14 nt, Homo sapiens
auaaugguuuacug

SEQ ID NO: 1793032 - RNA, 14 nt, Homo sapiens
gaaggccuggccca

SEQ ID NO: 1793033 - RNA, 14 nt, Homo sapiens
ugacagauuuccau

SEQ ID NO: 1793034 - RNA, 15 nt, Homo sapiens
uucuaaaguucuaag

SEQ ID NO: 1793035 - RNA, 19 nt, Homo sapiens
gaauggcaggugucauaug

SEQ ID NO: 1793036 - RNA, 23 nt, Homo sapiens
aaggggcuucuaaugacccagau

SEQ ID NO: 1793037 - RNA, 18 nt, Homo sapiens
uaacaucaugcauucaca

SEQ ID NO: 1793038 - RNA, 21 nt, Homo sapiens
cugauuuuuaaaguacuuucu

SEQ ID NO: 1793039 - RNA, 21 nt, Homo sapiens
uaaaugccacuucaccaagga

SEQ ID NO: 1793040 - RNA, 21 nt, Homo sapiens
caaaccuugugcucuuuucaa

SEQ ID NO: 1793041 - RNA, 19 nt, Homo sapiens
aaaugccugguaccagagg

SEQ ID NO: 1793042 - RNA, 19 nt, Homo sapiens
agacuauuaggugcaauuu

SEQ ID NO: 1793043 - RNA, 19 nt, Homo sapiens
agugauacauguacuccag

SEQ ID NO: 1793044 - RNA, 19 nt, Homo sapiens
ugugguaacuucuuugaag

SEQ ID NO: 1793045 - RNA, 23 nt, Homo sapiens
aauuuggauuuacgacugaagaa

SEQ ID NO: 1793046 - RNA, 22 nt, Homo sapiens
uagaagcagaaugaaaccacau

SEQ ID NO: 1793047 - RNA, 21 nt, Homo sapiens
cugguguucuguuucaaugua

SEQ ID NO: 1793048 - RNA, 20 nt, Homo sapiens
aagauaguuacaaaauacaa

SEQ ID NO: 1793049 - RNA, 20 nt, Homo sapiens
agauuguauauuuauucaca

SEQ ID NO: 1793050 - RNA, 18 nt, Homo sapiens
uaacaguugugaugacua

SEQ ID NO: 1793051 - RNA, 15 nt, Homo sapiens
ugcaagccaucucua

SEQ ID NO: 1793052 - RNA, 19 nt, Homo sapiens
acuuauuuaugaacagacu

SEQ ID NO: 1793053 - RNA, 18 nt, Homo sapiens
auucuaauugucagugau

SEQ ID NO: 1793054 - RNA, 22 nt, Homo sapiens
agcuacuugggaggcugagcca

SEQ ID NO: 1793055 - RNA, 14 nt, Homo sapiens
aaacuacaucucca

SEQ ID NO: 1793056 - RNA, 18 nt, Homo sapiens
aaccauccgcaaccugag

SEQ ID NO: 1793057 - RNA, 12 nt, Homo sapiens
cagauagcaucu

SEQ ID NO: 1793058 - RNA, 17 nt, Homo sapiens
aaacuaugguucccaau

SEQ ID NO: 1793059 - RNA, 17 nt, Homo sapiens
agaccugugugccaggg

SEQ ID NO: 1793060 - RNA, 19 nt, Homo sapiens
uuaugaaugugaagccuuc

SEQ ID NO: 1793061 - RNA, 22 nt, Homo sapiens
ucaguuaauggcucaucaacaa

SEQ ID NO: 1793062 - RNA, 11 nt, Homo sapiens
ugugccagcuc

SEQ ID NO: 1793063 - RNA, 15 nt, Homo sapiens
cagaaacaacugcca

SEQ ID NO: 1793064 - RNA, 21 nt, Homo sapiens
aguuguacaugauaagacauu

SEQ ID NO: 1793065 - RNA, 19 nt, Homo sapiens
aguguccccuccacuguca

SEQ ID NO: 1793066 - RNA, 12 nt, Homo sapiens
aaguugacuuau

SEQ ID NO: 1793067 - RNA, 14 nt, Homo sapiens
cucaggguggggcu

SEQ ID NO: 1793068 - RNA, 14 nt, Homo sapiens
ucccgaauccacag

SEQ ID NO: 1793069 - RNA, 14 nt, Homo sapiens
accagauugcucug

SEQ ID NO: 1793070 - RNA, 20 nt, Homo sapiens
ggauggggugggcuuagggg

SEQ ID NO: 1793071 - RNA, 15 nt, Homo sapiens
cugccgaauauagaa

SEQ ID NO: 1793072 - RNA, 17 nt, Homo sapiens
gggcagcauagcaagac

SEQ ID NO: 1793073 - RNA, 20 nt, Homo sapiens
agcaaaauccuuacuuccag

SEQ ID NO: 1793074 - RNA, 16 nt, Homo sapiens
uuggaccauccuauuu

SEQ ID NO: 1793075 - RNA, 13 nt, Homo sapiens
cagucucccuucc

SEQ ID NO: 1793076 - RNA, 15 nt, Homo sapiens
cuguacacagaauug

SEQ ID NO: 1793077 - RNA, 19 nt, Homo sapiens
uccacauccccaccuucca

SEQ ID NO: 1793078 - RNA, 19 nt, Homo sapiens
acugcuugugcacuggaug

SEQ ID NO: 1793079 - RNA, 20 nt, Homo sapiens
guguaaucucucauggugaa

SEQ ID NO: 1793080 - RNA, 16 nt, Homo sapiens
gcaaaauucccaggga

SEQ ID NO: 1793081 - RNA, 14 nt, Homo sapiens
uggcuuuaugcaaa

SEQ ID NO: 1793082 - RNA, 22 nt, Homo sapiens
augugucaaacauaggacugga

SEQ ID NO: 1793083 - RNA, 12 nt, Homo sapiens
auugcaccagau

SEQ ID NO: 1793084 - RNA, 17 nt, Homo sapiens
ccuguuugaaaguaaaa

SEQ ID NO: 1793085 - RNA, 14 nt, Homo sapiens
aauaaaaccaaaga

SEQ ID NO: 1793086 - RNA, 20 nt, Homo sapiens
agaagguuucuggagcagug

SEQ ID NO: 1793087 - RNA, 20 nt, Homo sapiens
cuacucuauguaugcaucua

SEQ ID NO: 1793088 - RNA, 14 nt, Homo sapiens
gaaggacacaguga

SEQ ID NO: 1793089 - RNA, 11 nt, Homo sapiens
gucaccuugcu

SEQ ID NO: 1793090 - RNA, 11 nt, Homo sapiens
cucaccuuccu

SEQ ID NO: 1793091 - RNA, 15 nt, Homo sapiens
agcagugcuucucaa

SEQ ID NO: 1793092 - RNA, 23 nt, Homo sapiens
auuaacugacgaagaagcaacua

SEQ ID NO: 1793093 - RNA, 18 nt, Homo sapiens
auacaccacaaaaaccaa

SEQ ID NO: 1793094 - RNA, 14 nt, Homo sapiens
auuuguauuugcca

SEQ ID NO: 1793095 - RNA, 14 nt, Homo sapiens
aggccuauuguuga

SEQ ID NO: 1793096 - RNA, 14 nt, Homo sapiens
uuuugaauaugccu

SEQ ID NO: 1793097 - RNA, 15 nt, Homo sapiens
agucccacuacuugu

SEQ ID NO: 1793098 - RNA, 19 nt, Homo sapiens
ccacugcacuccagccuag

SEQ ID NO: 1793099 - RNA, 22 nt, Homo sapiens
cagugcugugucauuccaaaua

SEQ ID NO: 1793100 - RNA, 20 nt, Homo sapiens
uaagcaccugccucagcaau

SEQ ID NO: 1793101 - RNA, 18 nt, Homo sapiens
uuuccuugacuucuuuga

SEQ ID NO: 1793102 - RNA, 21 nt, Homo sapiens
caagcgauucuccugucucag

SEQ ID NO: 1793103 - RNA, 13 nt, Homo sapiens
gagaagcaccagc

SEQ ID NO: 1793104 - RNA, 17 nt, Homo sapiens
gguccucucugagucaa

SEQ ID NO: 1793105 - RNA, 19 nt, Homo sapiens
gagaugggggcuucuuccu

SEQ ID NO: 1793106 - RNA, 20 nt, Homo sapiens
aaugaaaacauucagaggaa

SEQ ID NO: 1793107 - RNA, 16 nt, Homo sapiens
gaaaagggucuuggga

SEQ ID NO: 1793108 - RNA, 15 nt, Homo sapiens
ucuacauacuaugga

SEQ ID NO: 1793109 - RNA, 23 nt, Homo sapiens
cccacuugucacugacacaaagg

SEQ ID NO: 1793110 - RNA, 14 nt, Homo sapiens
ccauccucuguuac

SEQ ID NO: 1793111 - RNA, 14 nt, Homo sapiens
uuuugcacauucua

SEQ ID NO: 1793112 - RNA, 16 nt, Homo sapiens
ggacagaaaugccacu

SEQ ID NO: 1793113 - RNA, 16 nt, Homo sapiens
cuucccccugcaaaaa

SEQ ID NO: 1793114 - RNA, 16 nt, Homo sapiens
aauuuucaauuugaga

SEQ ID NO: 1793115 - RNA, 13 nt, Homo sapiens
uuuugagaacaaa

SEQ ID NO: 1793116 - RNA, 16 nt, Homo sapiens
gucuaacauauucaau

SEQ ID NO: 1793117 - RNA, 19 nt, Homo sapiens
cuccuggcucaagcccuga

SEQ ID NO: 1793118 - RNA, 18 nt, Homo sapiens
ucagacaauuuauccaaa

SEQ ID NO: 1793119 - RNA, 11 nt, Homo sapiens
aauaugauuau

SEQ ID NO: 1793120 - RNA, 20 nt, Homo sapiens
gaaaagcuagguguuuaaua

SEQ ID NO: 1793121 - RNA, 20 nt, Homo sapiens
gacaguucccagagugggcu

SEQ ID NO: 1793122 - RNA, 21 nt, Homo sapiens
cucuuccaggaagcacaggcc

SEQ ID NO: 1793123 - RNA, 16 nt, Homo sapiens
uauacgcccuugagcu

SEQ ID NO: 1793124 - RNA, 18 nt, Homo sapiens
gacaggccacaccacagc

SEQ ID NO: 1793125 - RNA, 17 nt, Homo sapiens
uuuuaaaucaaguauuu

SEQ ID NO: 1793126 - RNA, 15 nt, Homo sapiens
uacggugauccuuuu

SEQ ID NO: 1793127 - RNA, 22 nt, Homo sapiens
cuguguggcccuggacaagcca

SEQ ID NO: 1793128 - RNA, 18 nt, Homo sapiens
uacaagauaagcuuccag

SEQ ID NO: 1793129 - RNA, 17 nt, Homo sapiens
ccucaucugcacggugg

SEQ ID NO: 1793130 - RNA, 16 nt, Homo sapiens
acagauggucacacag

SEQ ID NO: 1793131 - RNA, 13 nt, Homo sapiens
cuuaccacagugu

SEQ ID NO: 1793132 - RNA, 14 nt, Homo sapiens
aguucagcaaagag

SEQ ID NO: 1793133 - RNA, 18 nt, Homo sapiens
aagcugaagaccauggau

SEQ ID NO: 1793134 - RNA, 18 nt, Homo sapiens
acagcuucauguucccaa

SEQ ID NO: 1793135 - RNA, 20 nt, Homo sapiens
cuuucauauucucuuuguga

SEQ ID NO: 1793136 - RNA, 18 nt, Homo sapiens
uuuuaaauuuuaugucau

SEQ ID NO: 1793137 - RNA, 12 nt, Homo sapiens
ccucggcuaccc

SEQ ID NO: 1793138 - RNA, 22 nt, Homo sapiens
agggggacacauccaucuugca

SEQ ID NO: 1793139 - RNA, 15 nt, Homo sapiens
cuaaguuccuuccca

SEQ ID NO: 1793140 - RNA, 15 nt, Homo sapiens
auuaugccacuuccu

SEQ ID NO: 1793141 - RNA, 24 nt, Homo sapiens
agggccucugugcagacaguguca

SEQ ID NO: 1793142 - RNA, 21 nt, Homo sapiens
ucuuuuaaauaauauccaccu

SEQ ID NO: 1793143 - RNA, 19 nt, Homo sapiens
uaucauucagcaucuacuc

SEQ ID NO: 1793144 - RNA, 14 nt, Homo sapiens
agccagacuggcac

SEQ ID NO: 1793145 - RNA, 21 nt, Homo sapiens
agcagauuuaagauauguaac

SEQ ID NO: 1793146 - RNA, 12 nt, Homo sapiens
caagguuuacau

SEQ ID NO: 1793147 - RNA, 15 nt, Homo sapiens
ccgucuggaccuggg

SEQ ID NO: 1793148 - RNA, 19 nt, Homo sapiens
aagcugggagggaggggga

SEQ ID NO: 1793149 - RNA, 13 nt, Homo sapiens
acaugccaugccu

SEQ ID NO: 1793150 - RNA, 19 nt, Homo sapiens
ugccaccacgucuggcuaa

SEQ ID NO: 1793151 - RNA, 22 nt, Homo sapiens
uggggucucucucccuaccucc

SEQ ID NO: 1793152 - RNA, 20 nt, Homo sapiens
aucaagaaacauucagacca

SEQ ID NO: 1793153 - RNA, 18 nt, Homo sapiens
aacagccucacuccucag

SEQ ID NO: 1793154 - RNA, 21 nt, Homo sapiens
aagcuguugguguucuaagac

SEQ ID NO: 1793155 - RNA, 19 nt, Homo sapiens
acuaugaggacugccuuau

SEQ ID NO: 1793156 - RNA, 24 nt, Homo sapiens
ucugugggaagcucccagaguuug

SEQ ID NO: 1793157 - RNA, 16 nt, Homo sapiens
cagcaugauucuucca

SEQ ID NO: 1793158 - RNA, 20 nt, Homo sapiens
uguuuuacaucuuuugggaa

SEQ ID NO: 1793159 - RNA, 20 nt, Homo sapiens
cagcaccuccgggacugacc

SEQ ID NO: 1793160 - RNA, 20 nt, Homo sapiens
ccagucuguugcugcuccau

SEQ ID NO: 1793161 - RNA, 22 nt, Homo sapiens
agacgaacagcugacauggagu

SEQ ID NO: 1793162 - RNA, 13 nt, Homo sapiens
gccuuguuccuca

SEQ ID NO: 1793163 - RNA, 14 nt, Homo sapiens
ugcuaucagcaaug

SEQ ID NO: 1793164 - RNA, 14 nt, Homo sapiens
ugaaaucagccuug

SEQ ID NO: 1793165 - RNA, 16 nt, Homo sapiens
ucugccgcuaccuccc

SEQ ID NO: 1793166 - RNA, 14 nt, Homo sapiens
ccuuucagucugau

SEQ ID NO: 1793167 - RNA, 16 nt, Homo sapiens
caaugcuuuuaaugaa

SEQ ID NO: 1793168 - RNA, 20 nt, Homo sapiens
gaugucaggauguugcucca

SEQ ID NO: 1793169 - RNA, 22 nt, Homo sapiens
guagaauuaccauuaauuacau

SEQ ID NO: 1793170 - RNA, 21 nt, Homo sapiens
uucuaccuuuaaaauuuacca

SEQ ID NO: 1793171 - RNA, 22 nt, Homo sapiens
aggaaggacuuacccaguauua

SEQ ID NO: 1793172 - RNA, 15 nt, Homo sapiens
aguuuuccaggaaua

SEQ ID NO: 1793173 - RNA, 18 nt, Homo sapiens
gugugaagcuuugcacac

SEQ ID NO: 1793174 - RNA, 16 nt, Homo sapiens
aaaccaaacucugugu

SEQ ID NO: 1793175 - RNA, 21 nt, Homo sapiens
cuucugcuaauaccucuuacu

SEQ ID NO: 1793176 - RNA, 14 nt, Homo sapiens
aauacauaacauuc

SEQ ID NO: 1793177 - RNA, 18 nt, Homo sapiens
ucucaccuggacuccagu

SEQ ID NO: 1793178 - RNA, 20 nt, Homo sapiens
guaaaugcuccagcacucaa

SEQ ID NO: 1793179 - RNA, 15 nt, Homo sapiens
gagcacucucacccc

SEQ ID NO: 1793180 - RNA, 15 nt, Homo sapiens
ucuguucugauauua

SEQ ID NO: 1793181 - RNA, 19 nt, Homo sapiens
cuccagcaagcagugcccu

SEQ ID NO: 1793182 - RNA, 22 nt, Homo sapiens
aguacuaaauucuuaguaaaau

SEQ ID NO: 1793183 - RNA, 13 nt, Homo sapiens
acaccccaccucu

SEQ ID NO: 1793184 - RNA, 19 nt, Homo sapiens
cugcguagaagauauggaa

SEQ ID NO: 1793185 - RNA, 18 nt, Homo sapiens
caagggggcugcucugca

SEQ ID NO: 1793186 - RNA, 15 nt, Homo sapiens
agcaaaaauguaaaa

SEQ ID NO: 1793187 - RNA, 17 nt, Homo sapiens
ccaagggaucugccauu

SEQ ID NO: 1793188 - RNA, 23 nt, Homo sapiens
caugaacacacauggaugcacac

SEQ ID NO: 1793189 - RNA, 21 nt, Homo sapiens
uagauguccucagaagucagu

SEQ ID NO: 1793190 - RNA, 14 nt, Homo sapiens
gagagacugugagg

SEQ ID NO: 1793191 - RNA, 14 nt, Homo sapiens
cuaauuauguagcu

SEQ ID NO: 1793192 - RNA, 18 nt, Homo sapiens
aggcacccccagaaugac

SEQ ID NO: 1793193 - RNA, 16 nt, Homo sapiens
uccugcauguguauau

SEQ ID NO: 1793194 - RNA, 22 nt, Homo sapiens
gggauggcguggucaagcacuc

SEQ ID NO: 1793195 - RNA, 15 nt, Homo sapiens
ucaaaggcaguuugu

SEQ ID NO: 1793196 - RNA, 23 nt, Homo sapiens
aucauuuuuguaggaagcauuuu

SEQ ID NO: 1793197 - RNA, 19 nt, Homo sapiens
aaaaguuaauaacagcucc

SEQ ID NO: 1793198 - RNA, 23 nt, Homo sapiens
agaauuagauuuuaaaacuucau

SEQ ID NO: 1793199 - RNA, 20 nt, Homo sapiens
ucugaggaucagcacugcca

SEQ ID NO: 1793200 - RNA, 18 nt, Homo sapiens
auuugucuccaugauacc

SEQ ID NO: 1793201 - RNA, 18 nt, Homo sapiens
gaauaaagccugcuuuuu

SEQ ID NO: 1793202 - RNA, 22 nt, Homo sapiens
ugucuaagaauaaugacguauu

SEQ ID NO: 1793203 - RNA, 15 nt, Homo sapiens
ucccacaaugcugau

SEQ ID NO: 1793204 - RNA, 21 nt, Homo sapiens
ccugugacaacacucaucaca

SEQ ID NO: 1793205 - RNA, 14 nt, Homo sapiens
uaugcaguaugcuu

SEQ ID NO: 1793206 - RNA, 17 nt, Homo sapiens
uucggaccgaaggugac

SEQ ID NO: 1793207 - RNA, 22 nt, Homo sapiens
agccugccuccuucagugacaa

SEQ ID NO: 1793208 - RNA, 12 nt, Homo sapiens
accucacugcag

SEQ ID NO: 1793209 - RNA, 22 nt, Homo sapiens
aauccauucuuaaaguacuugu

SEQ ID NO: 1793210 - RNA, 14 nt, Homo sapiens
uugagaguuaauaa

SEQ ID NO: 1793211 - RNA, 15 nt, Homo sapiens
agaaguuuauucuca

SEQ ID NO: 1793212 - RNA, 18 nt, Homo sapiens
gcgggccuaacauguugu

SEQ ID NO: 1793213 - RNA, 17 nt, Homo sapiens
augcaccccaacauuga

SEQ ID NO: 1793214 - RNA, 19 nt, Homo sapiens
agcccacagaggacagugc

SEQ ID NO: 1793215 - RNA, 15 nt, Homo sapiens
uaaaguuccugucau

SEQ ID NO: 1793216 - RNA, 15 nt, Homo sapiens
auguuaauaucugau

SEQ ID NO: 1793217 - RNA, 22 nt, Homo sapiens
aucucacaaguaggaucaagaa

SEQ ID NO: 1793218 - RNA, 21 nt, Homo sapiens
uacacacaaaaauuaacaaaa

SEQ ID NO: 1793219 - RNA, 22 nt, Homo sapiens
ccucucuaagccacagcuucuu

SEQ ID NO: 1793220 - RNA, 19 nt, Homo sapiens
uuuaccuguuuuacuuuug

SEQ ID NO: 1793221 - RNA, 15 nt, Homo sapiens
guccuagagaauucc

SEQ ID NO: 1793222 - RNA, 19 nt, Homo sapiens
gauuuaauacguacuuuag

SEQ ID NO: 1793223 - RNA, 14 nt, Homo sapiens
caugcaaaugagcu

SEQ ID NO: 1793224 - RNA, 16 nt, Homo sapiens
agauguauauauuucc

SEQ ID NO: 1793225 - RNA, 16 nt, Homo sapiens
ggccgccuguccucac

SEQ ID NO: 1793226 - RNA, 13 nt, Homo sapiens
guacugcauguga

SEQ ID NO: 1793227 - RNA, 11 nt, Homo sapiens
uccaauacugc

SEQ ID NO: 1793228 - RNA, 22 nt, Homo sapiens
ccagcuccacagggugggauga

SEQ ID NO: 1793229 - RNA, 13 nt, Homo sapiens
cuuuugcugugau

SEQ ID NO: 1793230 - RNA, 22 nt, Homo sapiens
cagcagaaaggagaacuaucca

SEQ ID NO: 1793231 - RNA, 14 nt, Homo sapiens
aaauuugucuuuca

SEQ ID NO: 1793232 - RNA, 15 nt, Homo sapiens
cuguccucuuuguga

SEQ ID NO: 1793233 - RNA, 18 nt, Homo sapiens
ucagaaaauggcacuugg

SEQ ID NO: 1793234 - RNA, 23 nt, Homo sapiens
ccugaauaaagauucuacaacac

SEQ ID NO: 1793235 - RNA, 23 nt, Homo sapiens
uucccuuugucuuucaaacucca

SEQ ID NO: 1793236 - RNA, 19 nt, Homo sapiens
auggcuuuagcuaccucac

SEQ ID NO: 1793237 - RNA, 18 nt, Homo sapiens
uuacuguccaccaguuua

SEQ ID NO: 1793238 - RNA, 14 nt, Homo sapiens
uucuuaaagccuua

SEQ ID NO: 1793239 - RNA, 14 nt, Homo sapiens
uuaaaaaagcaaaa

SEQ ID NO: 1793240 - RNA, 22 nt, Homo sapiens
aaaaggaucuccuuuuuuccca

SEQ ID NO: 1793241 - RNA, 18 nt, Homo sapiens
cacauccagccuuggaau

SEQ ID NO: 1793242 - RNA, 19 nt, Homo sapiens
ugugcauguauauuacuga

SEQ ID NO: 1793243 - RNA, 16 nt, Homo sapiens
cgaagccuuaacuuua

SEQ ID NO: 1793244 - RNA, 15 nt, Homo sapiens
accuucuaaaagcca

SEQ ID NO: 1793245 - RNA, 16 nt, Homo sapiens
cugcaaguauccagac

SEQ ID NO: 1793246 - RNA, 21 nt, Homo sapiens
uacugucuuacuauuauagca

SEQ ID NO: 1793247 - RNA, 14 nt, Homo sapiens
uaccaaaaacaaua

SEQ ID NO: 1793248 - RNA, 15 nt, Homo sapiens
gacagccauuuucca

SEQ ID NO: 1793249 - RNA, 20 nt, Homo sapiens
uggucaauccgaaguaugag

SEQ ID NO: 1793250 - RNA, 19 nt, Homo sapiens
agaaccccugaaguauuuu

SEQ ID NO: 1793251 - RNA, 17 nt, Homo sapiens
caaucaucuauugagug

SEQ ID NO: 1793252 - RNA, 12 nt, Homo sapiens
agcccacugagg

SEQ ID NO: 1793253 - RNA, 20 nt, Homo sapiens
uugagacuuacggcaagaag

SEQ ID NO: 1793254 - RNA, 17 nt, Homo sapiens
cuaguuucugugugaac

SEQ ID NO: 1793255 - RNA, 16 nt, Homo sapiens
uuguuuuaaguuuacu

SEQ ID NO: 1793256 - RNA, 20 nt, Homo sapiens
ucaugugagaaagcuaaaau

SEQ ID NO: 1793257 - RNA, 14 nt, Homo sapiens
uaggugucucauag

SEQ ID NO: 1793258 - RNA, 19 nt, Homo sapiens
gacuggacgugcucagaca

SEQ ID NO: 1793259 - RNA, 24 nt, Homo sapiens
auuccagaaugaagaauucagauu

SEQ ID NO: 1793260 - RNA, 22 nt, Homo sapiens
cccggacauacucucugccugg

SEQ ID NO: 1793261 - RNA, 12 nt, Homo sapiens
guucccauuugc

SEQ ID NO: 1793262 - RNA, 12 nt, Homo sapiens
ccucugccucaa

SEQ ID NO: 1793263 - RNA, 15 nt, Homo sapiens
agggaagaguucuga

SEQ ID NO: 1793264 - RNA, 12 nt, Homo sapiens
uuuugaugacug

SEQ ID NO: 1793265 - RNA, 17 nt, Homo sapiens
aacuuguaucugaagac

SEQ ID NO: 1793266 - RNA, 14 nt, Homo sapiens
cuugacauaccuac

SEQ ID NO: 1793267 - RNA, 21 nt, Homo sapiens
guauccucugaccuacauacg

SEQ ID NO: 1793268 - RNA, 20 nt, Homo sapiens
uccaggacagcaggcuuuga

SEQ ID NO: 1793269 - RNA, 14 nt, Homo sapiens
ucacacuuugccau

SEQ ID NO: 1793270 - RNA, 16 nt, Homo sapiens
caagggucagggugag

SEQ ID NO: 1793271 - RNA, 17 nt, Homo sapiens
cuucgacuacugcuccu

SEQ ID NO: 1793272 - RNA, 12 nt, Homo sapiens
augcugagcuca

SEQ ID NO: 1793273 - RNA, 16 nt, Homo sapiens
aggagugacuaggugg

SEQ ID NO: 1793274 - RNA, 14 nt, Homo sapiens
uuagauuucuagca

SEQ ID NO: 1793275 - RNA, 12 nt, Homo sapiens
cuggugcauggc

SEQ ID NO: 1793276 - RNA, 13 nt, Homo sapiens
uuuauuauggaaa

SEQ ID NO: 1793277 - RNA, 21 nt, Homo sapiens
agaaucuguagaggagccugg

SEQ ID NO: 1793278 - RNA, 15 nt, Homo sapiens
uacagguuaaccugc

SEQ ID NO: 1793279 - RNA, 17 nt, Homo sapiens
ugacccagguagucaaa

SEQ ID NO: 1793280 - RNA, 19 nt, Homo sapiens
acuauucugauuacacaaa

SEQ ID NO: 1793281 - RNA, 17 nt, Homo sapiens
aaccauggugaagugcu

SEQ ID NO: 1793282 - RNA, 17 nt, Homo sapiens
gcugggcugagugacac

SEQ ID NO: 1793283 - RNA, 16 nt, Homo sapiens
gaggagcuggaaccau

SEQ ID NO: 1793284 - RNA, 19 nt, Homo sapiens
gccuuuuguggauugacag

SEQ ID NO: 1793285 - RNA, 21 nt, Homo sapiens
agcuuggaggucacagcugga

SEQ ID NO: 1793286 - RNA, 23 nt, Homo sapiens
cuguucuguuggaugacuuugag

SEQ ID NO: 1793287 - RNA, 17 nt, Homo sapiens
cucagccuccugaguag

SEQ ID NO: 1793288 - RNA, 13 nt, Homo sapiens
cagucacugugag

SEQ ID NO: 1793289 - RNA, 16 nt, Homo sapiens
aucggcugcauugaag

SEQ ID NO: 1793290 - RNA, 22 nt, Homo sapiens
ugaagcguugccauugaacuca

SEQ ID NO: 1793291 - RNA, 15 nt, Homo sapiens
uaguuauuuacuuga

SEQ ID NO: 1793292 - RNA, 15 nt, Homo sapiens
cugguguagcacuua

SEQ ID NO: 1793293 - RNA, 16 nt, Homo sapiens
uacuccaugcacauag

SEQ ID NO: 1793294 - RNA, 17 nt, Homo sapiens
auugccuggacugacca

SEQ ID NO: 1793295 - RNA, 17 nt, Homo sapiens
acagauggucacacaga

SEQ ID NO: 1793296 - RNA, 15 nt, Homo sapiens
cucgaaacacagaaa

SEQ ID NO: 1793297 - RNA, 15 nt, Homo sapiens
cagcuagugccuuua

SEQ ID NO: 1793298 - RNA, 21 nt, Homo sapiens
cuucuuaucacacuugcaaau

SEQ ID NO: 1793299 - RNA, 22 nt, Homo sapiens
aacaggucuuugaaauaugcau

SEQ ID NO: 1793300 - RNA, 12 nt, Homo sapiens
aacccaccagcc

SEQ ID NO: 1793301 - RNA, 19 nt, Homo sapiens
aggcagcugccucugcucc

SEQ ID NO: 1793302 - RNA, 21 nt, Homo sapiens
uacaaccaaccaccuuuccag

SEQ ID NO: 1793303 - RNA, 16 nt, Homo sapiens
aguccugguucagugg

SEQ ID NO: 1793304 - RNA, 20 nt, Homo sapiens
cuugcacuccggagguagag

SEQ ID NO: 1793305 - RNA, 20 nt, Homo sapiens
augcauccagcaguacaaua

SEQ ID NO: 1793306 - RNA, 18 nt, Homo sapiens
acucacauucucuuccca

SEQ ID NO: 1793307 - RNA, 16 nt, Homo sapiens
caagccaggagaagac

SEQ ID NO: 1793308 - RNA, 19 nt, Homo sapiens
gccagcccggcucggccca

SEQ ID NO: 1793309 - RNA, 21 nt, Homo sapiens
aaagccucagccauucacugc

SEQ ID NO: 1793310 - RNA, 13 nt, Homo sapiens
ucaauuacaaagc

SEQ ID NO: 1793311 - RNA, 13 nt, Homo sapiens
aguucugccuuau

SEQ ID NO: 1793312 - RNA, 16 nt, Homo sapiens
uugcuuccgacaccuc

SEQ ID NO: 1793313 - RNA, 17 nt, Homo sapiens
agacucagccugcaguu

SEQ ID NO: 1793314 - RNA, 18 nt, Homo sapiens
acagaguggggagcuccu

SEQ ID NO: 1793315 - RNA, 18 nt, Homo sapiens
uccugcugauccagaugc

SEQ ID NO: 1793316 - RNA, 15 nt, Homo sapiens
aauauuugcugugaa

SEQ ID NO: 1793317 - RNA, 17 nt, Homo sapiens
gaaaaucaagcaguuuc

SEQ ID NO: 1793318 - RNA, 18 nt, Homo sapiens
agauagguacuauuaucc

SEQ ID NO: 1793319 - RNA, 15 nt, Homo sapiens
guucgagaccagccu

SEQ ID NO: 1793320 - RNA, 16 nt, Homo sapiens
gauccagcucaaggga

SEQ ID NO: 1793321 - RNA, 15 nt, Homo sapiens
augugaaaguuacaa

SEQ ID NO: 1793322 - RNA, 12 nt, Homo sapiens
auagaaugaacu

SEQ ID NO: 1793323 - RNA, 23 nt, Homo sapiens
uacagggcaucgagccaccaagc

SEQ ID NO: 1793324 - RNA, 22 nt, Homo sapiens
caugguuuugugccaucuguag

SEQ ID NO: 1793325 - RNA, 18 nt, Homo sapiens
cugugcuguggcauagac

SEQ ID NO: 1793326 - RNA, 21 nt, Homo sapiens
aucauccccauccuccagaga

SEQ ID NO: 1793327 - RNA, 18 nt, Homo sapiens
agcauaauaaaaaggcaa

SEQ ID NO: 1793328 - RNA, 17 nt, Homo sapiens
agucuuucuaacugaau

SEQ ID NO: 1793329 - RNA, 14 nt, Homo sapiens
gccacaaaccugcc

SEQ ID NO: 1793330 - RNA, 15 nt, Homo sapiens
caugaaccaagugga

SEQ ID NO: 1793331 - RNA, 22 nt, Homo sapiens
ucauaauuguugaccuaagaau

SEQ ID NO: 1793332 - RNA, 22 nt, Homo sapiens
cuuucaggaauuuuguaaucuc

SEQ ID NO: 1793333 - RNA, 18 nt, Homo sapiens
gccacaaggacgcuggcu

SEQ ID NO: 1793334 - RNA, 21 nt, Homo sapiens
agcauggccccaguccaugcu

SEQ ID NO: 1793335 - RNA, 16 nt, Homo sapiens
uccucccacugucugc

SEQ ID NO: 1793336 - RNA, 12 nt, Homo sapiens
ucuguaccuugc

SEQ ID NO: 1793337 - RNA, 21 nt, Homo sapiens
aaggucuauggcucaugucug

SEQ ID NO: 1793338 - RNA, 21 nt, Homo sapiens
uauaguguucacaaacuguga

SEQ ID NO: 1793339 - RNA, 11 nt, Homo sapiens
ugugcacacac

SEQ ID NO: 1793340 - RNA, 15 nt, Homo sapiens
cuguccaguucccag

SEQ ID NO: 1793341 - RNA, 16 nt, Homo sapiens
aaaugcaucacaugau

SEQ ID NO: 1793342 - RNA, 16 nt, Homo sapiens
agagggacagugggcu

SEQ ID NO: 1793343 - RNA, 21 nt, Homo sapiens
ucacugcagcgcgcuccugac

SEQ ID NO: 1793344 - RNA, 16 nt, Homo sapiens
aaaagaauauuuagaa

SEQ ID NO: 1793345 - RNA, 14 nt, Homo sapiens
cccaccaccugucc

SEQ ID NO: 1793346 - RNA, 21 nt, Homo sapiens
agguguuguauauagagugga

SEQ ID NO: 1793347 - RNA, 16 nt, Homo sapiens
cuuuucccacauucau

SEQ ID NO: 1793348 - RNA, 14 nt, Homo sapiens
uuuuaucuccaagu

SEQ ID NO: 1793349 - RNA, 14 nt, Homo sapiens
aagcagaagccaua

SEQ ID NO: 1793350 - RNA, 16 nt, Homo sapiens
gcaacugaaauuacau

SEQ ID NO: 1793351 - RNA, 16 nt, Homo sapiens
caauaacuucuauguu

SEQ ID NO: 1793352 - RNA, 15 nt, Homo sapiens
acuccagaucugcac

SEQ ID NO: 1793353 - RNA, 22 nt, Homo sapiens
cuaagguuuagauaaauauuga

SEQ ID NO: 1793354 - RNA, 17 nt, Homo sapiens
aucuucccacuuugcca

SEQ ID NO: 1793355 - RNA, 22 nt, Homo sapiens
cuggaagaaggaagaagccaga

SEQ ID NO: 1793356 - RNA, 19 nt, Homo sapiens
uugaagaggccuaagucaa

SEQ ID NO: 1793357 - RNA, 14 nt, Homo sapiens
cuuuaaacauugac

SEQ ID NO: 1793358 - RNA, 22 nt, Homo sapiens
ucauguccugaugccauggaau

SEQ ID NO: 1793359 - RNA, 14 nt, Homo sapiens
augggccagaguug

SEQ ID NO: 1793360 - RNA, 17 nt, Homo sapiens
aaacuagaugaccucau

SEQ ID NO: 1793361 - RNA, 18 nt, Homo sapiens
cauguauuagcucacuga

SEQ ID NO: 1793362 - RNA, 12 nt, Homo sapiens
auggacugcacc

SEQ ID NO: 1793363 - RNA, 21 nt, Homo sapiens
uggaaaagucacacagacaca

SEQ ID NO: 1793364 - RNA, 18 nt, Homo sapiens
cacacugugauuuugccc

SEQ ID NO: 1793365 - RNA, 21 nt, Homo sapiens
aguuuuguaaauguacuggua

SEQ ID NO: 1793366 - RNA, 17 nt, Homo sapiens
augaaaaugaaucuuca

SEQ ID NO: 1793367 - RNA, 17 nt, Homo sapiens
gguugguuuaaugcaau

SEQ ID NO: 1793368 - RNA, 14 nt, Homo sapiens
ccugccaaugccac

SEQ ID NO: 1793369 - RNA, 22 nt, Homo sapiens
gaccuggccucugccauccucc

SEQ ID NO: 1793370 - RNA, 15 nt, Homo sapiens
gugagucgagauugc

SEQ ID NO: 1793371 - RNA, 18 nt, Homo sapiens
uuuaaacacaugccuuaa

SEQ ID NO: 1793372 - RNA, 14 nt, Homo sapiens
ucagguggaaaaac

SEQ ID NO: 1793373 - RNA, 21 nt, Homo sapiens
ggaauuuggcucaacuucagu

SEQ ID NO: 1793374 - RNA, 20 nt, Homo sapiens
accacggaggaugaugccag

SEQ ID NO: 1793375 - RNA, 21 nt, Homo sapiens
ucaauaugaaggacuauuaau

SEQ ID NO: 1793376 - RNA, 17 nt, Homo sapiens
ccucuccuccucagcug

SEQ ID NO: 1793377 - RNA, 17 nt, Homo sapiens
gaccagagcaccucagc

SEQ ID NO: 1793378 - RNA, 13 nt, Homo sapiens
aacagauucucca

SEQ ID NO: 1793379 - RNA, 18 nt, Homo sapiens
uucauccggggaggaaac

SEQ ID NO: 1793380 - RNA, 18 nt, Homo sapiens
cacagccuucccucugca

SEQ ID NO: 1793381 - RNA, 14 nt, Homo sapiens
ucuuguauacacau

SEQ ID NO: 1793382 - RNA, 14 nt, Homo sapiens
uuucuaaaguaaaa

SEQ ID NO: 1793383 - RNA, 23 nt, Homo sapiens
gaugccagccggguaccucaguu

SEQ ID NO: 1793384 - RNA, 17 nt, Homo sapiens
ugcaaagcccagcuuga

SEQ ID NO: 1793385 - RNA, 22 nt, Homo sapiens
ggagcugguugaauugucuuua

SEQ ID NO: 1793386 - RNA, 16 nt, Homo sapiens
agauuucucauuugcc

SEQ ID NO: 1793387 - RNA, 13 nt, Homo sapiens
auuugcaccacuu

SEQ ID NO: 1793388 - RNA, 22 nt, Homo sapiens
cagccucuucccaugcuggugg

SEQ ID NO: 1793389 - RNA, 17 nt, Homo sapiens
cuacagggugucuguca

SEQ ID NO: 1793390 - RNA, 22 nt, Homo sapiens
ugaccuacuuugguaguggaau

SEQ ID NO: 1793391 - RNA, 14 nt, Homo sapiens
ucguauacccugga

SEQ ID NO: 1793392 - RNA, 15 nt, Homo sapiens
uuuuucauuguccau

SEQ ID NO: 1793393 - RNA, 21 nt, Homo sapiens
gcugcaucuuccagucucucc

SEQ ID NO: 1793394 - RNA, 20 nt, Homo sapiens
gcaauaguggaacgaacuuu

SEQ ID NO: 1793395 - RNA, 20 nt, Homo sapiens
gcuucuucugaaagaauuau

SEQ ID NO: 1793396 - RNA, 15 nt, Homo sapiens
ggaucacucucugcu

SEQ ID NO: 1793397 - RNA, 19 nt, Homo sapiens
aauucuuuggaacuuuaau

SEQ ID NO: 1793398 - RNA, 14 nt, Homo sapiens
ucuaacaaauucca

SEQ ID NO: 1793399 - RNA, 16 nt, Homo sapiens
auuugugauaucuaau

SEQ ID NO: 1793400 - RNA, 20 nt, Homo sapiens
gcccccgccugccaccggag

SEQ ID NO: 1793401 - RNA, 17 nt, Homo sapiens
cgggauggccagagaug

SEQ ID NO: 1793402 - RNA, 16 nt, Homo sapiens
cugggaaaacagugaa

SEQ ID NO: 1793403 - RNA, 16 nt, Homo sapiens
auggugccccaggacc

SEQ ID NO: 1793404 - RNA, 13 nt, Homo sapiens
cauagucuuauua

SEQ ID NO: 1793405 - RNA, 17 nt, Homo sapiens
acuuaacaucaacagga

SEQ ID NO: 1793406 - RNA, 21 nt, Homo sapiens
aacuucuuauacgucuagccu

SEQ ID NO: 1793407 - RNA, 12 nt, Homo sapiens
cuuuuuccagag

SEQ ID NO: 1793408 - RNA, 23 nt, Homo sapiens
gugacaugaacccauccaaugga

SEQ ID NO: 1793409 - RNA, 21 nt, Homo sapiens
ccuggaugaucacuaauacua

SEQ ID NO: 1793410 - RNA, 15 nt, Homo sapiens
cuggccagaccaggu

SEQ ID NO: 1793411 - RNA, 14 nt, Homo sapiens
accacuuuuuguaa

SEQ ID NO: 1793412 - RNA, 16 nt, Homo sapiens
uaccaguguacugcuu

SEQ ID NO: 1793413 - RNA, 18 nt, Homo sapiens
gcuuuugugccucucaca

SEQ ID NO: 1793414 - RNA, 18 nt, Homo sapiens
agaucaacauuccagggu

SEQ ID NO: 1793415 - RNA, 19 nt, Homo sapiens
cuguauauacaauaacaua

SEQ ID NO: 1793416 - RNA, 16 nt, Homo sapiens
cucugucuuuccagca

SEQ ID NO: 1793417 - RNA, 23 nt, Homo sapiens
auguauugcagugcggcucacau

SEQ ID NO: 1793418 - RNA, 17 nt, Homo sapiens
ugcagguucauggauua

SEQ ID NO: 1793419 - RNA, 19 nt, Homo sapiens
uaugcuuugaaugcaaaag

SEQ ID NO: 1793420 - RNA, 23 nt, Homo sapiens
acaagauccaggcagaaggagau

SEQ ID NO: 1793421 - RNA, 17 nt, Homo sapiens
cggcgggacugucaaug

SEQ ID NO: 1793422 - RNA, 17 nt, Homo sapiens
gcauuagagggagccca

SEQ ID NO: 1793423 - RNA, 12 nt, Homo sapiens
accucugaggac

SEQ ID NO: 1793424 - RNA, 16 nt, Homo sapiens
cucuaggaaucaaagu

SEQ ID NO: 1793425 - RNA, 15 nt, Homo sapiens
agaaaugaucuuuac

SEQ ID NO: 1793426 - RNA, 12 nt, Homo sapiens
ugugucuguaca

SEQ ID NO: 1793427 - RNA, 14 nt, Homo sapiens
cugaacauugcacu

SEQ ID NO: 1793428 - RNA, 23 nt, Homo sapiens
gaucugaacagaaauaccaaaau

SEQ ID NO: 1793429 - RNA, 16 nt, Homo sapiens
gacauugauacaguga

SEQ ID NO: 1793430 - RNA, 20 nt, Homo sapiens
cccucugggcagcugucaug

SEQ ID NO: 1793431 - RNA, 23 nt, Homo sapiens
uaaaaaggaccagagaauucuua

SEQ ID NO: 1793432 - RNA, 17 nt, Homo sapiens
cagucaaggugauauau

SEQ ID NO: 1793433 - RNA, 20 nt, Homo sapiens
ucacgaacuguucacacugc

SEQ ID NO: 1793434 - RNA, 15 nt, Homo sapiens
aacuaggcucagaga

SEQ ID NO: 1793435 - RNA, 13 nt, Homo sapiens
caugaaagcguaa

SEQ ID NO: 1793436 - RNA, 20 nt, Homo sapiens
uuuguauuugggccaguuga

SEQ ID NO: 1793437 - RNA, 13 nt, Homo sapiens
aauguuuuauuuc

SEQ ID NO: 1793438 - RNA, 19 nt, Homo sapiens
ggcugggcuccucauuuuu

SEQ ID NO: 1793439 - RNA, 19 nt, Homo sapiens
agcuucucuacagacucca

SEQ ID NO: 1793440 - RNA, 20 nt, Homo sapiens
aauaaaauucuguaauuuga

SEQ ID NO: 1793441 - RNA, 13 nt, Homo sapiens
auccagaggaauu

SEQ ID NO: 1793442 - RNA, 20 nt, Homo sapiens
ucuucacugucugacuuuag

SEQ ID NO: 1793443 - RNA, 18 nt, Homo sapiens
uccucccuguuaaauguc

SEQ ID NO: 1793444 - RNA, 22 nt, Homo sapiens
uuagaugugcugcuuugauaua

SEQ ID NO: 1793445 - RNA, 18 nt, Homo sapiens
agaaauuuuucuaguaua

SEQ ID NO: 1793446 - RNA, 13 nt, Homo sapiens
uguucuuugccag

SEQ ID NO: 1793447 - RNA, 14 nt, Homo sapiens
ggaaaaucucagca

SEQ ID NO: 1793448 - RNA, 22 nt, Homo sapiens
augauggaaaaaauacauugaa

SEQ ID NO: 1793449 - RNA, 21 nt, Homo sapiens
gacauuggauguggagcuccu

SEQ ID NO: 1793450 - RNA, 11 nt, Homo sapiens
ucucucaggag

SEQ ID NO: 1793451 - RNA, 19 nt, Homo sapiens
gccacccagcaacacagag

SEQ ID NO: 1793452 - RNA, 17 nt, Homo sapiens
ccucugcuuuugcacac

SEQ ID NO: 1793453 - RNA, 18 nt, Homo sapiens
caggaaagggagggaaua

SEQ ID NO: 1793454 - RNA, 22 nt, Homo sapiens
uauaaugaaugacuuccccaau

SEQ ID NO: 1793455 - RNA, 16 nt, Homo sapiens
uucuaacgccagcaca

SEQ ID NO: 1793456 - RNA, 21 nt, Homo sapiens
caagcuuguuaucagcuuuca

SEQ ID NO: 1793457 - RNA, 20 nt, Homo sapiens
ucuuacccaguuaacaaaag

SEQ ID NO: 1793458 - RNA, 13 nt, Homo sapiens
acauucuuccaaa

SEQ ID NO: 1793459 - RNA, 22 nt, Homo sapiens
gcgauccaccugucucagccuc

SEQ ID NO: 1793460 - RNA, 16 nt, Homo sapiens
gcauugucucucucga

SEQ ID NO: 1793461 - RNA, 11 nt, Homo sapiens
aguaguucuca

SEQ ID NO: 1793462 - RNA, 16 nt, Homo sapiens
cacuuccaagagccuu

SEQ ID NO: 1793463 - RNA, 21 nt, Homo sapiens
caauaacuagcuucuuauaau

SEQ ID NO: 1793464 - RNA, 22 nt, Homo sapiens
uaagcucuuugaaacaacuuuc

SEQ ID NO: 1793465 - RNA, 22 nt, Homo sapiens
aggcaggcugggacggaccagc

SEQ ID NO: 1793466 - RNA, 20 nt, Homo sapiens
ugcauuuauggucaacacuu

SEQ ID NO: 1793467 - RNA, 12 nt, Homo sapiens
gaaaacaggcuc

SEQ ID NO: 1793468 - RNA, 12 nt, Homo sapiens
gcucacaggaaa

SEQ ID NO: 1793469 - RNA, 18 nt, Homo sapiens
caccucaaagcgguuuaa

SEQ ID NO: 1793470 - RNA, 18 nt, Homo sapiens
ugcuaguguucugucuaa

SEQ ID NO: 1793471 - RNA, 16 nt, Homo sapiens
ucacuuuagaugcuga

SEQ ID NO: 1793472 - RNA, 15 nt, Homo sapiens
caucuuuguuuacca

SEQ ID NO: 1793473 - RNA, 14 nt, Homo sapiens
caagggucuucagg

SEQ ID NO: 1793474 - RNA, 17 nt, Homo sapiens
ugucuaaacaaugcuga

SEQ ID NO: 1793475 - RNA, 13 nt, Homo sapiens
agacagugaaaga

SEQ ID NO: 1793476 - RNA, 14 nt, Homo sapiens
gggguuaccaugua

SEQ ID NO: 1793477 - RNA, 20 nt, Homo sapiens
gcucacgccuguaaucccag

SEQ ID NO: 1793478 - RNA, 22 nt, Homo sapiens
acuaauugacuugcaaagaccu

SEQ ID NO: 1793479 - RNA, 22 nt, Homo sapiens
aacauucuguguucacaugugu

SEQ ID NO: 1793480 - RNA, 15 nt, Homo sapiens
cuccacucaccacaa

SEQ ID NO: 1793481 - RNA, 15 nt, Homo sapiens
gagaaacugccacau

SEQ ID NO: 1793482 - RNA, 15 nt, Homo sapiens
ccugagggagcucca

SEQ ID NO: 1793483 - RNA, 17 nt, Homo sapiens
aguuguauuucaaauau

SEQ ID NO: 1793484 - RNA, 14 nt, Homo sapiens
caucuuguccccaa

SEQ ID NO: 1793485 - RNA, 15 nt, Homo sapiens
acauaaguaauucaa

SEQ ID NO: 1793486 - RNA, 22 nt, Homo sapiens
aauuucaagaaguguaguucaa

SEQ ID NO: 1793487 - RNA, 20 nt, Homo sapiens
agacagugcccuuggugcga

SEQ ID NO: 1793488 - RNA, 15 nt, Homo sapiens
ucaucuacuacaggg

SEQ ID NO: 1793489 - RNA, 21 nt, Homo sapiens
gagacuguuaucaggacuuga

SEQ ID NO: 1793490 - RNA, 13 nt, Homo sapiens
gaauuagccaaaa

SEQ ID NO: 1793491 - RNA, 16 nt, Homo sapiens
guguuacuguugcacu

SEQ ID NO: 1793492 - RNA, 22 nt, Homo sapiens
ccgggaacuggagucugucucu

SEQ ID NO: 1793493 - RNA, 18 nt, Homo sapiens
aucauuauaaauaauguu

SEQ ID NO: 1793494 - RNA, 15 nt, Homo sapiens
caaagcuacuugaag

SEQ ID NO: 1793495 - RNA, 19 nt, Homo sapiens
gccuccaggggcagggccu

SEQ ID NO: 1793496 - RNA, 15 nt, Homo sapiens
agaaacaucuagaaa

SEQ ID NO: 1793497 - RNA, 20 nt, Homo sapiens
accccagguccugcagucug

SEQ ID NO: 1793498 - RNA, 22 nt, Homo sapiens
ggauuauucugggggcugcagu

SEQ ID NO: 1793499 - RNA, 23 nt, Homo sapiens
guauaucaugaaacacuucucau

SEQ ID NO: 1793500 - RNA, 21 nt, Homo sapiens
auagugucugaugaauguuaa

SEQ ID NO: 1793501 - RNA, 18 nt, Homo sapiens
gaguaucugagaaccaac

SEQ ID NO: 1793502 - RNA, 15 nt, Homo sapiens
aauacaucaaaaaug

SEQ ID NO: 1793503 - RNA, 15 nt, Homo sapiens
cacugauugguguuu

SEQ ID NO: 1793504 - RNA, 20 nt, Homo sapiens
gccccugcccgagagcucuu

SEQ ID NO: 1793505 - RNA, 21 nt, Homo sapiens
guaagcucuuugaaacaacuu

SEQ ID NO: 1793506 - RNA, 16 nt, Homo sapiens
uaguuaaacagugcca

SEQ ID NO: 1793507 - RNA, 21 nt, Homo sapiens
uacagagaaaaucaaagcagu

SEQ ID NO: 1793508 - RNA, 19 nt, Homo sapiens
caacccacucccuguagug

SEQ ID NO: 1793509 - RNA, 20 nt, Homo sapiens
ucaguauuuacauacagcuu

SEQ ID NO: 1793510 - RNA, 22 nt, Homo sapiens
agaagcuugcugguagcacuug

SEQ ID NO: 1793511 - RNA, 21 nt, Homo sapiens
cauguguugcaccguucucug

SEQ ID NO: 1793512 - RNA, 20 nt, Homo sapiens
ucagccucugccagcgccaa

SEQ ID NO: 1793513 - RNA, 20 nt, Homo sapiens
acagcucuuaaauguagcaa

SEQ ID NO: 1793514 - RNA, 11 nt, Homo sapiens
gaggcccucaa

SEQ ID NO: 1793515 - RNA, 13 nt, Homo sapiens
uuccucuaugaag

SEQ ID NO: 1793516 - RNA, 17 nt, Homo sapiens
acuccguuuccaaauac

SEQ ID NO: 1793517 - RNA, 20 nt, Homo sapiens
uuaauacauugaucaggcca

SEQ ID NO: 1793518 - RNA, 14 nt, Homo sapiens
uaaucaacagauaa

SEQ ID NO: 1793519 - RNA, 14 nt, Homo sapiens
aacauauuaaaggu

SEQ ID NO: 1793520 - RNA, 13 nt, Homo sapiens
ucucaagcuugcu

SEQ ID NO: 1793521 - RNA, 18 nt, Homo sapiens
cacuuugucuaacucaga

SEQ ID NO: 1793522 - RNA, 17 nt, Homo sapiens
gcccagcccauggagau

SEQ ID NO: 1793523 - RNA, 16 nt, Homo sapiens
aagaugaaggcaucaa

SEQ ID NO: 1793524 - RNA, 17 nt, Homo sapiens
caagauaaaaccagagc

SEQ ID NO: 1793525 - RNA, 14 nt, Homo sapiens
uuaaaaaaacugga

SEQ ID NO: 1793526 - RNA, 13 nt, Homo sapiens
caaaggauuugau

SEQ ID NO: 1793527 - RNA, 22 nt, Homo sapiens
ucaauauaagaagcaaucuuug

SEQ ID NO: 1793528 - RNA, 12 nt, Homo sapiens
uuuccucuccaa

SEQ ID NO: 1793529 - RNA, 14 nt, Homo sapiens
gcggaagagcaugu

SEQ ID NO: 1793530 - RNA, 12 nt, Homo sapiens
aaaaggucuuua

SEQ ID NO: 1793531 - RNA, 17 nt, Homo sapiens
aaagcugcuugcuguaa

SEQ ID NO: 1793532 - RNA, 20 nt, Homo sapiens
ccauaucuacaguacuucca

SEQ ID NO: 1793533 - RNA, 22 nt, Homo sapiens
cuuucugacaagauaaaggaag

SEQ ID NO: 1793534 - RNA, 17 nt, Homo sapiens
agguccugugagcaaag

SEQ ID NO: 1793535 - RNA, 19 nt, Homo sapiens
cuuuccaagaccaaccuac

SEQ ID NO: 1793536 - RNA, 19 nt, Homo sapiens
acccaggcugcagugcaau

SEQ ID NO: 1793537 - RNA, 21 nt, Homo sapiens
ugggggugccgcuuucucuga

SEQ ID NO: 1793538 - RNA, 16 nt, Homo sapiens
cagaaauacugcucug

SEQ ID NO: 1793539 - RNA, 18 nt, Homo sapiens
agauuaguaaccaguuau

SEQ ID NO: 1793540 - RNA, 23 nt, Homo sapiens
ucugaagcccucccagguguuaa

SEQ ID NO: 1793541 - RNA, 15 nt, Homo sapiens
ccuuuuucacuuuga

SEQ ID NO: 1793542 - RNA, 15 nt, Homo sapiens
caugcccauucacac

SEQ ID NO: 1793543 - RNA, 15 nt, Homo sapiens
gauucaccucuucuu

SEQ ID NO: 1793544 - RNA, 15 nt, Homo sapiens
cuacuugcaauucaa

SEQ ID NO: 1793545 - RNA, 15 nt, Homo sapiens
gucuuuagaugcuau

SEQ ID NO: 1793546 - RNA, 17 nt, Homo sapiens
cuucuuccugcuggaca

SEQ ID NO: 1793547 - RNA, 12 nt, Homo sapiens
gccacacguguc

SEQ ID NO: 1793548 - RNA, 16 nt, Homo sapiens
ccccuguagcagucac

SEQ ID NO: 1793549 - RNA, 21 nt, Homo sapiens
caaaauguggaaugcauccaa

SEQ ID NO: 1793550 - RNA, 20 nt, Homo sapiens
gggaaccauguauaugagcu

SEQ ID NO: 1793551 - RNA, 17 nt, Homo sapiens
aauuuucaaguuuacac

SEQ ID NO: 1793552 - RNA, 15 nt, Homo sapiens
caucucugccuguca

SEQ ID NO: 1793553 - RNA, 21 nt, Homo sapiens
uuuacauacugcugucuaugu

SEQ ID NO: 1793554 - RNA, 18 nt, Homo sapiens
auuaugcaucugcuacug

SEQ ID NO: 1793555 - RNA, 18 nt, Homo sapiens
cucugucuggauuugccu

SEQ ID NO: 1793556 - RNA, 19 nt, Homo sapiens
cucugcuugcauccccaac

SEQ ID NO: 1793557 - RNA, 15 nt, Homo sapiens
ucuuagccucccaaa

SEQ ID NO: 1793558 - RNA, 14 nt, Homo sapiens
gaucuccacuguug

SEQ ID NO: 1793559 - RNA, 14 nt, Homo sapiens
aguggcauguauga

SEQ ID NO: 1793560 - RNA, 22 nt, Homo sapiens
aucagcuuuauaauaaacuguu

SEQ ID NO: 1793561 - RNA, 16 nt, Homo sapiens
aauccaggcagaucca

SEQ ID NO: 1793562 - RNA, 21 nt, Homo sapiens
augaagggaugcugcaaugua

SEQ ID NO: 1793563 - RNA, 23 nt, Homo sapiens
cccagcaaagucugcaucuggcg

SEQ ID NO: 1793564 - RNA, 15 nt, Homo sapiens
gcacaaaacuacuuu

SEQ ID NO: 1793565 - RNA, 23 nt, Homo sapiens
cuaaaauuauuauauauacaugg

SEQ ID NO: 1793566 - RNA, 11 nt, Homo sapiens
caaaacacagg

SEQ ID NO: 1793567 - RNA, 19 nt, Homo sapiens
ucuaagaauaauggacucu

SEQ ID NO: 1793568 - RNA, 15 nt, Homo sapiens
ccagcuccucaucca

SEQ ID NO: 1793569 - RNA, 16 nt, Homo sapiens
aucaugccacugcacu

SEQ ID NO: 1793570 - RNA, 14 nt, Homo sapiens
cugagaaccaaaag

SEQ ID NO: 1793571 - RNA, 20 nt, Homo sapiens
cacugaaucuccccuccuca

SEQ ID NO: 1793572 - RNA, 20 nt, Homo sapiens
caauagauugggcacugugg

SEQ ID NO: 1793573 - RNA, 22 nt, Homo sapiens
ggcaccccuuaauggaaacacg

SEQ ID NO: 1793574 - RNA, 16 nt, Homo sapiens
caaugugcugcugcuu

SEQ ID NO: 1793575 - RNA, 21 nt, Homo sapiens
ucaucuugggaagggccaugg

SEQ ID NO: 1793576 - RNA, 12 nt, Homo sapiens
guuuugcaacaa

SEQ ID NO: 1793577 - RNA, 15 nt, Homo sapiens
caaaugcacaucuca

SEQ ID NO: 1793578 - RNA, 15 nt, Homo sapiens
guuuggccucucuau

SEQ ID NO: 1793579 - RNA, 12 nt, Homo sapiens
aguauccaguca

SEQ ID NO: 1793580 - RNA, 17 nt, Homo sapiens
aagaugaaaacuuuuac

SEQ ID NO: 1793581 - RNA, 16 nt, Homo sapiens
auuuuucucuaacuca

SEQ ID NO: 1793582 - RNA, 14 nt, Homo sapiens
ucccauaucuugcc

SEQ ID NO: 1793583 - RNA, 21 nt, Homo sapiens
aaaccauccucucccuucuua

SEQ ID NO: 1793584 - RNA, 16 nt, Homo sapiens
uggaaggagaaagggg

SEQ ID NO: 1793585 - RNA, 13 nt, Homo sapiens
cucuccugcugca

SEQ ID NO: 1793586 - RNA, 13 nt, Homo sapiens
uggcccugugcua

SEQ ID NO: 1793587 - RNA, 14 nt, Homo sapiens
caaagaagaaccau

SEQ ID NO: 1793588 - RNA, 16 nt, Homo sapiens
acuguguaaaccacau

SEQ ID NO: 1793589 - RNA, 18 nt, Homo sapiens
cuuuaaaaagcaguccuc

SEQ ID NO: 1793590 - RNA, 15 nt, Homo sapiens
uauugggauaucauu

SEQ ID NO: 1793591 - RNA, 14 nt, Homo sapiens
auuuaagaucacag

SEQ ID NO: 1793592 - RNA, 12 nt, Homo sapiens
cuccuugcugca

SEQ ID NO: 1793593 - RNA, 16 nt, Homo sapiens
cugccuacccacgugc

SEQ ID NO: 1793594 - RNA, 15 nt, Homo sapiens
auugcaucaguucau

SEQ ID NO: 1793595 - RNA, 15 nt, Homo sapiens
ccuccgggaggucau

SEQ ID NO: 1793596 - RNA, 19 nt, Homo sapiens
ggcuuugggacaccugggg

SEQ ID NO: 1793597 - RNA, 20 nt, Homo sapiens
cagaaucuaacugguggaca

SEQ ID NO: 1793598 - RNA, 14 nt, Homo sapiens
acaagauccaggca

SEQ ID NO: 1793599 - RNA, 20 nt, Homo sapiens
cugggcagcuucuguuggca

SEQ ID NO: 1793600 - RNA, 13 nt, Homo sapiens
aaaggaagaugua

SEQ ID NO: 1793601 - RNA, 13 nt, Homo sapiens
agcccuauuacuu

SEQ ID NO: 1793602 - RNA, 15 nt, Homo sapiens
guuuuguacuuacau

SEQ ID NO: 1793603 - RNA, 19 nt, Homo sapiens
uuauucaggaugguuucuu

SEQ ID NO: 1793604 - RNA, 19 nt, Homo sapiens
ggcgaccagggccaucucc

SEQ ID NO: 1793605 - RNA, 13 nt, Homo sapiens
cacaagucuucca

SEQ ID NO: 1793606 - RNA, 19 nt, Homo sapiens
aaagaugaccuuugucuca

SEQ ID NO: 1793607 - RNA, 16 nt, Homo sapiens
agguaaaaacugaacu

SEQ ID NO: 1793608 - RNA, 16 nt, Homo sapiens
ucagaguauggagcuc

SEQ ID NO: 1793609 - RNA, 13 nt, Homo sapiens
cuccagucuuccg

SEQ ID NO: 1793610 - RNA, 14 nt, Homo sapiens
aauuuagcugccuu

SEQ ID NO: 1793611 - RNA, 20 nt, Homo sapiens
aucugcuuuuuauuuuacaa

SEQ ID NO: 1793612 - RNA, 13 nt, Homo sapiens
accugucauucua

SEQ ID NO: 1793613 - RNA, 22 nt, Homo sapiens
ugagauguuguguggcaauggg

SEQ ID NO: 1793614 - RNA, 19 nt, Homo sapiens
ucuuuccuccuuccaugga

SEQ ID NO: 1793615 - RNA, 21 nt, Homo sapiens
ccucaccuuggcaccagacac

SEQ ID NO: 1793616 - RNA, 15 nt, Homo sapiens
uuacuuaaaggaaua

SEQ ID NO: 1793617 - RNA, 20 nt, Homo sapiens
caaaaugcagauuccucaga

SEQ ID NO: 1793618 - RNA, 16 nt, Homo sapiens
ucaggaccugggaccu

SEQ ID NO: 1793619 - RNA, 22 nt, Homo sapiens
gaaaaccauucuggacacuguc

SEQ ID NO: 1793620 - RNA, 20 nt, Homo sapiens
agagaagcggauuuccaggg

SEQ ID NO: 1793621 - RNA, 17 nt, Homo sapiens
uaaggaauaaagccuuu

SEQ ID NO: 1793622 - RNA, 15 nt, Homo sapiens
ugggcugggccugug

SEQ ID NO: 1793623 - RNA, 15 nt, Homo sapiens
uggggugggccucug

SEQ ID NO: 1793624 - RNA, 19 nt, Homo sapiens
ugagggcacucucugccag

SEQ ID NO: 1793625 - RNA, 14 nt, Homo sapiens
guuuaaagugcagu

SEQ ID NO: 1793626 - RNA, 22 nt, Homo sapiens
augacuggaguaaaccauguau

SEQ ID NO: 1793627 - RNA, 15 nt, Homo sapiens
cacuuuaaaaccucu

SEQ ID NO: 1793628 - RNA, 12 nt, Homo sapiens
acagagaagcug

SEQ ID NO: 1793629 - RNA, 12 nt, Homo sapiens
acaaagaagcua

SEQ ID NO: 1793630 - RNA, 17 nt, Homo sapiens
ugccuucucccugggaa

SEQ ID NO: 1793631 - RNA, 17 nt, Homo sapiens
ugcguuaaauaagcaaa

SEQ ID NO: 1793632 - RNA, 20 nt, Homo sapiens
aaguaauuuccccacucuga

SEQ ID NO: 1793633 - RNA, 22 nt, Homo sapiens
uugauuuuuauaaauacugcaa

SEQ ID NO: 1793634 - RNA, 14 nt, Homo sapiens
cuaugauacugucu

SEQ ID NO: 1793635 - RNA, 15 nt, Homo sapiens
ugucacuagucucac

SEQ ID NO: 1793636 - RNA, 12 nt, Homo sapiens
agacaucaucaa

SEQ ID NO: 1793637 - RNA, 16 nt, Homo sapiens
ugugaaaacagaagaa

SEQ ID NO: 1793638 - RNA, 16 nt, Homo sapiens
cgcuuaguuaucagcu

SEQ ID NO: 1793639 - RNA, 17 nt, Homo sapiens
ccuccuaaaguagacuu

SEQ ID NO: 1793640 - RNA, 16 nt, Homo sapiens
guacauagucuguucc

SEQ ID NO: 1793641 - RNA, 18 nt, Homo sapiens
caacaggguagauuucuc

SEQ ID NO: 1793642 - RNA, 15 nt, Homo sapiens
uuucagagcauaaaa

SEQ ID NO: 1793643 - RNA, 12 nt, Homo sapiens
acagccucagaa

SEQ ID NO: 1793644 - RNA, 19 nt, Homo sapiens
cagcaagaaacguguucua

SEQ ID NO: 1793645 - RNA, 22 nt, Homo sapiens
ccgcaauguugguuucacugag

SEQ ID NO: 1793646 - RNA, 12 nt, Homo sapiens
gaagggccagag

SEQ ID NO: 1793647 - RNA, 13 nt, Homo sapiens
uaacuuaauucaa

SEQ ID NO: 1793648 - RNA, 14 nt, Homo sapiens
agucaccucaugga

SEQ ID NO: 1793649 - RNA, 17 nt, Homo sapiens
uaaauaugcagugauau

SEQ ID NO: 1793650 - RNA, 22 nt, Homo sapiens
ucaucaguaguucacauacaaa

SEQ ID NO: 1793651 - RNA, 13 nt, Homo sapiens
gaaauacuugaaa

SEQ ID NO: 1793652 - RNA, 23 nt, Homo sapiens
ucaugggaaugauagcccagaac

SEQ ID NO: 1793653 - RNA, 14 nt, Homo sapiens
gccccccuucccac

SEQ ID NO: 1793654 - RNA, 16 nt, Homo sapiens
ccucugaacuugccuu

SEQ ID NO: 1793655 - RNA, 20 nt, Homo sapiens
cugauggccccuccagcaca

SEQ ID NO: 1793656 - RNA, 23 nt, Homo sapiens
gcugggauuacaggcaugugcca

SEQ ID NO: 1793657 - RNA, 17 nt, Homo sapiens
cuuuguuuuggggguca

SEQ ID NO: 1793658 - RNA, 14 nt, Homo sapiens
uacacguacuucua

SEQ ID NO: 1793659 - RNA, 20 nt, Homo sapiens
auuuacuauuacucccagga

SEQ ID NO: 1793660 - RNA, 18 nt, Homo sapiens
cuguuuagcagaacucau

SEQ ID NO: 1793661 - RNA, 18 nt, Homo sapiens
aagcucauagcacauguu

SEQ ID NO: 1793662 - RNA, 18 nt, Homo sapiens
cacagcccagaaccacag

SEQ ID NO: 1793663 - RNA, 15 nt, Homo sapiens
aaauguaaagccagc

SEQ ID NO: 1793664 - RNA, 23 nt, Homo sapiens
ccaugaacaucuuuagugucuga

SEQ ID NO: 1793665 - RNA, 15 nt, Homo sapiens
ugaguccccuacucc

SEQ ID NO: 1793666 - RNA, 18 nt, Homo sapiens
gaaagggaugguggagug

SEQ ID NO: 1793667 - RNA, 22 nt, Homo sapiens
gugauccugccuugcugugaaa

SEQ ID NO: 1793668 - RNA, 16 nt, Homo sapiens
cauggaaucgaagugu

SEQ ID NO: 1793669 - RNA, 16 nt, Homo sapiens
agaaaaugauugcuua

SEQ ID NO: 1793670 - RNA, 13 nt, Homo sapiens
ggagccuguccuu

SEQ ID NO: 1793671 - RNA, 19 nt, Homo sapiens
cauacuuucccacagcacu

SEQ ID NO: 1793672 - RNA, 16 nt, Homo sapiens
uacacuaguccauaag

SEQ ID NO: 1793673 - RNA, 13 nt, Homo sapiens
ggccagccagcca

SEQ ID NO: 1793674 - RNA, 16 nt, Homo sapiens
agcuccgcgugucuca

SEQ ID NO: 1793675 - RNA, 18 nt, Homo sapiens
aaaccauaaacauuugca

SEQ ID NO: 1793676 - RNA, 20 nt, Homo sapiens
augucaacagagcaaggaga

SEQ ID NO: 1793677 - RNA, 13 nt, Homo sapiens
aaagccuugugua

SEQ ID NO: 1793678 - RNA, 23 nt, Homo sapiens
cuuauccauaggcgcaggugcac

SEQ ID NO: 1793679 - RNA, 14 nt, Homo sapiens
ucacugaagugauu

SEQ ID NO: 1793680 - RNA, 20 nt, Homo sapiens
uuggggggaauucucagugc

SEQ ID NO: 1793681 - RNA, 19 nt, Homo sapiens
aucuucauaauauucccag

SEQ ID NO: 1793682 - RNA, 18 nt, Homo sapiens
auagugaugaugaucuca

SEQ ID NO: 1793683 - RNA, 20 nt, Homo sapiens
cugaaucaagcacacuguau

SEQ ID NO: 1793684 - RNA, 15 nt, Homo sapiens
gugugaccugacacc

SEQ ID NO: 1793685 - RNA, 17 nt, Homo sapiens
cuuguuuucuacuuugc

SEQ ID NO: 1793686 - RNA, 23 nt, Homo sapiens
cacagccgcagccucccucugac

SEQ ID NO: 1793687 - RNA, 11 nt, Homo sapiens
gcuaguguuua

SEQ ID NO: 1793688 - RNA, 16 nt, Homo sapiens
ccacagggccuugaau

SEQ ID NO: 1793689 - RNA, 18 nt, Homo sapiens
ucuggcuguguugcccug

SEQ ID NO: 1793690 - RNA, 14 nt, Homo sapiens
caggccucccucaa

SEQ ID NO: 1793691 - RNA, 16 nt, Homo sapiens
gcuuuuccugauguuc

SEQ ID NO: 1793692 - RNA, 20 nt, Homo sapiens
uuccacucccuuugccagug

SEQ ID NO: 1793693 - RNA, 22 nt, Homo sapiens
gucuuuuaaugauacugucuaa

SEQ ID NO: 1793694 - RNA, 20 nt, Homo sapiens
gaaagcuaugaauguuacua

SEQ ID NO: 1793695 - RNA, 16 nt, Homo sapiens
cagcuguuagagucca

SEQ ID NO: 1793696 - RNA, 20 nt, Homo sapiens
uuucuacuuccccugggaug

SEQ ID NO: 1793697 - RNA, 14 nt, Homo sapiens
uguuaaaacuggga

SEQ ID NO: 1793698 - RNA, 20 nt, Homo sapiens
ucauaccuacaucagacaaa

SEQ ID NO: 1793699 - RNA, 11 nt, Homo sapiens
cuucagggugg

SEQ ID NO: 1793700 - RNA, 21 nt, Homo sapiens
acuguccuguuuucuuaggca

SEQ ID NO: 1793701 - RNA, 20 nt, Homo sapiens
uugcucaacagaacauaugu

SEQ ID NO: 1793702 - RNA, 15 nt, Homo sapiens
cugcuugugcacugg

SEQ ID NO: 1793703 - RNA, 21 nt, Homo sapiens
aguuaaauagaguauaugcac

SEQ ID NO: 1793704 - RNA, 15 nt, Homo sapiens
accacagucagugga

SEQ ID NO: 1793705 - RNA, 15 nt, Homo sapiens
gagcacgauguggaa

SEQ ID NO: 1793706 - RNA, 13 nt, Homo sapiens
uaaaaaaauucca

SEQ ID NO: 1793707 - RNA, 19 nt, Homo sapiens
ugcugauuauuuaugaccu

SEQ ID NO: 1793708 - RNA, 14 nt, Homo sapiens
acuuuagcuuuuac

SEQ ID NO: 1793709 - RNA, 13 nt, Homo sapiens
ucaccacaccacu

SEQ ID NO: 1793710 - RNA, 18 nt, Homo sapiens
ccuagcucucccagugaa

SEQ ID NO: 1793711 - RNA, 21 nt, Homo sapiens
gcccaaauccccucccuguga

SEQ ID NO: 1793712 - RNA, 13 nt, Homo sapiens
caccgcgugccau

SEQ ID NO: 1793713 - RNA, 18 nt, Homo sapiens
aauacuucauuaauuuca

SEQ ID NO: 1793714 - RNA, 18 nt, Homo sapiens
auacauaagcagcauuuc

SEQ ID NO: 1793715 - RNA, 14 nt, Homo sapiens
cuauagcuuuuccc

SEQ ID NO: 1793716 - RNA, 21 nt, Homo sapiens
uucuacuuuaagguuugcaga

SEQ ID NO: 1793717 - RNA, 20 nt, Homo sapiens
cuccauacugggcuaaggaa

SEQ ID NO: 1793718 - RNA, 19 nt, Homo sapiens
acauucacugagugccuac

SEQ ID NO: 1793719 - RNA, 20 nt, Homo sapiens
gugaauuuuaaaaugcaaau

SEQ ID NO: 1793720 - RNA, 18 nt, Homo sapiens
ugaauuuccucaucccuc

SEQ ID NO: 1793721 - RNA, 17 nt, Homo sapiens
ucucaugccagugccuu

SEQ ID NO: 1793722 - RNA, 23 nt, Homo sapiens
uuugcauuaauaauccuuccagg

SEQ ID NO: 1793723 - RNA, 20 nt, Homo sapiens
cgucucuacuaaaaauacaa

SEQ ID NO: 1793724 - RNA, 13 nt, Homo sapiens
acuaaaucccucc

SEQ ID NO: 1793725 - RNA, 19 nt, Homo sapiens
gagacuccgucucaaaaaa

SEQ ID NO: 1793726 - RNA, 14 nt, Homo sapiens
auguaaauacaaau

SEQ ID NO: 1793727 - RNA, 18 nt, Homo sapiens
uaauuuaucagauugcuu

SEQ ID NO: 1793728 - RNA, 16 nt, Homo sapiens
guuaagagcucacccc

SEQ ID NO: 1793729 - RNA, 17 nt, Homo sapiens
ccaggguagaggcugac

SEQ ID NO: 1793730 - RNA, 20 nt, Homo sapiens
agccaaaaucccaccacugc

SEQ ID NO: 1793731 - RNA, 21 nt, Homo sapiens
auuauuucaaccgcuugccau

SEQ ID NO: 1793732 - RNA, 18 nt, Homo sapiens
uggucugagcugucccaa

SEQ ID NO: 1793733 - RNA, 14 nt, Homo sapiens
cagccacauuucag

SEQ ID NO: 1793734 - RNA, 20 nt, Homo sapiens
caaauaguucugaacauuuu

SEQ ID NO: 1793735 - RNA, 17 nt, Homo sapiens
uacuuuaaaguagugau

SEQ ID NO: 1793736 - RNA, 23 nt, Homo sapiens
cuccauaccugccccugccugac

SEQ ID NO: 1793737 - RNA, 19 nt, Homo sapiens
cccagugacaacaucgcaa

SEQ ID NO: 1793738 - RNA, 18 nt, Homo sapiens
ucguuucacaucuguaua

SEQ ID NO: 1793739 - RNA, 17 nt, Homo sapiens
aguaucacgauuugcag

SEQ ID NO: 1793740 - RNA, 17 nt, Homo sapiens
agauggaauaaagcccu

SEQ ID NO: 1793741 - RNA, 19 nt, Homo sapiens
auucuuguauauuauggaa

SEQ ID NO: 1793742 - RNA, 22 nt, Homo sapiens
uaaagguuuuuaaauuguuuca

SEQ ID NO: 1793743 - RNA, 15 nt, Homo sapiens
ucaucuuucuuccaa

SEQ ID NO: 1793744 - RNA, 12 nt, Homo sapiens
auuucuaugcag

SEQ ID NO: 1793745 - RNA, 13 nt, Homo sapiens
ucugguguugacu

SEQ ID NO: 1793746 - RNA, 20 nt, Homo sapiens
agggggagcccuggugcuac

SEQ ID NO: 1793747 - RNA, 22 nt, Homo sapiens
uaggcuguguauuucuuuucag

SEQ ID NO: 1793748 - RNA, 16 nt, Homo sapiens
cccugcccauacugag

SEQ ID NO: 1793749 - RNA, 12 nt, Homo sapiens
agccuccaacac

SEQ ID NO: 1793750 - RNA, 14 nt, Homo sapiens
aaaauuacuaauaa

SEQ ID NO: 1793751 - RNA, 23 nt, Homo sapiens
gggcagccccaccucacagccag

SEQ ID NO: 1793752 - RNA, 19 nt, Homo sapiens
gaagagaaaccauccucuc

SEQ ID NO: 1793753 - RNA, 19 nt, Homo sapiens
ggaagcggagcuugcagug

SEQ ID NO: 1793754 - RNA, 19 nt, Homo sapiens
uaggcgcuggggcucagcu

SEQ ID NO: 1793755 - RNA, 16 nt, Homo sapiens
caaaguccagauacca

SEQ ID NO: 1793756 - RNA, 20 nt, Homo sapiens
gaaggaguuaauauuucuaa

SEQ ID NO: 1793757 - RNA, 17 nt, Homo sapiens
aauugcucaaugcauga

SEQ ID NO: 1793758 - RNA, 18 nt, Homo sapiens
auguaaaccuaagcacgu

SEQ ID NO: 1793759 - RNA, 22 nt, Homo sapiens
accucccccaagcagagcuucc

SEQ ID NO: 1793760 - RNA, 14 nt, Homo sapiens
cuuuauugcaaugc

SEQ ID NO: 1793761 - RNA, 15 nt, Homo sapiens
acuauguaacaugua

SEQ ID NO: 1793762 - RNA, 15 nt, Homo sapiens
cuagccuaagugugg

SEQ ID NO: 1793763 - RNA, 18 nt, Homo sapiens
gggcaccagcucaugcca

SEQ ID NO: 1793764 - RNA, 17 nt, Homo sapiens
auggaaaguuguaucca

SEQ ID NO: 1793765 - RNA, 15 nt, Homo sapiens
agccguauuuuacau

SEQ ID NO: 1793766 - RNA, 13 nt, Homo sapiens
auuuauuuuacac

SEQ ID NO: 1793767 - RNA, 16 nt, Homo sapiens
ucgcguucccaaagau

SEQ ID NO: 1793768 - RNA, 15 nt, Homo sapiens
caucuuuucuacuuc

SEQ ID NO: 1793769 - RNA, 18 nt, Homo sapiens
gcuuccaugauguuacau

SEQ ID NO: 1793770 - RNA, 20 nt, Homo sapiens
uuggaccgauaagugugcuu

SEQ ID NO: 1793771 - RNA, 13 nt, Homo sapiens
cucagugaucuca

SEQ ID NO: 1793772 - RNA, 13 nt, Homo sapiens
aaggccucacuca

SEQ ID NO: 1793773 - RNA, 17 nt, Homo sapiens
gaaggugaggucuggga

SEQ ID NO: 1793774 - RNA, 15 nt, Homo sapiens
cacaugcagucucag

SEQ ID NO: 1793775 - RNA, 20 nt, Homo sapiens
acuucuguguugugauuccc

SEQ ID NO: 1793776 - RNA, 16 nt, Homo sapiens
augcaagucugugagu

SEQ ID NO: 1793777 - RNA, 20 nt, Homo sapiens
ucacaauaauauauccacau

SEQ ID NO: 1793778 - RNA, 19 nt, Homo sapiens
uauaugguuuuuccagcua

SEQ ID NO: 1793779 - RNA, 14 nt, Homo sapiens
ugaggucucagccc

SEQ ID NO: 1793780 - RNA, 12 nt, Homo sapiens
cggaaguuuuca

SEQ ID NO: 1793781 - RNA, 22 nt, Homo sapiens
cugggauuaaggcgugagccac

SEQ ID NO: 1793782 - RNA, 15 nt, Homo sapiens
ucucuacgcaaaaaa

SEQ ID NO: 1793783 - RNA, 16 nt, Homo sapiens
aauuuauucacauaua

SEQ ID NO: 1793784 - RNA, 12 nt, Homo sapiens
ugccccaccugc

SEQ ID NO: 1793785 - RNA, 12 nt, Homo sapiens
cucgccacuggg

SEQ ID NO: 1793786 - RNA, 17 nt, Homo sapiens
ccaaauuagugaaccaa

SEQ ID NO: 1793787 - RNA, 12 nt, Homo sapiens
gaggaaucugaa

SEQ ID NO: 1793788 - RNA, 18 nt, Homo sapiens
agcuuuggugcaucucau

SEQ ID NO: 1793789 - RNA, 13 nt, Homo sapiens
aaaguuauugaua

SEQ ID NO: 1793790 - RNA, 13 nt, Homo sapiens
uagguuauaggua

SEQ ID NO: 1793791 - RNA, 13 nt, Homo sapiens
acguuugccaaau

SEQ ID NO: 1793792 - RNA, 15 nt, Homo sapiens
gccauguccaaagag

SEQ ID NO: 1793793 - RNA, 17 nt, Homo sapiens
uccucugugcaaaggga

SEQ ID NO: 1793794 - RNA, 20 nt, Homo sapiens
ugugccaccgccuucccuga

SEQ ID NO: 1793795 - RNA, 11 nt, Homo sapiens
uccugugacug

SEQ ID NO: 1793796 - RNA, 16 nt, Homo sapiens
cuugccucucucagga

SEQ ID NO: 1793797 - RNA, 16 nt, Homo sapiens
aggugacccugaugaa

SEQ ID NO: 1793798 - RNA, 14 nt, Homo sapiens
gauacugcugccaa

SEQ ID NO: 1793799 - RNA, 13 nt, Homo sapiens
cuacuaucacuga

SEQ ID NO: 1793800 - RNA, 20 nt, Homo sapiens
auaaaaauaaaucaguucau

SEQ ID NO: 1793801 - RNA, 22 nt, Homo sapiens
uuuucuuuuaagcuauccacag

SEQ ID NO: 1793802 - RNA, 20 nt, Homo sapiens
ugaauauaggaagcauaugc

SEQ ID NO: 1793803 - RNA, 14 nt, Homo sapiens
ucaagaacaggaca

SEQ ID NO: 1793804 - RNA, 21 nt, Homo sapiens
aaauaaaacagcagcagcaaa

SEQ ID NO: 1793805 - RNA, 13 nt, Homo sapiens
cucauaucaaucc

SEQ ID NO: 1793806 - RNA, 22 nt, Homo sapiens
acaaacaugggugguaacaaga

SEQ ID NO: 1793807 - RNA, 17 nt, Homo sapiens
ugcugccggcacagcug

SEQ ID NO: 1793808 - RNA, 22 nt, Homo sapiens
uaaaagcaauucugacugucca

SEQ ID NO: 1793809 - RNA, 23 nt, Homo sapiens
uacggagccaugucaugugccac

SEQ ID NO: 1793810 - RNA, 17 nt, Homo sapiens
ccuguucugaacugugg

SEQ ID NO: 1793811 - RNA, 13 nt, Homo sapiens
ucaccagaucuga

SEQ ID NO: 1793812 - RNA, 13 nt, Homo sapiens
ggaucugggcaaa

SEQ ID NO: 1793813 - RNA, 13 nt, Homo sapiens
accauucaaauga

SEQ ID NO: 1793814 - RNA, 22 nt, Homo sapiens
cugaggcccgaucuccacuguu

SEQ ID NO: 1793815 - RNA, 14 nt, Homo sapiens
cuggauguauguaa

SEQ ID NO: 1793816 - RNA, 17 nt, Homo sapiens
uuaguuugcuuuaguca

SEQ ID NO: 1793817 - RNA, 13 nt, Homo sapiens
gauauugucuuca

SEQ ID NO: 1793818 - RNA, 20 nt, Homo sapiens
ccuucaauuuguagacucuu

SEQ ID NO: 1793819 - RNA, 15 nt, Homo sapiens
ucuaggacugcagug

SEQ ID NO: 1793820 - RNA, 15 nt, Homo sapiens
ugcgagacucugaug

SEQ ID NO: 1793821 - RNA, 22 nt, Homo sapiens
caaagugcugggauuacaggca

SEQ ID NO: 1793822 - RNA, 22 nt, Homo sapiens
aaccugaugagcaagaauuaua

SEQ ID NO: 1793823 - RNA, 14 nt, Homo sapiens
ucuugcauccaaac

SEQ ID NO: 1793824 - RNA, 15 nt, Homo sapiens
cuugaauauggaaca

SEQ ID NO: 1793825 - RNA, 21 nt, Homo sapiens
uccuagcgcagccaugugauu

SEQ ID NO: 1793826 - RNA, 18 nt, Homo sapiens
aucaaccuauuaaaauac

SEQ ID NO: 1793827 - RNA, 20 nt, Homo sapiens
gcucauugcaagcucaagug

SEQ ID NO: 1793828 - RNA, 21 nt, Homo sapiens
caguguuucauauucaugcaa

SEQ ID NO: 1793829 - RNA, 14 nt, Homo sapiens
auuaccaaaacaag

SEQ ID NO: 1793830 - RNA, 15 nt, Homo sapiens
agguuucuccuugaa

SEQ ID NO: 1793831 - RNA, 19 nt, Homo sapiens
ucucuuuuaggaggcacaa

SEQ ID NO: 1793832 - RNA, 15 nt, Homo sapiens
augacugaagggaaa

SEQ ID NO: 1793833 - RNA, 16 nt, Homo sapiens
caguggugugaucucg

SEQ ID NO: 1793834 - RNA, 20 nt, Homo sapiens
agcccgcaucagcugcucag

SEQ ID NO: 1793835 - RNA, 19 nt, Homo sapiens
auauacuugguucucucca

SEQ ID NO: 1793836 - RNA, 17 nt, Homo sapiens
ugggugagcucuuccag

SEQ ID NO: 1793837 - RNA, 23 nt, Homo sapiens
cuuucuaucgugacucaauucaa

SEQ ID NO: 1793838 - RNA, 22 nt, Homo sapiens
ugauauaucaaacugaaacaaa

SEQ ID NO: 1793839 - RNA, 17 nt, Homo sapiens
auauucauuuccacucu

SEQ ID NO: 1793840 - RNA, 19 nt, Homo sapiens
gacaauaaauuugaugaau

SEQ ID NO: 1793841 - RNA, 14 nt, Homo sapiens
aaugaauuuaucuu

SEQ ID NO: 1793842 - RNA, 21 nt, Homo sapiens
cuggcugcgcucggccugcuc

SEQ ID NO: 1793843 - RNA, 22 nt, Homo sapiens
caugucuuaccagugacgcugc

SEQ ID NO: 1793844 - RNA, 20 nt, Homo sapiens
agcccuuuuuguacugauau

SEQ ID NO: 1793845 - RNA, 16 nt, Homo sapiens
aaugacuuacuuuccu

SEQ ID NO: 1793846 - RNA, 20 nt, Homo sapiens
aaaccugccccuuggcugcu

SEQ ID NO: 1793847 - RNA, 20 nt, Homo sapiens
aauauugaaguuguuuauca

SEQ ID NO: 1793848 - RNA, 16 nt, Homo sapiens
gcauuguuucuguggg

SEQ ID NO: 1793849 - RNA, 17 nt, Homo sapiens
cuucucccccccggggc

SEQ ID NO: 1793850 - RNA, 14 nt, Homo sapiens
auucuaauuugcau

SEQ ID NO: 1793851 - RNA, 22 nt, Homo sapiens
ccugcuacaguagcugugggga

SEQ ID NO: 1793852 - RNA, 18 nt, Homo sapiens
uuuaaaauaaacuguaaa

SEQ ID NO: 1793853 - RNA, 15 nt, Homo sapiens
uaguauaauugaccu

SEQ ID NO: 1793854 - RNA, 15 nt, Homo sapiens
gugcagaucuuugaa

SEQ ID NO: 1793855 - RNA, 14 nt, Homo sapiens
uguuccuguuacaa

SEQ ID NO: 1793856 - RNA, 15 nt, Homo sapiens
cugacagcagcaucu

SEQ ID NO: 1793857 - RNA, 13 nt, Homo sapiens
uuccacucaaaau

SEQ ID NO: 1793858 - RNA, 16 nt, Homo sapiens
caauacaaagaugacu

SEQ ID NO: 1793859 - RNA, 21 nt, Homo sapiens
guuaauauaauuuaacagaag

SEQ ID NO: 1793860 - RNA, 15 nt, Homo sapiens
uguucuuuugcaaua

SEQ ID NO: 1793861 - RNA, 20 nt, Homo sapiens
gagacagaguuucaccaugu

SEQ ID NO: 1793862 - RNA, 21 nt, Homo sapiens
aagaaagcuguaauauauagu

SEQ ID NO: 1793863 - RNA, 19 nt, Homo sapiens
cauucaguuguuuugcaua

SEQ ID NO: 1793864 - RNA, 22 nt, Homo sapiens
agaucuucaaaaguaaugccuc

SEQ ID NO: 1793865 - RNA, 12 nt, Homo sapiens
auguccauacua

SEQ ID NO: 1793866 - RNA, 18 nt, Homo sapiens
ugcuuccucccaacaagc

SEQ ID NO: 1793867 - RNA, 22 nt, Homo sapiens
acgccucuucccacaccuguca

SEQ ID NO: 1793868 - RNA, 21 nt, Homo sapiens
ggcacugaauuaaucaucuau

SEQ ID NO: 1793869 - RNA, 21 nt, Homo sapiens
uguucucauuugaucagggga

SEQ ID NO: 1793870 - RNA, 19 nt, Homo sapiens
ccuggucaacauggugaaa

SEQ ID NO: 1793871 - RNA, 20 nt, Homo sapiens
accacuguggaagucccuca

SEQ ID NO: 1793872 - RNA, 13 nt, Homo sapiens
gcucgucauacag

SEQ ID NO: 1793873 - RNA, 13 nt, Homo sapiens
gccaagagucacu

SEQ ID NO: 1793874 - RNA, 22 nt, Homo sapiens
gcaucauuccccgacacugcca

SEQ ID NO: 1793875 - RNA, 18 nt, Homo sapiens
gaaaaauauuccaagcuu

SEQ ID NO: 1793876 - RNA, 14 nt, Homo sapiens
ucaaggccuuccaa

SEQ ID NO: 1793877 - RNA, 15 nt, Homo sapiens
guuuacagcacuacu

SEQ ID NO: 1793878 - RNA, 15 nt, Homo sapiens
auuucauccuugaau

SEQ ID NO: 1793879 - RNA, 14 nt, Homo sapiens
gaccaaugccuuaa

SEQ ID NO: 1793880 - RNA, 21 nt, Homo sapiens
guccugggggcugcugcacug

SEQ ID NO: 1793881 - RNA, 20 nt, Homo sapiens
aggcgugguggcgggugccu

SEQ ID NO: 1793882 - RNA, 20 nt, Homo sapiens
aaaaggacucugcuucaguc

SEQ ID NO: 1793883 - RNA, 13 nt, Homo sapiens
aggagaguguuua

SEQ ID NO: 1793884 - RNA, 20 nt, Homo sapiens
cuauauuuauuugacucagc

SEQ ID NO: 1793885 - RNA, 19 nt, Homo sapiens
guguuuuuuccccauugua

SEQ ID NO: 1793886 - RNA, 17 nt, Homo sapiens
cuccuucuccauaaagc

SEQ ID NO: 1793887 - RNA, 14 nt, Homo sapiens
ucgcauccagacag

SEQ ID NO: 1793888 - RNA, 11 nt, Homo sapiens
gcccaauccau

SEQ ID NO: 1793889 - RNA, 22 nt, Homo sapiens
agccacccaggccacugaccuc

SEQ ID NO: 1793890 - RNA, 11 nt, Homo sapiens
aagccagugaa

SEQ ID NO: 1793891 - RNA, 17 nt, Homo sapiens
uuugcuaugugcuccua

SEQ ID NO: 1793892 - RNA, 17 nt, Homo sapiens
aaugcucccaccugaau

SEQ ID NO: 1793893 - RNA, 17 nt, Homo sapiens
ugacaguaguaccaaau

SEQ ID NO: 1793894 - RNA, 23 nt, Homo sapiens
cccagcuucaaaugcaaauucau

SEQ ID NO: 1793895 - RNA, 23 nt, Homo sapiens
auacuauuuaauuauuucacuuu

SEQ ID NO: 1793896 - RNA, 22 nt, Homo sapiens
cuguauauaaaucuucaaagcu

SEQ ID NO: 1793897 - RNA, 12 nt, Homo sapiens
guaaauugccau

SEQ ID NO: 1793898 - RNA, 15 nt, Homo sapiens
aagaugugauuuauu

SEQ ID NO: 1793899 - RNA, 14 nt, Homo sapiens
ccuuucuuugccuc

SEQ ID NO: 1793900 - RNA, 20 nt, Homo sapiens
ucuccauaaaaguccuguca

SEQ ID NO: 1793901 - RNA, 16 nt, Homo sapiens
gcagaugagguugcua

SEQ ID NO: 1793902 - RNA, 23 nt, Homo sapiens
cauuucuagagagccccugacaa

SEQ ID NO: 1793903 - RNA, 17 nt, Homo sapiens
uaccuuaucauguggcu

SEQ ID NO: 1793904 - RNA, 19 nt, Homo sapiens
uaguccgcuuucucuugcu

SEQ ID NO: 1793905 - RNA, 22 nt, Homo sapiens
aguacucagcagcccucauaua

SEQ ID NO: 1793906 - RNA, 18 nt, Homo sapiens
aaggaaauagacuuugua

SEQ ID NO: 1793907 - RNA, 11 nt, Homo sapiens
cuaaacuacaa

SEQ ID NO: 1793908 - RNA, 17 nt, Homo sapiens
gcguaguccgcuuucuc

SEQ ID NO: 1793909 - RNA, 13 nt, Homo sapiens
cuacaacuuuaaa

SEQ ID NO: 1793910 - RNA, 13 nt, Homo sapiens
cuuauacuuuucu

SEQ ID NO: 1793911 - RNA, 20 nt, Homo sapiens
ccuggccaacauggcaaaac

SEQ ID NO: 1793912 - RNA, 22 nt, Homo sapiens
ucuucauuuauuuugacuguga

SEQ ID NO: 1793913 - RNA, 14 nt, Homo sapiens
cagacaugauaugc

SEQ ID NO: 1793914 - RNA, 13 nt, Homo sapiens
acacccuaauaag

SEQ ID NO: 1793915 - RNA, 19 nt, Homo sapiens
auugucagaguucugcucu

SEQ ID NO: 1793916 - RNA, 12 nt, Homo sapiens
aucacugugaaa

SEQ ID NO: 1793917 - RNA, 21 nt, Homo sapiens
agcuccuuguuuuugccaaag

SEQ ID NO: 1793918 - RNA, 18 nt, Homo sapiens
ugcauacuguugauacaa

SEQ ID NO: 1793919 - RNA, 18 nt, Homo sapiens
caacauggcccuaccaga

SEQ ID NO: 1793920 - RNA, 13 nt, Homo sapiens
accuucagaagcu

SEQ ID NO: 1793921 - RNA, 17 nt, Homo sapiens
aauuaaaacucauuuag

SEQ ID NO: 1793922 - RNA, 21 nt, Homo sapiens
aggccauugggauauucugaa

SEQ ID NO: 1793923 - RNA, 18 nt, Homo sapiens
cugugacuuaagaagccu

SEQ ID NO: 1793924 - RNA, 20 nt, Homo sapiens
aaacauugaaauauuaguua

SEQ ID NO: 1793925 - RNA, 23 nt, Homo sapiens
guauaguguucacaaacugugaa

SEQ ID NO: 1793926 - RNA, 17 nt, Homo sapiens
auuguaacagacauugu

SEQ ID NO: 1793927 - RNA, 15 nt, Homo sapiens
ucaaauaucucacca

SEQ ID NO: 1793928 - RNA, 14 nt, Homo sapiens
auguagcccugggu

SEQ ID NO: 1793929 - RNA, 23 nt, Homo sapiens
uguaaaacuuuggugcauuguua

SEQ ID NO: 1793930 - RNA, 15 nt, Homo sapiens
gagcacagcagggga

SEQ ID NO: 1793931 - RNA, 12 nt, Homo sapiens
ugugccaugccc

SEQ ID NO: 1793932 - RNA, 21 nt, Homo sapiens
ucuaaaaggggaggagcccuc

SEQ ID NO: 1793933 - RNA, 18 nt, Homo sapiens
acaucugugucucuggaa

SEQ ID NO: 1793934 - RNA, 19 nt, Homo sapiens
gaagacuauauuguacaca

SEQ ID NO: 1793935 - RNA, 19 nt, Homo sapiens
augcaccugcaaucccagc

SEQ ID NO: 1793936 - RNA, 17 nt, Homo sapiens
gccccuguccccagucc

SEQ ID NO: 1793937 - RNA, 23 nt, Homo sapiens
ucauaaacugagccucuuuucaa

SEQ ID NO: 1793938 - RNA, 14 nt, Homo sapiens
aguuacuuaccugc

SEQ ID NO: 1793939 - RNA, 19 nt, Homo sapiens
ccaacaagugcucuuucca

SEQ ID NO: 1793940 - RNA, 18 nt, Homo sapiens
uucuugcacuauuccaca

SEQ ID NO: 1793941 - RNA, 16 nt, Homo sapiens
aagcagcaacuugcaa

SEQ ID NO: 1793942 - RNA, 22 nt, Homo sapiens
ucucaccuucgccuuugcugaa

SEQ ID NO: 1793943 - RNA, 17 nt, Homo sapiens
auagcuaauuuuugcaa

SEQ ID NO: 1793944 - RNA, 15 nt, Homo sapiens
gaucuguaacagggu

SEQ ID NO: 1793945 - RNA, 22 nt, Homo sapiens
ucucuauauucggaauguaacu

SEQ ID NO: 1793946 - RNA, 13 nt, Homo sapiens
accuguacacacu

SEQ ID NO: 1793947 - RNA, 19 nt, Homo sapiens
uucuaaauaaggugugaaa

SEQ ID NO: 1793948 - RNA, 15 nt, Homo sapiens
ccauaaagacaauca

SEQ ID NO: 1793949 - RNA, 16 nt, Homo sapiens
cuucacugaauaucau

SEQ ID NO: 1793950 - RNA, 19 nt, Homo sapiens
cccauaggcccacacacag

SEQ ID NO: 1793951 - RNA, 19 nt, Homo sapiens
aaagauucucaucacucaa

SEQ ID NO: 1793952 - RNA, 23 nt, Homo sapiens
aucaauguucacgcaacuugaaa

SEQ ID NO: 1793953 - RNA, 23 nt, Homo sapiens
cuggucuucgcagccuagauaug

SEQ ID NO: 1793954 - RNA, 18 nt, Homo sapiens
auucuaggaaaucagaag

SEQ ID NO: 1793955 - RNA, 18 nt, Homo sapiens
cuuuuaugcaaccauaag

SEQ ID NO: 1793956 - RNA, 14 nt, Homo sapiens
aaagacuauugcaa

SEQ ID NO: 1793957 - RNA, 22 nt, Homo sapiens
uucuccugugaauggaggcaga

SEQ ID NO: 1793958 - RNA, 23 nt, Homo sapiens
ggaagucaucucauuccacuguu

SEQ ID NO: 1793959 - RNA, 9 nt, Homo sapiens
ggugucaau

SEQ ID NO: 1793960 - RNA, 20 nt, Homo sapiens
ugucuuuacuaaacagauuu

SEQ ID NO: 1793961 - RNA, 20 nt, Homo sapiens
uagaauauccuacuucucca

SEQ ID NO: 1793962 - RNA, 21 nt, Homo sapiens
uuuuaaagaaaaugugucugc

SEQ ID NO: 1793963 - RNA, 20 nt, Homo sapiens
gggaccuggccccaggcugu

SEQ ID NO: 1793964 - RNA, 19 nt, Homo sapiens
gaaacuguagucucaggac

SEQ ID NO: 1793965 - RNA, 19 nt, Homo sapiens
uuaaggucuaaucagugau

SEQ ID NO: 1793966 - RNA, 22 nt, Homo sapiens
gggacuuuaccugcugggaccu

SEQ ID NO: 1793967 - RNA, 18 nt, Homo sapiens
aggacuuuggcaagugau

SEQ ID NO: 1793968 - RNA, 13 nt, Homo sapiens
gaccuuaaaugca

SEQ ID NO: 1793969 - RNA, 14 nt, Homo sapiens
cuuuaugugcaaaa

SEQ ID NO: 1793970 - RNA, 15 nt, Homo sapiens
caauaaaaaguucag

SEQ ID NO: 1793971 - RNA, 18 nt, Homo sapiens
aaugcugugguugauauu

SEQ ID NO: 1793972 - RNA, 19 nt, Homo sapiens
cccucuaggcucugccuuc

SEQ ID NO: 1793973 - RNA, 15 nt, Homo sapiens
aaaaguaagcccuug

SEQ ID NO: 1793974 - RNA, 18 nt, Homo sapiens
aaacagcuuucuggguaa

SEQ ID NO: 1793975 - RNA, 24 nt, Homo sapiens
uggggagguggcacuagggaucaa

SEQ ID NO: 1793976 - RNA, 18 nt, Homo sapiens
uugagccaguggugcuaa

SEQ ID NO: 1793977 - RNA, 14 nt, Homo sapiens
augcacgaucucag

SEQ ID NO: 1793978 - RNA, 19 nt, Homo sapiens
aggcggcacauuggcagug

SEQ ID NO: 1793979 - RNA, 19 nt, Homo sapiens
cuuaagcccagugcacuga

SEQ ID NO: 1793980 - RNA, 19 nt, Homo sapiens
cagccucagaggagcucua

SEQ ID NO: 1793981 - RNA, 17 nt, Homo sapiens
cuggaagacacuucaga

SEQ ID NO: 1793982 - RNA, 15 nt, Homo sapiens
auuauaaacagcagg

SEQ ID NO: 1793983 - RNA, 15 nt, Homo sapiens
agacagcggucccag

SEQ ID NO: 1793984 - RNA, 16 nt, Homo sapiens
uacuucauuaauuuca

SEQ ID NO: 1793985 - RNA, 22 nt, Homo sapiens
accucccaaauuugaguugcac

SEQ ID NO: 1793986 - RNA, 19 nt, Homo sapiens
acucaguaacagugcagua

SEQ ID NO: 1793987 - RNA, 14 nt, Homo sapiens
caaauuaucuucac

SEQ ID NO: 1793988 - RNA, 17 nt, Homo sapiens
cuaccuagaugcuccuu

SEQ ID NO: 1793989 - RNA, 17 nt, Homo sapiens
gaaauaugaagcacuuu

SEQ ID NO: 1793990 - RNA, 17 nt, Homo sapiens
acagagcuuucaaacac

SEQ ID NO: 1793991 - RNA, 15 nt, Homo sapiens
uaauuaugcaauuag

SEQ ID NO: 1793992 - RNA, 17 nt, Homo sapiens
acuuuggcugaacuaca

SEQ ID NO: 1793993 - RNA, 18 nt, Homo sapiens
auuguagauaacacugac

SEQ ID NO: 1793994 - RNA, 13 nt, Homo sapiens
uacauuagacaca

SEQ ID NO: 1793995 - RNA, 18 nt, Homo sapiens
uugaacacuagucugugu

SEQ ID NO: 1793996 - RNA, 14 nt, Homo sapiens
ucuccauuugcucu

SEQ ID NO: 1793997 - RNA, 22 nt, Homo sapiens
gaaaucuuugguggccaaagau

SEQ ID NO: 1793998 - RNA, 22 nt, Homo sapiens
uucgguacugagcagccacuac

SEQ ID NO: 1793999 - RNA, 14 nt, Homo sapiens
ucuuccucccugga

SEQ ID NO: 1794000 - RNA, 23 nt, Homo sapiens
aaaagcuucauucucacucugcu

SEQ ID NO: 1794001 - RNA, 17 nt, Homo sapiens
cacacguaagcacauuc

SEQ ID NO: 1794002 - RNA, 17 nt, Homo sapiens
agacuggcagccaggga

SEQ ID NO: 1794003 - RNA, 12 nt, Homo sapiens
augcaaccauaa

SEQ ID NO: 1794004 - RNA, 12 nt, Homo sapiens
ccggaagccaaa

SEQ ID NO: 1794005 - RNA, 13 nt, Homo sapiens
ccucaugucauuu

SEQ ID NO: 1794006 - RNA, 20 nt, Homo sapiens
acugcagccuugaacuccug

SEQ ID NO: 1794007 - RNA, 20 nt, Homo sapiens
augcaguccucaucuccagc

SEQ ID NO: 1794008 - RNA, 16 nt, Homo sapiens
aggacacugauccagu

SEQ ID NO: 1794009 - RNA, 22 nt, Homo sapiens
ccuugggcacaaacaagcacau

SEQ ID NO: 1794010 - RNA, 17 nt, Homo sapiens
aguuuaaacaaagggaa

SEQ ID NO: 1794011 - RNA, 17 nt, Homo sapiens
ugacagggaaaacugca

SEQ ID NO: 1794012 - RNA, 24 nt, Homo sapiens
agauugcgccacugcacuccaguc

SEQ ID NO: 1794013 - RNA, 15 nt, Homo sapiens
uggaugcgugugaac

SEQ ID NO: 1794014 - RNA, 15 nt, Homo sapiens
gagaaauggaugugu

SEQ ID NO: 1794015 - RNA, 17 nt, Homo sapiens
ccccaguccucaggcag

SEQ ID NO: 1794016 - RNA, 18 nt, Homo sapiens
aaauuuuaaaaaucuaag

SEQ ID NO: 1794017 - RNA, 16 nt, Homo sapiens
uguuagucaguauucu

SEQ ID NO: 1794018 - RNA, 15 nt, Homo sapiens
agaccugagaaccuu

SEQ ID NO: 1794019 - RNA, 23 nt, Homo sapiens
gagcucgcacggcgccaggugau

SEQ ID NO: 1794020 - RNA, 17 nt, Homo sapiens
gagcccgcagcccagac

SEQ ID NO: 1794021 - RNA, 17 nt, Homo sapiens
ucaaaauuuaaagccau

SEQ ID NO: 1794022 - RNA, 14 nt, Homo sapiens
uugacuuucuaauu

SEQ ID NO: 1794023 - RNA, 17 nt, Homo sapiens
acucauguucauucagc

SEQ ID NO: 1794024 - RNA, 17 nt, Homo sapiens
uggcugaccccaaagag

SEQ ID NO: 1794025 - RNA, 16 nt, Homo sapiens
aggaggcagagagggu

SEQ ID NO: 1794026 - RNA, 19 nt, Homo sapiens
cccaucguuacccauuucu

SEQ ID NO: 1794027 - RNA, 20 nt, Homo sapiens
auauugcuuccuguguaaca

SEQ ID NO: 1794028 - RNA, 16 nt, Homo sapiens
guaaaucagugcagua

SEQ ID NO: 1794029 - RNA, 23 nt, Homo sapiens
ggccagagccgaggcgggcgggg

SEQ ID NO: 1794030 - RNA, 18 nt, Homo sapiens
cuguaaccuuaucuaaga

SEQ ID NO: 1794031 - RNA, 15 nt, Homo sapiens
agacaggguggggcu

SEQ ID NO: 1794032 - RNA, 18 nt, Homo sapiens
uagcagguaguuagcuuc

SEQ ID NO: 1794033 - RNA, 20 nt, Homo sapiens
caauucauucucucugaaca

SEQ ID NO: 1794034 - RNA, 18 nt, Homo sapiens
ugaagcgaacaucuucau

SEQ ID NO: 1794035 - RNA, 15 nt, Homo sapiens
ucucucacugcauuu

SEQ ID NO: 1794036 - RNA, 18 nt, Homo sapiens
aucgacacuuacuccagu

SEQ ID NO: 1794037 - RNA, 20 nt, Homo sapiens
cuggagucaaaacacuugua

SEQ ID NO: 1794038 - RNA, 23 nt, Homo sapiens
gguggagcagcaaacuuggugaa

SEQ ID NO: 1794039 - RNA, 23 nt, Homo sapiens
gauucagcauuauuccuccagga

SEQ ID NO: 1794040 - RNA, 18 nt, Homo sapiens
gugcacacacacacacau

SEQ ID NO: 1794041 - RNA, 16 nt, Homo sapiens
ccuccuucccuguguc

SEQ ID NO: 1794042 - RNA, 14 nt, Homo sapiens
cccugucuugcuua

SEQ ID NO: 1794043 - RNA, 15 nt, Homo sapiens
gcuugguagcacuuu

SEQ ID NO: 1794044 - RNA, 13 nt, Homo sapiens
uuaaugucuucac

SEQ ID NO: 1794045 - RNA, 17 nt, Homo sapiens
agccauuucacucucaa

SEQ ID NO: 1794046 - RNA, 22 nt, Homo sapiens
accccaggacgcccucacugca

SEQ ID NO: 1794047 - RNA, 11 nt, Homo sapiens
gcacaaagggc

SEQ ID NO: 1794048 - RNA, 21 nt, Homo sapiens
uguguaauggagauugccuca

SEQ ID NO: 1794049 - RNA, 19 nt, Homo sapiens
ugaccucaagugaucugcc

SEQ ID NO: 1794050 - RNA, 23 nt, Homo sapiens
cauauaauggaagcaauaagcca

SEQ ID NO: 1794051 - RNA, 21 nt, Homo sapiens
agccaaacugucuuugucacc

SEQ ID NO: 1794052 - RNA, 18 nt, Homo sapiens
uuucauccaggccugcca

SEQ ID NO: 1794053 - RNA, 19 nt, Homo sapiens
uugcgccacugcacuccag

SEQ ID NO: 1794054 - RNA, 19 nt, Homo sapiens
uugugccacuguacuccag

SEQ ID NO: 1794055 - RNA, 14 nt, Homo sapiens
caccaucaccucuc

SEQ ID NO: 1794056 - RNA, 14 nt, Homo sapiens
gaccuucagcucac

SEQ ID NO: 1794057 - RNA, 19 nt, Homo sapiens
aaagcgagacuccaucuca

SEQ ID NO: 1794058 - RNA, 21 nt, Homo sapiens
ggccuccagaagcugcuccuu

SEQ ID NO: 1794059 - RNA, 20 nt, Homo sapiens
agucauuaacaagaaacagg

SEQ ID NO: 1794060 - RNA, 18 nt, Homo sapiens
gccacuggacugacgacu

SEQ ID NO: 1794061 - RNA, 20 nt, Homo sapiens
guagggaaucucauccauca

SEQ ID NO: 1794062 - RNA, 21 nt, Homo sapiens
ugaccugugauauuuuacuug

SEQ ID NO: 1794063 - RNA, 17 nt, Homo sapiens
accuguggagaagccua

SEQ ID NO: 1794064 - RNA, 14 nt, Homo sapiens
guacauagcuguuu

SEQ ID NO: 1794065 - RNA, 23 nt, Homo sapiens
cucaaaccgccggccacacuggu

SEQ ID NO: 1794066 - RNA, 12 nt, Homo sapiens
acgcaugcaggg

SEQ ID NO: 1794067 - RNA, 18 nt, Homo sapiens
ucugacugucaccucgug

SEQ ID NO: 1794068 - RNA, 23 nt, Homo sapiens
uauuuuacacguaucucuuggua

SEQ ID NO: 1794069 - RNA, 22 nt, Homo sapiens
uauuaauaaagcauucuuuaac

SEQ ID NO: 1794070 - RNA, 21 nt, Homo sapiens
aaagcaccucaagugcaagga

SEQ ID NO: 1794071 - RNA, 20 nt, Homo sapiens
auuuuucuuauuuagcccau

SEQ ID NO: 1794072 - RNA, 16 nt, Homo sapiens
gcauuuagucuugcca

SEQ ID NO: 1794073 - RNA, 12 nt, Homo sapiens
ucucacaaauga

SEQ ID NO: 1794074 - RNA, 16 nt, Homo sapiens
caacaauccuauggaa

SEQ ID NO: 1794075 - RNA, 19 nt, Homo sapiens
uccucugugaaacugggau

SEQ ID NO: 1794076 - RNA, 18 nt, Homo sapiens
caggcuggaccagacccc

SEQ ID NO: 1794077 - RNA, 14 nt, Homo sapiens
guuaucugagauag

SEQ ID NO: 1794078 - RNA, 21 nt, Homo sapiens
gcuccucuccccagcccagag

SEQ ID NO: 1794079 - RNA, 19 nt, Homo sapiens
agaaaucuuucucccucaa

SEQ ID NO: 1794080 - RNA, 18 nt, Homo sapiens
caucggaguugacaguga

SEQ ID NO: 1794081 - RNA, 17 nt, Homo sapiens
agaauauguugcuuuga

SEQ ID NO: 1794082 - RNA, 17 nt, Homo sapiens
cagugcacccacucugc

SEQ ID NO: 1794083 - RNA, 17 nt, Homo sapiens
gcccaagggcuccagac

SEQ ID NO: 1794084 - RNA, 16 nt, Homo sapiens
caugguuuugaaaugc

SEQ ID NO: 1794085 - RNA, 20 nt, Homo sapiens
aagcugggggugaaagggaa

SEQ ID NO: 1794086 - RNA, 16 nt, Homo sapiens
cguuugacuagccauc

SEQ ID NO: 1794087 - RNA, 21 nt, Homo sapiens
ucagauaaugcccagacauuu

SEQ ID NO: 1794088 - RNA, 18 nt, Homo sapiens
gcuucauuugugucaaug

SEQ ID NO: 1794089 - RNA, 21 nt, Homo sapiens
uccuaaacuguuuauuugcac

SEQ ID NO: 1794090 - RNA, 15 nt, Homo sapiens
caggucaaaaaccug

SEQ ID NO: 1794091 - RNA, 20 nt, Homo sapiens
cccagagcaucuugcaucca

SEQ ID NO: 1794092 - RNA, 14 nt, Homo sapiens
caaucuuacuuugu

SEQ ID NO: 1794093 - RNA, 20 nt, Homo sapiens
cacuaacuaaucacuuuccc

SEQ ID NO: 1794094 - RNA, 14 nt, Homo sapiens
cgcgcccuccccca

SEQ ID NO: 1794095 - RNA, 15 nt, Homo sapiens
uugucggguucuccc

SEQ ID NO: 1794096 - RNA, 20 nt, Homo sapiens
uccaaccugccugugcauga

SEQ ID NO: 1794097 - RNA, 21 nt, Homo sapiens
uaaagucaacaaccaugccag

SEQ ID NO: 1794098 - RNA, 14 nt, Homo sapiens
uggcugcaaggugg

SEQ ID NO: 1794099 - RNA, 13 nt, Homo sapiens
ccucugcccucau

SEQ ID NO: 1794100 - RNA, 14 nt, Homo sapiens
ucaguaccccaugg

SEQ ID NO: 1794101 - RNA, 17 nt, Homo sapiens
ugaucauuacauggcug

SEQ ID NO: 1794102 - RNA, 15 nt, Homo sapiens
gugcaguugugauuu

SEQ ID NO: 1794103 - RNA, 22 nt, Homo sapiens
agguauaagaaguccuaucuca

SEQ ID NO: 1794104 - RNA, 23 nt, Homo sapiens
cagaaacaaaaucaaaacagaga

SEQ ID NO: 1794105 - RNA, 20 nt, Homo sapiens
uaugcccugcagagcaauaa

SEQ ID NO: 1794106 - RNA, 21 nt, Homo sapiens
ccgucuuggcuuauccacuuu

SEQ ID NO: 1794107 - RNA, 18 nt, Homo sapiens
aaggggcccaaauucuuu

SEQ ID NO: 1794108 - RNA, 13 nt, Homo sapiens
cacaccaagugga

SEQ ID NO: 1794109 - RNA, 18 nt, Homo sapiens
uguucugcauggauucag

SEQ ID NO: 1794110 - RNA, 16 nt, Homo sapiens
aucucugcuuacuaau

SEQ ID NO: 1794111 - RNA, 12 nt, Homo sapiens
aaugcugcuaca

SEQ ID NO: 1794112 - RNA, 22 nt, Homo sapiens
cagugcauuuuguuucuguaua

SEQ ID NO: 1794113 - RNA, 16 nt, Homo sapiens
cugcuagucacuggaa

SEQ ID NO: 1794114 - RNA, 15 nt, Homo sapiens
ugucaaaccugcaaa

SEQ ID NO: 1794115 - RNA, 21 nt, Homo sapiens
gaaugguccgugcuaaggacu

SEQ ID NO: 1794116 - RNA, 21 nt, Homo sapiens
ugauucacaacuaggaccuca

SEQ ID NO: 1794117 - RNA, 19 nt, Homo sapiens
aacagugguggcaacauuc

SEQ ID NO: 1794118 - RNA, 16 nt, Homo sapiens
aguaaucauauaucaa

SEQ ID NO: 1794119 - RNA, 14 nt, Homo sapiens
aggagaagugggga

SEQ ID NO: 1794120 - RNA, 20 nt, Homo sapiens
gacccugagcagaauacugg

SEQ ID NO: 1794121 - RNA, 23 nt, Homo sapiens
aggucuccaccccucaagccagg

SEQ ID NO: 1794122 - RNA, 15 nt, Homo sapiens
auaaagcugugagca

SEQ ID NO: 1794123 - RNA, 14 nt, Homo sapiens
auucucagauuaaa

SEQ ID NO: 1794124 - RNA, 20 nt, Homo sapiens
uuacacacgugugauguaug

SEQ ID NO: 1794125 - RNA, 21 nt, Homo sapiens
acuuccucuucuucauugcag

SEQ ID NO: 1794126 - RNA, 19 nt, Homo sapiens
ugcuggacuugccuaaaau

SEQ ID NO: 1794127 - RNA, 23 nt, Homo sapiens
augggcagacugaaccaguccag

SEQ ID NO: 1794128 - RNA, 14 nt, Homo sapiens
guguuuugucagac

SEQ ID NO: 1794129 - RNA, 17 nt, Homo sapiens
ccuggggcgagcacugu

SEQ ID NO: 1794130 - RNA, 20 nt, Homo sapiens
aagagcuauuuuagaaagcu

SEQ ID NO: 1794131 - RNA, 15 nt, Homo sapiens
uuuaugcacuucaaa

SEQ ID NO: 1794132 - RNA, 14 nt, Homo sapiens
uggagggacuuuua

SEQ ID NO: 1794133 - RNA, 15 nt, Homo sapiens
caggcauuucauuua

SEQ ID NO: 1794134 - RNA, 14 nt, Homo sapiens
ggaguucacuucau

SEQ ID NO: 1794135 - RNA, 17 nt, Homo sapiens
ccuuuauuuugcuucca

SEQ ID NO: 1794136 - RNA, 16 nt, Homo sapiens
acaaagcacaguuuga

SEQ ID NO: 1794137 - RNA, 17 nt, Homo sapiens
acuacaggcucaugcca

SEQ ID NO: 1794138 - RNA, 15 nt, Homo sapiens
ugugacuagauauca

SEQ ID NO: 1794139 - RNA, 18 nt, Homo sapiens
gcuucauuuuugggagaa

SEQ ID NO: 1794140 - RNA, 16 nt, Homo sapiens
ugccugaucugcacau

SEQ ID NO: 1794141 - RNA, 12 nt, Homo sapiens
uaaaaaguugca

SEQ ID NO: 1794142 - RNA, 22 nt, Homo sapiens
acuucaguuuuauuuuugccaa

SEQ ID NO: 1794143 - RNA, 23 nt, Homo sapiens
gcuaaggaugguuuuaucuuccc

SEQ ID NO: 1794144 - RNA, 14 nt, Homo sapiens
cuccucgcugccag

SEQ ID NO: 1794145 - RNA, 18 nt, Homo sapiens
aucugugcuacacuggau

SEQ ID NO: 1794146 - RNA, 19 nt, Homo sapiens
cuacugaugguuacauaua

SEQ ID NO: 1794147 - RNA, 15 nt, Homo sapiens
ccaacccacuggccc

SEQ ID NO: 1794148 - RNA, 15 nt, Homo sapiens
cuaaaugaagugcaa

SEQ ID NO: 1794149 - RNA, 12 nt, Homo sapiens
ccggccugaugg

SEQ ID NO: 1794150 - RNA, 12 nt, Homo sapiens
uucucucuuguc

SEQ ID NO: 1794151 - RNA, 12 nt, Homo sapiens
uuuucucuugcc

SEQ ID NO: 1794152 - RNA, 13 nt, Homo sapiens
gaauuaagcacag

SEQ ID NO: 1794153 - RNA, 22 nt, Homo sapiens
gacaucaacauggcaauugcac

SEQ ID NO: 1794154 - RNA, 18 nt, Homo sapiens
aagcccaaucugcaagga

SEQ ID NO: 1794155 - RNA, 15 nt, Homo sapiens
auuuacugagagaag

SEQ ID NO: 1794156 - RNA, 19 nt, Homo sapiens
ggcacucuucccaccucag

SEQ ID NO: 1794157 - RNA, 14 nt, Homo sapiens
cucaugauauguca

SEQ ID NO: 1794158 - RNA, 18 nt, Homo sapiens
cccgaaaggucaccucac

SEQ ID NO: 1794159 - RNA, 12 nt, Homo sapiens
auauauuccaac

SEQ ID NO: 1794160 - RNA, 12 nt, Homo sapiens
auucauuccauu

SEQ ID NO: 1794161 - RNA, 13 nt, Homo sapiens
ugaggacauggag

SEQ ID NO: 1794162 - RNA, 13 nt, Homo sapiens
ggaggacagggag

SEQ ID NO: 1794163 - RNA, 20 nt, Homo sapiens
cacaaaagcagauacuugag

SEQ ID NO: 1794164 - RNA, 22 nt, Homo sapiens
auugaaagugggcaaaagcuua

SEQ ID NO: 1794165 - RNA, 21 nt, Homo sapiens
ucuacuuuccaggcuaguccg

SEQ ID NO: 1794166 - RNA, 14 nt, Homo sapiens
cuuuaggcuuucaa

SEQ ID NO: 1794167 - RNA, 15 nt, Homo sapiens
cagaucauauuucac

SEQ ID NO: 1794168 - RNA, 18 nt, Homo sapiens
aauuuaauuuugcaggau

SEQ ID NO: 1794169 - RNA, 22 nt, Homo sapiens
auguaaaacacaagacugucau

SEQ ID NO: 1794170 - RNA, 16 nt, Homo sapiens
gaccuguuuuaaauga

SEQ ID NO: 1794171 - RNA, 15 nt, Homo sapiens
cagaucuaugccaca

SEQ ID NO: 1794172 - RNA, 20 nt, Homo sapiens
cuucccacagcauuccucca

SEQ ID NO: 1794173 - RNA, 18 nt, Homo sapiens
guucaugaugcagucucc

SEQ ID NO: 1794174 - RNA, 15 nt, Homo sapiens
uaauugccacugaga

SEQ ID NO: 1794175 - RNA, 15 nt, Homo sapiens
cauuuaagaacugag

SEQ ID NO: 1794176 - RNA, 20 nt, Homo sapiens
agccuugcacacccacugcc

SEQ ID NO: 1794177 - RNA, 16 nt, Homo sapiens
accagcuugcgaauaa

SEQ ID NO: 1794178 - RNA, 19 nt, Homo sapiens
auucuuaccucauuugcau

SEQ ID NO: 1794179 - RNA, 22 nt, Homo sapiens
auugucauaucagcacauauuu

SEQ ID NO: 1794180 - RNA, 14 nt, Homo sapiens
cuuauuaugcauaa

SEQ ID NO: 1794181 - RNA, 14 nt, Homo sapiens
gagaaggaagccau

SEQ ID NO: 1794182 - RNA, 14 nt, Homo sapiens
gcauaauagucaau

SEQ ID NO: 1794183 - RNA, 11 nt, Homo sapiens
ugcucacuggu

SEQ ID NO: 1794184 - RNA, 16 nt, Homo sapiens
acagaaaauagcuuuu

SEQ ID NO: 1794185 - RNA, 21 nt, Homo sapiens
aagaaagacucuauucucaaa

SEQ ID NO: 1794186 - RNA, 22 nt, Homo sapiens
caguaugagucaaugugcagug

SEQ ID NO: 1794187 - RNA, 22 nt, Homo sapiens
caucaugaacuggcuuguacau

SEQ ID NO: 1794188 - RNA, 17 nt, Homo sapiens
ugggagagcaacuggac

SEQ ID NO: 1794189 - RNA, 14 nt, Homo sapiens
acguguuuaauuaa

SEQ ID NO: 1794190 - RNA, 12 nt, Homo sapiens
ugucucaggcac

SEQ ID NO: 1794191 - RNA, 19 nt, Homo sapiens
cagauauuaauaauuccaa

SEQ ID NO: 1794192 - RNA, 20 nt, Homo sapiens
guccccgaugcugaccucac

SEQ ID NO: 1794193 - RNA, 14 nt, Homo sapiens
auuaaugucauuuc

SEQ ID NO: 1794194 - RNA, 18 nt, Homo sapiens
ucagugaauaaaccauca

SEQ ID NO: 1794195 - RNA, 21 nt, Homo sapiens
uccuggagcaaucacagauga

SEQ ID NO: 1794196 - RNA, 14 nt, Homo sapiens
acacccuuccucaa

SEQ ID NO: 1794197 - RNA, 14 nt, Homo sapiens
ccacggcuggauac

SEQ ID NO: 1794198 - RNA, 19 nt, Homo sapiens
uaaaaaaugucucauguca

SEQ ID NO: 1794199 - RNA, 19 nt, Homo sapiens
aacagcaccaccauuuaau

SEQ ID NO: 1794200 - RNA, 20 nt, Homo sapiens
agugucuaauaaugcugaag

SEQ ID NO: 1794201 - RNA, 12 nt, Homo sapiens
uuaacacucauu

SEQ ID NO: 1794202 - RNA, 16 nt, Homo sapiens
aauuuguuguuccuuu

SEQ ID NO: 1794203 - RNA, 17 nt, Homo sapiens
aagggucauuagacaaa

SEQ ID NO: 1794204 - RNA, 17 nt, Homo sapiens
gacagcugccugggauc

SEQ ID NO: 1794205 - RNA, 12 nt, Homo sapiens
uguccagcagcc

SEQ ID NO: 1794206 - RNA, 20 nt, Homo sapiens
cacucuuauagaaaguucaa

SEQ ID NO: 1794207 - RNA, 16 nt, Homo sapiens
cagcuccaaccuggag

SEQ ID NO: 1794208 - RNA, 20 nt, Homo sapiens
agcaaaauuaaauacauaaa

SEQ ID NO: 1794209 - RNA, 22 nt, Homo sapiens
cagccccuuaagcaugcuucua

SEQ ID NO: 1794210 - RNA, 14 nt, Homo sapiens
augaugcaaccaaa

SEQ ID NO: 1794211 - RNA, 14 nt, Homo sapiens
accaaucagcacuc

SEQ ID NO: 1794212 - RNA, 17 nt, Homo sapiens
gcucauuuuuucuuaca

SEQ ID NO: 1794213 - RNA, 15 nt, Homo sapiens
cauuauacauuugau

SEQ ID NO: 1794214 - RNA, 19 nt, Homo sapiens
ccccugagaguuuccucag

SEQ ID NO: 1794215 - RNA, 22 nt, Homo sapiens
gcugcacccugcgccuccagag

SEQ ID NO: 1794216 - RNA, 21 nt, Homo sapiens
ugucacuacaaaaauacaauu

SEQ ID NO: 1794217 - RNA, 15 nt, Homo sapiens
aaacguuugacaaac

SEQ ID NO: 1794218 - RNA, 18 nt, Homo sapiens
ugagaccuggcagccaca

SEQ ID NO: 1794219 - RNA, 20 nt, Homo sapiens
cauugauuucuaaugauaua

SEQ ID NO: 1794220 - RNA, 21 nt, Homo sapiens
caaacuucccugacucuucaa

SEQ ID NO: 1794221 - RNA, 20 nt, Homo sapiens
ccugggaccucccccggcag

SEQ ID NO: 1794222 - RNA, 12 nt, Homo sapiens
ccugaugcagug

SEQ ID NO: 1794223 - RNA, 16 nt, Homo sapiens
gaacccauuugccaug

SEQ ID NO: 1794224 - RNA, 14 nt, Homo sapiens
cuaacacacuuuau

SEQ ID NO: 1794225 - RNA, 15 nt, Homo sapiens
cagccucaguggcca

SEQ ID NO: 1794226 - RNA, 22 nt, Homo sapiens
cgugagccucagccaccccuca

SEQ ID NO: 1794227 - RNA, 20 nt, Homo sapiens
cucucccaugcacacaaaca

SEQ ID NO: 1794228 - RNA, 21 nt, Homo sapiens
aggucaggacggcuccucaga

SEQ ID NO: 1794229 - RNA, 20 nt, Homo sapiens
cacaagaacaaauacacuuu

SEQ ID NO: 1794230 - RNA, 19 nt, Homo sapiens
ugcagcucucuuuccucug

SEQ ID NO: 1794231 - RNA, 18 nt, Homo sapiens
aaguaaaagcagcauaaa

SEQ ID NO: 1794232 - RNA, 13 nt, Homo sapiens
cuaguaagugccu

SEQ ID NO: 1794233 - RNA, 16 nt, Homo sapiens
uauucaguaaugaaga

SEQ ID NO: 1794234 - RNA, 18 nt, Homo sapiens
gucuucauccccucagaa

SEQ ID NO: 1794235 - RNA, 15 nt, Homo sapiens
uguagcauuucuuga

SEQ ID NO: 1794236 - RNA, 16 nt, Homo sapiens
acuguauuuagugauu

SEQ ID NO: 1794237 - RNA, 23 nt, Homo sapiens
gcaaaagcagugggcuccuggca

SEQ ID NO: 1794238 - RNA, 16 nt, Homo sapiens
cuaggaaauccauuca

SEQ ID NO: 1794239 - RNA, 17 nt, Homo sapiens
aauguuauauacaucuc

SEQ ID NO: 1794240 - RNA, 18 nt, Homo sapiens
uuaagcaaauaaacugua

SEQ ID NO: 1794241 - RNA, 21 nt, Homo sapiens
acuauguggcugaaaaugcaa

SEQ ID NO: 1794242 - RNA, 17 nt, Homo sapiens
gggacaacugcggugau

SEQ ID NO: 1794243 - RNA, 18 nt, Homo sapiens
agacagagccuuguucua

SEQ ID NO: 1794244 - RNA, 15 nt, Homo sapiens
uuacauuaacauuua

SEQ ID NO: 1794245 - RNA, 21 nt, Homo sapiens
uaaacagcacaccugugucca

SEQ ID NO: 1794246 - RNA, 22 nt, Homo sapiens
aagaugagaugguuucuagaga

SEQ ID NO: 1794247 - RNA, 20 nt, Homo sapiens
gucuuugaaauaugcaugua

SEQ ID NO: 1794248 - RNA, 13 nt, Homo sapiens
guuaauaaagaag

SEQ ID NO: 1794249 - RNA, 23 nt, Homo sapiens
ccuguuggggaccucaccugcug

SEQ ID NO: 1794250 - RNA, 19 nt, Homo sapiens
gguuaaaaaaaaaagucac

SEQ ID NO: 1794251 - RNA, 17 nt, Homo sapiens
aaaguuucucuuuucaa

SEQ ID NO: 1794252 - RNA, 11 nt, Homo sapiens
caacauacugu

SEQ ID NO: 1794253 - RNA, 23 nt, Homo sapiens
gucccacaccgcuggucccugcc

SEQ ID NO: 1794254 - RNA, 15 nt, Homo sapiens
cugucagucacagcc

SEQ ID NO: 1794255 - RNA, 18 nt, Homo sapiens
auacacccaaacacuuac

SEQ ID NO: 1794256 - RNA, 15 nt, Homo sapiens
gugacaugccaucca

SEQ ID NO: 1794257 - RNA, 16 nt, Homo sapiens
uugggauaggacugag

SEQ ID NO: 1794258 - RNA, 22 nt, Homo sapiens
gaaguugcccaccaaaacacag

SEQ ID NO: 1794259 - RNA, 21 nt, Homo sapiens
agucauugaaauuuacuguga

SEQ ID NO: 1794260 - RNA, 16 nt, Homo sapiens
aacgugcucaugggcu

SEQ ID NO: 1794261 - RNA, 12 nt, Homo sapiens
cuagacuuucug

SEQ ID NO: 1794262 - RNA, 23 nt, Homo sapiens
cagcauuguugagcugucaucaa

SEQ ID NO: 1794263 - RNA, 22 nt, Homo sapiens
uccuuucauaaagcaccagcag

SEQ ID NO: 1794264 - RNA, 22 nt, Homo sapiens
ggaaaauaggaagugaacccau

SEQ ID NO: 1794265 - RNA, 21 nt, Homo sapiens
uaaguauuucccagcacauga

SEQ ID NO: 1794266 - RNA, 18 nt, Homo sapiens
caccuucuaccaccaggg

SEQ ID NO: 1794267 - RNA, 18 nt, Homo sapiens
gaggugccuucuucaggg

SEQ ID NO: 1794268 - RNA, 12 nt, Homo sapiens
gcuaguguuucc

SEQ ID NO: 1794269 - RNA, 17 nt, Homo sapiens
cacuaggccugaaauga

SEQ ID NO: 1794270 - RNA, 16 nt, Homo sapiens
uggcaacaucuuggcu

SEQ ID NO: 1794271 - RNA, 16 nt, Homo sapiens
aagcuggaacauuuga

SEQ ID NO: 1794272 - RNA, 20 nt, Homo sapiens
uacugcacauuuuguacaaa

SEQ ID NO: 1794273 - RNA, 13 nt, Homo sapiens
gcuaaagccagga

SEQ ID NO: 1794274 - RNA, 12 nt, Homo sapiens
auuaaacaaaua

SEQ ID NO: 1794275 - RNA, 16 nt, Homo sapiens
acauugcuucauuaaa

SEQ ID NO: 1794276 - RNA, 23 nt, Homo sapiens
aguggggagagagcccuucccag

SEQ ID NO: 1794277 - RNA, 16 nt, Homo sapiens
uggauguaaagugugg

SEQ ID NO: 1794278 - RNA, 21 nt, Homo sapiens
uuugauuagaggaacuucuga

SEQ ID NO: 1794279 - RNA, 19 nt, Homo sapiens
aaaaauuuuaaguguucuc

SEQ ID NO: 1794280 - RNA, 16 nt, Homo sapiens
gcaggagaucaucuga

SEQ ID NO: 1794281 - RNA, 15 nt, Homo sapiens
uguuucugaaaggga

SEQ ID NO: 1794282 - RNA, 21 nt, Homo sapiens
agggaugaguccccugugaga

SEQ ID NO: 1794283 - RNA, 22 nt, Homo sapiens
cuccuccaggguggcagcaaca

SEQ ID NO: 1794284 - RNA, 18 nt, Homo sapiens
gaaauguuugcugaguga

SEQ ID NO: 1794285 - RNA, 15 nt, Homo sapiens
auguguaugauacua

SEQ ID NO: 1794286 - RNA, 19 nt, Homo sapiens
gaauccaauuaaugauuca

SEQ ID NO: 1794287 - RNA, 17 nt, Homo sapiens
uacucaggaaccucacc

SEQ ID NO: 1794288 - RNA, 18 nt, Homo sapiens
uagucucaccuacuccag

SEQ ID NO: 1794289 - RNA, 23 nt, Homo sapiens
aggcagggugcaguaucaugccc

SEQ ID NO: 1794290 - RNA, 12 nt, Homo sapiens
cccuauggugcu

SEQ ID NO: 1794291 - RNA, 19 nt, Homo sapiens
agcccacugccuggaaagc

SEQ ID NO: 1794292 - RNA, 13 nt, Homo sapiens
cccccacuacuaa

SEQ ID NO: 1794293 - RNA, 11 nt, Homo sapiens
auuacuggcaa

SEQ ID NO: 1794294 - RNA, 15 nt, Homo sapiens
agauguaacauuccu

SEQ ID NO: 1794295 - RNA, 22 nt, Homo sapiens
aaaauuuaaaaaguuagccagg

SEQ ID NO: 1794296 - RNA, 15 nt, Homo sapiens
cuagagaacacugug

SEQ ID NO: 1794297 - RNA, 16 nt, Homo sapiens
cucagagccagucuuu

SEQ ID NO: 1794298 - RNA, 21 nt, Homo sapiens
gguaccaggcccgcacugggg

SEQ ID NO: 1794299 - RNA, 14 nt, Homo sapiens
agcccuguguccug

SEQ ID NO: 1794300 - RNA, 16 nt, Homo sapiens
aagaauuuucagcaaa

SEQ ID NO: 1794301 - RNA, 14 nt, Homo sapiens
uaucagucucugag

SEQ ID NO: 1794302 - RNA, 14 nt, Homo sapiens
auguuaugcaaaaa

SEQ ID NO: 1794303 - RNA, 22 nt, Homo sapiens
ugggggugccgcuuucucugag

SEQ ID NO: 1794304 - RNA, 12 nt, Homo sapiens
auuaaaauaucc

SEQ ID NO: 1794305 - RNA, 19 nt, Homo sapiens
agggcauuguguucacugu

SEQ ID NO: 1794306 - RNA, 20 nt, Homo sapiens
gcuucuugccucugugcugu

SEQ ID NO: 1794307 - RNA, 13 nt, Homo sapiens
uaaguccuuccac

SEQ ID NO: 1794308 - RNA, 18 nt, Homo sapiens
gauagcuuggagggaugg

SEQ ID NO: 1794309 - RNA, 23 nt, Homo sapiens
acuaucucuagagugagaaucug

SEQ ID NO: 1794310 - RNA, 20 nt, Homo sapiens
aauguaaauuaaaauuucca

SEQ ID NO: 1794311 - RNA, 16 nt, Homo sapiens
aacauacaggugccuu

SEQ ID NO: 1794312 - RNA, 17 nt, Homo sapiens
aguccccuucuguguuu

SEQ ID NO: 1794313 - RNA, 23 nt, Homo sapiens
acucucaggaccacccugccaag

SEQ ID NO: 1794314 - RNA, 13 nt, Homo sapiens
aaaagaguuuaaa

SEQ ID NO: 1794315 - RNA, 18 nt, Homo sapiens
uccugagauucugggaaa

SEQ ID NO: 1794316 - RNA, 19 nt, Homo sapiens
agcuuuggaccuaauccaa

SEQ ID NO: 1794317 - RNA, 13 nt, Homo sapiens
uggcucuuucuau

SEQ ID NO: 1794318 - RNA, 12 nt, Homo sapiens
aucagugcagua

SEQ ID NO: 1794319 - RNA, 15 nt, Homo sapiens
aagacaucuccacca

SEQ ID NO: 1794320 - RNA, 21 nt, Homo sapiens
caauguucauagcaacauuau

SEQ ID NO: 1794321 - RNA, 20 nt, Homo sapiens
uaaauuuaucaguaccuaag

SEQ ID NO: 1794322 - RNA, 14 nt, Homo sapiens
uucuaaaugcauau

SEQ ID NO: 1794323 - RNA, 14 nt, Homo sapiens
auccccacccaguc

SEQ ID NO: 1794324 - RNA, 20 nt, Homo sapiens
auuaacuauuaguguuaacu

SEQ ID NO: 1794325 - RNA, 13 nt, Homo sapiens
accuuuuccccaa

SEQ ID NO: 1794326 - RNA, 13 nt, Homo sapiens
auuuuuuccuuaa

SEQ ID NO: 1794327 - RNA, 19 nt, Homo sapiens
agagugagaccauguuuca

SEQ ID NO: 1794328 - RNA, 20 nt, Homo sapiens
gugagauauuugguaccaug

SEQ ID NO: 1794329 - RNA, 16 nt, Homo sapiens
aaaccuacauauucca

SEQ ID NO: 1794330 - RNA, 21 nt, Homo sapiens
gcaccuguugugugccugaca

SEQ ID NO: 1794331 - RNA, 21 nt, Homo sapiens
gcucagguuuccuuccuucgc

SEQ ID NO: 1794332 - RNA, 20 nt, Homo sapiens
cucucaguaguuuaguacaa

SEQ ID NO: 1794333 - RNA, 16 nt, Homo sapiens
uauguaauaaccaaau

SEQ ID NO: 1794334 - RNA, 13 nt, Homo sapiens
caagcccugccca

SEQ ID NO: 1794335 - RNA, 20 nt, Homo sapiens
ggaaaaugcaaugucuuaaa

SEQ ID NO: 1794336 - RNA, 17 nt, Homo sapiens
cacccagggacacucca

SEQ ID NO: 1794337 - RNA, 16 nt, Homo sapiens
uauucucugcaauuug

SEQ ID NO: 1794338 - RNA, 14 nt, Homo sapiens
guggugugcugcuu

SEQ ID NO: 1794339 - RNA, 18 nt, Homo sapiens
gcaaugccacagcccugu

SEQ ID NO: 1794340 - RNA, 17 nt, Homo sapiens
acauuucuaugccaaac

SEQ ID NO: 1794341 - RNA, 22 nt, Homo sapiens
uguagccucgccgucugugaau

SEQ ID NO: 1794342 - RNA, 15 nt, Homo sapiens
gcccugaacaaagca

SEQ ID NO: 1794343 - RNA, 16 nt, Homo sapiens
cuuuaucauggaauuu

SEQ ID NO: 1794344 - RNA, 18 nt, Homo sapiens
ucuaaagccacgcugugu

SEQ ID NO: 1794345 - RNA, 19 nt, Homo sapiens
auacauggaauagcaccug

SEQ ID NO: 1794346 - RNA, 20 nt, Homo sapiens
cagagaguaugugagaacca

SEQ ID NO: 1794347 - RNA, 15 nt, Homo sapiens
aauauuuuccaugaa

SEQ ID NO: 1794348 - RNA, 17 nt, Homo sapiens
gggguuucuggggucca

SEQ ID NO: 1794349 - RNA, 23 nt, Homo sapiens
cuauauauaaagacaacaaaaga

SEQ ID NO: 1794350 - RNA, 19 nt, Homo sapiens
gucuggggagaauguaauc

SEQ ID NO: 1794351 - RNA, 12 nt, Homo sapiens
agcccacaucca

SEQ ID NO: 1794352 - RNA, 17 nt, Homo sapiens
cugcgcugugcuggucu

SEQ ID NO: 1794353 - RNA, 19 nt, Homo sapiens
ccaaggacagucagcauuu

SEQ ID NO: 1794354 - RNA, 21 nt, Homo sapiens
aaacugggggcucuguauaua

SEQ ID NO: 1794355 - RNA, 16 nt, Homo sapiens
agagauuuuccucucc

SEQ ID NO: 1794356 - RNA, 21 nt, Homo sapiens
uaaaccuugaagggcuuuauu

SEQ ID NO: 1794357 - RNA, 13 nt, Homo sapiens
cuuuagucugcaa

SEQ ID NO: 1794358 - RNA, 20 nt, Homo sapiens
gcuguuguauuaccaaagca

SEQ ID NO: 1794359 - RNA, 19 nt, Homo sapiens
uuccuuaguuucaaagugu

SEQ ID NO: 1794360 - RNA, 23 nt, Homo sapiens
uuuauauguaauuaacauaucuu

SEQ ID NO: 1794361 - RNA, 14 nt, Homo sapiens
ucacuuuguuaaaa

SEQ ID NO: 1794362 - RNA, 20 nt, Homo sapiens
ucaagucaucuauaguugau

SEQ ID NO: 1794363 - RNA, 14 nt, Homo sapiens
ucccaacagccuua

SEQ ID NO: 1794364 - RNA, 16 nt, Homo sapiens
auacagauagauauau

SEQ ID NO: 1794365 - RNA, 17 nt, Homo sapiens
ucagaugaacucauguc

SEQ ID NO: 1794366 - RNA, 13 nt, Homo sapiens
gaauuucaucuca

SEQ ID NO: 1794367 - RNA, 13 nt, Homo sapiens
ccagaugauauaa

SEQ ID NO: 1794368 - RNA, 13 nt, Homo sapiens
gacuugcacaaau

SEQ ID NO: 1794369 - RNA, 23 nt, Homo sapiens
aaucacauuucugaguguucucc

SEQ ID NO: 1794370 - RNA, 14 nt, Homo sapiens
cgaacagcuuauuu

SEQ ID NO: 1794371 - RNA, 22 nt, Homo sapiens
ccagguguucuacacucaucuu

SEQ ID NO: 1794372 - RNA, 17 nt, Homo sapiens
uguguacccuccaugua

SEQ ID NO: 1794373 - RNA, 15 nt, Homo sapiens
ccuacauucuuuauu

SEQ ID NO: 1794374 - RNA, 17 nt, Homo sapiens
acugagucaucuuguga

SEQ ID NO: 1794375 - RNA, 15 nt, Homo sapiens
ucuuucugcauaaua

SEQ ID NO: 1794376 - RNA, 16 nt, Homo sapiens
agaaaaaaaaauacuu

SEQ ID NO: 1794377 - RNA, 13 nt, Homo sapiens
cuguuaccagagg

SEQ ID NO: 1794378 - RNA, 20 nt, Homo sapiens
gagggcagcuggagaucuua

SEQ ID NO: 1794379 - RNA, 14 nt, Homo sapiens
accccuuugcccuu

SEQ ID NO: 1794380 - RNA, 14 nt, Homo sapiens
auuauuuuguuacu

SEQ ID NO: 1794381 - RNA, 18 nt, Homo sapiens
aaauaacuaaugucucua

SEQ ID NO: 1794382 - RNA, 16 nt, Homo sapiens
guaauugccuacaaua

SEQ ID NO: 1794383 - RNA, 14 nt, Homo sapiens
gccaugaaccaaau

SEQ ID NO: 1794384 - RNA, 14 nt, Homo sapiens
ccacugaagcccau

SEQ ID NO: 1794385 - RNA, 23 nt, Homo sapiens
caccaacaacagucagccagcuu

SEQ ID NO: 1794386 - RNA, 15 nt, Homo sapiens
aagggagaaaugcca

SEQ ID NO: 1794387 - RNA, 20 nt, Homo sapiens
ccuugcaucaagggcuuuau

SEQ ID NO: 1794388 - RNA, 14 nt, Homo sapiens
agucaccaugccug

SEQ ID NO: 1794389 - RNA, 15 nt, Homo sapiens
uccuuuuuaucugau

SEQ ID NO: 1794390 - RNA, 14 nt, Homo sapiens
uaauagaaagccag

SEQ ID NO: 1794391 - RNA, 17 nt, Homo sapiens
ucucugggcuggaugag

SEQ ID NO: 1794392 - RNA, 15 nt, Homo sapiens
aaguggugaaugaca

SEQ ID NO: 1794393 - RNA, 17 nt, Homo sapiens
uacagucauuuuccuac

SEQ ID NO: 1794394 - RNA, 22 nt, Homo sapiens
ucaaaagguauuauacauguga

SEQ ID NO: 1794395 - RNA, 16 nt, Homo sapiens
caggcucaacauaaca

SEQ ID NO: 1794396 - RNA, 18 nt, Homo sapiens
ggaucuugccacauuucu

SEQ ID NO: 1794397 - RNA, 13 nt, Homo sapiens
ucuucuaagcaaa

SEQ ID NO: 1794398 - RNA, 21 nt, Homo sapiens
cucauccgcuacuacaucaag

SEQ ID NO: 1794399 - RNA, 15 nt, Homo sapiens
uaaaguacaucucua

SEQ ID NO: 1794400 - RNA, 23 nt, Homo sapiens
gcccuuuaacuuucagaggcaau

SEQ ID NO: 1794401 - RNA, 15 nt, Homo sapiens
cugcagcggcaggac

SEQ ID NO: 1794402 - RNA, 22 nt, Homo sapiens
aucuccuuacagucacuaauau

SEQ ID NO: 1794403 - RNA, 19 nt, Homo sapiens
uaccuggaggaaugauuag

SEQ ID NO: 1794404 - RNA, 21 nt, Homo sapiens
uauguuuuuagaggcuuuucc

SEQ ID NO: 1794405 - RNA, 15 nt, Homo sapiens
uguuaacuguucaaa

SEQ ID NO: 1794406 - RNA, 19 nt, Homo sapiens
aacucaugaggagggaaaa

SEQ ID NO: 1794407 - RNA, 22 nt, Homo sapiens
uuaccugggaaagggcuguuau

SEQ ID NO: 1794408 - RNA, 22 nt, Homo sapiens
cuuccagugguaccagcucacu

SEQ ID NO: 1794409 - RNA, 20 nt, Homo sapiens
acuuaauaauuuuuaccuaa

SEQ ID NO: 1794410 - RNA, 17 nt, Homo sapiens
aaugauuuugguggaaa

SEQ ID NO: 1794411 - RNA, 21 nt, Homo sapiens
aaaccaaaguaaccuuuugca

SEQ ID NO: 1794412 - RNA, 20 nt, Homo sapiens
aacuacuguuaacacugcua

SEQ ID NO: 1794413 - RNA, 16 nt, Homo sapiens
uccgguuauucacuug

SEQ ID NO: 1794414 - RNA, 21 nt, Homo sapiens
guuggagacucagcauugggg

SEQ ID NO: 1794415 - RNA, 17 nt, Homo sapiens
caccgcgcccagcccua

SEQ ID NO: 1794416 - RNA, 20 nt, Homo sapiens
uagugaugaaccagaguuuc

SEQ ID NO: 1794417 - RNA, 21 nt, Homo sapiens
guggguggcuucuaguuugca

SEQ ID NO: 1794418 - RNA, 19 nt, Homo sapiens
gauccugccuugcugugaa

SEQ ID NO: 1794419 - RNA, 15 nt, Homo sapiens
uugacuucugacaaa

SEQ ID NO: 1794420 - RNA, 14 nt, Homo sapiens
ugcaagugugugca

SEQ ID NO: 1794421 - RNA, 22 nt, Homo sapiens
acgaaagcugggcaacaugccu

SEQ ID NO: 1794422 - RNA, 14 nt, Homo sapiens
agucuucugggcug

SEQ ID NO: 1794423 - RNA, 14 nt, Homo sapiens
cgccuucagguucc

SEQ ID NO: 1794424 - RNA, 16 nt, Homo sapiens
aacauuuaauuuagau

SEQ ID NO: 1794425 - RNA, 20 nt, Homo sapiens
uccagccccagacaacagcc

SEQ ID NO: 1794426 - RNA, 20 nt, Homo sapiens
cuauggaauguaaagugcaa

SEQ ID NO: 1794427 - RNA, 15 nt, Homo sapiens
cauuagauaaacaca

SEQ ID NO: 1794428 - RNA, 15 nt, Homo sapiens
gcaccucucugggaa

SEQ ID NO: 1794429 - RNA, 16 nt, Homo sapiens
gacaaccgaugcucca

SEQ ID NO: 1794430 - RNA, 15 nt, Homo sapiens
accuaaaacaucuca

SEQ ID NO: 1794431 - RNA, 15 nt, Homo sapiens
acucacaacacuuaa

SEQ ID NO: 1794432 - RNA, 21 nt, Homo sapiens
uaucaaagugugauauacaaa

SEQ ID NO: 1794433 - RNA, 19 nt, Homo sapiens
aauacuaaaugugcaagua

SEQ ID NO: 1794434 - RNA, 12 nt, Homo sapiens
guuuucucugaa

SEQ ID NO: 1794435 - RNA, 15 nt, Homo sapiens
ucaagcuaccuucau

SEQ ID NO: 1794436 - RNA, 15 nt, Homo sapiens
gguucuuagcccuug

SEQ ID NO: 1794437 - RNA, 17 nt, Homo sapiens
caguauuuuguguccuc

SEQ ID NO: 1794438 - RNA, 17 nt, Homo sapiens
cagcccccaucacccaa

SEQ ID NO: 1794439 - RNA, 16 nt, Homo sapiens
ccucccccugccagag

SEQ ID NO: 1794440 - RNA, 15 nt, Homo sapiens
ugaaguauuucucac

SEQ ID NO: 1794441 - RNA, 16 nt, Homo sapiens
gauuuuagccaugccu

SEQ ID NO: 1794442 - RNA, 19 nt, Homo sapiens
gggcucugggggcagauuu

SEQ ID NO: 1794443 - RNA, 22 nt, Homo sapiens
uauggaagcaaccagcaaauua

SEQ ID NO: 1794444 - RNA, 15 nt, Homo sapiens
ccaugaaauugaccc

SEQ ID NO: 1794445 - RNA, 18 nt, Homo sapiens
uuaccuccccugccaggg

SEQ ID NO: 1794446 - RNA, 21 nt, Homo sapiens
gagccuugggagccacugcca

SEQ ID NO: 1794447 - RNA, 21 nt, Homo sapiens
cacuguggcauugucuguaau

SEQ ID NO: 1794448 - RNA, 21 nt, Homo sapiens
ccaucuggcuuuuucugccac

SEQ ID NO: 1794449 - RNA, 21 nt, Homo sapiens
gaaaucucaucuuuguaauac

SEQ ID NO: 1794450 - RNA, 21 nt, Homo sapiens
aaauacaugccuuuccagugc

SEQ ID NO: 1794451 - RNA, 14 nt, Homo sapiens
acaaccauacuuua

SEQ ID NO: 1794452 - RNA, 20 nt, Homo sapiens
uucaaauuuagcaaccuaga

SEQ ID NO: 1794453 - RNA, 21 nt, Homo sapiens
ugggcauuuauauuccacuug

SEQ ID NO: 1794454 - RNA, 14 nt, Homo sapiens
ccugggccuggacc

SEQ ID NO: 1794455 - RNA, 11 nt, Homo sapiens
acaagcacaga

SEQ ID NO: 1794456 - RNA, 19 nt, Homo sapiens
cuauuuaaaauaagcacac

SEQ ID NO: 1794457 - RNA, 22 nt, Homo sapiens
ggaugauuauuuucuguucuau

SEQ ID NO: 1794458 - RNA, 13 nt, Homo sapiens
ggagaauugagaa

SEQ ID NO: 1794459 - RNA, 14 nt, Homo sapiens
gggcggggcuguca

SEQ ID NO: 1794460 - RNA, 20 nt, Homo sapiens
ggggcacaagugucugugca

SEQ ID NO: 1794461 - RNA, 20 nt, Homo sapiens
uucacaaugugaaacugaag

SEQ ID NO: 1794462 - RNA, 19 nt, Homo sapiens
gaagagcucacuaugguca

SEQ ID NO: 1794463 - RNA, 17 nt, Homo sapiens
cuaugcaagccuugcua

SEQ ID NO: 1794464 - RNA, 17 nt, Homo sapiens
agcucucagggcugucu

SEQ ID NO: 1794465 - RNA, 12 nt, Homo sapiens
guccucucugag

SEQ ID NO: 1794466 - RNA, 17 nt, Homo sapiens
ugcuugccgaaacugga

SEQ ID NO: 1794467 - RNA, 16 nt, Homo sapiens
cuuccgggaacuggag

SEQ ID NO: 1794468 - RNA, 17 nt, Homo sapiens
ggugauccgccuaccuc

SEQ ID NO: 1794469 - RNA, 15 nt, Homo sapiens
aaagguuuaauguca

SEQ ID NO: 1794470 - RNA, 15 nt, Homo sapiens
aauuguuuaaauuca

SEQ ID NO: 1794471 - RNA, 14 nt, Homo sapiens
auggccaggccaga

SEQ ID NO: 1794472 - RNA, 22 nt, Homo sapiens
agagugaccauaugacccagga

SEQ ID NO: 1794473 - RNA, 12 nt, Homo sapiens
ucugcuugucaa

SEQ ID NO: 1794474 - RNA, 13 nt, Homo sapiens
uguauacaccaag

SEQ ID NO: 1794475 - RNA, 23 nt, Homo sapiens
gccaagcuuucuucuacaaccag

SEQ ID NO: 1794476 - RNA, 23 nt, Homo sapiens
ucuugcuagauuuugcugagaug

SEQ ID NO: 1794477 - RNA, 16 nt, Homo sapiens
ugaacugcacaaugca

SEQ ID NO: 1794478 - RNA, 23 nt, Homo sapiens
auauaaaauguuucaagcgcuua

SEQ ID NO: 1794479 - RNA, 16 nt, Homo sapiens
cacacaaaugcagaca

SEQ ID NO: 1794480 - RNA, 20 nt, Homo sapiens
gguccucugauuucacauau

SEQ ID NO: 1794481 - RNA, 16 nt, Homo sapiens
aaggaagcuccacugu

SEQ ID NO: 1794482 - RNA, 18 nt, Homo sapiens
ugacaggcagccuggaca

SEQ ID NO: 1794483 - RNA, 22 nt, Homo sapiens
ucagaauagcuguuuuguguau

SEQ ID NO: 1794484 - RNA, 14 nt, Homo sapiens
acaggaagugacaa

SEQ ID NO: 1794485 - RNA, 14 nt, Homo sapiens
uaacacugugaaug

SEQ ID NO: 1794486 - RNA, 16 nt, Homo sapiens
uuacuauaauuugacu

SEQ ID NO: 1794487 - RNA, 22 nt, Homo sapiens
uaaagacuuguauagcaugaaa

SEQ ID NO: 1794488 - RNA, 12 nt, Homo sapiens
ucaaagccauau

SEQ ID NO: 1794489 - RNA, 12 nt, Homo sapiens
acaaagccuuau

SEQ ID NO: 1794490 - RNA, 19 nt, Homo sapiens
uccugcgcucugccacugu

SEQ ID NO: 1794491 - RNA, 16 nt, Homo sapiens
ccugugggaccccagg

SEQ ID NO: 1794492 - RNA, 17 nt, Homo sapiens
ugacuagcgccuggccu

SEQ ID NO: 1794493 - RNA, 13 nt, Homo sapiens
aggaacacuccuu

SEQ ID NO: 1794494 - RNA, 14 nt, Homo sapiens
uucuucagagugaa

SEQ ID NO: 1794495 - RNA, 21 nt, Homo sapiens
ucuaccaaguaagacaucuca

SEQ ID NO: 1794496 - RNA, 16 nt, Homo sapiens
caaaacauacccagug

SEQ ID NO: 1794497 - RNA, 13 nt, Homo sapiens
augcugugugaga

SEQ ID NO: 1794498 - RNA, 20 nt, Homo sapiens
cacgucacugcacuccagcu

SEQ ID NO: 1794499 - RNA, 20 nt, Homo sapiens
ucaggaaggcuauugcugag

SEQ ID NO: 1794500 - RNA, 19 nt, Homo sapiens
accuuuucuauuuaccucc

SEQ ID NO: 1794501 - RNA, 17 nt, Homo sapiens
cacacgccuucaugcca

SEQ ID NO: 1794502 - RNA, 17 nt, Homo sapiens
caguuuuugacuucaua

SEQ ID NO: 1794503 - RNA, 17 nt, Homo sapiens
aagcugacuuugccaaa

SEQ ID NO: 1794504 - RNA, 22 nt, Homo sapiens
gcgggagccucccugccucagg

SEQ ID NO: 1794505 - RNA, 20 nt, Homo sapiens
accauccuggccaacauugu

SEQ ID NO: 1794506 - RNA, 23 nt, Homo sapiens
aggaagggcugggccaccaggga

SEQ ID NO: 1794507 - RNA, 11 nt, Homo sapiens
gccacuuuccu

SEQ ID NO: 1794508 - RNA, 12 nt, Homo sapiens
gagccaugucau

SEQ ID NO: 1794509 - RNA, 18 nt, Homo sapiens
uguauuuuccaacuuguu

SEQ ID NO: 1794510 - RNA, 21 nt, Homo sapiens
gcaucugggcaggaugacuuu

SEQ ID NO: 1794511 - RNA, 19 nt, Homo sapiens
uaacacacauagauagauu

SEQ ID NO: 1794512 - RNA, 17 nt, Homo sapiens
cuucuauaauuguauau

SEQ ID NO: 1794513 - RNA, 22 nt, Homo sapiens
aacucaguccuguacucugggg

SEQ ID NO: 1794514 - RNA, 15 nt, Homo sapiens
cuucccagagaacuu

SEQ ID NO: 1794515 - RNA, 15 nt, Homo sapiens
aggccaacacugugg

SEQ ID NO: 1794516 - RNA, 15 nt, Homo sapiens
guguuauaccaacua

SEQ ID NO: 1794517 - RNA, 22 nt, Homo sapiens
aacaugauacugcugcuuguca

SEQ ID NO: 1794518 - RNA, 18 nt, Homo sapiens
guaugcaacucugacguu

SEQ ID NO: 1794519 - RNA, 15 nt, Homo sapiens
uagagaauaaucaua

SEQ ID NO: 1794520 - RNA, 16 nt, Homo sapiens
aauauucuaauuuuag

SEQ ID NO: 1794521 - RNA, 23 nt, Homo sapiens
uggaggcacaacgcaccagacac

SEQ ID NO: 1794522 - RNA, 18 nt, Homo sapiens
agaguugccccgucucug

SEQ ID NO: 1794523 - RNA, 20 nt, Homo sapiens
cacagcugggcaaagccaca

SEQ ID NO: 1794524 - RNA, 11 nt, Homo sapiens
ggacacagacc

SEQ ID NO: 1794525 - RNA, 21 nt, Homo sapiens
cuugaauauuuauucagugac

SEQ ID NO: 1794526 - RNA, 21 nt, Homo sapiens
agcaugauacaaauuccacag

SEQ ID NO: 1794527 - RNA, 18 nt, Homo sapiens
ucacuuuucccacuccaa

SEQ ID NO: 1794528 - RNA, 11 nt, Homo sapiens
cuuggccuagc

SEQ ID NO: 1794529 - RNA, 22 nt, Homo sapiens
cuacagacaccaaguuccguca

SEQ ID NO: 1794530 - RNA, 15 nt, Homo sapiens
acuucugcaggaucc

SEQ ID NO: 1794531 - RNA, 13 nt, Homo sapiens
ggccccgggcugg

SEQ ID NO: 1794532 - RNA, 21 nt, Homo sapiens
cccauccuucuccaccaaaga

SEQ ID NO: 1794533 - RNA, 16 nt, Homo sapiens
gaaauucacaaaguua

SEQ ID NO: 1794534 - RNA, 18 nt, Homo sapiens
ugguuuaaauaugaauga

SEQ ID NO: 1794535 - RNA, 18 nt, Homo sapiens
caacccuaucuccugaca

SEQ ID NO: 1794536 - RNA, 15 nt, Homo sapiens
cuguaaaccccaaga

SEQ ID NO: 1794537 - RNA, 17 nt, Homo sapiens
acaaaagcauuuugcua

SEQ ID NO: 1794538 - RNA, 19 nt, Homo sapiens
uaaauguacuacauuugca

SEQ ID NO: 1794539 - RNA, 22 nt, Homo sapiens
ccuuuccucugcagcacuuuaa

SEQ ID NO: 1794540 - RNA, 13 nt, Homo sapiens
agacagugcagug

SEQ ID NO: 1794541 - RNA, 22 nt, Homo sapiens
gugguuauuuucuccaugucug

SEQ ID NO: 1794542 - RNA, 15 nt, Homo sapiens
gcuuuauugccucug

SEQ ID NO: 1794543 - RNA, 16 nt, Homo sapiens
auuugacauuauccag

SEQ ID NO: 1794544 - RNA, 16 nt, Homo sapiens
ugggaccgugcgagcu

SEQ ID NO: 1794545 - RNA, 16 nt, Homo sapiens
augcugagauccucau

SEQ ID NO: 1794546 - RNA, 21 nt, Homo sapiens
guggcccugccuggcuagucc

SEQ ID NO: 1794547 - RNA, 22 nt, Homo sapiens
ucccaagagcuuccagagcucu

SEQ ID NO: 1794548 - RNA, 22 nt, Homo sapiens
aggggcuuguugcaggcugugg

SEQ ID NO: 1794549 - RNA, 17 nt, Homo sapiens
accgccugaaggcacag

SEQ ID NO: 1794550 - RNA, 17 nt, Homo sapiens
guuuucuccucccccau

SEQ ID NO: 1794551 - RNA, 23 nt, Homo sapiens
gcguccuggggccugugcacugu

SEQ ID NO: 1794552 - RNA, 22 nt, Homo sapiens
auucugugcuguuacaguuuuc

SEQ ID NO: 1794553 - RNA, 17 nt, Homo sapiens
cccugcacaggcacaca

SEQ ID NO: 1794554 - RNA, 23 nt, Homo sapiens
ccuuccucgguggcucuggggua

SEQ ID NO: 1794555 - RNA, 22 nt, Homo sapiens
cagagcaaguuccugagugcgu

SEQ ID NO: 1794556 - RNA, 21 nt, Homo sapiens
cuaugucaagaggcugaauua

SEQ ID NO: 1794557 - RNA, 23 nt, Homo sapiens
auggaccuccguggccaaaaagu

SEQ ID NO: 1794558 - RNA, 19 nt, Homo sapiens
uggcacgaucucagcucac

SEQ ID NO: 1794559 - RNA, 19 nt, Homo sapiens
ggcaagcucuaucaccaag

SEQ ID NO: 1794560 - RNA, 14 nt, Homo sapiens
ucauggaacacuca

SEQ ID NO: 1794561 - RNA, 13 nt, Homo sapiens
ggaaccaugaaga

SEQ ID NO: 1794562 - RNA, 15 nt, Homo sapiens
agaguaucaucaacg

SEQ ID NO: 1794563 - RNA, 15 nt, Homo sapiens
caauuagcauucugu

SEQ ID NO: 1794564 - RNA, 15 nt, Homo sapiens
auaaauaagcacuau

SEQ ID NO: 1794565 - RNA, 20 nt, Homo sapiens
gcuuuucauugcugugacag

SEQ ID NO: 1794566 - RNA, 15 nt, Homo sapiens
ugaaagcacaugaau

SEQ ID NO: 1794567 - RNA, 13 nt, Homo sapiens
agcgguaccccag

SEQ ID NO: 1794568 - RNA, 20 nt, Homo sapiens
auguucauccuaacaugaca

SEQ ID NO: 1794569 - RNA, 19 nt, Homo sapiens
ccugcgcgucaucucugac

SEQ ID NO: 1794570 - RNA, 18 nt, Homo sapiens
acuguucuauucaucuca

SEQ ID NO: 1794571 - RNA, 14 nt, Homo sapiens
ugcuggaugcauuu

SEQ ID NO: 1794572 - RNA, 16 nt, Homo sapiens
cacugcacucuagccg

SEQ ID NO: 1794573 - RNA, 17 nt, Homo sapiens
uauccuguuuuugcaaa

SEQ ID NO: 1794574 - RNA, 19 nt, Homo sapiens
ggaacauccuccacugacu

SEQ ID NO: 1794575 - RNA, 21 nt, Homo sapiens
cuugggcacuuuuuaauucac

SEQ ID NO: 1794576 - RNA, 16 nt, Homo sapiens
uugcuuuuuuuccaau

SEQ ID NO: 1794577 - RNA, 16 nt, Homo sapiens
uaugcaauuagguuuu

SEQ ID NO: 1794578 - RNA, 17 nt, Homo sapiens
aaaaggguuucuugaca

SEQ ID NO: 1794579 - RNA, 13 nt, Homo sapiens
agacaaguuccau

SEQ ID NO: 1794580 - RNA, 19 nt, Homo sapiens
cccaggucucuccacugcu

SEQ ID NO: 1794581 - RNA, 12 nt, Homo sapiens
accaaagcuuua

SEQ ID NO: 1794582 - RNA, 17 nt, Homo sapiens
gcuugagccugucacgu

SEQ ID NO: 1794583 - RNA, 14 nt, Homo sapiens
ggugaguggaugaa

SEQ ID NO: 1794584 - RNA, 20 nt, Homo sapiens
auuguguuuuccuaaacaca

SEQ ID NO: 1794585 - RNA, 23 nt, Homo sapiens
auuuuguguuuaggaacuacuga

SEQ ID NO: 1794586 - RNA, 20 nt, Homo sapiens
ccucaaaucuucuaauucca

SEQ ID NO: 1794587 - RNA, 19 nt, Homo sapiens
uaagaauucaaacuggggc

SEQ ID NO: 1794588 - RNA, 15 nt, Homo sapiens
aggaaaaaugggagc

SEQ ID NO: 1794589 - RNA, 14 nt, Homo sapiens
aaggugugcuacag

SEQ ID NO: 1794590 - RNA, 22 nt, Homo sapiens
ugaaaaaugguaauuguugcua

SEQ ID NO: 1794591 - RNA, 22 nt, Homo sapiens
ugggucauagaaauucuuuaua

SEQ ID NO: 1794592 - RNA, 16 nt, Homo sapiens
ggaugagagggugcua

SEQ ID NO: 1794593 - RNA, 18 nt, Homo sapiens
aauguuaugacuauguaa

SEQ ID NO: 1794594 - RNA, 19 nt, Homo sapiens
cacgcaccggaguucugcc

SEQ ID NO: 1794595 - RNA, 16 nt, Homo sapiens
caagaugaaacagggc

SEQ ID NO: 1794596 - RNA, 15 nt, Homo sapiens
gaccugccuccuucc

SEQ ID NO: 1794597 - RNA, 12 nt, Homo sapiens
gagcccuugcac

SEQ ID NO: 1794598 - RNA, 14 nt, Homo sapiens
auacaaaccacugu

SEQ ID NO: 1794599 - RNA, 22 nt, Homo sapiens
guauggccccaccugcucuuuc

SEQ ID NO: 1794600 - RNA, 19 nt, Homo sapiens
ggaaauguaugugugucua

SEQ ID NO: 1794601 - RNA, 17 nt, Homo sapiens
cucccuggaugacauua

SEQ ID NO: 1794602 - RNA, 23 nt, Homo sapiens
caggaggucugguccgagucuca

SEQ ID NO: 1794603 - RNA, 20 nt, Homo sapiens
gcauggacucuggguuucau

SEQ ID NO: 1794604 - RNA, 19 nt, Homo sapiens
cgcuucuccuccagguauu

SEQ ID NO: 1794605 - RNA, 20 nt, Homo sapiens
aacucagcgugaguuacccu

SEQ ID NO: 1794606 - RNA, 19 nt, Homo sapiens
uuugacaacaauccaaaaa

SEQ ID NO: 1794607 - RNA, 21 nt, Homo sapiens
ucaaccaucucucagcaguua

SEQ ID NO: 1794608 - RNA, 20 nt, Homo sapiens
uucugauaaaagauggccau

SEQ ID NO: 1794609 - RNA, 19 nt, Homo sapiens
uugugaugaugcugugaca

SEQ ID NO: 1794610 - RNA, 15 nt, Homo sapiens
cauguucuccucuau

SEQ ID NO: 1794611 - RNA, 21 nt, Homo sapiens
cagcgugaggagcgaucucag

SEQ ID NO: 1794612 - RNA, 14 nt, Homo sapiens
aaaugauguuguca

SEQ ID NO: 1794613 - RNA, 16 nt, Homo sapiens
gguagagguggugaga

SEQ ID NO: 1794614 - RNA, 22 nt, Homo sapiens
uuaugaggguccucuacuucag

SEQ ID NO: 1794615 - RNA, 20 nt, Homo sapiens
aucucaugccagugccuuau

SEQ ID NO: 1794616 - RNA, 22 nt, Homo sapiens
ccucaaguucuuggaccaguuu

SEQ ID NO: 1794617 - RNA, 19 nt, Homo sapiens
gugaguguuucuaugagug

SEQ ID NO: 1794618 - RNA, 19 nt, Homo sapiens
aaugucuucaagacuuuuc

SEQ ID NO: 1794619 - RNA, 19 nt, Homo sapiens
uaaugcacucucaguaaug

SEQ ID NO: 1794620 - RNA, 15 nt, Homo sapiens
accaguuuuauccau

SEQ ID NO: 1794621 - RNA, 23 nt, Homo sapiens
cucccugcagaugccacccuagc

SEQ ID NO: 1794622 - RNA, 13 nt, Homo sapiens
aaucaaauggugu

SEQ ID NO: 1794623 - RNA, 18 nt, Homo sapiens
uuuuccuucagagugaau

SEQ ID NO: 1794624 - RNA, 21 nt, Homo sapiens
agucuaaagauggaguuucua

SEQ ID NO: 1794625 - RNA, 17 nt, Homo sapiens
aauuacuuguguuacuu

SEQ ID NO: 1794626 - RNA, 17 nt, Homo sapiens
cugucuugccagauuac

SEQ ID NO: 1794627 - RNA, 22 nt, Homo sapiens
auguggcugacuaggucaauuu

SEQ ID NO: 1794628 - RNA, 14 nt, Homo sapiens
uaaacugaacauau

SEQ ID NO: 1794629 - RNA, 13 nt, Homo sapiens
uuuguaacauaau

SEQ ID NO: 1794630 - RNA, 15 nt, Homo sapiens
uacuuuuuaguaauu

SEQ ID NO: 1794631 - RNA, 18 nt, Homo sapiens
accuuguguacuuucuuc

SEQ ID NO: 1794632 - RNA, 12 nt, Homo sapiens
cucugaugcaau

SEQ ID NO: 1794633 - RNA, 13 nt, Homo sapiens
uacauuagugcca

SEQ ID NO: 1794634 - RNA, 18 nt, Homo sapiens
ucuccuauguaguucuca

SEQ ID NO: 1794635 - RNA, 23 nt, Homo sapiens
auggcugaguuuauuaguacaug

SEQ ID NO: 1794636 - RNA, 21 nt, Homo sapiens
caacuccaaggcaaaugucca

SEQ ID NO: 1794637 - RNA, 21 nt, Homo sapiens
gagaucauaaagagcacguuu

SEQ ID NO: 1794638 - RNA, 15 nt, Homo sapiens
ggcccacccaucacg

SEQ ID NO: 1794639 - RNA, 14 nt, Homo sapiens
cauuuaucuacuau

SEQ ID NO: 1794640 - RNA, 13 nt, Homo sapiens
uucacaccuaccc

SEQ ID NO: 1794641 - RNA, 18 nt, Homo sapiens
acaaagccccccagcucc

SEQ ID NO: 1794642 - RNA, 21 nt, Homo sapiens
caauucagaaaggaugcacag

SEQ ID NO: 1794643 - RNA, 19 nt, Homo sapiens
agucugcuuaccaaaacau

SEQ ID NO: 1794644 - RNA, 15 nt, Homo sapiens
auaucuguggucuuc

SEQ ID NO: 1794645 - RNA, 18 nt, Homo sapiens
auggugaaaauauuugac

SEQ ID NO: 1794646 - RNA, 22 nt, Homo sapiens
augccuuucuguaaccaaaaau

SEQ ID NO: 1794647 - RNA, 17 nt, Homo sapiens
uuccagcuagugaccca

SEQ ID NO: 1794648 - RNA, 17 nt, Homo sapiens
ugugucccuuccugcuu

SEQ ID NO: 1794649 - RNA, 14 nt, Homo sapiens
gucggucccugaga

SEQ ID NO: 1794650 - RNA, 19 nt, Homo sapiens
ugacaguuuacaaaugaca

SEQ ID NO: 1794651 - RNA, 20 nt, Homo sapiens
gcccugccccacccaacucc

SEQ ID NO: 1794652 - RNA, 19 nt, Homo sapiens
cacauauuggagggaaauc

SEQ ID NO: 1794653 - RNA, 20 nt, Homo sapiens
uaauguaguauacacuggca

SEQ ID NO: 1794654 - RNA, 17 nt, Homo sapiens
acauuguauguaucuau

SEQ ID NO: 1794655 - RNA, 15 nt, Homo sapiens
aaaacuggaagcaca

SEQ ID NO: 1794656 - RNA, 14 nt, Homo sapiens
agucagcagucaug

SEQ ID NO: 1794657 - RNA, 20 nt, Homo sapiens
guacauugggcacauaucuc

SEQ ID NO: 1794658 - RNA, 22 nt, Homo sapiens
uucuguaaauaccauugacaca

SEQ ID NO: 1794659 - RNA, 18 nt, Homo sapiens
auaccaguggaggaauuu

SEQ ID NO: 1794660 - RNA, 13 nt, Homo sapiens
uucuccaauauca

SEQ ID NO: 1794661 - RNA, 13 nt, Homo sapiens
uuuacagcugccu

SEQ ID NO: 1794662 - RNA, 15 nt, Homo sapiens
aaugcaggcuguuuc

SEQ ID NO: 1794663 - RNA, 17 nt, Homo sapiens
ucaccuucugccaugau

SEQ ID NO: 1794664 - RNA, 20 nt, Homo sapiens
cuuuuaucugcccagaauuc

SEQ ID NO: 1794665 - RNA, 18 nt, Homo sapiens
gaccuuaaaugcuacuga

SEQ ID NO: 1794666 - RNA, 15 nt, Homo sapiens
aaagcuuccauucca

SEQ ID NO: 1794667 - RNA, 17 nt, Homo sapiens
gcugcuuagacauaaca

SEQ ID NO: 1794668 - RNA, 20 nt, Homo sapiens
auucccaugguagacuguga

SEQ ID NO: 1794669 - RNA, 23 nt, Homo sapiens
agacucacucuuccacauuccca

SEQ ID NO: 1794670 - RNA, 22 nt, Homo sapiens
ccaagagcagcugggaacugac

SEQ ID NO: 1794671 - RNA, 15 nt, Homo sapiens
ugcugauaaguagca

SEQ ID NO: 1794672 - RNA, 16 nt, Homo sapiens
uccuuuuucacuuuga

SEQ ID NO: 1794673 - RNA, 22 nt, Homo sapiens
auucuguguauuaacaugcaau

SEQ ID NO: 1794674 - RNA, 13 nt, Homo sapiens
cucuggcuucugu

SEQ ID NO: 1794675 - RNA, 15 nt, Homo sapiens
cuuuucugcaauuca

SEQ ID NO: 1794676 - RNA, 13 nt, Homo sapiens
uugcucugccacc

SEQ ID NO: 1794677 - RNA, 17 nt, Homo sapiens
uuuauuaugcaaccagu

SEQ ID NO: 1794678 - RNA, 23 nt, Homo sapiens
uaaagacagggucucacucucau

SEQ ID NO: 1794679 - RNA, 18 nt, Homo sapiens
agccugggcuccucugca

SEQ ID NO: 1794680 - RNA, 15 nt, Homo sapiens
agaagacucugaccu

SEQ ID NO: 1794681 - RNA, 15 nt, Homo sapiens
agcuuaauaaguauu

SEQ ID NO: 1794682 - RNA, 15 nt, Homo sapiens
aaccaaauaggcuuu

SEQ ID NO: 1794683 - RNA, 15 nt, Homo sapiens
cguauacuguaacuu

SEQ ID NO: 1794684 - RNA, 18 nt, Homo sapiens
gaccagagcaguuucauc

SEQ ID NO: 1794685 - RNA, 18 nt, Homo sapiens
ugcauugccaagugccau

SEQ ID NO: 1794686 - RNA, 15 nt, Homo sapiens
caauacauguaucua

SEQ ID NO: 1794687 - RNA, 21 nt, Homo sapiens
ccagcaccuggcacaccagaa

SEQ ID NO: 1794688 - RNA, 16 nt, Homo sapiens
cagucuguugcugcuc

SEQ ID NO: 1794689 - RNA, 20 nt, Homo sapiens
gccucagcggacaagcagcu

SEQ ID NO: 1794690 - RNA, 16 nt, Homo sapiens
auugcuucugugcaau

SEQ ID NO: 1794691 - RNA, 23 nt, Homo sapiens
uaaauuuuuuuuuuaauugcacu

SEQ ID NO: 1794692 - RNA, 19 nt, Homo sapiens
cccaggccuccccagcacc

SEQ ID NO: 1794693 - RNA, 20 nt, Homo sapiens
auaucaauauuuucugcaau

SEQ ID NO: 1794694 - RNA, 20 nt, Homo sapiens
gagguuccucgcaggucuca

SEQ ID NO: 1794695 - RNA, 14 nt, Homo sapiens
ggaagauacacuga

SEQ ID NO: 1794696 - RNA, 18 nt, Homo sapiens
guggcucuccaguguaaa

SEQ ID NO: 1794697 - RNA, 16 nt, Homo sapiens
aaccccacaagcacca

SEQ ID NO: 1794698 - RNA, 20 nt, Homo sapiens
caugagaaugucauuugcua

SEQ ID NO: 1794699 - RNA, 12 nt, Homo sapiens
gaaccauaucaa

SEQ ID NO: 1794700 - RNA, 15 nt, Homo sapiens
cucccuccaccagcc

SEQ ID NO: 1794701 - RNA, 19 nt, Homo sapiens
gucuaacauauucaaugca

SEQ ID NO: 1794702 - RNA, 13 nt, Homo sapiens
uuuaaguacucac

SEQ ID NO: 1794703 - RNA, 15 nt, Homo sapiens
agagucaacauaugu

SEQ ID NO: 1794704 - RNA, 19 nt, Homo sapiens
auacagggucucuuccuuc

SEQ ID NO: 1794705 - RNA, 18 nt, Homo sapiens
uugaaugcuuaaaugauc

SEQ ID NO: 1794706 - RNA, 19 nt, Homo sapiens
accaaagucacaaaucauc

SEQ ID NO: 1794707 - RNA, 21 nt, Homo sapiens
augcuacaagacgggcaaaau

SEQ ID NO: 1794708 - RNA, 14 nt, Homo sapiens
gucgggacaugguu

SEQ ID NO: 1794709 - RNA, 14 nt, Homo sapiens
ucugagagacagaa

SEQ ID NO: 1794710 - RNA, 17 nt, Homo sapiens
gggccuuugggugcugu

SEQ ID NO: 1794711 - RNA, 21 nt, Homo sapiens
cuaaucuucuuaugcaauuuc

SEQ ID NO: 1794712 - RNA, 21 nt, Homo sapiens
cuagggcucuccaagcacuag

SEQ ID NO: 1794713 - RNA, 14 nt, Homo sapiens
uauuccucagugag

SEQ ID NO: 1794714 - RNA, 18 nt, Homo sapiens
cacuguuaucuucacuuu

SEQ ID NO: 1794715 - RNA, 18 nt, Homo sapiens
uaauccaggacagcauua

SEQ ID NO: 1794716 - RNA, 16 nt, Homo sapiens
aggaaggcuacuugag

SEQ ID NO: 1794717 - RNA, 22 nt, Homo sapiens
gaacaacccaccauuucugggg

SEQ ID NO: 1794718 - RNA, 16 nt, Homo sapiens
aggccugcgugugucu

SEQ ID NO: 1794719 - RNA, 15 nt, Homo sapiens
cacagcaggggagcc

SEQ ID NO: 1794720 - RNA, 22 nt, Homo sapiens
cguccugaggaguguccugucu

SEQ ID NO: 1794721 - RNA, 16 nt, Homo sapiens
ucccucagacccagga

SEQ ID NO: 1794722 - RNA, 17 nt, Homo sapiens
aaaggcccccacuucuc

SEQ ID NO: 1794723 - RNA, 21 nt, Homo sapiens
caugguuuuugcucuacuuua

SEQ ID NO: 1794724 - RNA, 14 nt, Homo sapiens
uggaugaacauuca

SEQ ID NO: 1794725 - RNA, 19 nt, Homo sapiens
cguuucaaaaacacagugu

SEQ ID NO: 1794726 - RNA, 23 nt, Homo sapiens
gcagaguacuggcugauggagua

SEQ ID NO: 1794727 - RNA, 13 nt, Homo sapiens
acaaagcauggua

SEQ ID NO: 1794728 - RNA, 15 nt, Homo sapiens
cuaguuacuguggua

SEQ ID NO: 1794729 - RNA, 13 nt, Homo sapiens
acagacaccagca

SEQ ID NO: 1794730 - RNA, 16 nt, Homo sapiens
gaaauuuauucacaua

SEQ ID NO: 1794731 - RNA, 12 nt, Homo sapiens
ugaaucuucacg

SEQ ID NO: 1794732 - RNA, 18 nt, Homo sapiens
agugagccugguggaaca

SEQ ID NO: 1794733 - RNA, 15 nt, Homo sapiens
agauauauaugugcu

SEQ ID NO: 1794734 - RNA, 19 nt, Homo sapiens
aaguaaaaggaaaugcucc

SEQ ID NO: 1794735 - RNA, 16 nt, Homo sapiens
caugauacaaagaucu

SEQ ID NO: 1794736 - RNA, 20 nt, Homo sapiens
uacauccuugauuacuucca

SEQ ID NO: 1794737 - RNA, 18 nt, Homo sapiens
augagauuuuucauguau

SEQ ID NO: 1794738 - RNA, 17 nt, Homo sapiens
uaaaagccaauuagcuc

SEQ ID NO: 1794739 - RNA, 14 nt, Homo sapiens
auuccagaccaaaa

SEQ ID NO: 1794740 - RNA, 23 nt, Homo sapiens
cagcucuggaugaaggcaaaaac

SEQ ID NO: 1794741 - RNA, 14 nt, Homo sapiens
caguuuuguugccc

SEQ ID NO: 1794742 - RNA, 14 nt, Homo sapiens
cucaugaaccucaa

SEQ ID NO: 1794743 - RNA, 20 nt, Homo sapiens
ucauuauagaucccccagac

SEQ ID NO: 1794744 - RNA, 22 nt, Homo sapiens
aagaugauucaaaguaguuuua

SEQ ID NO: 1794745 - RNA, 14 nt, Homo sapiens
auccacuuugacuc

SEQ ID NO: 1794746 - RNA, 14 nt, Homo sapiens
uguaaguacucuaa

SEQ ID NO: 1794747 - RNA, 22 nt, Homo sapiens
ucaugauuucaagauguuauau

SEQ ID NO: 1794748 - RNA, 14 nt, Homo sapiens
ccacaaguggcaga

SEQ ID NO: 1794749 - RNA, 20 nt, Homo sapiens
ugcuuuguuaucaaauggac

SEQ ID NO: 1794750 - RNA, 12 nt, Homo sapiens
cagcccuaggcu

SEQ ID NO: 1794751 - RNA, 16 nt, Homo sapiens
aacuuaaggaagcaaa

SEQ ID NO: 1794752 - RNA, 14 nt, Homo sapiens
gggcauaaacuguu

SEQ ID NO: 1794753 - RNA, 21 nt, Homo sapiens
uguacuacaucuaguuaauca

SEQ ID NO: 1794754 - RNA, 19 nt, Homo sapiens
acuucuucaguguccuuca

SEQ ID NO: 1794755 - RNA, 20 nt, Homo sapiens
uuccgacaggagcacugcau

SEQ ID NO: 1794756 - RNA, 21 nt, Homo sapiens
acugaaauggacugacuguaa

SEQ ID NO: 1794757 - RNA, 15 nt, Homo sapiens
uuucuguaacacacu

SEQ ID NO: 1794758 - RNA, 16 nt, Homo sapiens
auuuuauagacuacca

SEQ ID NO: 1794759 - RNA, 21 nt, Homo sapiens
aauacagucuuccauuugcaa

SEQ ID NO: 1794760 - RNA, 15 nt, Homo sapiens
agauuuaacauuauc

SEQ ID NO: 1794761 - RNA, 18 nt, Homo sapiens
cuuaaaaaauacuuuaug

SEQ ID NO: 1794762 - RNA, 12 nt, Homo sapiens
uaauauugcaag

SEQ ID NO: 1794763 - RNA, 12 nt, Homo sapiens
uuauauugcuag

SEQ ID NO: 1794764 - RNA, 22 nt, Homo sapiens
cuaccauucaaaauugcuucuu

SEQ ID NO: 1794765 - RNA, 14 nt, Homo sapiens
gugaccuugagcaa

SEQ ID NO: 1794766 - RNA, 21 nt, Homo sapiens
cgaaaucccugcucacugcag

SEQ ID NO: 1794767 - RNA, 15 nt, Homo sapiens
ugggaacagugugca

SEQ ID NO: 1794768 - RNA, 21 nt, Homo sapiens
aguacauaaggaguugccgca

SEQ ID NO: 1794769 - RNA, 14 nt, Homo sapiens
gauagaagauuguu

SEQ ID NO: 1794770 - RNA, 20 nt, Homo sapiens
ucuaaguggaaaaaguauua

SEQ ID NO: 1794771 - RNA, 19 nt, Homo sapiens
uauccagauggaggcacca

SEQ ID NO: 1794772 - RNA, 16 nt, Homo sapiens
ccaauauuuaccagac

SEQ ID NO: 1794773 - RNA, 16 nt, Homo sapiens
ggacaguaucccacau

SEQ ID NO: 1794774 - RNA, 17 nt, Homo sapiens
auugaucaaugcauguu

SEQ ID NO: 1794775 - RNA, 17 nt, Homo sapiens
auugaccuuugcacgaa

SEQ ID NO: 1794776 - RNA, 15 nt, Homo sapiens
acauuagacacacau

SEQ ID NO: 1794777 - RNA, 21 nt, Homo sapiens
acagggcuguugucauuugua

SEQ ID NO: 1794778 - RNA, 17 nt, Homo sapiens
caagucacccaucagau

SEQ ID NO: 1794779 - RNA, 14 nt, Homo sapiens
aagcaucuuccuua

SEQ ID NO: 1794780 - RNA, 12 nt, Homo sapiens
caacauaacuga

SEQ ID NO: 1794781 - RNA, 17 nt, Homo sapiens
uuaaugugaccuagcaa

SEQ ID NO: 1794782 - RNA, 20 nt, Homo sapiens
augacuuuaucauuuuguua

SEQ ID NO: 1794783 - RNA, 15 nt, Homo sapiens
acagacagcuuagaa

SEQ ID NO: 1794784 - RNA, 15 nt, Homo sapiens
ugaaaugccuggaag

SEQ ID NO: 1794785 - RNA, 14 nt, Homo sapiens
cuuccccaaaggaa

SEQ ID NO: 1794786 - RNA, 16 nt, Homo sapiens
ucucuuaggacaguaa

SEQ ID NO: 1794787 - RNA, 17 nt, Homo sapiens
uccccaagaagaugaaa

SEQ ID NO: 1794788 - RNA, 13 nt, Homo sapiens
ggaggccagagga

SEQ ID NO: 1794789 - RNA, 10 nt, Homo sapiens
caaaccacau

SEQ ID NO: 1794790 - RNA, 19 nt, Homo sapiens
cuuuuggcauuuuacugua

SEQ ID NO: 1794791 - RNA, 15 nt, Homo sapiens
uaaguccaacuacua

SEQ ID NO: 1794792 - RNA, 15 nt, Homo sapiens
gucucaggcaccuca

SEQ ID NO: 1794793 - RNA, 19 nt, Homo sapiens
guuacugcuugaccaaaga

SEQ ID NO: 1794794 - RNA, 14 nt, Homo sapiens
gaaguaauugacag

SEQ ID NO: 1794795 - RNA, 18 nt, Homo sapiens
cuagaagaagcuauguca

SEQ ID NO: 1794796 - RNA, 12 nt, Homo sapiens
uuguaauucuuu

SEQ ID NO: 1794797 - RNA, 20 nt, Homo sapiens
accuuuugcuccuaucccau

SEQ ID NO: 1794798 - RNA, 20 nt, Homo sapiens
ugagauaaaugcacauuuca

SEQ ID NO: 1794799 - RNA, 19 nt, Homo sapiens
aguuuucacaaugccuaga

SEQ ID NO: 1794800 - RNA, 23 nt, Homo sapiens
cuugcugauuuucagacagggaa

SEQ ID NO: 1794801 - RNA, 20 nt, Homo sapiens
cuagcauucugcaacauuua

SEQ ID NO: 1794802 - RNA, 15 nt, Homo sapiens
gcacacccacucagc

SEQ ID NO: 1794803 - RNA, 13 nt, Homo sapiens
gagagacugccau

SEQ ID NO: 1794804 - RNA, 16 nt, Homo sapiens
cuggcgcccaguggag

SEQ ID NO: 1794805 - RNA, 20 nt, Homo sapiens
ugguaaaacucacugugauc

SEQ ID NO: 1794806 - RNA, 15 nt, Homo sapiens
agauggcugcugcuc

SEQ ID NO: 1794807 - RNA, 13 nt, Homo sapiens
cagagucaucuga

SEQ ID NO: 1794808 - RNA, 16 nt, Homo sapiens
ucuuaagcacuuugaa

SEQ ID NO: 1794809 - RNA, 23 nt, Homo sapiens
cugucuucgaggacagcaaugca

SEQ ID NO: 1794810 - RNA, 18 nt, Homo sapiens
cuccaccaacccaucaga

SEQ ID NO: 1794811 - RNA, 12 nt, Homo sapiens
uguauauuacau

SEQ ID NO: 1794812 - RNA, 23 nt, Homo sapiens
aaucauuaaggucauuacucuca

SEQ ID NO: 1794813 - RNA, 13 nt, Homo sapiens
caaguuuacuuuu

SEQ ID NO: 1794814 - RNA, 16 nt, Homo sapiens
uccguagcuucuaguc

SEQ ID NO: 1794815 - RNA, 17 nt, Homo sapiens
gacaucaagcucaaggc

SEQ ID NO: 1794816 - RNA, 15 nt, Homo sapiens
gugcauuucuaggac

SEQ ID NO: 1794817 - RNA, 12 nt, Homo sapiens
aagccugaugau

SEQ ID NO: 1794818 - RNA, 19 nt, Homo sapiens
cugauuuguggaaaggagg

SEQ ID NO: 1794819 - RNA, 15 nt, Homo sapiens
agcacugaaauaucc

SEQ ID NO: 1794820 - RNA, 18 nt, Homo sapiens
ucacuauggacuuacccu

SEQ ID NO: 1794821 - RNA, 15 nt, Homo sapiens
aauuuaacagaaguu

SEQ ID NO: 1794822 - RNA, 14 nt, Homo sapiens
ucccaaagcacuuu

SEQ ID NO: 1794823 - RNA, 13 nt, Homo sapiens
aggggugcauucu

SEQ ID NO: 1794824 - RNA, 11 nt, Homo sapiens
aggugggagag

SEQ ID NO: 1794825 - RNA, 17 nt, Homo sapiens
uuucugacucugagcua

SEQ ID NO: 1794826 - RNA, 16 nt, Homo sapiens
aaccgagaagguuuau

SEQ ID NO: 1794827 - RNA, 17 nt, Homo sapiens
cauggauaugugccagg

SEQ ID NO: 1794828 - RNA, 19 nt, Homo sapiens
guauuguuugggauccuau

SEQ ID NO: 1794829 - RNA, 16 nt, Homo sapiens
cucaagaccaaaugga

SEQ ID NO: 1794830 - RNA, 15 nt, Homo sapiens
acaauaaaaaccaaa

SEQ ID NO: 1794831 - RNA, 21 nt, Homo sapiens
gcccuuucauaaaaaccaaac

SEQ ID NO: 1794832 - RNA, 23 nt, Homo sapiens
ccaaaugaagauuuuuaggagug

SEQ ID NO: 1794833 - RNA, 20 nt, Homo sapiens
cauuauccuugcuaugauga

SEQ ID NO: 1794834 - RNA, 16 nt, Homo sapiens
acagaaucucagucug

SEQ ID NO: 1794835 - RNA, 21 nt, Homo sapiens
uauaaucaucaaguaauacaa

SEQ ID NO: 1794836 - RNA, 21 nt, Homo sapiens
caccugcggggccacccaucg

SEQ ID NO: 1794837 - RNA, 22 nt, Homo sapiens
aaauacauaucgcugacuucau

SEQ ID NO: 1794838 - RNA, 21 nt, Homo sapiens
aauaagaauucagacaucuga

SEQ ID NO: 1794839 - RNA, 20 nt, Homo sapiens
acacuuuuuggaagugaaaa

SEQ ID NO: 1794840 - RNA, 18 nt, Homo sapiens
aauuguuaauaugcagcc

SEQ ID NO: 1794841 - RNA, 18 nt, Homo sapiens
gaaguagccaacagcgaa

SEQ ID NO: 1794842 - RNA, 15 nt, Homo sapiens
gccccagccuaggaa

SEQ ID NO: 1794843 - RNA, 15 nt, Homo sapiens
gcaccggccucggga

SEQ ID NO: 1794844 - RNA, 12 nt, Homo sapiens
acgucacacuug

SEQ ID NO: 1794845 - RNA, 22 nt, Homo sapiens
uguuuuccaaagaaaaguauug

SEQ ID NO: 1794846 - RNA, 16 nt, Homo sapiens
aucauggcagugauga

SEQ ID NO: 1794847 - RNA, 18 nt, Homo sapiens
cugcuugguagcacuuua

SEQ ID NO: 1794848 - RNA, 13 nt, Homo sapiens
aggauacccagau

SEQ ID NO: 1794849 - RNA, 23 nt, Homo sapiens
gccuccccccacccgaagccaau

SEQ ID NO: 1794850 - RNA, 23 nt, Homo sapiens
aaguggcagacagaagcuucucu

SEQ ID NO: 1794851 - RNA, 15 nt, Homo sapiens
gcaggaaaaguugau

SEQ ID NO: 1794852 - RNA, 19 nt, Homo sapiens
ugcaaguucauaggucucc

SEQ ID NO: 1794853 - RNA, 23 nt, Homo sapiens
ggacuaccucugugccuugccac

SEQ ID NO: 1794854 - RNA, 14 nt, Homo sapiens
uuugaaaaugcucu

SEQ ID NO: 1794855 - RNA, 18 nt, Homo sapiens
uugagccuggcuguccaa

SEQ ID NO: 1794856 - RNA, 14 nt, Homo sapiens
ccuuguauaguguc

SEQ ID NO: 1794857 - RNA, 19 nt, Homo sapiens
uccgagaggugggccaguc

SEQ ID NO: 1794858 - RNA, 15 nt, Homo sapiens
cuauuguaaugccaa

SEQ ID NO: 1794859 - RNA, 22 nt, Homo sapiens
cagcuuccaaaucucauacaca

SEQ ID NO: 1794860 - RNA, 18 nt, Homo sapiens
uaagugaagugauacuau

SEQ ID NO: 1794861 - RNA, 20 nt, Homo sapiens
agccucugccgcugccaugc

SEQ ID NO: 1794862 - RNA, 17 nt, Homo sapiens
ugaacagcuaauuguac

SEQ ID NO: 1794863 - RNA, 13 nt, Homo sapiens
ucagccacuguga

SEQ ID NO: 1794864 - RNA, 17 nt, Homo sapiens
uggcuggaaggggucca

SEQ ID NO: 1794865 - RNA, 16 nt, Homo sapiens
gaaacuuuaauccaaa

SEQ ID NO: 1794866 - RNA, 12 nt, Homo sapiens
ccucagggaugg

SEQ ID NO: 1794867 - RNA, 21 nt, Homo sapiens
ucuagucucucuggggccaca

SEQ ID NO: 1794868 - RNA, 14 nt, Homo sapiens
caccauugugaagc

SEQ ID NO: 1794869 - RNA, 23 nt, Homo sapiens
caccacacuuuccgcuuucacuu

SEQ ID NO: 1794870 - RNA, 15 nt, Homo sapiens
gagaacaacuggcag

SEQ ID NO: 1794871 - RNA, 21 nt, Homo sapiens
gcuguuuagaacuacugauaa

SEQ ID NO: 1794872 - RNA, 13 nt, Homo sapiens
gcugagggcauua

SEQ ID NO: 1794873 - RNA, 14 nt, Homo sapiens
gugcacucucugcu

SEQ ID NO: 1794874 - RNA, 16 nt, Homo sapiens
cagccuccccgugcca

SEQ ID NO: 1794875 - RNA, 14 nt, Homo sapiens
gcacaucauuggaa

SEQ ID NO: 1794876 - RNA, 23 nt, Homo sapiens
uauuuaauucuaguuucucucaa

SEQ ID NO: 1794877 - RNA, 18 nt, Homo sapiens
gcaucugaccaucuguga

SEQ ID NO: 1794878 - RNA, 14 nt, Homo sapiens
cagcaggacacuga

SEQ ID NO: 1794879 - RNA, 17 nt, Homo sapiens
ucaccaaacacaagaaa

SEQ ID NO: 1794880 - RNA, 22 nt, Homo sapiens
uuugugaaugugagguguugcu

SEQ ID NO: 1794881 - RNA, 21 nt, Homo sapiens
auuuguacuuugacaaacuga

SEQ ID NO: 1794882 - RNA, 13 nt, Homo sapiens
cuauucucaccag

SEQ ID NO: 1794883 - RNA, 17 nt, Homo sapiens
auagaauuaacacauga

SEQ ID NO: 1794884 - RNA, 14 nt, Homo sapiens
agcaucugucccac

SEQ ID NO: 1794885 - RNA, 23 nt, Homo sapiens
aagcauccauuaauuaaugagac

SEQ ID NO: 1794886 - RNA, 15 nt, Homo sapiens
guuuuagaaccagcc

SEQ ID NO: 1794887 - RNA, 14 nt, Homo sapiens
cggcuuccucaggg

SEQ ID NO: 1794888 - RNA, 17 nt, Homo sapiens
aacaauauaauuuucac

SEQ ID NO: 1794889 - RNA, 14 nt, Homo sapiens
aaaacugacagagg

SEQ ID NO: 1794890 - RNA, 17 nt, Homo sapiens
auaaauauagagaugug

SEQ ID NO: 1794891 - RNA, 15 nt, Homo sapiens
caccucucagcugcu

SEQ ID NO: 1794892 - RNA, 16 nt, Homo sapiens
agaauucuuacauguu

SEQ ID NO: 1794893 - RNA, 18 nt, Homo sapiens
cacucaucagguaaacug

SEQ ID NO: 1794894 - RNA, 20 nt, Homo sapiens
acaaaggugauuuuccugug

SEQ ID NO: 1794895 - RNA, 23 nt, Homo sapiens
gacuugaggccugagacacagcc

SEQ ID NO: 1794896 - RNA, 17 nt, Homo sapiens
guauauuucccuguuuc

SEQ ID NO: 1794897 - RNA, 17 nt, Homo sapiens
cuccacuugccuuguga

SEQ ID NO: 1794898 - RNA, 18 nt, Homo sapiens
ucuucaaagcaaagcucu

SEQ ID NO: 1794899 - RNA, 23 nt, Homo sapiens
guccaagucucgcuacauuuccg

SEQ ID NO: 1794900 - RNA, 19 nt, Homo sapiens
gaaaucauugugugucuuc

SEQ ID NO: 1794901 - RNA, 20 nt, Homo sapiens
agaugucaggaaacauucag

SEQ ID NO: 1794902 - RNA, 20 nt, Homo sapiens
aaugcuuuuaaaugcucucu

SEQ ID NO: 1794903 - RNA, 19 nt, Homo sapiens
ucagcuuugggguuccuuu

SEQ ID NO: 1794904 - RNA, 16 nt, Homo sapiens
uaaucacucuaauuaa

SEQ ID NO: 1794905 - RNA, 21 nt, Homo sapiens
augauuuacucaauaucugaa

SEQ ID NO: 1794906 - RNA, 21 nt, Homo sapiens
gaaauggccaaagcacaugca

SEQ ID NO: 1794907 - RNA, 14 nt, Homo sapiens
uagaggcuauuccu

SEQ ID NO: 1794908 - RNA, 16 nt, Homo sapiens
accaguaugaaugaca

SEQ ID NO: 1794909 - RNA, 14 nt, Homo sapiens
uggacuuccaaucu

SEQ ID NO: 1794910 - RNA, 22 nt, Homo sapiens
acgauugaaaugaaaacucuau

SEQ ID NO: 1794911 - RNA, 21 nt, Homo sapiens
uauauuuuaaaaauaaauuca

SEQ ID NO: 1794912 - RNA, 13 nt, Homo sapiens
gaaugaauuucaa

SEQ ID NO: 1794913 - RNA, 16 nt, Homo sapiens
uaaaacauuggcauuu

SEQ ID NO: 1794914 - RNA, 17 nt, Homo sapiens
uuuaguccuguacugua

SEQ ID NO: 1794915 - RNA, 19 nt, Homo sapiens
cauaucuggcucaacaucu

SEQ ID NO: 1794916 - RNA, 21 nt, Homo sapiens
uuacuuuuuuuuaagucacaa

SEQ ID NO: 1794917 - RNA, 21 nt, Homo sapiens
auucuuguaucaaauucaaua

SEQ ID NO: 1794918 - RNA, 23 nt, Homo sapiens
ucacuguggaagaaauuccuucc

SEQ ID NO: 1794919 - RNA, 23 nt, Homo sapiens
aaacacgccugcaaacgcugccu

SEQ ID NO: 1794920 - RNA, 14 nt, Homo sapiens
ucaguucccagaau

SEQ ID NO: 1794921 - RNA, 13 nt, Homo sapiens
cuccugaccaaag

SEQ ID NO: 1794922 - RNA, 15 nt, Homo sapiens
auaccucaguuugca

SEQ ID NO: 1794923 - RNA, 21 nt, Homo sapiens
ugcaauggaauauaaauauca

SEQ ID NO: 1794924 - RNA, 16 nt, Homo sapiens
ugauguacuacauuaa

SEQ ID NO: 1794925 - RNA, 19 nt, Homo sapiens
cggcacccugauccucacc

SEQ ID NO: 1794926 - RNA, 15 nt, Homo sapiens
agucaccaaguguau

SEQ ID NO: 1794927 - RNA, 14 nt, Homo sapiens
cauccgcuacuaca

SEQ ID NO: 1794928 - RNA, 14 nt, Homo sapiens
auacagucuuccac

SEQ ID NO: 1794929 - RNA, 11 nt, Homo sapiens
ggccagcacca

SEQ ID NO: 1794930 - RNA, 21 nt, Homo sapiens
auguaaaagaacuuacugauu

SEQ ID NO: 1794931 - RNA, 21 nt, Homo sapiens
gaggacugcaccauugcugcu

SEQ ID NO: 1794932 - RNA, 15 nt, Homo sapiens
auggguuaagagcuc

SEQ ID NO: 1794933 - RNA, 22 nt, Homo sapiens
ccaggcccuuggcugcaggcaa

SEQ ID NO: 1794934 - RNA, 16 nt, Homo sapiens
caccugcccugcugag

SEQ ID NO: 1794935 - RNA, 15 nt, Homo sapiens
uccauaaaauuggau

SEQ ID NO: 1794936 - RNA, 12 nt, Homo sapiens
cuacacauacag

SEQ ID NO: 1794937 - RNA, 22 nt, Homo sapiens
aacugcaucaagaugugacaug

SEQ ID NO: 1794938 - RNA, 22 nt, Homo sapiens
auuaguuguuuagagaaugaga

SEQ ID NO: 1794939 - RNA, 20 nt, Homo sapiens
gugccuuaaccuagaggguc

SEQ ID NO: 1794940 - RNA, 19 nt, Homo sapiens
cagagugagacccugucuc

SEQ ID NO: 1794941 - RNA, 20 nt, Homo sapiens
uccacaccacuguugccuuu

SEQ ID NO: 1794942 - RNA, 20 nt, Homo sapiens
cagagccuagccaccuccca

SEQ ID NO: 1794943 - RNA, 23 nt, Homo sapiens
accccucccucuguccaccagcc

SEQ ID NO: 1794944 - RNA, 12 nt, Homo sapiens
ggccuacuucuc

SEQ ID NO: 1794945 - RNA, 22 nt, Homo sapiens
ucuuggggggucagggugcugu

SEQ ID NO: 1794946 - RNA, 19 nt, Homo sapiens
cacugguuuguucccugug

SEQ ID NO: 1794947 - RNA, 13 nt, Homo sapiens
cuccuuuagccau

SEQ ID NO: 1794948 - RNA, 18 nt, Homo sapiens
uggaccagugaccaaacc

SEQ ID NO: 1794949 - RNA, 17 nt, Homo sapiens
ggauccagccauuccug

SEQ ID NO: 1794950 - RNA, 19 nt, Homo sapiens
cacuccuguaacugucuca

SEQ ID NO: 1794951 - RNA, 19 nt, Homo sapiens
ugcuccucugccugugccc

SEQ ID NO: 1794952 - RNA, 21 nt, Homo sapiens
caccgugccuggcugauucag

SEQ ID NO: 1794953 - RNA, 20 nt, Homo sapiens
gagauaaauuuaaagucuaa

SEQ ID NO: 1794954 - RNA, 14 nt, Homo sapiens
cuggauuuuuacca

SEQ ID NO: 1794955 - RNA, 20 nt, Homo sapiens
ugccaucugugauaugccau

SEQ ID NO: 1794956 - RNA, 15 nt, Homo sapiens
cagacucucacaugc

SEQ ID NO: 1794957 - RNA, 15 nt, Homo sapiens
uagaugguuacacug

SEQ ID NO: 1794958 - RNA, 19 nt, Homo sapiens
ucaccagagcuucucuggg

SEQ ID NO: 1794959 - RNA, 18 nt, Homo sapiens
cuggccugagaauugagg

SEQ ID NO: 1794960 - RNA, 13 nt, Homo sapiens
ucaaggacuggua

SEQ ID NO: 1794961 - RNA, 15 nt, Homo sapiens
uacacacuugcauga

SEQ ID NO: 1794962 - RNA, 13 nt, Homo sapiens
cgggcaccuguaa

SEQ ID NO: 1794963 - RNA, 20 nt, Homo sapiens
ucuaaccugcgucauuucag

SEQ ID NO: 1794964 - RNA, 16 nt, Homo sapiens
acagaagccaagcucc

SEQ ID NO: 1794965 - RNA, 15 nt, Homo sapiens
ucggggccugcugga

SEQ ID NO: 1794966 - RNA, 17 nt, Homo sapiens
ugcccucggagugccac

SEQ ID NO: 1794967 - RNA, 23 nt, Homo sapiens
aacauccuggagaguaucugaga

SEQ ID NO: 1794968 - RNA, 12 nt, Homo sapiens
cauuuuguauaa

SEQ ID NO: 1794969 - RNA, 19 nt, Homo sapiens
uacaggugugagccaccac

SEQ ID NO: 1794970 - RNA, 21 nt, Homo sapiens
guagcugagaaaacuaaguca

SEQ ID NO: 1794971 - RNA, 20 nt, Homo sapiens
acccucacccccuccuggca

SEQ ID NO: 1794972 - RNA, 19 nt, Homo sapiens
ugaaggcuagaagugugaa

SEQ ID NO: 1794973 - RNA, 22 nt, Homo sapiens
ccuggucagugguggucuucaa

SEQ ID NO: 1794974 - RNA, 21 nt, Homo sapiens
uucucugccuuuuuacuauac

SEQ ID NO: 1794975 - RNA, 19 nt, Homo sapiens
agccucccgaguagcugag

SEQ ID NO: 1794976 - RNA, 20 nt, Homo sapiens
cuccccugggcagacuugac

SEQ ID NO: 1794977 - RNA, 15 nt, Homo sapiens
auaugaguuacugaa

SEQ ID NO: 1794978 - RNA, 21 nt, Homo sapiens
gaaaaugagggccgcuuugag

SEQ ID NO: 1794979 - RNA, 18 nt, Homo sapiens
aucuaauaacuagccuca

SEQ ID NO: 1794980 - RNA, 17 nt, Homo sapiens
guaaugaaggacaguga

SEQ ID NO: 1794981 - RNA, 22 nt, Homo sapiens
uuggcuccaugcuccucacugc

SEQ ID NO: 1794982 - RNA, 17 nt, Homo sapiens
aagggaaauaacaguau

SEQ ID NO: 1794983 - RNA, 15 nt, Homo sapiens
ccgugaacucuggug

SEQ ID NO: 1794984 - RNA, 14 nt, Homo sapiens
uuguccuugcccca

SEQ ID NO: 1794985 - RNA, 16 nt, Homo sapiens
cucacacccacacaaa

SEQ ID NO: 1794986 - RNA, 20 nt, Homo sapiens
auuguuacauuauguggaaa

SEQ ID NO: 1794987 - RNA, 20 nt, Homo sapiens
cuggagauggacaacucaau

SEQ ID NO: 1794988 - RNA, 15 nt, Homo sapiens
ccucuggucacuuca

SEQ ID NO: 1794989 - RNA, 14 nt, Homo sapiens
aucccuucccuguc

SEQ ID NO: 1794990 - RNA, 18 nt, Homo sapiens
aaacauucaggagcuucc

SEQ ID NO: 1794991 - RNA, 14 nt, Homo sapiens
ccagccaagcuuua

SEQ ID NO: 1794992 - RNA, 15 nt, Homo sapiens
aauuuguuugugcuu

SEQ ID NO: 1794993 - RNA, 24 nt, Homo sapiens
uggaugcagcacgccaacauggca

SEQ ID NO: 1794994 - RNA, 22 nt, Homo sapiens
auuccaggaggaguuagccaaa

SEQ ID NO: 1794995 - RNA, 16 nt, Homo sapiens
cugaugcuaauuuuca

SEQ ID NO: 1794996 - RNA, 13 nt, Homo sapiens
gauugucugagga

SEQ ID NO: 1794997 - RNA, 21 nt, Homo sapiens
auucauuuaucaccagcauau

SEQ ID NO: 1794998 - RNA, 21 nt, Homo sapiens
accuaacuggcuuacuuccua

SEQ ID NO: 1794999 - RNA, 19 nt, Homo sapiens
uccugugagguuucccaau

SEQ ID NO: 1795000 - RNA, 22 nt, Homo sapiens
agacuggcagggacgaggacaa

SEQ ID NO: 1795001 - RNA, 19 nt, Homo sapiens
gacaaacuccugaaaugcc

SEQ ID NO: 1795002 - RNA, 19 nt, Homo sapiens
aacccugccgucaccacca

SEQ ID NO: 1795003 - RNA, 15 nt, Homo sapiens
cccucuuuggcaguu

SEQ ID NO: 1795004 - RNA, 12 nt, Homo sapiens
acaaauucuaaa

SEQ ID NO: 1795005 - RNA, 20 nt, Homo sapiens
uaaguggggagagagcccuu

SEQ ID NO: 1795006 - RNA, 23 nt, Homo sapiens
uaaacacgccugcaaacgcugcc

SEQ ID NO: 1795007 - RNA, 15 nt, Homo sapiens
uuuauuaaucuuagu

SEQ ID NO: 1795008 - RNA, 19 nt, Homo sapiens
guggggccuguggaaugag

SEQ ID NO: 1795009 - RNA, 14 nt, Homo sapiens
uguagaugugauua

SEQ ID NO: 1795010 - RNA, 19 nt, Homo sapiens
acuuggacucuccuaguga

SEQ ID NO: 1795011 - RNA, 14 nt, Homo sapiens
uacaaaguauuugc

SEQ ID NO: 1795012 - RNA, 17 nt, Homo sapiens
gcucacguguauucuau

SEQ ID NO: 1795013 - RNA, 19 nt, Homo sapiens
gccauauguggaacaagca

SEQ ID NO: 1795014 - RNA, 15 nt, Homo sapiens
uacuugcacucuuua

SEQ ID NO: 1795015 - RNA, 19 nt, Homo sapiens
uugcugcucacauucugag

SEQ ID NO: 1795016 - RNA, 12 nt, Homo sapiens
acacugccagug

SEQ ID NO: 1795017 - RNA, 23 nt, Homo sapiens
agaaggggacagcgccaccucuu

SEQ ID NO: 1795018 - RNA, 13 nt, Homo sapiens
gucuuugucaugc

SEQ ID NO: 1795019 - RNA, 13 nt, Homo sapiens
augaaauuugcaa

SEQ ID NO: 1795020 - RNA, 12 nt, Homo sapiens
ccuuuaucucaa

SEQ ID NO: 1795021 - RNA, 13 nt, Homo sapiens
aauuuuuccugca

SEQ ID NO: 1795022 - RNA, 18 nt, Homo sapiens
auaguaacuucuaaagag

SEQ ID NO: 1795023 - RNA, 17 nt, Homo sapiens
uccauauuuuacugauc

SEQ ID NO: 1795024 - RNA, 18 nt, Homo sapiens
uucauaccuucugaugaa

SEQ ID NO: 1795025 - RNA, 19 nt, Homo sapiens
caacuggcugaaagguuaa

SEQ ID NO: 1795026 - RNA, 18 nt, Homo sapiens
auaagccccaagcgaauu

SEQ ID NO: 1795027 - RNA, 16 nt, Homo sapiens
uucaccuggaagcauu

SEQ ID NO: 1795028 - RNA, 20 nt, Homo sapiens
uuuagagccaaauucauccu

SEQ ID NO: 1795029 - RNA, 17 nt, Homo sapiens
gccaccccaaagcccuc

SEQ ID NO: 1795030 - RNA, 14 nt, Homo sapiens
ugggacguggucag

SEQ ID NO: 1795031 - RNA, 16 nt, Homo sapiens
ccccagccucuucuag

SEQ ID NO: 1795032 - RNA, 21 nt, Homo sapiens
auucugauuauugaguuccag

SEQ ID NO: 1795033 - RNA, 14 nt, Homo sapiens
uuuaucuguucuug

SEQ ID NO: 1795034 - RNA, 13 nt, Homo sapiens
auccaaccacugu

SEQ ID NO: 1795035 - RNA, 16 nt, Homo sapiens
aaaacuaaacuuucau

SEQ ID NO: 1795036 - RNA, 22 nt, Homo sapiens
aggccucaagaacaaacacugc

SEQ ID NO: 1795037 - RNA, 15 nt, Homo sapiens
uguucugggggacag

SEQ ID NO: 1795038 - RNA, 15 nt, Homo sapiens
ggucacauucaggaa

SEQ ID NO: 1795039 - RNA, 15 nt, Homo sapiens
acaaaaaauacuuua

SEQ ID NO: 1795040 - RNA, 16 nt, Homo sapiens
ccagacaccaucacca

SEQ ID NO: 1795041 - RNA, 15 nt, Homo sapiens
cuccucugcccuuca

SEQ ID NO: 1795042 - RNA, 16 nt, Homo sapiens
uucacuuaacaaacaa

SEQ ID NO: 1795043 - RNA, 15 nt, Homo sapiens
agaacauacacugug

SEQ ID NO: 1795044 - RNA, 18 nt, Homo sapiens
ccaaggguuucgacuggu

SEQ ID NO: 1795045 - RNA, 16 nt, Homo sapiens
acaucacagaacaucc

SEQ ID NO: 1795046 - RNA, 13 nt, Homo sapiens
gauucagcauuug

SEQ ID NO: 1795047 - RNA, 17 nt, Homo sapiens
aggagaaaggggcccca

SEQ ID NO: 1795048 - RNA, 20 nt, Homo sapiens
ggaguucuagaaccacuucc

SEQ ID NO: 1795049 - RNA, 16 nt, Homo sapiens
auccuuccacuaucau

SEQ ID NO: 1795050 - RNA, 17 nt, Homo sapiens
uuguacaaugguuuauu

SEQ ID NO: 1795051 - RNA, 18 nt, Homo sapiens
auuuuuaccuaaucucca

SEQ ID NO: 1795052 - RNA, 18 nt, Homo sapiens
ugcuuacacggaugccuu

SEQ ID NO: 1795053 - RNA, 18 nt, Homo sapiens
accucgacccacucucaa

SEQ ID NO: 1795054 - RNA, 13 nt, Homo sapiens
acuacaugcacuu

SEQ ID NO: 1795055 - RNA, 17 nt, Homo sapiens
aaaguacuguccucaaa

SEQ ID NO: 1795056 - RNA, 21 nt, Homo sapiens
uaacaagaucauuaucuucau

SEQ ID NO: 1795057 - RNA, 23 nt, Homo sapiens
uuaaacuuaagggaaaaguucuc

SEQ ID NO: 1795058 - RNA, 17 nt, Homo sapiens
cuacaaaagcaaaguga

SEQ ID NO: 1795059 - RNA, 15 nt, Homo sapiens
ucuauaaacauaugc

SEQ ID NO: 1795060 - RNA, 23 nt, Homo sapiens
gccagcuaauaagaagugccaag

SEQ ID NO: 1795061 - RNA, 19 nt, Homo sapiens
uauaccaugugugcuaaua

SEQ ID NO: 1795062 - RNA, 16 nt, Homo sapiens
gaaacaaggaaggaca

SEQ ID NO: 1795063 - RNA, 15 nt, Homo sapiens
ggcaucuccauuuca

SEQ ID NO: 1795064 - RNA, 22 nt, Homo sapiens
ggcuuuccuucuguauucauaa

SEQ ID NO: 1795065 - RNA, 19 nt, Homo sapiens
uauuuccugcuacacaaaa

SEQ ID NO: 1795066 - RNA, 19 nt, Homo sapiens
aagcuuauuuagcacauuu

SEQ ID NO: 1795067 - RNA, 15 nt, Homo sapiens
uucagagaagucagu

SEQ ID NO: 1795068 - RNA, 23 nt, Homo sapiens
caucaacaagaguugucuugucc

SEQ ID NO: 1795069 - RNA, 13 nt, Homo sapiens
ucaacacuguuac

SEQ ID NO: 1795070 - RNA, 15 nt, Homo sapiens
agacugaaaagccau

SEQ ID NO: 1795071 - RNA, 22 nt, Homo sapiens
ucccagcuacucagguggcuaa

SEQ ID NO: 1795072 - RNA, 17 nt, Homo sapiens
cucugcagcccucagau

SEQ ID NO: 1795073 - RNA, 21 nt, Homo sapiens
ccggggauucuguacaugcau

SEQ ID NO: 1795074 - RNA, 21 nt, Homo sapiens
uacccccagaggccuuggcca

SEQ ID NO: 1795075 - RNA, 19 nt, Homo sapiens
agagagauacaucuuauaa

SEQ ID NO: 1795076 - RNA, 14 nt, Homo sapiens
uguggacacagauc

SEQ ID NO: 1795077 - RNA, 14 nt, Homo sapiens
cacuguggaaaaug

SEQ ID NO: 1795078 - RNA, 13 nt, Homo sapiens
ugaaaucuuuuaa

SEQ ID NO: 1795079 - RNA, 14 nt, Homo sapiens
caacgaaaagcaca

SEQ ID NO: 1795080 - RNA, 17 nt, Homo sapiens
cauaucuguaugccuca

SEQ ID NO: 1795081 - RNA, 13 nt, Homo sapiens
auacugagccugc

SEQ ID NO: 1795082 - RNA, 18 nt, Homo sapiens
ucaaaauaaaggcgcuaa

SEQ ID NO: 1795083 - RNA, 23 nt, Homo sapiens
gcucacaaccaccauucagucaa

SEQ ID NO: 1795084 - RNA, 18 nt, Homo sapiens
aaacuagaauaauaaugc

SEQ ID NO: 1795085 - RNA, 15 nt, Homo sapiens
cauagauugcaaaua

SEQ ID NO: 1795086 - RNA, 15 nt, Homo sapiens
ccugguuugaagaaa

SEQ ID NO: 1795087 - RNA, 21 nt, Homo sapiens
ccugauauucaggcuacucau

SEQ ID NO: 1795088 - RNA, 20 nt, Homo sapiens
ucugaggcagaugagcuuac

SEQ ID NO: 1795089 - RNA, 15 nt, Homo sapiens
agccaugaagggaug

SEQ ID NO: 1795090 - RNA, 18 nt, Homo sapiens
aucagcuuucagggccau

SEQ ID NO: 1795091 - RNA, 20 nt, Homo sapiens
aacacauuagauguuacugu

SEQ ID NO: 1795092 - RNA, 20 nt, Homo sapiens
gcacaaagcucaagaugaca

SEQ ID NO: 1795093 - RNA, 19 nt, Homo sapiens
agacugaaacgccuugcac

SEQ ID NO: 1795094 - RNA, 19 nt, Homo sapiens
caggccacccaaaggagcu

SEQ ID NO: 1795095 - RNA, 18 nt, Homo sapiens
uaaucaugucguauuugc

SEQ ID NO: 1795096 - RNA, 13 nt, Homo sapiens
ugcaucaugaguu

SEQ ID NO: 1795097 - RNA, 20 nt, Homo sapiens
augaaaucuucccaguauua

SEQ ID NO: 1795098 - RNA, 23 nt, Homo sapiens
ugcaguggcgcgaucucagcuca

SEQ ID NO: 1795099 - RNA, 13 nt, Homo sapiens
ggcuccuaccugg

SEQ ID NO: 1795100 - RNA, 20 nt, Homo sapiens
acuaguauggccagcagaca

SEQ ID NO: 1795101 - RNA, 21 nt, Homo sapiens
cauuaugaguaguguggaauu

SEQ ID NO: 1795102 - RNA, 15 nt, Homo sapiens
uaugaaaccaacugu

SEQ ID NO: 1795103 - RNA, 23 nt, Homo sapiens
acauaaauuacuuuuucauucuu

SEQ ID NO: 1795104 - RNA, 22 nt, Homo sapiens
aucagcacuccucaucaucacu

SEQ ID NO: 1795105 - RNA, 17 nt, Homo sapiens
cgaguggauaauuccaa

SEQ ID NO: 1795106 - RNA, 22 nt, Homo sapiens
ccugaaaauguuaccaguguua

SEQ ID NO: 1795107 - RNA, 18 nt, Homo sapiens
gcuguuuucaacauugua

SEQ ID NO: 1795108 - RNA, 23 nt, Homo sapiens
gcuaucucucagugaacugugag

SEQ ID NO: 1795109 - RNA, 18 nt, Homo sapiens
gaucuuucugcaggaaau

SEQ ID NO: 1795110 - RNA, 19 nt, Homo sapiens
gcugacacgcucaguugaa

SEQ ID NO: 1795111 - RNA, 22 nt, Homo sapiens
auugaagagggccaaacacuga

SEQ ID NO: 1795112 - RNA, 16 nt, Homo sapiens
caggaacccuucucca

SEQ ID NO: 1795113 - RNA, 17 nt, Homo sapiens
uccaggccuguacucau

SEQ ID NO: 1795114 - RNA, 15 nt, Homo sapiens
agugguguucagcca

SEQ ID NO: 1795115 - RNA, 13 nt, Homo sapiens
gaauuggcauuuc

SEQ ID NO: 1795116 - RNA, 16 nt, Homo sapiens
uggacuccccucccug

SEQ ID NO: 1795117 - RNA, 21 nt, Homo sapiens
acaaagcagaagguuaaguca

SEQ ID NO: 1795118 - RNA, 21 nt, Homo sapiens
cuccgagcugguaggcauucc

SEQ ID NO: 1795119 - RNA, 23 nt, Homo sapiens
cauuuaggaaagcagugcaguac

SEQ ID NO: 1795120 - RNA, 18 nt, Homo sapiens
aucuuggccuuacuguau

SEQ ID NO: 1795121 - RNA, 22 nt, Homo sapiens
ugcaaaguacauguauuuuuaa

SEQ ID NO: 1795122 - RNA, 21 nt, Homo sapiens
aagcuguucucaggaucacug

SEQ ID NO: 1795123 - RNA, 19 nt, Homo sapiens
aacaugguuaccucugcau

SEQ ID NO: 1795124 - RNA, 16 nt, Homo sapiens
gauauuugguaccaug

SEQ ID NO: 1795125 - RNA, 22 nt, Homo sapiens
agccacuuucugccagcaucug

SEQ ID NO: 1795126 - RNA, 20 nt, Homo sapiens
gcugggauuacaggugcgug

SEQ ID NO: 1795127 - RNA, 16 nt, Homo sapiens
augcuggguguugcau

SEQ ID NO: 1795128 - RNA, 23 nt, Homo sapiens
ugacgccugauggugcugcucag

SEQ ID NO: 1795129 - RNA, 14 nt, Homo sapiens
aaaugccacucccu

SEQ ID NO: 1795130 - RNA, 21 nt, Homo sapiens
gagugcugacccaacagccuc

SEQ ID NO: 1795131 - RNA, 20 nt, Homo sapiens
gcaauaaauuuauauacuuu

SEQ ID NO: 1795132 - RNA, 13 nt, Homo sapiens
acuaaaaguuuag

SEQ ID NO: 1795133 - RNA, 14 nt, Homo sapiens
caagaacugcaucu

SEQ ID NO: 1795134 - RNA, 21 nt, Homo sapiens
agcacuguguucacacuuuuc

SEQ ID NO: 1795135 - RNA, 22 nt, Homo sapiens
cuggcccaucauggggggagca

SEQ ID NO: 1795136 - RNA, 13 nt, Homo sapiens
agcaguaggauau

SEQ ID NO: 1795137 - RNA, 14 nt, Homo sapiens
auaguccgucucug

SEQ ID NO: 1795138 - RNA, 20 nt, Homo sapiens
ggaagugcccucgagcacug

SEQ ID NO: 1795139 - RNA, 21 nt, Homo sapiens
auacggagccaugucaugugc

SEQ ID NO: 1795140 - RNA, 22 nt, Homo sapiens
aauccagcucccuagacugcau

SEQ ID NO: 1795141 - RNA, 20 nt, Homo sapiens
ggugaacaagcaaacccaga

SEQ ID NO: 1795142 - RNA, 15 nt, Homo sapiens
ucccaagaugcagaa

SEQ ID NO: 1795143 - RNA, 23 nt, Homo sapiens
ugccugauuuguuccuucugggg

SEQ ID NO: 1795144 - RNA, 15 nt, Homo sapiens
uuagaugaaugucag

SEQ ID NO: 1795145 - RNA, 17 nt, Homo sapiens
agucccccuggucugaa

SEQ ID NO: 1795146 - RNA, 15 nt, Homo sapiens
aacuuaaaguauaau

SEQ ID NO: 1795147 - RNA, 13 nt, Homo sapiens
aaaauuaacuggu

SEQ ID NO: 1795148 - RNA, 19 nt, Homo sapiens
ggauaagcacuagaucucc

SEQ ID NO: 1795149 - RNA, 13 nt, Homo sapiens
gaauaacaaggaa

SEQ ID NO: 1795150 - RNA, 22 nt, Homo sapiens
auuuggucacacucucaccuag

SEQ ID NO: 1795151 - RNA, 23 nt, Homo sapiens
agugauuuuggccacacugucaa

SEQ ID NO: 1795152 - RNA, 19 nt, Homo sapiens
gggacauuccucuaggacu

SEQ ID NO: 1795153 - RNA, 19 nt, Homo sapiens
ugcaagaaaaaaacuuacu

SEQ ID NO: 1795154 - RNA, 23 nt, Homo sapiens
cugcacagcuggccaccauggca

SEQ ID NO: 1795155 - RNA, 22 nt, Homo sapiens
gccacgcggccccacauugcac

SEQ ID NO: 1795156 - RNA, 13 nt, Homo sapiens
uuaaacgggcugc

SEQ ID NO: 1795157 - RNA, 16 nt, Homo sapiens
aagccaggaccugcug

SEQ ID NO: 1795158 - RNA, 22 nt, Homo sapiens
ggcuguaugucugacagucuuu

SEQ ID NO: 1795159 - RNA, 15 nt, Homo sapiens
gcuuaccuucugcug

SEQ ID NO: 1795160 - RNA, 15 nt, Homo sapiens
aucagaaaaccaaag

SEQ ID NO: 1795161 - RNA, 22 nt, Homo sapiens
gugaggaugucugggccacuca

SEQ ID NO: 1795162 - RNA, 14 nt, Homo sapiens
ucuccaggggccug

SEQ ID NO: 1795163 - RNA, 22 nt, Homo sapiens
ugugaaauaaauaugaauggag

SEQ ID NO: 1795164 - RNA, 17 nt, Homo sapiens
accucacgcaccuccca

SEQ ID NO: 1795165 - RNA, 18 nt, Homo sapiens
auugccuugagguacuuu

SEQ ID NO: 1795166 - RNA, 21 nt, Homo sapiens
ccuuuucacaauggaaaaccu

SEQ ID NO: 1795167 - RNA, 12 nt, Homo sapiens
auuucaagacua

SEQ ID NO: 1795168 - RNA, 20 nt, Homo sapiens
gccugagugcuuuaccuuua

SEQ ID NO: 1795169 - RNA, 15 nt, Homo sapiens
aucucuuucuacucu

SEQ ID NO: 1795170 - RNA, 13 nt, Homo sapiens
aagaggacugugu

SEQ ID NO: 1795171 - RNA, 23 nt, Homo sapiens
guaacugcucuugaacauugugg

SEQ ID NO: 1795172 - RNA, 18 nt, Homo sapiens
acaacuugaauaauacac

SEQ ID NO: 1795173 - RNA, 18 nt, Homo sapiens
ugugaagauuucauggac

SEQ ID NO: 1795174 - RNA, 20 nt, Homo sapiens
augacauuccaccauuguga

SEQ ID NO: 1795175 - RNA, 12 nt, Homo sapiens
ucaugaucauuc

SEQ ID NO: 1795176 - RNA, 16 nt, Homo sapiens
accuacauauuccaug

SEQ ID NO: 1795177 - RNA, 21 nt, Homo sapiens
aauuuuuuaguauaaguacau

SEQ ID NO: 1795178 - RNA, 10 nt, Homo sapiens
ccauccucac

SEQ ID NO: 1795179 - RNA, 12 nt, Homo sapiens
ucaaaugugcau

SEQ ID NO: 1795180 - RNA, 21 nt, Homo sapiens
agccugcugguuuuaucugag

SEQ ID NO: 1795181 - RNA, 20 nt, Homo sapiens
ggauagcuauuuucuuacag

SEQ ID NO: 1795182 - RNA, 13 nt, Homo sapiens
aagguuugugcug

SEQ ID NO: 1795183 - RNA, 19 nt, Homo sapiens
gaggauuaggggaugggga

SEQ ID NO: 1795184 - RNA, 15 nt, Homo sapiens
gugaacgcccagaga

SEQ ID NO: 1795185 - RNA, 17 nt, Homo sapiens
aauauccuccaaugugu

SEQ ID NO: 1795186 - RNA, 14 nt, Homo sapiens
aacuggaaggccuu

SEQ ID NO: 1795187 - RNA, 20 nt, Homo sapiens
cagcugcggcaucccugugu

SEQ ID NO: 1795188 - RNA, 16 nt, Homo sapiens
gcagguucccaagcuc

SEQ ID NO: 1795189 - RNA, 16 nt, Homo sapiens
gcacaugccuacugcu

SEQ ID NO: 1795190 - RNA, 22 nt, Homo sapiens
guugguuuggccacucuugacc

SEQ ID NO: 1795191 - RNA, 15 nt, Homo sapiens
ucaauuucaacaugg

SEQ ID NO: 1795192 - RNA, 15 nt, Homo sapiens
gaaaaguguuaggga

SEQ ID NO: 1795193 - RNA, 14 nt, Homo sapiens
gucauagauguuuc

SEQ ID NO: 1795194 - RNA, 19 nt, Homo sapiens
cuggcccuguugugggggu

SEQ ID NO: 1795195 - RNA, 20 nt, Homo sapiens
uuuggagaaaugucauaaau

SEQ ID NO: 1795196 - RNA, 16 nt, Homo sapiens
ucaucucucugcccaa

SEQ ID NO: 1795197 - RNA, 16 nt, Homo sapiens
cccacagguccuccau

SEQ ID NO: 1795198 - RNA, 20 nt, Homo sapiens
ugcccaggcuggagcgcagu

SEQ ID NO: 1795199 - RNA, 18 nt, Homo sapiens
ccugucaccaugacuucc

SEQ ID NO: 1795200 - RNA, 14 nt, Homo sapiens
gcaucccaggggac

SEQ ID NO: 1795201 - RNA, 20 nt, Homo sapiens
uaaaauaguggaucucaguu

SEQ ID NO: 1795202 - RNA, 14 nt, Homo sapiens
aaaagacaaaugug

SEQ ID NO: 1795203 - RNA, 23 nt, Homo sapiens
agacucaaagagggagugcauuu

SEQ ID NO: 1795204 - RNA, 12 nt, Homo sapiens
accaaacugugg

SEQ ID NO: 1795205 - RNA, 18 nt, Homo sapiens
cacuguuugccauucucu

SEQ ID NO: 1795206 - RNA, 14 nt, Homo sapiens
ggcuuuccugguuc

SEQ ID NO: 1795207 - RNA, 14 nt, Homo sapiens
agcuaaaccaagaa

SEQ ID NO: 1795208 - RNA, 20 nt, Homo sapiens
uguuucuaaagguagaucau

SEQ ID NO: 1795209 - RNA, 18 nt, Homo sapiens
gcuauaauucuauacugu

SEQ ID NO: 1795210 - RNA, 20 nt, Homo sapiens
caguuuucauaguauccaua

SEQ ID NO: 1795211 - RNA, 14 nt, Homo sapiens
gauaauuaaugauu

SEQ ID NO: 1795212 - RNA, 15 nt, Homo sapiens
gaugggauuucaccg

SEQ ID NO: 1795213 - RNA, 14 nt, Homo sapiens
uaugaaucugcuca

SEQ ID NO: 1795214 - RNA, 18 nt, Homo sapiens
uggcccgcgucuagcuua

SEQ ID NO: 1795215 - RNA, 20 nt, Homo sapiens
ucccuuggucuuuucuugcc

SEQ ID NO: 1795216 - RNA, 17 nt, Homo sapiens
auauccuugauguacag

SEQ ID NO: 1795217 - RNA, 21 nt, Homo sapiens
acucgcccucgccaguggugu

SEQ ID NO: 1795218 - RNA, 18 nt, Homo sapiens
uagauuguaauacacaua

SEQ ID NO: 1795219 - RNA, 23 nt, Homo sapiens
gccuccuagaccuguucuuucca

SEQ ID NO: 1795220 - RNA, 23 nt, Homo sapiens
cuuuuaaaaggcccuguggucug

SEQ ID NO: 1795221 - RNA, 15 nt, Homo sapiens
cucuaaugccaaguu

SEQ ID NO: 1795222 - RNA, 21 nt, Homo sapiens
auuugagcaugcacagcugcu

SEQ ID NO: 1795223 - RNA, 16 nt, Homo sapiens
gcaucugauuugcaua

SEQ ID NO: 1795224 - RNA, 18 nt, Homo sapiens
ccaaaaaagaugccaaca

SEQ ID NO: 1795225 - RNA, 19 nt, Homo sapiens
uucuugcaagcaugcuugu

SEQ ID NO: 1795226 - RNA, 19 nt, Homo sapiens
gucuaacgcugaacugaca

SEQ ID NO: 1795227 - RNA, 17 nt, Homo sapiens
gaagcgcggcuaacuua

SEQ ID NO: 1795228 - RNA, 18 nt, Homo sapiens
auuauauucacagacuga

SEQ ID NO: 1795229 - RNA, 16 nt, Homo sapiens
caauauuuacucauca

SEQ ID NO: 1795230 - RNA, 13 nt, Homo sapiens
ucaagugccuuaa

SEQ ID NO: 1795231 - RNA, 15 nt, Homo sapiens
ucuaggccagguaug

SEQ ID NO: 1795232 - RNA, 23 nt, Homo sapiens
gucauguaagggaagcuggaauu

SEQ ID NO: 1795233 - RNA, 15 nt, Homo sapiens
ucacuacucagugau

SEQ ID NO: 1795234 - RNA, 15 nt, Homo sapiens
gggauugcugugaaa

SEQ ID NO: 1795235 - RNA, 16 nt, Homo sapiens
ggcggaucuuuggaca

SEQ ID NO: 1795236 - RNA, 17 nt, Homo sapiens
caggugcgcacuaccac

SEQ ID NO: 1795237 - RNA, 17 nt, Homo sapiens
ucacaaauggcuacauc

SEQ ID NO: 1795238 - RNA, 22 nt, Homo sapiens
agacuauguagcaauauaucag

SEQ ID NO: 1795239 - RNA, 21 nt, Homo sapiens
augagcaauguggauaugacc

SEQ ID NO: 1795240 - RNA, 16 nt, Homo sapiens
gaggaacugcuugugc

SEQ ID NO: 1795241 - RNA, 16 nt, Homo sapiens
uagguguggcugugaa

SEQ ID NO: 1795242 - RNA, 21 nt, Homo sapiens
gaaugaaccuucuggccuccc

SEQ ID NO: 1795243 - RNA, 20 nt, Homo sapiens
caucccaaagugcugggauu

SEQ ID NO: 1795244 - RNA, 16 nt, Homo sapiens
acaggguaccaggaua

SEQ ID NO: 1795245 - RNA, 22 nt, Homo sapiens
guuuucucuguauaacuuguga

SEQ ID NO: 1795246 - RNA, 23 nt, Homo sapiens
aaugugacuugagcccagaguga

SEQ ID NO: 1795247 - RNA, 15 nt, Homo sapiens
uagcuauggaaucaa

SEQ ID NO: 1795248 - RNA, 18 nt, Homo sapiens
cuaaaugaguaaacccag

SEQ ID NO: 1795249 - RNA, 23 nt, Homo sapiens
gcaagacauuauauagcaguaaa

SEQ ID NO: 1795250 - RNA, 19 nt, Homo sapiens
acauagcuaguuaugugag

SEQ ID NO: 1795251 - RNA, 13 nt, Homo sapiens
ccaggcugaaaag

SEQ ID NO: 1795252 - RNA, 15 nt, Homo sapiens
acagaaaccuuuuau

SEQ ID NO: 1795253 - RNA, 22 nt, Homo sapiens
cauugaaacuaagagcucucaa

SEQ ID NO: 1795254 - RNA, 13 nt, Homo sapiens
accugaacaaacc

SEQ ID NO: 1795255 - RNA, 19 nt, Homo sapiens
augacuuuuauaacauuuu

SEQ ID NO: 1795256 - RNA, 19 nt, Homo sapiens
agcagggaauugauccacu

SEQ ID NO: 1795257 - RNA, 21 nt, Homo sapiens
ugaccucagcugcacauuccu

SEQ ID NO: 1795258 - RNA, 14 nt, Homo sapiens
aagacaaacuccug

SEQ ID NO: 1795259 - RNA, 16 nt, Homo sapiens
caagaccaucccugaa

SEQ ID NO: 1795260 - RNA, 15 nt, Homo sapiens
ucaguccacugcuga

SEQ ID NO: 1795261 - RNA, 23 nt, Homo sapiens
agcucugaggggaggcaccucca

SEQ ID NO: 1795262 - RNA, 16 nt, Homo sapiens
gcuuuaauuucaugaa

SEQ ID NO: 1795263 - RNA, 18 nt, Homo sapiens
accucaagcccugagggg

SEQ ID NO: 1795264 - RNA, 19 nt, Homo sapiens
ugugugcucacaauguucu

SEQ ID NO: 1795265 - RNA, 17 nt, Homo sapiens
augccacagcccuguca

SEQ ID NO: 1795266 - RNA, 17 nt, Homo sapiens
acgugaaacagagugau

SEQ ID NO: 1795267 - RNA, 15 nt, Homo sapiens
ccgguggaaggccuu

SEQ ID NO: 1795268 - RNA, 21 nt, Homo sapiens
uaaauaaaacgugacagggaa

SEQ ID NO: 1795269 - RNA, 16 nt, Homo sapiens
ugcacagagauaugca

SEQ ID NO: 1795270 - RNA, 17 nt, Homo sapiens
uguuuuuauuucaauug

SEQ ID NO: 1795271 - RNA, 13 nt, Homo sapiens
aacacucacugcc

SEQ ID NO: 1795272 - RNA, 22 nt, Homo sapiens
cccacucccaggaccaagauug

SEQ ID NO: 1795273 - RNA, 13 nt, Homo sapiens
cacgcccgucucu

SEQ ID NO: 1795274 - RNA, 15 nt, Homo sapiens
cauuauuagcacuuc

SEQ ID NO: 1795275 - RNA, 14 nt, Homo sapiens
cuaguguaccuccu

SEQ ID NO: 1795276 - RNA, 17 nt, Homo sapiens
auuagaaguuaccaaau

SEQ ID NO: 1795277 - RNA, 21 nt, Homo sapiens
aauugaccuuuugacuuaaag

SEQ ID NO: 1795278 - RNA, 23 nt, Homo sapiens
cagagguuucuggcagccaguac

SEQ ID NO: 1795279 - RNA, 22 nt, Homo sapiens
uuccauggaaauaaaaaguaug

SEQ ID NO: 1795280 - RNA, 17 nt, Homo sapiens
aucauccuuuccagcau

SEQ ID NO: 1795281 - RNA, 20 nt, Homo sapiens
cugagacugaagaccaguau

SEQ ID NO: 1795282 - RNA, 13 nt, Homo sapiens
uuuuuauacugua

SEQ ID NO: 1795283 - RNA, 22 nt, Homo sapiens
gcucugauugcuuuauccaaaa

SEQ ID NO: 1795284 - RNA, 22 nt, Homo sapiens
augcaaccaugggcaccaggca

SEQ ID NO: 1795285 - RNA, 17 nt, Homo sapiens
cacuguaacaauacugg

SEQ ID NO: 1795286 - RNA, 14 nt, Homo sapiens
uucauauaugcaaa

SEQ ID NO: 1795287 - RNA, 21 nt, Homo sapiens
cugaaauuguuuuaccagcuc

SEQ ID NO: 1795288 - RNA, 18 nt, Homo sapiens
gcagcaucauucagcaaa

SEQ ID NO: 1795289 - RNA, 11 nt, Homo sapiens
ugcgucuuccg

SEQ ID NO: 1795290 - RNA, 22 nt, Homo sapiens
ccagagccuggggauuccagcu

SEQ ID NO: 1795291 - RNA, 12 nt, Homo sapiens
acaccucagugg

SEQ ID NO: 1795292 - RNA, 14 nt, Homo sapiens
auucucuguacaua

SEQ ID NO: 1795293 - RNA, 15 nt, Homo sapiens
aacuuucucuuugcc

SEQ ID NO: 1795294 - RNA, 21 nt, Homo sapiens
agcucagacggccuagugugc

SEQ ID NO: 1795295 - RNA, 17 nt, Homo sapiens
ggaaggagggagcugcu

SEQ ID NO: 1795296 - RNA, 17 nt, Homo sapiens
auacaguagugucauca

SEQ ID NO: 1795297 - RNA, 20 nt, Homo sapiens
auuauuuugugcaacauaac

SEQ ID NO: 1795298 - RNA, 18 nt, Homo sapiens
cuuaaauuauaccaaaga

SEQ ID NO: 1795299 - RNA, 16 nt, Homo sapiens
ugacgcagcacaagcu

SEQ ID NO: 1795300 - RNA, 22 nt, Homo sapiens
caucagucaucaggugugcuca

SEQ ID NO: 1795301 - RNA, 18 nt, Homo sapiens
agccacuaccuucugacc

SEQ ID NO: 1795302 - RNA, 13 nt, Homo sapiens
guucuuagagugu

SEQ ID NO: 1795303 - RNA, 16 nt, Homo sapiens
aucuucuguaccaaaa

SEQ ID NO: 1795304 - RNA, 14 nt, Homo sapiens
cuuuagaugccaaa

SEQ ID NO: 1795305 - RNA, 18 nt, Homo sapiens
ugaauacagucucaucuu

SEQ ID NO: 1795306 - RNA, 16 nt, Homo sapiens
ggcagauauagcauua

SEQ ID NO: 1795307 - RNA, 22 nt, Homo sapiens
acagugugaagacacugugcag

SEQ ID NO: 1795308 - RNA, 17 nt, Homo sapiens
aaguguaaaucuaaaca

SEQ ID NO: 1795309 - RNA, 16 nt, Homo sapiens
acauagagauaugcac

SEQ ID NO: 1795310 - RNA, 15 nt, Homo sapiens
acaggaaaagggcau

SEQ ID NO: 1795311 - RNA, 18 nt, Homo sapiens
ugaaguagacauggaauu

SEQ ID NO: 1795312 - RNA, 19 nt, Homo sapiens
ggcuggcauggugaggcuu

SEQ ID NO: 1795313 - RNA, 18 nt, Homo sapiens
aucugcaaacaugccagg

SEQ ID NO: 1795314 - RNA, 20 nt, Homo sapiens
gcucuucaaaauaaaacauc

SEQ ID NO: 1795315 - RNA, 15 nt, Homo sapiens
uuauguaacuaucaa

SEQ ID NO: 1795316 - RNA, 16 nt, Homo sapiens
ucuagacaaaaaccau

SEQ ID NO: 1795317 - RNA, 13 nt, Homo sapiens
uuagauacacuuc

SEQ ID NO: 1795318 - RNA, 19 nt, Homo sapiens
uguucugggggacagagaa

SEQ ID NO: 1795319 - RNA, 16 nt, Homo sapiens
uacuguuaacacugcu

SEQ ID NO: 1795320 - RNA, 20 nt, Homo sapiens
aguccaggccucucucugcu

SEQ ID NO: 1795321 - RNA, 14 nt, Homo sapiens
ugaaacuguguauu

SEQ ID NO: 1795322 - RNA, 18 nt, Homo sapiens
cuuuuguguuccuaugga

SEQ ID NO: 1795323 - RNA, 13 nt, Homo sapiens
aguaaaacuguau

SEQ ID NO: 1795324 - RNA, 16 nt, Homo sapiens
caccaggggugcucac

SEQ ID NO: 1795325 - RNA, 22 nt, Homo sapiens
uguucaguguugacauagccuu

SEQ ID NO: 1795326 - RNA, 16 nt, Homo sapiens
aaagaugaaaaguaua

SEQ ID NO: 1795327 - RNA, 21 nt, Homo sapiens
uguuauuggguaucaccacug

SEQ ID NO: 1795328 - RNA, 15 nt, Homo sapiens
uaggcuagagacaga

SEQ ID NO: 1795329 - RNA, 16 nt, Homo sapiens
ccaggugagaagugag

SEQ ID NO: 1795330 - RNA, 15 nt, Homo sapiens
ugugguggcucaugc

SEQ ID NO: 1795331 - RNA, 20 nt, Homo sapiens
gagggaccagacacaggucc

SEQ ID NO: 1795332 - RNA, 16 nt, Homo sapiens
agcugcuggcuugcag

SEQ ID NO: 1795333 - RNA, 15 nt, Homo sapiens
augcaaaucaauuac

SEQ ID NO: 1795334 - RNA, 19 nt, Homo sapiens
aaauuugcaugcaaaauau

SEQ ID NO: 1795335 - RNA, 15 nt, Homo sapiens
uggugaugugccugu

SEQ ID NO: 1795336 - RNA, 14 nt, Homo sapiens
cugccaaccagagc

SEQ ID NO: 1795337 - RNA, 22 nt, Homo sapiens
augucuaauaaaauauaaucua

SEQ ID NO: 1795338 - RNA, 18 nt, Homo sapiens
caugcaaaagcaaucaua

SEQ ID NO: 1795339 - RNA, 20 nt, Homo sapiens
aggcaguuccaggaguacuu

SEQ ID NO: 1795340 - RNA, 21 nt, Homo sapiens
gagcucgggaguuugagacca

SEQ ID NO: 1795341 - RNA, 22 nt, Homo sapiens
uacuguaaagagaccuaccuca

SEQ ID NO: 1795342 - RNA, 15 nt, Homo sapiens
ugaauuuccuaucug

SEQ ID NO: 1795343 - RNA, 16 nt, Homo sapiens
cuggccucugccuuug

SEQ ID NO: 1795344 - RNA, 14 nt, Homo sapiens
auuauccucaaguu

SEQ ID NO: 1795345 - RNA, 13 nt, Homo sapiens
aacucgcucagaa

SEQ ID NO: 1795346 - RNA, 20 nt, Homo sapiens
cuuaugguaccagaugcagc

SEQ ID NO: 1795347 - RNA, 17 nt, Homo sapiens
gccaacugcugcuuuuu

SEQ ID NO: 1795348 - RNA, 15 nt, Homo sapiens
ccagaccauugucuc

SEQ ID NO: 1795349 - RNA, 20 nt, Homo sapiens
ucuccaaggagcaugucacu

SEQ ID NO: 1795350 - RNA, 17 nt, Homo sapiens
uaagacaacagaugugg

SEQ ID NO: 1795351 - RNA, 21 nt, Homo sapiens
uuuuacuuccaugauacuuua

SEQ ID NO: 1795352 - RNA, 23 nt, Homo sapiens
ccccuucaccuucugccaugauu

SEQ ID NO: 1795353 - RNA, 22 nt, Homo sapiens
cuguuccuccuaaaacaauccu

SEQ ID NO: 1795354 - RNA, 14 nt, Homo sapiens
accaaucugugaga

SEQ ID NO: 1795355 - RNA, 16 nt, Homo sapiens
cuucuaccaccagggc

SEQ ID NO: 1795356 - RNA, 17 nt, Homo sapiens
uuugaccacccaccuga

SEQ ID NO: 1795357 - RNA, 21 nt, Homo sapiens
ugucuguguauacauauguau

SEQ ID NO: 1795358 - RNA, 15 nt, Homo sapiens
ucacuuauaccaaag

SEQ ID NO: 1795359 - RNA, 22 nt, Homo sapiens
uaaacguccauuaagcugagag

SEQ ID NO: 1795360 - RNA, 22 nt, Homo sapiens
auuuuguggcaaaauauucuuc

SEQ ID NO: 1795361 - RNA, 14 nt, Homo sapiens
uagacaccuagaaa

SEQ ID NO: 1795362 - RNA, 21 nt, Homo sapiens
uuaucuauagcuaaguacaca

SEQ ID NO: 1795363 - RNA, 15 nt, Homo sapiens
ugacaacuuugccag

SEQ ID NO: 1795364 - RNA, 23 nt, Homo sapiens
uaggccccuggggcucccgaaga

SEQ ID NO: 1795365 - RNA, 14 nt, Homo sapiens
cugaguuucuuggc

SEQ ID NO: 1795366 - RNA, 16 nt, Homo sapiens
uaucagaccucugauc

SEQ ID NO: 1795367 - RNA, 18 nt, Homo sapiens
agguguugggucaguggc

SEQ ID NO: 1795368 - RNA, 20 nt, Homo sapiens
cccuauaucuauaaacacug

SEQ ID NO: 1795369 - RNA, 13 nt, Homo sapiens
acagauaccccac

SEQ ID NO: 1795370 - RNA, 17 nt, Homo sapiens
gucagcaacagagcaaa

SEQ ID NO: 1795371 - RNA, 23 nt, Homo sapiens
gcuacaucuuuuuuucuaugaaa

SEQ ID NO: 1795372 - RNA, 23 nt, Homo sapiens
acuucuuaaauauuuaguugaua

SEQ ID NO: 1795373 - RNA, 22 nt, Homo sapiens
gcaucguuuucuuugcugugcc

SEQ ID NO: 1795374 - RNA, 19 nt, Homo sapiens
ccaagggauggacaucuug

SEQ ID NO: 1795375 - RNA, 15 nt, Homo sapiens
gcccugucuuuccag

SEQ ID NO: 1795376 - RNA, 23 nt, Homo sapiens
gaaagaggagcgugucucugaac

SEQ ID NO: 1795377 - RNA, 21 nt, Homo sapiens
gcuaaauuauuauuuagcuuc

SEQ ID NO: 1795378 - RNA, 15 nt, Homo sapiens
ucccaggcugucagg

SEQ ID NO: 1795379 - RNA, 12 nt, Homo sapiens
agaucugugccu

SEQ ID NO: 1795380 - RNA, 16 nt, Homo sapiens
ggaagucgagggaugg

SEQ ID NO: 1795381 - RNA, 20 nt, Homo sapiens
ugaccccugcuuugccccac

SEQ ID NO: 1795382 - RNA, 22 nt, Homo sapiens
ccugacauuaagacacaccucu

SEQ ID NO: 1795383 - RNA, 23 nt, Homo sapiens
cuucugcuuucucgggaauuuuc

SEQ ID NO: 1795384 - RNA, 16 nt, Homo sapiens
ucccagugaugcugua

SEQ ID NO: 1795385 - RNA, 12 nt, Homo sapiens
augaaugaaacu

SEQ ID NO: 1795386 - RNA, 17 nt, Homo sapiens
caugagcauuggauaca

SEQ ID NO: 1795387 - RNA, 18 nt, Homo sapiens
cuucagucuugaugcagu

SEQ ID NO: 1795388 - RNA, 23 nt, Homo sapiens
guucaccuugggaugaugccuca

SEQ ID NO: 1795389 - RNA, 19 nt, Homo sapiens
uccauccaccccucuggca

SEQ ID NO: 1795390 - RNA, 20 nt, Homo sapiens
cuuuccacccacucuucaca

SEQ ID NO: 1795391 - RNA, 15 nt, Homo sapiens
cugguuagaaaugca

SEQ ID NO: 1795392 - RNA, 17 nt, Homo sapiens
augaaucaaaagugccu

SEQ ID NO: 1795393 - RNA, 20 nt, Homo sapiens
auucuucaaccucauugaca

SEQ ID NO: 1795394 - RNA, 13 nt, Homo sapiens
guuaugugaauga

SEQ ID NO: 1795395 - RNA, 23 nt, Homo sapiens
uguccccucucaucuaugcucuu

SEQ ID NO: 1795396 - RNA, 14 nt, Homo sapiens
aaugaguaacaucu

SEQ ID NO: 1795397 - RNA, 14 nt, Homo sapiens
gaaaucuugcuuca

SEQ ID NO: 1795398 - RNA, 22 nt, Homo sapiens
ucuucagagauaggccuguggg

SEQ ID NO: 1795399 - RNA, 19 nt, Homo sapiens
gaauaaacgccuucccaaa

SEQ ID NO: 1795400 - RNA, 21 nt, Homo sapiens
ugcauuaaaaaugcauauacu

SEQ ID NO: 1795401 - RNA, 19 nt, Homo sapiens
cccugguccccucccccau

SEQ ID NO: 1795402 - RNA, 15 nt, Homo sapiens
uugacucuccagaaa

SEQ ID NO: 1795403 - RNA, 18 nt, Homo sapiens
aauguccugaauccagca

SEQ ID NO: 1795404 - RNA, 19 nt, Homo sapiens
auccuuuacaagauggaga

SEQ ID NO: 1795405 - RNA, 17 nt, Homo sapiens
agcauggagaguggcau

SEQ ID NO: 1795406 - RNA, 18 nt, Homo sapiens
cacgucuuccuucugccu

SEQ ID NO: 1795407 - RNA, 16 nt, Homo sapiens
gcaauccuaagcaaaa

SEQ ID NO: 1795408 - RNA, 18 nt, Homo sapiens
ugggcuggggccucagac

SEQ ID NO: 1795409 - RNA, 18 nt, Homo sapiens
cugaggggauaccauaaa

SEQ ID NO: 1795410 - RNA, 16 nt, Homo sapiens
aauauuauacuucuuu

SEQ ID NO: 1795411 - RNA, 16 nt, Homo sapiens
uauuccuuucuaucau

SEQ ID NO: 1795412 - RNA, 14 nt, Homo sapiens
uggacgugcucaga

SEQ ID NO: 1795413 - RNA, 23 nt, Homo sapiens
ccugcccagaguaugggcacuca

SEQ ID NO: 1795414 - RNA, 21 nt, Homo sapiens
auacaaucagcccagugcaaa

SEQ ID NO: 1795415 - RNA, 20 nt, Homo sapiens
acgugauccucucaccucag

SEQ ID NO: 1795416 - RNA, 20 nt, Homo sapiens
gcucccuaccccagggcccu

SEQ ID NO: 1795417 - RNA, 21 nt, Homo sapiens
caucuugcuaugagguuugcu

SEQ ID NO: 1795418 - RNA, 17 nt, Homo sapiens
augagccaucacuagaa

SEQ ID NO: 1795419 - RNA, 22 nt, Homo sapiens
ugcaagaauuuaaagaaauauu

SEQ ID NO: 1795420 - RNA, 23 nt, Homo sapiens
acuggugcaugacaaguacugua

SEQ ID NO: 1795421 - RNA, 17 nt, Homo sapiens
aucagcucuuccugugu

SEQ ID NO: 1795422 - RNA, 15 nt, Homo sapiens
uuucuacaaugcaca

SEQ ID NO: 1795423 - RNA, 22 nt, Homo sapiens
uuucagaagagacugauccaaa

SEQ ID NO: 1795424 - RNA, 13 nt, Homo sapiens
cccugcugugggu

SEQ ID NO: 1795425 - RNA, 17 nt, Homo sapiens
agggaucccuaacuguu

SEQ ID NO: 1795426 - RNA, 16 nt, Homo sapiens
gauacagccugcaagu

SEQ ID NO: 1795427 - RNA, 23 nt, Homo sapiens
aaaauuguuuuucccaccuuguc

SEQ ID NO: 1795428 - RNA, 16 nt, Homo sapiens
cagugguuggcaauug

SEQ ID NO: 1795429 - RNA, 14 nt, Homo sapiens
cugaacacucaucc

SEQ ID NO: 1795430 - RNA, 22 nt, Homo sapiens
ugaagccuggacgcagccacac

SEQ ID NO: 1795431 - RNA, 14 nt, Homo sapiens
aggagccuuuucaa

SEQ ID NO: 1795432 - RNA, 13 nt, Homo sapiens
cuugaacacuggg

SEQ ID NO: 1795433 - RNA, 15 nt, Homo sapiens
uagcugcucacuuaa

SEQ ID NO: 1795434 - RNA, 13 nt, Homo sapiens
uucaacauuguau

SEQ ID NO: 1795435 - RNA, 13 nt, Homo sapiens
accucaagugauc

SEQ ID NO: 1795436 - RNA, 18 nt, Homo sapiens
ucgagauuaacggugcua

SEQ ID NO: 1795437 - RNA, 11 nt, Homo sapiens
ccaccauuccc

SEQ ID NO: 1795438 - RNA, 20 nt, Homo sapiens
aagcaauccucccacuucag

SEQ ID NO: 1795439 - RNA, 21 nt, Homo sapiens
cacauacugcaugcucaggac

SEQ ID NO: 1795440 - RNA, 20 nt, Homo sapiens
acuaacaaaggcagcugugu

SEQ ID NO: 1795441 - RNA, 19 nt, Homo sapiens
cacagucccaucugcuuca

SEQ ID NO: 1795442 - RNA, 13 nt, Homo sapiens
ccaugaugcauug

SEQ ID NO: 1795443 - RNA, 14 nt, Homo sapiens
ugaguuccuagcca

SEQ ID NO: 1795444 - RNA, 15 nt, Homo sapiens
aaagagcacuuaaga

SEQ ID NO: 1795445 - RNA, 22 nt, Homo sapiens
acauagccuauauuuacaguga

SEQ ID NO: 1795446 - RNA, 20 nt, Homo sapiens
cagcaaaaugugaaugggaa

SEQ ID NO: 1795447 - RNA, 18 nt, Homo sapiens
uaaaacucaaggcuuaua

SEQ ID NO: 1795448 - RNA, 20 nt, Homo sapiens
uuuuagaaauuugguuucaa

SEQ ID NO: 1795449 - RNA, 20 nt, Homo sapiens
aucugauuuucaaaaaucau

SEQ ID NO: 1795450 - RNA, 23 nt, Homo sapiens
uacugaacaaucaaagcacuugg

SEQ ID NO: 1795451 - RNA, 16 nt, Homo sapiens
aggaaagaagcauuuc

SEQ ID NO: 1795452 - RNA, 20 nt, Homo sapiens
gaaaccaaggaaagugaaac

SEQ ID NO: 1795453 - RNA, 20 nt, Homo sapiens
ggaucacagcugcaggccac

SEQ ID NO: 1795454 - RNA, 22 nt, Homo sapiens
cuuuugcaggcucccaccuuua

SEQ ID NO: 1795455 - RNA, 17 nt, Homo sapiens
agcgaguggagucugcc

SEQ ID NO: 1795456 - RNA, 14 nt, Homo sapiens
auaguaacaacaaa

SEQ ID NO: 1795457 - RNA, 18 nt, Homo sapiens
auuuuuguuaagcucagg

SEQ ID NO: 1795458 - RNA, 19 nt, Homo sapiens
uaacaacaauaacacuguc

SEQ ID NO: 1795459 - RNA, 15 nt, Homo sapiens
aaguaucaugcauuc

SEQ ID NO: 1795460 - RNA, 20 nt, Homo sapiens
ugcccaucaucucugccuuu

SEQ ID NO: 1795461 - RNA, 19 nt, Homo sapiens
caaaugacuuuauuauuua

SEQ ID NO: 1795462 - RNA, 15 nt, Homo sapiens
aguggagagugacau

SEQ ID NO: 1795463 - RNA, 23 nt, Homo sapiens
ugccaagccuggagccccugugu

SEQ ID NO: 1795464 - RNA, 21 nt, Homo sapiens
cacguugcccaagguugcaca

SEQ ID NO: 1795465 - RNA, 16 nt, Homo sapiens
aacugaauucuggaca

SEQ ID NO: 1795466 - RNA, 22 nt, Homo sapiens
cagucuuuugugucagugucuu

SEQ ID NO: 1795467 - RNA, 14 nt, Homo sapiens
uguucacauaugau

SEQ ID NO: 1795468 - RNA, 14 nt, Homo sapiens
ucuuaucauggucu

SEQ ID NO: 1795469 - RNA, 22 nt, Homo sapiens
acacaaaugguaaacuccucca

SEQ ID NO: 1795470 - RNA, 15 nt, Homo sapiens
caacacacacaugcu

SEQ ID NO: 1795471 - RNA, 21 nt, Homo sapiens
uacagccugccccugacugug

SEQ ID NO: 1795472 - RNA, 17 nt, Homo sapiens
ccguggcuuugugcuua

SEQ ID NO: 1795473 - RNA, 15 nt, Homo sapiens
gguagaaguggcaua

SEQ ID NO: 1795474 - RNA, 20 nt, Homo sapiens
auuguauuccucaugucauc

SEQ ID NO: 1795475 - RNA, 13 nt, Homo sapiens
uuacaacagaagc

SEQ ID NO: 1795476 - RNA, 15 nt, Homo sapiens
gagugagcaaggggg

SEQ ID NO: 1795477 - RNA, 19 nt, Homo sapiens
uauaguuucaccacuccuc

SEQ ID NO: 1795478 - RNA, 13 nt, Homo sapiens
uggaauacaguca

SEQ ID NO: 1795479 - RNA, 23 nt, Homo sapiens
gcacuggcugcucugucuugguc

SEQ ID NO: 1795480 - RNA, 23 nt, Homo sapiens
cccuuuuucuaacgggcauuucu

SEQ ID NO: 1795481 - RNA, 23 nt, Homo sapiens
uuccguccccgccgccucacugc

SEQ ID NO: 1795482 - RNA, 21 nt, Homo sapiens
caggguucugaggcaaauggc

SEQ ID NO: 1795483 - RNA, 21 nt, Homo sapiens
ccucaagccccauuuccucac

SEQ ID NO: 1795484 - RNA, 16 nt, Homo sapiens
uuugucagagugcaca

SEQ ID NO: 1795485 - RNA, 14 nt, Homo sapiens
ucuaucagguccca

SEQ ID NO: 1795486 - RNA, 15 nt, Homo sapiens
aucacagauuuccaa

SEQ ID NO: 1795487 - RNA, 15 nt, Homo sapiens
agaaaccaggcccug

SEQ ID NO: 1795488 - RNA, 20 nt, Homo sapiens
acuguucaguauugcaauaa

SEQ ID NO: 1795489 - RNA, 16 nt, Homo sapiens
auguauagacuuggcu

SEQ ID NO: 1795490 - RNA, 18 nt, Homo sapiens
cugaaauuaucauuggua

SEQ ID NO: 1795491 - RNA, 17 nt, Homo sapiens
accauuugacuguucaa

SEQ ID NO: 1795492 - RNA, 13 nt, Homo sapiens
uagcccaggagag

SEQ ID NO: 1795493 - RNA, 16 nt, Homo sapiens
ucuggaagccuggacu

SEQ ID NO: 1795494 - RNA, 15 nt, Homo sapiens
cugcagagacuucua

SEQ ID NO: 1795495 - RNA, 22 nt, Homo sapiens
uucuccuuggaggacaguggga

SEQ ID NO: 1795496 - RNA, 18 nt, Homo sapiens
agccugagucaccugcag

SEQ ID NO: 1795497 - RNA, 19 nt, Homo sapiens
cagaaguuacuaaguauua

SEQ ID NO: 1795498 - RNA, 16 nt, Homo sapiens
aaguaacaucagccau

SEQ ID NO: 1795499 - RNA, 18 nt, Homo sapiens
acccacccaaaagucacc

SEQ ID NO: 1795500 - RNA, 21 nt, Homo sapiens
ugacugcaaucaugugcuuca

SEQ ID NO: 1795501 - RNA, 15 nt, Homo sapiens
gauuggccccacuga

SEQ ID NO: 1795502 - RNA, 18 nt, Homo sapiens
ccuucuuuaccuucauuu

SEQ ID NO: 1795503 - RNA, 22 nt, Homo sapiens
ucagugagguuaucuugcugca

SEQ ID NO: 1795504 - RNA, 20 nt, Homo sapiens
ucaaaauagucuaaggccau

SEQ ID NO: 1795505 - RNA, 21 nt, Homo sapiens
cuuaccuuguuuugccaguga

SEQ ID NO: 1795506 - RNA, 21 nt, Homo sapiens
acugagccaaacacacuguaa

SEQ ID NO: 1795507 - RNA, 15 nt, Homo sapiens
caaaacacauaguua

SEQ ID NO: 1795508 - RNA, 15 nt, Homo sapiens
auguggugauacuga

SEQ ID NO: 1795509 - RNA, 19 nt, Homo sapiens
auucucaugggaaggggag

SEQ ID NO: 1795510 - RNA, 22 nt, Homo sapiens
cggugaaaccccgucucuacua

SEQ ID NO: 1795511 - RNA, 14 nt, Homo sapiens
cuggguuccugcaa

SEQ ID NO: 1795512 - RNA, 20 nt, Homo sapiens
ccagugccacgcacaggugc

SEQ ID NO: 1795513 - RNA, 20 nt, Homo sapiens
cuuuccagauaagcagaguu

SEQ ID NO: 1795514 - RNA, 19 nt, Homo sapiens
gcugcaggcacacacgccu

SEQ ID NO: 1795515 - RNA, 19 nt, Homo sapiens
acauuucucaagggccaug

SEQ ID NO: 1795516 - RNA, 15 nt, Homo sapiens
gaaguaucagcacua

SEQ ID NO: 1795517 - RNA, 15 nt, Homo sapiens
aacucuugugaauua

SEQ ID NO: 1795518 - RNA, 18 nt, Homo sapiens
gggaugcccccaggcagc

SEQ ID NO: 1795519 - RNA, 19 nt, Homo sapiens
auaccucuuagcugagugg

SEQ ID NO: 1795520 - RNA, 15 nt, Homo sapiens
aucuauuuguacaau

SEQ ID NO: 1795521 - RNA, 14 nt, Homo sapiens
aaacauugccugau

SEQ ID NO: 1795522 - RNA, 14 nt, Homo sapiens
caagucugacucuc

SEQ ID NO: 1795523 - RNA, 14 nt, Homo sapiens
cauucaauauugac

SEQ ID NO: 1795524 - RNA, 18 nt, Homo sapiens
augcacaggggaaggaaa

SEQ ID NO: 1795525 - RNA, 20 nt, Homo sapiens
cuauuuuuaaaaucauaaca

SEQ ID NO: 1795526 - RNA, 18 nt, Homo sapiens
cccuucauccuugacucc

SEQ ID NO: 1795527 - RNA, 22 nt, Homo sapiens
ucauuggaccuguucaaaaagg

SEQ ID NO: 1795528 - RNA, 12 nt, Homo sapiens
agagacacuggu

SEQ ID NO: 1795529 - RNA, 18 nt, Homo sapiens
gccuucccaggaguacac

SEQ ID NO: 1795530 - RNA, 14 nt, Homo sapiens
cuaugucuggcaga

SEQ ID NO: 1795531 - RNA, 18 nt, Homo sapiens
gcagcugugaccacagca

SEQ ID NO: 1795532 - RNA, 19 nt, Homo sapiens
ucaaguauuaagcaguuca

SEQ ID NO: 1795533 - RNA, 17 nt, Homo sapiens
cuaaugaacucuuucaa

SEQ ID NO: 1795534 - RNA, 13 nt, Homo sapiens
gaacauguagaaa

SEQ ID NO: 1795535 - RNA, 13 nt, Homo sapiens
gaggucccuucaa

SEQ ID NO: 1795536 - RNA, 14 nt, Homo sapiens
agaacugucuuuca

SEQ ID NO: 1795537 - RNA, 12 nt, Homo sapiens
gccuauuccagg

SEQ ID NO: 1795538 - RNA, 23 nt, Homo sapiens
uaacaucccaauaaaguccucuu

SEQ ID NO: 1795539 - RNA, 21 nt, Homo sapiens
gccuccccucuccuuccugug

SEQ ID NO: 1795540 - RNA, 21 nt, Homo sapiens
ucacaaaggaauggaggcucu

SEQ ID NO: 1795541 - RNA, 23 nt, Homo sapiens
ugugguaguuggaaacaaaucau

SEQ ID NO: 1795542 - RNA, 16 nt, Homo sapiens
agucagaccucagcaa

SEQ ID NO: 1795543 - RNA, 14 nt, Homo sapiens
cugggcagauccuc

SEQ ID NO: 1795544 - RNA, 23 nt, Homo sapiens
aggcgguggacuugaacuuuccu

SEQ ID NO: 1795545 - RNA, 20 nt, Homo sapiens
ucaaguuggcuucuaaucaa

SEQ ID NO: 1795546 - RNA, 14 nt, Homo sapiens
aaauaaucucuuag

SEQ ID NO: 1795547 - RNA, 19 nt, Homo sapiens
ggaaagcagugcaguacuc

SEQ ID NO: 1795548 - RNA, 18 nt, Homo sapiens
uucagcagagaaguuuuc

SEQ ID NO: 1795549 - RNA, 11 nt, Homo sapiens
cuccacaugcu

SEQ ID NO: 1795550 - RNA, 21 nt, Homo sapiens
ucaaaaguugguguugacaua

SEQ ID NO: 1795551 - RNA, 12 nt, Homo sapiens
ucacuucuucca

SEQ ID NO: 1795552 - RNA, 12 nt, Homo sapiens
aaacaauuccac

SEQ ID NO: 1795553 - RNA, 15 nt, Homo sapiens
auaugcaucccacag

SEQ ID NO: 1795554 - RNA, 17 nt, Homo sapiens
uuucuuaucacaaaaaa

SEQ ID NO: 1795555 - RNA, 16 nt, Homo sapiens
uccagcuuuacugugg

SEQ ID NO: 1795556 - RNA, 13 nt, Homo sapiens
aauggauccucau

SEQ ID NO: 1795557 - RNA, 17 nt, Homo sapiens
cauugccuccaccucuc

SEQ ID NO: 1795558 - RNA, 15 nt, Homo sapiens
uaaacagacucgcuu

SEQ ID NO: 1795559 - RNA, 22 nt, Homo sapiens
aaugugauaauauauugcuaaa

SEQ ID NO: 1795560 - RNA, 11 nt, Homo sapiens
gagaugcccau

SEQ ID NO: 1795561 - RNA, 15 nt, Homo sapiens
agccuggagggaugc

SEQ ID NO: 1795562 - RNA, 21 nt, Homo sapiens
auggcccucccagugccuccu

SEQ ID NO: 1795563 - RNA, 21 nt, Homo sapiens
agucaggaauggcugcaccuu

SEQ ID NO: 1795564 - RNA, 20 nt, Homo sapiens
aauugugcaaccugauuaca

SEQ ID NO: 1795565 - RNA, 21 nt, Homo sapiens
aaucuucugccuucucaugau

SEQ ID NO: 1795566 - RNA, 14 nt, Homo sapiens
cacagagugccauc

SEQ ID NO: 1795567 - RNA, 14 nt, Homo sapiens
auacuacuuaugaa

SEQ ID NO: 1795568 - RNA, 15 nt, Homo sapiens
gccuuuuggaaaucc

SEQ ID NO: 1795569 - RNA, 17 nt, Homo sapiens
agcaagcucccaaggga

SEQ ID NO: 1795570 - RNA, 20 nt, Homo sapiens
aggagcucaguugagaaaca

SEQ ID NO: 1795571 - RNA, 22 nt, Homo sapiens
ugaauauaaauuuguguucuca

SEQ ID NO: 1795572 - RNA, 21 nt, Homo sapiens
cuccauaugcuguacaugaca

SEQ ID NO: 1795573 - RNA, 12 nt, Homo sapiens
uagaacauucca

SEQ ID NO: 1795574 - RNA, 16 nt, Homo sapiens
agccaugccugagguc

SEQ ID NO: 1795575 - RNA, 19 nt, Homo sapiens
ugccacucccugcugugug

SEQ ID NO: 1795576 - RNA, 20 nt, Homo sapiens
acauguuuccuaccaagcau

SEQ ID NO: 1795577 - RNA, 18 nt, Homo sapiens
uaauggggcagacacaac

SEQ ID NO: 1795578 - RNA, 21 nt, Homo sapiens
aucagcuccagcugcucuguc

SEQ ID NO: 1795579 - RNA, 22 nt, Homo sapiens
cacaaucuuuccuugucucuca

SEQ ID NO: 1795580 - RNA, 15 nt, Homo sapiens
gcccugucugugugc

SEQ ID NO: 1795581 - RNA, 12 nt, Homo sapiens
uccuuguugccc

SEQ ID NO: 1795582 - RNA, 17 nt, Homo sapiens
aaucuugcugucaagga

SEQ ID NO: 1795583 - RNA, 20 nt, Homo sapiens
ucuuguauacacauauauac

SEQ ID NO: 1795584 - RNA, 21 nt, Homo sapiens
gcucaagcgauccucccaccu

SEQ ID NO: 1795585 - RNA, 13 nt, Homo sapiens
ugagcuguuaucu

SEQ ID NO: 1795586 - RNA, 21 nt, Homo sapiens
cuguccaucagauacuauggu

SEQ ID NO: 1795587 - RNA, 18 nt, Homo sapiens
ucgucuuuuuccaaacaa

SEQ ID NO: 1795588 - RNA, 23 nt, Homo sapiens
auuucaccacucaaaggccagac

SEQ ID NO: 1795589 - RNA, 19 nt, Homo sapiens
auguauauuaaaacugcac

SEQ ID NO: 1795590 - RNA, 16 nt, Homo sapiens
augcaccaaguacagc

SEQ ID NO: 1795591 - RNA, 19 nt, Homo sapiens
guauuaggugucauuucca

SEQ ID NO: 1795592 - RNA, 21 nt, Homo sapiens
aagagcacuaguugugaauuu

SEQ ID NO: 1795593 - RNA, 13 nt, Homo sapiens
uuacauguuguaa

SEQ ID NO: 1795594 - RNA, 13 nt, Homo sapiens
cauuucaucuggg

SEQ ID NO: 1795595 - RNA, 14 nt, Homo sapiens
cuuggaacauggaa

SEQ ID NO: 1795596 - RNA, 14 nt, Homo sapiens
aauuauaccagugu

SEQ ID NO: 1795597 - RNA, 15 nt, Homo sapiens
ggagaugccaugagc

SEQ ID NO: 1795598 - RNA, 18 nt, Homo sapiens
ucugggcucaagcuuucc

SEQ ID NO: 1795599 - RNA, 16 nt, Homo sapiens
agcauaacauggagcu

SEQ ID NO: 1795600 - RNA, 15 nt, Homo sapiens
aggcccgcacugggg

SEQ ID NO: 1795601 - RNA, 21 nt, Homo sapiens
uuguuuuaacugauuacugua

SEQ ID NO: 1795602 - RNA, 20 nt, Homo sapiens
aucauauuugaaaaccauau

SEQ ID NO: 1795603 - RNA, 13 nt, Homo sapiens
ugggacaucuucu

SEQ ID NO: 1795604 - RNA, 20 nt, Homo sapiens
augugcauuauuuuccagau

SEQ ID NO: 1795605 - RNA, 14 nt, Homo sapiens
cagaggauguggcc

SEQ ID NO: 1795606 - RNA, 17 nt, Homo sapiens
gucaagugaaggagcug

SEQ ID NO: 1795607 - RNA, 14 nt, Homo sapiens
ugccccagcugggc

SEQ ID NO: 1795608 - RNA, 19 nt, Homo sapiens
gauaugaguacauacucaa

SEQ ID NO: 1795609 - RNA, 16 nt, Homo sapiens
auacaaucagcccagu

SEQ ID NO: 1795610 - RNA, 21 nt, Homo sapiens
aaaaagcaacaucuucauaga

SEQ ID NO: 1795611 - RNA, 21 nt, Homo sapiens
ccagcaguuuccugccagaua

SEQ ID NO: 1795612 - RNA, 19 nt, Homo sapiens
cagaugggcauauguguca

SEQ ID NO: 1795613 - RNA, 22 nt, Homo sapiens
gggucuugcuuucuuugaccuc

SEQ ID NO: 1795614 - RNA, 14 nt, Homo sapiens
acgugccugugauc

SEQ ID NO: 1795615 - RNA, 15 nt, Homo sapiens
guacaagcauucugu

SEQ ID NO: 1795616 - RNA, 15 nt, Homo sapiens
gcucaaucacacugg

SEQ ID NO: 1795617 - RNA, 13 nt, Homo sapiens
ugacaccacuaaa

SEQ ID NO: 1795618 - RNA, 16 nt, Homo sapiens
cccacugaacaugcuc

SEQ ID NO: 1795619 - RNA, 13 nt, Homo sapiens
cagucaggaugag

SEQ ID NO: 1795620 - RNA, 17 nt, Homo sapiens
uagcugggacuacaggu

SEQ ID NO: 1795621 - RNA, 18 nt, Homo sapiens
cugucauggaaaagccca

SEQ ID NO: 1795622 - RNA, 15 nt, Homo sapiens
cagucaguuuugcuc

SEQ ID NO: 1795623 - RNA, 21 nt, Homo sapiens
uuugguagaaggacugaacaa

SEQ ID NO: 1795624 - RNA, 12 nt, Homo sapiens
cccaagcacucc

SEQ ID NO: 1795625 - RNA, 19 nt, Homo sapiens
aaagcaguggacaccagga

SEQ ID NO: 1795626 - RNA, 12 nt, Homo sapiens
ucuauguaucua

SEQ ID NO: 1795627 - RNA, 13 nt, Homo sapiens
uggcagggacccc

SEQ ID NO: 1795628 - RNA, 18 nt, Homo sapiens
acggucuccugacuggug

SEQ ID NO: 1795629 - RNA, 15 nt, Homo sapiens
cagugagaagcugag

SEQ ID NO: 1795630 - RNA, 13 nt, Homo sapiens
cuucagaucugag

SEQ ID NO: 1795631 - RNA, 20 nt, Homo sapiens
aauacaauaaauauuugaac

SEQ ID NO: 1795632 - RNA, 17 nt, Homo sapiens
cuucuucaaacaggaau

SEQ ID NO: 1795633 - RNA, 20 nt, Homo sapiens
aacagucacccuucugggca

SEQ ID NO: 1795634 - RNA, 23 nt, Homo sapiens
cuuacuuccuagucuacuugagg

SEQ ID NO: 1795635 - RNA, 15 nt, Homo sapiens
ggaaacaaagcaaua

SEQ ID NO: 1795636 - RNA, 12 nt, Homo sapiens
acagagacucuc

SEQ ID NO: 1795637 - RNA, 18 nt, Homo sapiens
ugaggcggcccugaccaa

SEQ ID NO: 1795638 - RNA, 15 nt, Homo sapiens
aucacucaaccuuau

SEQ ID NO: 1795639 - RNA, 22 nt, Homo sapiens
aguuuuucuuacuugcauuuau

SEQ ID NO: 1795640 - RNA, 14 nt, Homo sapiens
auuuccacuucuuc

SEQ ID NO: 1795641 - RNA, 17 nt, Homo sapiens
ucucaugaccaaaugcu

SEQ ID NO: 1795642 - RNA, 16 nt, Homo sapiens
accaucugucuugcca

SEQ ID NO: 1795643 - RNA, 21 nt, Homo sapiens
guauaagguaauaaaacucug

SEQ ID NO: 1795644 - RNA, 15 nt, Homo sapiens
uuuuacccacaugac

SEQ ID NO: 1795645 - RNA, 22 nt, Homo sapiens
ucaugaagcguggagacagcuu

SEQ ID NO: 1795646 - RNA, 23 nt, Homo sapiens
augucucuuguuaaaugagcuua

SEQ ID NO: 1795647 - RNA, 14 nt, Homo sapiens
cugcugaggacaau

SEQ ID NO: 1795648 - RNA, 18 nt, Homo sapiens
aagaccuauaaaucauua

SEQ ID NO: 1795649 - RNA, 15 nt, Homo sapiens
acuuguccaauuaau

SEQ ID NO: 1795650 - RNA, 16 nt, Homo sapiens
caauuccccuacauca

SEQ ID NO: 1795651 - RNA, 15 nt, Homo sapiens
cuauuguuacucugg

SEQ ID NO: 1795652 - RNA, 14 nt, Homo sapiens
agaacuacugauaa

SEQ ID NO: 1795653 - RNA, 17 nt, Homo sapiens
ugauuacuguccagcuu

SEQ ID NO: 1795654 - RNA, 13 nt, Homo sapiens
gacaaaaggcaga

SEQ ID NO: 1795655 - RNA, 14 nt, Homo sapiens
uuuuggggcuguau

SEQ ID NO: 1795656 - RNA, 21 nt, Homo sapiens
ccucguccaaggcaguucugu

SEQ ID NO: 1795657 - RNA, 13 nt, Homo sapiens
auaguuaugugau

SEQ ID NO: 1795658 - RNA, 23 nt, Homo sapiens
aaggucauggccacacugugaca

SEQ ID NO: 1795659 - RNA, 17 nt, Homo sapiens
gauuauagugacaauga

SEQ ID NO: 1795660 - RNA, 23 nt, Homo sapiens
ucuuccaucccaggacaccacac

SEQ ID NO: 1795661 - RNA, 13 nt, Homo sapiens
uggauauucauuc

SEQ ID NO: 1795662 - RNA, 21 nt, Homo sapiens
ucuaacaaacucaaaaucugg

SEQ ID NO: 1795663 - RNA, 20 nt, Homo sapiens
uaggcaauggugaacuguca

SEQ ID NO: 1795664 - RNA, 9 nt, Homo sapiens
acacagcca

SEQ ID NO: 1795665 - RNA, 16 nt, Homo sapiens
ccugaacuuacacaaa

SEQ ID NO: 1795666 - RNA, 15 nt, Homo sapiens
caguaccugugccug

SEQ ID NO: 1795667 - RNA, 17 nt, Homo sapiens
ccauacauuaucauuca

SEQ ID NO: 1795668 - RNA, 17 nt, Homo sapiens
guauuaaaccuuuccau

SEQ ID NO: 1795669 - RNA, 18 nt, Homo sapiens
uuuuuaccuaggcaccau

SEQ ID NO: 1795670 - RNA, 13 nt, Homo sapiens
ccuccguggcaca

SEQ ID NO: 1795671 - RNA, 22 nt, Homo sapiens
auucuguaaaauuaaacaaaua

SEQ ID NO: 1795672 - RNA, 15 nt, Homo sapiens
agccuauaucuucau

SEQ ID NO: 1795673 - RNA, 21 nt, Homo sapiens
agcaucuacaccugaggacaa

SEQ ID NO: 1795674 - RNA, 22 nt, Homo sapiens
guaugugugaagugagugaguu

SEQ ID NO: 1795675 - RNA, 19 nt, Homo sapiens
ugaggcagggcaaaugaca

SEQ ID NO: 1795676 - RNA, 16 nt, Homo sapiens
ucaguuggugcugcuu

SEQ ID NO: 1795677 - RNA, 18 nt, Homo sapiens
aaagcucaccaucuucac

SEQ ID NO: 1795678 - RNA, 15 nt, Homo sapiens
guucuagucaugugu

SEQ ID NO: 1795679 - RNA, 17 nt, Homo sapiens
ucuuugucuuaucuggc

SEQ ID NO: 1795680 - RNA, 19 nt, Homo sapiens
ccacuuaaaaaauguccau

SEQ ID NO: 1795681 - RNA, 19 nt, Homo sapiens
aaugcaucuguccucaugu

SEQ ID NO: 1795682 - RNA, 14 nt, Homo sapiens
aacagccaaaacaa

SEQ ID NO: 1795683 - RNA, 18 nt, Homo sapiens
gaacauccggaacagcca

SEQ ID NO: 1795684 - RNA, 16 nt, Homo sapiens
caguaccucaguauuc

SEQ ID NO: 1795685 - RNA, 23 nt, Homo sapiens
ugcuuuagcagagauaacuuauc

SEQ ID NO: 1795686 - RNA, 17 nt, Homo sapiens
uguaggagaaagagccu

SEQ ID NO: 1795687 - RNA, 15 nt, Homo sapiens
uuuaauccuagagau

SEQ ID NO: 1795688 - RNA, 17 nt, Homo sapiens
auggccccuccuugcaa

SEQ ID NO: 1795689 - RNA, 23 nt, Homo sapiens
ccagacuugcacuggggugggau

SEQ ID NO: 1795690 - RNA, 13 nt, Homo sapiens
aauuccaauauga

SEQ ID NO: 1795691 - RNA, 23 nt, Homo sapiens
gcuuaacacaguggguggugagu

SEQ ID NO: 1795692 - RNA, 17 nt, Homo sapiens
uugauaguuuacaaaca

SEQ ID NO: 1795693 - RNA, 20 nt, Homo sapiens
augaguaaacugagacuuaa

SEQ ID NO: 1795694 - RNA, 16 nt, Homo sapiens
cugagcugcagcucuc

SEQ ID NO: 1795695 - RNA, 18 nt, Homo sapiens
gcuccacucugacuggca

SEQ ID NO: 1795696 - RNA, 18 nt, Homo sapiens
ucuuucuaaggacccaaa

SEQ ID NO: 1795697 - RNA, 21 nt, Homo sapiens
aguuucuuaacccuuuccaga

SEQ ID NO: 1795698 - RNA, 12 nt, Homo sapiens
ggacuacuccaa

SEQ ID NO: 1795699 - RNA, 21 nt, Homo sapiens
cuugaggauuuugaguaucuc

SEQ ID NO: 1795700 - RNA, 22 nt, Homo sapiens
uguccugagcaccacacccagu

SEQ ID NO: 1795701 - RNA, 20 nt, Homo sapiens
auugugauuagacagaacac

SEQ ID NO: 1795702 - RNA, 19 nt, Homo sapiens
caaaauguucaguuuauau

SEQ ID NO: 1795703 - RNA, 19 nt, Homo sapiens
uagcuuuuuaccguucacu

SEQ ID NO: 1795704 - RNA, 20 nt, Homo sapiens
ggcauugccucggcuggcuc

SEQ ID NO: 1795705 - RNA, 12 nt, Homo sapiens
gagagacugcuc

SEQ ID NO: 1795706 - RNA, 22 nt, Homo sapiens
agugaaaaucgaggaagcaccu

SEQ ID NO: 1795707 - RNA, 23 nt, Homo sapiens
aaaaaauuugauuuagcauucau

SEQ ID NO: 1795708 - RNA, 13 nt, Homo sapiens
uucuggacacugu

SEQ ID NO: 1795709 - RNA, 21 nt, Homo sapiens
ugaacagguucuccaggugau

SEQ ID NO: 1795710 - RNA, 13 nt, Homo sapiens
cuuucaccaagua

SEQ ID NO: 1795711 - RNA, 14 nt, Homo sapiens
uuauauaauucaag

SEQ ID NO: 1795712 - RNA, 17 nt, Homo sapiens
aggaugcuuguacauaa

SEQ ID NO: 1795713 - RNA, 17 nt, Homo sapiens
cagcuuucaagugccuu

SEQ ID NO: 1795714 - RNA, 13 nt, Homo sapiens
aacaaugcauuuu

SEQ ID NO: 1795715 - RNA, 19 nt, Homo sapiens
auaaagguuagauaagucc

SEQ ID NO: 1795716 - RNA, 15 nt, Homo sapiens
cacccuggcccagcu

SEQ ID NO: 1795717 - RNA, 17 nt, Homo sapiens
augacaccaucagacau

SEQ ID NO: 1795718 - RNA, 20 nt, Homo sapiens
ggugaccucuagagcuggag

SEQ ID NO: 1795719 - RNA, 15 nt, Homo sapiens
acauucucuuugaua

SEQ ID NO: 1795720 - RNA, 13 nt, Homo sapiens
gacuguugccacc

SEQ ID NO: 1795721 - RNA, 18 nt, Homo sapiens
uugaccugaacucugcaa

SEQ ID NO: 1795722 - RNA, 14 nt, Homo sapiens
ucuccaguggauuc

SEQ ID NO: 1795723 - RNA, 22 nt, Homo sapiens
gucucuuguaauccgaaucucu

SEQ ID NO: 1795724 - RNA, 22 nt, Homo sapiens
cacccauugucucauugccagu

SEQ ID NO: 1795725 - RNA, 22 nt, Homo sapiens
ccaggcugcuggagugcagugg

SEQ ID NO: 1795726 - RNA, 14 nt, Homo sapiens
ucugaaacuuaauu

SEQ ID NO: 1795727 - RNA, 20 nt, Homo sapiens
auuguuuucccaaguguaau

SEQ ID NO: 1795728 - RNA, 15 nt, Homo sapiens
uguacacaacaaucc

SEQ ID NO: 1795729 - RNA, 17 nt, Homo sapiens
uuuaauuguaccauuca

SEQ ID NO: 1795730 - RNA, 14 nt, Homo sapiens
aaucauuccacuau

SEQ ID NO: 1795731 - RNA, 17 nt, Homo sapiens
cuguaguugggccuaaa

SEQ ID NO: 1795732 - RNA, 19 nt, Homo sapiens
uaauucucuguggaaugaa

SEQ ID NO: 1795733 - RNA, 18 nt, Homo sapiens
uacauuucccugugcuga

SEQ ID NO: 1795734 - RNA, 17 nt, Homo sapiens
auacagguccugcacau

SEQ ID NO: 1795735 - RNA, 18 nt, Homo sapiens
ugucguuuucacauauga

SEQ ID NO: 1795736 - RNA, 13 nt, Homo sapiens
aaguccagccacu

SEQ ID NO: 1795737 - RNA, 22 nt, Homo sapiens
agccuuaggaaggccuucagga

SEQ ID NO: 1795738 - RNA, 18 nt, Homo sapiens
uccuggaaacagcagugu

SEQ ID NO: 1795739 - RNA, 12 nt, Homo sapiens
agacccggcugc

SEQ ID NO: 1795740 - RNA, 21 nt, Homo sapiens
caaugccaacaaagcuuacaa

SEQ ID NO: 1795741 - RNA, 13 nt, Homo sapiens
ucaggggccucuc

SEQ ID NO: 1795742 - RNA, 19 nt, Homo sapiens
uuguuuguucacauaugau

SEQ ID NO: 1795743 - RNA, 19 nt, Homo sapiens
acauugaaagagaaccagu

SEQ ID NO: 1795744 - RNA, 18 nt, Homo sapiens
uccuaaccucaagugauc

SEQ ID NO: 1795745 - RNA, 17 nt, Homo sapiens
gaggcagaacugcuuga

SEQ ID NO: 1795746 - RNA, 16 nt, Homo sapiens
cuaacaggcacuuuga

SEQ ID NO: 1795747 - RNA, 20 nt, Homo sapiens
agacuaccggacacucguca

SEQ ID NO: 1795748 - RNA, 23 nt, Homo sapiens
agccauaguggagagaacugaau

SEQ ID NO: 1795749 - RNA, 15 nt, Homo sapiens
aguuccuuccuggcc

SEQ ID NO: 1795750 - RNA, 21 nt, Homo sapiens
aagcugaauccuuccauuucu

SEQ ID NO: 1795751 - RNA, 15 nt, Homo sapiens
uaaaaagaaauguga

SEQ ID NO: 1795752 - RNA, 22 nt, Homo sapiens
ugggauuagcccgcuagcauua

SEQ ID NO: 1795753 - RNA, 23 nt, Homo sapiens
uaauuagaacaauagcuauugca

SEQ ID NO: 1795754 - RNA, 14 nt, Homo sapiens
ugaacaagguuuca

SEQ ID NO: 1795755 - RNA, 19 nt, Homo sapiens
acaaaggcugacauucacu

SEQ ID NO: 1795756 - RNA, 22 nt, Homo sapiens
ugccucagccucccaauuagcu

SEQ ID NO: 1795757 - RNA, 16 nt, Homo sapiens
ccccucagaugaucuc

SEQ ID NO: 1795758 - RNA, 14 nt, Homo sapiens
cccugccacugggc

SEQ ID NO: 1795759 - RNA, 19 nt, Homo sapiens
uucaggugugacucuagca

SEQ ID NO: 1795760 - RNA, 14 nt, Homo sapiens
uaugugacugacaa

SEQ ID NO: 1795761 - RNA, 23 nt, Homo sapiens
aaggcaauuccugauggaaaaug

SEQ ID NO: 1795762 - RNA, 18 nt, Homo sapiens
gaccugcuccgccaggaa

SEQ ID NO: 1795763 - RNA, 14 nt, Homo sapiens
cuuaguauugugau

SEQ ID NO: 1795764 - RNA, 17 nt, Homo sapiens
ggcuugaagccaaagaa

SEQ ID NO: 1795765 - RNA, 17 nt, Homo sapiens
ugcuugaaaccaaagau

SEQ ID NO: 1795766 - RNA, 20 nt, Homo sapiens
uaaaaguaaacuacuguuag

SEQ ID NO: 1795767 - RNA, 20 nt, Homo sapiens
acccagucuucuacacagau

SEQ ID NO: 1795768 - RNA, 21 nt, Homo sapiens
ggaacacuagacaagccagaa

SEQ ID NO: 1795769 - RNA, 17 nt, Homo sapiens
guaggguuugacauuuc

SEQ ID NO: 1795770 - RNA, 14 nt, Homo sapiens
uuggcacauuucau

SEQ ID NO: 1795771 - RNA, 16 nt, Homo sapiens
uauacaggcauaaaau

SEQ ID NO: 1795772 - RNA, 18 nt, Homo sapiens
ccucauagaacacacuuu

SEQ ID NO: 1795773 - RNA, 21 nt, Homo sapiens
acaccgagugaggccauagca

SEQ ID NO: 1795774 - RNA, 18 nt, Homo sapiens
cauugucuuuccugaaug

SEQ ID NO: 1795775 - RNA, 16 nt, Homo sapiens
cuucauuucauguaua

SEQ ID NO: 1795776 - RNA, 12 nt, Homo sapiens
cuuagcugucac

SEQ ID NO: 1795777 - RNA, 18 nt, Homo sapiens
uacacacauaugucauau

SEQ ID NO: 1795778 - RNA, 17 nt, Homo sapiens
gcagcugagaccagggu

SEQ ID NO: 1795779 - RNA, 16 nt, Homo sapiens
ugggcggcacagccuu

SEQ ID NO: 1795780 - RNA, 23 nt, Homo sapiens
gcaaagcaacauggcagagcagu

SEQ ID NO: 1795781 - RNA, 21 nt, Homo sapiens
acaaguugcgacggagagaaa

SEQ ID NO: 1795782 - RNA, 16 nt, Homo sapiens
guuucccuuucacugg

SEQ ID NO: 1795783 - RNA, 17 nt, Homo sapiens
aguaggggcuacuguga

SEQ ID NO: 1795784 - RNA, 18 nt, Homo sapiens
ucaguacuucagcaagag

SEQ ID NO: 1795785 - RNA, 20 nt, Homo sapiens
cauaucuauaaaaugacaga

SEQ ID NO: 1795786 - RNA, 15 nt, Homo sapiens
augggaaucauucca

SEQ ID NO: 1795787 - RNA, 22 nt, Homo sapiens
ccuuguggcugagaacuggaca

SEQ ID NO: 1795788 - RNA, 13 nt, Homo sapiens
uucuaccagcuca

SEQ ID NO: 1795789 - RNA, 16 nt, Homo sapiens
uccagaagugugauug

SEQ ID NO: 1795790 - RNA, 21 nt, Homo sapiens
uauuuugauuguuugaugaau

SEQ ID NO: 1795791 - RNA, 16 nt, Homo sapiens
acaauaggucuuucuc

SEQ ID NO: 1795792 - RNA, 22 nt, Homo sapiens
ccaagagccugagugacagagc

SEQ ID NO: 1795793 - RNA, 16 nt, Homo sapiens
auucaaagagcuugaa

SEQ ID NO: 1795794 - RNA, 15 nt, Homo sapiens
ugcucuuaagccuaa

SEQ ID NO: 1795795 - RNA, 15 nt, Homo sapiens
agccaaaccccuaga

SEQ ID NO: 1795796 - RNA, 16 nt, Homo sapiens
cucgaggcggaucuuu

SEQ ID NO: 1795797 - RNA, 16 nt, Homo sapiens
cuugaaggugcugacg

SEQ ID NO: 1795798 - RNA, 16 nt, Homo sapiens
uggagaggaaaagcca

SEQ ID NO: 1795799 - RNA, 20 nt, Homo sapiens
ucuugaguguuaugugaauu

SEQ ID NO: 1795800 - RNA, 16 nt, Homo sapiens
augaugagaagcagaa

SEQ ID NO: 1795801 - RNA, 20 nt, Homo sapiens
uuuccauguaucuaccucac

SEQ ID NO: 1795802 - RNA, 18 nt, Homo sapiens
gcaggucugaagcucaac

SEQ ID NO: 1795803 - RNA, 16 nt, Homo sapiens
caagcuuagaagccac

SEQ ID NO: 1795804 - RNA, 19 nt, Homo sapiens
aaccugcucuccucuucua

SEQ ID NO: 1795805 - RNA, 17 nt, Homo sapiens
aggccaaggccucagga

SEQ ID NO: 1795806 - RNA, 21 nt, Homo sapiens
gcaugggagugaucucaccaa

SEQ ID NO: 1795807 - RNA, 18 nt, Homo sapiens
aaaauaucacuugucaau

SEQ ID NO: 1795808 - RNA, 21 nt, Homo sapiens
gcuaaacccuucaacuaugca

SEQ ID NO: 1795809 - RNA, 15 nt, Homo sapiens
augaugugaaacacu

SEQ ID NO: 1795810 - RNA, 14 nt, Homo sapiens
ccaguauaccucau

SEQ ID NO: 1795811 - RNA, 19 nt, Homo sapiens
ucccuuagugacucuugaa

SEQ ID NO: 1795812 - RNA, 15 nt, Homo sapiens
auggaucagcucuuc

SEQ ID NO: 1795813 - RNA, 18 nt, Homo sapiens
uugucccuaugcauauca

SEQ ID NO: 1795814 - RNA, 13 nt, Homo sapiens
acacugcuuuaaa

SEQ ID NO: 1795815 - RNA, 16 nt, Homo sapiens
cuccucccaagcacuu

SEQ ID NO: 1795816 - RNA, 22 nt, Homo sapiens
acuggagaguggagucgacuca

SEQ ID NO: 1795817 - RNA, 23 nt, Homo sapiens
agucaccuccuccacucacucca

SEQ ID NO: 1795818 - RNA, 17 nt, Homo sapiens
gcacauucauccucaca

SEQ ID NO: 1795819 - RNA, 22 nt, Homo sapiens
uuuaaauuacaauuuuaucugu

SEQ ID NO: 1795820 - RNA, 23 nt, Homo sapiens
ugagauggauguauuuguagcca

SEQ ID NO: 1795821 - RNA, 12 nt, Homo sapiens
gugaugaugcug

SEQ ID NO: 1795822 - RNA, 13 nt, Homo sapiens
caagacagccaca

SEQ ID NO: 1795823 - RNA, 23 nt, Homo sapiens
uguggcccagggaagccaaaaga

SEQ ID NO: 1795824 - RNA, 19 nt, Homo sapiens
gagaagggggucucuguua

SEQ ID NO: 1795825 - RNA, 18 nt, Homo sapiens
agccucuagaacagccag

SEQ ID NO: 1795826 - RNA, 22 nt, Homo sapiens
auuuaagguccuaaauucuuaa

SEQ ID NO: 1795827 - RNA, 16 nt, Homo sapiens
uggcccccuguccucu

SEQ ID NO: 1795828 - RNA, 16 nt, Homo sapiens
auuaucacaugauuau

SEQ ID NO: 1795829 - RNA, 21 nt, Homo sapiens
gagacacaacuauuuuuccaa

SEQ ID NO: 1795830 - RNA, 19 nt, Homo sapiens
caggaaacaugaagcauaa

SEQ ID NO: 1795831 - RNA, 17 nt, Homo sapiens
acagaaacaaaaucaaa

SEQ ID NO: 1795832 - RNA, 14 nt, Homo sapiens
uuucagcuacauau

SEQ ID NO: 1795833 - RNA, 18 nt, Homo sapiens
cagaaugcucacacugaa

SEQ ID NO: 1795834 - RNA, 17 nt, Homo sapiens
agacaaguaaucacuaa

SEQ ID NO: 1795835 - RNA, 19 nt, Homo sapiens
ugcuuugcggcaucuccau

SEQ ID NO: 1795836 - RNA, 22 nt, Homo sapiens
guacaaguauauaauaugucac

SEQ ID NO: 1795837 - RNA, 15 nt, Homo sapiens
cuucuagaugccacu

SEQ ID NO: 1795838 - RNA, 18 nt, Homo sapiens
cagccaaacccugucuga

SEQ ID NO: 1795839 - RNA, 17 nt, Homo sapiens
aacgagauaccaucuca

SEQ ID NO: 1795840 - RNA, 12 nt, Homo sapiens
uuucuggcucuu

SEQ ID NO: 1795841 - RNA, 16 nt, Homo sapiens
ccugcugagucccuca

SEQ ID NO: 1795842 - RNA, 18 nt, Homo sapiens
cucacauuucaccccagg

SEQ ID NO: 1795843 - RNA, 12 nt, Homo sapiens
uaguucuacucc

SEQ ID NO: 1795844 - RNA, 15 nt, Homo sapiens
accauggaguggcag

SEQ ID NO: 1795845 - RNA, 20 nt, Homo sapiens
ugggacacaaaacuccgccc

SEQ ID NO: 1795846 - RNA, 15 nt, Homo sapiens
guaaauugauucaag

SEQ ID NO: 1795847 - RNA, 23 nt, Homo sapiens
cgccccagcaggugcugacuuca

SEQ ID NO: 1795848 - RNA, 16 nt, Homo sapiens
ucucgcagauguuacc

SEQ ID NO: 1795849 - RNA, 12 nt, Homo sapiens
aggggauguuua

SEQ ID NO: 1795850 - RNA, 16 nt, Homo sapiens
ccucagaugcacauga

SEQ ID NO: 1795851 - RNA, 23 nt, Homo sapiens
gcuugcaaaaacuacaaccaaug

SEQ ID NO: 1795852 - RNA, 17 nt, Homo sapiens
aagcauuauccuuuuau

SEQ ID NO: 1795853 - RNA, 16 nt, Homo sapiens
uaucuauguagaauau

SEQ ID NO: 1795854 - RNA, 24 nt, Homo sapiens
cugcucaggguucaucugaagauu

SEQ ID NO: 1795855 - RNA, 20 nt, Homo sapiens
aaguaaaacuugcugccuga

SEQ ID NO: 1795856 - RNA, 16 nt, Homo sapiens
gaguauccucuugcca

SEQ ID NO: 1795857 - RNA, 16 nt, Homo sapiens
gaaaugcuaugucauu

SEQ ID NO: 1795858 - RNA, 14 nt, Homo sapiens
caacagcugccgac

SEQ ID NO: 1795859 - RNA, 20 nt, Homo sapiens
ucacacccugcaaggcccac

SEQ ID NO: 1795860 - RNA, 19 nt, Homo sapiens
agacaaggaggaguuccac

SEQ ID NO: 1795861 - RNA, 23 nt, Homo sapiens
uggagccccggaucccaagcccu

SEQ ID NO: 1795862 - RNA, 15 nt, Homo sapiens
agaauugaaacugag

SEQ ID NO: 1795863 - RNA, 17 nt, Homo sapiens
gagaaguauacucuuga

SEQ ID NO: 1795864 - RNA, 13 nt, Homo sapiens
cucuccauggcca

SEQ ID NO: 1795865 - RNA, 22 nt, Homo sapiens
aaagaucuugaauagucucauc

SEQ ID NO: 1795866 - RNA, 15 nt, Homo sapiens
guauacacacauaua

SEQ ID NO: 1795867 - RNA, 14 nt, Homo sapiens
gauauggcaggacu

SEQ ID NO: 1795868 - RNA, 14 nt, Homo sapiens
agaucucaacaugg

SEQ ID NO: 1795869 - RNA, 22 nt, Homo sapiens
aaucucuucuuugcugcaguca

SEQ ID NO: 1795870 - RNA, 20 nt, Homo sapiens
uugaaaauaguuaccuucaa

SEQ ID NO: 1795871 - RNA, 17 nt, Homo sapiens
cccuguuuaacauuuca

SEQ ID NO: 1795872 - RNA, 21 nt, Homo sapiens
uccccccugcugcccagugca

SEQ ID NO: 1795873 - RNA, 24 nt, Homo sapiens
aucccucucacaagaaugugcaga

SEQ ID NO: 1795874 - RNA, 23 nt, Homo sapiens
agcacaugaaaaccauuaccuga

SEQ ID NO: 1795875 - RNA, 17 nt, Homo sapiens
ucuaagaggagaggcag

SEQ ID NO: 1795876 - RNA, 21 nt, Homo sapiens
ugugacugcuuuuuugccuca

SEQ ID NO: 1795877 - RNA, 22 nt, Homo sapiens
ccacuaggguccaccaggaguu

SEQ ID NO: 1795878 - RNA, 17 nt, Homo sapiens
auauuaauauauuucca

SEQ ID NO: 1795879 - RNA, 13 nt, Homo sapiens
caggauuccagaa

SEQ ID NO: 1795880 - RNA, 15 nt, Homo sapiens
cuuuggugcuuucca

SEQ ID NO: 1795881 - RNA, 15 nt, Homo sapiens
uuaacuugguucuca

SEQ ID NO: 1795882 - RNA, 18 nt, Homo sapiens
ucgaggcuagaggcauuu

SEQ ID NO: 1795883 - RNA, 19 nt, Homo sapiens
aaaauucucagaggacuug

SEQ ID NO: 1795884 - RNA, 16 nt, Homo sapiens
guauaacaacuuugaa

SEQ ID NO: 1795885 - RNA, 12 nt, Homo sapiens
gaaaccuggcau

SEQ ID NO: 1795886 - RNA, 21 nt, Homo sapiens
ccaucucugugauuaccucuc

SEQ ID NO: 1795887 - RNA, 15 nt, Homo sapiens
cccuccccuuuugaa

SEQ ID NO: 1795888 - RNA, 14 nt, Homo sapiens
agaccuaugacuuc

SEQ ID NO: 1795889 - RNA, 19 nt, Homo sapiens
agcuaugauaagauugaaa

SEQ ID NO: 1795890 - RNA, 19 nt, Homo sapiens
aucuggaacgcucuaggca

SEQ ID NO: 1795891 - RNA, 21 nt, Homo sapiens
uugcucuucagaugccacuuc

SEQ ID NO: 1795892 - RNA, 21 nt, Homo sapiens
uguauuagagcgccagcuccu

SEQ ID NO: 1795893 - RNA, 23 nt, Homo sapiens
uuugggcccagggacaccagcca

SEQ ID NO: 1795894 - RNA, 20 nt, Homo sapiens
uucagcgagacccuugcauu

SEQ ID NO: 1795895 - RNA, 18 nt, Homo sapiens
augacaccaaauaugucc

SEQ ID NO: 1795896 - RNA, 18 nt, Homo sapiens
cccuacccuccugcugag

SEQ ID NO: 1795897 - RNA, 17 nt, Homo sapiens
auccucucuaucacauc

SEQ ID NO: 1795898 - RNA, 23 nt, Homo sapiens
auuggauugcgccuuuguauuau

SEQ ID NO: 1795899 - RNA, 22 nt, Homo sapiens
gccuaccccaguuccuagcacu

SEQ ID NO: 1795900 - RNA, 22 nt, Homo sapiens
caguuaggcaccuuaacuggag

SEQ ID NO: 1795901 - RNA, 16 nt, Homo sapiens
auguaaugcauaggaa

SEQ ID NO: 1795902 - RNA, 21 nt, Homo sapiens
aaagagaagcaaaaucuacca

SEQ ID NO: 1795903 - RNA, 22 nt, Homo sapiens
aaaccugggaccccgagcuucc

SEQ ID NO: 1795904 - RNA, 13 nt, Homo sapiens
ucacugaacucca

SEQ ID NO: 1795905 - RNA, 19 nt, Homo sapiens
gcaagugugcucuccuggg

SEQ ID NO: 1795906 - RNA, 22 nt, Homo sapiens
agcuuuagugaauuaaauuuag

SEQ ID NO: 1795907 - RNA, 18 nt, Homo sapiens
agagcaagacuccauuuc

SEQ ID NO: 1795908 - RNA, 14 nt, Homo sapiens
aggauguaguucug

SEQ ID NO: 1795909 - RNA, 16 nt, Homo sapiens
uuccccccuacuugag

SEQ ID NO: 1795910 - RNA, 14 nt, Homo sapiens
cccagagcccguca

SEQ ID NO: 1795911 - RNA, 16 nt, Homo sapiens
gaccuggcuggugaca

SEQ ID NO: 1795912 - RNA, 20 nt, Homo sapiens
gaugagaugguuucuagaga

SEQ ID NO: 1795913 - RNA, 15 nt, Homo sapiens
caacaguugcuaaac

SEQ ID NO: 1795914 - RNA, 15 nt, Homo sapiens
acccaccaaaugccu

SEQ ID NO: 1795915 - RNA, 18 nt, Homo sapiens
gcuacaaaauaaagcugu

SEQ ID NO: 1795916 - RNA, 18 nt, Homo sapiens
aggagagagaaagccagg

SEQ ID NO: 1795917 - RNA, 18 nt, Homo sapiens
gugcaguugugauuucug

SEQ ID NO: 1795918 - RNA, 17 nt, Homo sapiens
aauucuuuguauaugca

SEQ ID NO: 1795919 - RNA, 17 nt, Homo sapiens
cccgagggacuccagau

SEQ ID NO: 1795920 - RNA, 18 nt, Homo sapiens
uucuacaucuuuuauaca

SEQ ID NO: 1795921 - RNA, 20 nt, Homo sapiens
uagcuuccuccaacccgcag

SEQ ID NO: 1795922 - RNA, 20 nt, Homo sapiens
caggugccuggcuugcugug

SEQ ID NO: 1795923 - RNA, 20 nt, Homo sapiens
accuaccuggaagaagccau

SEQ ID NO: 1795924 - RNA, 18 nt, Homo sapiens
ugucaccccucacuguga

SEQ ID NO: 1795925 - RNA, 14 nt, Homo sapiens
cucacauaggaagu

SEQ ID NO: 1795926 - RNA, 14 nt, Homo sapiens
gcuuaguaucucau

SEQ ID NO: 1795927 - RNA, 21 nt, Homo sapiens
caaaaagagacccacaauaaa

SEQ ID NO: 1795928 - RNA, 14 nt, Homo sapiens
acacauuugcccaa

SEQ ID NO: 1795929 - RNA, 19 nt, Homo sapiens
caagcaagcucccaaggga

SEQ ID NO: 1795930 - RNA, 17 nt, Homo sapiens
cucccauccuaaucauc

SEQ ID NO: 1795931 - RNA, 23 nt, Homo sapiens
gccagcugacuagaucucuggau

SEQ ID NO: 1795932 - RNA, 20 nt, Homo sapiens
cagccucugggucugaguca

SEQ ID NO: 1795933 - RNA, 18 nt, Homo sapiens
guggaaaacuuaugcuga

SEQ ID NO: 1795934 - RNA, 20 nt, Homo sapiens
cagggcagccucccccggcu

SEQ ID NO: 1795935 - RNA, 19 nt, Homo sapiens
ccuaaccucgggugaucca

SEQ ID NO: 1795936 - RNA, 15 nt, Homo sapiens
cucaagcacugacac

SEQ ID NO: 1795937 - RNA, 13 nt, Homo sapiens
ccagggaugggca

SEQ ID NO: 1795938 - RNA, 16 nt, Homo sapiens
gacacuagaugauauu

SEQ ID NO: 1795939 - RNA, 14 nt, Homo sapiens
gcugccucccuuuc

SEQ ID NO: 1795940 - RNA, 12 nt, Homo sapiens
ccaucuguaugc

SEQ ID NO: 1795941 - RNA, 20 nt, Homo sapiens
caccuucaccuggaugugca

SEQ ID NO: 1795942 - RNA, 15 nt, Homo sapiens
aaacagcucucccuc

SEQ ID NO: 1795943 - RNA, 19 nt, Homo sapiens
auauuuaaaaaauuaugga

SEQ ID NO: 1795944 - RNA, 15 nt, Homo sapiens
cuguccuggcugcuc

SEQ ID NO: 1795945 - RNA, 13 nt, Homo sapiens
uccagugccugac

SEQ ID NO: 1795946 - RNA, 22 nt, Homo sapiens
gaacucucagaaauaaaucaca

SEQ ID NO: 1795947 - RNA, 20 nt, Homo sapiens
ccucacagagugcauuguga

SEQ ID NO: 1795948 - RNA, 16 nt, Homo sapiens
uauuuuuuucccaagg

SEQ ID NO: 1795949 - RNA, 17 nt, Homo sapiens
gaccacagaggcugugg

SEQ ID NO: 1795950 - RNA, 12 nt, Homo sapiens
uuacagaauucc

SEQ ID NO: 1795951 - RNA, 20 nt, Homo sapiens
agcagaggaccagggccuuu

SEQ ID NO: 1795952 - RNA, 17 nt, Homo sapiens
aaccaccccaucugcau

SEQ ID NO: 1795953 - RNA, 18 nt, Homo sapiens
uggagacaguaacauuuc

SEQ ID NO: 1795954 - RNA, 14 nt, Homo sapiens
uuuuagaaaucagc

SEQ ID NO: 1795955 - RNA, 15 nt, Homo sapiens
accaaaaugagaguu

SEQ ID NO: 1795956 - RNA, 21 nt, Homo sapiens
ccuguaugguuucuacuuuau

SEQ ID NO: 1795957 - RNA, 20 nt, Homo sapiens
cugcgucugacauccugacc

SEQ ID NO: 1795958 - RNA, 22 nt, Homo sapiens
uacacuugugcacccucuaucc

SEQ ID NO: 1795959 - RNA, 16 nt, Homo sapiens
gccagccaugcauugu

SEQ ID NO: 1795960 - RNA, 11 nt, Homo sapiens
ugacagugaag

SEQ ID NO: 1795961 - RNA, 16 nt, Homo sapiens
aaugucuucacucuau

SEQ ID NO: 1795962 - RNA, 13 nt, Homo sapiens
cacauauaacaug

SEQ ID NO: 1795963 - RNA, 19 nt, Homo sapiens
cucugaccuaucacuucca

SEQ ID NO: 1795964 - RNA, 16 nt, Homo sapiens
gcugggauuuacacuu

SEQ ID NO: 1795965 - RNA, 13 nt, Homo sapiens
ccagugaccaaac

SEQ ID NO: 1795966 - RNA, 21 nt, Homo sapiens
ugcugauccucccaggcuucc

SEQ ID NO: 1795967 - RNA, 18 nt, Homo sapiens
cacauugcugauaugcaa

SEQ ID NO: 1795968 - RNA, 20 nt, Homo sapiens
uuguuccucucaaaccugug

SEQ ID NO: 1795969 - RNA, 16 nt, Homo sapiens
uaaugaauacauuucc

SEQ ID NO: 1795970 - RNA, 18 nt, Homo sapiens
cauuugcuguucaucuug

SEQ ID NO: 1795971 - RNA, 19 nt, Homo sapiens
aggcaagauugauguuucc

SEQ ID NO: 1795972 - RNA, 15 nt, Homo sapiens
acaagagggacaagu

SEQ ID NO: 1795973 - RNA, 21 nt, Homo sapiens
cccaguguguuucugaucuga

SEQ ID NO: 1795974 - RNA, 17 nt, Homo sapiens
gagcauguuacugacag

SEQ ID NO: 1795975 - RNA, 16 nt, Homo sapiens
cucgaggcucuuccau

SEQ ID NO: 1795976 - RNA, 21 nt, Homo sapiens
gccuuucuaguccuauucuau

SEQ ID NO: 1795977 - RNA, 15 nt, Homo sapiens
acgcagccaggacac

SEQ ID NO: 1795978 - RNA, 12 nt, Homo sapiens
gccgcugcuuga

SEQ ID NO: 1795979 - RNA, 19 nt, Homo sapiens
gacagagugagacucuguc

SEQ ID NO: 1795980 - RNA, 13 nt, Homo sapiens
uugcuagauuucu

SEQ ID NO: 1795981 - RNA, 16 nt, Homo sapiens
gcaaggauuacagaaa

SEQ ID NO: 1795982 - RNA, 14 nt, Homo sapiens
guaagcucuacuga

SEQ ID NO: 1795983 - RNA, 14 nt, Homo sapiens
agaagcuucuugcu

SEQ ID NO: 1795984 - RNA, 21 nt, Homo sapiens
auucuguccccaaauguccau

SEQ ID NO: 1795985 - RNA, 14 nt, Homo sapiens
cauguaauccuuuu

SEQ ID NO: 1795986 - RNA, 11 nt, Homo sapiens
aggacaaccac

SEQ ID NO: 1795987 - RNA, 20 nt, Homo sapiens
ccuaaugcucaccuuuauca

SEQ ID NO: 1795988 - RNA, 20 nt, Homo sapiens
uaacugugaacaaucagauu

SEQ ID NO: 1795989 - RNA, 15 nt, Homo sapiens
aaaccacuagaacuc

SEQ ID NO: 1795990 - RNA, 14 nt, Homo sapiens
gggagacaaucuaa

SEQ ID NO: 1795991 - RNA, 15 nt, Homo sapiens
acccagccagcugca

SEQ ID NO: 1795992 - RNA, 20 nt, Homo sapiens
uuuauuccagagaagccagg

SEQ ID NO: 1795993 - RNA, 17 nt, Homo sapiens
cacaacaaaaauuugaa

SEQ ID NO: 1795994 - RNA, 21 nt, Homo sapiens
uaccagauaacaaacacugaa

SEQ ID NO: 1795995 - RNA, 22 nt, Homo sapiens
uccaaaccuggccugagccucc

SEQ ID NO: 1795996 - RNA, 22 nt, Homo sapiens
caccagggaauacuauacagcc

SEQ ID NO: 1795997 - RNA, 23 nt, Homo sapiens
gaccuaaaaugaaguaacacaau

SEQ ID NO: 1795998 - RNA, 21 nt, Homo sapiens
cuauccccggacgcaugcagg

SEQ ID NO: 1795999 - RNA, 22 nt, Homo sapiens
auccacgccaaguggaagccac

SEQ ID NO: 1796000 - RNA, 20 nt, Homo sapiens
aaaggggaaauaacugccuu

SEQ ID NO: 1796001 - RNA, 17 nt, Homo sapiens
gaauugacaacccaaac

SEQ ID NO: 1796002 - RNA, 14 nt, Homo sapiens
ucuuuaccuugcau

SEQ ID NO: 1796003 - RNA, 13 nt, Homo sapiens
agaugcacugaag

SEQ ID NO: 1796004 - RNA, 13 nt, Homo sapiens
acauacacucaaa

SEQ ID NO: 1796005 - RNA, 13 nt, Homo sapiens
ucagcucugcaua

SEQ ID NO: 1796006 - RNA, 12 nt, Homo sapiens
guguuggugcug

SEQ ID NO: 1796007 - RNA, 17 nt, Homo sapiens
auccuaaaaaacacugg

SEQ ID NO: 1796008 - RNA, 20 nt, Homo sapiens
ccaaugaaagacacuguuuc

SEQ ID NO: 1796009 - RNA, 19 nt, Homo sapiens
uggacaauggacuguacaa

SEQ ID NO: 1796010 - RNA, 18 nt, Homo sapiens
ccuuagaaauuagugcca

SEQ ID NO: 1796011 - RNA, 14 nt, Homo sapiens
cucauguagccuca

SEQ ID NO: 1796012 - RNA, 15 nt, Homo sapiens
ggggcgucaccucca

SEQ ID NO: 1796013 - RNA, 20 nt, Homo sapiens
aggcuguuuauauguucaca

SEQ ID NO: 1796014 - RNA, 21 nt, Homo sapiens
ccugauugaucacacaguguu

SEQ ID NO: 1796015 - RNA, 17 nt, Homo sapiens
ugcccugaguccaagag

SEQ ID NO: 1796016 - RNA, 23 nt, Homo sapiens
ggaggaacuuuucaagcugcuga

SEQ ID NO: 1796017 - RNA, 16 nt, Homo sapiens
uugauuuuuugcccag

SEQ ID NO: 1796018 - RNA, 16 nt, Homo sapiens
uguaucaguguccuuu

SEQ ID NO: 1796019 - RNA, 16 nt, Homo sapiens
agcaucagagcccuuu

SEQ ID NO: 1796020 - RNA, 17 nt, Homo sapiens
aagauacagaacucuuu

SEQ ID NO: 1796021 - RNA, 15 nt, Homo sapiens
ccccucagagugcaa

SEQ ID NO: 1796022 - RNA, 19 nt, Homo sapiens
ccaagcugugcccugacca

SEQ ID NO: 1796023 - RNA, 22 nt, Homo sapiens
aagguccugcuauuacuaagga

SEQ ID NO: 1796024 - RNA, 14 nt, Homo sapiens
gaucuugguccugu

SEQ ID NO: 1796025 - RNA, 17 nt, Homo sapiens
gaacuugaacugauuca

SEQ ID NO: 1796026 - RNA, 17 nt, Homo sapiens
ucaucauuucagccaaa

SEQ ID NO: 1796027 - RNA, 19 nt, Homo sapiens
guugguugaacuaugcuga

SEQ ID NO: 1796028 - RNA, 18 nt, Homo sapiens
caguuaggcagugcagua

SEQ ID NO: 1796029 - RNA, 22 nt, Homo sapiens
cacaggccucucuucacacacu

SEQ ID NO: 1796030 - RNA, 14 nt, Homo sapiens
ucucagcucuucca

SEQ ID NO: 1796031 - RNA, 20 nt, Homo sapiens
agcaaaugcuauuugauaac

SEQ ID NO: 1796032 - RNA, 14 nt, Homo sapiens
cuaaagucucaggu

SEQ ID NO: 1796033 - RNA, 16 nt, Homo sapiens
gaguaacagggcagaa

SEQ ID NO: 1796034 - RNA, 11 nt, Homo sapiens
uuugguuuugc

SEQ ID NO: 1796035 - RNA, 24 nt, Homo sapiens
guccacgagcuguuuacuagggau

SEQ ID NO: 1796036 - RNA, 16 nt, Homo sapiens
gcucaucugauuuuug

SEQ ID NO: 1796037 - RNA, 13 nt, Homo sapiens
cacugauuucccc

SEQ ID NO: 1796038 - RNA, 16 nt, Homo sapiens
acgaaucuguuaccag

SEQ ID NO: 1796039 - RNA, 20 nt, Homo sapiens
augcuaguagcagugagcaa

SEQ ID NO: 1796040 - RNA, 20 nt, Homo sapiens
uugcugccuuaaugacauuc

SEQ ID NO: 1796041 - RNA, 22 nt, Homo sapiens
acagagacaucucccuguggga

SEQ ID NO: 1796042 - RNA, 20 nt, Homo sapiens
cagauggcagguuugcaauc

SEQ ID NO: 1796043 - RNA, 20 nt, Homo sapiens
accauccuggcuaacacggu

SEQ ID NO: 1796044 - RNA, 23 nt, Homo sapiens
caagagcagcugggaacugacau

SEQ ID NO: 1796045 - RNA, 13 nt, Homo sapiens
gccaggugcagug

SEQ ID NO: 1796046 - RNA, 17 nt, Homo sapiens
uuccaugguuaccugac

SEQ ID NO: 1796047 - RNA, 21 nt, Homo sapiens
gacuccaggccgccugcagcc

SEQ ID NO: 1796048 - RNA, 12 nt, Homo sapiens
guugcuucaggc

SEQ ID NO: 1796049 - RNA, 13 nt, Homo sapiens
gacuggagcucau

SEQ ID NO: 1796050 - RNA, 13 nt, Homo sapiens
cacuugaggucag

SEQ ID NO: 1796051 - RNA, 9 nt, Homo sapiens
uuugccaac

SEQ ID NO: 1796052 - RNA, 23 nt, Homo sapiens
aaaccacugggcauaaugcuucc

SEQ ID NO: 1796053 - RNA, 14 nt, Homo sapiens
ucaagagucucucc

SEQ ID NO: 1796054 - RNA, 16 nt, Homo sapiens
acuguaggaacaagca

SEQ ID NO: 1796055 - RNA, 15 nt, Homo sapiens
caaacuaaacccuca

SEQ ID NO: 1796056 - RNA, 19 nt, Homo sapiens
ucuggggggcagggaaaac

SEQ ID NO: 1796057 - RNA, 16 nt, Homo sapiens
ccacccuccucaagaa

SEQ ID NO: 1796058 - RNA, 18 nt, Homo sapiens
aguuuaugcauacaguaa

SEQ ID NO: 1796059 - RNA, 13 nt, Homo sapiens
agacucaaaggga

SEQ ID NO: 1796060 - RNA, 15 nt, Homo sapiens
caauauuacuuuguc

SEQ ID NO: 1796061 - RNA, 22 nt, Homo sapiens
guauaucauggaauuuccauug

SEQ ID NO: 1796062 - RNA, 20 nt, Homo sapiens
aagaaugucuccauuguuaa

SEQ ID NO: 1796063 - RNA, 22 nt, Homo sapiens
uucccagcuucugccacauaaa

SEQ ID NO: 1796064 - RNA, 16 nt, Homo sapiens
ugaacauuacauugcc

SEQ ID NO: 1796065 - RNA, 13 nt, Homo sapiens
auacgucuagccu

SEQ ID NO: 1796066 - RNA, 22 nt, Homo sapiens
uacucagcaacuguuagcuggg

SEQ ID NO: 1796067 - RNA, 13 nt, Homo sapiens
cauugcagucugc

SEQ ID NO: 1796068 - RNA, 15 nt, Homo sapiens
cuccugucugcccua

SEQ ID NO: 1796069 - RNA, 16 nt, Homo sapiens
gagaacuauccaaaac

SEQ ID NO: 1796070 - RNA, 12 nt, Homo sapiens
ccagucaaagac

SEQ ID NO: 1796071 - RNA, 22 nt, Homo sapiens
auuguuguucuguuaacugaau

SEQ ID NO: 1796072 - RNA, 23 nt, Homo sapiens
gccaucccuuuuuuuacauuuca

SEQ ID NO: 1796073 - RNA, 22 nt, Homo sapiens
acauacaggccauacuuuacaa

SEQ ID NO: 1796074 - RNA, 15 nt, Homo sapiens
uugaccucauuucaa

SEQ ID NO: 1796075 - RNA, 15 nt, Homo sapiens
cccagagagagcucu

SEQ ID NO: 1796076 - RNA, 17 nt, Homo sapiens
cucaacacccaacuguc

SEQ ID NO: 1796077 - RNA, 16 nt, Homo sapiens
uuguauauuauggaag

SEQ ID NO: 1796078 - RNA, 21 nt, Homo sapiens
auugucagaugcugugcaaau

SEQ ID NO: 1796079 - RNA, 22 nt, Homo sapiens
gaggacacaguuucuauuguaa

SEQ ID NO: 1796080 - RNA, 19 nt, Homo sapiens
cagauucucccuugcucug

SEQ ID NO: 1796081 - RNA, 20 nt, Homo sapiens
ucagcaacuucuagcauaua

SEQ ID NO: 1796082 - RNA, 16 nt, Homo sapiens
cacucaaaauauguca

SEQ ID NO: 1796083 - RNA, 11 nt, Homo sapiens
uugaacagggc

SEQ ID NO: 1796084 - RNA, 17 nt, Homo sapiens
auaaucuguauucuugc

SEQ ID NO: 1796085 - RNA, 14 nt, Homo sapiens
aaacaacaaaaacc

SEQ ID NO: 1796086 - RNA, 14 nt, Homo sapiens
cugcaccaugcugc

SEQ ID NO: 1796087 - RNA, 17 nt, Homo sapiens
gaauuacaggcacauac

SEQ ID NO: 1796088 - RNA, 15 nt, Homo sapiens
uuggaaucacauucu

SEQ ID NO: 1796089 - RNA, 16 nt, Homo sapiens
uucacuggacacuuca

SEQ ID NO: 1796090 - RNA, 13 nt, Homo sapiens
gucucaguuuuca

SEQ ID NO: 1796091 - RNA, 18 nt, Homo sapiens
auauugagcaauauguca

SEQ ID NO: 1796092 - RNA, 19 nt, Homo sapiens
agcaucuugccagccucag

SEQ ID NO: 1796093 - RNA, 11 nt, Homo sapiens
uuccuaucuca

SEQ ID NO: 1796094 - RNA, 20 nt, Homo sapiens
caaguuguaacuuauauuga

SEQ ID NO: 1796095 - RNA, 24 nt, Homo sapiens
ucauguggcauucucucugcucag

SEQ ID NO: 1796096 - RNA, 20 nt, Homo sapiens
aacacggggcuugcaacuua

SEQ ID NO: 1796097 - RNA, 21 nt, Homo sapiens
agucaaauuuguaaaucuuau

SEQ ID NO: 1796098 - RNA, 19 nt, Homo sapiens
acacugcuaggugggccag

SEQ ID NO: 1796099 - RNA, 12 nt, Homo sapiens
cagaacacuuug

SEQ ID NO: 1796100 - RNA, 13 nt, Homo sapiens
uuugaagucagag

SEQ ID NO: 1796101 - RNA, 20 nt, Homo sapiens
cugagagcucucucuucucu

SEQ ID NO: 1796102 - RNA, 21 nt, Homo sapiens
acagcuugggucagguucuug

SEQ ID NO: 1796103 - RNA, 13 nt, Homo sapiens
uauccaaauugau

SEQ ID NO: 1796104 - RNA, 17 nt, Homo sapiens
uuacuaauuauacuacu

SEQ ID NO: 1796105 - RNA, 17 nt, Homo sapiens
acacugggacacuguca

SEQ ID NO: 1796106 - RNA, 15 nt, Homo sapiens
ggauggccguggaug

SEQ ID NO: 1796107 - RNA, 23 nt, Homo sapiens
ggucuaugccaggcccauuuccu

SEQ ID NO: 1796108 - RNA, 14 nt, Homo sapiens
ucacauaugucuua

SEQ ID NO: 1796109 - RNA, 21 nt, Homo sapiens
caacuauaaaacuaggugcug

SEQ ID NO: 1796110 - RNA, 16 nt, Homo sapiens
guaacaaucacuguuc

SEQ ID NO: 1796111 - RNA, 13 nt, Homo sapiens
auuacuacuguac

SEQ ID NO: 1796112 - RNA, 13 nt, Homo sapiens
aggggugggacac

SEQ ID NO: 1796113 - RNA, 20 nt, Homo sapiens
auacuugccuucugauagua

SEQ ID NO: 1796114 - RNA, 15 nt, Homo sapiens
auggucagaauuucc

SEQ ID NO: 1796115 - RNA, 14 nt, Homo sapiens
ugcacacacagaug

SEQ ID NO: 1796116 - RNA, 20 nt, Homo sapiens
gcccaugcaauuuuauuaaa

SEQ ID NO: 1796117 - RNA, 14 nt, Homo sapiens
cugugucaauguga

SEQ ID NO: 1796118 - RNA, 22 nt, Homo sapiens
agggcaaaaagucuacauacuu

SEQ ID NO: 1796119 - RNA, 18 nt, Homo sapiens
cccagcacuuuagaucac

SEQ ID NO: 1796120 - RNA, 19 nt, Homo sapiens
cuaugagauggccaugcuc

SEQ ID NO: 1796121 - RNA, 19 nt, Homo sapiens
uuauaucauacaguuuuca

SEQ ID NO: 1796122 - RNA, 14 nt, Homo sapiens
cuacuucccuuucc

SEQ ID NO: 1796123 - RNA, 21 nt, Homo sapiens
accaagguuuugaaaucccau

SEQ ID NO: 1796124 - RNA, 23 nt, Homo sapiens
ugaugccauuacagaaccaaauc

SEQ ID NO: 1796125 - RNA, 20 nt, Homo sapiens
gcccacuucauagaugagaa

SEQ ID NO: 1796126 - RNA, 22 nt, Homo sapiens
aacuaccagugggcauguauua

SEQ ID NO: 1796127 - RNA, 13 nt, Homo sapiens
uaacuucaugaag

SEQ ID NO: 1796128 - RNA, 19 nt, Homo sapiens
ugaaguguaguggcaucca

SEQ ID NO: 1796129 - RNA, 23 nt, Homo sapiens
auaucuccauggcccugucccag

SEQ ID NO: 1796130 - RNA, 20 nt, Homo sapiens
ugacaauggcaacaauuuga

SEQ ID NO: 1796131 - RNA, 18 nt, Homo sapiens
cccaggcugagccucagu

SEQ ID NO: 1796132 - RNA, 13 nt, Homo sapiens
ccauuauuaugca

SEQ ID NO: 1796133 - RNA, 13 nt, Homo sapiens
acaugguggacag

SEQ ID NO: 1796134 - RNA, 15 nt, Homo sapiens
cauggaggccaagaa

SEQ ID NO: 1796135 - RNA, 13 nt, Homo sapiens
gacaugugacauu

SEQ ID NO: 1796136 - RNA, 14 nt, Homo sapiens
uucucugguaauau

SEQ ID NO: 1796137 - RNA, 21 nt, Homo sapiens
aaccuuccauucacaccagcu

SEQ ID NO: 1796138 - RNA, 16 nt, Homo sapiens
auuauagccacauccc

SEQ ID NO: 1796139 - RNA, 17 nt, Homo sapiens
uggucuggguuuggcag

SEQ ID NO: 1796140 - RNA, 14 nt, Homo sapiens
auuucuacucuuaa

SEQ ID NO: 1796141 - RNA, 15 nt, Homo sapiens
agguggaucacugga

SEQ ID NO: 1796142 - RNA, 21 nt, Homo sapiens
caguaauaaaacaucuuucca

SEQ ID NO: 1796143 - RNA, 14 nt, Homo sapiens
uaguaaaagccauc

SEQ ID NO: 1796144 - RNA, 15 nt, Homo sapiens
caggauguugcucca

SEQ ID NO: 1796145 - RNA, 21 nt, Homo sapiens
cuaacuuuuuugcuauccagc

SEQ ID NO: 1796146 - RNA, 16 nt, Homo sapiens
aaguuuggaagcacug

SEQ ID NO: 1796147 - RNA, 17 nt, Homo sapiens
gucaccuacgugccacu

SEQ ID NO: 1796148 - RNA, 16 nt, Homo sapiens
agaaagccucagugaa

SEQ ID NO: 1796149 - RNA, 23 nt, Homo sapiens
ccuguuacuugaaauaccaguga

SEQ ID NO: 1796150 - RNA, 23 nt, Homo sapiens
uuuagaaaucacaacaaacugaa

SEQ ID NO: 1796151 - RNA, 17 nt, Homo sapiens
acugcugggcuuggcag

SEQ ID NO: 1796152 - RNA, 18 nt, Homo sapiens
cuggugccccuuugcccg

SEQ ID NO: 1796153 - RNA, 17 nt, Homo sapiens
gcauaacacacuacugg

SEQ ID NO: 1796154 - RNA, 19 nt, Homo sapiens
ucucaauuugaaacacaag

SEQ ID NO: 1796155 - RNA, 18 nt, Homo sapiens
ggacauagccagcauuuu

SEQ ID NO: 1796156 - RNA, 14 nt, Homo sapiens
aagaaacugaugaa

SEQ ID NO: 1796157 - RNA, 18 nt, Homo sapiens
acugguuuuccaacuuaa

SEQ ID NO: 1796158 - RNA, 19 nt, Homo sapiens
ucaugucucacuucacagc

SEQ ID NO: 1796159 - RNA, 21 nt, Homo sapiens
auuuauuccccagugacucca

SEQ ID NO: 1796160 - RNA, 19 nt, Homo sapiens
agugccgacagcucuccaa

SEQ ID NO: 1796161 - RNA, 12 nt, Homo sapiens
gauugauuagau

SEQ ID NO: 1796162 - RNA, 17 nt, Homo sapiens
agaaccacuaaccccgc

SEQ ID NO: 1796163 - RNA, 22 nt, Homo sapiens
ccccuagugcuauucuguguug

SEQ ID NO: 1796164 - RNA, 13 nt, Homo sapiens
auuuauucaggaa

SEQ ID NO: 1796165 - RNA, 22 nt, Homo sapiens
gaggcaagguugggcuggugcu

SEQ ID NO: 1796166 - RNA, 16 nt, Homo sapiens
cagauagaaagcauua

SEQ ID NO: 1796167 - RNA, 17 nt, Homo sapiens
guaguuaaggagccuaa

SEQ ID NO: 1796168 - RNA, 13 nt, Homo sapiens
acucccugccuac

SEQ ID NO: 1796169 - RNA, 13 nt, Homo sapiens
aaagagaaaaugc

SEQ ID NO: 1796170 - RNA, 17 nt, Homo sapiens
cagggcugcaucccgca

SEQ ID NO: 1796171 - RNA, 12 nt, Homo sapiens
cuucaugagcac

SEQ ID NO: 1796172 - RNA, 12 nt, Homo sapiens
cuaaaugagcua

SEQ ID NO: 1796173 - RNA, 18 nt, Homo sapiens
ugguggagggcacuucag

SEQ ID NO: 1796174 - RNA, 18 nt, Homo sapiens
cucaaaguacugggauua

SEQ ID NO: 1796175 - RNA, 15 nt, Homo sapiens
cucucagugccuucu

SEQ ID NO: 1796176 - RNA, 16 nt, Homo sapiens
gggggcggccuaugac

SEQ ID NO: 1796177 - RNA, 15 nt, Homo sapiens
auauuaugucuucau

SEQ ID NO: 1796178 - RNA, 14 nt, Homo sapiens
augcaguacuguaa

SEQ ID NO: 1796179 - RNA, 15 nt, Homo sapiens
ucauuaugauuucau

SEQ ID NO: 1796180 - RNA, 21 nt, Homo sapiens
agguuuuccugaagaauugaa

SEQ ID NO: 1796181 - RNA, 15 nt, Homo sapiens
agcuaacaaguagca

SEQ ID NO: 1796182 - RNA, 23 nt, Homo sapiens
gugaagacaaugacuuacuguac

SEQ ID NO: 1796183 - RNA, 22 nt, Homo sapiens
uuuucacaacaaaagcuuuuga

SEQ ID NO: 1796184 - RNA, 18 nt, Homo sapiens
uacuuggaauccuguguc

SEQ ID NO: 1796185 - RNA, 17 nt, Homo sapiens
cuuggcccaggagcucu

SEQ ID NO: 1796186 - RNA, 14 nt, Homo sapiens
ggaagccccaggga

SEQ ID NO: 1796187 - RNA, 13 nt, Homo sapiens
uagcgcagugucc

SEQ ID NO: 1796188 - RNA, 13 nt, Homo sapiens
gaaucaauucaau

SEQ ID NO: 1796189 - RNA, 21 nt, Homo sapiens
uccccagcccaggguggacuu

SEQ ID NO: 1796190 - RNA, 20 nt, Homo sapiens
gcugccaagccccauccugc

SEQ ID NO: 1796191 - RNA, 15 nt, Homo sapiens
cagaacacuggauuu

SEQ ID NO: 1796192 - RNA, 12 nt, Homo sapiens
aauguccagcca

SEQ ID NO: 1796193 - RNA, 14 nt, Homo sapiens
guuuuucagcaccc

SEQ ID NO: 1796194 - RNA, 14 nt, Homo sapiens
cagcauauauauaa

SEQ ID NO: 1796195 - RNA, 15 nt, Homo sapiens
ucugagcugagccag

SEQ ID NO: 1796196 - RNA, 22 nt, Homo sapiens
ucaggcauuuuuguaaugagcc

SEQ ID NO: 1796197 - RNA, 19 nt, Homo sapiens
cccuuccggagucuuugaa

SEQ ID NO: 1796198 - RNA, 16 nt, Homo sapiens
uagcaaagauaucuca

SEQ ID NO: 1796199 - RNA, 19 nt, Homo sapiens
uaacaugaagcaaacuaac

SEQ ID NO: 1796200 - RNA, 23 nt, Homo sapiens
agaccuuuuggcccaaucucugc

SEQ ID NO: 1796201 - RNA, 20 nt, Homo sapiens
ucaccaaaguauuaauguac

SEQ ID NO: 1796202 - RNA, 12 nt, Homo sapiens
uuccaaacacca

SEQ ID NO: 1796203 - RNA, 20 nt, Homo sapiens
uggcuguagaaggagacaga

SEQ ID NO: 1796204 - RNA, 16 nt, Homo sapiens
ugagaaauagugcacu

SEQ ID NO: 1796205 - RNA, 19 nt, Homo sapiens
aggaaaguugugauucuuu

SEQ ID NO: 1796206 - RNA, 17 nt, Homo sapiens
uucugcauauguugaau

SEQ ID NO: 1796207 - RNA, 18 nt, Homo sapiens
uugccugccacuguguga

SEQ ID NO: 1796208 - RNA, 17 nt, Homo sapiens
uagcuggccacagugag

SEQ ID NO: 1796209 - RNA, 19 nt, Homo sapiens
ucauaacuugagaccuaau

SEQ ID NO: 1796210 - RNA, 22 nt, Homo sapiens
guacaucguuugcaaaugucag

SEQ ID NO: 1796211 - RNA, 18 nt, Homo sapiens
ugcaaccacucuguggcc

SEQ ID NO: 1796212 - RNA, 11 nt, Homo sapiens
uguuugcacac

SEQ ID NO: 1796213 - RNA, 17 nt, Homo sapiens
uuaaugcuucuuucauu

SEQ ID NO: 1796214 - RNA, 13 nt, Homo sapiens
cgugugucucaug

SEQ ID NO: 1796215 - RNA, 19 nt, Homo sapiens
aggacagcugaaccccugg

SEQ ID NO: 1796216 - RNA, 16 nt, Homo sapiens
uaaauggcaccuguau

SEQ ID NO: 1796217 - RNA, 13 nt, Homo sapiens
augagaaagggag

SEQ ID NO: 1796218 - RNA, 20 nt, Homo sapiens
cauuuaggcaaauaagcacu

SEQ ID NO: 1796219 - RNA, 12 nt, Homo sapiens
ccgaaaccagag

SEQ ID NO: 1796220 - RNA, 16 nt, Homo sapiens
cuuaacuauccuaaca

SEQ ID NO: 1796221 - RNA, 12 nt, Homo sapiens
accccagauuca

SEQ ID NO: 1796222 - RNA, 11 nt, Homo sapiens
cuguggcacag

SEQ ID NO: 1796223 - RNA, 13 nt, Homo sapiens
gaagauagaucca

SEQ ID NO: 1796224 - RNA, 19 nt, Homo sapiens
ccuucacagagacacgugg

SEQ ID NO: 1796225 - RNA, 22 nt, Homo sapiens
aggugcaugcaugcccucucug

SEQ ID NO: 1796226 - RNA, 19 nt, Homo sapiens
cagaaaaaaggacuguaua

SEQ ID NO: 1796227 - RNA, 14 nt, Homo sapiens
cacuucucuuccuu

SEQ ID NO: 1796228 - RNA, 11 nt, Homo sapiens
ucuucagccau

SEQ ID NO: 1796229 - RNA, 16 nt, Homo sapiens
acuguaacgauugaca

SEQ ID NO: 1796230 - RNA, 14 nt, Homo sapiens
gaaacugcauuauu

SEQ ID NO: 1796231 - RNA, 13 nt, Homo sapiens
gauccaagacaaa

SEQ ID NO: 1796232 - RNA, 20 nt, Homo sapiens
uuggagaggagguguggagu

SEQ ID NO: 1796233 - RNA, 16 nt, Homo sapiens
aaacaguuccauucaa

SEQ ID NO: 1796234 - RNA, 23 nt, Homo sapiens
agaaauuuugccugccauuuuca

SEQ ID NO: 1796235 - RNA, 19 nt, Homo sapiens
auaagcuuucucucagaaa

SEQ ID NO: 1796236 - RNA, 14 nt, Homo sapiens
aacuuucuaaugau

SEQ ID NO: 1796237 - RNA, 14 nt, Homo sapiens
ggggcggugcaggg

SEQ ID NO: 1796238 - RNA, 16 nt, Homo sapiens
auuucuacuuugacua

SEQ ID NO: 1796239 - RNA, 12 nt, Homo sapiens
cuagaagcacag

SEQ ID NO: 1796240 - RNA, 20 nt, Homo sapiens
agcuggagggaccuugucuc

SEQ ID NO: 1796241 - RNA, 14 nt, Homo sapiens
gcaguucaugaccc

SEQ ID NO: 1796242 - RNA, 18 nt, Homo sapiens
cuucaaaauaaguguaau

SEQ ID NO: 1796243 - RNA, 18 nt, Homo sapiens
aacuccaacauccacucu

SEQ ID NO: 1796244 - RNA, 20 nt, Homo sapiens
acucaguaaggcagugcagu

SEQ ID NO: 1796245 - RNA, 14 nt, Homo sapiens
ugggacugcugcuu

SEQ ID NO: 1796246 - RNA, 22 nt, Homo sapiens
ugugccuggccaacauaauguu

SEQ ID NO: 1796247 - RNA, 15 nt, Homo sapiens
cuucuuaauucucca

SEQ ID NO: 1796248 - RNA, 11 nt, Homo sapiens
aaacauuguuc

SEQ ID NO: 1796249 - RNA, 13 nt, Homo sapiens
auuaccaaaacaa

SEQ ID NO: 1796250 - RNA, 17 nt, Homo sapiens
accuucuuuaaggcaua

SEQ ID NO: 1796251 - RNA, 15 nt, Homo sapiens
gacaggcaggccaga

SEQ ID NO: 1796252 - RNA, 16 nt, Homo sapiens
aucccuuuccaaaggc

SEQ ID NO: 1796253 - RNA, 15 nt, Homo sapiens
auccuccacagagag

SEQ ID NO: 1796254 - RNA, 17 nt, Homo sapiens
aaucuaguuuuggcaag

SEQ ID NO: 1796255 - RNA, 17 nt, Homo sapiens
agggggauaaagagggu

SEQ ID NO: 1796256 - RNA, 22 nt, Homo sapiens
caccuaagaucucgguuugcca

SEQ ID NO: 1796257 - RNA, 17 nt, Homo sapiens
aucuaagacaaucacgc

SEQ ID NO: 1796258 - RNA, 19 nt, Homo sapiens
gaaaucaguaaacacugug

SEQ ID NO: 1796259 - RNA, 14 nt, Homo sapiens
auuucauagcugua

SEQ ID NO: 1796260 - RNA, 11 nt, Homo sapiens
gguaaucagca

SEQ ID NO: 1796261 - RNA, 21 nt, Homo sapiens
ggauauccuuaucagagcuaa

SEQ ID NO: 1796262 - RNA, 23 nt, Homo sapiens
aauaugaaccuauuuucauuugu

SEQ ID NO: 1796263 - RNA, 20 nt, Homo sapiens
uugcgagccucgcagccucc

SEQ ID NO: 1796264 - RNA, 23 nt, Homo sapiens
aauugccuuaaggccacacuggc

SEQ ID NO: 1796265 - RNA, 21 nt, Homo sapiens
uugcacaaaaucacacagcca

SEQ ID NO: 1796266 - RNA, 15 nt, Homo sapiens
uggcuaugggaauca

SEQ ID NO: 1796267 - RNA, 13 nt, Homo sapiens
ucaccaaggcuga

SEQ ID NO: 1796268 - RNA, 22 nt, Homo sapiens
aaaaucacacagccaagccagu

SEQ ID NO: 1796269 - RNA, 23 nt, Homo sapiens
uagcuauauccauguacuguagu

SEQ ID NO: 1796270 - RNA, 23 nt, Homo sapiens
cggggaaggauuuugcaguucuu

SEQ ID NO: 1796271 - RNA, 15 nt, Homo sapiens
aucgcugucaucuca

SEQ ID NO: 1796272 - RNA, 15 nt, Homo sapiens
agaaggcaaaagagu

SEQ ID NO: 1796273 - RNA, 13 nt, Homo sapiens
cugggcacaauca

SEQ ID NO: 1796274 - RNA, 15 nt, Homo sapiens
ucaaagcaaguuuca

SEQ ID NO: 1796275 - RNA, 20 nt, Homo sapiens
uccccauuaguauccuguua

SEQ ID NO: 1796276 - RNA, 12 nt, Homo sapiens
gggaccccaaac

SEQ ID NO: 1796277 - RNA, 16 nt, Homo sapiens
aggaaaaccgaauuag

SEQ ID NO: 1796278 - RNA, 16 nt, Homo sapiens
gauuguauauggaaca

SEQ ID NO: 1796279 - RNA, 16 nt, Homo sapiens
ugccuacacacacagc

SEQ ID NO: 1796280 - RNA, 17 nt, Homo sapiens
guauuuuucagaaauca

SEQ ID NO: 1796281 - RNA, 13 nt, Homo sapiens
agcugcugaagag

SEQ ID NO: 1796282 - RNA, 18 nt, Homo sapiens
uuaucugagcugagccag

SEQ ID NO: 1796283 - RNA, 22 nt, Homo sapiens
guagcuaggacuacagacaugu

SEQ ID NO: 1796284 - RNA, 14 nt, Homo sapiens
uuggagcaaaccau

SEQ ID NO: 1796285 - RNA, 15 nt, Homo sapiens
uucucaugacuccua

SEQ ID NO: 1796286 - RNA, 12 nt, Homo sapiens
gccuucucacca

SEQ ID NO: 1796287 - RNA, 22 nt, Homo sapiens
ggucuuaggaugugucuugggg

SEQ ID NO: 1796288 - RNA, 18 nt, Homo sapiens
cccuggggacccacgugg

SEQ ID NO: 1796289 - RNA, 17 nt, Homo sapiens
ucauccccucguccugu

SEQ ID NO: 1796290 - RNA, 20 nt, Homo sapiens
agccggagccuccagcugcc

SEQ ID NO: 1796291 - RNA, 15 nt, Homo sapiens
aagauauauguguau

SEQ ID NO: 1796292 - RNA, 19 nt, Homo sapiens
cacccaggcuggagugcaa

SEQ ID NO: 1796293 - RNA, 12 nt, Homo sapiens
cuuuaccaggag

SEQ ID NO: 1796294 - RNA, 20 nt, Homo sapiens
agacuuauggaacagggaug

SEQ ID NO: 1796295 - RNA, 14 nt, Homo sapiens
uuuagugucucuaa

SEQ ID NO: 1796296 - RNA, 16 nt, Homo sapiens
caucgggccaucucag

SEQ ID NO: 1796297 - RNA, 20 nt, Homo sapiens
ugacaauaaaggaacuaauc

SEQ ID NO: 1796298 - RNA, 13 nt, Homo sapiens
ccaagaacacaag

SEQ ID NO: 1796299 - RNA, 22 nt, Homo sapiens
uggaggaaauguguauuaccaa

SEQ ID NO: 1796300 - RNA, 17 nt, Homo sapiens
cugacuuucucuucuac

SEQ ID NO: 1796301 - RNA, 11 nt, Homo sapiens
aagugccccug

SEQ ID NO: 1796302 - RNA, 17 nt, Homo sapiens
cauggguuaagagcuca

SEQ ID NO: 1796303 - RNA, 22 nt, Homo sapiens
uucuguccacucuggagagcag

SEQ ID NO: 1796304 - RNA, 20 nt, Homo sapiens
gucauuaacccaucucugaa

SEQ ID NO: 1796305 - RNA, 16 nt, Homo sapiens
auguccuuucauuugu

SEQ ID NO: 1796306 - RNA, 19 nt, Homo sapiens
guccucaggccugaacuca

SEQ ID NO: 1796307 - RNA, 12 nt, Homo sapiens
ccuaaguacaag

SEQ ID NO: 1796308 - RNA, 16 nt, Homo sapiens
caugcgguuuccaagg

SEQ ID NO: 1796309 - RNA, 14 nt, Homo sapiens
cuaucguaucuuua

SEQ ID NO: 1796310 - RNA, 22 nt, Homo sapiens
guucaguagagaauucauguga

SEQ ID NO: 1796311 - RNA, 15 nt, Homo sapiens
gaaauuguaucucag

SEQ ID NO: 1796312 - RNA, 23 nt, Homo sapiens
gguggcuaccaugcaggauuuga

SEQ ID NO: 1796313 - RNA, 18 nt, Homo sapiens
auucauuuacaacuucca

SEQ ID NO: 1796314 - RNA, 11 nt, Homo sapiens
cccacagugac

SEQ ID NO: 1796315 - RNA, 16 nt, Homo sapiens
aaaguaaaauaguuua

SEQ ID NO: 1796316 - RNA, 18 nt, Homo sapiens
ggguggcuuugcauuucu

SEQ ID NO: 1796317 - RNA, 19 nt, Homo sapiens
agggcuccagcauccagcc

SEQ ID NO: 1796318 - RNA, 20 nt, Homo sapiens
agacccaacuuucucacugc

SEQ ID NO: 1796319 - RNA, 19 nt, Homo sapiens
gggcaacauagugauaccc

SEQ ID NO: 1796320 - RNA, 15 nt, Homo sapiens
aagagucugucuuga

SEQ ID NO: 1796321 - RNA, 18 nt, Homo sapiens
auuaaaaacccauaacua

SEQ ID NO: 1796322 - RNA, 13 nt, Homo sapiens
ucaaccacugugg

SEQ ID NO: 1796323 - RNA, 12 nt, Homo sapiens
gacaaguacugu

SEQ ID NO: 1796324 - RNA, 18 nt, Homo sapiens
auggaaacauuacaguuc

SEQ ID NO: 1796325 - RNA, 21 nt, Homo sapiens
acuaugccugaugugacgcua

SEQ ID NO: 1796326 - RNA, 17 nt, Homo sapiens
gagauuuuaauucugug

SEQ ID NO: 1796327 - RNA, 22 nt, Homo sapiens
cacugaugcuuagauguuccag

SEQ ID NO: 1796328 - RNA, 16 nt, Homo sapiens
acaaguuuacaugaua

SEQ ID NO: 1796329 - RNA, 16 nt, Homo sapiens
gccuauaagccaaaau

SEQ ID NO: 1796330 - RNA, 20 nt, Homo sapiens
cugccggggguucaggguug

SEQ ID NO: 1796331 - RNA, 14 nt, Homo sapiens
guguugcaugcagc

SEQ ID NO: 1796332 - RNA, 14 nt, Homo sapiens
caaauggccucaug

SEQ ID NO: 1796333 - RNA, 13 nt, Homo sapiens
aaauuaagcacac

SEQ ID NO: 1796334 - RNA, 20 nt, Homo sapiens
aaaagcccagcaucacugau

SEQ ID NO: 1796335 - RNA, 19 nt, Homo sapiens
uguuaagccauguguucca

SEQ ID NO: 1796336 - RNA, 13 nt, Homo sapiens
auaggacuggaag

SEQ ID NO: 1796337 - RNA, 13 nt, Homo sapiens
aaugucuuugguc

SEQ ID NO: 1796338 - RNA, 14 nt, Homo sapiens
aggauguaagccug

SEQ ID NO: 1796339 - RNA, 18 nt, Homo sapiens
cuggugcccccagacagc

SEQ ID NO: 1796340 - RNA, 17 nt, Homo sapiens
cuuaucagugugcaaua

SEQ ID NO: 1796341 - RNA, 16 nt, Homo sapiens
ucaagucaaucauuuc

SEQ ID NO: 1796342 - RNA, 15 nt, Homo sapiens
guaaaucagugcagu

SEQ ID NO: 1796343 - RNA, 22 nt, Homo sapiens
acuuuauucggaccaagcagag

SEQ ID NO: 1796344 - RNA, 18 nt, Homo sapiens
aacucucaguggugccug

SEQ ID NO: 1796345 - RNA, 19 nt, Homo sapiens
aaagaccaucuccuguaaa

SEQ ID NO: 1796346 - RNA, 23 nt, Homo sapiens
ugccaagauacuugaacacugug

SEQ ID NO: 1796347 - RNA, 14 nt, Homo sapiens
uaaaugaacugacu

SEQ ID NO: 1796348 - RNA, 15 nt, Homo sapiens
cagcuucuguuggca

SEQ ID NO: 1796349 - RNA, 18 nt, Homo sapiens
uaaaauaaaguacauuau

SEQ ID NO: 1796350 - RNA, 21 nt, Homo sapiens
uccauccccauguguuucagg

SEQ ID NO: 1796351 - RNA, 14 nt, Homo sapiens
uucaauauuaugaa

SEQ ID NO: 1796352 - RNA, 15 nt, Homo sapiens
aucuccaucucaaaa

SEQ ID NO: 1796353 - RNA, 21 nt, Homo sapiens
uccugaccucgugaucuaccc

SEQ ID NO: 1796354 - RNA, 24 nt, Homo sapiens
aguuuccugcuauauuaacaucau

SEQ ID NO: 1796355 - RNA, 18 nt, Homo sapiens
uaacccgauuauugugua

SEQ ID NO: 1796356 - RNA, 18 nt, Homo sapiens
gaaacugagucacucaca

SEQ ID NO: 1796357 - RNA, 12 nt, Homo sapiens
gccccucugauu

SEQ ID NO: 1796358 - RNA, 17 nt, Homo sapiens
agcaucacugccuuggc

SEQ ID NO: 1796359 - RNA, 20 nt, Homo sapiens
gggcccaugggauugcacag

SEQ ID NO: 1796360 - RNA, 18 nt, Homo sapiens
gagacagaccgggguuca

SEQ ID NO: 1796361 - RNA, 14 nt, Homo sapiens
aggagagugagugc

SEQ ID NO: 1796362 - RNA, 20 nt, Homo sapiens
gagaagagaugcugccauuu

SEQ ID NO: 1796363 - RNA, 19 nt, Homo sapiens
uguaagacauuuguauauu

SEQ ID NO: 1796364 - RNA, 16 nt, Homo sapiens
guuucugugucauuaa

SEQ ID NO: 1796365 - RNA, 16 nt, Homo sapiens
aguacaguagcuuaaa

SEQ ID NO: 1796366 - RNA, 17 nt, Homo sapiens
cccuuuucccugcauuc

SEQ ID NO: 1796367 - RNA, 17 nt, Homo sapiens
gccucccccaauggcaa

SEQ ID NO: 1796368 - RNA, 16 nt, Homo sapiens
gauuuaugaugcacuu

SEQ ID NO: 1796369 - RNA, 17 nt, Homo sapiens
cagcuucuucacaggca

SEQ ID NO: 1796370 - RNA, 16 nt, Homo sapiens
uuuggauguuuccacg

SEQ ID NO: 1796371 - RNA, 17 nt, Homo sapiens
cuagacaaaaaccauug

SEQ ID NO: 1796372 - RNA, 16 nt, Homo sapiens
gagguacucugcacau

SEQ ID NO: 1796373 - RNA, 21 nt, Homo sapiens
agaaaaaaagcaugugucaug

SEQ ID NO: 1796374 - RNA, 23 nt, Homo sapiens
uuaaauaaaguuuggacuuaucu

SEQ ID NO: 1796375 - RNA, 14 nt, Homo sapiens
ucauucucagugag

SEQ ID NO: 1796376 - RNA, 14 nt, Homo sapiens
cagcccugccuugc

SEQ ID NO: 1796377 - RNA, 17 nt, Homo sapiens
aucuguugugcaugcuc

SEQ ID NO: 1796378 - RNA, 19 nt, Homo sapiens
aucaguugaaggcuagaag

SEQ ID NO: 1796379 - RNA, 18 nt, Homo sapiens
ugcagcccccugcuucuc

SEQ ID NO: 1796380 - RNA, 15 nt, Homo sapiens
guagauaagugcuca

SEQ ID NO: 1796381 - RNA, 22 nt, Homo sapiens
uucuuaaaacaaagccaugcca

SEQ ID NO: 1796382 - RNA, 19 nt, Homo sapiens
uucacauaacuucucugag

SEQ ID NO: 1796383 - RNA, 15 nt, Homo sapiens
cuguuagacaaaagu

SEQ ID NO: 1796384 - RNA, 17 nt, Homo sapiens
ccaauuucagacuccca

SEQ ID NO: 1796385 - RNA, 13 nt, Homo sapiens
uacagaacacauu

SEQ ID NO: 1796386 - RNA, 12 nt, Homo sapiens
aaaauuacuuug

SEQ ID NO: 1796387 - RNA, 20 nt, Homo sapiens
uccugaccuugugauccacc

SEQ ID NO: 1796388 - RNA, 15 nt, Homo sapiens
caaucuuaaugucuc

SEQ ID NO: 1796389 - RNA, 16 nt, Homo sapiens
uaaaguaucugagauu

SEQ ID NO: 1796390 - RNA, 20 nt, Homo sapiens
ccgccaccaugcccggcuaa

SEQ ID NO: 1796391 - RNA, 22 nt, Homo sapiens
uguauaaacaagccuaacauug

SEQ ID NO: 1796392 - RNA, 15 nt, Homo sapiens
agaaaaaaagggauc

SEQ ID NO: 1796393 - RNA, 13 nt, Homo sapiens
caaagaagguguu

SEQ ID NO: 1796394 - RNA, 15 nt, Homo sapiens
ccuugugaaccccaa

SEQ ID NO: 1796395 - RNA, 14 nt, Homo sapiens
uccuaucaauccaa

SEQ ID NO: 1796396 - RNA, 14 nt, Homo sapiens
aucccucauccuca

SEQ ID NO: 1796397 - RNA, 19 nt, Homo sapiens
uauguuaaagcaucagaga

SEQ ID NO: 1796398 - RNA, 22 nt, Homo sapiens
ccacuguauaugcauauaguga

SEQ ID NO: 1796399 - RNA, 19 nt, Homo sapiens
cugauuuuguauguaaaua

SEQ ID NO: 1796400 - RNA, 17 nt, Homo sapiens
uacaggaaguaguucua

SEQ ID NO: 1796401 - RNA, 21 nt, Homo sapiens
cuuguccccgggguauuagca

SEQ ID NO: 1796402 - RNA, 13 nt, Homo sapiens
caacacugugcac

SEQ ID NO: 1796403 - RNA, 18 nt, Homo sapiens
aauuuuaugugcuucaca

SEQ ID NO: 1796404 - RNA, 15 nt, Homo sapiens
aaagcagacaggugu

SEQ ID NO: 1796405 - RNA, 17 nt, Homo sapiens
cccugagguaucugugu

SEQ ID NO: 1796406 - RNA, 18 nt, Homo sapiens
cuggccuugagcuucuaa

SEQ ID NO: 1796407 - RNA, 14 nt, Homo sapiens
uauauccccaaaau

SEQ ID NO: 1796408 - RNA, 23 nt, Homo sapiens
caauuuucuuuuuuauacucaau

SEQ ID NO: 1796409 - RNA, 23 nt, Homo sapiens
gaaagguuaauucucuagggcua

SEQ ID NO: 1796410 - RNA, 13 nt, Homo sapiens
cagauggggaaac

SEQ ID NO: 1796411 - RNA, 14 nt, Homo sapiens
gccgagaagccagu

SEQ ID NO: 1796412 - RNA, 19 nt, Homo sapiens
aaugacauggacacaucag

SEQ ID NO: 1796413 - RNA, 20 nt, Homo sapiens
cagggcuuuacuccguaaca

SEQ ID NO: 1796414 - RNA, 16 nt, Homo sapiens
guauggcagaggugca

SEQ ID NO: 1796415 - RNA, 17 nt, Homo sapiens
uuaaaacagcugcgaca

SEQ ID NO: 1796416 - RNA, 17 nt, Homo sapiens
caccacagccuccaaaa

SEQ ID NO: 1796417 - RNA, 22 nt, Homo sapiens
cucaaaagaaaauauagucaca

SEQ ID NO: 1796418 - RNA, 18 nt, Homo sapiens
auguaaguugaccuucuc

SEQ ID NO: 1796419 - RNA, 23 nt, Homo sapiens
agaacaaugggaggcugugauuu

SEQ ID NO: 1796420 - RNA, 16 nt, Homo sapiens
uagagcuuccacuguc

SEQ ID NO: 1796421 - RNA, 17 nt, Homo sapiens
aagacuugagccaucca

SEQ ID NO: 1796422 - RNA, 20 nt, Homo sapiens
augcuuccagcuaacagguc

SEQ ID NO: 1796423 - RNA, 21 nt, Homo sapiens
uaacugugcagagacuuuauc

SEQ ID NO: 1796424 - RNA, 13 nt, Homo sapiens
ggcaaaugugaug

SEQ ID NO: 1796425 - RNA, 14 nt, Homo sapiens
aaauauugucauaa

SEQ ID NO: 1796426 - RNA, 16 nt, Homo sapiens
uauaaauaagcacuau

SEQ ID NO: 1796427 - RNA, 12 nt, Homo sapiens
uauacaugacuu

SEQ ID NO: 1796428 - RNA, 21 nt, Homo sapiens
gaaaccucacgacuggucacc

SEQ ID NO: 1796429 - RNA, 16 nt, Homo sapiens
acaucuuaauccugaa

SEQ ID NO: 1796430 - RNA, 16 nt, Homo sapiens
gcuacaagaacauuug

SEQ ID NO: 1796431 - RNA, 18 nt, Homo sapiens
uguaguccuagccacuca

SEQ ID NO: 1796432 - RNA, 14 nt, Homo sapiens
cuggagaguggcau

SEQ ID NO: 1796433 - RNA, 13 nt, Homo sapiens
guuaacuugcaua

SEQ ID NO: 1796434 - RNA, 18 nt, Homo sapiens
uucuuuuugaaaugucaa

SEQ ID NO: 1796435 - RNA, 17 nt, Homo sapiens
cacuuguuucuacucaa

SEQ ID NO: 1796436 - RNA, 21 nt, Homo sapiens
gcaaauguaguauggccugug

SEQ ID NO: 1796437 - RNA, 13 nt, Homo sapiens
gaggcccugugau

SEQ ID NO: 1796438 - RNA, 21 nt, Homo sapiens
uuuguaguaguuguacuauga

SEQ ID NO: 1796439 - RNA, 18 nt, Homo sapiens
uaagcaugugucccagga

SEQ ID NO: 1796440 - RNA, 14 nt, Homo sapiens
agccagaggcaucu

SEQ ID NO: 1796441 - RNA, 17 nt, Homo sapiens
ccaucuugaucuuugag

SEQ ID NO: 1796442 - RNA, 19 nt, Homo sapiens
gugccagauuuaugcauau

SEQ ID NO: 1796443 - RNA, 15 nt, Homo sapiens
cccugcuagcacaga

SEQ ID NO: 1796444 - RNA, 17 nt, Homo sapiens
uagcuccaaaccuucac

SEQ ID NO: 1796445 - RNA, 16 nt, Homo sapiens
gauucuucugccucag

SEQ ID NO: 1796446 - RNA, 23 nt, Homo sapiens
cucagauuuccacagagacuguu

SEQ ID NO: 1796447 - RNA, 18 nt, Homo sapiens
cagaaagcugcuugccau

SEQ ID NO: 1796448 - RNA, 14 nt, Homo sapiens
uggccagcacguuc

SEQ ID NO: 1796449 - RNA, 22 nt, Homo sapiens
gaaccccuggccucaagcaauc

SEQ ID NO: 1796450 - RNA, 17 nt, Homo sapiens
agcuguccccugaccca

SEQ ID NO: 1796451 - RNA, 23 nt, Homo sapiens
acuaauagaauaaaggcaguuuu

SEQ ID NO: 1796452 - RNA, 19 nt, Homo sapiens
cagcugggccagcaagcac

SEQ ID NO: 1796453 - RNA, 11 nt, Homo sapiens
cuugagccauc

SEQ ID NO: 1796454 - RNA, 11 nt, Homo sapiens
cauggaucucu

SEQ ID NO: 1796455 - RNA, 13 nt, Homo sapiens
uuguaauacacau

SEQ ID NO: 1796456 - RNA, 18 nt, Homo sapiens
aaugauuuuucuuuacaa

SEQ ID NO: 1796457 - RNA, 19 nt, Homo sapiens
ucugggccagaauuucaaa

SEQ ID NO: 1796458 - RNA, 19 nt, Homo sapiens
cagguguauggagucaccu

SEQ ID NO: 1796459 - RNA, 23 nt, Homo sapiens
uccuuuugaaagaaucagucuug

SEQ ID NO: 1796460 - RNA, 21 nt, Homo sapiens
aacaccuagcuuuauucuuca

SEQ ID NO: 1796461 - RNA, 22 nt, Homo sapiens
cucuuaggcuaagagaugugac

SEQ ID NO: 1796462 - RNA, 21 nt, Homo sapiens
agcauuuauuuuggggaggaa

SEQ ID NO: 1796463 - RNA, 12 nt, Homo sapiens
aauaauugcuca

SEQ ID NO: 1796464 - RNA, 19 nt, Homo sapiens
gacacacacguuauaauca

SEQ ID NO: 1796465 - RNA, 13 nt, Homo sapiens
uaaaaccagagca

SEQ ID NO: 1796466 - RNA, 20 nt, Homo sapiens
aguuuuacacucuagugcca

SEQ ID NO: 1796467 - RNA, 19 nt, Homo sapiens
ugggcgcucucccuaccuu

SEQ ID NO: 1796468 - RNA, 23 nt, Homo sapiens
ucaaggacgaauuugcacaguga

SEQ ID NO: 1796469 - RNA, 20 nt, Homo sapiens
acacuuaucagcagcaacaa

SEQ ID NO: 1796470 - RNA, 20 nt, Homo sapiens
gaguuacuggauuuguuguu

SEQ ID NO: 1796471 - RNA, 13 nt, Homo sapiens
cguuuuauuccag

SEQ ID NO: 1796472 - RNA, 19 nt, Homo sapiens
aucuuucauccuugacuaa

SEQ ID NO: 1796473 - RNA, 18 nt, Homo sapiens
acauuuucuuaugucuca

SEQ ID NO: 1796474 - RNA, 16 nt, Homo sapiens
gucaugaauagaaaaa

SEQ ID NO: 1796475 - RNA, 15 nt, Homo sapiens
guuuuccauucucau

SEQ ID NO: 1796476 - RNA, 23 nt, Homo sapiens
cucuucuggggcaggcugggcca

SEQ ID NO: 1796477 - RNA, 14 nt, Homo sapiens
aagucuaacgcuga

SEQ ID NO: 1796478 - RNA, 20 nt, Homo sapiens
ccagccuggccagacaagaa

SEQ ID NO: 1796479 - RNA, 17 nt, Homo sapiens
auucacaacacaaucaa

SEQ ID NO: 1796480 - RNA, 23 nt, Homo sapiens
uuccucagauugcugaaucccau

SEQ ID NO: 1796481 - RNA, 20 nt, Homo sapiens
ggcucugccuucaaagggaa

SEQ ID NO: 1796482 - RNA, 20 nt, Homo sapiens
acuggcccacacgugcauag

SEQ ID NO: 1796483 - RNA, 21 nt, Homo sapiens
ucuguaaauuuaacugcauau

SEQ ID NO: 1796484 - RNA, 19 nt, Homo sapiens
cagccccagagcagggugu

SEQ ID NO: 1796485 - RNA, 14 nt, Homo sapiens
agacuuacugcuca

SEQ ID NO: 1796486 - RNA, 14 nt, Homo sapiens
uacuuuacaaacca

SEQ ID NO: 1796487 - RNA, 20 nt, Homo sapiens
ccuccacuuguucagggcuu

SEQ ID NO: 1796488 - RNA, 16 nt, Homo sapiens
uuaacuucuacauuca

SEQ ID NO: 1796489 - RNA, 14 nt, Homo sapiens
uuuaaguaauuuca

SEQ ID NO: 1796490 - RNA, 22 nt, Homo sapiens
aaaaccacugggaggagucuau

SEQ ID NO: 1796491 - RNA, 18 nt, Homo sapiens
ugaagcaaccuacuuuug

SEQ ID NO: 1796492 - RNA, 15 nt, Homo sapiens
augugcuguguaaag

SEQ ID NO: 1796493 - RNA, 16 nt, Homo sapiens
uguggaagagcauuag

SEQ ID NO: 1796494 - RNA, 18 nt, Homo sapiens
cccaggaggaggauugug

SEQ ID NO: 1796495 - RNA, 21 nt, Homo sapiens
ccagguacaggagaggcagca

SEQ ID NO: 1796496 - RNA, 17 nt, Homo sapiens
auaucauuuuauucaca

SEQ ID NO: 1796497 - RNA, 21 nt, Homo sapiens
agugccugauacugccugaca

SEQ ID NO: 1796498 - RNA, 15 nt, Homo sapiens
gcagggaagggugcc

SEQ ID NO: 1796499 - RNA, 17 nt, Homo sapiens
auagugacuaugaacuu

SEQ ID NO: 1796500 - RNA, 18 nt, Homo sapiens
ggccauggcucaugggac

SEQ ID NO: 1796501 - RNA, 16 nt, Homo sapiens
gaaaaaaaaugaccuc

SEQ ID NO: 1796502 - RNA, 14 nt, Homo sapiens
gcuuuaguggggaa

SEQ ID NO: 1796503 - RNA, 12 nt, Homo sapiens
gaagaccaguca

SEQ ID NO: 1796504 - RNA, 15 nt, Homo sapiens
agcuacuaugcccaa

SEQ ID NO: 1796505 - RNA, 12 nt, Homo sapiens
guagucuugucu

SEQ ID NO: 1796506 - RNA, 22 nt, Homo sapiens
gcccaucaucucugccuuugag

SEQ ID NO: 1796507 - RNA, 17 nt, Homo sapiens
acauaauagaauuuccu

SEQ ID NO: 1796508 - RNA, 18 nt, Homo sapiens
agaagugugaagugcaga

SEQ ID NO: 1796509 - RNA, 21 nt, Homo sapiens
uaggcauuugcugaauacaga

SEQ ID NO: 1796510 - RNA, 13 nt, Homo sapiens
aucuuauguuaaa

SEQ ID NO: 1796511 - RNA, 17 nt, Homo sapiens
uuccacaaguuaaauaa

SEQ ID NO: 1796512 - RNA, 18 nt, Homo sapiens
gagggugcagggaccaag

SEQ ID NO: 1796513 - RNA, 19 nt, Homo sapiens
ccaagcagagaagcucucg

SEQ ID NO: 1796514 - RNA, 17 nt, Homo sapiens
ucuguacaugacuguau

SEQ ID NO: 1796515 - RNA, 14 nt, Homo sapiens
gggcucagccuggu

SEQ ID NO: 1796516 - RNA, 19 nt, Homo sapiens
aaagaugaaugcaauagua

SEQ ID NO: 1796517 - RNA, 15 nt, Homo sapiens
gccuccagcucccac

SEQ ID NO: 1796518 - RNA, 18 nt, Homo sapiens
cuaggggaggggggagcc

SEQ ID NO: 1796519 - RNA, 14 nt, Homo sapiens
agcuaccagguguu

SEQ ID NO: 1796520 - RNA, 17 nt, Homo sapiens
auuguaggcaaccuucc

SEQ ID NO: 1796521 - RNA, 20 nt, Homo sapiens
caggaaagcuggugucugau

SEQ ID NO: 1796522 - RNA, 14 nt, Homo sapiens
auccagagugauuc

SEQ ID NO: 1796523 - RNA, 14 nt, Homo sapiens
uucuucagagacag

SEQ ID NO: 1796524 - RNA, 17 nt, Homo sapiens
cuuuaucugugaccaca

SEQ ID NO: 1796525 - RNA, 17 nt, Homo sapiens
gcaugagccagcucugu

SEQ ID NO: 1796526 - RNA, 16 nt, Homo sapiens
ccugaaauuaacucag

SEQ ID NO: 1796527 - RNA, 18 nt, Homo sapiens
aaugcugcuucuccuccc

SEQ ID NO: 1796528 - RNA, 22 nt, Homo sapiens
cauuauucaagaaagauaucua

SEQ ID NO: 1796529 - RNA, 17 nt, Homo sapiens
agacacuacaugaugac

SEQ ID NO: 1796530 - RNA, 22 nt, Homo sapiens
cuguugauguaucugaguugcc

SEQ ID NO: 1796531 - RNA, 22 nt, Homo sapiens
aaacucacuauauaagucacau

SEQ ID NO: 1796532 - RNA, 14 nt, Homo sapiens
cuguugcuguuggc

SEQ ID NO: 1796533 - RNA, 18 nt, Homo sapiens
uaagaaaacaucacugaa

SEQ ID NO: 1796534 - RNA, 14 nt, Homo sapiens
acccuuucuggcac

SEQ ID NO: 1796535 - RNA, 13 nt, Homo sapiens
acacaagcacuuu

SEQ ID NO: 1796536 - RNA, 13 nt, Homo sapiens
acuuaagcacacu

SEQ ID NO: 1796537 - RNA, 13 nt, Homo sapiens
aaugcucccugaa

SEQ ID NO: 1796538 - RNA, 18 nt, Homo sapiens
aaggcaggagaugcagca

SEQ ID NO: 1796539 - RNA, 18 nt, Homo sapiens
caagcgucaucuguguaa

SEQ ID NO: 1796540 - RNA, 15 nt, Homo sapiens
ugauaucaacagcuu

SEQ ID NO: 1796541 - RNA, 18 nt, Homo sapiens
ugaaacacacauggacau

SEQ ID NO: 1796542 - RNA, 20 nt, Homo sapiens
acagucucugagaaguacuu

SEQ ID NO: 1796543 - RNA, 16 nt, Homo sapiens
ugacucagagugcaag

SEQ ID NO: 1796544 - RNA, 18 nt, Homo sapiens
uguucugcagucaucucc

SEQ ID NO: 1796545 - RNA, 12 nt, Homo sapiens
gacaaugaccaa

SEQ ID NO: 1796546 - RNA, 22 nt, Homo sapiens
gggaggcggcacauuggcagug

SEQ ID NO: 1796547 - RNA, 17 nt, Homo sapiens
aagagaugcacuauaug

SEQ ID NO: 1796548 - RNA, 15 nt, Homo sapiens
gagaaccaggcugcu

SEQ ID NO: 1796549 - RNA, 16 nt, Homo sapiens
uuguguuugaagcaca

SEQ ID NO: 1796550 - RNA, 18 nt, Homo sapiens
ugcggcugcaucuuccag

SEQ ID NO: 1796551 - RNA, 11 nt, Homo sapiens
gugggggucca

SEQ ID NO: 1796552 - RNA, 23 nt, Homo sapiens
uacaggggagaaggaaaugcagg

SEQ ID NO: 1796553 - RNA, 14 nt, Homo sapiens
gcgaggacaucaaa

SEQ ID NO: 1796554 - RNA, 14 nt, Homo sapiens
aacauucacagccc

SEQ ID NO: 1796555 - RNA, 13 nt, Homo sapiens
auccagacagucg

SEQ ID NO: 1796556 - RNA, 21 nt, Homo sapiens
auuuacuguggcuucuuaauc

SEQ ID NO: 1796557 - RNA, 19 nt, Homo sapiens
gugcaguggugugaucuca

SEQ ID NO: 1796558 - RNA, 18 nt, Homo sapiens
ucuaaggaauaugagcuu

SEQ ID NO: 1796559 - RNA, 22 nt, Homo sapiens
uggguccuaauuaccagucuuu

SEQ ID NO: 1796560 - RNA, 19 nt, Homo sapiens
cauguaaaccuaagcacgu

SEQ ID NO: 1796561 - RNA, 12 nt, Homo sapiens
uuucagcugcaa

SEQ ID NO: 1796562 - RNA, 20 nt, Homo sapiens
auucagaaggaucuucaucu

SEQ ID NO: 1796563 - RNA, 14 nt, Homo sapiens
aaguaagcauuucc

SEQ ID NO: 1796564 - RNA, 17 nt, Homo sapiens
aguuaccuuucuagguc

SEQ ID NO: 1796565 - RNA, 16 nt, Homo sapiens
uuccugcuccaugacu

SEQ ID NO: 1796566 - RNA, 18 nt, Homo sapiens
uacucuuaaaugagaaag

SEQ ID NO: 1796567 - RNA, 23 nt, Homo sapiens
uucaaacuaggggacaaagcaaa

SEQ ID NO: 1796568 - RNA, 13 nt, Homo sapiens
auagccagcauuu

SEQ ID NO: 1796569 - RNA, 14 nt, Homo sapiens
ucuauuauagccac

SEQ ID NO: 1796570 - RNA, 13 nt, Homo sapiens
aacuucacuccaa

SEQ ID NO: 1796571 - RNA, 19 nt, Homo sapiens
gcccacagucugacuuccc

SEQ ID NO: 1796572 - RNA, 19 nt, Homo sapiens
agcccagaagcccaguaac

SEQ ID NO: 1796573 - RNA, 19 nt, Homo sapiens
caguguuacuguguuuauc

SEQ ID NO: 1796574 - RNA, 12 nt, Homo sapiens
gacaugccuugg

SEQ ID NO: 1796575 - RNA, 18 nt, Homo sapiens
aaagcauuugcaacagcu

SEQ ID NO: 1796576 - RNA, 18 nt, Homo sapiens
cuaggugcccagucuuga

SEQ ID NO: 1796577 - RNA, 22 nt, Homo sapiens
uccugacuuaaaacaaaaggaa

SEQ ID NO: 1796578 - RNA, 16 nt, Homo sapiens
agguucuaaaguucua

SEQ ID NO: 1796579 - RNA, 16 nt, Homo sapiens
uauagauauguagaua

SEQ ID NO: 1796580 - RNA, 20 nt, Homo sapiens
gaagggaaaugacuucucca

SEQ ID NO: 1796581 - RNA, 14 nt, Homo sapiens
accaguacugggaa

SEQ ID NO: 1796582 - RNA, 21 nt, Homo sapiens
auuuucaauuuggagcauuaa

SEQ ID NO: 1796583 - RNA, 14 nt, Homo sapiens
auagaaacaccagu

SEQ ID NO: 1796584 - RNA, 19 nt, Homo sapiens
gaggacauaaugggguccu

SEQ ID NO: 1796585 - RNA, 14 nt, Homo sapiens
gaccauuccaggaa

SEQ ID NO: 1796586 - RNA, 16 nt, Homo sapiens
uugagacuccccaaua

SEQ ID NO: 1796587 - RNA, 14 nt, Homo sapiens
auuuaagacacugu

SEQ ID NO: 1796588 - RNA, 22 nt, Homo sapiens
aucgcugucaucucagcuggau

SEQ ID NO: 1796589 - RNA, 19 nt, Homo sapiens
caccaaauacaauucaaau

SEQ ID NO: 1796590 - RNA, 17 nt, Homo sapiens
ggauuacaguguagcua

SEQ ID NO: 1796591 - RNA, 21 nt, Homo sapiens
ccuaacacuaucauaguuauu

SEQ ID NO: 1796592 - RNA, 22 nt, Homo sapiens
uggccuaugcacauauggacuc

SEQ ID NO: 1796593 - RNA, 19 nt, Homo sapiens
aaauuauauuugugcuaua

SEQ ID NO: 1796594 - RNA, 13 nt, Homo sapiens
guuugucuucucc

SEQ ID NO: 1796595 - RNA, 18 nt, Homo sapiens
agguccaugugcacugca

SEQ ID NO: 1796596 - RNA, 21 nt, Homo sapiens
uguauauagaguggaaucucu

SEQ ID NO: 1796597 - RNA, 16 nt, Homo sapiens
cauggcugccaucuca

SEQ ID NO: 1796598 - RNA, 16 nt, Homo sapiens
agcuacaauauucucu

SEQ ID NO: 1796599 - RNA, 14 nt, Homo sapiens
acaauaaacccuca

SEQ ID NO: 1796600 - RNA, 19 nt, Homo sapiens
auuugugaaagugccaaaa

SEQ ID NO: 1796601 - RNA, 23 nt, Homo sapiens
uuugugaaaugaaaacauguaau

SEQ ID NO: 1796602 - RNA, 13 nt, Homo sapiens
cucccucugggaa

SEQ ID NO: 1796603 - RNA, 18 nt, Homo sapiens
aaucccuguaauauuuag

SEQ ID NO: 1796604 - RNA, 17 nt, Homo sapiens
cacagcccugagaguca

SEQ ID NO: 1796605 - RNA, 22 nt, Homo sapiens
gccaggaaucacuggcuguuaa

SEQ ID NO: 1796606 - RNA, 15 nt, Homo sapiens
gaggcugcaaucaca

SEQ ID NO: 1796607 - RNA, 19 nt, Homo sapiens
uuaguuaaaacacauauca

SEQ ID NO: 1796608 - RNA, 17 nt, Homo sapiens
aacucuuaagagaacau

SEQ ID NO: 1796609 - RNA, 13 nt, Homo sapiens
ucuacagugccaa

SEQ ID NO: 1796610 - RNA, 14 nt, Homo sapiens
ugggaaaaccagac

SEQ ID NO: 1796611 - RNA, 13 nt, Homo sapiens
cuuagaaaauuca

SEQ ID NO: 1796612 - RNA, 21 nt, Homo sapiens
cagcaucaucugcacugccca

SEQ ID NO: 1796613 - RNA, 16 nt, Homo sapiens
cauaauuuacaugcaa

SEQ ID NO: 1796614 - RNA, 21 nt, Homo sapiens
ccugcagccgugcaggacucu

SEQ ID NO: 1796615 - RNA, 17 nt, Homo sapiens
uagagcugagagucuga

SEQ ID NO: 1796616 - RNA, 19 nt, Homo sapiens
aaaggaaaaucacaucucc

SEQ ID NO: 1796617 - RNA, 22 nt, Homo sapiens
acccuuuugugucuaugauguu

SEQ ID NO: 1796618 - RNA, 13 nt, Homo sapiens
ucuauguuugcac

SEQ ID NO: 1796619 - RNA, 22 nt, Homo sapiens
uuugugcauguauauuacugau

SEQ ID NO: 1796620 - RNA, 14 nt, Homo sapiens
ugccccccaugagg

SEQ ID NO: 1796621 - RNA, 20 nt, Homo sapiens
acauauaaauuaauacauaa

SEQ ID NO: 1796622 - RNA, 17 nt, Homo sapiens
gagggacuuugcugauu

SEQ ID NO: 1796623 - RNA, 16 nt, Homo sapiens
auaccuuccuucccug

SEQ ID NO: 1796624 - RNA, 20 nt, Homo sapiens
aaaucuuucuuucuuagaaa

SEQ ID NO: 1796625 - RNA, 22 nt, Homo sapiens
gaagcauggcauauagugcccu

SEQ ID NO: 1796626 - RNA, 11 nt, Homo sapiens
uuaagaauucu

SEQ ID NO: 1796627 - RNA, 21 nt, Homo sapiens
acgggcgccaagacucagggg

SEQ ID NO: 1796628 - RNA, 21 nt, Homo sapiens
uaucugggugcaugaucuuga

SEQ ID NO: 1796629 - RNA, 21 nt, Homo sapiens
uuuccagcgggacucuucuca

SEQ ID NO: 1796630 - RNA, 13 nt, Homo sapiens
augcagcgugaag

SEQ ID NO: 1796631 - RNA, 15 nt, Homo sapiens
uuccucucuuggcaa

SEQ ID NO: 1796632 - RNA, 21 nt, Homo sapiens
ccauggagggggcuugcacuc

SEQ ID NO: 1796633 - RNA, 14 nt, Homo sapiens
ugggacagccauuu

SEQ ID NO: 1796634 - RNA, 19 nt, Homo sapiens
uggagggcuagaaucugga

SEQ ID NO: 1796635 - RNA, 16 nt, Homo sapiens
cucacacucucugcag

SEQ ID NO: 1796636 - RNA, 19 nt, Homo sapiens
cucugggaaaaucuauucc

SEQ ID NO: 1796637 - RNA, 12 nt, Homo sapiens
aaaacacaacau

SEQ ID NO: 1796638 - RNA, 13 nt, Homo sapiens
cagcacaggcacc

SEQ ID NO: 1796639 - RNA, 22 nt, Homo sapiens
cuuugccucucaauugucauug

SEQ ID NO: 1796640 - RNA, 16 nt, Homo sapiens
cagaauugagagugau

SEQ ID NO: 1796641 - RNA, 18 nt, Homo sapiens
auggguaacacugauuac

SEQ ID NO: 1796642 - RNA, 14 nt, Homo sapiens
caggggcagugaag

SEQ ID NO: 1796643 - RNA, 19 nt, Homo sapiens
guugcaaaucacucugcaa

SEQ ID NO: 1796644 - RNA, 14 nt, Homo sapiens
gcagggacuugccu

SEQ ID NO: 1796645 - RNA, 15 nt, Homo sapiens
ugaaaauuauggcug

SEQ ID NO: 1796646 - RNA, 19 nt, Homo sapiens
gcuuuuucucagcccugac

SEQ ID NO: 1796647 - RNA, 12 nt, Homo sapiens
aaaccuucaucc

SEQ ID NO: 1796648 - RNA, 15 nt, Homo sapiens
uuacauaaagacugu

SEQ ID NO: 1796649 - RNA, 23 nt, Homo sapiens
augugucucaggaaaacagcuag

SEQ ID NO: 1796650 - RNA, 23 nt, Homo sapiens
uagucagcgcaguuuagcaguua

SEQ ID NO: 1796651 - RNA, 12 nt, Homo sapiens
aauuauuugaag

SEQ ID NO: 1796652 - RNA, 11 nt, Homo sapiens
ccggacagugg

SEQ ID NO: 1796653 - RNA, 14 nt, Homo sapiens
gguaagcaccagga

SEQ ID NO: 1796654 - RNA, 13 nt, Homo sapiens
cagguaaggugag

SEQ ID NO: 1796655 - RNA, 16 nt, Homo sapiens
uuuuaauuugauacaa

SEQ ID NO: 1796656 - RNA, 13 nt, Homo sapiens
auuaaacacugua

SEQ ID NO: 1796657 - RNA, 20 nt, Homo sapiens
auaccuagauuccauacagu

SEQ ID NO: 1796658 - RNA, 16 nt, Homo sapiens
ugauggugcaugccug

SEQ ID NO: 1796659 - RNA, 19 nt, Homo sapiens
ugcaugaaucuguacccuu

SEQ ID NO: 1796660 - RNA, 21 nt, Homo sapiens
aauguuaauugggcaggugaa

SEQ ID NO: 1796661 - RNA, 17 nt, Homo sapiens
gaccuuuuaacuccuca

SEQ ID NO: 1796662 - RNA, 23 nt, Homo sapiens
ggauuuuuagauucccagugucu

SEQ ID NO: 1796663 - RNA, 15 nt, Homo sapiens
ccccaccccaguggg

SEQ ID NO: 1796664 - RNA, 22 nt, Homo sapiens
ugcuaguguucugucuaaaaac

SEQ ID NO: 1796665 - RNA, 15 nt, Homo sapiens
aacucauuccugccu

SEQ ID NO: 1796666 - RNA, 22 nt, Homo sapiens
accuuauagguuacucauaagg

SEQ ID NO: 1796667 - RNA, 17 nt, Homo sapiens
cuuguguugcacugaac

SEQ ID NO: 1796668 - RNA, 13 nt, Homo sapiens
cucaauugggaaa

SEQ ID NO: 1796669 - RNA, 17 nt, Homo sapiens
aaaaucacugugcugau

SEQ ID NO: 1796670 - RNA, 17 nt, Homo sapiens
auaauauuuuucuuaga

SEQ ID NO: 1796671 - RNA, 13 nt, Homo sapiens
cuacuacagagaa

SEQ ID NO: 1796672 - RNA, 21 nt, Homo sapiens
uggagccugcauuaugcacgu

SEQ ID NO: 1796673 - RNA, 18 nt, Homo sapiens
auugucugccauuacacc

SEQ ID NO: 1796674 - RNA, 15 nt, Homo sapiens
cucgcuucauaggca

SEQ ID NO: 1796675 - RNA, 14 nt, Homo sapiens
ccgauuagaaggca

SEQ ID NO: 1796676 - RNA, 19 nt, Homo sapiens
ugggggucagucacuugaa

SEQ ID NO: 1796677 - RNA, 21 nt, Homo sapiens
cuuuagcuaccucacuaugcu

SEQ ID NO: 1796678 - RNA, 17 nt, Homo sapiens
cauucauuuaacagagc

SEQ ID NO: 1796679 - RNA, 19 nt, Homo sapiens
ugccuuggguggaccaggc

SEQ ID NO: 1796680 - RNA, 22 nt, Homo sapiens
uucucucacuguguuacugcuu

SEQ ID NO: 1796681 - RNA, 16 nt, Homo sapiens
caaugaagaaguuucu

SEQ ID NO: 1796682 - RNA, 15 nt, Homo sapiens
cugcucuuucucugc

SEQ ID NO: 1796683 - RNA, 21 nt, Homo sapiens
gcuggaccaguggugccuugg

SEQ ID NO: 1796684 - RNA, 13 nt, Homo sapiens
cuuggagucaaaa

SEQ ID NO: 1796685 - RNA, 16 nt, Homo sapiens
aaucucaggucuucac

SEQ ID NO: 1796686 - RNA, 16 nt, Homo sapiens
uguguaccuaagggag

SEQ ID NO: 1796687 - RNA, 17 nt, Homo sapiens
acugauuacguuuacau

SEQ ID NO: 1796688 - RNA, 13 nt, Homo sapiens
uggauccacuuuu

SEQ ID NO: 1796689 - RNA, 17 nt, Homo sapiens
uauuauuuuugagacag

SEQ ID NO: 1796690 - RNA, 13 nt, Homo sapiens
cuaucuccugaca

SEQ ID NO: 1796691 - RNA, 19 nt, Homo sapiens
cugcuccccuaaagccagg

SEQ ID NO: 1796692 - RNA, 23 nt, Homo sapiens
gaaugcgcugaucguuucuucca

SEQ ID NO: 1796693 - RNA, 22 nt, Homo sapiens
augagcuggguacugacugaga

SEQ ID NO: 1796694 - RNA, 12 nt, Homo sapiens
ugaacaagagcu

SEQ ID NO: 1796695 - RNA, 12 nt, Homo sapiens
uccacaagacau

SEQ ID NO: 1796696 - RNA, 20 nt, Homo sapiens
aaugcccccugagugacugc

SEQ ID NO: 1796697 - RNA, 18 nt, Homo sapiens
ugagcaaauugauuagaa

SEQ ID NO: 1796698 - RNA, 20 nt, Homo sapiens
uccagcuaacauacuauaua

SEQ ID NO: 1796699 - RNA, 12 nt, Homo sapiens
caagaugagcug

SEQ ID NO: 1796700 - RNA, 15 nt, Homo sapiens
acuuugaaccauaaa

SEQ ID NO: 1796701 - RNA, 16 nt, Homo sapiens
agucaauuugcugaaa

SEQ ID NO: 1796702 - RNA, 14 nt, Homo sapiens
uuaauuguacucaa

SEQ ID NO: 1796703 - RNA, 14 nt, Homo sapiens
ccaguuuuuugcca

SEQ ID NO: 1796704 - RNA, 23 nt, Homo sapiens
caaaugcgcacgaccuacauuaa

SEQ ID NO: 1796705 - RNA, 22 nt, Homo sapiens
caucaauucuuagaauaucuaa

SEQ ID NO: 1796706 - RNA, 22 nt, Homo sapiens
cauaacagucuuacugcaggca

SEQ ID NO: 1796707 - RNA, 20 nt, Homo sapiens
auguagcucuuugucaggga

SEQ ID NO: 1796708 - RNA, 14 nt, Homo sapiens
cagcaggugcaagg

SEQ ID NO: 1796709 - RNA, 18 nt, Homo sapiens
uauauuaaaguguuauac

SEQ ID NO: 1796710 - RNA, 19 nt, Homo sapiens
ugaggcuggacuccagauc

SEQ ID NO: 1796711 - RNA, 23 nt, Homo sapiens
cacacaucccagcccaauccagg

SEQ ID NO: 1796712 - RNA, 21 nt, Homo sapiens
uugccaugagaguucugucac

SEQ ID NO: 1796713 - RNA, 15 nt, Homo sapiens
uaagagacaacuauc

SEQ ID NO: 1796714 - RNA, 14 nt, Homo sapiens
uccaugcuccucac

SEQ ID NO: 1796715 - RNA, 15 nt, Homo sapiens
cacuuuaaagcccuu

SEQ ID NO: 1796716 - RNA, 15 nt, Homo sapiens
uuguacaggacugua

SEQ ID NO: 1796717 - RNA, 16 nt, Homo sapiens
aauugcuccauuccug

SEQ ID NO: 1796718 - RNA, 12 nt, Homo sapiens
ucaaaugccuga

SEQ ID NO: 1796719 - RNA, 14 nt, Homo sapiens
cagcugcaggcaca

SEQ ID NO: 1796720 - RNA, 16 nt, Homo sapiens
cccgcauagcacuugc

SEQ ID NO: 1796721 - RNA, 20 nt, Homo sapiens
caguguuggggaugccuugg

SEQ ID NO: 1796722 - RNA, 21 nt, Homo sapiens
cugucacguucuccacacggg

SEQ ID NO: 1796723 - RNA, 23 nt, Homo sapiens
cugaauuuggagucugacugugc

SEQ ID NO: 1796724 - RNA, 16 nt, Homo sapiens
ucuggcccagccuacc

SEQ ID NO: 1796725 - RNA, 16 nt, Homo sapiens
ugguugccacaucuua

SEQ ID NO: 1796726 - RNA, 23 nt, Homo sapiens
gccccaccccaccuccacuccca

SEQ ID NO: 1796727 - RNA, 22 nt, Homo sapiens
uccugccacuagguuucaccuc

SEQ ID NO: 1796728 - RNA, 14 nt, Homo sapiens
ugcaguugauucug

SEQ ID NO: 1796729 - RNA, 20 nt, Homo sapiens
uauuucaugggaauauucaa

SEQ ID NO: 1796730 - RNA, 18 nt, Homo sapiens
uagaauugcaaucuauaa

SEQ ID NO: 1796731 - RNA, 23 nt, Homo sapiens
auaaauagaguguuuuucaugga

SEQ ID NO: 1796732 - RNA, 16 nt, Homo sapiens
gcuaacuacaugaaca

SEQ ID NO: 1796733 - RNA, 23 nt, Homo sapiens
cccuguuuucugagcccgggcug

SEQ ID NO: 1796734 - RNA, 19 nt, Homo sapiens
aacuaaagugugcuuuaua

SEQ ID NO: 1796735 - RNA, 17 nt, Homo sapiens
cacuucaaggugacaga

SEQ ID NO: 1796736 - RNA, 18 nt, Homo sapiens
aaggccugcccugaugcu

SEQ ID NO: 1796737 - RNA, 15 nt, Homo sapiens
cuggaaaacugccuu

SEQ ID NO: 1796738 - RNA, 15 nt, Homo sapiens
aaagauuaaaaccaa

SEQ ID NO: 1796739 - RNA, 15 nt, Homo sapiens
ucugaaaaucuccuu

SEQ ID NO: 1796740 - RNA, 14 nt, Homo sapiens
auacagagaugaac

SEQ ID NO: 1796741 - RNA, 18 nt, Homo sapiens
cagcaggaccugugcuuu

SEQ ID NO: 1796742 - RNA, 20 nt, Homo sapiens
augcgucccaagauguugau

SEQ ID NO: 1796743 - RNA, 23 nt, Homo sapiens
cuggaauaagaagcaaauaaaua

SEQ ID NO: 1796744 - RNA, 16 nt, Homo sapiens
cuuuuuggccugugau

SEQ ID NO: 1796745 - RNA, 23 nt, Homo sapiens
gggcccagaggagaggagacaga

SEQ ID NO: 1796746 - RNA, 19 nt, Homo sapiens
aaagcuagauaugccuuaa

SEQ ID NO: 1796747 - RNA, 15 nt, Homo sapiens
ugggugggacacaga

SEQ ID NO: 1796748 - RNA, 16 nt, Homo sapiens
uuaugaguucuguaua

SEQ ID NO: 1796749 - RNA, 17 nt, Homo sapiens
ucgauauccugaucucg

SEQ ID NO: 1796750 - RNA, 18 nt, Homo sapiens
cacaguccaggaacaagc

SEQ ID NO: 1796751 - RNA, 18 nt, Homo sapiens
uaagaugaucaucuccag

SEQ ID NO: 1796752 - RNA, 12 nt, Homo sapiens
gcaggaagccaa

SEQ ID NO: 1796753 - RNA, 22 nt, Homo sapiens
uguacacugacuugagaccagu

SEQ ID NO: 1796754 - RNA, 15 nt, Homo sapiens
ucucagcucuuccau

SEQ ID NO: 1796755 - RNA, 12 nt, Homo sapiens
uaaacucagauu

SEQ ID NO: 1796756 - RNA, 15 nt, Homo sapiens
auaccagcucagggg

SEQ ID NO: 1796757 - RNA, 19 nt, Homo sapiens
ugaguuugggauuguggua

SEQ ID NO: 1796758 - RNA, 14 nt, Homo sapiens
caaauaauagcaau

SEQ ID NO: 1796759 - RNA, 16 nt, Homo sapiens
cugcacuacuaugaga

SEQ ID NO: 1796760 - RNA, 20 nt, Homo sapiens
aggauccagugacaugauuc

SEQ ID NO: 1796761 - RNA, 21 nt, Homo sapiens
aguuuaaaacccaaacuucca

SEQ ID NO: 1796762 - RNA, 11 nt, Homo sapiens
aaacagaagau

SEQ ID NO: 1796763 - RNA, 15 nt, Homo sapiens
uugaguauugcugau

SEQ ID NO: 1796764 - RNA, 16 nt, Homo sapiens
cagccucccccggcuc

SEQ ID NO: 1796765 - RNA, 19 nt, Homo sapiens
ugaaagacucuucacucca

SEQ ID NO: 1796766 - RNA, 13 nt, Homo sapiens
acaaaugacauca

SEQ ID NO: 1796767 - RNA, 14 nt, Homo sapiens
uuccaacacacaau

SEQ ID NO: 1796768 - RNA, 14 nt, Homo sapiens
cuuaaucauaucaa

SEQ ID NO: 1796769 - RNA, 17 nt, Homo sapiens
ugaugacucaaggccaa

SEQ ID NO: 1796770 - RNA, 23 nt, Homo sapiens
uguacaagguauguacaguucau

SEQ ID NO: 1796771 - RNA, 14 nt, Homo sapiens
gugcucugugucaa

SEQ ID NO: 1796772 - RNA, 22 nt, Homo sapiens
aaucaguguguuacuaucuaca

SEQ ID NO: 1796773 - RNA, 13 nt, Homo sapiens
ccauaaagugcca

SEQ ID NO: 1796774 - RNA, 16 nt, Homo sapiens
cucuugaggagcucaa

SEQ ID NO: 1796775 - RNA, 22 nt, Homo sapiens
uacuauuuaagagaacaagcaa

SEQ ID NO: 1796776 - RNA, 13 nt, Homo sapiens
ccuccaagcauuu

SEQ ID NO: 1796777 - RNA, 17 nt, Homo sapiens
gggacuuccuugcucuc

SEQ ID NO: 1796778 - RNA, 20 nt, Homo sapiens
aguuggccagcgucuugcuc

SEQ ID NO: 1796779 - RNA, 13 nt, Homo sapiens
caugagguaaaag

SEQ ID NO: 1796780 - RNA, 15 nt, Homo sapiens
uccuccagccaagau

SEQ ID NO: 1796781 - RNA, 20 nt, Homo sapiens
ggcagagccaccagggcacu

SEQ ID NO: 1796782 - RNA, 15 nt, Homo sapiens
augcuccaccgucag

SEQ ID NO: 1796783 - RNA, 14 nt, Homo sapiens
ggccagcaugguga

SEQ ID NO: 1796784 - RNA, 23 nt, Homo sapiens
gucauuccucuccuagcccuccu

SEQ ID NO: 1796785 - RNA, 18 nt, Homo sapiens
uccaccuggaagcccucu

SEQ ID NO: 1796786 - RNA, 13 nt, Homo sapiens
uacugaagcuuua

SEQ ID NO: 1796787 - RNA, 13 nt, Homo sapiens
gccagagcuaaaa

SEQ ID NO: 1796788 - RNA, 18 nt, Homo sapiens
aggaguaguugauaaauu

SEQ ID NO: 1796789 - RNA, 17 nt, Homo sapiens
aagugggcagcauaaag

SEQ ID NO: 1796790 - RNA, 16 nt, Homo sapiens
ccuuccaggugggugu

SEQ ID NO: 1796791 - RNA, 16 nt, Homo sapiens
cugugugugcugccag

SEQ ID NO: 1796792 - RNA, 19 nt, Homo sapiens
guccaaguggcugugacau

SEQ ID NO: 1796793 - RNA, 22 nt, Homo sapiens
gaggcagaccauccaccaggcc

SEQ ID NO: 1796794 - RNA, 16 nt, Homo sapiens
aaggguucagggcaug

SEQ ID NO: 1796795 - RNA, 19 nt, Homo sapiens
ccagacaauggcccagguc

SEQ ID NO: 1796796 - RNA, 18 nt, Homo sapiens
cauuuaaagagauuuccc

SEQ ID NO: 1796797 - RNA, 16 nt, Homo sapiens
cucaagacugaaacgg

SEQ ID NO: 1796798 - RNA, 12 nt, Homo sapiens
cacagaccccag

SEQ ID NO: 1796799 - RNA, 14 nt, Homo sapiens
ucagcuuggcugua

SEQ ID NO: 1796800 - RNA, 12 nt, Homo sapiens
aaagcaucaaag

SEQ ID NO: 1796801 - RNA, 16 nt, Homo sapiens
agauguccaucagaug

SEQ ID NO: 1796802 - RNA, 22 nt, Homo sapiens
ggacaccuggccgccuccagga

SEQ ID NO: 1796803 - RNA, 17 nt, Homo sapiens
aaccaagcuguacccuu

SEQ ID NO: 1796804 - RNA, 18 nt, Homo sapiens
cucccugcucuaacaccu

SEQ ID NO: 1796805 - RNA, 11 nt, Homo sapiens
cccuugccaug

SEQ ID NO: 1796806 - RNA, 16 nt, Homo sapiens
aaaguuuaaagacacu

SEQ ID NO: 1796807 - RNA, 20 nt, Homo sapiens
aauuucaaaaauauaacuua

SEQ ID NO: 1796808 - RNA, 16 nt, Homo sapiens
auacucuaugugauuu

SEQ ID NO: 1796809 - RNA, 22 nt, Homo sapiens
uuuagauuaggucacauuacau

SEQ ID NO: 1796810 - RNA, 13 nt, Homo sapiens
guaguuaaccaaa

SEQ ID NO: 1796811 - RNA, 20 nt, Homo sapiens
guuccucaucugagaggcuc

SEQ ID NO: 1796812 - RNA, 16 nt, Homo sapiens
auaaaacaacucugau

SEQ ID NO: 1796813 - RNA, 15 nt, Homo sapiens
ccggacaguggcacc

SEQ ID NO: 1796814 - RNA, 23 nt, Homo sapiens
uucuguagauguugucuuggcuu

SEQ ID NO: 1796815 - RNA, 22 nt, Homo sapiens
ccccagcucuggcuuccagaaa

SEQ ID NO: 1796816 - RNA, 20 nt, Homo sapiens
gaaaaguggagaaauggcaa

SEQ ID NO: 1796817 - RNA, 13 nt, Homo sapiens
uuaaagaugcuga

SEQ ID NO: 1796818 - RNA, 16 nt, Homo sapiens
ccaauaaaccagugug

SEQ ID NO: 1796819 - RNA, 13 nt, Homo sapiens
augugccuggaaa

SEQ ID NO: 1796820 - RNA, 12 nt, Homo sapiens
augcacugagua

SEQ ID NO: 1796821 - RNA, 21 nt, Homo sapiens
cgcccagagaacaagcacugu

SEQ ID NO: 1796822 - RNA, 16 nt, Homo sapiens
caugccgcgucccugc

SEQ ID NO: 1796823 - RNA, 15 nt, Homo sapiens
gagacugaagaccag

SEQ ID NO: 1796824 - RNA, 21 nt, Homo sapiens
acagaacuggaggcaguccau

SEQ ID NO: 1796825 - RNA, 13 nt, Homo sapiens
caggcagaaggag

SEQ ID NO: 1796826 - RNA, 22 nt, Homo sapiens
ggaggccgaagcuaacagggaa

SEQ ID NO: 1796827 - RNA, 15 nt, Homo sapiens
cccagucacugugag

SEQ ID NO: 1796828 - RNA, 12 nt, Homo sapiens
aauuucacaagc

SEQ ID NO: 1796829 - RNA, 18 nt, Homo sapiens
acuuagguuauuuugcuu

SEQ ID NO: 1796830 - RNA, 13 nt, Homo sapiens
gaccaccaccagg

SEQ ID NO: 1796831 - RNA, 22 nt, Homo sapiens
guggggagguuaaucuaggaau

SEQ ID NO: 1796832 - RNA, 18 nt, Homo sapiens
ucuuaaccuauucccaaa

SEQ ID NO: 1796833 - RNA, 23 nt, Homo sapiens
uucuacccuccaugugagaauau

SEQ ID NO: 1796834 - RNA, 15 nt, Homo sapiens
gaugaaacuuugaaa

SEQ ID NO: 1796835 - RNA, 17 nt, Homo sapiens
cauggucccaggcuucc

SEQ ID NO: 1796836 - RNA, 21 nt, Homo sapiens
uuuaaauaaaaaaguuuacag

SEQ ID NO: 1796837 - RNA, 18 nt, Homo sapiens
gacaacagccguccuccc

SEQ ID NO: 1796838 - RNA, 18 nt, Homo sapiens
gaggccccaauaccccau

SEQ ID NO: 1796839 - RNA, 18 nt, Homo sapiens
ucuaaaaauaguuaacac

SEQ ID NO: 1796840 - RNA, 18 nt, Homo sapiens
ugccacuggcaugcucuu

SEQ ID NO: 1796841 - RNA, 15 nt, Homo sapiens
ugcugagaaggacac

SEQ ID NO: 1796842 - RNA, 18 nt, Homo sapiens
ccgcugcgucugcacuga

SEQ ID NO: 1796843 - RNA, 20 nt, Homo sapiens
cuuaagcauaaaaauugaau

SEQ ID NO: 1796844 - RNA, 15 nt, Homo sapiens
cugugugaaggugaa

SEQ ID NO: 1796845 - RNA, 15 nt, Homo sapiens
aggccugacugccaa

SEQ ID NO: 1796846 - RNA, 21 nt, Homo sapiens
cuuaggugacaauguccccca

SEQ ID NO: 1796847 - RNA, 21 nt, Homo sapiens
ggccaccugcaggucacugaa

SEQ ID NO: 1796848 - RNA, 21 nt, Homo sapiens
gcggaaggagggagcucugau

SEQ ID NO: 1796849 - RNA, 15 nt, Homo sapiens
ccaugcgggugcaca

SEQ ID NO: 1796850 - RNA, 14 nt, Homo sapiens
acugauuuaucuau

SEQ ID NO: 1796851 - RNA, 19 nt, Homo sapiens
ucugagcacagcugcauua

SEQ ID NO: 1796852 - RNA, 15 nt, Homo sapiens
uaccuuguuccaaau

SEQ ID NO: 1796853 - RNA, 15 nt, Homo sapiens
aguuacuguccuguu

SEQ ID NO: 1796854 - RNA, 20 nt, Homo sapiens
cauauccaacaugugcucag

SEQ ID NO: 1796855 - RNA, 16 nt, Homo sapiens
cuccucguccauuuua

SEQ ID NO: 1796856 - RNA, 13 nt, Homo sapiens
cugagauugacaa

SEQ ID NO: 1796857 - RNA, 17 nt, Homo sapiens
gccccgucucucuugga

SEQ ID NO: 1796858 - RNA, 19 nt, Homo sapiens
gcagagguaaaagugugag

SEQ ID NO: 1796859 - RNA, 14 nt, Homo sapiens
gcauaugauuuauc

SEQ ID NO: 1796860 - RNA, 17 nt, Homo sapiens
ccaaucugugagaaguu

SEQ ID NO: 1796861 - RNA, 18 nt, Homo sapiens
cuuaccacuaaauccuug

SEQ ID NO: 1796862 - RNA, 22 nt, Homo sapiens
ggaagagcccgcagggccaugc

SEQ ID NO: 1796863 - RNA, 19 nt, Homo sapiens
uuagaccccauacaaguuu

SEQ ID NO: 1796864 - RNA, 14 nt, Homo sapiens
aauucagcacuuaa

SEQ ID NO: 1796865 - RNA, 16 nt, Homo sapiens
uguaggaggggcugca

SEQ ID NO: 1796866 - RNA, 15 nt, Homo sapiens
gagcuugaucuguga

SEQ ID NO: 1796867 - RNA, 23 nt, Homo sapiens
aaggagagcccaggccugcccuc

SEQ ID NO: 1796868 - RNA, 13 nt, Homo sapiens
ggugcacugggag

SEQ ID NO: 1796869 - RNA, 20 nt, Homo sapiens
guuauuuauaaucacuuuuu

SEQ ID NO: 1796870 - RNA, 22 nt, Homo sapiens
ggagagacacucccagggacaa

SEQ ID NO: 1796871 - RNA, 14 nt, Homo sapiens
uagcagcagugcau

SEQ ID NO: 1796872 - RNA, 13 nt, Homo sapiens
aguagacaagcaa

SEQ ID NO: 1796873 - RNA, 16 nt, Homo sapiens
ugagccaucaucaugg

SEQ ID NO: 1796874 - RNA, 15 nt, Homo sapiens
ggcuuggcagccagu

SEQ ID NO: 1796875 - RNA, 16 nt, Homo sapiens
agcagccuccagugcu

SEQ ID NO: 1796876 - RNA, 20 nt, Homo sapiens
agauccaggaacacaugcac

SEQ ID NO: 1796877 - RNA, 14 nt, Homo sapiens
agggucucuucagg

SEQ ID NO: 1796878 - RNA, 14 nt, Homo sapiens
auucugguauauag

SEQ ID NO: 1796879 - RNA, 22 nt, Homo sapiens
gcuuuccuuguuuugauuuaug

SEQ ID NO: 1796880 - RNA, 22 nt, Homo sapiens
acugucacauaaugcucauacu

SEQ ID NO: 1796881 - RNA, 15 nt, Homo sapiens
uuggacagacacugu

SEQ ID NO: 1796882 - RNA, 12 nt, Homo sapiens
gagagugcacau

SEQ ID NO: 1796883 - RNA, 14 nt, Homo sapiens
acacgcgaaaguau

SEQ ID NO: 1796884 - RNA, 16 nt, Homo sapiens
cauauagaaugcagag

SEQ ID NO: 1796885 - RNA, 23 nt, Homo sapiens
ggggcugggcugggcgcgguggu

SEQ ID NO: 1796886 - RNA, 22 nt, Homo sapiens
gagaggcagcuaucugcacucu

SEQ ID NO: 1796887 - RNA, 17 nt, Homo sapiens
ugucucccuucuugggu

SEQ ID NO: 1796888 - RNA, 19 nt, Homo sapiens
ccagggagacagagcucac

SEQ ID NO: 1796889 - RNA, 21 nt, Homo sapiens
augcaugaauuccacuccuuc

SEQ ID NO: 1796890 - RNA, 20 nt, Homo sapiens
cccaugguacuccaugcauu

SEQ ID NO: 1796891 - RNA, 19 nt, Homo sapiens
gaagggggucaaaggaaga

SEQ ID NO: 1796892 - RNA, 16 nt, Homo sapiens
auacacuuuguugcaa

SEQ ID NO: 1796893 - RNA, 21 nt, Homo sapiens
cauuccuaaucaaauucuguc

SEQ ID NO: 1796894 - RNA, 15 nt, Homo sapiens
ggacaccacacccag

SEQ ID NO: 1796895 - RNA, 21 nt, Homo sapiens
uaugugaaauguauagcugcu

SEQ ID NO: 1796896 - RNA, 15 nt, Homo sapiens
cuaaauuaugacugc

SEQ ID NO: 1796897 - RNA, 20 nt, Homo sapiens
agaggcaggugguaggccau

SEQ ID NO: 1796898 - RNA, 23 nt, Homo sapiens
gcuuauccuguuuucauggacag

SEQ ID NO: 1796899 - RNA, 15 nt, Homo sapiens
aaagcaauugugaaa

SEQ ID NO: 1796900 - RNA, 22 nt, Homo sapiens
aaagaagauuuugccacauuug

SEQ ID NO: 1796901 - RNA, 19 nt, Homo sapiens
augucagagcuauguuccc

SEQ ID NO: 1796902 - RNA, 15 nt, Homo sapiens
gucuguuuguuguau

SEQ ID NO: 1796903 - RNA, 14 nt, Homo sapiens
ucccaguguuccau

SEQ ID NO: 1796904 - RNA, 14 nt, Homo sapiens
aucucuugaccucg

SEQ ID NO: 1796905 - RNA, 18 nt, Homo sapiens
aggcuaauauauuccaac

SEQ ID NO: 1796906 - RNA, 18 nt, Homo sapiens
augaauaaauuccuucaa

SEQ ID NO: 1796907 - RNA, 15 nt, Homo sapiens
gcaggggcacggugg

SEQ ID NO: 1796908 - RNA, 23 nt, Homo sapiens
acgcuccuuugugugugugucag

SEQ ID NO: 1796909 - RNA, 14 nt, Homo sapiens
uauuaacuugagcu

SEQ ID NO: 1796910 - RNA, 15 nt, Homo sapiens
uuagcacauguguaa

SEQ ID NO: 1796911 - RNA, 15 nt, Homo sapiens
cuuccccuuccuaau

SEQ ID NO: 1796912 - RNA, 17 nt, Homo sapiens
cagagccagugugguca

SEQ ID NO: 1796913 - RNA, 14 nt, Homo sapiens
cuuugcuguucgca

SEQ ID NO: 1796914 - RNA, 14 nt, Homo sapiens
ucugccugcccuga

SEQ ID NO: 1796915 - RNA, 17 nt, Homo sapiens
cauucaagaaaucauua

SEQ ID NO: 1796916 - RNA, 11 nt, Homo sapiens
aggaccugcug

SEQ ID NO: 1796917 - RNA, 18 nt, Homo sapiens
uagaacugucugugaaca

SEQ ID NO: 1796918 - RNA, 12 nt, Homo sapiens
cagacucuuaaa

SEQ ID NO: 1796919 - RNA, 23 nt, Homo sapiens
aaugcucugucuucaaugaucaa

SEQ ID NO: 1796920 - RNA, 14 nt, Homo sapiens
uacuucugcuccau

SEQ ID NO: 1796921 - RNA, 19 nt, Homo sapiens
gacuuccucagagcgagaa

SEQ ID NO: 1796922 - RNA, 19 nt, Homo sapiens
uuaaaacuggaccuguaua

SEQ ID NO: 1796923 - RNA, 14 nt, Homo sapiens
aaauaaguguuuua

SEQ ID NO: 1796924 - RNA, 22 nt, Homo sapiens
ucacugggggacacuguggcag

SEQ ID NO: 1796925 - RNA, 23 nt, Homo sapiens
gugacaguauaaagggcaaagga

SEQ ID NO: 1796926 - RNA, 13 nt, Homo sapiens
aaaugugacucag

SEQ ID NO: 1796927 - RNA, 19 nt, Homo sapiens
uccuuggaacacauaagaa

SEQ ID NO: 1796928 - RNA, 14 nt, Homo sapiens
ggaacagugugcaa

SEQ ID NO: 1796929 - RNA, 15 nt, Homo sapiens
aaauaaauagcuaua

SEQ ID NO: 1796930 - RNA, 21 nt, Homo sapiens
ucagacaguggaugagacaca

SEQ ID NO: 1796931 - RNA, 21 nt, Homo sapiens
ccucauuccggccacaucauu

SEQ ID NO: 1796932 - RNA, 18 nt, Homo sapiens
ugcagaacagacacuuua

SEQ ID NO: 1796933 - RNA, 17 nt, Homo sapiens
cucugcagcucagggac

SEQ ID NO: 1796934 - RNA, 12 nt, Homo sapiens
cuucacugccag

SEQ ID NO: 1796935 - RNA, 11 nt, Homo sapiens
gacuugccacu

SEQ ID NO: 1796936 - RNA, 20 nt, Homo sapiens
aaagaucauaguugcaaaau

SEQ ID NO: 1796937 - RNA, 21 nt, Homo sapiens
aagugucugugugcaagugug

SEQ ID NO: 1796938 - RNA, 19 nt, Homo sapiens
ucccucgaacccacacugc

SEQ ID NO: 1796939 - RNA, 21 nt, Homo sapiens
uccugauggcuggcaggcagu

SEQ ID NO: 1796940 - RNA, 18 nt, Homo sapiens
gcccagggagaagggaca

SEQ ID NO: 1796941 - RNA, 16 nt, Homo sapiens
gucuauuaauauucag

SEQ ID NO: 1796942 - RNA, 15 nt, Homo sapiens
aucugcucuguacau

SEQ ID NO: 1796943 - RNA, 15 nt, Homo sapiens
aacaguuccauucaa

SEQ ID NO: 1796944 - RNA, 18 nt, Homo sapiens
ccugggcaacauagugau

SEQ ID NO: 1796945 - RNA, 16 nt, Homo sapiens
ccucauggagaccuca

SEQ ID NO: 1796946 - RNA, 23 nt, Homo sapiens
caauuccuucuucaacgccaucu

SEQ ID NO: 1796947 - RNA, 19 nt, Homo sapiens
ccaaggaaacccccagugu

SEQ ID NO: 1796948 - RNA, 20 nt, Homo sapiens
ucucgaagugcugagauuac

SEQ ID NO: 1796949 - RNA, 13 nt, Homo sapiens
caggggcucccac

SEQ ID NO: 1796950 - RNA, 22 nt, Homo sapiens
gaagggacggcugugggaccag

SEQ ID NO: 1796951 - RNA, 15 nt, Homo sapiens
agcaaauguggcucc

SEQ ID NO: 1796952 - RNA, 21 nt, Homo sapiens
uacuuacauaucugacuucua

SEQ ID NO: 1796953 - RNA, 17 nt, Homo sapiens
auguauaucuuugcacu

SEQ ID NO: 1796954 - RNA, 21 nt, Homo sapiens
aguucagagccaagccuuaaa

SEQ ID NO: 1796955 - RNA, 22 nt, Homo sapiens
cagaauuugauucguaugauca

SEQ ID NO: 1796956 - RNA, 12 nt, Homo sapiens
gaaggugccucu

SEQ ID NO: 1796957 - RNA, 21 nt, Homo sapiens
caacugaagccuucuucugcc

SEQ ID NO: 1796958 - RNA, 16 nt, Homo sapiens
uacuacaucagugugg

SEQ ID NO: 1796959 - RNA, 20 nt, Homo sapiens
uaacuguuaacuaugacaga

SEQ ID NO: 1796960 - RNA, 17 nt, Homo sapiens
ugggccaaaaucaugcc

SEQ ID NO: 1796961 - RNA, 17 nt, Homo sapiens
aaaucagugguguuaca

SEQ ID NO: 1796962 - RNA, 22 nt, Homo sapiens
caaagacuuaagcccagugcac

SEQ ID NO: 1796963 - RNA, 19 nt, Homo sapiens
uuaccauucagcaugagau

SEQ ID NO: 1796964 - RNA, 19 nt, Homo sapiens
ucaguaaggcagugcagua

SEQ ID NO: 1796965 - RNA, 23 nt, Homo sapiens
cacccaccaggccagcucaggaa

SEQ ID NO: 1796966 - RNA, 16 nt, Homo sapiens
gccacgcgguacaaag

SEQ ID NO: 1796967 - RNA, 11 nt, Homo sapiens
augaacaucuc

SEQ ID NO: 1796968 - RNA, 19 nt, Homo sapiens
cagcucacacccuaauaag

SEQ ID NO: 1796969 - RNA, 13 nt, Homo sapiens
gacugauagacac

SEQ ID NO: 1796970 - RNA, 17 nt, Homo sapiens
ucauggcagcuaagcca

SEQ ID NO: 1796971 - RNA, 19 nt, Homo sapiens
agagugauugcagcuuuau

SEQ ID NO: 1796972 - RNA, 16 nt, Homo sapiens
gacucaaauguucuaa

SEQ ID NO: 1796973 - RNA, 17 nt, Homo sapiens
agacuauuuuauaugau

SEQ ID NO: 1796974 - RNA, 19 nt, Homo sapiens
cagccuggcugguccccaa

SEQ ID NO: 1796975 - RNA, 18 nt, Homo sapiens
gaaauuaaagucuuccau

SEQ ID NO: 1796976 - RNA, 12 nt, Homo sapiens
cuaacugugcaa

SEQ ID NO: 1796977 - RNA, 15 nt, Homo sapiens
agcagacaccauuca

SEQ ID NO: 1796978 - RNA, 15 nt, Homo sapiens
ucuuucuuugcugcu

SEQ ID NO: 1796979 - RNA, 22 nt, Homo sapiens
cucaauaauauaauaauaguua

SEQ ID NO: 1796980 - RNA, 15 nt, Homo sapiens
ugccccacuuguccu

SEQ ID NO: 1796981 - RNA, 19 nt, Homo sapiens
ggcucuaauucacagugcu

SEQ ID NO: 1796982 - RNA, 15 nt, Homo sapiens
cuggcugaccugcug

SEQ ID NO: 1796983 - RNA, 22 nt, Homo sapiens
agauggcugcugcucacccucc

SEQ ID NO: 1796984 - RNA, 16 nt, Homo sapiens
ucaucgggaaaggcaa

SEQ ID NO: 1796985 - RNA, 17 nt, Homo sapiens
aacagugucuugagcuc

SEQ ID NO: 1796986 - RNA, 17 nt, Homo sapiens
cacuucucuacucugga

SEQ ID NO: 1796987 - RNA, 23 nt, Homo sapiens
aaaaggcugaaaggaauauaguc

SEQ ID NO: 1796988 - RNA, 12 nt, Homo sapiens
ugugaacccugg

SEQ ID NO: 1796989 - RNA, 15 nt, Homo sapiens
gggugaacaaucccc

SEQ ID NO: 1796990 - RNA, 13 nt, Homo sapiens
agugcuugugauu

SEQ ID NO: 1796991 - RNA, 13 nt, Homo sapiens
ucuuagaauuugu

SEQ ID NO: 1796992 - RNA, 13 nt, Homo sapiens
gcagugaaguaua

SEQ ID NO: 1796993 - RNA, 12 nt, Homo sapiens
aaaauguucaca

SEQ ID NO: 1796994 - RNA, 21 nt, Homo sapiens
auguaguuuugugaugcauuu

SEQ ID NO: 1796995 - RNA, 16 nt, Homo sapiens
cacuuaauaauugcau

SEQ ID NO: 1796996 - RNA, 16 nt, Homo sapiens
auuucaaaacuucaga

SEQ ID NO: 1796997 - RNA, 14 nt, Homo sapiens
caggaugauuuugg

SEQ ID NO: 1796998 - RNA, 16 nt, Homo sapiens
acaccucagcugccuc

SEQ ID NO: 1796999 - RNA, 20 nt, Homo sapiens
gcuucugagagcaaagggaa

SEQ ID NO: 1797000 - RNA, 16 nt, Homo sapiens
ccaguucagauucaua

SEQ ID NO: 1797001 - RNA, 20 nt, Homo sapiens
uuguauaggggcaacuguau

SEQ ID NO: 1797002 - RNA, 21 nt, Homo sapiens
agccuuggggcugaugcaguu

SEQ ID NO: 1797003 - RNA, 15 nt, Homo sapiens
agcauccacgucaau

SEQ ID NO: 1797004 - RNA, 20 nt, Homo sapiens
uaaaauauccuguaacuaca

SEQ ID NO: 1797005 - RNA, 15 nt, Homo sapiens
aaagaggacaucaga

SEQ ID NO: 1797006 - RNA, 19 nt, Homo sapiens
ucuaguuucacguaaauau

SEQ ID NO: 1797007 - RNA, 21 nt, Homo sapiens
cucaaucugcaaacaugccag

SEQ ID NO: 1797008 - RNA, 18 nt, Homo sapiens
cuuggagucaaaaggcaa

SEQ ID NO: 1797009 - RNA, 17 nt, Homo sapiens
guaaucuacaaaggaaa

SEQ ID NO: 1797010 - RNA, 21 nt, Homo sapiens
caucaaguguaauuagcuuuu

SEQ ID NO: 1797011 - RNA, 15 nt, Homo sapiens
aacauuguguugaca

SEQ ID NO: 1797012 - RNA, 19 nt, Homo sapiens
ccuuucaccccucuuccca

SEQ ID NO: 1797013 - RNA, 15 nt, Homo sapiens
caaugguugaugaua

SEQ ID NO: 1797014 - RNA, 13 nt, Homo sapiens
uccaggcacagcu

SEQ ID NO: 1797015 - RNA, 13 nt, Homo sapiens
gucagaguagaag

SEQ ID NO: 1797016 - RNA, 17 nt, Homo sapiens
uugucaacacaaagaca

SEQ ID NO: 1797017 - RNA, 19 nt, Homo sapiens
gaaaauaugauauauaugu

SEQ ID NO: 1797018 - RNA, 16 nt, Homo sapiens
ucacuaaguaugaucu

SEQ ID NO: 1797019 - RNA, 18 nt, Homo sapiens
uccccucuccuccacauu

SEQ ID NO: 1797020 - RNA, 13 nt, Homo sapiens
agaaacugcucua

SEQ ID NO: 1797021 - RNA, 18 nt, Homo sapiens
ccuucugguuuuaggaaa

SEQ ID NO: 1797022 - RNA, 17 nt, Homo sapiens
uuuaguaguuacuaaaa

SEQ ID NO: 1797023 - RNA, 13 nt, Homo sapiens
uauugcagcuuaa

SEQ ID NO: 1797024 - RNA, 21 nt, Homo sapiens
ucucggagcauauauguagcu

SEQ ID NO: 1797025 - RNA, 17 nt, Homo sapiens
ccaguuucagcucacuu

SEQ ID NO: 1797026 - RNA, 17 nt, Homo sapiens
ugugccccuguaaauag

SEQ ID NO: 1797027 - RNA, 19 nt, Homo sapiens
gaacuucuaaacacuucau

SEQ ID NO: 1797028 - RNA, 15 nt, Homo sapiens
uaaagauuucugcuc

SEQ ID NO: 1797029 - RNA, 20 nt, Homo sapiens
gcccaccugugaucccagcu

SEQ ID NO: 1797030 - RNA, 22 nt, Homo sapiens
cuuuaaacacucuucagagaaa

SEQ ID NO: 1797031 - RNA, 21 nt, Homo sapiens
gcccuucccacaggacauuuc

SEQ ID NO: 1797032 - RNA, 17 nt, Homo sapiens
ucaaaucuucuaauucc

SEQ ID NO: 1797033 - RNA, 12 nt, Homo sapiens
gaaggcaaauga

SEQ ID NO: 1797034 - RNA, 23 nt, Homo sapiens
aguuaguguuuugccucaccuaa

SEQ ID NO: 1797035 - RNA, 21 nt, Homo sapiens
gaccuugggggaagacuuuaa

SEQ ID NO: 1797036 - RNA, 20 nt, Homo sapiens
ugugcuaucgcaaaucacaa

SEQ ID NO: 1797037 - RNA, 15 nt, Homo sapiens
agaugucuucuugca

SEQ ID NO: 1797038 - RNA, 22 nt, Homo sapiens
auggcacuaguauuucuaugaa

SEQ ID NO: 1797039 - RNA, 16 nt, Homo sapiens
ucaggaccacccugcc

SEQ ID NO: 1797040 - RNA, 12 nt, Homo sapiens
ugagaaagacaa

SEQ ID NO: 1797041 - RNA, 22 nt, Homo sapiens
aacacuacugcuaaauccucau

SEQ ID NO: 1797042 - RNA, 21 nt, Homo sapiens
ucacccacuucuacaugcuca

SEQ ID NO: 1797043 - RNA, 18 nt, Homo sapiens
ugacugagcagcauccac

SEQ ID NO: 1797044 - RNA, 16 nt, Homo sapiens
aauagugucauccuca

SEQ ID NO: 1797045 - RNA, 23 nt, Homo sapiens
gaugauuuguauguuaaagugac

SEQ ID NO: 1797046 - RNA, 20 nt, Homo sapiens
uuugaauuuuuuagugacua

SEQ ID NO: 1797047 - RNA, 19 nt, Homo sapiens
gcagcccuacaacaaccug

SEQ ID NO: 1797048 - RNA, 14 nt, Homo sapiens
aaagcaaguguuca

SEQ ID NO: 1797049 - RNA, 17 nt, Homo sapiens
aucccgaaaaucucucg

SEQ ID NO: 1797050 - RNA, 24 nt, Homo sapiens
cucugggugucucccacaugucua

SEQ ID NO: 1797051 - RNA, 13 nt, Homo sapiens
gcaggccaaugua

SEQ ID NO: 1797052 - RNA, 20 nt, Homo sapiens
augaaauguuucacuaugau

SEQ ID NO: 1797053 - RNA, 12 nt, Homo sapiens
aaaaucaaacag

SEQ ID NO: 1797054 - RNA, 13 nt, Homo sapiens
acauacugucuaa

SEQ ID NO: 1797055 - RNA, 15 nt, Homo sapiens
cccgucgacguagaa

SEQ ID NO: 1797056 - RNA, 21 nt, Homo sapiens
gcuuuuuuuuguagccagucc

SEQ ID NO: 1797057 - RNA, 22 nt, Homo sapiens
ugaugggccagcaggagccagc

SEQ ID NO: 1797058 - RNA, 21 nt, Homo sapiens
aagaacuucuccuacuguagc

SEQ ID NO: 1797059 - RNA, 17 nt, Homo sapiens
auuugugauacuuccuc

SEQ ID NO: 1797060 - RNA, 15 nt, Homo sapiens
cuuccuugccaguga

SEQ ID NO: 1797061 - RNA, 14 nt, Homo sapiens
uaaaauacugaaua

SEQ ID NO: 1797062 - RNA, 19 nt, Homo sapiens
cuccgugugucucaugcca

SEQ ID NO: 1797063 - RNA, 16 nt, Homo sapiens
aagcaguagacaaucc

SEQ ID NO: 1797064 - RNA, 12 nt, Homo sapiens
cguugcuuucac

SEQ ID NO: 1797065 - RNA, 20 nt, Homo sapiens
gaauucauuaugcugugguc

SEQ ID NO: 1797066 - RNA, 22 nt, Homo sapiens
auaaagcaccagcaguguuuaa

SEQ ID NO: 1797067 - RNA, 18 nt, Homo sapiens
caagcucucuugccgagg

SEQ ID NO: 1797068 - RNA, 16 nt, Homo sapiens
acuuacauguguguau

SEQ ID NO: 1797069 - RNA, 19 nt, Homo sapiens
aguguuugaaaaagcuggu

SEQ ID NO: 1797070 - RNA, 13 nt, Homo sapiens
uaaacacaguaag

SEQ ID NO: 1797071 - RNA, 13 nt, Homo sapiens
uuuucacagauug

SEQ ID NO: 1797072 - RNA, 20 nt, Homo sapiens
gaguuuuuccucccagugag

SEQ ID NO: 1797073 - RNA, 14 nt, Homo sapiens
cuacauuccaaaga

SEQ ID NO: 1797074 - RNA, 15 nt, Homo sapiens
aacaucucuuucuca

SEQ ID NO: 1797075 - RNA, 14 nt, Homo sapiens
uaccuauuccuuca

SEQ ID NO: 1797076 - RNA, 17 nt, Homo sapiens
uaaaucccacaucccag

SEQ ID NO: 1797077 - RNA, 14 nt, Homo sapiens
auacaacacagacg

SEQ ID NO: 1797078 - RNA, 21 nt, Homo sapiens
cuugccaggggcaguuuuagc

SEQ ID NO: 1797079 - RNA, 12 nt, Homo sapiens
auaaagcacaaa

SEQ ID NO: 1797080 - RNA, 12 nt, Homo sapiens
acauuugccuua

SEQ ID NO: 1797081 - RNA, 16 nt, Homo sapiens
aggcaaauaagcacuc

SEQ ID NO: 1797082 - RNA, 13 nt, Homo sapiens
aacugcuaaugca

SEQ ID NO: 1797083 - RNA, 14 nt, Homo sapiens
cucauuuuaggccu

SEQ ID NO: 1797084 - RNA, 19 nt, Homo sapiens
aaguguuuuguaacuucau

SEQ ID NO: 1797085 - RNA, 14 nt, Homo sapiens
uaaaugugagcaaa

SEQ ID NO: 1797086 - RNA, 17 nt, Homo sapiens
cuucggcagcuacucag

SEQ ID NO: 1797087 - RNA, 20 nt, Homo sapiens
uuacgguccaugccuuuaau

SEQ ID NO: 1797088 - RNA, 21 nt, Homo sapiens
uuugaugggcaugaaugagac

SEQ ID NO: 1797089 - RNA, 14 nt, Homo sapiens
ccgggcucagggac

SEQ ID NO: 1797090 - RNA, 15 nt, Homo sapiens
uaggacucuuugguc

SEQ ID NO: 1797091 - RNA, 15 nt, Homo sapiens
agaaauaauaauauc

SEQ ID NO: 1797092 - RNA, 22 nt, Homo sapiens
ugaccucuauaauugccacuga

SEQ ID NO: 1797093 - RNA, 16 nt, Homo sapiens
aacuucuuauacgucu

SEQ ID NO: 1797094 - RNA, 14 nt, Homo sapiens
cccugcaaagccca

SEQ ID NO: 1797095 - RNA, 22 nt, Homo sapiens
aaaguccugugguuaacgccuu

SEQ ID NO: 1797096 - RNA, 14 nt, Homo sapiens
cucuccuucuuagc

SEQ ID NO: 1797097 - RNA, 14 nt, Homo sapiens
ccugugaaugccac

SEQ ID NO: 1797098 - RNA, 16 nt, Homo sapiens
aacacagagcugcuau

SEQ ID NO: 1797099 - RNA, 21 nt, Homo sapiens
ugcaagaccuagugcucuuaa

SEQ ID NO: 1797100 - RNA, 23 nt, Homo sapiens
uugauuuaagcuuuccuguugaa

SEQ ID NO: 1797101 - RNA, 18 nt, Homo sapiens
agcaggaccugccaagaa

SEQ ID NO: 1797102 - RNA, 15 nt, Homo sapiens
augcagaacuucccu

SEQ ID NO: 1797103 - RNA, 16 nt, Homo sapiens
gaggugucuuaagccu

SEQ ID NO: 1797104 - RNA, 23 nt, Homo sapiens
uaaaggugguccuuccuaccucu

SEQ ID NO: 1797105 - RNA, 16 nt, Homo sapiens
cugucaugccaaaagu

SEQ ID NO: 1797106 - RNA, 16 nt, Homo sapiens
aaggagaacuauccaa

SEQ ID NO: 1797107 - RNA, 20 nt, Homo sapiens
aauacuuuugcugaugcuuu

SEQ ID NO: 1797108 - RNA, 17 nt, Homo sapiens
ccccucgugucagcuca

SEQ ID NO: 1797109 - RNA, 21 nt, Homo sapiens
cauggcccccaggggcaggac

SEQ ID NO: 1797110 - RNA, 19 nt, Homo sapiens
cucuguuucccuuucacug

SEQ ID NO: 1797111 - RNA, 15 nt, Homo sapiens
ugaugccuuggucag

SEQ ID NO: 1797112 - RNA, 21 nt, Homo sapiens
agagccaccuggcagggcuca

SEQ ID NO: 1797113 - RNA, 16 nt, Homo sapiens
cugacuguacuccucc

SEQ ID NO: 1797114 - RNA, 21 nt, Homo sapiens
uguauuaaaaauaaacaagca

SEQ ID NO: 1797115 - RNA, 23 nt, Homo sapiens
ucauaaucugaugauaugugguc

SEQ ID NO: 1797116 - RNA, 17 nt, Homo sapiens
gaagcguuguccucagc

SEQ ID NO: 1797117 - RNA, 18 nt, Homo sapiens
auuaugccauagcaagau

SEQ ID NO: 1797118 - RNA, 18 nt, Homo sapiens
cauagucuuuguuuacau

SEQ ID NO: 1797119 - RNA, 15 nt, Homo sapiens
aauagaaacauugaa

SEQ ID NO: 1797120 - RNA, 15 nt, Homo sapiens
aauauguacauuugu

SEQ ID NO: 1797121 - RNA, 15 nt, Homo sapiens
cuuacccaauuuccc

SEQ ID NO: 1797122 - RNA, 15 nt, Homo sapiens
augagccacugugcc

SEQ ID NO: 1797123 - RNA, 15 nt, Homo sapiens
caggaaucucagaga

SEQ ID NO: 1797124 - RNA, 22 nt, Homo sapiens
agauacccaucuugaaaaacac

SEQ ID NO: 1797125 - RNA, 17 nt, Homo sapiens
ucacacugaagccacag

SEQ ID NO: 1797126 - RNA, 19 nt, Homo sapiens
uacaaggggugugacuuga

SEQ ID NO: 1797127 - RNA, 17 nt, Homo sapiens
ucaccugcccugugcau

SEQ ID NO: 1797128 - RNA, 22 nt, Homo sapiens
cacacaacuaggaaguggcuga

SEQ ID NO: 1797129 - RNA, 17 nt, Homo sapiens
cagaaaucaaacugcuu

SEQ ID NO: 1797130 - RNA, 17 nt, Homo sapiens
aaugaggucuguuuaaa

SEQ ID NO: 1797131 - RNA, 14 nt, Homo sapiens
cuuagauauuucau

SEQ ID NO: 1797132 - RNA, 14 nt, Homo sapiens
cacaagccagaccc

SEQ ID NO: 1797133 - RNA, 12 nt, Homo sapiens
gagaacaucugc

SEQ ID NO: 1797134 - RNA, 17 nt, Homo sapiens
uccacgcuucuccggau

SEQ ID NO: 1797135 - RNA, 20 nt, Homo sapiens
acuggguuccccacagugac

SEQ ID NO: 1797136 - RNA, 20 nt, Homo sapiens
auauaaauuuuuugugauca

SEQ ID NO: 1797137 - RNA, 19 nt, Homo sapiens
aauuuugcgauacacugca

SEQ ID NO: 1797138 - RNA, 10 nt, Homo sapiens
uaucucucaa

SEQ ID NO: 1797139 - RNA, 19 nt, Homo sapiens
caugucauuucagaaguua

SEQ ID NO: 1797140 - RNA, 14 nt, Homo sapiens
ccagccaggaagau

SEQ ID NO: 1797141 - RNA, 19 nt, Homo sapiens
ccacuucuggcaugggaca

SEQ ID NO: 1797142 - RNA, 19 nt, Homo sapiens
ugugucccaggcagggaga

SEQ ID NO: 1797143 - RNA, 19 nt, Homo sapiens
caagaaaaguugaagaaga

SEQ ID NO: 1797144 - RNA, 17 nt, Homo sapiens
cuucuugagcugaccca

SEQ ID NO: 1797145 - RNA, 21 nt, Homo sapiens
gaacauuagccguaguggaau

SEQ ID NO: 1797146 - RNA, 19 nt, Homo sapiens
aaaacuacaguuguaauaa

SEQ ID NO: 1797147 - RNA, 15 nt, Homo sapiens
gugaaguaaaagagg

SEQ ID NO: 1797148 - RNA, 19 nt, Homo sapiens
auguuaaguccucccugac

SEQ ID NO: 1797149 - RNA, 18 nt, Homo sapiens
uuacaauugcaguuuugc

SEQ ID NO: 1797150 - RNA, 18 nt, Homo sapiens
cauguuguaacauuucac

SEQ ID NO: 1797151 - RNA, 20 nt, Homo sapiens
acugcaaccuccacauccca

SEQ ID NO: 1797152 - RNA, 22 nt, Homo sapiens
gcaucccugaaacaucucaaca

SEQ ID NO: 1797153 - RNA, 16 nt, Homo sapiens
cuauaaaauauaguuu

SEQ ID NO: 1797154 - RNA, 15 nt, Homo sapiens
agacagugacuggug

SEQ ID NO: 1797155 - RNA, 13 nt, Homo sapiens
agcucagcuucgu

SEQ ID NO: 1797156 - RNA, 15 nt, Homo sapiens
auaguagacacacua

SEQ ID NO: 1797157 - RNA, 14 nt, Homo sapiens
uuuaaagccuccuc

SEQ ID NO: 1797158 - RNA, 21 nt, Homo sapiens
ggugaacaaaguuuaccagaa

SEQ ID NO: 1797159 - RNA, 19 nt, Homo sapiens
aauugaaccgucaauguga

SEQ ID NO: 1797160 - RNA, 14 nt, Homo sapiens
agucccugccugaa

SEQ ID NO: 1797161 - RNA, 23 nt, Homo sapiens
gcucacaccuguccuucucaggc

SEQ ID NO: 1797162 - RNA, 21 nt, Homo sapiens
aucuaucacccaggaaucuca

SEQ ID NO: 1797163 - RNA, 19 nt, Homo sapiens
auuuaaaaaaaaagucaga

SEQ ID NO: 1797164 - RNA, 16 nt, Homo sapiens
uccugaaguuguacuu

SEQ ID NO: 1797165 - RNA, 13 nt, Homo sapiens
ugagauggggaca

SEQ ID NO: 1797166 - RNA, 14 nt, Homo sapiens
auaaacagacuguu

SEQ ID NO: 1797167 - RNA, 23 nt, Homo sapiens
aaagacuuacaggccucgcuaca

SEQ ID NO: 1797168 - RNA, 16 nt, Homo sapiens
caaaucguauaccuua

SEQ ID NO: 1797169 - RNA, 19 nt, Homo sapiens
agcuuguuguuuuuugcua

SEQ ID NO: 1797170 - RNA, 18 nt, Homo sapiens
gagccgucagagcaguga

SEQ ID NO: 1797171 - RNA, 19 nt, Homo sapiens
caggccaaacauggccaga

SEQ ID NO: 1797172 - RNA, 16 nt, Homo sapiens
ucuuuauucacaguau

SEQ ID NO: 1797173 - RNA, 18 nt, Homo sapiens
acaccauugcaugaauuc

SEQ ID NO: 1797174 - RNA, 16 nt, Homo sapiens
ugugcacgagugggaa

SEQ ID NO: 1797175 - RNA, 14 nt, Homo sapiens
uucuuuaucaccug

SEQ ID NO: 1797176 - RNA, 22 nt, Homo sapiens
gaaaguacccucuuuuaccaac

SEQ ID NO: 1797177 - RNA, 19 nt, Homo sapiens
cucccugcugugugacuuu

SEQ ID NO: 1797178 - RNA, 23 nt, Homo sapiens
acacugaagaagucacugaacaa

SEQ ID NO: 1797179 - RNA, 20 nt, Homo sapiens
ucaggccagccugucccuga

SEQ ID NO: 1797180 - RNA, 21 nt, Homo sapiens
gggccaaauucccaaccugcu

SEQ ID NO: 1797181 - RNA, 20 nt, Homo sapiens
auguuuuuaaacagugucau

SEQ ID NO: 1797182 - RNA, 13 nt, Homo sapiens
ucaugcacugagg

SEQ ID NO: 1797183 - RNA, 15 nt, Homo sapiens
aaaaucacaucucca

SEQ ID NO: 1797184 - RNA, 21 nt, Homo sapiens
cugguugcuucagaccugaca

SEQ ID NO: 1797185 - RNA, 16 nt, Homo sapiens
gaaaaacuuaaauauu

SEQ ID NO: 1797186 - RNA, 20 nt, Homo sapiens
uuuaggaaagcagugcagua

SEQ ID NO: 1797187 - RNA, 14 nt, Homo sapiens
gggauuugcuccug

SEQ ID NO: 1797188 - RNA, 20 nt, Homo sapiens
cagguucccugccacacuau

SEQ ID NO: 1797189 - RNA, 18 nt, Homo sapiens
aauauuuucucuguacuu

SEQ ID NO: 1797190 - RNA, 18 nt, Homo sapiens
cucaugacuuuugguuaa

SEQ ID NO: 1797191 - RNA, 21 nt, Homo sapiens
ggaggcccaaaugauggauca

SEQ ID NO: 1797192 - RNA, 21 nt, Homo sapiens
cuugggaaggacacagcagua

SEQ ID NO: 1797193 - RNA, 12 nt, Homo sapiens
auguaccauaau

SEQ ID NO: 1797194 - RNA, 21 nt, Homo sapiens
auuuagccaccaucuuugcag

SEQ ID NO: 1797195 - RNA, 22 nt, Homo sapiens
aaggcucccggaauuccgucac

SEQ ID NO: 1797196 - RNA, 17 nt, Homo sapiens
ugggcuacacagcagcu

SEQ ID NO: 1797197 - RNA, 18 nt, Homo sapiens
aauguacccagccuacca

SEQ ID NO: 1797198 - RNA, 18 nt, Homo sapiens
uaggaaccuaugaaacua

SEQ ID NO: 1797199 - RNA, 21 nt, Homo sapiens
uaauauaggguuuguuugcug

SEQ ID NO: 1797200 - RNA, 15 nt, Homo sapiens
uuugaagcucagaaa

SEQ ID NO: 1797201 - RNA, 15 nt, Homo sapiens
acaucugcauuucua

SEQ ID NO: 1797202 - RNA, 11 nt, Homo sapiens
auagcacuuuc

SEQ ID NO: 1797203 - RNA, 15 nt, Homo sapiens
ggaagguuaucagug

SEQ ID NO: 1797204 - RNA, 20 nt, Homo sapiens
uauggucauccaaauggacu

SEQ ID NO: 1797205 - RNA, 15 nt, Homo sapiens
ugaacugcacaaugc

SEQ ID NO: 1797206 - RNA, 18 nt, Homo sapiens
uccuuugauagaaaggaa

SEQ ID NO: 1797207 - RNA, 16 nt, Homo sapiens
aaaccaauugcugcua

SEQ ID NO: 1797208 - RNA, 22 nt, Homo sapiens
uccccucccuggcucccaugac

SEQ ID NO: 1797209 - RNA, 22 nt, Homo sapiens
acccaacccaugccccugacag

SEQ ID NO: 1797210 - RNA, 17 nt, Homo sapiens
gaaauguaugugcucuu

SEQ ID NO: 1797211 - RNA, 20 nt, Homo sapiens
agaaaugguuuccucuggau

SEQ ID NO: 1797212 - RNA, 11 nt, Homo sapiens
ucuauccuuua

SEQ ID NO: 1797213 - RNA, 15 nt, Homo sapiens
gacucaauguggaaa

SEQ ID NO: 1797214 - RNA, 17 nt, Homo sapiens
agccaagaucacgccau

SEQ ID NO: 1797215 - RNA, 14 nt, Homo sapiens
cacagggucugcac

SEQ ID NO: 1797216 - RNA, 14 nt, Homo sapiens
ggugaucugggauu

SEQ ID NO: 1797217 - RNA, 22 nt, Homo sapiens
agacuugaugaauaaacacuuu

SEQ ID NO: 1797218 - RNA, 20 nt, Homo sapiens
auuagugcugauagcugugu

SEQ ID NO: 1797219 - RNA, 15 nt, Homo sapiens
gguguccugaagcug

SEQ ID NO: 1797220 - RNA, 16 nt, Homo sapiens
auggugaauuaaucac

SEQ ID NO: 1797221 - RNA, 20 nt, Homo sapiens
aaagcucucuauaccaaaga

SEQ ID NO: 1797222 - RNA, 18 nt, Homo sapiens
aagaguuucuccuuuuga

SEQ ID NO: 1797223 - RNA, 16 nt, Homo sapiens
ccucguagccaucucu

SEQ ID NO: 1797224 - RNA, 15 nt, Homo sapiens
uaauggggaggacaa

SEQ ID NO: 1797225 - RNA, 18 nt, Homo sapiens
guacaaguuuuguauaaa

SEQ ID NO: 1797226 - RNA, 18 nt, Homo sapiens
cuccaauguacaacuucc

SEQ ID NO: 1797227 - RNA, 20 nt, Homo sapiens
cagaggaauuuauaccucaa

SEQ ID NO: 1797228 - RNA, 22 nt, Homo sapiens
cagccuggcugguccccaaggc

SEQ ID NO: 1797229 - RNA, 20 nt, Homo sapiens
aucagaacuggaccaucucc

SEQ ID NO: 1797230 - RNA, 17 nt, Homo sapiens
agaccaggcccuggcua

SEQ ID NO: 1797231 - RNA, 19 nt, Homo sapiens
gcagcacuggaaccaccug

SEQ ID NO: 1797232 - RNA, 20 nt, Homo sapiens
uaauugugaaaauuacaguu

SEQ ID NO: 1797233 - RNA, 18 nt, Homo sapiens
uaaaaugacaaacaugau

SEQ ID NO: 1797234 - RNA, 18 nt, Homo sapiens
caggggaguaugcaaaag

SEQ ID NO: 1797235 - RNA, 18 nt, Homo sapiens
aaaaaccaauagcuuuaa

SEQ ID NO: 1797236 - RNA, 17 nt, Homo sapiens
ucuacacucacaaucau

SEQ ID NO: 1797237 - RNA, 22 nt, Homo sapiens
gccucugccccucccaacccag

SEQ ID NO: 1797238 - RNA, 16 nt, Homo sapiens
cuuacucugagcucau

SEQ ID NO: 1797239 - RNA, 18 nt, Homo sapiens
agugcgugugaaacagcg

SEQ ID NO: 1797240 - RNA, 20 nt, Homo sapiens
ccaggguauucuuuuuccau

SEQ ID NO: 1797241 - RNA, 14 nt, Homo sapiens
gcaagucugugagu

SEQ ID NO: 1797242 - RNA, 14 nt, Homo sapiens
aaggcagauggggc

SEQ ID NO: 1797243 - RNA, 16 nt, Homo sapiens
ucugaggauucagggg

SEQ ID NO: 1797244 - RNA, 23 nt, Homo sapiens
uguaaaaugucuguuaacuuaau

SEQ ID NO: 1797245 - RNA, 19 nt, Homo sapiens
gauggaaguaaagccucaa

SEQ ID NO: 1797246 - RNA, 22 nt, Homo sapiens
gccuguaacacauaguggcuuc

SEQ ID NO: 1797247 - RNA, 14 nt, Homo sapiens
uaauauauuguaca

SEQ ID NO: 1797248 - RNA, 15 nt, Homo sapiens
ggucccaggaccuga

SEQ ID NO: 1797249 - RNA, 20 nt, Homo sapiens
gcaguaaauauuuacuauuu

SEQ ID NO: 1797250 - RNA, 15 nt, Homo sapiens
ggaagguucauugcc

SEQ ID NO: 1797251 - RNA, 20 nt, Homo sapiens
aauuguauaagucaagcaca

SEQ ID NO: 1797252 - RNA, 15 nt, Homo sapiens
ccaggaguaccugga

SEQ ID NO: 1797253 - RNA, 16 nt, Homo sapiens
aacuaccucaaaacac

SEQ ID NO: 1797254 - RNA, 14 nt, Homo sapiens
gugaggcauugcac

SEQ ID NO: 1797255 - RNA, 19 nt, Homo sapiens
ugcuugaacccagaaggca

SEQ ID NO: 1797256 - RNA, 19 nt, Homo sapiens
agcuacguguacauauuug

SEQ ID NO: 1797257 - RNA, 19 nt, Homo sapiens
ucaaggaaaggccugaaag

SEQ ID NO: 1797258 - RNA, 14 nt, Homo sapiens
gggagcgaaaguug

SEQ ID NO: 1797259 - RNA, 16 nt, Homo sapiens
uucacaggcacuccug

SEQ ID NO: 1797260 - RNA, 18 nt, Homo sapiens
agugcacuaaacaaauaa

SEQ ID NO: 1797261 - RNA, 15 nt, Homo sapiens
aggagcuuggcagag

SEQ ID NO: 1797262 - RNA, 22 nt, Homo sapiens
gagucccucacguuucuucccc

SEQ ID NO: 1797263 - RNA, 22 nt, Homo sapiens
ugucaacacaaacuggcuuaau

SEQ ID NO: 1797264 - RNA, 19 nt, Homo sapiens
cacuaaauugacacuuaaa

SEQ ID NO: 1797265 - RNA, 14 nt, Homo sapiens
aaaauggcaccuaa

SEQ ID NO: 1797266 - RNA, 14 nt, Homo sapiens
ugugccacacagug

SEQ ID NO: 1797267 - RNA, 23 nt, Homo sapiens
aauggccuggugagacuguccau

SEQ ID NO: 1797268 - RNA, 20 nt, Homo sapiens
aaacuguuccaaucaugaaa

SEQ ID NO: 1797269 - RNA, 14 nt, Homo sapiens
agaaaaugaugcug

SEQ ID NO: 1797270 - RNA, 14 nt, Homo sapiens
uuaaaggugugcua

SEQ ID NO: 1797271 - RNA, 22 nt, Homo sapiens
uugucaagaagcguuaugugca

SEQ ID NO: 1797272 - RNA, 11 nt, Homo sapiens
agccuggccac

SEQ ID NO: 1797273 - RNA, 21 nt, Homo sapiens
cuucgggaagaaggggacaau

SEQ ID NO: 1797274 - RNA, 23 nt, Homo sapiens
auauacauuagacacacauauac

SEQ ID NO: 1797275 - RNA, 20 nt, Homo sapiens
agaugugcaggcuccuccuc

SEQ ID NO: 1797276 - RNA, 18 nt, Homo sapiens
gcauuucugguguguauc

SEQ ID NO: 1797277 - RNA, 17 nt, Homo sapiens
gaaauacuuaaugccaa

SEQ ID NO: 1797278 - RNA, 14 nt, Homo sapiens
accauaaccacuga

SEQ ID NO: 1797279 - RNA, 23 nt, Homo sapiens
ugcuggagggaagaucuugaugg

SEQ ID NO: 1797280 - RNA, 16 nt, Homo sapiens
uuuucacuugucuccu

SEQ ID NO: 1797281 - RNA, 17 nt, Homo sapiens
auuuucaauuaauauua

SEQ ID NO: 1797282 - RNA, 19 nt, Homo sapiens
aaaugaaggaaaagcaugu

SEQ ID NO: 1797283 - RNA, 23 nt, Homo sapiens
augugcugugugagugagcacac

SEQ ID NO: 1797284 - RNA, 12 nt, Homo sapiens
uacucucuugcc

SEQ ID NO: 1797285 - RNA, 13 nt, Homo sapiens
cuuaccuguucuc

SEQ ID NO: 1797286 - RNA, 14 nt, Homo sapiens
ccucuuuaaaaaca

SEQ ID NO: 1797287 - RNA, 16 nt, Homo sapiens
cauaauauuucuuaaa

SEQ ID NO: 1797288 - RNA, 14 nt, Homo sapiens
cagaaucuuuaaag

SEQ ID NO: 1797289 - RNA, 20 nt, Homo sapiens
cucuaacacggccaggcugg

SEQ ID NO: 1797290 - RNA, 14 nt, Homo sapiens
aaccccaucucuac

SEQ ID NO: 1797291 - RNA, 17 nt, Homo sapiens
ucucauuacuuauacug

SEQ ID NO: 1797292 - RNA, 11 nt, Homo sapiens
aaggauguuuu

SEQ ID NO: 1797293 - RNA, 17 nt, Homo sapiens
cucacauaucugucauu

SEQ ID NO: 1797294 - RNA, 21 nt, Homo sapiens
ucugaugcaagcaagaaacac

SEQ ID NO: 1797295 - RNA, 14 nt, Homo sapiens
uuccucaacagcug

SEQ ID NO: 1797296 - RNA, 22 nt, Homo sapiens
gaggguuauaaauuuuagcaag

SEQ ID NO: 1797297 - RNA, 16 nt, Homo sapiens
aaauuaaauacauaaa

SEQ ID NO: 1797298 - RNA, 14 nt, Homo sapiens
ccauuuugugaaug

SEQ ID NO: 1797299 - RNA, 23 nt, Homo sapiens
aagugauccucacgccuuggccu

SEQ ID NO: 1797300 - RNA, 22 nt, Homo sapiens
uuggaaauagaaauuuccagag

SEQ ID NO: 1797301 - RNA, 20 nt, Homo sapiens
auuugaaaaacauacauuau

SEQ ID NO: 1797302 - RNA, 17 nt, Homo sapiens
auccaugcaccuaccuu

SEQ ID NO: 1797303 - RNA, 16 nt, Homo sapiens
aguggccucuuugucu

SEQ ID NO: 1797304 - RNA, 14 nt, Homo sapiens
uguuguuuaccuga

SEQ ID NO: 1797305 - RNA, 13 nt, Homo sapiens
cugagucacuuga

SEQ ID NO: 1797306 - RNA, 13 nt, Homo sapiens
auucuuaccaucu

SEQ ID NO: 1797307 - RNA, 13 nt, Homo sapiens
aacuuuaccucuu

SEQ ID NO: 1797308 - RNA, 13 nt, Homo sapiens
cauaauacauuaa

SEQ ID NO: 1797309 - RNA, 13 nt, Homo sapiens
cacauuacaucau

SEQ ID NO: 1797310 - RNA, 22 nt, Homo sapiens
aucuacaaaaaacaacaaauaa

SEQ ID NO: 1797311 - RNA, 23 nt, Homo sapiens
gccauuggggcagggacccuccu

SEQ ID NO: 1797312 - RNA, 21 nt, Homo sapiens
cuggauccagccaugccugag

SEQ ID NO: 1797313 - RNA, 16 nt, Homo sapiens
uauuguuauauccuga

SEQ ID NO: 1797314 - RNA, 18 nt, Homo sapiens
caaauucauauucugucu

SEQ ID NO: 1797315 - RNA, 21 nt, Homo sapiens
uugcacacuuugguaccagau

SEQ ID NO: 1797316 - RNA, 15 nt, Homo sapiens
guuauuuauaguguu

SEQ ID NO: 1797317 - RNA, 21 nt, Homo sapiens
ucgcaaacguuucuugaacaa

SEQ ID NO: 1797318 - RNA, 20 nt, Homo sapiens
cuuugaauagcagguaguua

SEQ ID NO: 1797319 - RNA, 13 nt, Homo sapiens
gugucugucagac

SEQ ID NO: 1797320 - RNA, 21 nt, Homo sapiens
aacagccuaucuuugugugac

SEQ ID NO: 1797321 - RNA, 18 nt, Homo sapiens
gaucuuccagaagcugua

SEQ ID NO: 1797322 - RNA, 19 nt, Homo sapiens
aaccauguugguugcacuu

SEQ ID NO: 1797323 - RNA, 16 nt, Homo sapiens
uggggccaggggaccu

SEQ ID NO: 1797324 - RNA, 20 nt, Homo sapiens
gagggagggcugacccagau

SEQ ID NO: 1797325 - RNA, 19 nt, Homo sapiens
ggaaaaaacaaaaucaugu

SEQ ID NO: 1797326 - RNA, 19 nt, Homo sapiens
cuacagggugucugucagu

SEQ ID NO: 1797327 - RNA, 13 nt, Homo sapiens
acacccagccuca

SEQ ID NO: 1797328 - RNA, 21 nt, Homo sapiens
uggggacagaggauuucugcu

SEQ ID NO: 1797329 - RNA, 14 nt, Homo sapiens
acauaugacaauaa

SEQ ID NO: 1797330 - RNA, 21 nt, Homo sapiens
ggcugcugcggugucacuggg

SEQ ID NO: 1797331 - RNA, 14 nt, Homo sapiens
agcauuugcaccuc

SEQ ID NO: 1797332 - RNA, 13 nt, Homo sapiens
acaaauauuccug

SEQ ID NO: 1797333 - RNA, 14 nt, Homo sapiens
cugugauagaggcu

SEQ ID NO: 1797334 - RNA, 19 nt, Homo sapiens
cuaaaaguucucaauguag

SEQ ID NO: 1797335 - RNA, 19 nt, Homo sapiens
guucuacguggaugauuuc

SEQ ID NO: 1797336 - RNA, 13 nt, Homo sapiens
auggacagugggc

SEQ ID NO: 1797337 - RNA, 13 nt, Homo sapiens
auccccagugcca

SEQ ID NO: 1797338 - RNA, 20 nt, Homo sapiens
cccuacaaaaccacuggaaa

SEQ ID NO: 1797339 - RNA, 19 nt, Homo sapiens
uauuucaauaaaucuuuca

SEQ ID NO: 1797340 - RNA, 16 nt, Homo sapiens
ucaaccaugaccucac

SEQ ID NO: 1797341 - RNA, 20 nt, Homo sapiens
auuuaaugaagacccagugu

SEQ ID NO: 1797342 - RNA, 14 nt, Homo sapiens
cucaccugacauua

SEQ ID NO: 1797343 - RNA, 15 nt, Homo sapiens
uagccuggccagcau

SEQ ID NO: 1797344 - RNA, 11 nt, Homo sapiens
cacauucacca

SEQ ID NO: 1797345 - RNA, 17 nt, Homo sapiens
ccucuuuuucucuguau

SEQ ID NO: 1797346 - RNA, 18 nt, Homo sapiens
cuccuucggcuuugcccc

SEQ ID NO: 1797347 - RNA, 16 nt, Homo sapiens
uacauccugaguguga

SEQ ID NO: 1797348 - RNA, 18 nt, Homo sapiens
cuucucccauccaagaga

SEQ ID NO: 1797349 - RNA, 21 nt, Homo sapiens
auucacaauagaaacucacca

SEQ ID NO: 1797350 - RNA, 19 nt, Homo sapiens
aaucucuugccugcuccau

SEQ ID NO: 1797351 - RNA, 22 nt, Homo sapiens
uuuuguccuaaaacaccuggua

SEQ ID NO: 1797352 - RNA, 12 nt, Homo sapiens
augaguggcuuc

SEQ ID NO: 1797353 - RNA, 17 nt, Homo sapiens
guaucuuugacaauucu

SEQ ID NO: 1797354 - RNA, 18 nt, Homo sapiens
acuauggaaagcagccau

SEQ ID NO: 1797355 - RNA, 17 nt, Homo sapiens
uaucacagggucaccuc

SEQ ID NO: 1797356 - RNA, 14 nt, Homo sapiens
aacaacauaucuca

SEQ ID NO: 1797357 - RNA, 22 nt, Homo sapiens
cagcuacuugggaggcugagcc

SEQ ID NO: 1797358 - RNA, 11 nt, Homo sapiens
auaaugguugg

SEQ ID NO: 1797359 - RNA, 14 nt, Homo sapiens
ccuuaccucuggaa

SEQ ID NO: 1797360 - RNA, 14 nt, Homo sapiens
gcuggccuguguga

SEQ ID NO: 1797361 - RNA, 22 nt, Homo sapiens
agguauucguaaggaugggaag

SEQ ID NO: 1797362 - RNA, 23 nt, Homo sapiens
ugagagauagcuuauuacucuga

SEQ ID NO: 1797363 - RNA, 13 nt, Homo sapiens
caaaucauuccuu

SEQ ID NO: 1797364 - RNA, 14 nt, Homo sapiens
cccuccuacccugc

SEQ ID NO: 1797365 - RNA, 15 nt, Homo sapiens
gauaguuuaccugaa

SEQ ID NO: 1797366 - RNA, 20 nt, Homo sapiens
ccuugcaaauaaucacagau

SEQ ID NO: 1797367 - RNA, 14 nt, Homo sapiens
caggccaucaucag

SEQ ID NO: 1797368 - RNA, 20 nt, Homo sapiens
caaggccacuacauugagga

SEQ ID NO: 1797369 - RNA, 16 nt, Homo sapiens
ccaggggcggugcagg

SEQ ID NO: 1797370 - RNA, 15 nt, Homo sapiens
gaaaauauaguuccu

SEQ ID NO: 1797371 - RNA, 19 nt, Homo sapiens
ugguaucuaauucuuuaau

SEQ ID NO: 1797372 - RNA, 13 nt, Homo sapiens
cuggugauggucc

SEQ ID NO: 1797373 - RNA, 13 nt, Homo sapiens
uuuacaaaggggg

SEQ ID NO: 1797374 - RNA, 17 nt, Homo sapiens
gcacuauuuauuuacaa

SEQ ID NO: 1797375 - RNA, 17 nt, Homo sapiens
cugcaguuccaaaagag

SEQ ID NO: 1797376 - RNA, 16 nt, Homo sapiens
uugcuucaaacugaga

SEQ ID NO: 1797377 - RNA, 22 nt, Homo sapiens
uucaugcagaguugaaguuuac

SEQ ID NO: 1797378 - RNA, 19 nt, Homo sapiens
cuguucugaaaggagacau

SEQ ID NO: 1797379 - RNA, 22 nt, Homo sapiens
agaugugugauucacaguguga

SEQ ID NO: 1797380 - RNA, 14 nt, Homo sapiens
cccagaguggcuca

SEQ ID NO: 1797381 - RNA, 18 nt, Homo sapiens
auugucucaaagcaucaa

SEQ ID NO: 1797382 - RNA, 21 nt, Homo sapiens
cuuauuauauuucuuuuuaga

SEQ ID NO: 1797383 - RNA, 20 nt, Homo sapiens
cuucacgauuaacugugaaa

SEQ ID NO: 1797384 - RNA, 12 nt, Homo sapiens
cacuauaugcaa

SEQ ID NO: 1797385 - RNA, 22 nt, Homo sapiens
cuuaucaacauuugggggauaa

SEQ ID NO: 1797386 - RNA, 18 nt, Homo sapiens
uacaaaacuacaugagaa

SEQ ID NO: 1797387 - RNA, 23 nt, Homo sapiens
gaugacugaaaaugaacuguaaa

SEQ ID NO: 1797388 - RNA, 12 nt, Homo sapiens
uaaaaaguucag

SEQ ID NO: 1797389 - RNA, 16 nt, Homo sapiens
cucuucccccuuccaa

SEQ ID NO: 1797390 - RNA, 23 nt, Homo sapiens
ugugaagccuuuaucuaugggag

SEQ ID NO: 1797391 - RNA, 16 nt, Homo sapiens
cuggagaaaaauaucu

SEQ ID NO: 1797392 - RNA, 22 nt, Homo sapiens
augcaccuuauauuucugugua

SEQ ID NO: 1797393 - RNA, 18 nt, Homo sapiens
gauaugcugcuugugacc

SEQ ID NO: 1797394 - RNA, 16 nt, Homo sapiens
aucaugucaggccauc

SEQ ID NO: 1797395 - RNA, 24 nt, Homo sapiens
augugaguuucagaaauucucaaa

SEQ ID NO: 1797396 - RNA, 22 nt, Homo sapiens
gccuguaauccgagcacuuugg

SEQ ID NO: 1797397 - RNA, 16 nt, Homo sapiens
auaccauggcacugac

SEQ ID NO: 1797398 - RNA, 12 nt, Homo sapiens
cuuuuuucuucc

SEQ ID NO: 1797399 - RNA, 11 nt, Homo sapiens
uauccuuccag

SEQ ID NO: 1797400 - RNA, 15 nt, Homo sapiens
cugauaaugcucacu

SEQ ID NO: 1797401 - RNA, 19 nt, Homo sapiens
ggaaugcuucuucucaggc

SEQ ID NO: 1797402 - RNA, 16 nt, Homo sapiens
uuccuuaaaaugugag

SEQ ID NO: 1797403 - RNA, 14 nt, Homo sapiens
ccucuguccagcca

SEQ ID NO: 1797404 - RNA, 12 nt, Homo sapiens
cuucaguguccu

SEQ ID NO: 1797405 - RNA, 17 nt, Homo sapiens
ccauugccuagcucuuu

SEQ ID NO: 1797406 - RNA, 22 nt, Homo sapiens
uaaaagauuuuuuuuaaucuag

SEQ ID NO: 1797407 - RNA, 19 nt, Homo sapiens
agguucuaggcuaccagaa

SEQ ID NO: 1797408 - RNA, 14 nt, Homo sapiens
ccgaggacuuugau

SEQ ID NO: 1797409 - RNA, 14 nt, Homo sapiens
cugaggagcuguga

SEQ ID NO: 1797410 - RNA, 14 nt, Homo sapiens
gccuggaggccaga

SEQ ID NO: 1797411 - RNA, 18 nt, Homo sapiens
gccauacuguaugcagua

SEQ ID NO: 1797412 - RNA, 21 nt, Homo sapiens
aggcauucuaagucacaggau

SEQ ID NO: 1797413 - RNA, 22 nt, Homo sapiens
cucccaccccggccuccacucc

SEQ ID NO: 1797414 - RNA, 20 nt, Homo sapiens
uuaaaaaugucuugcuguug

SEQ ID NO: 1797415 - RNA, 19 nt, Homo sapiens
aggaauuucaccuguaaac

SEQ ID NO: 1797416 - RNA, 18 nt, Homo sapiens
uguggaggccugaugcug

SEQ ID NO: 1797417 - RNA, 15 nt, Homo sapiens
aggacauaaagagag

SEQ ID NO: 1797418 - RNA, 19 nt, Homo sapiens
gagccaccugacucuugca

SEQ ID NO: 1797419 - RNA, 17 nt, Homo sapiens
agaguggcccagaauug

SEQ ID NO: 1797420 - RNA, 15 nt, Homo sapiens
caccauguauuuugu

SEQ ID NO: 1797421 - RNA, 17 nt, Homo sapiens
agauuauuugugcauuu

SEQ ID NO: 1797422 - RNA, 15 nt, Homo sapiens
caaaugacagauucu

SEQ ID NO: 1797423 - RNA, 20 nt, Homo sapiens
augagaucuagacgccccca

SEQ ID NO: 1797424 - RNA, 14 nt, Homo sapiens
uuugucugcuagua

SEQ ID NO: 1797425 - RNA, 16 nt, Homo sapiens
uucuaaaggacauaca

SEQ ID NO: 1797426 - RNA, 13 nt, Homo sapiens
auuaacauaccua

SEQ ID NO: 1797427 - RNA, 16 nt, Homo sapiens
gcauuuuuuaccacaa

SEQ ID NO: 1797428 - RNA, 16 nt, Homo sapiens
ccgaagaugguggcca

SEQ ID NO: 1797429 - RNA, 16 nt, Homo sapiens
aagcagagagcacagc

SEQ ID NO: 1797430 - RNA, 10 nt, Homo sapiens
augacugggc

SEQ ID NO: 1797431 - RNA, 17 nt, Homo sapiens
agaggagccagacagac

SEQ ID NO: 1797432 - RNA, 14 nt, Homo sapiens
ccacucccugccaa

SEQ ID NO: 1797433 - RNA, 12 nt, Homo sapiens
gacagagacgca

SEQ ID NO: 1797434 - RNA, 17 nt, Homo sapiens
ugggacaggugccaggu

SEQ ID NO: 1797435 - RNA, 20 nt, Homo sapiens
gauagaugcagguccauucu

SEQ ID NO: 1797436 - RNA, 16 nt, Homo sapiens
uuaaucuauaacuaca

SEQ ID NO: 1797437 - RNA, 15 nt, Homo sapiens
ccucauaaaaggacu

SEQ ID NO: 1797438 - RNA, 19 nt, Homo sapiens
ugcaaagauuugcuuuaau

SEQ ID NO: 1797439 - RNA, 17 nt, Homo sapiens
gcagagcauucagacuc

SEQ ID NO: 1797440 - RNA, 17 nt, Homo sapiens
cuagaauucugguguuu

SEQ ID NO: 1797441 - RNA, 23 nt, Homo sapiens
ugaaguggucugaauucuggaau

SEQ ID NO: 1797442 - RNA, 12 nt, Homo sapiens
uuggaggggcca

SEQ ID NO: 1797443 - RNA, 13 nt, Homo sapiens
ccaaauguuccau

SEQ ID NO: 1797444 - RNA, 20 nt, Homo sapiens
uuaaaccagaacccaguguu

SEQ ID NO: 1797445 - RNA, 13 nt, Homo sapiens
uagauaugccuua

SEQ ID NO: 1797446 - RNA, 18 nt, Homo sapiens
cuguguaauaucaaacac

SEQ ID NO: 1797447 - RNA, 21 nt, Homo sapiens
guaucuuuuuuaaacuguaaa

SEQ ID NO: 1797448 - RNA, 19 nt, Homo sapiens
gcaggagaaucacuggaac

SEQ ID NO: 1797449 - RNA, 19 nt, Homo sapiens
auuguaaacuaguacuauu

SEQ ID NO: 1797450 - RNA, 19 nt, Homo sapiens
cauggccacacugugacac

SEQ ID NO: 1797451 - RNA, 11 nt, Homo sapiens
cucagcccagg

SEQ ID NO: 1797452 - RNA, 23 nt, Homo sapiens
ugcgccgggggaccuggggacuc

SEQ ID NO: 1797453 - RNA, 17 nt, Homo sapiens
gccgugcagcugggauu

SEQ ID NO: 1797454 - RNA, 22 nt, Homo sapiens
auugucauaggauuaagcaguu

SEQ ID NO: 1797455 - RNA, 15 nt, Homo sapiens
cagagccagaugcag

SEQ ID NO: 1797456 - RNA, 21 nt, Homo sapiens
gaugccauggcaacuuagaga

SEQ ID NO: 1797457 - RNA, 16 nt, Homo sapiens
auuaugauguccaggg

SEQ ID NO: 1797458 - RNA, 16 nt, Homo sapiens
gccccaggaucacucu

SEQ ID NO: 1797459 - RNA, 15 nt, Homo sapiens
uaaggaauuaccaag

SEQ ID NO: 1797460 - RNA, 20 nt, Homo sapiens
cuuguaaauacauaaaacaa

SEQ ID NO: 1797461 - RNA, 17 nt, Homo sapiens
gaacugagugugcucuu

SEQ ID NO: 1797462 - RNA, 18 nt, Homo sapiens
caaccuucaaguauccaa

SEQ ID NO: 1797463 - RNA, 23 nt, Homo sapiens
uucucaugacuccuacuuuucau

SEQ ID NO: 1797464 - RNA, 19 nt, Homo sapiens
gcagcagcuuuugacuguu

SEQ ID NO: 1797465 - RNA, 16 nt, Homo sapiens
ugguaaacuccuccac

SEQ ID NO: 1797466 - RNA, 18 nt, Homo sapiens
acggaucagaugucuaua

SEQ ID NO: 1797467 - RNA, 19 nt, Homo sapiens
uuaaacacacauugcagcu

SEQ ID NO: 1797468 - RNA, 16 nt, Homo sapiens
uaacuucuaauggcca

SEQ ID NO: 1797469 - RNA, 23 nt, Homo sapiens
cuguguagcaucugcauugccca

SEQ ID NO: 1797470 - RNA, 18 nt, Homo sapiens
uugaugccagagggccag

SEQ ID NO: 1797471 - RNA, 11 nt, Homo sapiens
gccgcuagucu

SEQ ID NO: 1797472 - RNA, 22 nt, Homo sapiens
aaccuuaauguggggccucagu

SEQ ID NO: 1797473 - RNA, 24 nt, Homo sapiens
aguauauuuuugucugcagcuguu

SEQ ID NO: 1797474 - RNA, 19 nt, Homo sapiens
aaggaaagagaaaccugag

SEQ ID NO: 1797475 - RNA, 20 nt, Homo sapiens
acuuuuguaaauuauugaug

SEQ ID NO: 1797476 - RNA, 17 nt, Homo sapiens
caaaccauggauagaau

SEQ ID NO: 1797477 - RNA, 20 nt, Homo sapiens
ccuccuuggcuuuaugcaaa

SEQ ID NO: 1797478 - RNA, 14 nt, Homo sapiens
acaugucagaacua

SEQ ID NO: 1797479 - RNA, 17 nt, Homo sapiens
ucagcccugacccugug

SEQ ID NO: 1797480 - RNA, 21 nt, Homo sapiens
cugcuuuaauuaccuggugag

SEQ ID NO: 1797481 - RNA, 14 nt, Homo sapiens
acagugagccaaau

SEQ ID NO: 1797482 - RNA, 24 nt, Homo sapiens
guacaauaaaaacauugccuuuga

SEQ ID NO: 1797483 - RNA, 23 nt, Homo sapiens
aaaccauuauaaaaucuuuccau

SEQ ID NO: 1797484 - RNA, 18 nt, Homo sapiens
ugggcucugugggcugca

SEQ ID NO: 1797485 - RNA, 13 nt, Homo sapiens
caaucuuuuauac

SEQ ID NO: 1797486 - RNA, 14 nt, Homo sapiens
ugauccugugaagu

SEQ ID NO: 1797487 - RNA, 22 nt, Homo sapiens
gaggcuauggaggguccuccuc

SEQ ID NO: 1797488 - RNA, 15 nt, Homo sapiens
aagcagacagucaca

SEQ ID NO: 1797489 - RNA, 22 nt, Homo sapiens
auguuacaauucucucacuuaa

SEQ ID NO: 1797490 - RNA, 18 nt, Homo sapiens
ucagcaaggggcucugcc

SEQ ID NO: 1797491 - RNA, 14 nt, Homo sapiens
cucagcauaccugc

SEQ ID NO: 1797492 - RNA, 15 nt, Homo sapiens
cacugguguaucuca

SEQ ID NO: 1797493 - RNA, 17 nt, Homo sapiens
aaaacugcccauuguaa

SEQ ID NO: 1797494 - RNA, 22 nt, Homo sapiens
agucaggguucacuugggcucu

SEQ ID NO: 1797495 - RNA, 13 nt, Homo sapiens
cuccacugucacc

SEQ ID NO: 1797496 - RNA, 16 nt, Homo sapiens
ccugagugguccccac

SEQ ID NO: 1797497 - RNA, 16 nt, Homo sapiens
cugaucacuagccugu

SEQ ID NO: 1797498 - RNA, 19 nt, Homo sapiens
agucagaguccagugcucu

SEQ ID NO: 1797499 - RNA, 22 nt, Homo sapiens
agaaaggcaaaguacauuguaa

SEQ ID NO: 1797500 - RNA, 11 nt, Homo sapiens
uuuuuuacucg

SEQ ID NO: 1797501 - RNA, 14 nt, Homo sapiens
caguuuaccugaaa

SEQ ID NO: 1797502 - RNA, 20 nt, Homo sapiens
cuguagaucagguuugccca

SEQ ID NO: 1797503 - RNA, 21 nt, Homo sapiens
aauugcaguaaagucuugucu

SEQ ID NO: 1797504 - RNA, 16 nt, Homo sapiens
aaauauucacucucca

SEQ ID NO: 1797505 - RNA, 16 nt, Homo sapiens
uuaauguuaacaagac

SEQ ID NO: 1797506 - RNA, 19 nt, Homo sapiens
aucucagggcacaauggcu

SEQ ID NO: 1797507 - RNA, 20 nt, Homo sapiens
caaaauuggaagcugucaua

SEQ ID NO: 1797508 - RNA, 17 nt, Homo sapiens
uacuucaggggcacuuc

SEQ ID NO: 1797509 - RNA, 12 nt, Homo sapiens
agccagacacuc

SEQ ID NO: 1797510 - RNA, 21 nt, Homo sapiens
uuccccuugcccagggcucag

SEQ ID NO: 1797511 - RNA, 20 nt, Homo sapiens
acaaauuaaauaaauuaccc

SEQ ID NO: 1797512 - RNA, 23 nt, Homo sapiens
aaauggggaaaagaaaaaccacg

SEQ ID NO: 1797513 - RNA, 18 nt, Homo sapiens
uguuucagcugcaguuga

SEQ ID NO: 1797514 - RNA, 21 nt, Homo sapiens
gacugaaguucgcauugaacu

SEQ ID NO: 1797515 - RNA, 15 nt, Homo sapiens
acucuccuaggcauu

SEQ ID NO: 1797516 - RNA, 14 nt, Homo sapiens
aauuuugggggaaa

SEQ ID NO: 1797517 - RNA, 15 nt, Homo sapiens
cucuuugaucccaua

SEQ ID NO: 1797518 - RNA, 17 nt, Homo sapiens
agcuccgccucccgggu

SEQ ID NO: 1797519 - RNA, 21 nt, Homo sapiens
auaguucccuagucuauucau

SEQ ID NO: 1797520 - RNA, 17 nt, Homo sapiens
gaccagagugggaccaa

SEQ ID NO: 1797521 - RNA, 20 nt, Homo sapiens
uucuauacuuucucacaugu

SEQ ID NO: 1797522 - RNA, 20 nt, Homo sapiens
auuaucaaaugaauaaaucc

SEQ ID NO: 1797523 - RNA, 21 nt, Homo sapiens
accagcuaucugucaucucuc

SEQ ID NO: 1797524 - RNA, 17 nt, Homo sapiens
gcccuaugcaagcaaac

SEQ ID NO: 1797525 - RNA, 24 nt, Homo sapiens
aacuguccggccccgagucacuca

SEQ ID NO: 1797526 - RNA, 12 nt, Homo sapiens
uacacugugaag

SEQ ID NO: 1797527 - RNA, 12 nt, Homo sapiens
uuuuuaaugucu

SEQ ID NO: 1797528 - RNA, 18 nt, Homo sapiens
gucuuauaucccagguga

SEQ ID NO: 1797529 - RNA, 16 nt, Homo sapiens
uauuuguggggugaga

SEQ ID NO: 1797530 - RNA, 12 nt, Homo sapiens
aacauggugaaa

SEQ ID NO: 1797531 - RNA, 13 nt, Homo sapiens
auacacuaugaag

SEQ ID NO: 1797532 - RNA, 17 nt, Homo sapiens
auggcacccaugcaccu

SEQ ID NO: 1797533 - RNA, 19 nt, Homo sapiens
ccagcaaaacauaaacuga

SEQ ID NO: 1797534 - RNA, 22 nt, Homo sapiens
gggaagauacugacuagucaua

SEQ ID NO: 1797535 - RNA, 21 nt, Homo sapiens
agucuugcucuuucgccaagg

SEQ ID NO: 1797536 - RNA, 21 nt, Homo sapiens
cauccuugaugcaagugcaac

SEQ ID NO: 1797537 - RNA, 13 nt, Homo sapiens
accaaaugaauuu

SEQ ID NO: 1797538 - RNA, 21 nt, Homo sapiens
agcuucuucugaaagaauuau

SEQ ID NO: 1797539 - RNA, 18 nt, Homo sapiens
uccagaaauacuacugug

SEQ ID NO: 1797540 - RNA, 18 nt, Homo sapiens
uuugagcccccauuccac

SEQ ID NO: 1797541 - RNA, 18 nt, Homo sapiens
acgcaccuggguguuaca

SEQ ID NO: 1797542 - RNA, 17 nt, Homo sapiens
cuuuuaaucaacuguag

SEQ ID NO: 1797543 - RNA, 21 nt, Homo sapiens
ugcauuuucccagauacuucc

SEQ ID NO: 1797544 - RNA, 16 nt, Homo sapiens
cacaaggacuuccugu

SEQ ID NO: 1797545 - RNA, 17 nt, Homo sapiens
ugcacuuuugaaauaaa

SEQ ID NO: 1797546 - RNA, 13 nt, Homo sapiens
auuucuaucagcc

SEQ ID NO: 1797547 - RNA, 15 nt, Homo sapiens
uaucaaaacauauca

SEQ ID NO: 1797548 - RNA, 21 nt, Homo sapiens
caucugcuuuacucuggacca

SEQ ID NO: 1797549 - RNA, 14 nt, Homo sapiens
guucagugccuugg

SEQ ID NO: 1797550 - RNA, 19 nt, Homo sapiens
uucucucuccagucuucca

SEQ ID NO: 1797551 - RNA, 20 nt, Homo sapiens
caguucaacauaaagagcaa

SEQ ID NO: 1797552 - RNA, 14 nt, Homo sapiens
gagugucacugagc

SEQ ID NO: 1797553 - RNA, 18 nt, Homo sapiens
cugacaguauuaagggua

SEQ ID NO: 1797554 - RNA, 14 nt, Homo sapiens
gccuugcuuguuaa

SEQ ID NO: 1797555 - RNA, 15 nt, Homo sapiens
agaaaggucagccuu

SEQ ID NO: 1797556 - RNA, 12 nt, Homo sapiens
cugucaccuugc

SEQ ID NO: 1797557 - RNA, 22 nt, Homo sapiens
ccaagggauggacaucuuguca

SEQ ID NO: 1797558 - RNA, 15 nt, Homo sapiens
ccucagccuugccag

SEQ ID NO: 1797559 - RNA, 13 nt, Homo sapiens
gcaugcucaggac

SEQ ID NO: 1797560 - RNA, 18 nt, Homo sapiens
uuucagugcuuugcccuu

SEQ ID NO: 1797561 - RNA, 21 nt, Homo sapiens
aaggcccucuauuucucucuu

SEQ ID NO: 1797562 - RNA, 20 nt, Homo sapiens
cccuguucaaagaugcauuu

SEQ ID NO: 1797563 - RNA, 22 nt, Homo sapiens
uccuguccucugcccccaaggu

SEQ ID NO: 1797564 - RNA, 19 nt, Homo sapiens
agcuauauucugagacuuu

SEQ ID NO: 1797565 - RNA, 21 nt, Homo sapiens
caaaucguccaaagaucucaa

SEQ ID NO: 1797566 - RNA, 15 nt, Homo sapiens
acacaggcauggcua

SEQ ID NO: 1797567 - RNA, 20 nt, Homo sapiens
cuuaacuauaaggugccuca

SEQ ID NO: 1797568 - RNA, 17 nt, Homo sapiens
acucauguggacuggga

SEQ ID NO: 1797569 - RNA, 18 nt, Homo sapiens
auuccauuuuacuuccau

SEQ ID NO: 1797570 - RNA, 13 nt, Homo sapiens
guccccuggagaa

SEQ ID NO: 1797571 - RNA, 16 nt, Homo sapiens
cucagguagauuuugu

SEQ ID NO: 1797572 - RNA, 13 nt, Homo sapiens
uaaaggcucugug

SEQ ID NO: 1797573 - RNA, 20 nt, Homo sapiens
auggcacugacaaugggcac

SEQ ID NO: 1797574 - RNA, 13 nt, Homo sapiens
acaaaaggcaucu

SEQ ID NO: 1797575 - RNA, 22 nt, Homo sapiens
cugagcccuacucccugcagau

SEQ ID NO: 1797576 - RNA, 22 nt, Homo sapiens
acucaaugccaacuuuuuguua

SEQ ID NO: 1797577 - RNA, 13 nt, Homo sapiens
agcagauuuaaca

SEQ ID NO: 1797578 - RNA, 20 nt, Homo sapiens
gaaggaauggaggagucuca

SEQ ID NO: 1797579 - RNA, 14 nt, Homo sapiens
augucuaccucuga

SEQ ID NO: 1797580 - RNA, 15 nt, Homo sapiens
aucagaguaugucag

SEQ ID NO: 1797581 - RNA, 15 nt, Homo sapiens
cagagucucacucuc

SEQ ID NO: 1797582 - RNA, 15 nt, Homo sapiens
gggaccuuggcugcu

SEQ ID NO: 1797583 - RNA, 17 nt, Homo sapiens
cugaccacagcacagcc

SEQ ID NO: 1797584 - RNA, 22 nt, Homo sapiens
ccuucaaaaagcaaucuggaag

SEQ ID NO: 1797585 - RNA, 21 nt, Homo sapiens
ccuggcaggggaaacucuggu

SEQ ID NO: 1797586 - RNA, 18 nt, Homo sapiens
cuugaaaaaaaacagugg

SEQ ID NO: 1797587 - RNA, 13 nt, Homo sapiens
augagccaugaga

SEQ ID NO: 1797588 - RNA, 13 nt, Homo sapiens
aggacucagcaca

SEQ ID NO: 1797589 - RNA, 15 nt, Homo sapiens
ugggcagagcugcau

SEQ ID NO: 1797590 - RNA, 19 nt, Homo sapiens
ugaguacuggaauaaacag

SEQ ID NO: 1797591 - RNA, 19 nt, Homo sapiens
uguggagaucagaaaguga

SEQ ID NO: 1797592 - RNA, 18 nt, Homo sapiens
gcaugccacccucacaca

SEQ ID NO: 1797593 - RNA, 19 nt, Homo sapiens
augcaugguuucagcacua

SEQ ID NO: 1797594 - RNA, 21 nt, Homo sapiens
gcuuugguucuucagaugcuc

SEQ ID NO: 1797595 - RNA, 17 nt, Homo sapiens
auaaauguacauuaauu

SEQ ID NO: 1797596 - RNA, 16 nt, Homo sapiens
cauacugacauaagau

SEQ ID NO: 1797597 - RNA, 16 nt, Homo sapiens
cauaaugucauacgaa

SEQ ID NO: 1797598 - RNA, 21 nt, Homo sapiens
ugcaggacauuuggcugugau

SEQ ID NO: 1797599 - RNA, 17 nt, Homo sapiens
gccgcagacgggcacag

SEQ ID NO: 1797600 - RNA, 21 nt, Homo sapiens
acauuaacucaggcauuucau

SEQ ID NO: 1797601 - RNA, 19 nt, Homo sapiens
ggucaggggcucccuacau

SEQ ID NO: 1797602 - RNA, 23 nt, Homo sapiens
cucagcauggcguaucaggaaag

SEQ ID NO: 1797603 - RNA, 12 nt, Homo sapiens
aacgcacaggaa

SEQ ID NO: 1797604 - RNA, 19 nt, Homo sapiens
uggccuaaagccagcauuu

SEQ ID NO: 1797605 - RNA, 15 nt, Homo sapiens
auauaaugguuuacu

SEQ ID NO: 1797606 - RNA, 14 nt, Homo sapiens
ucaugagcugucug

SEQ ID NO: 1797607 - RNA, 17 nt, Homo sapiens
uacccucggucauuccu

SEQ ID NO: 1797608 - RNA, 20 nt, Homo sapiens
cguacccuuugcacacaggg

SEQ ID NO: 1797609 - RNA, 19 nt, Homo sapiens
ccauaauuaugaaaacuca

SEQ ID NO: 1797610 - RNA, 18 nt, Homo sapiens
acucaaugagcucuucca

SEQ ID NO: 1797611 - RNA, 20 nt, Homo sapiens
cuuuaaaauauaucuggaac

SEQ ID NO: 1797612 - RNA, 19 nt, Homo sapiens
uauccuggcaacucaaggc

SEQ ID NO: 1797613 - RNA, 17 nt, Homo sapiens
cuaacaggcacuuugag

SEQ ID NO: 1797614 - RNA, 14 nt, Homo sapiens
ccuccucaaaccua

SEQ ID NO: 1797615 - RNA, 19 nt, Homo sapiens
aaugcucccagcugugcug

SEQ ID NO: 1797616 - RNA, 16 nt, Homo sapiens
augugugucugaagac

SEQ ID NO: 1797617 - RNA, 15 nt, Homo sapiens
uaauguuauucauuu

SEQ ID NO: 1797618 - RNA, 17 nt, Homo sapiens
uaucuuugugugacaug

SEQ ID NO: 1797619 - RNA, 17 nt, Homo sapiens
cugcacagcaggcugcc

SEQ ID NO: 1797620 - RNA, 18 nt, Homo sapiens
ugugaaugugacuacuua

SEQ ID NO: 1797621 - RNA, 13 nt, Homo sapiens
cagccagcauuac

SEQ ID NO: 1797622 - RNA, 21 nt, Homo sapiens
accuauuuuuuucucuauucu

SEQ ID NO: 1797623 - RNA, 12 nt, Homo sapiens
cuucaacccagu

SEQ ID NO: 1797624 - RNA, 20 nt, Homo sapiens
agugcuaagagccucuggaa

SEQ ID NO: 1797625 - RNA, 21 nt, Homo sapiens
aaccaaauuacaaguauucag

SEQ ID NO: 1797626 - RNA, 23 nt, Homo sapiens
auucacaguugagugcaucccag

SEQ ID NO: 1797627 - RNA, 15 nt, Homo sapiens
aacaaacuacaugua

SEQ ID NO: 1797628 - RNA, 15 nt, Homo sapiens
uugcagcugauguug

SEQ ID NO: 1797629 - RNA, 13 nt, Homo sapiens
gugagaacacagc

SEQ ID NO: 1797630 - RNA, 15 nt, Homo sapiens
uuaguacauccucac

SEQ ID NO: 1797631 - RNA, 18 nt, Homo sapiens
cauaaagugaauguuuac

SEQ ID NO: 1797632 - RNA, 18 nt, Homo sapiens
ugauaaucuucaggugaa

SEQ ID NO: 1797633 - RNA, 23 nt, Homo sapiens
acccagaaaaucugaauuggaau

SEQ ID NO: 1797634 - RNA, 18 nt, Homo sapiens
gcgcaguguggagacggg

SEQ ID NO: 1797635 - RNA, 14 nt, Homo sapiens
uugucaccaugauc

SEQ ID NO: 1797636 - RNA, 14 nt, Homo sapiens
uuuuccccauuaua

SEQ ID NO: 1797637 - RNA, 14 nt, Homo sapiens
aacauguauguaaa

SEQ ID NO: 1797638 - RNA, 21 nt, Homo sapiens
gcugccuuuucucauucuguu

SEQ ID NO: 1797639 - RNA, 20 nt, Homo sapiens
ugccaaugaacaucucaugu

SEQ ID NO: 1797640 - RNA, 22 nt, Homo sapiens
uguaagaaauacagacuggaug

SEQ ID NO: 1797641 - RNA, 16 nt, Homo sapiens
uuugcuugcaauguag

SEQ ID NO: 1797642 - RNA, 20 nt, Homo sapiens
ggugcuggaagucuccauga

SEQ ID NO: 1797643 - RNA, 17 nt, Homo sapiens
uguauaaguccuugcaa

SEQ ID NO: 1797644 - RNA, 19 nt, Homo sapiens
aaauuacaauaaaaccuuu

SEQ ID NO: 1797645 - RNA, 19 nt, Homo sapiens
cagacucaaggccuccagc

SEQ ID NO: 1797646 - RNA, 21 nt, Homo sapiens
uuucugaacaaagagagcuca

SEQ ID NO: 1797647 - RNA, 14 nt, Homo sapiens
gaggguccucaguc

SEQ ID NO: 1797648 - RNA, 23 nt, Homo sapiens
cuuaaauugguauuaacuaugau

SEQ ID NO: 1797649 - RNA, 16 nt, Homo sapiens
acaggggaucauguua

SEQ ID NO: 1797650 - RNA, 20 nt, Homo sapiens
aacuucaaaaaaaucuaaca

SEQ ID NO: 1797651 - RNA, 23 nt, Homo sapiens
acaguuaauuaugugcauauuaa

SEQ ID NO: 1797652 - RNA, 17 nt, Homo sapiens
ucagaagccuacuuuga

SEQ ID NO: 1797653 - RNA, 16 nt, Homo sapiens
ggggccauuugcaaua

SEQ ID NO: 1797654 - RNA, 17 nt, Homo sapiens
cuggaucccaucaaaga

SEQ ID NO: 1797655 - RNA, 16 nt, Homo sapiens
ggaacaauguuugaua

SEQ ID NO: 1797656 - RNA, 12 nt, Homo sapiens
auccuauggcag

SEQ ID NO: 1797657 - RNA, 14 nt, Homo sapiens
uuaugcugugguca

SEQ ID NO: 1797658 - RNA, 11 nt, Homo sapiens
acggugcaguc

SEQ ID NO: 1797659 - RNA, 14 nt, Homo sapiens
uaacuuauuugccc

SEQ ID NO: 1797660 - RNA, 15 nt, Homo sapiens
agcuauaacauuugc

SEQ ID NO: 1797661 - RNA, 19 nt, Homo sapiens
ccacuggacugucuaugaa

SEQ ID NO: 1797662 - RNA, 16 nt, Homo sapiens
ccuuuugccaaucuca

SEQ ID NO: 1797663 - RNA, 17 nt, Homo sapiens
aggcugaccacagcaca

SEQ ID NO: 1797664 - RNA, 22 nt, Homo sapiens
uuaguucuauuucuaucccaaa

SEQ ID NO: 1797665 - RNA, 17 nt, Homo sapiens
uuaagaaaaacauguca

SEQ ID NO: 1797666 - RNA, 12 nt, Homo sapiens
uagcuguaaaac

SEQ ID NO: 1797667 - RNA, 16 nt, Homo sapiens
uggcagauuuucuucu

SEQ ID NO: 1797668 - RNA, 15 nt, Homo sapiens
gagcaagggggccca

SEQ ID NO: 1797669 - RNA, 17 nt, Homo sapiens
cagugucuuuccaccuu

SEQ ID NO: 1797670 - RNA, 21 nt, Homo sapiens
agcggucauucuacacugagg

SEQ ID NO: 1797671 - RNA, 18 nt, Homo sapiens
uguggaauauggcaauag

SEQ ID NO: 1797672 - RNA, 16 nt, Homo sapiens
cauuaaggaauuugau

SEQ ID NO: 1797673 - RNA, 16 nt, Homo sapiens
aagccaugugcagcca

SEQ ID NO: 1797674 - RNA, 18 nt, Homo sapiens
ugacagcccgcaggauca

SEQ ID NO: 1797675 - RNA, 18 nt, Homo sapiens
cuuggucacauacaauua

SEQ ID NO: 1797676 - RNA, 16 nt, Homo sapiens
uaaauauacuaugaaa

SEQ ID NO: 1797677 - RNA, 20 nt, Homo sapiens
acauuccucugcagcacuuc

SEQ ID NO: 1797678 - RNA, 21 nt, Homo sapiens
uuaaauguugcacaucauuca

SEQ ID NO: 1797679 - RNA, 13 nt, Homo sapiens
cuucagggccaga

SEQ ID NO: 1797680 - RNA, 15 nt, Homo sapiens
guggcggggcagcag

SEQ ID NO: 1797681 - RNA, 11 nt, Homo sapiens
acagugaaugg

SEQ ID NO: 1797682 - RNA, 17 nt, Homo sapiens
aguucauucauacucaa

SEQ ID NO: 1797683 - RNA, 21 nt, Homo sapiens
cagccucacuucuaccugccc

SEQ ID NO: 1797684 - RNA, 16 nt, Homo sapiens
ccaguuccuccaagag

SEQ ID NO: 1797685 - RNA, 15 nt, Homo sapiens
ugauggucauaucca

SEQ ID NO: 1797686 - RNA, 13 nt, Homo sapiens
uugugccuuucac

SEQ ID NO: 1797687 - RNA, 13 nt, Homo sapiens
cagcgacuggcau

SEQ ID NO: 1797688 - RNA, 14 nt, Homo sapiens
uaggcugacaccaa

SEQ ID NO: 1797689 - RNA, 21 nt, Homo sapiens
aaaccauucaugaugaacuca

SEQ ID NO: 1797690 - RNA, 21 nt, Homo sapiens
gaaauuagguugaaacauauc

SEQ ID NO: 1797691 - RNA, 13 nt, Homo sapiens
aagguagaacaaa

SEQ ID NO: 1797692 - RNA, 14 nt, Homo sapiens
ugagaccucuagag

SEQ ID NO: 1797693 - RNA, 23 nt, Homo sapiens
ccaggggaaugaucucugaugac

SEQ ID NO: 1797694 - RNA, 15 nt, Homo sapiens
cucagcccauccccu

SEQ ID NO: 1797695 - RNA, 12 nt, Homo sapiens
uaacuacagugu

SEQ ID NO: 1797696 - RNA, 16 nt, Homo sapiens
cucucaacuucaucag

SEQ ID NO: 1797697 - RNA, 11 nt, Homo sapiens
auaaugcuucu

SEQ ID NO: 1797698 - RNA, 14 nt, Homo sapiens
aaagcccacaggcc

SEQ ID NO: 1797699 - RNA, 23 nt, Homo sapiens
guaggcccugcuuuaucagggga

SEQ ID NO: 1797700 - RNA, 15 nt, Homo sapiens
uccauccuccugugu

SEQ ID NO: 1797701 - RNA, 17 nt, Homo sapiens
gugucuaguuugcauac

SEQ ID NO: 1797702 - RNA, 14 nt, Homo sapiens
aagcaggcuucuau

SEQ ID NO: 1797703 - RNA, 18 nt, Homo sapiens
ugagagaauaaaaacuuc

SEQ ID NO: 1797704 - RNA, 18 nt, Homo sapiens
agccucuccgacucugca

SEQ ID NO: 1797705 - RNA, 21 nt, Homo sapiens
aaauuaagaaauucacuuccc

SEQ ID NO: 1797706 - RNA, 22 nt, Homo sapiens
aaggaaaugcaagcucuggaaa

SEQ ID NO: 1797707 - RNA, 19 nt, Homo sapiens
aucucauuuccaagcaagu

SEQ ID NO: 1797708 - RNA, 16 nt, Homo sapiens
uuacaguguuuggaca

SEQ ID NO: 1797709 - RNA, 21 nt, Homo sapiens
gaaauuguguuugacauucug

SEQ ID NO: 1797710 - RNA, 16 nt, Homo sapiens
cuugcagaacugccau

SEQ ID NO: 1797711 - RNA, 23 nt, Homo sapiens
uaggauaccacuuuucauugcaa

SEQ ID NO: 1797712 - RNA, 16 nt, Homo sapiens
cucugcuaaaacaaca

SEQ ID NO: 1797713 - RNA, 20 nt, Homo sapiens
uggaaacgcaaaugaguauu

SEQ ID NO: 1797714 - RNA, 22 nt, Homo sapiens
uugguagaggaaggaugcaaag

SEQ ID NO: 1797715 - RNA, 14 nt, Homo sapiens
caacacugugcacg

SEQ ID NO: 1797716 - RNA, 13 nt, Homo sapiens
uugaugaauuugg

SEQ ID NO: 1797717 - RNA, 16 nt, Homo sapiens
aucaaaucagucagug

SEQ ID NO: 1797718 - RNA, 13 nt, Homo sapiens
auaguccaaagac

SEQ ID NO: 1797719 - RNA, 17 nt, Homo sapiens
gugccgcuuucucugag

SEQ ID NO: 1797720 - RNA, 16 nt, Homo sapiens
gcauggcugagcugcc

SEQ ID NO: 1797721 - RNA, 12 nt, Homo sapiens
acggccaugaga

SEQ ID NO: 1797722 - RNA, 19 nt, Homo sapiens
gcacgguuuccagauguaa

SEQ ID NO: 1797723 - RNA, 23 nt, Homo sapiens
uccugaccucaaguaauccaccu

SEQ ID NO: 1797724 - RNA, 18 nt, Homo sapiens
accaagauuaugugacuu

SEQ ID NO: 1797725 - RNA, 12 nt, Homo sapiens
gaaaggccuuca

SEQ ID NO: 1797726 - RNA, 14 nt, Homo sapiens
ugaggccugagaca

SEQ ID NO: 1797727 - RNA, 14 nt, Homo sapiens
cuacguuaacccau

SEQ ID NO: 1797728 - RNA, 16 nt, Homo sapiens
ucugcuccagccccuu

SEQ ID NO: 1797729 - RNA, 20 nt, Homo sapiens
uauucagauguacacccacc

SEQ ID NO: 1797730 - RNA, 20 nt, Homo sapiens
caccccuuccccuuguaaaa

SEQ ID NO: 1797731 - RNA, 19 nt, Homo sapiens
uguagguaauauuguucua

SEQ ID NO: 1797732 - RNA, 20 nt, Homo sapiens
cguggugagguugugcugcc

SEQ ID NO: 1797733 - RNA, 23 nt, Homo sapiens
aaagcugagaagaaugaaaaugc

SEQ ID NO: 1797734 - RNA, 16 nt, Homo sapiens
cauguuuaauguuauc

SEQ ID NO: 1797735 - RNA, 14 nt, Homo sapiens
caguucaugccuga

SEQ ID NO: 1797736 - RNA, 13 nt, Homo sapiens
uuccguuuugccu

SEQ ID NO: 1797737 - RNA, 17 nt, Homo sapiens
aaaagagcuauugccaa

SEQ ID NO: 1797738 - RNA, 22 nt, Homo sapiens
acuggccuguaaucuaccagug

SEQ ID NO: 1797739 - RNA, 23 nt, Homo sapiens
accuuauauuuacaauaaaugaa

SEQ ID NO: 1797740 - RNA, 14 nt, Homo sapiens
ggcccccaguggga

SEQ ID NO: 1797741 - RNA, 16 nt, Homo sapiens
guauauagaacacaag

SEQ ID NO: 1797742 - RNA, 16 nt, Homo sapiens
gggagcucaguuuuca

SEQ ID NO: 1797743 - RNA, 16 nt, Homo sapiens
cacagggcaggggugg

SEQ ID NO: 1797744 - RNA, 12 nt, Homo sapiens
aaacucauccau

SEQ ID NO: 1797745 - RNA, 18 nt, Homo sapiens
auuccuggaauaaaccac

SEQ ID NO: 1797746 - RNA, 15 nt, Homo sapiens
ccuauuuacuggaaa

SEQ ID NO: 1797747 - RNA, 17 nt, Homo sapiens
uggaggguaaaugaugu

SEQ ID NO: 1797748 - RNA, 21 nt, Homo sapiens
guucaggguugguagcaggga

SEQ ID NO: 1797749 - RNA, 22 nt, Homo sapiens
cucaugcaugcaaauuagacaa

SEQ ID NO: 1797750 - RNA, 15 nt, Homo sapiens
accugcacuuggccu

SEQ ID NO: 1797751 - RNA, 23 nt, Homo sapiens
aauuugggaaaagaagcugucag

SEQ ID NO: 1797752 - RNA, 12 nt, Homo sapiens
cagacgugugac

SEQ ID NO: 1797753 - RNA, 14 nt, Homo sapiens
gcgaacaaccacag

SEQ ID NO: 1797754 - RNA, 22 nt, Homo sapiens
cuucuccccucucccagggaug

SEQ ID NO: 1797755 - RNA, 19 nt, Homo sapiens
auuauuuggagccugccaa

SEQ ID NO: 1797756 - RNA, 14 nt, Homo sapiens
ucacugauuugaca

SEQ ID NO: 1797757 - RNA, 20 nt, Homo sapiens
aggcuggaugacuugcucaa

SEQ ID NO: 1797758 - RNA, 21 nt, Homo sapiens
auguggaagaacuuaggcauc

SEQ ID NO: 1797759 - RNA, 21 nt, Homo sapiens
gggcauccuggaugauuucau

SEQ ID NO: 1797760 - RNA, 15 nt, Homo sapiens
ucagauauuugcacc

SEQ ID NO: 1797761 - RNA, 18 nt, Homo sapiens
ggaucucaggcuucugca

SEQ ID NO: 1797762 - RNA, 17 nt, Homo sapiens
gcucaggagaagccagu

SEQ ID NO: 1797763 - RNA, 16 nt, Homo sapiens
uguagcauccuggaau

SEQ ID NO: 1797764 - RNA, 21 nt, Homo sapiens
uugaauccagaacacaaccuu

SEQ ID NO: 1797765 - RNA, 21 nt, Homo sapiens
ucagauccugggcacauucuu

SEQ ID NO: 1797766 - RNA, 13 nt, Homo sapiens
cuguuuguuaaaa

SEQ ID NO: 1797767 - RNA, 19 nt, Homo sapiens
uaaguguucaguguugaca

SEQ ID NO: 1797768 - RNA, 20 nt, Homo sapiens
ccuaugccagagcagugcca

SEQ ID NO: 1797769 - RNA, 14 nt, Homo sapiens
gaaauauagccaaa

SEQ ID NO: 1797770 - RNA, 14 nt, Homo sapiens
aaauuuuaaccuau

SEQ ID NO: 1797771 - RNA, 18 nt, Homo sapiens
acaaacugaagauaauga

SEQ ID NO: 1797772 - RNA, 18 nt, Homo sapiens
gugcaaggaaauuugcaa

SEQ ID NO: 1797773 - RNA, 20 nt, Homo sapiens
gccccuccccagacucucag

SEQ ID NO: 1797774 - RNA, 17 nt, Homo sapiens
aggaccgucuugcuuug

SEQ ID NO: 1797775 - RNA, 13 nt, Homo sapiens
aggcaguguuccu

SEQ ID NO: 1797776 - RNA, 14 nt, Homo sapiens
uccuguagcacgcu

SEQ ID NO: 1797777 - RNA, 13 nt, Homo sapiens
aggaaacaguuaa

SEQ ID NO: 1797778 - RNA, 22 nt, Homo sapiens
cuagcauuucccaacacaaaga

SEQ ID NO: 1797779 - RNA, 16 nt, Homo sapiens
cucaggccucugcucu

SEQ ID NO: 1797780 - RNA, 20 nt, Homo sapiens
agcuauauuauacaaauacu

SEQ ID NO: 1797781 - RNA, 22 nt, Homo sapiens
uugaggaaguggcugucccugu

SEQ ID NO: 1797782 - RNA, 13 nt, Homo sapiens
gccaaaccaggac

SEQ ID NO: 1797783 - RNA, 20 nt, Homo sapiens
augauuguuugaaagucugu

SEQ ID NO: 1797784 - RNA, 17 nt, Homo sapiens
caaaaagucacaguuaa

SEQ ID NO: 1797785 - RNA, 22 nt, Homo sapiens
aaauaaaauuuuccuuggcaau

SEQ ID NO: 1797786 - RNA, 19 nt, Homo sapiens
ggggagcaguaaacuuucu

SEQ ID NO: 1797787 - RNA, 15 nt, Homo sapiens
gcccacgacacugca

SEQ ID NO: 1797788 - RNA, 23 nt, Homo sapiens
cauggaccaaaggguuuacuuga

SEQ ID NO: 1797789 - RNA, 16 nt, Homo sapiens
aagagccccacucuca

SEQ ID NO: 1797790 - RNA, 13 nt, Homo sapiens
aacaaacauggau

SEQ ID NO: 1797791 - RNA, 13 nt, Homo sapiens
ugcuuacaaagua

SEQ ID NO: 1797792 - RNA, 17 nt, Homo sapiens
gaccugaugaccuggga

SEQ ID NO: 1797793 - RNA, 15 nt, Homo sapiens
caucucccucugauu

SEQ ID NO: 1797794 - RNA, 16 nt, Homo sapiens
uccuggaauaaaccac

SEQ ID NO: 1797795 - RNA, 15 nt, Homo sapiens
aagaacugccauaaa

SEQ ID NO: 1797796 - RNA, 15 nt, Homo sapiens
uacaagcuacauaug

SEQ ID NO: 1797797 - RNA, 14 nt, Homo sapiens
uaaagcauuuuaca

SEQ ID NO: 1797798 - RNA, 15 nt, Homo sapiens
uggaaagcacaagac

SEQ ID NO: 1797799 - RNA, 19 nt, Homo sapiens
cagguagaccaggugcuca

SEQ ID NO: 1797800 - RNA, 13 nt, Homo sapiens
caaggcucaaggg

SEQ ID NO: 1797801 - RNA, 17 nt, Homo sapiens
acccuacuuucauuccu

SEQ ID NO: 1797802 - RNA, 20 nt, Homo sapiens
ggcauggacaucagcaucac

SEQ ID NO: 1797803 - RNA, 22 nt, Homo sapiens
ugagcgucagcauccagguuua

SEQ ID NO: 1797804 - RNA, 22 nt, Homo sapiens
ccacaauuacauacuauucuua

SEQ ID NO: 1797805 - RNA, 23 nt, Homo sapiens
cuggaaugcaguggugugcucug

SEQ ID NO: 1797806 - RNA, 18 nt, Homo sapiens
aaaccagaaaucuaaucu

SEQ ID NO: 1797807 - RNA, 21 nt, Homo sapiens
cugaaauagugguucuuggaa

SEQ ID NO: 1797808 - RNA, 13 nt, Homo sapiens
uucacacuaugga

SEQ ID NO: 1797809 - RNA, 23 nt, Homo sapiens
acuucaauguauugagcauguga

SEQ ID NO: 1797810 - RNA, 21 nt, Homo sapiens
gacgggacccugagccugugu

SEQ ID NO: 1797811 - RNA, 21 nt, Homo sapiens
ucuacguauggcuccacaccu

SEQ ID NO: 1797812 - RNA, 18 nt, Homo sapiens
cuaacguccacuagcuua

SEQ ID NO: 1797813 - RNA, 22 nt, Homo sapiens
auguauaaauuaauacagagua

SEQ ID NO: 1797814 - RNA, 19 nt, Homo sapiens
agacaaaauuguaagccag

SEQ ID NO: 1797815 - RNA, 20 nt, Homo sapiens
auuuggauaaaaggaaccaa

SEQ ID NO: 1797816 - RNA, 21 nt, Homo sapiens
uccccagaagcagccauaaaa

SEQ ID NO: 1797817 - RNA, 16 nt, Homo sapiens
aauagcuaagcaucuc

SEQ ID NO: 1797818 - RNA, 18 nt, Homo sapiens
uaaauuuaaaacuggccu

SEQ ID NO: 1797819 - RNA, 12 nt, Homo sapiens
uucuuccuuccu

SEQ ID NO: 1797820 - RNA, 22 nt, Homo sapiens
ucacagcccugcuuaccagaua

SEQ ID NO: 1797821 - RNA, 12 nt, Homo sapiens
aagcaacuguga

SEQ ID NO: 1797822 - RNA, 15 nt, Homo sapiens
uacccucaccuguca

SEQ ID NO: 1797823 - RNA, 16 nt, Homo sapiens
guguacacgugacaga

SEQ ID NO: 1797824 - RNA, 17 nt, Homo sapiens
ucacccuuggacaagac

SEQ ID NO: 1797825 - RNA, 21 nt, Homo sapiens
uaaauaauuuauggauuuaug

SEQ ID NO: 1797826 - RNA, 15 nt, Homo sapiens
cuuggccacggccug

SEQ ID NO: 1797827 - RNA, 22 nt, Homo sapiens
agagcaagguuucguggcagca

SEQ ID NO: 1797828 - RNA, 22 nt, Homo sapiens
ucaguguagaaccuaauucaau

SEQ ID NO: 1797829 - RNA, 22 nt, Homo sapiens
auuggcaggaaaaaugcagcuu

SEQ ID NO: 1797830 - RNA, 21 nt, Homo sapiens
cauucugcucuuugauucaaa

SEQ ID NO: 1797831 - RNA, 20 nt, Homo sapiens
ggcuuuccucagcaccuggg

SEQ ID NO: 1797832 - RNA, 22 nt, Homo sapiens
ucuccuucaccccuauggugcu

SEQ ID NO: 1797833 - RNA, 11 nt, Homo sapiens
ggagaguucaa

SEQ ID NO: 1797834 - RNA, 18 nt, Homo sapiens
agcacaaaaucagccaaa

SEQ ID NO: 1797835 - RNA, 16 nt, Homo sapiens
agaauggggugagcag

SEQ ID NO: 1797836 - RNA, 16 nt, Homo sapiens
acuccaagccaaauac

SEQ ID NO: 1797837 - RNA, 21 nt, Homo sapiens
ugugcuaucgcaaaucacaaa

SEQ ID NO: 1797838 - RNA, 11 nt, Homo sapiens
gagagccaaac

SEQ ID NO: 1797839 - RNA, 17 nt, Homo sapiens
cuucagccuuaauggaa

SEQ ID NO: 1797840 - RNA, 16 nt, Homo sapiens
ggcagugaaguguuua

SEQ ID NO: 1797841 - RNA, 13 nt, Homo sapiens
cuuaaaugccaau

SEQ ID NO: 1797842 - RNA, 20 nt, Homo sapiens
aagauuuuaaaggaccucau

SEQ ID NO: 1797843 - RNA, 21 nt, Homo sapiens
cuccuguguggacguugccug

SEQ ID NO: 1797844 - RNA, 11 nt, Homo sapiens
uaugaugcuaa

SEQ ID NO: 1797845 - RNA, 14 nt, Homo sapiens
ucucaucacuuuuc

SEQ ID NO: 1797846 - RNA, 20 nt, Homo sapiens
uaauuccuucagcacuuuag

SEQ ID NO: 1797847 - RNA, 20 nt, Homo sapiens
caaagugacauuccugaguc

SEQ ID NO: 1797848 - RNA, 18 nt, Homo sapiens
caaaggcuuucuuuccaa

SEQ ID NO: 1797849 - RNA, 21 nt, Homo sapiens
ugggauguccaccacaguaaa

SEQ ID NO: 1797850 - RNA, 21 nt, Homo sapiens
agcuuaagaauuuacaguucc

SEQ ID NO: 1797851 - RNA, 22 nt, Homo sapiens
aucucccugccgccucaaugug

SEQ ID NO: 1797852 - RNA, 14 nt, Homo sapiens
cugucauugcacau

SEQ ID NO: 1797853 - RNA, 14 nt, Homo sapiens
uguugaacuuagaa

SEQ ID NO: 1797854 - RNA, 16 nt, Homo sapiens
ucaccaggugcaugca

SEQ ID NO: 1797855 - RNA, 21 nt, Homo sapiens
agacgcccuauuucuauguca

SEQ ID NO: 1797856 - RNA, 13 nt, Homo sapiens
accucagggacaa

SEQ ID NO: 1797857 - RNA, 17 nt, Homo sapiens
ccaggauccugcaggaa

SEQ ID NO: 1797858 - RNA, 17 nt, Homo sapiens
augaagacccaguguaa

SEQ ID NO: 1797859 - RNA, 13 nt, Homo sapiens
cucuccagccauu

SEQ ID NO: 1797860 - RNA, 18 nt, Homo sapiens
agguuaugaaacauauca

SEQ ID NO: 1797861 - RNA, 20 nt, Homo sapiens
aagcccgcggggacauuggg

SEQ ID NO: 1797862 - RNA, 15 nt, Homo sapiens
agagagcggcuuccc

SEQ ID NO: 1797863 - RNA, 15 nt, Homo sapiens
guugaugucgaugcu

SEQ ID NO: 1797864 - RNA, 14 nt, Homo sapiens
gcagaaauacagua

SEQ ID NO: 1797865 - RNA, 17 nt, Homo sapiens
ugccuccagacaugugc

SEQ ID NO: 1797866 - RNA, 20 nt, Homo sapiens
uagaauaaucuugcucacag

SEQ ID NO: 1797867 - RNA, 22 nt, Homo sapiens
gaccugccugaacgcacaugac

SEQ ID NO: 1797868 - RNA, 21 nt, Homo sapiens
cugauggauaucccuaccuug

SEQ ID NO: 1797869 - RNA, 19 nt, Homo sapiens
aacagugaugaugcaugga

SEQ ID NO: 1797870 - RNA, 23 nt, Homo sapiens
cucugacgcaaaaccacuuuccu

SEQ ID NO: 1797871 - RNA, 23 nt, Homo sapiens
cuuuuuugaaaucaguaaacacu

SEQ ID NO: 1797872 - RNA, 19 nt, Homo sapiens
uucaaagacggaguauucu

SEQ ID NO: 1797873 - RNA, 19 nt, Homo sapiens
agaaauguuguucauuauu

SEQ ID NO: 1797874 - RNA, 23 nt, Homo sapiens
aagauaggacuaaaguugugcca

SEQ ID NO: 1797875 - RNA, 18 nt, Homo sapiens
auauuuucugcaauccaa

SEQ ID NO: 1797876 - RNA, 13 nt, Homo sapiens
cagcauguucuca

SEQ ID NO: 1797877 - RNA, 22 nt, Homo sapiens
uccgccaaucuggcccuuacac

SEQ ID NO: 1797878 - RNA, 21 nt, Homo sapiens
uucauaagcuuuguaauucag

SEQ ID NO: 1797879 - RNA, 23 nt, Homo sapiens
uggccuuccccagccucuucuag

SEQ ID NO: 1797880 - RNA, 18 nt, Homo sapiens
cucacucucccuggagcu

SEQ ID NO: 1797881 - RNA, 17 nt, Homo sapiens
auguguucauucuggaa

SEQ ID NO: 1797882 - RNA, 19 nt, Homo sapiens
auaggaacaauaagaacaa

SEQ ID NO: 1797883 - RNA, 19 nt, Homo sapiens
cugcucccucacccaggca

SEQ ID NO: 1797884 - RNA, 13 nt, Homo sapiens
caaaaauguaaca

SEQ ID NO: 1797885 - RNA, 20 nt, Homo sapiens
cccgacuaucccugcacaua

SEQ ID NO: 1797886 - RNA, 13 nt, Homo sapiens
gcuggcaccagaa

SEQ ID NO: 1797887 - RNA, 23 nt, Homo sapiens
cagauccuggaaacagcagugua

SEQ ID NO: 1797888 - RNA, 20 nt, Homo sapiens
aauauuuuauauuguuauau

SEQ ID NO: 1797889 - RNA, 20 nt, Homo sapiens
auaaauauuauuagauuuau

SEQ ID NO: 1797890 - RNA, 22 nt, Homo sapiens
cauccaggugggaggugucaga

SEQ ID NO: 1797891 - RNA, 19 nt, Homo sapiens
uguaaacguuucaguaaua

SEQ ID NO: 1797892 - RNA, 23 nt, Homo sapiens
gucucaccuggacuuaagcaucu

SEQ ID NO: 1797893 - RNA, 20 nt, Homo sapiens
cucacacuguaagaguucac

SEQ ID NO: 1797894 - RNA, 19 nt, Homo sapiens
uuuaauacagugagcucua

SEQ ID NO: 1797895 - RNA, 14 nt, Homo sapiens
aggagacacaucca

SEQ ID NO: 1797896 - RNA, 21 nt, Homo sapiens
cugcuugagcuuucugugcau

SEQ ID NO: 1797897 - RNA, 17 nt, Homo sapiens
ucaggagcuuuacucau

SEQ ID NO: 1797898 - RNA, 22 nt, Homo sapiens
gugggcuccugacaauacugua

SEQ ID NO: 1797899 - RNA, 13 nt, Homo sapiens
agaacuacauauu

SEQ ID NO: 1797900 - RNA, 20 nt, Homo sapiens
uuucaugccccggcugcaca

SEQ ID NO: 1797901 - RNA, 22 nt, Homo sapiens
auguugagggaagcuuccauaa

SEQ ID NO: 1797902 - RNA, 18 nt, Homo sapiens
cugauguguccucaggga

SEQ ID NO: 1797903 - RNA, 14 nt, Homo sapiens
auauauuauucuca

SEQ ID NO: 1797904 - RNA, 20 nt, Homo sapiens
gauuuucaauaauagacuua

SEQ ID NO: 1797905 - RNA, 20 nt, Homo sapiens
aauaaauuauacacuaugaa

SEQ ID NO: 1797906 - RNA, 11 nt, Homo sapiens
uguaaccacug

SEQ ID NO: 1797907 - RNA, 15 nt, Homo sapiens
uuuuaaauggcauga

SEQ ID NO: 1797908 - RNA, 23 nt, Homo sapiens
cucagcggcaaaauuaauggaca

SEQ ID NO: 1797909 - RNA, 14 nt, Homo sapiens
aacaaagaaugggc

SEQ ID NO: 1797910 - RNA, 19 nt, Homo sapiens
uccaacagcucaagucuuc

SEQ ID NO: 1797911 - RNA, 20 nt, Homo sapiens
auaacagaaagccuggguga

SEQ ID NO: 1797912 - RNA, 16 nt, Homo sapiens
uugaagcuguugcuau

SEQ ID NO: 1797913 - RNA, 19 nt, Homo sapiens
cauagccugcagccucauc

SEQ ID NO: 1797914 - RNA, 20 nt, Homo sapiens
uacucagcauuugauuaaca

SEQ ID NO: 1797915 - RNA, 15 nt, Homo sapiens
acauccucacuuuua

SEQ ID NO: 1797916 - RNA, 13 nt, Homo sapiens
agacuccaugaga

SEQ ID NO: 1797917 - RNA, 19 nt, Homo sapiens
cauacaggauuugaacuca

SEQ ID NO: 1797918 - RNA, 16 nt, Homo sapiens
uggggagaaaguacuu

SEQ ID NO: 1797919 - RNA, 17 nt, Homo sapiens
ucuuuuaccaguaugaa

SEQ ID NO: 1797920 - RNA, 16 nt, Homo sapiens
uacuauaaaaaacauu

SEQ ID NO: 1797921 - RNA, 19 nt, Homo sapiens
aauuauuccuugcuuucau

SEQ ID NO: 1797922 - RNA, 18 nt, Homo sapiens
ccuaagcagaccacugau

SEQ ID NO: 1797923 - RNA, 14 nt, Homo sapiens
guugucagcuuugg

SEQ ID NO: 1797924 - RNA, 16 nt, Homo sapiens
aaugaaaagcuuagga

SEQ ID NO: 1797925 - RNA, 23 nt, Homo sapiens
gcaaauguaguauggccuguguc

SEQ ID NO: 1797926 - RNA, 18 nt, Homo sapiens
uacuaguccugacacuga

SEQ ID NO: 1797927 - RNA, 20 nt, Homo sapiens
cuaacacagccaucaaggga

SEQ ID NO: 1797928 - RNA, 23 nt, Homo sapiens
auccuccccagcgccaucugugu

SEQ ID NO: 1797929 - RNA, 13 nt, Homo sapiens
augacaauggacc

SEQ ID NO: 1797930 - RNA, 18 nt, Homo sapiens
uagcucuuugggccucuc

SEQ ID NO: 1797931 - RNA, 14 nt, Homo sapiens
uguccaagugccac

SEQ ID NO: 1797932 - RNA, 20 nt, Homo sapiens
cacacugugacacacuacac

SEQ ID NO: 1797933 - RNA, 13 nt, Homo sapiens
uuagaaaugcaaa

SEQ ID NO: 1797934 - RNA, 21 nt, Homo sapiens
ugaguugccaagacaaaucaa

SEQ ID NO: 1797935 - RNA, 22 nt, Homo sapiens
cccagaugcucuccccuccucg

SEQ ID NO: 1797936 - RNA, 20 nt, Homo sapiens
ggcuccagaugcagggcagu

SEQ ID NO: 1797937 - RNA, 21 nt, Homo sapiens
cucaguaacagugcaguacuc

SEQ ID NO: 1797938 - RNA, 18 nt, Homo sapiens
guuuguccuugcaccuga

SEQ ID NO: 1797939 - RNA, 17 nt, Homo sapiens
uauuuaugccucuguau

SEQ ID NO: 1797940 - RNA, 17 nt, Homo sapiens
cuaaagugcugggauua

SEQ ID NO: 1797941 - RNA, 23 nt, Homo sapiens
aauguuaaguugauggugaugaa

SEQ ID NO: 1797942 - RNA, 17 nt, Homo sapiens
gaaauuuuuaaaucauu

SEQ ID NO: 1797943 - RNA, 13 nt, Homo sapiens
cugcuaccaaggc

SEQ ID NO: 1797944 - RNA, 17 nt, Homo sapiens
auuauaccgcagaguau

SEQ ID NO: 1797945 - RNA, 22 nt, Homo sapiens
acugcacccuggauuugcauac

SEQ ID NO: 1797946 - RNA, 18 nt, Homo sapiens
ucaaguaccucaucugca

SEQ ID NO: 1797947 - RNA, 14 nt, Homo sapiens
acccagagguccag

SEQ ID NO: 1797948 - RNA, 22 nt, Homo sapiens
uggaguagaauuaagucagagc

SEQ ID NO: 1797949 - RNA, 19 nt, Homo sapiens
cuugcuucaaccccaugag

SEQ ID NO: 1797950 - RNA, 18 nt, Homo sapiens
guguugguguauuugcca

SEQ ID NO: 1797951 - RNA, 21 nt, Homo sapiens
cuugagaaaccuuauuguacc

SEQ ID NO: 1797952 - RNA, 17 nt, Homo sapiens
cucgaaaaccaucacau

SEQ ID NO: 1797953 - RNA, 24 nt, Homo sapiens
gacacuggugguucuacugaccca

SEQ ID NO: 1797954 - RNA, 21 nt, Homo sapiens
gccaguggcuggaucugugag

SEQ ID NO: 1797955 - RNA, 16 nt, Homo sapiens
aacaggaaaccacuua

SEQ ID NO: 1797956 - RNA, 23 nt, Homo sapiens
gccauugaauuugccuuccucau

SEQ ID NO: 1797957 - RNA, 19 nt, Homo sapiens
ugagaagcuuugguucugc

SEQ ID NO: 1797958 - RNA, 23 nt, Homo sapiens
gcaugaugcgggccagugcucca

SEQ ID NO: 1797959 - RNA, 15 nt, Homo sapiens
guaggugguuuugaa

SEQ ID NO: 1797960 - RNA, 22 nt, Homo sapiens
ccagcccgacaggcaugcacca

SEQ ID NO: 1797961 - RNA, 19 nt, Homo sapiens
cuacuccccuuucuuccaa

SEQ ID NO: 1797962 - RNA, 23 nt, Homo sapiens
agguuaaaaucuuagaaaauuaa

SEQ ID NO: 1797963 - RNA, 22 nt, Homo sapiens
acacuacucuuacauguauaaa

SEQ ID NO: 1797964 - RNA, 14 nt, Homo sapiens
ccugaccucugcaa

SEQ ID NO: 1797965 - RNA, 17 nt, Homo sapiens
agaaagaacgugaucuc

SEQ ID NO: 1797966 - RNA, 22 nt, Homo sapiens
uaaaaccaucaaaaauauucca

SEQ ID NO: 1797967 - RNA, 12 nt, Homo sapiens
auguaauacuga

SEQ ID NO: 1797968 - RNA, 19 nt, Homo sapiens
ccuccucagaggacaguuu

SEQ ID NO: 1797969 - RNA, 15 nt, Homo sapiens
gggcuuaccagguga

SEQ ID NO: 1797970 - RNA, 20 nt, Homo sapiens
agugacuuugagcugagugc

SEQ ID NO: 1797971 - RNA, 13 nt, Homo sapiens
aaaauuagcaugg

SEQ ID NO: 1797972 - RNA, 23 nt, Homo sapiens
uucuaaaacuaaauagcauguau

SEQ ID NO: 1797973 - RNA, 23 nt, Homo sapiens
auaauaaacuucuggugugauac

SEQ ID NO: 1797974 - RNA, 12 nt, Homo sapiens
ggugagugugca

SEQ ID NO: 1797975 - RNA, 12 nt, Homo sapiens
guugaguguuca

SEQ ID NO: 1797976 - RNA, 12 nt, Homo sapiens
gcagaagugaug

SEQ ID NO: 1797977 - RNA, 21 nt, Homo sapiens
uuguagaggggcaacugauga

SEQ ID NO: 1797978 - RNA, 17 nt, Homo sapiens
acacaauucuucuucca

SEQ ID NO: 1797979 - RNA, 15 nt, Homo sapiens
ggugcaugaugcugc

SEQ ID NO: 1797980 - RNA, 18 nt, Homo sapiens
cacccugcgggccagggu

SEQ ID NO: 1797981 - RNA, 15 nt, Homo sapiens
aggaagaucaggcca

SEQ ID NO: 1797982 - RNA, 22 nt, Homo sapiens
aucuuauuuaauuuuugcaauu

SEQ ID NO: 1797983 - RNA, 22 nt, Homo sapiens
cguccuuuaaagugcugcagua

SEQ ID NO: 1797984 - RNA, 21 nt, Homo sapiens
acauugagaucacuacucagu

SEQ ID NO: 1797985 - RNA, 19 nt, Homo sapiens
caaguaucuaaauuuggaa

SEQ ID NO: 1797986 - RNA, 13 nt, Homo sapiens
aggcaugaaauga

SEQ ID NO: 1797987 - RNA, 14 nt, Homo sapiens
acucuccuagugac

SEQ ID NO: 1797988 - RNA, 19 nt, Homo sapiens
acccuggauggggcuucca

SEQ ID NO: 1797989 - RNA, 15 nt, Homo sapiens
gaucauuucugccau

SEQ ID NO: 1797990 - RNA, 21 nt, Homo sapiens
gaagaggccaguaggagacac

SEQ ID NO: 1797991 - RNA, 12 nt, Homo sapiens
uucaccaugaug

SEQ ID NO: 1797992 - RNA, 12 nt, Homo sapiens
cagaagcccuga

SEQ ID NO: 1797993 - RNA, 22 nt, Homo sapiens
cuugaagauuucucugagauca

SEQ ID NO: 1797994 - RNA, 19 nt, Homo sapiens
uugaugucaagcaaugggg

SEQ ID NO: 1797995 - RNA, 15 nt, Homo sapiens
auccuuaacugucca

SEQ ID NO: 1797996 - RNA, 14 nt, Homo sapiens
aaagcuucugcaau

SEQ ID NO: 1797997 - RNA, 19 nt, Homo sapiens
aaacccugucucuacuaaa

SEQ ID NO: 1797998 - RNA, 21 nt, Homo sapiens
cugucacuaaauggcagugag

SEQ ID NO: 1797999 - RNA, 14 nt, Homo sapiens
aacaggcauuccag

SEQ ID NO: 1798000 - RNA, 17 nt, Homo sapiens
cgcuuaucaacuaauga

SEQ ID NO: 1798001 - RNA, 13 nt, Homo sapiens
gggcgacugugaa

SEQ ID NO: 1798002 - RNA, 19 nt, Homo sapiens
acuccucggccuggcuccu

SEQ ID NO: 1798003 - RNA, 18 nt, Homo sapiens
ugaacuggccucugccuu

SEQ ID NO: 1798004 - RNA, 19 nt, Homo sapiens
uccucaaauacaugcacag

SEQ ID NO: 1798005 - RNA, 20 nt, Homo sapiens
aauauaaaguugguucacuu

SEQ ID NO: 1798006 - RNA, 23 nt, Homo sapiens
gaaauuuagcauuguagugcuuu

SEQ ID NO: 1798007 - RNA, 17 nt, Homo sapiens
gagcagugcagccacca

SEQ ID NO: 1798008 - RNA, 19 nt, Homo sapiens
ucugaucaguuuccuccaa

SEQ ID NO: 1798009 - RNA, 15 nt, Homo sapiens
uaaacaaaaagccaa

SEQ ID NO: 1798010 - RNA, 23 nt, Homo sapiens
aacaaugcaguacaggacauaua

SEQ ID NO: 1798011 - RNA, 17 nt, Homo sapiens
uauugucauugucacaa

SEQ ID NO: 1798012 - RNA, 17 nt, Homo sapiens
auuggaagauuauugag

SEQ ID NO: 1798013 - RNA, 13 nt, Homo sapiens
ggccugcuccaga

SEQ ID NO: 1798014 - RNA, 14 nt, Homo sapiens
ugcggaagccaaag

SEQ ID NO: 1798015 - RNA, 17 nt, Homo sapiens
ugcaagagacucuggcc

SEQ ID NO: 1798016 - RNA, 23 nt, Homo sapiens
guuaaacuacucuugaauuccug

SEQ ID NO: 1798017 - RNA, 21 nt, Homo sapiens
cgaaauauuacaguagugcau

SEQ ID NO: 1798018 - RNA, 16 nt, Homo sapiens
gccacagcagccacuu

SEQ ID NO: 1798019 - RNA, 19 nt, Homo sapiens
cggcuuccuacagccagca

SEQ ID NO: 1798020 - RNA, 12 nt, Homo sapiens
caauacugccuu

SEQ ID NO: 1798021 - RNA, 16 nt, Homo sapiens
gcccagcccuccuuca

SEQ ID NO: 1798022 - RNA, 16 nt, Homo sapiens
auaaauaaacuucaac

SEQ ID NO: 1798023 - RNA, 17 nt, Homo sapiens
aaaguaaauacaugcau

SEQ ID NO: 1798024 - RNA, 15 nt, Homo sapiens
acucauugucucagu

SEQ ID NO: 1798025 - RNA, 15 nt, Homo sapiens
uuucuuagauucuga

SEQ ID NO: 1798026 - RNA, 23 nt, Homo sapiens
cugccaccccuuggcacugugga

SEQ ID NO: 1798027 - RNA, 23 nt, Homo sapiens
gauuacucgaucaaaaccuuccu

SEQ ID NO: 1798028 - RNA, 17 nt, Homo sapiens
auacgauuugagccuga

SEQ ID NO: 1798029 - RNA, 15 nt, Homo sapiens
gcagugagcuucuau

SEQ ID NO: 1798030 - RNA, 18 nt, Homo sapiens
acaaugcagugccuuucu

SEQ ID NO: 1798031 - RNA, 16 nt, Homo sapiens
cugagcgaggagugac

SEQ ID NO: 1798032 - RNA, 14 nt, Homo sapiens
acagacaugaacug

SEQ ID NO: 1798033 - RNA, 20 nt, Homo sapiens
uguaaaaaccuucccauaaa

SEQ ID NO: 1798034 - RNA, 17 nt, Homo sapiens
acacaguuguugaauga

SEQ ID NO: 1798035 - RNA, 18 nt, Homo sapiens
ucaauucagugauggcaa

SEQ ID NO: 1798036 - RNA, 15 nt, Homo sapiens
acaacaugcacauuc

SEQ ID NO: 1798037 - RNA, 14 nt, Homo sapiens
cugauccugugaag

SEQ ID NO: 1798038 - RNA, 14 nt, Homo sapiens
auacauauguagcu

SEQ ID NO: 1798039 - RNA, 14 nt, Homo sapiens
aucaagucugugaa

SEQ ID NO: 1798040 - RNA, 15 nt, Homo sapiens
cagccugguuugcaa

SEQ ID NO: 1798041 - RNA, 14 nt, Homo sapiens
ugcacacauuucug

SEQ ID NO: 1798042 - RNA, 19 nt, Homo sapiens
acugagcugagaccacuga

SEQ ID NO: 1798043 - RNA, 15 nt, Homo sapiens
gcugaauucacuuaa

SEQ ID NO: 1798044 - RNA, 23 nt, Homo sapiens
caagaccuuucaaagccauuuua

SEQ ID NO: 1798045 - RNA, 20 nt, Homo sapiens
ugcugucuccaugcuggaua

SEQ ID NO: 1798046 - RNA, 19 nt, Homo sapiens
aucuuagggaacuuugaua

SEQ ID NO: 1798047 - RNA, 11 nt, Homo sapiens
cauucuucagu

SEQ ID NO: 1798048 - RNA, 11 nt, Homo sapiens
aggucuuccag

SEQ ID NO: 1798049 - RNA, 20 nt, Homo sapiens
agagacacugagccagucuu

SEQ ID NO: 1798050 - RNA, 14 nt, Homo sapiens
acacagaccaccau

SEQ ID NO: 1798051 - RNA, 15 nt, Homo sapiens
ccuucuaccuugaau

SEQ ID NO: 1798052 - RNA, 15 nt, Homo sapiens
uagcucugccuuacc

SEQ ID NO: 1798053 - RNA, 15 nt, Homo sapiens
ccaaaaauggcagug

SEQ ID NO: 1798054 - RNA, 16 nt, Homo sapiens
uagccaucauaacuca

SEQ ID NO: 1798055 - RNA, 17 nt, Homo sapiens
ccauauuugauaguaua

SEQ ID NO: 1798056 - RNA, 17 nt, Homo sapiens
cccauucagacacuuca

SEQ ID NO: 1798057 - RNA, 14 nt, Homo sapiens
caucuugucauuuu

SEQ ID NO: 1798058 - RNA, 18 nt, Homo sapiens
cuuugcagugagugcugc

SEQ ID NO: 1798059 - RNA, 19 nt, Homo sapiens
guucccccuaaacauggcu

SEQ ID NO: 1798060 - RNA, 18 nt, Homo sapiens
acucaucuaaaaauggau

SEQ ID NO: 1798061 - RNA, 20 nt, Homo sapiens
agucacuuauaauuaugcua

SEQ ID NO: 1798062 - RNA, 23 nt, Homo sapiens
aaaauuagccagaugugguggca

SEQ ID NO: 1798063 - RNA, 17 nt, Homo sapiens
acaggccugagauuuca

SEQ ID NO: 1798064 - RNA, 18 nt, Homo sapiens
uuagcagcugacuuucaa

SEQ ID NO: 1798065 - RNA, 21 nt, Homo sapiens
cugagggucacaguaccuuga

SEQ ID NO: 1798066 - RNA, 16 nt, Homo sapiens
ugugucagccaugacc

SEQ ID NO: 1798067 - RNA, 14 nt, Homo sapiens
cuaagauggcuuuu

SEQ ID NO: 1798068 - RNA, 15 nt, Homo sapiens
acauuugcaaaaugg

SEQ ID NO: 1798069 - RNA, 17 nt, Homo sapiens
uaaccguuuuucaagaa

SEQ ID NO: 1798070 - RNA, 17 nt, Homo sapiens
caaaccgagugcaauga

SEQ ID NO: 1798071 - RNA, 14 nt, Homo sapiens
aggccuugagcaca

SEQ ID NO: 1798072 - RNA, 22 nt, Homo sapiens
cuggaauuacaaaacucagaga

SEQ ID NO: 1798073 - RNA, 16 nt, Homo sapiens
acuguauucgugcauu

SEQ ID NO: 1798074 - RNA, 14 nt, Homo sapiens
auauguagcucauc

SEQ ID NO: 1798075 - RNA, 16 nt, Homo sapiens
gcuagcuuucuccuua

SEQ ID NO: 1798076 - RNA, 20 nt, Homo sapiens
aguuucuauggauucacuuc

SEQ ID NO: 1798077 - RNA, 19 nt, Homo sapiens
aaacuccugugucugugua

SEQ ID NO: 1798078 - RNA, 17 nt, Homo sapiens
accuaguagucauuuca

SEQ ID NO: 1798079 - RNA, 15 nt, Homo sapiens
aauuuuaucaugcca

SEQ ID NO: 1798080 - RNA, 19 nt, Homo sapiens
aaacuccaaacauccucuu

SEQ ID NO: 1798081 - RNA, 16 nt, Homo sapiens
uaauaaauauuuaguc

SEQ ID NO: 1798082 - RNA, 19 nt, Homo sapiens
ggaaaagcaaaacuguagg

SEQ ID NO: 1798083 - RNA, 17 nt, Homo sapiens
auauauagaauuguaga

SEQ ID NO: 1798084 - RNA, 17 nt, Homo sapiens
uguacgauucacuccuu

SEQ ID NO: 1798085 - RNA, 14 nt, Homo sapiens
ccugugaccagcac

SEQ ID NO: 1798086 - RNA, 21 nt, Homo sapiens
auggaaaaugucaaccuuugu

SEQ ID NO: 1798087 - RNA, 15 nt, Homo sapiens
gcugcugaaacugug

SEQ ID NO: 1798088 - RNA, 14 nt, Homo sapiens
gcagcgcgugcaca

SEQ ID NO: 1798089 - RNA, 15 nt, Homo sapiens
gauaauuagcaguau

SEQ ID NO: 1798090 - RNA, 20 nt, Homo sapiens
gaaggcaaagagaccacuca

SEQ ID NO: 1798091 - RNA, 14 nt, Homo sapiens
aaacauuugccaag

SEQ ID NO: 1798092 - RNA, 18 nt, Homo sapiens
aucuagcauagcacaaac

SEQ ID NO: 1798093 - RNA, 22 nt, Homo sapiens
gcuggcaccuuaguugcaugac

SEQ ID NO: 1798094 - RNA, 15 nt, Homo sapiens
acauugauaauucaa

SEQ ID NO: 1798095 - RNA, 15 nt, Homo sapiens
ccugugaucaagcaa

SEQ ID NO: 1798096 - RNA, 12 nt, Homo sapiens
ggagcucuccac

SEQ ID NO: 1798097 - RNA, 18 nt, Homo sapiens
acucccugcugugugacu

SEQ ID NO: 1798098 - RNA, 15 nt, Homo sapiens
uaugguucucaggcc

SEQ ID NO: 1798099 - RNA, 23 nt, Homo sapiens
ugacuguaaacauagauagugcu

SEQ ID NO: 1798100 - RNA, 21 nt, Homo sapiens
aucugggugggauaauggacu

SEQ ID NO: 1798101 - RNA, 17 nt, Homo sapiens
gugacaaugguuucacc

SEQ ID NO: 1798102 - RNA, 17 nt, Homo sapiens
uugaccccuuccuccag

SEQ ID NO: 1798103 - RNA, 15 nt, Homo sapiens
ugggaacuccacucu

SEQ ID NO: 1798104 - RNA, 18 nt, Homo sapiens
gcaagaaaagcgcagaga

SEQ ID NO: 1798105 - RNA, 23 nt, Homo sapiens
ccugaaagucccagaucaagccu

SEQ ID NO: 1798106 - RNA, 13 nt, Homo sapiens
cagcaaagcaaca

SEQ ID NO: 1798107 - RNA, 18 nt, Homo sapiens
ucauggcuuuguauccaa

SEQ ID NO: 1798108 - RNA, 20 nt, Homo sapiens
ccaccuggaccccugcauug

SEQ ID NO: 1798109 - RNA, 14 nt, Homo sapiens
gaaacaauguggag

SEQ ID NO: 1798110 - RNA, 19 nt, Homo sapiens
agcugugacauauucugag

SEQ ID NO: 1798111 - RNA, 16 nt, Homo sapiens
uaauauuuuuagcucu

SEQ ID NO: 1798112 - RNA, 19 nt, Homo sapiens
auggccaggccucagggac

SEQ ID NO: 1798113 - RNA, 17 nt, Homo sapiens
acucaccugcacuaaca

SEQ ID NO: 1798114 - RNA, 20 nt, Homo sapiens
ugaacuccugaccucaggua

SEQ ID NO: 1798115 - RNA, 13 nt, Homo sapiens
ggcagccacgugc

SEQ ID NO: 1798116 - RNA, 13 nt, Homo sapiens
cacuccacagugu

SEQ ID NO: 1798117 - RNA, 20 nt, Homo sapiens
uaaugcaaacugggaugaaa

SEQ ID NO: 1798118 - RNA, 21 nt, Homo sapiens
ugugguaggcacuguacuuaa

SEQ ID NO: 1798119 - RNA, 13 nt, Homo sapiens
uccaaucugugau

SEQ ID NO: 1798120 - RNA, 13 nt, Homo sapiens
guagaacugagaa

SEQ ID NO: 1798121 - RNA, 23 nt, Homo sapiens
cugcagaggggaaaccaguguag

SEQ ID NO: 1798122 - RNA, 11 nt, Homo sapiens
ugaaauggagu

SEQ ID NO: 1798123 - RNA, 15 nt, Homo sapiens
aggcuacuguaaggc

SEQ ID NO: 1798124 - RNA, 20 nt, Homo sapiens
aaaccccaucucuacuaaaa

SEQ ID NO: 1798125 - RNA, 15 nt, Homo sapiens
ggagaaaaaaacuuc

SEQ ID NO: 1798126 - RNA, 18 nt, Homo sapiens
ucaugugcuuuguagcuu

SEQ ID NO: 1798127 - RNA, 12 nt, Homo sapiens
caaugauucagc

SEQ ID NO: 1798128 - RNA, 13 nt, Homo sapiens
uuauuaugucuca

SEQ ID NO: 1798129 - RNA, 21 nt, Homo sapiens
acuaaaugguugucuggguca

SEQ ID NO: 1798130 - RNA, 15 nt, Homo sapiens
ucaaagugugacauu

SEQ ID NO: 1798131 - RNA, 19 nt, Homo sapiens
gaccucucucaaagugcug

SEQ ID NO: 1798132 - RNA, 21 nt, Homo sapiens
aacucuagaugguaugccucu

SEQ ID NO: 1798133 - RNA, 21 nt, Homo sapiens
acuuaagcaucuggcucuaau

SEQ ID NO: 1798134 - RNA, 22 nt, Homo sapiens
ucccgcccuuccaugugccuuu

SEQ ID NO: 1798135 - RNA, 18 nt, Homo sapiens
ugacauccccacccuugg

SEQ ID NO: 1798136 - RNA, 14 nt, Homo sapiens
ucucaugauuauua

SEQ ID NO: 1798137 - RNA, 17 nt, Homo sapiens
accacugcacuccaguc

SEQ ID NO: 1798138 - RNA, 14 nt, Homo sapiens
ucuaacgcaaaaau

SEQ ID NO: 1798139 - RNA, 19 nt, Homo sapiens
ggucagaacagagccuuug

SEQ ID NO: 1798140 - RNA, 16 nt, Homo sapiens
aucaagauacacuugu

SEQ ID NO: 1798141 - RNA, 22 nt, Homo sapiens
agacuauaagcagaagcacaua

SEQ ID NO: 1798142 - RNA, 20 nt, Homo sapiens
cagauuccccaggaaucuug

SEQ ID NO: 1798143 - RNA, 18 nt, Homo sapiens
aaagagcagccuggcuaa

SEQ ID NO: 1798144 - RNA, 17 nt, Homo sapiens
cagcuaguccuagugaa

SEQ ID NO: 1798145 - RNA, 21 nt, Homo sapiens
ugcagcaucuacuacucuguc

SEQ ID NO: 1798146 - RNA, 24 nt, Homo sapiens
acugcacacagggugguggcacau

SEQ ID NO: 1798147 - RNA, 21 nt, Homo sapiens
cuccaccuaccacucacauga

SEQ ID NO: 1798148 - RNA, 14 nt, Homo sapiens
cuuugcccuaccuu

SEQ ID NO: 1798149 - RNA, 17 nt, Homo sapiens
uaagcucgagugaauuu

SEQ ID NO: 1798150 - RNA, 13 nt, Homo sapiens
aaaauaccagcug

SEQ ID NO: 1798151 - RNA, 14 nt, Homo sapiens
aagaaucaccucaa

SEQ ID NO: 1798152 - RNA, 12 nt, Homo sapiens
auaaaaaacauc

SEQ ID NO: 1798153 - RNA, 23 nt, Homo sapiens
gccaggucacccuuugcugugag

SEQ ID NO: 1798154 - RNA, 15 nt, Homo sapiens
cagcucaaccacagu

SEQ ID NO: 1798155 - RNA, 17 nt, Homo sapiens
augcaguacguucucag

SEQ ID NO: 1798156 - RNA, 15 nt, Homo sapiens
ucagaccgucuuccu

SEQ ID NO: 1798157 - RNA, 23 nt, Homo sapiens
agaaauagugcacuccaagaaac

SEQ ID NO: 1798158 - RNA, 21 nt, Homo sapiens
accuguguauggugaccucuc

SEQ ID NO: 1798159 - RNA, 22 nt, Homo sapiens
aggcagaaacacaaccacucac

SEQ ID NO: 1798160 - RNA, 16 nt, Homo sapiens
ucagggcaugcuuauu

SEQ ID NO: 1798161 - RNA, 13 nt, Homo sapiens
uuaugaucuuggc

SEQ ID NO: 1798162 - RNA, 18 nt, Homo sapiens
cccuuuuuuuacauuuca

SEQ ID NO: 1798163 - RNA, 15 nt, Homo sapiens
ugcccaucccagugu

SEQ ID NO: 1798164 - RNA, 20 nt, Homo sapiens
auaugucucaggucccugca

SEQ ID NO: 1798165 - RNA, 22 nt, Homo sapiens
acacagaggacggcuuccccau

SEQ ID NO: 1798166 - RNA, 14 nt, Homo sapiens
cuggugaugguccc

SEQ ID NO: 1798167 - RNA, 22 nt, Homo sapiens
aauggauacaugguuaaaggau

SEQ ID NO: 1798168 - RNA, 21 nt, Homo sapiens
gcucagagacugcaagcugcu

SEQ ID NO: 1798169 - RNA, 20 nt, Homo sapiens
ugcaaggcccucuauuucuc

SEQ ID NO: 1798170 - RNA, 12 nt, Homo sapiens
ugacaaaccauc

SEQ ID NO: 1798171 - RNA, 13 nt, Homo sapiens
ccuacccaguucc

SEQ ID NO: 1798172 - RNA, 16 nt, Homo sapiens
cuaccuaguuuguuag

SEQ ID NO: 1798173 - RNA, 19 nt, Homo sapiens
ugcccaggagaaaagaaga

SEQ ID NO: 1798174 - RNA, 17 nt, Homo sapiens
ccacggggucugcagca

SEQ ID NO: 1798175 - RNA, 15 nt, Homo sapiens
augcaaaacauuuca

SEQ ID NO: 1798176 - RNA, 19 nt, Homo sapiens
uuuugucuaugggacucaa

SEQ ID NO: 1798177 - RNA, 15 nt, Homo sapiens
gcuuggcaucugugu

SEQ ID NO: 1798178 - RNA, 18 nt, Homo sapiens
aggccccugucucagggu

SEQ ID NO: 1798179 - RNA, 22 nt, Homo sapiens
gagauccacccccaagcacucc

SEQ ID NO: 1798180 - RNA, 16 nt, Homo sapiens
cccagaaaguccagcu

SEQ ID NO: 1798181 - RNA, 17 nt, Homo sapiens
cacgcucgcugccauca

SEQ ID NO: 1798182 - RNA, 13 nt, Homo sapiens
augucaucaaaua

SEQ ID NO: 1798183 - RNA, 18 nt, Homo sapiens
agcccaggcacaacuuca

SEQ ID NO: 1798184 - RNA, 23 nt, Homo sapiens
auguuaauugggcaggugaaaag

SEQ ID NO: 1798185 - RNA, 23 nt, Homo sapiens
aaugaccucauguccuucuuguc

SEQ ID NO: 1798186 - RNA, 17 nt, Homo sapiens
cugauccagaugcccag

SEQ ID NO: 1798187 - RNA, 15 nt, Homo sapiens
cagagaaaaugagaa

SEQ ID NO: 1798188 - RNA, 15 nt, Homo sapiens
auuuucaacauuuca

SEQ ID NO: 1798189 - RNA, 15 nt, Homo sapiens
aauggaaacuuggaa

SEQ ID NO: 1798190 - RNA, 15 nt, Homo sapiens
cugccauaaagccau

SEQ ID NO: 1798191 - RNA, 14 nt, Homo sapiens
gccacacagcagcg

SEQ ID NO: 1798192 - RNA, 21 nt, Homo sapiens
uccuaugagagaagagaguau

SEQ ID NO: 1798193 - RNA, 14 nt, Homo sapiens
gaauuuagaccuuu

SEQ ID NO: 1798194 - RNA, 18 nt, Homo sapiens
uaaauuuuuuuguaugaa

SEQ ID NO: 1798195 - RNA, 23 nt, Homo sapiens
ugcuaauacagguccugcacauu

SEQ ID NO: 1798196 - RNA, 23 nt, Homo sapiens
caguuuaaggaacuucugaagau

SEQ ID NO: 1798197 - RNA, 21 nt, Homo sapiens
aggcacaucaacugaucucau

SEQ ID NO: 1798198 - RNA, 23 nt, Homo sapiens
agagaaaccgggagaaggcauga

SEQ ID NO: 1798199 - RNA, 17 nt, Homo sapiens
uauagacacacauacau

SEQ ID NO: 1798200 - RNA, 17 nt, Homo sapiens
cuaaacuacaacgaaca

SEQ ID NO: 1798201 - RNA, 21 nt, Homo sapiens
aagccuuuagagccagcccau

SEQ ID NO: 1798202 - RNA, 14 nt, Homo sapiens
cauuaauacuguag

SEQ ID NO: 1798203 - RNA, 21 nt, Homo sapiens
cuuaccagaucuaauauugac

SEQ ID NO: 1798204 - RNA, 15 nt, Homo sapiens
ucuuauauuucauau

SEQ ID NO: 1798205 - RNA, 14 nt, Homo sapiens
uaaugcuucauuca

SEQ ID NO: 1798206 - RNA, 17 nt, Homo sapiens
agauauuuuuagaauuu

SEQ ID NO: 1798207 - RNA, 13 nt, Homo sapiens
agagcccagcucc

SEQ ID NO: 1798208 - RNA, 22 nt, Homo sapiens
cauguauauuuuauaugaaaga

SEQ ID NO: 1798209 - RNA, 17 nt, Homo sapiens
uucagcucccacacaca

SEQ ID NO: 1798210 - RNA, 20 nt, Homo sapiens
aaaugcuuagacucuugaag

SEQ ID NO: 1798211 - RNA, 20 nt, Homo sapiens
gcccuaggacaggaggagcu

SEQ ID NO: 1798212 - RNA, 20 nt, Homo sapiens
uuuucuaaaaaaagaaaaaa

SEQ ID NO: 1798213 - RNA, 21 nt, Homo sapiens
ucaucugccggcccccaggac

SEQ ID NO: 1798214 - RNA, 18 nt, Homo sapiens
auuaauuuuuaaggaugu

SEQ ID NO: 1798215 - RNA, 16 nt, Homo sapiens
acacgccaaugcacac

SEQ ID NO: 1798216 - RNA, 17 nt, Homo sapiens
uauuaaauuagacuucc

SEQ ID NO: 1798217 - RNA, 15 nt, Homo sapiens
ucacucgaacccggg

SEQ ID NO: 1798218 - RNA, 18 nt, Homo sapiens
gugggcuccggcacccac

SEQ ID NO: 1798219 - RNA, 11 nt, Homo sapiens
ucuggcagcuc

SEQ ID NO: 1798220 - RNA, 11 nt, Homo sapiens
uccggcagcuu

SEQ ID NO: 1798221 - RNA, 20 nt, Homo sapiens
uaagacaaccccagccaauc

SEQ ID NO: 1798222 - RNA, 20 nt, Homo sapiens
ucaauacacucaagugccau

SEQ ID NO: 1798223 - RNA, 23 nt, Homo sapiens
ucuggcuccccaaggcugcaaag

SEQ ID NO: 1798224 - RNA, 17 nt, Homo sapiens
aauaauugcaaauaucc

SEQ ID NO: 1798225 - RNA, 18 nt, Homo sapiens
cagaauauugacaagcua

SEQ ID NO: 1798226 - RNA, 16 nt, Homo sapiens
uguagcguguuuacau

SEQ ID NO: 1798227 - RNA, 23 nt, Homo sapiens
agauauacauaucaaguauguug

SEQ ID NO: 1798228 - RNA, 19 nt, Homo sapiens
cugcagauagaaagcauua

SEQ ID NO: 1798229 - RNA, 18 nt, Homo sapiens
ugccugugcuacaauuca

SEQ ID NO: 1798230 - RNA, 18 nt, Homo sapiens
auggaagguuagguuugu

SEQ ID NO: 1798231 - RNA, 21 nt, Homo sapiens
gacaaauuagcaugcaagcuu

SEQ ID NO: 1798232 - RNA, 13 nt, Homo sapiens
aacaauccauuca

SEQ ID NO: 1798233 - RNA, 17 nt, Homo sapiens
aaaggccagagucacag

SEQ ID NO: 1798234 - RNA, 21 nt, Homo sapiens
cuuucacugagccuccacagc

SEQ ID NO: 1798235 - RNA, 18 nt, Homo sapiens
ugccagcuauaaucuccc

SEQ ID NO: 1798236 - RNA, 21 nt, Homo sapiens
cuuucuuuaacauaucauuca

SEQ ID NO: 1798237 - RNA, 22 nt, Homo sapiens
ccuggagaagaauggcuuucaa

SEQ ID NO: 1798238 - RNA, 18 nt, Homo sapiens
aaaguaauaaauuccaau

SEQ ID NO: 1798239 - RNA, 18 nt, Homo sapiens
caagcuuguuaucagcuu

SEQ ID NO: 1798240 - RNA, 18 nt, Homo sapiens
uuuucaaagguacuugga

SEQ ID NO: 1798241 - RNA, 14 nt, Homo sapiens
uauuuaagacauaa

SEQ ID NO: 1798242 - RNA, 16 nt, Homo sapiens
ccuggguggcuacucu

SEQ ID NO: 1798243 - RNA, 18 nt, Homo sapiens
uggucaggcuggucucaa

SEQ ID NO: 1798244 - RNA, 21 nt, Homo sapiens
caugcacuuaaagaaguauuu

SEQ ID NO: 1798245 - RNA, 13 nt, Homo sapiens
uagcugagcacag

SEQ ID NO: 1798246 - RNA, 20 nt, Homo sapiens
uaaguaccccugauaagcaa

SEQ ID NO: 1798247 - RNA, 15 nt, Homo sapiens
cagaucccacuugca

SEQ ID NO: 1798248 - RNA, 18 nt, Homo sapiens
uuccugacuggcaaagga

SEQ ID NO: 1798249 - RNA, 17 nt, Homo sapiens
cuggacugccggcucua

SEQ ID NO: 1798250 - RNA, 14 nt, Homo sapiens
gcuagcuuuccaau

SEQ ID NO: 1798251 - RNA, 21 nt, Homo sapiens
uaaauaaacaucugaucugua

SEQ ID NO: 1798252 - RNA, 14 nt, Homo sapiens
auuuggaggcaauc

SEQ ID NO: 1798253 - RNA, 16 nt, Homo sapiens
uggguauguguuuauu

SEQ ID NO: 1798254 - RNA, 14 nt, Homo sapiens
caagucaguucugu

SEQ ID NO: 1798255 - RNA, 15 nt, Homo sapiens
gaaggucacuacugc

SEQ ID NO: 1798256 - RNA, 16 nt, Homo sapiens
uuuaacuugaggguaa

SEQ ID NO: 1798257 - RNA, 18 nt, Homo sapiens
ccauccuucccuuuggag

SEQ ID NO: 1798258 - RNA, 15 nt, Homo sapiens
accagagcauuucca

SEQ ID NO: 1798259 - RNA, 21 nt, Homo sapiens
accgggccacuccuuccugcc

SEQ ID NO: 1798260 - RNA, 19 nt, Homo sapiens
agaauguuaaaaagugaaa

SEQ ID NO: 1798261 - RNA, 22 nt, Homo sapiens
cuuuucuaguuuuauacaaaga

SEQ ID NO: 1798262 - RNA, 16 nt, Homo sapiens
uggacagccugaguca

SEQ ID NO: 1798263 - RNA, 16 nt, Homo sapiens
ucauucagcagucagu

SEQ ID NO: 1798264 - RNA, 18 nt, Homo sapiens
accaaguuuuauugucaa

SEQ ID NO: 1798265 - RNA, 14 nt, Homo sapiens
gaaaucaaacugcu

SEQ ID NO: 1798266 - RNA, 14 nt, Homo sapiens
gaagucaaacuacu

SEQ ID NO: 1798267 - RNA, 14 nt, Homo sapiens
caagucuaguggaa

SEQ ID NO: 1798268 - RNA, 13 nt, Homo sapiens
ccacuuaucagug

SEQ ID NO: 1798269 - RNA, 22 nt, Homo sapiens
acuuaguacuaucugugcguag

SEQ ID NO: 1798270 - RNA, 21 nt, Homo sapiens
ucaaaggccagagucacagga

SEQ ID NO: 1798271 - RNA, 13 nt, Homo sapiens
ucugccauuugcu

SEQ ID NO: 1798272 - RNA, 14 nt, Homo sapiens
uccggcacacugcc

SEQ ID NO: 1798273 - RNA, 17 nt, Homo sapiens
uguacauuagucauuca

SEQ ID NO: 1798274 - RNA, 17 nt, Homo sapiens
gaagaagugagcagugu

SEQ ID NO: 1798275 - RNA, 17 nt, Homo sapiens
aagccaggaaagcguuu

SEQ ID NO: 1798276 - RNA, 20 nt, Homo sapiens
cucaaauacaugcacaguca

SEQ ID NO: 1798277 - RNA, 14 nt, Homo sapiens
cauugaguccagcu

SEQ ID NO: 1798278 - RNA, 19 nt, Homo sapiens
gauagcuauuuucuuacag

SEQ ID NO: 1798279 - RNA, 12 nt, Homo sapiens
uaaucuacuuuc

SEQ ID NO: 1798280 - RNA, 18 nt, Homo sapiens
uaagaaaaaaacuugucu

SEQ ID NO: 1798281 - RNA, 13 nt, Homo sapiens
uuaucugcaccua

SEQ ID NO: 1798282 - RNA, 13 nt, Homo sapiens
aucugcaaaaugg

SEQ ID NO: 1798283 - RNA, 14 nt, Homo sapiens
cuuggcugcuuaaa

SEQ ID NO: 1798284 - RNA, 22 nt, Homo sapiens
gcugucacaauuauuaccaucu

SEQ ID NO: 1798285 - RNA, 15 nt, Homo sapiens
uggccuggaccauuc

SEQ ID NO: 1798286 - RNA, 17 nt, Homo sapiens
guuggguucacuugcca

SEQ ID NO: 1798287 - RNA, 22 nt, Homo sapiens
uucccugaauguauugaacuug

SEQ ID NO: 1798288 - RNA, 16 nt, Homo sapiens
gagccaggacugugga

SEQ ID NO: 1798289 - RNA, 17 nt, Homo sapiens
aguaaauacagcaauua

SEQ ID NO: 1798290 - RNA, 20 nt, Homo sapiens
uccaaggccccaccuucuau

SEQ ID NO: 1798291 - RNA, 19 nt, Homo sapiens
uucuauuacuuauuguaug

SEQ ID NO: 1798292 - RNA, 22 nt, Homo sapiens
augagcagaaggaaacaaaaaa

SEQ ID NO: 1798293 - RNA, 15 nt, Homo sapiens
gccuguguucuuccu

SEQ ID NO: 1798294 - RNA, 13 nt, Homo sapiens
auuacugauauca

SEQ ID NO: 1798295 - RNA, 12 nt, Homo sapiens
caugcacugagg

SEQ ID NO: 1798296 - RNA, 18 nt, Homo sapiens
ccaaaguccucugcucca

SEQ ID NO: 1798297 - RNA, 14 nt, Homo sapiens
guaauccagcaaua

SEQ ID NO: 1798298 - RNA, 21 nt, Homo sapiens
auaauuuucuaccuggucucu

SEQ ID NO: 1798299 - RNA, 23 nt, Homo sapiens
ugcucucaaaaugugaacugacu

SEQ ID NO: 1798300 - RNA, 22 nt, Homo sapiens
cuuugauacagucaacaagccu

SEQ ID NO: 1798301 - RNA, 19 nt, Homo sapiens
gcgucaugacgugcaugag

SEQ ID NO: 1798302 - RNA, 14 nt, Homo sapiens
guacagugagccaa

SEQ ID NO: 1798303 - RNA, 18 nt, Homo sapiens
auggcacaugauaugagu

SEQ ID NO: 1798304 - RNA, 16 nt, Homo sapiens
uguauuucuagcauua

SEQ ID NO: 1798305 - RNA, 17 nt, Homo sapiens
uaaacuagaugaccuca

SEQ ID NO: 1798306 - RNA, 13 nt, Homo sapiens
acacacagaugca

SEQ ID NO: 1798307 - RNA, 14 nt, Homo sapiens
uacuaccguuauac

SEQ ID NO: 1798308 - RNA, 20 nt, Homo sapiens
ccccugcggucaggcugggc

SEQ ID NO: 1798309 - RNA, 21 nt, Homo sapiens
cagagcuggaccaguggugcc

SEQ ID NO: 1798310 - RNA, 17 nt, Homo sapiens
ugcaaaaagcuagucaa

SEQ ID NO: 1798311 - RNA, 21 nt, Homo sapiens
aaaccauuuuugcugaauuca

SEQ ID NO: 1798312 - RNA, 18 nt, Homo sapiens
ccagcaggcaacucaaag

SEQ ID NO: 1798313 - RNA, 13 nt, Homo sapiens
uacuuaacugugu

SEQ ID NO: 1798314 - RNA, 19 nt, Homo sapiens
cgcccacccgaguaccucc

SEQ ID NO: 1798315 - RNA, 16 nt, Homo sapiens
ucuccauugugugauc

SEQ ID NO: 1798316 - RNA, 20 nt, Homo sapiens
ucucaaacuccugaccucaa

SEQ ID NO: 1798317 - RNA, 20 nt, Homo sapiens
cacaggaacaacagcaucuu

SEQ ID NO: 1798318 - RNA, 20 nt, Homo sapiens
ucucgaacuccuaaccucaa

SEQ ID NO: 1798319 - RNA, 21 nt, Homo sapiens
ccaugagacccuggugccugg

SEQ ID NO: 1798320 - RNA, 20 nt, Homo sapiens
uaaacucugaauaagcacuu

SEQ ID NO: 1798321 - RNA, 21 nt, Homo sapiens
cacaacuuggguucuucucag

SEQ ID NO: 1798322 - RNA, 17 nt, Homo sapiens
acuaaagauacauaccu

SEQ ID NO: 1798323 - RNA, 16 nt, Homo sapiens
gcuuaaaguugucacu

SEQ ID NO: 1798324 - RNA, 24 nt, Homo sapiens
uacauucccuaucaaaacauauca

SEQ ID NO: 1798325 - RNA, 18 nt, Homo sapiens
aaauauaacaucuaugaa

SEQ ID NO: 1798326 - RNA, 16 nt, Homo sapiens
uccccagguguguugg

SEQ ID NO: 1798327 - RNA, 17 nt, Homo sapiens
ccaccaagaagcacugg

SEQ ID NO: 1798328 - RNA, 19 nt, Homo sapiens
caggaugggguucuggaaa

SEQ ID NO: 1798329 - RNA, 14 nt, Homo sapiens
aaacuuccaaagcu

SEQ ID NO: 1798330 - RNA, 21 nt, Homo sapiens
cagcucacuuuuucauaguca

SEQ ID NO: 1798331 - RNA, 23 nt, Homo sapiens
guguccaccauccccagcuggug

SEQ ID NO: 1798332 - RNA, 17 nt, Homo sapiens
ugccacagccagaggag

SEQ ID NO: 1798333 - RNA, 14 nt, Homo sapiens
gcucugaagaccuc

SEQ ID NO: 1798334 - RNA, 18 nt, Homo sapiens
gccacuaaguacagcuga

SEQ ID NO: 1798335 - RNA, 15 nt, Homo sapiens
uagauccauuuggac

SEQ ID NO: 1798336 - RNA, 23 nt, Homo sapiens
cuagauugcuuugaaaacaugac

SEQ ID NO: 1798337 - RNA, 18 nt, Homo sapiens
gucuucuuucuccaugga

SEQ ID NO: 1798338 - RNA, 14 nt, Homo sapiens
auagacuuacugca

SEQ ID NO: 1798339 - RNA, 15 nt, Homo sapiens
cacaaauguuuuaaa

SEQ ID NO: 1798340 - RNA, 13 nt, Homo sapiens
ccuaccacauuca

SEQ ID NO: 1798341 - RNA, 13 nt, Homo sapiens
acccccaccucaa

SEQ ID NO: 1798342 - RNA, 15 nt, Homo sapiens
cauuuaauagacuua

SEQ ID NO: 1798343 - RNA, 21 nt, Homo sapiens
cucccuccagcacaaacacaa

SEQ ID NO: 1798344 - RNA, 15 nt, Homo sapiens
uuaagaaaucuggcc

SEQ ID NO: 1798345 - RNA, 12 nt, Homo sapiens
aauuaugcaaau

SEQ ID NO: 1798346 - RNA, 12 nt, Homo sapiens
agagaugcagug

SEQ ID NO: 1798347 - RNA, 14 nt, Homo sapiens
ugauuaaugcuaaa

SEQ ID NO: 1798348 - RNA, 19 nt, Homo sapiens
cuacaaaaugacuaggaua

SEQ ID NO: 1798349 - RNA, 14 nt, Homo sapiens
ucuuuauugcacua

SEQ ID NO: 1798350 - RNA, 22 nt, Homo sapiens
guggucuaagguucagccugaa

SEQ ID NO: 1798351 - RNA, 14 nt, Homo sapiens
acacuaacuaugca

SEQ ID NO: 1798352 - RNA, 14 nt, Homo sapiens
aguaacacauuugg

SEQ ID NO: 1798353 - RNA, 21 nt, Homo sapiens
uaaacaaucuuagacauuuau

SEQ ID NO: 1798354 - RNA, 20 nt, Homo sapiens
uggaacuuagcaucugaagu

SEQ ID NO: 1798355 - RNA, 15 nt, Homo sapiens
uccaaauaacaucaa

SEQ ID NO: 1798356 - RNA, 22 nt, Homo sapiens
uccugcguagaagauauggaag

SEQ ID NO: 1798357 - RNA, 14 nt, Homo sapiens
ucucaaugugcaau

SEQ ID NO: 1798358 - RNA, 17 nt, Homo sapiens
gccaaauaugcacuuuc

SEQ ID NO: 1798359 - RNA, 13 nt, Homo sapiens
auacuuacuauaa

SEQ ID NO: 1798360 - RNA, 21 nt, Homo sapiens
uuugcaggagaaaaguaucaa

SEQ ID NO: 1798361 - RNA, 14 nt, Homo sapiens
gaaaugacuuugaa

SEQ ID NO: 1798362 - RNA, 19 nt, Homo sapiens
cagugagcuuggaaaggac

SEQ ID NO: 1798363 - RNA, 12 nt, Homo sapiens
agagcuuuggua

SEQ ID NO: 1798364 - RNA, 23 nt, Homo sapiens
gggaaggucccgaauggagucca

SEQ ID NO: 1798365 - RNA, 19 nt, Homo sapiens
ucuuacuugcaaaauggag

SEQ ID NO: 1798366 - RNA, 17 nt, Homo sapiens
cuaccuccagacuucaa

SEQ ID NO: 1798367 - RNA, 15 nt, Homo sapiens
ucacagcaugugcaa

SEQ ID NO: 1798368 - RNA, 23 nt, Homo sapiens
gagauuuguaggaaggucucauu

SEQ ID NO: 1798369 - RNA, 12 nt, Homo sapiens
cagccuccaaag

SEQ ID NO: 1798370 - RNA, 20 nt, Homo sapiens
auuugcucccaccacggggu

SEQ ID NO: 1798371 - RNA, 19 nt, Homo sapiens
gacuuaaggggcugggaug

SEQ ID NO: 1798372 - RNA, 16 nt, Homo sapiens
cccaauuacacacagc

SEQ ID NO: 1798373 - RNA, 23 nt, Homo sapiens
aucucuaauuggaagaaauuccu

SEQ ID NO: 1798374 - RNA, 23 nt, Homo sapiens
acuuaggaaauggcuuugugauu

SEQ ID NO: 1798375 - RNA, 17 nt, Homo sapiens
cuuucucaucuugauga

SEQ ID NO: 1798376 - RNA, 18 nt, Homo sapiens
ucaggacagaugccacac

SEQ ID NO: 1798377 - RNA, 12 nt, Homo sapiens
acuuugacaaau

SEQ ID NO: 1798378 - RNA, 16 nt, Homo sapiens
ugugugcgugugcgca

SEQ ID NO: 1798379 - RNA, 17 nt, Homo sapiens
augaacagcagaaagac

SEQ ID NO: 1798380 - RNA, 17 nt, Homo sapiens
aauaaagaauuaacaga

SEQ ID NO: 1798381 - RNA, 15 nt, Homo sapiens
ccauuuccauggugc

SEQ ID NO: 1798382 - RNA, 16 nt, Homo sapiens
uggcugggucuucaag

SEQ ID NO: 1798383 - RNA, 16 nt, Homo sapiens
acuuugggaggccaag

SEQ ID NO: 1798384 - RNA, 22 nt, Homo sapiens
agaaaucuccuaacaaaagaac

SEQ ID NO: 1798385 - RNA, 15 nt, Homo sapiens
cuaguaagugccuuc

SEQ ID NO: 1798386 - RNA, 20 nt, Homo sapiens
gcagcugaaauucaccaaga

SEQ ID NO: 1798387 - RNA, 20 nt, Homo sapiens
agacuccuggcuucaugugg

SEQ ID NO: 1798388 - RNA, 16 nt, Homo sapiens
aacgcuauuccagcug

SEQ ID NO: 1798389 - RNA, 14 nt, Homo sapiens
ccugggagacagac

SEQ ID NO: 1798390 - RNA, 13 nt, Homo sapiens
cugcuuuguucaa

SEQ ID NO: 1798391 - RNA, 21 nt, Homo sapiens
ugcacacggaugcacagagau

SEQ ID NO: 1798392 - RNA, 15 nt, Homo sapiens
uuuuuaauagcacua

SEQ ID NO: 1798393 - RNA, 15 nt, Homo sapiens
cugccagcaucugca

SEQ ID NO: 1798394 - RNA, 18 nt, Homo sapiens
ccuaaacccagugcugcu

SEQ ID NO: 1798395 - RNA, 21 nt, Homo sapiens
ccaguggaagcagguguauug

SEQ ID NO: 1798396 - RNA, 20 nt, Homo sapiens
uauuaacucuguaaaagugu

SEQ ID NO: 1798397 - RNA, 21 nt, Homo sapiens
gagacccugccuuuaaaaaca

SEQ ID NO: 1798398 - RNA, 23 nt, Homo sapiens
uacauuuauaaaauaaaaaggaa

SEQ ID NO: 1798399 - RNA, 23 nt, Homo sapiens
cuucauauguuggguaagaaaca

SEQ ID NO: 1798400 - RNA, 15 nt, Homo sapiens
cagugucuaccuucc

SEQ ID NO: 1798401 - RNA, 21 nt, Homo sapiens
uguugagacugauucagagga

SEQ ID NO: 1798402 - RNA, 20 nt, Homo sapiens
agcagucagaguccagugcu

SEQ ID NO: 1798403 - RNA, 19 nt, Homo sapiens
gccaagaucacaguggcca

SEQ ID NO: 1798404 - RNA, 13 nt, Homo sapiens
cucgcucucucuc

SEQ ID NO: 1798405 - RNA, 16 nt, Homo sapiens
cuguaguuuuacauau

SEQ ID NO: 1798406 - RNA, 15 nt, Homo sapiens
cucugauacccagag

SEQ ID NO: 1798407 - RNA, 17 nt, Homo sapiens
uuccauaggacaaauga

SEQ ID NO: 1798408 - RNA, 23 nt, Homo sapiens
ucaagccuccccaguucuacuga

SEQ ID NO: 1798409 - RNA, 17 nt, Homo sapiens
ccacauucgucacagau

SEQ ID NO: 1798410 - RNA, 18 nt, Homo sapiens
aagcccgucaucuucccu

SEQ ID NO: 1798411 - RNA, 14 nt, Homo sapiens
uuucuaaauuuugu

SEQ ID NO: 1798412 - RNA, 21 nt, Homo sapiens
acuuugccucugaaacuuaau

SEQ ID NO: 1798413 - RNA, 16 nt, Homo sapiens
guaggugaaagaacaa

SEQ ID NO: 1798414 - RNA, 15 nt, Homo sapiens
aaaguaccaggugaa

SEQ ID NO: 1798415 - RNA, 16 nt, Homo sapiens
gcucagcccuagcccu

SEQ ID NO: 1798416 - RNA, 22 nt, Homo sapiens
cgugacggagcccacacugcca

SEQ ID NO: 1798417 - RNA, 23 nt, Homo sapiens
guuuacaacaucaccagugccac

SEQ ID NO: 1798418 - RNA, 23 nt, Homo sapiens
uucuuauuauuuuugagacagag

SEQ ID NO: 1798419 - RNA, 20 nt, Homo sapiens
acuuugauuuuauaugcuau

SEQ ID NO: 1798420 - RNA, 20 nt, Homo sapiens
ucccaaggugcuaggauuac

SEQ ID NO: 1798421 - RNA, 14 nt, Homo sapiens
cuucuuaugguggu

SEQ ID NO: 1798422 - RNA, 21 nt, Homo sapiens
uuugcacuuaauggcuguuga

SEQ ID NO: 1798423 - RNA, 19 nt, Homo sapiens
cuguugccucaguccccca

SEQ ID NO: 1798424 - RNA, 18 nt, Homo sapiens
cuucaauacaaaaagcca

SEQ ID NO: 1798425 - RNA, 14 nt, Homo sapiens
aucagccauuugcc

SEQ ID NO: 1798426 - RNA, 22 nt, Homo sapiens
caaugggaagguuguucuuggc

SEQ ID NO: 1798427 - RNA, 17 nt, Homo sapiens
aaaggagauucuuugag

SEQ ID NO: 1798428 - RNA, 22 nt, Homo sapiens
aacugcuuuauacacugucacg

SEQ ID NO: 1798429 - RNA, 16 nt, Homo sapiens
uggaucaauguaaugu

SEQ ID NO: 1798430 - RNA, 18 nt, Homo sapiens
cugggcauuguugagguu

SEQ ID NO: 1798431 - RNA, 23 nt, Homo sapiens
gugcugccccuugcaagccauaa

SEQ ID NO: 1798432 - RNA, 13 nt, Homo sapiens
auuacacauuuau

SEQ ID NO: 1798433 - RNA, 13 nt, Homo sapiens
acaauacaucaac

SEQ ID NO: 1798434 - RNA, 23 nt, Homo sapiens
cuggaggaccagauugcucugcc

SEQ ID NO: 1798435 - RNA, 19 nt, Homo sapiens
ugauaaguacuacauaccu

SEQ ID NO: 1798436 - RNA, 22 nt, Homo sapiens
aucacacucucuucuuacugua

SEQ ID NO: 1798437 - RNA, 17 nt, Homo sapiens
uucacugagaagacauu

SEQ ID NO: 1798438 - RNA, 14 nt, Homo sapiens
cuuuucauguagaa

SEQ ID NO: 1798439 - RNA, 13 nt, Homo sapiens
ucacucagaggaa

SEQ ID NO: 1798440 - RNA, 21 nt, Homo sapiens
guuccugugugacccugggca

SEQ ID NO: 1798441 - RNA, 20 nt, Homo sapiens
acaaauuagcaaucauuuua

SEQ ID NO: 1798442 - RNA, 17 nt, Homo sapiens
ccuuuccucuagcuuuu

SEQ ID NO: 1798443 - RNA, 15 nt, Homo sapiens
ucugggcacaaucau

SEQ ID NO: 1798444 - RNA, 20 nt, Homo sapiens
aucaccagcagacacugccg

SEQ ID NO: 1798445 - RNA, 22 nt, Homo sapiens
cuaaaaugacaagccuucuuaa

SEQ ID NO: 1798446 - RNA, 12 nt, Homo sapiens
ugcaccaaauag

SEQ ID NO: 1798447 - RNA, 12 nt, Homo sapiens
aggaaggagcug

SEQ ID NO: 1798448 - RNA, 15 nt, Homo sapiens
acuuuuaauuucacu

SEQ ID NO: 1798449 - RNA, 21 nt, Homo sapiens
uggacugaugccccagggauu

SEQ ID NO: 1798450 - RNA, 23 nt, Homo sapiens
uaguugcauauauggacaccgac

SEQ ID NO: 1798451 - RNA, 22 nt, Homo sapiens
caguaaacguguuuguggucaa

SEQ ID NO: 1798452 - RNA, 23 nt, Homo sapiens
ccgaagagcccugagcucaggcu

SEQ ID NO: 1798453 - RNA, 21 nt, Homo sapiens
aagacucagaauccacagugu

SEQ ID NO: 1798454 - RNA, 16 nt, Homo sapiens
ucugucacccagguug

SEQ ID NO: 1798455 - RNA, 20 nt, Homo sapiens
cagaugcaaucucuugucuc

SEQ ID NO: 1798456 - RNA, 22 nt, Homo sapiens
ugaaauucaggaugcugugaua

SEQ ID NO: 1798457 - RNA, 22 nt, Homo sapiens
uuuaaauaguuugacacuugaa

SEQ ID NO: 1798458 - RNA, 20 nt, Homo sapiens
uucaacuaugcaaugaaugu

SEQ ID NO: 1798459 - RNA, 21 nt, Homo sapiens
uaagcauauguguuacuucaa

SEQ ID NO: 1798460 - RNA, 22 nt, Homo sapiens
uuuacuagcaccugccagggag

SEQ ID NO: 1798461 - RNA, 13 nt, Homo sapiens
gugucagggauga

SEQ ID NO: 1798462 - RNA, 22 nt, Homo sapiens
acuguuuauggaaauaccagga

SEQ ID NO: 1798463 - RNA, 23 nt, Homo sapiens
gcuacuggaaugguguuuuguca

SEQ ID NO: 1798464 - RNA, 14 nt, Homo sapiens
agaagcaguuggug

SEQ ID NO: 1798465 - RNA, 20 nt, Homo sapiens
uccuugccuaaggugucuga

SEQ ID NO: 1798466 - RNA, 18 nt, Homo sapiens
gacugguuguugccaaac

SEQ ID NO: 1798467 - RNA, 22 nt, Homo sapiens
gucagaaaccaaagugaccucc

SEQ ID NO: 1798468 - RNA, 18 nt, Homo sapiens
uccagacucacuugccau

SEQ ID NO: 1798469 - RNA, 13 nt, Homo sapiens
auuaauaccaaag

SEQ ID NO: 1798470 - RNA, 18 nt, Homo sapiens
acaauuuuaaaguucuua

SEQ ID NO: 1798471 - RNA, 21 nt, Homo sapiens
gccccugcagauucugagcaa

SEQ ID NO: 1798472 - RNA, 18 nt, Homo sapiens
gcuucagauaccaugcaa

SEQ ID NO: 1798473 - RNA, 23 nt, Homo sapiens
ucacacucucuucuuacuguauu

SEQ ID NO: 1798474 - RNA, 17 nt, Homo sapiens
cuguagcaagaugcaaa

SEQ ID NO: 1798475 - RNA, 15 nt, Homo sapiens
cggaguugacaguga

SEQ ID NO: 1798476 - RNA, 17 nt, Homo sapiens
cuuaaaaucuaauucaa

SEQ ID NO: 1798477 - RNA, 18 nt, Homo sapiens
gccugggcuguggacaga

SEQ ID NO: 1798478 - RNA, 21 nt, Homo sapiens
aaggaucaucuauguauucaa

SEQ ID NO: 1798479 - RNA, 15 nt, Homo sapiens
cucucaggccaaacu

SEQ ID NO: 1798480 - RNA, 17 nt, Homo sapiens
gaaucucucuacucaga

SEQ ID NO: 1798481 - RNA, 14 nt, Homo sapiens
uucuugguuccaau

SEQ ID NO: 1798482 - RNA, 16 nt, Homo sapiens
cuacugaggugcuaug

SEQ ID NO: 1798483 - RNA, 21 nt, Homo sapiens
cccaggagaguacauggcauu

SEQ ID NO: 1798484 - RNA, 20 nt, Homo sapiens
uaaucauguaaaugcucauu

SEQ ID NO: 1798485 - RNA, 20 nt, Homo sapiens
ccuauuuauuggggugccua

SEQ ID NO: 1798486 - RNA, 13 nt, Homo sapiens
aagaugcccucau

SEQ ID NO: 1798487 - RNA, 14 nt, Homo sapiens
uauaccauuuccuc

SEQ ID NO: 1798488 - RNA, 11 nt, Homo sapiens
uuaaaacuauu

SEQ ID NO: 1798489 - RNA, 15 nt, Homo sapiens
aaaagacuccaaaga

SEQ ID NO: 1798490 - RNA, 19 nt, Homo sapiens
ucagauagaccugugaccu

SEQ ID NO: 1798491 - RNA, 19 nt, Homo sapiens
cacuagaucucccuuaaua

SEQ ID NO: 1798492 - RNA, 20 nt, Homo sapiens
uucauauauuuguaugaucc

SEQ ID NO: 1798493 - RNA, 15 nt, Homo sapiens
ucaguaaggauuuug

SEQ ID NO: 1798494 - RNA, 13 nt, Homo sapiens
ccaaagaucccac

SEQ ID NO: 1798495 - RNA, 14 nt, Homo sapiens
aaggcagugcagua

SEQ ID NO: 1798496 - RNA, 21 nt, Homo sapiens
uucuaaaggaaaucaaaugaa

SEQ ID NO: 1798497 - RNA, 18 nt, Homo sapiens
gccaaguccacuguccuc

SEQ ID NO: 1798498 - RNA, 13 nt, Homo sapiens
ugccaagaacucu

SEQ ID NO: 1798499 - RNA, 15 nt, Homo sapiens
ggccucagccugggg

SEQ ID NO: 1798500 - RNA, 21 nt, Homo sapiens
cauacugcuggaguccagugc

SEQ ID NO: 1798501 - RNA, 17 nt, Homo sapiens
agaucugucccuuaaua

SEQ ID NO: 1798502 - RNA, 17 nt, Homo sapiens
ucuguagccuggucugu

SEQ ID NO: 1798503 - RNA, 22 nt, Homo sapiens
acucaaaccacauggaccacga

SEQ ID NO: 1798504 - RNA, 19 nt, Homo sapiens
ccaugaagcacugagcaga

SEQ ID NO: 1798505 - RNA, 14 nt, Homo sapiens
cugcuccugucacc

SEQ ID NO: 1798506 - RNA, 14 nt, Homo sapiens
cagcugcugacacg

SEQ ID NO: 1798507 - RNA, 15 nt, Homo sapiens
cuugcuggcugugaa

SEQ ID NO: 1798508 - RNA, 21 nt, Homo sapiens
auguagcagcagccuacugag

SEQ ID NO: 1798509 - RNA, 16 nt, Homo sapiens
aaauguccguguaaaa

SEQ ID NO: 1798510 - RNA, 21 nt, Homo sapiens
ggcaagaagcacagguccuga

SEQ ID NO: 1798511 - RNA, 20 nt, Homo sapiens
gucugaaaagaggagccaga

SEQ ID NO: 1798512 - RNA, 14 nt, Homo sapiens
caaugaaauacuga

SEQ ID NO: 1798513 - RNA, 14 nt, Homo sapiens
uucaaaaacuaaaa

SEQ ID NO: 1798514 - RNA, 18 nt, Homo sapiens
cuucauuucucuugcuca

SEQ ID NO: 1798515 - RNA, 15 nt, Homo sapiens
auuugggugaacaaa

SEQ ID NO: 1798516 - RNA, 13 nt, Homo sapiens
uagcauaauacag

SEQ ID NO: 1798517 - RNA, 17 nt, Homo sapiens
gacacuuaccacucacc

SEQ ID NO: 1798518 - RNA, 18 nt, Homo sapiens
uuuucaccauaauuuaau

SEQ ID NO: 1798519 - RNA, 21 nt, Homo sapiens
gacugucaguucucugggaag

SEQ ID NO: 1798520 - RNA, 22 nt, Homo sapiens
agaguucugucacggucacuuu

SEQ ID NO: 1798521 - RNA, 17 nt, Homo sapiens
accuuuuuggacacaca

SEQ ID NO: 1798522 - RNA, 16 nt, Homo sapiens
gucccuauucugccau

SEQ ID NO: 1798523 - RNA, 22 nt, Homo sapiens
uacccaggauucccccaacaca

SEQ ID NO: 1798524 - RNA, 18 nt, Homo sapiens
guaaucuguugacagugc

SEQ ID NO: 1798525 - RNA, 22 nt, Homo sapiens
ggacacccugguucccaccauu

SEQ ID NO: 1798526 - RNA, 23 nt, Homo sapiens
ugaauuguuaauucacagaauag

SEQ ID NO: 1798527 - RNA, 14 nt, Homo sapiens
cugccgagagucca

SEQ ID NO: 1798528 - RNA, 16 nt, Homo sapiens
uuucuugaaguccagu

SEQ ID NO: 1798529 - RNA, 19 nt, Homo sapiens
uggagcgccacacacugca

SEQ ID NO: 1798530 - RNA, 12 nt, Homo sapiens
aggugguguuga

SEQ ID NO: 1798531 - RNA, 15 nt, Homo sapiens
acaguaacacaauua

SEQ ID NO: 1798532 - RNA, 13 nt, Homo sapiens
gugcuuaaccaaa

SEQ ID NO: 1798533 - RNA, 14 nt, Homo sapiens
caaaugauuaguua

SEQ ID NO: 1798534 - RNA, 13 nt, Homo sapiens
ggugcuccaagca

SEQ ID NO: 1798535 - RNA, 11 nt, Homo sapiens
ugcugagcaca

SEQ ID NO: 1798536 - RNA, 12 nt, Homo sapiens
uucaaguguaca

SEQ ID NO: 1798537 - RNA, 17 nt, Homo sapiens
cauuauuuucugucaga

SEQ ID NO: 1798538 - RNA, 23 nt, Homo sapiens
aucugguaaaagcaccauuguga

SEQ ID NO: 1798539 - RNA, 18 nt, Homo sapiens
uaccacaugccaagcacu

SEQ ID NO: 1798540 - RNA, 16 nt, Homo sapiens
uguaugugugugcaug

SEQ ID NO: 1798541 - RNA, 16 nt, Homo sapiens
uguguguauguacaua

SEQ ID NO: 1798542 - RNA, 16 nt, Homo sapiens
ucaacauuucaguguu

SEQ ID NO: 1798543 - RNA, 22 nt, Homo sapiens
uggucuuuguaucuuccauauu

SEQ ID NO: 1798544 - RNA, 15 nt, Homo sapiens
ugucuucaaaauaua

SEQ ID NO: 1798545 - RNA, 13 nt, Homo sapiens
ggccuccaagcca

SEQ ID NO: 1798546 - RNA, 19 nt, Homo sapiens
cucaguaacagugcaguac

SEQ ID NO: 1798547 - RNA, 18 nt, Homo sapiens
acaggagcuuaaacagcu

SEQ ID NO: 1798548 - RNA, 19 nt, Homo sapiens
uuuucccucacuugcauca

SEQ ID NO: 1798549 - RNA, 13 nt, Homo sapiens
agagacucuggcc

SEQ ID NO: 1798550 - RNA, 13 nt, Homo sapiens
gaauaagucccuu

SEQ ID NO: 1798551 - RNA, 21 nt, Homo sapiens
ggguggcccuugcaguucagc

SEQ ID NO: 1798552 - RNA, 18 nt, Homo sapiens
auaaagguucuaugauau

SEQ ID NO: 1798553 - RNA, 22 nt, Homo sapiens
accuccugucacucacugaggc

SEQ ID NO: 1798554 - RNA, 18 nt, Homo sapiens
uuacagagaaaagacaua

SEQ ID NO: 1798555 - RNA, 22 nt, Homo sapiens
uguuuuaauccuuaacacauuc

SEQ ID NO: 1798556 - RNA, 21 nt, Homo sapiens
agauuucaaauuaaucuuucu

SEQ ID NO: 1798557 - RNA, 16 nt, Homo sapiens
cuuaaaaaugccaaaa

SEQ ID NO: 1798558 - RNA, 17 nt, Homo sapiens
cucaaguuccagugcag

SEQ ID NO: 1798559 - RNA, 14 nt, Homo sapiens
guagccagcugguc

SEQ ID NO: 1798560 - RNA, 17 nt, Homo sapiens
aaauuaaaccaacaaca

SEQ ID NO: 1798561 - RNA, 19 nt, Homo sapiens
cugagugaauuacagacaa

SEQ ID NO: 1798562 - RNA, 19 nt, Homo sapiens
uuugcacuugucuuugacu

SEQ ID NO: 1798563 - RNA, 17 nt, Homo sapiens
aaacuaccuuccaguuc

SEQ ID NO: 1798564 - RNA, 22 nt, Homo sapiens
aacccuuuuuuccgucaaaauu

SEQ ID NO: 1798565 - RNA, 19 nt, Homo sapiens
ggagagccagcuuugcuau

SEQ ID NO: 1798566 - RNA, 17 nt, Homo sapiens
uuuaguuccaacaaaga

SEQ ID NO: 1798567 - RNA, 15 nt, Homo sapiens
cugugcagaccuuac

SEQ ID NO: 1798568 - RNA, 18 nt, Homo sapiens
acuaaugcaaacugggau

SEQ ID NO: 1798569 - RNA, 18 nt, Homo sapiens
acauggugugaguccaaa

SEQ ID NO: 1798570 - RNA, 20 nt, Homo sapiens
ugagcugaagacaaaccacu

SEQ ID NO: 1798571 - RNA, 16 nt, Homo sapiens
gcagccggagucacug

SEQ ID NO: 1798572 - RNA, 20 nt, Homo sapiens
guaggccuuggcccaccuga

SEQ ID NO: 1798573 - RNA, 17 nt, Homo sapiens
cuucagggcgcacagca

SEQ ID NO: 1798574 - RNA, 18 nt, Homo sapiens
aacaacaauaacaacaau

SEQ ID NO: 1798575 - RNA, 18 nt, Homo sapiens
accucuugcgagauaaga

SEQ ID NO: 1798576 - RNA, 22 nt, Homo sapiens
uguuuauucauccagcaguguu

SEQ ID NO: 1798577 - RNA, 20 nt, Homo sapiens
cugauaaaacugguuuuaga

SEQ ID NO: 1798578 - RNA, 17 nt, Homo sapiens
aaaguuauauucacagu

SEQ ID NO: 1798579 - RNA, 23 nt, Homo sapiens
gaccuccaccugggagaugcugg

SEQ ID NO: 1798580 - RNA, 15 nt, Homo sapiens
ucuguuuaggugccu

SEQ ID NO: 1798581 - RNA, 16 nt, Homo sapiens
uuggcagauguggauu

SEQ ID NO: 1798582 - RNA, 14 nt, Homo sapiens
cugucccaccaacu

SEQ ID NO: 1798583 - RNA, 15 nt, Homo sapiens
augcuuccugacaau

SEQ ID NO: 1798584 - RNA, 14 nt, Homo sapiens
uucccucugcauug

SEQ ID NO: 1798585 - RNA, 22 nt, Homo sapiens
uguaacacagucuggcaguugc

SEQ ID NO: 1798586 - RNA, 23 nt, Homo sapiens
ggaaucagaacucaaauggggcc

SEQ ID NO: 1798587 - RNA, 21 nt, Homo sapiens
caagugccccaccacucccca

SEQ ID NO: 1798588 - RNA, 15 nt, Homo sapiens
cuucuagggagacaa

SEQ ID NO: 1798589 - RNA, 16 nt, Homo sapiens
agcagcagcagcagca

SEQ ID NO: 1798590 - RNA, 21 nt, Homo sapiens
cagcaagcagugcccucugga

SEQ ID NO: 1798591 - RNA, 15 nt, Homo sapiens
cuacuuuaagcacua

SEQ ID NO: 1798592 - RNA, 18 nt, Homo sapiens
ccuguggguaucaguucu

SEQ ID NO: 1798593 - RNA, 15 nt, Homo sapiens
aucacagucuacuga

SEQ ID NO: 1798594 - RNA, 14 nt, Homo sapiens
uucagacucucucc

SEQ ID NO: 1798595 - RNA, 14 nt, Homo sapiens
guuucuggcucuug

SEQ ID NO: 1798596 - RNA, 14 nt, Homo sapiens
cuuccuggguccug

SEQ ID NO: 1798597 - RNA, 17 nt, Homo sapiens
cauggacauguguuuaa

SEQ ID NO: 1798598 - RNA, 15 nt, Homo sapiens
auauaggcuucucac

SEQ ID NO: 1798599 - RNA, 16 nt, Homo sapiens
caucccucuguucaca

SEQ ID NO: 1798600 - RNA, 16 nt, Homo sapiens
ucgauuucuaccucag

SEQ ID NO: 1798601 - RNA, 17 nt, Homo sapiens
agacacaucuccuccau

SEQ ID NO: 1798602 - RNA, 13 nt, Homo sapiens
uuugagugauccu

SEQ ID NO: 1798603 - RNA, 15 nt, Homo sapiens
ccagaugcauguuca

SEQ ID NO: 1798604 - RNA, 17 nt, Homo sapiens
uauguguguuuugcuaa

SEQ ID NO: 1798605 - RNA, 20 nt, Homo sapiens
gaugugugucucaccccuca

SEQ ID NO: 1798606 - RNA, 11 nt, Homo sapiens
ccugggcacag

SEQ ID NO: 1798607 - RNA, 18 nt, Homo sapiens
gcaucucugaacauuucu

SEQ ID NO: 1798608 - RNA, 16 nt, Homo sapiens
cuguacucacugagua

SEQ ID NO: 1798609 - RNA, 18 nt, Homo sapiens
agccaaguuuauauacaa

SEQ ID NO: 1798610 - RNA, 16 nt, Homo sapiens
gcagagauguacugca

SEQ ID NO: 1798611 - RNA, 23 nt, Homo sapiens
acaccgaugugcgcacacacaga

SEQ ID NO: 1798612 - RNA, 13 nt, Homo sapiens
auuuuacauuucu

SEQ ID NO: 1798613 - RNA, 22 nt, Homo sapiens
uucucuugucccagcuucuccc

SEQ ID NO: 1798614 - RNA, 16 nt, Homo sapiens
caaaauacagcacuuu

SEQ ID NO: 1798615 - RNA, 14 nt, Homo sapiens
ugacacaaugaagu

SEQ ID NO: 1798616 - RNA, 19 nt, Homo sapiens
gagccaccacaccggccaa

SEQ ID NO: 1798617 - RNA, 23 nt, Homo sapiens
ccagacucagcuggaagucuacc

SEQ ID NO: 1798618 - RNA, 19 nt, Homo sapiens
aagguguuaaaugugcuau

SEQ ID NO: 1798619 - RNA, 13 nt, Homo sapiens
aauuuucacugug

SEQ ID NO: 1798620 - RNA, 22 nt, Homo sapiens
caaaaagaugaccuuugucuca

SEQ ID NO: 1798621 - RNA, 14 nt, Homo sapiens
auguguuuccauau

SEQ ID NO: 1798622 - RNA, 16 nt, Homo sapiens
ggcuccaacacugcug

SEQ ID NO: 1798623 - RNA, 14 nt, Homo sapiens
gcuaccaguauuua

SEQ ID NO: 1798624 - RNA, 19 nt, Homo sapiens
cugcagaaguaagccucau

SEQ ID NO: 1798625 - RNA, 13 nt, Homo sapiens
uuauauauguccu

SEQ ID NO: 1798626 - RNA, 15 nt, Homo sapiens
gaaauaacaauguua

SEQ ID NO: 1798627 - RNA, 19 nt, Homo sapiens
cauuggaccuguucaaaaa

SEQ ID NO: 1798628 - RNA, 17 nt, Homo sapiens
caucgggggugaaucuu

SEQ ID NO: 1798629 - RNA, 14 nt, Homo sapiens
aagguggaguggau

SEQ ID NO: 1798630 - RNA, 21 nt, Homo sapiens
gccugggugugaccugacacc

SEQ ID NO: 1798631 - RNA, 14 nt, Homo sapiens
uggggguauuguau

SEQ ID NO: 1798632 - RNA, 13 nt, Homo sapiens
gcguuugcgggaa

SEQ ID NO: 1798633 - RNA, 18 nt, Homo sapiens
ccaccaccaucaccagac

SEQ ID NO: 1798634 - RNA, 22 nt, Homo sapiens
aaggcucauaccuggcuugcag

SEQ ID NO: 1798635 - RNA, 23 nt, Homo sapiens
auucuaguaauaaagacucuaca

SEQ ID NO: 1798636 - RNA, 16 nt, Homo sapiens
aagucaaaugugugcu

SEQ ID NO: 1798637 - RNA, 16 nt, Homo sapiens
ccauguguggcccacc

SEQ ID NO: 1798638 - RNA, 21 nt, Homo sapiens
uccugccagguuuaaacauca

SEQ ID NO: 1798639 - RNA, 18 nt, Homo sapiens
acaaaccuuacuauggaa

SEQ ID NO: 1798640 - RNA, 21 nt, Homo sapiens
augacggcaaacucagucaua

SEQ ID NO: 1798641 - RNA, 14 nt, Homo sapiens
ccuaaaacaguauu

SEQ ID NO: 1798642 - RNA, 15 nt, Homo sapiens
cccuugccaucacac

SEQ ID NO: 1798643 - RNA, 17 nt, Homo sapiens
ccagaaagcugccagag

SEQ ID NO: 1798644 - RNA, 20 nt, Homo sapiens
uauauauuuuugugcacauu

SEQ ID NO: 1798645 - RNA, 17 nt, Homo sapiens
cuaagcaaucacugggc

SEQ ID NO: 1798646 - RNA, 16 nt, Homo sapiens
caucaugggcuggaca

SEQ ID NO: 1798647 - RNA, 20 nt, Homo sapiens
uauugccucuaugugcaacu

SEQ ID NO: 1798648 - RNA, 10 nt, Homo sapiens
uaacuuuauu

SEQ ID NO: 1798649 - RNA, 21 nt, Homo sapiens
uagaacucuagagagccuuaa

SEQ ID NO: 1798650 - RNA, 15 nt, Homo sapiens
caugccugggaaaug

SEQ ID NO: 1798651 - RNA, 21 nt, Homo sapiens
ucucccagggagugagcagcu

SEQ ID NO: 1798652 - RNA, 15 nt, Homo sapiens
acugccaugccagcu

SEQ ID NO: 1798653 - RNA, 14 nt, Homo sapiens
ugguaggauuuaua

SEQ ID NO: 1798654 - RNA, 20 nt, Homo sapiens
cacuggguguaaacacaucu

SEQ ID NO: 1798655 - RNA, 19 nt, Homo sapiens
acuugcuuaucaacuuccu

SEQ ID NO: 1798656 - RNA, 22 nt, Homo sapiens
cuuuaagccuucaaaacuauag

SEQ ID NO: 1798657 - RNA, 14 nt, Homo sapiens
ucuucauguucagu

SEQ ID NO: 1798658 - RNA, 23 nt, Homo sapiens
gcugacguccaguguacagugaa

SEQ ID NO: 1798659 - RNA, 10 nt, Homo sapiens
ccagcuguca

SEQ ID NO: 1798660 - RNA, 18 nt, Homo sapiens
accauccuuuacuauuaa

SEQ ID NO: 1798661 - RNA, 21 nt, Homo sapiens
ccuccaugugggugcuaggga

SEQ ID NO: 1798662 - RNA, 16 nt, Homo sapiens
uguuucuggauuugca

SEQ ID NO: 1798663 - RNA, 21 nt, Homo sapiens
ccugcccacuuagccguccau

SEQ ID NO: 1798664 - RNA, 14 nt, Homo sapiens
caaaauguucacaa

SEQ ID NO: 1798665 - RNA, 16 nt, Homo sapiens
ugcugcccucacugcc

SEQ ID NO: 1798666 - RNA, 16 nt, Homo sapiens
ugaaacauggcugugu

SEQ ID NO: 1798667 - RNA, 13 nt, Homo sapiens
uauucuucuagag

SEQ ID NO: 1798668 - RNA, 23 nt, Homo sapiens
ucacuuaaagcccgccugacaga

SEQ ID NO: 1798669 - RNA, 23 nt, Homo sapiens
acuuuuucuggucucuaccacug

SEQ ID NO: 1798670 - RNA, 18 nt, Homo sapiens
cccacccuccucaagaag

SEQ ID NO: 1798671 - RNA, 14 nt, Homo sapiens
ggaauuuaauuuau

SEQ ID NO: 1798672 - RNA, 11 nt, Homo sapiens
acguguugccu

SEQ ID NO: 1798673 - RNA, 11 nt, Homo sapiens
aaguguugcau

SEQ ID NO: 1798674 - RNA, 17 nt, Homo sapiens
ugaauuaguccuugcuu

SEQ ID NO: 1798675 - RNA, 15 nt, Homo sapiens
uccauucuucuugcu

SEQ ID NO: 1798676 - RNA, 15 nt, Homo sapiens
uguugccuugcauuu

SEQ ID NO: 1798677 - RNA, 19 nt, Homo sapiens
augcuuucgauaguguuaa

SEQ ID NO: 1798678 - RNA, 15 nt, Homo sapiens
agaugcccuccaauc

SEQ ID NO: 1798679 - RNA, 22 nt, Homo sapiens
caccgagaggaaaaaggcuucu

SEQ ID NO: 1798680 - RNA, 15 nt, Homo sapiens
gaucuucccacagga

SEQ ID NO: 1798681 - RNA, 14 nt, Homo sapiens
gccacgugggcaaa

SEQ ID NO: 1798682 - RNA, 17 nt, Homo sapiens
cauucaguucuuaucaa

SEQ ID NO: 1798683 - RNA, 20 nt, Homo sapiens
auagacuguaagcuccauga

SEQ ID NO: 1798684 - RNA, 19 nt, Homo sapiens
cccacaggagcguguacua

SEQ ID NO: 1798685 - RNA, 18 nt, Homo sapiens
aggcacguuuggcauuuc

SEQ ID NO: 1798686 - RNA, 19 nt, Homo sapiens
ggcuguguugucagcacug

SEQ ID NO: 1798687 - RNA, 17 nt, Homo sapiens
ugaaucucccacuccag

SEQ ID NO: 1798688 - RNA, 24 nt, Homo sapiens
ggcccacguagggcggcacucaca

SEQ ID NO: 1798689 - RNA, 23 nt, Homo sapiens
aguuacaugguaauuaugugaua

SEQ ID NO: 1798690 - RNA, 19 nt, Homo sapiens
uuaagucucugacucuugc

SEQ ID NO: 1798691 - RNA, 21 nt, Homo sapiens
cagcuuaaaguuguguaucug

SEQ ID NO: 1798692 - RNA, 19 nt, Homo sapiens
ggacgagacccuacaggag

SEQ ID NO: 1798693 - RNA, 19 nt, Homo sapiens
cugagcagguguucuucau

SEQ ID NO: 1798694 - RNA, 23 nt, Homo sapiens
caucucagcgccagcucuaccag

SEQ ID NO: 1798695 - RNA, 22 nt, Homo sapiens
acugaauuuggaggcuggagua

SEQ ID NO: 1798696 - RNA, 15 nt, Homo sapiens
caccuccuccacuca

SEQ ID NO: 1798697 - RNA, 17 nt, Homo sapiens
cugcugcagucagcaca

SEQ ID NO: 1798698 - RNA, 14 nt, Homo sapiens
ugacauuccagcau

SEQ ID NO: 1798699 - RNA, 19 nt, Homo sapiens
ccauuaacaaugaccuuua

SEQ ID NO: 1798700 - RNA, 14 nt, Homo sapiens
cuuuguauaugcau

SEQ ID NO: 1798701 - RNA, 20 nt, Homo sapiens
cucugaaugaaccuucuggc

SEQ ID NO: 1798702 - RNA, 13 nt, Homo sapiens
ugcaauagauuac

SEQ ID NO: 1798703 - RNA, 14 nt, Homo sapiens
aucugcuuaccaca

SEQ ID NO: 1798704 - RNA, 14 nt, Homo sapiens
uagccuuacuguga

SEQ ID NO: 1798705 - RNA, 22 nt, Homo sapiens
agauggaaaaacugaggcuuag

SEQ ID NO: 1798706 - RNA, 18 nt, Homo sapiens
ccuugucuaguuucccac

SEQ ID NO: 1798707 - RNA, 22 nt, Homo sapiens
uucccugaaggaaccaaagcga

SEQ ID NO: 1798708 - RNA, 16 nt, Homo sapiens
ggagcuguaaaccaga

SEQ ID NO: 1798709 - RNA, 18 nt, Homo sapiens
cuccacuccuucccaaau

SEQ ID NO: 1798710 - RNA, 16 nt, Homo sapiens
aaacccagccucuaga

SEQ ID NO: 1798711 - RNA, 18 nt, Homo sapiens
ucagagcagcacuggggu

SEQ ID NO: 1798712 - RNA, 18 nt, Homo sapiens
uucaucauaauaaauauc

SEQ ID NO: 1798713 - RNA, 20 nt, Homo sapiens
cagggcggucuucugcucca

SEQ ID NO: 1798714 - RNA, 13 nt, Homo sapiens
cuuuaaaauucua

SEQ ID NO: 1798715 - RNA, 19 nt, Homo sapiens
cugaauuuggccugcacua

SEQ ID NO: 1798716 - RNA, 14 nt, Homo sapiens
ucagcuaugcaaau

SEQ ID NO: 1798717 - RNA, 22 nt, Homo sapiens
aaaaguucauaacagugccauu

SEQ ID NO: 1798718 - RNA, 22 nt, Homo sapiens
cugaagagcuauuauauaaaaa

SEQ ID NO: 1798719 - RNA, 22 nt, Homo sapiens
ccccuucagaccuugcaaucac

SEQ ID NO: 1798720 - RNA, 22 nt, Homo sapiens
cuuaccuguucucuaguuuucc

SEQ ID NO: 1798721 - RNA, 17 nt, Homo sapiens
ggcccagaugacauccc

SEQ ID NO: 1798722 - RNA, 15 nt, Homo sapiens
ugacgacgacaacga

SEQ ID NO: 1798723 - RNA, 18 nt, Homo sapiens
uucccugaccucccucua

SEQ ID NO: 1798724 - RNA, 18 nt, Homo sapiens
ugaggcaauuagacacuu

SEQ ID NO: 1798725 - RNA, 16 nt, Homo sapiens
caugugagucccugug

SEQ ID NO: 1798726 - RNA, 16 nt, Homo sapiens
caccaaauucugaauu

SEQ ID NO: 1798727 - RNA, 15 nt, Homo sapiens
aacucacaccugccu

SEQ ID NO: 1798728 - RNA, 15 nt, Homo sapiens
uuugaaaucuaugaa

SEQ ID NO: 1798729 - RNA, 22 nt, Homo sapiens
guauaagugguguguguaugcg

SEQ ID NO: 1798730 - RNA, 18 nt, Homo sapiens
agcgccaggcugaccaca

SEQ ID NO: 1798731 - RNA, 21 nt, Homo sapiens
ugccauguggcuaacuuuuau

SEQ ID NO: 1798732 - RNA, 16 nt, Homo sapiens
gaaccacgucugcuaa

SEQ ID NO: 1798733 - RNA, 20 nt, Homo sapiens
cagggacugcaaguggccau

SEQ ID NO: 1798734 - RNA, 21 nt, Homo sapiens
augaccuuugguacaugccug

SEQ ID NO: 1798735 - RNA, 20 nt, Homo sapiens
acacaaggauagaugcuggc

SEQ ID NO: 1798736 - RNA, 19 nt, Homo sapiens
uaagcgguuuucuuaggca

SEQ ID NO: 1798737 - RNA, 18 nt, Homo sapiens
cagaaaaagaucuuucau

SEQ ID NO: 1798738 - RNA, 22 nt, Homo sapiens
gacuccugcucucuauccaaaa

SEQ ID NO: 1798739 - RNA, 23 nt, Homo sapiens
aaucugaggccuccucucucagu

SEQ ID NO: 1798740 - RNA, 19 nt, Homo sapiens
aaacguggagaaucacagg

SEQ ID NO: 1798741 - RNA, 23 nt, Homo sapiens
ccugaagaaacaaggcauugaau

SEQ ID NO: 1798742 - RNA, 22 nt, Homo sapiens
uaccacaugguccauuucaugu

SEQ ID NO: 1798743 - RNA, 14 nt, Homo sapiens
ugcugccaugugga

SEQ ID NO: 1798744 - RNA, 13 nt, Homo sapiens
acacaggcuucau

SEQ ID NO: 1798745 - RNA, 16 nt, Homo sapiens
gaaaggucaccucacu

SEQ ID NO: 1798746 - RNA, 12 nt, Homo sapiens
cgaaucugagaa

SEQ ID NO: 1798747 - RNA, 12 nt, Homo sapiens
aaucaguucugu

SEQ ID NO: 1798748 - RNA, 23 nt, Homo sapiens
cuggccuugagaaaggcauuggc

SEQ ID NO: 1798749 - RNA, 15 nt, Homo sapiens
aggcugaucccugag

SEQ ID NO: 1798750 - RNA, 19 nt, Homo sapiens
aacaugucacacuggcuau

SEQ ID NO: 1798751 - RNA, 19 nt, Homo sapiens
cugguggggaucagacaga

SEQ ID NO: 1798752 - RNA, 23 nt, Homo sapiens
ggguauuguuaggagaugucauc

SEQ ID NO: 1798753 - RNA, 21 nt, Homo sapiens
cugucacuugaccaauacuga

SEQ ID NO: 1798754 - RNA, 21 nt, Homo sapiens
agcucuacgucccacauuuua

SEQ ID NO: 1798755 - RNA, 20 nt, Homo sapiens
ggggacagcuccacucugac

SEQ ID NO: 1798756 - RNA, 20 nt, Homo sapiens
ucugggaaaggugcucaaag

SEQ ID NO: 1798757 - RNA, 17 nt, Homo sapiens
gaaaccagaaauaccac

SEQ ID NO: 1798758 - RNA, 24 nt, Homo sapiens
accaugccucuccaacaucuucaa

SEQ ID NO: 1798759 - RNA, 12 nt, Homo sapiens
cagaauuaugaa

SEQ ID NO: 1798760 - RNA, 17 nt, Homo sapiens
auuuuggcaagcucuau

SEQ ID NO: 1798761 - RNA, 12 nt, Homo sapiens
uacuguacuuaa

SEQ ID NO: 1798762 - RNA, 21 nt, Homo sapiens
augcauaaauaugcagugaua

SEQ ID NO: 1798763 - RNA, 20 nt, Homo sapiens
uuucuuccaguuagagucuu

SEQ ID NO: 1798764 - RNA, 17 nt, Homo sapiens
gucugccccgcccucau

SEQ ID NO: 1798765 - RNA, 20 nt, Homo sapiens
ggacucgccuguaaucucac

SEQ ID NO: 1798766 - RNA, 19 nt, Homo sapiens
ggacuuccuccccauguga

SEQ ID NO: 1798767 - RNA, 14 nt, Homo sapiens
cccaggcaggucug

SEQ ID NO: 1798768 - RNA, 20 nt, Homo sapiens
gcccauuucauauucuuuca

SEQ ID NO: 1798769 - RNA, 21 nt, Homo sapiens
uaaacacggggcuugcaacuu

SEQ ID NO: 1798770 - RNA, 18 nt, Homo sapiens
cuucugagcaguuuucca

SEQ ID NO: 1798771 - RNA, 16 nt, Homo sapiens
cucaaagaaaacuguc

SEQ ID NO: 1798772 - RNA, 15 nt, Homo sapiens
uuccccacugcacac

SEQ ID NO: 1798773 - RNA, 15 nt, Homo sapiens
gagugagcaaccagc

SEQ ID NO: 1798774 - RNA, 21 nt, Homo sapiens
gccagugcuaagcugcccuga

SEQ ID NO: 1798775 - RNA, 21 nt, Homo sapiens
cggaauccagugcuuccacag

SEQ ID NO: 1798776 - RNA, 23 nt, Homo sapiens
uaaaggcuugauauuuuccaaau

SEQ ID NO: 1798777 - RNA, 22 nt, Homo sapiens
uaguaacugccucaguguuuca

SEQ ID NO: 1798778 - RNA, 14 nt, Homo sapiens
gugcaauacuuaga

SEQ ID NO: 1798779 - RNA, 16 nt, Homo sapiens
caaaagucuggccuuu

SEQ ID NO: 1798780 - RNA, 14 nt, Homo sapiens
aagagaaaugaugu

SEQ ID NO: 1798781 - RNA, 21 nt, Homo sapiens
aaaccaagucuacuucacuaa

SEQ ID NO: 1798782 - RNA, 23 nt, Homo sapiens
cugagaugaacccuggcauuugg

SEQ ID NO: 1798783 - RNA, 22 nt, Homo sapiens
aaaacuaguuauaaaaauuaca

SEQ ID NO: 1798784 - RNA, 14 nt, Homo sapiens
guccgugcacugga

SEQ ID NO: 1798785 - RNA, 12 nt, Homo sapiens
cacuaaccaaug

SEQ ID NO: 1798786 - RNA, 17 nt, Homo sapiens
acuaugucugaacauag

SEQ ID NO: 1798787 - RNA, 21 nt, Homo sapiens
uccccucauccacuaggugcc

SEQ ID NO: 1798788 - RNA, 18 nt, Homo sapiens
cgcaguggggugaucuca

SEQ ID NO: 1798789 - RNA, 16 nt, Homo sapiens
cucaaaggacugaccu

SEQ ID NO: 1798790 - RNA, 17 nt, Homo sapiens
gcaugucugcaccuccg

SEQ ID NO: 1798791 - RNA, 13 nt, Homo sapiens
aauuuucauucau

SEQ ID NO: 1798792 - RNA, 13 nt, Homo sapiens
gagacuacaggug

SEQ ID NO: 1798793 - RNA, 15 nt, Homo sapiens
ugggugucucugcau

SEQ ID NO: 1798794 - RNA, 18 nt, Homo sapiens
gcuggauggggagucuca

SEQ ID NO: 1798795 - RNA, 12 nt, Homo sapiens
auaaccaaguga

SEQ ID NO: 1798796 - RNA, 17 nt, Homo sapiens
uggggccccaucuugau

SEQ ID NO: 1798797 - RNA, 13 nt, Homo sapiens
ccugucauauaau

SEQ ID NO: 1798798 - RNA, 13 nt, Homo sapiens
agacugucaguag

SEQ ID NO: 1798799 - RNA, 20 nt, Homo sapiens
ccgcagggagggcuguggug

SEQ ID NO: 1798800 - RNA, 23 nt, Homo sapiens
uuggaccgaguagaggcauuuag

SEQ ID NO: 1798801 - RNA, 23 nt, Homo sapiens
ugugcaagcgacgacagaugcua

SEQ ID NO: 1798802 - RNA, 14 nt, Homo sapiens
aaagcaaagcucuu

SEQ ID NO: 1798803 - RNA, 14 nt, Homo sapiens
uauaggaccaagau

SEQ ID NO: 1798804 - RNA, 14 nt, Homo sapiens
cacgcacacgagaa

SEQ ID NO: 1798805 - RNA, 19 nt, Homo sapiens
gcagggguagaagcaaagg

SEQ ID NO: 1798806 - RNA, 18 nt, Homo sapiens
aaaaaccauaggcugcuc

SEQ ID NO: 1798807 - RNA, 17 nt, Homo sapiens
cuagguaacgagggcaa

SEQ ID NO: 1798808 - RNA, 18 nt, Homo sapiens
ugccauacuuuccuguau

SEQ ID NO: 1798809 - RNA, 12 nt, Homo sapiens
uugcacuccagc

SEQ ID NO: 1798810 - RNA, 19 nt, Homo sapiens
agcucuacgugcuccucag

SEQ ID NO: 1798811 - RNA, 17 nt, Homo sapiens
ucuaacgggcauucaca

SEQ ID NO: 1798812 - RNA, 20 nt, Homo sapiens
ggccaggacgggccacacgu

SEQ ID NO: 1798813 - RNA, 20 nt, Homo sapiens
cuccuuuggaaugcuguauu

SEQ ID NO: 1798814 - RNA, 21 nt, Homo sapiens
gagugcgcagaucugugccug

SEQ ID NO: 1798815 - RNA, 23 nt, Homo sapiens
caggcugccccaccccuccauga

SEQ ID NO: 1798816 - RNA, 21 nt, Homo sapiens
gcucagugccacaaagcucaa

SEQ ID NO: 1798817 - RNA, 14 nt, Homo sapiens
uuaauggcuguaug

SEQ ID NO: 1798818 - RNA, 10 nt, Homo sapiens
uuaacuacag

SEQ ID NO: 1798819 - RNA, 15 nt, Homo sapiens
agagagcuguuccca

SEQ ID NO: 1798820 - RNA, 18 nt, Homo sapiens
agccuggaagccaaacaa

SEQ ID NO: 1798821 - RNA, 21 nt, Homo sapiens
aaaaaggaaaacucaccauuu

SEQ ID NO: 1798822 - RNA, 17 nt, Homo sapiens
gcaucugcacauaggca

SEQ ID NO: 1798823 - RNA, 19 nt, Homo sapiens
acagccccugcaacaaaga

SEQ ID NO: 1798824 - RNA, 20 nt, Homo sapiens
accuggcagggcucacacuc

SEQ ID NO: 1798825 - RNA, 19 nt, Homo sapiens
ucccuuuuucuccacacuc

SEQ ID NO: 1798826 - RNA, 13 nt, Homo sapiens
cuuguccugaugc

SEQ ID NO: 1798827 - RNA, 14 nt, Homo sapiens
caaaggaugugaua

SEQ ID NO: 1798828 - RNA, 23 nt, Homo sapiens
cugaauugcccguuuccauacag

SEQ ID NO: 1798829 - RNA, 23 nt, Homo sapiens
ugugagacugaguucuauauucu

SEQ ID NO: 1798830 - RNA, 13 nt, Homo sapiens
gcgguauccagag

SEQ ID NO: 1798831 - RNA, 17 nt, Homo sapiens
uccaggcgaugugcaag

SEQ ID NO: 1798832 - RNA, 20 nt, Homo sapiens
caguuaagacaacaggcauu

SEQ ID NO: 1798833 - RNA, 11 nt, Homo sapiens
guaugugaaua

SEQ ID NO: 1798834 - RNA, 13 nt, Homo sapiens
gcaacgcugccuu

SEQ ID NO: 1798835 - RNA, 21 nt, Homo sapiens
ucagacugaaacgccuugcac

SEQ ID NO: 1798836 - RNA, 20 nt, Homo sapiens
ugaagccguccaagaacaag

SEQ ID NO: 1798837 - RNA, 17 nt, Homo sapiens
gagggugguaaagugaa

SEQ ID NO: 1798838 - RNA, 21 nt, Homo sapiens
ccuggacugccuugaauaucc

SEQ ID NO: 1798839 - RNA, 21 nt, Homo sapiens
aaaacucugguaaaugaucac

SEQ ID NO: 1798840 - RNA, 14 nt, Homo sapiens
uaagcaugugaugu

SEQ ID NO: 1798841 - RNA, 21 nt, Homo sapiens
caauauuaaguccaaauccaa

SEQ ID NO: 1798842 - RNA, 19 nt, Homo sapiens
augugccauuuaugugagu

SEQ ID NO: 1798843 - RNA, 14 nt, Homo sapiens
ccaaagguuuugca

SEQ ID NO: 1798844 - RNA, 20 nt, Homo sapiens
ccuuucuccaggaccaauaa

SEQ ID NO: 1798845 - RNA, 16 nt, Homo sapiens
ccgaauuccugcguuu

SEQ ID NO: 1798846 - RNA, 22 nt, Homo sapiens
cacuguccugugaggacagcug

SEQ ID NO: 1798847 - RNA, 17 nt, Homo sapiens
auuuugggccuguuccu

SEQ ID NO: 1798848 - RNA, 19 nt, Homo sapiens
auccuggggcagcacuccc

SEQ ID NO: 1798849 - RNA, 18 nt, Homo sapiens
cagagggaucuuguguac

SEQ ID NO: 1798850 - RNA, 18 nt, Homo sapiens
gagaacaaagcuguuaaa

SEQ ID NO: 1798851 - RNA, 15 nt, Homo sapiens
ugccucauaccccac

SEQ ID NO: 1798852 - RNA, 19 nt, Homo sapiens
gcuucaaguguugcucuug

SEQ ID NO: 1798853 - RNA, 19 nt, Homo sapiens
auuucccuggaauuuaauu

SEQ ID NO: 1798854 - RNA, 12 nt, Homo sapiens
uucauuaccuca

SEQ ID NO: 1798855 - RNA, 12 nt, Homo sapiens
uuccuuaccucc

SEQ ID NO: 1798856 - RNA, 18 nt, Homo sapiens
uauaacuauuacaguguu

SEQ ID NO: 1798857 - RNA, 19 nt, Homo sapiens
uuuauuuuacauagaucau

SEQ ID NO: 1798858 - RNA, 19 nt, Homo sapiens
aauugaaaaugaccaaaau

SEQ ID NO: 1798859 - RNA, 22 nt, Homo sapiens
uccucaggaaauuagauaaaua

SEQ ID NO: 1798860 - RNA, 12 nt, Homo sapiens
cacauugaucau

SEQ ID NO: 1798861 - RNA, 14 nt, Homo sapiens
aucauauauacugu

SEQ ID NO: 1798862 - RNA, 20 nt, Homo sapiens
uggcuauguccuaauaauau

SEQ ID NO: 1798863 - RNA, 22 nt, Homo sapiens
cagagaaaagucaggugcaguc

SEQ ID NO: 1798864 - RNA, 18 nt, Homo sapiens
gucugccuggaggccagg

SEQ ID NO: 1798865 - RNA, 11 nt, Homo sapiens
uuuuaucucca

SEQ ID NO: 1798866 - RNA, 16 nt, Homo sapiens
cagaggcagaucugag

SEQ ID NO: 1798867 - RNA, 22 nt, Homo sapiens
cuuacaagaaaggccugaaugg

SEQ ID NO: 1798868 - RNA, 14 nt, Homo sapiens
gaagaaucugcucu

SEQ ID NO: 1798869 - RNA, 15 nt, Homo sapiens
cuguucaucccaugu

SEQ ID NO: 1798870 - RNA, 14 nt, Homo sapiens
uggacucuaaagac

SEQ ID NO: 1798871 - RNA, 16 nt, Homo sapiens
auugcucuaugucugc

SEQ ID NO: 1798872 - RNA, 21 nt, Homo sapiens
ucuaggauaacuugcuuucuu

SEQ ID NO: 1798873 - RNA, 15 nt, Homo sapiens
ccauucugcauuuag

SEQ ID NO: 1798874 - RNA, 21 nt, Homo sapiens
ccacgcagaggacgcacgcuc

SEQ ID NO: 1798875 - RNA, 15 nt, Homo sapiens
ugauauggguuuaua

SEQ ID NO: 1798876 - RNA, 14 nt, Homo sapiens
guguucaguguuga

SEQ ID NO: 1798877 - RNA, 16 nt, Homo sapiens
gaauuugaauacugca

SEQ ID NO: 1798878 - RNA, 16 nt, Homo sapiens
augcagcacauauacu

SEQ ID NO: 1798879 - RNA, 23 nt, Homo sapiens
ccuuggagcuguaaaccagagag

SEQ ID NO: 1798880 - RNA, 17 nt, Homo sapiens
uagcauucauaaccaaa

SEQ ID NO: 1798881 - RNA, 20 nt, Homo sapiens
gaccuugggggaagacuuua

SEQ ID NO: 1798882 - RNA, 12 nt, Homo sapiens
agggggcccaaa

SEQ ID NO: 1798883 - RNA, 16 nt, Homo sapiens
gaguaacacaaaguga

SEQ ID NO: 1798884 - RNA, 13 nt, Homo sapiens
ugaugaugcaguu

SEQ ID NO: 1798885 - RNA, 13 nt, Homo sapiens
uggagaugcaaau

SEQ ID NO: 1798886 - RNA, 18 nt, Homo sapiens
cuuacccuucugugccca

SEQ ID NO: 1798887 - RNA, 15 nt, Homo sapiens
gcuguuucagcuuua

SEQ ID NO: 1798888 - RNA, 14 nt, Homo sapiens
cuccuuucucuuau

SEQ ID NO: 1798889 - RNA, 19 nt, Homo sapiens
aacaguacugguuacuuuc

SEQ ID NO: 1798890 - RNA, 20 nt, Homo sapiens
agcaaguguguguuugccaa

SEQ ID NO: 1798891 - RNA, 13 nt, Homo sapiens
uaaggaagggaaa

SEQ ID NO: 1798892 - RNA, 18 nt, Homo sapiens
cucauuccuguagucaaa

SEQ ID NO: 1798893 - RNA, 18 nt, Homo sapiens
gaagccacaggccugaga

SEQ ID NO: 1798894 - RNA, 13 nt, Homo sapiens
gugaaaaugugac

SEQ ID NO: 1798895 - RNA, 13 nt, Homo sapiens
cacaaaaucacac

SEQ ID NO: 1798896 - RNA, 18 nt, Homo sapiens
cuuauuucagauucaccu

SEQ ID NO: 1798897 - RNA, 23 nt, Homo sapiens
gaaccuggcaagucacaggacua

SEQ ID NO: 1798898 - RNA, 20 nt, Homo sapiens
aauaaauuuuuuuuggucaa

SEQ ID NO: 1798899 - RNA, 20 nt, Homo sapiens
guaguuuuguuuaugcauuu

SEQ ID NO: 1798900 - RNA, 16 nt, Homo sapiens
agcauggagcauggga

SEQ ID NO: 1798901 - RNA, 17 nt, Homo sapiens
uggguucucuacaugca

SEQ ID NO: 1798902 - RNA, 22 nt, Homo sapiens
cuucugauuucucuucagcuuu

SEQ ID NO: 1798903 - RNA, 23 nt, Homo sapiens
acauggaugcgaggaccacuuug

SEQ ID NO: 1798904 - RNA, 14 nt, Homo sapiens
uccuaauuaccagu

SEQ ID NO: 1798905 - RNA, 21 nt, Homo sapiens
ucugccggcccccaggacaag

SEQ ID NO: 1798906 - RNA, 16 nt, Homo sapiens
ggaccaggagugggug

SEQ ID NO: 1798907 - RNA, 19 nt, Homo sapiens
uguguccaugugugugcaa

SEQ ID NO: 1798908 - RNA, 16 nt, Homo sapiens
cuaagucaauuccacc

SEQ ID NO: 1798909 - RNA, 17 nt, Homo sapiens
cuaagaugaaauugcca

SEQ ID NO: 1798910 - RNA, 22 nt, Homo sapiens
uuccuagugccuacaaugggaa

SEQ ID NO: 1798911 - RNA, 17 nt, Homo sapiens
cuuguuccccuaaucua

SEQ ID NO: 1798912 - RNA, 23 nt, Homo sapiens
agcuauccagugacuuguucuga

SEQ ID NO: 1798913 - RNA, 15 nt, Homo sapiens
caucuuauagcacuu

SEQ ID NO: 1798914 - RNA, 19 nt, Homo sapiens
aagguuuaugggcauccuc

SEQ ID NO: 1798915 - RNA, 13 nt, Homo sapiens
aauucacucccac

SEQ ID NO: 1798916 - RNA, 14 nt, Homo sapiens
gccucccaagcacc

SEQ ID NO: 1798917 - RNA, 12 nt, Homo sapiens
auuuccagugag

SEQ ID NO: 1798918 - RNA, 17 nt, Homo sapiens
ugagacucuagggucca

SEQ ID NO: 1798919 - RNA, 18 nt, Homo sapiens
agacuuuuguguaaaaag

SEQ ID NO: 1798920 - RNA, 22 nt, Homo sapiens
uccgcccccggauuugcucagg

SEQ ID NO: 1798921 - RNA, 17 nt, Homo sapiens
uaaggaaacugcuuuau

SEQ ID NO: 1798922 - RNA, 22 nt, Homo sapiens
gcuguauguuugaucacacagc

SEQ ID NO: 1798923 - RNA, 17 nt, Homo sapiens
agagaauuuggagccag

SEQ ID NO: 1798924 - RNA, 13 nt, Homo sapiens
caaucuacacugc

SEQ ID NO: 1798925 - RNA, 21 nt, Homo sapiens
gauagauuuucuucugagacu

SEQ ID NO: 1798926 - RNA, 13 nt, Homo sapiens
ucugggucuacca

SEQ ID NO: 1798927 - RNA, 18 nt, Homo sapiens
acaggccucuccauuugc

SEQ ID NO: 1798928 - RNA, 17 nt, Homo sapiens
caccuccugccucaggu

SEQ ID NO: 1798929 - RNA, 13 nt, Homo sapiens
aggaccacagugg

SEQ ID NO: 1798930 - RNA, 24 nt, Homo sapiens
gaguaggugggggaacacugagaa

SEQ ID NO: 1798931 - RNA, 19 nt, Homo sapiens
aucuaccccuuccagaagc

SEQ ID NO: 1798932 - RNA, 14 nt, Homo sapiens
uuaaugcacuaaaa

SEQ ID NO: 1798933 - RNA, 11 nt, Homo sapiens
agaaaacucaa

SEQ ID NO: 1798934 - RNA, 19 nt, Homo sapiens
gaugcugccggcacagcug

SEQ ID NO: 1798935 - RNA, 23 nt, Homo sapiens
aaacugcuucccuuacuuugcug

SEQ ID NO: 1798936 - RNA, 18 nt, Homo sapiens
aacacccagaggucucau

SEQ ID NO: 1798937 - RNA, 13 nt, Homo sapiens
gucuucaaucucu

SEQ ID NO: 1798938 - RNA, 14 nt, Homo sapiens
uagaguugauacua

SEQ ID NO: 1798939 - RNA, 24 nt, Homo sapiens
agaauuguuaccugucauuuugca

SEQ ID NO: 1798940 - RNA, 14 nt, Homo sapiens
gcucuuccauuucu

SEQ ID NO: 1798941 - RNA, 17 nt, Homo sapiens
gcucaaacaacauucca

SEQ ID NO: 1798942 - RNA, 15 nt, Homo sapiens
gguuaacacgagcua

SEQ ID NO: 1798943 - RNA, 16 nt, Homo sapiens
uaagugacacagacau

SEQ ID NO: 1798944 - RNA, 22 nt, Homo sapiens
agauaauuguuucauucauccu

SEQ ID NO: 1798945 - RNA, 17 nt, Homo sapiens
aauggagcucaguaaca

SEQ ID NO: 1798946 - RNA, 21 nt, Homo sapiens
cgccuguaaucccagcacuuu

SEQ ID NO: 1798947 - RNA, 16 nt, Homo sapiens
ugcaguggccccuuag

SEQ ID NO: 1798948 - RNA, 16 nt, Homo sapiens
gaagcuggugcgcccu

SEQ ID NO: 1798949 - RNA, 12 nt, Homo sapiens
ugcuccaucucc

SEQ ID NO: 1798950 - RNA, 22 nt, Homo sapiens
aauucagaagaccccugacuca

SEQ ID NO: 1798951 - RNA, 14 nt, Homo sapiens
ucacggccaagugu

SEQ ID NO: 1798952 - RNA, 23 nt, Homo sapiens
auggcuggggccgcugggguccg

SEQ ID NO: 1798953 - RNA, 20 nt, Homo sapiens
uaccuggcuugaagcugcuc

SEQ ID NO: 1798954 - RNA, 17 nt, Homo sapiens
acaccucacugucaucu

SEQ ID NO: 1798955 - RNA, 17 nt, Homo sapiens
ugagcacacaacaggcu

SEQ ID NO: 1798956 - RNA, 18 nt, Homo sapiens
uacuucuauucagcauug

SEQ ID NO: 1798957 - RNA, 18 nt, Homo sapiens
accaucgaaaagaacaug

SEQ ID NO: 1798958 - RNA, 18 nt, Homo sapiens
cuggguggcacugccaug

SEQ ID NO: 1798959 - RNA, 15 nt, Homo sapiens
acacaaauuugccug

SEQ ID NO: 1798960 - RNA, 18 nt, Homo sapiens
gcaccugccuccggccug

SEQ ID NO: 1798961 - RNA, 20 nt, Homo sapiens
agaccgggguucaagccaug

SEQ ID NO: 1798962 - RNA, 18 nt, Homo sapiens
auaacuaguguugcuugg

SEQ ID NO: 1798963 - RNA, 20 nt, Homo sapiens
cuagauuuauuaguccuaau

SEQ ID NO: 1798964 - RNA, 15 nt, Homo sapiens
uguucugucuuccca

SEQ ID NO: 1798965 - RNA, 14 nt, Homo sapiens
gacuggccaaaaau

SEQ ID NO: 1798966 - RNA, 20 nt, Homo sapiens
aacuucucgcaacugaagga

SEQ ID NO: 1798967 - RNA, 17 nt, Homo sapiens
aguacucuaauauacag

SEQ ID NO: 1798968 - RNA, 18 nt, Homo sapiens
cauuaucgggagcagugu

SEQ ID NO: 1798969 - RNA, 18 nt, Homo sapiens
gagccuauaucuucaucu

SEQ ID NO: 1798970 - RNA, 13 nt, Homo sapiens
cggguguguacac

SEQ ID NO: 1798971 - RNA, 23 nt, Homo sapiens
cuaccuguuacuauuaucugugc

SEQ ID NO: 1798972 - RNA, 20 nt, Homo sapiens
cacacuucuugaaacagccu

SEQ ID NO: 1798973 - RNA, 13 nt, Homo sapiens
acagcccugucag

SEQ ID NO: 1798974 - RNA, 16 nt, Homo sapiens
aggugcugaucugugg

SEQ ID NO: 1798975 - RNA, 19 nt, Homo sapiens
cuguuuuuugaugcuuggc

SEQ ID NO: 1798976 - RNA, 17 nt, Homo sapiens
agcuaguggcuucaaaa

SEQ ID NO: 1798977 - RNA, 14 nt, Homo sapiens
cagcuccugaccaa

SEQ ID NO: 1798978 - RNA, 14 nt, Homo sapiens
aacagcacugacua

SEQ ID NO: 1798979 - RNA, 20 nt, Homo sapiens
gauucacaaugaaaugcucu

SEQ ID NO: 1798980 - RNA, 23 nt, Homo sapiens
accuuaaggaaaaguaagggaau

SEQ ID NO: 1798981 - RNA, 12 nt, Homo sapiens
caaaacacugug

SEQ ID NO: 1798982 - RNA, 15 nt, Homo sapiens
ugcugccacacuguc

SEQ ID NO: 1798983 - RNA, 22 nt, Homo sapiens
cauccaaacuaaaaggaaguca

SEQ ID NO: 1798984 - RNA, 17 nt, Homo sapiens
ccaugagaaaagggaag

SEQ ID NO: 1798985 - RNA, 12 nt, Homo sapiens
gcucauguuugg

SEQ ID NO: 1798986 - RNA, 19 nt, Homo sapiens
gaccccacuuaugcugcug

SEQ ID NO: 1798987 - RNA, 15 nt, Homo sapiens
ccgcuccaaugccua

SEQ ID NO: 1798988 - RNA, 13 nt, Homo sapiens
acucagaacccag

SEQ ID NO: 1798989 - RNA, 17 nt, Homo sapiens
aauagcuuauguacaaa

SEQ ID NO: 1798990 - RNA, 12 nt, Homo sapiens
ggccuccagggc

SEQ ID NO: 1798991 - RNA, 12 nt, Homo sapiens
uuccuccauugc

SEQ ID NO: 1798992 - RNA, 14 nt, Homo sapiens
ccugcuaaagagug

SEQ ID NO: 1798993 - RNA, 21 nt, Homo sapiens
uugauuuuaaugaaugccuaa

SEQ ID NO: 1798994 - RNA, 13 nt, Homo sapiens
acaugacuggugg

SEQ ID NO: 1798995 - RNA, 13 nt, Homo sapiens
uauggaaggugac

SEQ ID NO: 1798996 - RNA, 18 nt, Homo sapiens
gaugcucuggcuugcccc

SEQ ID NO: 1798997 - RNA, 15 nt, Homo sapiens
cugagaaggacaccu

SEQ ID NO: 1798998 - RNA, 12 nt, Homo sapiens
acuacuaccucu

SEQ ID NO: 1798999 - RNA, 23 nt, Homo sapiens
uucugucagcagugaaacuuaua

SEQ ID NO: 1799000 - RNA, 13 nt, Homo sapiens
guaguccaucacc

SEQ ID NO: 1799001 - RNA, 14 nt, Homo sapiens
aucccucuaaugag

SEQ ID NO: 1799002 - RNA, 22 nt, Homo sapiens
cccaggccagagccugugggca

SEQ ID NO: 1799003 - RNA, 20 nt, Homo sapiens
aagacacugaaauauacaca

SEQ ID NO: 1799004 - RNA, 21 nt, Homo sapiens
uuauuuacagcugugcuccac

SEQ ID NO: 1799005 - RNA, 15 nt, Homo sapiens
gugauuuacgcucau

SEQ ID NO: 1799006 - RNA, 21 nt, Homo sapiens
auaagcuguaauaucauuuua

SEQ ID NO: 1799007 - RNA, 13 nt, Homo sapiens
uccugccuagucu

SEQ ID NO: 1799008 - RNA, 20 nt, Homo sapiens
cccaacuacccgggccugac

SEQ ID NO: 1799009 - RNA, 15 nt, Homo sapiens
uuuagaugaauguca

SEQ ID NO: 1799010 - RNA, 18 nt, Homo sapiens
guggacagucugcucuag

SEQ ID NO: 1799011 - RNA, 21 nt, Homo sapiens
cuuuagcuagaagaauuucaa

SEQ ID NO: 1799012 - RNA, 23 nt, Homo sapiens
cacauagcugggauuugaacuga

SEQ ID NO: 1799013 - RNA, 21 nt, Homo sapiens
accacuauucuuaacuauuca

SEQ ID NO: 1799014 - RNA, 16 nt, Homo sapiens
aaacuaaaucucuaau

SEQ ID NO: 1799015 - RNA, 17 nt, Homo sapiens
ucugccaucaacuacua

SEQ ID NO: 1799016 - RNA, 14 nt, Homo sapiens
ugcacaacaaagga

SEQ ID NO: 1799017 - RNA, 17 nt, Homo sapiens
aaaugcucuuuugcaca

SEQ ID NO: 1799018 - RNA, 15 nt, Homo sapiens
gcaggccagggcagu

SEQ ID NO: 1799019 - RNA, 22 nt, Homo sapiens
aguaagacagauucuucacugu

SEQ ID NO: 1799020 - RNA, 19 nt, Homo sapiens
uacaagucagcuccagcuu

SEQ ID NO: 1799021 - RNA, 16 nt, Homo sapiens
uuucaagucauauucu

SEQ ID NO: 1799022 - RNA, 16 nt, Homo sapiens
cagaacagacacuuua

SEQ ID NO: 1799023 - RNA, 17 nt, Homo sapiens
cucggcagucacuucca

SEQ ID NO: 1799024 - RNA, 22 nt, Homo sapiens
ucaacugagguucuugggauac

SEQ ID NO: 1799025 - RNA, 17 nt, Homo sapiens
caccuguguacugagua

SEQ ID NO: 1799026 - RNA, 18 nt, Homo sapiens
cuaguaauguagauuuac

SEQ ID NO: 1799027 - RNA, 23 nt, Homo sapiens
uaaaauauguaguugugucuuaa

SEQ ID NO: 1799028 - RNA, 20 nt, Homo sapiens
uugauauuuaagcagcuuga

SEQ ID NO: 1799029 - RNA, 17 nt, Homo sapiens
uggguucugcacagcug

SEQ ID NO: 1799030 - RNA, 23 nt, Homo sapiens
gggaaaagaaaaagauugagaga

SEQ ID NO: 1799031 - RNA, 18 nt, Homo sapiens
guuaacgucaucucaggg

SEQ ID NO: 1799032 - RNA, 17 nt, Homo sapiens
uuuaaacauuaugaugu

SEQ ID NO: 1799033 - RNA, 20 nt, Homo sapiens
aucauuacugccaucuuuau

SEQ ID NO: 1799034 - RNA, 11 nt, Homo sapiens
auaugucuuca

SEQ ID NO: 1799035 - RNA, 15 nt, Homo sapiens
cuagcccacuuguca

SEQ ID NO: 1799036 - RNA, 20 nt, Homo sapiens
cgccgcagguguuuggcacc

SEQ ID NO: 1799037 - RNA, 18 nt, Homo sapiens
ucugacaguccuuggggu

SEQ ID NO: 1799038 - RNA, 14 nt, Homo sapiens
cuccgcugcuuacu

SEQ ID NO: 1799039 - RNA, 17 nt, Homo sapiens
auuucugaaaugugcag

SEQ ID NO: 1799040 - RNA, 16 nt, Homo sapiens
uucucucugugcuggu

SEQ ID NO: 1799041 - RNA, 22 nt, Homo sapiens
ugggaacagggacgggggagcu

SEQ ID NO: 1799042 - RNA, 18 nt, Homo sapiens
caggaguucgaguuacag

SEQ ID NO: 1799043 - RNA, 14 nt, Homo sapiens
uugauucaguauua

SEQ ID NO: 1799044 - RNA, 14 nt, Homo sapiens
uagaaucagaauaa

SEQ ID NO: 1799045 - RNA, 14 nt, Homo sapiens
uuaacacagugucu

SEQ ID NO: 1799046 - RNA, 22 nt, Homo sapiens
agccuuuguugcuaucaaucca

SEQ ID NO: 1799047 - RNA, 22 nt, Homo sapiens
cccccaucccuacccuugucca

SEQ ID NO: 1799048 - RNA, 14 nt, Homo sapiens
accuggacggugcg

SEQ ID NO: 1799049 - RNA, 16 nt, Homo sapiens
cauaccaccaccaaga

SEQ ID NO: 1799050 - RNA, 22 nt, Homo sapiens
agcaguuugcuuuguaugcacu

SEQ ID NO: 1799051 - RNA, 20 nt, Homo sapiens
auuccaaaguucuuaucucu

SEQ ID NO: 1799052 - RNA, 18 nt, Homo sapiens
ccacaccacagguucuca

SEQ ID NO: 1799053 - RNA, 15 nt, Homo sapiens
ugguuauauguauau

SEQ ID NO: 1799054 - RNA, 21 nt, Homo sapiens
accagcagaucccagcucacg

SEQ ID NO: 1799055 - RNA, 18 nt, Homo sapiens
guuuauuaagcaucagaa

SEQ ID NO: 1799056 - RNA, 19 nt, Homo sapiens
ugauauguucaacuggaga

SEQ ID NO: 1799057 - RNA, 19 nt, Homo sapiens
acaaauuuuuuucuuguuu

SEQ ID NO: 1799058 - RNA, 16 nt, Homo sapiens
cuucuuucaucugggg

SEQ ID NO: 1799059 - RNA, 19 nt, Homo sapiens
auuuauaaaacuucucaag

SEQ ID NO: 1799060 - RNA, 16 nt, Homo sapiens
caugccuccugcacac

SEQ ID NO: 1799061 - RNA, 12 nt, Homo sapiens
ucuccaugcugc

SEQ ID NO: 1799062 - RNA, 14 nt, Homo sapiens
uagaguauaugcac

SEQ ID NO: 1799063 - RNA, 22 nt, Homo sapiens
cuuucaugaauucugucauuuc

SEQ ID NO: 1799064 - RNA, 20 nt, Homo sapiens
cuguuaugcuguuuccuagc

SEQ ID NO: 1799065 - RNA, 23 nt, Homo sapiens
aaugcccuaccugccuguucucc

SEQ ID NO: 1799066 - RNA, 19 nt, Homo sapiens
ucacaggcauauucccugc

SEQ ID NO: 1799067 - RNA, 17 nt, Homo sapiens
ccuccaccacaucugcc

SEQ ID NO: 1799068 - RNA, 21 nt, Homo sapiens
caacaguucuuguuagaauca

SEQ ID NO: 1799069 - RNA, 23 nt, Homo sapiens
cuucaggguccugagauuuacac

SEQ ID NO: 1799070 - RNA, 17 nt, Homo sapiens
gauuaugcccaauauua

SEQ ID NO: 1799071 - RNA, 23 nt, Homo sapiens
aggcccugucagcauguuuccag

SEQ ID NO: 1799072 - RNA, 17 nt, Homo sapiens
aaacccuucucuucucc

SEQ ID NO: 1799073 - RNA, 16 nt, Homo sapiens
gcgggcauggcgugga

SEQ ID NO: 1799074 - RNA, 21 nt, Homo sapiens
uuugaaugaguuuauauggaa

SEQ ID NO: 1799075 - RNA, 22 nt, Homo sapiens
agucagccaucgccaacuuguc

SEQ ID NO: 1799076 - RNA, 15 nt, Homo sapiens
uagcugggacuacag

SEQ ID NO: 1799077 - RNA, 19 nt, Homo sapiens
gauccuccaacagcuguca

SEQ ID NO: 1799078 - RNA, 16 nt, Homo sapiens
gcuguuccaccuuccc

SEQ ID NO: 1799079 - RNA, 19 nt, Homo sapiens
agucuuguuuuuuauucag

SEQ ID NO: 1799080 - RNA, 21 nt, Homo sapiens
cgccauugagaaugugcuuug

SEQ ID NO: 1799081 - RNA, 17 nt, Homo sapiens
uuugaggccaaaacaga

SEQ ID NO: 1799082 - RNA, 12 nt, Homo sapiens
aguuucugaguc

SEQ ID NO: 1799083 - RNA, 21 nt, Homo sapiens
uuugugauucccuccagugaa

SEQ ID NO: 1799084 - RNA, 16 nt, Homo sapiens
ugaugggcuguucuaa

SEQ ID NO: 1799085 - RNA, 21 nt, Homo sapiens
ugggagcuucccacaccugcc

SEQ ID NO: 1799086 - RNA, 19 nt, Homo sapiens
auucuuaagggaacuucca

SEQ ID NO: 1799087 - RNA, 15 nt, Homo sapiens
caaauuuaagcaaga

SEQ ID NO: 1799088 - RNA, 10 nt, Homo sapiens
ccauuccucu

SEQ ID NO: 1799089 - RNA, 20 nt, Homo sapiens
cacaugacauagcacuugcc

SEQ ID NO: 1799090 - RNA, 15 nt, Homo sapiens
auccucguucuaaua

SEQ ID NO: 1799091 - RNA, 13 nt, Homo sapiens
guauauuuuggga

SEQ ID NO: 1799092 - RNA, 13 nt, Homo sapiens
uuaaaaaacagag

SEQ ID NO: 1799093 - RNA, 20 nt, Homo sapiens
uacguucaucaccugcuaga

SEQ ID NO: 1799094 - RNA, 15 nt, Homo sapiens
agacauuugcugaac

SEQ ID NO: 1799095 - RNA, 14 nt, Homo sapiens
ugcguucacuccaa

SEQ ID NO: 1799096 - RNA, 14 nt, Homo sapiens
gcuguagaugacaa

SEQ ID NO: 1799097 - RNA, 16 nt, Homo sapiens
cacaggagcguguacu

SEQ ID NO: 1799098 - RNA, 19 nt, Homo sapiens
caggagcauguccuauccc

SEQ ID NO: 1799099 - RNA, 20 nt, Homo sapiens
auccgaaccuccucugugaa

SEQ ID NO: 1799100 - RNA, 17 nt, Homo sapiens
cccaaaucucaaaagau

SEQ ID NO: 1799101 - RNA, 21 nt, Homo sapiens
auguguaaagaucuacaugaa

SEQ ID NO: 1799102 - RNA, 15 nt, Homo sapiens
gcuauuuccauucca

SEQ ID NO: 1799103 - RNA, 22 nt, Homo sapiens
ggcagaagagacccaaccacuu

SEQ ID NO: 1799104 - RNA, 20 nt, Homo sapiens
ugcuaaugcaauuagcauua

SEQ ID NO: 1799105 - RNA, 16 nt, Homo sapiens
uaaaaauguccugccu

SEQ ID NO: 1799106 - RNA, 22 nt, Homo sapiens
ugguggggccauacccaugugu

SEQ ID NO: 1799107 - RNA, 12 nt, Homo sapiens
cugaaaagggaa

SEQ ID NO: 1799108 - RNA, 13 nt, Homo sapiens
uauguccaugaaa

SEQ ID NO: 1799109 - RNA, 13 nt, Homo sapiens
uacugaugugaua

SEQ ID NO: 1799110 - RNA, 19 nt, Homo sapiens
uaggagcaacuucucugau

SEQ ID NO: 1799111 - RNA, 18 nt, Homo sapiens
cuugugcacuggaugugg

SEQ ID NO: 1799112 - RNA, 13 nt, Homo sapiens
ccuuuguugucua

SEQ ID NO: 1799113 - RNA, 14 nt, Homo sapiens
ccacagguuuuagc

SEQ ID NO: 1799114 - RNA, 14 nt, Homo sapiens
uaaagccaaaguuu

SEQ ID NO: 1799115 - RNA, 22 nt, Homo sapiens
acguauuuuuucuaaugugcau

SEQ ID NO: 1799116 - RNA, 21 nt, Homo sapiens
ucuuuacaaaacuacaugaga

SEQ ID NO: 1799117 - RNA, 20 nt, Homo sapiens
ucacaucaugcuguuuuauc

SEQ ID NO: 1799118 - RNA, 17 nt, Homo sapiens
ugaaaugucgaucaaga

SEQ ID NO: 1799119 - RNA, 14 nt, Homo sapiens
ucaauaugugaaag

SEQ ID NO: 1799120 - RNA, 14 nt, Homo sapiens
cuaggaaugcuuuu

SEQ ID NO: 1799121 - RNA, 23 nt, Homo sapiens
uuccgggacaaguggucugggac

SEQ ID NO: 1799122 - RNA, 20 nt, Homo sapiens
ugccauccucaaacacugca

SEQ ID NO: 1799123 - RNA, 13 nt, Homo sapiens
ucuccuugccuuc

SEQ ID NO: 1799124 - RNA, 13 nt, Homo sapiens
cacacuuugaagg

SEQ ID NO: 1799125 - RNA, 18 nt, Homo sapiens
gcuguggccucacuuccc

SEQ ID NO: 1799126 - RNA, 19 nt, Homo sapiens
cgcucagaacaguaucuuu

SEQ ID NO: 1799127 - RNA, 17 nt, Homo sapiens
accuugcuaagcacucu

SEQ ID NO: 1799128 - RNA, 15 nt, Homo sapiens
ccacaguguuaccug

SEQ ID NO: 1799129 - RNA, 19 nt, Homo sapiens
cucuccaaacagucaccau

SEQ ID NO: 1799130 - RNA, 14 nt, Homo sapiens
gcccuucagugccc

SEQ ID NO: 1799131 - RNA, 11 nt, Homo sapiens
ccuaugaauaa

SEQ ID NO: 1799132 - RNA, 15 nt, Homo sapiens
gacagcaucaaagag

SEQ ID NO: 1799133 - RNA, 14 nt, Homo sapiens
cuagccagcaaaga

SEQ ID NO: 1799134 - RNA, 15 nt, Homo sapiens
ugauuuaucuuucaa

SEQ ID NO: 1799135 - RNA, 24 nt, Homo sapiens
caaagaauugauucauguucauca

SEQ ID NO: 1799136 - RNA, 14 nt, Homo sapiens
ccccaggcacuguu

SEQ ID NO: 1799137 - RNA, 23 nt, Homo sapiens
uaaaauaauuuuaaaaguuggga

SEQ ID NO: 1799138 - RNA, 22 nt, Homo sapiens
uuugcuuguguacaaacccaga

SEQ ID NO: 1799139 - RNA, 21 nt, Homo sapiens
gauauugaucaaauauagaaa

SEQ ID NO: 1799140 - RNA, 13 nt, Homo sapiens
aaaggaaaaccag

SEQ ID NO: 1799141 - RNA, 21 nt, Homo sapiens
acagacagggccuagcuuuca

SEQ ID NO: 1799142 - RNA, 15 nt, Homo sapiens
uuuaacaacuaugau

SEQ ID NO: 1799143 - RNA, 22 nt, Homo sapiens
ccugugucggggcugaccucuc

SEQ ID NO: 1799144 - RNA, 19 nt, Homo sapiens
uguggguguggcaguuaca

SEQ ID NO: 1799145 - RNA, 15 nt, Homo sapiens
gaacacuguucuacc

SEQ ID NO: 1799146 - RNA, 14 nt, Homo sapiens
acagacacuuuuca

SEQ ID NO: 1799147 - RNA, 14 nt, Homo sapiens
ucuuacacauagca

SEQ ID NO: 1799148 - RNA, 19 nt, Homo sapiens
caaacuacugccauuucag

SEQ ID NO: 1799149 - RNA, 19 nt, Homo sapiens
auucaaaaacauaacugag

SEQ ID NO: 1799150 - RNA, 22 nt, Homo sapiens
caagaaaaccuagaucugcacu

SEQ ID NO: 1799151 - RNA, 16 nt, Homo sapiens
acuuauuucagccaaa

SEQ ID NO: 1799152 - RNA, 24 nt, Homo sapiens
uucucuauuguauccaaaggagaa

SEQ ID NO: 1799153 - RNA, 17 nt, Homo sapiens
uuuuacccacacacaga

SEQ ID NO: 1799154 - RNA, 10 nt, Homo sapiens
caacauucau

SEQ ID NO: 1799155 - RNA, 21 nt, Homo sapiens
gagacuaugugucaugauuuc

SEQ ID NO: 1799156 - RNA, 19 nt, Homo sapiens
ugauuaaaaaugcuuuuag

SEQ ID NO: 1799157 - RNA, 15 nt, Homo sapiens
uauuaagccacuuaa

SEQ ID NO: 1799158 - RNA, 21 nt, Homo sapiens
cccuguauucucagcacuuug

SEQ ID NO: 1799159 - RNA, 23 nt, Homo sapiens
acaugcuauguucugucuuccca

SEQ ID NO: 1799160 - RNA, 13 nt, Homo sapiens
aguuaauccaaac

SEQ ID NO: 1799161 - RNA, 18 nt, Homo sapiens
ucugacugccaagccaga

SEQ ID NO: 1799162 - RNA, 19 nt, Homo sapiens
auguauuuguaguguuauu

SEQ ID NO: 1799163 - RNA, 13 nt, Homo sapiens
cugucauguggaa

SEQ ID NO: 1799164 - RNA, 23 nt, Homo sapiens
cuuucagccugcuucuuccccag

SEQ ID NO: 1799165 - RNA, 16 nt, Homo sapiens
acagagauugaacucc

SEQ ID NO: 1799166 - RNA, 22 nt, Homo sapiens
gaguauuaaugaaaagcacaaa

SEQ ID NO: 1799167 - RNA, 23 nt, Homo sapiens
uuuuacaauaaaacuuugcugcc

SEQ ID NO: 1799168 - RNA, 21 nt, Homo sapiens
uucuaaagacuuguauagcau

SEQ ID NO: 1799169 - RNA, 17 nt, Homo sapiens
aaauagauccagugcug

SEQ ID NO: 1799170 - RNA, 14 nt, Homo sapiens
cacagucacuggau

SEQ ID NO: 1799171 - RNA, 19 nt, Homo sapiens
auguacagauauacuucag

SEQ ID NO: 1799172 - RNA, 19 nt, Homo sapiens
cgagccauagagccugaaa

SEQ ID NO: 1799173 - RNA, 14 nt, Homo sapiens
cagggccacucaac

SEQ ID NO: 1799174 - RNA, 14 nt, Homo sapiens
guccugggcaaagg

SEQ ID NO: 1799175 - RNA, 13 nt, Homo sapiens
gucucaugugguc

SEQ ID NO: 1799176 - RNA, 21 nt, Homo sapiens
cuauugaaaacagugucuuga

SEQ ID NO: 1799177 - RNA, 20 nt, Homo sapiens
cagagcaaugacugugcuca

SEQ ID NO: 1799178 - RNA, 22 nt, Homo sapiens
ggaaacggcucuuguuugaaag

SEQ ID NO: 1799179 - RNA, 23 nt, Homo sapiens
ugacacgccuaaggucacagcua

SEQ ID NO: 1799180 - RNA, 19 nt, Homo sapiens
aacccuucaacuaugcaau

SEQ ID NO: 1799181 - RNA, 18 nt, Homo sapiens
aaucugcaccccacuuca

SEQ ID NO: 1799182 - RNA, 18 nt, Homo sapiens
cugccuggccaggcccug

SEQ ID NO: 1799183 - RNA, 16 nt, Homo sapiens
cucuuacauugaaugu

SEQ ID NO: 1799184 - RNA, 12 nt, Homo sapiens
acccaucugcac

SEQ ID NO: 1799185 - RNA, 15 nt, Homo sapiens
ccacccccuccuguc

SEQ ID NO: 1799186 - RNA, 21 nt, Homo sapiens
ccuuccugcugcgcaguucuc

SEQ ID NO: 1799187 - RNA, 15 nt, Homo sapiens
gauacugcaaaggcu

SEQ ID NO: 1799188 - RNA, 14 nt, Homo sapiens
guaacugcaccugg

SEQ ID NO: 1799189 - RNA, 15 nt, Homo sapiens
uuggaagcauacaaa

SEQ ID NO: 1799190 - RNA, 18 nt, Homo sapiens
uagcucaauacaauguga

SEQ ID NO: 1799191 - RNA, 14 nt, Homo sapiens
agauggcaggcuac

SEQ ID NO: 1799192 - RNA, 22 nt, Homo sapiens
acagcuagaaagcugcacuggu

SEQ ID NO: 1799193 - RNA, 17 nt, Homo sapiens
ccgugguuuguacucaa

SEQ ID NO: 1799194 - RNA, 12 nt, Homo sapiens
acaaaacaaagc

SEQ ID NO: 1799195 - RNA, 15 nt, Homo sapiens
cuagcucuuggggaa

SEQ ID NO: 1799196 - RNA, 22 nt, Homo sapiens
gaaccaaucaagguagaacaaa

SEQ ID NO: 1799197 - RNA, 16 nt, Homo sapiens
cuuguucucacugucu

SEQ ID NO: 1799198 - RNA, 16 nt, Homo sapiens
uaauauauccaugauc

SEQ ID NO: 1799199 - RNA, 13 nt, Homo sapiens
agguccuccucuc

SEQ ID NO: 1799200 - RNA, 13 nt, Homo sapiens
cucaccucaggac

SEQ ID NO: 1799201 - RNA, 17 nt, Homo sapiens
uaaacuccuacuaaauc

SEQ ID NO: 1799202 - RNA, 15 nt, Homo sapiens
aagugguuaaaacau

SEQ ID NO: 1799203 - RNA, 18 nt, Homo sapiens
cacaauacagugguauaa

SEQ ID NO: 1799204 - RNA, 16 nt, Homo sapiens
guagaauauucagaca

SEQ ID NO: 1799205 - RNA, 23 nt, Homo sapiens
gugaauuuguuugugacaacuaa

SEQ ID NO: 1799206 - RNA, 16 nt, Homo sapiens
agaaaggacuguaaaa

SEQ ID NO: 1799207 - RNA, 15 nt, Homo sapiens
uaauaaagacagggu

SEQ ID NO: 1799208 - RNA, 23 nt, Homo sapiens
uugaaaauauaugacuuugaaua

SEQ ID NO: 1799209 - RNA, 14 nt, Homo sapiens
agaagcaagccaga

SEQ ID NO: 1799210 - RNA, 14 nt, Homo sapiens
ggaauaaaaccauc

SEQ ID NO: 1799211 - RNA, 16 nt, Homo sapiens
cguuugugcauaucug

SEQ ID NO: 1799212 - RNA, 20 nt, Homo sapiens
ugcaauauuuccucauguga

SEQ ID NO: 1799213 - RNA, 16 nt, Homo sapiens
ugcuuguaaaggugcu

SEQ ID NO: 1799214 - RNA, 20 nt, Homo sapiens
aggccuccagccccaugugu

SEQ ID NO: 1799215 - RNA, 20 nt, Homo sapiens
cuccagacucuagauguuua

SEQ ID NO: 1799216 - RNA, 12 nt, Homo sapiens
aaaggcauauau

SEQ ID NO: 1799217 - RNA, 22 nt, Homo sapiens
aggacaccugccuucaaagcca

SEQ ID NO: 1799218 - RNA, 13 nt, Homo sapiens
ugauuuucaugaa

SEQ ID NO: 1799219 - RNA, 14 nt, Homo sapiens
acaauguacaauua

SEQ ID NO: 1799220 - RNA, 23 nt, Homo sapiens
ccuggagaugcagcuacuggaau

SEQ ID NO: 1799221 - RNA, 15 nt, Homo sapiens
acacuggugguucua

SEQ ID NO: 1799222 - RNA, 22 nt, Homo sapiens
cccaaaacugauacccuuugaa

SEQ ID NO: 1799223 - RNA, 22 nt, Homo sapiens
aaauauguccgcagaauggacu

SEQ ID NO: 1799224 - RNA, 14 nt, Homo sapiens
gcggugcagcgugu

SEQ ID NO: 1799225 - RNA, 22 nt, Homo sapiens
cugugcugaacauaacuucuca

SEQ ID NO: 1799226 - RNA, 18 nt, Homo sapiens
cagauaaacaacaaauaa

SEQ ID NO: 1799227 - RNA, 14 nt, Homo sapiens
agggggaccugucc

SEQ ID NO: 1799228 - RNA, 15 nt, Homo sapiens
augcauccauuucag

SEQ ID NO: 1799229 - RNA, 13 nt, Homo sapiens
ucagaagauaucu

SEQ ID NO: 1799230 - RNA, 22 nt, Homo sapiens
aguuugcaaauagaacuaauac

SEQ ID NO: 1799231 - RNA, 22 nt, Homo sapiens
ugaaacuuugagaucuaaaaau

SEQ ID NO: 1799232 - RNA, 17 nt, Homo sapiens
caggcagccucugucag

SEQ ID NO: 1799233 - RNA, 18 nt, Homo sapiens
aucuugccagccucaggc

SEQ ID NO: 1799234 - RNA, 20 nt, Homo sapiens
ugagucuguguuguguccug

SEQ ID NO: 1799235 - RNA, 15 nt, Homo sapiens
uugagcuccccaaaa

SEQ ID NO: 1799236 - RNA, 15 nt, Homo sapiens
ugggcauugacaaau

SEQ ID NO: 1799237 - RNA, 19 nt, Homo sapiens
cagugguuuagaaauuacu

SEQ ID NO: 1799238 - RNA, 17 nt, Homo sapiens
ggccaggcuggucucaa

SEQ ID NO: 1799239 - RNA, 18 nt, Homo sapiens
accuccugaguaauaagc

SEQ ID NO: 1799240 - RNA, 14 nt, Homo sapiens
cuucucuccuugcc

SEQ ID NO: 1799241 - RNA, 19 nt, Homo sapiens
gucacuugcuggcugugaa

SEQ ID NO: 1799242 - RNA, 17 nt, Homo sapiens
accagaggaaacuugca

SEQ ID NO: 1799243 - RNA, 17 nt, Homo sapiens
gccaggugaacuggaau

SEQ ID NO: 1799244 - RNA, 12 nt, Homo sapiens
cuuguaccucaa

SEQ ID NO: 1799245 - RNA, 20 nt, Homo sapiens
aauguauauuuugaugagcu

SEQ ID NO: 1799246 - RNA, 17 nt, Homo sapiens
ugccuucugcacauaaa

SEQ ID NO: 1799247 - RNA, 18 nt, Homo sapiens
auuugcauuucagaauau

SEQ ID NO: 1799248 - RNA, 12 nt, Homo sapiens
gucaucaucaag

SEQ ID NO: 1799249 - RNA, 22 nt, Homo sapiens
gaggcuucuccuucuccuuccc

SEQ ID NO: 1799250 - RNA, 16 nt, Homo sapiens
ucaaaggagcuuucuc

SEQ ID NO: 1799251 - RNA, 12 nt, Homo sapiens
cuuuuucauaua

SEQ ID NO: 1799252 - RNA, 12 nt, Homo sapiens
uauauucacuuu

SEQ ID NO: 1799253 - RNA, 20 nt, Homo sapiens
aggcuggagugcaguggcuc

SEQ ID NO: 1799254 - RNA, 14 nt, Homo sapiens
cagucgcccggggc

SEQ ID NO: 1799255 - RNA, 23 nt, Homo sapiens
ccaggaggcagcuguugcaguga

SEQ ID NO: 1799256 - RNA, 19 nt, Homo sapiens
acaguccuaccucaguuca

SEQ ID NO: 1799257 - RNA, 17 nt, Homo sapiens
ucaugagccugcuggaa

SEQ ID NO: 1799258 - RNA, 14 nt, Homo sapiens
cugcucaguuucug

SEQ ID NO: 1799259 - RNA, 17 nt, Homo sapiens
gccggcauggugccugg

SEQ ID NO: 1799260 - RNA, 21 nt, Homo sapiens
ucaggccagugugucucugaa

SEQ ID NO: 1799261 - RNA, 16 nt, Homo sapiens
caccagggucccagga

SEQ ID NO: 1799262 - RNA, 23 nt, Homo sapiens
guucuaccaauuauagaucaaau

SEQ ID NO: 1799263 - RNA, 21 nt, Homo sapiens
uaacaagggcugcaaugcccu

SEQ ID NO: 1799264 - RNA, 16 nt, Homo sapiens
auaaacugcuuugcaa

SEQ ID NO: 1799265 - RNA, 16 nt, Homo sapiens
ucaccagcugcaaagu

SEQ ID NO: 1799266 - RNA, 14 nt, Homo sapiens
aaucagauucagga

SEQ ID NO: 1799267 - RNA, 21 nt, Homo sapiens
caccuagaaaggaacugcaau

SEQ ID NO: 1799268 - RNA, 19 nt, Homo sapiens
ccuucuccccucagccaau

SEQ ID NO: 1799269 - RNA, 21 nt, Homo sapiens
cauaaaaucuuggcgagucau

SEQ ID NO: 1799270 - RNA, 16 nt, Homo sapiens
caucucuuuaccuggg

SEQ ID NO: 1799271 - RNA, 15 nt, Homo sapiens
aaagaaaaaccacga

SEQ ID NO: 1799272 - RNA, 16 nt, Homo sapiens
cugaggacuaugccau

SEQ ID NO: 1799273 - RNA, 21 nt, Homo sapiens
acaguggggaaggcaugacac

SEQ ID NO: 1799274 - RNA, 22 nt, Homo sapiens
caccauauuaccacagacauac

SEQ ID NO: 1799275 - RNA, 21 nt, Homo sapiens
ccaggguuccagacagggugg

SEQ ID NO: 1799276 - RNA, 19 nt, Homo sapiens
caucaaauggaagacacau

SEQ ID NO: 1799277 - RNA, 21 nt, Homo sapiens
aguugggcaaaacccaggaca

SEQ ID NO: 1799278 - RNA, 16 nt, Homo sapiens
agaugcuuaaaaaccu

SEQ ID NO: 1799279 - RNA, 23 nt, Homo sapiens
uacacuuuaugccggaugugcuu

SEQ ID NO: 1799280 - RNA, 16 nt, Homo sapiens
gccacuguuaagccau

SEQ ID NO: 1799281 - RNA, 13 nt, Homo sapiens
ccuccaacccugc

SEQ ID NO: 1799282 - RNA, 15 nt, Homo sapiens
uuuauaucuauagua

SEQ ID NO: 1799283 - RNA, 22 nt, Homo sapiens
caggguggagaugaggugcuca

SEQ ID NO: 1799284 - RNA, 13 nt, Homo sapiens
caaucauguacug

SEQ ID NO: 1799285 - RNA, 12 nt, Homo sapiens
agagucaucuca

SEQ ID NO: 1799286 - RNA, 23 nt, Homo sapiens
agcagccuggaagaaacagucca

SEQ ID NO: 1799287 - RNA, 20 nt, Homo sapiens
uuauaaacaaacaaacauug

SEQ ID NO: 1799288 - RNA, 14 nt, Homo sapiens
acacuguaccccag

SEQ ID NO: 1799289 - RNA, 15 nt, Homo sapiens
ucauucuucuggcaa

SEQ ID NO: 1799290 - RNA, 16 nt, Homo sapiens
agggagagagugcuau

SEQ ID NO: 1799291 - RNA, 10 nt, Homo sapiens
aacuucccag

SEQ ID NO: 1799292 - RNA, 18 nt, Homo sapiens
ucuuccaaacaggcucag

SEQ ID NO: 1799293 - RNA, 17 nt, Homo sapiens
uguacacugacuugaga

SEQ ID NO: 1799294 - RNA, 13 nt, Homo sapiens
cagacacuuauuu

SEQ ID NO: 1799295 - RNA, 11 nt, Homo sapiens
ccgggacaccu

SEQ ID NO: 1799296 - RNA, 17 nt, Homo sapiens
uacaaauuuaugcauuu

SEQ ID NO: 1799297 - RNA, 21 nt, Homo sapiens
cagaugcuguuaguaccuaca

SEQ ID NO: 1799298 - RNA, 20 nt, Homo sapiens
ccauaaacgguuccugguga

SEQ ID NO: 1799299 - RNA, 15 nt, Homo sapiens
uaggaugcuugggaa

SEQ ID NO: 1799300 - RNA, 13 nt, Homo sapiens
cugccgugcacuc

SEQ ID NO: 1799301 - RNA, 17 nt, Homo sapiens
uagauuaagaaauagac

SEQ ID NO: 1799302 - RNA, 17 nt, Homo sapiens
uuguccugaccuugaga

SEQ ID NO: 1799303 - RNA, 14 nt, Homo sapiens
gucugaacaauaua

SEQ ID NO: 1799304 - RNA, 15 nt, Homo sapiens
cugggagacugggac

SEQ ID NO: 1799305 - RNA, 15 nt, Homo sapiens
caagaacacaagaag

SEQ ID NO: 1799306 - RNA, 14 nt, Homo sapiens
acacacuggccauu

SEQ ID NO: 1799307 - RNA, 12 nt, Homo sapiens
gccaagaacuug

SEQ ID NO: 1799308 - RNA, 21 nt, Homo sapiens
gcacccuggauugaucggagc

SEQ ID NO: 1799309 - RNA, 14 nt, Homo sapiens
cagaaguuccucaa

SEQ ID NO: 1799310 - RNA, 18 nt, Homo sapiens
aucuauuuugaugcagca

SEQ ID NO: 1799311 - RNA, 18 nt, Homo sapiens
ucuggguccauacaccag

SEQ ID NO: 1799312 - RNA, 15 nt, Homo sapiens
ucaauaaaguauuua

SEQ ID NO: 1799313 - RNA, 17 nt, Homo sapiens
uacugcacuuacaaucc

SEQ ID NO: 1799314 - RNA, 17 nt, Homo sapiens
ugaagugguucagucua

SEQ ID NO: 1799315 - RNA, 21 nt, Homo sapiens
cucagcuuuuucguauuucaa

SEQ ID NO: 1799316 - RNA, 21 nt, Homo sapiens
uuucccucucucauacccucc

SEQ ID NO: 1799317 - RNA, 11 nt, Homo sapiens
uaaagcacuua

SEQ ID NO: 1799318 - RNA, 18 nt, Homo sapiens
caggacugccauuggacu

SEQ ID NO: 1799319 - RNA, 22 nt, Homo sapiens
guuuagaagagccugacugugu

SEQ ID NO: 1799320 - RNA, 15 nt, Homo sapiens
cagaacuccuaccug

SEQ ID NO: 1799321 - RNA, 14 nt, Homo sapiens
uaugaauauuucau

SEQ ID NO: 1799322 - RNA, 20 nt, Homo sapiens
uuuuugaguacuguacuauc

SEQ ID NO: 1799323 - RNA, 23 nt, Homo sapiens
uugaaggcccaggucaacaucua

SEQ ID NO: 1799324 - RNA, 18 nt, Homo sapiens
gcccauaaccaguauuuu

SEQ ID NO: 1799325 - RNA, 17 nt, Homo sapiens
aaguguacaauuuucau

SEQ ID NO: 1799326 - RNA, 14 nt, Homo sapiens
guugaaagcuguau

SEQ ID NO: 1799327 - RNA, 11 nt, Homo sapiens
uacagcacugu

SEQ ID NO: 1799328 - RNA, 13 nt, Homo sapiens
guuccauguuaaa

SEQ ID NO: 1799329 - RNA, 15 nt, Homo sapiens
gcaggaagcuuguca

SEQ ID NO: 1799330 - RNA, 14 nt, Homo sapiens
gagaaugugaacau

SEQ ID NO: 1799331 - RNA, 18 nt, Homo sapiens
auccaagauuuaaaugcc

SEQ ID NO: 1799332 - RNA, 14 nt, Homo sapiens
ugguuucauuugaa

SEQ ID NO: 1799333 - RNA, 15 nt, Homo sapiens
guguuaaaacugaau

SEQ ID NO: 1799334 - RNA, 18 nt, Homo sapiens
aguaaaaaauaacuauca

SEQ ID NO: 1799335 - RNA, 16 nt, Homo sapiens
gaauaagcaaaauuca

SEQ ID NO: 1799336 - RNA, 19 nt, Homo sapiens
aggggcuucacccaugaaa

SEQ ID NO: 1799337 - RNA, 13 nt, Homo sapiens
aggggcucuggag

SEQ ID NO: 1799338 - RNA, 13 nt, Homo sapiens
agggccucuggac

SEQ ID NO: 1799339 - RNA, 21 nt, Homo sapiens
cauaaacuuuccucuuccugc

SEQ ID NO: 1799340 - RNA, 20 nt, Homo sapiens
guuucucaaagaugcguuug

SEQ ID NO: 1799341 - RNA, 16 nt, Homo sapiens
aaaucuuuccaucuca

SEQ ID NO: 1799342 - RNA, 16 nt, Homo sapiens
acucuccucaucucua

SEQ ID NO: 1799343 - RNA, 13 nt, Homo sapiens
uccagcacccaga

SEQ ID NO: 1799344 - RNA, 15 nt, Homo sapiens
cucaauaaaucuuug

SEQ ID NO: 1799345 - RNA, 14 nt, Homo sapiens
uacuuuuaucuuaa

SEQ ID NO: 1799346 - RNA, 18 nt, Homo sapiens
ugaauuauucugauucuu

SEQ ID NO: 1799347 - RNA, 16 nt, Homo sapiens
cuuccuguuaauguau

SEQ ID NO: 1799348 - RNA, 23 nt, Homo sapiens
aucuugcaagcaaaucccauuuc

SEQ ID NO: 1799349 - RNA, 15 nt, Homo sapiens
ugcuuucaauuacaa

SEQ ID NO: 1799350 - RNA, 17 nt, Homo sapiens
gaucccugcucucugag

SEQ ID NO: 1799351 - RNA, 11 nt, Homo sapiens
caagcucugcu

SEQ ID NO: 1799352 - RNA, 17 nt, Homo sapiens
uguccucacucucgcca

SEQ ID NO: 1799353 - RNA, 18 nt, Homo sapiens
agcccagacucugagcug

SEQ ID NO: 1799354 - RNA, 18 nt, Homo sapiens
cuguugaguugcugccac

SEQ ID NO: 1799355 - RNA, 22 nt, Homo sapiens
uuaaaauguaggccuccaguuc

SEQ ID NO: 1799356 - RNA, 15 nt, Homo sapiens
cugcuuucuuuguaa

SEQ ID NO: 1799357 - RNA, 20 nt, Homo sapiens
ucuugcgggccuggacaagg

SEQ ID NO: 1799358 - RNA, 19 nt, Homo sapiens
ggaggccaagaacuugcaa

SEQ ID NO: 1799359 - RNA, 15 nt, Homo sapiens
aacucaaacaaaagu

SEQ ID NO: 1799360 - RNA, 14 nt, Homo sapiens
uauacagugauaua

SEQ ID NO: 1799361 - RNA, 14 nt, Homo sapiens
agagagaaccagga

SEQ ID NO: 1799362 - RNA, 19 nt, Homo sapiens
agcucugacccugaugcuu

SEQ ID NO: 1799363 - RNA, 19 nt, Homo sapiens
acucccagauggcucuuuc

SEQ ID NO: 1799364 - RNA, 15 nt, Homo sapiens
ccuuucuuacauuag

SEQ ID NO: 1799365 - RNA, 21 nt, Homo sapiens
uccuacacccuuggacuugag

SEQ ID NO: 1799366 - RNA, 22 nt, Homo sapiens
acaugcccucggucacugaguc

SEQ ID NO: 1799367 - RNA, 15 nt, Homo sapiens
aguugaacaucucac

SEQ ID NO: 1799368 - RNA, 21 nt, Homo sapiens
uuuggcccaaacucaucuuga

SEQ ID NO: 1799369 - RNA, 18 nt, Homo sapiens
uuaauuuuuauuucuucc

SEQ ID NO: 1799370 - RNA, 19 nt, Homo sapiens
auuacugcccacuugucaa

SEQ ID NO: 1799371 - RNA, 14 nt, Homo sapiens
cucugaauguccca

SEQ ID NO: 1799372 - RNA, 13 nt, Homo sapiens
uuguuacugguac

SEQ ID NO: 1799373 - RNA, 22 nt, Homo sapiens
cucuucuggccuggugucuccu

SEQ ID NO: 1799374 - RNA, 24 nt, Homo sapiens
uacacgcauguaugcaugcacaaa

SEQ ID NO: 1799375 - RNA, 20 nt, Homo sapiens
gacauaugacaauaagccac

SEQ ID NO: 1799376 - RNA, 15 nt, Homo sapiens
auauuagcauugcca

SEQ ID NO: 1799377 - RNA, 22 nt, Homo sapiens
uuccuaugaauacuauugcaga

SEQ ID NO: 1799378 - RNA, 20 nt, Homo sapiens
cauaaaaguuggcucaggag

SEQ ID NO: 1799379 - RNA, 13 nt, Homo sapiens
ggcuaaauacaau

SEQ ID NO: 1799380 - RNA, 20 nt, Homo sapiens
aaaggagacaaguuccaugg

SEQ ID NO: 1799381 - RNA, 15 nt, Homo sapiens
uaacuuugcuugcag

SEQ ID NO: 1799382 - RNA, 16 nt, Homo sapiens
ucagucagcccagugg

SEQ ID NO: 1799383 - RNA, 16 nt, Homo sapiens
aauaaauauuuaauga

SEQ ID NO: 1799384 - RNA, 14 nt, Homo sapiens
uuugaaacuauuaa

SEQ ID NO: 1799385 - RNA, 16 nt, Homo sapiens
agaucuccuggcaaag

SEQ ID NO: 1799386 - RNA, 16 nt, Homo sapiens
auuuuguaacugccua

SEQ ID NO: 1799387 - RNA, 16 nt, Homo sapiens
cauaucaccagucuua

SEQ ID NO: 1799388 - RNA, 18 nt, Homo sapiens
uauuggagauuaaucuac

SEQ ID NO: 1799389 - RNA, 18 nt, Homo sapiens
auguguuuuagaugguuu

SEQ ID NO: 1799390 - RNA, 20 nt, Homo sapiens
gcauaaggaguuagaaccac

SEQ ID NO: 1799391 - RNA, 15 nt, Homo sapiens
cuccaaaagcacuua

SEQ ID NO: 1799392 - RNA, 17 nt, Homo sapiens
guaaagagauuguucua

SEQ ID NO: 1799393 - RNA, 21 nt, Homo sapiens
uuugaauguuuucaaaaccaa

SEQ ID NO: 1799394 - RNA, 15 nt, Homo sapiens
aaugagcaccuccau

SEQ ID NO: 1799395 - RNA, 15 nt, Homo sapiens
caguuucuucaugca

SEQ ID NO: 1799396 - RNA, 17 nt, Homo sapiens
acccagccugagugcac

SEQ ID NO: 1799397 - RNA, 20 nt, Homo sapiens
cugucuccccuuuccccgcg

SEQ ID NO: 1799398 - RNA, 14 nt, Homo sapiens
gacuuuuaaucagu

SEQ ID NO: 1799399 - RNA, 15 nt, Homo sapiens
augucaguggaagaa

SEQ ID NO: 1799400 - RNA, 23 nt, Homo sapiens
gacauguaacgaaacacuucaau

SEQ ID NO: 1799401 - RNA, 19 nt, Homo sapiens
aagacggaaaccucccuuu

SEQ ID NO: 1799402 - RNA, 19 nt, Homo sapiens
gaagcacagagggcuaggg

SEQ ID NO: 1799403 - RNA, 18 nt, Homo sapiens
aaucugagaaucacauuu

SEQ ID NO: 1799404 - RNA, 14 nt, Homo sapiens
gccgcagacgggca

SEQ ID NO: 1799405 - RNA, 12 nt, Homo sapiens
aaaccucauugu

SEQ ID NO: 1799406 - RNA, 13 nt, Homo sapiens
cacacagcaggaa

SEQ ID NO: 1799407 - RNA, 23 nt, Homo sapiens
agucaauccccucauucaggaaa

SEQ ID NO: 1799408 - RNA, 13 nt, Homo sapiens
aaaccuuugccaa

SEQ ID NO: 1799409 - RNA, 19 nt, Homo sapiens
ugccaccgccuucccugac

SEQ ID NO: 1799410 - RNA, 16 nt, Homo sapiens
caauacccuacugugg

SEQ ID NO: 1799411 - RNA, 14 nt, Homo sapiens
cuguucugcacuga

SEQ ID NO: 1799412 - RNA, 22 nt, Homo sapiens
agucauuguuucccaucacugu

SEQ ID NO: 1799413 - RNA, 16 nt, Homo sapiens
auauuuuucuaaagaa

SEQ ID NO: 1799414 - RNA, 18 nt, Homo sapiens
cuuccuuuuguauccucc

SEQ ID NO: 1799415 - RNA, 22 nt, Homo sapiens
gaaaguaaauauuucaggcaua

SEQ ID NO: 1799416 - RNA, 15 nt, Homo sapiens
cauggagcugucauc

SEQ ID NO: 1799417 - RNA, 13 nt, Homo sapiens
aggaucagaaagu

SEQ ID NO: 1799418 - RNA, 13 nt, Homo sapiens
agagacagaagaa

SEQ ID NO: 1799419 - RNA, 22 nt, Homo sapiens
ugcagacugaaaagacaaaguu

SEQ ID NO: 1799420 - RNA, 18 nt, Homo sapiens
gaaacugaaaacuguaaa

SEQ ID NO: 1799421 - RNA, 18 nt, Homo sapiens
auggcaauuggcaucauu

SEQ ID NO: 1799422 - RNA, 17 nt, Homo sapiens
acagcaaggauggagcu

SEQ ID NO: 1799423 - RNA, 20 nt, Homo sapiens
agacacuaccccauauacac

SEQ ID NO: 1799424 - RNA, 14 nt, Homo sapiens
accaaagacaucag

SEQ ID NO: 1799425 - RNA, 15 nt, Homo sapiens
acugacuccugugga

SEQ ID NO: 1799426 - RNA, 16 nt, Homo sapiens
uggaacauaugcacag

SEQ ID NO: 1799427 - RNA, 17 nt, Homo sapiens
ugccuuaggaagugacu

SEQ ID NO: 1799428 - RNA, 12 nt, Homo sapiens
gcugucucugag

SEQ ID NO: 1799429 - RNA, 23 nt, Homo sapiens
aacacagcuuacaaucgcaaauc

SEQ ID NO: 1799430 - RNA, 19 nt, Homo sapiens
ucccugcuaccugauuuca

SEQ ID NO: 1799431 - RNA, 17 nt, Homo sapiens
gauggaauaacucugug

SEQ ID NO: 1799432 - RNA, 17 nt, Homo sapiens
agcucuguaguggaaua

SEQ ID NO: 1799433 - RNA, 14 nt, Homo sapiens
acugauguacaauu

SEQ ID NO: 1799434 - RNA, 22 nt, Homo sapiens
uuacuugagcaaagaacuaagg

SEQ ID NO: 1799435 - RNA, 21 nt, Homo sapiens
cuaacaugcaccuugcuccca

SEQ ID NO: 1799436 - RNA, 22 nt, Homo sapiens
gcccacagcugagaauguggaa

SEQ ID NO: 1799437 - RNA, 13 nt, Homo sapiens
cauuuuuuuagaa

SEQ ID NO: 1799438 - RNA, 17 nt, Homo sapiens
cacucugggcacaagca

SEQ ID NO: 1799439 - RNA, 21 nt, Homo sapiens
accaauguccuuguggucuuu

SEQ ID NO: 1799440 - RNA, 13 nt, Homo sapiens
cucugaguuugaa

SEQ ID NO: 1799441 - RNA, 20 nt, Homo sapiens
agaguugggaugcggggcag

SEQ ID NO: 1799442 - RNA, 17 nt, Homo sapiens
gaguggucgagugacac

SEQ ID NO: 1799443 - RNA, 21 nt, Homo sapiens
cguguguauuagaaugcaugu

SEQ ID NO: 1799444 - RNA, 16 nt, Homo sapiens
uagucagacuucagac

SEQ ID NO: 1799445 - RNA, 20 nt, Homo sapiens
ccacgcauacacacaugccc

SEQ ID NO: 1799446 - RNA, 14 nt, Homo sapiens
cugccaccacuggg

SEQ ID NO: 1799447 - RNA, 21 nt, Homo sapiens
gauuucaguuacuuaccugca

SEQ ID NO: 1799448 - RNA, 12 nt, Homo sapiens
acccacuggcca

SEQ ID NO: 1799449 - RNA, 21 nt, Homo sapiens
uggccuuguuucaaaauucuc

SEQ ID NO: 1799450 - RNA, 12 nt, Homo sapiens
cucaugccauca

SEQ ID NO: 1799451 - RNA, 13 nt, Homo sapiens
cuuccaugucucc

SEQ ID NO: 1799452 - RNA, 12 nt, Homo sapiens
acugaacauauu

SEQ ID NO: 1799453 - RNA, 16 nt, Homo sapiens
cauuuuacauucuguc

SEQ ID NO: 1799454 - RNA, 20 nt, Homo sapiens
ggccaauaaauaugauguua

SEQ ID NO: 1799455 - RNA, 15 nt, Homo sapiens
guaucuggcuucccu

SEQ ID NO: 1799456 - RNA, 12 nt, Homo sapiens
ggaacacuguca

SEQ ID NO: 1799457 - RNA, 21 nt, Homo sapiens
aaggaucuuaggcaugacugu

SEQ ID NO: 1799458 - RNA, 21 nt, Homo sapiens
cuauauuuuuauuucauucac

SEQ ID NO: 1799459 - RNA, 17 nt, Homo sapiens
uauuuuauaucaauuua

SEQ ID NO: 1799460 - RNA, 14 nt, Homo sapiens
uaaacuguacaugu

SEQ ID NO: 1799461 - RNA, 20 nt, Homo sapiens
gacagagccagacugucuca

SEQ ID NO: 1799462 - RNA, 20 nt, Homo sapiens
cuucccugcucagcuucugc

SEQ ID NO: 1799463 - RNA, 16 nt, Homo sapiens
uauuccaagcauauaa

SEQ ID NO: 1799464 - RNA, 15 nt, Homo sapiens
ugguuuccuauuucc

SEQ ID NO: 1799465 - RNA, 18 nt, Homo sapiens
uggccgggcccugcugag

SEQ ID NO: 1799466 - RNA, 18 nt, Homo sapiens
gucugaaagcagguuaac

SEQ ID NO: 1799467 - RNA, 22 nt, Homo sapiens
accuaaaaauguaggcuuucau

SEQ ID NO: 1799468 - RNA, 21 nt, Homo sapiens
aaauuuguccaauggcuguaa

SEQ ID NO: 1799469 - RNA, 20 nt, Homo sapiens
ggcaacacagcgagacuccg

SEQ ID NO: 1799470 - RNA, 14 nt, Homo sapiens
uaaauuuaacucug

SEQ ID NO: 1799471 - RNA, 23 nt, Homo sapiens
ucggaagagagggcugagccaug

SEQ ID NO: 1799472 - RNA, 17 nt, Homo sapiens
uagccuuugucauuuua

SEQ ID NO: 1799473 - RNA, 17 nt, Homo sapiens
agugagggcucacucag

SEQ ID NO: 1799474 - RNA, 13 nt, Homo sapiens
uguaaaaauaacc

SEQ ID NO: 1799475 - RNA, 17 nt, Homo sapiens
uuugagacaaagucuca

SEQ ID NO: 1799476 - RNA, 23 nt, Homo sapiens
uagagagccugucaccagagcuu

SEQ ID NO: 1799477 - RNA, 13 nt, Homo sapiens
caaucuucucaga

SEQ ID NO: 1799478 - RNA, 18 nt, Homo sapiens
acaaacuuauucuacuga

SEQ ID NO: 1799479 - RNA, 16 nt, Homo sapiens
gacccucagcugucac

SEQ ID NO: 1799480 - RNA, 14 nt, Homo sapiens
cuuacuagggguca

SEQ ID NO: 1799481 - RNA, 23 nt, Homo sapiens
cugucccaccccuaccucuagua

SEQ ID NO: 1799482 - RNA, 18 nt, Homo sapiens
accucguuacucucaccu

SEQ ID NO: 1799483 - RNA, 18 nt, Homo sapiens
aacucaaggauaccuucu

SEQ ID NO: 1799484 - RNA, 18 nt, Homo sapiens
ggaugggcuucacugggg

SEQ ID NO: 1799485 - RNA, 23 nt, Homo sapiens
agcaguuugguuucuagcaugaa

SEQ ID NO: 1799486 - RNA, 20 nt, Homo sapiens
uccugcccaccugucaaaca

SEQ ID NO: 1799487 - RNA, 20 nt, Homo sapiens
aucagcaaaaaaguacuuaa

SEQ ID NO: 1799488 - RNA, 17 nt, Homo sapiens
aggcuggcacaggacau

SEQ ID NO: 1799489 - RNA, 19 nt, Homo sapiens
auugaaagggaguauuaca

SEQ ID NO: 1799490 - RNA, 15 nt, Homo sapiens
auuaaagcaguaaua

SEQ ID NO: 1799491 - RNA, 16 nt, Homo sapiens
auuucuguauacugua

SEQ ID NO: 1799492 - RNA, 11 nt, Homo sapiens
aguugcuguau

SEQ ID NO: 1799493 - RNA, 17 nt, Homo sapiens
aauuaaaaauacagugu

SEQ ID NO: 1799494 - RNA, 11 nt, Homo sapiens
gaauugcacau

SEQ ID NO: 1799495 - RNA, 19 nt, Homo sapiens
uuggucucuuucuuuccaa

SEQ ID NO: 1799496 - RNA, 21 nt, Homo sapiens
cuaguaauaauguaauacugu

SEQ ID NO: 1799497 - RNA, 18 nt, Homo sapiens
gggcccagaccacugucu

SEQ ID NO: 1799498 - RNA, 20 nt, Homo sapiens
augcccauucuuuucacuuc

SEQ ID NO: 1799499 - RNA, 15 nt, Homo sapiens
auuuaacuacccuua

SEQ ID NO: 1799500 - RNA, 17 nt, Homo sapiens
cacucuggcagcucaga

SEQ ID NO: 1799501 - RNA, 23 nt, Homo sapiens
acuggaugcauguuuuccagcuc

SEQ ID NO: 1799502 - RNA, 18 nt, Homo sapiens
caaagauaauuuauuuca

SEQ ID NO: 1799503 - RNA, 17 nt, Homo sapiens
aaauagaaccacuauga

SEQ ID NO: 1799504 - RNA, 16 nt, Homo sapiens
acccaccuugaccaua

SEQ ID NO: 1799505 - RNA, 19 nt, Homo sapiens
augaaauaugugaagccca

SEQ ID NO: 1799506 - RNA, 12 nt, Homo sapiens
cuggccaugaau

SEQ ID NO: 1799507 - RNA, 19 nt, Homo sapiens
uuuaggaaaguugugauuc

SEQ ID NO: 1799508 - RNA, 19 nt, Homo sapiens
caaauggugcuucaauguc

SEQ ID NO: 1799509 - RNA, 21 nt, Homo sapiens
uucuacuuacacaucuuccac

SEQ ID NO: 1799510 - RNA, 19 nt, Homo sapiens
uagauuuucuuuugccuuu

SEQ ID NO: 1799511 - RNA, 23 nt, Homo sapiens
uuucuguaauguaaauaaacuau

SEQ ID NO: 1799512 - RNA, 15 nt, Homo sapiens
auuguuuacagagcu

SEQ ID NO: 1799513 - RNA, 12 nt, Homo sapiens
uucaaccagcau

SEQ ID NO: 1799514 - RNA, 13 nt, Homo sapiens
auuagaugaacuc

SEQ ID NO: 1799515 - RNA, 23 nt, Homo sapiens
aacacugaaaugaaaucuuccca

SEQ ID NO: 1799516 - RNA, 12 nt, Homo sapiens
aaucaacagaua

SEQ ID NO: 1799517 - RNA, 23 nt, Homo sapiens
cuuugccuuuccauaaucacuca

SEQ ID NO: 1799518 - RNA, 13 nt, Homo sapiens
auccaacuuccaa

SEQ ID NO: 1799519 - RNA, 23 nt, Homo sapiens
aguggcgcaugccuguaauccca

SEQ ID NO: 1799520 - RNA, 23 nt, Homo sapiens
gccuuuaaauuguuccucuuugu

SEQ ID NO: 1799521 - RNA, 14 nt, Homo sapiens
ugauagauccagau

SEQ ID NO: 1799522 - RNA, 15 nt, Homo sapiens
acagcccaucaccuc

SEQ ID NO: 1799523 - RNA, 15 nt, Homo sapiens
ugagucaaagacuua

SEQ ID NO: 1799524 - RNA, 22 nt, Homo sapiens
gauaaagauggauggcuguuaa

SEQ ID NO: 1799525 - RNA, 16 nt, Homo sapiens
gagaaaaugaauuugg

SEQ ID NO: 1799526 - RNA, 17 nt, Homo sapiens
cuucagucuugguaaaa

SEQ ID NO: 1799527 - RNA, 17 nt, Homo sapiens
uauuugugucacaaaga

SEQ ID NO: 1799528 - RNA, 23 nt, Homo sapiens
uuacaagauggcgaccaccaaag

SEQ ID NO: 1799529 - RNA, 20 nt, Homo sapiens
ucugaauaaaguguaacaau

SEQ ID NO: 1799530 - RNA, 21 nt, Homo sapiens
ccugugaaguccuucaccuca

SEQ ID NO: 1799531 - RNA, 15 nt, Homo sapiens
uuacaguugcaucag

SEQ ID NO: 1799532 - RNA, 13 nt, Homo sapiens
aaucacuacugua

SEQ ID NO: 1799533 - RNA, 23 nt, Homo sapiens
ccuguucuuguuacggcagucac

SEQ ID NO: 1799534 - RNA, 12 nt, Homo sapiens
acaaacaugugg

SEQ ID NO: 1799535 - RNA, 14 nt, Homo sapiens
uuguuaaucaauca

SEQ ID NO: 1799536 - RNA, 15 nt, Homo sapiens
ugugucaggaaacau

SEQ ID NO: 1799537 - RNA, 21 nt, Homo sapiens
aagaggaaugugcaacauucu

SEQ ID NO: 1799538 - RNA, 20 nt, Homo sapiens
gcuugauuuucuuucuccuc

SEQ ID NO: 1799539 - RNA, 20 nt, Homo sapiens
ucacacucggccacuagugg

SEQ ID NO: 1799540 - RNA, 16 nt, Homo sapiens
augugcuauugaacug

SEQ ID NO: 1799541 - RNA, 17 nt, Homo sapiens
uuaaauuacaauuuuau

SEQ ID NO: 1799542 - RNA, 20 nt, Homo sapiens
uaggcuuuguaugacaguga

SEQ ID NO: 1799543 - RNA, 15 nt, Homo sapiens
ucuuacagcacaucu

SEQ ID NO: 1799544 - RNA, 20 nt, Homo sapiens
ugaccucugacaacugugaa

SEQ ID NO: 1799545 - RNA, 15 nt, Homo sapiens
gugaaaggugcuaua

SEQ ID NO: 1799546 - RNA, 23 nt, Homo sapiens
uuccaguggcuuggguucacagu

SEQ ID NO: 1799547 - RNA, 14 nt, Homo sapiens
caggggcucaggau

SEQ ID NO: 1799548 - RNA, 21 nt, Homo sapiens
uuauauggauaaucugagcag

SEQ ID NO: 1799549 - RNA, 14 nt, Homo sapiens
auaauuuauacagg

SEQ ID NO: 1799550 - RNA, 16 nt, Homo sapiens
ugcaaauuaaaacaua

SEQ ID NO: 1799551 - RNA, 21 nt, Homo sapiens
cugugcauacauguucaucgu

SEQ ID NO: 1799552 - RNA, 15 nt, Homo sapiens
aauuugaagcucaga

SEQ ID NO: 1799553 - RNA, 22 nt, Homo sapiens
cuuauuuugucuuauucuuaag

SEQ ID NO: 1799554 - RNA, 15 nt, Homo sapiens
uuacaaauaguucug

SEQ ID NO: 1799555 - RNA, 13 nt, Homo sapiens
aaaggagugaaug

SEQ ID NO: 1799556 - RNA, 10 nt, Homo sapiens
acgcacacac

SEQ ID NO: 1799557 - RNA, 13 nt, Homo sapiens
uggccaucuccug

SEQ ID NO: 1799558 - RNA, 20 nt, Homo sapiens
acugcaaugucaaaguuuaa

SEQ ID NO: 1799559 - RNA, 19 nt, Homo sapiens
uauguuuaucaacucaaga

SEQ ID NO: 1799560 - RNA, 21 nt, Homo sapiens
gagaugggagaaucacuugaa

SEQ ID NO: 1799561 - RNA, 20 nt, Homo sapiens
aaccuaccaccccuuccugu

SEQ ID NO: 1799562 - RNA, 20 nt, Homo sapiens
gacaucuggcggccaaguga

SEQ ID NO: 1799563 - RNA, 23 nt, Homo sapiens
cacuucaaacuacuuugcugcua

SEQ ID NO: 1799564 - RNA, 17 nt, Homo sapiens
gcagguaggucggcacu

SEQ ID NO: 1799565 - RNA, 23 nt, Homo sapiens
ccugucccagagguuaucugccu

SEQ ID NO: 1799566 - RNA, 18 nt, Homo sapiens
acagaugaagacaucagg

SEQ ID NO: 1799567 - RNA, 13 nt, Homo sapiens
aaaacacauauca

SEQ ID NO: 1799568 - RNA, 13 nt, Homo sapiens
gcggcccagaccc

SEQ ID NO: 1799569 - RNA, 18 nt, Homo sapiens
auguuuauuuagcucuga

SEQ ID NO: 1799570 - RNA, 19 nt, Homo sapiens
gauacccaaaggucaagaa

SEQ ID NO: 1799571 - RNA, 13 nt, Homo sapiens
aagcuaccaaaaa

SEQ ID NO: 1799572 - RNA, 12 nt, Homo sapiens
aauauggcucuu

SEQ ID NO: 1799573 - RNA, 18 nt, Homo sapiens
auguuucucccauaggcu

SEQ ID NO: 1799574 - RNA, 16 nt, Homo sapiens
ggacagacaccgugga

SEQ ID NO: 1799575 - RNA, 23 nt, Homo sapiens
uaaggacuuuggcuuacauuuga

SEQ ID NO: 1799576 - RNA, 18 nt, Homo sapiens
uucccacacugugaacua

SEQ ID NO: 1799577 - RNA, 15 nt, Homo sapiens
uaaaugccccaaagc

SEQ ID NO: 1799578 - RNA, 14 nt, Homo sapiens
acgcugucucugac

SEQ ID NO: 1799579 - RNA, 14 nt, Homo sapiens
ccuccacaugcugc

SEQ ID NO: 1799580 - RNA, 19 nt, Homo sapiens
gaauguuaacaugcgcauu

SEQ ID NO: 1799581 - RNA, 13 nt, Homo sapiens
uacuugagacugu

SEQ ID NO: 1799582 - RNA, 14 nt, Homo sapiens
uuaaaaaauccugc

SEQ ID NO: 1799583 - RNA, 20 nt, Homo sapiens
acuuuaauuauuguuauaca

SEQ ID NO: 1799584 - RNA, 20 nt, Homo sapiens
gugaaagcaucacuugggau

SEQ ID NO: 1799585 - RNA, 14 nt, Homo sapiens
cucaucauuuccau

SEQ ID NO: 1799586 - RNA, 17 nt, Homo sapiens
acuuccucuaaaacccu

SEQ ID NO: 1799587 - RNA, 14 nt, Homo sapiens
acaggcagcucuga

SEQ ID NO: 1799588 - RNA, 19 nt, Homo sapiens
accuaaugggaaucauucc

SEQ ID NO: 1799589 - RNA, 20 nt, Homo sapiens
agccauuuuucaaagcaauu

SEQ ID NO: 1799590 - RNA, 20 nt, Homo sapiens
uugugguggcugcuccauga

SEQ ID NO: 1799591 - RNA, 14 nt, Homo sapiens
aaaagacugaccaa

SEQ ID NO: 1799592 - RNA, 15 nt, Homo sapiens
aucuucugccuuagu

SEQ ID NO: 1799593 - RNA, 15 nt, Homo sapiens
cagugucuuccugug

SEQ ID NO: 1799594 - RNA, 23 nt, Homo sapiens
accaugugccacacaccuugaca

SEQ ID NO: 1799595 - RNA, 14 nt, Homo sapiens
cuucagguagaaau

SEQ ID NO: 1799596 - RNA, 16 nt, Homo sapiens
accuaccacauucacu

SEQ ID NO: 1799597 - RNA, 19 nt, Homo sapiens
aaagccuccaguccaagga

SEQ ID NO: 1799598 - RNA, 22 nt, Homo sapiens
uccuggguacugaaagccuuag

SEQ ID NO: 1799599 - RNA, 20 nt, Homo sapiens
cuaaaauggacgaaucuaua

SEQ ID NO: 1799600 - RNA, 19 nt, Homo sapiens
caacagaaguugaagcaca

SEQ ID NO: 1799601 - RNA, 18 nt, Homo sapiens
uauggagguucaaugaga

SEQ ID NO: 1799602 - RNA, 18 nt, Homo sapiens
gaauuaguccuugcuugg

SEQ ID NO: 1799603 - RNA, 16 nt, Homo sapiens
gcggagcuugcaguga

SEQ ID NO: 1799604 - RNA, 23 nt, Homo sapiens
ccaccaauccccgccacagcagg

SEQ ID NO: 1799605 - RNA, 19 nt, Homo sapiens
cagugggcacuaagggugg

SEQ ID NO: 1799606 - RNA, 18 nt, Homo sapiens
caguaacacagugcagug

SEQ ID NO: 1799607 - RNA, 14 nt, Homo sapiens
uggcccaucugugc

SEQ ID NO: 1799608 - RNA, 15 nt, Homo sapiens
ucuaccugagcauuc

SEQ ID NO: 1799609 - RNA, 18 nt, Homo sapiens
gccugaagaagcacuucu

SEQ ID NO: 1799610 - RNA, 20 nt, Homo sapiens
aacaugaaaacauugaugaa

SEQ ID NO: 1799611 - RNA, 16 nt, Homo sapiens
uccuucagcaucucac

SEQ ID NO: 1799612 - RNA, 21 nt, Homo sapiens
uuaacugagcuacuagagaua

SEQ ID NO: 1799613 - RNA, 19 nt, Homo sapiens
ggggagauaagaaacccuc

SEQ ID NO: 1799614 - RNA, 22 nt, Homo sapiens
ugugucaguggggcucucugag

SEQ ID NO: 1799615 - RNA, 18 nt, Homo sapiens
acaaaggcugaugucuua

SEQ ID NO: 1799616 - RNA, 19 nt, Homo sapiens
acuggcuucugcuugucau

SEQ ID NO: 1799617 - RNA, 21 nt, Homo sapiens
guguauucuuaaaaugcaaua

SEQ ID NO: 1799618 - RNA, 19 nt, Homo sapiens
caucauggaucaaccaagu

SEQ ID NO: 1799619 - RNA, 17 nt, Homo sapiens
ucucagaauguuggcaa

SEQ ID NO: 1799620 - RNA, 14 nt, Homo sapiens
aacaagauuuccac

SEQ ID NO: 1799621 - RNA, 22 nt, Homo sapiens
aucccuccauucauccuuccau

SEQ ID NO: 1799622 - RNA, 16 nt, Homo sapiens
gcacagcuaugaaggc

SEQ ID NO: 1799623 - RNA, 16 nt, Homo sapiens
uaguauauuuauacuc

SEQ ID NO: 1799624 - RNA, 23 nt, Homo sapiens
aguggacagucuggccacuguca

SEQ ID NO: 1799625 - RNA, 18 nt, Homo sapiens
uccuggcuccuucacuga

SEQ ID NO: 1799626 - RNA, 18 nt, Homo sapiens
ggaggaaugcucccccau

SEQ ID NO: 1799627 - RNA, 18 nt, Homo sapiens
gacuuuuccugcugccug

SEQ ID NO: 1799628 - RNA, 18 nt, Homo sapiens
cuccuuuagaguugcaug

SEQ ID NO: 1799629 - RNA, 17 nt, Homo sapiens
ggcuguggguggugauu

SEQ ID NO: 1799630 - RNA, 20 nt, Homo sapiens
aaugugugaaggucuugccu

SEQ ID NO: 1799631 - RNA, 13 nt, Homo sapiens
ggugaggaccacu

SEQ ID NO: 1799632 - RNA, 19 nt, Homo sapiens
ugaaaauguacauguuccu

SEQ ID NO: 1799633 - RNA, 16 nt, Homo sapiens
ccaucgcaaccaggau

SEQ ID NO: 1799634 - RNA, 19 nt, Homo sapiens
guuguuuaugcaagagcug

SEQ ID NO: 1799635 - RNA, 12 nt, Homo sapiens
uaaaaucuacuc

SEQ ID NO: 1799636 - RNA, 13 nt, Homo sapiens
ggguagaucucaa

SEQ ID NO: 1799637 - RNA, 15 nt, Homo sapiens
uggugugauugcaca

SEQ ID NO: 1799638 - RNA, 16 nt, Homo sapiens
uaaucucucugcagcu

SEQ ID NO: 1799639 - RNA, 11 nt, Homo sapiens
aaacuugccug

SEQ ID NO: 1799640 - RNA, 16 nt, Homo sapiens
ccucccauuugcagac

SEQ ID NO: 1799641 - RNA, 18 nt, Homo sapiens
uguaaauacacauagcau

SEQ ID NO: 1799642 - RNA, 13 nt, Homo sapiens
acagaccacagag

SEQ ID NO: 1799643 - RNA, 13 nt, Homo sapiens
auguguauuucau

SEQ ID NO: 1799644 - RNA, 21 nt, Homo sapiens
ccuccuuggcuuuaugcaaau

SEQ ID NO: 1799645 - RNA, 14 nt, Homo sapiens
gcaggagguucugg

SEQ ID NO: 1799646 - RNA, 19 nt, Homo sapiens
caaaagaagcccggcuccu

SEQ ID NO: 1799647 - RNA, 18 nt, Homo sapiens
aaaauggcaagagaucau

SEQ ID NO: 1799648 - RNA, 12 nt, Homo sapiens
auuggacuccag

SEQ ID NO: 1799649 - RNA, 12 nt, Homo sapiens
cuaagacuacua

SEQ ID NO: 1799650 - RNA, 20 nt, Homo sapiens
uuaccaacuuccccccaaaa

SEQ ID NO: 1799651 - RNA, 12 nt, Homo sapiens
aaaagcagcuca

SEQ ID NO: 1799652 - RNA, 23 nt, Homo sapiens
uaccuucaggguuggauguaguu

SEQ ID NO: 1799653 - RNA, 13 nt, Homo sapiens
ggugggagccaac

SEQ ID NO: 1799654 - RNA, 13 nt, Homo sapiens
gcauacuguguua

SEQ ID NO: 1799655 - RNA, 15 nt, Homo sapiens
agucugagcuucuuu

SEQ ID NO: 1799656 - RNA, 12 nt, Homo sapiens
guuugaacauuu

SEQ ID NO: 1799657 - RNA, 22 nt, Homo sapiens
uccuuagcuuucccugugccac

SEQ ID NO: 1799658 - RNA, 16 nt, Homo sapiens
gcgccgugaguucuca

SEQ ID NO: 1799659 - RNA, 21 nt, Homo sapiens
acuucuguaauuuaaaagcuc

SEQ ID NO: 1799660 - RNA, 15 nt, Homo sapiens
guguggagcacgugg

SEQ ID NO: 1799661 - RNA, 11 nt, Homo sapiens
ugacacgcagc

SEQ ID NO: 1799662 - RNA, 13 nt, Homo sapiens
cacucucaugucc

SEQ ID NO: 1799663 - RNA, 19 nt, Homo sapiens
gcacagggcaugaaaugaa

SEQ ID NO: 1799664 - RNA, 18 nt, Homo sapiens
ggauuuguuuaaaaacca

SEQ ID NO: 1799665 - RNA, 19 nt, Homo sapiens
aucuccgucucccaaagug

SEQ ID NO: 1799666 - RNA, 18 nt, Homo sapiens
auucuuucuaaacuacaa

SEQ ID NO: 1799667 - RNA, 21 nt, Homo sapiens
acagggagacccguccauuug

SEQ ID NO: 1799668 - RNA, 13 nt, Homo sapiens
cuuuggacacuca

SEQ ID NO: 1799669 - RNA, 21 nt, Homo sapiens
ccagccuuuugagaguaauuu

SEQ ID NO: 1799670 - RNA, 14 nt, Homo sapiens
caauuccaucagca

SEQ ID NO: 1799671 - RNA, 15 nt, Homo sapiens
uccccagcagucaau

SEQ ID NO: 1799672 - RNA, 23 nt, Homo sapiens
agugcuguugguggcagugacuu

SEQ ID NO: 1799673 - RNA, 21 nt, Homo sapiens
ucuuuucaaagguacuuggau

SEQ ID NO: 1799674 - RNA, 17 nt, Homo sapiens
cuucauuuaacaaguaa

SEQ ID NO: 1799675 - RNA, 16 nt, Homo sapiens
ggcgucccuaccuccu

SEQ ID NO: 1799676 - RNA, 16 nt, Homo sapiens
ucuauuauaaaaccau

SEQ ID NO: 1799677 - RNA, 18 nt, Homo sapiens
guaagcuuguaugugguu

SEQ ID NO: 1799678 - RNA, 16 nt, Homo sapiens
cccaugauaguguauu

SEQ ID NO: 1799679 - RNA, 21 nt, Homo sapiens
uccacucgccuucaucuccca

SEQ ID NO: 1799680 - RNA, 21 nt, Homo sapiens
aaugguagaacggauaccugc

SEQ ID NO: 1799681 - RNA, 18 nt, Homo sapiens
uuuagauuaaacaaacaa

SEQ ID NO: 1799682 - RNA, 12 nt, Homo sapiens
ccaaaugagauc

SEQ ID NO: 1799683 - RNA, 20 nt, Homo sapiens
cucaggguccagacccugaa

SEQ ID NO: 1799684 - RNA, 23 nt, Homo sapiens
aaaaugaaggaaaagcauguuau

SEQ ID NO: 1799685 - RNA, 16 nt, Homo sapiens
ugugccuggagcuccu

SEQ ID NO: 1799686 - RNA, 18 nt, Homo sapiens
cuccugagcucaagugau

SEQ ID NO: 1799687 - RNA, 22 nt, Homo sapiens
caagcgugucaggcugucagug

SEQ ID NO: 1799688 - RNA, 15 nt, Homo sapiens
ugaaagugaugauac

SEQ ID NO: 1799689 - RNA, 20 nt, Homo sapiens
auuuuaaccaaucagaugac

SEQ ID NO: 1799690 - RNA, 18 nt, Homo sapiens
acuucuucagcuugggca

SEQ ID NO: 1799691 - RNA, 18 nt, Homo sapiens
uagacgaggccacagcug

SEQ ID NO: 1799692 - RNA, 19 nt, Homo sapiens
uuuugugucuaccuuguua

SEQ ID NO: 1799693 - RNA, 23 nt, Homo sapiens
uggccgccacccccaucuuccac

SEQ ID NO: 1799694 - RNA, 23 nt, Homo sapiens
aguggcauggcuccagucugcug

SEQ ID NO: 1799695 - RNA, 17 nt, Homo sapiens
uaauacugucuaggaaa

SEQ ID NO: 1799696 - RNA, 13 nt, Homo sapiens
uccgaaacauaca

SEQ ID NO: 1799697 - RNA, 22 nt, Homo sapiens
ucuguccagccgugugugcaug

SEQ ID NO: 1799698 - RNA, 15 nt, Homo sapiens
augacacauuugaaa

SEQ ID NO: 1799699 - RNA, 17 nt, Homo sapiens
agcuaauuaaacacauu

SEQ ID NO: 1799700 - RNA, 18 nt, Homo sapiens
cuuuucccauugccaugc

SEQ ID NO: 1799701 - RNA, 20 nt, Homo sapiens
cacuuugggaggcugaggcg

SEQ ID NO: 1799702 - RNA, 15 nt, Homo sapiens
uugcuaguacuagua

SEQ ID NO: 1799703 - RNA, 18 nt, Homo sapiens
cuguuucaugagcccaaa

SEQ ID NO: 1799704 - RNA, 18 nt, Homo sapiens
gaaccacauucagggaaa

SEQ ID NO: 1799705 - RNA, 20 nt, Homo sapiens
ccugggaggagagacacugg

SEQ ID NO: 1799706 - RNA, 14 nt, Homo sapiens
gagagucggccaga

SEQ ID NO: 1799707 - RNA, 16 nt, Homo sapiens
ucaguauaaaaccaug

SEQ ID NO: 1799708 - RNA, 20 nt, Homo sapiens
aauuuuaauuccugauuaaa

SEQ ID NO: 1799709 - RNA, 19 nt, Homo sapiens
acuaaugccauaggugaga

SEQ ID NO: 1799710 - RNA, 12 nt, Homo sapiens
uauacaaagugu

SEQ ID NO: 1799711 - RNA, 15 nt, Homo sapiens
accauuaaaaucuug

SEQ ID NO: 1799712 - RNA, 11 nt, Homo sapiens
ucccuuuacaa

SEQ ID NO: 1799713 - RNA, 15 nt, Homo sapiens
aaaauuuucuuucaa

SEQ ID NO: 1799714 - RNA, 20 nt, Homo sapiens
auguagaauuauaacuaauu

SEQ ID NO: 1799715 - RNA, 14 nt, Homo sapiens
gaauaaaaugauua

SEQ ID NO: 1799716 - RNA, 13 nt, Homo sapiens
acaucuaacucau

SEQ ID NO: 1799717 - RNA, 18 nt, Homo sapiens
uuuuuauaaauaucaugc

SEQ ID NO: 1799718 - RNA, 12 nt, Homo sapiens
cuagguggugcu

SEQ ID NO: 1799719 - RNA, 12 nt, Homo sapiens
ugaaaauggaga

SEQ ID NO: 1799720 - RNA, 13 nt, Homo sapiens
ugcgugaagacca

SEQ ID NO: 1799721 - RNA, 13 nt, Homo sapiens
ugugugaagauca

SEQ ID NO: 1799722 - RNA, 14 nt, Homo sapiens
ccuuucgucugcca

SEQ ID NO: 1799723 - RNA, 21 nt, Homo sapiens
augccccauggggcaucucuu

SEQ ID NO: 1799724 - RNA, 11 nt, Homo sapiens
aaauacucuga

SEQ ID NO: 1799725 - RNA, 13 nt, Homo sapiens
aguggaaacaaag

SEQ ID NO: 1799726 - RNA, 21 nt, Homo sapiens
uaaaugaagugcccacuaaga

SEQ ID NO: 1799727 - RNA, 14 nt, Homo sapiens
ccccagagcucuuu

SEQ ID NO: 1799728 - RNA, 16 nt, Homo sapiens
acuauaaggugccuca

SEQ ID NO: 1799729 - RNA, 14 nt, Homo sapiens
uuaguaacaucaua

SEQ ID NO: 1799730 - RNA, 22 nt, Homo sapiens
acuggugguucuacugacccaa

SEQ ID NO: 1799731 - RNA, 13 nt, Homo sapiens
acucaaacugccu

SEQ ID NO: 1799732 - RNA, 23 nt, Homo sapiens
ccuuagcuauucccagggaaccc

SEQ ID NO: 1799733 - RNA, 18 nt, Homo sapiens
gaugauuuaauauggauu

SEQ ID NO: 1799734 - RNA, 12 nt, Homo sapiens
aaaguagggaug

SEQ ID NO: 1799735 - RNA, 16 nt, Homo sapiens
agguaucccagcuuug

SEQ ID NO: 1799736 - RNA, 19 nt, Homo sapiens
uggagggaagcaccaugaa

SEQ ID NO: 1799737 - RNA, 20 nt, Homo sapiens
cugguagguucugucugugc

SEQ ID NO: 1799738 - RNA, 13 nt, Homo sapiens
guacauagccuau

SEQ ID NO: 1799739 - RNA, 22 nt, Homo sapiens
cgucgaaagaaagaauauguaa

SEQ ID NO: 1799740 - RNA, 16 nt, Homo sapiens
acucccccagcuuucc

SEQ ID NO: 1799741 - RNA, 21 nt, Homo sapiens
agaaacacuaaagcauucaau

SEQ ID NO: 1799742 - RNA, 17 nt, Homo sapiens
ggagaagagcgcagugu

SEQ ID NO: 1799743 - RNA, 16 nt, Homo sapiens
ugagaaaauaucuugc

SEQ ID NO: 1799744 - RNA, 20 nt, Homo sapiens
gaccacacgcccccacaggc

SEQ ID NO: 1799745 - RNA, 17 nt, Homo sapiens
uaacuguggacaaaagu

SEQ ID NO: 1799746 - RNA, 21 nt, Homo sapiens
aacagaagggcuaacucaguu

SEQ ID NO: 1799747 - RNA, 20 nt, Homo sapiens
ccacagccuuaccaaagcag

SEQ ID NO: 1799748 - RNA, 16 nt, Homo sapiens
cucccaggccaggcuc

SEQ ID NO: 1799749 - RNA, 20 nt, Homo sapiens
acaaaguagaggaauccaug

SEQ ID NO: 1799750 - RNA, 23 nt, Homo sapiens
cuguucugaaaggagacauugcu

SEQ ID NO: 1799751 - RNA, 21 nt, Homo sapiens
ggcucgccucaggaaugggcu

SEQ ID NO: 1799752 - RNA, 17 nt, Homo sapiens
ugcaccaggagacagac

SEQ ID NO: 1799753 - RNA, 22 nt, Homo sapiens
uggcuggagcugcccccuccag

SEQ ID NO: 1799754 - RNA, 18 nt, Homo sapiens
gaacaauaaaaugucuuc

SEQ ID NO: 1799755 - RNA, 21 nt, Homo sapiens
guacuggagagcaacacagga

SEQ ID NO: 1799756 - RNA, 21 nt, Homo sapiens
aggggacacugaaccuuguug

SEQ ID NO: 1799757 - RNA, 11 nt, Homo sapiens
agccuauggca

SEQ ID NO: 1799758 - RNA, 16 nt, Homo sapiens
cauuggccgacaucac

SEQ ID NO: 1799759 - RNA, 17 nt, Homo sapiens
uaaagaaaaaaauacua

SEQ ID NO: 1799760 - RNA, 17 nt, Homo sapiens
uguaucggagacaguga

SEQ ID NO: 1799761 - RNA, 20 nt, Homo sapiens
ccuagacucugucuaccugg

SEQ ID NO: 1799762 - RNA, 15 nt, Homo sapiens
agaaacaccgaguga

SEQ ID NO: 1799763 - RNA, 19 nt, Homo sapiens
aacucaaaaauauuugcug

SEQ ID NO: 1799764 - RNA, 21 nt, Homo sapiens
aaaagugaucaauaaaaugug

SEQ ID NO: 1799765 - RNA, 16 nt, Homo sapiens
aguauuacuuucugcc

SEQ ID NO: 1799766 - RNA, 21 nt, Homo sapiens
cccuauguuuauuuuuguaca

SEQ ID NO: 1799767 - RNA, 14 nt, Homo sapiens
ucuguauucacuua

SEQ ID NO: 1799768 - RNA, 18 nt, Homo sapiens
gcgauccucccaccucag

SEQ ID NO: 1799769 - RNA, 22 nt, Homo sapiens
ccaugucagaugggaaaucugc

SEQ ID NO: 1799770 - RNA, 19 nt, Homo sapiens
ucaaauuaagugugcauga

SEQ ID NO: 1799771 - RNA, 14 nt, Homo sapiens
uggauauuugccuu

SEQ ID NO: 1799772 - RNA, 16 nt, Homo sapiens
caaaugcccaagggaa

SEQ ID NO: 1799773 - RNA, 15 nt, Homo sapiens
agaugucaucaagcu

SEQ ID NO: 1799774 - RNA, 21 nt, Homo sapiens
guuaauuauaccccaugauac

SEQ ID NO: 1799775 - RNA, 15 nt, Homo sapiens
uucucaaaguuaaaa

SEQ ID NO: 1799776 - RNA, 22 nt, Homo sapiens
ccacaaucuggcuuagugccac

SEQ ID NO: 1799777 - RNA, 19 nt, Homo sapiens
aagaggcaccacuaaaaga

SEQ ID NO: 1799778 - RNA, 20 nt, Homo sapiens
agagauuugguuaagcucac

SEQ ID NO: 1799779 - RNA, 11 nt, Homo sapiens
auaugugccaa

SEQ ID NO: 1799780 - RNA, 19 nt, Homo sapiens
uaaccucuaaauucuuuca

SEQ ID NO: 1799781 - RNA, 16 nt, Homo sapiens
auauaacugucuuagu

SEQ ID NO: 1799782 - RNA, 16 nt, Homo sapiens
gaauaugaaacuuuca

SEQ ID NO: 1799783 - RNA, 18 nt, Homo sapiens
gcuggccagauuuccuca

SEQ ID NO: 1799784 - RNA, 18 nt, Homo sapiens
agagaaaggguaauuucc

SEQ ID NO: 1799785 - RNA, 12 nt, Homo sapiens
uaugaaacugca

SEQ ID NO: 1799786 - RNA, 15 nt, Homo sapiens
aucccaauucauuuc

SEQ ID NO: 1799787 - RNA, 20 nt, Homo sapiens
ccccacccuggccuagacca

SEQ ID NO: 1799788 - RNA, 20 nt, Homo sapiens
ccccucucccagcccuggua

SEQ ID NO: 1799789 - RNA, 14 nt, Homo sapiens
uuucugagaaagac

SEQ ID NO: 1799790 - RNA, 17 nt, Homo sapiens
cuaagucaguuucacau

SEQ ID NO: 1799791 - RNA, 14 nt, Homo sapiens
gaaaucuauuucau

SEQ ID NO: 1799792 - RNA, 14 nt, Homo sapiens
uuuaucuagaacau

SEQ ID NO: 1799793 - RNA, 15 nt, Homo sapiens
augguccaguacaaa

SEQ ID NO: 1799794 - RNA, 13 nt, Homo sapiens
aagugaaagugag

SEQ ID NO: 1799795 - RNA, 22 nt, Homo sapiens
auggccauagcuuuuauucauu

SEQ ID NO: 1799796 - RNA, 21 nt, Homo sapiens
cugcacaaaagucucaauguu

SEQ ID NO: 1799797 - RNA, 17 nt, Homo sapiens
gaggacuuuucuuugug

SEQ ID NO: 1799798 - RNA, 16 nt, Homo sapiens
augaguuuauauggaa

SEQ ID NO: 1799799 - RNA, 16 nt, Homo sapiens
uauucccagcuacuca

SEQ ID NO: 1799800 - RNA, 15 nt, Homo sapiens
uaugcaaaagguuua

SEQ ID NO: 1799801 - RNA, 18 nt, Homo sapiens
cauaguauuggagcacau

SEQ ID NO: 1799802 - RNA, 22 nt, Homo sapiens
ucccccaaagcaaugugagucc

SEQ ID NO: 1799803 - RNA, 16 nt, Homo sapiens
aguagagacaggguuu

SEQ ID NO: 1799804 - RNA, 18 nt, Homo sapiens
gccucuggcucucauggg

SEQ ID NO: 1799805 - RNA, 16 nt, Homo sapiens
gauucuaaaacauucu

SEQ ID NO: 1799806 - RNA, 20 nt, Homo sapiens
agaucugggggacagaggaa

SEQ ID NO: 1799807 - RNA, 15 nt, Homo sapiens
agcaauaacauuccc

SEQ ID NO: 1799808 - RNA, 17 nt, Homo sapiens
gaauaggaguucuccug

SEQ ID NO: 1799809 - RNA, 17 nt, Homo sapiens
acuccugggcucugaac

SEQ ID NO: 1799810 - RNA, 18 nt, Homo sapiens
aguaccuauauugauuua

SEQ ID NO: 1799811 - RNA, 19 nt, Homo sapiens
aagauuuugaaugcuuccu

SEQ ID NO: 1799812 - RNA, 16 nt, Homo sapiens
aaucucacaaaugauc

SEQ ID NO: 1799813 - RNA, 17 nt, Homo sapiens
gggcagcgccaggcuga

SEQ ID NO: 1799814 - RNA, 16 nt, Homo sapiens
ucauucacaacuauga

SEQ ID NO: 1799815 - RNA, 21 nt, Homo sapiens
uucucacagugggagccaggg

SEQ ID NO: 1799816 - RNA, 19 nt, Homo sapiens
ucuucucaucuuuuaucua

SEQ ID NO: 1799817 - RNA, 22 nt, Homo sapiens
cacaccccucagcgcucccugu

SEQ ID NO: 1799818 - RNA, 16 nt, Homo sapiens
cccgccuggaggagau

SEQ ID NO: 1799819 - RNA, 20 nt, Homo sapiens
acaaccagaccaaccgccug

SEQ ID NO: 1799820 - RNA, 13 nt, Homo sapiens
augccauaaucag

SEQ ID NO: 1799821 - RNA, 13 nt, Homo sapiens
agcagauaaggcc

SEQ ID NO: 1799822 - RNA, 15 nt, Homo sapiens
ucuaccugagaucua

SEQ ID NO: 1799823 - RNA, 22 nt, Homo sapiens
ugcugugucuucauuuucauua

SEQ ID NO: 1799824 - RNA, 16 nt, Homo sapiens
cccugguccugcacug

SEQ ID NO: 1799825 - RNA, 19 nt, Homo sapiens
acugccguccucagguggg

SEQ ID NO: 1799826 - RNA, 15 nt, Homo sapiens
aguaucccacaucca

SEQ ID NO: 1799827 - RNA, 18 nt, Homo sapiens
ugugauuaaagcuaagga

SEQ ID NO: 1799828 - RNA, 14 nt, Homo sapiens
uguuugcccgggaa

SEQ ID NO: 1799829 - RNA, 16 nt, Homo sapiens
ugcaggaacaugaccc

SEQ ID NO: 1799830 - RNA, 18 nt, Homo sapiens
ccugucugaaggacacuu

SEQ ID NO: 1799831 - RNA, 17 nt, Homo sapiens
cuugaccucgugaucca

SEQ ID NO: 1799832 - RNA, 14 nt, Homo sapiens
agacaaaauuacuu

SEQ ID NO: 1799833 - RNA, 22 nt, Homo sapiens
uggguggauuauaaacaacaga

SEQ ID NO: 1799834 - RNA, 21 nt, Homo sapiens
aaggcuucugugucaaugccu

SEQ ID NO: 1799835 - RNA, 23 nt, Homo sapiens
gcuuggaaacuggaugaggucau

SEQ ID NO: 1799836 - RNA, 13 nt, Homo sapiens
ucugccuuugcca

SEQ ID NO: 1799837 - RNA, 22 nt, Homo sapiens
cuagaguucauggauauguuau

SEQ ID NO: 1799838 - RNA, 18 nt, Homo sapiens
aaugacauugaacugaau

SEQ ID NO: 1799839 - RNA, 22 nt, Homo sapiens
caguuucuuuggccagaaggau

SEQ ID NO: 1799840 - RNA, 22 nt, Homo sapiens
ugcauuugccuucauccaccca

SEQ ID NO: 1799841 - RNA, 14 nt, Homo sapiens
ucuucaauggaaua

SEQ ID NO: 1799842 - RNA, 16 nt, Homo sapiens
aucaucacaaauggcu

SEQ ID NO: 1799843 - RNA, 19 nt, Homo sapiens
uggagagcagcaggugcug

SEQ ID NO: 1799844 - RNA, 21 nt, Homo sapiens
gcgccaucuucacauucugaa

SEQ ID NO: 1799845 - RNA, 20 nt, Homo sapiens
cauguuugccuucugcacau

SEQ ID NO: 1799846 - RNA, 18 nt, Homo sapiens
aucauucacuucacugug

SEQ ID NO: 1799847 - RNA, 14 nt, Homo sapiens
caggaaauaguguu

SEQ ID NO: 1799848 - RNA, 14 nt, Homo sapiens
aacguggggcagca

SEQ ID NO: 1799849 - RNA, 19 nt, Homo sapiens
aaagcuucaaguuuucuca

SEQ ID NO: 1799850 - RNA, 20 nt, Homo sapiens
uaaaagaaaaucuuuaggcu

SEQ ID NO: 1799851 - RNA, 20 nt, Homo sapiens
guaaguauuuccauagucaa

SEQ ID NO: 1799852 - RNA, 23 nt, Homo sapiens
aggaagguagcccagcacuguga

SEQ ID NO: 1799853 - RNA, 13 nt, Homo sapiens
ggagcaccuggug

SEQ ID NO: 1799854 - RNA, 14 nt, Homo sapiens
ggcaccugauacuu

SEQ ID NO: 1799855 - RNA, 21 nt, Homo sapiens
aaggccuuguuaaaauccaag

SEQ ID NO: 1799856 - RNA, 21 nt, Homo sapiens
ggaccagucccgucgugcagu

SEQ ID NO: 1799857 - RNA, 12 nt, Homo sapiens
aaucagccagac

SEQ ID NO: 1799858 - RNA, 12 nt, Homo sapiens
aauuagccagau

SEQ ID NO: 1799859 - RNA, 22 nt, Homo sapiens
auacuguauuaagagugaaaau

SEQ ID NO: 1799860 - RNA, 13 nt, Homo sapiens
cuuguuauaugca

SEQ ID NO: 1799861 - RNA, 17 nt, Homo sapiens
accuugagcaucaggaa

SEQ ID NO: 1799862 - RNA, 18 nt, Homo sapiens
gacuaccuccacucaugu

SEQ ID NO: 1799863 - RNA, 14 nt, Homo sapiens
cagggaucuugcaa

SEQ ID NO: 1799864 - RNA, 14 nt, Homo sapiens
ugcuucgacuacug

SEQ ID NO: 1799865 - RNA, 13 nt, Homo sapiens
ucucugaggacaa

SEQ ID NO: 1799866 - RNA, 17 nt, Homo sapiens
caggccaugcauggcuc

SEQ ID NO: 1799867 - RNA, 15 nt, Homo sapiens
aacugacuucuuugu

SEQ ID NO: 1799868 - RNA, 16 nt, Homo sapiens
ccauggugcuuguuaa

SEQ ID NO: 1799869 - RNA, 16 nt, Homo sapiens
ugucauugacaaagcu

SEQ ID NO: 1799870 - RNA, 20 nt, Homo sapiens
uuaaaacaacacucacauuu

SEQ ID NO: 1799871 - RNA, 19 nt, Homo sapiens
gcccgugcccuaccacaca

SEQ ID NO: 1799872 - RNA, 11 nt, Homo sapiens
uagaaccugga

SEQ ID NO: 1799873 - RNA, 18 nt, Homo sapiens
uguguggcaaacuugcag

SEQ ID NO: 1799874 - RNA, 16 nt, Homo sapiens
ugucuauuauuuagaa

SEQ ID NO: 1799875 - RNA, 20 nt, Homo sapiens
acugucuauuuaagugcaau

SEQ ID NO: 1799876 - RNA, 15 nt, Homo sapiens
aaugcgguucagggc

SEQ ID NO: 1799877 - RNA, 17 nt, Homo sapiens
agacuuuaaaccaccua

SEQ ID NO: 1799878 - RNA, 22 nt, Homo sapiens
ggcccauggaggagacaggaag

SEQ ID NO: 1799879 - RNA, 15 nt, Homo sapiens
cucgugggucccaga

SEQ ID NO: 1799880 - RNA, 15 nt, Homo sapiens
ugacauuugcucuga

SEQ ID NO: 1799881 - RNA, 19 nt, Homo sapiens
ugccagggccccucucccc

SEQ ID NO: 1799882 - RNA, 15 nt, Homo sapiens
gcaagcuaguuccca

SEQ ID NO: 1799883 - RNA, 21 nt, Homo sapiens
aauucuaaauauugacacuua

SEQ ID NO: 1799884 - RNA, 14 nt, Homo sapiens
agcuuuugcuucau

SEQ ID NO: 1799885 - RNA, 19 nt, Homo sapiens
auguacuuaaauuacacau

SEQ ID NO: 1799886 - RNA, 23 nt, Homo sapiens
gcaaaauucccagggaagugcuc

SEQ ID NO: 1799887 - RNA, 19 nt, Homo sapiens
ccuguuuuaccguugcuaa

SEQ ID NO: 1799888 - RNA, 13 nt, Homo sapiens
agugagaugaagg

SEQ ID NO: 1799889 - RNA, 12 nt, Homo sapiens
aaagaggugcug

SEQ ID NO: 1799890 - RNA, 19 nt, Homo sapiens
uuuaaaccuuuuucuugau

SEQ ID NO: 1799891 - RNA, 11 nt, Homo sapiens
caacagccaac

SEQ ID NO: 1799892 - RNA, 13 nt, Homo sapiens
gaccguccagggg

SEQ ID NO: 1799893 - RNA, 21 nt, Homo sapiens
cacucuucugaauugacugua

SEQ ID NO: 1799894 - RNA, 16 nt, Homo sapiens
uugccucuaugugcaa

SEQ ID NO: 1799895 - RNA, 13 nt, Homo sapiens
ugacagacaaaga

SEQ ID NO: 1799896 - RNA, 14 nt, Homo sapiens
ccagacagcuugac

SEQ ID NO: 1799897 - RNA, 12 nt, Homo sapiens
cuggcucuguca

SEQ ID NO: 1799898 - RNA, 14 nt, Homo sapiens
uggucauugaggga

SEQ ID NO: 1799899 - RNA, 19 nt, Homo sapiens
ugaagaggaguugcuugau

SEQ ID NO: 1799900 - RNA, 22 nt, Homo sapiens
cccaguaucucuucagucucua

SEQ ID NO: 1799901 - RNA, 23 nt, Homo sapiens
aaaugcuuugauuguucauauca

SEQ ID NO: 1799902 - RNA, 19 nt, Homo sapiens
gacguacuuugugcuggga

SEQ ID NO: 1799903 - RNA, 14 nt, Homo sapiens
acaaacuacuugau

SEQ ID NO: 1799904 - RNA, 23 nt, Homo sapiens
ccuuuccugccgagugcucugau

SEQ ID NO: 1799905 - RNA, 12 nt, Homo sapiens
aaacugcagugu

SEQ ID NO: 1799906 - RNA, 15 nt, Homo sapiens
uuagacccugcauuu

SEQ ID NO: 1799907 - RNA, 14 nt, Homo sapiens
uauugccuugugaa

SEQ ID NO: 1799908 - RNA, 16 nt, Homo sapiens
augauuucaaaaucag

SEQ ID NO: 1799909 - RNA, 22 nt, Homo sapiens
uugagacuuucuucuagugcuu

SEQ ID NO: 1799910 - RNA, 20 nt, Homo sapiens
auuacaaucgagacugcaau

SEQ ID NO: 1799911 - RNA, 16 nt, Homo sapiens
cuaguaagaugcacug

SEQ ID NO: 1799912 - RNA, 14 nt, Homo sapiens
uuaaucaaaccacu

SEQ ID NO: 1799913 - RNA, 15 nt, Homo sapiens
ucuggcucuacacau

SEQ ID NO: 1799914 - RNA, 22 nt, Homo sapiens
ggccaggugagguccaccggcc

SEQ ID NO: 1799915 - RNA, 13 nt, Homo sapiens
ugcccuuuuccag

SEQ ID NO: 1799916 - RNA, 15 nt, Homo sapiens
auagcccugccucaa

SEQ ID NO: 1799917 - RNA, 22 nt, Homo sapiens
aagucagaucuggucuaguuaa

SEQ ID NO: 1799918 - RNA, 17 nt, Homo sapiens
uaugaugaaaaccuaca

SEQ ID NO: 1799919 - RNA, 14 nt, Homo sapiens
aucucaaacuauga

SEQ ID NO: 1799920 - RNA, 18 nt, Homo sapiens
aaaagcaaaucuguauaa

SEQ ID NO: 1799921 - RNA, 16 nt, Homo sapiens
uuuaauuauaccgcua

SEQ ID NO: 1799922 - RNA, 15 nt, Homo sapiens
uugguggaugugaug

SEQ ID NO: 1799923 - RNA, 22 nt, Homo sapiens
ccucaaagcccccacuucucuc

SEQ ID NO: 1799924 - RNA, 19 nt, Homo sapiens
aaaaauuuuggucauagca

SEQ ID NO: 1799925 - RNA, 15 nt, Homo sapiens
cagauccccacuguc

SEQ ID NO: 1799926 - RNA, 21 nt, Homo sapiens
ggugccuuccacccugcccug

SEQ ID NO: 1799927 - RNA, 13 nt, Homo sapiens
ugauucuaaaggg

SEQ ID NO: 1799928 - RNA, 16 nt, Homo sapiens
aacaaagcaugcucag

SEQ ID NO: 1799929 - RNA, 17 nt, Homo sapiens
gcccacugcuggugcca

SEQ ID NO: 1799930 - RNA, 23 nt, Homo sapiens
agacaugguggcaugcaccugca

SEQ ID NO: 1799931 - RNA, 17 nt, Homo sapiens
uuaaagaaaauugccaa

SEQ ID NO: 1799932 - RNA, 22 nt, Homo sapiens
ccuggcugagagaggaagagcu

SEQ ID NO: 1799933 - RNA, 14 nt, Homo sapiens
gauuuuguauucca

SEQ ID NO: 1799934 - RNA, 16 nt, Homo sapiens
agcaacagacucucac

SEQ ID NO: 1799935 - RNA, 20 nt, Homo sapiens
accauuugcuuaaaccugga

SEQ ID NO: 1799936 - RNA, 19 nt, Homo sapiens
auuuguugcuaauuugcca

SEQ ID NO: 1799937 - RNA, 19 nt, Homo sapiens
guauuuuuguuaguuuaca

SEQ ID NO: 1799938 - RNA, 16 nt, Homo sapiens
augucuuuccaaaagu

SEQ ID NO: 1799939 - RNA, 13 nt, Homo sapiens
cuuccuauuucua

SEQ ID NO: 1799940 - RNA, 13 nt, Homo sapiens
cuuuauauuuccc

SEQ ID NO: 1799941 - RNA, 18 nt, Homo sapiens
aguuguuaugccaugauu

SEQ ID NO: 1799942 - RNA, 12 nt, Homo sapiens
uaacggcacugu

SEQ ID NO: 1799943 - RNA, 20 nt, Homo sapiens
ccguugcugcguucuuucaa

SEQ ID NO: 1799944 - RNA, 16 nt, Homo sapiens
ugcuacauauaugcaa

SEQ ID NO: 1799945 - RNA, 17 nt, Homo sapiens
aaacgcgaccuuggccg

SEQ ID NO: 1799946 - RNA, 16 nt, Homo sapiens
agugcaccuacugcuu

SEQ ID NO: 1799947 - RNA, 19 nt, Homo sapiens
aaagcaaagguuggcaaca

SEQ ID NO: 1799948 - RNA, 22 nt, Homo sapiens
uaagccaacuuuaauugcuuaa

SEQ ID NO: 1799949 - RNA, 16 nt, Homo sapiens
auugcuguugagaugg

SEQ ID NO: 1799950 - RNA, 17 nt, Homo sapiens
gggcuaguagaacugga

SEQ ID NO: 1799951 - RNA, 16 nt, Homo sapiens
uaaaaucuguuaccau

SEQ ID NO: 1799952 - RNA, 14 nt, Homo sapiens
ugagugcccugugu

SEQ ID NO: 1799953 - RNA, 19 nt, Homo sapiens
cauagagaagaucuaauac

SEQ ID NO: 1799954 - RNA, 18 nt, Homo sapiens
caucuggcuuuuucugcc

SEQ ID NO: 1799955 - RNA, 15 nt, Homo sapiens
gacagcugcucuuua

SEQ ID NO: 1799956 - RNA, 15 nt, Homo sapiens
cuuuuucauucccug

SEQ ID NO: 1799957 - RNA, 17 nt, Homo sapiens
aauguuauuuccugaga

SEQ ID NO: 1799958 - RNA, 21 nt, Homo sapiens
cugagucaaauccaguggugg

SEQ ID NO: 1799959 - RNA, 15 nt, Homo sapiens
cuggucccucugcag

SEQ ID NO: 1799960 - RNA, 22 nt, Homo sapiens
gcagaaacaucggauuugggga

SEQ ID NO: 1799961 - RNA, 20 nt, Homo sapiens
ucaguuauaauuauuccacu

SEQ ID NO: 1799962 - RNA, 16 nt, Homo sapiens
ucuagaagacuacaau

SEQ ID NO: 1799963 - RNA, 21 nt, Homo sapiens
ugcgaucuggguucacugcaa

SEQ ID NO: 1799964 - RNA, 16 nt, Homo sapiens
gcuucugugugcugcu

SEQ ID NO: 1799965 - RNA, 23 nt, Homo sapiens
uguacauaacuuagagacuuuag

SEQ ID NO: 1799966 - RNA, 19 nt, Homo sapiens
gaacucaaauggggccaga

SEQ ID NO: 1799967 - RNA, 18 nt, Homo sapiens
cccucaacaccucugcac

SEQ ID NO: 1799968 - RNA, 12 nt, Homo sapiens
cuucacuacuuu

SEQ ID NO: 1799969 - RNA, 14 nt, Homo sapiens
aucagaauaggaag

SEQ ID NO: 1799970 - RNA, 13 nt, Homo sapiens
aggacaaauugag

SEQ ID NO: 1799971 - RNA, 14 nt, Homo sapiens
gcuacagugucugg

SEQ ID NO: 1799972 - RNA, 22 nt, Homo sapiens
guacguaucagcggccccuuga

SEQ ID NO: 1799973 - RNA, 12 nt, Homo sapiens
cacuuuaccucu

SEQ ID NO: 1799974 - RNA, 16 nt, Homo sapiens
gcugaggugugcgguu

SEQ ID NO: 1799975 - RNA, 13 nt, Homo sapiens
aaagacaagcugc

SEQ ID NO: 1799976 - RNA, 15 nt, Homo sapiens
aguagagucacugga

SEQ ID NO: 1799977 - RNA, 14 nt, Homo sapiens
agacugccaaagaa

SEQ ID NO: 1799978 - RNA, 17 nt, Homo sapiens
ugaaguggccagaugag

SEQ ID NO: 1799979 - RNA, 16 nt, Homo sapiens
agaaauguaguuugca

SEQ ID NO: 1799980 - RNA, 20 nt, Homo sapiens
aucccacuaaagugucaagg

SEQ ID NO: 1799981 - RNA, 18 nt, Homo sapiens
ugaacauauccaucaucc

SEQ ID NO: 1799982 - RNA, 18 nt, Homo sapiens
gacuuucaugcagccuaa

SEQ ID NO: 1799983 - RNA, 15 nt, Homo sapiens
gcagaaacagcauau

SEQ ID NO: 1799984 - RNA, 17 nt, Homo sapiens
uuuaccgagcacuguga

SEQ ID NO: 1799985 - RNA, 16 nt, Homo sapiens
agaaagacaaaaugug

SEQ ID NO: 1799986 - RNA, 16 nt, Homo sapiens
cauuuccuaugcaaau

SEQ ID NO: 1799987 - RNA, 15 nt, Homo sapiens
ggacuggaccagaca

SEQ ID NO: 1799988 - RNA, 20 nt, Homo sapiens
ccucuccagcccuauggaag

SEQ ID NO: 1799989 - RNA, 19 nt, Homo sapiens
gcccuaggggagcaccgug

SEQ ID NO: 1799990 - RNA, 19 nt, Homo sapiens
cauguugaagccacugccu

SEQ ID NO: 1799991 - RNA, 14 nt, Homo sapiens
agcucuaguucaaa

SEQ ID NO: 1799992 - RNA, 20 nt, Homo sapiens
gccaggagguuggugacuga

SEQ ID NO: 1799993 - RNA, 20 nt, Homo sapiens
cuaucucuacugaaugucau

SEQ ID NO: 1799994 - RNA, 17 nt, Homo sapiens
accccuggggaugggga

SEQ ID NO: 1799995 - RNA, 21 nt, Homo sapiens
uuuacuccucaguuccucacc

SEQ ID NO: 1799996 - RNA, 21 nt, Homo sapiens
cuuaaaccuggaacaucucac

SEQ ID NO: 1799997 - RNA, 19 nt, Homo sapiens
gcucagggaaaagcagcuc

SEQ ID NO: 1799998 - RNA, 15 nt, Homo sapiens
ucaaguucuacauca

SEQ ID NO: 1799999 - RNA, 19 nt, Homo sapiens
agaacugcuugaacccagg

SEQ ID NO: 1800000 - RNA, 20 nt, Homo sapiens
cucaugauguauuguugcuu

SEQ ID NO: 1800001 - RNA, 19 nt, Homo sapiens
uccuaagcuggagugcagu

SEQ ID NO: 1800002 - RNA, 20 nt, Homo sapiens
uuggaauaacccaaaacugc

SEQ ID NO: 1800003 - RNA, 13 nt, Homo sapiens
cagcucauucauu

SEQ ID NO: 1800004 - RNA, 22 nt, Homo sapiens
gucuccuaagcuggagugcagu

SEQ ID NO: 1800005 - RNA, 15 nt, Homo sapiens
gcucuucaucauaua

SEQ ID NO: 1800006 - RNA, 17 nt, Homo sapiens
agauaggccaugggcac

SEQ ID NO: 1800007 - RNA, 23 nt, Homo sapiens
cuuaauggauguaauacauuucu

SEQ ID NO: 1800008 - RNA, 20 nt, Homo sapiens
aggucauugguggcagagug

SEQ ID NO: 1800009 - RNA, 16 nt, Homo sapiens
ugggccaagccagggu

SEQ ID NO: 1800010 - RNA, 19 nt, Homo sapiens
cuacgggcacaacuggaag

SEQ ID NO: 1800011 - RNA, 20 nt, Homo sapiens
uggaguagccauucuuuauu

SEQ ID NO: 1800012 - RNA, 18 nt, Homo sapiens
gcaggcccccgggguccu

SEQ ID NO: 1800013 - RNA, 15 nt, Homo sapiens
gugaagcaccaagcu

SEQ ID NO: 1800014 - RNA, 14 nt, Homo sapiens
uugaaacugaaugu

SEQ ID NO: 1800015 - RNA, 13 nt, Homo sapiens
uagaaaguggaaa

SEQ ID NO: 1800016 - RNA, 21 nt, Homo sapiens
aaccuugcuguccugaucugu

SEQ ID NO: 1800017 - RNA, 21 nt, Homo sapiens
cccagaggaugucacaaagau

SEQ ID NO: 1800018 - RNA, 12 nt, Homo sapiens
caaguucauuac

SEQ ID NO: 1800019 - RNA, 20 nt, Homo sapiens
caacaucagcucacuggcag

SEQ ID NO: 1800020 - RNA, 15 nt, Homo sapiens
uuccauuaacagcaa

SEQ ID NO: 1800021 - RNA, 23 nt, Homo sapiens
cagaagcauuuuaaauguaguuu

SEQ ID NO: 1800022 - RNA, 18 nt, Homo sapiens
acugcgaucuucagagca

SEQ ID NO: 1800023 - RNA, 16 nt, Homo sapiens
aggaugaaggggccag

SEQ ID NO: 1800024 - RNA, 20 nt, Homo sapiens
agccaagggauggacaucuu

SEQ ID NO: 1800025 - RNA, 13 nt, Homo sapiens
ucuauguauauuc

SEQ ID NO: 1800026 - RNA, 22 nt, Homo sapiens
ccaggguugaucacacucuggg

SEQ ID NO: 1800027 - RNA, 17 nt, Homo sapiens
cagcaaagcccccagag

SEQ ID NO: 1800028 - RNA, 13 nt, Homo sapiens
aucuacacuucgc

SEQ ID NO: 1800029 - RNA, 20 nt, Homo sapiens
ccucugccuuguccugaugc

SEQ ID NO: 1800030 - RNA, 15 nt, Homo sapiens
gcuucaaaugauccu

SEQ ID NO: 1800031 - RNA, 21 nt, Homo sapiens
uaucggggucacuugcaauug

SEQ ID NO: 1800032 - RNA, 18 nt, Homo sapiens
aggccucuuggaccucug

SEQ ID NO: 1800033 - RNA, 21 nt, Homo sapiens
ucccgcaggcuucguuugccu

SEQ ID NO: 1800034 - RNA, 13 nt, Homo sapiens
uuuuauaauguca

SEQ ID NO: 1800035 - RNA, 16 nt, Homo sapiens
aaccgugauaagccuu

SEQ ID NO: 1800036 - RNA, 17 nt, Homo sapiens
cacuaccaauuucccau

SEQ ID NO: 1800037 - RNA, 21 nt, Homo sapiens
gucaugucucugguggugcug

SEQ ID NO: 1800038 - RNA, 12 nt, Homo sapiens
aggaaucaucuc

SEQ ID NO: 1800039 - RNA, 19 nt, Homo sapiens
gugggccacguguucucac

SEQ ID NO: 1800040 - RNA, 15 nt, Homo sapiens
cagugggcagugcau

SEQ ID NO: 1800041 - RNA, 22 nt, Homo sapiens
agccugggguguccuacaguga

SEQ ID NO: 1800042 - RNA, 13 nt, Homo sapiens
caaaccucaagua

SEQ ID NO: 1800043 - RNA, 13 nt, Homo sapiens
aaaaccuccagua

SEQ ID NO: 1800044 - RNA, 17 nt, Homo sapiens
cagccuggccaccagcu

SEQ ID NO: 1800045 - RNA, 14 nt, Homo sapiens
uauuuaugccucug

SEQ ID NO: 1800046 - RNA, 11 nt, Homo sapiens
ucacugucagu

SEQ ID NO: 1800047 - RNA, 18 nt, Homo sapiens
cucaaugaaaccuuccuc

SEQ ID NO: 1800048 - RNA, 18 nt, Homo sapiens
aaauauugcuucaauaau

SEQ ID NO: 1800049 - RNA, 20 nt, Homo sapiens
uccaguggaacagucuuccc

SEQ ID NO: 1800050 - RNA, 18 nt, Homo sapiens
agcagguaaggaaagggc

SEQ ID NO: 1800051 - RNA, 20 nt, Homo sapiens
uccuuugaaaagagaauauu

SEQ ID NO: 1800052 - RNA, 17 nt, Homo sapiens
cuuuggcugcagguguu

SEQ ID NO: 1800053 - RNA, 21 nt, Homo sapiens
gauuaccuaguagucauuuca

SEQ ID NO: 1800054 - RNA, 14 nt, Homo sapiens
aaucacugucaaua

SEQ ID NO: 1800055 - RNA, 22 nt, Homo sapiens
gaaaaguagacaaucauuguuu

SEQ ID NO: 1800056 - RNA, 21 nt, Homo sapiens
uugugaccacugaauucacuc

SEQ ID NO: 1800057 - RNA, 15 nt, Homo sapiens
gaaaacauauuugug

SEQ ID NO: 1800058 - RNA, 18 nt, Homo sapiens
cccugcaccaugcugcug

SEQ ID NO: 1800059 - RNA, 21 nt, Homo sapiens
cggguccccaaaccuguuccc

SEQ ID NO: 1800060 - RNA, 16 nt, Homo sapiens
aaugcauucccugaau

SEQ ID NO: 1800061 - RNA, 21 nt, Homo sapiens
gccaggcaaaggaaauuguca

SEQ ID NO: 1800062 - RNA, 17 nt, Homo sapiens
cgugggggcacugacca

SEQ ID NO: 1800063 - RNA, 20 nt, Homo sapiens
auuauaaaguucagauguuu

SEQ ID NO: 1800064 - RNA, 22 nt, Homo sapiens
cuucgguuuguauuuagugucu

SEQ ID NO: 1800065 - RNA, 17 nt, Homo sapiens
aauaaacaacauugucu

SEQ ID NO: 1800066 - RNA, 17 nt, Homo sapiens
uauaagcauacaacugg

SEQ ID NO: 1800067 - RNA, 15 nt, Homo sapiens
uuaucauaaauucaa

SEQ ID NO: 1800068 - RNA, 15 nt, Homo sapiens
uaucaauaauacaaa

SEQ ID NO: 1800069 - RNA, 18 nt, Homo sapiens
aacccggugcaucuggca

SEQ ID NO: 1800070 - RNA, 15 nt, Homo sapiens
uguguggccugccuu

SEQ ID NO: 1800071 - RNA, 20 nt, Homo sapiens
cacucagcucuuggcuccac

SEQ ID NO: 1800072 - RNA, 15 nt, Homo sapiens
aacaaauacaaaauc

SEQ ID NO: 1800073 - RNA, 21 nt, Homo sapiens
gucccugagaagccucauggg

SEQ ID NO: 1800074 - RNA, 13 nt, Homo sapiens
aaauauuuugcuu

SEQ ID NO: 1800075 - RNA, 16 nt, Homo sapiens
guggcuauuaaaacuc

SEQ ID NO: 1800076 - RNA, 12 nt, Homo sapiens
cucuaguuuuaa

SEQ ID NO: 1800077 - RNA, 22 nt, Homo sapiens
ucacugaguuuuguuucacuuu

SEQ ID NO: 1800078 - RNA, 14 nt, Homo sapiens
agcagaaggcagga

SEQ ID NO: 1800079 - RNA, 18 nt, Homo sapiens
auuaaaguuaaacuguau

SEQ ID NO: 1800080 - RNA, 19 nt, Homo sapiens
uaagaacuaaaauguucua

SEQ ID NO: 1800081 - RNA, 20 nt, Homo sapiens
agucuaugaugcuguugccc

SEQ ID NO: 1800082 - RNA, 20 nt, Homo sapiens
cugcagaagacaguauggca

SEQ ID NO: 1800083 - RNA, 21 nt, Homo sapiens
augacuguccaagugccacau

SEQ ID NO: 1800084 - RNA, 20 nt, Homo sapiens
cuugggcgucucccccagag

SEQ ID NO: 1800085 - RNA, 21 nt, Homo sapiens
gcagaggcggaaaccuugcag

SEQ ID NO: 1800086 - RNA, 15 nt, Homo sapiens
gaaagaaacuaccuu

SEQ ID NO: 1800087 - RNA, 14 nt, Homo sapiens
aacccugugcuguc

SEQ ID NO: 1800088 - RNA, 16 nt, Homo sapiens
ccagccuacacugcca

SEQ ID NO: 1800089 - RNA, 15 nt, Homo sapiens
caaaacgugcaugga

SEQ ID NO: 1800090 - RNA, 17 nt, Homo sapiens
uauguguguuguuucca

SEQ ID NO: 1800091 - RNA, 21 nt, Homo sapiens
cugcaccuuacaacucgggga

SEQ ID NO: 1800092 - RNA, 19 nt, Homo sapiens
cacuuggagcuaaaacugg

SEQ ID NO: 1800093 - RNA, 14 nt, Homo sapiens
gcaaaccauuuuua

SEQ ID NO: 1800094 - RNA, 17 nt, Homo sapiens
guucuuccucuuaccug

SEQ ID NO: 1800095 - RNA, 14 nt, Homo sapiens
uggcagaaagcaaa

SEQ ID NO: 1800096 - RNA, 21 nt, Homo sapiens
accuuucaggaaaguaucucu

SEQ ID NO: 1800097 - RNA, 13 nt, Homo sapiens
agaggucugagcc

SEQ ID NO: 1800098 - RNA, 18 nt, Homo sapiens
ucaucucccaccuagcag

SEQ ID NO: 1800099 - RNA, 18 nt, Homo sapiens
agagaauccacauaaaag

SEQ ID NO: 1800100 - RNA, 18 nt, Homo sapiens
uucucuaccgggcgaguc

SEQ ID NO: 1800101 - RNA, 19 nt, Homo sapiens
cuauacuuaggcauagucu

SEQ ID NO: 1800102 - RNA, 16 nt, Homo sapiens
ggcuuggaguggccaa

SEQ ID NO: 1800103 - RNA, 23 nt, Homo sapiens
ugcucuugugauguuugcucaga

SEQ ID NO: 1800104 - RNA, 20 nt, Homo sapiens
uccuaggcucugggugcagu

SEQ ID NO: 1800105 - RNA, 11 nt, Homo sapiens
uauuugccagc

SEQ ID NO: 1800106 - RNA, 22 nt, Homo sapiens
aucucauugcuuacaagccuaa

SEQ ID NO: 1800107 - RNA, 11 nt, Homo sapiens
aggaguacaau

SEQ ID NO: 1800108 - RNA, 21 nt, Homo sapiens
aguuaccuacaagaacaauga

SEQ ID NO: 1800109 - RNA, 16 nt, Homo sapiens
aauucauuguguauga

SEQ ID NO: 1800110 - RNA, 15 nt, Homo sapiens
aaauuuaaaauuacg

SEQ ID NO: 1800111 - RNA, 18 nt, Homo sapiens
cauucaaccuuaccaaaa

SEQ ID NO: 1800112 - RNA, 22 nt, Homo sapiens
cugucagaaaaagcuagcacua

SEQ ID NO: 1800113 - RNA, 13 nt, Homo sapiens
aacugguuguaua

SEQ ID NO: 1800114 - RNA, 13 nt, Homo sapiens
acaacagugcauu

SEQ ID NO: 1800115 - RNA, 18 nt, Homo sapiens
agaacuuuucgacauauu

SEQ ID NO: 1800116 - RNA, 12 nt, Homo sapiens
uaagaaccaaaa

SEQ ID NO: 1800117 - RNA, 12 nt, Homo sapiens
aauaaaccuaug

SEQ ID NO: 1800118 - RNA, 21 nt, Homo sapiens
acuuaauuuugugaccacagu

SEQ ID NO: 1800119 - RNA, 12 nt, Homo sapiens
aucauguuccua

SEQ ID NO: 1800120 - RNA, 19 nt, Homo sapiens
agucccgucccugcccaga

SEQ ID NO: 1800121 - RNA, 20 nt, Homo sapiens
ucaagaacaggacauagcac

SEQ ID NO: 1800122 - RNA, 13 nt, Homo sapiens
uggugugcugcuu

SEQ ID NO: 1800123 - RNA, 21 nt, Homo sapiens
uugaaauguaggcaucaugca

SEQ ID NO: 1800124 - RNA, 20 nt, Homo sapiens
auaugucacugggaccauca

SEQ ID NO: 1800125 - RNA, 22 nt, Homo sapiens
cugcaucuccccucagauucca

SEQ ID NO: 1800126 - RNA, 12 nt, Homo sapiens
ccuuaagccagg

SEQ ID NO: 1800127 - RNA, 14 nt, Homo sapiens
agggaaaaugagua

SEQ ID NO: 1800128 - RNA, 20 nt, Homo sapiens
uaaaaguaucuuuaacaauu

SEQ ID NO: 1800129 - RNA, 11 nt, Homo sapiens
aauuaaaggaa

SEQ ID NO: 1800130 - RNA, 21 nt, Homo sapiens
cauucuaauccuugcuauuaa

SEQ ID NO: 1800131 - RNA, 15 nt, Homo sapiens
cuuccaguugcuugc

SEQ ID NO: 1800132 - RNA, 15 nt, Homo sapiens
ugcagugcucauuca

SEQ ID NO: 1800133 - RNA, 14 nt, Homo sapiens
gcggaaagcccugu

SEQ ID NO: 1800134 - RNA, 16 nt, Homo sapiens
cauugagcugagaucg

SEQ ID NO: 1800135 - RNA, 16 nt, Homo sapiens
guuugaaucugaaugc

SEQ ID NO: 1800136 - RNA, 23 nt, Homo sapiens
cacauccccauccccuucuagcc

SEQ ID NO: 1800137 - RNA, 22 nt, Homo sapiens
auuucugaggagccugcaacau

SEQ ID NO: 1800138 - RNA, 18 nt, Homo sapiens
agaaauaauaauauccag

SEQ ID NO: 1800139 - RNA, 17 nt, Homo sapiens
agaaaacacagccugug

SEQ ID NO: 1800140 - RNA, 18 nt, Homo sapiens
uaagacccacaaacugcc

SEQ ID NO: 1800141 - RNA, 15 nt, Homo sapiens
gucauugagggacca

SEQ ID NO: 1800142 - RNA, 16 nt, Homo sapiens
uauuaccauuacuugu

SEQ ID NO: 1800143 - RNA, 21 nt, Homo sapiens
ggagucucugccacccacuca

SEQ ID NO: 1800144 - RNA, 16 nt, Homo sapiens
accaaccgaacaugac

SEQ ID NO: 1800145 - RNA, 16 nt, Homo sapiens
agauagaagaacugca

SEQ ID NO: 1800146 - RNA, 16 nt, Homo sapiens
aauuuccuggucacau

SEQ ID NO: 1800147 - RNA, 20 nt, Homo sapiens
guugccaauuuuuguuuucc

SEQ ID NO: 1800148 - RNA, 13 nt, Homo sapiens
ucaaaauugccuu

SEQ ID NO: 1800149 - RNA, 15 nt, Homo sapiens
acucugucacacuaa

SEQ ID NO: 1800150 - RNA, 17 nt, Homo sapiens
auaauggaaacauuuac

SEQ ID NO: 1800151 - RNA, 20 nt, Homo sapiens
gauauacuugagugugcaag

SEQ ID NO: 1800152 - RNA, 16 nt, Homo sapiens
uucaguggugugaucu

SEQ ID NO: 1800153 - RNA, 22 nt, Homo sapiens
uccugcccugcccccucggggg

SEQ ID NO: 1800154 - RNA, 14 nt, Homo sapiens
ggcugagcaugugg

SEQ ID NO: 1800155 - RNA, 15 nt, Homo sapiens
agccucugugcugca

SEQ ID NO: 1800156 - RNA, 20 nt, Homo sapiens
gccaugauggugcugaccuc

SEQ ID NO: 1800157 - RNA, 17 nt, Homo sapiens
caaaaauucaugcccca

SEQ ID NO: 1800158 - RNA, 15 nt, Homo sapiens
ccccagacucaagau

SEQ ID NO: 1800159 - RNA, 22 nt, Homo sapiens
cagagaaagaaaaggcaaaaga

SEQ ID NO: 1800160 - RNA, 20 nt, Homo sapiens
uuacgaucccccaagugucc

SEQ ID NO: 1800161 - RNA, 16 nt, Homo sapiens
ccuaaaggacuauuau

SEQ ID NO: 1800162 - RNA, 21 nt, Homo sapiens
augucaaggaaugaagaacaa

SEQ ID NO: 1800163 - RNA, 13 nt, Homo sapiens
cucaaaguuuuau

SEQ ID NO: 1800164 - RNA, 17 nt, Homo sapiens
auggaaauucccuucau

SEQ ID NO: 1800165 - RNA, 19 nt, Homo sapiens
aaucuuccagcaugcaucc

SEQ ID NO: 1800166 - RNA, 14 nt, Homo sapiens
uuuaaaaccaguaa

SEQ ID NO: 1800167 - RNA, 23 nt, Homo sapiens
aauguaauaauaaugaaugucau

SEQ ID NO: 1800168 - RNA, 19 nt, Homo sapiens
cagacagaagucuccucaa

SEQ ID NO: 1800169 - RNA, 22 nt, Homo sapiens
agggaauucagugggaccaaug

SEQ ID NO: 1800170 - RNA, 22 nt, Homo sapiens
caugcuaaaauucuauagagau

SEQ ID NO: 1800171 - RNA, 18 nt, Homo sapiens
aauauggguugcauuugg

SEQ ID NO: 1800172 - RNA, 17 nt, Homo sapiens
uugaucagaucuuacaa

SEQ ID NO: 1800173 - RNA, 16 nt, Homo sapiens
auaacaguaguguuac

SEQ ID NO: 1800174 - RNA, 22 nt, Homo sapiens
ccucaccucuccaggugcucau

SEQ ID NO: 1800175 - RNA, 17 nt, Homo sapiens
augauuuugcuuuccaa

SEQ ID NO: 1800176 - RNA, 16 nt, Homo sapiens
cuauguaaaugcaucu

SEQ ID NO: 1800177 - RNA, 23 nt, Homo sapiens
gcccagggguggggcccaugggg

SEQ ID NO: 1800178 - RNA, 22 nt, Homo sapiens
cagaaacugaugccaaggggcu

SEQ ID NO: 1800179 - RNA, 14 nt, Homo sapiens
caugacagcugucu

SEQ ID NO: 1800180 - RNA, 14 nt, Homo sapiens
augaaccacugcac

SEQ ID NO: 1800181 - RNA, 23 nt, Homo sapiens
caggagauguaggaggggaacua

SEQ ID NO: 1800182 - RNA, 16 nt, Homo sapiens
gagcaaagagccagca

SEQ ID NO: 1800183 - RNA, 15 nt, Homo sapiens
aauggcgugaucucg

SEQ ID NO: 1800184 - RNA, 22 nt, Homo sapiens
aauggagaauuaaaacuuugua

SEQ ID NO: 1800185 - RNA, 14 nt, Homo sapiens
uacaaggugugugu

SEQ ID NO: 1800186 - RNA, 17 nt, Homo sapiens
cuggcaagucaccugca

SEQ ID NO: 1800187 - RNA, 23 nt, Homo sapiens
gaaaucauaggguucugaucaca

SEQ ID NO: 1800188 - RNA, 23 nt, Homo sapiens
ugcacucuaaaagguucagggaa

SEQ ID NO: 1800189 - RNA, 20 nt, Homo sapiens
ccuguaucagcacuccucau

SEQ ID NO: 1800190 - RNA, 14 nt, Homo sapiens
auaaguuucacuga

SEQ ID NO: 1800191 - RNA, 14 nt, Homo sapiens
caaaaauuaucuau

SEQ ID NO: 1800192 - RNA, 12 nt, Homo sapiens
cuccuccaggga

SEQ ID NO: 1800193 - RNA, 12 nt, Homo sapiens
cucauccagggc

SEQ ID NO: 1800194 - RNA, 21 nt, Homo sapiens
ggacagcgccaccucuuguca

SEQ ID NO: 1800195 - RNA, 17 nt, Homo sapiens
uuccuuuacccuccaca

SEQ ID NO: 1800196 - RNA, 21 nt, Homo sapiens
aguuuuucccucagugaaggc

SEQ ID NO: 1800197 - RNA, 21 nt, Homo sapiens
agcacaauuugcacuaaauca

SEQ ID NO: 1800198 - RNA, 17 nt, Homo sapiens
guccugccaggauuaaa

SEQ ID NO: 1800199 - RNA, 19 nt, Homo sapiens
cggugugugugccauguca

SEQ ID NO: 1800200 - RNA, 18 nt, Homo sapiens
gaaucacuagguaacuua

SEQ ID NO: 1800201 - RNA, 11 nt, Homo sapiens
aauagugccaa

SEQ ID NO: 1800202 - RNA, 16 nt, Homo sapiens
aauacagcauuucuuu

SEQ ID NO: 1800203 - RNA, 20 nt, Homo sapiens
caagguauguacaguucaua

SEQ ID NO: 1800204 - RNA, 20 nt, Homo sapiens
gaauuuguuaucaguaagaa

SEQ ID NO: 1800205 - RNA, 19 nt, Homo sapiens
aauaacauuuaaauuccac

SEQ ID NO: 1800206 - RNA, 13 nt, Homo sapiens
gugaggacaaauc

SEQ ID NO: 1800207 - RNA, 18 nt, Homo sapiens
caggccgacccaagggag

SEQ ID NO: 1800208 - RNA, 16 nt, Homo sapiens
ggaggggcagagccag

SEQ ID NO: 1800209 - RNA, 13 nt, Homo sapiens
uuaaaucaagucc

SEQ ID NO: 1800210 - RNA, 14 nt, Homo sapiens
gugugugugcacau

SEQ ID NO: 1800211 - RNA, 20 nt, Homo sapiens
uucuguggaaguagcuuuga

SEQ ID NO: 1800212 - RNA, 23 nt, Homo sapiens
gccuccacaugcugccuggcaca

SEQ ID NO: 1800213 - RNA, 19 nt, Homo sapiens
auucauucuggaggggcag

SEQ ID NO: 1800214 - RNA, 13 nt, Homo sapiens
gucccaaccugau

SEQ ID NO: 1800215 - RNA, 16 nt, Homo sapiens
cacagauguucaccca

SEQ ID NO: 1800216 - RNA, 16 nt, Homo sapiens
cccauaguucacugac

SEQ ID NO: 1800217 - RNA, 14 nt, Homo sapiens
ugaggucccugugu

SEQ ID NO: 1800218 - RNA, 16 nt, Homo sapiens
gaaaucaauguguaca

SEQ ID NO: 1800219 - RNA, 19 nt, Homo sapiens
aggcaugguguguggugcu

SEQ ID NO: 1800220 - RNA, 14 nt, Homo sapiens
agagguuaucugcc

SEQ ID NO: 1800221 - RNA, 19 nt, Homo sapiens
auuccuuagacucuuuucc

SEQ ID NO: 1800222 - RNA, 20 nt, Homo sapiens
gugaguuggggcgacuguga

SEQ ID NO: 1800223 - RNA, 22 nt, Homo sapiens
gaagcacuacagagcaucccac

SEQ ID NO: 1800224 - RNA, 18 nt, Homo sapiens
caugaguucaaauacuuu

SEQ ID NO: 1800225 - RNA, 17 nt, Homo sapiens
uguauuaaccuaccugu

SEQ ID NO: 1800226 - RNA, 14 nt, Homo sapiens
uaauaucaucucaa

SEQ ID NO: 1800227 - RNA, 15 nt, Homo sapiens
aagucuagaaucaua

SEQ ID NO: 1800228 - RNA, 16 nt, Homo sapiens
aucuucaggacacuca

SEQ ID NO: 1800229 - RNA, 16 nt, Homo sapiens
caccaugcgcugcuca

SEQ ID NO: 1800230 - RNA, 20 nt, Homo sapiens
cuauaaagguugacaauaaa

SEQ ID NO: 1800231 - RNA, 15 nt, Homo sapiens
accaggaaccucuuc

SEQ ID NO: 1800232 - RNA, 15 nt, Homo sapiens
auucuucacucagga

SEQ ID NO: 1800233 - RNA, 14 nt, Homo sapiens
aacccagucacugu

SEQ ID NO: 1800234 - RNA, 23 nt, Homo sapiens
ccuguccaucagccaggacaguc

SEQ ID NO: 1800235 - RNA, 15 nt, Homo sapiens
gacaggcagacacau

SEQ ID NO: 1800236 - RNA, 16 nt, Homo sapiens
ugggaagggcagggaa

SEQ ID NO: 1800237 - RNA, 13 nt, Homo sapiens
gucagaguucugc

SEQ ID NO: 1800238 - RNA, 13 nt, Homo sapiens
aacuaauucucac

SEQ ID NO: 1800239 - RNA, 16 nt, Homo sapiens
aaaauguauuuuucac

SEQ ID NO: 1800240 - RNA, 15 nt, Homo sapiens
aaggaacugucacca

SEQ ID NO: 1800241 - RNA, 20 nt, Homo sapiens
caggcaugugucccuuccaa

SEQ ID NO: 1800242 - RNA, 16 nt, Homo sapiens
uaccuuguagcagugu

SEQ ID NO: 1800243 - RNA, 17 nt, Homo sapiens
uccaauaacuagugaua

SEQ ID NO: 1800244 - RNA, 11 nt, Homo sapiens
ccaugcaguua

SEQ ID NO: 1800245 - RNA, 21 nt, Homo sapiens
aucaauaguguccuaugcaau

SEQ ID NO: 1800246 - RNA, 15 nt, Homo sapiens
aauguugcuuucuga

SEQ ID NO: 1800247 - RNA, 18 nt, Homo sapiens
auacuguucaaugguucu

SEQ ID NO: 1800248 - RNA, 16 nt, Homo sapiens
gucugucucagcucaa

SEQ ID NO: 1800249 - RNA, 13 nt, Homo sapiens
cuccuggacuaca

SEQ ID NO: 1800250 - RNA, 22 nt, Homo sapiens
uguuaaguaacacucaccauca

SEQ ID NO: 1800251 - RNA, 15 nt, Homo sapiens
ccguguugcaugaag

SEQ ID NO: 1800252 - RNA, 16 nt, Homo sapiens
augguguccauuuuau

SEQ ID NO: 1800253 - RNA, 13 nt, Homo sapiens
agacugugcuguu

SEQ ID NO: 1800254 - RNA, 18 nt, Homo sapiens
acuuuaguggucuaauca

SEQ ID NO: 1800255 - RNA, 20 nt, Homo sapiens
uaaauuuguguucucaaaua

SEQ ID NO: 1800256 - RNA, 15 nt, Homo sapiens
cacggaaagccucau

SEQ ID NO: 1800257 - RNA, 15 nt, Homo sapiens
uuuaccuuugcccua

SEQ ID NO: 1800258 - RNA, 20 nt, Homo sapiens
auugggacuccaugcuccuu

SEQ ID NO: 1800259 - RNA, 15 nt, Homo sapiens
uuaggcacugaggga

SEQ ID NO: 1800260 - RNA, 19 nt, Homo sapiens
gucaugcacucaggcagac

SEQ ID NO: 1800261 - RNA, 14 nt, Homo sapiens
gaaccucugaugcc

SEQ ID NO: 1800262 - RNA, 19 nt, Homo sapiens
gguauuuuggucacagggu

SEQ ID NO: 1800263 - RNA, 13 nt, Homo sapiens
gagccauccuccu

SEQ ID NO: 1800264 - RNA, 14 nt, Homo sapiens
aaaaugggaacaau

SEQ ID NO: 1800265 - RNA, 13 nt, Homo sapiens
caguggugccauc

SEQ ID NO: 1800266 - RNA, 20 nt, Homo sapiens
acucuggccacccaaacagg

SEQ ID NO: 1800267 - RNA, 14 nt, Homo sapiens
auaaagaugaucua

SEQ ID NO: 1800268 - RNA, 16 nt, Homo sapiens
aaccuccgacucaaca

SEQ ID NO: 1800269 - RNA, 13 nt, Homo sapiens
accugacuugccu

SEQ ID NO: 1800270 - RNA, 16 nt, Homo sapiens
agauuggguuuugcuu

SEQ ID NO: 1800271 - RNA, 18 nt, Homo sapiens
cuuucaugaacacagccu

SEQ ID NO: 1800272 - RNA, 14 nt, Homo sapiens
ugcgccugaguaac

SEQ ID NO: 1800273 - RNA, 17 nt, Homo sapiens
ggacucagaacagucug

SEQ ID NO: 1800274 - RNA, 14 nt, Homo sapiens
cuuccaucaccucc

SEQ ID NO: 1800275 - RNA, 20 nt, Homo sapiens
ucaaagacagagaagaccaa

SEQ ID NO: 1800276 - RNA, 16 nt, Homo sapiens
guucccaauacaaaaa

SEQ ID NO: 1800277 - RNA, 20 nt, Homo sapiens
augguggcucacaccuguaa

SEQ ID NO: 1800278 - RNA, 17 nt, Homo sapiens
cuauuuucccaugccag

SEQ ID NO: 1800279 - RNA, 16 nt, Homo sapiens
cuuuccugacuuacaa

SEQ ID NO: 1800280 - RNA, 19 nt, Homo sapiens
gugccgguaccagccugac

SEQ ID NO: 1800281 - RNA, 18 nt, Homo sapiens
cucuaaacugguacaauu

SEQ ID NO: 1800282 - RNA, 18 nt, Homo sapiens
cgggucuauggggagaaa

SEQ ID NO: 1800283 - RNA, 22 nt, Homo sapiens
ucugcuuucuccuguagcacaa

SEQ ID NO: 1800284 - RNA, 17 nt, Homo sapiens
auacuuuagaaguagaa

SEQ ID NO: 1800285 - RNA, 15 nt, Homo sapiens
uaaauuuucuuuaag

SEQ ID NO: 1800286 - RNA, 13 nt, Homo sapiens
aaugauccuguau

SEQ ID NO: 1800287 - RNA, 13 nt, Homo sapiens
aauauuccuguga

SEQ ID NO: 1800288 - RNA, 15 nt, Homo sapiens
gcauggaacagugca

SEQ ID NO: 1800289 - RNA, 16 nt, Homo sapiens
gaugauaaaacacaaa

SEQ ID NO: 1800290 - RNA, 14 nt, Homo sapiens
uauugcaaagucag

SEQ ID NO: 1800291 - RNA, 16 nt, Homo sapiens
accuguucuguagcuu

SEQ ID NO: 1800292 - RNA, 19 nt, Homo sapiens
augccagcuuaucucaggg

SEQ ID NO: 1800293 - RNA, 14 nt, Homo sapiens
ggugagaaagggau

SEQ ID NO: 1800294 - RNA, 14 nt, Homo sapiens
cugccuuugccucc

SEQ ID NO: 1800295 - RNA, 15 nt, Homo sapiens
cuguuuuaauaauua

SEQ ID NO: 1800296 - RNA, 21 nt, Homo sapiens
aucuuaaugaacacacaagcu

SEQ ID NO: 1800297 - RNA, 17 nt, Homo sapiens
uaacauguuaucaaauc

SEQ ID NO: 1800298 - RNA, 19 nt, Homo sapiens
uagccccgagacaccaucc

SEQ ID NO: 1800299 - RNA, 20 nt, Homo sapiens
ggcacauuggcaguguguca

SEQ ID NO: 1800300 - RNA, 15 nt, Homo sapiens
ggucuccuaaccaag

SEQ ID NO: 1800301 - RNA, 14 nt, Homo sapiens
cagaaagggccuug

SEQ ID NO: 1800302 - RNA, 14 nt, Homo sapiens
gugugucaaugcca

SEQ ID NO: 1800303 - RNA, 20 nt, Homo sapiens
auugagaaaaauauauacua

SEQ ID NO: 1800304 - RNA, 22 nt, Homo sapiens
uacacauucucacaauuguaaa

SEQ ID NO: 1800305 - RNA, 18 nt, Homo sapiens
caaauaguagauggcaaa

SEQ ID NO: 1800306 - RNA, 14 nt, Homo sapiens
gaaauacacuacaa

SEQ ID NO: 1800307 - RNA, 11 nt, Homo sapiens
uacaucuggcc

SEQ ID NO: 1800308 - RNA, 17 nt, Homo sapiens
uauuagauaaauuucaa

SEQ ID NO: 1800309 - RNA, 17 nt, Homo sapiens
ucacuuaaacucagcua

SEQ ID NO: 1800310 - RNA, 21 nt, Homo sapiens
ucauuuauagaugucaggaaa

SEQ ID NO: 1800311 - RNA, 17 nt, Homo sapiens
ccucucucccugccuca

SEQ ID NO: 1800312 - RNA, 17 nt, Homo sapiens
cccacacuggagccauc

SEQ ID NO: 1800313 - RNA, 16 nt, Homo sapiens
aggcguacacaugcac

SEQ ID NO: 1800314 - RNA, 16 nt, Homo sapiens
acaggagaacaugcug

SEQ ID NO: 1800315 - RNA, 20 nt, Homo sapiens
ucuguguuuuugaaauauua

SEQ ID NO: 1800316 - RNA, 17 nt, Homo sapiens
caaauaauauugccuug

SEQ ID NO: 1800317 - RNA, 16 nt, Homo sapiens
gucacaacaauuaaau

SEQ ID NO: 1800318 - RNA, 16 nt, Homo sapiens
uguuuuccccacauuc

SEQ ID NO: 1800319 - RNA, 12 nt, Homo sapiens
aaugcaccacuu

SEQ ID NO: 1800320 - RNA, 14 nt, Homo sapiens
ucucucuuaucacc

SEQ ID NO: 1800321 - RNA, 14 nt, Homo sapiens
uuaaucaugaaugu

SEQ ID NO: 1800322 - RNA, 13 nt, Homo sapiens
gagucuccucacu

SEQ ID NO: 1800323 - RNA, 21 nt, Homo sapiens
uggaugggcccugcaagacac

SEQ ID NO: 1800324 - RNA, 17 nt, Homo sapiens
ucauaucuuuuaauugu

SEQ ID NO: 1800325 - RNA, 16 nt, Homo sapiens
acuggauagugggggu

SEQ ID NO: 1800326 - RNA, 16 nt, Homo sapiens
uauugaaugugaaaca

SEQ ID NO: 1800327 - RNA, 15 nt, Homo sapiens
aucuuguacauuaua

SEQ ID NO: 1800328 - RNA, 16 nt, Homo sapiens
cgagaagguacugaaa

SEQ ID NO: 1800329 - RNA, 15 nt, Homo sapiens
aaggaaccaaagcga

SEQ ID NO: 1800330 - RNA, 15 nt, Homo sapiens
guaagccaagucaug

SEQ ID NO: 1800331 - RNA, 22 nt, Homo sapiens
agugguggguaauuguacaaua

SEQ ID NO: 1800332 - RNA, 17 nt, Homo sapiens
ucuuuccagaccccaca

SEQ ID NO: 1800333 - RNA, 14 nt, Homo sapiens
gaauaaauaccucu

SEQ ID NO: 1800334 - RNA, 17 nt, Homo sapiens
augggcagcucaucucu

SEQ ID NO: 1800335 - RNA, 15 nt, Homo sapiens
auuaaguauuacuga

SEQ ID NO: 1800336 - RNA, 15 nt, Homo sapiens
aaaauauauaucaaa

SEQ ID NO: 1800337 - RNA, 17 nt, Homo sapiens
guaauuccucccuaaga

SEQ ID NO: 1800338 - RNA, 19 nt, Homo sapiens
acauugccuucuggagcug

SEQ ID NO: 1800339 - RNA, 20 nt, Homo sapiens
gcauccccuuggcugugagg

SEQ ID NO: 1800340 - RNA, 23 nt, Homo sapiens
gaaaggcgcuuggcaucacacau

SEQ ID NO: 1800341 - RNA, 19 nt, Homo sapiens
aucuuuuuuaggcuucucc

SEQ ID NO: 1800342 - RNA, 16 nt, Homo sapiens
gcaagcaccugggugu

SEQ ID NO: 1800343 - RNA, 13 nt, Homo sapiens
ugggggaaacuuc

SEQ ID NO: 1800344 - RNA, 15 nt, Homo sapiens
ucagugcugcaauug

SEQ ID NO: 1800345 - RNA, 13 nt, Homo sapiens
uggauaugcugcu

SEQ ID NO: 1800346 - RNA, 18 nt, Homo sapiens
ccaaaguaacugaauuau

SEQ ID NO: 1800347 - RNA, 17 nt, Homo sapiens
uaauugaagaaugggaa

SEQ ID NO: 1800348 - RNA, 23 nt, Homo sapiens
aauguaagaucguucucugccuc

SEQ ID NO: 1800349 - RNA, 21 nt, Homo sapiens
ucuguuuccuggucagcaugu

SEQ ID NO: 1800350 - RNA, 19 nt, Homo sapiens
uuguggcacacaacugugg

SEQ ID NO: 1800351 - RNA, 13 nt, Homo sapiens
cuugaaaacugga

SEQ ID NO: 1800352 - RNA, 22 nt, Homo sapiens
auuugcgguuagaaucccaugg

SEQ ID NO: 1800353 - RNA, 16 nt, Homo sapiens
caguacuaaugaagug

SEQ ID NO: 1800354 - RNA, 19 nt, Homo sapiens
agggcuggaagcuuucauu

SEQ ID NO: 1800355 - RNA, 18 nt, Homo sapiens
acuagaacacaaauccaa

SEQ ID NO: 1800356 - RNA, 16 nt, Homo sapiens
cugucuggcugaggau

SEQ ID NO: 1800357 - RNA, 16 nt, Homo sapiens
ucccacacgauuagcu

SEQ ID NO: 1800358 - RNA, 15 nt, Homo sapiens
cauuaagguagaacu

SEQ ID NO: 1800359 - RNA, 19 nt, Homo sapiens
ggaagaucagcacccuaag

SEQ ID NO: 1800360 - RNA, 22 nt, Homo sapiens
augggaggaaaagcccaggaga

SEQ ID NO: 1800361 - RNA, 15 nt, Homo sapiens
uaacacugcuaauga

SEQ ID NO: 1800362 - RNA, 16 nt, Homo sapiens
guuauguuugcacuuu

SEQ ID NO: 1800363 - RNA, 16 nt, Homo sapiens
cacccaagaugaauua

SEQ ID NO: 1800364 - RNA, 19 nt, Homo sapiens
acuguggccugugcccagg

SEQ ID NO: 1800365 - RNA, 18 nt, Homo sapiens
cuaaaaaugcaucuggcu

SEQ ID NO: 1800366 - RNA, 13 nt, Homo sapiens
aguuaggggagag

SEQ ID NO: 1800367 - RNA, 21 nt, Homo sapiens
ugcuuugggaagacugaggca

SEQ ID NO: 1800368 - RNA, 17 nt, Homo sapiens
cagcaacacacaugcuc

SEQ ID NO: 1800369 - RNA, 19 nt, Homo sapiens
ggacauuuaaaauucaauu

SEQ ID NO: 1800370 - RNA, 17 nt, Homo sapiens
uuaaagugguucuggau

SEQ ID NO: 1800371 - RNA, 13 nt, Homo sapiens
ggagggcaggcau

SEQ ID NO: 1800372 - RNA, 18 nt, Homo sapiens
ccugcuccuuucugccca

SEQ ID NO: 1800373 - RNA, 17 nt, Homo sapiens
uacccacuugcuuuuaa

SEQ ID NO: 1800374 - RNA, 18 nt, Homo sapiens
ugugaggcccucagggca

SEQ ID NO: 1800375 - RNA, 14 nt, Homo sapiens
ccacagucacugga

SEQ ID NO: 1800376 - RNA, 14 nt, Homo sapiens
uucuauugccuucu

SEQ ID NO: 1800377 - RNA, 13 nt, Homo sapiens
cccuaucugcaaa

SEQ ID NO: 1800378 - RNA, 21 nt, Homo sapiens
aaacauugguucuuguauuaa

SEQ ID NO: 1800379 - RNA, 18 nt, Homo sapiens
gaacuaccuaauuuucaa

SEQ ID NO: 1800380 - RNA, 17 nt, Homo sapiens
acuuaaaagaacaugua

SEQ ID NO: 1800381 - RNA, 23 nt, Homo sapiens
accauguauucauccagaguucu

SEQ ID NO: 1800382 - RNA, 22 nt, Homo sapiens
uugauaagaggaauuugguaua

SEQ ID NO: 1800383 - RNA, 16 nt, Homo sapiens
gauauggagcccugua

SEQ ID NO: 1800384 - RNA, 18 nt, Homo sapiens
auccaucugaggcuucau

SEQ ID NO: 1800385 - RNA, 16 nt, Homo sapiens
augaguugaggccacu

SEQ ID NO: 1800386 - RNA, 12 nt, Homo sapiens
aaugccugugaa

SEQ ID NO: 1800387 - RNA, 18 nt, Homo sapiens
cauguccccugcuugaac

SEQ ID NO: 1800388 - RNA, 13 nt, Homo sapiens
gggcugggcagaa

SEQ ID NO: 1800389 - RNA, 19 nt, Homo sapiens
gagaggccacagugcaauu

SEQ ID NO: 1800390 - RNA, 21 nt, Homo sapiens
uucuuguaccacuucaucaaa

SEQ ID NO: 1800391 - RNA, 23 nt, Homo sapiens
agcccauggcuuuagcuaccuca

SEQ ID NO: 1800392 - RNA, 14 nt, Homo sapiens
aaaaacaaauggga

SEQ ID NO: 1800393 - RNA, 12 nt, Homo sapiens
aacucucuccac

SEQ ID NO: 1800394 - RNA, 15 nt, Homo sapiens
accggacgcaugcag

SEQ ID NO: 1800395 - RNA, 11 nt, Homo sapiens
agucuguucuc

SEQ ID NO: 1800396 - RNA, 22 nt, Homo sapiens
ucacuucccaccucucuaccua

SEQ ID NO: 1800397 - RNA, 22 nt, Homo sapiens
ucauuuuuccuucccuucucca

SEQ ID NO: 1800398 - RNA, 16 nt, Homo sapiens
uccuauagacuguaag

SEQ ID NO: 1800399 - RNA, 15 nt, Homo sapiens
aaccagcacuccauc

SEQ ID NO: 1800400 - RNA, 22 nt, Homo sapiens
gaagcauugccuggacugacca

SEQ ID NO: 1800401 - RNA, 20 nt, Homo sapiens
uagcaaagacuugugugaug

SEQ ID NO: 1800402 - RNA, 22 nt, Homo sapiens
ggcguauuuauacucacugagu

SEQ ID NO: 1800403 - RNA, 14 nt, Homo sapiens
uggaagauuugccc

SEQ ID NO: 1800404 - RNA, 22 nt, Homo sapiens
agauggguauuaaacuugucag

SEQ ID NO: 1800405 - RNA, 12 nt, Homo sapiens
aagcaaggagcc

SEQ ID NO: 1800406 - RNA, 15 nt, Homo sapiens
gcgcucucuuugcaa

SEQ ID NO: 1800407 - RNA, 15 nt, Homo sapiens
uuuauucuuccucaa

SEQ ID NO: 1800408 - RNA, 14 nt, Homo sapiens
auucuuuaccucag

SEQ ID NO: 1800409 - RNA, 17 nt, Homo sapiens
guguaaauucagucuuu

SEQ ID NO: 1800410 - RNA, 20 nt, Homo sapiens
auugaaucuaaaaccaaaua

SEQ ID NO: 1800411 - RNA, 13 nt, Homo sapiens
auuuuucuaacua

SEQ ID NO: 1800412 - RNA, 22 nt, Homo sapiens
uuaauacuccagagacagggaa

SEQ ID NO: 1800413 - RNA, 14 nt, Homo sapiens
gcaugccacccuca

SEQ ID NO: 1800414 - RNA, 13 nt, Homo sapiens
uggaacuagucau

SEQ ID NO: 1800415 - RNA, 13 nt, Homo sapiens
cacucagcugucc

SEQ ID NO: 1800416 - RNA, 20 nt, Homo sapiens
aucagaagcgcugaugguca

SEQ ID NO: 1800417 - RNA, 14 nt, Homo sapiens
cggaggcugcagug

SEQ ID NO: 1800418 - RNA, 22 nt, Homo sapiens
cuccaucuccugaccucgugau

SEQ ID NO: 1800419 - RNA, 15 nt, Homo sapiens
auugugaccacugaa

SEQ ID NO: 1800420 - RNA, 16 nt, Homo sapiens
guaccauucucaggug

SEQ ID NO: 1800421 - RNA, 17 nt, Homo sapiens
cacaagcuggaagcaca

SEQ ID NO: 1800422 - RNA, 19 nt, Homo sapiens
ucccuccccaaacccauca

SEQ ID NO: 1800423 - RNA, 20 nt, Homo sapiens
cagucagcucucuccuuuca

SEQ ID NO: 1800424 - RNA, 16 nt, Homo sapiens
caccaagccacugaua

SEQ ID NO: 1800425 - RNA, 21 nt, Homo sapiens
acagaaagagacuccgucuca

SEQ ID NO: 1800426 - RNA, 21 nt, Homo sapiens
gcccuaggaaacuaauacaau

SEQ ID NO: 1800427 - RNA, 23 nt, Homo sapiens
acagacuuccucuuucuaagauu

SEQ ID NO: 1800428 - RNA, 22 nt, Homo sapiens
ggaaaauuuuaaaaauacagau

SEQ ID NO: 1800429 - RNA, 19 nt, Homo sapiens
ugccccccagccucuggca

SEQ ID NO: 1800430 - RNA, 19 nt, Homo sapiens
ucucauaaguagcauucau

SEQ ID NO: 1800431 - RNA, 17 nt, Homo sapiens
ggccagggaaagcccgu

SEQ ID NO: 1800432 - RNA, 19 nt, Homo sapiens
gcccugaacaaagcaccuc

SEQ ID NO: 1800433 - RNA, 14 nt, Homo sapiens
cugauaucagcacu

SEQ ID NO: 1800434 - RNA, 20 nt, Homo sapiens
ucuuuaugucuuuugaugaa

SEQ ID NO: 1800435 - RNA, 14 nt, Homo sapiens
uagaaugauucccu

SEQ ID NO: 1800436 - RNA, 14 nt, Homo sapiens
ccccacaacuuuaa

SEQ ID NO: 1800437 - RNA, 16 nt, Homo sapiens
cuauucuccauacucu

SEQ ID NO: 1800438 - RNA, 19 nt, Homo sapiens
augcuguuuaugaacggaa

SEQ ID NO: 1800439 - RNA, 13 nt, Homo sapiens
cuugaagacuccc

SEQ ID NO: 1800440 - RNA, 17 nt, Homo sapiens
uacccugugcuaagcac

SEQ ID NO: 1800441 - RNA, 16 nt, Homo sapiens
uacauaguacauacaa

SEQ ID NO: 1800442 - RNA, 12 nt, Homo sapiens
aauucuucucca

SEQ ID NO: 1800443 - RNA, 22 nt, Homo sapiens
cagcuucauaauuuccaugaua

SEQ ID NO: 1800444 - RNA, 23 nt, Homo sapiens
ggccauuggguuuggggccaugg

SEQ ID NO: 1800445 - RNA, 21 nt, Homo sapiens
aauucuuuucuuuuccauuua

SEQ ID NO: 1800446 - RNA, 19 nt, Homo sapiens
cugccuggaguacuuugaa

SEQ ID NO: 1800447 - RNA, 14 nt, Homo sapiens
uagcaacaucuuuu

SEQ ID NO: 1800448 - RNA, 20 nt, Homo sapiens
uagguuaauaaaucaagcca

SEQ ID NO: 1800449 - RNA, 22 nt, Homo sapiens
gugcaucaugucucuuugccaa

SEQ ID NO: 1800450 - RNA, 12 nt, Homo sapiens
gcuaaaugcaaa

SEQ ID NO: 1800451 - RNA, 12 nt, Homo sapiens
uguuaccaaaua

SEQ ID NO: 1800452 - RNA, 13 nt, Homo sapiens
uuuacuugaucau

SEQ ID NO: 1800453 - RNA, 23 nt, Homo sapiens
uaucaaauacaucuccaguacau

SEQ ID NO: 1800454 - RNA, 13 nt, Homo sapiens
cuggcccaaagca

SEQ ID NO: 1800455 - RNA, 15 nt, Homo sapiens
caggacccagggaau

SEQ ID NO: 1800456 - RNA, 16 nt, Homo sapiens
ugaccaagaacugcau

SEQ ID NO: 1800457 - RNA, 16 nt, Homo sapiens
ucuaaacugcuguuaa

SEQ ID NO: 1800458 - RNA, 22 nt, Homo sapiens
gacuguuuauagcuguuggaag

SEQ ID NO: 1800459 - RNA, 16 nt, Homo sapiens
gucuugacucauggca

SEQ ID NO: 1800460 - RNA, 23 nt, Homo sapiens
cugccuccauucugaccauuuca

SEQ ID NO: 1800461 - RNA, 21 nt, Homo sapiens
agucugggccccaucauuaaa

SEQ ID NO: 1800462 - RNA, 18 nt, Homo sapiens
acccuuagcgggacaaag

SEQ ID NO: 1800463 - RNA, 20 nt, Homo sapiens
aucucuuucaucuagcucca

SEQ ID NO: 1800464 - RNA, 23 nt, Homo sapiens
ucucacuuugccccaguuacaaa

SEQ ID NO: 1800465 - RNA, 21 nt, Homo sapiens
cuguguuaauuuaaguuuuga

SEQ ID NO: 1800466 - RNA, 21 nt, Homo sapiens
ucacaauggugcucauuucau

SEQ ID NO: 1800467 - RNA, 19 nt, Homo sapiens
aggcaggcuuuuccuccaa

SEQ ID NO: 1800468 - RNA, 13 nt, Homo sapiens
uuggcuaaucagu

SEQ ID NO: 1800469 - RNA, 15 nt, Homo sapiens
guagauacuagcuau

SEQ ID NO: 1800470 - RNA, 11 nt, Homo sapiens
caccuccucau

SEQ ID NO: 1800471 - RNA, 12 nt, Homo sapiens
caugcacauuca

SEQ ID NO: 1800472 - RNA, 17 nt, Homo sapiens
uccucugcauuuacaca

SEQ ID NO: 1800473 - RNA, 15 nt, Homo sapiens
cuacagaaauugaaa

SEQ ID NO: 1800474 - RNA, 16 nt, Homo sapiens
ggcaugaaggugucau

SEQ ID NO: 1800475 - RNA, 15 nt, Homo sapiens
cagaaagauuuuccu

SEQ ID NO: 1800476 - RNA, 15 nt, Homo sapiens
auuguuacuccauau

SEQ ID NO: 1800477 - RNA, 14 nt, Homo sapiens
ccacaaacuguaau

SEQ ID NO: 1800478 - RNA, 14 nt, Homo sapiens
acauccagcccagg

SEQ ID NO: 1800479 - RNA, 14 nt, Homo sapiens
accuggcuuuuacu

SEQ ID NO: 1800480 - RNA, 22 nt, Homo sapiens
cucaaacucuugaccucaggug

SEQ ID NO: 1800481 - RNA, 22 nt, Homo sapiens
aucaacuaaaguuguacuuuaa

SEQ ID NO: 1800482 - RNA, 20 nt, Homo sapiens
acauuagaagaaaacauaua

SEQ ID NO: 1800483 - RNA, 19 nt, Homo sapiens
caaaacgcaaaacccagua

SEQ ID NO: 1800484 - RNA, 17 nt, Homo sapiens
aaguaguuaucauguua

SEQ ID NO: 1800485 - RNA, 16 nt, Homo sapiens
caacucaucuucacag

SEQ ID NO: 1800486 - RNA, 13 nt, Homo sapiens
uguaaccacugca

SEQ ID NO: 1800487 - RNA, 21 nt, Homo sapiens
aaggaaggugaugugugaguc

SEQ ID NO: 1800488 - RNA, 16 nt, Homo sapiens
uaccaaaaaaguauuu

SEQ ID NO: 1800489 - RNA, 21 nt, Homo sapiens
gcagaaauauuugugacaaaa

SEQ ID NO: 1800490 - RNA, 16 nt, Homo sapiens
guuccuacacaggaca

SEQ ID NO: 1800491 - RNA, 19 nt, Homo sapiens
uccagugccagcaaugaca

SEQ ID NO: 1800492 - RNA, 21 nt, Homo sapiens
ucuuuucuggaauguaaucaa

SEQ ID NO: 1800493 - RNA, 14 nt, Homo sapiens
uccuuuauacugug

SEQ ID NO: 1800494 - RNA, 18 nt, Homo sapiens
gaauguuuguuucagugc

SEQ ID NO: 1800495 - RNA, 21 nt, Homo sapiens
cccccauuguggucacaggaa

SEQ ID NO: 1800496 - RNA, 16 nt, Homo sapiens
uaaacuagauauagcu

SEQ ID NO: 1800497 - RNA, 23 nt, Homo sapiens
auuccuugucaccagcaacaucu

SEQ ID NO: 1800498 - RNA, 13 nt, Homo sapiens
auuggcaugucuc

SEQ ID NO: 1800499 - RNA, 20 nt, Homo sapiens
ccugugacccucucacuuac

SEQ ID NO: 1800500 - RNA, 17 nt, Homo sapiens
aauggaaaauacauuuu

SEQ ID NO: 1800501 - RNA, 19 nt, Homo sapiens
augaugagaguuucuguua

SEQ ID NO: 1800502 - RNA, 22 nt, Homo sapiens
ugucccaccacagucccucacc

SEQ ID NO: 1800503 - RNA, 21 nt, Homo sapiens
cagagauuuucaacauuucaa

SEQ ID NO: 1800504 - RNA, 13 nt, Homo sapiens
gaaaaaaagugag

SEQ ID NO: 1800505 - RNA, 20 nt, Homo sapiens
uccauuaaacuucuacugag

SEQ ID NO: 1800506 - RNA, 20 nt, Homo sapiens
gauaccccaaaguccaggcu

SEQ ID NO: 1800507 - RNA, 20 nt, Homo sapiens
uauucaaaaacauaacugag

SEQ ID NO: 1800508 - RNA, 22 nt, Homo sapiens
ucaugaaauuacuuaucaucca

SEQ ID NO: 1800509 - RNA, 14 nt, Homo sapiens
uauauauaagcuca

SEQ ID NO: 1800510 - RNA, 20 nt, Homo sapiens
uagugccugaauuuguucuc

SEQ ID NO: 1800511 - RNA, 14 nt, Homo sapiens
uaucaacacugcag

SEQ ID NO: 1800512 - RNA, 16 nt, Homo sapiens
gugcauauuaaaacaa

SEQ ID NO: 1800513 - RNA, 20 nt, Homo sapiens
ggagccgggacccucaggug

SEQ ID NO: 1800514 - RNA, 12 nt, Homo sapiens
uuaugaugcuaa

SEQ ID NO: 1800515 - RNA, 20 nt, Homo sapiens
cugcaccgagagagauggaa

SEQ ID NO: 1800516 - RNA, 21 nt, Homo sapiens
cucaugauaccaccuuuacug

SEQ ID NO: 1800517 - RNA, 16 nt, Homo sapiens
cgggaaguucaaggaa

SEQ ID NO: 1800518 - RNA, 21 nt, Homo sapiens
gaagaugaauggucuggcaau

SEQ ID NO: 1800519 - RNA, 22 nt, Homo sapiens
cuaucagggcaagcucauagca

SEQ ID NO: 1800520 - RNA, 17 nt, Homo sapiens
agcucagcccauuucuu

SEQ ID NO: 1800521 - RNA, 22 nt, Homo sapiens
cugaugggaaugauuaagggag

SEQ ID NO: 1800522 - RNA, 15 nt, Homo sapiens
ugcugaacauugcau

SEQ ID NO: 1800523 - RNA, 16 nt, Homo sapiens
accagaauugugcaaa

SEQ ID NO: 1800524 - RNA, 22 nt, Homo sapiens
uuugacucaugaacuauuuaca

SEQ ID NO: 1800525 - RNA, 17 nt, Homo sapiens
gacacgcaacuggcuca

SEQ ID NO: 1800526 - RNA, 20 nt, Homo sapiens
uuguuccuggggaauucacu

SEQ ID NO: 1800527 - RNA, 21 nt, Homo sapiens
cuaagcccaaauauaaaaaca

SEQ ID NO: 1800528 - RNA, 16 nt, Homo sapiens
acuugccaagugaagg

SEQ ID NO: 1800529 - RNA, 12 nt, Homo sapiens
ucaucugcucag

SEQ ID NO: 1800530 - RNA, 17 nt, Homo sapiens
caggacagcaguacuca

SEQ ID NO: 1800531 - RNA, 12 nt, Homo sapiens
cuuucugccuug

SEQ ID NO: 1800532 - RNA, 19 nt, Homo sapiens
uaauaacuuucucugugaa

SEQ ID NO: 1800533 - RNA, 15 nt, Homo sapiens
cagagcagaugcaga

SEQ ID NO: 1800534 - RNA, 12 nt, Homo sapiens
cugugcagugac

SEQ ID NO: 1800535 - RNA, 14 nt, Homo sapiens
ucauauuucuuuuc

SEQ ID NO: 1800536 - RNA, 23 nt, Homo sapiens
acuggauucuuaaccaagaaaca

SEQ ID NO: 1800537 - RNA, 14 nt, Homo sapiens
acacccuggaugcu

SEQ ID NO: 1800538 - RNA, 14 nt, Homo sapiens
cugggccauugugg

SEQ ID NO: 1800539 - RNA, 23 nt, Homo sapiens
ugguuccaguaaggauuuuuaug

SEQ ID NO: 1800540 - RNA, 18 nt, Homo sapiens
ugcucuggggcuugcuau

SEQ ID NO: 1800541 - RNA, 12 nt, Homo sapiens
ucaaaguucucu

SEQ ID NO: 1800542 - RNA, 15 nt, Homo sapiens
aaaaacaaagugcaa

SEQ ID NO: 1800543 - RNA, 13 nt, Homo sapiens
ccauuuguaaugu

SEQ ID NO: 1800544 - RNA, 15 nt, Homo sapiens
cuucacaugcaucaa

SEQ ID NO: 1800545 - RNA, 19 nt, Homo sapiens
gaauccccgaaggugcugg

SEQ ID NO: 1800546 - RNA, 21 nt, Homo sapiens
aaacgugaaauucuauugaaa

SEQ ID NO: 1800547 - RNA, 18 nt, Homo sapiens
ucguaaguucugugcagu

SEQ ID NO: 1800548 - RNA, 23 nt, Homo sapiens
acaucuuuuaggggaagugacaa

SEQ ID NO: 1800549 - RNA, 18 nt, Homo sapiens
uccacagaacuagccuua

SEQ ID NO: 1800550 - RNA, 18 nt, Homo sapiens
ccacauccaacuccagca

SEQ ID NO: 1800551 - RNA, 21 nt, Homo sapiens
cccucagccucugccacugug

SEQ ID NO: 1800552 - RNA, 20 nt, Homo sapiens
auggcugagcugcccacagc

SEQ ID NO: 1800553 - RNA, 15 nt, Homo sapiens
cuggagagugcacau

SEQ ID NO: 1800554 - RNA, 19 nt, Homo sapiens
uuaauacugacucaguguc

SEQ ID NO: 1800555 - RNA, 19 nt, Homo sapiens
auguggaauuacauaacag

SEQ ID NO: 1800556 - RNA, 15 nt, Homo sapiens
cacucccuccaucaa

SEQ ID NO: 1800557 - RNA, 21 nt, Homo sapiens
uguucacuucuaaaccaaaaa

SEQ ID NO: 1800558 - RNA, 20 nt, Homo sapiens
augucaugaggaaacuacug

SEQ ID NO: 1800559 - RNA, 16 nt, Homo sapiens
ugucacucugugccuu

SEQ ID NO: 1800560 - RNA, 19 nt, Homo sapiens
ucaguuuuuuuuuuuccag

SEQ ID NO: 1800561 - RNA, 22 nt, Homo sapiens
uguuaucugguuuuuaaaagcu

SEQ ID NO: 1800562 - RNA, 16 nt, Homo sapiens
cagcccugaacaaagc

SEQ ID NO: 1800563 - RNA, 12 nt, Homo sapiens
gcaggaucucag

SEQ ID NO: 1800564 - RNA, 16 nt, Homo sapiens
aaacuggagaugcauc

SEQ ID NO: 1800565 - RNA, 11 nt, Homo sapiens
accagcccagc

SEQ ID NO: 1800566 - RNA, 17 nt, Homo sapiens
ccaggauugucacucca

SEQ ID NO: 1800567 - RNA, 16 nt, Homo sapiens
agaccccaaagaucuc

SEQ ID NO: 1800568 - RNA, 20 nt, Homo sapiens
aaauucaugccccaguauua

SEQ ID NO: 1800569 - RNA, 21 nt, Homo sapiens
gccucgcuucacggacaggaa

SEQ ID NO: 1800570 - RNA, 16 nt, Homo sapiens
cacaaguggaccuuag

SEQ ID NO: 1800571 - RNA, 23 nt, Homo sapiens
aucuuucuugaaugaaugaaaga

SEQ ID NO: 1800572 - RNA, 13 nt, Homo sapiens
caggccccaggac

SEQ ID NO: 1800573 - RNA, 16 nt, Homo sapiens
ucuuucuacagccuaa

SEQ ID NO: 1800574 - RNA, 19 nt, Homo sapiens
guuacuuaauugccagcaa

SEQ ID NO: 1800575 - RNA, 15 nt, Homo sapiens
agaucguuguuuaca

SEQ ID NO: 1800576 - RNA, 18 nt, Homo sapiens
caucucagugcuguaaaa

SEQ ID NO: 1800577 - RNA, 15 nt, Homo sapiens
cugaagggugacuaa

SEQ ID NO: 1800578 - RNA, 19 nt, Homo sapiens
cccaaucugcacacuccag

SEQ ID NO: 1800579 - RNA, 18 nt, Homo sapiens
cagggaagccccagugag

SEQ ID NO: 1800580 - RNA, 18 nt, Homo sapiens
ccucuugucccuuggcac

SEQ ID NO: 1800581 - RNA, 20 nt, Homo sapiens
cugcuuuuaaagauauggcu

SEQ ID NO: 1800582 - RNA, 12 nt, Homo sapiens
guaaaggcagua

SEQ ID NO: 1800583 - RNA, 20 nt, Homo sapiens
ugguaggaggcagagucucu

SEQ ID NO: 1800584 - RNA, 14 nt, Homo sapiens
auaauucuaugaga

SEQ ID NO: 1800585 - RNA, 12 nt, Homo sapiens
aagaugaugcuc

SEQ ID NO: 1800586 - RNA, 22 nt, Homo sapiens
aucuggucugaauaacacugga

SEQ ID NO: 1800587 - RNA, 17 nt, Homo sapiens
uacacaauacaguauua

SEQ ID NO: 1800588 - RNA, 20 nt, Homo sapiens
gguuagguagcaacaacaga

SEQ ID NO: 1800589 - RNA, 21 nt, Homo sapiens
ucuacacauucggcugaaugu

SEQ ID NO: 1800590 - RNA, 19 nt, Homo sapiens
aggcuugguuccuucccaa

SEQ ID NO: 1800591 - RNA, 16 nt, Homo sapiens
cuccuggucuugagau

SEQ ID NO: 1800592 - RNA, 14 nt, Homo sapiens
caucuuccaacuca

SEQ ID NO: 1800593 - RNA, 21 nt, Homo sapiens
agguaacaugauuguuugaca

SEQ ID NO: 1800594 - RNA, 19 nt, Homo sapiens
uauguucccagcagugggg

SEQ ID NO: 1800595 - RNA, 16 nt, Homo sapiens
aguuaaaagacugcag

SEQ ID NO: 1800596 - RNA, 16 nt, Homo sapiens
cugaugcagccgucca

SEQ ID NO: 1800597 - RNA, 15 nt, Homo sapiens
aaauauuaguauaaa

SEQ ID NO: 1800598 - RNA, 14 nt, Homo sapiens
ccucuguugccaag

SEQ ID NO: 1800599 - RNA, 20 nt, Homo sapiens
uugagaagaugaagguuuaa

SEQ ID NO: 1800600 - RNA, 16 nt, Homo sapiens
ggcccugaggaauaaa

SEQ ID NO: 1800601 - RNA, 16 nt, Homo sapiens
ccccuaaaccaacuga

SEQ ID NO: 1800602 - RNA, 13 nt, Homo sapiens
gucacuugcaauu

SEQ ID NO: 1800603 - RNA, 19 nt, Homo sapiens
acucaagaggcugaggcag

SEQ ID NO: 1800604 - RNA, 14 nt, Homo sapiens
uucagacaaaaugg

SEQ ID NO: 1800605 - RNA, 18 nt, Homo sapiens
uuuuagcaguucugcaaa

SEQ ID NO: 1800606 - RNA, 15 nt, Homo sapiens
ccagaaguguauuca

SEQ ID NO: 1800607 - RNA, 13 nt, Homo sapiens
uucuuccaucuga

SEQ ID NO: 1800608 - RNA, 21 nt, Homo sapiens
uagacgagcaggcuucuuccc

SEQ ID NO: 1800609 - RNA, 15 nt, Homo sapiens
guagaagugucacag

SEQ ID NO: 1800610 - RNA, 13 nt, Homo sapiens
auauauaaacaga

SEQ ID NO: 1800611 - RNA, 20 nt, Homo sapiens
cuauccguguugcagguuca

SEQ ID NO: 1800612 - RNA, 16 nt, Homo sapiens
cuccgccucucagguu

SEQ ID NO: 1800613 - RNA, 18 nt, Homo sapiens
uuccauaauacauaacau

SEQ ID NO: 1800614 - RNA, 16 nt, Homo sapiens
ccacgugcugcugaca

SEQ ID NO: 1800615 - RNA, 20 nt, Homo sapiens
ucaccugcgcagggcccucu

SEQ ID NO: 1800616 - RNA, 18 nt, Homo sapiens
guagcagagucauuguua

SEQ ID NO: 1800617 - RNA, 15 nt, Homo sapiens
uaaacaaauucauau

SEQ ID NO: 1800618 - RNA, 15 nt, Homo sapiens
cuaucuaacacuuuu

SEQ ID NO: 1800619 - RNA, 14 nt, Homo sapiens
acacuguggccagg

SEQ ID NO: 1800620 - RNA, 14 nt, Homo sapiens
uacaccucugggcc

SEQ ID NO: 1800621 - RNA, 12 nt, Homo sapiens
uaauuacuuaau

SEQ ID NO: 1800622 - RNA, 17 nt, Homo sapiens
gcccuuuggguacuacu

SEQ ID NO: 1800623 - RNA, 16 nt, Homo sapiens
gaucugauaagcaaga

SEQ ID NO: 1800624 - RNA, 20 nt, Homo sapiens
acucuauuaaaucuugcaac

SEQ ID NO: 1800625 - RNA, 16 nt, Homo sapiens
cuucaguccuuugucu

SEQ ID NO: 1800626 - RNA, 14 nt, Homo sapiens
ccucaucugcuccu

SEQ ID NO: 1800627 - RNA, 15 nt, Homo sapiens
auuacuuacuuauua

SEQ ID NO: 1800628 - RNA, 22 nt, Homo sapiens
aagaugacucguucccauagau

SEQ ID NO: 1800629 - RNA, 16 nt, Homo sapiens
uggcauggccaccacc

SEQ ID NO: 1800630 - RNA, 20 nt, Homo sapiens
agguccuuguuguuucuugc

SEQ ID NO: 1800631 - RNA, 12 nt, Homo sapiens
aucuagcacucc

SEQ ID NO: 1800632 - RNA, 16 nt, Homo sapiens
accaugaaauauccag

SEQ ID NO: 1800633 - RNA, 16 nt, Homo sapiens
gugccauuucucaggg

SEQ ID NO: 1800634 - RNA, 18 nt, Homo sapiens
gaaguuaagcagccuuuc

SEQ ID NO: 1800635 - RNA, 17 nt, Homo sapiens
ugcacaggucccacugc

SEQ ID NO: 1800636 - RNA, 17 nt, Homo sapiens
aggauuuuaaaugcugu

SEQ ID NO: 1800637 - RNA, 23 nt, Homo sapiens
uaaugccaaguaacaaugcaugc

SEQ ID NO: 1800638 - RNA, 19 nt, Homo sapiens
cugaguagcuggauuacag

SEQ ID NO: 1800639 - RNA, 22 nt, Homo sapiens
cugucaggggcucccacaggau

SEQ ID NO: 1800640 - RNA, 20 nt, Homo sapiens
caagugugugcacaugugug

SEQ ID NO: 1800641 - RNA, 17 nt, Homo sapiens
cuccaguauucuuguca

SEQ ID NO: 1800642 - RNA, 14 nt, Homo sapiens
uauauguacuagca

SEQ ID NO: 1800643 - RNA, 19 nt, Homo sapiens
guucuccauuucacuugac

SEQ ID NO: 1800644 - RNA, 16 nt, Homo sapiens
aaugcuuagaaauuca

SEQ ID NO: 1800645 - RNA, 21 nt, Homo sapiens
cuaguuaggaaguuaccugga

SEQ ID NO: 1800646 - RNA, 15 nt, Homo sapiens
ugcacuguccugcuc

SEQ ID NO: 1800647 - RNA, 17 nt, Homo sapiens
gccuccccgugccaaaa

SEQ ID NO: 1800648 - RNA, 14 nt, Homo sapiens
ucacuuaagccugg

SEQ ID NO: 1800649 - RNA, 17 nt, Homo sapiens
uuguacuucuguguuca

SEQ ID NO: 1800650 - RNA, 21 nt, Homo sapiens
uauaaacaaaagaaucuucca

SEQ ID NO: 1800651 - RNA, 13 nt, Homo sapiens
caucaaaugcuca

SEQ ID NO: 1800652 - RNA, 13 nt, Homo sapiens
uaaaacuucuuaa

SEQ ID NO: 1800653 - RNA, 23 nt, Homo sapiens
gcuucuuauucgggugugagucu

SEQ ID NO: 1800654 - RNA, 22 nt, Homo sapiens
gcaaagucuaaaguuuacagua

SEQ ID NO: 1800655 - RNA, 24 nt, Homo sapiens
uacauuuuuugggcagcaauuuaa

SEQ ID NO: 1800656 - RNA, 21 nt, Homo sapiens
ccagcuacccaggaggcugaa

SEQ ID NO: 1800657 - RNA, 19 nt, Homo sapiens
aaugccaauaugacacagc

SEQ ID NO: 1800658 - RNA, 16 nt, Homo sapiens
cugaauaacuugaaga

SEQ ID NO: 1800659 - RNA, 22 nt, Homo sapiens
uaaagcauaggguaguuugcaa

SEQ ID NO: 1800660 - RNA, 16 nt, Homo sapiens
uaaagagagagcuaua

SEQ ID NO: 1800661 - RNA, 20 nt, Homo sapiens
uaaauuacccccuccuccag

SEQ ID NO: 1800662 - RNA, 15 nt, Homo sapiens
acaaaaacuaaaaac

SEQ ID NO: 1800663 - RNA, 19 nt, Homo sapiens
cuaggaaaaucacuugcca

SEQ ID NO: 1800664 - RNA, 11 nt, Homo sapiens
uuuuugcccau

SEQ ID NO: 1800665 - RNA, 16 nt, Homo sapiens
auacaucaauauguau

SEQ ID NO: 1800666 - RNA, 20 nt, Homo sapiens
uccaaaaaggaacacuggaa

SEQ ID NO: 1800667 - RNA, 14 nt, Homo sapiens
acaacaugcacauu

SEQ ID NO: 1800668 - RNA, 17 nt, Homo sapiens
ccaauugccucuugcag

SEQ ID NO: 1800669 - RNA, 14 nt, Homo sapiens
cuucauauaaugcc

SEQ ID NO: 1800670 - RNA, 16 nt, Homo sapiens
cuaggcagacaccagg

SEQ ID NO: 1800671 - RNA, 13 nt, Homo sapiens
gaggcugucuucu

SEQ ID NO: 1800672 - RNA, 14 nt, Homo sapiens
ugaggcaugauuua

SEQ ID NO: 1800673 - RNA, 22 nt, Homo sapiens
ugucaaauggagcugaauuuga

SEQ ID NO: 1800674 - RNA, 15 nt, Homo sapiens
acuguccauuccaaa

SEQ ID NO: 1800675 - RNA, 16 nt, Homo sapiens
cuucuacaguggcaca

SEQ ID NO: 1800676 - RNA, 12 nt, Homo sapiens
agcagaacccag

SEQ ID NO: 1800677 - RNA, 21 nt, Homo sapiens
auuucuuuguuauacauuuaa

SEQ ID NO: 1800678 - RNA, 22 nt, Homo sapiens
ugcuauugugaauagugccgca

SEQ ID NO: 1800679 - RNA, 19 nt, Homo sapiens
uaaguuauaccagcaaaag

SEQ ID NO: 1800680 - RNA, 19 nt, Homo sapiens
aggauucaggccucugagg

SEQ ID NO: 1800681 - RNA, 19 nt, Homo sapiens
gccuuggguuucugugcag

SEQ ID NO: 1800682 - RNA, 16 nt, Homo sapiens
ggcauuuaaggagcag

SEQ ID NO: 1800683 - RNA, 15 nt, Homo sapiens
gaccucaagccauca

SEQ ID NO: 1800684 - RNA, 21 nt, Homo sapiens
ccugguuuguucucuguugua

SEQ ID NO: 1800685 - RNA, 17 nt, Homo sapiens
gcugaggcagaacugcu

SEQ ID NO: 1800686 - RNA, 13 nt, Homo sapiens
gccucacuccauu

SEQ ID NO: 1800687 - RNA, 17 nt, Homo sapiens
ucagaauccacucuucu

SEQ ID NO: 1800688 - RNA, 20 nt, Homo sapiens
ucuauaauggaaacauuuac

SEQ ID NO: 1800689 - RNA, 20 nt, Homo sapiens
caagggcggggacagccaca

SEQ ID NO: 1800690 - RNA, 20 nt, Homo sapiens
auaaauuuuagugugccuuc

SEQ ID NO: 1800691 - RNA, 11 nt, Homo sapiens
gaacuguuaca

SEQ ID NO: 1800692 - RNA, 16 nt, Homo sapiens
accucugggagcucaa

SEQ ID NO: 1800693 - RNA, 17 nt, Homo sapiens
acauuuccaaaugaacu

SEQ ID NO: 1800694 - RNA, 17 nt, Homo sapiens
ucaguaguaucaaugau

SEQ ID NO: 1800695 - RNA, 19 nt, Homo sapiens
cagauuucagcuacauaua

SEQ ID NO: 1800696 - RNA, 19 nt, Homo sapiens
ccuaaagcuuuuauuuaac

SEQ ID NO: 1800697 - RNA, 15 nt, Homo sapiens
uucuuaaaauucagu

SEQ ID NO: 1800698 - RNA, 15 nt, Homo sapiens
aaugauaacuggaaa

SEQ ID NO: 1800699 - RNA, 13 nt, Homo sapiens
ucuggacuccacc

SEQ ID NO: 1800700 - RNA, 23 nt, Homo sapiens
aacugagauuacaggcacccacc

SEQ ID NO: 1800701 - RNA, 15 nt, Homo sapiens
agucgagaagccagg

SEQ ID NO: 1800702 - RNA, 18 nt, Homo sapiens
ucuucaccugauucaacu

SEQ ID NO: 1800703 - RNA, 23 nt, Homo sapiens
uuuuauuguuguuguuugauccc

SEQ ID NO: 1800704 - RNA, 22 nt, Homo sapiens
acucuaaccaguguacagguca

SEQ ID NO: 1800705 - RNA, 19 nt, Homo sapiens
aauauuccuggcauaccuu

SEQ ID NO: 1800706 - RNA, 19 nt, Homo sapiens
cgcucaucccacccgccca

SEQ ID NO: 1800707 - RNA, 15 nt, Homo sapiens
aagacaacucugcuu

SEQ ID NO: 1800708 - RNA, 23 nt, Homo sapiens
caauuugucuuuggaaaauucag

SEQ ID NO: 1800709 - RNA, 22 nt, Homo sapiens
guucccacucccucucuugccg

SEQ ID NO: 1800710 - RNA, 15 nt, Homo sapiens
aggguguuugcagcu

SEQ ID NO: 1800711 - RNA, 17 nt, Homo sapiens
ucggugcagagugcaga

SEQ ID NO: 1800712 - RNA, 15 nt, Homo sapiens
uugccucucaauugu

SEQ ID NO: 1800713 - RNA, 19 nt, Homo sapiens
acucuggaccccaggccau

SEQ ID NO: 1800714 - RNA, 18 nt, Homo sapiens
agucucccgaguagcugg

SEQ ID NO: 1800715 - RNA, 15 nt, Homo sapiens
caugcagaaauugac

SEQ ID NO: 1800716 - RNA, 19 nt, Homo sapiens
accaguuaaaagcauuuua

SEQ ID NO: 1800717 - RNA, 13 nt, Homo sapiens
cccaaaacaugca

SEQ ID NO: 1800718 - RNA, 13 nt, Homo sapiens
aaugcaccacuuu

SEQ ID NO: 1800719 - RNA, 16 nt, Homo sapiens
cacuuugaggacauuu

SEQ ID NO: 1800720 - RNA, 12 nt, Homo sapiens
uaugaacaucca

SEQ ID NO: 1800721 - RNA, 17 nt, Homo sapiens
ucaguauuauuucaaga

SEQ ID NO: 1800722 - RNA, 14 nt, Homo sapiens
uuuguuuguggcau

SEQ ID NO: 1800723 - RNA, 15 nt, Homo sapiens
ccaggccugccuguu

SEQ ID NO: 1800724 - RNA, 14 nt, Homo sapiens
uacuguauguaaua

SEQ ID NO: 1800725 - RNA, 22 nt, Homo sapiens
cucuaaggcuaaggauagggaa

SEQ ID NO: 1800726 - RNA, 11 nt, Homo sapiens
caaacugccuu

SEQ ID NO: 1800727 - RNA, 15 nt, Homo sapiens
gcaaucucucucugu

SEQ ID NO: 1800728 - RNA, 16 nt, Homo sapiens
agccacgaaugaauga

SEQ ID NO: 1800729 - RNA, 13 nt, Homo sapiens
guccaaaacugcc

SEQ ID NO: 1800730 - RNA, 19 nt, Homo sapiens
acaaacagaaaugacugug

SEQ ID NO: 1800731 - RNA, 14 nt, Homo sapiens
aaaauuaugcaaau

SEQ ID NO: 1800732 - RNA, 17 nt, Homo sapiens
auuaaucucuaaaauuc

SEQ ID NO: 1800733 - RNA, 14 nt, Homo sapiens
cagcauuauugaaa

SEQ ID NO: 1800734 - RNA, 20 nt, Homo sapiens
guucucuucuuuaaagggau

SEQ ID NO: 1800735 - RNA, 17 nt, Homo sapiens
aaggaguccuugcauca

SEQ ID NO: 1800736 - RNA, 17 nt, Homo sapiens
ccauguccauagccaua

SEQ ID NO: 1800737 - RNA, 14 nt, Homo sapiens
gcagaucacuugag

SEQ ID NO: 1800738 - RNA, 21 nt, Homo sapiens
uuaagucuuaucaagcagcca

SEQ ID NO: 1800739 - RNA, 15 nt, Homo sapiens
uaaccuugugccuug

SEQ ID NO: 1800740 - RNA, 16 nt, Homo sapiens
gaagaagcaguuuacu

SEQ ID NO: 1800741 - RNA, 13 nt, Homo sapiens
ugcucccacagaa

SEQ ID NO: 1800742 - RNA, 14 nt, Homo sapiens
ccuaaauguucccu

SEQ ID NO: 1800743 - RNA, 15 nt, Homo sapiens
caaguggagccaccu

SEQ ID NO: 1800744 - RNA, 18 nt, Homo sapiens
uccuagagauuuggugua

SEQ ID NO: 1800745 - RNA, 13 nt, Homo sapiens
ugaaagaggccaa

SEQ ID NO: 1800746 - RNA, 19 nt, Homo sapiens
cugguggcccgacagccug

SEQ ID NO: 1800747 - RNA, 17 nt, Homo sapiens
aguagcugugaacauug

SEQ ID NO: 1800748 - RNA, 16 nt, Homo sapiens
caaccagggagacugc

SEQ ID NO: 1800749 - RNA, 22 nt, Homo sapiens
ccacuccaagugccccaccacu

SEQ ID NO: 1800750 - RNA, 15 nt, Homo sapiens
auccccucccaucau

SEQ ID NO: 1800751 - RNA, 15 nt, Homo sapiens
uaugaucucauccca

SEQ ID NO: 1800752 - RNA, 21 nt, Homo sapiens
cccuuccacuuugaguaccaa

SEQ ID NO: 1800753 - RNA, 15 nt, Homo sapiens
uauguuuacauauca

SEQ ID NO: 1800754 - RNA, 20 nt, Homo sapiens
ucuaccucucagcugcugaa

SEQ ID NO: 1800755 - RNA, 22 nt, Homo sapiens
accaaugggccuccagagaccc

SEQ ID NO: 1800756 - RNA, 22 nt, Homo sapiens
accuuuacucacacuaugugca

SEQ ID NO: 1800757 - RNA, 19 nt, Homo sapiens
ggaccugaguuugggagag

SEQ ID NO: 1800758 - RNA, 15 nt, Homo sapiens
aacauuucucuccac

SEQ ID NO: 1800759 - RNA, 19 nt, Homo sapiens
uccuugacgucguuuuaca

SEQ ID NO: 1800760 - RNA, 13 nt, Homo sapiens
gcuacaaaaccua

SEQ ID NO: 1800761 - RNA, 18 nt, Homo sapiens
cauaugauugugcacaua

SEQ ID NO: 1800762 - RNA, 17 nt, Homo sapiens
auccuggaccaagcaca

SEQ ID NO: 1800763 - RNA, 17 nt, Homo sapiens
uagauaaaaaucccaga

SEQ ID NO: 1800764 - RNA, 22 nt, Homo sapiens
caaucaauucauaucuauuuau

SEQ ID NO: 1800765 - RNA, 14 nt, Homo sapiens
ucacuauugaugca

SEQ ID NO: 1800766 - RNA, 16 nt, Homo sapiens
aagcaaguuguugcuu

SEQ ID NO: 1800767 - RNA, 14 nt, Homo sapiens
cucuucagaugcca

SEQ ID NO: 1800768 - RNA, 12 nt, Homo sapiens
uauucagcuuua

SEQ ID NO: 1800769 - RNA, 20 nt, Homo sapiens
aaugguaacuuuacaacugg

SEQ ID NO: 1800770 - RNA, 22 nt, Homo sapiens
cuccguggccaaaaaguaccau

SEQ ID NO: 1800771 - RNA, 18 nt, Homo sapiens
gaaccuaggaggguguga

SEQ ID NO: 1800772 - RNA, 14 nt, Homo sapiens
aacucaacuucuuu

SEQ ID NO: 1800773 - RNA, 15 nt, Homo sapiens
augaaaaacagcaga

SEQ ID NO: 1800774 - RNA, 14 nt, Homo sapiens
aauuaacucaagau

SEQ ID NO: 1800775 - RNA, 13 nt, Homo sapiens
gcuggcacugaca

SEQ ID NO: 1800776 - RNA, 16 nt, Homo sapiens
accagcccgccaguug

SEQ ID NO: 1800777 - RNA, 13 nt, Homo sapiens
aaauuguguuucc

SEQ ID NO: 1800778 - RNA, 22 nt, Homo sapiens
cacccaccagcuccacacauuc

SEQ ID NO: 1800779 - RNA, 14 nt, Homo sapiens
uccgccugccucag

SEQ ID NO: 1800780 - RNA, 17 nt, Homo sapiens
acuugcggauuuccacc

SEQ ID NO: 1800781 - RNA, 14 nt, Homo sapiens
gacauaaagccaug

SEQ ID NO: 1800782 - RNA, 20 nt, Homo sapiens
aacacagcaugcauuuagca

SEQ ID NO: 1800783 - RNA, 14 nt, Homo sapiens
agauagaucugugu

SEQ ID NO: 1800784 - RNA, 22 nt, Homo sapiens
ugaagauacgguugcuucaccu

SEQ ID NO: 1800785 - RNA, 11 nt, Homo sapiens
cccuuacacaa

SEQ ID NO: 1800786 - RNA, 20 nt, Homo sapiens
cagaagaaaggcauugcaca

SEQ ID NO: 1800787 - RNA, 13 nt, Homo sapiens
uacacuugugauu

SEQ ID NO: 1800788 - RNA, 17 nt, Homo sapiens
aaaaagccaguuugggu

SEQ ID NO: 1800789 - RNA, 15 nt, Homo sapiens
ccuucaaacuuccag

SEQ ID NO: 1800790 - RNA, 15 nt, Homo sapiens
cuaaaagacaugcau

SEQ ID NO: 1800791 - RNA, 22 nt, Homo sapiens
cgcugagcgaggagaugcuccu

SEQ ID NO: 1800792 - RNA, 17 nt, Homo sapiens
ugucuuacauaaucaca

SEQ ID NO: 1800793 - RNA, 14 nt, Homo sapiens
ugggccacugccag

SEQ ID NO: 1800794 - RNA, 21 nt, Homo sapiens
aagucaccacuccauucccaa

SEQ ID NO: 1800795 - RNA, 22 nt, Homo sapiens
ggaggggugguacuuggcacca

SEQ ID NO: 1800796 - RNA, 23 nt, Homo sapiens
guuacuugcugcccugugcuccu

SEQ ID NO: 1800797 - RNA, 12 nt, Homo sapiens
aauccaguauua

SEQ ID NO: 1800798 - RNA, 20 nt, Homo sapiens
acugugcguuuuagaguaug

SEQ ID NO: 1800799 - RNA, 14 nt, Homo sapiens
aaagauucaaagcu

SEQ ID NO: 1800800 - RNA, 16 nt, Homo sapiens
uauuucuuaacauauu

SEQ ID NO: 1800801 - RNA, 23 nt, Homo sapiens
aaaggacucuggaagauuuucau

SEQ ID NO: 1800802 - RNA, 23 nt, Homo sapiens
ugugguuuuuaaagaagggggcu

SEQ ID NO: 1800803 - RNA, 23 nt, Homo sapiens
accuggggacuccucaaaccacu

SEQ ID NO: 1800804 - RNA, 23 nt, Homo sapiens
auuaacaugcuuaugacaaugac

SEQ ID NO: 1800805 - RNA, 17 nt, Homo sapiens
aaauucacaagcugccu

SEQ ID NO: 1800806 - RNA, 17 nt, Homo sapiens
accacgauucucccaaa

SEQ ID NO: 1800807 - RNA, 16 nt, Homo sapiens
cucaacucacuagaug

SEQ ID NO: 1800808 - RNA, 21 nt, Homo sapiens
auucuaaucccaacaagcaag

SEQ ID NO: 1800809 - RNA, 16 nt, Homo sapiens
cuucuccuaugcauuu

SEQ ID NO: 1800810 - RNA, 23 nt, Homo sapiens
ucaaaaguugguguugacauaca

SEQ ID NO: 1800811 - RNA, 23 nt, Homo sapiens
ccagaggcagccucugcacuccc

SEQ ID NO: 1800812 - RNA, 22 nt, Homo sapiens
uucucuuuguggggcuuggcgu

SEQ ID NO: 1800813 - RNA, 14 nt, Homo sapiens
acuucccuaaugaa

SEQ ID NO: 1800814 - RNA, 22 nt, Homo sapiens
guuacauuaaagcccuguguua

SEQ ID NO: 1800815 - RNA, 22 nt, Homo sapiens
cuacugccauuucagugagaaa

SEQ ID NO: 1800816 - RNA, 18 nt, Homo sapiens
aauguaaauauuccuuau

SEQ ID NO: 1800817 - RNA, 21 nt, Homo sapiens
ucaauuaacagcagaaucuca

SEQ ID NO: 1800818 - RNA, 22 nt, Homo sapiens
uaaucaguaugcaaagcaaucu

SEQ ID NO: 1800819 - RNA, 19 nt, Homo sapiens
ccugcaguuugacuucuuu

SEQ ID NO: 1800820 - RNA, 20 nt, Homo sapiens
ucucugggagacuuucccua

SEQ ID NO: 1800821 - RNA, 18 nt, Homo sapiens
gccaggcaccaucugcca

SEQ ID NO: 1800822 - RNA, 14 nt, Homo sapiens
ggaagaacaucugg

SEQ ID NO: 1800823 - RNA, 14 nt, Homo sapiens
ugacugacccaaaa

SEQ ID NO: 1800824 - RNA, 13 nt, Homo sapiens
uuaucccucucuu

SEQ ID NO: 1800825 - RNA, 21 nt, Homo sapiens
gcaccaggcacgaacccaccu

SEQ ID NO: 1800826 - RNA, 19 nt, Homo sapiens
uccacuggacacugugaaa

SEQ ID NO: 1800827 - RNA, 16 nt, Homo sapiens
uugucgggacagagag

SEQ ID NO: 1800828 - RNA, 19 nt, Homo sapiens
aaccggcauauuauuccau

SEQ ID NO: 1800829 - RNA, 15 nt, Homo sapiens
cccugccgaacacac

SEQ ID NO: 1800830 - RNA, 22 nt, Homo sapiens
acagcaaccucuucaugagcuu

SEQ ID NO: 1800831 - RNA, 16 nt, Homo sapiens
uucagcuagaauccug

SEQ ID NO: 1800832 - RNA, 15 nt, Homo sapiens
acaagccagccaacu

SEQ ID NO: 1800833 - RNA, 16 nt, Homo sapiens
uggcaugggacagggg

SEQ ID NO: 1800834 - RNA, 16 nt, Homo sapiens
agugacccacaugcca

SEQ ID NO: 1800835 - RNA, 23 nt, Homo sapiens
uggaggccuguccugaccugucu

SEQ ID NO: 1800836 - RNA, 14 nt, Homo sapiens
ggcaugacacucua

SEQ ID NO: 1800837 - RNA, 12 nt, Homo sapiens
cagaacauaucc

SEQ ID NO: 1800838 - RNA, 14 nt, Homo sapiens
aagucacugacccu

SEQ ID NO: 1800839 - RNA, 16 nt, Homo sapiens
agaugaggcacuggaa

SEQ ID NO: 1800840 - RNA, 20 nt, Homo sapiens
ggaccaggauugcacugaca

SEQ ID NO: 1800841 - RNA, 21 nt, Homo sapiens
cuaccauuauuuccccuucaa

SEQ ID NO: 1800842 - RNA, 19 nt, Homo sapiens
agcaacaaaaucauggcuu

SEQ ID NO: 1800843 - RNA, 13 nt, Homo sapiens
uucuguuuccaua

SEQ ID NO: 1800844 - RNA, 21 nt, Homo sapiens
auggaauuuauaauucaguau

SEQ ID NO: 1800845 - RNA, 14 nt, Homo sapiens
gaaucaaacaaaag

SEQ ID NO: 1800846 - RNA, 14 nt, Homo sapiens
ugaaauuacuuuaa

SEQ ID NO: 1800847 - RNA, 16 nt, Homo sapiens
aauaaagcaacagacu

SEQ ID NO: 1800848 - RNA, 14 nt, Homo sapiens
cuguuuugugagaa

SEQ ID NO: 1800849 - RNA, 12 nt, Homo sapiens
aauuuccaugau

SEQ ID NO: 1800850 - RNA, 19 nt, Homo sapiens
auccauggggcugauugua

SEQ ID NO: 1800851 - RNA, 20 nt, Homo sapiens
cucuccuggcacccagagaa

SEQ ID NO: 1800852 - RNA, 20 nt, Homo sapiens
uucauccagggaaaugccuc

SEQ ID NO: 1800853 - RNA, 18 nt, Homo sapiens
gaaaccaaauuacaagua

SEQ ID NO: 1800854 - RNA, 17 nt, Homo sapiens
caagcccagccuaucuc

SEQ ID NO: 1800855 - RNA, 15 nt, Homo sapiens
ggagauuucaguuac

SEQ ID NO: 1800856 - RNA, 20 nt, Homo sapiens
gaaggucccaccuccauuug

SEQ ID NO: 1800857 - RNA, 16 nt, Homo sapiens
uaaaaauuaaauggau

SEQ ID NO: 1800858 - RNA, 23 nt, Homo sapiens
ccuagauaugaauauauggcauu

SEQ ID NO: 1800859 - RNA, 17 nt, Homo sapiens
aagauguucacuguggc

SEQ ID NO: 1800860 - RNA, 20 nt, Homo sapiens
auuccuauuggaaacagaga

SEQ ID NO: 1800861 - RNA, 20 nt, Homo sapiens
aucccagcaucucagagucc

SEQ ID NO: 1800862 - RNA, 20 nt, Homo sapiens
cucagguccuuuagucuguu

SEQ ID NO: 1800863 - RNA, 18 nt, Homo sapiens
ccuaugucaccuugauga

SEQ ID NO: 1800864 - RNA, 23 nt, Homo sapiens
aagcacuguuggagcuacugcaa

SEQ ID NO: 1800865 - RNA, 22 nt, Homo sapiens
aagacuucccuaacacuuaccc

SEQ ID NO: 1800866 - RNA, 12 nt, Homo sapiens
accucagccucc

SEQ ID NO: 1800867 - RNA, 24 nt, Homo sapiens
ucccaucagaaagauucauuggca

SEQ ID NO: 1800868 - RNA, 16 nt, Homo sapiens
uuuauuggggugccua

SEQ ID NO: 1800869 - RNA, 13 nt, Homo sapiens
uaggugcucuucc

SEQ ID NO: 1800870 - RNA, 19 nt, Homo sapiens
augaugcuggaaauaugaa

SEQ ID NO: 1800871 - RNA, 20 nt, Homo sapiens
aggucccagacaugcugccc

SEQ ID NO: 1800872 - RNA, 15 nt, Homo sapiens
ugagucagcaccuug

SEQ ID NO: 1800873 - RNA, 16 nt, Homo sapiens
ccaacaagccucaaag

SEQ ID NO: 1800874 - RNA, 16 nt, Homo sapiens
uacaagucagcuccag

SEQ ID NO: 1800875 - RNA, 22 nt, Homo sapiens
cugcaaacgcuucaguuguuag

SEQ ID NO: 1800876 - RNA, 21 nt, Homo sapiens
guaaauagggaaaauaaucuc

SEQ ID NO: 1800877 - RNA, 21 nt, Homo sapiens
acaagccuucagccacaggga

SEQ ID NO: 1800878 - RNA, 23 nt, Homo sapiens
cuaauugucuuuguucugugauu

SEQ ID NO: 1800879 - RNA, 12 nt, Homo sapiens
ccugcacacuca

SEQ ID NO: 1800880 - RNA, 17 nt, Homo sapiens
gagaagcgggaguggcu

SEQ ID NO: 1800881 - RNA, 21 nt, Homo sapiens
uccauuucucaaucagugcag

SEQ ID NO: 1800882 - RNA, 15 nt, Homo sapiens
aaauuauuucucuca

SEQ ID NO: 1800883 - RNA, 18 nt, Homo sapiens
accuggcagcaaacugcu

SEQ ID NO: 1800884 - RNA, 17 nt, Homo sapiens
gaauagccauguacuau

SEQ ID NO: 1800885 - RNA, 15 nt, Homo sapiens
agcaugcagguggug

SEQ ID NO: 1800886 - RNA, 18 nt, Homo sapiens
guuguuauuaacagcuga

SEQ ID NO: 1800887 - RNA, 20 nt, Homo sapiens
accccaguuccuagcacugc

SEQ ID NO: 1800888 - RNA, 18 nt, Homo sapiens
guauuaauaaagcauucu

SEQ ID NO: 1800889 - RNA, 16 nt, Homo sapiens
aaaggaugcccaaaga

SEQ ID NO: 1800890 - RNA, 14 nt, Homo sapiens
uuucaugugcuaua

SEQ ID NO: 1800891 - RNA, 20 nt, Homo sapiens
uuccuaauaaguuugaucaa

SEQ ID NO: 1800892 - RNA, 14 nt, Homo sapiens
gcccuggagcucaa

SEQ ID NO: 1800893 - RNA, 11 nt, Homo sapiens
cacagacacac

SEQ ID NO: 1800894 - RNA, 14 nt, Homo sapiens
uccucgagaggcac

SEQ ID NO: 1800895 - RNA, 15 nt, Homo sapiens
aaugagguggcucau

SEQ ID NO: 1800896 - RNA, 16 nt, Homo sapiens
ugaaacaaauuuacau

SEQ ID NO: 1800897 - RNA, 20 nt, Homo sapiens
cugagaagcaguauaagccu

SEQ ID NO: 1800898 - RNA, 17 nt, Homo sapiens
acaaaccugcauggugu

SEQ ID NO: 1800899 - RNA, 22 nt, Homo sapiens
uugagaccuaaucucuguaaag

SEQ ID NO: 1800900 - RNA, 21 nt, Homo sapiens
aaguaauuuacaaaccucuca

SEQ ID NO: 1800901 - RNA, 23 nt, Homo sapiens
aaaaguuagucaauccugucaua

SEQ ID NO: 1800902 - RNA, 18 nt, Homo sapiens
cauguugugauguacaca

SEQ ID NO: 1800903 - RNA, 18 nt, Homo sapiens
gcuuacaaauacuaaaaa

SEQ ID NO: 1800904 - RNA, 21 nt, Homo sapiens
auuuauugccucuaugugcaa

SEQ ID NO: 1800905 - RNA, 18 nt, Homo sapiens
cacaguggccaagaucac

SEQ ID NO: 1800906 - RNA, 22 nt, Homo sapiens
gcugggcucuaagguacugugg

SEQ ID NO: 1800907 - RNA, 17 nt, Homo sapiens
aaggaguuuuuuuguca

SEQ ID NO: 1800908 - RNA, 22 nt, Homo sapiens
auuagacagaacaccuaugcaa

SEQ ID NO: 1800909 - RNA, 13 nt, Homo sapiens
gcugcugcucacc

SEQ ID NO: 1800910 - RNA, 21 nt, Homo sapiens
uuagauuaaauaaaacuuaaa

SEQ ID NO: 1800911 - RNA, 21 nt, Homo sapiens
uuugaauaaagaauacuugaa

SEQ ID NO: 1800912 - RNA, 17 nt, Homo sapiens
agaggcagucagaggac

SEQ ID NO: 1800913 - RNA, 15 nt, Homo sapiens
gcucaucaacaauca

SEQ ID NO: 1800914 - RNA, 17 nt, Homo sapiens
ucccacuaaagugucaa

SEQ ID NO: 1800915 - RNA, 19 nt, Homo sapiens
caaaauaccaugccauuua

SEQ ID NO: 1800916 - RNA, 13 nt, Homo sapiens
ugcccagccugcu

SEQ ID NO: 1800917 - RNA, 21 nt, Homo sapiens
aggauuuggggcagagggaca

SEQ ID NO: 1800918 - RNA, 17 nt, Homo sapiens
cucuuuccuaaagccaa

SEQ ID NO: 1800919 - RNA, 16 nt, Homo sapiens
ugcucaguauugagac

SEQ ID NO: 1800920 - RNA, 19 nt, Homo sapiens
guauucgaaaccugugauu

SEQ ID NO: 1800921 - RNA, 13 nt, Homo sapiens
acaucaauguuca

SEQ ID NO: 1800922 - RNA, 17 nt, Homo sapiens
aggagcccuccauucca

SEQ ID NO: 1800923 - RNA, 15 nt, Homo sapiens
agguaacucuuugca

SEQ ID NO: 1800924 - RNA, 20 nt, Homo sapiens
gaaacccccaucucuacuaa

SEQ ID NO: 1800925 - RNA, 22 nt, Homo sapiens
cuuaauaagauauuuaguaaua

SEQ ID NO: 1800926 - RNA, 16 nt, Homo sapiens
acacccgcacugccca

SEQ ID NO: 1800927 - RNA, 13 nt, Homo sapiens
caauucaguccug

SEQ ID NO: 1800928 - RNA, 24 nt, Homo sapiens
agcuuuuuauucuacuacuuggaa

SEQ ID NO: 1800929 - RNA, 16 nt, Homo sapiens
agccuguggugcuuga

SEQ ID NO: 1800930 - RNA, 21 nt, Homo sapiens
cuguaaucccagcacuuugau

SEQ ID NO: 1800931 - RNA, 18 nt, Homo sapiens
agaaaggauuuccuuucu

SEQ ID NO: 1800932 - RNA, 13 nt, Homo sapiens
gguaaauugccau

SEQ ID NO: 1800933 - RNA, 17 nt, Homo sapiens
aagccugaguacuccac

SEQ ID NO: 1800934 - RNA, 14 nt, Homo sapiens
cagcuguccagcug

SEQ ID NO: 1800935 - RNA, 14 nt, Homo sapiens
ucagacucucagac

SEQ ID NO: 1800936 - RNA, 14 nt, Homo sapiens
caacuuuccaacuu

SEQ ID NO: 1800937 - RNA, 19 nt, Homo sapiens
gaagcugcucacugcucac

SEQ ID NO: 1800938 - RNA, 20 nt, Homo sapiens
gagcaccacacccaguggga

SEQ ID NO: 1800939 - RNA, 14 nt, Homo sapiens
uggccucugcugaa

SEQ ID NO: 1800940 - RNA, 14 nt, Homo sapiens
uggccaaugugcau

SEQ ID NO: 1800941 - RNA, 16 nt, Homo sapiens
auuuugguacugugau

SEQ ID NO: 1800942 - RNA, 13 nt, Homo sapiens
gcaucccuguguu

SEQ ID NO: 1800943 - RNA, 20 nt, Homo sapiens
gacauuccaaagaacagccu

SEQ ID NO: 1800944 - RNA, 16 nt, Homo sapiens
acugucuuccucaaaa

SEQ ID NO: 1800945 - RNA, 18 nt, Homo sapiens
uccuguaacuacaaugau

SEQ ID NO: 1800946 - RNA, 19 nt, Homo sapiens
aaaauaaucaaaccaaaga

SEQ ID NO: 1800947 - RNA, 14 nt, Homo sapiens
uguccaacuccagu

SEQ ID NO: 1800948 - RNA, 17 nt, Homo sapiens
ucacaauaggaggagaa

SEQ ID NO: 1800949 - RNA, 14 nt, Homo sapiens
gaauaaaauauuga

SEQ ID NO: 1800950 - RNA, 14 nt, Homo sapiens
uuauguaaguuuau

SEQ ID NO: 1800951 - RNA, 21 nt, Homo sapiens
auauuuuaaaaauaaauucaa

SEQ ID NO: 1800952 - RNA, 20 nt, Homo sapiens
ggaagagcuaggcagggugu

SEQ ID NO: 1800953 - RNA, 17 nt, Homo sapiens
cauucaacucuccaaug

SEQ ID NO: 1800954 - RNA, 18 nt, Homo sapiens
uggggcuuuuacaccagu

SEQ ID NO: 1800955 - RNA, 15 nt, Homo sapiens
cggaccgaaggugac

SEQ ID NO: 1800956 - RNA, 16 nt, Homo sapiens
gucucaucuucucuca

SEQ ID NO: 1800957 - RNA, 18 nt, Homo sapiens
ucucugacgcuugugaca

SEQ ID NO: 1800958 - RNA, 15 nt, Homo sapiens
gucaaugaccauuca

SEQ ID NO: 1800959 - RNA, 21 nt, Homo sapiens
gaugucauaucauuucacugu

SEQ ID NO: 1800960 - RNA, 23 nt, Homo sapiens
ggagagcuguuccagaacacaga

SEQ ID NO: 1800961 - RNA, 22 nt, Homo sapiens
uucuaacugaaggugcaguuga

SEQ ID NO: 1800962 - RNA, 13 nt, Homo sapiens
accaccuucaaua

SEQ ID NO: 1800963 - RNA, 17 nt, Homo sapiens
acaccgauaaccacagg

SEQ ID NO: 1800964 - RNA, 19 nt, Homo sapiens
uucuuuaaccaaacaauau

SEQ ID NO: 1800965 - RNA, 21 nt, Homo sapiens
uuguaaaagggaaagaaggcc

SEQ ID NO: 1800966 - RNA, 14 nt, Homo sapiens
agaaggcauugcuu

SEQ ID NO: 1800967 - RNA, 12 nt, Homo sapiens
agguuccuguca

SEQ ID NO: 1800968 - RNA, 16 nt, Homo sapiens
aauuuucuacaaccua

SEQ ID NO: 1800969 - RNA, 17 nt, Homo sapiens
cuguguagagccugcau

SEQ ID NO: 1800970 - RNA, 15 nt, Homo sapiens
cagccccacugccag

SEQ ID NO: 1800971 - RNA, 15 nt, Homo sapiens
gcugggcucaggaaa

SEQ ID NO: 1800972 - RNA, 11 nt, Homo sapiens
agggugacugu

SEQ ID NO: 1800973 - RNA, 16 nt, Homo sapiens
uuuacucuuaugauca

SEQ ID NO: 1800974 - RNA, 14 nt, Homo sapiens
auagcauacugugu

SEQ ID NO: 1800975 - RNA, 22 nt, Homo sapiens
auuuccuauuggaaaauacauc

SEQ ID NO: 1800976 - RNA, 13 nt, Homo sapiens
ugcccuaaacccu

SEQ ID NO: 1800977 - RNA, 22 nt, Homo sapiens
uuucuauaauguugucauuuca

SEQ ID NO: 1800978 - RNA, 14 nt, Homo sapiens
acugagacuagauu

SEQ ID NO: 1800979 - RNA, 21 nt, Homo sapiens
ccuuuaucaccucauucugaa

SEQ ID NO: 1800980 - RNA, 14 nt, Homo sapiens
uuuaaaacauguaa

SEQ ID NO: 1800981 - RNA, 21 nt, Homo sapiens
cauacugaaaaaaugcugagc

SEQ ID NO: 1800982 - RNA, 12 nt, Homo sapiens
aaagaccaguuu

SEQ ID NO: 1800983 - RNA, 14 nt, Homo sapiens
ucauccucccugac

SEQ ID NO: 1800984 - RNA, 18 nt, Homo sapiens
ugggagccagaauucacu

SEQ ID NO: 1800985 - RNA, 11 nt, Homo sapiens
aacugaacuua

SEQ ID NO: 1800986 - RNA, 20 nt, Homo sapiens
gaaauggccaggauccucuc

SEQ ID NO: 1800987 - RNA, 20 nt, Homo sapiens
ucccuggggcugugcauucc

SEQ ID NO: 1800988 - RNA, 21 nt, Homo sapiens
agaguaacccugucuaaugaa

SEQ ID NO: 1800989 - RNA, 15 nt, Homo sapiens
ccugccccagcacuc

SEQ ID NO: 1800990 - RNA, 18 nt, Homo sapiens
gaggaacuguccagagag

SEQ ID NO: 1800991 - RNA, 19 nt, Homo sapiens
aauauuaaggaaaaaagca

SEQ ID NO: 1800992 - RNA, 21 nt, Homo sapiens
uccguucuauuuugugaauuu

SEQ ID NO: 1800993 - RNA, 21 nt, Homo sapiens
aagcucacucuggauuccaca

SEQ ID NO: 1800994 - RNA, 20 nt, Homo sapiens
acagcuauaccucacaauaa

SEQ ID NO: 1800995 - RNA, 17 nt, Homo sapiens
ucuuggccaucuaaaca

SEQ ID NO: 1800996 - RNA, 14 nt, Homo sapiens
gugcaacaaacuca

SEQ ID NO: 1800997 - RNA, 12 nt, Homo sapiens
uuacaagccuaa

SEQ ID NO: 1800998 - RNA, 18 nt, Homo sapiens
aauuaaauggaucacuga

SEQ ID NO: 1800999 - RNA, 16 nt, Homo sapiens
ggaaucaauuucccag

SEQ ID NO: 1801000 - RNA, 13 nt, Homo sapiens
agggcaccagagg

SEQ ID NO: 1801001 - RNA, 19 nt, Homo sapiens
gauggcagaacucccacaa

SEQ ID NO: 1801002 - RNA, 14 nt, Homo sapiens
acugguaaagccuc

SEQ ID NO: 1801003 - RNA, 20 nt, Homo sapiens
gcugccggcuccccucgaca

SEQ ID NO: 1801004 - RNA, 17 nt, Homo sapiens
cuuuggagcagcuucug

SEQ ID NO: 1801005 - RNA, 20 nt, Homo sapiens
cucaagcuaugugagcucac

SEQ ID NO: 1801006 - RNA, 19 nt, Homo sapiens
ccuauacguuucuguggag

SEQ ID NO: 1801007 - RNA, 23 nt, Homo sapiens
aggcaggcuuucugggugugacu

SEQ ID NO: 1801008 - RNA, 14 nt, Homo sapiens
ggugucgucuguga

SEQ ID NO: 1801009 - RNA, 14 nt, Homo sapiens
aagaccaaagcaga

SEQ ID NO: 1801010 - RNA, 16 nt, Homo sapiens
gcggaaucagcuucua

SEQ ID NO: 1801011 - RNA, 21 nt, Homo sapiens
agguagcccccuaaaugggca

SEQ ID NO: 1801012 - RNA, 15 nt, Homo sapiens
cuguauucugcaaca

SEQ ID NO: 1801013 - RNA, 22 nt, Homo sapiens
caagccaugcuggugggccauu

SEQ ID NO: 1801014 - RNA, 15 nt, Homo sapiens
caccugaccucugaa

SEQ ID NO: 1801015 - RNA, 16 nt, Homo sapiens
aaugugaggguggugg

SEQ ID NO: 1801016 - RNA, 20 nt, Homo sapiens
uucaccguguuagccaggau

SEQ ID NO: 1801017 - RNA, 19 nt, Homo sapiens
agcaagacccccaucucug

SEQ ID NO: 1801018 - RNA, 23 nt, Homo sapiens
aaucaacuggagucuaugcuuaa

SEQ ID NO: 1801019 - RNA, 12 nt, Homo sapiens
aguaaagccacg

SEQ ID NO: 1801020 - RNA, 15 nt, Homo sapiens
accagggcugcucuu

SEQ ID NO: 1801021 - RNA, 21 nt, Homo sapiens
gcauuacucccuaugugcgua

SEQ ID NO: 1801022 - RNA, 17 nt, Homo sapiens
ugucucugcuauggaau

SEQ ID NO: 1801023 - RNA, 19 nt, Homo sapiens
uucaaaaaacucucuccca

SEQ ID NO: 1801024 - RNA, 23 nt, Homo sapiens
ucuugucuacuggacuguaaaau

SEQ ID NO: 1801025 - RNA, 18 nt, Homo sapiens
cuccauucauccuuccau

SEQ ID NO: 1801026 - RNA, 18 nt, Homo sapiens
cugcuucugugcauuugu

SEQ ID NO: 1801027 - RNA, 13 nt, Homo sapiens
cacagauaugcac

SEQ ID NO: 1801028 - RNA, 21 nt, Homo sapiens
gcagguuggaacuaugcagug

SEQ ID NO: 1801029 - RNA, 20 nt, Homo sapiens
accucugguccacacuagaa

SEQ ID NO: 1801030 - RNA, 23 nt, Homo sapiens
auaauugcuccuauacuauugaa

SEQ ID NO: 1801031 - RNA, 15 nt, Homo sapiens
uuuggggccucaaga

SEQ ID NO: 1801032 - RNA, 19 nt, Homo sapiens
ugcuggaugacuugagaug

SEQ ID NO: 1801033 - RNA, 19 nt, Homo sapiens
agcacaggaggcuccguga

SEQ ID NO: 1801034 - RNA, 15 nt, Homo sapiens
aaaagugaagacaga

SEQ ID NO: 1801035 - RNA, 14 nt, Homo sapiens
aucaaaugauuuca

SEQ ID NO: 1801036 - RNA, 23 nt, Homo sapiens
ucaacuucaggaaagcagcaguu

SEQ ID NO: 1801037 - RNA, 15 nt, Homo sapiens
caugcaaauugugaa

SEQ ID NO: 1801038 - RNA, 24 nt, Homo sapiens
cuuuugcucugauagacaaaauca

SEQ ID NO: 1801039 - RNA, 22 nt, Homo sapiens
uucuuaaauggaauuauuuuga

SEQ ID NO: 1801040 - RNA, 12 nt, Homo sapiens
acaacuaccuga

SEQ ID NO: 1801041 - RNA, 13 nt, Homo sapiens
cacagagugugcu

SEQ ID NO: 1801042 - RNA, 20 nt, Homo sapiens
aaagcaggucagaagaggga

SEQ ID NO: 1801043 - RNA, 22 nt, Homo sapiens
uaaaauguauuuuagacuuccu

SEQ ID NO: 1801044 - RNA, 17 nt, Homo sapiens
aguuauaggauuuucac

SEQ ID NO: 1801045 - RNA, 14 nt, Homo sapiens
uaaucaguucugug

SEQ ID NO: 1801046 - RNA, 20 nt, Homo sapiens
auuccuacagcacuacuggg

SEQ ID NO: 1801047 - RNA, 12 nt, Homo sapiens
gacuccaugcug

SEQ ID NO: 1801048 - RNA, 22 nt, Homo sapiens
gccacacucagcacaaggccau

SEQ ID NO: 1801049 - RNA, 19 nt, Homo sapiens
uuuaauaaaacugcgagga

SEQ ID NO: 1801050 - RNA, 18 nt, Homo sapiens
gcccucaacccugugauc

SEQ ID NO: 1801051 - RNA, 17 nt, Homo sapiens
acuccuuucagccacau

SEQ ID NO: 1801052 - RNA, 19 nt, Homo sapiens
aagaaaauggccagugaga

SEQ ID NO: 1801053 - RNA, 16 nt, Homo sapiens
aauaaauuuugugcaa

SEQ ID NO: 1801054 - RNA, 18 nt, Homo sapiens
ggauaagcacuagaucuc

SEQ ID NO: 1801055 - RNA, 20 nt, Homo sapiens
aacaucaacuuuuuucuuuc

SEQ ID NO: 1801056 - RNA, 15 nt, Homo sapiens
gguaauuaugugaua

SEQ ID NO: 1801057 - RNA, 15 nt, Homo sapiens
caaucaaagcacuug

SEQ ID NO: 1801058 - RNA, 18 nt, Homo sapiens
ugcuaauucaaagcucua

SEQ ID NO: 1801059 - RNA, 15 nt, Homo sapiens
uugaagcucagaaag

SEQ ID NO: 1801060 - RNA, 19 nt, Homo sapiens
uggccaagaaaauugccuu

SEQ ID NO: 1801061 - RNA, 19 nt, Homo sapiens
ccucuugaaugcuuaaaug

SEQ ID NO: 1801062 - RNA, 17 nt, Homo sapiens
gacagacaggcucuuag

SEQ ID NO: 1801063 - RNA, 20 nt, Homo sapiens
aguguucacauggcucucau

SEQ ID NO: 1801064 - RNA, 17 nt, Homo sapiens
aaagcaucccugugagc

SEQ ID NO: 1801065 - RNA, 16 nt, Homo sapiens
auuuguagccaaagaa

SEQ ID NO: 1801066 - RNA, 18 nt, Homo sapiens
agaugacauggugaaaau

SEQ ID NO: 1801067 - RNA, 16 nt, Homo sapiens
ugaaacuacaucucca

SEQ ID NO: 1801068 - RNA, 19 nt, Homo sapiens
ccauacaccagcaaugaag

SEQ ID NO: 1801069 - RNA, 21 nt, Homo sapiens
augaauuugagcaggucucau

SEQ ID NO: 1801070 - RNA, 14 nt, Homo sapiens
auuuaccuggaaac

SEQ ID NO: 1801071 - RNA, 13 nt, Homo sapiens
acugccugaauaa

SEQ ID NO: 1801072 - RNA, 14 nt, Homo sapiens
cugaaguuucacau

SEQ ID NO: 1801073 - RNA, 19 nt, Homo sapiens
ucuaaguuaaacagucagu

SEQ ID NO: 1801074 - RNA, 17 nt, Homo sapiens
ccugccuugcugugaaa

SEQ ID NO: 1801075 - RNA, 17 nt, Homo sapiens
ugagacuuaaaacaugg

SEQ ID NO: 1801076 - RNA, 17 nt, Homo sapiens
uauauacaaagaauucu

SEQ ID NO: 1801077 - RNA, 20 nt, Homo sapiens
uugcacaguaggauguggaa

SEQ ID NO: 1801078 - RNA, 15 nt, Homo sapiens
cucuugcugccagcu

SEQ ID NO: 1801079 - RNA, 14 nt, Homo sapiens
guggauacuggggg

SEQ ID NO: 1801080 - RNA, 18 nt, Homo sapiens
aaaauagucuaguguagu

SEQ ID NO: 1801081 - RNA, 20 nt, Homo sapiens
uccauggcaggaaggcuugu

SEQ ID NO: 1801082 - RNA, 17 nt, Homo sapiens
accuaggucgccaguga

SEQ ID NO: 1801083 - RNA, 12 nt, Homo sapiens
ggccuuuacuag

SEQ ID NO: 1801084 - RNA, 17 nt, Homo sapiens
ugcgcagggcucuuuga

SEQ ID NO: 1801085 - RNA, 18 nt, Homo sapiens
ccugaugaaaacauagca

SEQ ID NO: 1801086 - RNA, 20 nt, Homo sapiens
cugagaaauagguaucaaaa

SEQ ID NO: 1801087 - RNA, 23 nt, Homo sapiens
aaaaaccuuguagauagcuugag

SEQ ID NO: 1801088 - RNA, 15 nt, Homo sapiens
uuucucugccaguga

SEQ ID NO: 1801089 - RNA, 22 nt, Homo sapiens
uguuuccauagcuacuauaugc

SEQ ID NO: 1801090 - RNA, 15 nt, Homo sapiens
cuaaugaaauugaga

SEQ ID NO: 1801091 - RNA, 21 nt, Homo sapiens
ugggggccucugccuccagga

SEQ ID NO: 1801092 - RNA, 18 nt, Homo sapiens
gaggucuuuugacaugug

SEQ ID NO: 1801093 - RNA, 19 nt, Homo sapiens
ugcugggugccuccuugcc

SEQ ID NO: 1801094 - RNA, 16 nt, Homo sapiens
agguugccugggccac

SEQ ID NO: 1801095 - RNA, 20 nt, Homo sapiens
uguaaagcccuugcacagcu

SEQ ID NO: 1801096 - RNA, 19 nt, Homo sapiens
caacuccuuucagccacau

SEQ ID NO: 1801097 - RNA, 17 nt, Homo sapiens
ggccugaagcucuucuc

SEQ ID NO: 1801098 - RNA, 21 nt, Homo sapiens
guccucacccugugggaccgc

SEQ ID NO: 1801099 - RNA, 17 nt, Homo sapiens
uuucuugcagaucaaau

SEQ ID NO: 1801100 - RNA, 16 nt, Homo sapiens
auaaucgagucuaccu

SEQ ID NO: 1801101 - RNA, 11 nt, Homo sapiens
aauauucacuc

SEQ ID NO: 1801102 - RNA, 16 nt, Homo sapiens
ccucaucagucuccau

SEQ ID NO: 1801103 - RNA, 23 nt, Homo sapiens
uucagaauauucauauuggaaaa

SEQ ID NO: 1801104 - RNA, 14 nt, Homo sapiens
uaccuaaugucuca

SEQ ID NO: 1801105 - RNA, 22 nt, Homo sapiens
cuauggaaacuuuuguacuugu

SEQ ID NO: 1801106 - RNA, 16 nt, Homo sapiens
caccuggcucaccuug

SEQ ID NO: 1801107 - RNA, 18 nt, Homo sapiens
ugcuaacaucucaucuua

SEQ ID NO: 1801108 - RNA, 15 nt, Homo sapiens
ccagaucacugccac

SEQ ID NO: 1801109 - RNA, 18 nt, Homo sapiens
uuguaguuuaaauucuuc

SEQ ID NO: 1801110 - RNA, 14 nt, Homo sapiens
caaagcugccuguc

SEQ ID NO: 1801111 - RNA, 17 nt, Homo sapiens
agggaaggugagccaga

SEQ ID NO: 1801112 - RNA, 14 nt, Homo sapiens
cuugaauauuccug

SEQ ID NO: 1801113 - RNA, 23 nt, Homo sapiens
agacaguuuugcuuuaguacaau

SEQ ID NO: 1801114 - RNA, 20 nt, Homo sapiens
ccauugcucccagugccaaa

SEQ ID NO: 1801115 - RNA, 22 nt, Homo sapiens
cuuucucuuuuaggaggcacaa

SEQ ID NO: 1801116 - RNA, 13 nt, Homo sapiens
cuccauucauccu

SEQ ID NO: 1801117 - RNA, 19 nt, Homo sapiens
cucaauccauccauguacu

SEQ ID NO: 1801118 - RNA, 16 nt, Homo sapiens
uaccagcagcuggaau

SEQ ID NO: 1801119 - RNA, 20 nt, Homo sapiens
caugagcuacucaugacuga

SEQ ID NO: 1801120 - RNA, 16 nt, Homo sapiens
aguggaggcacuuuag

SEQ ID NO: 1801121 - RNA, 17 nt, Homo sapiens
acagaacucaacuguau

SEQ ID NO: 1801122 - RNA, 12 nt, Homo sapiens
acccccugccca

SEQ ID NO: 1801123 - RNA, 20 nt, Homo sapiens
cuauucccugucacuacaca

SEQ ID NO: 1801124 - RNA, 14 nt, Homo sapiens
uagcacuauuuaca

SEQ ID NO: 1801125 - RNA, 18 nt, Homo sapiens
aucuguuugauacaguau

SEQ ID NO: 1801126 - RNA, 22 nt, Homo sapiens
gcaaaugucacggcuacucuau

SEQ ID NO: 1801127 - RNA, 17 nt, Homo sapiens
gcaguucuaguuugcau

SEQ ID NO: 1801128 - RNA, 22 nt, Homo sapiens
auucuuauuaguuccccaaaua

SEQ ID NO: 1801129 - RNA, 17 nt, Homo sapiens
acacugaagguugacac

SEQ ID NO: 1801130 - RNA, 22 nt, Homo sapiens
gggcaaagcugugcacuugcag

SEQ ID NO: 1801131 - RNA, 14 nt, Homo sapiens
ucaagcaguuucua

SEQ ID NO: 1801132 - RNA, 19 nt, Homo sapiens
cacauaacuucucugaguc

SEQ ID NO: 1801133 - RNA, 21 nt, Homo sapiens
augaggacuguccccaugccc

SEQ ID NO: 1801134 - RNA, 19 nt, Homo sapiens
agucauggcuaauuuaaca

SEQ ID NO: 1801135 - RNA, 21 nt, Homo sapiens
uuuaaagaauucuuuuuacau

SEQ ID NO: 1801136 - RNA, 14 nt, Homo sapiens
gaaaccccgucucu

SEQ ID NO: 1801137 - RNA, 14 nt, Homo sapiens
aaaaccccaucucu

SEQ ID NO: 1801138 - RNA, 21 nt, Homo sapiens
gaaggcaacgcaccaucccuc

SEQ ID NO: 1801139 - RNA, 19 nt, Homo sapiens
agcugucccaccugcacac

SEQ ID NO: 1801140 - RNA, 16 nt, Homo sapiens
aaacagggacaaagaa

SEQ ID NO: 1801141 - RNA, 20 nt, Homo sapiens
acugcuuuaaaaaacaauua

SEQ ID NO: 1801142 - RNA, 16 nt, Homo sapiens
ccuuagauuagcucug

SEQ ID NO: 1801143 - RNA, 17 nt, Homo sapiens
gucccuuucacacugug

SEQ ID NO: 1801144 - RNA, 19 nt, Homo sapiens
auacuacaguaacugugac

SEQ ID NO: 1801145 - RNA, 18 nt, Homo sapiens
aguggucucuacuguggc

SEQ ID NO: 1801146 - RNA, 16 nt, Homo sapiens
aaacucacucacuguu

SEQ ID NO: 1801147 - RNA, 21 nt, Homo sapiens
uggcccgcgugauuguggcau

SEQ ID NO: 1801148 - RNA, 22 nt, Homo sapiens
augucaaugccaggauuucuca

SEQ ID NO: 1801149 - RNA, 18 nt, Homo sapiens
aauauacacuuuacauuc

SEQ ID NO: 1801150 - RNA, 18 nt, Homo sapiens
auuaaccaucuuuaauca

SEQ ID NO: 1801151 - RNA, 16 nt, Homo sapiens
auaguuauagccagaa

SEQ ID NO: 1801152 - RNA, 18 nt, Homo sapiens
cauccugaggcuccacuu

SEQ ID NO: 1801153 - RNA, 22 nt, Homo sapiens
gagaacugguucuugccuuccc

SEQ ID NO: 1801154 - RNA, 21 nt, Homo sapiens
acuucugcuccauagacauca

SEQ ID NO: 1801155 - RNA, 17 nt, Homo sapiens
ccuucgcccugugcacc

SEQ ID NO: 1801156 - RNA, 17 nt, Homo sapiens
ucagucccccugugcau

SEQ ID NO: 1801157 - RNA, 14 nt, Homo sapiens
cuguaccuuucuaa

SEQ ID NO: 1801158 - RNA, 13 nt, Homo sapiens
aaauagucacuca

SEQ ID NO: 1801159 - RNA, 20 nt, Homo sapiens
cacuuccugcugcgaaagac

SEQ ID NO: 1801160 - RNA, 17 nt, Homo sapiens
uauccaggacucuguca

SEQ ID NO: 1801161 - RNA, 19 nt, Homo sapiens
agaucaaauauauuucaag

SEQ ID NO: 1801162 - RNA, 19 nt, Homo sapiens
aaucuguaaucagcaauaa

SEQ ID NO: 1801163 - RNA, 13 nt, Homo sapiens
cauacaugcugcg

SEQ ID NO: 1801164 - RNA, 13 nt, Homo sapiens
aauuaaaauccag

SEQ ID NO: 1801165 - RNA, 21 nt, Homo sapiens
aacaagagauuuaaguuuuaa

SEQ ID NO: 1801166 - RNA, 17 nt, Homo sapiens
aagggaauacugugcau

SEQ ID NO: 1801167 - RNA, 23 nt, Homo sapiens
aaugcaaaugaaggaaugcaaua

SEQ ID NO: 1801168 - RNA, 21 nt, Homo sapiens
caggggagaaacgaaaaccac

SEQ ID NO: 1801169 - RNA, 11 nt, Homo sapiens
gugagcacaaa

SEQ ID NO: 1801170 - RNA, 17 nt, Homo sapiens
gaagaacaaaucugggc

SEQ ID NO: 1801171 - RNA, 22 nt, Homo sapiens
uaaaauauuuuguaaugcugca

SEQ ID NO: 1801172 - RNA, 21 nt, Homo sapiens
aaaauuuaggaccaauaccuc

SEQ ID NO: 1801173 - RNA, 17 nt, Homo sapiens
cagcccgcaacucucca

SEQ ID NO: 1801174 - RNA, 13 nt, Homo sapiens
gcacacacagaua

SEQ ID NO: 1801175 - RNA, 16 nt, Homo sapiens
cucuucccgggaucac

SEQ ID NO: 1801176 - RNA, 15 nt, Homo sapiens
uccccguuucuugca

SEQ ID NO: 1801177 - RNA, 23 nt, Homo sapiens
uagggagaagucugcaagauguc

SEQ ID NO: 1801178 - RNA, 14 nt, Homo sapiens
cagcccaaccuuca

SEQ ID NO: 1801179 - RNA, 20 nt, Homo sapiens
gccccuuaguccccaagccc

SEQ ID NO: 1801180 - RNA, 21 nt, Homo sapiens
cuggacgugcgcgaugccugg

SEQ ID NO: 1801181 - RNA, 23 nt, Homo sapiens
cugaggacaaggaaauuccucag

SEQ ID NO: 1801182 - RNA, 14 nt, Homo sapiens
uuguguucugcucc

SEQ ID NO: 1801183 - RNA, 15 nt, Homo sapiens
cauacccaugcacag

SEQ ID NO: 1801184 - RNA, 21 nt, Homo sapiens
acauuuucuaacaaacucaaa

SEQ ID NO: 1801185 - RNA, 21 nt, Homo sapiens
auuuagaaacugauuucuuca

SEQ ID NO: 1801186 - RNA, 18 nt, Homo sapiens
uacaagacuuaguggaau

SEQ ID NO: 1801187 - RNA, 21 nt, Homo sapiens
gaauuagauuucuauaggauu

SEQ ID NO: 1801188 - RNA, 21 nt, Homo sapiens
cggggguacagcccuugcacu

SEQ ID NO: 1801189 - RNA, 16 nt, Homo sapiens
acuuuagguagaugaa

SEQ ID NO: 1801190 - RNA, 20 nt, Homo sapiens
uguauaaguugaaggaaaau

SEQ ID NO: 1801191 - RNA, 18 nt, Homo sapiens
aaauuuacguauauuuca

SEQ ID NO: 1801192 - RNA, 15 nt, Homo sapiens
acaacacucaucaca

SEQ ID NO: 1801193 - RNA, 13 nt, Homo sapiens
cugauguggcaac

SEQ ID NO: 1801194 - RNA, 23 nt, Homo sapiens
ugauauuuauuagugguguauau

SEQ ID NO: 1801195 - RNA, 22 nt, Homo sapiens
agcuucccgaguaacugagauu

SEQ ID NO: 1801196 - RNA, 11 nt, Homo sapiens
ggcacuuguau

SEQ ID NO: 1801197 - RNA, 14 nt, Homo sapiens
ugccagggccuguc

SEQ ID NO: 1801198 - RNA, 19 nt, Homo sapiens
gcaauugucuuguaccuug

SEQ ID NO: 1801199 - RNA, 20 nt, Homo sapiens
aucuaucggaagaacaugaa

SEQ ID NO: 1801200 - RNA, 23 nt, Homo sapiens
aaucaagcuuuugcuugauccag

SEQ ID NO: 1801201 - RNA, 14 nt, Homo sapiens
auggcaacacugaa

SEQ ID NO: 1801202 - RNA, 23 nt, Homo sapiens
cccaggccucugccccaagagca

SEQ ID NO: 1801203 - RNA, 16 nt, Homo sapiens
ccaguaggaggaggau

SEQ ID NO: 1801204 - RNA, 17 nt, Homo sapiens
uuuaauggcaugucaga

SEQ ID NO: 1801205 - RNA, 21 nt, Homo sapiens
ucuuaguguuguggacacugc

SEQ ID NO: 1801206 - RNA, 14 nt, Homo sapiens
agcucagccucccc

SEQ ID NO: 1801207 - RNA, 19 nt, Homo sapiens
aguugggcauaguggcacu

SEQ ID NO: 1801208 - RNA, 23 nt, Homo sapiens
cagacuguaagauguuguuuuag

SEQ ID NO: 1801209 - RNA, 15 nt, Homo sapiens
gaaacaaacauggau

SEQ ID NO: 1801210 - RNA, 13 nt, Homo sapiens
agugcuacuugag

SEQ ID NO: 1801211 - RNA, 23 nt, Homo sapiens
gcagauaacuuuuuugagucauu

SEQ ID NO: 1801212 - RNA, 19 nt, Homo sapiens
guacaaaaauuaugcaauu

SEQ ID NO: 1801213 - RNA, 12 nt, Homo sapiens
cuauaagccaga

SEQ ID NO: 1801214 - RNA, 23 nt, Homo sapiens
acccagaugcaagacacugugcc

SEQ ID NO: 1801215 - RNA, 16 nt, Homo sapiens
uucuuagcucaaugag

SEQ ID NO: 1801216 - RNA, 15 nt, Homo sapiens
aaaaugaauuugacu

SEQ ID NO: 1801217 - RNA, 20 nt, Homo sapiens
ucaacuuuacuuuuaaaauc

SEQ ID NO: 1801218 - RNA, 17 nt, Homo sapiens
gacagagggagagaaua

SEQ ID NO: 1801219 - RNA, 23 nt, Homo sapiens
gugaauuuuucucuaacucagaa

SEQ ID NO: 1801220 - RNA, 14 nt, Homo sapiens
aggcugaggacuua

SEQ ID NO: 1801221 - RNA, 16 nt, Homo sapiens
cagcccauugcugcca

SEQ ID NO: 1801222 - RNA, 11 nt, Homo sapiens
cuaugccuuua

SEQ ID NO: 1801223 - RNA, 13 nt, Homo sapiens
acugccaaacagu

SEQ ID NO: 1801224 - RNA, 22 nt, Homo sapiens
acaacugaauagcaaguggcau

SEQ ID NO: 1801225 - RNA, 16 nt, Homo sapiens
agaugacaaugggagc

SEQ ID NO: 1801226 - RNA, 13 nt, Homo sapiens
cgugccuguaguc

SEQ ID NO: 1801227 - RNA, 15 nt, Homo sapiens
aauuguuaugaucua

SEQ ID NO: 1801228 - RNA, 21 nt, Homo sapiens
agcaugaaauguccucuugaa

SEQ ID NO: 1801229 - RNA, 20 nt, Homo sapiens
cgugacuguuacuuuauaca

SEQ ID NO: 1801230 - RNA, 17 nt, Homo sapiens
uaaacucaucuauccag

SEQ ID NO: 1801231 - RNA, 21 nt, Homo sapiens
uggccauggacgaauaugaau

SEQ ID NO: 1801232 - RNA, 20 nt, Homo sapiens
agugaagaacacuacugcua

SEQ ID NO: 1801233 - RNA, 11 nt, Homo sapiens
uccacgagcua

SEQ ID NO: 1801234 - RNA, 19 nt, Homo sapiens
aagcaguuuacucuagacu

SEQ ID NO: 1801235 - RNA, 15 nt, Homo sapiens
gccaauagucauaug

SEQ ID NO: 1801236 - RNA, 16 nt, Homo sapiens
aggugcuuuguaauau

SEQ ID NO: 1801237 - RNA, 15 nt, Homo sapiens
caccagccugagcca

SEQ ID NO: 1801238 - RNA, 14 nt, Homo sapiens
gauaggccuguggg

SEQ ID NO: 1801239 - RNA, 14 nt, Homo sapiens
gaucaccaccugaa

SEQ ID NO: 1801240 - RNA, 20 nt, Homo sapiens
cuucauuuuuaagacuguaa

SEQ ID NO: 1801241 - RNA, 16 nt, Homo sapiens
acagaacaccuaugca

SEQ ID NO: 1801242 - RNA, 24 nt, Homo sapiens
guucacugagcuccccagaucucc

SEQ ID NO: 1801243 - RNA, 18 nt, Homo sapiens
gauugggucagcuggcuu

SEQ ID NO: 1801244 - RNA, 15 nt, Homo sapiens
cauauucuaaaacca

SEQ ID NO: 1801245 - RNA, 13 nt, Homo sapiens
uacuuacaucagg

SEQ ID NO: 1801246 - RNA, 15 nt, Homo sapiens
cacacaaacaccucc

SEQ ID NO: 1801247 - RNA, 19 nt, Homo sapiens
uacaagauucucugauacc

SEQ ID NO: 1801248 - RNA, 14 nt, Homo sapiens
aaagaaguaaaagc

SEQ ID NO: 1801249 - RNA, 14 nt, Homo sapiens
acuguuaaucaugg

SEQ ID NO: 1801250 - RNA, 17 nt, Homo sapiens
uauuugagacuccucag

SEQ ID NO: 1801251 - RNA, 22 nt, Homo sapiens
ccgccuuccuccuccacagugc

SEQ ID NO: 1801252 - RNA, 15 nt, Homo sapiens
acuccagcccugucc

SEQ ID NO: 1801253 - RNA, 18 nt, Homo sapiens
acauaaguguugguagca

SEQ ID NO: 1801254 - RNA, 18 nt, Homo sapiens
ugggggaacacugagaaa

SEQ ID NO: 1801255 - RNA, 12 nt, Homo sapiens
auugcugugaaa

SEQ ID NO: 1801256 - RNA, 12 nt, Homo sapiens
auaacugugaug

SEQ ID NO: 1801257 - RNA, 13 nt, Homo sapiens
uggaaaacuacaa

SEQ ID NO: 1801258 - RNA, 18 nt, Homo sapiens
uauuagcaacugugcuac

SEQ ID NO: 1801259 - RNA, 20 nt, Homo sapiens
acaucuauuauaaaaccaug

SEQ ID NO: 1801260 - RNA, 20 nt, Homo sapiens
auagggagacccccaucuuu

SEQ ID NO: 1801261 - RNA, 14 nt, Homo sapiens
ccaccaacaccagg

SEQ ID NO: 1801262 - RNA, 13 nt, Homo sapiens
aggaguacaggug

SEQ ID NO: 1801263 - RNA, 15 nt, Homo sapiens
caaaugugugacugc

SEQ ID NO: 1801264 - RNA, 11 nt, Homo sapiens
cagcaaggugg

SEQ ID NO: 1801265 - RNA, 15 nt, Homo sapiens
uaaauagaguuugcu

SEQ ID NO: 1801266 - RNA, 13 nt, Homo sapiens
aggggcagugaag

SEQ ID NO: 1801267 - RNA, 13 nt, Homo sapiens
uggguuuggugua

SEQ ID NO: 1801268 - RNA, 20 nt, Homo sapiens
agugaccgggcacuggcacu

SEQ ID NO: 1801269 - RNA, 13 nt, Homo sapiens
aguauacaugacu

SEQ ID NO: 1801270 - RNA, 18 nt, Homo sapiens
uaugaauugacagacugu

SEQ ID NO: 1801271 - RNA, 23 nt, Homo sapiens
gugcgugcucccgaugcugcuau

SEQ ID NO: 1801272 - RNA, 21 nt, Homo sapiens
ugccugaaaugcuucuguuuu

SEQ ID NO: 1801273 - RNA, 15 nt, Homo sapiens
acagcccaacagcug

SEQ ID NO: 1801274 - RNA, 17 nt, Homo sapiens
uuaguccaauuccuugc

SEQ ID NO: 1801275 - RNA, 15 nt, Homo sapiens
caaaauuaugcugca

SEQ ID NO: 1801276 - RNA, 20 nt, Homo sapiens
gaccuugcaaucacaaaagg

SEQ ID NO: 1801277 - RNA, 15 nt, Homo sapiens
ugccauguguuuauc

SEQ ID NO: 1801278 - RNA, 17 nt, Homo sapiens
ugguaaaauacauauaa

SEQ ID NO: 1801279 - RNA, 12 nt, Homo sapiens
uauaacauccac

SEQ ID NO: 1801280 - RNA, 16 nt, Homo sapiens
aaagauguuugucaga

SEQ ID NO: 1801281 - RNA, 18 nt, Homo sapiens
ggaucaggcugcuggaaa

SEQ ID NO: 1801282 - RNA, 15 nt, Homo sapiens
aucaucucugugacc

SEQ ID NO: 1801283 - RNA, 15 nt, Homo sapiens
uucaagccagugugu

SEQ ID NO: 1801284 - RNA, 12 nt, Homo sapiens
acaccugacaaa

SEQ ID NO: 1801285 - RNA, 15 nt, Homo sapiens
cguaaauuauuacau

SEQ ID NO: 1801286 - RNA, 13 nt, Homo sapiens
ccacccugcucau

SEQ ID NO: 1801287 - RNA, 15 nt, Homo sapiens
guaucaacacuguua

SEQ ID NO: 1801288 - RNA, 14 nt, Homo sapiens
auuaaacgggcugc

SEQ ID NO: 1801289 - RNA, 14 nt, Homo sapiens
aaggcagcugccuc

SEQ ID NO: 1801290 - RNA, 16 nt, Homo sapiens
ccuuuguugcacaaau

SEQ ID NO: 1801291 - RNA, 23 nt, Homo sapiens
cugguaggaaggauaucggguca

SEQ ID NO: 1801292 - RNA, 17 nt, Homo sapiens
uuucuggaaaacugccu

SEQ ID NO: 1801293 - RNA, 20 nt, Homo sapiens
aaacugggcuccugcuuuau

SEQ ID NO: 1801294 - RNA, 16 nt, Homo sapiens
cccuucaacuaugcaa

SEQ ID NO: 1801295 - RNA, 21 nt, Homo sapiens
caacaggccccccagccaaga

SEQ ID NO: 1801296 - RNA, 22 nt, Homo sapiens
acucuccccaguccucaggcag

SEQ ID NO: 1801297 - RNA, 19 nt, Homo sapiens
ucuugaauaguacauuuuc

SEQ ID NO: 1801298 - RNA, 21 nt, Homo sapiens
caagugaacauuacauugcca

SEQ ID NO: 1801299 - RNA, 18 nt, Homo sapiens
aaugcagacugcugcaaa

SEQ ID NO: 1801300 - RNA, 18 nt, Homo sapiens
ccagaccccuguggcaga

SEQ ID NO: 1801301 - RNA, 20 nt, Homo sapiens
aacaugccaggccucaggga

SEQ ID NO: 1801302 - RNA, 16 nt, Homo sapiens
ccucccaccaccccau

SEQ ID NO: 1801303 - RNA, 19 nt, Homo sapiens
gccacagggacgacccggg

SEQ ID NO: 1801304 - RNA, 15 nt, Homo sapiens
cuuucaggaccuuuu

SEQ ID NO: 1801305 - RNA, 17 nt, Homo sapiens
agagaagcagaauccuu

SEQ ID NO: 1801306 - RNA, 21 nt, Homo sapiens
gcuaaucaaagccagggucuc

SEQ ID NO: 1801307 - RNA, 14 nt, Homo sapiens
gaauuuacucaggc

SEQ ID NO: 1801308 - RNA, 15 nt, Homo sapiens
aaacacuggugccaa

SEQ ID NO: 1801309 - RNA, 21 nt, Homo sapiens
ccucuggcuuggccacagcca

SEQ ID NO: 1801310 - RNA, 14 nt, Homo sapiens
gcuucugccuucaa

SEQ ID NO: 1801311 - RNA, 16 nt, Homo sapiens
cauguuccuucaagau

SEQ ID NO: 1801312 - RNA, 19 nt, Homo sapiens
gccagcucccugaaucuga

SEQ ID NO: 1801313 - RNA, 17 nt, Homo sapiens
auaagugcccucuccca

SEQ ID NO: 1801314 - RNA, 18 nt, Homo sapiens
agaguggcuuccaucuca

SEQ ID NO: 1801315 - RNA, 16 nt, Homo sapiens
ucuucuggauuagaau

SEQ ID NO: 1801316 - RNA, 22 nt, Homo sapiens
augaagauuuuuaauuacaaua

SEQ ID NO: 1801317 - RNA, 17 nt, Homo sapiens
cuggacaggcacuaucu

SEQ ID NO: 1801318 - RNA, 22 nt, Homo sapiens
gcgcaguuggucuuuaaccacu

SEQ ID NO: 1801319 - RNA, 14 nt, Homo sapiens
uagaaauuccccac

SEQ ID NO: 1801320 - RNA, 17 nt, Homo sapiens
ugccuuuuccccaggga

SEQ ID NO: 1801321 - RNA, 12 nt, Homo sapiens
caagcugcauuu

SEQ ID NO: 1801322 - RNA, 23 nt, Homo sapiens
agaaaguuuagaucugucccuua

SEQ ID NO: 1801323 - RNA, 17 nt, Homo sapiens
ucuccccacuaaccaca

SEQ ID NO: 1801324 - RNA, 17 nt, Homo sapiens
agauccgagugugauuu

SEQ ID NO: 1801325 - RNA, 22 nt, Homo sapiens
aacauaacaaaaucacuuccau

SEQ ID NO: 1801326 - RNA, 14 nt, Homo sapiens
cauguauacuuaau

SEQ ID NO: 1801327 - RNA, 13 nt, Homo sapiens
agcagugccucuu

SEQ ID NO: 1801328 - RNA, 14 nt, Homo sapiens
uaaaaaguggcuaa

SEQ ID NO: 1801329 - RNA, 18 nt, Homo sapiens
gaauuucacaagcuauuu

SEQ ID NO: 1801330 - RNA, 18 nt, Homo sapiens
gucaccagguccugugag

SEQ ID NO: 1801331 - RNA, 20 nt, Homo sapiens
ccagccaagagggcugcaaa

SEQ ID NO: 1801332 - RNA, 13 nt, Homo sapiens
ggucccugagcuc

SEQ ID NO: 1801333 - RNA, 13 nt, Homo sapiens
ggcuacugaguca

SEQ ID NO: 1801334 - RNA, 18 nt, Homo sapiens
gauacacuugaaggacca

SEQ ID NO: 1801335 - RNA, 15 nt, Homo sapiens
ccugcccaugugucc

SEQ ID NO: 1801336 - RNA, 19 nt, Homo sapiens
ucugaacugcacaaugcau

SEQ ID NO: 1801337 - RNA, 14 nt, Homo sapiens
uaacaguaucucaa

SEQ ID NO: 1801338 - RNA, 16 nt, Homo sapiens
cccugcugcuggugca

SEQ ID NO: 1801339 - RNA, 18 nt, Homo sapiens
cuauauuuagauuguuaa

SEQ ID NO: 1801340 - RNA, 13 nt, Homo sapiens
gagagcacuugau

SEQ ID NO: 1801341 - RNA, 14 nt, Homo sapiens
aaauuaauaucaca

SEQ ID NO: 1801342 - RNA, 18 nt, Homo sapiens
ugggacacccaacacuuu

SEQ ID NO: 1801343 - RNA, 23 nt, Homo sapiens
uguccccuccccucuguuuacau

SEQ ID NO: 1801344 - RNA, 18 nt, Homo sapiens
cuucacuggcuuccauca

SEQ ID NO: 1801345 - RNA, 13 nt, Homo sapiens
aagauugauacuu

SEQ ID NO: 1801346 - RNA, 22 nt, Homo sapiens
ugcaugucugccuaugcacuga

SEQ ID NO: 1801347 - RNA, 14 nt, Homo sapiens
guggcgacucuaua

SEQ ID NO: 1801348 - RNA, 14 nt, Homo sapiens
cuggguucuagaac

SEQ ID NO: 1801349 - RNA, 20 nt, Homo sapiens
cuuuccaaaaccuaaagagg

SEQ ID NO: 1801350 - RNA, 20 nt, Homo sapiens
ccaaaaagggauccguacau

SEQ ID NO: 1801351 - RNA, 12 nt, Homo sapiens
cccuaaagggag

SEQ ID NO: 1801352 - RNA, 17 nt, Homo sapiens
acuucuuuccaugggcg

SEQ ID NO: 1801353 - RNA, 22 nt, Homo sapiens
ccucagguugcugguugcugug

SEQ ID NO: 1801354 - RNA, 14 nt, Homo sapiens
cauacugcauuuca

SEQ ID NO: 1801355 - RNA, 17 nt, Homo sapiens
uaaaaacugcagugucu

SEQ ID NO: 1801356 - RNA, 15 nt, Homo sapiens
cacgauggucuccau

SEQ ID NO: 1801357 - RNA, 23 nt, Homo sapiens
aaccagcacuccaucacugagag

SEQ ID NO: 1801358 - RNA, 14 nt, Homo sapiens
ugaaggaaacagaa

SEQ ID NO: 1801359 - RNA, 22 nt, Homo sapiens
uagauauagccccauuacuaca

SEQ ID NO: 1801360 - RNA, 21 nt, Homo sapiens
cuucccccgcuuuggacagaa

SEQ ID NO: 1801361 - RNA, 17 nt, Homo sapiens
caguaugaaaaugucau

SEQ ID NO: 1801362 - RNA, 12 nt, Homo sapiens
aaccacauuaua

SEQ ID NO: 1801363 - RNA, 12 nt, Homo sapiens
acuguacauaaa

SEQ ID NO: 1801364 - RNA, 16 nt, Homo sapiens
agucuguauuccugau

SEQ ID NO: 1801365 - RNA, 16 nt, Homo sapiens
uaccaaaacaagauua

SEQ ID NO: 1801366 - RNA, 15 nt, Homo sapiens
ggacagaaccacuga

SEQ ID NO: 1801367 - RNA, 17 nt, Homo sapiens
gggccuuuccuggcuga

SEQ ID NO: 1801368 - RNA, 15 nt, Homo sapiens
gcuggaacacaauaa

SEQ ID NO: 1801369 - RNA, 16 nt, Homo sapiens
acauucaaaccaaaua

SEQ ID NO: 1801370 - RNA, 21 nt, Homo sapiens
ucaaccuccugggcuaaguga

SEQ ID NO: 1801371 - RNA, 16 nt, Homo sapiens
uuaucacuuaaacuug

SEQ ID NO: 1801372 - RNA, 23 nt, Homo sapiens
uggcaaguugcaucagaaagcuu

SEQ ID NO: 1801373 - RNA, 19 nt, Homo sapiens
ccagcuguuaccugagaua

SEQ ID NO: 1801374 - RNA, 18 nt, Homo sapiens
auggaauauucauuuuac

SEQ ID NO: 1801375 - RNA, 21 nt, Homo sapiens
uacauacacuguauguuauag

SEQ ID NO: 1801376 - RNA, 19 nt, Homo sapiens
uaucuggccauugcacuuc

SEQ ID NO: 1801377 - RNA, 12 nt, Homo sapiens
aucaaauacuuu

SEQ ID NO: 1801378 - RNA, 21 nt, Homo sapiens
uaaaguaccacacauauugca

SEQ ID NO: 1801379 - RNA, 13 nt, Homo sapiens
caaguauccagac

SEQ ID NO: 1801380 - RNA, 18 nt, Homo sapiens
ucuagaucuguuaccaau

SEQ ID NO: 1801381 - RNA, 16 nt, Homo sapiens
uucaaccaacuguaau

SEQ ID NO: 1801382 - RNA, 17 nt, Homo sapiens
uccaccugaggaacugu

SEQ ID NO: 1801383 - RNA, 12 nt, Homo sapiens
caaaacuuucag

SEQ ID NO: 1801384 - RNA, 16 nt, Homo sapiens
cuugguaaucaugaaa

SEQ ID NO: 1801385 - RNA, 21 nt, Homo sapiens
ccugcaaccugauugugucuc

SEQ ID NO: 1801386 - RNA, 13 nt, Homo sapiens
auaguuacaagca

SEQ ID NO: 1801387 - RNA, 16 nt, Homo sapiens
aauccuccauuugcug

SEQ ID NO: 1801388 - RNA, 20 nt, Homo sapiens
gcccccucgcgccccugucc

SEQ ID NO: 1801389 - RNA, 12 nt, Homo sapiens
gcugggugguca

SEQ ID NO: 1801390 - RNA, 17 nt, Homo sapiens
gaaaccagcaucugcac

SEQ ID NO: 1801391 - RNA, 15 nt, Homo sapiens
acaaaagucugucuu

SEQ ID NO: 1801392 - RNA, 12 nt, Homo sapiens
cuccuaaaacaa

SEQ ID NO: 1801393 - RNA, 15 nt, Homo sapiens
uaccauauuuaauaa

SEQ ID NO: 1801394 - RNA, 13 nt, Homo sapiens
uugagauggaguu

SEQ ID NO: 1801395 - RNA, 15 nt, Homo sapiens
ugggauguucagcac

SEQ ID NO: 1801396 - RNA, 15 nt, Homo sapiens
gguuguuucuguucc

SEQ ID NO: 1801397 - RNA, 18 nt, Homo sapiens
agacgggguuucacugug

SEQ ID NO: 1801398 - RNA, 23 nt, Homo sapiens
cauggaaauucccuucaucugga

SEQ ID NO: 1801399 - RNA, 10 nt, Homo sapiens
agagugccac

SEQ ID NO: 1801400 - RNA, 22 nt, Homo sapiens
aguuuacagaauggaaccaaaa

SEQ ID NO: 1801401 - RNA, 22 nt, Homo sapiens
gcgacagaagucuugucucaag

SEQ ID NO: 1801402 - RNA, 13 nt, Homo sapiens
ugaauuagcucac

SEQ ID NO: 1801403 - RNA, 20 nt, Homo sapiens
gauauuggggccaugaguaa

SEQ ID NO: 1801404 - RNA, 17 nt, Homo sapiens
ugccugcuucuuuccag

SEQ ID NO: 1801405 - RNA, 15 nt, Homo sapiens
gugccaguucuuucc

SEQ ID NO: 1801406 - RNA, 21 nt, Homo sapiens
aauugcugcuuguacacucau

SEQ ID NO: 1801407 - RNA, 22 nt, Homo sapiens
acugcuuuuaaaugaccaaaga

SEQ ID NO: 1801408 - RNA, 11 nt, Homo sapiens
uauuugaaccc

SEQ ID NO: 1801409 - RNA, 14 nt, Homo sapiens
gauaauaauggguu

SEQ ID NO: 1801410 - RNA, 15 nt, Homo sapiens
auaaauuugcacugu

SEQ ID NO: 1801411 - RNA, 21 nt, Homo sapiens
acucccacucaguacuguaca

SEQ ID NO: 1801412 - RNA, 16 nt, Homo sapiens
ucacagcuccucccac

SEQ ID NO: 1801413 - RNA, 22 nt, Homo sapiens
gcccgcagugcugggaccagag

SEQ ID NO: 1801414 - RNA, 19 nt, Homo sapiens
ccuucuguggcuuggagau

SEQ ID NO: 1801415 - RNA, 14 nt, Homo sapiens
auuuuuuaagugac

SEQ ID NO: 1801416 - RNA, 20 nt, Homo sapiens
cauuucacgggcaacacuca

SEQ ID NO: 1801417 - RNA, 21 nt, Homo sapiens
agccaugggaccaaaccuagc

SEQ ID NO: 1801418 - RNA, 18 nt, Homo sapiens
uaaggcugugugaauuuu

SEQ ID NO: 1801419 - RNA, 20 nt, Homo sapiens
uaacugacaagccaucuuga

SEQ ID NO: 1801420 - RNA, 21 nt, Homo sapiens
ccguccccucccagggagcaa

SEQ ID NO: 1801421 - RNA, 18 nt, Homo sapiens
uacauuuugcucugugaa

SEQ ID NO: 1801422 - RNA, 17 nt, Homo sapiens
ugaguuccagggcugcu

SEQ ID NO: 1801423 - RNA, 23 nt, Homo sapiens
uguaacaaauauauugcaaaaac

SEQ ID NO: 1801424 - RNA, 23 nt, Homo sapiens
aauuauaguuaggcuuccaugau

SEQ ID NO: 1801425 - RNA, 15 nt, Homo sapiens
ccaggccaccuccag

SEQ ID NO: 1801426 - RNA, 14 nt, Homo sapiens
cucucccugccaag

SEQ ID NO: 1801427 - RNA, 20 nt, Homo sapiens
cagauuauccuuccuccuca

SEQ ID NO: 1801428 - RNA, 18 nt, Homo sapiens
guaauuaaaggaacagag

SEQ ID NO: 1801429 - RNA, 17 nt, Homo sapiens
ucccccagagguggaua

SEQ ID NO: 1801430 - RNA, 11 nt, Homo sapiens
uuguugccaug

SEQ ID NO: 1801431 - RNA, 11 nt, Homo sapiens
auauugccuua

SEQ ID NO: 1801432 - RNA, 11 nt, Homo sapiens
uuuuugccauu

SEQ ID NO: 1801433 - RNA, 15 nt, Homo sapiens
uuacaagagaagaaa

SEQ ID NO: 1801434 - RNA, 18 nt, Homo sapiens
uaucuugaagucagccac

SEQ ID NO: 1801435 - RNA, 12 nt, Homo sapiens
auugagaugaaa

SEQ ID NO: 1801436 - RNA, 22 nt, Homo sapiens
uaucucaaaguuuaacacaauu

SEQ ID NO: 1801437 - RNA, 14 nt, Homo sapiens
guuuccugacuccu

SEQ ID NO: 1801438 - RNA, 13 nt, Homo sapiens
auaaccacagggc

SEQ ID NO: 1801439 - RNA, 13 nt, Homo sapiens
cuaaagugucaag

SEQ ID NO: 1801440 - RNA, 17 nt, Homo sapiens
uacgacuucauuccuuc

SEQ ID NO: 1801441 - RNA, 14 nt, Homo sapiens
gauugcugcaaaga

SEQ ID NO: 1801442 - RNA, 15 nt, Homo sapiens
acacagcacaugcac

SEQ ID NO: 1801443 - RNA, 16 nt, Homo sapiens
cuggaggaacugcuug

SEQ ID NO: 1801444 - RNA, 17 nt, Homo sapiens
ggcgcgaucucagcuca

SEQ ID NO: 1801445 - RNA, 20 nt, Homo sapiens
ccccgacucccuccccagau

SEQ ID NO: 1801446 - RNA, 19 nt, Homo sapiens
uauggccaggggacacugu

SEQ ID NO: 1801447 - RNA, 14 nt, Homo sapiens
uugacauaacacua

SEQ ID NO: 1801448 - RNA, 20 nt, Homo sapiens
ugcaagucuucaugauucug

SEQ ID NO: 1801449 - RNA, 14 nt, Homo sapiens
aggagacacaggga

SEQ ID NO: 1801450 - RNA, 14 nt, Homo sapiens
caaaaucaagagau

SEQ ID NO: 1801451 - RNA, 14 nt, Homo sapiens
guggcacucaugga

SEQ ID NO: 1801452 - RNA, 15 nt, Homo sapiens
aacaauaaauaugua

SEQ ID NO: 1801453 - RNA, 21 nt, Homo sapiens
gguggauuugagcuguggcug

SEQ ID NO: 1801454 - RNA, 21 nt, Homo sapiens
cuggagggaggcugggcgggu

SEQ ID NO: 1801455 - RNA, 19 nt, Homo sapiens
gggcugggccccugggcga

SEQ ID NO: 1801456 - RNA, 16 nt, Homo sapiens
gugaacugucuuggcu

SEQ ID NO: 1801457 - RNA, 19 nt, Homo sapiens
uccuuuuuuaaaaaugcaa

SEQ ID NO: 1801458 - RNA, 19 nt, Homo sapiens
gucuccucuuuaaaacaaa

SEQ ID NO: 1801459 - RNA, 18 nt, Homo sapiens
aauggcauggcaggaguc

SEQ ID NO: 1801460 - RNA, 17 nt, Homo sapiens
ucugugucaaugugauu

SEQ ID NO: 1801461 - RNA, 15 nt, Homo sapiens
uacacauacauguaa

SEQ ID NO: 1801462 - RNA, 18 nt, Homo sapiens
uauguaauugaaaaccaa

SEQ ID NO: 1801463 - RNA, 17 nt, Homo sapiens
aggaguuguaccuccau

SEQ ID NO: 1801464 - RNA, 17 nt, Homo sapiens
agcaccacagugaaucc

SEQ ID NO: 1801465 - RNA, 19 nt, Homo sapiens
ucagaaguuuggauaaccu

SEQ ID NO: 1801466 - RNA, 17 nt, Homo sapiens
caggcaugcaccagugc

SEQ ID NO: 1801467 - RNA, 16 nt, Homo sapiens
ggcagaggccaugaag

SEQ ID NO: 1801468 - RNA, 18 nt, Homo sapiens
gugauccacccaccucag

SEQ ID NO: 1801469 - RNA, 20 nt, Homo sapiens
uaauggcagcuagugccuuu

SEQ ID NO: 1801470 - RNA, 22 nt, Homo sapiens
aaugaucagacuugauuuacaa

SEQ ID NO: 1801471 - RNA, 13 nt, Homo sapiens
uuuucaaggcauu

SEQ ID NO: 1801472 - RNA, 18 nt, Homo sapiens
aaaugcaaccauuuuuag

SEQ ID NO: 1801473 - RNA, 19 nt, Homo sapiens
ccucauugcugucuugccc

SEQ ID NO: 1801474 - RNA, 14 nt, Homo sapiens
guaaauaacaggca

SEQ ID NO: 1801475 - RNA, 14 nt, Homo sapiens
acuaacacaugcac

SEQ ID NO: 1801476 - RNA, 18 nt, Homo sapiens
gacucauccugaacagca

SEQ ID NO: 1801477 - RNA, 17 nt, Homo sapiens
uccaguguuugggauga

SEQ ID NO: 1801478 - RNA, 19 nt, Homo sapiens
accauugaccucagcugca

SEQ ID NO: 1801479 - RNA, 21 nt, Homo sapiens
cagggcuuuacuaucuuuuca

SEQ ID NO: 1801480 - RNA, 19 nt, Homo sapiens
cuccacaguuuugccuuaa

SEQ ID NO: 1801481 - RNA, 19 nt, Homo sapiens
gcucagaucucaugggaua

SEQ ID NO: 1801482 - RNA, 18 nt, Homo sapiens
ugaaacagaauacuguua

SEQ ID NO: 1801483 - RNA, 17 nt, Homo sapiens
aaacuccuguuucacuu

SEQ ID NO: 1801484 - RNA, 18 nt, Homo sapiens
cggaguucagacucucag

SEQ ID NO: 1801485 - RNA, 19 nt, Homo sapiens
ugcuggcccauaaacaccc

SEQ ID NO: 1801486 - RNA, 16 nt, Homo sapiens
uacugcagcaccucca

SEQ ID NO: 1801487 - RNA, 23 nt, Homo sapiens
aaugcuuaaaggggcuguggcug

SEQ ID NO: 1801488 - RNA, 22 nt, Homo sapiens
aaacaaacuuauucuacugaaa

SEQ ID NO: 1801489 - RNA, 15 nt, Homo sapiens
agacaugaaccacca

SEQ ID NO: 1801490 - RNA, 14 nt, Homo sapiens
cugcauuuguguca

SEQ ID NO: 1801491 - RNA, 19 nt, Homo sapiens
acuggagccccaucagcuc

SEQ ID NO: 1801492 - RNA, 17 nt, Homo sapiens
cugcugugcacauuuau

SEQ ID NO: 1801493 - RNA, 23 nt, Homo sapiens
gccuugcacaaaaagcacaagca

SEQ ID NO: 1801494 - RNA, 18 nt, Homo sapiens
ccaaagugcagggauuac

SEQ ID NO: 1801495 - RNA, 20 nt, Homo sapiens
augcucuucugaaggcugau

SEQ ID NO: 1801496 - RNA, 17 nt, Homo sapiens
agcugaaggcaguggca

SEQ ID NO: 1801497 - RNA, 14 nt, Homo sapiens
uccuauucuguugc

SEQ ID NO: 1801498 - RNA, 21 nt, Homo sapiens
uagguuuugauuuauaugugu

SEQ ID NO: 1801499 - RNA, 16 nt, Homo sapiens
agaagcauacaacuuu

SEQ ID NO: 1801500 - RNA, 22 nt, Homo sapiens
uggaaaagcaacuucauuugac

SEQ ID NO: 1801501 - RNA, 14 nt, Homo sapiens
gauguggugauacu

SEQ ID NO: 1801502 - RNA, 19 nt, Homo sapiens
ugggagucaggccugggca

SEQ ID NO: 1801503 - RNA, 22 nt, Homo sapiens
cccagagacauacuugaagggc

SEQ ID NO: 1801504 - RNA, 22 nt, Homo sapiens
auaaaucugaagugguucaguc

SEQ ID NO: 1801505 - RNA, 16 nt, Homo sapiens
uguagcaguaucucau

SEQ ID NO: 1801506 - RNA, 14 nt, Homo sapiens
gcuggccgcggugg

SEQ ID NO: 1801507 - RNA, 23 nt, Homo sapiens
cugugguugcagccugaccaaaa

SEQ ID NO: 1801508 - RNA, 21 nt, Homo sapiens
aguaaagaguacacucagcca

SEQ ID NO: 1801509 - RNA, 23 nt, Homo sapiens
cucuguauuuuuucuugcauuga

SEQ ID NO: 1801510 - RNA, 15 nt, Homo sapiens
aucucaauaacaaac

SEQ ID NO: 1801511 - RNA, 20 nt, Homo sapiens
ggggccugaaagcaacagcu

SEQ ID NO: 1801512 - RNA, 23 nt, Homo sapiens
gaaugguuguacguuuugcacau

SEQ ID NO: 1801513 - RNA, 17 nt, Homo sapiens
aauagauuaguacugga

SEQ ID NO: 1801514 - RNA, 15 nt, Homo sapiens
cagugcaaagauuug

SEQ ID NO: 1801515 - RNA, 19 nt, Homo sapiens
ccuguguauaaagccauua

SEQ ID NO: 1801516 - RNA, 12 nt, Homo sapiens
gugaucucaggg

SEQ ID NO: 1801517 - RNA, 20 nt, Homo sapiens
cggcuuucagggcagccccu

SEQ ID NO: 1801518 - RNA, 18 nt, Homo sapiens
ugcccuggugcauggccu

SEQ ID NO: 1801519 - RNA, 19 nt, Homo sapiens
ugagugaaauauuacucug

SEQ ID NO: 1801520 - RNA, 15 nt, Homo sapiens
ugacuuaggugugaa

SEQ ID NO: 1801521 - RNA, 18 nt, Homo sapiens
caccagaugugacagugu

SEQ ID NO: 1801522 - RNA, 15 nt, Homo sapiens
ggcaccuucauucuc

SEQ ID NO: 1801523 - RNA, 14 nt, Homo sapiens
cugauaaugcucac

SEQ ID NO: 1801524 - RNA, 15 nt, Homo sapiens
cuuaagagacuacag

SEQ ID NO: 1801525 - RNA, 20 nt, Homo sapiens
ugaaacgacucaaaaugaca

SEQ ID NO: 1801526 - RNA, 15 nt, Homo sapiens
aaucucuaccccuuu

SEQ ID NO: 1801527 - RNA, 20 nt, Homo sapiens
cagagggaaguuuaaaaccc

SEQ ID NO: 1801528 - RNA, 15 nt, Homo sapiens
cuucuguauucacuu

SEQ ID NO: 1801529 - RNA, 19 nt, Homo sapiens
uggcaucaucucagcucac

SEQ ID NO: 1801530 - RNA, 22 nt, Homo sapiens
ugacaacugugacuguacccaa

SEQ ID NO: 1801531 - RNA, 15 nt, Homo sapiens
cuuagaaaccaaauu

SEQ ID NO: 1801532 - RNA, 16 nt, Homo sapiens
uccagggacacacagc

SEQ ID NO: 1801533 - RNA, 14 nt, Homo sapiens
ccuaaccuagagau

SEQ ID NO: 1801534 - RNA, 17 nt, Homo sapiens
caggcaaagcaagugau

SEQ ID NO: 1801535 - RNA, 16 nt, Homo sapiens
uaagacagugcagugc

SEQ ID NO: 1801536 - RNA, 16 nt, Homo sapiens
caggcaaagauuucau

SEQ ID NO: 1801537 - RNA, 17 nt, Homo sapiens
gaugcagcuacuggaau

SEQ ID NO: 1801538 - RNA, 18 nt, Homo sapiens
auuuaaccuacuagacaa

SEQ ID NO: 1801539 - RNA, 23 nt, Homo sapiens
augccuauguacucuacgccaaa

SEQ ID NO: 1801540 - RNA, 14 nt, Homo sapiens
ccaggcgcugcaua

SEQ ID NO: 1801541 - RNA, 14 nt, Homo sapiens
caagacaagugauu

SEQ ID NO: 1801542 - RNA, 21 nt, Homo sapiens
ccugggcuucgucuacuccuu

SEQ ID NO: 1801543 - RNA, 15 nt, Homo sapiens
cuguucuuuccaaag

SEQ ID NO: 1801544 - RNA, 17 nt, Homo sapiens
aacucauuagacuggaa

SEQ ID NO: 1801545 - RNA, 13 nt, Homo sapiens
agauccucuggga

SEQ ID NO: 1801546 - RNA, 13 nt, Homo sapiens
ucugaugcaagca

SEQ ID NO: 1801547 - RNA, 17 nt, Homo sapiens
ucaaaugucgaugcuac

SEQ ID NO: 1801548 - RNA, 13 nt, Homo sapiens
aacccaaugccug

SEQ ID NO: 1801549 - RNA, 13 nt, Homo sapiens
ccagaaucccucu

SEQ ID NO: 1801550 - RNA, 13 nt, Homo sapiens
agaaccacugucu

SEQ ID NO: 1801551 - RNA, 20 nt, Homo sapiens
aucagaccacucccuucccc

SEQ ID NO: 1801552 - RNA, 16 nt, Homo sapiens
ugcaauuuccaacaca

SEQ ID NO: 1801553 - RNA, 13 nt, Homo sapiens
acacugaaaccaa

SEQ ID NO: 1801554 - RNA, 13 nt, Homo sapiens
aucaagaaauacu

SEQ ID NO: 1801555 - RNA, 21 nt, Homo sapiens
cucugauuugaaggcaaaaau

SEQ ID NO: 1801556 - RNA, 13 nt, Homo sapiens
ucaagaagaggaa

SEQ ID NO: 1801557 - RNA, 15 nt, Homo sapiens
auuccaucagcacaa

SEQ ID NO: 1801558 - RNA, 12 nt, Homo sapiens
ucucucucguuc

SEQ ID NO: 1801559 - RNA, 22 nt, Homo sapiens
uaaaccgaacugauguaaguaa

SEQ ID NO: 1801560 - RNA, 18 nt, Homo sapiens
gcugcccaaucauuugca

SEQ ID NO: 1801561 - RNA, 22 nt, Homo sapiens
uuuuauggcucacacagcuuaa

SEQ ID NO: 1801562 - RNA, 19 nt, Homo sapiens
ugauuuuguuuacugaaau

SEQ ID NO: 1801563 - RNA, 17 nt, Homo sapiens
aguuucuuuggccagaa

SEQ ID NO: 1801564 - RNA, 22 nt, Homo sapiens
auucugucuucauccccucaga

SEQ ID NO: 1801565 - RNA, 18 nt, Homo sapiens
ucaguagcugagugcacu

SEQ ID NO: 1801566 - RNA, 21 nt, Homo sapiens
gaagcccucggccuccagacu

SEQ ID NO: 1801567 - RNA, 22 nt, Homo sapiens
uugagaccuuugauuuuuugcc

SEQ ID NO: 1801568 - RNA, 14 nt, Homo sapiens
cagccugcucccua

SEQ ID NO: 1801569 - RNA, 23 nt, Homo sapiens
uggucauccgggaggacaaccag

SEQ ID NO: 1801570 - RNA, 17 nt, Homo sapiens
cagacccagccccggug

SEQ ID NO: 1801571 - RNA, 19 nt, Homo sapiens
ucucuuugauuauuugcau

SEQ ID NO: 1801572 - RNA, 19 nt, Homo sapiens
agugaggaacccugaucuc

SEQ ID NO: 1801573 - RNA, 12 nt, Homo sapiens
ugagggugcuga

SEQ ID NO: 1801574 - RNA, 22 nt, Homo sapiens
ucuggggcucagcccugagcua

SEQ ID NO: 1801575 - RNA, 20 nt, Homo sapiens
cuguaaggcaggcccauuca

SEQ ID NO: 1801576 - RNA, 18 nt, Homo sapiens
ccucucccugcugcuccu

SEQ ID NO: 1801577 - RNA, 12 nt, Homo sapiens
cugaaucuaccu

SEQ ID NO: 1801578 - RNA, 22 nt, Homo sapiens
ccaucaugcaaaauucuuucag

SEQ ID NO: 1801579 - RNA, 22 nt, Homo sapiens
acucaguaaaucagugcaguac

SEQ ID NO: 1801580 - RNA, 21 nt, Homo sapiens
ccaggcugcuggagugcagug

SEQ ID NO: 1801581 - RNA, 21 nt, Homo sapiens
uaucuucuguuucauaaugca

SEQ ID NO: 1801582 - RNA, 15 nt, Homo sapiens
aaucagaagcacaaa

SEQ ID NO: 1801583 - RNA, 15 nt, Homo sapiens
acugaagacucugca

SEQ ID NO: 1801584 - RNA, 21 nt, Homo sapiens
cacucuugaaaaaugcauguu

SEQ ID NO: 1801585 - RNA, 18 nt, Homo sapiens
ugccgccccggacagugg

SEQ ID NO: 1801586 - RNA, 19 nt, Homo sapiens
cccuuaguuuccacugccu

SEQ ID NO: 1801587 - RNA, 14 nt, Homo sapiens
ccucacucagucca

SEQ ID NO: 1801588 - RNA, 15 nt, Homo sapiens
auguuaagaguacua

SEQ ID NO: 1801589 - RNA, 15 nt, Homo sapiens
caaaagauucuacaa

SEQ ID NO: 1801590 - RNA, 23 nt, Homo sapiens
aggguggcaucaggagcugcuca

SEQ ID NO: 1801591 - RNA, 23 nt, Homo sapiens
auuugauuuuuuuuuuuaaucua

SEQ ID NO: 1801592 - RNA, 15 nt, Homo sapiens
uccaggguggaugau

SEQ ID NO: 1801593 - RNA, 16 nt, Homo sapiens
uuucccauguauugau

SEQ ID NO: 1801594 - RNA, 21 nt, Homo sapiens
acuuucgaccgacuuucccca

SEQ ID NO: 1801595 - RNA, 19 nt, Homo sapiens
cguaggauuuggggugaau

SEQ ID NO: 1801596 - RNA, 14 nt, Homo sapiens
caacagaacucccg

SEQ ID NO: 1801597 - RNA, 18 nt, Homo sapiens
acagcuaagaugccaugu

SEQ ID NO: 1801598 - RNA, 18 nt, Homo sapiens
caucacuuucauucaauu

SEQ ID NO: 1801599 - RNA, 22 nt, Homo sapiens
ucuaaacuaggauugacauucu

SEQ ID NO: 1801600 - RNA, 17 nt, Homo sapiens
auugacuuguauaccuu

SEQ ID NO: 1801601 - RNA, 12 nt, Homo sapiens
guuuaacauuca

SEQ ID NO: 1801602 - RNA, 20 nt, Homo sapiens
ccccacaacacaccuugccc

SEQ ID NO: 1801603 - RNA, 23 nt, Homo sapiens
aaauaguauuccaaucacugugc

SEQ ID NO: 1801604 - RNA, 15 nt, Homo sapiens
accaugcaauuccau

SEQ ID NO: 1801605 - RNA, 16 nt, Homo sapiens
gcaagggcugugcuga

SEQ ID NO: 1801606 - RNA, 14 nt, Homo sapiens
uguaagagugauuu

SEQ ID NO: 1801607 - RNA, 13 nt, Homo sapiens
ugaauacauuucc

SEQ ID NO: 1801608 - RNA, 19 nt, Homo sapiens
cucaaaguuuuauuauaaa

SEQ ID NO: 1801609 - RNA, 19 nt, Homo sapiens
uaaaagaaccgagcaauuu

SEQ ID NO: 1801610 - RNA, 16 nt, Homo sapiens
uaaacauuucuuucaa

SEQ ID NO: 1801611 - RNA, 15 nt, Homo sapiens
caguggacacucaga

SEQ ID NO: 1801612 - RNA, 20 nt, Homo sapiens
ccuaggauacccagaugcca

SEQ ID NO: 1801613 - RNA, 22 nt, Homo sapiens
ugcucuacgggugaugugauuc

SEQ ID NO: 1801614 - RNA, 14 nt, Homo sapiens
auuucaaagacuca

SEQ ID NO: 1801615 - RNA, 14 nt, Homo sapiens
cuugcaaagccuuu

SEQ ID NO: 1801616 - RNA, 18 nt, Homo sapiens
cagauagaugcaggucca

SEQ ID NO: 1801617 - RNA, 19 nt, Homo sapiens
aaguuaaaccaugugacua

SEQ ID NO: 1801618 - RNA, 15 nt, Homo sapiens
guagauuacugaaaa

SEQ ID NO: 1801619 - RNA, 20 nt, Homo sapiens
gcacauugguuuaagcccag

SEQ ID NO: 1801620 - RNA, 15 nt, Homo sapiens
caucccaucaucuug

SEQ ID NO: 1801621 - RNA, 14 nt, Homo sapiens
augccugcuugaua

SEQ ID NO: 1801622 - RNA, 13 nt, Homo sapiens
ugucuggggacag

SEQ ID NO: 1801623 - RNA, 23 nt, Homo sapiens
uaccauggguguggauggcagug

SEQ ID NO: 1801624 - RNA, 23 nt, Homo sapiens
aaaacugccccccuccuuuccaa

SEQ ID NO: 1801625 - RNA, 16 nt, Homo sapiens
cuggcuggacuggagg

SEQ ID NO: 1801626 - RNA, 21 nt, Homo sapiens
ggucucuuucuuuacucuggg

SEQ ID NO: 1801627 - RNA, 13 nt, Homo sapiens
uacuuggacaguu

SEQ ID NO: 1801628 - RNA, 16 nt, Homo sapiens
agguguuuguggggcu

SEQ ID NO: 1801629 - RNA, 20 nt, Homo sapiens
aaaauuauuuauuguuacag

SEQ ID NO: 1801630 - RNA, 12 nt, Homo sapiens
cuacugcuccug

SEQ ID NO: 1801631 - RNA, 17 nt, Homo sapiens
acguaauuguacaagca

SEQ ID NO: 1801632 - RNA, 20 nt, Homo sapiens
acaagguggugcuucugcca

SEQ ID NO: 1801633 - RNA, 23 nt, Homo sapiens
aucaucccaggggagaacuacau

SEQ ID NO: 1801634 - RNA, 19 nt, Homo sapiens
aaaggggacagaucuugag

SEQ ID NO: 1801635 - RNA, 16 nt, Homo sapiens
uucucguuuucacagg

SEQ ID NO: 1801636 - RNA, 16 nt, Homo sapiens
ccucuggaauggcuca

SEQ ID NO: 1801637 - RNA, 16 nt, Homo sapiens
agguagaacacugcua

SEQ ID NO: 1801638 - RNA, 14 nt, Homo sapiens
uaagaaaacuaaga

SEQ ID NO: 1801639 - RNA, 16 nt, Homo sapiens
ccuuuagcgggacuca

SEQ ID NO: 1801640 - RNA, 14 nt, Homo sapiens
cugagaaugaccug

SEQ ID NO: 1801641 - RNA, 19 nt, Homo sapiens
uaguguuuugcaagggaau

SEQ ID NO: 1801642 - RNA, 20 nt, Homo sapiens
auuguguugggaccugugau

SEQ ID NO: 1801643 - RNA, 20 nt, Homo sapiens
uaugaaaauauagacauucu

SEQ ID NO: 1801644 - RNA, 16 nt, Homo sapiens
guauuugcugccagac

SEQ ID NO: 1801645 - RNA, 14 nt, Homo sapiens
uggggaggcccaaa

SEQ ID NO: 1801646 - RNA, 20 nt, Homo sapiens
uggucucaaacuuguggccu

SEQ ID NO: 1801647 - RNA, 18 nt, Homo sapiens
aggcgauggggcaagaca

SEQ ID NO: 1801648 - RNA, 11 nt, Homo sapiens
aacauguuaag

SEQ ID NO: 1801649 - RNA, 11 nt, Homo sapiens
ucuuuuaccaa

SEQ ID NO: 1801650 - RNA, 14 nt, Homo sapiens
cauaacuagaguau

SEQ ID NO: 1801651 - RNA, 14 nt, Homo sapiens
gugagcuacuuugu

SEQ ID NO: 1801652 - RNA, 14 nt, Homo sapiens
gauagcuacagugu

SEQ ID NO: 1801653 - RNA, 16 nt, Homo sapiens
auccuaagucucuuac

SEQ ID NO: 1801654 - RNA, 19 nt, Homo sapiens
acaagucucaggggaccau

SEQ ID NO: 1801655 - RNA, 19 nt, Homo sapiens
ugacagcuagcagaucucu

SEQ ID NO: 1801656 - RNA, 15 nt, Homo sapiens
gccccauuccuugcg

SEQ ID NO: 1801657 - RNA, 11 nt, Homo sapiens
aaaucacuuga

SEQ ID NO: 1801658 - RNA, 20 nt, Homo sapiens
aucuuaaaugagaccaaagu

SEQ ID NO: 1801659 - RNA, 14 nt, Homo sapiens
ucacuauucccgac

SEQ ID NO: 1801660 - RNA, 14 nt, Homo sapiens
cccucccacaccca

SEQ ID NO: 1801661 - RNA, 16 nt, Homo sapiens
auggggcccuguccag

SEQ ID NO: 1801662 - RNA, 21 nt, Homo sapiens
cuccagggacagcaacuauca

SEQ ID NO: 1801663 - RNA, 15 nt, Homo sapiens
uggcccuucuuucag

SEQ ID NO: 1801664 - RNA, 19 nt, Homo sapiens
ucucagaguguuuugacca

SEQ ID NO: 1801665 - RNA, 13 nt, Homo sapiens
aguuaggugcuga

SEQ ID NO: 1801666 - RNA, 14 nt, Homo sapiens
gggccugcccagug

SEQ ID NO: 1801667 - RNA, 17 nt, Homo sapiens
uuaccucucugggaccu

SEQ ID NO: 1801668 - RNA, 17 nt, Homo sapiens
agugccauuacuacugu

SEQ ID NO: 1801669 - RNA, 14 nt, Homo sapiens
gcuguggaagccag

SEQ ID NO: 1801670 - RNA, 14 nt, Homo sapiens
gcgugcaugugcac

SEQ ID NO: 1801671 - RNA, 22 nt, Homo sapiens
cacccugguucccaccauuccc

SEQ ID NO: 1801672 - RNA, 22 nt, Homo sapiens
uucuagagcuuagcauaucuga

SEQ ID NO: 1801673 - RNA, 17 nt, Homo sapiens
ugaaaucaacucucuuc

SEQ ID NO: 1801674 - RNA, 16 nt, Homo sapiens
uaucaguagugccuuu

SEQ ID NO: 1801675 - RNA, 16 nt, Homo sapiens
uucaguuguacuucca

SEQ ID NO: 1801676 - RNA, 20 nt, Homo sapiens
uucacacacacucugaagaa

SEQ ID NO: 1801677 - RNA, 16 nt, Homo sapiens
aauaaaaugagcaaaa

SEQ ID NO: 1801678 - RNA, 21 nt, Homo sapiens
ucuacugucuggaagacaugu

SEQ ID NO: 1801679 - RNA, 21 nt, Homo sapiens
cuuucaugaguuucccagaga

SEQ ID NO: 1801680 - RNA, 16 nt, Homo sapiens
uacuaaaacacugaaa

SEQ ID NO: 1801681 - RNA, 23 nt, Homo sapiens
auggaaccuccuuucucuucucu

SEQ ID NO: 1801682 - RNA, 13 nt, Homo sapiens
agguguugucaag

SEQ ID NO: 1801683 - RNA, 19 nt, Homo sapiens
ucucaaacucccgaccuca

SEQ ID NO: 1801684 - RNA, 21 nt, Homo sapiens
uguacagaaaguaucacaaau

SEQ ID NO: 1801685 - RNA, 20 nt, Homo sapiens
auuggauuuguccaaacagg

SEQ ID NO: 1801686 - RNA, 19 nt, Homo sapiens
ggcagcaaggucauggucu

SEQ ID NO: 1801687 - RNA, 14 nt, Homo sapiens
auaacuacuuccau

SEQ ID NO: 1801688 - RNA, 15 nt, Homo sapiens
agggcgaaggccauu

SEQ ID NO: 1801689 - RNA, 15 nt, Homo sapiens
gaugaugccucauga

SEQ ID NO: 1801690 - RNA, 16 nt, Homo sapiens
acuagaucucccuuaa

SEQ ID NO: 1801691 - RNA, 14 nt, Homo sapiens
aucuguucaguguu

SEQ ID NO: 1801692 - RNA, 16 nt, Homo sapiens
acuacaaagcuucuau

SEQ ID NO: 1801693 - RNA, 16 nt, Homo sapiens
augucagugugacuga

SEQ ID NO: 1801694 - RNA, 18 nt, Homo sapiens
uggcugcaagagcccaga

SEQ ID NO: 1801695 - RNA, 15 nt, Homo sapiens
uugaugaguguaaca

SEQ ID NO: 1801696 - RNA, 18 nt, Homo sapiens
uauucaagugaaugggga

SEQ ID NO: 1801697 - RNA, 11 nt, Homo sapiens
aaagacugcag

SEQ ID NO: 1801698 - RNA, 15 nt, Homo sapiens
acuacuggcaauuug

SEQ ID NO: 1801699 - RNA, 21 nt, Homo sapiens
caccuaggucgccagugaaau

SEQ ID NO: 1801700 - RNA, 19 nt, Homo sapiens
ugucauauuuuccuuuaug

SEQ ID NO: 1801701 - RNA, 21 nt, Homo sapiens
acucuuauagaaaguucaaaa

SEQ ID NO: 1801702 - RNA, 17 nt, Homo sapiens
gccagccagugccauuc

SEQ ID NO: 1801703 - RNA, 22 nt, Homo sapiens
cuaaccagauggaacacuggaa

SEQ ID NO: 1801704 - RNA, 21 nt, Homo sapiens
uaaauaagcccagugcugcug

SEQ ID NO: 1801705 - RNA, 13 nt, Homo sapiens
gcuuucaguauua

SEQ ID NO: 1801706 - RNA, 16 nt, Homo sapiens
gcagggaacaugggga

SEQ ID NO: 1801707 - RNA, 20 nt, Homo sapiens
uacagagauuacuuugcugc

SEQ ID NO: 1801708 - RNA, 14 nt, Homo sapiens
gcuugcacacuucc

SEQ ID NO: 1801709 - RNA, 19 nt, Homo sapiens
ggcaguuuuagcagcacuu

SEQ ID NO: 1801710 - RNA, 16 nt, Homo sapiens
agcugggcauggugcg

SEQ ID NO: 1801711 - RNA, 19 nt, Homo sapiens
uucaacuaguaccacagaa

SEQ ID NO: 1801712 - RNA, 14 nt, Homo sapiens
ccuuuuaaaacaau

SEQ ID NO: 1801713 - RNA, 14 nt, Homo sapiens
cucuuggcagucac

SEQ ID NO: 1801714 - RNA, 12 nt, Homo sapiens
gggaacuggcag

SEQ ID NO: 1801715 - RNA, 15 nt, Homo sapiens
augaauagacuaucu

SEQ ID NO: 1801716 - RNA, 17 nt, Homo sapiens
cgggggaggcccgcaga

SEQ ID NO: 1801717 - RNA, 10 nt, Homo sapiens
uacugugaug

SEQ ID NO: 1801718 - RNA, 10 nt, Homo sapiens
agcugugaaa

SEQ ID NO: 1801719 - RNA, 21 nt, Homo sapiens
aguccaucaaguaccucaucu

SEQ ID NO: 1801720 - RNA, 21 nt, Homo sapiens
cuugccugcaugaaacauguu

SEQ ID NO: 1801721 - RNA, 17 nt, Homo sapiens
uugggccagcuuuucaa

SEQ ID NO: 1801722 - RNA, 15 nt, Homo sapiens
ccuuccuccucucaa

SEQ ID NO: 1801723 - RNA, 12 nt, Homo sapiens
cuccccaacagc

SEQ ID NO: 1801724 - RNA, 17 nt, Homo sapiens
cugggaaggagggagcu

SEQ ID NO: 1801725 - RNA, 21 nt, Homo sapiens
ucuuacgcucugcucaaugaa

SEQ ID NO: 1801726 - RNA, 17 nt, Homo sapiens
acccaagagaguggaag

SEQ ID NO: 1801727 - RNA, 12 nt, Homo sapiens
acaaaauugcag

SEQ ID NO: 1801728 - RNA, 15 nt, Homo sapiens
agaaauacacaggga

SEQ ID NO: 1801729 - RNA, 22 nt, Homo sapiens
aaaaucaucuuggccacuuuaa

SEQ ID NO: 1801730 - RNA, 18 nt, Homo sapiens
accacagggucugcacuc

SEQ ID NO: 1801731 - RNA, 16 nt, Homo sapiens
gaauucauuucacugu

SEQ ID NO: 1801732 - RNA, 20 nt, Homo sapiens
aggacaaacagugaauuuaa

SEQ ID NO: 1801733 - RNA, 20 nt, Homo sapiens
cacacggaugcacagagaua

SEQ ID NO: 1801734 - RNA, 12 nt, Homo sapiens
ucaaccccauga

SEQ ID NO: 1801735 - RNA, 18 nt, Homo sapiens
uauguuggggcccugugc

SEQ ID NO: 1801736 - RNA, 23 nt, Homo sapiens
gcugcuuucgaauaaagugaaua

SEQ ID NO: 1801737 - RNA, 22 nt, Homo sapiens
gaaaacaaugcugagaaugaga

SEQ ID NO: 1801738 - RNA, 15 nt, Homo sapiens
cgcacacacagugau

SEQ ID NO: 1801739 - RNA, 13 nt, Homo sapiens
uucugucuuccua

SEQ ID NO: 1801740 - RNA, 20 nt, Homo sapiens
aaauagagcaaccaguacua

SEQ ID NO: 1801741 - RNA, 21 nt, Homo sapiens
ccaaagagccuuuccaaagag

SEQ ID NO: 1801742 - RNA, 21 nt, Homo sapiens
uguaaaauuuauuuauauucc

SEQ ID NO: 1801743 - RNA, 14 nt, Homo sapiens
uaaugaaugcuuaa

SEQ ID NO: 1801744 - RNA, 18 nt, Homo sapiens
cuuuuuuucuuguaugca

SEQ ID NO: 1801745 - RNA, 13 nt, Homo sapiens
ugauucacaauga

SEQ ID NO: 1801746 - RNA, 18 nt, Homo sapiens
agaauggcuuuggucucu

SEQ ID NO: 1801747 - RNA, 20 nt, Homo sapiens
gcuagaguuuuaacuuuuaa

SEQ ID NO: 1801748 - RNA, 22 nt, Homo sapiens
gagucuccaacggcaagggaac

SEQ ID NO: 1801749 - RNA, 18 nt, Homo sapiens
gagacaccacaaggcagc

SEQ ID NO: 1801750 - RNA, 17 nt, Homo sapiens
gucagggaccugcugcu

SEQ ID NO: 1801751 - RNA, 23 nt, Homo sapiens
ccugcauuugugucauugacaaa

SEQ ID NO: 1801752 - RNA, 21 nt, Homo sapiens
agacuauggauguguucucua

SEQ ID NO: 1801753 - RNA, 21 nt, Homo sapiens
agaauguccaaugguaggaau

SEQ ID NO: 1801754 - RNA, 17 nt, Homo sapiens
acauugauuggcauauu

SEQ ID NO: 1801755 - RNA, 19 nt, Homo sapiens
acacauuggaauugauguc

SEQ ID NO: 1801756 - RNA, 22 nt, Homo sapiens
aucuugugguaacuugcugcuu

SEQ ID NO: 1801757 - RNA, 23 nt, Homo sapiens
auuugaauucaauucugauucca

SEQ ID NO: 1801758 - RNA, 23 nt, Homo sapiens
gaauuggccugaacagauguaaa

SEQ ID NO: 1801759 - RNA, 16 nt, Homo sapiens
guccugauggcccaaa

SEQ ID NO: 1801760 - RNA, 17 nt, Homo sapiens
ugcuuuugaaaaguuga

SEQ ID NO: 1801761 - RNA, 19 nt, Homo sapiens
ugggugagaacaaccaaaa

SEQ ID NO: 1801762 - RNA, 21 nt, Homo sapiens
gagcccgcucugcacagggau

SEQ ID NO: 1801763 - RNA, 20 nt, Homo sapiens
cccugagccccauacagggc

SEQ ID NO: 1801764 - RNA, 19 nt, Homo sapiens
cuuguauagcuuuuaucug

SEQ ID NO: 1801765 - RNA, 13 nt, Homo sapiens
uuucaucaucccc

SEQ ID NO: 1801766 - RNA, 15 nt, Homo sapiens
uuuugugugugucua

SEQ ID NO: 1801767 - RNA, 14 nt, Homo sapiens
gaccaggggaccag

SEQ ID NO: 1801768 - RNA, 23 nt, Homo sapiens
auuacagguuggaucucacaaau

SEQ ID NO: 1801769 - RNA, 15 nt, Homo sapiens
agucaagauuuccau

SEQ ID NO: 1801770 - RNA, 15 nt, Homo sapiens
ugcaaauaaucacag

SEQ ID NO: 1801771 - RNA, 15 nt, Homo sapiens
aacaacuuguagcag

SEQ ID NO: 1801772 - RNA, 21 nt, Homo sapiens
uaaaugaagaaaaguauugca

SEQ ID NO: 1801773 - RNA, 19 nt, Homo sapiens
cauaaaauguaucuuccau

SEQ ID NO: 1801774 - RNA, 21 nt, Homo sapiens
cagugagucgagauugcacug

SEQ ID NO: 1801775 - RNA, 20 nt, Homo sapiens
cagagggcguguuguuuuac

SEQ ID NO: 1801776 - RNA, 16 nt, Homo sapiens
gaaacuuaauuacauc

SEQ ID NO: 1801777 - RNA, 21 nt, Homo sapiens
aacuacauuucuacuaugauc

SEQ ID NO: 1801778 - RNA, 21 nt, Homo sapiens
acuuuguaaaaggacucuucc

SEQ ID NO: 1801779 - RNA, 18 nt, Homo sapiens
uuuguuccccaagacauu

SEQ ID NO: 1801780 - RNA, 14 nt, Homo sapiens
augacacuuguccc

SEQ ID NO: 1801781 - RNA, 15 nt, Homo sapiens
gaagucaugcguuua

SEQ ID NO: 1801782 - RNA, 17 nt, Homo sapiens
aguauaaguauucaagu

SEQ ID NO: 1801783 - RNA, 22 nt, Homo sapiens
uaaauauuaaccugaauuauuc

SEQ ID NO: 1801784 - RNA, 21 nt, Homo sapiens
gauuuuuacacauguaucuau

SEQ ID NO: 1801785 - RNA, 21 nt, Homo sapiens
uagugaaaaaugucacuauau

SEQ ID NO: 1801786 - RNA, 19 nt, Homo sapiens
cgacguuugacuagccauc

SEQ ID NO: 1801787 - RNA, 19 nt, Homo sapiens
gggucucacaguguugccc

SEQ ID NO: 1801788 - RNA, 13 nt, Homo sapiens
ugacauuccaggg

SEQ ID NO: 1801789 - RNA, 17 nt, Homo sapiens
cagucuuuuguccugca

SEQ ID NO: 1801790 - RNA, 19 nt, Homo sapiens
auaaaauuaacugguggca

SEQ ID NO: 1801791 - RNA, 16 nt, Homo sapiens
cucugauccgagcuca

SEQ ID NO: 1801792 - RNA, 13 nt, Homo sapiens
ucuguugccaguc

SEQ ID NO: 1801793 - RNA, 13 nt, Homo sapiens
ugcucacacaauc

SEQ ID NO: 1801794 - RNA, 18 nt, Homo sapiens
uccccauaguaaugagug

SEQ ID NO: 1801795 - RNA, 20 nt, Homo sapiens
agaaguggugacauuuugca

SEQ ID NO: 1801796 - RNA, 15 nt, Homo sapiens
ugcccgagagcucuu

SEQ ID NO: 1801797 - RNA, 12 nt, Homo sapiens
uaaacaugucac

SEQ ID NO: 1801798 - RNA, 12 nt, Homo sapiens
aaaccaugacaa

SEQ ID NO: 1801799 - RNA, 16 nt, Homo sapiens
caaaauccaacuaaug

SEQ ID NO: 1801800 - RNA, 15 nt, Homo sapiens
augucaggguucugc

SEQ ID NO: 1801801 - RNA, 12 nt, Homo sapiens
ggccauguauua

SEQ ID NO: 1801802 - RNA, 12 nt, Homo sapiens
gugcugcaccug

SEQ ID NO: 1801803 - RNA, 20 nt, Homo sapiens
ucuaaagauggaaaaaccac

SEQ ID NO: 1801804 - RNA, 22 nt, Homo sapiens
uggagccgagcggggagccagg

SEQ ID NO: 1801805 - RNA, 17 nt, Homo sapiens
aaguggucuuaagaaau

SEQ ID NO: 1801806 - RNA, 24 nt, Homo sapiens
agcugccuaggauguucugggcua

SEQ ID NO: 1801807 - RNA, 15 nt, Homo sapiens
cauaaauacugucaa

SEQ ID NO: 1801808 - RNA, 19 nt, Homo sapiens
gacaaggucuugcuauguu

SEQ ID NO: 1801809 - RNA, 22 nt, Homo sapiens
gugaugacauucccugcuaaua

SEQ ID NO: 1801810 - RNA, 18 nt, Homo sapiens
cugguauuuaucugcaag

SEQ ID NO: 1801811 - RNA, 21 nt, Homo sapiens
aauuuucuagauuuucuacuu

SEQ ID NO: 1801812 - RNA, 16 nt, Homo sapiens
aguguucacauggcuc

SEQ ID NO: 1801813 - RNA, 14 nt, Homo sapiens
uuguuaccacagag

SEQ ID NO: 1801814 - RNA, 20 nt, Homo sapiens
gguuccuguuugaacccagg

SEQ ID NO: 1801815 - RNA, 18 nt, Homo sapiens
gucuccagucaucuguaa

SEQ ID NO: 1801816 - RNA, 22 nt, Homo sapiens
gcacagaucugcuugaucaauu

SEQ ID NO: 1801817 - RNA, 23 nt, Homo sapiens
aaaagaaaaucuuuaggcuuuca

SEQ ID NO: 1801818 - RNA, 13 nt, Homo sapiens
aaauauacauuca

SEQ ID NO: 1801819 - RNA, 13 nt, Homo sapiens
acuuuaagcacua

SEQ ID NO: 1801820 - RNA, 18 nt, Homo sapiens
ucaaacucgcagcaguaa

SEQ ID NO: 1801821 - RNA, 17 nt, Homo sapiens
aggaugucuaaauguuu

SEQ ID NO: 1801822 - RNA, 23 nt, Homo sapiens
cauggcacucccuccagcacaaa

SEQ ID NO: 1801823 - RNA, 21 nt, Homo sapiens
ugcacacugccuggcccaaaa

SEQ ID NO: 1801824 - RNA, 16 nt, Homo sapiens
cacuggguucugcuac

SEQ ID NO: 1801825 - RNA, 20 nt, Homo sapiens
agacacuggcguuacugcuu

SEQ ID NO: 1801826 - RNA, 11 nt, Homo sapiens
ccucagggugg

SEQ ID NO: 1801827 - RNA, 14 nt, Homo sapiens
ucucgagaggcaau

SEQ ID NO: 1801828 - RNA, 14 nt, Homo sapiens
gcagggcccugugg

SEQ ID NO: 1801829 - RNA, 17 nt, Homo sapiens
aagaaauuuuaugaagu

SEQ ID NO: 1801830 - RNA, 20 nt, Homo sapiens
uguguuuuuaauaaagacag

SEQ ID NO: 1801831 - RNA, 18 nt, Homo sapiens
ccuuaaaugcuacugaaa

SEQ ID NO: 1801832 - RNA, 18 nt, Homo sapiens
auauauauuauauauauc

SEQ ID NO: 1801833 - RNA, 18 nt, Homo sapiens
ucucugcuugcuuggccc

SEQ ID NO: 1801834 - RNA, 15 nt, Homo sapiens
uucuaggcaucccag

SEQ ID NO: 1801835 - RNA, 15 nt, Homo sapiens
accccagcuccuagg

SEQ ID NO: 1801836 - RNA, 13 nt, Homo sapiens
aggcaacugcauu

SEQ ID NO: 1801837 - RNA, 17 nt, Homo sapiens
acccucaagacaaauga

SEQ ID NO: 1801838 - RNA, 17 nt, Homo sapiens
aacugaacgacaaagca

SEQ ID NO: 1801839 - RNA, 21 nt, Homo sapiens
aaucugaggcauccucugacu

SEQ ID NO: 1801840 - RNA, 14 nt, Homo sapiens
agugcccugagcca

SEQ ID NO: 1801841 - RNA, 15 nt, Homo sapiens
ccucccgaacacuga

SEQ ID NO: 1801842 - RNA, 22 nt, Homo sapiens
accacuuucccacacugugaac

SEQ ID NO: 1801843 - RNA, 15 nt, Homo sapiens
ugugaaucaauccug

SEQ ID NO: 1801844 - RNA, 15 nt, Homo sapiens
uucaagggaccucuc

SEQ ID NO: 1801845 - RNA, 18 nt, Homo sapiens
accacuuuggagcacugu

SEQ ID NO: 1801846 - RNA, 18 nt, Homo sapiens
cugucgguggcugccuuu

SEQ ID NO: 1801847 - RNA, 15 nt, Homo sapiens
aaccucuguucccca

SEQ ID NO: 1801848 - RNA, 18 nt, Homo sapiens
aguccaucuaacaucaua

SEQ ID NO: 1801849 - RNA, 22 nt, Homo sapiens
cuuaggaacagcucuucacuca

SEQ ID NO: 1801850 - RNA, 20 nt, Homo sapiens
guugucuacauuaaaucacu

SEQ ID NO: 1801851 - RNA, 12 nt, Homo sapiens
aaaagcugcaua

SEQ ID NO: 1801852 - RNA, 12 nt, Homo sapiens
auuugcugcuau

SEQ ID NO: 1801853 - RNA, 22 nt, Homo sapiens
ugauauuuaacuuuuugccaaa

SEQ ID NO: 1801854 - RNA, 22 nt, Homo sapiens
agccguuuguuccccaagacau

SEQ ID NO: 1801855 - RNA, 16 nt, Homo sapiens
cacaaaccaagccaug

SEQ ID NO: 1801856 - RNA, 21 nt, Homo sapiens
aucauguuuucccuaugagca

SEQ ID NO: 1801857 - RNA, 19 nt, Homo sapiens
aagcuggguuugauucaaa

SEQ ID NO: 1801858 - RNA, 17 nt, Homo sapiens
aucucggcuuauggcaa

SEQ ID NO: 1801859 - RNA, 21 nt, Homo sapiens
guauuuuacuuugugcaauau

SEQ ID NO: 1801860 - RNA, 15 nt, Homo sapiens
caacucauuuuuaca

SEQ ID NO: 1801861 - RNA, 21 nt, Homo sapiens
ucugacucauccccacagcug

SEQ ID NO: 1801862 - RNA, 17 nt, Homo sapiens
uuaaggaaggcacuaaa

SEQ ID NO: 1801863 - RNA, 14 nt, Homo sapiens
gucagcacuaccuc

SEQ ID NO: 1801864 - RNA, 18 nt, Homo sapiens
ucaaaagccagaugugaa

SEQ ID NO: 1801865 - RNA, 18 nt, Homo sapiens
cuaucuaucuuccaaaug

SEQ ID NO: 1801866 - RNA, 16 nt, Homo sapiens
uagcucaaucugcaaa

SEQ ID NO: 1801867 - RNA, 22 nt, Homo sapiens
acagggugugguaugagggggu

SEQ ID NO: 1801868 - RNA, 17 nt, Homo sapiens
gucugucucagcucaac

SEQ ID NO: 1801869 - RNA, 18 nt, Homo sapiens
gcaccagagggauaaaaa

SEQ ID NO: 1801870 - RNA, 23 nt, Homo sapiens
acaucuaagaaaauuuacuguaa

SEQ ID NO: 1801871 - RNA, 22 nt, Homo sapiens
ugggagauggaggcgggaaaau

SEQ ID NO: 1801872 - RNA, 20 nt, Homo sapiens
ugugggaccugcuccaggcu

SEQ ID NO: 1801873 - RNA, 14 nt, Homo sapiens
agcuauauccaugu

SEQ ID NO: 1801874 - RNA, 14 nt, Homo sapiens
caguguggccucuu

SEQ ID NO: 1801875 - RNA, 21 nt, Homo sapiens
auaaaaguuaauaacagcucc

SEQ ID NO: 1801876 - RNA, 18 nt, Homo sapiens
ugaaauuucuuguucaua

SEQ ID NO: 1801877 - RNA, 15 nt, Homo sapiens
gguuuagaaugcugc

SEQ ID NO: 1801878 - RNA, 21 nt, Homo sapiens
auaaacaacuaaauaacugua

SEQ ID NO: 1801879 - RNA, 18 nt, Homo sapiens
gucuucugccagcccauu

SEQ ID NO: 1801880 - RNA, 16 nt, Homo sapiens
ugcuaugguuugccau

SEQ ID NO: 1801881 - RNA, 19 nt, Homo sapiens
gauuaagauacacuccugc

SEQ ID NO: 1801882 - RNA, 18 nt, Homo sapiens
caaauaccagagcacaga

SEQ ID NO: 1801883 - RNA, 20 nt, Homo sapiens
ucucagaccggcaacaucag

SEQ ID NO: 1801884 - RNA, 19 nt, Homo sapiens
aguucuacauuauucuuca

SEQ ID NO: 1801885 - RNA, 23 nt, Homo sapiens
aaacugagucacucacauugaga

SEQ ID NO: 1801886 - RNA, 16 nt, Homo sapiens
acauuaguauagucuc

SEQ ID NO: 1801887 - RNA, 18 nt, Homo sapiens
cugaguagcugagacuac

SEQ ID NO: 1801888 - RNA, 16 nt, Homo sapiens
uucccccacuugggag

SEQ ID NO: 1801889 - RNA, 22 nt, Homo sapiens
agaggccuggagcccacaaccu

SEQ ID NO: 1801890 - RNA, 16 nt, Homo sapiens
ggguuaaaucaaagau

SEQ ID NO: 1801891 - RNA, 14 nt, Homo sapiens
aucucaagugccau

SEQ ID NO: 1801892 - RNA, 17 nt, Homo sapiens
augaauaaacugaauau

SEQ ID NO: 1801893 - RNA, 12 nt, Homo sapiens
ucuacuaccugu

SEQ ID NO: 1801894 - RNA, 11 nt, Homo sapiens
uacacauauaa

SEQ ID NO: 1801895 - RNA, 18 nt, Homo sapiens
ugugccuuugcaaaucag

SEQ ID NO: 1801896 - RNA, 14 nt, Homo sapiens
gccacuguaggggu

SEQ ID NO: 1801897 - RNA, 17 nt, Homo sapiens
accaaagcaaucauuaa

SEQ ID NO: 1801898 - RNA, 14 nt, Homo sapiens
ucccucuaaugaga

SEQ ID NO: 1801899 - RNA, 17 nt, Homo sapiens
ucuauuuaagugcaauu

SEQ ID NO: 1801900 - RNA, 13 nt, Homo sapiens
ggaauaagcauuc

SEQ ID NO: 1801901 - RNA, 15 nt, Homo sapiens
acccaucucaacagg

SEQ ID NO: 1801902 - RNA, 14 nt, Homo sapiens
acccuaggugcuca

SEQ ID NO: 1801903 - RNA, 15 nt, Homo sapiens
uggagaauugacuga

SEQ ID NO: 1801904 - RNA, 15 nt, Homo sapiens
aaaaggguaagcuag

SEQ ID NO: 1801905 - RNA, 13 nt, Homo sapiens
gcacuucauaucu

SEQ ID NO: 1801906 - RNA, 22 nt, Homo sapiens
ugaguuaaaucaguaaucuguc

SEQ ID NO: 1801907 - RNA, 20 nt, Homo sapiens
gauacccaggaccaagccac

SEQ ID NO: 1801908 - RNA, 22 nt, Homo sapiens
uugcugaccauuuuggauguca

SEQ ID NO: 1801909 - RNA, 20 nt, Homo sapiens
gugaaaccccgucuguacua

SEQ ID NO: 1801910 - RNA, 14 nt, Homo sapiens
agauacuagcuauc

SEQ ID NO: 1801911 - RNA, 15 nt, Homo sapiens
cuggucgccuuccac

SEQ ID NO: 1801912 - RNA, 20 nt, Homo sapiens
ucauggcaucauugcauucc

SEQ ID NO: 1801913 - RNA, 15 nt, Homo sapiens
acccauaacuaccag

SEQ ID NO: 1801914 - RNA, 16 nt, Homo sapiens
agagucccugccugga

SEQ ID NO: 1801915 - RNA, 20 nt, Homo sapiens
aauaacaucaacaacacagc

SEQ ID NO: 1801916 - RNA, 22 nt, Homo sapiens
agugaaggucaugcaugccaau

SEQ ID NO: 1801917 - RNA, 23 nt, Homo sapiens
ugcaaauucaguaguaacagagu

SEQ ID NO: 1801918 - RNA, 23 nt, Homo sapiens
ucguggggggagguggacagucc

SEQ ID NO: 1801919 - RNA, 17 nt, Homo sapiens
ggggucuguguggugcc

SEQ ID NO: 1801920 - RNA, 22 nt, Homo sapiens
aaaggcuaagcuucacuguaaa

SEQ ID NO: 1801921 - RNA, 17 nt, Homo sapiens
aagacucugagccaagg

SEQ ID NO: 1801922 - RNA, 17 nt, Homo sapiens
acuuuugaaaagcuuuu

SEQ ID NO: 1801923 - RNA, 19 nt, Homo sapiens
ugaaaagauuauuggaaag

SEQ ID NO: 1801924 - RNA, 21 nt, Homo sapiens
ggaagggaguuggugugcuau

SEQ ID NO: 1801925 - RNA, 21 nt, Homo sapiens
gauauugaugauaacacuuaa

SEQ ID NO: 1801926 - RNA, 21 nt, Homo sapiens
gauaucaugccccuguacucc

SEQ ID NO: 1801927 - RNA, 18 nt, Homo sapiens
acaaucaugaacagcucu

SEQ ID NO: 1801928 - RNA, 18 nt, Homo sapiens
gacacccaugccagagag

SEQ ID NO: 1801929 - RNA, 16 nt, Homo sapiens
gguggaaggcagacag

SEQ ID NO: 1801930 - RNA, 17 nt, Homo sapiens
aaugcugcuuccacuca

SEQ ID NO: 1801931 - RNA, 15 nt, Homo sapiens
ccgcuuuucugccac

SEQ ID NO: 1801932 - RNA, 12 nt, Homo sapiens
aggaguccaggc

SEQ ID NO: 1801933 - RNA, 14 nt, Homo sapiens
cuaaaguacuggga

SEQ ID NO: 1801934 - RNA, 15 nt, Homo sapiens
caucugcgaacccaa

SEQ ID NO: 1801935 - RNA, 16 nt, Homo sapiens
accaauaugaacugca

SEQ ID NO: 1801936 - RNA, 12 nt, Homo sapiens
ccaggugcucag

SEQ ID NO: 1801937 - RNA, 18 nt, Homo sapiens
agugaaaucugugcaaua

SEQ ID NO: 1801938 - RNA, 13 nt, Homo sapiens
cccacgcccucau

SEQ ID NO: 1801939 - RNA, 14 nt, Homo sapiens
ucugauccauccau

SEQ ID NO: 1801940 - RNA, 19 nt, Homo sapiens
cuucuaauuagaucaauua

SEQ ID NO: 1801941 - RNA, 23 nt, Homo sapiens
acauauuccugguguagcacuua

SEQ ID NO: 1801942 - RNA, 14 nt, Homo sapiens
ucucuccuacuguu

SEQ ID NO: 1801943 - RNA, 21 nt, Homo sapiens
cugagguuuagaugugcaacc

SEQ ID NO: 1801944 - RNA, 23 nt, Homo sapiens
auccaccgccacugggccuguca

SEQ ID NO: 1801945 - RNA, 14 nt, Homo sapiens
ccaucuaugagcug

SEQ ID NO: 1801946 - RNA, 13 nt, Homo sapiens
uugagccucagaa

SEQ ID NO: 1801947 - RNA, 12 nt, Homo sapiens
caggcaggccac

SEQ ID NO: 1801948 - RNA, 13 nt, Homo sapiens
uaaggugaaauuu

SEQ ID NO: 1801949 - RNA, 20 nt, Homo sapiens
uacucuggagagacugugcu

SEQ ID NO: 1801950 - RNA, 17 nt, Homo sapiens
ugcaauuggggaagaaa

SEQ ID NO: 1801951 - RNA, 15 nt, Homo sapiens
gaacauacacuguga

SEQ ID NO: 1801952 - RNA, 13 nt, Homo sapiens
uuagcaaggcaga

SEQ ID NO: 1801953 - RNA, 21 nt, Homo sapiens
aacaaugccuuguuguauucc

SEQ ID NO: 1801954 - RNA, 16 nt, Homo sapiens
gccuggacgcagccac

SEQ ID NO: 1801955 - RNA, 14 nt, Homo sapiens
ggcuggagugggcu

SEQ ID NO: 1801956 - RNA, 13 nt, Homo sapiens
uauuauguucaau

SEQ ID NO: 1801957 - RNA, 22 nt, Homo sapiens
uaccugccagauaaccaaguga

SEQ ID NO: 1801958 - RNA, 13 nt, Homo sapiens
uaaauacauaugg

SEQ ID NO: 1801959 - RNA, 13 nt, Homo sapiens
uaaguacauauag

SEQ ID NO: 1801960 - RNA, 18 nt, Homo sapiens
uagcauucauauuuucca

SEQ ID NO: 1801961 - RNA, 16 nt, Homo sapiens
cugaauaaauaccucu

SEQ ID NO: 1801962 - RNA, 18 nt, Homo sapiens
agccuacugccucuccag

SEQ ID NO: 1801963 - RNA, 16 nt, Homo sapiens
acuccaccucuaccaa

SEQ ID NO: 1801964 - RNA, 17 nt, Homo sapiens
ccuaacuggcuuacuuc

SEQ ID NO: 1801965 - RNA, 17 nt, Homo sapiens
ugaaccagugauccaug

SEQ ID NO: 1801966 - RNA, 14 nt, Homo sapiens
gaaauauucacaag

SEQ ID NO: 1801967 - RNA, 13 nt, Homo sapiens
ccaugcccggcua

SEQ ID NO: 1801968 - RNA, 14 nt, Homo sapiens
aagaaguuacuuuu

SEQ ID NO: 1801969 - RNA, 14 nt, Homo sapiens
aacaggcacuuuga

SEQ ID NO: 1801970 - RNA, 22 nt, Homo sapiens
agauucccuugcacuguaucau

SEQ ID NO: 1801971 - RNA, 16 nt, Homo sapiens
auacacaagugcacag

SEQ ID NO: 1801972 - RNA, 22 nt, Homo sapiens
uacuuggcugcuuccugugaca

SEQ ID NO: 1801973 - RNA, 12 nt, Homo sapiens
uaaauguaagaa

SEQ ID NO: 1801974 - RNA, 18 nt, Homo sapiens
aggccacaggagacauua

SEQ ID NO: 1801975 - RNA, 21 nt, Homo sapiens
cugauguguucucugaucugc

SEQ ID NO: 1801976 - RNA, 22 nt, Homo sapiens
auacuguuuccuaugacauuac

SEQ ID NO: 1801977 - RNA, 14 nt, Homo sapiens
uagaaaaucugagu

SEQ ID NO: 1801978 - RNA, 17 nt, Homo sapiens
agcugaccugguacuga

SEQ ID NO: 1801979 - RNA, 16 nt, Homo sapiens
aaguguuuuuuauuga

SEQ ID NO: 1801980 - RNA, 13 nt, Homo sapiens
gguagcugggauu

SEQ ID NO: 1801981 - RNA, 19 nt, Homo sapiens
aucuuguuucugaguuuca

SEQ ID NO: 1801982 - RNA, 14 nt, Homo sapiens
aucgagccacugca

SEQ ID NO: 1801983 - RNA, 13 nt, Homo sapiens
gagcaguggcaga

SEQ ID NO: 1801984 - RNA, 15 nt, Homo sapiens
augaaccccagucag

SEQ ID NO: 1801985 - RNA, 18 nt, Homo sapiens
guguuuaaauaaacacag

SEQ ID NO: 1801986 - RNA, 17 nt, Homo sapiens
ucaugugaaaucauuca

SEQ ID NO: 1801987 - RNA, 14 nt, Homo sapiens
uuacugaugugaua

SEQ ID NO: 1801988 - RNA, 16 nt, Homo sapiens
augugacauuccauga

SEQ ID NO: 1801989 - RNA, 13 nt, Homo sapiens
gugguauucuguc

SEQ ID NO: 1801990 - RNA, 21 nt, Homo sapiens
cauguguaugugucugcuaau

SEQ ID NO: 1801991 - RNA, 19 nt, Homo sapiens
caagaauguuguuagcuuu

SEQ ID NO: 1801992 - RNA, 13 nt, Homo sapiens
uauauaaguugcu

SEQ ID NO: 1801993 - RNA, 14 nt, Homo sapiens
cugaagauggcauc

SEQ ID NO: 1801994 - RNA, 17 nt, Homo sapiens
ggaauacagucauucca

SEQ ID NO: 1801995 - RNA, 14 nt, Homo sapiens
gucugcauugcugg

SEQ ID NO: 1801996 - RNA, 20 nt, Homo sapiens
ucaucauggcaucauugcau

SEQ ID NO: 1801997 - RNA, 23 nt, Homo sapiens
acaggcugccucaugacccuccu

SEQ ID NO: 1801998 - RNA, 15 nt, Homo sapiens
aucuuguuacuguga

SEQ ID NO: 1801999 - RNA, 18 nt, Homo sapiens
ugggauccacuucuuggu

SEQ ID NO: 1802000 - RNA, 16 nt, Homo sapiens
agaugcggccaaagau

SEQ ID NO: 1802001 - RNA, 17 nt, Homo sapiens
aggcugaacauaaauca

SEQ ID NO: 1802002 - RNA, 17 nt, Homo sapiens
cuguguaguuaauuuaa

SEQ ID NO: 1802003 - RNA, 14 nt, Homo sapiens
agcugucccauggg

SEQ ID NO: 1802004 - RNA, 22 nt, Homo sapiens
cuugaaggauggaugagucaga

SEQ ID NO: 1802005 - RNA, 19 nt, Homo sapiens
acagcauggaaaagguuaa

SEQ ID NO: 1802006 - RNA, 16 nt, Homo sapiens
gccauauaaguuugaa

SEQ ID NO: 1802007 - RNA, 15 nt, Homo sapiens
caucuggaaaccucu

SEQ ID NO: 1802008 - RNA, 20 nt, Homo sapiens
guacuccagccugggugaca

SEQ ID NO: 1802009 - RNA, 11 nt, Homo sapiens
cauucuucucu

SEQ ID NO: 1802010 - RNA, 13 nt, Homo sapiens
aauauauacucaa

SEQ ID NO: 1802011 - RNA, 15 nt, Homo sapiens
caaaagggcuuccua

SEQ ID NO: 1802012 - RNA, 13 nt, Homo sapiens
uucuaagcaugua

SEQ ID NO: 1802013 - RNA, 20 nt, Homo sapiens
uguuacucauuuuauucacu

SEQ ID NO: 1802014 - RNA, 14 nt, Homo sapiens
uaucugaacuaauu

SEQ ID NO: 1802015 - RNA, 13 nt, Homo sapiens
gggauuggaagaa

SEQ ID NO: 1802016 - RNA, 20 nt, Homo sapiens
accagaagugccaugcucag

SEQ ID NO: 1802017 - RNA, 19 nt, Homo sapiens
ccagcuagcugcagagcca

SEQ ID NO: 1802018 - RNA, 14 nt, Homo sapiens
cacaaacacaccuc

SEQ ID NO: 1802019 - RNA, 17 nt, Homo sapiens
aauaucaagcagugaaa

SEQ ID NO: 1802020 - RNA, 15 nt, Homo sapiens
uaaacuuguguauga

SEQ ID NO: 1802021 - RNA, 23 nt, Homo sapiens
aaagauuuaacaaauacauucau

SEQ ID NO: 1802022 - RNA, 17 nt, Homo sapiens
caaauaaagauagaccu

SEQ ID NO: 1802023 - RNA, 15 nt, Homo sapiens
ucaaauaaacacugu

SEQ ID NO: 1802024 - RNA, 12 nt, Homo sapiens
acuuugcuccuc

SEQ ID NO: 1802025 - RNA, 20 nt, Homo sapiens
agugguccacaagcuucugu

SEQ ID NO: 1802026 - RNA, 15 nt, Homo sapiens
auuauauagcacaua

SEQ ID NO: 1802027 - RNA, 15 nt, Homo sapiens
cuccacucacuccag

SEQ ID NO: 1802028 - RNA, 19 nt, Homo sapiens
cucaggagccugugacaua

SEQ ID NO: 1802029 - RNA, 19 nt, Homo sapiens
caaacuguagcaagaugca

SEQ ID NO: 1802030 - RNA, 16 nt, Homo sapiens
cagacacagacuggca

SEQ ID NO: 1802031 - RNA, 16 nt, Homo sapiens
gugucaugaauuccuu

SEQ ID NO: 1802032 - RNA, 21 nt, Homo sapiens
ccaguaccuucugccagaaga

SEQ ID NO: 1802033 - RNA, 23 nt, Homo sapiens
agcggggagccaggaaagaagag

SEQ ID NO: 1802034 - RNA, 17 nt, Homo sapiens
ccuccugaggcuuuggc

SEQ ID NO: 1802035 - RNA, 19 nt, Homo sapiens
uuccuuuugauggggagaa

SEQ ID NO: 1802036 - RNA, 19 nt, Homo sapiens
ccaggcuugucacuagcag

SEQ ID NO: 1802037 - RNA, 18 nt, Homo sapiens
cacuagagaccaaaaagg

SEQ ID NO: 1802038 - RNA, 17 nt, Homo sapiens
agcagaaacagcauauu

SEQ ID NO: 1802039 - RNA, 17 nt, Homo sapiens
uuaaaguguaauaauau

SEQ ID NO: 1802040 - RNA, 21 nt, Homo sapiens
cccauagaaacaugacacuga

SEQ ID NO: 1802041 - RNA, 16 nt, Homo sapiens
ugaugagaauuucuaa

SEQ ID NO: 1802042 - RNA, 17 nt, Homo sapiens
uacacaguuauacaugu

SEQ ID NO: 1802043 - RNA, 15 nt, Homo sapiens
aguccacuguggcac

SEQ ID NO: 1802044 - RNA, 17 nt, Homo sapiens
uacugucuguuaugauu

SEQ ID NO: 1802045 - RNA, 16 nt, Homo sapiens
agguuuagaugugcaa

SEQ ID NO: 1802046 - RNA, 20 nt, Homo sapiens
agcacugacagauuuccauc

SEQ ID NO: 1802047 - RNA, 12 nt, Homo sapiens
agaccucuccca

SEQ ID NO: 1802048 - RNA, 12 nt, Homo sapiens
ccaacucuagcc

SEQ ID NO: 1802049 - RNA, 21 nt, Homo sapiens
aaagaagcaaucuccuuacug

SEQ ID NO: 1802050 - RNA, 22 nt, Homo sapiens
guaagucugcguugguucugaa

SEQ ID NO: 1802051 - RNA, 17 nt, Homo sapiens
uaaggucuguaguauac

SEQ ID NO: 1802052 - RNA, 20 nt, Homo sapiens
uucccuugagaugaguuucu

SEQ ID NO: 1802053 - RNA, 16 nt, Homo sapiens
uggucacaggcugugc

SEQ ID NO: 1802054 - RNA, 17 nt, Homo sapiens
uuccucuagaagccaag

SEQ ID NO: 1802055 - RNA, 21 nt, Homo sapiens
augaagacccccuccaaagag

SEQ ID NO: 1802056 - RNA, 19 nt, Homo sapiens
uugaagaggugaaaugggg

SEQ ID NO: 1802057 - RNA, 19 nt, Homo sapiens
uuacuccaccaucaccucu

SEQ ID NO: 1802058 - RNA, 20 nt, Homo sapiens
gcauagcaaaugacauaagc

SEQ ID NO: 1802059 - RNA, 19 nt, Homo sapiens
agcaaugcccguaaugcuu

SEQ ID NO: 1802060 - RNA, 16 nt, Homo sapiens
ucucagugcucuccua

SEQ ID NO: 1802061 - RNA, 16 nt, Homo sapiens
accuggaaacugcuca

SEQ ID NO: 1802062 - RNA, 15 nt, Homo sapiens
gccccucuuggagaa

SEQ ID NO: 1802063 - RNA, 17 nt, Homo sapiens
ugugaguguaaguguga

SEQ ID NO: 1802064 - RNA, 15 nt, Homo sapiens
ugacuggcaccaaca

SEQ ID NO: 1802065 - RNA, 15 nt, Homo sapiens
caauuuucacugugu

SEQ ID NO: 1802066 - RNA, 17 nt, Homo sapiens
uuacauauagcugauaa

SEQ ID NO: 1802067 - RNA, 17 nt, Homo sapiens
cucagcucccugacccc

SEQ ID NO: 1802068 - RNA, 16 nt, Homo sapiens
auccaggugugccccu

SEQ ID NO: 1802069 - RNA, 19 nt, Homo sapiens
auggaugaaacuauaacuu

SEQ ID NO: 1802070 - RNA, 18 nt, Homo sapiens
gugauggcagggcuguga

SEQ ID NO: 1802071 - RNA, 21 nt, Homo sapiens
ccucuuauaacuucugaagua

SEQ ID NO: 1802072 - RNA, 19 nt, Homo sapiens
agccugccaaagugccugg

SEQ ID NO: 1802073 - RNA, 17 nt, Homo sapiens
cugggagcccucaggca

SEQ ID NO: 1802074 - RNA, 15 nt, Homo sapiens
aaacugaaucacaau

SEQ ID NO: 1802075 - RNA, 17 nt, Homo sapiens
gcagacuacacaggaug

SEQ ID NO: 1802076 - RNA, 17 nt, Homo sapiens
ccucggugggcauucac

SEQ ID NO: 1802077 - RNA, 14 nt, Homo sapiens
gcagucuaauuaca

SEQ ID NO: 1802078 - RNA, 11 nt, Homo sapiens
ugaaaaccaua

SEQ ID NO: 1802079 - RNA, 12 nt, Homo sapiens
cagccaugccag

SEQ ID NO: 1802080 - RNA, 12 nt, Homo sapiens
uagaaauaagcc

SEQ ID NO: 1802081 - RNA, 15 nt, Homo sapiens
uugauauaaucuuuc

SEQ ID NO: 1802082 - RNA, 19 nt, Homo sapiens
cucuguucuuggaacaacg

SEQ ID NO: 1802083 - RNA, 17 nt, Homo sapiens
auguauauacacaucca

SEQ ID NO: 1802084 - RNA, 20 nt, Homo sapiens
uccaggggugggacacccug

SEQ ID NO: 1802085 - RNA, 19 nt, Homo sapiens
auuagaaaaaaauuacuaa

SEQ ID NO: 1802086 - RNA, 18 nt, Homo sapiens
acucucuuucuuccacua

SEQ ID NO: 1802087 - RNA, 21 nt, Homo sapiens
cuuggggguuuucaaugugaa

SEQ ID NO: 1802088 - RNA, 18 nt, Homo sapiens
cugcuccacgaagccuua

SEQ ID NO: 1802089 - RNA, 22 nt, Homo sapiens
uuauucauuuggugacugugua

SEQ ID NO: 1802090 - RNA, 22 nt, Homo sapiens
gcugcguucuuucaaugcugac

SEQ ID NO: 1802091 - RNA, 20 nt, Homo sapiens
gcccccaccgccgggguccu

SEQ ID NO: 1802092 - RNA, 15 nt, Homo sapiens
gauaguaacaaugaa

SEQ ID NO: 1802093 - RNA, 21 nt, Homo sapiens
uguaaaauaaaaccaccaaag

SEQ ID NO: 1802094 - RNA, 23 nt, Homo sapiens
augagcgucacugcccaccaaag

SEQ ID NO: 1802095 - RNA, 15 nt, Homo sapiens
uguuugucagcaucu

SEQ ID NO: 1802096 - RNA, 20 nt, Homo sapiens
gcucccuagccagaggcucu

SEQ ID NO: 1802097 - RNA, 13 nt, Homo sapiens
agagggaugcuug

SEQ ID NO: 1802098 - RNA, 17 nt, Homo sapiens
aggucuggcggcuccau

SEQ ID NO: 1802099 - RNA, 18 nt, Homo sapiens
cauuauccugugugauua

SEQ ID NO: 1802100 - RNA, 13 nt, Homo sapiens
agaugacaggaag

SEQ ID NO: 1802101 - RNA, 23 nt, Homo sapiens
ucaagcuauaaugcuauuuugau

SEQ ID NO: 1802102 - RNA, 22 nt, Homo sapiens
aaguucccuaugaaaaaugugu

SEQ ID NO: 1802103 - RNA, 20 nt, Homo sapiens
aaaacugaggccuaaaugug

SEQ ID NO: 1802104 - RNA, 21 nt, Homo sapiens
accgcauuccaggggcugcag

SEQ ID NO: 1802105 - RNA, 17 nt, Homo sapiens
aggcugcuagauguagg

SEQ ID NO: 1802106 - RNA, 13 nt, Homo sapiens
uggaugguucuca

SEQ ID NO: 1802107 - RNA, 16 nt, Homo sapiens
gaccucucagcagaaa

SEQ ID NO: 1802108 - RNA, 21 nt, Homo sapiens
ugcaaaaccggcaaccuguaa

SEQ ID NO: 1802109 - RNA, 16 nt, Homo sapiens
uggccaaguuccucua

SEQ ID NO: 1802110 - RNA, 19 nt, Homo sapiens
gagaaguuaagaauugagc

SEQ ID NO: 1802111 - RNA, 21 nt, Homo sapiens
aaggacaggccacaccacagc

SEQ ID NO: 1802112 - RNA, 14 nt, Homo sapiens
cucaaaugcuaaau

SEQ ID NO: 1802113 - RNA, 17 nt, Homo sapiens
aaaaagucagagacaga

SEQ ID NO: 1802114 - RNA, 16 nt, Homo sapiens
guucauccaucaucug

SEQ ID NO: 1802115 - RNA, 22 nt, Homo sapiens
gccuugggagagaugccuucca

SEQ ID NO: 1802116 - RNA, 16 nt, Homo sapiens
gguccuaaaagcaaaa

SEQ ID NO: 1802117 - RNA, 18 nt, Homo sapiens
aauaaauucuaaauuaca

SEQ ID NO: 1802118 - RNA, 18 nt, Homo sapiens
cuguaguccuuucugccu

SEQ ID NO: 1802119 - RNA, 20 nt, Homo sapiens
uuauacaggaugaugacuau

SEQ ID NO: 1802120 - RNA, 23 nt, Homo sapiens
uagcucucccaacucuugcacag

SEQ ID NO: 1802121 - RNA, 18 nt, Homo sapiens
cuaagccuggaagccauc

SEQ ID NO: 1802122 - RNA, 15 nt, Homo sapiens
ccagccgcacuggga

SEQ ID NO: 1802123 - RNA, 15 nt, Homo sapiens
caagcagccaaggga

SEQ ID NO: 1802124 - RNA, 20 nt, Homo sapiens
agggcuggcugcuggaagaa

SEQ ID NO: 1802125 - RNA, 14 nt, Homo sapiens
cucucacacugaau

SEQ ID NO: 1802126 - RNA, 14 nt, Homo sapiens
ugaaauaauucaaa

SEQ ID NO: 1802127 - RNA, 14 nt, Homo sapiens
auccauaaagacaa

SEQ ID NO: 1802128 - RNA, 15 nt, Homo sapiens
auucuaucaagccca

SEQ ID NO: 1802129 - RNA, 18 nt, Homo sapiens
ccuccaugcucccuuaau

SEQ ID NO: 1802130 - RNA, 17 nt, Homo sapiens
aaacaacuuggcauuuc

SEQ ID NO: 1802131 - RNA, 16 nt, Homo sapiens
auuccaccuucccaug

SEQ ID NO: 1802132 - RNA, 15 nt, Homo sapiens
aauuaaagcuguuau

SEQ ID NO: 1802133 - RNA, 19 nt, Homo sapiens
acuuugaauguguuucaca

SEQ ID NO: 1802134 - RNA, 18 nt, Homo sapiens
cucacagaagaauaugac

SEQ ID NO: 1802135 - RNA, 21 nt, Homo sapiens
ccggcgaggguaugucagugu

SEQ ID NO: 1802136 - RNA, 21 nt, Homo sapiens
ugccugaauugagaauuuuga

SEQ ID NO: 1802137 - RNA, 20 nt, Homo sapiens
uaaacaagggucaauucaaa

SEQ ID NO: 1802138 - RNA, 13 nt, Homo sapiens
gcaugcaagcuca

SEQ ID NO: 1802139 - RNA, 18 nt, Homo sapiens
aauugcuagucaggguga

SEQ ID NO: 1802140 - RNA, 19 nt, Homo sapiens
gcccguaaucccagcuacu

SEQ ID NO: 1802141 - RNA, 15 nt, Homo sapiens
auauguacuugucaa

SEQ ID NO: 1802142 - RNA, 13 nt, Homo sapiens
cucaacucggggg

SEQ ID NO: 1802143 - RNA, 17 nt, Homo sapiens
cggggcacccagcccaa

SEQ ID NO: 1802144 - RNA, 17 nt, Homo sapiens
ucucucacuguugcagu

SEQ ID NO: 1802145 - RNA, 13 nt, Homo sapiens
gaccuuaaacuga

SEQ ID NO: 1802146 - RNA, 22 nt, Homo sapiens
gaugucgcccuacucaccugag

SEQ ID NO: 1802147 - RNA, 20 nt, Homo sapiens
agcagaagcacauaugaacu

SEQ ID NO: 1802148 - RNA, 22 nt, Homo sapiens
gggaugcugccugagucaccca

SEQ ID NO: 1802149 - RNA, 13 nt, Homo sapiens
uuguugugugugc

SEQ ID NO: 1802150 - RNA, 18 nt, Homo sapiens
aggucagcgugcuuagcc

SEQ ID NO: 1802151 - RNA, 15 nt, Homo sapiens
aggcugacuucagag

SEQ ID NO: 1802152 - RNA, 13 nt, Homo sapiens
ugcuuuagaacuu

SEQ ID NO: 1802153 - RNA, 17 nt, Homo sapiens
ccccucucguguuugau

SEQ ID NO: 1802154 - RNA, 14 nt, Homo sapiens
guuugagagagcag

SEQ ID NO: 1802155 - RNA, 13 nt, Homo sapiens
uguaagugcugcu

SEQ ID NO: 1802156 - RNA, 20 nt, Homo sapiens
aguaagcaacuagcugggca

SEQ ID NO: 1802157 - RNA, 20 nt, Homo sapiens
cuccaaauguccuuucucag

SEQ ID NO: 1802158 - RNA, 21 nt, Homo sapiens
gugggcaucucaguuaggaga

SEQ ID NO: 1802159 - RNA, 10 nt, Homo sapiens
uaacaucaac

SEQ ID NO: 1802160 - RNA, 21 nt, Homo sapiens
gagauggauguauuuguagcc

SEQ ID NO: 1802161 - RNA, 23 nt, Homo sapiens
aguaaaugcuagguuaauuccaa

SEQ ID NO: 1802162 - RNA, 18 nt, Homo sapiens
guaacaauacaugagaaa

SEQ ID NO: 1802163 - RNA, 18 nt, Homo sapiens
uuuugaaaaagcgaaaaa

SEQ ID NO: 1802164 - RNA, 12 nt, Homo sapiens
aggaaauaucau

SEQ ID NO: 1802165 - RNA, 22 nt, Homo sapiens
uccuucaggcagcugaaauuca

SEQ ID NO: 1802166 - RNA, 15 nt, Homo sapiens
acaaacaauaccuga

SEQ ID NO: 1802167 - RNA, 14 nt, Homo sapiens
ugcaaggcacugac

SEQ ID NO: 1802168 - RNA, 13 nt, Homo sapiens
acacugcuuguga

SEQ ID NO: 1802169 - RNA, 13 nt, Homo sapiens
uuggacagcugcu

SEQ ID NO: 1802170 - RNA, 15 nt, Homo sapiens
aagauugcaccacug

SEQ ID NO: 1802171 - RNA, 16 nt, Homo sapiens
aauacaacacaucuaa

SEQ ID NO: 1802172 - RNA, 14 nt, Homo sapiens
cugcccuucucacg

SEQ ID NO: 1802173 - RNA, 20 nt, Homo sapiens
agggacacacagugacaaaa

SEQ ID NO: 1802174 - RNA, 19 nt, Homo sapiens
acacugacuguugcuguaa

SEQ ID NO: 1802175 - RNA, 19 nt, Homo sapiens
aucuuucucuuacaaucug

SEQ ID NO: 1802176 - RNA, 16 nt, Homo sapiens
auucuaagauuguaca

SEQ ID NO: 1802177 - RNA, 21 nt, Homo sapiens
ggagucugccuccaugcugca

SEQ ID NO: 1802178 - RNA, 22 nt, Homo sapiens
guaugcugcaugaaagcguuau

SEQ ID NO: 1802179 - RNA, 21 nt, Homo sapiens
aaaugucucugcuccuacauc

SEQ ID NO: 1802180 - RNA, 13 nt, Homo sapiens
agagcuggaugcu

SEQ ID NO: 1802181 - RNA, 20 nt, Homo sapiens
uuaugacuccccccuuccaa

SEQ ID NO: 1802182 - RNA, 18 nt, Homo sapiens
ggucagagggcccagugg

SEQ ID NO: 1802183 - RNA, 23 nt, Homo sapiens
gaguuccugagacaugcucuuuu

SEQ ID NO: 1802184 - RNA, 13 nt, Homo sapiens
agccccacucuca

SEQ ID NO: 1802185 - RNA, 16 nt, Homo sapiens
ucagagccaagccuua

SEQ ID NO: 1802186 - RNA, 15 nt, Homo sapiens
ggaccccagcuguga

SEQ ID NO: 1802187 - RNA, 23 nt, Homo sapiens
auagcaacuccccuacaucaaau

SEQ ID NO: 1802188 - RNA, 13 nt, Homo sapiens
aguccaagguauu

SEQ ID NO: 1802189 - RNA, 12 nt, Homo sapiens
cagugaccucau

SEQ ID NO: 1802190 - RNA, 13 nt, Homo sapiens
gcagucacuugau

SEQ ID NO: 1802191 - RNA, 11 nt, Homo sapiens
uugccagguga

SEQ ID NO: 1802192 - RNA, 17 nt, Homo sapiens
gauguaugaaggcuuuu

SEQ ID NO: 1802193 - RNA, 23 nt, Homo sapiens
cauaagccauugcuucucccuca

SEQ ID NO: 1802194 - RNA, 13 nt, Homo sapiens
cugaggauuucaa

SEQ ID NO: 1802195 - RNA, 21 nt, Homo sapiens
uccaaaaauagcccugcaaaa

SEQ ID NO: 1802196 - RNA, 13 nt, Homo sapiens
ucugaguccuuug

SEQ ID NO: 1802197 - RNA, 14 nt, Homo sapiens
cuugaucauucuca

SEQ ID NO: 1802198 - RNA, 15 nt, Homo sapiens
cagugaaagcuuuca

SEQ ID NO: 1802199 - RNA, 22 nt, Homo sapiens
ucccuccagggccacugcuuga

SEQ ID NO: 1802200 - RNA, 17 nt, Homo sapiens
gagacaguguuuugcca

SEQ ID NO: 1802201 - RNA, 16 nt, Homo sapiens
aaacacucaucuccuc

SEQ ID NO: 1802202 - RNA, 12 nt, Homo sapiens
aaggugaccucu

SEQ ID NO: 1802203 - RNA, 17 nt, Homo sapiens
cugccucccaucucaac

SEQ ID NO: 1802204 - RNA, 22 nt, Homo sapiens
gugauuaaagcaagagaauuau

SEQ ID NO: 1802205 - RNA, 16 nt, Homo sapiens
uguuggcuagccucug

SEQ ID NO: 1802206 - RNA, 16 nt, Homo sapiens
aucucagaaaagcccu

SEQ ID NO: 1802207 - RNA, 15 nt, Homo sapiens
aacaugacacugacc

SEQ ID NO: 1802208 - RNA, 23 nt, Homo sapiens
uaaccuguuuauauaauuuugca

SEQ ID NO: 1802209 - RNA, 17 nt, Homo sapiens
uucacguaagacuuuuu

SEQ ID NO: 1802210 - RNA, 14 nt, Homo sapiens
aacauccuuguaca

SEQ ID NO: 1802211 - RNA, 23 nt, Homo sapiens
aucaauccugcccccagccaugg

SEQ ID NO: 1802212 - RNA, 19 nt, Homo sapiens
uuacccaacucuguacaaa

SEQ ID NO: 1802213 - RNA, 22 nt, Homo sapiens
cuccuuugcuaaugcuaugcaa

SEQ ID NO: 1802214 - RNA, 16 nt, Homo sapiens
uugcaaucuucuacuu

SEQ ID NO: 1802215 - RNA, 20 nt, Homo sapiens
uaguagacaaagagccagaa

SEQ ID NO: 1802216 - RNA, 19 nt, Homo sapiens
agucuugcauugaauuuag

SEQ ID NO: 1802217 - RNA, 13 nt, Homo sapiens
ccucacuccacuc

SEQ ID NO: 1802218 - RNA, 13 nt, Homo sapiens
ccaggcagccuca

SEQ ID NO: 1802219 - RNA, 15 nt, Homo sapiens
caguaaaaauggaaa

SEQ ID NO: 1802220 - RNA, 21 nt, Homo sapiens
caguagagcacuuuucacuua

SEQ ID NO: 1802221 - RNA, 16 nt, Homo sapiens
ucuccucgcugacccu

SEQ ID NO: 1802222 - RNA, 12 nt, Homo sapiens
aguugugcaugc

SEQ ID NO: 1802223 - RNA, 14 nt, Homo sapiens
agugccugggaaug

SEQ ID NO: 1802224 - RNA, 18 nt, Homo sapiens
aggagcugagcuuuccag

SEQ ID NO: 1802225 - RNA, 18 nt, Homo sapiens
aacaacucgaaucacuca

SEQ ID NO: 1802226 - RNA, 22 nt, Homo sapiens
aggaagagauugagcuacuuca

SEQ ID NO: 1802227 - RNA, 22 nt, Homo sapiens
caaaguaaaaauaaacuguuau

SEQ ID NO: 1802228 - RNA, 12 nt, Homo sapiens
uaaacagaggau

SEQ ID NO: 1802229 - RNA, 19 nt, Homo sapiens
caggggugccugugggggu

SEQ ID NO: 1802230 - RNA, 24 nt, Homo sapiens
gcaccaccgaccaacuccagacuu

SEQ ID NO: 1802231 - RNA, 15 nt, Homo sapiens
gcacagcuaauucua

SEQ ID NO: 1802232 - RNA, 18 nt, Homo sapiens
cucucccaggacccauca

SEQ ID NO: 1802233 - RNA, 15 nt, Homo sapiens
auuuaagccuuauaa

SEQ ID NO: 1802234 - RNA, 16 nt, Homo sapiens
ugagcaaauggugcug

SEQ ID NO: 1802235 - RNA, 20 nt, Homo sapiens
cgauaucuucagaaaaccua

SEQ ID NO: 1802236 - RNA, 15 nt, Homo sapiens
cacaguuuaccucag

SEQ ID NO: 1802237 - RNA, 15 nt, Homo sapiens
aacaaugcugagaau

SEQ ID NO: 1802238 - RNA, 20 nt, Homo sapiens
aaugacucaugccucugagc

SEQ ID NO: 1802239 - RNA, 17 nt, Homo sapiens
gagagcaucugcucuga

SEQ ID NO: 1802240 - RNA, 20 nt, Homo sapiens
gccucuggcaaguagcuuuc

SEQ ID NO: 1802241 - RNA, 22 nt, Homo sapiens
acgaugcaauucuagccaaaaa

SEQ ID NO: 1802242 - RNA, 13 nt, Homo sapiens
auggagaccucau

SEQ ID NO: 1802243 - RNA, 17 nt, Homo sapiens
acagaugcuggccucuu

SEQ ID NO: 1802244 - RNA, 13 nt, Homo sapiens
auuuaacucauaa

SEQ ID NO: 1802245 - RNA, 17 nt, Homo sapiens
aaugucaguauguggaa

SEQ ID NO: 1802246 - RNA, 17 nt, Homo sapiens
ccugauuuguugggacc

SEQ ID NO: 1802247 - RNA, 15 nt, Homo sapiens
cugaagggcauacaa

SEQ ID NO: 1802248 - RNA, 17 nt, Homo sapiens
uggucccaaguuuaauu

SEQ ID NO: 1802249 - RNA, 20 nt, Homo sapiens
ugacuuucaguaaacauaaa

SEQ ID NO: 1802250 - RNA, 20 nt, Homo sapiens
acacguaaugaaacuuggau

SEQ ID NO: 1802251 - RNA, 17 nt, Homo sapiens
gaaauaacuuguguuac

SEQ ID NO: 1802252 - RNA, 17 nt, Homo sapiens
uucagaccaaugcucaa

SEQ ID NO: 1802253 - RNA, 22 nt, Homo sapiens
cugcagggccauggcucagggu

SEQ ID NO: 1802254 - RNA, 13 nt, Homo sapiens
gaaaaacauuuca

SEQ ID NO: 1802255 - RNA, 14 nt, Homo sapiens
cagggccacuggaa

SEQ ID NO: 1802256 - RNA, 14 nt, Homo sapiens
cugagccacagaaa

SEQ ID NO: 1802257 - RNA, 19 nt, Homo sapiens
ucaaauaucaguuacccac

SEQ ID NO: 1802258 - RNA, 21 nt, Homo sapiens
guccugcugugugaauuccca

SEQ ID NO: 1802259 - RNA, 22 nt, Homo sapiens
uuucaaauauguaaacuuuaac

SEQ ID NO: 1802260 - RNA, 12 nt, Homo sapiens
guaaacuugaaa

SEQ ID NO: 1802261 - RNA, 19 nt, Homo sapiens
uguuuguaguugacauaaa

SEQ ID NO: 1802262 - RNA, 22 nt, Homo sapiens
cagcugggagacacagcaagac

SEQ ID NO: 1802263 - RNA, 15 nt, Homo sapiens
ggcaguauuaagugu

SEQ ID NO: 1802264 - RNA, 19 nt, Homo sapiens
ccaaagggaggguggcaga

SEQ ID NO: 1802265 - RNA, 20 nt, Homo sapiens
cgccucucccaccccaugca

SEQ ID NO: 1802266 - RNA, 21 nt, Homo sapiens
cuacugacuggacuucucuca

SEQ ID NO: 1802267 - RNA, 20 nt, Homo sapiens
ucuccauuuguuaucuggga

SEQ ID NO: 1802268 - RNA, 11 nt, Homo sapiens
aaagacaucag

SEQ ID NO: 1802269 - RNA, 23 nt, Homo sapiens
cuuccuuauuuagccuaggagua

SEQ ID NO: 1802270 - RNA, 14 nt, Homo sapiens
gaugcaagugcaac

SEQ ID NO: 1802271 - RNA, 13 nt, Homo sapiens
ccuuggauaccua

SEQ ID NO: 1802272 - RNA, 19 nt, Homo sapiens
aauacaaaaaucagccaga

SEQ ID NO: 1802273 - RNA, 19 nt, Homo sapiens
augcauugccuguaacaau

SEQ ID NO: 1802274 - RNA, 21 nt, Homo sapiens
ugagccaaggcuuuugcaaag

SEQ ID NO: 1802275 - RNA, 16 nt, Homo sapiens
ucccaguuaacuguua

SEQ ID NO: 1802276 - RNA, 20 nt, Homo sapiens
cauugagaaauaaagcacau

SEQ ID NO: 1802277 - RNA, 21 nt, Homo sapiens
aauacuguuucacuaauacuu

SEQ ID NO: 1802278 - RNA, 14 nt, Homo sapiens
uggucugccucuga

SEQ ID NO: 1802279 - RNA, 13 nt, Homo sapiens
uacaugugccaug

SEQ ID NO: 1802280 - RNA, 14 nt, Homo sapiens
gggacugugagacu

SEQ ID NO: 1802281 - RNA, 14 nt, Homo sapiens
aaugccugugccaa

SEQ ID NO: 1802282 - RNA, 17 nt, Homo sapiens
cauguccuaauucuucu

SEQ ID NO: 1802283 - RNA, 20 nt, Homo sapiens
caaaucauacuuuuucuuug

SEQ ID NO: 1802284 - RNA, 18 nt, Homo sapiens
aauaaaacugcacagugc

SEQ ID NO: 1802285 - RNA, 22 nt, Homo sapiens
acaccagcuguucugucccuug

SEQ ID NO: 1802286 - RNA, 14 nt, Homo sapiens
cuauaaugcuauuu

SEQ ID NO: 1802287 - RNA, 16 nt, Homo sapiens
ucuugagcaguggcug

SEQ ID NO: 1802288 - RNA, 17 nt, Homo sapiens
ccuguacuaaaccaccu

SEQ ID NO: 1802289 - RNA, 14 nt, Homo sapiens
aaagagaaacuuug

SEQ ID NO: 1802290 - RNA, 20 nt, Homo sapiens
caaggaaugauccauacuga

SEQ ID NO: 1802291 - RNA, 16 nt, Homo sapiens
cugucaaaacuacuga

SEQ ID NO: 1802292 - RNA, 16 nt, Homo sapiens
cugucuauacuacagu

SEQ ID NO: 1802293 - RNA, 23 nt, Homo sapiens
ucaaaauaaaaaguaaugacuua

SEQ ID NO: 1802294 - RNA, 17 nt, Homo sapiens
ggaguaaucuguguaca

SEQ ID NO: 1802295 - RNA, 17 nt, Homo sapiens
accuaagucucugugaa

SEQ ID NO: 1802296 - RNA, 18 nt, Homo sapiens
guaauaauguaauacugu

SEQ ID NO: 1802297 - RNA, 23 nt, Homo sapiens
acaggaagaaaauagaacagcuc

SEQ ID NO: 1802298 - RNA, 14 nt, Homo sapiens
aaguaccucagcau

SEQ ID NO: 1802299 - RNA, 16 nt, Homo sapiens
aggauuuaccaaauag

SEQ ID NO: 1802300 - RNA, 13 nt, Homo sapiens
ugacaauugugaa

SEQ ID NO: 1802301 - RNA, 16 nt, Homo sapiens
guauauagaugugcaa

SEQ ID NO: 1802302 - RNA, 23 nt, Homo sapiens
cuguucgugcuuguaaugcucac

SEQ ID NO: 1802303 - RNA, 16 nt, Homo sapiens
uucuguaaaaguuacu

SEQ ID NO: 1802304 - RNA, 19 nt, Homo sapiens
gggugacagagcaagugag

SEQ ID NO: 1802305 - RNA, 16 nt, Homo sapiens
gucuccauggcaucuu

SEQ ID NO: 1802306 - RNA, 14 nt, Homo sapiens
uauguggauuucau

SEQ ID NO: 1802307 - RNA, 19 nt, Homo sapiens
uuuaauugcaaagcuguca

SEQ ID NO: 1802308 - RNA, 23 nt, Homo sapiens
ugaggcaggaggaucacagugac

SEQ ID NO: 1802309 - RNA, 20 nt, Homo sapiens
accauuagauaaacacaggc

SEQ ID NO: 1802310 - RNA, 21 nt, Homo sapiens
uuaucgcccugagaagaucua

SEQ ID NO: 1802311 - RNA, 14 nt, Homo sapiens
gacaaaagcaguuu

SEQ ID NO: 1802312 - RNA, 22 nt, Homo sapiens
acucugagcccccugaccuucc

SEQ ID NO: 1802313 - RNA, 17 nt, Homo sapiens
ucagaauugaaacacuu

SEQ ID NO: 1802314 - RNA, 16 nt, Homo sapiens
uauaauucuacaggau

SEQ ID NO: 1802315 - RNA, 22 nt, Homo sapiens
gagaugacccaaucugccuuug

SEQ ID NO: 1802316 - RNA, 14 nt, Homo sapiens
cauggaagcgcaca

SEQ ID NO: 1802317 - RNA, 21 nt, Homo sapiens
gagaugaaggaaggacuauga

SEQ ID NO: 1802318 - RNA, 17 nt, Homo sapiens
auuauaacugugcaaau

SEQ ID NO: 1802319 - RNA, 19 nt, Homo sapiens
cuccagugggcugaugcug

SEQ ID NO: 1802320 - RNA, 18 nt, Homo sapiens
auguuguaauucaugcca

SEQ ID NO: 1802321 - RNA, 16 nt, Homo sapiens
ucacucccauaagcua

SEQ ID NO: 1802322 - RNA, 13 nt, Homo sapiens
cccugcaaaaaga

SEQ ID NO: 1802323 - RNA, 13 nt, Homo sapiens
acagacaacacug

SEQ ID NO: 1802324 - RNA, 23 nt, Homo sapiens
acguguaacuugugcuuuugcaa

SEQ ID NO: 1802325 - RNA, 15 nt, Homo sapiens
gcguuaugugcagua

SEQ ID NO: 1802326 - RNA, 16 nt, Homo sapiens
ucaggaaugauugcug

SEQ ID NO: 1802327 - RNA, 15 nt, Homo sapiens
accgaugcuuuacca

SEQ ID NO: 1802328 - RNA, 16 nt, Homo sapiens
uugacuagccaucuca

SEQ ID NO: 1802329 - RNA, 12 nt, Homo sapiens
uuagaggggcca

SEQ ID NO: 1802330 - RNA, 18 nt, Homo sapiens
ugcauauuccaugacuca

SEQ ID NO: 1802331 - RNA, 19 nt, Homo sapiens
cuuguaacuuaauauacua

SEQ ID NO: 1802332 - RNA, 22 nt, Homo sapiens
aguacucuuaacuccuagccca

SEQ ID NO: 1802333 - RNA, 16 nt, Homo sapiens
ugaggcauuuccagac

SEQ ID NO: 1802334 - RNA, 18 nt, Homo sapiens
gacuuccaucugugccau

SEQ ID NO: 1802335 - RNA, 15 nt, Homo sapiens
cgccaacgagcagug

SEQ ID NO: 1802336 - RNA, 23 nt, Homo sapiens
caaauauaucugcuauucuccau

SEQ ID NO: 1802337 - RNA, 21 nt, Homo sapiens
aaaucaugccauugcacucca

SEQ ID NO: 1802338 - RNA, 21 nt, Homo sapiens
aauucccaagagggcuuuauu

SEQ ID NO: 1802339 - RNA, 21 nt, Homo sapiens
ggcaacaagagcgaaacucca

SEQ ID NO: 1802340 - RNA, 15 nt, Homo sapiens
cugagugaaguccag

SEQ ID NO: 1802341 - RNA, 23 nt, Homo sapiens
caaauuggagcagggacagauca

SEQ ID NO: 1802342 - RNA, 23 nt, Homo sapiens
aauucaaugacagggaugccaac

SEQ ID NO: 1802343 - RNA, 16 nt, Homo sapiens
uccauuuucugugaga

SEQ ID NO: 1802344 - RNA, 23 nt, Homo sapiens
cauugcuuuugggagacuggaaa

SEQ ID NO: 1802345 - RNA, 19 nt, Homo sapiens
ucaauuucucugaggacac

SEQ ID NO: 1802346 - RNA, 21 nt, Homo sapiens
ggauccuauucucaccaggaa

SEQ ID NO: 1802347 - RNA, 15 nt, Homo sapiens
agcugaguaugcuga

SEQ ID NO: 1802348 - RNA, 20 nt, Homo sapiens
ccagagccuauggaaagggu

SEQ ID NO: 1802349 - RNA, 18 nt, Homo sapiens
uaguugcauauauggaca

SEQ ID NO: 1802350 - RNA, 18 nt, Homo sapiens
aaucuguccgugaccuau

SEQ ID NO: 1802351 - RNA, 19 nt, Homo sapiens
cugaccacagcacagccaa

SEQ ID NO: 1802352 - RNA, 13 nt, Homo sapiens
cauggugcuacuu

SEQ ID NO: 1802353 - RNA, 21 nt, Homo sapiens
auuugugguccacugagcuau

SEQ ID NO: 1802354 - RNA, 19 nt, Homo sapiens
ugggaauuuggagugacca

SEQ ID NO: 1802355 - RNA, 14 nt, Homo sapiens
uuauacuaccaagu

SEQ ID NO: 1802356 - RNA, 21 nt, Homo sapiens
cuccauuuagaaaauguucac

SEQ ID NO: 1802357 - RNA, 12 nt, Homo sapiens
cucauugcuugg

SEQ ID NO: 1802358 - RNA, 22 nt, Homo sapiens
acauuuuucauuauaacuuuaa

SEQ ID NO: 1802359 - RNA, 11 nt, Homo sapiens
accuuuuccaa

SEQ ID NO: 1802360 - RNA, 17 nt, Homo sapiens
uuuagaagugucauguu

SEQ ID NO: 1802361 - RNA, 18 nt, Homo sapiens
ggggcuuugggcccaaga

SEQ ID NO: 1802362 - RNA, 22 nt, Homo sapiens
acauauuccaugggacuuuccu

SEQ ID NO: 1802363 - RNA, 22 nt, Homo sapiens
acuaucaauaauacaaagcaaa

SEQ ID NO: 1802364 - RNA, 13 nt, Homo sapiens
uucauuucacaca

SEQ ID NO: 1802365 - RNA, 17 nt, Homo sapiens
ugagcaugcacacugag

SEQ ID NO: 1802366 - RNA, 18 nt, Homo sapiens
aaauauaauuuacauuaa

SEQ ID NO: 1802367 - RNA, 15 nt, Homo sapiens
aggcaugacuaaugc

SEQ ID NO: 1802368 - RNA, 19 nt, Homo sapiens
aauaauacaccagagauaa

SEQ ID NO: 1802369 - RNA, 14 nt, Homo sapiens
gagccugggaugau

SEQ ID NO: 1802370 - RNA, 14 nt, Homo sapiens
gcaaauaaauaucc

SEQ ID NO: 1802371 - RNA, 23 nt, Homo sapiens
uuuacucacacuaugugcaaaaa

SEQ ID NO: 1802372 - RNA, 17 nt, Homo sapiens
agccaagcuguguucau

SEQ ID NO: 1802373 - RNA, 23 nt, Homo sapiens
ucccuuuaccuucauauguguaa

SEQ ID NO: 1802374 - RNA, 16 nt, Homo sapiens
uuuucuaaacuuuaau

SEQ ID NO: 1802375 - RNA, 24 nt, Homo sapiens
uaaaaccauguaaagucaucauca

SEQ ID NO: 1802376 - RNA, 19 nt, Homo sapiens
augagggcagggacaucau

SEQ ID NO: 1802377 - RNA, 13 nt, Homo sapiens
ccugaaugaaaua

SEQ ID NO: 1802378 - RNA, 16 nt, Homo sapiens
agacugccauacauaa

SEQ ID NO: 1802379 - RNA, 21 nt, Homo sapiens
ugcacccaacuacugagcuga

SEQ ID NO: 1802380 - RNA, 17 nt, Homo sapiens
aaacagagaacccugug

SEQ ID NO: 1802381 - RNA, 17 nt, Homo sapiens
uggggccgaaagaacag

SEQ ID NO: 1802382 - RNA, 19 nt, Homo sapiens
uucaucuaaucuuaccagu

SEQ ID NO: 1802383 - RNA, 20 nt, Homo sapiens
cccugucauucgugguugau

SEQ ID NO: 1802384 - RNA, 22 nt, Homo sapiens
gaaguucaccauuaaaagggau

SEQ ID NO: 1802385 - RNA, 20 nt, Homo sapiens
cccugcucugcccaggcaag

SEQ ID NO: 1802386 - RNA, 13 nt, Homo sapiens
cacuuuacuuuca

SEQ ID NO: 1802387 - RNA, 13 nt, Homo sapiens
cauuuuacuucca

SEQ ID NO: 1802388 - RNA, 16 nt, Homo sapiens
uuugcagucaguucau

SEQ ID NO: 1802389 - RNA, 21 nt, Homo sapiens
ggacagggcccccggccacgc

SEQ ID NO: 1802390 - RNA, 16 nt, Homo sapiens
cugccuaaaauaugau

SEQ ID NO: 1802391 - RNA, 21 nt, Homo sapiens
uacaauaaagcaaugugguag

SEQ ID NO: 1802392 - RNA, 16 nt, Homo sapiens
aagaacuuuagcaugg

SEQ ID NO: 1802393 - RNA, 22 nt, Homo sapiens
aagaaagcaaugccaaucuuca

SEQ ID NO: 1802394 - RNA, 20 nt, Homo sapiens
agagaggugucaaccagaga

SEQ ID NO: 1802395 - RNA, 22 nt, Homo sapiens
gaccuguguauggugaccucuc

SEQ ID NO: 1802396 - RNA, 12 nt, Homo sapiens
uaaauucugcuc

SEQ ID NO: 1802397 - RNA, 21 nt, Homo sapiens
ccaguauaaagggacuugaag

SEQ ID NO: 1802398 - RNA, 15 nt, Homo sapiens
caauaaugugugaga

SEQ ID NO: 1802399 - RNA, 23 nt, Homo sapiens
uauaguuaaucuauaacuacaua

SEQ ID NO: 1802400 - RNA, 17 nt, Homo sapiens
gccaggcuugcagucuc

SEQ ID NO: 1802401 - RNA, 14 nt, Homo sapiens
uagaaauaagacaa

SEQ ID NO: 1802402 - RNA, 23 nt, Homo sapiens
agaccaguucuuggccuaugaua

SEQ ID NO: 1802403 - RNA, 13 nt, Homo sapiens
gaaacuguccaaa

SEQ ID NO: 1802404 - RNA, 13 nt, Homo sapiens
ccugcugugauga

SEQ ID NO: 1802405 - RNA, 15 nt, Homo sapiens
gucuugugaaggcag

SEQ ID NO: 1802406 - RNA, 14 nt, Homo sapiens
agcaauucuccugc

SEQ ID NO: 1802407 - RNA, 16 nt, Homo sapiens
auaucuagucacuugu

SEQ ID NO: 1802408 - RNA, 19 nt, Homo sapiens
ggaauaucaucugucauua

SEQ ID NO: 1802409 - RNA, 12 nt, Homo sapiens
auauacaucaua

SEQ ID NO: 1802410 - RNA, 14 nt, Homo sapiens
aacauuaguucuau

SEQ ID NO: 1802411 - RNA, 13 nt, Homo sapiens
cugagggcacucu

SEQ ID NO: 1802412 - RNA, 20 nt, Homo sapiens
ucgcccaggcuggagugcaa

SEQ ID NO: 1802413 - RNA, 22 nt, Homo sapiens
cagaggcucuaauguacaauaa

SEQ ID NO: 1802414 - RNA, 13 nt, Homo sapiens
aauuaaaugcaug

SEQ ID NO: 1802415 - RNA, 16 nt, Homo sapiens
ugcucgggugcugcca

SEQ ID NO: 1802416 - RNA, 19 nt, Homo sapiens
cucagaacagucugaaaua

SEQ ID NO: 1802417 - RNA, 20 nt, Homo sapiens
uccccauuggaacuagucau

SEQ ID NO: 1802418 - RNA, 21 nt, Homo sapiens
aaccagacaaggaaauacccu

SEQ ID NO: 1802419 - RNA, 21 nt, Homo sapiens
ucauaugugaaauggccaaag

SEQ ID NO: 1802420 - RNA, 13 nt, Homo sapiens
ccuggcaauguuu

SEQ ID NO: 1802421 - RNA, 18 nt, Homo sapiens
ccagcgagagaaagaguu

SEQ ID NO: 1802422 - RNA, 20 nt, Homo sapiens
ccucauauacuugaauauua

SEQ ID NO: 1802423 - RNA, 14 nt, Homo sapiens
cauuuucuguucca

SEQ ID NO: 1802424 - RNA, 19 nt, Homo sapiens
aguggcaucugaaaacaau

SEQ ID NO: 1802425 - RNA, 12 nt, Homo sapiens
auuaaagcaauc

SEQ ID NO: 1802426 - RNA, 18 nt, Homo sapiens
uaagugguauauacauau

SEQ ID NO: 1802427 - RNA, 12 nt, Homo sapiens
cuccacuccucc

SEQ ID NO: 1802428 - RNA, 19 nt, Homo sapiens
uacuucucgccaucagcuu

SEQ ID NO: 1802429 - RNA, 22 nt, Homo sapiens
acaaauccaaugaaaugaguuu

SEQ ID NO: 1802430 - RNA, 15 nt, Homo sapiens
cuugcacccaugugu

SEQ ID NO: 1802431 - RNA, 15 nt, Homo sapiens
uaucugucuuuccac

SEQ ID NO: 1802432 - RNA, 20 nt, Homo sapiens
agagcaggaagcauucagag

SEQ ID NO: 1802433 - RNA, 17 nt, Homo sapiens
uauuagcaacugugcua

SEQ ID NO: 1802434 - RNA, 14 nt, Homo sapiens
acucuuauuacugu

SEQ ID NO: 1802435 - RNA, 12 nt, Homo sapiens
aggccuacccca

SEQ ID NO: 1802436 - RNA, 12 nt, Homo sapiens
cuagauugugaa

SEQ ID NO: 1802437 - RNA, 18 nt, Homo sapiens
cuggauuguugacaugag

SEQ ID NO: 1802438 - RNA, 13 nt, Homo sapiens
aacuuaacauugc

SEQ ID NO: 1802439 - RNA, 22 nt, Homo sapiens
aguuugaaaguuguacaugaua

SEQ ID NO: 1802440 - RNA, 15 nt, Homo sapiens
cgugaugaucuagcc

SEQ ID NO: 1802441 - RNA, 13 nt, Homo sapiens
acauuguacuguu

SEQ ID NO: 1802442 - RNA, 16 nt, Homo sapiens
acaguaacccagagcu

SEQ ID NO: 1802443 - RNA, 21 nt, Homo sapiens
cuauguaaaugugaauggaaa

SEQ ID NO: 1802444 - RNA, 22 nt, Homo sapiens
gacaggauguggcacugcuuga

SEQ ID NO: 1802445 - RNA, 20 nt, Homo sapiens
gacagucauaaauacuguca

SEQ ID NO: 1802446 - RNA, 16 nt, Homo sapiens
gccuagucccuuccac

SEQ ID NO: 1802447 - RNA, 17 nt, Homo sapiens
uaaauauuaaguguuua

SEQ ID NO: 1802448 - RNA, 16 nt, Homo sapiens
caagugccauucaucc

SEQ ID NO: 1802449 - RNA, 20 nt, Homo sapiens
acuuaugggcccagccagcc

SEQ ID NO: 1802450 - RNA, 21 nt, Homo sapiens
cauucugucacccagacugga

SEQ ID NO: 1802451 - RNA, 13 nt, Homo sapiens
uucuucugccuca

SEQ ID NO: 1802452 - RNA, 16 nt, Homo sapiens
cacuucauggaccaag

SEQ ID NO: 1802453 - RNA, 21 nt, Homo sapiens
ucugggaaaaucuauuccugc

SEQ ID NO: 1802454 - RNA, 16 nt, Homo sapiens
auuaagguaacuacug

SEQ ID NO: 1802455 - RNA, 19 nt, Homo sapiens
guaagauuuuccauuguau

SEQ ID NO: 1802456 - RNA, 20 nt, Homo sapiens
aaugaaucaacaaaccacaa

SEQ ID NO: 1802457 - RNA, 13 nt, Homo sapiens
cugacugcaauga

SEQ ID NO: 1802458 - RNA, 15 nt, Homo sapiens
cgcaccagacacuca

SEQ ID NO: 1802459 - RNA, 13 nt, Homo sapiens
uaauuuacauuaa

SEQ ID NO: 1802460 - RNA, 13 nt, Homo sapiens
auauauacuauau

SEQ ID NO: 1802461 - RNA, 15 nt, Homo sapiens
ugaggcauuacaaau

SEQ ID NO: 1802462 - RNA, 23 nt, Homo sapiens
ccagcuccuuggcugcagccauc

SEQ ID NO: 1802463 - RNA, 18 nt, Homo sapiens
acucgccagcccaaaugc

SEQ ID NO: 1802464 - RNA, 19 nt, Homo sapiens
cccagugggaacugugcaa

SEQ ID NO: 1802465 - RNA, 22 nt, Homo sapiens
auuauuucacuuuagaugcuga

SEQ ID NO: 1802466 - RNA, 22 nt, Homo sapiens
cugauucaggagaucacugcuc

SEQ ID NO: 1802467 - RNA, 21 nt, Homo sapiens
uccuacacacucugagucucu

SEQ ID NO: 1802468 - RNA, 22 nt, Homo sapiens
ccaaaugauagaacuguacugu

SEQ ID NO: 1802469 - RNA, 18 nt, Homo sapiens
gcuguguggaaccaccug

SEQ ID NO: 1802470 - RNA, 16 nt, Homo sapiens
gacucaagugucucag

SEQ ID NO: 1802471 - RNA, 22 nt, Homo sapiens
aaucucagcuaacauuccaugu

SEQ ID NO: 1802472 - RNA, 15 nt, Homo sapiens
gauucaauauugaau

SEQ ID NO: 1802473 - RNA, 15 nt, Homo sapiens
aaaucauuguagaaa

SEQ ID NO: 1802474 - RNA, 20 nt, Homo sapiens
auccucugcuaccaucucau

SEQ ID NO: 1802475 - RNA, 18 nt, Homo sapiens
ggcacaugacagugguua

SEQ ID NO: 1802476 - RNA, 20 nt, Homo sapiens
gugucuguacacguguccug

SEQ ID NO: 1802477 - RNA, 11 nt, Homo sapiens
gauuguucuca

SEQ ID NO: 1802478 - RNA, 15 nt, Homo sapiens
ccaucaucacuguaa

SEQ ID NO: 1802479 - RNA, 15 nt, Homo sapiens
uaaggugaaccaaag

SEQ ID NO: 1802480 - RNA, 19 nt, Homo sapiens
aggagguucacugagcucc

SEQ ID NO: 1802481 - RNA, 19 nt, Homo sapiens
aauaucacagaaaagcaug

SEQ ID NO: 1802482 - RNA, 17 nt, Homo sapiens
cuucacgcccuuggcca

SEQ ID NO: 1802483 - RNA, 13 nt, Homo sapiens
acuugugcuauaa

SEQ ID NO: 1802484 - RNA, 14 nt, Homo sapiens
aaguaaacagucag

SEQ ID NO: 1802485 - RNA, 18 nt, Homo sapiens
uguacuuuucccauuugu

SEQ ID NO: 1802486 - RNA, 17 nt, Homo sapiens
ucccuucuuugcugcug

SEQ ID NO: 1802487 - RNA, 16 nt, Homo sapiens
aucauaguugcaaaau

SEQ ID NO: 1802488 - RNA, 19 nt, Homo sapiens
cuucccaugggcagaggac

SEQ ID NO: 1802489 - RNA, 20 nt, Homo sapiens
auauaacuaagacauaugca

SEQ ID NO: 1802490 - RNA, 15 nt, Homo sapiens
gacaccuccauuucu

SEQ ID NO: 1802491 - RNA, 13 nt, Homo sapiens
agggaagaacucu

SEQ ID NO: 1802492 - RNA, 19 nt, Homo sapiens
auucucugucucauccauc

SEQ ID NO: 1802493 - RNA, 17 nt, Homo sapiens
caugcuucuacugugac

SEQ ID NO: 1802494 - RNA, 17 nt, Homo sapiens
ccuugguggagcagcca

SEQ ID NO: 1802495 - RNA, 14 nt, Homo sapiens
auucuuuaaacuac

SEQ ID NO: 1802496 - RNA, 13 nt, Homo sapiens
aaugagugauaaa

SEQ ID NO: 1802497 - RNA, 22 nt, Homo sapiens
cgggagcuuugggugaccagcc

SEQ ID NO: 1802498 - RNA, 21 nt, Homo sapiens
acuugcccugccacuuugcau

SEQ ID NO: 1802499 - RNA, 12 nt, Homo sapiens
uuaaaaagucaa

SEQ ID NO: 1802500 - RNA, 16 nt, Homo sapiens
ugucuccacacacagc

SEQ ID NO: 1802501 - RNA, 16 nt, Homo sapiens
acccucagaugcacau

SEQ ID NO: 1802502 - RNA, 16 nt, Homo sapiens
uuggcucacugcaacu

SEQ ID NO: 1802503 - RNA, 16 nt, Homo sapiens
cuugauauuuuccaaa

SEQ ID NO: 1802504 - RNA, 18 nt, Homo sapiens
gaucugagaagacaugaa

SEQ ID NO: 1802505 - RNA, 20 nt, Homo sapiens
uagaaccugggcugugcugc

SEQ ID NO: 1802506 - RNA, 23 nt, Homo sapiens
ccaaggugggcggaucacuugag

SEQ ID NO: 1802507 - RNA, 13 nt, Homo sapiens
aauaaaagcacaa

SEQ ID NO: 1802508 - RNA, 14 nt, Homo sapiens
uuaaaaaacuucau

SEQ ID NO: 1802509 - RNA, 15 nt, Homo sapiens
cccuaggaagcugga

SEQ ID NO: 1802510 - RNA, 13 nt, Homo sapiens
cagucacaacaga

SEQ ID NO: 1802511 - RNA, 17 nt, Homo sapiens
uccccuuaccccaguca

SEQ ID NO: 1802512 - RNA, 13 nt, Homo sapiens
ugccaagugccau

SEQ ID NO: 1802513 - RNA, 21 nt, Homo sapiens
ugcaaaggacagauccaggga

SEQ ID NO: 1802514 - RNA, 21 nt, Homo sapiens
auucccaccugccacaguuca

SEQ ID NO: 1802515 - RNA, 15 nt, Homo sapiens
ccuuugccagccauu

SEQ ID NO: 1802516 - RNA, 16 nt, Homo sapiens
acuacuguacacggac

SEQ ID NO: 1802517 - RNA, 18 nt, Homo sapiens
gacuagauguaguauuuu

SEQ ID NO: 1802518 - RNA, 13 nt, Homo sapiens
ugggcuucacugg

SEQ ID NO: 1802519 - RNA, 21 nt, Homo sapiens
guggaagaggagcaacaauca

SEQ ID NO: 1802520 - RNA, 21 nt, Homo sapiens
gacgggguugucgagaucuca

SEQ ID NO: 1802521 - RNA, 15 nt, Homo sapiens
ccaaauguguaauau

SEQ ID NO: 1802522 - RNA, 20 nt, Homo sapiens
gaucuaauauugacugccuc

SEQ ID NO: 1802523 - RNA, 15 nt, Homo sapiens
auauaaaaugcugau

SEQ ID NO: 1802524 - RNA, 14 nt, Homo sapiens
auuagacacacaua

SEQ ID NO: 1802525 - RNA, 15 nt, Homo sapiens
cuaugcagacaucuc

SEQ ID NO: 1802526 - RNA, 23 nt, Homo sapiens
caacaauaaaguacuuuaccuaa

SEQ ID NO: 1802527 - RNA, 16 nt, Homo sapiens
agacugguuaggacaa

SEQ ID NO: 1802528 - RNA, 18 nt, Homo sapiens
uaaguuuuuaaucuggga

SEQ ID NO: 1802529 - RNA, 15 nt, Homo sapiens
uaagcaucuguguaa

SEQ ID NO: 1802530 - RNA, 14 nt, Homo sapiens
uaagaucagacucu

SEQ ID NO: 1802531 - RNA, 13 nt, Homo sapiens
gaacccugucccu

SEQ ID NO: 1802532 - RNA, 15 nt, Homo sapiens
cuguguggugcauuc

SEQ ID NO: 1802533 - RNA, 12 nt, Homo sapiens
aggccugaauca

SEQ ID NO: 1802534 - RNA, 17 nt, Homo sapiens
uaaaacacaguauugua

SEQ ID NO: 1802535 - RNA, 14 nt, Homo sapiens
aaaacuuaguuugu

SEQ ID NO: 1802536 - RNA, 13 nt, Homo sapiens
aacacuaccaugc

SEQ ID NO: 1802537 - RNA, 15 nt, Homo sapiens
uacauuucuaucagu

SEQ ID NO: 1802538 - RNA, 20 nt, Homo sapiens
ccuuggcuuaccugaccucu

SEQ ID NO: 1802539 - RNA, 21 nt, Homo sapiens
uagaaguugacaggcagugcc

SEQ ID NO: 1802540 - RNA, 16 nt, Homo sapiens
gcaccaacaucuacaa

SEQ ID NO: 1802541 - RNA, 23 nt, Homo sapiens
aggcacuguggcccuucugucca

SEQ ID NO: 1802542 - RNA, 22 nt, Homo sapiens
auuauuggcugcuuugccucua

SEQ ID NO: 1802543 - RNA, 13 nt, Homo sapiens
cugccuugcaccu

SEQ ID NO: 1802544 - RNA, 17 nt, Homo sapiens
auuugggaaagaaaaag

SEQ ID NO: 1802545 - RNA, 17 nt, Homo sapiens
gaaauguggaugugauu

SEQ ID NO: 1802546 - RNA, 21 nt, Homo sapiens
cucgugauuggaaacucacca

SEQ ID NO: 1802547 - RNA, 22 nt, Homo sapiens
ugaaucaugguuuuucuuagua

SEQ ID NO: 1802548 - RNA, 13 nt, Homo sapiens
caaugguggugca

SEQ ID NO: 1802549 - RNA, 15 nt, Homo sapiens
aaugaggucacuaug

SEQ ID NO: 1802550 - RNA, 19 nt, Homo sapiens
gaucuuggagacaggccau

SEQ ID NO: 1802551 - RNA, 19 nt, Homo sapiens
cccuuggggccuaugcaga

SEQ ID NO: 1802552 - RNA, 19 nt, Homo sapiens
uaucuaauaaauacuuaag

SEQ ID NO: 1802553 - RNA, 13 nt, Homo sapiens
aucccauggaaua

SEQ ID NO: 1802554 - RNA, 17 nt, Homo sapiens
gaggcgaugccacgcuu

SEQ ID NO: 1802555 - RNA, 21 nt, Homo sapiens
acagcucaagucuucccugau

SEQ ID NO: 1802556 - RNA, 19 nt, Homo sapiens
agugaugacuggcuugaga

SEQ ID NO: 1802557 - RNA, 12 nt, Homo sapiens
caaugauucaua

SEQ ID NO: 1802558 - RNA, 12 nt, Homo sapiens
auccccaaaaug

SEQ ID NO: 1802559 - RNA, 22 nt, Homo sapiens
cucuccaccacccaacccaaac

SEQ ID NO: 1802560 - RNA, 22 nt, Homo sapiens
cuugccaguuguauaacugaaa

SEQ ID NO: 1802561 - RNA, 22 nt, Homo sapiens
aguaaaaaaggagacaguuuau

SEQ ID NO: 1802562 - RNA, 15 nt, Homo sapiens
gagcugccagccggg

SEQ ID NO: 1802563 - RNA, 15 nt, Homo sapiens
aagagagacauggaa

SEQ ID NO: 1802564 - RNA, 15 nt, Homo sapiens
cuauacuuucucaca

SEQ ID NO: 1802565 - RNA, 15 nt, Homo sapiens
uuucuuuuccauuua

SEQ ID NO: 1802566 - RNA, 13 nt, Homo sapiens
uggacuccaccuu

SEQ ID NO: 1802567 - RNA, 23 nt, Homo sapiens
aaauuucuuaaucggugcauuga

SEQ ID NO: 1802568 - RNA, 16 nt, Homo sapiens
cacaucagcaauuuca

SEQ ID NO: 1802569 - RNA, 14 nt, Homo sapiens
cuaaaaccaucaua

SEQ ID NO: 1802570 - RNA, 13 nt, Homo sapiens
guaaauugcaaau

SEQ ID NO: 1802571 - RNA, 17 nt, Homo sapiens
ggagugacgcaucucca

SEQ ID NO: 1802572 - RNA, 15 nt, Homo sapiens
ggagagucacuugaa

SEQ ID NO: 1802573 - RNA, 17 nt, Homo sapiens
aaggcccugcugaguca

SEQ ID NO: 1802574 - RNA, 22 nt, Homo sapiens
cugagcuuggcguuuggaccca

SEQ ID NO: 1802575 - RNA, 11 nt, Homo sapiens
uggacaugacg

SEQ ID NO: 1802576 - RNA, 17 nt, Homo sapiens
ugguggcacacaccagu

SEQ ID NO: 1802577 - RNA, 21 nt, Homo sapiens
uuucccgcccccagauugaua

SEQ ID NO: 1802578 - RNA, 23 nt, Homo sapiens
acauuauuauguauucacuuuaa

SEQ ID NO: 1802579 - RNA, 17 nt, Homo sapiens
cugagcuuccucuucgg

SEQ ID NO: 1802580 - RNA, 16 nt, Homo sapiens
gggcaagggaccugcu

SEQ ID NO: 1802581 - RNA, 13 nt, Homo sapiens
gcuuuauucugca

SEQ ID NO: 1802582 - RNA, 13 nt, Homo sapiens
aaacgacaaauca

SEQ ID NO: 1802583 - RNA, 19 nt, Homo sapiens
ugaaaaacagaaagcaucc

SEQ ID NO: 1802584 - RNA, 12 nt, Homo sapiens
cuccaagauuuc

SEQ ID NO: 1802585 - RNA, 13 nt, Homo sapiens
gagucuagauucu

SEQ ID NO: 1802586 - RNA, 16 nt, Homo sapiens
cuaauaagaagugcca

SEQ ID NO: 1802587 - RNA, 12 nt, Homo sapiens
cuaaagacauga

SEQ ID NO: 1802588 - RNA, 17 nt, Homo sapiens
gccccucggcucuggag

SEQ ID NO: 1802589 - RNA, 13 nt, Homo sapiens
gcucuucugacau

SEQ ID NO: 1802590 - RNA, 14 nt, Homo sapiens
aaaugacaugcacu

SEQ ID NO: 1802591 - RNA, 21 nt, Homo sapiens
uauuaaucaacuuuccuuaaa

SEQ ID NO: 1802592 - RNA, 19 nt, Homo sapiens
cugcagccugcaggaccuc

SEQ ID NO: 1802593 - RNA, 19 nt, Homo sapiens
aaauagaacaaccugcaca

SEQ ID NO: 1802594 - RNA, 13 nt, Homo sapiens
gacuggcaauaaa

SEQ ID NO: 1802595 - RNA, 20 nt, Homo sapiens
uuugcuuuagagacagggac

SEQ ID NO: 1802596 - RNA, 17 nt, Homo sapiens
aauaccauuuaguaaga

SEQ ID NO: 1802597 - RNA, 21 nt, Homo sapiens
ucucgcucccuuucagguuua

SEQ ID NO: 1802598 - RNA, 21 nt, Homo sapiens
ugccguuuccccuccuuggcu

SEQ ID NO: 1802599 - RNA, 17 nt, Homo sapiens
uucagaagagaugggcu

SEQ ID NO: 1802600 - RNA, 15 nt, Homo sapiens
ucuacgcauaaacua

SEQ ID NO: 1802601 - RNA, 16 nt, Homo sapiens
acuaguuuaagcaaau

SEQ ID NO: 1802602 - RNA, 22 nt, Homo sapiens
gugcuaugaagccaacugacaa

SEQ ID NO: 1802603 - RNA, 23 nt, Homo sapiens
ugcaccugucauaugcucugauu

SEQ ID NO: 1802604 - RNA, 14 nt, Homo sapiens
agagaaaaauggac

SEQ ID NO: 1802605 - RNA, 17 nt, Homo sapiens
ugauuucuuuguagcau

SEQ ID NO: 1802606 - RNA, 14 nt, Homo sapiens
agcacaaagacaua

SEQ ID NO: 1802607 - RNA, 14 nt, Homo sapiens
aaagccaaggaguc

SEQ ID NO: 1802608 - RNA, 20 nt, Homo sapiens
acgaccacagggucugcacu

SEQ ID NO: 1802609 - RNA, 23 nt, Homo sapiens
uuuguauuuauuuccagaccaau

SEQ ID NO: 1802610 - RNA, 15 nt, Homo sapiens
aagcccacagcacag

SEQ ID NO: 1802611 - RNA, 15 nt, Homo sapiens
gaaggugaacuuugu

SEQ ID NO: 1802612 - RNA, 20 nt, Homo sapiens
cucaccuugcagaaccagug

SEQ ID NO: 1802613 - RNA, 14 nt, Homo sapiens
ucaaaaaguguuua

SEQ ID NO: 1802614 - RNA, 17 nt, Homo sapiens
uccuucauucaacccac

SEQ ID NO: 1802615 - RNA, 13 nt, Homo sapiens
aaucugugugcau

SEQ ID NO: 1802616 - RNA, 18 nt, Homo sapiens
uugaacacaggcaaagag

SEQ ID NO: 1802617 - RNA, 20 nt, Homo sapiens
ggagucaccuucccuugcca

SEQ ID NO: 1802618 - RNA, 14 nt, Homo sapiens
uacugguugacuuu

SEQ ID NO: 1802619 - RNA, 11 nt, Homo sapiens
uccacucugag

SEQ ID NO: 1802620 - RNA, 21 nt, Homo sapiens
gcaaaggguaauaacaugggc

SEQ ID NO: 1802621 - RNA, 22 nt, Homo sapiens
ugccucucucauccacuuucca

SEQ ID NO: 1802622 - RNA, 14 nt, Homo sapiens
aauguuuuucucaa

SEQ ID NO: 1802623 - RNA, 13 nt, Homo sapiens
caaaacuggauag

SEQ ID NO: 1802624 - RNA, 23 nt, Homo sapiens
gaaucuugaggaacggaucagau

SEQ ID NO: 1802625 - RNA, 22 nt, Homo sapiens
gauaauacuugaccucugugac

SEQ ID NO: 1802626 - RNA, 20 nt, Homo sapiens
acaaaagaauaacauuuucu

SEQ ID NO: 1802627 - RNA, 16 nt, Homo sapiens
agagggcaggggugcu

SEQ ID NO: 1802628 - RNA, 14 nt, Homo sapiens
auaguugugcaugc

SEQ ID NO: 1802629 - RNA, 22 nt, Homo sapiens
caagacagcaugccuucaaauc

SEQ ID NO: 1802630 - RNA, 20 nt, Homo sapiens
accugaccucugaagagcug

SEQ ID NO: 1802631 - RNA, 21 nt, Homo sapiens
ggcagugccuccugggaccau

SEQ ID NO: 1802632 - RNA, 13 nt, Homo sapiens
acagaucccgggg

SEQ ID NO: 1802633 - RNA, 18 nt, Homo sapiens
aggaaagggauaguccaa

SEQ ID NO: 1802634 - RNA, 17 nt, Homo sapiens
ccugcacacacaugcau

SEQ ID NO: 1802635 - RNA, 13 nt, Homo sapiens
gagaugcagcuac

SEQ ID NO: 1802636 - RNA, 19 nt, Homo sapiens
aacagcuguauuaucuuaa

SEQ ID NO: 1802637 - RNA, 19 nt, Homo sapiens
ucuccaacagccagugugu

SEQ ID NO: 1802638 - RNA, 22 nt, Homo sapiens
cucacucugggcuguaacgugg

SEQ ID NO: 1802639 - RNA, 15 nt, Homo sapiens
ugaugugcacugcau

SEQ ID NO: 1802640 - RNA, 14 nt, Homo sapiens
cgcaggcccaguga

SEQ ID NO: 1802641 - RNA, 20 nt, Homo sapiens
ucacccugccuuaucuugca

SEQ ID NO: 1802642 - RNA, 23 nt, Homo sapiens
uuauucuaauaaauauacuauga

SEQ ID NO: 1802643 - RNA, 23 nt, Homo sapiens
uugcuuuuaugacaaauagcaua

SEQ ID NO: 1802644 - RNA, 21 nt, Homo sapiens
acucagacugcaugacaguca

SEQ ID NO: 1802645 - RNA, 22 nt, Homo sapiens
aggcuccagagggcacucugcu

SEQ ID NO: 1802646 - RNA, 13 nt, Homo sapiens
uccccgugccaaa

SEQ ID NO: 1802647 - RNA, 23 nt, Homo sapiens
ugaaaagcacagccucagaauaa

SEQ ID NO: 1802648 - RNA, 15 nt, Homo sapiens
acugcaugcacuucu

SEQ ID NO: 1802649 - RNA, 18 nt, Homo sapiens
gacugauacugcagugac

SEQ ID NO: 1802650 - RNA, 20 nt, Homo sapiens
gggaaauugcuccauuccug

SEQ ID NO: 1802651 - RNA, 21 nt, Homo sapiens
uccuuuacgguccaugccuuu

SEQ ID NO: 1802652 - RNA, 15 nt, Homo sapiens
augcagcagcuugcu

SEQ ID NO: 1802653 - RNA, 20 nt, Homo sapiens
agcacccuggagagugcaca

SEQ ID NO: 1802654 - RNA, 21 nt, Homo sapiens
caagaguuuucuuccuuguaa

SEQ ID NO: 1802655 - RNA, 16 nt, Homo sapiens
uuuuuaacaguguucu

SEQ ID NO: 1802656 - RNA, 23 nt, Homo sapiens
uuaacugugaaauguacgucauu

SEQ ID NO: 1802657 - RNA, 15 nt, Homo sapiens
auauaauacugacug

SEQ ID NO: 1802658 - RNA, 16 nt, Homo sapiens
cauagacuuaggcauu

SEQ ID NO: 1802659 - RNA, 23 nt, Homo sapiens
ucauugaagaccagcuuucucau

SEQ ID NO: 1802660 - RNA, 21 nt, Homo sapiens
cugacuuagccuaaacaaccu

SEQ ID NO: 1802661 - RNA, 15 nt, Homo sapiens
cuuaaauauugaaua

SEQ ID NO: 1802662 - RNA, 16 nt, Homo sapiens
caugaauacacuuaca

SEQ ID NO: 1802663 - RNA, 17 nt, Homo sapiens
auuugucauucauucaa

SEQ ID NO: 1802664 - RNA, 19 nt, Homo sapiens
auguaauagugacagcaaa

SEQ ID NO: 1802665 - RNA, 15 nt, Homo sapiens
aacagcugucucuaa

SEQ ID NO: 1802666 - RNA, 19 nt, Homo sapiens
caguucuuagauucagggg

SEQ ID NO: 1802667 - RNA, 17 nt, Homo sapiens
uuacccacucaucagaa

SEQ ID NO: 1802668 - RNA, 20 nt, Homo sapiens
ccaaucagcacucuguaaaa

SEQ ID NO: 1802669 - RNA, 14 nt, Homo sapiens
aucauuacuuauga

SEQ ID NO: 1802670 - RNA, 15 nt, Homo sapiens
cuggcucugggacua

SEQ ID NO: 1802671 - RNA, 21 nt, Homo sapiens
ugaaauuuguuauacuucaaa

SEQ ID NO: 1802672 - RNA, 19 nt, Homo sapiens
cagacugacaguuuacaga

SEQ ID NO: 1802673 - RNA, 19 nt, Homo sapiens
ucagaguuugguuaaucag

SEQ ID NO: 1802674 - RNA, 14 nt, Homo sapiens
aguaaguaaagugg

SEQ ID NO: 1802675 - RNA, 18 nt, Homo sapiens
gcaugaaguaauaugcac

SEQ ID NO: 1802676 - RNA, 20 nt, Homo sapiens
cuuccugaacucccagucau

SEQ ID NO: 1802677 - RNA, 14 nt, Homo sapiens
gaaauuauuauuca

SEQ ID NO: 1802678 - RNA, 15 nt, Homo sapiens
aauaaugcaaacuuu

SEQ ID NO: 1802679 - RNA, 14 nt, Homo sapiens
aacugaaucaggaa

SEQ ID NO: 1802680 - RNA, 16 nt, Homo sapiens
uaacuauuuguaaaag

SEQ ID NO: 1802681 - RNA, 21 nt, Homo sapiens
ugauuuuuguaauaaaaggua

SEQ ID NO: 1802682 - RNA, 23 nt, Homo sapiens
aucaaauggaagacacauugaaa

SEQ ID NO: 1802683 - RNA, 14 nt, Homo sapiens
cacccuuucugcca

SEQ ID NO: 1802684 - RNA, 18 nt, Homo sapiens
auccaacuggaaggcuuu

SEQ ID NO: 1802685 - RNA, 20 nt, Homo sapiens
uccauucaugccaaagcaaa

SEQ ID NO: 1802686 - RNA, 13 nt, Homo sapiens
uuugaaacaguug

SEQ ID NO: 1802687 - RNA, 22 nt, Homo sapiens
cuucgcugccaggacaccugcc

SEQ ID NO: 1802688 - RNA, 15 nt, Homo sapiens
ucugaagcuuuacca

SEQ ID NO: 1802689 - RNA, 22 nt, Homo sapiens
acccguggcugaugguguggcc

SEQ ID NO: 1802690 - RNA, 20 nt, Homo sapiens
augaucccuguguugucucu

SEQ ID NO: 1802691 - RNA, 15 nt, Homo sapiens
acacaaauuuguaaa

SEQ ID NO: 1802692 - RNA, 19 nt, Homo sapiens
agcccuccaaaagcacuua

SEQ ID NO: 1802693 - RNA, 21 nt, Homo sapiens
uaaaagaugcauuaucuauga

SEQ ID NO: 1802694 - RNA, 16 nt, Homo sapiens
uuacaggaaugaagaa

SEQ ID NO: 1802695 - RNA, 13 nt, Homo sapiens
agucucaccagcc

SEQ ID NO: 1802696 - RNA, 15 nt, Homo sapiens
uuaauguaaaaccca

SEQ ID NO: 1802697 - RNA, 15 nt, Homo sapiens
uauugcaagcauuga

SEQ ID NO: 1802698 - RNA, 15 nt, Homo sapiens
caguucuaaccuccu

SEQ ID NO: 1802699 - RNA, 16 nt, Homo sapiens
acauucagcugagguu

SEQ ID NO: 1802700 - RNA, 15 nt, Homo sapiens
ccucaugguacugua

SEQ ID NO: 1802701 - RNA, 19 nt, Homo sapiens
ugagcccccugaugccacc

SEQ ID NO: 1802702 - RNA, 20 nt, Homo sapiens
guuggacuucagucuugccu

SEQ ID NO: 1802703 - RNA, 21 nt, Homo sapiens
gaccuccucccaagcacuuca

SEQ ID NO: 1802704 - RNA, 18 nt, Homo sapiens
agauagauaauguucucc

SEQ ID NO: 1802705 - RNA, 17 nt, Homo sapiens
cgcccgucucuuucuca

SEQ ID NO: 1802706 - RNA, 12 nt, Homo sapiens
acucuuggugca

SEQ ID NO: 1802707 - RNA, 15 nt, Homo sapiens
gauacuucacuacuu

SEQ ID NO: 1802708 - RNA, 21 nt, Homo sapiens
ccugcauuugugucauugaca

SEQ ID NO: 1802709 - RNA, 15 nt, Homo sapiens
cucuaacgugauaaa

SEQ ID NO: 1802710 - RNA, 15 nt, Homo sapiens
uucaagccauuccaa

SEQ ID NO: 1802711 - RNA, 13 nt, Homo sapiens
gaguucucugaug

SEQ ID NO: 1802712 - RNA, 21 nt, Homo sapiens
caaaucuugguugaugccaaa

SEQ ID NO: 1802713 - RNA, 21 nt, Homo sapiens
uguuuguuuauuagaugaauu

SEQ ID NO: 1802714 - RNA, 20 nt, Homo sapiens
cucuugccaaaucaaaagac

SEQ ID NO: 1802715 - RNA, 21 nt, Homo sapiens
guuuuccuugauaaaagucau

SEQ ID NO: 1802716 - RNA, 17 nt, Homo sapiens
uauacaauaacccaguu

SEQ ID NO: 1802717 - RNA, 16 nt, Homo sapiens
caacuggaagcacaga

SEQ ID NO: 1802718 - RNA, 16 nt, Homo sapiens
cugccuccuggccaag

SEQ ID NO: 1802719 - RNA, 18 nt, Homo sapiens
uugaauggaaaacacaug

SEQ ID NO: 1802720 - RNA, 23 nt, Homo sapiens
agacgaggccacagcugccaucg

SEQ ID NO: 1802721 - RNA, 15 nt, Homo sapiens
ccucaguuuccucau

SEQ ID NO: 1802722 - RNA, 15 nt, Homo sapiens
cuggauaacuguaaa

SEQ ID NO: 1802723 - RNA, 23 nt, Homo sapiens
cacucugaggucucuguggcagg

SEQ ID NO: 1802724 - RNA, 16 nt, Homo sapiens
cugugaccugcuccug

SEQ ID NO: 1802725 - RNA, 12 nt, Homo sapiens
aggaaccugcac

SEQ ID NO: 1802726 - RNA, 21 nt, Homo sapiens
uaaugguguagaacacuaauu

SEQ ID NO: 1802727 - RNA, 18 nt, Homo sapiens
aaagccaaacaagccuua

SEQ ID NO: 1802728 - RNA, 24 nt, Homo sapiens
uaagaguggaaccaacacuaacau

SEQ ID NO: 1802729 - RNA, 15 nt, Homo sapiens
uucaaaaugagauau

SEQ ID NO: 1802730 - RNA, 18 nt, Homo sapiens
ucugucccccaugcucug

SEQ ID NO: 1802731 - RNA, 16 nt, Homo sapiens
agucaaggugcucaau

SEQ ID NO: 1802732 - RNA, 17 nt, Homo sapiens
cagacgucucaagacug

SEQ ID NO: 1802733 - RNA, 14 nt, Homo sapiens
agagccacugccau

SEQ ID NO: 1802734 - RNA, 21 nt, Homo sapiens
gaguuugggaacugcaauaac

SEQ ID NO: 1802735 - RNA, 23 nt, Homo sapiens
cauuguacaguuuguuuacacac

SEQ ID NO: 1802736 - RNA, 18 nt, Homo sapiens
gugucugcaggauugauu

SEQ ID NO: 1802737 - RNA, 16 nt, Homo sapiens
uauguagaacuguuca

SEQ ID NO: 1802738 - RNA, 14 nt, Homo sapiens
caauguuagccaca

SEQ ID NO: 1802739 - RNA, 21 nt, Homo sapiens
gcuggagcccgguguucagug

SEQ ID NO: 1802740 - RNA, 16 nt, Homo sapiens
cugggccccaucauua

SEQ ID NO: 1802741 - RNA, 13 nt, Homo sapiens
guaacagugcagu

SEQ ID NO: 1802742 - RNA, 14 nt, Homo sapiens
ccauggauccugaa

SEQ ID NO: 1802743 - RNA, 14 nt, Homo sapiens
acccgccuuggccu

SEQ ID NO: 1802744 - RNA, 18 nt, Homo sapiens
auggcaccuucauucucc

SEQ ID NO: 1802745 - RNA, 16 nt, Homo sapiens
uucuccaaauacaagu

SEQ ID NO: 1802746 - RNA, 12 nt, Homo sapiens
aauguccuccaa

SEQ ID NO: 1802747 - RNA, 18 nt, Homo sapiens
acucccaccacaggcaua

SEQ ID NO: 1802748 - RNA, 13 nt, Homo sapiens
ucagccaagugca

SEQ ID NO: 1802749 - RNA, 16 nt, Homo sapiens
ccaaugucucccacac

SEQ ID NO: 1802750 - RNA, 16 nt, Homo sapiens
cacagagcaguggcca

SEQ ID NO: 1802751 - RNA, 14 nt, Homo sapiens
aucgguagcuugaa

SEQ ID NO: 1802752 - RNA, 18 nt, Homo sapiens
augaaacaaacuacugug

SEQ ID NO: 1802753 - RNA, 20 nt, Homo sapiens
uuaauuugguuuucacauug

SEQ ID NO: 1802754 - RNA, 22 nt, Homo sapiens
ugccucuccugggacaaccaga

SEQ ID NO: 1802755 - RNA, 18 nt, Homo sapiens
gccacaaauaacaucuca

SEQ ID NO: 1802756 - RNA, 16 nt, Homo sapiens
agcuaccucaaacuuc

SEQ ID NO: 1802757 - RNA, 23 nt, Homo sapiens
ucauuaccgucugugauugccau

SEQ ID NO: 1802758 - RNA, 14 nt, Homo sapiens
gcagacagaccuca

SEQ ID NO: 1802759 - RNA, 14 nt, Homo sapiens
agagauaaaugagc

SEQ ID NO: 1802760 - RNA, 17 nt, Homo sapiens
guuguuuaacuugucuu

SEQ ID NO: 1802761 - RNA, 22 nt, Homo sapiens
acccaaaacacaggaagucagu

SEQ ID NO: 1802762 - RNA, 16 nt, Homo sapiens
uaacuacacagaggac

SEQ ID NO: 1802763 - RNA, 21 nt, Homo sapiens
gugacuccuaugaucucaggu

SEQ ID NO: 1802764 - RNA, 20 nt, Homo sapiens
gauacuugaauaaccaucug

SEQ ID NO: 1802765 - RNA, 13 nt, Homo sapiens
aaguauauaugaa

SEQ ID NO: 1802766 - RNA, 12 nt, Homo sapiens
agaccaaaauaa

SEQ ID NO: 1802767 - RNA, 21 nt, Homo sapiens
uuauauuaaaauaagcacugu

SEQ ID NO: 1802768 - RNA, 13 nt, Homo sapiens
agccccaugccau

SEQ ID NO: 1802769 - RNA, 22 nt, Homo sapiens
auuuaaauguuaugacuaugua

SEQ ID NO: 1802770 - RNA, 21 nt, Homo sapiens
gauaaaccauggccaauucag

SEQ ID NO: 1802771 - RNA, 19 nt, Homo sapiens
aggaauccaaaagacaaaa

SEQ ID NO: 1802772 - RNA, 22 nt, Homo sapiens
uagaaagccccucaccucagga

SEQ ID NO: 1802773 - RNA, 19 nt, Homo sapiens
cacagaggacucacuugcc

SEQ ID NO: 1802774 - RNA, 16 nt, Homo sapiens
ggcucauuuacuugaa

SEQ ID NO: 1802775 - RNA, 14 nt, Homo sapiens
ucuauguauauucu

SEQ ID NO: 1802776 - RNA, 18 nt, Homo sapiens
uuauuaaaagaguagaaa

SEQ ID NO: 1802777 - RNA, 16 nt, Homo sapiens
uuaagugccccacaga

SEQ ID NO: 1802778 - RNA, 23 nt, Homo sapiens
cuaaaaaaaaaauccagccucau

SEQ ID NO: 1802779 - RNA, 23 nt, Homo sapiens
uauuuaaaaugcauaauucacau

SEQ ID NO: 1802780 - RNA, 14 nt, Homo sapiens
agcacgguggugcc

SEQ ID NO: 1802781 - RNA, 17 nt, Homo sapiens
ggucauccaaacucaaa

SEQ ID NO: 1802782 - RNA, 16 nt, Homo sapiens
cugcaguauaaauaac

SEQ ID NO: 1802783 - RNA, 20 nt, Homo sapiens
uuaguugcacuaacugcugg

SEQ ID NO: 1802784 - RNA, 22 nt, Homo sapiens
uaccuguaagggcaaagucaau

SEQ ID NO: 1802785 - RNA, 18 nt, Homo sapiens
ugucauaaucucuuucca

SEQ ID NO: 1802786 - RNA, 19 nt, Homo sapiens
accuccagccuccugccca

SEQ ID NO: 1802787 - RNA, 14 nt, Homo sapiens
agaaauauuccaaa

SEQ ID NO: 1802788 - RNA, 12 nt, Homo sapiens
gcauugcacuug

SEQ ID NO: 1802789 - RNA, 12 nt, Homo sapiens
ccauugcaguug

SEQ ID NO: 1802790 - RNA, 18 nt, Homo sapiens
aaugccaaaauucauuca

SEQ ID NO: 1802791 - RNA, 15 nt, Homo sapiens
ugaugggaucuguaa

SEQ ID NO: 1802792 - RNA, 16 nt, Homo sapiens
ccuaaguccuuuaugu

SEQ ID NO: 1802793 - RNA, 15 nt, Homo sapiens
acuacagaguguuau

SEQ ID NO: 1802794 - RNA, 23 nt, Homo sapiens
acauuaaaaagccuuacaguuau

SEQ ID NO: 1802795 - RNA, 13 nt, Homo sapiens
uuccuugaacugu

SEQ ID NO: 1802796 - RNA, 20 nt, Homo sapiens
guacaaguauauaauauguc

SEQ ID NO: 1802797 - RNA, 19 nt, Homo sapiens
auucuuuccuucuuucauu

SEQ ID NO: 1802798 - RNA, 15 nt, Homo sapiens
aucuccacugauaag

SEQ ID NO: 1802799 - RNA, 22 nt, Homo sapiens
auaacuggaaaacagaacacuu

SEQ ID NO: 1802800 - RNA, 12 nt, Homo sapiens
ugagaagugaua

SEQ ID NO: 1802801 - RNA, 12 nt, Homo sapiens
aucagcuuugua

SEQ ID NO: 1802802 - RNA, 12 nt, Homo sapiens
caggcaccagca

SEQ ID NO: 1802803 - RNA, 16 nt, Homo sapiens
gaaaagggcuuucuca

SEQ ID NO: 1802804 - RNA, 22 nt, Homo sapiens
guguucaccaucccaaagccaa

SEQ ID NO: 1802805 - RNA, 19 nt, Homo sapiens
cuccugggcccaagugauc

SEQ ID NO: 1802806 - RNA, 11 nt, Homo sapiens
uuuuugcugaa

SEQ ID NO: 1802807 - RNA, 12 nt, Homo sapiens
gucugaugacac

SEQ ID NO: 1802808 - RNA, 20 nt, Homo sapiens
ucccacgacuguuguacaag

SEQ ID NO: 1802809 - RNA, 18 nt, Homo sapiens
gucauauauaucacccag

SEQ ID NO: 1802810 - RNA, 24 nt, Homo sapiens
gaugccacccagcaacacagagcu

SEQ ID NO: 1802811 - RNA, 22 nt, Homo sapiens
cuaagggccacaucccacugcc

SEQ ID NO: 1802812 - RNA, 16 nt, Homo sapiens
ugggaaagccaugacc

SEQ ID NO: 1802813 - RNA, 16 nt, Homo sapiens
caaguaaaaaggcuaa

SEQ ID NO: 1802814 - RNA, 12 nt, Homo sapiens
uuugggcugugg

SEQ ID NO: 1802815 - RNA, 14 nt, Homo sapiens
agcagugcuucuca

SEQ ID NO: 1802816 - RNA, 17 nt, Homo sapiens
gaggguccagacugucc

SEQ ID NO: 1802817 - RNA, 13 nt, Homo sapiens
aaauguugacagg

SEQ ID NO: 1802818 - RNA, 13 nt, Homo sapiens
ccaguuugcaauu

SEQ ID NO: 1802819 - RNA, 20 nt, Homo sapiens
guaucaauggagcaugugug

SEQ ID NO: 1802820 - RNA, 13 nt, Homo sapiens
uucuuucaaagga

SEQ ID NO: 1802821 - RNA, 19 nt, Homo sapiens
ggcugcagugagcugagau

SEQ ID NO: 1802822 - RNA, 21 nt, Homo sapiens
cugacuguuuccaucaagggu

SEQ ID NO: 1802823 - RNA, 17 nt, Homo sapiens
ucuuaauuuacuuuaag

SEQ ID NO: 1802824 - RNA, 17 nt, Homo sapiens
gcuuuaaaaacuauuua

SEQ ID NO: 1802825 - RNA, 16 nt, Homo sapiens
aauuauugacacugaa

SEQ ID NO: 1802826 - RNA, 16 nt, Homo sapiens
acauugcugauaugca

SEQ ID NO: 1802827 - RNA, 13 nt, Homo sapiens
aaaauacaguucu

SEQ ID NO: 1802828 - RNA, 17 nt, Homo sapiens
uccuggacucauugcuu

SEQ ID NO: 1802829 - RNA, 13 nt, Homo sapiens
aguaaauccacag

SEQ ID NO: 1802830 - RNA, 13 nt, Homo sapiens
aguuaauccacug

SEQ ID NO: 1802831 - RNA, 21 nt, Homo sapiens
cuguaagaagcggcauagcac

SEQ ID NO: 1802832 - RNA, 19 nt, Homo sapiens
uaacagcuaauaagagaua

SEQ ID NO: 1802833 - RNA, 13 nt, Homo sapiens
uaaaaguggcauu

SEQ ID NO: 1802834 - RNA, 21 nt, Homo sapiens
uccaaccccccaccugccauu

SEQ ID NO: 1802835 - RNA, 17 nt, Homo sapiens
uuuccagagaacugcag

SEQ ID NO: 1802836 - RNA, 16 nt, Homo sapiens
ugaucaaagcaccuug

SEQ ID NO: 1802837 - RNA, 17 nt, Homo sapiens
cacugacauuauaucau

SEQ ID NO: 1802838 - RNA, 21 nt, Homo sapiens
ccuccgaaguagcugggauua

SEQ ID NO: 1802839 - RNA, 13 nt, Homo sapiens
ugcaacucacuga

SEQ ID NO: 1802840 - RNA, 11 nt, Homo sapiens
acguccuccac

SEQ ID NO: 1802841 - RNA, 16 nt, Homo sapiens
uuucagcuuccucuaa

SEQ ID NO: 1802842 - RNA, 16 nt, Homo sapiens
ccuucucucuccagaa

SEQ ID NO: 1802843 - RNA, 16 nt, Homo sapiens
caaagucugaagucag

SEQ ID NO: 1802844 - RNA, 19 nt, Homo sapiens
acagcgagagggagaccca

SEQ ID NO: 1802845 - RNA, 17 nt, Homo sapiens
ccuucagcuccagggaa

SEQ ID NO: 1802846 - RNA, 18 nt, Homo sapiens
acccugcuuuuugcuucu

SEQ ID NO: 1802847 - RNA, 17 nt, Homo sapiens
aggaauuuguacuucuu

SEQ ID NO: 1802848 - RNA, 19 nt, Homo sapiens
ucccuaauaaagcugugug

SEQ ID NO: 1802849 - RNA, 16 nt, Homo sapiens
ugaaaugaaugucuga

SEQ ID NO: 1802850 - RNA, 14 nt, Homo sapiens
cuguuguuacugga

SEQ ID NO: 1802851 - RNA, 22 nt, Homo sapiens
uuagggggagcccuggugcuac

SEQ ID NO: 1802852 - RNA, 17 nt, Homo sapiens
uaucuuucuaaaacugc

SEQ ID NO: 1802853 - RNA, 13 nt, Homo sapiens
agugagagcuucc

SEQ ID NO: 1802854 - RNA, 14 nt, Homo sapiens
cccuguaugauucc

SEQ ID NO: 1802855 - RNA, 18 nt, Homo sapiens
ccucugaguuaaauaauu

SEQ ID NO: 1802856 - RNA, 19 nt, Homo sapiens
ucauccuaaaaaguuccau

SEQ ID NO: 1802857 - RNA, 19 nt, Homo sapiens
gcuguggccuaaccugccg

SEQ ID NO: 1802858 - RNA, 14 nt, Homo sapiens
caggaaacaugaaa

SEQ ID NO: 1802859 - RNA, 17 nt, Homo sapiens
auagagugucucagggu

SEQ ID NO: 1802860 - RNA, 10 nt, Homo sapiens
ccucuugccu

SEQ ID NO: 1802861 - RNA, 21 nt, Homo sapiens
guugacucuaguacugugaau

SEQ ID NO: 1802862 - RNA, 22 nt, Homo sapiens
ugagccaaagcuuaugugacau

SEQ ID NO: 1802863 - RNA, 13 nt, Homo sapiens
accaugagcaccu

SEQ ID NO: 1802864 - RNA, 18 nt, Homo sapiens
aagcuuuaugauuuucau

SEQ ID NO: 1802865 - RNA, 18 nt, Homo sapiens
uuguuuucuaacuuuaug

SEQ ID NO: 1802866 - RNA, 18 nt, Homo sapiens
agccugcuaaggaacaau

SEQ ID NO: 1802867 - RNA, 13 nt, Homo sapiens
augaagugcaaua

SEQ ID NO: 1802868 - RNA, 18 nt, Homo sapiens
uacuaauuuccaugugua

SEQ ID NO: 1802869 - RNA, 21 nt, Homo sapiens
aaucugaagaagaaaugaaua

SEQ ID NO: 1802870 - RNA, 19 nt, Homo sapiens
uggugaaaaccccaucucu

SEQ ID NO: 1802871 - RNA, 22 nt, Homo sapiens
gcauuuuguuuguuucuucacu

SEQ ID NO: 1802872 - RNA, 22 nt, Homo sapiens
accucacuucuggcacugugac

SEQ ID NO: 1802873 - RNA, 23 nt, Homo sapiens
uguucagacauuccauggugauu

SEQ ID NO: 1802874 - RNA, 14 nt, Homo sapiens
accgagcacuguga

SEQ ID NO: 1802875 - RNA, 21 nt, Homo sapiens
uguuaaauguuauuauuacca

SEQ ID NO: 1802876 - RNA, 17 nt, Homo sapiens
gcaaauaguaaucugua

SEQ ID NO: 1802877 - RNA, 15 nt, Homo sapiens
gggagguugugcaug

SEQ ID NO: 1802878 - RNA, 21 nt, Homo sapiens
uggaaauaaagucagauggaa

SEQ ID NO: 1802879 - RNA, 21 nt, Homo sapiens
caacugcuuguaaaggugcuc

SEQ ID NO: 1802880 - RNA, 18 nt, Homo sapiens
gaaauagaaaauucugcc

SEQ ID NO: 1802881 - RNA, 13 nt, Homo sapiens
agaaacguggauc

SEQ ID NO: 1802882 - RNA, 13 nt, Homo sapiens
accuacgugccac

SEQ ID NO: 1802883 - RNA, 14 nt, Homo sapiens
uaagaacugcccag

SEQ ID NO: 1802884 - RNA, 19 nt, Homo sapiens
cgcuacccaccuccaggga

SEQ ID NO: 1802885 - RNA, 20 nt, Homo sapiens
agaugccaaaaaagaugcca

SEQ ID NO: 1802886 - RNA, 18 nt, Homo sapiens
ccgggacccucaggugua

SEQ ID NO: 1802887 - RNA, 17 nt, Homo sapiens
agagaucauauccucag

SEQ ID NO: 1802888 - RNA, 20 nt, Homo sapiens
ggccaggcacccccaaauca

SEQ ID NO: 1802889 - RNA, 16 nt, Homo sapiens
gcugaggccuaugcag

SEQ ID NO: 1802890 - RNA, 16 nt, Homo sapiens
guaauacacauaucua

SEQ ID NO: 1802891 - RNA, 17 nt, Homo sapiens
caggccaugugagccac

SEQ ID NO: 1802892 - RNA, 16 nt, Homo sapiens
ggauucucaccguggg

SEQ ID NO: 1802893 - RNA, 14 nt, Homo sapiens
ugcuugucaucugc

SEQ ID NO: 1802894 - RNA, 16 nt, Homo sapiens
uguaauguucauuucc

SEQ ID NO: 1802895 - RNA, 17 nt, Homo sapiens
gccggaguccacuccca

SEQ ID NO: 1802896 - RNA, 17 nt, Homo sapiens
gacaccugcagccuuug

SEQ ID NO: 1802897 - RNA, 15 nt, Homo sapiens
uaacacucaugaagc

SEQ ID NO: 1802898 - RNA, 22 nt, Homo sapiens
acaucccuuccuggaaacagca

SEQ ID NO: 1802899 - RNA, 15 nt, Homo sapiens
caacaagaaauaaua

SEQ ID NO: 1802900 - RNA, 15 nt, Homo sapiens
gagagauaugccugg

SEQ ID NO: 1802901 - RNA, 15 nt, Homo sapiens
caguucgacucugug

SEQ ID NO: 1802902 - RNA, 20 nt, Homo sapiens
caugcaaguagcuggcugua

SEQ ID NO: 1802903 - RNA, 22 nt, Homo sapiens
aacagaggaagaauuuguuauc

SEQ ID NO: 1802904 - RNA, 15 nt, Homo sapiens
cccugagguccugca

SEQ ID NO: 1802905 - RNA, 16 nt, Homo sapiens
uaacauuggcuacaaa

SEQ ID NO: 1802906 - RNA, 17 nt, Homo sapiens
uucagcaucacuaaacc

SEQ ID NO: 1802907 - RNA, 19 nt, Homo sapiens
ggccagaaaaaaguguuua

SEQ ID NO: 1802908 - RNA, 17 nt, Homo sapiens
aaggguggauugauguu

SEQ ID NO: 1802909 - RNA, 16 nt, Homo sapiens
gugauccaacauggga

SEQ ID NO: 1802910 - RNA, 19 nt, Homo sapiens
gggagacugggcugaggga

SEQ ID NO: 1802911 - RNA, 20 nt, Homo sapiens
uacacacacacacacagcca

SEQ ID NO: 1802912 - RNA, 22 nt, Homo sapiens
ccugcugugaugacuugccauu

SEQ ID NO: 1802913 - RNA, 14 nt, Homo sapiens
cagaucucaugaga

SEQ ID NO: 1802914 - RNA, 10 nt, Homo sapiens
cuuagacauu

SEQ ID NO: 1802915 - RNA, 14 nt, Homo sapiens
ccuccucugugaaa

SEQ ID NO: 1802916 - RNA, 14 nt, Homo sapiens
aaauacaacacuga

SEQ ID NO: 1802917 - RNA, 17 nt, Homo sapiens
auauauggcauuugcag

SEQ ID NO: 1802918 - RNA, 16 nt, Homo sapiens
uauuucacuaucuucu

SEQ ID NO: 1802919 - RNA, 23 nt, Homo sapiens
uugugaaguggaaauguucuaaa

SEQ ID NO: 1802920 - RNA, 22 nt, Homo sapiens
uaugaaaggcagggcaagaaca

SEQ ID NO: 1802921 - RNA, 12 nt, Homo sapiens
aaauagaacgaa

SEQ ID NO: 1802922 - RNA, 11 nt, Homo sapiens
auuuugcacug

SEQ ID NO: 1802923 - RNA, 22 nt, Homo sapiens
gugaguauaaaauaaagcaaau

SEQ ID NO: 1802924 - RNA, 23 nt, Homo sapiens
uugagauaaagucaaaugccaaa

SEQ ID NO: 1802925 - RNA, 12 nt, Homo sapiens
aaucuguacaaa

SEQ ID NO: 1802926 - RNA, 23 nt, Homo sapiens
cuuuagugaccccugccuacuuc

SEQ ID NO: 1802927 - RNA, 12 nt, Homo sapiens
uggguuggaaag

SEQ ID NO: 1802928 - RNA, 20 nt, Homo sapiens
gcgcaguguuuugcaagugc

SEQ ID NO: 1802929 - RNA, 12 nt, Homo sapiens
acugaagcuuaa

SEQ ID NO: 1802930 - RNA, 22 nt, Homo sapiens
agucucucuggggccacacaga

SEQ ID NO: 1802931 - RNA, 16 nt, Homo sapiens
cucuuggaugcagcuu

SEQ ID NO: 1802932 - RNA, 16 nt, Homo sapiens
agcaauaugcauuuaa

SEQ ID NO: 1802933 - RNA, 22 nt, Homo sapiens
aaauuaaggguuaaaucagaga

SEQ ID NO: 1802934 - RNA, 22 nt, Homo sapiens
caagagguacuguaauggguaa

SEQ ID NO: 1802935 - RNA, 21 nt, Homo sapiens
cagccugaccaacauggugaa

SEQ ID NO: 1802936 - RNA, 22 nt, Homo sapiens
ggaguaggugcuaaccuggaua

SEQ ID NO: 1802937 - RNA, 20 nt, Homo sapiens
caaaggcugagaacacugug

SEQ ID NO: 1802938 - RNA, 16 nt, Homo sapiens
ugcgucccugcucagc

SEQ ID NO: 1802939 - RNA, 16 nt, Homo sapiens
agccgcauggcacucu

SEQ ID NO: 1802940 - RNA, 17 nt, Homo sapiens
uuucucuuuaaucuccu

SEQ ID NO: 1802941 - RNA, 16 nt, Homo sapiens
caaagaagaaccaucu

SEQ ID NO: 1802942 - RNA, 13 nt, Homo sapiens
ccuccugcccaag

SEQ ID NO: 1802943 - RNA, 17 nt, Homo sapiens
acuugauucugcagucg

SEQ ID NO: 1802944 - RNA, 15 nt, Homo sapiens
auccauuucaggacu

SEQ ID NO: 1802945 - RNA, 19 nt, Homo sapiens
agauguguguucucaguga

SEQ ID NO: 1802946 - RNA, 17 nt, Homo sapiens
gucaaaaagggcuugag

SEQ ID NO: 1802947 - RNA, 14 nt, Homo sapiens
ugccuuugccucca

SEQ ID NO: 1802948 - RNA, 13 nt, Homo sapiens
cagaucugugcuc

SEQ ID NO: 1802949 - RNA, 19 nt, Homo sapiens
guguuuucccaaagcacuu

SEQ ID NO: 1802950 - RNA, 20 nt, Homo sapiens
cagguccagcuuuacugugg

SEQ ID NO: 1802951 - RNA, 21 nt, Homo sapiens
ugaugaucaaaaccugugcca

SEQ ID NO: 1802952 - RNA, 12 nt, Homo sapiens
uaacuguucaaa

SEQ ID NO: 1802953 - RNA, 20 nt, Homo sapiens
gccaccuagaaaggggccca

SEQ ID NO: 1802954 - RNA, 22 nt, Homo sapiens
uuacuugaaccugggaggcaga

SEQ ID NO: 1802955 - RNA, 22 nt, Homo sapiens
uaauugcauuucugcucuucca

SEQ ID NO: 1802956 - RNA, 16 nt, Homo sapiens
ccagaaaacacauuuc

SEQ ID NO: 1802957 - RNA, 16 nt, Homo sapiens
acauugugaaugcugu

SEQ ID NO: 1802958 - RNA, 18 nt, Homo sapiens
uccuuuuuuauacacaua

SEQ ID NO: 1802959 - RNA, 16 nt, Homo sapiens
ugugcagugacuguag

SEQ ID NO: 1802960 - RNA, 20 nt, Homo sapiens
acaguaaauacacugugaag

SEQ ID NO: 1802961 - RNA, 13 nt, Homo sapiens
ggaagaauuuacu

SEQ ID NO: 1802962 - RNA, 19 nt, Homo sapiens
ucuguuuccauagcaccau

SEQ ID NO: 1802963 - RNA, 16 nt, Homo sapiens
aaaagaagagccuuaa

SEQ ID NO: 1802964 - RNA, 20 nt, Homo sapiens
acggagucucacucugucac

SEQ ID NO: 1802965 - RNA, 19 nt, Homo sapiens
cuggcacgcccuacuccac

SEQ ID NO: 1802966 - RNA, 16 nt, Homo sapiens
cagucauuccaagaac

SEQ ID NO: 1802967 - RNA, 16 nt, Homo sapiens
aaugaugcugucugaa

SEQ ID NO: 1802968 - RNA, 15 nt, Homo sapiens
uauucuuacuaaucu

SEQ ID NO: 1802969 - RNA, 18 nt, Homo sapiens
ccuuggggaagaggcaag

SEQ ID NO: 1802970 - RNA, 13 nt, Homo sapiens
cuuuugcauuaaa

SEQ ID NO: 1802971 - RNA, 13 nt, Homo sapiens
gacaaauugagac

SEQ ID NO: 1802972 - RNA, 18 nt, Homo sapiens
aacagauaucagugucuc

SEQ ID NO: 1802973 - RNA, 19 nt, Homo sapiens
acaucaggagacugggcuc

SEQ ID NO: 1802974 - RNA, 15 nt, Homo sapiens
gaagaguuaaaacag

SEQ ID NO: 1802975 - RNA, 21 nt, Homo sapiens
aaaggcuguggcaucagggua

SEQ ID NO: 1802976 - RNA, 21 nt, Homo sapiens
aucugucuucagcacauucca

SEQ ID NO: 1802977 - RNA, 17 nt, Homo sapiens
aauuauuaucuucuuaa

SEQ ID NO: 1802978 - RNA, 22 nt, Homo sapiens
gauccuaaaacaaaagcucauc

SEQ ID NO: 1802979 - RNA, 15 nt, Homo sapiens
gaacuaugagucuuu

SEQ ID NO: 1802980 - RNA, 16 nt, Homo sapiens
gcacuuaugauuucau

SEQ ID NO: 1802981 - RNA, 13 nt, Homo sapiens
uggcucucagagg

SEQ ID NO: 1802982 - RNA, 21 nt, Homo sapiens
uugccucuucuuugugccuuu

SEQ ID NO: 1802983 - RNA, 18 nt, Homo sapiens
ucauguuuagccaguguu

SEQ ID NO: 1802984 - RNA, 13 nt, Homo sapiens
acuugccacugcc

SEQ ID NO: 1802985 - RNA, 12 nt, Homo sapiens
agcuguucaaac

SEQ ID NO: 1802986 - RNA, 12 nt, Homo sapiens
gaaaaauuauua

SEQ ID NO: 1802987 - RNA, 12 nt, Homo sapiens
augugugcaaaa

SEQ ID NO: 1802988 - RNA, 21 nt, Homo sapiens
uaauguaggacuguauaggua

SEQ ID NO: 1802989 - RNA, 17 nt, Homo sapiens
aaauuauuucucucaca

SEQ ID NO: 1802990 - RNA, 17 nt, Homo sapiens
acacaaacuauuacuua

SEQ ID NO: 1802991 - RNA, 19 nt, Homo sapiens
cucugccuuugacauuuaa

SEQ ID NO: 1802992 - RNA, 23 nt, Homo sapiens
cugccuccuuuccccucccucag

SEQ ID NO: 1802993 - RNA, 16 nt, Homo sapiens
aacaugcucaguaccu

SEQ ID NO: 1802994 - RNA, 19 nt, Homo sapiens
ucuguaacaucacuaucca

SEQ ID NO: 1802995 - RNA, 18 nt, Homo sapiens
cccaugcuggcugaagag

SEQ ID NO: 1802996 - RNA, 19 nt, Homo sapiens
agcuuggguccaccaugca

SEQ ID NO: 1802997 - RNA, 19 nt, Homo sapiens
aggaccccauccuguucuc

SEQ ID NO: 1802998 - RNA, 19 nt, Homo sapiens
aaaauucauuucacauuaa

SEQ ID NO: 1802999 - RNA, 12 nt, Homo sapiens
gaucagugaaaa

SEQ ID NO: 1803000 - RNA, 17 nt, Homo sapiens
agauauuggauacccca

SEQ ID NO: 1803001 - RNA, 20 nt, Homo sapiens
aagcaucauuauuugcagag

SEQ ID NO: 1803002 - RNA, 13 nt, Homo sapiens
aagaggagccaga

SEQ ID NO: 1803003 - RNA, 23 nt, Homo sapiens
uaaaucuaucaaaauuacccuaa

SEQ ID NO: 1803004 - RNA, 12 nt, Homo sapiens
ucccacucucag

SEQ ID NO: 1803005 - RNA, 12 nt, Homo sapiens
acccccaugcug

SEQ ID NO: 1803006 - RNA, 18 nt, Homo sapiens
uaaguuccuacuaggcaa

SEQ ID NO: 1803007 - RNA, 17 nt, Homo sapiens
gccucuucucugaugac

SEQ ID NO: 1803008 - RNA, 14 nt, Homo sapiens
uugcacaugugacc

SEQ ID NO: 1803009 - RNA, 21 nt, Homo sapiens
uaucuacauaaguccuuucaa

SEQ ID NO: 1803010 - RNA, 16 nt, Homo sapiens
acaaaccucuaaccca

SEQ ID NO: 1803011 - RNA, 23 nt, Homo sapiens
gauaaaacacuaacuuaaugugu

SEQ ID NO: 1803012 - RNA, 21 nt, Homo sapiens
cgcuuaaaaaaacaaauugga

SEQ ID NO: 1803013 - RNA, 20 nt, Homo sapiens
ugagggcaugugcggcugaa

SEQ ID NO: 1803014 - RNA, 19 nt, Homo sapiens
aaaggugguguuucuguaa

SEQ ID NO: 1803015 - RNA, 13 nt, Homo sapiens
uaugaacauggag

SEQ ID NO: 1803016 - RNA, 22 nt, Homo sapiens
ucccucgucuucagcugcauuu

SEQ ID NO: 1803017 - RNA, 21 nt, Homo sapiens
ccacagcuuauggcaucucau

SEQ ID NO: 1803018 - RNA, 15 nt, Homo sapiens
uagauugauucaccc

SEQ ID NO: 1803019 - RNA, 16 nt, Homo sapiens
agggccuguaauccca

SEQ ID NO: 1803020 - RNA, 22 nt, Homo sapiens
uauccuuuuaucucacaaauaa

SEQ ID NO: 1803021 - RNA, 17 nt, Homo sapiens
guaauaauaaugggaga

SEQ ID NO: 1803022 - RNA, 21 nt, Homo sapiens
caccaaguucuggaaaccacg

SEQ ID NO: 1803023 - RNA, 13 nt, Homo sapiens
aaugcugcauuuu

SEQ ID NO: 1803024 - RNA, 13 nt, Homo sapiens
ugagcuaugauaa

SEQ ID NO: 1803025 - RNA, 13 nt, Homo sapiens
gugaauccaggag

SEQ ID NO: 1803026 - RNA, 17 nt, Homo sapiens
uguccuaugggagucaa

SEQ ID NO: 1803027 - RNA, 20 nt, Homo sapiens
acucuccagacaucaccaac

SEQ ID NO: 1803028 - RNA, 21 nt, Homo sapiens
agcuccacccuggccgagucc

SEQ ID NO: 1803029 - RNA, 16 nt, Homo sapiens
uuguaaauugucucaa

SEQ ID NO: 1803030 - RNA, 17 nt, Homo sapiens
agcuuacagaaugggag

SEQ ID NO: 1803031 - RNA, 22 nt, Homo sapiens
uuggcuacacacaaaccaguau

SEQ ID NO: 1803032 - RNA, 14 nt, Homo sapiens
uaacuaaacuaacg

SEQ ID NO: 1803033 - RNA, 16 nt, Homo sapiens
uuaagucaccuguaua

SEQ ID NO: 1803034 - RNA, 22 nt, Homo sapiens
ggaagaccccagcacagacuca

SEQ ID NO: 1803035 - RNA, 20 nt, Homo sapiens
acugugaaggaacucugcag

SEQ ID NO: 1803036 - RNA, 19 nt, Homo sapiens
uaauaugauuauuaaucag

SEQ ID NO: 1803037 - RNA, 23 nt, Homo sapiens
uccagggcuauagggugugauga

SEQ ID NO: 1803038 - RNA, 16 nt, Homo sapiens
uucaaccuugagacag

SEQ ID NO: 1803039 - RNA, 16 nt, Homo sapiens
auaggacaacacugcu

SEQ ID NO: 1803040 - RNA, 14 nt, Homo sapiens
aagacuguugugcu

SEQ ID NO: 1803041 - RNA, 21 nt, Homo sapiens
uaaggaacauguacuguuacu

SEQ ID NO: 1803042 - RNA, 20 nt, Homo sapiens
gauauaauuacuuaauguga

SEQ ID NO: 1803043 - RNA, 23 nt, Homo sapiens
ugguuacucaaaagaacaagagu

SEQ ID NO: 1803044 - RNA, 20 nt, Homo sapiens
uugugaccccuuucacuuac

SEQ ID NO: 1803045 - RNA, 22 nt, Homo sapiens
ucuucaggguguuaaggcagug

SEQ ID NO: 1803046 - RNA, 14 nt, Homo sapiens
auuugcccaaaauc

SEQ ID NO: 1803047 - RNA, 14 nt, Homo sapiens
cauggagaccaucu

SEQ ID NO: 1803048 - RNA, 18 nt, Homo sapiens
guguaaaauuaauguaau

SEQ ID NO: 1803049 - RNA, 15 nt, Homo sapiens
cuccugcugcucccu

SEQ ID NO: 1803050 - RNA, 16 nt, Homo sapiens
cacugaggguggcacu

SEQ ID NO: 1803051 - RNA, 18 nt, Homo sapiens
cauaguugugcaugccug

SEQ ID NO: 1803052 - RNA, 22 nt, Homo sapiens
cauaucuacacuucgcaccgga

SEQ ID NO: 1803053 - RNA, 17 nt, Homo sapiens
caauuacuacaaaugga

SEQ ID NO: 1803054 - RNA, 12 nt, Homo sapiens
cucacucaggac

SEQ ID NO: 1803055 - RNA, 17 nt, Homo sapiens
ccacagugguacucugu

SEQ ID NO: 1803056 - RNA, 18 nt, Homo sapiens
uguugucucugcucuucc

SEQ ID NO: 1803057 - RNA, 22 nt, Homo sapiens
gacgggcaaaauaaagugacag

SEQ ID NO: 1803058 - RNA, 16 nt, Homo sapiens
uagguuaggaauucaa

SEQ ID NO: 1803059 - RNA, 15 nt, Homo sapiens
ugaguuuagugaucu

SEQ ID NO: 1803060 - RNA, 15 nt, Homo sapiens
cuagaagaauuugag

SEQ ID NO: 1803061 - RNA, 21 nt, Homo sapiens
caacccgugccaaguccaggu

SEQ ID NO: 1803062 - RNA, 18 nt, Homo sapiens
gucagcauguacuccccu

SEQ ID NO: 1803063 - RNA, 23 nt, Homo sapiens
gcugccaaccauaccuuccuucc

SEQ ID NO: 1803064 - RNA, 22 nt, Homo sapiens
acacugcacagaagacagcagc

SEQ ID NO: 1803065 - RNA, 13 nt, Homo sapiens
caaugacauuuau

SEQ ID NO: 1803066 - RNA, 20 nt, Homo sapiens
auauuugggggggaauaaga

SEQ ID NO: 1803067 - RNA, 16 nt, Homo sapiens
auuccuugccaugugg

SEQ ID NO: 1803068 - RNA, 14 nt, Homo sapiens
cauagccagcauuu

SEQ ID NO: 1803069 - RNA, 19 nt, Homo sapiens
agcugaaagaggccaaaca

SEQ ID NO: 1803070 - RNA, 20 nt, Homo sapiens
agcccuccuggaauggagcu

SEQ ID NO: 1803071 - RNA, 14 nt, Homo sapiens
agaaauauggacac

SEQ ID NO: 1803072 - RNA, 19 nt, Homo sapiens
aacuuugaacaagguuuca

SEQ ID NO: 1803073 - RNA, 15 nt, Homo sapiens
ccuucagaagcuauu

SEQ ID NO: 1803074 - RNA, 18 nt, Homo sapiens
auuuauaugcaugcacag

SEQ ID NO: 1803075 - RNA, 22 nt, Homo sapiens
auucagcucuggagaacagugg

SEQ ID NO: 1803076 - RNA, 13 nt, Homo sapiens
uaccuuugcugau

SEQ ID NO: 1803077 - RNA, 15 nt, Homo sapiens
uaaaguaugugcaua

SEQ ID NO: 1803078 - RNA, 21 nt, Homo sapiens
caacacucaagucuauugaau

SEQ ID NO: 1803079 - RNA, 13 nt, Homo sapiens
cuguggugcagug

SEQ ID NO: 1803080 - RNA, 13 nt, Homo sapiens
cuagugugcaagu

SEQ ID NO: 1803081 - RNA, 13 nt, Homo sapiens
cuaaagugcaaaa

SEQ ID NO: 1803082 - RNA, 17 nt, Homo sapiens
aauuagacauaccucuc

SEQ ID NO: 1803083 - RNA, 19 nt, Homo sapiens
cagaaagcuucauccacag

SEQ ID NO: 1803084 - RNA, 13 nt, Homo sapiens
gaaucucagagaa

SEQ ID NO: 1803085 - RNA, 22 nt, Homo sapiens
ugccauuauagcgccuguauaa

SEQ ID NO: 1803086 - RNA, 13 nt, Homo sapiens
uacaacaggcagu

SEQ ID NO: 1803087 - RNA, 15 nt, Homo sapiens
gaauaucugguuucu

SEQ ID NO: 1803088 - RNA, 20 nt, Homo sapiens
cguggggcucccgccuccaa

SEQ ID NO: 1803089 - RNA, 20 nt, Homo sapiens
agcaauucuccugccuuagc

SEQ ID NO: 1803090 - RNA, 17 nt, Homo sapiens
ucaugucccagaacuua

SEQ ID NO: 1803091 - RNA, 14 nt, Homo sapiens
gacagcuauaauua

SEQ ID NO: 1803092 - RNA, 22 nt, Homo sapiens
aucucaaauccuugagcacuca

SEQ ID NO: 1803093 - RNA, 20 nt, Homo sapiens
ggcaggagaauugcuugaac

SEQ ID NO: 1803094 - RNA, 16 nt, Homo sapiens
aguuuacaaucagcca

SEQ ID NO: 1803095 - RNA, 13 nt, Homo sapiens
guuacaucuugua

SEQ ID NO: 1803096 - RNA, 23 nt, Homo sapiens
aguuguggggagauccacuggga

SEQ ID NO: 1803097 - RNA, 20 nt, Homo sapiens
uaaacugucuuuuuccucaa

SEQ ID NO: 1803098 - RNA, 16 nt, Homo sapiens
aaaaaccaaauaagca

SEQ ID NO: 1803099 - RNA, 16 nt, Homo sapiens
gcuggcaagcagggaa

SEQ ID NO: 1803100 - RNA, 18 nt, Homo sapiens
acaaaggcugacauucac

SEQ ID NO: 1803101 - RNA, 12 nt, Homo sapiens
uuucuguucuca

SEQ ID NO: 1803102 - RNA, 12 nt, Homo sapiens
ucuauguucccc

SEQ ID NO: 1803103 - RNA, 12 nt, Homo sapiens
acucaccaucug

SEQ ID NO: 1803104 - RNA, 15 nt, Homo sapiens
auuccuuagcagcuc

SEQ ID NO: 1803105 - RNA, 17 nt, Homo sapiens
caccauucgucaucacu

SEQ ID NO: 1803106 - RNA, 13 nt, Homo sapiens
uaagacacugugc

SEQ ID NO: 1803107 - RNA, 18 nt, Homo sapiens
ccgaguggccauggcaug

SEQ ID NO: 1803108 - RNA, 16 nt, Homo sapiens
aggugauccacccacc

SEQ ID NO: 1803109 - RNA, 16 nt, Homo sapiens
cauuggcacaauguau

SEQ ID NO: 1803110 - RNA, 16 nt, Homo sapiens
uuuuggaauuaugucu

SEQ ID NO: 1803111 - RNA, 21 nt, Homo sapiens
guaacugggaucgcaccuuuu

SEQ ID NO: 1803112 - RNA, 18 nt, Homo sapiens
ggccucugccuccaggag

SEQ ID NO: 1803113 - RNA, 23 nt, Homo sapiens
ugcuagaaaguuaggggguucuu

SEQ ID NO: 1803114 - RNA, 22 nt, Homo sapiens
uugccaacauggugaaacucca

SEQ ID NO: 1803115 - RNA, 19 nt, Homo sapiens
uucucuacagacuccaaaa

SEQ ID NO: 1803116 - RNA, 12 nt, Homo sapiens
ccgaaaagcaaa

SEQ ID NO: 1803117 - RNA, 13 nt, Homo sapiens
acaucucacuuca

SEQ ID NO: 1803118 - RNA, 16 nt, Homo sapiens
cacguaucucuuggua

SEQ ID NO: 1803119 - RNA, 11 nt, Homo sapiens
augcaaugccu

SEQ ID NO: 1803120 - RNA, 13 nt, Homo sapiens
uguaaagaaggga

SEQ ID NO: 1803121 - RNA, 19 nt, Homo sapiens
agagccucuggcaucucuu

SEQ ID NO: 1803122 - RNA, 14 nt, Homo sapiens
gauaaaccaguuga

SEQ ID NO: 1803123 - RNA, 19 nt, Homo sapiens
agcuggacaugcuuuggca

SEQ ID NO: 1803124 - RNA, 21 nt, Homo sapiens
caucucccagaccgccaguga

SEQ ID NO: 1803125 - RNA, 15 nt, Homo sapiens
ugucuccaugcacau

SEQ ID NO: 1803126 - RNA, 22 nt, Homo sapiens
cugguaaaagcaccauugugaa

SEQ ID NO: 1803127 - RNA, 22 nt, Homo sapiens
accaguacucccccagcuuucc

SEQ ID NO: 1803128 - RNA, 21 nt, Homo sapiens
auuaaaacuugggcaccagcu

SEQ ID NO: 1803129 - RNA, 16 nt, Homo sapiens
cauuauucuucacuua

SEQ ID NO: 1803130 - RNA, 16 nt, Homo sapiens
agaggaaguucagauc

SEQ ID NO: 1803131 - RNA, 13 nt, Homo sapiens
uccagucuggauc

SEQ ID NO: 1803132 - RNA, 16 nt, Homo sapiens
cuucuucagauucagc

SEQ ID NO: 1803133 - RNA, 18 nt, Homo sapiens
auuucuccagaacccauu

SEQ ID NO: 1803134 - RNA, 23 nt, Homo sapiens
ucaaaaaaaaaaaaaagaaucca

SEQ ID NO: 1803135 - RNA, 14 nt, Homo sapiens
cuaccaucagggac

SEQ ID NO: 1803136 - RNA, 22 nt, Homo sapiens
gucucaguguccucaucuguaa

SEQ ID NO: 1803137 - RNA, 18 nt, Homo sapiens
aagaaagagucaaugaga

SEQ ID NO: 1803138 - RNA, 18 nt, Homo sapiens
agcaggcccaaugcugcu

SEQ ID NO: 1803139 - RNA, 19 nt, Homo sapiens
aauuucaaaaugcauguga

SEQ ID NO: 1803140 - RNA, 16 nt, Homo sapiens
acucagggaaagcauu

SEQ ID NO: 1803141 - RNA, 19 nt, Homo sapiens
gcugccccccauuucugua

SEQ ID NO: 1803142 - RNA, 19 nt, Homo sapiens
cuugggaaggaaggcagug

SEQ ID NO: 1803143 - RNA, 18 nt, Homo sapiens
ugcccaggcagucuuugc

SEQ ID NO: 1803144 - RNA, 12 nt, Homo sapiens
caacuucugggc

SEQ ID NO: 1803145 - RNA, 23 nt, Homo sapiens
caaguacaaguauauaauauguc

SEQ ID NO: 1803146 - RNA, 17 nt, Homo sapiens
ccuccaagccuggcacc

SEQ ID NO: 1803147 - RNA, 17 nt, Homo sapiens
ugaugaugaugaugacu

SEQ ID NO: 1803148 - RNA, 18 nt, Homo sapiens
aggucaucuuuuuccccu

SEQ ID NO: 1803149 - RNA, 18 nt, Homo sapiens
cuuucuuucuaacuccag

SEQ ID NO: 1803150 - RNA, 13 nt, Homo sapiens
aagaaaaggacaa

SEQ ID NO: 1803151 - RNA, 12 nt, Homo sapiens
uaugaugcacuu

SEQ ID NO: 1803152 - RNA, 19 nt, Homo sapiens
uuugcuucaaaaacauucu

SEQ ID NO: 1803153 - RNA, 21 nt, Homo sapiens
auguuccugccuccuugauau

SEQ ID NO: 1803154 - RNA, 16 nt, Homo sapiens
cuuggucacaugugac

SEQ ID NO: 1803155 - RNA, 17 nt, Homo sapiens
gagaugaggcuggauag

SEQ ID NO: 1803156 - RNA, 22 nt, Homo sapiens
auuugaacuacuuaaacaguau

SEQ ID NO: 1803157 - RNA, 12 nt, Homo sapiens
guugacauggga

SEQ ID NO: 1803158 - RNA, 14 nt, Homo sapiens
caagagucauguca

SEQ ID NO: 1803159 - RNA, 19 nt, Homo sapiens
ugcagaagagaaacugagg

SEQ ID NO: 1803160 - RNA, 19 nt, Homo sapiens
gcagucacacugcugggaa

SEQ ID NO: 1803161 - RNA, 11 nt, Homo sapiens
ccuaucuguaa

SEQ ID NO: 1803162 - RNA, 15 nt, Homo sapiens
gcaaguuagugaaac

SEQ ID NO: 1803163 - RNA, 13 nt, Homo sapiens
gaaaaccucuuuc

SEQ ID NO: 1803164 - RNA, 20 nt, Homo sapiens
ccuuuuauuaauacauucac

SEQ ID NO: 1803165 - RNA, 20 nt, Homo sapiens
ccacugacacccaguguccu

SEQ ID NO: 1803166 - RNA, 13 nt, Homo sapiens
caucaaguguaau

SEQ ID NO: 1803167 - RNA, 17 nt, Homo sapiens
caugguauuaucuagua

SEQ ID NO: 1803168 - RNA, 17 nt, Homo sapiens
ccgugagugacauagcc

SEQ ID NO: 1803169 - RNA, 21 nt, Homo sapiens
aguucuugagggccuccccac

SEQ ID NO: 1803170 - RNA, 20 nt, Homo sapiens
cagaaacccuuuuacaguca

SEQ ID NO: 1803171 - RNA, 16 nt, Homo sapiens
agccaaagcagaauuu

SEQ ID NO: 1803172 - RNA, 19 nt, Homo sapiens
agggcugguguggcugcuc

SEQ ID NO: 1803173 - RNA, 20 nt, Homo sapiens
gacaagacccccagcacuug

SEQ ID NO: 1803174 - RNA, 18 nt, Homo sapiens
aagggaauugcucagaga

SEQ ID NO: 1803175 - RNA, 23 nt, Homo sapiens
accucgaguggcgaguccagaca

SEQ ID NO: 1803176 - RNA, 23 nt, Homo sapiens
gacuuuuuuaaauguuugcaaug

SEQ ID NO: 1803177 - RNA, 19 nt, Homo sapiens
ggacauuuuuucagucaua

SEQ ID NO: 1803178 - RNA, 20 nt, Homo sapiens
cucucccaaaaaacuacuuc

SEQ ID NO: 1803179 - RNA, 17 nt, Homo sapiens
ccaggccagugggccug

SEQ ID NO: 1803180 - RNA, 15 nt, Homo sapiens
uucuccuguugcaau

SEQ ID NO: 1803181 - RNA, 14 nt, Homo sapiens
cagagacagggaaa

SEQ ID NO: 1803182 - RNA, 15 nt, Homo sapiens
ugcacacaccugcac

SEQ ID NO: 1803183 - RNA, 13 nt, Homo sapiens
uggauucuggaug

SEQ ID NO: 1803184 - RNA, 20 nt, Homo sapiens
cagaggcugcugcugcugca

SEQ ID NO: 1803185 - RNA, 17 nt, Homo sapiens
ugguuaguuaacacuga

SEQ ID NO: 1803186 - RNA, 19 nt, Homo sapiens
cuucugaaguguguccauc

SEQ ID NO: 1803187 - RNA, 18 nt, Homo sapiens
cuuguuuccuuagcuugg

SEQ ID NO: 1803188 - RNA, 20 nt, Homo sapiens
aacguucgauuucuaccuca

SEQ ID NO: 1803189 - RNA, 13 nt, Homo sapiens
ugaggggugcugg

SEQ ID NO: 1803190 - RNA, 16 nt, Homo sapiens
gggcccgcaccgacca

SEQ ID NO: 1803191 - RNA, 16 nt, Homo sapiens
uaguauugaaaacuag

SEQ ID NO: 1803192 - RNA, 17 nt, Homo sapiens
acuagagcuugcaguga

SEQ ID NO: 1803193 - RNA, 21 nt, Homo sapiens
uuaccaggcaccaaaagaagu

SEQ ID NO: 1803194 - RNA, 23 nt, Homo sapiens
aaaaauuauuagaacauucacuu

SEQ ID NO: 1803195 - RNA, 17 nt, Homo sapiens
cugagaacagugcacaa

SEQ ID NO: 1803196 - RNA, 17 nt, Homo sapiens
ucugauucuacagugau

SEQ ID NO: 1803197 - RNA, 14 nt, Homo sapiens
uagaggcuuucaaa

SEQ ID NO: 1803198 - RNA, 19 nt, Homo sapiens
auagauuguaauacacaua

SEQ ID NO: 1803199 - RNA, 23 nt, Homo sapiens
cccaguccaagaccccaaaucac

SEQ ID NO: 1803200 - RNA, 16 nt, Homo sapiens
uccagggccagaugag

SEQ ID NO: 1803201 - RNA, 18 nt, Homo sapiens
aguggcguuguucauaga

SEQ ID NO: 1803202 - RNA, 15 nt, Homo sapiens
uccagccugcuguau

SEQ ID NO: 1803203 - RNA, 22 nt, Homo sapiens
gaggcucuaaccacacagccua

SEQ ID NO: 1803204 - RNA, 13 nt, Homo sapiens
gguuaauguaaua

SEQ ID NO: 1803205 - RNA, 15 nt, Homo sapiens
accuuuccccacucc

SEQ ID NO: 1803206 - RNA, 13 nt, Homo sapiens
gauauaugcucug

SEQ ID NO: 1803207 - RNA, 23 nt, Homo sapiens
cuggaccauaauagacaccaaaa

SEQ ID NO: 1803208 - RNA, 23 nt, Homo sapiens
guaacuucucccuucuccugacc

SEQ ID NO: 1803209 - RNA, 17 nt, Homo sapiens
uuuugcagaaugagcca

SEQ ID NO: 1803210 - RNA, 21 nt, Homo sapiens
gacgguuaacuuguauauucc

SEQ ID NO: 1803211 - RNA, 15 nt, Homo sapiens
aauaaaaaguucaga

SEQ ID NO: 1803212 - RNA, 18 nt, Homo sapiens
gagagcuuaaauugucau

SEQ ID NO: 1803213 - RNA, 22 nt, Homo sapiens
uauauuggaaucuguaucagaa

SEQ ID NO: 1803214 - RNA, 23 nt, Homo sapiens
aauguccuugugaugugcacgua

SEQ ID NO: 1803215 - RNA, 23 nt, Homo sapiens
uuuguggcauaaauuacagucau

SEQ ID NO: 1803216 - RNA, 22 nt, Homo sapiens
gcaguugaaacaagaagccaca

SEQ ID NO: 1803217 - RNA, 16 nt, Homo sapiens
aucccuucggagccaa

SEQ ID NO: 1803218 - RNA, 19 nt, Homo sapiens
aaugggaaauguuuggcca

SEQ ID NO: 1803219 - RNA, 17 nt, Homo sapiens
acagagggcaggcacuc

SEQ ID NO: 1803220 - RNA, 16 nt, Homo sapiens
ucaacuuuuccuuuca

SEQ ID NO: 1803221 - RNA, 19 nt, Homo sapiens
uauauauucuacacauaua

SEQ ID NO: 1803222 - RNA, 18 nt, Homo sapiens
acaccagaguguaugcau

SEQ ID NO: 1803223 - RNA, 13 nt, Homo sapiens
ggcugauuuacua

SEQ ID NO: 1803224 - RNA, 21 nt, Homo sapiens
cuucaucuguucagucaucuc

SEQ ID NO: 1803225 - RNA, 20 nt, Homo sapiens
cugucaucuuuuuccacuuu

SEQ ID NO: 1803226 - RNA, 14 nt, Homo sapiens
agcacacacuuuug

SEQ ID NO: 1803227 - RNA, 12 nt, Homo sapiens
ugaaagaacaag

SEQ ID NO: 1803228 - RNA, 20 nt, Homo sapiens
aaggaauuuccucccaauuc

SEQ ID NO: 1803229 - RNA, 18 nt, Homo sapiens
auugucuugguugccagu

SEQ ID NO: 1803230 - RNA, 21 nt, Homo sapiens
ccagaaccuguccuugcacac

SEQ ID NO: 1803231 - RNA, 16 nt, Homo sapiens
gaacugaucauguuua

SEQ ID NO: 1803232 - RNA, 18 nt, Homo sapiens
cauaaaaacuacugaaua

SEQ ID NO: 1803233 - RNA, 13 nt, Homo sapiens
ccuacauuaucuc

SEQ ID NO: 1803234 - RNA, 16 nt, Homo sapiens
auacagcucuucucag

SEQ ID NO: 1803235 - RNA, 19 nt, Homo sapiens
uugucaugguuacaaacua

SEQ ID NO: 1803236 - RNA, 23 nt, Homo sapiens
ucuccuauuccuucacacaguuc

SEQ ID NO: 1803237 - RNA, 16 nt, Homo sapiens
aauucugcuccugaaa

SEQ ID NO: 1803238 - RNA, 13 nt, Homo sapiens
cuaauuaggcaag

SEQ ID NO: 1803239 - RNA, 22 nt, Homo sapiens
uucuauaacagauauggcagcu

SEQ ID NO: 1803240 - RNA, 18 nt, Homo sapiens
acccccgacccugcccug

SEQ ID NO: 1803241 - RNA, 23 nt, Homo sapiens
aaggacuuuccuuccuccaucuc

SEQ ID NO: 1803242 - RNA, 20 nt, Homo sapiens
aacagaguuugauaugggcu

SEQ ID NO: 1803243 - RNA, 15 nt, Homo sapiens
gccacagagaaguuu

SEQ ID NO: 1803244 - RNA, 14 nt, Homo sapiens
uauuagcagcaaaa

SEQ ID NO: 1803245 - RNA, 12 nt, Homo sapiens
ucaaaacacugu

SEQ ID NO: 1803246 - RNA, 18 nt, Homo sapiens
uuaaauacacauuaucac

SEQ ID NO: 1803247 - RNA, 14 nt, Homo sapiens
guugagaauguuca

SEQ ID NO: 1803248 - RNA, 13 nt, Homo sapiens
guuacugcaguga

SEQ ID NO: 1803249 - RNA, 22 nt, Homo sapiens
ugcugaagguccaggcuugccu

SEQ ID NO: 1803250 - RNA, 13 nt, Homo sapiens
aucccaacuuccu

SEQ ID NO: 1803251 - RNA, 13 nt, Homo sapiens
uaaauaacaaaac

SEQ ID NO: 1803252 - RNA, 19 nt, Homo sapiens
ugaguuucuggcucuugag

SEQ ID NO: 1803253 - RNA, 16 nt, Homo sapiens
ucuacuuaaugagaua

SEQ ID NO: 1803254 - RNA, 14 nt, Homo sapiens
ucagagcuacacaa

SEQ ID NO: 1803255 - RNA, 14 nt, Homo sapiens
acagaacuucacag

SEQ ID NO: 1803256 - RNA, 19 nt, Homo sapiens
aggagaucuggcugugagg

SEQ ID NO: 1803257 - RNA, 17 nt, Homo sapiens
ugugaaacucaucucau

SEQ ID NO: 1803258 - RNA, 14 nt, Homo sapiens
uugauguacuuuac

SEQ ID NO: 1803259 - RNA, 22 nt, Homo sapiens
uggggagaagaaauacagucaa

SEQ ID NO: 1803260 - RNA, 20 nt, Homo sapiens
ugcagaggauaaggaggcac

SEQ ID NO: 1803261 - RNA, 17 nt, Homo sapiens
ugacuaacuagacacca

SEQ ID NO: 1803262 - RNA, 17 nt, Homo sapiens
aagauauaagacuuaau

SEQ ID NO: 1803263 - RNA, 23 nt, Homo sapiens
uauacaauaauugaaguguuccc

SEQ ID NO: 1803264 - RNA, 13 nt, Homo sapiens
agcacacuggaau

SEQ ID NO: 1803265 - RNA, 23 nt, Homo sapiens
aaucauaugguugacaguaugca

SEQ ID NO: 1803266 - RNA, 23 nt, Homo sapiens
aacauaguauucaugacuaugga

SEQ ID NO: 1803267 - RNA, 21 nt, Homo sapiens
caucucaccuucagucaagaa

SEQ ID NO: 1803268 - RNA, 16 nt, Homo sapiens
cagaaagcauccuaaa

SEQ ID NO: 1803269 - RNA, 13 nt, Homo sapiens
auuccuagcaaau

SEQ ID NO: 1803270 - RNA, 18 nt, Homo sapiens
agcacuggaaccaccugg

SEQ ID NO: 1803271 - RNA, 20 nt, Homo sapiens
ccccaccuugccaagcuuuc

SEQ ID NO: 1803272 - RNA, 11 nt, Homo sapiens
aaaauucucau

SEQ ID NO: 1803273 - RNA, 18 nt, Homo sapiens
cauuuuuaagaacaagca

SEQ ID NO: 1803274 - RNA, 22 nt, Homo sapiens
cucauauaaaaggugagcucag

SEQ ID NO: 1803275 - RNA, 20 nt, Homo sapiens
aguucacauuaacucaggca

SEQ ID NO: 1803276 - RNA, 17 nt, Homo sapiens
cauauauacacauauac

SEQ ID NO: 1803277 - RNA, 17 nt, Homo sapiens
ucuuuccuuccuuccuc

SEQ ID NO: 1803278 - RNA, 14 nt, Homo sapiens
agaacagccagacc

SEQ ID NO: 1803279 - RNA, 18 nt, Homo sapiens
cuuucugaaauuagggcc

SEQ ID NO: 1803280 - RNA, 15 nt, Homo sapiens
ucaguacagcacucc

SEQ ID NO: 1803281 - RNA, 11 nt, Homo sapiens
gcuccuggacu

SEQ ID NO: 1803282 - RNA, 15 nt, Homo sapiens
cuguuuugccuucac

SEQ ID NO: 1803283 - RNA, 15 nt, Homo sapiens
cagggacauuuucaa

SEQ ID NO: 1803284 - RNA, 21 nt, Homo sapiens
cucuuggagcuuuuuugcaua

SEQ ID NO: 1803285 - RNA, 17 nt, Homo sapiens
ucccucuguuaggucca

SEQ ID NO: 1803286 - RNA, 20 nt, Homo sapiens
ugugacuauaaagcuguuau

SEQ ID NO: 1803287 - RNA, 16 nt, Homo sapiens
ggaaagaugaucagcu

SEQ ID NO: 1803288 - RNA, 22 nt, Homo sapiens
uugauacugaccuuguagcuau

SEQ ID NO: 1803289 - RNA, 23 nt, Homo sapiens
ggccuccagagaccccaggaaca

SEQ ID NO: 1803290 - RNA, 17 nt, Homo sapiens
gaaaagauuuaagcaca

SEQ ID NO: 1803291 - RNA, 13 nt, Homo sapiens
gccgugccuggug

SEQ ID NO: 1803292 - RNA, 20 nt, Homo sapiens
ccuguauucuacagcagaua

SEQ ID NO: 1803293 - RNA, 22 nt, Homo sapiens
ugauuuuauuguacaaguugaa

SEQ ID NO: 1803294 - RNA, 12 nt, Homo sapiens
ccgcucucucug

SEQ ID NO: 1803295 - RNA, 20 nt, Homo sapiens
gucuccucuucaaauaaaca

SEQ ID NO: 1803296 - RNA, 17 nt, Homo sapiens
ccagcuacaggcuugag

SEQ ID NO: 1803297 - RNA, 13 nt, Homo sapiens
gagccaccaugcc

SEQ ID NO: 1803298 - RNA, 17 nt, Homo sapiens
gaaaggcaucuaagaca

SEQ ID NO: 1803299 - RNA, 19 nt, Homo sapiens
ccucuuugucuaaaacaau

SEQ ID NO: 1803300 - RNA, 12 nt, Homo sapiens
gccugugccagc

SEQ ID NO: 1803301 - RNA, 19 nt, Homo sapiens
ucagcaaaugccuuuucaa

SEQ ID NO: 1803302 - RNA, 13 nt, Homo sapiens
gucaaaacugaag

SEQ ID NO: 1803303 - RNA, 17 nt, Homo sapiens
gcuggccgcugugccag

SEQ ID NO: 1803304 - RNA, 21 nt, Homo sapiens
ggaacuagagggauacacuga

SEQ ID NO: 1803305 - RNA, 22 nt, Homo sapiens
auauguauuuugucauauguau

SEQ ID NO: 1803306 - RNA, 23 nt, Homo sapiens
uaguauucugaucaguugccaaa

SEQ ID NO: 1803307 - RNA, 16 nt, Homo sapiens
ugccccucaccugccu

SEQ ID NO: 1803308 - RNA, 14 nt, Homo sapiens
ggcuuccaugccug

SEQ ID NO: 1803309 - RNA, 19 nt, Homo sapiens
uccugacuuuuaaugucau

SEQ ID NO: 1803310 - RNA, 19 nt, Homo sapiens
cuaaaaccacaugugcaac

SEQ ID NO: 1803311 - RNA, 13 nt, Homo sapiens
aaagggaaguagu

SEQ ID NO: 1803312 - RNA, 16 nt, Homo sapiens
acucauuucaucucau

SEQ ID NO: 1803313 - RNA, 22 nt, Homo sapiens
agugagcccaucugcacagugg

SEQ ID NO: 1803314 - RNA, 12 nt, Homo sapiens
uggccacggcca

SEQ ID NO: 1803315 - RNA, 20 nt, Homo sapiens
ggcagacacagggacuugaa

SEQ ID NO: 1803316 - RNA, 15 nt, Homo sapiens
gucccuccaaagggc

SEQ ID NO: 1803317 - RNA, 16 nt, Homo sapiens
ccucccgucuucagau

SEQ ID NO: 1803318 - RNA, 18 nt, Homo sapiens
gauauuuauuuuuugcca

SEQ ID NO: 1803319 - RNA, 14 nt, Homo sapiens
cuguaaucacagcu

SEQ ID NO: 1803320 - RNA, 18 nt, Homo sapiens
auuaaugagaauuccuua

SEQ ID NO: 1803321 - RNA, 19 nt, Homo sapiens
accugccccccagccuuca

SEQ ID NO: 1803322 - RNA, 19 nt, Homo sapiens
cauaagacacuuagauuaa

SEQ ID NO: 1803323 - RNA, 15 nt, Homo sapiens
gaaaauacauuauua

SEQ ID NO: 1803324 - RNA, 20 nt, Homo sapiens
agcagcucacacccuaccuu

SEQ ID NO: 1803325 - RNA, 19 nt, Homo sapiens
aauuguagcaucuaaugaa

SEQ ID NO: 1803326 - RNA, 18 nt, Homo sapiens
cuacaaaacaauucaauu

SEQ ID NO: 1803327 - RNA, 15 nt, Homo sapiens
cuauggaaggguaau

SEQ ID NO: 1803328 - RNA, 21 nt, Homo sapiens
ugccaguuccagcuucaucua

SEQ ID NO: 1803329 - RNA, 17 nt, Homo sapiens
uuaagagugaagucaug

SEQ ID NO: 1803330 - RNA, 15 nt, Homo sapiens
aggagagagucccag

SEQ ID NO: 1803331 - RNA, 9 nt, Homo sapiens
augacaaau

SEQ ID NO: 1803332 - RNA, 15 nt, Homo sapiens
uaauugaacuaacaa

SEQ ID NO: 1803333 - RNA, 13 nt, Homo sapiens
uccucgcugccag

SEQ ID NO: 1803334 - RNA, 21 nt, Homo sapiens
ggaauccaguguggcucccac

SEQ ID NO: 1803335 - RNA, 16 nt, Homo sapiens
aauacugacuuucaaa

SEQ ID NO: 1803336 - RNA, 22 nt, Homo sapiens
acuguuuuuauaugcacaugua

SEQ ID NO: 1803337 - RNA, 18 nt, Homo sapiens
auccuccucuccaugcaa

SEQ ID NO: 1803338 - RNA, 14 nt, Homo sapiens
aggauauugucagu

SEQ ID NO: 1803339 - RNA, 22 nt, Homo sapiens
gaccuuggagcgagucugcccc

SEQ ID NO: 1803340 - RNA, 15 nt, Homo sapiens
ucaggcuucugagua

SEQ ID NO: 1803341 - RNA, 20 nt, Homo sapiens
uaaggaaguaucagcacuag

SEQ ID NO: 1803342 - RNA, 19 nt, Homo sapiens
ucaggcacaggucaggggu

SEQ ID NO: 1803343 - RNA, 15 nt, Homo sapiens
gcugccagugccugg

SEQ ID NO: 1803344 - RNA, 18 nt, Homo sapiens
ucucccauacuuuugaag

SEQ ID NO: 1803345 - RNA, 22 nt, Homo sapiens
acgugccaccaugacuggcuaa

SEQ ID NO: 1803346 - RNA, 13 nt, Homo sapiens
auaagugaagguu

SEQ ID NO: 1803347 - RNA, 20 nt, Homo sapiens
uagaaaagcaaagggugcua

SEQ ID NO: 1803348 - RNA, 22 nt, Homo sapiens
gucccucccucaccagccucac

SEQ ID NO: 1803349 - RNA, 19 nt, Homo sapiens
agguauugucuuuugacau

SEQ ID NO: 1803350 - RNA, 16 nt, Homo sapiens
gcagaccucaagccau

SEQ ID NO: 1803351 - RNA, 14 nt, Homo sapiens
ucuuaaaucugccu

SEQ ID NO: 1803352 - RNA, 23 nt, Homo sapiens
guggacaaacagggaacaaagaa

SEQ ID NO: 1803353 - RNA, 14 nt, Homo sapiens
ugugcauaugcaug

SEQ ID NO: 1803354 - RNA, 13 nt, Homo sapiens
gcaaacaggcagu

SEQ ID NO: 1803355 - RNA, 17 nt, Homo sapiens
aagaguccuuguuccag

SEQ ID NO: 1803356 - RNA, 15 nt, Homo sapiens
caugacauagcuuga

SEQ ID NO: 1803357 - RNA, 20 nt, Homo sapiens
guucaggaguuggagaccag

SEQ ID NO: 1803358 - RNA, 13 nt, Homo sapiens
aacaaaguccaca

SEQ ID NO: 1803359 - RNA, 21 nt, Homo sapiens
caugcgauguguccaaucgga

SEQ ID NO: 1803360 - RNA, 20 nt, Homo sapiens
ugugauuauuuuaugcacac

SEQ ID NO: 1803361 - RNA, 12 nt, Homo sapiens
ccuggugagaaa

SEQ ID NO: 1803362 - RNA, 12 nt, Homo sapiens
aaaucuaugaaa

SEQ ID NO: 1803363 - RNA, 18 nt, Homo sapiens
uugacaacaauccaaaaa

SEQ ID NO: 1803364 - RNA, 21 nt, Homo sapiens
uucuauacaacaggcagugga

SEQ ID NO: 1803365 - RNA, 14 nt, Homo sapiens
aauaauaaaaugca

SEQ ID NO: 1803366 - RNA, 15 nt, Homo sapiens
caaggggcuuugucc

SEQ ID NO: 1803367 - RNA, 22 nt, Homo sapiens
gcagaucauuucccaaaauucu

SEQ ID NO: 1803368 - RNA, 12 nt, Homo sapiens
uuggaagcacug

SEQ ID NO: 1803369 - RNA, 12 nt, Homo sapiens
auguaagcucuu

SEQ ID NO: 1803370 - RNA, 23 nt, Homo sapiens
auugaaauaaaugacaauguaau

SEQ ID NO: 1803371 - RNA, 17 nt, Homo sapiens
ucccaucccaucccauc

SEQ ID NO: 1803372 - RNA, 11 nt, Homo sapiens
agguggcaagc

SEQ ID NO: 1803373 - RNA, 13 nt, Homo sapiens
auuccaaacuuua

SEQ ID NO: 1803374 - RNA, 14 nt, Homo sapiens
gucaacacaaagac

SEQ ID NO: 1803375 - RNA, 21 nt, Homo sapiens
uaacaacuaauuauaaugcaa

SEQ ID NO: 1803376 - RNA, 19 nt, Homo sapiens
ccugcauggcucacacaga

SEQ ID NO: 1803377 - RNA, 20 nt, Homo sapiens
uaaacgacaagaauaauuca

SEQ ID NO: 1803378 - RNA, 22 nt, Homo sapiens
agucuaucaaccccagacacug

SEQ ID NO: 1803379 - RNA, 15 nt, Homo sapiens
ccuucuuugcugcug

SEQ ID NO: 1803380 - RNA, 23 nt, Homo sapiens
aaugcaaccauuuuuaggaagcu

SEQ ID NO: 1803381 - RNA, 21 nt, Homo sapiens
aaaacagauuuuagacuuacc

SEQ ID NO: 1803382 - RNA, 16 nt, Homo sapiens
acugaauuuugucuuu

SEQ ID NO: 1803383 - RNA, 15 nt, Homo sapiens
guaagacucauuccc

SEQ ID NO: 1803384 - RNA, 14 nt, Homo sapiens
uggggcaagccagg

SEQ ID NO: 1803385 - RNA, 17 nt, Homo sapiens
uacuugccacacacugu

SEQ ID NO: 1803386 - RNA, 23 nt, Homo sapiens
cugcagcccgccuuggcuuucuc

SEQ ID NO: 1803387 - RNA, 19 nt, Homo sapiens
gguugggagcagagcuaag

SEQ ID NO: 1803388 - RNA, 16 nt, Homo sapiens
ugagaccgaaucucac

SEQ ID NO: 1803389 - RNA, 19 nt, Homo sapiens
ucagucucugaauacacag

SEQ ID NO: 1803390 - RNA, 19 nt, Homo sapiens
caucugagcccagagauaa

SEQ ID NO: 1803391 - RNA, 18 nt, Homo sapiens
caaugucucuuugugcuc

SEQ ID NO: 1803392 - RNA, 18 nt, Homo sapiens
cuuaauagccauaugcaa

SEQ ID NO: 1803393 - RNA, 12 nt, Homo sapiens
acuucagucuuc

SEQ ID NO: 1803394 - RNA, 22 nt, Homo sapiens
aauacugaaccacuuugauauu

SEQ ID NO: 1803395 - RNA, 20 nt, Homo sapiens
ucaggcaaacguccacaaag

SEQ ID NO: 1803396 - RNA, 9 nt, Homo sapiens
aaauacuug

SEQ ID NO: 1803397 - RNA, 18 nt, Homo sapiens
aggcggucaugugugcau

SEQ ID NO: 1803398 - RNA, 22 nt, Homo sapiens
aauguucuccucaaacauuuau

SEQ ID NO: 1803399 - RNA, 22 nt, Homo sapiens
acuggagcacugaucaauccuu

SEQ ID NO: 1803400 - RNA, 15 nt, Homo sapiens
ucuuaaaaccagaga

SEQ ID NO: 1803401 - RNA, 19 nt, Homo sapiens
cauaaccgcugauucucag

SEQ ID NO: 1803402 - RNA, 22 nt, Homo sapiens
ggaguacaccccaacagcaccc

SEQ ID NO: 1803403 - RNA, 20 nt, Homo sapiens
acuucccaaagcacaaagca

SEQ ID NO: 1803404 - RNA, 15 nt, Homo sapiens
uaugaauaugauccc

SEQ ID NO: 1803405 - RNA, 16 nt, Homo sapiens
auauuuuuccacuuaa

SEQ ID NO: 1803406 - RNA, 20 nt, Homo sapiens
acagagucuggcucugucac

SEQ ID NO: 1803407 - RNA, 18 nt, Homo sapiens
gcgggggggggggcggug

SEQ ID NO: 1803408 - RNA, 21 nt, Homo sapiens
cacaguggucuggaauggacu

SEQ ID NO: 1803409 - RNA, 17 nt, Homo sapiens
cugggacagccacugga

SEQ ID NO: 1803410 - RNA, 14 nt, Homo sapiens
uggauaaguagaau

SEQ ID NO: 1803411 - RNA, 19 nt, Homo sapiens
gaaugaggaacaaucacaa

SEQ ID NO: 1803412 - RNA, 20 nt, Homo sapiens
cgugguuacucacaccugua

SEQ ID NO: 1803413 - RNA, 21 nt, Homo sapiens
ugggaaaaucuauuccugcca

SEQ ID NO: 1803414 - RNA, 21 nt, Homo sapiens
cuugaggcggauggcugugac

SEQ ID NO: 1803415 - RNA, 13 nt, Homo sapiens
ucuguucagauua

SEQ ID NO: 1803416 - RNA, 17 nt, Homo sapiens
gaaagacaucacauccc

SEQ ID NO: 1803417 - RNA, 17 nt, Homo sapiens
cacugguuuacacuuua

SEQ ID NO: 1803418 - RNA, 21 nt, Homo sapiens
cuugcuuuggucuucuuccaa

SEQ ID NO: 1803419 - RNA, 16 nt, Homo sapiens
guuuccucauuccuga

SEQ ID NO: 1803420 - RNA, 13 nt, Homo sapiens
ugcugucugggug

SEQ ID NO: 1803421 - RNA, 13 nt, Homo sapiens
gaacuaggugauc

SEQ ID NO: 1803422 - RNA, 23 nt, Homo sapiens
aaacuuuaggcccugccccagau

SEQ ID NO: 1803423 - RNA, 22 nt, Homo sapiens
uccaaucacccccaggaccucu

SEQ ID NO: 1803424 - RNA, 22 nt, Homo sapiens
aucucugucccacuuggcauca

SEQ ID NO: 1803425 - RNA, 19 nt, Homo sapiens
guuccugauagcuacccac

SEQ ID NO: 1803426 - RNA, 21 nt, Homo sapiens
aggcacagccggggccugccu

SEQ ID NO: 1803427 - RNA, 20 nt, Homo sapiens
ggucuagaaacauuucuauu

SEQ ID NO: 1803428 - RNA, 15 nt, Homo sapiens
cagaguguucccuga

SEQ ID NO: 1803429 - RNA, 15 nt, Homo sapiens
aaugaauuauguuau

SEQ ID NO: 1803430 - RNA, 12 nt, Homo sapiens
aucuucuuggag

SEQ ID NO: 1803431 - RNA, 15 nt, Homo sapiens
gcuuugcagugacag

SEQ ID NO: 1803432 - RNA, 16 nt, Homo sapiens
ucuacacauugcuacc

SEQ ID NO: 1803433 - RNA, 17 nt, Homo sapiens
uaaaugacuuuucuuaa

SEQ ID NO: 1803434 - RNA, 23 nt, Homo sapiens
aucaaagugugauauacaaagug

SEQ ID NO: 1803435 - RNA, 14 nt, Homo sapiens
gugugcgagucuga

SEQ ID NO: 1803436 - RNA, 16 nt, Homo sapiens
ucuacugugugaucag

SEQ ID NO: 1803437 - RNA, 22 nt, Homo sapiens
aguuuaugaugcaaaucugcca

SEQ ID NO: 1803438 - RNA, 12 nt, Homo sapiens
agauucauccau

SEQ ID NO: 1803439 - RNA, 12 nt, Homo sapiens
cucacauauuca

SEQ ID NO: 1803440 - RNA, 21 nt, Homo sapiens
ccucauggcaucauccauucu

SEQ ID NO: 1803441 - RNA, 20 nt, Homo sapiens
auagaauggagggagcucca

SEQ ID NO: 1803442 - RNA, 15 nt, Homo sapiens
ccugagagucagggu

SEQ ID NO: 1803443 - RNA, 16 nt, Homo sapiens
guuaauuauuuugaca

SEQ ID NO: 1803444 - RNA, 13 nt, Homo sapiens
aaaguacuaugaa

SEQ ID NO: 1803445 - RNA, 14 nt, Homo sapiens
cucuccucagacuu

SEQ ID NO: 1803446 - RNA, 18 nt, Homo sapiens
acaaagggcaggccuguu

SEQ ID NO: 1803447 - RNA, 22 nt, Homo sapiens
uaccagccuuggauacuccaug

SEQ ID NO: 1803448 - RNA, 23 nt, Homo sapiens
acagccucagaauaaaagaugau

SEQ ID NO: 1803449 - RNA, 15 nt, Homo sapiens
cgcccaaggcccacg

SEQ ID NO: 1803450 - RNA, 22 nt, Homo sapiens
ccuaauucuuguagaugcauua

SEQ ID NO: 1803451 - RNA, 14 nt, Homo sapiens
cugaaaaacugauc

SEQ ID NO: 1803452 - RNA, 14 nt, Homo sapiens
ccugucaaccugaa

SEQ ID NO: 1803453 - RNA, 15 nt, Homo sapiens
auuccuggcaugaca

SEQ ID NO: 1803454 - RNA, 17 nt, Homo sapiens
gcccagggccaccucuu

SEQ ID NO: 1803455 - RNA, 14 nt, Homo sapiens
caguagggcugcua

SEQ ID NO: 1803456 - RNA, 13 nt, Homo sapiens
uuuucucucaggg

SEQ ID NO: 1803457 - RNA, 22 nt, Homo sapiens
uaaugcuuccccacgggaacau

SEQ ID NO: 1803458 - RNA, 15 nt, Homo sapiens
ggccaaagaaggcag

SEQ ID NO: 1803459 - RNA, 20 nt, Homo sapiens
ggagaaucauguuucuuuga

SEQ ID NO: 1803460 - RNA, 17 nt, Homo sapiens
ugacgacuucacacuau

SEQ ID NO: 1803461 - RNA, 16 nt, Homo sapiens
aauuggcaucauucuc

SEQ ID NO: 1803462 - RNA, 14 nt, Homo sapiens
aggcagggcucucu

SEQ ID NO: 1803463 - RNA, 15 nt, Homo sapiens
acaguccucccaucu

SEQ ID NO: 1803464 - RNA, 16 nt, Homo sapiens
ugagccuuuguugcua

SEQ ID NO: 1803465 - RNA, 20 nt, Homo sapiens
caaaaaaacauuugucagua

SEQ ID NO: 1803466 - RNA, 16 nt, Homo sapiens
aguugcaaagcauuug

SEQ ID NO: 1803467 - RNA, 20 nt, Homo sapiens
cuccagcugggcucugcaau

SEQ ID NO: 1803468 - RNA, 16 nt, Homo sapiens
gccccaagacucugcu

SEQ ID NO: 1803469 - RNA, 15 nt, Homo sapiens
agccugugcaaaaaa

SEQ ID NO: 1803470 - RNA, 14 nt, Homo sapiens
gaggaggggaccaa

SEQ ID NO: 1803471 - RNA, 15 nt, Homo sapiens
cccagcugcacuuua

SEQ ID NO: 1803472 - RNA, 20 nt, Homo sapiens
ucagggacucggguggccug

SEQ ID NO: 1803473 - RNA, 20 nt, Homo sapiens
accucaguuucccucuguau

SEQ ID NO: 1803474 - RNA, 12 nt, Homo sapiens
acagagaaagca

SEQ ID NO: 1803475 - RNA, 13 nt, Homo sapiens
gggaucauuauuu

SEQ ID NO: 1803476 - RNA, 21 nt, Homo sapiens
aaucaagacugcaaacccuuu

SEQ ID NO: 1803477 - RNA, 22 nt, Homo sapiens
gaaagaggcacccuuccaucug

SEQ ID NO: 1803478 - RNA, 16 nt, Homo sapiens
ggauaauuccccaaga

SEQ ID NO: 1803479 - RNA, 20 nt, Homo sapiens
agauguuugcuuuuguuaaa

SEQ ID NO: 1803480 - RNA, 20 nt, Homo sapiens
cuaugcagaagauacgugca

SEQ ID NO: 1803481 - RNA, 13 nt, Homo sapiens
aacuaugugaugu

SEQ ID NO: 1803482 - RNA, 19 nt, Homo sapiens
uucuucaucugugacuccu

SEQ ID NO: 1803483 - RNA, 18 nt, Homo sapiens
aaauauuugcuaugaagc

SEQ ID NO: 1803484 - RNA, 17 nt, Homo sapiens
cauauauguauauacac

SEQ ID NO: 1803485 - RNA, 15 nt, Homo sapiens
uaacauugcacuuua

SEQ ID NO: 1803486 - RNA, 18 nt, Homo sapiens
gccuccaccgcugccuaa

SEQ ID NO: 1803487 - RNA, 19 nt, Homo sapiens
aaaguauucuucucuuccu

SEQ ID NO: 1803488 - RNA, 20 nt, Homo sapiens
gucuuaugaaacaauuugag

SEQ ID NO: 1803489 - RNA, 17 nt, Homo sapiens
cuuagugcaauaccugg

SEQ ID NO: 1803490 - RNA, 17 nt, Homo sapiens
aacaugcuugcauuaua

SEQ ID NO: 1803491 - RNA, 21 nt, Homo sapiens
aauuucuuccuuccacaguua

SEQ ID NO: 1803492 - RNA, 15 nt, Homo sapiens
cugucaucagccugu

SEQ ID NO: 1803493 - RNA, 19 nt, Homo sapiens
cacuccccuaucccauucu

SEQ ID NO: 1803494 - RNA, 21 nt, Homo sapiens
caaaauuaucagugcucugcu

SEQ ID NO: 1803495 - RNA, 14 nt, Homo sapiens
cucccccaucccua

SEQ ID NO: 1803496 - RNA, 15 nt, Homo sapiens
ucccugccacauaca

SEQ ID NO: 1803497 - RNA, 19 nt, Homo sapiens
acuucagcaguaccuauaa

SEQ ID NO: 1803498 - RNA, 15 nt, Homo sapiens
ggccaagccuaucaa

SEQ ID NO: 1803499 - RNA, 14 nt, Homo sapiens
cuccuaucuguguu

SEQ ID NO: 1803500 - RNA, 15 nt, Homo sapiens
uaggcucugccuucg

SEQ ID NO: 1803501 - RNA, 22 nt, Homo sapiens
gaaucccuuugcaccugagacc

SEQ ID NO: 1803502 - RNA, 22 nt, Homo sapiens
agcagcuagugguggcuucucc

SEQ ID NO: 1803503 - RNA, 20 nt, Homo sapiens
ugaaugaagcuaaugugaau

SEQ ID NO: 1803504 - RNA, 15 nt, Homo sapiens
gcuguuccacaaagc

SEQ ID NO: 1803505 - RNA, 13 nt, Homo sapiens
ucuccauuacacg

SEQ ID NO: 1803506 - RNA, 22 nt, Homo sapiens
ccugacugguugucagaaugga

SEQ ID NO: 1803507 - RNA, 19 nt, Homo sapiens
auggugcacugagcugcaa

SEQ ID NO: 1803508 - RNA, 19 nt, Homo sapiens
acuaugggcccgagcucau

SEQ ID NO: 1803509 - RNA, 14 nt, Homo sapiens
accagaacccagug

SEQ ID NO: 1803510 - RNA, 18 nt, Homo sapiens
agccuucagucccuauca

SEQ ID NO: 1803511 - RNA, 23 nt, Homo sapiens
gggauuauaggcaugagccacug

SEQ ID NO: 1803512 - RNA, 15 nt, Homo sapiens
cuuuuuucuauucaa

SEQ ID NO: 1803513 - RNA, 23 nt, Homo sapiens
cuaaugacaaguauuuucuacua

SEQ ID NO: 1803514 - RNA, 14 nt, Homo sapiens
cagacacacacaca

SEQ ID NO: 1803515 - RNA, 22 nt, Homo sapiens
cagucacaugaccugaucacua

SEQ ID NO: 1803516 - RNA, 16 nt, Homo sapiens
guauucccacaccagg

SEQ ID NO: 1803517 - RNA, 17 nt, Homo sapiens
cauaaaugacacuacuu

SEQ ID NO: 1803518 - RNA, 18 nt, Homo sapiens
ucuucuuucagacuugcc

SEQ ID NO: 1803519 - RNA, 18 nt, Homo sapiens
gugggacaaaccagagca

SEQ ID NO: 1803520 - RNA, 21 nt, Homo sapiens
gccucucggugaccuccgucc

SEQ ID NO: 1803521 - RNA, 16 nt, Homo sapiens
uucccagcaacacucc

SEQ ID NO: 1803522 - RNA, 21 nt, Homo sapiens
ggcccuggaugguccucuuac

SEQ ID NO: 1803523 - RNA, 19 nt, Homo sapiens
cccaaguuggagugcagug

SEQ ID NO: 1803524 - RNA, 19 nt, Homo sapiens
guuugagcgcagaguaaaa

SEQ ID NO: 1803525 - RNA, 16 nt, Homo sapiens
ccucuuuguuuaucuc

SEQ ID NO: 1803526 - RNA, 15 nt, Homo sapiens
uccaugcucuugacc

SEQ ID NO: 1803527 - RNA, 19 nt, Homo sapiens
cuguuuuuuggcuugcuua

SEQ ID NO: 1803528 - RNA, 16 nt, Homo sapiens
uaucugacuucauaca

SEQ ID NO: 1803529 - RNA, 18 nt, Homo sapiens
acaaucagcccagugcaa

SEQ ID NO: 1803530 - RNA, 14 nt, Homo sapiens
uauuuuuuuuacug

SEQ ID NO: 1803531 - RNA, 15 nt, Homo sapiens
gucaucgggccagaa

SEQ ID NO: 1803532 - RNA, 22 nt, Homo sapiens
ccauggcucuauuucuucuuca

SEQ ID NO: 1803533 - RNA, 12 nt, Homo sapiens
uuuuaagccauc

SEQ ID NO: 1803534 - RNA, 23 nt, Homo sapiens
gcaugagucuguuucccaagcua

SEQ ID NO: 1803535 - RNA, 16 nt, Homo sapiens
ccucauugaauccuca

SEQ ID NO: 1803536 - RNA, 13 nt, Homo sapiens
gcaagugcaaaag

SEQ ID NO: 1803537 - RNA, 13 nt, Homo sapiens
gcaaaugcaaaaa

SEQ ID NO: 1803538 - RNA, 16 nt, Homo sapiens
aauguaaacucucuuc

SEQ ID NO: 1803539 - RNA, 13 nt, Homo sapiens
uaaagcugcugag

SEQ ID NO: 1803540 - RNA, 18 nt, Homo sapiens
uucaauguuaaaucuaca

SEQ ID NO: 1803541 - RNA, 15 nt, Homo sapiens
ccacagcugugcaug

SEQ ID NO: 1803542 - RNA, 21 nt, Homo sapiens
aggcugcagugagcugugauu

SEQ ID NO: 1803543 - RNA, 18 nt, Homo sapiens
cuggcuggggccuguuga

SEQ ID NO: 1803544 - RNA, 12 nt, Homo sapiens
uucacuggcaua

SEQ ID NO: 1803545 - RNA, 16 nt, Homo sapiens
caaccuccaacaacga

SEQ ID NO: 1803546 - RNA, 22 nt, Homo sapiens
caucauuccccgacacugccaa

SEQ ID NO: 1803547 - RNA, 22 nt, Homo sapiens
cuccuggccaucccuucauuua

SEQ ID NO: 1803548 - RNA, 19 nt, Homo sapiens
cuucugacuacuuguugua

SEQ ID NO: 1803549 - RNA, 15 nt, Homo sapiens
accucuccauccugc

SEQ ID NO: 1803550 - RNA, 15 nt, Homo sapiens
gcuuccgacaccucu

SEQ ID NO: 1803551 - RNA, 21 nt, Homo sapiens
ccucaucugggggaguggaau

SEQ ID NO: 1803552 - RNA, 16 nt, Homo sapiens
aucaugucuugugcau

SEQ ID NO: 1803553 - RNA, 20 nt, Homo sapiens
auaucagcuuuucuuauucc

SEQ ID NO: 1803554 - RNA, 20 nt, Homo sapiens
ucacaggaaucugauugcau

SEQ ID NO: 1803555 - RNA, 19 nt, Homo sapiens
guggagcaugcaacacauc

SEQ ID NO: 1803556 - RNA, 16 nt, Homo sapiens
cuaucuuuucaucuca

SEQ ID NO: 1803557 - RNA, 14 nt, Homo sapiens
cauauuguuugugc

SEQ ID NO: 1803558 - RNA, 19 nt, Homo sapiens
ugcaguggcugugccacca

SEQ ID NO: 1803559 - RNA, 17 nt, Homo sapiens
gaaagcaaaaaauaccu

SEQ ID NO: 1803560 - RNA, 17 nt, Homo sapiens
aacuucuacuucugccc

SEQ ID NO: 1803561 - RNA, 23 nt, Homo sapiens
cccaggcugguauuuaucugcaa

SEQ ID NO: 1803562 - RNA, 22 nt, Homo sapiens
gugaaacgucccacacuuugaa

SEQ ID NO: 1803563 - RNA, 18 nt, Homo sapiens
ggucggggcuaggguagg

SEQ ID NO: 1803564 - RNA, 18 nt, Homo sapiens
gagacuugaaucaaguca

SEQ ID NO: 1803565 - RNA, 20 nt, Homo sapiens
uagaucccccagacuuuaca

SEQ ID NO: 1803566 - RNA, 15 nt, Homo sapiens
gauggaagcuuccag

SEQ ID NO: 1803567 - RNA, 17 nt, Homo sapiens
aaucaucuaagucagua

SEQ ID NO: 1803568 - RNA, 13 nt, Homo sapiens
uuaauuauugcuu

SEQ ID NO: 1803569 - RNA, 22 nt, Homo sapiens
uccaaaacuccugccccuguuc

SEQ ID NO: 1803570 - RNA, 23 nt, Homo sapiens
cuguaauguaacagcaauuuuca

SEQ ID NO: 1803571 - RNA, 23 nt, Homo sapiens
agcagcucuccccaggcauuugc

SEQ ID NO: 1803572 - RNA, 19 nt, Homo sapiens
uaaaaguuggagaagucuu

SEQ ID NO: 1803573 - RNA, 23 nt, Homo sapiens
ugcacuccagccugggugacaaa

SEQ ID NO: 1803574 - RNA, 23 nt, Homo sapiens
auggcagcccuucccuagcacac

SEQ ID NO: 1803575 - RNA, 13 nt, Homo sapiens
caucuguucauuc

SEQ ID NO: 1803576 - RNA, 19 nt, Homo sapiens
caggccucgggaccaacuc

SEQ ID NO: 1803577 - RNA, 23 nt, Homo sapiens
uccaauccguucccuucugccac

SEQ ID NO: 1803578 - RNA, 15 nt, Homo sapiens
aaccugccaguccca

SEQ ID NO: 1803579 - RNA, 16 nt, Homo sapiens
ugaguagggcaaugga

SEQ ID NO: 1803580 - RNA, 19 nt, Homo sapiens
auaccaagaugccaucugu

SEQ ID NO: 1803581 - RNA, 18 nt, Homo sapiens
uggucaagcacucgggaa

SEQ ID NO: 1803582 - RNA, 18 nt, Homo sapiens
uaaacauguccccuuccc

SEQ ID NO: 1803583 - RNA, 16 nt, Homo sapiens
uuacucuguuaccaca

SEQ ID NO: 1803584 - RNA, 16 nt, Homo sapiens
gaauucuggaaucaca

SEQ ID NO: 1803585 - RNA, 23 nt, Homo sapiens
acaaagagucuugguuccucuac

SEQ ID NO: 1803586 - RNA, 14 nt, Homo sapiens
cucccagguucaag

SEQ ID NO: 1803587 - RNA, 21 nt, Homo sapiens
caccccuaugcccacucuaau

SEQ ID NO: 1803588 - RNA, 18 nt, Homo sapiens
acuccugggcucaaguga

SEQ ID NO: 1803589 - RNA, 20 nt, Homo sapiens
caucauuuuugaugacuacc

SEQ ID NO: 1803590 - RNA, 22 nt, Homo sapiens
ggacuggaucccagcagugaug

SEQ ID NO: 1803591 - RNA, 19 nt, Homo sapiens
ucaccucagggguuaagag

SEQ ID NO: 1803592 - RNA, 15 nt, Homo sapiens
uuuaauuugcaucac

SEQ ID NO: 1803593 - RNA, 23 nt, Homo sapiens
cauuugaaaucuaugaaauauca

SEQ ID NO: 1803594 - RNA, 15 nt, Homo sapiens
uggaucgcugcacau

SEQ ID NO: 1803595 - RNA, 12 nt, Homo sapiens
aacuuauuucaa

SEQ ID NO: 1803596 - RNA, 12 nt, Homo sapiens
aacauauuucau

SEQ ID NO: 1803597 - RNA, 20 nt, Homo sapiens
cagagcgagagucugucuca

SEQ ID NO: 1803598 - RNA, 19 nt, Homo sapiens
uccucugcagcucagggac

SEQ ID NO: 1803599 - RNA, 22 nt, Homo sapiens
cgguaaaccgaggacccaugaa

SEQ ID NO: 1803600 - RNA, 22 nt, Homo sapiens
cauuuuauuuuuucuugcaaau

SEQ ID NO: 1803601 - RNA, 18 nt, Homo sapiens
gcaauauuauuucugugc

SEQ ID NO: 1803602 - RNA, 16 nt, Homo sapiens
uggauuauuccucaga

SEQ ID NO: 1803603 - RNA, 15 nt, Homo sapiens
uaaaaaucacacugu

SEQ ID NO: 1803604 - RNA, 14 nt, Homo sapiens
ccuugguguucaaa

SEQ ID NO: 1803605 - RNA, 19 nt, Homo sapiens
uuucuuaugccugucuuua

SEQ ID NO: 1803606 - RNA, 18 nt, Homo sapiens
auacuguggccugaaaua

SEQ ID NO: 1803607 - RNA, 19 nt, Homo sapiens
auuggcugguaaauugcca

SEQ ID NO: 1803608 - RNA, 19 nt, Homo sapiens
aaguucaacaacaccagaa

SEQ ID NO: 1803609 - RNA, 18 nt, Homo sapiens
cuaugauguauacugcca

SEQ ID NO: 1803610 - RNA, 20 nt, Homo sapiens
aaccucuucaugagcuugaa

SEQ ID NO: 1803611 - RNA, 21 nt, Homo sapiens
gugacagaggagaaaguggaa

SEQ ID NO: 1803612 - RNA, 24 nt, Homo sapiens
gcgaccauuucucagcaucgugcu

SEQ ID NO: 1803613 - RNA, 15 nt, Homo sapiens
ccuucagagagcagu

SEQ ID NO: 1803614 - RNA, 22 nt, Homo sapiens
ugacaggccuuccuccucucaa

SEQ ID NO: 1803615 - RNA, 20 nt, Homo sapiens
gcuacucaaguagcauuuac

SEQ ID NO: 1803616 - RNA, 18 nt, Homo sapiens
cauuccaaagaacagccu

SEQ ID NO: 1803617 - RNA, 17 nt, Homo sapiens
aaugaaccgcugaauau

SEQ ID NO: 1803618 - RNA, 14 nt, Homo sapiens
cuuucuuauccaac

SEQ ID NO: 1803619 - RNA, 23 nt, Homo sapiens
uaaaccaaugucauaacaggcau

SEQ ID NO: 1803620 - RNA, 17 nt, Homo sapiens
aaugauguaauauucca

SEQ ID NO: 1803621 - RNA, 22 nt, Homo sapiens
auuaaggcagcucauccaagcu

SEQ ID NO: 1803622 - RNA, 15 nt, Homo sapiens
uccgaagaaugaagu

SEQ ID NO: 1803623 - RNA, 19 nt, Homo sapiens
auuucgaagucaucauucc

SEQ ID NO: 1803624 - RNA, 18 nt, Homo sapiens
guguucccagagcacuuu

SEQ ID NO: 1803625 - RNA, 12 nt, Homo sapiens
uaaaacaauccu

SEQ ID NO: 1803626 - RNA, 22 nt, Homo sapiens
aacccuuuuccuccagacagau

SEQ ID NO: 1803627 - RNA, 16 nt, Homo sapiens
uuggacauccccagaa

SEQ ID NO: 1803628 - RNA, 17 nt, Homo sapiens
gucccugaagugccagc

SEQ ID NO: 1803629 - RNA, 13 nt, Homo sapiens
gucuugauuuguu

SEQ ID NO: 1803630 - RNA, 22 nt, Homo sapiens
aggucugagcacuggaguggcu

SEQ ID NO: 1803631 - RNA, 16 nt, Homo sapiens
ucugaugcaagcaaga

SEQ ID NO: 1803632 - RNA, 12 nt, Homo sapiens
aggggagcacaa

SEQ ID NO: 1803633 - RNA, 16 nt, Homo sapiens
cagacaacagaaguca

SEQ ID NO: 1803634 - RNA, 23 nt, Homo sapiens
gaguccacucccagugcuugcaa

SEQ ID NO: 1803635 - RNA, 17 nt, Homo sapiens
caaaugggguuucacaa

SEQ ID NO: 1803636 - RNA, 22 nt, Homo sapiens
ucuguaaguugcuuccuaacau

SEQ ID NO: 1803637 - RNA, 21 nt, Homo sapiens
cagggucucccuauguugccc

SEQ ID NO: 1803638 - RNA, 14 nt, Homo sapiens
cuugauuucacugg

SEQ ID NO: 1803639 - RNA, 21 nt, Homo sapiens
accagccugguccacugggaa

SEQ ID NO: 1803640 - RNA, 22 nt, Homo sapiens
aaaaccuuguggauaaguggcu

SEQ ID NO: 1803641 - RNA, 23 nt, Homo sapiens
cuauauuauauaaauaguauuuc

SEQ ID NO: 1803642 - RNA, 15 nt, Homo sapiens
uuccaggagacauau

SEQ ID NO: 1803643 - RNA, 14 nt, Homo sapiens
aggcaauggguuua

SEQ ID NO: 1803644 - RNA, 19 nt, Homo sapiens
aaguagaaaugggauguuu

SEQ ID NO: 1803645 - RNA, 18 nt, Homo sapiens
cagccaggcggcuggaau

SEQ ID NO: 1803646 - RNA, 18 nt, Homo sapiens
cagaaccaauuuacacuc

SEQ ID NO: 1803647 - RNA, 16 nt, Homo sapiens
gagcauaccacuugaa

SEQ ID NO: 1803648 - RNA, 14 nt, Homo sapiens
ccccucucaccuca

SEQ ID NO: 1803649 - RNA, 17 nt, Homo sapiens
cuuauauucuaagucac

SEQ ID NO: 1803650 - RNA, 22 nt, Homo sapiens
agcuccggguguagauucccuu

SEQ ID NO: 1803651 - RNA, 13 nt, Homo sapiens
ggaccauguguca

SEQ ID NO: 1803652 - RNA, 22 nt, Homo sapiens
ccauuguauuuaaaacauuuca

SEQ ID NO: 1803653 - RNA, 13 nt, Homo sapiens
cgcacagugcagu

SEQ ID NO: 1803654 - RNA, 18 nt, Homo sapiens
cuuaccuaucuguggaaa

SEQ ID NO: 1803655 - RNA, 22 nt, Homo sapiens
ggccaaggggugggccugugaa

SEQ ID NO: 1803656 - RNA, 22 nt, Homo sapiens
uaucaugcaaauuucaugacca

SEQ ID NO: 1803657 - RNA, 20 nt, Homo sapiens
agcucuccuccuccaucuca

SEQ ID NO: 1803658 - RNA, 21 nt, Homo sapiens
uugaucagggaccaugaaaag

SEQ ID NO: 1803659 - RNA, 22 nt, Homo sapiens
aagcacuauuaauacucugcag

SEQ ID NO: 1803660 - RNA, 13 nt, Homo sapiens
acauugauuggau

SEQ ID NO: 1803661 - RNA, 18 nt, Homo sapiens
uaugaauaaaauuguuau

SEQ ID NO: 1803662 - RNA, 19 nt, Homo sapiens
uacuuacauaucugacuuc

SEQ ID NO: 1803663 - RNA, 21 nt, Homo sapiens
acugagaguugcuuccagucc

SEQ ID NO: 1803664 - RNA, 15 nt, Homo sapiens
gcaaucuccaugugu

SEQ ID NO: 1803665 - RNA, 11 nt, Homo sapiens
ccaauguuuca

SEQ ID NO: 1803666 - RNA, 22 nt, Homo sapiens
auguacauagugcuaacaugaa

SEQ ID NO: 1803667 - RNA, 14 nt, Homo sapiens
uuauguuugcuaaa

SEQ ID NO: 1803668 - RNA, 15 nt, Homo sapiens
caaaauauacauuca

SEQ ID NO: 1803669 - RNA, 16 nt, Homo sapiens
aaucuuucaaaccagc

SEQ ID NO: 1803670 - RNA, 13 nt, Homo sapiens
cagcauuacagaa

SEQ ID NO: 1803671 - RNA, 16 nt, Homo sapiens
aaccaguuaugugaau

SEQ ID NO: 1803672 - RNA, 14 nt, Homo sapiens
agcuggcaccagaa

SEQ ID NO: 1803673 - RNA, 22 nt, Homo sapiens
uauaaagcauguggucuuauag

SEQ ID NO: 1803674 - RNA, 16 nt, Homo sapiens
ucuuaauccugaaugu

SEQ ID NO: 1803675 - RNA, 16 nt, Homo sapiens
ucaccacaucuugucu

SEQ ID NO: 1803676 - RNA, 12 nt, Homo sapiens
uuccacugcugc

SEQ ID NO: 1803677 - RNA, 16 nt, Homo sapiens
uuaguuuguguuauua

SEQ ID NO: 1803678 - RNA, 21 nt, Homo sapiens
uccacuccagauuuuuuacag

SEQ ID NO: 1803679 - RNA, 20 nt, Homo sapiens
uaagaaucuuagauaacuuc

SEQ ID NO: 1803680 - RNA, 15 nt, Homo sapiens
aaagaguagugcauu

SEQ ID NO: 1803681 - RNA, 16 nt, Homo sapiens
aagaauuggccaucuu

SEQ ID NO: 1803682 - RNA, 19 nt, Homo sapiens
auuaguaauaaaaauaaga

SEQ ID NO: 1803683 - RNA, 14 nt, Homo sapiens
agaaaaaguacaag

SEQ ID NO: 1803684 - RNA, 22 nt, Homo sapiens
agaacagagucucaggacagaa

SEQ ID NO: 1803685 - RNA, 22 nt, Homo sapiens
uuguaauaaaggucuuugcaca

SEQ ID NO: 1803686 - RNA, 15 nt, Homo sapiens
uugguaugagacaga

SEQ ID NO: 1803687 - RNA, 23 nt, Homo sapiens
uggacucagggcugguucagggc

SEQ ID NO: 1803688 - RNA, 17 nt, Homo sapiens
uccagccugcuguauaa

SEQ ID NO: 1803689 - RNA, 15 nt, Homo sapiens
cauauguacagaaga

SEQ ID NO: 1803690 - RNA, 21 nt, Homo sapiens
ugcauucauguacuacccuca

SEQ ID NO: 1803691 - RNA, 10 nt, Homo sapiens
ugcugugcaa

SEQ ID NO: 1803692 - RNA, 13 nt, Homo sapiens
acuguugaacuua

SEQ ID NO: 1803693 - RNA, 12 nt, Homo sapiens
ugguaguguccc

SEQ ID NO: 1803694 - RNA, 17 nt, Homo sapiens
gaacuauuguggguuuu

SEQ ID NO: 1803695 - RNA, 22 nt, Homo sapiens
cuuuuauaacugaaauacuuua

SEQ ID NO: 1803696 - RNA, 12 nt, Homo sapiens
uucuuaauguca

SEQ ID NO: 1803697 - RNA, 17 nt, Homo sapiens
cuuaccaaacucaggug

SEQ ID NO: 1803698 - RNA, 18 nt, Homo sapiens
uucuuucaaagaagccag

SEQ ID NO: 1803699 - RNA, 23 nt, Homo sapiens
gaccccagcuucauuaugcagcu

SEQ ID NO: 1803700 - RNA, 19 nt, Homo sapiens
cugucagcgccucaagggu

SEQ ID NO: 1803701 - RNA, 22 nt, Homo sapiens
acuuuuccccauugacccucac

SEQ ID NO: 1803702 - RNA, 15 nt, Homo sapiens
guccuaagcccacaa

SEQ ID NO: 1803703 - RNA, 14 nt, Homo sapiens
gcauaaagaauagu

SEQ ID NO: 1803704 - RNA, 15 nt, Homo sapiens
uuucauaguuggggu

SEQ ID NO: 1803705 - RNA, 14 nt, Homo sapiens
uaacuucacauuaa

SEQ ID NO: 1803706 - RNA, 17 nt, Homo sapiens
aucgagagugugcucuc

SEQ ID NO: 1803707 - RNA, 21 nt, Homo sapiens
auuaacaaaauauucuguaag

SEQ ID NO: 1803708 - RNA, 21 nt, Homo sapiens
auccucugacagcuguccuga

SEQ ID NO: 1803709 - RNA, 21 nt, Homo sapiens
ccucucccccuccuccaggga

SEQ ID NO: 1803710 - RNA, 18 nt, Homo sapiens
gagcuuuugaugccaggu

SEQ ID NO: 1803711 - RNA, 15 nt, Homo sapiens
ucccucaaagcacac

SEQ ID NO: 1803712 - RNA, 22 nt, Homo sapiens
uuacaggugugaaccacugugc

SEQ ID NO: 1803713 - RNA, 14 nt, Homo sapiens
uucaacaaguaccu

SEQ ID NO: 1803714 - RNA, 20 nt, Homo sapiens
aggucacucuccagcaguua

SEQ ID NO: 1803715 - RNA, 20 nt, Homo sapiens
gcuuguacagaagagacagu

SEQ ID NO: 1803716 - RNA, 13 nt, Homo sapiens
cuuccaaaucagg

SEQ ID NO: 1803717 - RNA, 16 nt, Homo sapiens
aacgaaugguacuaca

SEQ ID NO: 1803718 - RNA, 22 nt, Homo sapiens
agagugccguaacaacuguggu

SEQ ID NO: 1803719 - RNA, 22 nt, Homo sapiens
uaagccucaccuuugccuucca

SEQ ID NO: 1803720 - RNA, 23 nt, Homo sapiens
ccauguuucacaaggucuuuaaa

SEQ ID NO: 1803721 - RNA, 22 nt, Homo sapiens
agcuugggucagguucuugccu

SEQ ID NO: 1803722 - RNA, 16 nt, Homo sapiens
uucuggaaacauucag

SEQ ID NO: 1803723 - RNA, 13 nt, Homo sapiens
uaaaaaccaaauu

SEQ ID NO: 1803724 - RNA, 15 nt, Homo sapiens
cccuugaagcaauaa

SEQ ID NO: 1803725 - RNA, 18 nt, Homo sapiens
gcuuuaaaaaacacaguc

SEQ ID NO: 1803726 - RNA, 17 nt, Homo sapiens
aguugugcuaaaccaag

SEQ ID NO: 1803727 - RNA, 20 nt, Homo sapiens
cagggggcccgaacagggac

SEQ ID NO: 1803728 - RNA, 19 nt, Homo sapiens
augcagggcccccacagga

SEQ ID NO: 1803729 - RNA, 14 nt, Homo sapiens
agucuuccaugacc

SEQ ID NO: 1803730 - RNA, 21 nt, Homo sapiens
cagaccagguggaauuacuua

SEQ ID NO: 1803731 - RNA, 21 nt, Homo sapiens
uggcuaauuagcauggccaca

SEQ ID NO: 1803732 - RNA, 12 nt, Homo sapiens
aaaaccuagcau

SEQ ID NO: 1803733 - RNA, 16 nt, Homo sapiens
aaaaguuuacagauca

SEQ ID NO: 1803734 - RNA, 22 nt, Homo sapiens
agugacaugugcuggacacugu

SEQ ID NO: 1803735 - RNA, 19 nt, Homo sapiens
gagacaugguauugacuca

SEQ ID NO: 1803736 - RNA, 23 nt, Homo sapiens
gacccaaguguugaggggaccaa

SEQ ID NO: 1803737 - RNA, 17 nt, Homo sapiens
gcaguggcgugaucucg

SEQ ID NO: 1803738 - RNA, 12 nt, Homo sapiens
ugguuuugacag

SEQ ID NO: 1803739 - RNA, 17 nt, Homo sapiens
cauguauuuuacacaaa

SEQ ID NO: 1803740 - RNA, 16 nt, Homo sapiens
cugccccugccugaca

SEQ ID NO: 1803741 - RNA, 16 nt, Homo sapiens
caacaggaaucucaga

SEQ ID NO: 1803742 - RNA, 17 nt, Homo sapiens
agcuuuauuugcuguac

SEQ ID NO: 1803743 - RNA, 15 nt, Homo sapiens
aauaucccguguuac

SEQ ID NO: 1803744 - RNA, 11 nt, Homo sapiens
acccccggggc

SEQ ID NO: 1803745 - RNA, 23 nt, Homo sapiens
ugaaagaaccaaaagagaucaca

SEQ ID NO: 1803746 - RNA, 16 nt, Homo sapiens
auuuacgacugaagaa

SEQ ID NO: 1803747 - RNA, 22 nt, Homo sapiens
cacccucugugcuugugacaaa

SEQ ID NO: 1803748 - RNA, 14 nt, Homo sapiens
cacccugcgggcca

SEQ ID NO: 1803749 - RNA, 16 nt, Homo sapiens
aaaauguaauuacuua

SEQ ID NO: 1803750 - RNA, 15 nt, Homo sapiens
ugccuuaaacacuca

SEQ ID NO: 1803751 - RNA, 13 nt, Homo sapiens
aaacacuaccucu

SEQ ID NO: 1803752 - RNA, 13 nt, Homo sapiens
aaauucuaccuua

SEQ ID NO: 1803753 - RNA, 16 nt, Homo sapiens
auuuugcaccuguaaa

SEQ ID NO: 1803754 - RNA, 17 nt, Homo sapiens
cuuaacuccuaauguag

SEQ ID NO: 1803755 - RNA, 14 nt, Homo sapiens
ucauagcucacugc

SEQ ID NO: 1803756 - RNA, 14 nt, Homo sapiens
agcgugaugaucua

SEQ ID NO: 1803757 - RNA, 13 nt, Homo sapiens
ugaggccucucau

SEQ ID NO: 1803758 - RNA, 24 nt, Homo sapiens
cugugacuggcagcauugacucug

SEQ ID NO: 1803759 - RNA, 17 nt, Homo sapiens
accacacccagugggaa

SEQ ID NO: 1803760 - RNA, 20 nt, Homo sapiens
uauaaacccauuuuggugca

SEQ ID NO: 1803761 - RNA, 18 nt, Homo sapiens
agcgucuuuuuaaccuca

SEQ ID NO: 1803762 - RNA, 18 nt, Homo sapiens
ucugaacugcaacacugg

SEQ ID NO: 1803763 - RNA, 22 nt, Homo sapiens
uugaaaggccaacagcaagugu

SEQ ID NO: 1803764 - RNA, 16 nt, Homo sapiens
cuguaaucauguacuu

SEQ ID NO: 1803765 - RNA, 19 nt, Homo sapiens
guuguuaaugaaaauguca

SEQ ID NO: 1803766 - RNA, 22 nt, Homo sapiens
aagcagaaaguucaacuuccaa

SEQ ID NO: 1803767 - RNA, 18 nt, Homo sapiens
gccucugcaaacuaagga

SEQ ID NO: 1803768 - RNA, 20 nt, Homo sapiens
aggaauauuuucuucugcac

SEQ ID NO: 1803769 - RNA, 17 nt, Homo sapiens
cguaauugaaacauuua

SEQ ID NO: 1803770 - RNA, 21 nt, Homo sapiens
aguuucuagugucacugauga

SEQ ID NO: 1803771 - RNA, 22 nt, Homo sapiens
ugaccugaggcuccugugcuac

SEQ ID NO: 1803772 - RNA, 21 nt, Homo sapiens
aaguugagauucaaacccagg

SEQ ID NO: 1803773 - RNA, 16 nt, Homo sapiens
ccuguugcacccagcc

SEQ ID NO: 1803774 - RNA, 17 nt, Homo sapiens
uuuaucaguagaagugu

SEQ ID NO: 1803775 - RNA, 19 nt, Homo sapiens
auucaaauugacugaagca

SEQ ID NO: 1803776 - RNA, 19 nt, Homo sapiens
aacaugugguuaaugccau

SEQ ID NO: 1803777 - RNA, 11 nt, Homo sapiens
acuggugcucu

SEQ ID NO: 1803778 - RNA, 18 nt, Homo sapiens
ucuguuuuuucuguacac

SEQ ID NO: 1803779 - RNA, 17 nt, Homo sapiens
gaagcccaagauaucag

SEQ ID NO: 1803780 - RNA, 15 nt, Homo sapiens
ugacuuaaucucauu

SEQ ID NO: 1803781 - RNA, 12 nt, Homo sapiens
cagccagcaucu

SEQ ID NO: 1803782 - RNA, 15 nt, Homo sapiens
gcagacucucucuua

SEQ ID NO: 1803783 - RNA, 21 nt, Homo sapiens
gcagagcaaugacugugcuca

SEQ ID NO: 1803784 - RNA, 22 nt, Homo sapiens
aaaugugcauugaauacucuga

SEQ ID NO: 1803785 - RNA, 14 nt, Homo sapiens
cauccucacaguga

SEQ ID NO: 1803786 - RNA, 20 nt, Homo sapiens
cagggcacggggaccuggau

SEQ ID NO: 1803787 - RNA, 19 nt, Homo sapiens
aucuucuaucaaagcacau

SEQ ID NO: 1803788 - RNA, 17 nt, Homo sapiens
cagagucaaagcucauu

SEQ ID NO: 1803789 - RNA, 19 nt, Homo sapiens
cugauauuuucucuaggaa

SEQ ID NO: 1803790 - RNA, 15 nt, Homo sapiens
uagagaauagcuuua

SEQ ID NO: 1803791 - RNA, 22 nt, Homo sapiens
ggggcuuccucuagagucucac

SEQ ID NO: 1803792 - RNA, 15 nt, Homo sapiens
cucauguggccaagc

SEQ ID NO: 1803793 - RNA, 16 nt, Homo sapiens
ucaccuguuacugaaa

SEQ ID NO: 1803794 - RNA, 19 nt, Homo sapiens
uccuacuuauaaaguagaa

SEQ ID NO: 1803795 - RNA, 19 nt, Homo sapiens
cauggaaaaucagugacau

SEQ ID NO: 1803796 - RNA, 15 nt, Homo sapiens
caaagcacaugcuua

SEQ ID NO: 1803797 - RNA, 17 nt, Homo sapiens
agccgcucuccugccac

SEQ ID NO: 1803798 - RNA, 20 nt, Homo sapiens
aggcaauggugaacugucau

SEQ ID NO: 1803799 - RNA, 13 nt, Homo sapiens
aaauguaacugug

SEQ ID NO: 1803800 - RNA, 22 nt, Homo sapiens
cuuaucucggggagaaaugcaa

SEQ ID NO: 1803801 - RNA, 16 nt, Homo sapiens
cguaggugugacacuu

SEQ ID NO: 1803802 - RNA, 18 nt, Homo sapiens
aaugaacuuccauuugua

SEQ ID NO: 1803803 - RNA, 18 nt, Homo sapiens
uaaauaaauuaugcuuca

SEQ ID NO: 1803804 - RNA, 22 nt, Homo sapiens
cauggcacucuucccaccucag

SEQ ID NO: 1803805 - RNA, 21 nt, Homo sapiens
cuucauucacuucgccauuca

SEQ ID NO: 1803806 - RNA, 13 nt, Homo sapiens
aaaaaauggucaa

SEQ ID NO: 1803807 - RNA, 20 nt, Homo sapiens
agacucuggaaguauacuuu

SEQ ID NO: 1803808 - RNA, 13 nt, Homo sapiens
uaacucacuuuaa

SEQ ID NO: 1803809 - RNA, 16 nt, Homo sapiens
ugccuuggcuucaggg

SEQ ID NO: 1803810 - RNA, 16 nt, Homo sapiens
auccuuaacagaugaa

SEQ ID NO: 1803811 - RNA, 22 nt, Homo sapiens
aaacuggcugcuuuguucaaug

SEQ ID NO: 1803812 - RNA, 12 nt, Homo sapiens
augcacaguggg

SEQ ID NO: 1803813 - RNA, 19 nt, Homo sapiens
guuuuucuuguuguuauuc

SEQ ID NO: 1803814 - RNA, 19 nt, Homo sapiens
cucacgauuccagugcagu

SEQ ID NO: 1803815 - RNA, 21 nt, Homo sapiens
gcucccuccucuccuacccac

SEQ ID NO: 1803816 - RNA, 16 nt, Homo sapiens
uacuauagguccagaa

SEQ ID NO: 1803817 - RNA, 21 nt, Homo sapiens
uguuaugcauuuuuuaccaca

SEQ ID NO: 1803818 - RNA, 15 nt, Homo sapiens
ugagaaaaauaaaaa

SEQ ID NO: 1803819 - RNA, 12 nt, Homo sapiens
gagacauggcuu

SEQ ID NO: 1803820 - RNA, 16 nt, Homo sapiens
cagucuccgugguuga

SEQ ID NO: 1803821 - RNA, 20 nt, Homo sapiens
auggccuuccacgucuuccu

SEQ ID NO: 1803822 - RNA, 16 nt, Homo sapiens
ucuuuugagcauuuag

SEQ ID NO: 1803823 - RNA, 16 nt, Homo sapiens
ucuggggggcagggaa

SEQ ID NO: 1803824 - RNA, 22 nt, Homo sapiens
uccugauuucuagaacccguga

SEQ ID NO: 1803825 - RNA, 16 nt, Homo sapiens
ccucugggaucugcca

SEQ ID NO: 1803826 - RNA, 12 nt, Homo sapiens
uacuguucuuga

SEQ ID NO: 1803827 - RNA, 14 nt, Homo sapiens
ugccucuacccaac

SEQ ID NO: 1803828 - RNA, 18 nt, Homo sapiens
ccuauuccaggaauuccu

SEQ ID NO: 1803829 - RNA, 22 nt, Homo sapiens
agacaguauuuugacaaaauac

SEQ ID NO: 1803830 - RNA, 13 nt, Homo sapiens
aagagaauguauu

SEQ ID NO: 1803831 - RNA, 15 nt, Homo sapiens
caaucaugugcuuca

SEQ ID NO: 1803832 - RNA, 23 nt, Homo sapiens
uacuauauuaaauucugaaugca

SEQ ID NO: 1803833 - RNA, 15 nt, Homo sapiens
ccuaccaagauauac

SEQ ID NO: 1803834 - RNA, 14 nt, Homo sapiens
agagaaaauuugaa

SEQ ID NO: 1803835 - RNA, 13 nt, Homo sapiens
aaaacuucuuuaa

SEQ ID NO: 1803836 - RNA, 16 nt, Homo sapiens
ugaccuacucuugccu

SEQ ID NO: 1803837 - RNA, 19 nt, Homo sapiens
uuacaaaauacagggauua

SEQ ID NO: 1803838 - RNA, 19 nt, Homo sapiens
cagaaugcucuacuucuuu

SEQ ID NO: 1803839 - RNA, 21 nt, Homo sapiens
gagagcagcuucagugacaaa

SEQ ID NO: 1803840 - RNA, 16 nt, Homo sapiens
aaauauuuggaaugaa

SEQ ID NO: 1803841 - RNA, 14 nt, Homo sapiens
aagccuaaaugccu

SEQ ID NO: 1803842 - RNA, 14 nt, Homo sapiens
cugggaaacaggga

SEQ ID NO: 1803843 - RNA, 16 nt, Homo sapiens
uuuuaucacuugccgu

SEQ ID NO: 1803844 - RNA, 19 nt, Homo sapiens
uccuccuuguucuacucau

SEQ ID NO: 1803845 - RNA, 12 nt, Homo sapiens
ggagauacugau

SEQ ID NO: 1803846 - RNA, 18 nt, Homo sapiens
ccugguauuguaauauua

SEQ ID NO: 1803847 - RNA, 14 nt, Homo sapiens
cugccacaagcaca

SEQ ID NO: 1803848 - RNA, 14 nt, Homo sapiens
agcccccacugacc

SEQ ID NO: 1803849 - RNA, 22 nt, Homo sapiens
agccacagcugugcaugcucag

SEQ ID NO: 1803850 - RNA, 14 nt, Homo sapiens
gaaaaaugauuuca

SEQ ID NO: 1803851 - RNA, 14 nt, Homo sapiens
gaaaacugauuucc

SEQ ID NO: 1803852 - RNA, 19 nt, Homo sapiens
aucugaaagugguacuuga

SEQ ID NO: 1803853 - RNA, 15 nt, Homo sapiens
caaccucaucugcac

SEQ ID NO: 1803854 - RNA, 15 nt, Homo sapiens
ggggccagauccagc

SEQ ID NO: 1803855 - RNA, 16 nt, Homo sapiens
ugaaggcuuacuucag

SEQ ID NO: 1803856 - RNA, 17 nt, Homo sapiens
ucuuguuuaacauauau

SEQ ID NO: 1803857 - RNA, 18 nt, Homo sapiens
agcugacaaagcagauaa

SEQ ID NO: 1803858 - RNA, 18 nt, Homo sapiens
gaagguuuucauuugcca

SEQ ID NO: 1803859 - RNA, 14 nt, Homo sapiens
ccauacgagcaccu

SEQ ID NO: 1803860 - RNA, 11 nt, Homo sapiens
acagacauauu

SEQ ID NO: 1803861 - RNA, 20 nt, Homo sapiens
aucauauguaucuaaaugaa

SEQ ID NO: 1803862 - RNA, 14 nt, Homo sapiens
gcaacuucaaggga

SEQ ID NO: 1803863 - RNA, 12 nt, Homo sapiens
cugguucuaacu

SEQ ID NO: 1803864 - RNA, 21 nt, Homo sapiens
cgauccaugagggacuccucc

SEQ ID NO: 1803865 - RNA, 22 nt, Homo sapiens
aaaggugcuauuuaacauggga

SEQ ID NO: 1803866 - RNA, 19 nt, Homo sapiens
aacgccuucccuaagucac

SEQ ID NO: 1803867 - RNA, 23 nt, Homo sapiens
uagaagagccugacuguguucag

SEQ ID NO: 1803868 - RNA, 21 nt, Homo sapiens
ggaaguuuuguggaggagcuc

SEQ ID NO: 1803869 - RNA, 23 nt, Homo sapiens
auauugaacuuuuuuccacugaa

SEQ ID NO: 1803870 - RNA, 13 nt, Homo sapiens
agaaaaccagcuu

SEQ ID NO: 1803871 - RNA, 21 nt, Homo sapiens
auccuggcaaauaauacuaau

SEQ ID NO: 1803872 - RNA, 22 nt, Homo sapiens
ccccaaacauuaaucaccaaag

SEQ ID NO: 1803873 - RNA, 13 nt, Homo sapiens
uguggggauuuuc

SEQ ID NO: 1803874 - RNA, 12 nt, Homo sapiens
uuuccacaccau

SEQ ID NO: 1803875 - RNA, 21 nt, Homo sapiens
cacuacaccacacacaacagc

SEQ ID NO: 1803876 - RNA, 14 nt, Homo sapiens
ccucucuugccgac

SEQ ID NO: 1803877 - RNA, 16 nt, Homo sapiens
agcccagccacauuuc

SEQ ID NO: 1803878 - RNA, 14 nt, Homo sapiens
ccuguguugcccag

SEQ ID NO: 1803879 - RNA, 23 nt, Homo sapiens
cucacgcagacacacccacagaa

SEQ ID NO: 1803880 - RNA, 24 nt, Homo sapiens
ugcuucuguuaacugaagccugcu

SEQ ID NO: 1803881 - RNA, 21 nt, Homo sapiens
caugcucacacauuacaacag

SEQ ID NO: 1803882 - RNA, 20 nt, Homo sapiens
uguauuuuacuuugugcaau

SEQ ID NO: 1803883 - RNA, 15 nt, Homo sapiens
ccuccgccaaugcac

SEQ ID NO: 1803884 - RNA, 16 nt, Homo sapiens
auggagugcucacaaa

SEQ ID NO: 1803885 - RNA, 18 nt, Homo sapiens
uguccaaacaggugcugg

SEQ ID NO: 1803886 - RNA, 14 nt, Homo sapiens
cuuuucuacauaca

SEQ ID NO: 1803887 - RNA, 14 nt, Homo sapiens
ucccucucuugccu

SEQ ID NO: 1803888 - RNA, 16 nt, Homo sapiens
aauugaguuaaaucag

SEQ ID NO: 1803889 - RNA, 21 nt, Homo sapiens
ugaacacugauuguccauuua

SEQ ID NO: 1803890 - RNA, 13 nt, Homo sapiens
cacccacugugaa

SEQ ID NO: 1803891 - RNA, 24 nt, Homo sapiens
ugaaguuucagagcuacacaaaca

SEQ ID NO: 1803892 - RNA, 14 nt, Homo sapiens
aguacaaugcccag

SEQ ID NO: 1803893 - RNA, 19 nt, Homo sapiens
caaggcugggggaagaagc

SEQ ID NO: 1803894 - RNA, 12 nt, Homo sapiens
caccauucccug

SEQ ID NO: 1803895 - RNA, 15 nt, Homo sapiens
guauggauaguaaaa

SEQ ID NO: 1803896 - RNA, 18 nt, Homo sapiens
aggccugcccugaugcuc

SEQ ID NO: 1803897 - RNA, 20 nt, Homo sapiens
ucugcaaugacuguggaguu

SEQ ID NO: 1803898 - RNA, 19 nt, Homo sapiens
caaccacaaaccuaguacg

SEQ ID NO: 1803899 - RNA, 18 nt, Homo sapiens
acacauggacacaccaga

SEQ ID NO: 1803900 - RNA, 21 nt, Homo sapiens
gcgucucccauccugauccca

SEQ ID NO: 1803901 - RNA, 14 nt, Homo sapiens
cucugaauuccaag

SEQ ID NO: 1803902 - RNA, 22 nt, Homo sapiens
aagagauuuuucaugauuuuga

SEQ ID NO: 1803903 - RNA, 20 nt, Homo sapiens
uuccacuggcuccacaucca

SEQ ID NO: 1803904 - RNA, 17 nt, Homo sapiens
cuuuugacaaaggcaag

SEQ ID NO: 1803905 - RNA, 19 nt, Homo sapiens
ugguggcucaugccuguaa

SEQ ID NO: 1803906 - RNA, 18 nt, Homo sapiens
uuuuccagaagauuucac

SEQ ID NO: 1803907 - RNA, 23 nt, Homo sapiens
ggcagagcucugggaagugaagu

SEQ ID NO: 1803908 - RNA, 21 nt, Homo sapiens
cuccaaaacuggaccaccaga

SEQ ID NO: 1803909 - RNA, 20 nt, Homo sapiens
ucuggggguccucucugagu

SEQ ID NO: 1803910 - RNA, 18 nt, Homo sapiens
gcuuacaggcauggacau

SEQ ID NO: 1803911 - RNA, 11 nt, Homo sapiens
auggcaucuuc

SEQ ID NO: 1803912 - RNA, 17 nt, Homo sapiens
uuuugcuuuucaacaca

SEQ ID NO: 1803913 - RNA, 21 nt, Homo sapiens
cacgaucuuggcucacugcaa

SEQ ID NO: 1803914 - RNA, 21 nt, Homo sapiens
acauaccguuuauaaugccau

SEQ ID NO: 1803915 - RNA, 12 nt, Homo sapiens
ccaugaacauca

SEQ ID NO: 1803916 - RNA, 14 nt, Homo sapiens
uaacaaaaggacaa

SEQ ID NO: 1803917 - RNA, 21 nt, Homo sapiens
gccucaguuuccucaucugca

SEQ ID NO: 1803918 - RNA, 20 nt, Homo sapiens
uacaaguuuucauaagcaca

SEQ ID NO: 1803919 - RNA, 20 nt, Homo sapiens
ugagaagcccgaggucauca

SEQ ID NO: 1803920 - RNA, 18 nt, Homo sapiens
aucugagggaagauuuau

SEQ ID NO: 1803921 - RNA, 18 nt, Homo sapiens
acacacugaggcagggaa

SEQ ID NO: 1803922 - RNA, 14 nt, Homo sapiens
ugaccuaaauuauu

SEQ ID NO: 1803923 - RNA, 20 nt, Homo sapiens
gggugcccucugcucaggcc

SEQ ID NO: 1803924 - RNA, 22 nt, Homo sapiens
accaucauuauaaacgugauga

SEQ ID NO: 1803925 - RNA, 13 nt, Homo sapiens
cccugucauccag

SEQ ID NO: 1803926 - RNA, 22 nt, Homo sapiens
cuuuuuuguggugucuagcauu

SEQ ID NO: 1803927 - RNA, 15 nt, Homo sapiens
aguauuuuuucaagu

SEQ ID NO: 1803928 - RNA, 18 nt, Homo sapiens
ucugggauucccaccaag

SEQ ID NO: 1803929 - RNA, 14 nt, Homo sapiens
uuuugcagaaaaaa

SEQ ID NO: 1803930 - RNA, 17 nt, Homo sapiens
ucauaucauuucacugu

SEQ ID NO: 1803931 - RNA, 22 nt, Homo sapiens
cucagccgugcacucccuaaga

SEQ ID NO: 1803932 - RNA, 16 nt, Homo sapiens
ccaggcugcucagggc

SEQ ID NO: 1803933 - RNA, 14 nt, Homo sapiens
aagcagacuuuuca

SEQ ID NO: 1803934 - RNA, 14 nt, Homo sapiens
aggccccaugaccu

SEQ ID NO: 1803935 - RNA, 13 nt, Homo sapiens
gcuuuauuugcaa

SEQ ID NO: 1803936 - RNA, 14 nt, Homo sapiens
uugugccaauaugu

SEQ ID NO: 1803937 - RNA, 15 nt, Homo sapiens
ucaguuaagccuuug

SEQ ID NO: 1803938 - RNA, 21 nt, Homo sapiens
ucuuuaauuucugucagaaug

SEQ ID NO: 1803939 - RNA, 15 nt, Homo sapiens
gcuggccugugugau

SEQ ID NO: 1803940 - RNA, 19 nt, Homo sapiens
ccugaaacaugaacccaaa

SEQ ID NO: 1803941 - RNA, 16 nt, Homo sapiens
agaugagggugacugu

SEQ ID NO: 1803942 - RNA, 22 nt, Homo sapiens
ucuuccucugcuguagagccau

SEQ ID NO: 1803943 - RNA, 20 nt, Homo sapiens
aauuggccagggcaacaaua

SEQ ID NO: 1803944 - RNA, 13 nt, Homo sapiens
gaggcucagagag

SEQ ID NO: 1803945 - RNA, 14 nt, Homo sapiens
aauaauucauauuc

SEQ ID NO: 1803946 - RNA, 21 nt, Homo sapiens
aaugcugcaacuuuuuuaugu

SEQ ID NO: 1803947 - RNA, 17 nt, Homo sapiens
gacgccugcccugccca

SEQ ID NO: 1803948 - RNA, 14 nt, Homo sapiens
cuuauuacccaaac

SEQ ID NO: 1803949 - RNA, 13 nt, Homo sapiens
cacaggucuucac

SEQ ID NO: 1803950 - RNA, 14 nt, Homo sapiens
agccuuugccuccc

SEQ ID NO: 1803951 - RNA, 13 nt, Homo sapiens
cacgaaacuuguu

SEQ ID NO: 1803952 - RNA, 16 nt, Homo sapiens
cugccuaauaggcacc

SEQ ID NO: 1803953 - RNA, 21 nt, Homo sapiens
guuccaggguggccccagggc

SEQ ID NO: 1803954 - RNA, 13 nt, Homo sapiens
cacugugcacugc

SEQ ID NO: 1803955 - RNA, 18 nt, Homo sapiens
ccucauaucccauccuua

SEQ ID NO: 1803956 - RNA, 19 nt, Homo sapiens
accaagacugagccagcuu

SEQ ID NO: 1803957 - RNA, 15 nt, Homo sapiens
acaguggcacaauca

SEQ ID NO: 1803958 - RNA, 15 nt, Homo sapiens
gauuaaagugccuuc

SEQ ID NO: 1803959 - RNA, 14 nt, Homo sapiens
ucacgccacaaauc

SEQ ID NO: 1803960 - RNA, 18 nt, Homo sapiens
auucauuagcugugauuu

SEQ ID NO: 1803961 - RNA, 14 nt, Homo sapiens
ggaugggggggcca

SEQ ID NO: 1803962 - RNA, 18 nt, Homo sapiens
cuuaacaugggcucuuca

SEQ ID NO: 1803963 - RNA, 12 nt, Homo sapiens
cugcguguguau

SEQ ID NO: 1803964 - RNA, 21 nt, Homo sapiens
gcugaacuuguuuucugggaa

SEQ ID NO: 1803965 - RNA, 15 nt, Homo sapiens
ugccucccugagcua

SEQ ID NO: 1803966 - RNA, 23 nt, Homo sapiens
uggagacggguguugucggggaa

SEQ ID NO: 1803967 - RNA, 22 nt, Homo sapiens
agccucugcccaggcacugcua

SEQ ID NO: 1803968 - RNA, 12 nt, Homo sapiens
ccacugggaccc

SEQ ID NO: 1803969 - RNA, 23 nt, Homo sapiens
cugauuuauguuuugaucaaauu

SEQ ID NO: 1803970 - RNA, 17 nt, Homo sapiens
augugauuuacauuuca

SEQ ID NO: 1803971 - RNA, 16 nt, Homo sapiens
auaaucacacacacac

SEQ ID NO: 1803972 - RNA, 16 nt, Homo sapiens
uaaugaucaaaacaug

SEQ ID NO: 1803973 - RNA, 12 nt, Homo sapiens
uggacuuguaua

SEQ ID NO: 1803974 - RNA, 17 nt, Homo sapiens
aacccagagguggaugu

SEQ ID NO: 1803975 - RNA, 18 nt, Homo sapiens
caacugccugccuuaggg

SEQ ID NO: 1803976 - RNA, 12 nt, Homo sapiens
auuuagcuugaa

SEQ ID NO: 1803977 - RNA, 23 nt, Homo sapiens
auagagaagaucuaauaccaucc

SEQ ID NO: 1803978 - RNA, 21 nt, Homo sapiens
caagccuucuguucugcccag

SEQ ID NO: 1803979 - RNA, 17 nt, Homo sapiens
ggggcgagcacugugag

SEQ ID NO: 1803980 - RNA, 21 nt, Homo sapiens
aaagaucuugaauagucucau

SEQ ID NO: 1803981 - RNA, 15 nt, Homo sapiens
uugccauugccagga

SEQ ID NO: 1803982 - RNA, 18 nt, Homo sapiens
gucuccuucccacugucc

SEQ ID NO: 1803983 - RNA, 20 nt, Homo sapiens
aguagaaaggccagcugacu

SEQ ID NO: 1803984 - RNA, 17 nt, Homo sapiens
ugaaugcaauaguagga

SEQ ID NO: 1803985 - RNA, 14 nt, Homo sapiens
augaagaacacugu

SEQ ID NO: 1803986 - RNA, 16 nt, Homo sapiens
ucaucucccggugccu

SEQ ID NO: 1803987 - RNA, 20 nt, Homo sapiens
cucgcuagguagaacacugc

SEQ ID NO: 1803988 - RNA, 19 nt, Homo sapiens
cugugcccuggcuccaugc

SEQ ID NO: 1803989 - RNA, 22 nt, Homo sapiens
acccagaugacccccaucccuc

SEQ ID NO: 1803990 - RNA, 20 nt, Homo sapiens
uuauuaaaaccagucucaga

SEQ ID NO: 1803991 - RNA, 21 nt, Homo sapiens
cagcuucugauaaacacaauc

SEQ ID NO: 1803992 - RNA, 22 nt, Homo sapiens
agaagcagcuucuuuugucucc

SEQ ID NO: 1803993 - RNA, 18 nt, Homo sapiens
uauucagugguccaggau

SEQ ID NO: 1803994 - RNA, 18 nt, Homo sapiens
ucaggagcacagccauag

SEQ ID NO: 1803995 - RNA, 18 nt, Homo sapiens
uaaccaugaaaauagcca

SEQ ID NO: 1803996 - RNA, 18 nt, Homo sapiens
cauuccugcgcauggugc

SEQ ID NO: 1803997 - RNA, 16 nt, Homo sapiens
ucacuguuucucugcu

SEQ ID NO: 1803998 - RNA, 16 nt, Homo sapiens
ggagaguacagugagc

SEQ ID NO: 1803999 - RNA, 23 nt, Homo sapiens
agauguugaauucuuuugccaag

SEQ ID NO: 1804000 - RNA, 17 nt, Homo sapiens
gcuaauuugccacagga

SEQ ID NO: 1804001 - RNA, 19 nt, Homo sapiens
uacaauugugggcauaaac

SEQ ID NO: 1804002 - RNA, 18 nt, Homo sapiens
uaugcucagggucaauuu

SEQ ID NO: 1804003 - RNA, 15 nt, Homo sapiens
uucaaaccagcuuca

SEQ ID NO: 1804004 - RNA, 24 nt, Homo sapiens
aguccugggaauaugcuagugaug

SEQ ID NO: 1804005 - RNA, 21 nt, Homo sapiens
cacuccccccauaucuuuaaa

SEQ ID NO: 1804006 - RNA, 17 nt, Homo sapiens
aucacgccugugcagug

SEQ ID NO: 1804007 - RNA, 22 nt, Homo sapiens
cgagauguucgcucgugcagua

SEQ ID NO: 1804008 - RNA, 17 nt, Homo sapiens
agacccccacaccucag

SEQ ID NO: 1804009 - RNA, 17 nt, Homo sapiens
caggucgagcugugcuc

SEQ ID NO: 1804010 - RNA, 20 nt, Homo sapiens
aaaaacugccuuugauacag

SEQ ID NO: 1804011 - RNA, 22 nt, Homo sapiens
uaucuggguuuuagaaauucua

SEQ ID NO: 1804012 - RNA, 20 nt, Homo sapiens
ggcucagccucaaaugcagu

SEQ ID NO: 1804013 - RNA, 18 nt, Homo sapiens
aacuugauuaacuccucc

SEQ ID NO: 1804014 - RNA, 15 nt, Homo sapiens
caaugaaugaucauu

SEQ ID NO: 1804015 - RNA, 18 nt, Homo sapiens
uaaccccuaugaacucuu

SEQ ID NO: 1804016 - RNA, 15 nt, Homo sapiens
agcuucugcaauguu

SEQ ID NO: 1804017 - RNA, 14 nt, Homo sapiens
auggcugugaaaau

SEQ ID NO: 1804018 - RNA, 21 nt, Homo sapiens
aagacucgggauuaguacaca

SEQ ID NO: 1804019 - RNA, 14 nt, Homo sapiens
ucuauaaaacacau

SEQ ID NO: 1804020 - RNA, 13 nt, Homo sapiens
uagaguguuauca

SEQ ID NO: 1804021 - RNA, 22 nt, Homo sapiens
cucccuuucagguuuacuaugu

SEQ ID NO: 1804022 - RNA, 16 nt, Homo sapiens
cuuuaagacagaauuc

SEQ ID NO: 1804023 - RNA, 15 nt, Homo sapiens
cccaggcugggcaag

SEQ ID NO: 1804024 - RNA, 17 nt, Homo sapiens
gcccuggagccaacugc

SEQ ID NO: 1804025 - RNA, 20 nt, Homo sapiens
caaucacgggcgguccugca

SEQ ID NO: 1804026 - RNA, 15 nt, Homo sapiens
ucugcaacaaaaagu

SEQ ID NO: 1804027 - RNA, 20 nt, Homo sapiens
aacuagaguauaaaguaauu

SEQ ID NO: 1804028 - RNA, 23 nt, Homo sapiens
ucugcggcuguguaguaaaucuc

SEQ ID NO: 1804029 - RNA, 22 nt, Homo sapiens
uugagcgugaaucuguaucuug

SEQ ID NO: 1804030 - RNA, 14 nt, Homo sapiens
gcaugaucacagcu

SEQ ID NO: 1804031 - RNA, 14 nt, Homo sapiens
gggucuucagggga

SEQ ID NO: 1804032 - RNA, 14 nt, Homo sapiens
agaagcagaccauu

SEQ ID NO: 1804033 - RNA, 16 nt, Homo sapiens
uggauaaaacugugua

SEQ ID NO: 1804034 - RNA, 13 nt, Homo sapiens
acugaauacuuga

SEQ ID NO: 1804035 - RNA, 14 nt, Homo sapiens
uuacuggcacaagu

SEQ ID NO: 1804036 - RNA, 14 nt, Homo sapiens
aauauucauuugcu

SEQ ID NO: 1804037 - RNA, 19 nt, Homo sapiens
cgggugggcggcacagccu

SEQ ID NO: 1804038 - RNA, 22 nt, Homo sapiens
gaaaagcuaguguaccuccucu

SEQ ID NO: 1804039 - RNA, 18 nt, Homo sapiens
caugcgugugucagggau

SEQ ID NO: 1804040 - RNA, 23 nt, Homo sapiens
ugaaucaaucuggcuucugcauu

SEQ ID NO: 1804041 - RNA, 13 nt, Homo sapiens
cuuaaugcaaauu

SEQ ID NO: 1804042 - RNA, 14 nt, Homo sapiens
gacuuaaacugcug

SEQ ID NO: 1804043 - RNA, 20 nt, Homo sapiens
gaagcagaaugagaugauuu

SEQ ID NO: 1804044 - RNA, 18 nt, Homo sapiens
uguuuuaaucuccucuga

SEQ ID NO: 1804045 - RNA, 20 nt, Homo sapiens
caucaggcccgcuaggucca

SEQ ID NO: 1804046 - RNA, 14 nt, Homo sapiens
uccucccaaaagua

SEQ ID NO: 1804047 - RNA, 22 nt, Homo sapiens
uaucaccuagcagccucaaaac

SEQ ID NO: 1804048 - RNA, 23 nt, Homo sapiens
ggccuucuugugaucuugcucua

SEQ ID NO: 1804049 - RNA, 14 nt, Homo sapiens
uaaaagaucuugaa

SEQ ID NO: 1804050 - RNA, 15 nt, Homo sapiens
caauaaaugaacugc

SEQ ID NO: 1804051 - RNA, 16 nt, Homo sapiens
ggucuuauuuguaaag

SEQ ID NO: 1804052 - RNA, 21 nt, Homo sapiens
aaagaugcauuuucacugcaa

SEQ ID NO: 1804053 - RNA, 19 nt, Homo sapiens
ccuuucuauaauuuuacaa

SEQ ID NO: 1804054 - RNA, 15 nt, Homo sapiens
ugaauguagcuucca

SEQ ID NO: 1804055 - RNA, 14 nt, Homo sapiens
agaaaugaacaaaa

SEQ ID NO: 1804056 - RNA, 13 nt, Homo sapiens
gccagcucaggaa

SEQ ID NO: 1804057 - RNA, 22 nt, Homo sapiens
ccugcuuggucuuucauugcua

SEQ ID NO: 1804058 - RNA, 22 nt, Homo sapiens
cacaugaaugcagucaugcaaa

SEQ ID NO: 1804059 - RNA, 21 nt, Homo sapiens
uuccuugugguugaaaaccac

SEQ ID NO: 1804060 - RNA, 12 nt, Homo sapiens
acuggcauuaaa

SEQ ID NO: 1804061 - RNA, 12 nt, Homo sapiens
acugacuccuua

SEQ ID NO: 1804062 - RNA, 20 nt, Homo sapiens
gauauucuguugcuuuacag

SEQ ID NO: 1804063 - RNA, 17 nt, Homo sapiens
acacaucaggaguucaa

SEQ ID NO: 1804064 - RNA, 12 nt, Homo sapiens
gauauguaagag

SEQ ID NO: 1804065 - RNA, 22 nt, Homo sapiens
acuucccaaguguaagacucug

SEQ ID NO: 1804066 - RNA, 21 nt, Homo sapiens
uugcuaaauguaacagucuga

SEQ ID NO: 1804067 - RNA, 16 nt, Homo sapiens
ggacacaggcuccaaa

SEQ ID NO: 1804068 - RNA, 19 nt, Homo sapiens
ccaauugcuggaguacuua

SEQ ID NO: 1804069 - RNA, 13 nt, Homo sapiens
ugggccacagccc

SEQ ID NO: 1804070 - RNA, 22 nt, Homo sapiens
gcuacucuggaggcugagauag

SEQ ID NO: 1804071 - RNA, 15 nt, Homo sapiens
cauacagacagcaca

SEQ ID NO: 1804072 - RNA, 19 nt, Homo sapiens
ugacaucacagcagccucc

SEQ ID NO: 1804073 - RNA, 21 nt, Homo sapiens
aaguuaggaacgaacauguua

SEQ ID NO: 1804074 - RNA, 14 nt, Homo sapiens
cacacguaagcaca

SEQ ID NO: 1804075 - RNA, 15 nt, Homo sapiens
ccaggaaugauccca

SEQ ID NO: 1804076 - RNA, 22 nt, Homo sapiens
ugagaagcugccauaucuucag

SEQ ID NO: 1804077 - RNA, 15 nt, Homo sapiens
gcagcaaauuuucag

SEQ ID NO: 1804078 - RNA, 20 nt, Homo sapiens
cacguguuuuuguaucuuua

SEQ ID NO: 1804079 - RNA, 23 nt, Homo sapiens
aaauauuuuaucuuuuagcuaga

SEQ ID NO: 1804080 - RNA, 13 nt, Homo sapiens
caauaaaguacuu

SEQ ID NO: 1804081 - RNA, 18 nt, Homo sapiens
uauguuauuggaauuuuc

SEQ ID NO: 1804082 - RNA, 20 nt, Homo sapiens
ccugaaguguggcugcaucu

SEQ ID NO: 1804083 - RNA, 19 nt, Homo sapiens
aaacgucuucuaaacuucc

SEQ ID NO: 1804084 - RNA, 16 nt, Homo sapiens
uuguaaucaucauaga

SEQ ID NO: 1804085 - RNA, 14 nt, Homo sapiens
ucugcauacccuca

SEQ ID NO: 1804086 - RNA, 14 nt, Homo sapiens
uguggguaccugua

SEQ ID NO: 1804087 - RNA, 15 nt, Homo sapiens
ucagacccaacagca

SEQ ID NO: 1804088 - RNA, 20 nt, Homo sapiens
caauucccccuuaaacuucc

SEQ ID NO: 1804089 - RNA, 17 nt, Homo sapiens
agccguaguggaauuaa

SEQ ID NO: 1804090 - RNA, 22 nt, Homo sapiens
auuuaaggaagaaucuucugcc

SEQ ID NO: 1804091 - RNA, 22 nt, Homo sapiens
uaauguaauaauggaagccaaa

SEQ ID NO: 1804092 - RNA, 18 nt, Homo sapiens
uccugugcggacagcccu

SEQ ID NO: 1804093 - RNA, 22 nt, Homo sapiens
agccuuauuuuuguaugccuuu

SEQ ID NO: 1804094 - RNA, 20 nt, Homo sapiens
uacaacgccgagugcacugc

SEQ ID NO: 1804095 - RNA, 22 nt, Homo sapiens
aggugauuugaaggucuugauu

SEQ ID NO: 1804096 - RNA, 20 nt, Homo sapiens
augucauuuuuaauguaucu

SEQ ID NO: 1804097 - RNA, 14 nt, Homo sapiens
aauuagacuaagug

SEQ ID NO: 1804098 - RNA, 16 nt, Homo sapiens
ugcaguggugccauca

SEQ ID NO: 1804099 - RNA, 21 nt, Homo sapiens
aggaguccacugccuccauga

SEQ ID NO: 1804100 - RNA, 17 nt, Homo sapiens
uacaguuacaguugaug

SEQ ID NO: 1804101 - RNA, 15 nt, Homo sapiens
uuuuuacauccauga

SEQ ID NO: 1804102 - RNA, 19 nt, Homo sapiens
gacagggggcuaaggggcu

SEQ ID NO: 1804103 - RNA, 18 nt, Homo sapiens
ucccuuuuccaucaucuc

SEQ ID NO: 1804104 - RNA, 21 nt, Homo sapiens
gaaugggcuugaaacauuaua

SEQ ID NO: 1804105 - RNA, 17 nt, Homo sapiens
uucacugcagccuuuca

SEQ ID NO: 1804106 - RNA, 17 nt, Homo sapiens
cauguugagaccucagc

SEQ ID NO: 1804107 - RNA, 13 nt, Homo sapiens
ggcuuugcagugc

SEQ ID NO: 1804108 - RNA, 18 nt, Homo sapiens
ugcagauagaaagcauua

SEQ ID NO: 1804109 - RNA, 13 nt, Homo sapiens
cucugacugcuuu

SEQ ID NO: 1804110 - RNA, 15 nt, Homo sapiens
ucaauaauuacugua

SEQ ID NO: 1804111 - RNA, 15 nt, Homo sapiens
uaagauaauguugcu

SEQ ID NO: 1804112 - RNA, 23 nt, Homo sapiens
uuaugccauagcaagauugcuua

SEQ ID NO: 1804113 - RNA, 20 nt, Homo sapiens
caugggcuaaugaagaucau

SEQ ID NO: 1804114 - RNA, 15 nt, Homo sapiens
gcaagugugugcaca

SEQ ID NO: 1804115 - RNA, 21 nt, Homo sapiens
ccacaaucuggcuuagugcca

SEQ ID NO: 1804116 - RNA, 21 nt, Homo sapiens
gcauauguuuuccacauaaau

SEQ ID NO: 1804117 - RNA, 22 nt, Homo sapiens
aucaccucugauggcugaagaa

SEQ ID NO: 1804118 - RNA, 22 nt, Homo sapiens
aaaaucaaaucauccugucaca

SEQ ID NO: 1804119 - RNA, 21 nt, Homo sapiens
aaauuuacugucuaagauuaa

SEQ ID NO: 1804120 - RNA, 16 nt, Homo sapiens
ugccugccugugcuau

SEQ ID NO: 1804121 - RNA, 20 nt, Homo sapiens
ccucagcugccucacuuccu

SEQ ID NO: 1804122 - RNA, 16 nt, Homo sapiens
guagcuggcacuacag

SEQ ID NO: 1804123 - RNA, 19 nt, Homo sapiens
ucgacaaaggccacaggca

SEQ ID NO: 1804124 - RNA, 23 nt, Homo sapiens
uuaccauucauaguaagaauucu

SEQ ID NO: 1804125 - RNA, 16 nt, Homo sapiens
gauuggagauagggaa

SEQ ID NO: 1804126 - RNA, 15 nt, Homo sapiens
auguuuucucuaaga

SEQ ID NO: 1804127 - RNA, 23 nt, Homo sapiens
uuuccuugggcuuuagccuuaaa

SEQ ID NO: 1804128 - RNA, 19 nt, Homo sapiens
auggguaugcucaggucaa

SEQ ID NO: 1804129 - RNA, 22 nt, Homo sapiens
gugaaggcuggcaugauccaag

SEQ ID NO: 1804130 - RNA, 15 nt, Homo sapiens
caauaauacaaagca

SEQ ID NO: 1804131 - RNA, 17 nt, Homo sapiens
auacaacuccuauucac

SEQ ID NO: 1804132 - RNA, 12 nt, Homo sapiens
acgugugaggau

SEQ ID NO: 1804133 - RNA, 22 nt, Homo sapiens
aauauauauuauauauaaucua

SEQ ID NO: 1804134 - RNA, 15 nt, Homo sapiens
uuggaugcccugugg

SEQ ID NO: 1804135 - RNA, 22 nt, Homo sapiens
caaaauuucaaaagugaucugu

SEQ ID NO: 1804136 - RNA, 18 nt, Homo sapiens
aaagccaaauaaaaaucu

SEQ ID NO: 1804137 - RNA, 22 nt, Homo sapiens
uccauguggacugugccaucug

SEQ ID NO: 1804138 - RNA, 11 nt, Homo sapiens
guauuauaugu

SEQ ID NO: 1804139 - RNA, 14 nt, Homo sapiens
aaacauggugccua

SEQ ID NO: 1804140 - RNA, 18 nt, Homo sapiens
gaaacaagccugccauaa

SEQ ID NO: 1804141 - RNA, 16 nt, Homo sapiens
caguacuucagcaaga

SEQ ID NO: 1804142 - RNA, 21 nt, Homo sapiens
acugauccuggagaaaaggga

SEQ ID NO: 1804143 - RNA, 20 nt, Homo sapiens
aacgugaaauucuauugaaa

SEQ ID NO: 1804144 - RNA, 22 nt, Homo sapiens
cuuaccuauuauaaaaucuuac

SEQ ID NO: 1804145 - RNA, 12 nt, Homo sapiens
aggccagcagca

SEQ ID NO: 1804146 - RNA, 17 nt, Homo sapiens
agucagagaacagagau

SEQ ID NO: 1804147 - RNA, 20 nt, Homo sapiens
agagcaucugcucugagacg

SEQ ID NO: 1804148 - RNA, 23 nt, Homo sapiens
gaaggcugccaggggauuucgaa

SEQ ID NO: 1804149 - RNA, 21 nt, Homo sapiens
guaccucucaacauuaccaaa

SEQ ID NO: 1804150 - RNA, 16 nt, Homo sapiens
cugggaugggcuccca

SEQ ID NO: 1804151 - RNA, 23 nt, Homo sapiens
cuggcccagggggccuggagcau

SEQ ID NO: 1804152 - RNA, 16 nt, Homo sapiens
augugaauauggacag

SEQ ID NO: 1804153 - RNA, 17 nt, Homo sapiens
cccgugggugugugugg

SEQ ID NO: 1804154 - RNA, 15 nt, Homo sapiens
uucuguccuaccuuu

SEQ ID NO: 1804155 - RNA, 14 nt, Homo sapiens
augcagugcccuca

SEQ ID NO: 1804156 - RNA, 14 nt, Homo sapiens
uggccaaagucacu

SEQ ID NO: 1804157 - RNA, 22 nt, Homo sapiens
ugucauuuuacaagcauuagau

SEQ ID NO: 1804158 - RNA, 21 nt, Homo sapiens
agccauugaacagcugugagc

SEQ ID NO: 1804159 - RNA, 17 nt, Homo sapiens
ucuccuuagaaguggaa

SEQ ID NO: 1804160 - RNA, 22 nt, Homo sapiens
auucucaggccaucaucagugg

SEQ ID NO: 1804161 - RNA, 16 nt, Homo sapiens
aggccacacgcacugg

SEQ ID NO: 1804162 - RNA, 22 nt, Homo sapiens
uuacaagcugaguaaaauuccu

SEQ ID NO: 1804163 - RNA, 15 nt, Homo sapiens
cccugccagcucuuc

SEQ ID NO: 1804164 - RNA, 14 nt, Homo sapiens
cagccucuagaaca

SEQ ID NO: 1804165 - RNA, 21 nt, Homo sapiens
caccugguuccggcucugcac

SEQ ID NO: 1804166 - RNA, 17 nt, Homo sapiens
cguacuguaacugcuca

SEQ ID NO: 1804167 - RNA, 19 nt, Homo sapiens
aaaggugccagagcuccau

SEQ ID NO: 1804168 - RNA, 19 nt, Homo sapiens
ccagcuccaaccugcaaag

SEQ ID NO: 1804169 - RNA, 16 nt, Homo sapiens
acacguggguauuuaa

SEQ ID NO: 1804170 - RNA, 16 nt, Homo sapiens
aagaagugaacacuua

SEQ ID NO: 1804171 - RNA, 16 nt, Homo sapiens
ugcagagcuuuggcca

SEQ ID NO: 1804172 - RNA, 16 nt, Homo sapiens
aggcuacaaagcagag

SEQ ID NO: 1804173 - RNA, 17 nt, Homo sapiens
aaccuuuggaagucaug

SEQ ID NO: 1804174 - RNA, 20 nt, Homo sapiens
acaucuauguaucuaccauc

SEQ ID NO: 1804175 - RNA, 16 nt, Homo sapiens
acuuaaauuccucaac

SEQ ID NO: 1804176 - RNA, 16 nt, Homo sapiens
aguccuucugccauuu

SEQ ID NO: 1804177 - RNA, 21 nt, Homo sapiens
ucagcagaaacacacagucac

SEQ ID NO: 1804178 - RNA, 20 nt, Homo sapiens
ugaggaagccuaaauaaaaa

SEQ ID NO: 1804179 - RNA, 20 nt, Homo sapiens
gacaacaaucucaauuccau

SEQ ID NO: 1804180 - RNA, 22 nt, Homo sapiens
gcuacuaaaauauuaguguuau

SEQ ID NO: 1804181 - RNA, 14 nt, Homo sapiens
caggcgaugugcaa

SEQ ID NO: 1804182 - RNA, 23 nt, Homo sapiens
auaaaaaaugguucagaauuaaa

SEQ ID NO: 1804183 - RNA, 21 nt, Homo sapiens
caccuggggaauaaacuccag

SEQ ID NO: 1804184 - RNA, 15 nt, Homo sapiens
aacccucacccagag

SEQ ID NO: 1804185 - RNA, 23 nt, Homo sapiens
uuucucaaaggcccucagugaga

SEQ ID NO: 1804186 - RNA, 22 nt, Homo sapiens
uccucacagaguuaaauaugca

SEQ ID NO: 1804187 - RNA, 14 nt, Homo sapiens
cuguucuaagucca

SEQ ID NO: 1804188 - RNA, 20 nt, Homo sapiens
acccaggaggggaacacugc

SEQ ID NO: 1804189 - RNA, 22 nt, Homo sapiens
ccaagcaggaaaugaaaauguc

SEQ ID NO: 1804190 - RNA, 14 nt, Homo sapiens
ucuuaaaguugaau

SEQ ID NO: 1804191 - RNA, 23 nt, Homo sapiens
augaucaacucauuccagcuuuc

SEQ ID NO: 1804192 - RNA, 22 nt, Homo sapiens
gaacaaacuaugaucacaguga

SEQ ID NO: 1804193 - RNA, 20 nt, Homo sapiens
cggaaaacaagccugaggga

SEQ ID NO: 1804194 - RNA, 18 nt, Homo sapiens
aucucuuugaagguuuau

SEQ ID NO: 1804195 - RNA, 15 nt, Homo sapiens
ggccagugggcgggc

SEQ ID NO: 1804196 - RNA, 16 nt, Homo sapiens
ugaaaagcuaccauca

SEQ ID NO: 1804197 - RNA, 15 nt, Homo sapiens
ugcuguccugaucug

SEQ ID NO: 1804198 - RNA, 15 nt, Homo sapiens
accuaagaaguacau

SEQ ID NO: 1804199 - RNA, 19 nt, Homo sapiens
ugcaauaugccaagauuac

SEQ ID NO: 1804200 - RNA, 12 nt, Homo sapiens
ucugucuugggc

SEQ ID NO: 1804201 - RNA, 20 nt, Homo sapiens
ucaggaguuccagugcugca

SEQ ID NO: 1804202 - RNA, 15 nt, Homo sapiens
aacccaccagccuaa

SEQ ID NO: 1804203 - RNA, 14 nt, Homo sapiens
ucacugcgcauguu

SEQ ID NO: 1804204 - RNA, 22 nt, Homo sapiens
agcugagcacuuuugaaaagcu

SEQ ID NO: 1804205 - RNA, 19 nt, Homo sapiens
uguauaaauaaaugaucua

SEQ ID NO: 1804206 - RNA, 17 nt, Homo sapiens
cuugaugaugaucguca

SEQ ID NO: 1804207 - RNA, 13 nt, Homo sapiens
agcgugugugaac

SEQ ID NO: 1804208 - RNA, 16 nt, Homo sapiens
guuaaccucaguguca

SEQ ID NO: 1804209 - RNA, 21 nt, Homo sapiens
cacaaggcugaccaagagaga

SEQ ID NO: 1804210 - RNA, 19 nt, Homo sapiens
aauaaaaauuguagcuuuu

SEQ ID NO: 1804211 - RNA, 15 nt, Homo sapiens
gagcagccagcguua

SEQ ID NO: 1804212 - RNA, 22 nt, Homo sapiens
aagacauuucucuaacuccugc

SEQ ID NO: 1804213 - RNA, 18 nt, Homo sapiens
aguacuuauguugcacaa

SEQ ID NO: 1804214 - RNA, 23 nt, Homo sapiens
agaaaauugcugugccucccaaa

SEQ ID NO: 1804215 - RNA, 15 nt, Homo sapiens
gauaaucagccucuu

SEQ ID NO: 1804216 - RNA, 22 nt, Homo sapiens
gcacacacagauaugcacacac

SEQ ID NO: 1804217 - RNA, 17 nt, Homo sapiens
cuuaccuuuccugaugc

SEQ ID NO: 1804218 - RNA, 19 nt, Homo sapiens
cgagccaaguuaagaaugu

SEQ ID NO: 1804219 - RNA, 13 nt, Homo sapiens
ugcaggaagggaa

SEQ ID NO: 1804220 - RNA, 13 nt, Homo sapiens
ggaucugggcugu

SEQ ID NO: 1804221 - RNA, 18 nt, Homo sapiens
ugaaaacucacuucaaug

SEQ ID NO: 1804222 - RNA, 15 nt, Homo sapiens
caucaaaaucuggca

SEQ ID NO: 1804223 - RNA, 20 nt, Homo sapiens
ucagccccugggaacaggcc

SEQ ID NO: 1804224 - RNA, 22 nt, Homo sapiens
aggccaauguaucccugaggaa

SEQ ID NO: 1804225 - RNA, 21 nt, Homo sapiens
gcaaagcaccagcuucuccag

SEQ ID NO: 1804226 - RNA, 15 nt, Homo sapiens
aauggguuacuugau

SEQ ID NO: 1804227 - RNA, 15 nt, Homo sapiens
cccucuuugagggag

SEQ ID NO: 1804228 - RNA, 17 nt, Homo sapiens
agcacaaccacuguagc

SEQ ID NO: 1804229 - RNA, 19 nt, Homo sapiens
uaugcccauucuuuucacu

SEQ ID NO: 1804230 - RNA, 16 nt, Homo sapiens
uucauacuccuuuuaa

SEQ ID NO: 1804231 - RNA, 23 nt, Homo sapiens
gagaaaccauucuuuccccucag

SEQ ID NO: 1804232 - RNA, 24 nt, Homo sapiens
auaaugauuuuuuuacuaaugaua

SEQ ID NO: 1804233 - RNA, 22 nt, Homo sapiens
ccaaguccagauuuacacuggg

SEQ ID NO: 1804234 - RNA, 19 nt, Homo sapiens
uaacuauauguacagcucu

SEQ ID NO: 1804235 - RNA, 14 nt, Homo sapiens
cagagggaccagcu

SEQ ID NO: 1804236 - RNA, 22 nt, Homo sapiens
acucauuucauuccuaacacag

SEQ ID NO: 1804237 - RNA, 18 nt, Homo sapiens
gcuaauugugcacaucuc

SEQ ID NO: 1804238 - RNA, 21 nt, Homo sapiens
aacucuguacgaggcuucucu

SEQ ID NO: 1804239 - RNA, 18 nt, Homo sapiens
cuucaagagccucuggca

SEQ ID NO: 1804240 - RNA, 22 nt, Homo sapiens
auucuuaaccuggaacuggagu

SEQ ID NO: 1804241 - RNA, 23 nt, Homo sapiens
acuacaguuagggcuccuauuca

SEQ ID NO: 1804242 - RNA, 14 nt, Homo sapiens
aggagaagaggcau

SEQ ID NO: 1804243 - RNA, 23 nt, Homo sapiens
cuggaagccucuauugccaugag

SEQ ID NO: 1804244 - RNA, 22 nt, Homo sapiens
caucuggccuaauguuccagau

SEQ ID NO: 1804245 - RNA, 19 nt, Homo sapiens
uuaacugacuucuguccac

SEQ ID NO: 1804246 - RNA, 18 nt, Homo sapiens
gacucaaguccuuaccuc

SEQ ID NO: 1804247 - RNA, 19 nt, Homo sapiens
auuauuuuagagcaucuca

SEQ ID NO: 1804248 - RNA, 14 nt, Homo sapiens
gacuuggcacuuaa

SEQ ID NO: 1804249 - RNA, 23 nt, Homo sapiens
ucaagcucaucuguuaugcauag

SEQ ID NO: 1804250 - RNA, 21 nt, Homo sapiens
aaaauuagugguacuucaggu

SEQ ID NO: 1804251 - RNA, 19 nt, Homo sapiens
auuuggaauugaacucucu

SEQ ID NO: 1804252 - RNA, 19 nt, Homo sapiens
cugcgcagggcucuuugag

SEQ ID NO: 1804253 - RNA, 17 nt, Homo sapiens
caggacuccagcccauu

SEQ ID NO: 1804254 - RNA, 15 nt, Homo sapiens
guuucaacauaugaa

SEQ ID NO: 1804255 - RNA, 17 nt, Homo sapiens
gaccccagccauccagg

SEQ ID NO: 1804256 - RNA, 13 nt, Homo sapiens
gugugauugcacg

SEQ ID NO: 1804257 - RNA, 20 nt, Homo sapiens
uauuuuuguacugaaucuca

SEQ ID NO: 1804258 - RNA, 14 nt, Homo sapiens
augcuuaugacaau

SEQ ID NO: 1804259 - RNA, 11 nt, Homo sapiens
caaagacagaa

SEQ ID NO: 1804260 - RNA, 23 nt, Homo sapiens
uuugguuguguaagagaauguug

SEQ ID NO: 1804261 - RNA, 19 nt, Homo sapiens
auauuaaaagucacucuga

SEQ ID NO: 1804262 - RNA, 21 nt, Homo sapiens
ugacccugugccccgccuccc

SEQ ID NO: 1804263 - RNA, 17 nt, Homo sapiens
aaacgaucgcugugaaa

SEQ ID NO: 1804264 - RNA, 14 nt, Homo sapiens
auuccuguuuccau

SEQ ID NO: 1804265 - RNA, 12 nt, Homo sapiens
uaagcccaggau

SEQ ID NO: 1804266 - RNA, 18 nt, Homo sapiens
aaguccuaaaaguucuca

SEQ ID NO: 1804267 - RNA, 19 nt, Homo sapiens
cacccagcagaaauacaau

SEQ ID NO: 1804268 - RNA, 17 nt, Homo sapiens
gaggacgucuucuaggg

SEQ ID NO: 1804269 - RNA, 17 nt, Homo sapiens
ugaaugucaauaugaga

SEQ ID NO: 1804270 - RNA, 20 nt, Homo sapiens
acucagcucugucugcucaa

SEQ ID NO: 1804271 - RNA, 20 nt, Homo sapiens
caaauuuccuuucauaccuu

SEQ ID NO: 1804272 - RNA, 19 nt, Homo sapiens
gaagcuuaggcagggcucu

SEQ ID NO: 1804273 - RNA, 23 nt, Homo sapiens
ucagccaaaugacuucauuucug

SEQ ID NO: 1804274 - RNA, 23 nt, Homo sapiens
aaaauguaaaauccuacagugaa

SEQ ID NO: 1804275 - RNA, 17 nt, Homo sapiens
acaaccuuuuuauuuuc

SEQ ID NO: 1804276 - RNA, 22 nt, Homo sapiens
ccuggcaggggauccagcucaa

SEQ ID NO: 1804277 - RNA, 22 nt, Homo sapiens
uucaauauuuuuguauauacuu

SEQ ID NO: 1804278 - RNA, 22 nt, Homo sapiens
acaaccauccugcucauaacau

SEQ ID NO: 1804279 - RNA, 16 nt, Homo sapiens
ugaucaagaaugcaau

SEQ ID NO: 1804280 - RNA, 17 nt, Homo sapiens
cuuguugcaucucagau

SEQ ID NO: 1804281 - RNA, 14 nt, Homo sapiens
gucugcuucugcac

SEQ ID NO: 1804282 - RNA, 16 nt, Homo sapiens
gaacaagaacccagca

SEQ ID NO: 1804283 - RNA, 16 nt, Homo sapiens
aacaaagugcaaagcu

SEQ ID NO: 1804284 - RNA, 14 nt, Homo sapiens
gugguaugugacac

SEQ ID NO: 1804285 - RNA, 14 nt, Homo sapiens
guaacaucagccau

SEQ ID NO: 1804286 - RNA, 17 nt, Homo sapiens
cugccauuuuagugucu

SEQ ID NO: 1804287 - RNA, 19 nt, Homo sapiens
ucugagaaacucuacaugu

SEQ ID NO: 1804288 - RNA, 19 nt, Homo sapiens
ucaacuucagagacuaucu

SEQ ID NO: 1804289 - RNA, 14 nt, Homo sapiens
ccuugggguggugc

SEQ ID NO: 1804290 - RNA, 19 nt, Homo sapiens
aaaacuuguacaccaaugu

SEQ ID NO: 1804291 - RNA, 18 nt, Homo sapiens
aucaguaaauaacuggaa

SEQ ID NO: 1804292 - RNA, 12 nt, Homo sapiens
gcaggagaauca

SEQ ID NO: 1804293 - RNA, 19 nt, Homo sapiens
acauagugauaccccaucu

SEQ ID NO: 1804294 - RNA, 23 nt, Homo sapiens
cagguuuucuggguguccaaagg

SEQ ID NO: 1804295 - RNA, 13 nt, Homo sapiens
aauugaauacuuu

SEQ ID NO: 1804296 - RNA, 11 nt, Homo sapiens
ccaugugcaua

SEQ ID NO: 1804297 - RNA, 23 nt, Homo sapiens
cauuagaaacugaaaacuguaaa

SEQ ID NO: 1804298 - RNA, 18 nt, Homo sapiens
aagauuuucccagucugu

SEQ ID NO: 1804299 - RNA, 16 nt, Homo sapiens
ggcacgccaacagccc

SEQ ID NO: 1804300 - RNA, 22 nt, Homo sapiens
gccacgugggcaaacaggcagu

SEQ ID NO: 1804301 - RNA, 13 nt, Homo sapiens
uaaaguaccacac

SEQ ID NO: 1804302 - RNA, 15 nt, Homo sapiens
auaucuagucacuug

SEQ ID NO: 1804303 - RNA, 19 nt, Homo sapiens
uuguauuuuaauaguacau

SEQ ID NO: 1804304 - RNA, 18 nt, Homo sapiens
aacgagaagguacugaaa

SEQ ID NO: 1804305 - RNA, 13 nt, Homo sapiens
cuugccacacccc

SEQ ID NO: 1804306 - RNA, 21 nt, Homo sapiens
cugcaacuccagcguccucag

SEQ ID NO: 1804307 - RNA, 14 nt, Homo sapiens
ucccauguggaaca

SEQ ID NO: 1804308 - RNA, 14 nt, Homo sapiens
uuauguagcugaau

SEQ ID NO: 1804309 - RNA, 15 nt, Homo sapiens
aaaauauuugagaau

SEQ ID NO: 1804310 - RNA, 17 nt, Homo sapiens
guuugucaacacaaaga

SEQ ID NO: 1804311 - RNA, 14 nt, Homo sapiens
uucugagcaaagca

SEQ ID NO: 1804312 - RNA, 21 nt, Homo sapiens
gagacuccucaguucuugcca

SEQ ID NO: 1804313 - RNA, 17 nt, Homo sapiens
cuucaaaacugccauua

SEQ ID NO: 1804314 - RNA, 16 nt, Homo sapiens
ggaacagagucauauu

SEQ ID NO: 1804315 - RNA, 17 nt, Homo sapiens
uugacacauaugaacac

SEQ ID NO: 1804316 - RNA, 18 nt, Homo sapiens
cccccagccuuguuucug

SEQ ID NO: 1804317 - RNA, 16 nt, Homo sapiens
uauucugaaaaagaca

SEQ ID NO: 1804318 - RNA, 21 nt, Homo sapiens
acuggaagagaguuccgggaa

SEQ ID NO: 1804319 - RNA, 21 nt, Homo sapiens
acacugcacagaccuuaggga

SEQ ID NO: 1804320 - RNA, 11 nt, Homo sapiens
uugcugcaaag

SEQ ID NO: 1804321 - RNA, 14 nt, Homo sapiens
auaagaucuguuuu

SEQ ID NO: 1804322 - RNA, 16 nt, Homo sapiens
aucuguauuggcagca

SEQ ID NO: 1804323 - RNA, 22 nt, Homo sapiens
aaagcagacagcuccacccugg

SEQ ID NO: 1804324 - RNA, 17 nt, Homo sapiens
acaagagaagcugaugg

SEQ ID NO: 1804325 - RNA, 21 nt, Homo sapiens
cauucaaaguaauauaucaaa

SEQ ID NO: 1804326 - RNA, 21 nt, Homo sapiens
auguuacucaguguuaacaca

SEQ ID NO: 1804327 - RNA, 22 nt, Homo sapiens
gccagaaagagcugucuaugca

SEQ ID NO: 1804328 - RNA, 19 nt, Homo sapiens
gcaaauccgaaaucagcag

SEQ ID NO: 1804329 - RNA, 14 nt, Homo sapiens
aaaauaagccacau

SEQ ID NO: 1804330 - RNA, 19 nt, Homo sapiens
ucccucgucuucagcugca

SEQ ID NO: 1804331 - RNA, 21 nt, Homo sapiens
ggagaagagaugcugccauuu

SEQ ID NO: 1804332 - RNA, 20 nt, Homo sapiens
aauuauguuuugugauucaa

SEQ ID NO: 1804333 - RNA, 21 nt, Homo sapiens
cuggaguuguggugaggccac

SEQ ID NO: 1804334 - RNA, 12 nt, Homo sapiens
aucucagggaac

SEQ ID NO: 1804335 - RNA, 16 nt, Homo sapiens
agcagccccacaccag

SEQ ID NO: 1804336 - RNA, 20 nt, Homo sapiens
ugagaacccccuaaccucua

SEQ ID NO: 1804337 - RNA, 13 nt, Homo sapiens
aaacauucaguga

SEQ ID NO: 1804338 - RNA, 17 nt, Homo sapiens
aagcuuccgccgucuca

SEQ ID NO: 1804339 - RNA, 19 nt, Homo sapiens
aagcacaaauuucaucucc

SEQ ID NO: 1804340 - RNA, 16 nt, Homo sapiens
aaaucaaucuggugcu

SEQ ID NO: 1804341 - RNA, 17 nt, Homo sapiens
aaaauuauacugagaac

SEQ ID NO: 1804342 - RNA, 17 nt, Homo sapiens
gugccccugcucacagu

SEQ ID NO: 1804343 - RNA, 14 nt, Homo sapiens
ugcucaaaaugcca

SEQ ID NO: 1804344 - RNA, 12 nt, Homo sapiens
ugcugcucucag

SEQ ID NO: 1804345 - RNA, 14 nt, Homo sapiens
cgucauguuucuuc

SEQ ID NO: 1804346 - RNA, 12 nt, Homo sapiens
agauuaacaaca

SEQ ID NO: 1804347 - RNA, 13 nt, Homo sapiens
uguauugauacug

SEQ ID NO: 1804348 - RNA, 19 nt, Homo sapiens
agauugcuggaaaccaagu

SEQ ID NO: 1804349 - RNA, 18 nt, Homo sapiens
gcccugaacccacugcug

SEQ ID NO: 1804350 - RNA, 13 nt, Homo sapiens
guacaauaauuca

SEQ ID NO: 1804351 - RNA, 23 nt, Homo sapiens
gaaaaaaccguucaaauucucuu

SEQ ID NO: 1804352 - RNA, 14 nt, Homo sapiens
aggaguucugcuca

SEQ ID NO: 1804353 - RNA, 12 nt, Homo sapiens
gcuaauguugcu

SEQ ID NO: 1804354 - RNA, 11 nt, Homo sapiens
uucauguaauu

SEQ ID NO: 1804355 - RNA, 19 nt, Homo sapiens
acuuccuucagcaucucac

SEQ ID NO: 1804356 - RNA, 12 nt, Homo sapiens
ugcaucagugau

SEQ ID NO: 1804357 - RNA, 12 nt, Homo sapiens
uuugcagugucu

SEQ ID NO: 1804358 - RNA, 12 nt, Homo sapiens
aaggaaaucaaa

SEQ ID NO: 1804359 - RNA, 19 nt, Homo sapiens
cugccagcaggggugugau

SEQ ID NO: 1804360 - RNA, 22 nt, Homo sapiens
ccacgucccucgagcucuguag

SEQ ID NO: 1804361 - RNA, 13 nt, Homo sapiens
ucaaguucauuga

SEQ ID NO: 1804362 - RNA, 13 nt, Homo sapiens
aagaaucuaauag

SEQ ID NO: 1804363 - RNA, 13 nt, Homo sapiens
uuuugagacagag

SEQ ID NO: 1804364 - RNA, 13 nt, Homo sapiens
cccaauaauugca

SEQ ID NO: 1804365 - RNA, 23 nt, Homo sapiens
ucaugcuuugauuuacacucgaa

SEQ ID NO: 1804366 - RNA, 14 nt, Homo sapiens
ucuuggcuuaucca

SEQ ID NO: 1804367 - RNA, 14 nt, Homo sapiens
aaaaagucagagac

SEQ ID NO: 1804368 - RNA, 22 nt, Homo sapiens
ugacgcugcaugagacauugac

SEQ ID NO: 1804369 - RNA, 16 nt, Homo sapiens
ggaggucauacaugca

SEQ ID NO: 1804370 - RNA, 16 nt, Homo sapiens
gaugucaacugaccua

SEQ ID NO: 1804371 - RNA, 15 nt, Homo sapiens
ccuguuagacguccu

SEQ ID NO: 1804372 - RNA, 14 nt, Homo sapiens
uccuauuugcacac

SEQ ID NO: 1804373 - RNA, 13 nt, Homo sapiens
acagauugugaua

SEQ ID NO: 1804374 - RNA, 12 nt, Homo sapiens
acugguccaaaa

SEQ ID NO: 1804375 - RNA, 23 nt, Homo sapiens
gggagagccaaggccuaugccac

SEQ ID NO: 1804376 - RNA, 17 nt, Homo sapiens
ucacucugaguguuuua

SEQ ID NO: 1804377 - RNA, 16 nt, Homo sapiens
uccaaggccugugaau

SEQ ID NO: 1804378 - RNA, 23 nt, Homo sapiens
aguucucaucccucugucagggu

SEQ ID NO: 1804379 - RNA, 20 nt, Homo sapiens
uagacugaaaagccaugugu

SEQ ID NO: 1804380 - RNA, 17 nt, Homo sapiens
aguggaugcauuccuga

SEQ ID NO: 1804381 - RNA, 21 nt, Homo sapiens
ugagcucccaccucccuuccc

SEQ ID NO: 1804382 - RNA, 19 nt, Homo sapiens
augcuuugcucaugcgcaa

SEQ ID NO: 1804383 - RNA, 18 nt, Homo sapiens
gagaauccugccucuccc

SEQ ID NO: 1804384 - RNA, 20 nt, Homo sapiens
uugugaguuuaccuuguaua

SEQ ID NO: 1804385 - RNA, 13 nt, Homo sapiens
ccaaaaacauguu

SEQ ID NO: 1804386 - RNA, 19 nt, Homo sapiens
uuucccuucaaaaugcuuu

SEQ ID NO: 1804387 - RNA, 18 nt, Homo sapiens
auuucaucuacuacaggg

SEQ ID NO: 1804388 - RNA, 14 nt, Homo sapiens
guaaucuacaccaa

SEQ ID NO: 1804389 - RNA, 18 nt, Homo sapiens
agacaauugcauugcuac

SEQ ID NO: 1804390 - RNA, 19 nt, Homo sapiens
cccagggcaccauccagcu

SEQ ID NO: 1804391 - RNA, 22 nt, Homo sapiens
aauaaaugagagggaaucgacu

SEQ ID NO: 1804392 - RNA, 19 nt, Homo sapiens
uaagugcauuuauugccuc

SEQ ID NO: 1804393 - RNA, 17 nt, Homo sapiens
gacuucucuuugccuca

SEQ ID NO: 1804394 - RNA, 16 nt, Homo sapiens
ugacauucuucacugu

SEQ ID NO: 1804395 - RNA, 12 nt, Homo sapiens
aguggugcaauc

SEQ ID NO: 1804396 - RNA, 20 nt, Homo sapiens
cuuccaaaaauuacuuagua

SEQ ID NO: 1804397 - RNA, 20 nt, Homo sapiens
cauaagagcuuaagaaccau

SEQ ID NO: 1804398 - RNA, 16 nt, Homo sapiens
ugagaagacucaaguc

SEQ ID NO: 1804399 - RNA, 20 nt, Homo sapiens
ccacgaccuuugaagagcuu

SEQ ID NO: 1804400 - RNA, 23 nt, Homo sapiens
acuaaacaauaagcaagagacaa

SEQ ID NO: 1804401 - RNA, 18 nt, Homo sapiens
aaggcuggcagugacaga

SEQ ID NO: 1804402 - RNA, 20 nt, Homo sapiens
ucccugucccucuagugccu

SEQ ID NO: 1804403 - RNA, 22 nt, Homo sapiens
aauggcagggauacccagugau

SEQ ID NO: 1804404 - RNA, 12 nt, Homo sapiens
uuuaaaaaccaa

SEQ ID NO: 1804405 - RNA, 19 nt, Homo sapiens
uagcuggauauaauguauu

SEQ ID NO: 1804406 - RNA, 16 nt, Homo sapiens
gugcauguugccauga

SEQ ID NO: 1804407 - RNA, 15 nt, Homo sapiens
guuuccagcugccaa

SEQ ID NO: 1804408 - RNA, 23 nt, Homo sapiens
aggaaggaugaauaaguuuuauu

SEQ ID NO: 1804409 - RNA, 15 nt, Homo sapiens
ucaucacacucucca

SEQ ID NO: 1804410 - RNA, 12 nt, Homo sapiens
cagucacacaaa

SEQ ID NO: 1804411 - RNA, 20 nt, Homo sapiens
gcuucccaugucuuucucca

SEQ ID NO: 1804412 - RNA, 16 nt, Homo sapiens
gugaaguauacuguau

SEQ ID NO: 1804413 - RNA, 17 nt, Homo sapiens
ccaugaccccuucucuc

SEQ ID NO: 1804414 - RNA, 13 nt, Homo sapiens
gaaugaaccacug

SEQ ID NO: 1804415 - RNA, 15 nt, Homo sapiens
ccagagccaccaaag

SEQ ID NO: 1804416 - RNA, 11 nt, Homo sapiens
cugacuguugc

SEQ ID NO: 1804417 - RNA, 19 nt, Homo sapiens
ugcccucauuacugggccu

SEQ ID NO: 1804418 - RNA, 19 nt, Homo sapiens
ugcagcuuauauucaucca

SEQ ID NO: 1804419 - RNA, 21 nt, Homo sapiens
uauagcugugugaacguguau

SEQ ID NO: 1804420 - RNA, 14 nt, Homo sapiens
ccgcgccaacgcac

SEQ ID NO: 1804421 - RNA, 14 nt, Homo sapiens
cccagacaaccaaa

SEQ ID NO: 1804422 - RNA, 13 nt, Homo sapiens
cagcuugacucua

SEQ ID NO: 1804423 - RNA, 23 nt, Homo sapiens
gcuuccauuugugugugugcaag

SEQ ID NO: 1804424 - RNA, 20 nt, Homo sapiens
ccauuugggagaagaucuca

SEQ ID NO: 1804425 - RNA, 22 nt, Homo sapiens
cagagggguaggcagagccuuu

SEQ ID NO: 1804426 - RNA, 14 nt, Homo sapiens
uauaauaaaaccaa

SEQ ID NO: 1804427 - RNA, 22 nt, Homo sapiens
ccggccuugugacauucacuca

SEQ ID NO: 1804428 - RNA, 23 nt, Homo sapiens
uguauaaauuauucaguaacugu

SEQ ID NO: 1804429 - RNA, 22 nt, Homo sapiens
agcuugaggggucugcagucca

SEQ ID NO: 1804430 - RNA, 15 nt, Homo sapiens
gaagagcucaaggga

SEQ ID NO: 1804431 - RNA, 19 nt, Homo sapiens
aucgcaccacugcacucca

SEQ ID NO: 1804432 - RNA, 12 nt, Homo sapiens
augacauuucau

SEQ ID NO: 1804433 - RNA, 18 nt, Homo sapiens
uccaggguggaugaucuc

SEQ ID NO: 1804434 - RNA, 20 nt, Homo sapiens
auauaauguauuuucagcuc

SEQ ID NO: 1804435 - RNA, 19 nt, Homo sapiens
ugccuuagucccaauuuga

SEQ ID NO: 1804436 - RNA, 23 nt, Homo sapiens
cauucaugacaacaugaaaccua

SEQ ID NO: 1804437 - RNA, 16 nt, Homo sapiens
ggacacguaaccuggc

SEQ ID NO: 1804438 - RNA, 23 nt, Homo sapiens
aauuugucuuuuaauuuagcuua

SEQ ID NO: 1804439 - RNA, 19 nt, Homo sapiens
agggguggacggagccaaa

SEQ ID NO: 1804440 - RNA, 23 nt, Homo sapiens
gggagagacacucccagggacaa

SEQ ID NO: 1804441 - RNA, 15 nt, Homo sapiens
gagacuuaggccaga

SEQ ID NO: 1804442 - RNA, 23 nt, Homo sapiens
ccagagaaugcccacugccugua

SEQ ID NO: 1804443 - RNA, 16 nt, Homo sapiens
aaaucagaagcacaaa

SEQ ID NO: 1804444 - RNA, 17 nt, Homo sapiens
uucuugugauguuuuga

SEQ ID NO: 1804445 - RNA, 14 nt, Homo sapiens
auuucuuaugccug

SEQ ID NO: 1804446 - RNA, 16 nt, Homo sapiens
auuagaauauccauga

SEQ ID NO: 1804447 - RNA, 23 nt, Homo sapiens
ggcaagacgcgagugcuggugac

SEQ ID NO: 1804448 - RNA, 16 nt, Homo sapiens
auuucaaaccauuuac

SEQ ID NO: 1804449 - RNA, 17 nt, Homo sapiens
uuagaaaauucagcucc

SEQ ID NO: 1804450 - RNA, 17 nt, Homo sapiens
ggacagaaaaugcaaug

SEQ ID NO: 1804451 - RNA, 20 nt, Homo sapiens
cuuuggugcuuuucacuugu

SEQ ID NO: 1804452 - RNA, 22 nt, Homo sapiens
aucucaagcaaguuuaaucaau

SEQ ID NO: 1804453 - RNA, 14 nt, Homo sapiens
ccagcuuugcagug

SEQ ID NO: 1804454 - RNA, 14 nt, Homo sapiens
ccucagagugcaag

SEQ ID NO: 1804455 - RNA, 20 nt, Homo sapiens
acuacaggcgccugccagca

SEQ ID NO: 1804456 - RNA, 19 nt, Homo sapiens
agucuugaugacauuucac

SEQ ID NO: 1804457 - RNA, 15 nt, Homo sapiens
acuuauaguacauga

SEQ ID NO: 1804458 - RNA, 18 nt, Homo sapiens
uuguuuucauuaucucaa

SEQ ID NO: 1804459 - RNA, 14 nt, Homo sapiens
guccauuuugcccu

SEQ ID NO: 1804460 - RNA, 18 nt, Homo sapiens
acuguucccccugugcag

SEQ ID NO: 1804461 - RNA, 16 nt, Homo sapiens
uaggaagcacugaaaa

SEQ ID NO: 1804462 - RNA, 21 nt, Homo sapiens
agggauagaggggggcugccu

SEQ ID NO: 1804463 - RNA, 21 nt, Homo sapiens
gcaggcagguggacugacugu

SEQ ID NO: 1804464 - RNA, 16 nt, Homo sapiens
accaaacucaguucaa

SEQ ID NO: 1804465 - RNA, 13 nt, Homo sapiens
auacaaucagcug

SEQ ID NO: 1804466 - RNA, 14 nt, Homo sapiens
ugccuggcacagac

SEQ ID NO: 1804467 - RNA, 17 nt, Homo sapiens
auuucgcacuguauuaa

SEQ ID NO: 1804468 - RNA, 21 nt, Homo sapiens
gagcaacuuucuuacacugaa

SEQ ID NO: 1804469 - RNA, 18 nt, Homo sapiens
aaccacugugccacugac

SEQ ID NO: 1804470 - RNA, 18 nt, Homo sapiens
guugauccaucucaguca

SEQ ID NO: 1804471 - RNA, 15 nt, Homo sapiens
augacugauuacuca

SEQ ID NO: 1804472 - RNA, 23 nt, Homo sapiens
gcaaauccagucccaaugguccu

SEQ ID NO: 1804473 - RNA, 17 nt, Homo sapiens
aucuggauuccagagca

SEQ ID NO: 1804474 - RNA, 18 nt, Homo sapiens
auaucucccccacuccac

SEQ ID NO: 1804475 - RNA, 20 nt, Homo sapiens
ugguucugcuuucucuacua

SEQ ID NO: 1804476 - RNA, 17 nt, Homo sapiens
acggcgauucuccccau

SEQ ID NO: 1804477 - RNA, 17 nt, Homo sapiens
cugggaggcgucuccaa

SEQ ID NO: 1804478 - RNA, 13 nt, Homo sapiens
gucuagugugcug

SEQ ID NO: 1804479 - RNA, 15 nt, Homo sapiens
caaauaaauaucauc

SEQ ID NO: 1804480 - RNA, 22 nt, Homo sapiens
auaaauugaacuaaauccaaac

SEQ ID NO: 1804481 - RNA, 11 nt, Homo sapiens
aagcacugccu

SEQ ID NO: 1804482 - RNA, 18 nt, Homo sapiens
ccugcagaccucaagcca

SEQ ID NO: 1804483 - RNA, 20 nt, Homo sapiens
aauuagcagaagugaccaaa

SEQ ID NO: 1804484 - RNA, 15 nt, Homo sapiens
augaucucaaucucc

SEQ ID NO: 1804485 - RNA, 17 nt, Homo sapiens
ccucagacugcacccag

SEQ ID NO: 1804486 - RNA, 20 nt, Homo sapiens
cauaggaaaaugccaugaaa

SEQ ID NO: 1804487 - RNA, 21 nt, Homo sapiens
uugcucaguguccagcuucca

SEQ ID NO: 1804488 - RNA, 19 nt, Homo sapiens
auucaagaggaaaugucac

SEQ ID NO: 1804489 - RNA, 17 nt, Homo sapiens
gacaggauggcugugug

SEQ ID NO: 1804490 - RNA, 17 nt, Homo sapiens
ggaaggaggaauguggg

SEQ ID NO: 1804491 - RNA, 18 nt, Homo sapiens
auccauguaaauugcaaa

SEQ ID NO: 1804492 - RNA, 12 nt, Homo sapiens
agucuauucugu

SEQ ID NO: 1804493 - RNA, 19 nt, Homo sapiens
uccuaccugcugcugcuau

SEQ ID NO: 1804494 - RNA, 22 nt, Homo sapiens
gaaugacugacccaaaauguga

SEQ ID NO: 1804495 - RNA, 13 nt, Homo sapiens
ugugacauacaua

SEQ ID NO: 1804496 - RNA, 23 nt, Homo sapiens
agcaauggccagagccucuggcc

SEQ ID NO: 1804497 - RNA, 21 nt, Homo sapiens
ugcaugcccuaagagugucac

SEQ ID NO: 1804498 - RNA, 16 nt, Homo sapiens
gugauuuaauaguguu

SEQ ID NO: 1804499 - RNA, 16 nt, Homo sapiens
guaaucccagcuacuu

SEQ ID NO: 1804500 - RNA, 18 nt, Homo sapiens
ugucaacauugugaugua

SEQ ID NO: 1804501 - RNA, 23 nt, Homo sapiens
uggaggcucuucugugauuuuga

SEQ ID NO: 1804502 - RNA, 16 nt, Homo sapiens
uaaucugaaugugcaa

SEQ ID NO: 1804503 - RNA, 14 nt, Homo sapiens
gaaggaggugcaga

SEQ ID NO: 1804504 - RNA, 19 nt, Homo sapiens
gguuggacuguaagggauu

SEQ ID NO: 1804505 - RNA, 15 nt, Homo sapiens
aaccucagagggaua

SEQ ID NO: 1804506 - RNA, 18 nt, Homo sapiens
agcaggcaaauagcuuua

SEQ ID NO: 1804507 - RNA, 15 nt, Homo sapiens
agccaggaccugcug

SEQ ID NO: 1804508 - RNA, 20 nt, Homo sapiens
acucaucuuagugccugaga

SEQ ID NO: 1804509 - RNA, 16 nt, Homo sapiens
gacuucuccaggcaga

SEQ ID NO: 1804510 - RNA, 18 nt, Homo sapiens
caugugacaucuaccucc

SEQ ID NO: 1804511 - RNA, 22 nt, Homo sapiens
ugagccuucugaugagacugca

SEQ ID NO: 1804512 - RNA, 19 nt, Homo sapiens
ccagaaaucugcugcauuu

SEQ ID NO: 1804513 - RNA, 15 nt, Homo sapiens
ccugugaggugcaga

SEQ ID NO: 1804514 - RNA, 20 nt, Homo sapiens
aaauuacacaguuaaugcca

SEQ ID NO: 1804515 - RNA, 20 nt, Homo sapiens
acugagguugggcugagacc

SEQ ID NO: 1804516 - RNA, 21 nt, Homo sapiens
uucuauuuuauaaaacaaaua

SEQ ID NO: 1804517 - RNA, 15 nt, Homo sapiens
ccuaacuuucugaau

SEQ ID NO: 1804518 - RNA, 18 nt, Homo sapiens
uguaagauuuuccauugu

SEQ ID NO: 1804519 - RNA, 21 nt, Homo sapiens
cauuuuuaucccuuccugucu

SEQ ID NO: 1804520 - RNA, 20 nt, Homo sapiens
gauggccagucaugugcugg

SEQ ID NO: 1804521 - RNA, 14 nt, Homo sapiens
ccuggauccagcac

SEQ ID NO: 1804522 - RNA, 11 nt, Homo sapiens
ucaugauuuca

SEQ ID NO: 1804523 - RNA, 16 nt, Homo sapiens
ucaucuauguauucaa

SEQ ID NO: 1804524 - RNA, 12 nt, Homo sapiens
gugaacugggca

SEQ ID NO: 1804525 - RNA, 14 nt, Homo sapiens
auucauauuuucca

SEQ ID NO: 1804526 - RNA, 17 nt, Homo sapiens
ggcccaggcagagcuga

SEQ ID NO: 1804527 - RNA, 23 nt, Homo sapiens
acaugcuguuaccagagccucuu

SEQ ID NO: 1804528 - RNA, 21 nt, Homo sapiens
aagacucaccucauccuuacc

SEQ ID NO: 1804529 - RNA, 19 nt, Homo sapiens
uucaagguuauaugucuua

SEQ ID NO: 1804530 - RNA, 14 nt, Homo sapiens
ccauguauuuugua

SEQ ID NO: 1804531 - RNA, 21 nt, Homo sapiens
aggucaugccacugcacucua

SEQ ID NO: 1804532 - RNA, 19 nt, Homo sapiens
gacaaaauuguaagccaga

SEQ ID NO: 1804533 - RNA, 17 nt, Homo sapiens
cagugagaucaauguga

SEQ ID NO: 1804534 - RNA, 23 nt, Homo sapiens
uacugggugucauuucauuccau

SEQ ID NO: 1804535 - RNA, 19 nt, Homo sapiens
cccuucauacccaccagga

SEQ ID NO: 1804536 - RNA, 16 nt, Homo sapiens
aggguggcccuugcag

SEQ ID NO: 1804537 - RNA, 23 nt, Homo sapiens
cugaccaaacagccaacuagccc

SEQ ID NO: 1804538 - RNA, 21 nt, Homo sapiens
uacagacuuuuuucuugucau

SEQ ID NO: 1804539 - RNA, 17 nt, Homo sapiens
cuugucuuacauaauca

SEQ ID NO: 1804540 - RNA, 14 nt, Homo sapiens
agaagggcucagag

SEQ ID NO: 1804541 - RNA, 20 nt, Homo sapiens
aaggcuccugugugagccca

SEQ ID NO: 1804542 - RNA, 22 nt, Homo sapiens
ucccaggcgaucuugugucuac

SEQ ID NO: 1804543 - RNA, 17 nt, Homo sapiens
ggaaauuguuuaugugu

SEQ ID NO: 1804544 - RNA, 14 nt, Homo sapiens
agugcaacacugaa

SEQ ID NO: 1804545 - RNA, 22 nt, Homo sapiens
cauguauuucuuacguacacug

SEQ ID NO: 1804546 - RNA, 15 nt, Homo sapiens
cuuaggaaacccuuc

SEQ ID NO: 1804547 - RNA, 13 nt, Homo sapiens
uauuuuugacaga

SEQ ID NO: 1804548 - RNA, 16 nt, Homo sapiens
ugaguccugguuuccu

SEQ ID NO: 1804549 - RNA, 16 nt, Homo sapiens
auuuacugucccagga

SEQ ID NO: 1804550 - RNA, 20 nt, Homo sapiens
auauguauacuuaucuugcu

SEQ ID NO: 1804551 - RNA, 16 nt, Homo sapiens
ggcuuuucuuucuacc

SEQ ID NO: 1804552 - RNA, 13 nt, Homo sapiens
cuaacauaaaaua

SEQ ID NO: 1804553 - RNA, 13 nt, Homo sapiens
acucuaguucugu

SEQ ID NO: 1804554 - RNA, 13 nt, Homo sapiens
acuguaguucucu

SEQ ID NO: 1804555 - RNA, 16 nt, Homo sapiens
gccuccaauuggugcu

SEQ ID NO: 1804556 - RNA, 14 nt, Homo sapiens
gcucucuggacacu

SEQ ID NO: 1804557 - RNA, 22 nt, Homo sapiens
aagagauccuucuguaaagguu

SEQ ID NO: 1804558 - RNA, 11 nt, Homo sapiens
agauaccaugg

SEQ ID NO: 1804559 - RNA, 11 nt, Homo sapiens
uaauaccaaag

SEQ ID NO: 1804560 - RNA, 18 nt, Homo sapiens
ucgcuuuuaauaaacugc

SEQ ID NO: 1804561 - RNA, 20 nt, Homo sapiens
aauagaugguguaugcugua

SEQ ID NO: 1804562 - RNA, 22 nt, Homo sapiens
ccuuguccugaugcugugcuca

SEQ ID NO: 1804563 - RNA, 19 nt, Homo sapiens
guuaucccugcacacggca

SEQ ID NO: 1804564 - RNA, 17 nt, Homo sapiens
ugaaugugguuacuucc

SEQ ID NO: 1804565 - RNA, 16 nt, Homo sapiens
ucuuuaacagcuuucu

SEQ ID NO: 1804566 - RNA, 21 nt, Homo sapiens
guguggggcgggggucuauac

SEQ ID NO: 1804567 - RNA, 18 nt, Homo sapiens
augaccaguaauugugaa

SEQ ID NO: 1804568 - RNA, 20 nt, Homo sapiens
acugaaccacauucagggaa

SEQ ID NO: 1804569 - RNA, 23 nt, Homo sapiens
caguuuuauauuuauaagccuua

SEQ ID NO: 1804570 - RNA, 22 nt, Homo sapiens
aagagcuuuccuacuugcacuc

SEQ ID NO: 1804571 - RNA, 16 nt, Homo sapiens
uucuugaaacugugaa

SEQ ID NO: 1804572 - RNA, 22 nt, Homo sapiens
cucagaaauguaguuugcacuu

SEQ ID NO: 1804573 - RNA, 18 nt, Homo sapiens
uuacuuagcaugcacaaa

SEQ ID NO: 1804574 - RNA, 17 nt, Homo sapiens
aagugauacuauccagu

SEQ ID NO: 1804575 - RNA, 22 nt, Homo sapiens
gaguaucuuuaaaagugccuua

SEQ ID NO: 1804576 - RNA, 18 nt, Homo sapiens
ugcuugguuaaaauggcu

SEQ ID NO: 1804577 - RNA, 13 nt, Homo sapiens
acaccuagacucu

SEQ ID NO: 1804578 - RNA, 14 nt, Homo sapiens
cuuaauuucugccu

SEQ ID NO: 1804579 - RNA, 21 nt, Homo sapiens
acuguacaguuucuuccccaa

SEQ ID NO: 1804580 - RNA, 15 nt, Homo sapiens
augacugcagggcug

SEQ ID NO: 1804581 - RNA, 15 nt, Homo sapiens
ugugcaccuuuacac

SEQ ID NO: 1804582 - RNA, 19 nt, Homo sapiens
cgugggcucgauuccucag

SEQ ID NO: 1804583 - RNA, 20 nt, Homo sapiens
augauauauuaaaccuucag

SEQ ID NO: 1804584 - RNA, 15 nt, Homo sapiens
aaugacaugcacuga

SEQ ID NO: 1804585 - RNA, 16 nt, Homo sapiens
guggcaggaggcuuug

SEQ ID NO: 1804586 - RNA, 20 nt, Homo sapiens
acaccucauagguaugauuu

SEQ ID NO: 1804587 - RNA, 20 nt, Homo sapiens
acauccccuuuguguagaaa

SEQ ID NO: 1804588 - RNA, 15 nt, Homo sapiens
gaccuccguucaaua

SEQ ID NO: 1804589 - RNA, 15 nt, Homo sapiens
gccuggcuggcacag

SEQ ID NO: 1804590 - RNA, 22 nt, Homo sapiens
cucguucuccuuccccauuucc

SEQ ID NO: 1804591 - RNA, 14 nt, Homo sapiens
caagcaaauggaga

SEQ ID NO: 1804592 - RNA, 21 nt, Homo sapiens
gcgcccaugaugggagggauu

SEQ ID NO: 1804593 - RNA, 16 nt, Homo sapiens
uuagucuugauuucac

SEQ ID NO: 1804594 - RNA, 18 nt, Homo sapiens
ggagcucaucugcaaaag

SEQ ID NO: 1804595 - RNA, 17 nt, Homo sapiens
agaaaugcuaucagaaa

SEQ ID NO: 1804596 - RNA, 23 nt, Homo sapiens
caccucagggguuaagagcucag

SEQ ID NO: 1804597 - RNA, 14 nt, Homo sapiens
gucaauuacucuau

SEQ ID NO: 1804598 - RNA, 19 nt, Homo sapiens
uaauuagcaucucagguua

SEQ ID NO: 1804599 - RNA, 14 nt, Homo sapiens
cagacacugagcuu

SEQ ID NO: 1804600 - RNA, 23 nt, Homo sapiens
auguaacauguaggaaguaggaa

SEQ ID NO: 1804601 - RNA, 15 nt, Homo sapiens
uuuuaaguaauuuca

SEQ ID NO: 1804602 - RNA, 23 nt, Homo sapiens
acaacaguugcacagugccucaa

SEQ ID NO: 1804603 - RNA, 17 nt, Homo sapiens
ucuggcuaugcauuuga

SEQ ID NO: 1804604 - RNA, 15 nt, Homo sapiens
cucauguuuacaggg

SEQ ID NO: 1804605 - RNA, 23 nt, Homo sapiens
ucauuuuuccuucccuucuccau

SEQ ID NO: 1804606 - RNA, 18 nt, Homo sapiens
auuccuguuugucuacau

SEQ ID NO: 1804607 - RNA, 15 nt, Homo sapiens
accuacaagauuccu

SEQ ID NO: 1804608 - RNA, 15 nt, Homo sapiens
agccacaacugcagu

SEQ ID NO: 1804609 - RNA, 15 nt, Homo sapiens
aggagcuacucagga

SEQ ID NO: 1804610 - RNA, 21 nt, Homo sapiens
uauaauuuaaaaaaagcaaaa

SEQ ID NO: 1804611 - RNA, 22 nt, Homo sapiens
ucuacauuuuauuacacuaaau

SEQ ID NO: 1804612 - RNA, 15 nt, Homo sapiens
cggagauuuugaaca

SEQ ID NO: 1804613 - RNA, 19 nt, Homo sapiens
cucauagauguuaugcaaa

SEQ ID NO: 1804614 - RNA, 16 nt, Homo sapiens
cuauuuaugaauauua

SEQ ID NO: 1804615 - RNA, 14 nt, Homo sapiens
uuaauaaaaguaca

SEQ ID NO: 1804616 - RNA, 23 nt, Homo sapiens
gaaauaauaacagacaaggucaa

SEQ ID NO: 1804617 - RNA, 13 nt, Homo sapiens
cugauuaugugcc

SEQ ID NO: 1804618 - RNA, 19 nt, Homo sapiens
agcgcugagcuaucuccua

SEQ ID NO: 1804619 - RNA, 19 nt, Homo sapiens
acgagacccccauccagcc

SEQ ID NO: 1804620 - RNA, 13 nt, Homo sapiens
uugggccugagua

SEQ ID NO: 1804621 - RNA, 16 nt, Homo sapiens
uaagcagaagcauuaa

SEQ ID NO: 1804622 - RNA, 22 nt, Homo sapiens
ucuacuaauuuccugcugaaaa

SEQ ID NO: 1804623 - RNA, 15 nt, Homo sapiens
augguacucuaauca

SEQ ID NO: 1804624 - RNA, 21 nt, Homo sapiens
agacauggaagagagagccau

SEQ ID NO: 1804625 - RNA, 17 nt, Homo sapiens
aggggaaggagugugca

SEQ ID NO: 1804626 - RNA, 13 nt, Homo sapiens
uuaacacagauca

SEQ ID NO: 1804627 - RNA, 22 nt, Homo sapiens
ugccggaggaaaagcagcucaa

SEQ ID NO: 1804628 - RNA, 16 nt, Homo sapiens
uccaaaaauggcagug

SEQ ID NO: 1804629 - RNA, 17 nt, Homo sapiens
cagguaaggugagggaa

SEQ ID NO: 1804630 - RNA, 15 nt, Homo sapiens
cauuuuguucuacau

SEQ ID NO: 1804631 - RNA, 23 nt, Homo sapiens
gccauucuuuuaaauauuuguga

SEQ ID NO: 1804632 - RNA, 21 nt, Homo sapiens
ccacaaccaccuucaccugga

SEQ ID NO: 1804633 - RNA, 19 nt, Homo sapiens
acuggcauacuauguggau

SEQ ID NO: 1804634 - RNA, 17 nt, Homo sapiens
uuccuguccccagggga

SEQ ID NO: 1804635 - RNA, 17 nt, Homo sapiens
gugacaugugaaaccuu

SEQ ID NO: 1804636 - RNA, 16 nt, Homo sapiens
aucguccccugugauu

SEQ ID NO: 1804637 - RNA, 22 nt, Homo sapiens
gcaagauaaacauuauuaagua

SEQ ID NO: 1804638 - RNA, 14 nt, Homo sapiens
guccagcacuggaa

SEQ ID NO: 1804639 - RNA, 11 nt, Homo sapiens
ccuaguacaag

SEQ ID NO: 1804640 - RNA, 14 nt, Homo sapiens
acuaaaaaucauga

SEQ ID NO: 1804641 - RNA, 17 nt, Homo sapiens
gcuuaaaaaugccaaaa

SEQ ID NO: 1804642 - RNA, 13 nt, Homo sapiens
cagagcugagucg

SEQ ID NO: 1804643 - RNA, 19 nt, Homo sapiens
gaaaaauugccaauucuuu

SEQ ID NO: 1804644 - RNA, 23 nt, Homo sapiens
acaugaauugcauuuuacuuuaa

SEQ ID NO: 1804645 - RNA, 13 nt, Homo sapiens
aaaguacugagca

SEQ ID NO: 1804646 - RNA, 13 nt, Homo sapiens
gaacugcugccac

SEQ ID NO: 1804647 - RNA, 17 nt, Homo sapiens
uaaaagugcuacuugag

SEQ ID NO: 1804648 - RNA, 14 nt, Homo sapiens
uccugaugaugguc

SEQ ID NO: 1804649 - RNA, 18 nt, Homo sapiens
agcuggcacugucucugc

SEQ ID NO: 1804650 - RNA, 21 nt, Homo sapiens
auuaacuuuuauaaacuuuac

SEQ ID NO: 1804651 - RNA, 20 nt, Homo sapiens
uacucaccucaccccacugu

SEQ ID NO: 1804652 - RNA, 16 nt, Homo sapiens
cucuucuuuaccagaa

SEQ ID NO: 1804653 - RNA, 14 nt, Homo sapiens
uguugauuacauaa

SEQ ID NO: 1804654 - RNA, 17 nt, Homo sapiens
uaggcauuucacaaaaa

SEQ ID NO: 1804655 - RNA, 15 nt, Homo sapiens
gcacuugcuacuuca

SEQ ID NO: 1804656 - RNA, 12 nt, Homo sapiens
cucaaguucuaa

SEQ ID NO: 1804657 - RNA, 15 nt, Homo sapiens
ugcacuucaaauuca

SEQ ID NO: 1804658 - RNA, 15 nt, Homo sapiens
gaccagccccaccau

SEQ ID NO: 1804659 - RNA, 15 nt, Homo sapiens
gggcgaggacgugaa

SEQ ID NO: 1804660 - RNA, 16 nt, Homo sapiens
cuaguuaaaagccuuu

SEQ ID NO: 1804661 - RNA, 14 nt, Homo sapiens
ucuguacauuugca

SEQ ID NO: 1804662 - RNA, 22 nt, Homo sapiens
uguuucccuacuaacaucccaa

SEQ ID NO: 1804663 - RNA, 21 nt, Homo sapiens
ugcugcuccccuaaagccagg

SEQ ID NO: 1804664 - RNA, 23 nt, Homo sapiens
ucccaagagggcuccucacuauc

SEQ ID NO: 1804665 - RNA, 21 nt, Homo sapiens
ugaaauuuaacugccuaaaau

SEQ ID NO: 1804666 - RNA, 19 nt, Homo sapiens
ucacggcugcgcacugugu

SEQ ID NO: 1804667 - RNA, 23 nt, Homo sapiens
acaaaacagccucuuugcccaaa

SEQ ID NO: 1804668 - RNA, 13 nt, Homo sapiens
aaacuucuuucac

SEQ ID NO: 1804669 - RNA, 18 nt, Homo sapiens
gcuggagcaugagccagc

SEQ ID NO: 1804670 - RNA, 16 nt, Homo sapiens
aaagauguacugagag

SEQ ID NO: 1804671 - RNA, 13 nt, Homo sapiens
cuguuugcucacc

SEQ ID NO: 1804672 - RNA, 21 nt, Homo sapiens
cccuccaccggggaagggcau

SEQ ID NO: 1804673 - RNA, 21 nt, Homo sapiens
cacuggagcacaauaaauggc

SEQ ID NO: 1804674 - RNA, 15 nt, Homo sapiens
ccaugcuucuugccc

SEQ ID NO: 1804675 - RNA, 19 nt, Homo sapiens
aaugacucaggacaucccc

SEQ ID NO: 1804676 - RNA, 20 nt, Homo sapiens
uauguuuaaaaacauucccc

SEQ ID NO: 1804677 - RNA, 16 nt, Homo sapiens
aaugcaauccuucccu

SEQ ID NO: 1804678 - RNA, 21 nt, Homo sapiens
gcuaaaucauauuaguauuaa

SEQ ID NO: 1804679 - RNA, 13 nt, Homo sapiens
agcgcgaugaacg

SEQ ID NO: 1804680 - RNA, 14 nt, Homo sapiens
aucaugucauaaac

SEQ ID NO: 1804681 - RNA, 14 nt, Homo sapiens
ggccgcugugccag

SEQ ID NO: 1804682 - RNA, 21 nt, Homo sapiens
cuucccucucugaugucccag

SEQ ID NO: 1804683 - RNA, 14 nt, Homo sapiens
gugaauccugugca

SEQ ID NO: 1804684 - RNA, 18 nt, Homo sapiens
gcaaauaguagacauuug

SEQ ID NO: 1804685 - RNA, 19 nt, Homo sapiens
ggagucucucucucuccau

SEQ ID NO: 1804686 - RNA, 22 nt, Homo sapiens
aguuaaguugcuguaagcaccu

SEQ ID NO: 1804687 - RNA, 22 nt, Homo sapiens
gcaacuuguacugaaaaucugg

SEQ ID NO: 1804688 - RNA, 14 nt, Homo sapiens
ugggaucaauuugu

SEQ ID NO: 1804689 - RNA, 16 nt, Homo sapiens
uggcuaccucuguccc

SEQ ID NO: 1804690 - RNA, 15 nt, Homo sapiens
aaauauuuaugagaa

SEQ ID NO: 1804691 - RNA, 17 nt, Homo sapiens
auaugacuuuuucucag

SEQ ID NO: 1804692 - RNA, 15 nt, Homo sapiens
cuucccugcauuaac

SEQ ID NO: 1804693 - RNA, 12 nt, Homo sapiens
cuccagugccag

SEQ ID NO: 1804694 - RNA, 17 nt, Homo sapiens
ucccaacucuugcacag

SEQ ID NO: 1804695 - RNA, 21 nt, Homo sapiens
uaguggggcaaugacuuuccu

SEQ ID NO: 1804696 - RNA, 11 nt, Homo sapiens
ggagagccaga

SEQ ID NO: 1804697 - RNA, 15 nt, Homo sapiens
acaagcaaaccuucu

SEQ ID NO: 1804698 - RNA, 20 nt, Homo sapiens
agaaaauaacgauaaaagac

SEQ ID NO: 1804699 - RNA, 15 nt, Homo sapiens
ucugucaucugcugc

SEQ ID NO: 1804700 - RNA, 22 nt, Homo sapiens
cugagcccagccuacuuuucag

SEQ ID NO: 1804701 - RNA, 14 nt, Homo sapiens
aucacuuuuggaca

SEQ ID NO: 1804702 - RNA, 21 nt, Homo sapiens
uccuggcagcccagagacuuu

SEQ ID NO: 1804703 - RNA, 22 nt, Homo sapiens
uuccagccuucuacugcucucc

SEQ ID NO: 1804704 - RNA, 20 nt, Homo sapiens
gcuaccugggucaacccaac

SEQ ID NO: 1804705 - RNA, 18 nt, Homo sapiens
cuuguccagguugaucuu

SEQ ID NO: 1804706 - RNA, 15 nt, Homo sapiens
gcucuccaucuucca

SEQ ID NO: 1804707 - RNA, 18 nt, Homo sapiens
auaugauguggacauaug

SEQ ID NO: 1804708 - RNA, 15 nt, Homo sapiens
caggcuggagugcaa

SEQ ID NO: 1804709 - RNA, 15 nt, Homo sapiens
cagguuggaguguaa

SEQ ID NO: 1804710 - RNA, 13 nt, Homo sapiens
aggauauuccaaa

SEQ ID NO: 1804711 - RNA, 16 nt, Homo sapiens
ugcccacgucccgggc

SEQ ID NO: 1804712 - RNA, 15 nt, Homo sapiens
uguauuuaacugccu

SEQ ID NO: 1804713 - RNA, 15 nt, Homo sapiens
acaaaaaccaaaaaa

SEQ ID NO: 1804714 - RNA, 13 nt, Homo sapiens
caauuucauuuaa

SEQ ID NO: 1804715 - RNA, 16 nt, Homo sapiens
accugccauagucaga

SEQ ID NO: 1804716 - RNA, 17 nt, Homo sapiens
uaccuacaagaacaaug

SEQ ID NO: 1804717 - RNA, 17 nt, Homo sapiens
ugaauaaaaacccugua

SEQ ID NO: 1804718 - RNA, 14 nt, Homo sapiens
gcugccucuuggcu

SEQ ID NO: 1804719 - RNA, 21 nt, Homo sapiens
uaccuagagucaacucuggcc

SEQ ID NO: 1804720 - RNA, 17 nt, Homo sapiens
caccugcucuuuccucc

SEQ ID NO: 1804721 - RNA, 18 nt, Homo sapiens
ugaagacucgcaauuuca

SEQ ID NO: 1804722 - RNA, 19 nt, Homo sapiens
aauugauuuuucucuucau

SEQ ID NO: 1804723 - RNA, 16 nt, Homo sapiens
agagaagcaaguggcu

SEQ ID NO: 1804724 - RNA, 21 nt, Homo sapiens
ccaccuaaaaacauuuacuga

SEQ ID NO: 1804725 - RNA, 20 nt, Homo sapiens
cccucacugggacuuuguaa

SEQ ID NO: 1804726 - RNA, 12 nt, Homo sapiens
uggcaagaagac

SEQ ID NO: 1804727 - RNA, 20 nt, Homo sapiens
cuuacucccaggcacugucu

SEQ ID NO: 1804728 - RNA, 15 nt, Homo sapiens
caaaggauacuguaa

SEQ ID NO: 1804729 - RNA, 16 nt, Homo sapiens
gaaagccagugacucc

SEQ ID NO: 1804730 - RNA, 17 nt, Homo sapiens
uauagaucacauaacag

SEQ ID NO: 1804731 - RNA, 21 nt, Homo sapiens
aagggacccagaauauccaaa

SEQ ID NO: 1804732 - RNA, 15 nt, Homo sapiens
gaccccugaccucac

SEQ ID NO: 1804733 - RNA, 13 nt, Homo sapiens
ugucuuuugccau

SEQ ID NO: 1804734 - RNA, 17 nt, Homo sapiens
ggguacucaauggagua

SEQ ID NO: 1804735 - RNA, 21 nt, Homo sapiens
ugcaagugugugcaugugugc

SEQ ID NO: 1804736 - RNA, 13 nt, Homo sapiens
uguggccccaaga

SEQ ID NO: 1804737 - RNA, 21 nt, Homo sapiens
caaaauuguuuucacuuguau

SEQ ID NO: 1804738 - RNA, 21 nt, Homo sapiens
ugcauuugugguaaucuacac

SEQ ID NO: 1804739 - RNA, 13 nt, Homo sapiens
uguuacuagccuc

SEQ ID NO: 1804740 - RNA, 12 nt, Homo sapiens
uugaaacugagu

SEQ ID NO: 1804741 - RNA, 13 nt, Homo sapiens
ucauaaacaaaga

SEQ ID NO: 1804742 - RNA, 17 nt, Homo sapiens
cugccugggccaugcga

SEQ ID NO: 1804743 - RNA, 18 nt, Homo sapiens
ccugacuccuccaaggaa

SEQ ID NO: 1804744 - RNA, 22 nt, Homo sapiens
cugaggagccugcaacaugcca

SEQ ID NO: 1804745 - RNA, 16 nt, Homo sapiens
cugugagaggugacac

SEQ ID NO: 1804746 - RNA, 18 nt, Homo sapiens
ugacacauaaaaguaauu

SEQ ID NO: 1804747 - RNA, 21 nt, Homo sapiens
ggccacauagaugcugaugga

SEQ ID NO: 1804748 - RNA, 16 nt, Homo sapiens
auguauguaaauagcu

SEQ ID NO: 1804749 - RNA, 12 nt, Homo sapiens
aauuuaacaaac

SEQ ID NO: 1804750 - RNA, 12 nt, Homo sapiens
auauuaacauuc

SEQ ID NO: 1804751 - RNA, 13 nt, Homo sapiens
gaaguuacuuugu

SEQ ID NO: 1804752 - RNA, 15 nt, Homo sapiens
uccuguguauguaua

SEQ ID NO: 1804753 - RNA, 14 nt, Homo sapiens
caugggagugaucu

SEQ ID NO: 1804754 - RNA, 21 nt, Homo sapiens
uggugcuaaagauuguuaaau

SEQ ID NO: 1804755 - RNA, 21 nt, Homo sapiens
uccucaucaguagaugguacg

SEQ ID NO: 1804756 - RNA, 16 nt, Homo sapiens
aaguguacauguguga

SEQ ID NO: 1804757 - RNA, 24 nt, Homo sapiens
ugucacuuggugcauaagcacaga

SEQ ID NO: 1804758 - RNA, 18 nt, Homo sapiens
guuucuuggccacugaau

SEQ ID NO: 1804759 - RNA, 17 nt, Homo sapiens
caggauauccuuaucag

SEQ ID NO: 1804760 - RNA, 10 nt, Homo sapiens
ccaucucagg

SEQ ID NO: 1804761 - RNA, 20 nt, Homo sapiens
gaccaauugugcugccauuu

SEQ ID NO: 1804762 - RNA, 21 nt, Homo sapiens
aaauuccuugccccacaguug

SEQ ID NO: 1804763 - RNA, 21 nt, Homo sapiens
ugugucccuggcgcugugcua

SEQ ID NO: 1804764 - RNA, 20 nt, Homo sapiens
cagcagacacccuguguccu

SEQ ID NO: 1804765 - RNA, 18 nt, Homo sapiens
aguuauugcuggugcaaa

SEQ ID NO: 1804766 - RNA, 19 nt, Homo sapiens
uccuccugcccaccuguca

SEQ ID NO: 1804767 - RNA, 14 nt, Homo sapiens
aacccaaggagcac

SEQ ID NO: 1804768 - RNA, 15 nt, Homo sapiens
uccuaauaugcuuua

SEQ ID NO: 1804769 - RNA, 11 nt, Homo sapiens
ggggugcugcc

SEQ ID NO: 1804770 - RNA, 12 nt, Homo sapiens
ccgugggccaug

SEQ ID NO: 1804771 - RNA, 20 nt, Homo sapiens
augagaugguuucuagagau

SEQ ID NO: 1804772 - RNA, 20 nt, Homo sapiens
cccaucaggggcaggaacca

SEQ ID NO: 1804773 - RNA, 20 nt, Homo sapiens
ggccuuucugugugugaugu

SEQ ID NO: 1804774 - RNA, 23 nt, Homo sapiens
uacucgggaggcugagacaggag

SEQ ID NO: 1804775 - RNA, 22 nt, Homo sapiens
acaagaggccauuuaaguaucu

SEQ ID NO: 1804776 - RNA, 20 nt, Homo sapiens
ucuuugguuuuaucauucca

SEQ ID NO: 1804777 - RNA, 23 nt, Homo sapiens
agauuguaauucagaaaacauaa

SEQ ID NO: 1804778 - RNA, 17 nt, Homo sapiens
acuuagaucaucaguca

SEQ ID NO: 1804779 - RNA, 14 nt, Homo sapiens
cagcugacccggcc

SEQ ID NO: 1804780 - RNA, 19 nt, Homo sapiens
gaucucagaucacugcaac

SEQ ID NO: 1804781 - RNA, 15 nt, Homo sapiens
ggagcuggucugcca

SEQ ID NO: 1804782 - RNA, 15 nt, Homo sapiens
uuaacugaacuuaau

SEQ ID NO: 1804783 - RNA, 21 nt, Homo sapiens
aguucucuuuugauguagguu

SEQ ID NO: 1804784 - RNA, 21 nt, Homo sapiens
gaucaguggggccccaaagcc

SEQ ID NO: 1804785 - RNA, 19 nt, Homo sapiens
ucaugugccucuguccuua

SEQ ID NO: 1804786 - RNA, 22 nt, Homo sapiens
cuaagaaauccagcuucauaau

SEQ ID NO: 1804787 - RNA, 21 nt, Homo sapiens
ccaauuuaguggaaaaaaaca

SEQ ID NO: 1804788 - RNA, 20 nt, Homo sapiens
guaugauggcaggagaauca

SEQ ID NO: 1804789 - RNA, 13 nt, Homo sapiens
uaugucugccuuc

SEQ ID NO: 1804790 - RNA, 20 nt, Homo sapiens
agcuauuagcaacugugcua

SEQ ID NO: 1804791 - RNA, 22 nt, Homo sapiens
uguacagaaacaacugccaaau

SEQ ID NO: 1804792 - RNA, 23 nt, Homo sapiens
agaaugaucagcaucugugaugg

SEQ ID NO: 1804793 - RNA, 12 nt, Homo sapiens
ccagggcugcug

SEQ ID NO: 1804794 - RNA, 20 nt, Homo sapiens
gcaugucuuaaaugcucaua

SEQ ID NO: 1804795 - RNA, 17 nt, Homo sapiens
gcauuccagccugggca

SEQ ID NO: 1804796 - RNA, 24 nt, Homo sapiens
ucuagagcuugaugccaguaggcu

SEQ ID NO: 1804797 - RNA, 16 nt, Homo sapiens
ccacaccugggcauuu

SEQ ID NO: 1804798 - RNA, 13 nt, Homo sapiens
ugcauacuuuauu

SEQ ID NO: 1804799 - RNA, 11 nt, Homo sapiens
accccagcugc

SEQ ID NO: 1804800 - RNA, 18 nt, Homo sapiens
cuuuaaguaaaaauccaa

SEQ ID NO: 1804801 - RNA, 22 nt, Homo sapiens
uucugaauuauuaugucucaaa

SEQ ID NO: 1804802 - RNA, 17 nt, Homo sapiens
cuccucaguuucucaaa

SEQ ID NO: 1804803 - RNA, 16 nt, Homo sapiens
acuuugggaccugcuu

SEQ ID NO: 1804804 - RNA, 22 nt, Homo sapiens
ggucaugcauuguaaucaucau

SEQ ID NO: 1804805 - RNA, 19 nt, Homo sapiens
ucccacccugggcaaugca

SEQ ID NO: 1804806 - RNA, 19 nt, Homo sapiens
aacccuauugguaaagaau

SEQ ID NO: 1804807 - RNA, 13 nt, Homo sapiens
uguuggacagggg

SEQ ID NO: 1804808 - RNA, 17 nt, Homo sapiens
caucccuuuuucugcua

SEQ ID NO: 1804809 - RNA, 16 nt, Homo sapiens
uaugccuugaacuuau

SEQ ID NO: 1804810 - RNA, 21 nt, Homo sapiens
uguuguuaucuguuugagaaa

SEQ ID NO: 1804811 - RNA, 14 nt, Homo sapiens
acuccuacugaguu

SEQ ID NO: 1804812 - RNA, 17 nt, Homo sapiens
uaagccuuccacacuca

SEQ ID NO: 1804813 - RNA, 18 nt, Homo sapiens
aaccaguaacgugcugcu

SEQ ID NO: 1804814 - RNA, 19 nt, Homo sapiens
cacaaacugcagcugugag

SEQ ID NO: 1804815 - RNA, 13 nt, Homo sapiens
auaaauuacacau

SEQ ID NO: 1804816 - RNA, 16 nt, Homo sapiens
acucuaaaacuaucag

SEQ ID NO: 1804817 - RNA, 17 nt, Homo sapiens
ugagaacagauaaagau

SEQ ID NO: 1804818 - RNA, 21 nt, Homo sapiens
aucuuccaccucaccucuuug

SEQ ID NO: 1804819 - RNA, 23 nt, Homo sapiens
guaaaugacaucuacgaagccac

SEQ ID NO: 1804820 - RNA, 20 nt, Homo sapiens
caauaacucucuacaggaau

SEQ ID NO: 1804821 - RNA, 14 nt, Homo sapiens
aggggccacugggc

SEQ ID NO: 1804822 - RNA, 14 nt, Homo sapiens
cucacacaagcaca

SEQ ID NO: 1804823 - RNA, 14 nt, Homo sapiens
agauugcacuauug

SEQ ID NO: 1804824 - RNA, 23 nt, Homo sapiens
gaaaaugcaacucuaacucugag

SEQ ID NO: 1804825 - RNA, 23 nt, Homo sapiens
uaaauuauuauuugacaacaauc

SEQ ID NO: 1804826 - RNA, 14 nt, Homo sapiens
auaaaagcauuguu

SEQ ID NO: 1804827 - RNA, 13 nt, Homo sapiens
cugggcugggaaa

SEQ ID NO: 1804828 - RNA, 13 nt, Homo sapiens
ggagacugcugag

SEQ ID NO: 1804829 - RNA, 15 nt, Homo sapiens
auacauucuaugaca

SEQ ID NO: 1804830 - RNA, 15 nt, Homo sapiens
ggcagcuauccagug

SEQ ID NO: 1804831 - RNA, 20 nt, Homo sapiens
aucuguaugggucauucuca

SEQ ID NO: 1804832 - RNA, 16 nt, Homo sapiens
aguuucugacaauuaa

SEQ ID NO: 1804833 - RNA, 16 nt, Homo sapiens
gagcuugggugcauuu

SEQ ID NO: 1804834 - RNA, 15 nt, Homo sapiens
gaaaucagcaugaca

SEQ ID NO: 1804835 - RNA, 20 nt, Homo sapiens
ucuacuacccccacagaccu

SEQ ID NO: 1804836 - RNA, 21 nt, Homo sapiens
cuucccaagcagcugggauua

SEQ ID NO: 1804837 - RNA, 23 nt, Homo sapiens
aaccauuuuauuuuuugggccau

SEQ ID NO: 1804838 - RNA, 15 nt, Homo sapiens
gaugggccaccgggg

SEQ ID NO: 1804839 - RNA, 16 nt, Homo sapiens
guccuguccugcucau

SEQ ID NO: 1804840 - RNA, 16 nt, Homo sapiens
cacaacuugagaagac

SEQ ID NO: 1804841 - RNA, 18 nt, Homo sapiens
cuacgccuugucauugga

SEQ ID NO: 1804842 - RNA, 14 nt, Homo sapiens
accaccaccaucac

SEQ ID NO: 1804843 - RNA, 19 nt, Homo sapiens
ucuauuuuuaaccaaauaa

SEQ ID NO: 1804844 - RNA, 13 nt, Homo sapiens
augccugcucccu

SEQ ID NO: 1804845 - RNA, 16 nt, Homo sapiens
ucauaaucucuuucca

SEQ ID NO: 1804846 - RNA, 20 nt, Homo sapiens
aauagcgguacaaguucugg

SEQ ID NO: 1804847 - RNA, 21 nt, Homo sapiens
ggaaacugcucccaucauucc

SEQ ID NO: 1804848 - RNA, 18 nt, Homo sapiens
ucaccuguaaaacuuuau

SEQ ID NO: 1804849 - RNA, 16 nt, Homo sapiens
cucaguaaguuggcaa

SEQ ID NO: 1804850 - RNA, 12 nt, Homo sapiens
gcuucacuuaaa

SEQ ID NO: 1804851 - RNA, 14 nt, Homo sapiens
uccagguacugauc

SEQ ID NO: 1804852 - RNA, 17 nt, Homo sapiens
uucaagcacacuggaau

SEQ ID NO: 1804853 - RNA, 21 nt, Homo sapiens
caggcugguuugcaagaauga

SEQ ID NO: 1804854 - RNA, 12 nt, Homo sapiens
guugugccaaau

SEQ ID NO: 1804855 - RNA, 20 nt, Homo sapiens
ucacauucgacauaccccac

SEQ ID NO: 1804856 - RNA, 14 nt, Homo sapiens
aaaugcucacuggg

SEQ ID NO: 1804857 - RNA, 21 nt, Homo sapiens
auuauucugggggcugcaguu

SEQ ID NO: 1804858 - RNA, 16 nt, Homo sapiens
cuguucuuuuguccca

SEQ ID NO: 1804859 - RNA, 13 nt, Homo sapiens
agaugaacaucuc

SEQ ID NO: 1804860 - RNA, 21 nt, Homo sapiens
acgugacacaaacacacacaa

SEQ ID NO: 1804861 - RNA, 13 nt, Homo sapiens
ugucaaugugaac

SEQ ID NO: 1804862 - RNA, 15 nt, Homo sapiens
gaaaacuugacaugu

SEQ ID NO: 1804863 - RNA, 15 nt, Homo sapiens
acuugaggucaggag

SEQ ID NO: 1804864 - RNA, 17 nt, Homo sapiens
aagugagauacaaagcu

SEQ ID NO: 1804865 - RNA, 14 nt, Homo sapiens
uauaaacacauaau

SEQ ID NO: 1804866 - RNA, 14 nt, Homo sapiens
gaagacaaacaaua

SEQ ID NO: 1804867 - RNA, 15 nt, Homo sapiens
accuagaaguaacug

SEQ ID NO: 1804868 - RNA, 15 nt, Homo sapiens
aaggccgucauuuca

SEQ ID NO: 1804869 - RNA, 23 nt, Homo sapiens
gaagaaucucgacucucgugaua

SEQ ID NO: 1804870 - RNA, 15 nt, Homo sapiens
uccugccuucugucc

SEQ ID NO: 1804871 - RNA, 19 nt, Homo sapiens
gaauauguagucuaagcau

SEQ ID NO: 1804872 - RNA, 18 nt, Homo sapiens
acaguaacccaaaccuca

SEQ ID NO: 1804873 - RNA, 21 nt, Homo sapiens
uaauauaaaccgugugucaug

SEQ ID NO: 1804874 - RNA, 12 nt, Homo sapiens
aaaugcauggca

SEQ ID NO: 1804875 - RNA, 12 nt, Homo sapiens
aagagaaggcaa

SEQ ID NO: 1804876 - RNA, 17 nt, Homo sapiens
ggccuaugacccugugc

SEQ ID NO: 1804877 - RNA, 11 nt, Homo sapiens
agaaaacuggg

SEQ ID NO: 1804878 - RNA, 18 nt, Homo sapiens
accucuaaauucuuucau

SEQ ID NO: 1804879 - RNA, 20 nt, Homo sapiens
aaugaagauaaaugcuuuaa

SEQ ID NO: 1804880 - RNA, 19 nt, Homo sapiens
gauuauuugcccaaaucuu

SEQ ID NO: 1804881 - RNA, 21 nt, Homo sapiens
guuacuuuugacccaugugca

SEQ ID NO: 1804882 - RNA, 15 nt, Homo sapiens
ugggguaacaucugu

SEQ ID NO: 1804883 - RNA, 14 nt, Homo sapiens
gaaugaucuuggcu

SEQ ID NO: 1804884 - RNA, 23 nt, Homo sapiens
cgucacccuugguagaguuuauu

SEQ ID NO: 1804885 - RNA, 17 nt, Homo sapiens
guccaagagacauggaa

SEQ ID NO: 1804886 - RNA, 19 nt, Homo sapiens
cugccuccugugacgugag

SEQ ID NO: 1804887 - RNA, 15 nt, Homo sapiens
aaagaggaaccagga

SEQ ID NO: 1804888 - RNA, 18 nt, Homo sapiens
cugcccaggcacugcaaa

SEQ ID NO: 1804889 - RNA, 23 nt, Homo sapiens
cuuucuuguuugucagcaucuga

SEQ ID NO: 1804890 - RNA, 21 nt, Homo sapiens
accuggcagguuagaaccuag

SEQ ID NO: 1804891 - RNA, 14 nt, Homo sapiens
ucacuuauuucaua

SEQ ID NO: 1804892 - RNA, 21 nt, Homo sapiens
uaaaagcagcauaaagaauuu

SEQ ID NO: 1804893 - RNA, 15 nt, Homo sapiens
ccugccucugacuca

SEQ ID NO: 1804894 - RNA, 13 nt, Homo sapiens
aucucucauggug

SEQ ID NO: 1804895 - RNA, 21 nt, Homo sapiens
acugcccaggccuaucuggaa

SEQ ID NO: 1804896 - RNA, 21 nt, Homo sapiens
uaacaucacugucuugccaga

SEQ ID NO: 1804897 - RNA, 16 nt, Homo sapiens
uggacaauggacugua

SEQ ID NO: 1804898 - RNA, 19 nt, Homo sapiens
uggccuaauccaccuggug

SEQ ID NO: 1804899 - RNA, 18 nt, Homo sapiens
uuaccauacugucucugg

SEQ ID NO: 1804900 - RNA, 16 nt, Homo sapiens
uugacuggauauucau

SEQ ID NO: 1804901 - RNA, 17 nt, Homo sapiens
auuuaauacacaaugca

SEQ ID NO: 1804902 - RNA, 15 nt, Homo sapiens
cucagcuguccugca

SEQ ID NO: 1804903 - RNA, 16 nt, Homo sapiens
aggugguggcacugag

SEQ ID NO: 1804904 - RNA, 13 nt, Homo sapiens
gaggcuaccucac

SEQ ID NO: 1804905 - RNA, 16 nt, Homo sapiens
uuuuacaaaccuuuaa

SEQ ID NO: 1804906 - RNA, 20 nt, Homo sapiens
gcaauacggaacacugucaa

SEQ ID NO: 1804907 - RNA, 20 nt, Homo sapiens
cuacugaguagggggagcaa

SEQ ID NO: 1804908 - RNA, 16 nt, Homo sapiens
ucaucuguuguagauu

SEQ ID NO: 1804909 - RNA, 15 nt, Homo sapiens
ucacugucaccaccc

SEQ ID NO: 1804910 - RNA, 20 nt, Homo sapiens
uaucugcaaucuuugccaag

SEQ ID NO: 1804911 - RNA, 22 nt, Homo sapiens
uaugcagggagcugggcuucca

SEQ ID NO: 1804912 - RNA, 18 nt, Homo sapiens
gucccuugcuguuuucau

SEQ ID NO: 1804913 - RNA, 14 nt, Homo sapiens
gaaguaaaacaugc

SEQ ID NO: 1804914 - RNA, 17 nt, Homo sapiens
uugucuuucaaugcagu

SEQ ID NO: 1804915 - RNA, 22 nt, Homo sapiens
cacauugaagguauaugccaaa

SEQ ID NO: 1804916 - RNA, 14 nt, Homo sapiens
ucaucaagaauuua

SEQ ID NO: 1804917 - RNA, 18 nt, Homo sapiens
uucauguucaugugauua

SEQ ID NO: 1804918 - RNA, 16 nt, Homo sapiens
gacaccucaccucacc

SEQ ID NO: 1804919 - RNA, 12 nt, Homo sapiens
aguaacucccau

SEQ ID NO: 1804920 - RNA, 15 nt, Homo sapiens
ucagggccaugccug

SEQ ID NO: 1804921 - RNA, 20 nt, Homo sapiens
ggccugcccagucgacccca

SEQ ID NO: 1804922 - RNA, 16 nt, Homo sapiens
cucaccugggaaauca

SEQ ID NO: 1804923 - RNA, 23 nt, Homo sapiens
uacugucuuagaagaaauuaaua

SEQ ID NO: 1804924 - RNA, 18 nt, Homo sapiens
ugagauugggcauggggu

SEQ ID NO: 1804925 - RNA, 14 nt, Homo sapiens
uuuauacugcacuu

SEQ ID NO: 1804926 - RNA, 15 nt, Homo sapiens
gucuuaaacuccugg

SEQ ID NO: 1804927 - RNA, 20 nt, Homo sapiens
accacaggcccuuuccucag

SEQ ID NO: 1804928 - RNA, 18 nt, Homo sapiens
guaugauaaacaguugaa

SEQ ID NO: 1804929 - RNA, 22 nt, Homo sapiens
agcccagugggaucuuacccac

SEQ ID NO: 1804930 - RNA, 19 nt, Homo sapiens
ccguggcucacgucuguaa

SEQ ID NO: 1804931 - RNA, 15 nt, Homo sapiens
uucucugugaccuga

SEQ ID NO: 1804932 - RNA, 21 nt, Homo sapiens
ugaucacaucuaaagcuuuau

SEQ ID NO: 1804933 - RNA, 23 nt, Homo sapiens
ucacauuggcuauuuaaagacaa

SEQ ID NO: 1804934 - RNA, 18 nt, Homo sapiens
cuuuuacuuguucauuuc

SEQ ID NO: 1804935 - RNA, 15 nt, Homo sapiens
aaaugaguaguuugu

SEQ ID NO: 1804936 - RNA, 18 nt, Homo sapiens
cccuggguuagacugcca

SEQ ID NO: 1804937 - RNA, 19 nt, Homo sapiens
uggcacgugccugugaucc

SEQ ID NO: 1804938 - RNA, 19 nt, Homo sapiens
caaacacggacccauagac

SEQ ID NO: 1804939 - RNA, 13 nt, Homo sapiens
uggccuaaagaau

SEQ ID NO: 1804940 - RNA, 21 nt, Homo sapiens
uuugaaggaaaauuaaaccaa

SEQ ID NO: 1804941 - RNA, 24 nt, Homo sapiens
uuuauugccucuaugugcaacuga

SEQ ID NO: 1804942 - RNA, 21 nt, Homo sapiens
gauuaacuuucaaaagcaaac

SEQ ID NO: 1804943 - RNA, 21 nt, Homo sapiens
uggaauauaauuucaaaccac

SEQ ID NO: 1804944 - RNA, 15 nt, Homo sapiens
acaggccauacuuua

SEQ ID NO: 1804945 - RNA, 19 nt, Homo sapiens
gaaacaaaauguucugcua

SEQ ID NO: 1804946 - RNA, 16 nt, Homo sapiens
agagucaacaguaucu

SEQ ID NO: 1804947 - RNA, 21 nt, Homo sapiens
cugacuuaugaaacuugaaac

SEQ ID NO: 1804948 - RNA, 20 nt, Homo sapiens
ucagucguuuuagugucuga

SEQ ID NO: 1804949 - RNA, 15 nt, Homo sapiens
cucucuugcuuacaa

SEQ ID NO: 1804950 - RNA, 15 nt, Homo sapiens
auaaaagacaugaaa

SEQ ID NO: 1804951 - RNA, 20 nt, Homo sapiens
gucagugacgaggaacuccc

SEQ ID NO: 1804952 - RNA, 13 nt, Homo sapiens
auguaaagccagc

SEQ ID NO: 1804953 - RNA, 16 nt, Homo sapiens
uagauuuuaaagacaa

SEQ ID NO: 1804954 - RNA, 23 nt, Homo sapiens
acuaucuguaaugccuuuucuca

SEQ ID NO: 1804955 - RNA, 23 nt, Homo sapiens
cagcccugggguaugagcugcca

SEQ ID NO: 1804956 - RNA, 16 nt, Homo sapiens
uaugcagacaaccuca

SEQ ID NO: 1804957 - RNA, 20 nt, Homo sapiens
agagagcagcagcagcaggu

SEQ ID NO: 1804958 - RNA, 23 nt, Homo sapiens
uaaucccuucaaggaagugauaa

SEQ ID NO: 1804959 - RNA, 12 nt, Homo sapiens
uaacuuagcuug

SEQ ID NO: 1804960 - RNA, 20 nt, Homo sapiens
uggacccaucacuuuggaca

SEQ ID NO: 1804961 - RNA, 15 nt, Homo sapiens
ucuagcaaauaugcu

SEQ ID NO: 1804962 - RNA, 17 nt, Homo sapiens
aaaucaaaaucucucca

SEQ ID NO: 1804963 - RNA, 21 nt, Homo sapiens
ggccagugagaucaaugugac

SEQ ID NO: 1804964 - RNA, 17 nt, Homo sapiens
uaauuuaaauagcauua

SEQ ID NO: 1804965 - RNA, 19 nt, Homo sapiens
uccagacagagcccuguga

SEQ ID NO: 1804966 - RNA, 11 nt, Homo sapiens
gugaagaccaa

SEQ ID NO: 1804967 - RNA, 17 nt, Homo sapiens
uucuagcuguguccuca

SEQ ID NO: 1804968 - RNA, 17 nt, Homo sapiens
aacuuuucgacauauuu

SEQ ID NO: 1804969 - RNA, 16 nt, Homo sapiens
uuaacuaugacagaua

SEQ ID NO: 1804970 - RNA, 12 nt, Homo sapiens
uaggaccaagau

SEQ ID NO: 1804971 - RNA, 14 nt, Homo sapiens
guguggagcuguau

SEQ ID NO: 1804972 - RNA, 21 nt, Homo sapiens
ucuaaauucuuucaugagcuu

SEQ ID NO: 1804973 - RNA, 21 nt, Homo sapiens
agaccuugcaaucacaaaagg

SEQ ID NO: 1804974 - RNA, 17 nt, Homo sapiens
aauacaagccacuaccu

SEQ ID NO: 1804975 - RNA, 17 nt, Homo sapiens
gaaacuuggacauuuau

SEQ ID NO: 1804976 - RNA, 18 nt, Homo sapiens
cuucagaugacaaggauu

SEQ ID NO: 1804977 - RNA, 18 nt, Homo sapiens
aaucagaugggggacuga

SEQ ID NO: 1804978 - RNA, 13 nt, Homo sapiens
aaaauuaugucca

SEQ ID NO: 1804979 - RNA, 13 nt, Homo sapiens
gaaaagaaaugca

SEQ ID NO: 1804980 - RNA, 20 nt, Homo sapiens
auggucucugccaugaacug

SEQ ID NO: 1804981 - RNA, 16 nt, Homo sapiens
gucauccucccaccuc

SEQ ID NO: 1804982 - RNA, 16 nt, Homo sapiens
cagccugccuggagua

SEQ ID NO: 1804983 - RNA, 16 nt, Homo sapiens
accacaggcugccuca

SEQ ID NO: 1804984 - RNA, 22 nt, Homo sapiens
ugccucucggugaccuccgucc

SEQ ID NO: 1804985 - RNA, 20 nt, Homo sapiens
ccuucacagggguacagaaa

SEQ ID NO: 1804986 - RNA, 15 nt, Homo sapiens
auaaguguguuugca

SEQ ID NO: 1804987 - RNA, 23 nt, Homo sapiens
gaaacaaagaaagagauguuaag

SEQ ID NO: 1804988 - RNA, 20 nt, Homo sapiens
acaauuauuaccaucucucc

SEQ ID NO: 1804989 - RNA, 23 nt, Homo sapiens
gaaagccuaucaaagaccuugug

SEQ ID NO: 1804990 - RNA, 14 nt, Homo sapiens
gucucuauugauau

SEQ ID NO: 1804991 - RNA, 19 nt, Homo sapiens
agccuuuacuguuugauau

SEQ ID NO: 1804992 - RNA, 16 nt, Homo sapiens
cucaauaaaugcucau

SEQ ID NO: 1804993 - RNA, 19 nt, Homo sapiens
ugacaucuccucuaucaca

SEQ ID NO: 1804994 - RNA, 13 nt, Homo sapiens
gagcuugcaguga

SEQ ID NO: 1804995 - RNA, 15 nt, Homo sapiens
ggcauagcacccgug

SEQ ID NO: 1804996 - RNA, 17 nt, Homo sapiens
cucuacacccacccaaa

SEQ ID NO: 1804997 - RNA, 17 nt, Homo sapiens
ucacccacccuguggcu

SEQ ID NO: 1804998 - RNA, 15 nt, Homo sapiens
uuuaucccaucuuga

SEQ ID NO: 1804999 - RNA, 19 nt, Homo sapiens
accgugaagauacuuugua

SEQ ID NO: 1805000 - RNA, 19 nt, Homo sapiens
aauuuuuuuuaaaaaucca

SEQ ID NO: 1805001 - RNA, 17 nt, Homo sapiens
ugcuguggccucacuuc

SEQ ID NO: 1805002 - RNA, 20 nt, Homo sapiens
ugaauugaugaggacugucc

SEQ ID NO: 1805003 - RNA, 12 nt, Homo sapiens
uauuucaucucu

SEQ ID NO: 1805004 - RNA, 15 nt, Homo sapiens
ugugacacaucaagc

SEQ ID NO: 1805005 - RNA, 17 nt, Homo sapiens
aggaggcagagaggguc

SEQ ID NO: 1805006 - RNA, 20 nt, Homo sapiens
ggccaggaguuugagaccag

SEQ ID NO: 1805007 - RNA, 19 nt, Homo sapiens
aucuuuacacaaugucacg

SEQ ID NO: 1805008 - RNA, 18 nt, Homo sapiens
cagugggaguaccaaaga

SEQ ID NO: 1805009 - RNA, 23 nt, Homo sapiens
auccugaguucauccccugugaa

SEQ ID NO: 1805010 - RNA, 17 nt, Homo sapiens
ucacauggccuaugcac

SEQ ID NO: 1805011 - RNA, 16 nt, Homo sapiens
cagaacauauguugca

SEQ ID NO: 1805012 - RNA, 15 nt, Homo sapiens
cucccuccagauaua

SEQ ID NO: 1805013 - RNA, 15 nt, Homo sapiens
uauuccuaaugcuuu

SEQ ID NO: 1805014 - RNA, 15 nt, Homo sapiens
uguucccaaauuuuc

SEQ ID NO: 1805015 - RNA, 13 nt, Homo sapiens
uugacaacccaaa

SEQ ID NO: 1805016 - RNA, 13 nt, Homo sapiens
ucaacaaccugaa

SEQ ID NO: 1805017 - RNA, 18 nt, Homo sapiens
ugucacuugugauuugcc

SEQ ID NO: 1805018 - RNA, 15 nt, Homo sapiens
aaucauuucuaaaca

SEQ ID NO: 1805019 - RNA, 20 nt, Homo sapiens
auuuaugcagagacagcugu

SEQ ID NO: 1805020 - RNA, 12 nt, Homo sapiens
uauuuaaccuag

SEQ ID NO: 1805021 - RNA, 17 nt, Homo sapiens
gucaaaagaaauaaucc

SEQ ID NO: 1805022 - RNA, 13 nt, Homo sapiens
acauuugugcucc

SEQ ID NO: 1805023 - RNA, 22 nt, Homo sapiens
gucaucaaccgaugguccucac

SEQ ID NO: 1805024 - RNA, 22 nt, Homo sapiens
cuggcccaguuaauuugcacag

SEQ ID NO: 1805025 - RNA, 22 nt, Homo sapiens
gccucuccccagagcauuugau

SEQ ID NO: 1805026 - RNA, 16 nt, Homo sapiens
ccccugagccacagaa

SEQ ID NO: 1805027 - RNA, 14 nt, Homo sapiens
uuugagaaugguua

SEQ ID NO: 1805028 - RNA, 20 nt, Homo sapiens
uccuuugccugauccuccaa

SEQ ID NO: 1805029 - RNA, 14 nt, Homo sapiens
uacuuaaugcauau

SEQ ID NO: 1805030 - RNA, 19 nt, Homo sapiens
uaauagaaaaauuguaaua

SEQ ID NO: 1805031 - RNA, 19 nt, Homo sapiens
aggcaucugagugugagac

SEQ ID NO: 1805032 - RNA, 21 nt, Homo sapiens
uugccacagaugauacuucca

SEQ ID NO: 1805033 - RNA, 17 nt, Homo sapiens
gcuccaaugccuacuga

SEQ ID NO: 1805034 - RNA, 17 nt, Homo sapiens
aagaaggggcucuggau

SEQ ID NO: 1805035 - RNA, 20 nt, Homo sapiens
uugcaggggccggaguagga

SEQ ID NO: 1805036 - RNA, 16 nt, Homo sapiens
ggagguuguugcagug

SEQ ID NO: 1805037 - RNA, 17 nt, Homo sapiens
ucucaugggaaggggag

SEQ ID NO: 1805038 - RNA, 17 nt, Homo sapiens
uucuagaauccccacag

SEQ ID NO: 1805039 - RNA, 18 nt, Homo sapiens
uuagcacuauuuacauac

SEQ ID NO: 1805040 - RNA, 17 nt, Homo sapiens
gaaaaccauuaccugac

SEQ ID NO: 1805041 - RNA, 16 nt, Homo sapiens
aggccuccgucuuccc

SEQ ID NO: 1805042 - RNA, 14 nt, Homo sapiens
auaucacuuacuca

SEQ ID NO: 1805043 - RNA, 11 nt, Homo sapiens
ggucaucugcc

SEQ ID NO: 1805044 - RNA, 18 nt, Homo sapiens
uauggacucagccuugca

SEQ ID NO: 1805045 - RNA, 21 nt, Homo sapiens
uuuaaaauaaguugcagaaca

SEQ ID NO: 1805046 - RNA, 22 nt, Homo sapiens
cuugaaagcgaaauacuugaaa

SEQ ID NO: 1805047 - RNA, 20 nt, Homo sapiens
gcucaccguggauuuucuca

SEQ ID NO: 1805048 - RNA, 16 nt, Homo sapiens
accagaauaaacccag

SEQ ID NO: 1805049 - RNA, 14 nt, Homo sapiens
ucaauauuugaucu

SEQ ID NO: 1805050 - RNA, 18 nt, Homo sapiens
aagccaauaaaugaacug

SEQ ID NO: 1805051 - RNA, 20 nt, Homo sapiens
gcaaugguaacugcaccugg

SEQ ID NO: 1805052 - RNA, 16 nt, Homo sapiens
auuggaaaguacuccc

SEQ ID NO: 1805053 - RNA, 17 nt, Homo sapiens
uuaccuuggucaugcuu

SEQ ID NO: 1805054 - RNA, 18 nt, Homo sapiens
auaacauuuaauuuagau

SEQ ID NO: 1805055 - RNA, 21 nt, Homo sapiens
uuacauuagccauucauguau

SEQ ID NO: 1805056 - RNA, 15 nt, Homo sapiens
ucucucaaaacaaua

SEQ ID NO: 1805057 - RNA, 16 nt, Homo sapiens
ucccuucuccuugaua

SEQ ID NO: 1805058 - RNA, 13 nt, Homo sapiens
ucuuuccaaaaca

SEQ ID NO: 1805059 - RNA, 13 nt, Homo sapiens
aggcaaaggccag

SEQ ID NO: 1805060 - RNA, 16 nt, Homo sapiens
gacuuugaugcauuuc

SEQ ID NO: 1805061 - RNA, 21 nt, Homo sapiens
uaacuuccacagggucccaca

SEQ ID NO: 1805062 - RNA, 19 nt, Homo sapiens
caagcaagggcugugcuga

SEQ ID NO: 1805063 - RNA, 17 nt, Homo sapiens
ucauucccaggcacucu

SEQ ID NO: 1805064 - RNA, 18 nt, Homo sapiens
uuggaaaaaauguuguaa

SEQ ID NO: 1805065 - RNA, 15 nt, Homo sapiens
caaaauaauacuuca

SEQ ID NO: 1805066 - RNA, 16 nt, Homo sapiens
cucccagccugacucc

SEQ ID NO: 1805067 - RNA, 19 nt, Homo sapiens
uuacauaggccgagcugug

SEQ ID NO: 1805068 - RNA, 22 nt, Homo sapiens
auugugucuggucguuugacca

SEQ ID NO: 1805069 - RNA, 18 nt, Homo sapiens
caacugguuugccuauaa

SEQ ID NO: 1805070 - RNA, 18 nt, Homo sapiens
caaucuuauuacugagag

SEQ ID NO: 1805071 - RNA, 15 nt, Homo sapiens
cuaaagagcccuugc

SEQ ID NO: 1805072 - RNA, 13 nt, Homo sapiens
ccagccagcuccu

SEQ ID NO: 1805073 - RNA, 16 nt, Homo sapiens
ucaacauuaccaaaau

SEQ ID NO: 1805074 - RNA, 18 nt, Homo sapiens
gaauguccaaugguagga

SEQ ID NO: 1805075 - RNA, 20 nt, Homo sapiens
agcccgcaggaucaggugac

SEQ ID NO: 1805076 - RNA, 14 nt, Homo sapiens
caucucugucacac

SEQ ID NO: 1805077 - RNA, 16 nt, Homo sapiens
auugagaucacuacuc

SEQ ID NO: 1805078 - RNA, 13 nt, Homo sapiens
ugggaauugcaug

SEQ ID NO: 1805079 - RNA, 23 nt, Homo sapiens
cagugaaacuccaucucaauuua

SEQ ID NO: 1805080 - RNA, 16 nt, Homo sapiens
gguuugagaugcugua

SEQ ID NO: 1805081 - RNA, 21 nt, Homo sapiens
agaacauuuauaucaguuuca

SEQ ID NO: 1805082 - RNA, 20 nt, Homo sapiens
gcugaaaaucacuauaacca

SEQ ID NO: 1805083 - RNA, 13 nt, Homo sapiens
uaaaaugugcagu

SEQ ID NO: 1805084 - RNA, 17 nt, Homo sapiens
cuugucauguguauaaa

SEQ ID NO: 1805085 - RNA, 20 nt, Homo sapiens
augcaguuccugugccucca

SEQ ID NO: 1805086 - RNA, 15 nt, Homo sapiens
gaaacaauggcuaag

SEQ ID NO: 1805087 - RNA, 18 nt, Homo sapiens
agggcucuccaagggaau

SEQ ID NO: 1805088 - RNA, 12 nt, Homo sapiens
ucuaaagccagg

SEQ ID NO: 1805089 - RNA, 19 nt, Homo sapiens
cacacuguugucaaaaagu

SEQ ID NO: 1805090 - RNA, 14 nt, Homo sapiens
ucaccucucuucag

SEQ ID NO: 1805091 - RNA, 16 nt, Homo sapiens
ucucguaguccaucac

SEQ ID NO: 1805092 - RNA, 22 nt, Homo sapiens
aucccagcuacuugggagguug

SEQ ID NO: 1805093 - RNA, 13 nt, Homo sapiens
caaaacugccuca

SEQ ID NO: 1805094 - RNA, 13 nt, Homo sapiens
ccucucugcaaau

SEQ ID NO: 1805095 - RNA, 21 nt, Homo sapiens
uaagacauuaguaacauaaua

SEQ ID NO: 1805096 - RNA, 13 nt, Homo sapiens
ucagcagggcagu

SEQ ID NO: 1805097 - RNA, 13 nt, Homo sapiens
caccccaccucuu

SEQ ID NO: 1805098 - RNA, 19 nt, Homo sapiens
gcucaucuguacauacugu

SEQ ID NO: 1805099 - RNA, 17 nt, Homo sapiens
cuugaaugcugccagug

SEQ ID NO: 1805100 - RNA, 20 nt, Homo sapiens
caggcuggucucaaacuccu

SEQ ID NO: 1805101 - RNA, 16 nt, Homo sapiens
guuucaggacaugggg

SEQ ID NO: 1805102 - RNA, 17 nt, Homo sapiens
uucucucuccucuuuga

SEQ ID NO: 1805103 - RNA, 22 nt, Homo sapiens
auuauaaucucauuucaauuua

SEQ ID NO: 1805104 - RNA, 17 nt, Homo sapiens
ugcgugguauaaucucc

SEQ ID NO: 1805105 - RNA, 15 nt, Homo sapiens
gcugcuuucuucucu

SEQ ID NO: 1805106 - RNA, 16 nt, Homo sapiens
agcuauugcauguaaa

SEQ ID NO: 1805107 - RNA, 13 nt, Homo sapiens
uauagucuuccag

SEQ ID NO: 1805108 - RNA, 13 nt, Homo sapiens
ucuacugagccac

SEQ ID NO: 1805109 - RNA, 13 nt, Homo sapiens
ucagaagccugag

SEQ ID NO: 1805110 - RNA, 22 nt, Homo sapiens
uccuucccucaaagaggccuua

SEQ ID NO: 1805111 - RNA, 18 nt, Homo sapiens
aaucaaggccagugcuaa

SEQ ID NO: 1805112 - RNA, 13 nt, Homo sapiens
ucacaaagcuauu

SEQ ID NO: 1805113 - RNA, 15 nt, Homo sapiens
ugggaguuguaguua

SEQ ID NO: 1805114 - RNA, 17 nt, Homo sapiens
cccgcauagcacuugca

SEQ ID NO: 1805115 - RNA, 20 nt, Homo sapiens
uggccucccugcugugccau

SEQ ID NO: 1805116 - RNA, 17 nt, Homo sapiens
gcggcucuaaaccucag

SEQ ID NO: 1805117 - RNA, 18 nt, Homo sapiens
ucagccacauauugagau

SEQ ID NO: 1805118 - RNA, 22 nt, Homo sapiens
cacuccagguggaacaaacaga

SEQ ID NO: 1805119 - RNA, 17 nt, Homo sapiens
augcuuauguguugcau

SEQ ID NO: 1805120 - RNA, 20 nt, Homo sapiens
ucugauggguucaugucucu

SEQ ID NO: 1805121 - RNA, 22 nt, Homo sapiens
cuuggguauuuuaaccuguaua

SEQ ID NO: 1805122 - RNA, 15 nt, Homo sapiens
gaagacagcaaaaaa

SEQ ID NO: 1805123 - RNA, 14 nt, Homo sapiens
acagagucaagggu

SEQ ID NO: 1805124 - RNA, 19 nt, Homo sapiens
aagagucggauuaccaaaa

SEQ ID NO: 1805125 - RNA, 21 nt, Homo sapiens
cuccuugcugcauugauccag

SEQ ID NO: 1805126 - RNA, 21 nt, Homo sapiens
ccuaagaagaaggccagagag

SEQ ID NO: 1805127 - RNA, 18 nt, Homo sapiens
uuuuaaaagucucacaaa

SEQ ID NO: 1805128 - RNA, 16 nt, Homo sapiens
guuuaccuagaagaag

SEQ ID NO: 1805129 - RNA, 15 nt, Homo sapiens
gacucaauaaaauca

SEQ ID NO: 1805130 - RNA, 13 nt, Homo sapiens
acaagcaucagga

SEQ ID NO: 1805131 - RNA, 19 nt, Homo sapiens
ucguuauagagagcaauuu

SEQ ID NO: 1805132 - RNA, 23 nt, Homo sapiens
cccaagagcauaacuguucucau

SEQ ID NO: 1805133 - RNA, 14 nt, Homo sapiens
uagucucaccagcc

SEQ ID NO: 1805134 - RNA, 16 nt, Homo sapiens
cucacuuugacaccca

SEQ ID NO: 1805135 - RNA, 19 nt, Homo sapiens
ugagucaaaaaaucucaau

SEQ ID NO: 1805136 - RNA, 23 nt, Homo sapiens
gacuuacuaugggauggggucca

SEQ ID NO: 1805137 - RNA, 20 nt, Homo sapiens
auuuuacuuccaugauacuu

SEQ ID NO: 1805138 - RNA, 20 nt, Homo sapiens
uccuggccuucugaacucca

SEQ ID NO: 1805139 - RNA, 19 nt, Homo sapiens
uagagugcucugacccugg

SEQ ID NO: 1805140 - RNA, 17 nt, Homo sapiens
acuuauuauuauuguua

SEQ ID NO: 1805141 - RNA, 14 nt, Homo sapiens
uauuaccauguaaa

SEQ ID NO: 1805142 - RNA, 13 nt, Homo sapiens
cuuugcaaacccu

SEQ ID NO: 1805143 - RNA, 14 nt, Homo sapiens
uacuuaagugcugc

SEQ ID NO: 1805144 - RNA, 18 nt, Homo sapiens
aaucaccuugcauuucaa

SEQ ID NO: 1805145 - RNA, 14 nt, Homo sapiens
ugcacacaucacca

SEQ ID NO: 1805146 - RNA, 18 nt, Homo sapiens
aagagaaaccaggcccug

SEQ ID NO: 1805147 - RNA, 21 nt, Homo sapiens
uccaggaggaguuagccaaac

SEQ ID NO: 1805148 - RNA, 16 nt, Homo sapiens
acaaagcagauccuca

SEQ ID NO: 1805149 - RNA, 19 nt, Homo sapiens
auauuugagagacauuugu

SEQ ID NO: 1805150 - RNA, 13 nt, Homo sapiens
ggagugacucugg

SEQ ID NO: 1805151 - RNA, 13 nt, Homo sapiens
ggagggacucugu

SEQ ID NO: 1805152 - RNA, 15 nt, Homo sapiens
uauuuauauguacug

SEQ ID NO: 1805153 - RNA, 16 nt, Homo sapiens
auuuacaucccagaca

SEQ ID NO: 1805154 - RNA, 13 nt, Homo sapiens
uuauaaugggaua

SEQ ID NO: 1805155 - RNA, 13 nt, Homo sapiens
ugguuaugguguu

SEQ ID NO: 1805156 - RNA, 22 nt, Homo sapiens
ucaacauggaaaugauuuucau

SEQ ID NO: 1805157 - RNA, 23 nt, Homo sapiens
gccaugaggaggcagagaggguc

SEQ ID NO: 1805158 - RNA, 18 nt, Homo sapiens
cagucaaucuaugagggu

SEQ ID NO: 1805159 - RNA, 21 nt, Homo sapiens
auuggaugugcauuucuguga

SEQ ID NO: 1805160 - RNA, 22 nt, Homo sapiens
acuacuccucugcagugccuug

SEQ ID NO: 1805161 - RNA, 20 nt, Homo sapiens
auagguuuuucucauguauc

SEQ ID NO: 1805162 - RNA, 14 nt, Homo sapiens
cuccccucauggag

SEQ ID NO: 1805163 - RNA, 16 nt, Homo sapiens
guagccuaaagaccau

SEQ ID NO: 1805164 - RNA, 11 nt, Homo sapiens
uuuuugcucuu

SEQ ID NO: 1805165 - RNA, 14 nt, Homo sapiens
agagaauguauuug

SEQ ID NO: 1805166 - RNA, 15 nt, Homo sapiens
cucaaaacacccaaa

SEQ ID NO: 1805167 - RNA, 18 nt, Homo sapiens
ccaaggugaauagcacag

SEQ ID NO: 1805168 - RNA, 22 nt, Homo sapiens
aaagcagauugcagaaauacag

SEQ ID NO: 1805169 - RNA, 16 nt, Homo sapiens
acuggugcuaauguca

SEQ ID NO: 1805170 - RNA, 14 nt, Homo sapiens
aggaagacgugugg

SEQ ID NO: 1805171 - RNA, 19 nt, Homo sapiens
uuuaauaacauacuccuuu

SEQ ID NO: 1805172 - RNA, 19 nt, Homo sapiens
uucaggaaacaagcuuuau

SEQ ID NO: 1805173 - RNA, 21 nt, Homo sapiens
uagcaaagauaucucaucucu

SEQ ID NO: 1805174 - RNA, 21 nt, Homo sapiens
cuacccacaggacauucacca

SEQ ID NO: 1805175 - RNA, 16 nt, Homo sapiens
gaaaaaaucacuguuu

SEQ ID NO: 1805176 - RNA, 21 nt, Homo sapiens
caggagacuuuacauggaugc

SEQ ID NO: 1805177 - RNA, 24 nt, Homo sapiens
auuagcuuugucacuguuucacua

SEQ ID NO: 1805178 - RNA, 16 nt, Homo sapiens
ugcaaccauaagacaa

SEQ ID NO: 1805179 - RNA, 19 nt, Homo sapiens
ggacuucaaaaacugucaa

SEQ ID NO: 1805180 - RNA, 20 nt, Homo sapiens
ggcaaggugagggaugccau

SEQ ID NO: 1805181 - RNA, 17 nt, Homo sapiens
accugugaagcugaaaa

SEQ ID NO: 1805182 - RNA, 14 nt, Homo sapiens
ugacaaucaucucc

SEQ ID NO: 1805183 - RNA, 13 nt, Homo sapiens
aaguuucuaaaaa

SEQ ID NO: 1805184 - RNA, 15 nt, Homo sapiens
caugccucagugaag

SEQ ID NO: 1805185 - RNA, 16 nt, Homo sapiens
uuguuguccuuuucau

SEQ ID NO: 1805186 - RNA, 13 nt, Homo sapiens
uuugagacacugg

SEQ ID NO: 1805187 - RNA, 16 nt, Homo sapiens
ccucagggcacaaaga

SEQ ID NO: 1805188 - RNA, 20 nt, Homo sapiens
aguuuugacgguuuaugcug

SEQ ID NO: 1805189 - RNA, 21 nt, Homo sapiens
augaauagcgaaucaucucaa

SEQ ID NO: 1805190 - RNA, 23 nt, Homo sapiens
aaaugccagucucauugucaccu

SEQ ID NO: 1805191 - RNA, 18 nt, Homo sapiens
ggcaggcugggccauguc

SEQ ID NO: 1805192 - RNA, 21 nt, Homo sapiens
uuacuucacuuuaauucucau

SEQ ID NO: 1805193 - RNA, 15 nt, Homo sapiens
caccgccugccccca

SEQ ID NO: 1805194 - RNA, 15 nt, Homo sapiens
aacccacugugcuua

SEQ ID NO: 1805195 - RNA, 21 nt, Homo sapiens
gagggggcgguaggggcugca

SEQ ID NO: 1805196 - RNA, 11 nt, Homo sapiens
cuaaugcucac

SEQ ID NO: 1805197 - RNA, 22 nt, Homo sapiens
uaaguaggaugaaucauauuca

SEQ ID NO: 1805198 - RNA, 17 nt, Homo sapiens
cauccuagucucuauca

SEQ ID NO: 1805199 - RNA, 14 nt, Homo sapiens
uuaaacucagggac

SEQ ID NO: 1805200 - RNA, 22 nt, Homo sapiens
cugacccucaucuuucuuccaa

SEQ ID NO: 1805201 - RNA, 18 nt, Homo sapiens
agaacucuugacuuccug

SEQ ID NO: 1805202 - RNA, 19 nt, Homo sapiens
ugccauaucuucaggccau

SEQ ID NO: 1805203 - RNA, 20 nt, Homo sapiens
uguacaguuugcuguacuag

SEQ ID NO: 1805204 - RNA, 13 nt, Homo sapiens
auuuuuacugugu

SEQ ID NO: 1805205 - RNA, 16 nt, Homo sapiens
ccuaacaucaugcauu

SEQ ID NO: 1805206 - RNA, 18 nt, Homo sapiens
acucuccccauuggcacc

SEQ ID NO: 1805207 - RNA, 17 nt, Homo sapiens
ugaagauguuuguguau

SEQ ID NO: 1805208 - RNA, 15 nt, Homo sapiens
guagcaucuuccucu

SEQ ID NO: 1805209 - RNA, 14 nt, Homo sapiens
uccuacaagcuaaa

SEQ ID NO: 1805210 - RNA, 19 nt, Homo sapiens
uuaacuuuuauaccuaucu

SEQ ID NO: 1805211 - RNA, 15 nt, Homo sapiens
gauugcugacucaca

SEQ ID NO: 1805212 - RNA, 12 nt, Homo sapiens
cugaacagccaa

SEQ ID NO: 1805213 - RNA, 18 nt, Homo sapiens
agagggggcgaagggauc

SEQ ID NO: 1805214 - RNA, 11 nt, Homo sapiens
ucacuguguuu

SEQ ID NO: 1805215 - RNA, 11 nt, Homo sapiens
ccacugugcuu

SEQ ID NO: 1805216 - RNA, 15 nt, Homo sapiens
gucuucacucuucau

SEQ ID NO: 1805217 - RNA, 16 nt, Homo sapiens
ugauaggaaaaaucca

SEQ ID NO: 1805218 - RNA, 17 nt, Homo sapiens
acaucuacaaucaggag

SEQ ID NO: 1805219 - RNA, 21 nt, Homo sapiens
uugccgcacaugaaacauuau

SEQ ID NO: 1805220 - RNA, 16 nt, Homo sapiens
aaugauagaacuguac

SEQ ID NO: 1805221 - RNA, 21 nt, Homo sapiens
acagccaacacugaaaacacu

SEQ ID NO: 1805222 - RNA, 19 nt, Homo sapiens
ggaccagaagcauuucacc

SEQ ID NO: 1805223 - RNA, 23 nt, Homo sapiens
agcuugauuaaaucaaccaccua

SEQ ID NO: 1805224 - RNA, 23 nt, Homo sapiens
acuaugagccaggcaucauacua

SEQ ID NO: 1805225 - RNA, 17 nt, Homo sapiens
ugacuaacgccauccag

SEQ ID NO: 1805226 - RNA, 16 nt, Homo sapiens
uccaggagaaggccaa

SEQ ID NO: 1805227 - RNA, 13 nt, Homo sapiens
cuuuggcauggga

SEQ ID NO: 1805228 - RNA, 13 nt, Homo sapiens
cacagcugcccua

SEQ ID NO: 1805229 - RNA, 17 nt, Homo sapiens
cuccaugucuaugcucc

SEQ ID NO: 1805230 - RNA, 12 nt, Homo sapiens
agucaguaucug

SEQ ID NO: 1805231 - RNA, 14 nt, Homo sapiens
gauaccaugcaaua

SEQ ID NO: 1805232 - RNA, 15 nt, Homo sapiens
ugaucuacccgugcc

SEQ ID NO: 1805233 - RNA, 17 nt, Homo sapiens
gugugaaaccugacacc

SEQ ID NO: 1805234 - RNA, 17 nt, Homo sapiens
guggcagcaaaggaaga

SEQ ID NO: 1805235 - RNA, 16 nt, Homo sapiens
uuauuguugcauuaaa

SEQ ID NO: 1805236 - RNA, 16 nt, Homo sapiens
gcuuuauuuuuuugaa

SEQ ID NO: 1805237 - RNA, 19 nt, Homo sapiens
uucccauuuacaggucuuc

SEQ ID NO: 1805238 - RNA, 21 nt, Homo sapiens
agaaacuuauucgcaauagac

SEQ ID NO: 1805239 - RNA, 17 nt, Homo sapiens
acuccccagagcugugc

SEQ ID NO: 1805240 - RNA, 18 nt, Homo sapiens
caagcacuaaaaaguggc

SEQ ID NO: 1805241 - RNA, 13 nt, Homo sapiens
ugcuguugagaug

SEQ ID NO: 1805242 - RNA, 21 nt, Homo sapiens
ccaugaugcugagcccggaaa

SEQ ID NO: 1805243 - RNA, 22 nt, Homo sapiens
ucaaauuucuguucucucuucc

SEQ ID NO: 1805244 - RNA, 20 nt, Homo sapiens
aggaauauaugugugccuau

SEQ ID NO: 1805245 - RNA, 14 nt, Homo sapiens
uggccuucugggaa

SEQ ID NO: 1805246 - RNA, 19 nt, Homo sapiens
aacaucgcgaugggaaccg

SEQ ID NO: 1805247 - RNA, 23 nt, Homo sapiens
uaccugcucagcccugcaccaug

SEQ ID NO: 1805248 - RNA, 22 nt, Homo sapiens
ucccagguguuaacauuccaag

SEQ ID NO: 1805249 - RNA, 12 nt, Homo sapiens
gaaggacuauga

SEQ ID NO: 1805250 - RNA, 21 nt, Homo sapiens
cuccagggcuuugcuccagaa

SEQ ID NO: 1805251 - RNA, 13 nt, Homo sapiens
uccuuagugccag

SEQ ID NO: 1805252 - RNA, 14 nt, Homo sapiens
aaucuggucucuuc

SEQ ID NO: 1805253 - RNA, 23 nt, Homo sapiens
cauauucuaaguuagacucuucc

SEQ ID NO: 1805254 - RNA, 20 nt, Homo sapiens
guucuuucccacacugaaau

SEQ ID NO: 1805255 - RNA, 23 nt, Homo sapiens
caugccuucaaaucaaucuguaa

SEQ ID NO: 1805256 - RNA, 19 nt, Homo sapiens
gcgcaguggggugaucuca

SEQ ID NO: 1805257 - RNA, 16 nt, Homo sapiens
aagaagccacccuccu

SEQ ID NO: 1805258 - RNA, 18 nt, Homo sapiens
gccagagcaaacagaaaa

SEQ ID NO: 1805259 - RNA, 19 nt, Homo sapiens
ccuaaaguauaacaugucg

SEQ ID NO: 1805260 - RNA, 22 nt, Homo sapiens
acaaaaccuuuaaucugcaccu

SEQ ID NO: 1805261 - RNA, 10 nt, Homo sapiens
uuacuuugaa

SEQ ID NO: 1805262 - RNA, 16 nt, Homo sapiens
uuuauagcucucauca

SEQ ID NO: 1805263 - RNA, 20 nt, Homo sapiens
caaacugggaaccccuuucc

SEQ ID NO: 1805264 - RNA, 10 nt, Homo sapiens
ggcaguuuuu

SEQ ID NO: 1805265 - RNA, 14 nt, Homo sapiens
ucaucaguccugca

SEQ ID NO: 1805266 - RNA, 14 nt, Homo sapiens
cuuuaaguuuagaa

SEQ ID NO: 1805267 - RNA, 20 nt, Homo sapiens
aucaucuccaaaucuugcca

SEQ ID NO: 1805268 - RNA, 20 nt, Homo sapiens
ccaguuugcaccugucccca

SEQ ID NO: 1805269 - RNA, 16 nt, Homo sapiens
aggccugugugacucc

SEQ ID NO: 1805270 - RNA, 15 nt, Homo sapiens
cuccugguguuuuuc

SEQ ID NO: 1805271 - RNA, 22 nt, Homo sapiens
uucgggagggcacucacaugcc

SEQ ID NO: 1805272 - RNA, 15 nt, Homo sapiens
aaaugucaguccuug

SEQ ID NO: 1805273 - RNA, 19 nt, Homo sapiens
uucaaaacauuccaagaaa

SEQ ID NO: 1805274 - RNA, 14 nt, Homo sapiens
ugccagcacaaagu

SEQ ID NO: 1805275 - RNA, 21 nt, Homo sapiens
uacaacgauuguauuugugac

SEQ ID NO: 1805276 - RNA, 16 nt, Homo sapiens
uauuuaaaaugcauaa

SEQ ID NO: 1805277 - RNA, 14 nt, Homo sapiens
cugcucacagacau

SEQ ID NO: 1805278 - RNA, 19 nt, Homo sapiens
ccaccaaaugugcuuugag

SEQ ID NO: 1805279 - RNA, 19 nt, Homo sapiens
gguuuucgucaucuucccu

SEQ ID NO: 1805280 - RNA, 14 nt, Homo sapiens
ccugcauccaaucu

SEQ ID NO: 1805281 - RNA, 16 nt, Homo sapiens
aaaauauugacauuga

SEQ ID NO: 1805282 - RNA, 14 nt, Homo sapiens
uccugggauucaaa

SEQ ID NO: 1805283 - RNA, 23 nt, Homo sapiens
uuaaggccacacuggcaucuccc

SEQ ID NO: 1805284 - RNA, 14 nt, Homo sapiens
cccugcuuaccuga

SEQ ID NO: 1805285 - RNA, 14 nt, Homo sapiens
aaggacuucaggaa

SEQ ID NO: 1805286 - RNA, 17 nt, Homo sapiens
caggagccgcugcugag

SEQ ID NO: 1805287 - RNA, 21 nt, Homo sapiens
caaggucaugccacugcacuc

SEQ ID NO: 1805288 - RNA, 13 nt, Homo sapiens
gcaagacugucuc

SEQ ID NO: 1805289 - RNA, 16 nt, Homo sapiens
uuaaugauaaacucag

SEQ ID NO: 1805290 - RNA, 15 nt, Homo sapiens
cauauaucaaaguga

SEQ ID NO: 1805291 - RNA, 20 nt, Homo sapiens
uguuccacugcaaauaaagc

SEQ ID NO: 1805292 - RNA, 21 nt, Homo sapiens
uuuacgcuuaguuaucagcuu

SEQ ID NO: 1805293 - RNA, 15 nt, Homo sapiens
auuguacuaaagcca

SEQ ID NO: 1805294 - RNA, 13 nt, Homo sapiens
ucacaacaggcau

SEQ ID NO: 1805295 - RNA, 23 nt, Homo sapiens
aaacguacauacacacaaaaacu

SEQ ID NO: 1805296 - RNA, 23 nt, Homo sapiens
acccugagaaccccucugggaaa

SEQ ID NO: 1805297 - RNA, 17 nt, Homo sapiens
cuuugacaaauuacaaa

SEQ ID NO: 1805298 - RNA, 14 nt, Homo sapiens
agugaugccaugaa

SEQ ID NO: 1805299 - RNA, 14 nt, Homo sapiens
aggggagccagggu

SEQ ID NO: 1805300 - RNA, 18 nt, Homo sapiens
cccaggacccugaagggg

SEQ ID NO: 1805301 - RNA, 18 nt, Homo sapiens
ucaaugcuugauguuaca

SEQ ID NO: 1805302 - RNA, 15 nt, Homo sapiens
ugauauguaaaacag

SEQ ID NO: 1805303 - RNA, 22 nt, Homo sapiens
cuuuacaagauggguccaggau

SEQ ID NO: 1805304 - RNA, 19 nt, Homo sapiens
caccuucagaggcugaggu

SEQ ID NO: 1805305 - RNA, 19 nt, Homo sapiens
uggccagugagaucaaugu

SEQ ID NO: 1805306 - RNA, 12 nt, Homo sapiens
cucugauagcau

SEQ ID NO: 1805307 - RNA, 19 nt, Homo sapiens
uggaccacagcaugaaccu

SEQ ID NO: 1805308 - RNA, 16 nt, Homo sapiens
auguuuuaauuccaag

SEQ ID NO: 1805309 - RNA, 15 nt, Homo sapiens
cuuguaguaugcuua

SEQ ID NO: 1805310 - RNA, 18 nt, Homo sapiens
uccugagagcugcaugug

SEQ ID NO: 1805311 - RNA, 15 nt, Homo sapiens
augcagcauacaaaa

SEQ ID NO: 1805312 - RNA, 16 nt, Homo sapiens
auuacucugcucuuug

SEQ ID NO: 1805313 - RNA, 20 nt, Homo sapiens
gacuccacgaugccuuugag

SEQ ID NO: 1805314 - RNA, 16 nt, Homo sapiens
ccauccuacauaauac

SEQ ID NO: 1805315 - RNA, 17 nt, Homo sapiens
aaacauuuaacuuguuu

SEQ ID NO: 1805316 - RNA, 14 nt, Homo sapiens
cucauucagcaucu

SEQ ID NO: 1805317 - RNA, 14 nt, Homo sapiens
acagaggcauaucc

SEQ ID NO: 1805318 - RNA, 15 nt, Homo sapiens
uagaugaguccuguu

SEQ ID NO: 1805319 - RNA, 19 nt, Homo sapiens
uaaaaagugacacagcagc

SEQ ID NO: 1805320 - RNA, 13 nt, Homo sapiens
uguuauugccaau

SEQ ID NO: 1805321 - RNA, 16 nt, Homo sapiens
gaauauaccauuucaa

SEQ ID NO: 1805322 - RNA, 19 nt, Homo sapiens
cagcugccucugccacuga

SEQ ID NO: 1805323 - RNA, 19 nt, Homo sapiens
cucaggagcacagccauag

SEQ ID NO: 1805324 - RNA, 21 nt, Homo sapiens
aauggucagaggcgcaugaau

SEQ ID NO: 1805325 - RNA, 16 nt, Homo sapiens
ccucagcaagccaugc

SEQ ID NO: 1805326 - RNA, 21 nt, Homo sapiens
guaucugacaaaagguuugug

SEQ ID NO: 1805327 - RNA, 13 nt, Homo sapiens
caacccuaucucc

SEQ ID NO: 1805328 - RNA, 16 nt, Homo sapiens
acccugcccaccaaga

SEQ ID NO: 1805329 - RNA, 14 nt, Homo sapiens
acagggucucacuc

SEQ ID NO: 1805330 - RNA, 20 nt, Homo sapiens
cuguagagccgcauggcacu

SEQ ID NO: 1805331 - RNA, 21 nt, Homo sapiens
cuuuuaucucacaaauaagua

SEQ ID NO: 1805332 - RNA, 23 nt, Homo sapiens
gacagugguaaauauagaaccau

SEQ ID NO: 1805333 - RNA, 19 nt, Homo sapiens
uggauacaucugcugugug

SEQ ID NO: 1805334 - RNA, 15 nt, Homo sapiens
caaaaauuagcugug

SEQ ID NO: 1805335 - RNA, 13 nt, Homo sapiens
auguuaacuagaa

SEQ ID NO: 1805336 - RNA, 16 nt, Homo sapiens
acauuaaggaauuuga

SEQ ID NO: 1805337 - RNA, 13 nt, Homo sapiens
uguuguacuuuau

SEQ ID NO: 1805338 - RNA, 19 nt, Homo sapiens
aaaaugcaguccugaggag

SEQ ID NO: 1805339 - RNA, 13 nt, Homo sapiens
uuagagcugggaa

SEQ ID NO: 1805340 - RNA, 14 nt, Homo sapiens
agccugagagucua

SEQ ID NO: 1805341 - RNA, 20 nt, Homo sapiens
accuuuaaaguaaaggccuc

SEQ ID NO: 1805342 - RNA, 13 nt, Homo sapiens
gaguccuuaccuc

SEQ ID NO: 1805343 - RNA, 22 nt, Homo sapiens
gaucuccacaccaaagucaggg

SEQ ID NO: 1805344 - RNA, 14 nt, Homo sapiens
cauguccucaaaac

SEQ ID NO: 1805345 - RNA, 19 nt, Homo sapiens
gcuuccuaaguagcugggu

SEQ ID NO: 1805346 - RNA, 13 nt, Homo sapiens
ggugcaagcacuc

SEQ ID NO: 1805347 - RNA, 14 nt, Homo sapiens
augggagaaccucg

SEQ ID NO: 1805348 - RNA, 15 nt, Homo sapiens
caggugcaaguucau

SEQ ID NO: 1805349 - RNA, 15 nt, Homo sapiens
agauugaacacugcg

SEQ ID NO: 1805350 - RNA, 21 nt, Homo sapiens
caaaacaacagcaacaacaac

SEQ ID NO: 1805351 - RNA, 21 nt, Homo sapiens
auauuccuuugccaauucauu

SEQ ID NO: 1805352 - RNA, 15 nt, Homo sapiens
aauuacagcaaaaag

SEQ ID NO: 1805353 - RNA, 17 nt, Homo sapiens
cuucaaacccucaagag

SEQ ID NO: 1805354 - RNA, 15 nt, Homo sapiens
caucccucuacuuuc

SEQ ID NO: 1805355 - RNA, 23 nt, Homo sapiens
ccucugucugagacaggugccua

SEQ ID NO: 1805356 - RNA, 19 nt, Homo sapiens
auuucuaaauguuucccag

SEQ ID NO: 1805357 - RNA, 12 nt, Homo sapiens
aguccaucucaa

SEQ ID NO: 1805358 - RNA, 23 nt, Homo sapiens
uaucauguuaguaauaccucuaa

SEQ ID NO: 1805359 - RNA, 20 nt, Homo sapiens
augacuuuugguaaaggguu

SEQ ID NO: 1805360 - RNA, 13 nt, Homo sapiens
aacacacauggau

SEQ ID NO: 1805361 - RNA, 13 nt, Homo sapiens
ugcuuacaaaguc

SEQ ID NO: 1805362 - RNA, 15 nt, Homo sapiens
cccaacugacuugua

SEQ ID NO: 1805363 - RNA, 23 nt, Homo sapiens
guauuuaaaaauagaaacauauc

SEQ ID NO: 1805364 - RNA, 23 nt, Homo sapiens
uaaauucuauaggaacauaugaa

SEQ ID NO: 1805365 - RNA, 23 nt, Homo sapiens
acuugaaaugaggccuacucuaa

SEQ ID NO: 1805366 - RNA, 17 nt, Homo sapiens
acagagcgagacuccau

SEQ ID NO: 1805367 - RNA, 20 nt, Homo sapiens
uagccccuuagccaguugua

SEQ ID NO: 1805368 - RNA, 17 nt, Homo sapiens
ugaaauguagaauugaa

SEQ ID NO: 1805369 - RNA, 18 nt, Homo sapiens
aauccagcgguucucaaa

SEQ ID NO: 1805370 - RNA, 23 nt, Homo sapiens
acuagaucucccuuaauaaacuc

SEQ ID NO: 1805371 - RNA, 20 nt, Homo sapiens
uuacaacaguagagagggaa

SEQ ID NO: 1805372 - RNA, 16 nt, Homo sapiens
ucaucaggaagccugu

SEQ ID NO: 1805373 - RNA, 19 nt, Homo sapiens
uaucaaccuaaaugaguca

SEQ ID NO: 1805374 - RNA, 23 nt, Homo sapiens
cuggguuuauagaugugagccag

SEQ ID NO: 1805375 - RNA, 19 nt, Homo sapiens
aagcucuucccuugcucau

SEQ ID NO: 1805376 - RNA, 15 nt, Homo sapiens
ccauccuguuugaaa

SEQ ID NO: 1805377 - RNA, 21 nt, Homo sapiens
aucaggacugugaccaaagca

SEQ ID NO: 1805378 - RNA, 17 nt, Homo sapiens
guacuuaaauuacacau

SEQ ID NO: 1805379 - RNA, 20 nt, Homo sapiens
cagugccaccaucauagcuc

SEQ ID NO: 1805380 - RNA, 18 nt, Homo sapiens
gaagauuuaccacuugug

SEQ ID NO: 1805381 - RNA, 16 nt, Homo sapiens
aucccagcuaccucaa

SEQ ID NO: 1805382 - RNA, 19 nt, Homo sapiens
uccuguacaaucaugaaca

SEQ ID NO: 1805383 - RNA, 14 nt, Homo sapiens
uauaagcaacuuca

SEQ ID NO: 1805384 - RNA, 14 nt, Homo sapiens
uaaaagcaacauca

SEQ ID NO: 1805385 - RNA, 17 nt, Homo sapiens
auccaggaacacaugca

SEQ ID NO: 1805386 - RNA, 21 nt, Homo sapiens
ucaucaagaaauacuuucgaa

SEQ ID NO: 1805387 - RNA, 21 nt, Homo sapiens
cuauagucccagcuacucaga

SEQ ID NO: 1805388 - RNA, 15 nt, Homo sapiens
acagcagcaggaaug

SEQ ID NO: 1805389 - RNA, 15 nt, Homo sapiens
gaugcuguacaggua

SEQ ID NO: 1805390 - RNA, 13 nt, Homo sapiens
caggagcugcuca

SEQ ID NO: 1805391 - RNA, 21 nt, Homo sapiens
uuaagguuuguuuucauuaaa

SEQ ID NO: 1805392 - RNA, 21 nt, Homo sapiens
ugguggggcacggagggcagu

SEQ ID NO: 1805393 - RNA, 17 nt, Homo sapiens
uuaaucuaccuugcagu

SEQ ID NO: 1805394 - RNA, 14 nt, Homo sapiens
uucuggcugugcua

SEQ ID NO: 1805395 - RNA, 11 nt, Homo sapiens
gacccaauccc

SEQ ID NO: 1805396 - RNA, 13 nt, Homo sapiens
cuugguuuccuca

SEQ ID NO: 1805397 - RNA, 21 nt, Homo sapiens
auggcaugggggccucagggc

SEQ ID NO: 1805398 - RNA, 17 nt, Homo sapiens
cuaagccccguccccua

SEQ ID NO: 1805399 - RNA, 11 nt, Homo sapiens
cuuugugacca

SEQ ID NO: 1805400 - RNA, 12 nt, Homo sapiens
aauuuuugcaaa

SEQ ID NO: 1805401 - RNA, 12 nt, Homo sapiens
acuuuuugccaa

SEQ ID NO: 1805402 - RNA, 16 nt, Homo sapiens
aauacucugcagugau

SEQ ID NO: 1805403 - RNA, 16 nt, Homo sapiens
ggccacuugcucagac

SEQ ID NO: 1805404 - RNA, 17 nt, Homo sapiens
aacauacgggaaguuua

SEQ ID NO: 1805405 - RNA, 17 nt, Homo sapiens
uggguggagaagccauu

SEQ ID NO: 1805406 - RNA, 20 nt, Homo sapiens
cacucaggcuggaguacagu

SEQ ID NO: 1805407 - RNA, 20 nt, Homo sapiens
cacccaggcuggaguacagc

SEQ ID NO: 1805408 - RNA, 20 nt, Homo sapiens
agcuacucgggaggcugaga

SEQ ID NO: 1805409 - RNA, 19 nt, Homo sapiens
gacuaaccugcccacccac

SEQ ID NO: 1805410 - RNA, 23 nt, Homo sapiens
ccaggcuggaaugcaguggugcg

SEQ ID NO: 1805411 - RNA, 16 nt, Homo sapiens
cucuggagagacugug

SEQ ID NO: 1805412 - RNA, 15 nt, Homo sapiens
uuauaucagccugag

SEQ ID NO: 1805413 - RNA, 16 nt, Homo sapiens
ccacugagccugagau

SEQ ID NO: 1805414 - RNA, 11 nt, Homo sapiens
uucuucacucu

SEQ ID NO: 1805415 - RNA, 16 nt, Homo sapiens
ggaacuuuccagcagu

SEQ ID NO: 1805416 - RNA, 12 nt, Homo sapiens
ggugaaugagaa

SEQ ID NO: 1805417 - RNA, 16 nt, Homo sapiens
uaaagaagauaaacac

SEQ ID NO: 1805418 - RNA, 12 nt, Homo sapiens
cauuuguucuca

SEQ ID NO: 1805419 - RNA, 22 nt, Homo sapiens
gcugagauugagcagaagauca

SEQ ID NO: 1805420 - RNA, 17 nt, Homo sapiens
agaaucagacuaugaag

SEQ ID NO: 1805421 - RNA, 17 nt, Homo sapiens
cuugcuaccugugagca

SEQ ID NO: 1805422 - RNA, 12 nt, Homo sapiens
aguaucuuaccu

SEQ ID NO: 1805423 - RNA, 13 nt, Homo sapiens
ccuguuuguacug

SEQ ID NO: 1805424 - RNA, 24 nt, Homo sapiens
uguaaugccuuuucucaccuguca

SEQ ID NO: 1805425 - RNA, 15 nt, Homo sapiens
ccucucccucugguc

SEQ ID NO: 1805426 - RNA, 17 nt, Homo sapiens
ggcacugagaaagccaa

SEQ ID NO: 1805427 - RNA, 19 nt, Homo sapiens
aaucauaaauauaaucuaa

SEQ ID NO: 1805428 - RNA, 19 nt, Homo sapiens
accucacuguccugugaag

SEQ ID NO: 1805429 - RNA, 19 nt, Homo sapiens
caagacucugucucaaaaa

SEQ ID NO: 1805430 - RNA, 21 nt, Homo sapiens
agcccugcgccaccucacugc

SEQ ID NO: 1805431 - RNA, 21 nt, Homo sapiens
uugcugcaaacccaugaagcu

SEQ ID NO: 1805432 - RNA, 23 nt, Homo sapiens
cuguauaauagagauaaguccau

SEQ ID NO: 1805433 - RNA, 14 nt, Homo sapiens
aggaaugacaauaa

SEQ ID NO: 1805434 - RNA, 18 nt, Homo sapiens
cagcuggccccggagcca

SEQ ID NO: 1805435 - RNA, 14 nt, Homo sapiens
cuuauacccaugaa

SEQ ID NO: 1805436 - RNA, 13 nt, Homo sapiens
uccagaccugcuu

SEQ ID NO: 1805437 - RNA, 14 nt, Homo sapiens
guagcugcuaccuu

SEQ ID NO: 1805438 - RNA, 20 nt, Homo sapiens
cauguuuuaacaaaaaccaa

SEQ ID NO: 1805439 - RNA, 18 nt, Homo sapiens
cuaaacaagggcagugag

SEQ ID NO: 1805440 - RNA, 14 nt, Homo sapiens
acagggauucucac

SEQ ID NO: 1805441 - RNA, 19 nt, Homo sapiens
aucaguggacaaggggaga

SEQ ID NO: 1805442 - RNA, 22 nt, Homo sapiens
caaagaacucauuugaaugcuu

SEQ ID NO: 1805443 - RNA, 16 nt, Homo sapiens
ccucuuguugcugagu

SEQ ID NO: 1805444 - RNA, 14 nt, Homo sapiens
aaaacccacagaag

SEQ ID NO: 1805445 - RNA, 21 nt, Homo sapiens
cuauauguguauuauguaugc

SEQ ID NO: 1805446 - RNA, 16 nt, Homo sapiens
uacauauuugcacuga

SEQ ID NO: 1805447 - RNA, 20 nt, Homo sapiens
ucugaaaaaguauccugcuu

SEQ ID NO: 1805448 - RNA, 11 nt, Homo sapiens
augccacagac

SEQ ID NO: 1805449 - RNA, 22 nt, Homo sapiens
uacuuuuuuguuaauaagcaaa

SEQ ID NO: 1805450 - RNA, 22 nt, Homo sapiens
ucauaauuaaaauuuaucuuaa

SEQ ID NO: 1805451 - RNA, 17 nt, Homo sapiens
caggcaaagacugcagu

SEQ ID NO: 1805452 - RNA, 22 nt, Homo sapiens
caaaguuacugauucacugcau

SEQ ID NO: 1805453 - RNA, 17 nt, Homo sapiens
uuggauugcuggggcca

SEQ ID NO: 1805454 - RNA, 16 nt, Homo sapiens
ucccaccccaagcaaa

SEQ ID NO: 1805455 - RNA, 16 nt, Homo sapiens
uguaccauuugcaugg

SEQ ID NO: 1805456 - RNA, 18 nt, Homo sapiens
caggccauccauucacag

SEQ ID NO: 1805457 - RNA, 15 nt, Homo sapiens
ucuuucucugaggac

SEQ ID NO: 1805458 - RNA, 23 nt, Homo sapiens
cuuguggcuuugcaaccauuuuc

SEQ ID NO: 1805459 - RNA, 15 nt, Homo sapiens
acuggugcauuuaaa

SEQ ID NO: 1805460 - RNA, 13 nt, Homo sapiens
acaguugcauaga

SEQ ID NO: 1805461 - RNA, 17 nt, Homo sapiens
gucucgauuagacucca

SEQ ID NO: 1805462 - RNA, 21 nt, Homo sapiens
acaaaauguacgaaacuguau

SEQ ID NO: 1805463 - RNA, 13 nt, Homo sapiens
ggggucagggugc

SEQ ID NO: 1805464 - RNA, 20 nt, Homo sapiens
caauaugaaguuacuuucuu

SEQ ID NO: 1805465 - RNA, 19 nt, Homo sapiens
uccagcagaagacaaaaag

SEQ ID NO: 1805466 - RNA, 21 nt, Homo sapiens
gcaaacugcaugcccagagac

SEQ ID NO: 1805467 - RNA, 17 nt, Homo sapiens
cagggcugugugaaaca

SEQ ID NO: 1805468 - RNA, 17 nt, Homo sapiens
uuuucaacaaguaacuu

SEQ ID NO: 1805469 - RNA, 14 nt, Homo sapiens
aggcccuguccuaa

SEQ ID NO: 1805470 - RNA, 18 nt, Homo sapiens
cacucaaacauaacugug

SEQ ID NO: 1805471 - RNA, 15 nt, Homo sapiens
caggugucaccauca

SEQ ID NO: 1805472 - RNA, 19 nt, Homo sapiens
gaacuguggugccacauga

SEQ ID NO: 1805473 - RNA, 18 nt, Homo sapiens
ucuacugcaagacuuaaa

SEQ ID NO: 1805474 - RNA, 17 nt, Homo sapiens
ccaucugccagaucacc

SEQ ID NO: 1805475 - RNA, 14 nt, Homo sapiens
ccaaguccucauuu

SEQ ID NO: 1805476 - RNA, 14 nt, Homo sapiens
aaccuccuuuacca

SEQ ID NO: 1805477 - RNA, 15 nt, Homo sapiens
ggagugcaccaaaga

SEQ ID NO: 1805478 - RNA, 19 nt, Homo sapiens
uucuugaaauuuuaaccua

SEQ ID NO: 1805479 - RNA, 20 nt, Homo sapiens
gaauuuuuacccaauuggau

SEQ ID NO: 1805480 - RNA, 21 nt, Homo sapiens
cagaggaugcugacaucauuu

SEQ ID NO: 1805481 - RNA, 18 nt, Homo sapiens
cuuaacuggagaccagaa

SEQ ID NO: 1805482 - RNA, 14 nt, Homo sapiens
agaaacuccaauga

SEQ ID NO: 1805483 - RNA, 20 nt, Homo sapiens
gagucuugcucuguugccca

SEQ ID NO: 1805484 - RNA, 18 nt, Homo sapiens
uaagucaggaggaugcaa

SEQ ID NO: 1805485 - RNA, 22 nt, Homo sapiens
aauucuguauuaaggugucaua

SEQ ID NO: 1805486 - RNA, 13 nt, Homo sapiens
gcgccagcucuac

SEQ ID NO: 1805487 - RNA, 18 nt, Homo sapiens
cuccuugcccucaagcaa

SEQ ID NO: 1805488 - RNA, 16 nt, Homo sapiens
cuuucacccacagaaa

SEQ ID NO: 1805489 - RNA, 15 nt, Homo sapiens
gguggggugcacucg

SEQ ID NO: 1805490 - RNA, 18 nt, Homo sapiens
gaagcaaggcacaaguca

SEQ ID NO: 1805491 - RNA, 14 nt, Homo sapiens
uguucucuucuaua

SEQ ID NO: 1805492 - RNA, 16 nt, Homo sapiens
uacuccucucaucccc

SEQ ID NO: 1805493 - RNA, 16 nt, Homo sapiens
caaagccccccagcuc

SEQ ID NO: 1805494 - RNA, 14 nt, Homo sapiens
ccagcaucuggaag

SEQ ID NO: 1805495 - RNA, 15 nt, Homo sapiens
ugugagugugugcaa

SEQ ID NO: 1805496 - RNA, 23 nt, Homo sapiens
ucauuucauuguaugauguguug

SEQ ID NO: 1805497 - RNA, 23 nt, Homo sapiens
uuuaagaaaggaagcaacagaua

SEQ ID NO: 1805498 - RNA, 20 nt, Homo sapiens
cuugcuaaguuuucauagaa

SEQ ID NO: 1805499 - RNA, 23 nt, Homo sapiens
auggugcuuauuaagaccaaaga

SEQ ID NO: 1805500 - RNA, 20 nt, Homo sapiens
ugcuccauaguuuggcauuu

SEQ ID NO: 1805501 - RNA, 13 nt, Homo sapiens
ucccaccagagac

SEQ ID NO: 1805502 - RNA, 15 nt, Homo sapiens
uagguuccagcaugu

SEQ ID NO: 1805503 - RNA, 21 nt, Homo sapiens
ucacagagacucuguccuucc

SEQ ID NO: 1805504 - RNA, 12 nt, Homo sapiens
ccacggacucaa

SEQ ID NO: 1805505 - RNA, 21 nt, Homo sapiens
aaagcauucuucccugaaaag

SEQ ID NO: 1805506 - RNA, 18 nt, Homo sapiens
uugcacaguuaccugcac

SEQ ID NO: 1805507 - RNA, 23 nt, Homo sapiens
agacugcagccccagcugacacc

SEQ ID NO: 1805508 - RNA, 13 nt, Homo sapiens
cacagaagggugu

SEQ ID NO: 1805509 - RNA, 18 nt, Homo sapiens
cauagcagcuuauucaca

SEQ ID NO: 1805510 - RNA, 20 nt, Homo sapiens
ccaaggaauuucugcucugg

SEQ ID NO: 1805511 - RNA, 20 nt, Homo sapiens
augaaacaccuucucuggag

SEQ ID NO: 1805512 - RNA, 13 nt, Homo sapiens
augaagugcacag

SEQ ID NO: 1805513 - RNA, 20 nt, Homo sapiens
uggagaaaauggacguguua

SEQ ID NO: 1805514 - RNA, 15 nt, Homo sapiens
acucuucuagcauuu

SEQ ID NO: 1805515 - RNA, 16 nt, Homo sapiens
acugucucuccaguga

SEQ ID NO: 1805516 - RNA, 20 nt, Homo sapiens
aagcacauuauguuugcaac

SEQ ID NO: 1805517 - RNA, 16 nt, Homo sapiens
cacggucccccaggag

SEQ ID NO: 1805518 - RNA, 17 nt, Homo sapiens
acagcagccccugcaca

SEQ ID NO: 1805519 - RNA, 16 nt, Homo sapiens
gcagagccugagucac

SEQ ID NO: 1805520 - RNA, 15 nt, Homo sapiens
gacuugguugaacuu

SEQ ID NO: 1805521 - RNA, 20 nt, Homo sapiens
cuuccugggcagcccagaga

SEQ ID NO: 1805522 - RNA, 15 nt, Homo sapiens
aggagacacauucac

SEQ ID NO: 1805523 - RNA, 17 nt, Homo sapiens
ccucuccagagaggcuc

SEQ ID NO: 1805524 - RNA, 19 nt, Homo sapiens
gccuuucuuauuugcaaua

SEQ ID NO: 1805525 - RNA, 17 nt, Homo sapiens
cuaucacauuacaucau

SEQ ID NO: 1805526 - RNA, 20 nt, Homo sapiens
acagaccagcccuuccccau

SEQ ID NO: 1805527 - RNA, 17 nt, Homo sapiens
gucaauacugagccauu

SEQ ID NO: 1805528 - RNA, 16 nt, Homo sapiens
acaaaaccuuguguaa

SEQ ID NO: 1805529 - RNA, 19 nt, Homo sapiens
agucuugcucugucuccca

SEQ ID NO: 1805530 - RNA, 15 nt, Homo sapiens
ugguaaaaguauuug

SEQ ID NO: 1805531 - RNA, 20 nt, Homo sapiens
agggaagagugcauuuuccc

SEQ ID NO: 1805532 - RNA, 24 nt, Homo sapiens
aagccuccugcccccugccaguga

SEQ ID NO: 1805533 - RNA, 19 nt, Homo sapiens
ucaugaauucuucucaaag

SEQ ID NO: 1805534 - RNA, 15 nt, Homo sapiens
ccuaccaggacagaa

SEQ ID NO: 1805535 - RNA, 22 nt, Homo sapiens
gacuuguuucuuucugucucuc

SEQ ID NO: 1805536 - RNA, 18 nt, Homo sapiens
ccauuugcuaguucugcu

SEQ ID NO: 1805537 - RNA, 15 nt, Homo sapiens
aacaauaaaaugucu

SEQ ID NO: 1805538 - RNA, 15 nt, Homo sapiens
uucauuuauuugaca

SEQ ID NO: 1805539 - RNA, 21 nt, Homo sapiens
gaauaugauuaaaaauaucaa

SEQ ID NO: 1805540 - RNA, 23 nt, Homo sapiens
agagaaugaugcugugcauauca

SEQ ID NO: 1805541 - RNA, 21 nt, Homo sapiens
uguccccagcccuguccuggu

SEQ ID NO: 1805542 - RNA, 19 nt, Homo sapiens
ccagcaauuccugagccaa

SEQ ID NO: 1805543 - RNA, 21 nt, Homo sapiens
auaaucacauuaucaucugaa

SEQ ID NO: 1805544 - RNA, 18 nt, Homo sapiens
ucccagagauguugagaa

SEQ ID NO: 1805545 - RNA, 14 nt, Homo sapiens
auuuccagucucca

SEQ ID NO: 1805546 - RNA, 14 nt, Homo sapiens
uuucucagacuuua

SEQ ID NO: 1805547 - RNA, 15 nt, Homo sapiens
acacuaauacaccag

SEQ ID NO: 1805548 - RNA, 15 nt, Homo sapiens
uugacaguuugauaa

SEQ ID NO: 1805549 - RNA, 14 nt, Homo sapiens
gugccuaacaccag

SEQ ID NO: 1805550 - RNA, 18 nt, Homo sapiens
acuugaaguuuugguucu

SEQ ID NO: 1805551 - RNA, 21 nt, Homo sapiens
aacgggucugugggacuggcc

SEQ ID NO: 1805552 - RNA, 23 nt, Homo sapiens
ugcaaagcuuuugccugcaagag

SEQ ID NO: 1805553 - RNA, 15 nt, Homo sapiens
guuuucuuuuacuau

SEQ ID NO: 1805554 - RNA, 15 nt, Homo sapiens
ucucgguagcugugc

SEQ ID NO: 1805555 - RNA, 14 nt, Homo sapiens
uccugggucuacca

SEQ ID NO: 1805556 - RNA, 20 nt, Homo sapiens
aaaauugacuccccauugca

SEQ ID NO: 1805557 - RNA, 16 nt, Homo sapiens
uucuugggaaacaccc

SEQ ID NO: 1805558 - RNA, 16 nt, Homo sapiens
aaguguuccugucuca

SEQ ID NO: 1805559 - RNA, 16 nt, Homo sapiens
ucuucccacuuugcca

SEQ ID NO: 1805560 - RNA, 14 nt, Homo sapiens
guacuguacagggu

SEQ ID NO: 1805561 - RNA, 15 nt, Homo sapiens
augcuucuacuguga

SEQ ID NO: 1805562 - RNA, 13 nt, Homo sapiens
auuucuucacaaa

SEQ ID NO: 1805563 - RNA, 19 nt, Homo sapiens
auuuugucaaaucauggcc

SEQ ID NO: 1805564 - RNA, 18 nt, Homo sapiens
gcacucugggucuggcca

SEQ ID NO: 1805565 - RNA, 16 nt, Homo sapiens
uuucaaaacaauccuu

SEQ ID NO: 1805566 - RNA, 15 nt, Homo sapiens
ccauucagaugaaua

SEQ ID NO: 1805567 - RNA, 13 nt, Homo sapiens
uugccugccauuu

SEQ ID NO: 1805568 - RNA, 13 nt, Homo sapiens
guauugccacaau

SEQ ID NO: 1805569 - RNA, 12 nt, Homo sapiens
cagacugaaaua

SEQ ID NO: 1805570 - RNA, 20 nt, Homo sapiens
cgaacuccugaccucaggug

SEQ ID NO: 1805571 - RNA, 20 nt, Homo sapiens
cacaagaagaccagacugug

SEQ ID NO: 1805572 - RNA, 16 nt, Homo sapiens
aaacuacauuuugcaa

SEQ ID NO: 1805573 - RNA, 12 nt, Homo sapiens
cagcaauggaug

SEQ ID NO: 1805574 - RNA, 16 nt, Homo sapiens
gacaguaaacacucca

SEQ ID NO: 1805575 - RNA, 23 nt, Homo sapiens
auuuucgacguuugacuagccau

SEQ ID NO: 1805576 - RNA, 17 nt, Homo sapiens
gaagauaaauuggcuaa

SEQ ID NO: 1805577 - RNA, 13 nt, Homo sapiens
aacggacucagug

SEQ ID NO: 1805578 - RNA, 17 nt, Homo sapiens
gagcaagacuccauuuc

SEQ ID NO: 1805579 - RNA, 23 nt, Homo sapiens
agccaagucagcuuugccuucca

SEQ ID NO: 1805580 - RNA, 13 nt, Homo sapiens
aaaagcaaaauca

SEQ ID NO: 1805581 - RNA, 17 nt, Homo sapiens
uguucaaugaauauugu

SEQ ID NO: 1805582 - RNA, 15 nt, Homo sapiens
gaccucagugacuca

SEQ ID NO: 1805583 - RNA, 12 nt, Homo sapiens
cuucccacggcu

SEQ ID NO: 1805584 - RNA, 16 nt, Homo sapiens
aucucaucccuagucu

SEQ ID NO: 1805585 - RNA, 14 nt, Homo sapiens
aaaggacugugauu

SEQ ID NO: 1805586 - RNA, 21 nt, Homo sapiens
agccgagcggggagccaggaa

SEQ ID NO: 1805587 - RNA, 15 nt, Homo sapiens
cguacauaauacuga

SEQ ID NO: 1805588 - RNA, 19 nt, Homo sapiens
auguugauguguccgugaa

SEQ ID NO: 1805589 - RNA, 17 nt, Homo sapiens
aaaauggcaaaugcacu

SEQ ID NO: 1805590 - RNA, 16 nt, Homo sapiens
acauccauugucucuu

SEQ ID NO: 1805591 - RNA, 13 nt, Homo sapiens
aucuacaagccaa

SEQ ID NO: 1805592 - RNA, 14 nt, Homo sapiens
gucugagagcaaag

SEQ ID NO: 1805593 - RNA, 20 nt, Homo sapiens
aauccuuaacacauucaaua

SEQ ID NO: 1805594 - RNA, 15 nt, Homo sapiens
uguauauaugccuuu

SEQ ID NO: 1805595 - RNA, 19 nt, Homo sapiens
cagagaggggcagguugac

SEQ ID NO: 1805596 - RNA, 21 nt, Homo sapiens
ccuuuuccuuauuugccuucu

SEQ ID NO: 1805597 - RNA, 18 nt, Homo sapiens
gccuccccauacuuccug

SEQ ID NO: 1805598 - RNA, 17 nt, Homo sapiens
gucaacgugagcuggug

SEQ ID NO: 1805599 - RNA, 21 nt, Homo sapiens
ugcuccaagucuaggaacucc

SEQ ID NO: 1805600 - RNA, 14 nt, Homo sapiens
ccgcuuguacccag

SEQ ID NO: 1805601 - RNA, 14 nt, Homo sapiens
ccaccagaugcuga

SEQ ID NO: 1805602 - RNA, 14 nt, Homo sapiens
ccacccgaugcugc

SEQ ID NO: 1805603 - RNA, 21 nt, Homo sapiens
cccagcuccggccuguccucc

SEQ ID NO: 1805604 - RNA, 20 nt, Homo sapiens
cuaauaauaaauuaauaaca

SEQ ID NO: 1805605 - RNA, 22 nt, Homo sapiens
ccucuaggcccugugagcacaa

SEQ ID NO: 1805606 - RNA, 20 nt, Homo sapiens
uuuucugcuaccugguuuuc

SEQ ID NO: 1805607 - RNA, 11 nt, Homo sapiens
uguagauuuga

SEQ ID NO: 1805608 - RNA, 12 nt, Homo sapiens
uaucagugccau

SEQ ID NO: 1805609 - RNA, 23 nt, Homo sapiens
uaaaaaaaaaaaauggcuucaga

SEQ ID NO: 1805610 - RNA, 23 nt, Homo sapiens
uuaaggaugacagagaugugcau

SEQ ID NO: 1805611 - RNA, 13 nt, Homo sapiens
auguauacugcca

SEQ ID NO: 1805612 - RNA, 23 nt, Homo sapiens
uuuaguugauuauuuucugcuac

SEQ ID NO: 1805613 - RNA, 18 nt, Homo sapiens
agguuuauagaaagauag

SEQ ID NO: 1805614 - RNA, 17 nt, Homo sapiens
agccccagugacagcua

SEQ ID NO: 1805615 - RNA, 15 nt, Homo sapiens
agcuauucacagugc

SEQ ID NO: 1805616 - RNA, 17 nt, Homo sapiens
accaugggaaaugggaa

SEQ ID NO: 1805617 - RNA, 15 nt, Homo sapiens
ugaggaugucacuca

SEQ ID NO: 1805618 - RNA, 14 nt, Homo sapiens
gagacaguucaaga

SEQ ID NO: 1805619 - RNA, 15 nt, Homo sapiens
aaaggggaccccuau

SEQ ID NO: 1805620 - RNA, 18 nt, Homo sapiens
aauauaaaaacagacucu

SEQ ID NO: 1805621 - RNA, 21 nt, Homo sapiens
ccuucaugaugaauuacuucu

SEQ ID NO: 1805622 - RNA, 16 nt, Homo sapiens
acauuuaaaccuuuua

SEQ ID NO: 1805623 - RNA, 20 nt, Homo sapiens
cuggcuucaccgcauuccag

SEQ ID NO: 1805624 - RNA, 18 nt, Homo sapiens
guauaaaagggacugaga

SEQ ID NO: 1805625 - RNA, 21 nt, Homo sapiens
caaaagucaccacuccauucc

SEQ ID NO: 1805626 - RNA, 23 nt, Homo sapiens
ugcugggauggcuauauuaggca

SEQ ID NO: 1805627 - RNA, 18 nt, Homo sapiens
cuuuuuguuacagauuaa

SEQ ID NO: 1805628 - RNA, 20 nt, Homo sapiens
cuccugcaggugucuaucca

SEQ ID NO: 1805629 - RNA, 14 nt, Homo sapiens
ucaauguguacaag

SEQ ID NO: 1805630 - RNA, 16 nt, Homo sapiens
acuucagguuuuauca

SEQ ID NO: 1805631 - RNA, 15 nt, Homo sapiens
aacccugagcacucu

SEQ ID NO: 1805632 - RNA, 16 nt, Homo sapiens
ugaauaaaccaagaca

SEQ ID NO: 1805633 - RNA, 16 nt, Homo sapiens
auagcuucaucuugag

SEQ ID NO: 1805634 - RNA, 20 nt, Homo sapiens
agaccucggugggcauucac

SEQ ID NO: 1805635 - RNA, 23 nt, Homo sapiens
aaccccgagcugggggguuggca

SEQ ID NO: 1805636 - RNA, 22 nt, Homo sapiens
agcugggguggggaccucaggc

SEQ ID NO: 1805637 - RNA, 15 nt, Homo sapiens
ccuguccaugccccu

SEQ ID NO: 1805638 - RNA, 16 nt, Homo sapiens
caaguuucuaaauuga

SEQ ID NO: 1805639 - RNA, 14 nt, Homo sapiens
ccuacguuaaccca

SEQ ID NO: 1805640 - RNA, 18 nt, Homo sapiens
agaugaucagggauccaa

SEQ ID NO: 1805641 - RNA, 17 nt, Homo sapiens
uauaaagugcuugugua

SEQ ID NO: 1805642 - RNA, 15 nt, Homo sapiens
cccggccccaucaga

SEQ ID NO: 1805643 - RNA, 19 nt, Homo sapiens
cuuaauacucaugcauucu

SEQ ID NO: 1805644 - RNA, 16 nt, Homo sapiens
ugaccaaugggaugag

SEQ ID NO: 1805645 - RNA, 17 nt, Homo sapiens
ucacucuucaaaugccu

SEQ ID NO: 1805646 - RNA, 16 nt, Homo sapiens
auuuuauaagcauuua

SEQ ID NO: 1805647 - RNA, 20 nt, Homo sapiens
gagccgagaucaugccauug

SEQ ID NO: 1805648 - RNA, 22 nt, Homo sapiens
agagaguauuuuuauacaaacc

SEQ ID NO: 1805649 - RNA, 15 nt, Homo sapiens
cuaauucaguucuga

SEQ ID NO: 1805650 - RNA, 19 nt, Homo sapiens
aucaauagcaccccuacuc

SEQ ID NO: 1805651 - RNA, 16 nt, Homo sapiens
aauauguugaguucag

SEQ ID NO: 1805652 - RNA, 16 nt, Homo sapiens
cuggucaauaaaccac

SEQ ID NO: 1805653 - RNA, 16 nt, Homo sapiens
ucccaccuucacauug

SEQ ID NO: 1805654 - RNA, 14 nt, Homo sapiens
cucucuugccaaaa

SEQ ID NO: 1805655 - RNA, 14 nt, Homo sapiens
cauggggugaugcu

SEQ ID NO: 1805656 - RNA, 19 nt, Homo sapiens
ugaaccauucccuagucau

SEQ ID NO: 1805657 - RNA, 16 nt, Homo sapiens
agccaucauaacucac

SEQ ID NO: 1805658 - RNA, 19 nt, Homo sapiens
cagcccugaggugaaaggg

SEQ ID NO: 1805659 - RNA, 12 nt, Homo sapiens
cagugugacaag

SEQ ID NO: 1805660 - RNA, 16 nt, Homo sapiens
ccaccagcaguucccu

SEQ ID NO: 1805661 - RNA, 15 nt, Homo sapiens
gaggagcaagggugg

SEQ ID NO: 1805662 - RNA, 16 nt, Homo sapiens
aucuucuucagauuca

SEQ ID NO: 1805663 - RNA, 14 nt, Homo sapiens
auggguuagugcua

SEQ ID NO: 1805664 - RNA, 20 nt, Homo sapiens
auagagaucauccuuuccag

SEQ ID NO: 1805665 - RNA, 15 nt, Homo sapiens
aggacaguggaugcu

SEQ ID NO: 1805666 - RNA, 15 nt, Homo sapiens
auuucuugcaauuug

SEQ ID NO: 1805667 - RNA, 17 nt, Homo sapiens
accuugaccgacaugaa

SEQ ID NO: 1805668 - RNA, 11 nt, Homo sapiens
cagcauaccuu

SEQ ID NO: 1805669 - RNA, 17 nt, Homo sapiens
agagaauaaaaaaugua

SEQ ID NO: 1805670 - RNA, 16 nt, Homo sapiens
cggggucacuugcaau

SEQ ID NO: 1805671 - RNA, 22 nt, Homo sapiens
ucagaggaaaagggcaaaaaga

SEQ ID NO: 1805672 - RNA, 19 nt, Homo sapiens
agcagacgggcaaguggag

SEQ ID NO: 1805673 - RNA, 15 nt, Homo sapiens
ugacauuuugcagaa

SEQ ID NO: 1805674 - RNA, 16 nt, Homo sapiens
uauauaucaguuugau

SEQ ID NO: 1805675 - RNA, 21 nt, Homo sapiens
ggcuccugguuguuccucuca

SEQ ID NO: 1805676 - RNA, 16 nt, Homo sapiens
uaccagguuaccucac

SEQ ID NO: 1805677 - RNA, 13 nt, Homo sapiens
cagcaggaugcuc

SEQ ID NO: 1805678 - RNA, 21 nt, Homo sapiens
cggaagaacccucaggucaca

SEQ ID NO: 1805679 - RNA, 14 nt, Homo sapiens
uagaauuaugcugu

SEQ ID NO: 1805680 - RNA, 13 nt, Homo sapiens
ucuuagugucacu

SEQ ID NO: 1805681 - RNA, 18 nt, Homo sapiens
gcccaguuucacugccau

SEQ ID NO: 1805682 - RNA, 21 nt, Homo sapiens
gcacacacuguguacaguaaa

SEQ ID NO: 1805683 - RNA, 13 nt, Homo sapiens
auaagucucuagc

SEQ ID NO: 1805684 - RNA, 22 nt, Homo sapiens
gaaauggcagucugccugccuc

SEQ ID NO: 1805685 - RNA, 12 nt, Homo sapiens
ugaauccaagac

SEQ ID NO: 1805686 - RNA, 19 nt, Homo sapiens
ucccccucgcccuaugcaa

SEQ ID NO: 1805687 - RNA, 21 nt, Homo sapiens
aucaccaugaacaaagauaua

SEQ ID NO: 1805688 - RNA, 18 nt, Homo sapiens
gucuaggaacauacuuca

SEQ ID NO: 1805689 - RNA, 13 nt, Homo sapiens
aagcagcagggga

SEQ ID NO: 1805690 - RNA, 12 nt, Homo sapiens
aucuguccaaaa

SEQ ID NO: 1805691 - RNA, 23 nt, Homo sapiens
aguccaucuccagcauguaacug

SEQ ID NO: 1805692 - RNA, 10 nt, Homo sapiens
uggguucucu

SEQ ID NO: 1805693 - RNA, 16 nt, Homo sapiens
gcauagcagcugcuac

SEQ ID NO: 1805694 - RNA, 16 nt, Homo sapiens
aggguagggcacaaag

SEQ ID NO: 1805695 - RNA, 19 nt, Homo sapiens
gcaaauuaguugguuugug

SEQ ID NO: 1805696 - RNA, 12 nt, Homo sapiens
aggcuagaugau

SEQ ID NO: 1805697 - RNA, 20 nt, Homo sapiens
ccaggguuguuagaucuucu

SEQ ID NO: 1805698 - RNA, 21 nt, Homo sapiens
aucccaacaccaaacucuuaa

SEQ ID NO: 1805699 - RNA, 15 nt, Homo sapiens
uugcagacaguccuu

SEQ ID NO: 1805700 - RNA, 23 nt, Homo sapiens
cagccacauugagacuuucuucu

SEQ ID NO: 1805701 - RNA, 14 nt, Homo sapiens
ugauacccugaauu

SEQ ID NO: 1805702 - RNA, 11 nt, Homo sapiens
uuaaagcauuu

SEQ ID NO: 1805703 - RNA, 11 nt, Homo sapiens
cuaaagcacuu

SEQ ID NO: 1805704 - RNA, 23 nt, Homo sapiens
ggcuuccagaggagaguggccug

SEQ ID NO: 1805705 - RNA, 18 nt, Homo sapiens
cugccagccgcuggugcc

SEQ ID NO: 1805706 - RNA, 17 nt, Homo sapiens
gggcugggcaaggaaaa

SEQ ID NO: 1805707 - RNA, 21 nt, Homo sapiens
aacgcacacaguaucuaguca

SEQ ID NO: 1805708 - RNA, 23 nt, Homo sapiens
cagcccugcgccaccucacugca

SEQ ID NO: 1805709 - RNA, 15 nt, Homo sapiens
aggcucagauuguaa

SEQ ID NO: 1805710 - RNA, 14 nt, Homo sapiens
ccaaaguaaauguc

SEQ ID NO: 1805711 - RNA, 18 nt, Homo sapiens
cuggacugcacacuucca

SEQ ID NO: 1805712 - RNA, 18 nt, Homo sapiens
ugcaauuguggaucuuga

SEQ ID NO: 1805713 - RNA, 21 nt, Homo sapiens
ugggaagaugugcaacacaaa

SEQ ID NO: 1805714 - RNA, 18 nt, Homo sapiens
acugagaccauccuggcu

SEQ ID NO: 1805715 - RNA, 17 nt, Homo sapiens
cuugccugaacuccugc

SEQ ID NO: 1805716 - RNA, 18 nt, Homo sapiens
uucagguacuaaauaccu

SEQ ID NO: 1805717 - RNA, 15 nt, Homo sapiens
aauuauaagggcaaa

SEQ ID NO: 1805718 - RNA, 21 nt, Homo sapiens
ucccuagauagcuauuaagau

SEQ ID NO: 1805719 - RNA, 22 nt, Homo sapiens
ugccacauggagcuugacuuca

SEQ ID NO: 1805720 - RNA, 18 nt, Homo sapiens
uguagcuuuuaugugaua

SEQ ID NO: 1805721 - RNA, 16 nt, Homo sapiens
caagacaauuguugaa

SEQ ID NO: 1805722 - RNA, 15 nt, Homo sapiens
acuacagaaguggaa

SEQ ID NO: 1805723 - RNA, 17 nt, Homo sapiens
aggcugccugugugcau

SEQ ID NO: 1805724 - RNA, 16 nt, Homo sapiens
uuucagaacuuugaga

SEQ ID NO: 1805725 - RNA, 17 nt, Homo sapiens
ugucccuuggaacucuu

SEQ ID NO: 1805726 - RNA, 14 nt, Homo sapiens
cucuugaucugugu

SEQ ID NO: 1805727 - RNA, 15 nt, Homo sapiens
uuccaaaugcccaag

SEQ ID NO: 1805728 - RNA, 17 nt, Homo sapiens
gcucagagggaccucac

SEQ ID NO: 1805729 - RNA, 19 nt, Homo sapiens
ugguuuuuaaguacucacu

SEQ ID NO: 1805730 - RNA, 21 nt, Homo sapiens
uagaucuaguuuagaaaacau

SEQ ID NO: 1805731 - RNA, 18 nt, Homo sapiens
uugccugaauccaccugc

SEQ ID NO: 1805732 - RNA, 13 nt, Homo sapiens
aaacgauuuacca

SEQ ID NO: 1805733 - RNA, 13 nt, Homo sapiens
ugcaauuccaaga

SEQ ID NO: 1805734 - RNA, 23 nt, Homo sapiens
uguggcccuucuguccaccagac

SEQ ID NO: 1805735 - RNA, 16 nt, Homo sapiens
cagacucaguuuguca

SEQ ID NO: 1805736 - RNA, 23 nt, Homo sapiens
augacaugccacccucuccaugc

SEQ ID NO: 1805737 - RNA, 16 nt, Homo sapiens
uuacagugacugugga

SEQ ID NO: 1805738 - RNA, 10 nt, Homo sapiens
agacugauga

SEQ ID NO: 1805739 - RNA, 17 nt, Homo sapiens
agcucagccgugcacuc

SEQ ID NO: 1805740 - RNA, 13 nt, Homo sapiens
cuccuucccgccg

SEQ ID NO: 1805741 - RNA, 18 nt, Homo sapiens
ccugaggaaguuuugcau

SEQ ID NO: 1805742 - RNA, 18 nt, Homo sapiens
gagggcauauacagugaa

SEQ ID NO: 1805743 - RNA, 14 nt, Homo sapiens
aucuggaaccauca

SEQ ID NO: 1805744 - RNA, 11 nt, Homo sapiens
gaaucuucucu

SEQ ID NO: 1805745 - RNA, 14 nt, Homo sapiens
gcagagccaggaag

SEQ ID NO: 1805746 - RNA, 13 nt, Homo sapiens
acguuugcuuaaa

SEQ ID NO: 1805747 - RNA, 20 nt, Homo sapiens
uauauccagauggcaugugu

SEQ ID NO: 1805748 - RNA, 20 nt, Homo sapiens
auccuguauaagcacugaaa

SEQ ID NO: 1805749 - RNA, 14 nt, Homo sapiens
auuuucauucuguu

SEQ ID NO: 1805750 - RNA, 12 nt, Homo sapiens
caaaccugugua

SEQ ID NO: 1805751 - RNA, 17 nt, Homo sapiens
ggacaggugaauggagg

SEQ ID NO: 1805752 - RNA, 19 nt, Homo sapiens
uuagauucugaccaugacu

SEQ ID NO: 1805753 - RNA, 14 nt, Homo sapiens
aaggccuaccccag

SEQ ID NO: 1805754 - RNA, 15 nt, Homo sapiens
acucuugacagcagg

SEQ ID NO: 1805755 - RNA, 15 nt, Homo sapiens
aggcuggccagucca

SEQ ID NO: 1805756 - RNA, 23 nt, Homo sapiens
uaggauaacuggcacccagagaa

SEQ ID NO: 1805757 - RNA, 18 nt, Homo sapiens
ucuuagaaauacuuguga

SEQ ID NO: 1805758 - RNA, 20 nt, Homo sapiens
gucuguagcuccucaacuca

SEQ ID NO: 1805759 - RNA, 22 nt, Homo sapiens
uuuauuuuuuuaaaacacaaau

SEQ ID NO: 1805760 - RNA, 11 nt, Homo sapiens
gcuugccaaau

SEQ ID NO: 1805761 - RNA, 11 nt, Homo sapiens
gccugccaaac

SEQ ID NO: 1805762 - RNA, 21 nt, Homo sapiens
ucuccauuuucuucucuguga

SEQ ID NO: 1805763 - RNA, 12 nt, Homo sapiens
gcugccacucua

SEQ ID NO: 1805764 - RNA, 15 nt, Homo sapiens
aagacugaauuccaa

SEQ ID NO: 1805765 - RNA, 22 nt, Homo sapiens
cguggacucugcacaugucuug

SEQ ID NO: 1805766 - RNA, 14 nt, Homo sapiens
augguaacugauga

SEQ ID NO: 1805767 - RNA, 23 nt, Homo sapiens
aagcugcacaugugccacacagu

SEQ ID NO: 1805768 - RNA, 23 nt, Homo sapiens
gcccucacugucagucccacugc

SEQ ID NO: 1805769 - RNA, 15 nt, Homo sapiens
gcauuuacucucuua

SEQ ID NO: 1805770 - RNA, 12 nt, Homo sapiens
uucugugagaau

SEQ ID NO: 1805771 - RNA, 15 nt, Homo sapiens
aaacugugaagcauu

SEQ ID NO: 1805772 - RNA, 21 nt, Homo sapiens
auuacuguuuugggccuccau

SEQ ID NO: 1805773 - RNA, 22 nt, Homo sapiens
uaaaauauguaguugugucuua

SEQ ID NO: 1805774 - RNA, 19 nt, Homo sapiens
gacaacaccuuccuccugc

SEQ ID NO: 1805775 - RNA, 23 nt, Homo sapiens
gggggaguaagaaugugugugca

SEQ ID NO: 1805776 - RNA, 14 nt, Homo sapiens
ugaaccgcacagcu

SEQ ID NO: 1805777 - RNA, 14 nt, Homo sapiens
aguaaugcucugac

SEQ ID NO: 1805778 - RNA, 13 nt, Homo sapiens
uuuugccacuuag

SEQ ID NO: 1805779 - RNA, 13 nt, Homo sapiens
cauuaccauauaa

SEQ ID NO: 1805780 - RNA, 20 nt, Homo sapiens
agacugaguacguugugcau

SEQ ID NO: 1805781 - RNA, 15 nt, Homo sapiens
caaucuaaccacauc

SEQ ID NO: 1805782 - RNA, 14 nt, Homo sapiens
gauugcagacuguu

SEQ ID NO: 1805783 - RNA, 20 nt, Homo sapiens
auaaguccuuguguagcaaa

SEQ ID NO: 1805784 - RNA, 22 nt, Homo sapiens
aaccucauccaggcuaccaucc

SEQ ID NO: 1805785 - RNA, 19 nt, Homo sapiens
uccaugauguuuuccauga

SEQ ID NO: 1805786 - RNA, 15 nt, Homo sapiens
cagguggcauuugca

SEQ ID NO: 1805787 - RNA, 17 nt, Homo sapiens
ucuaaguucaagaagac

SEQ ID NO: 1805788 - RNA, 16 nt, Homo sapiens
ccaauccuaguugucu

SEQ ID NO: 1805789 - RNA, 17 nt, Homo sapiens
cagcccuugcuuggcca

SEQ ID NO: 1805790 - RNA, 15 nt, Homo sapiens
ucccuuguccugcuu

SEQ ID NO: 1805791 - RNA, 22 nt, Homo sapiens
cauugcacuaaaagugauguga

SEQ ID NO: 1805792 - RNA, 15 nt, Homo sapiens
uauugugguauugaa

SEQ ID NO: 1805793 - RNA, 15 nt, Homo sapiens
cugacgaagaagcaa

SEQ ID NO: 1805794 - RNA, 21 nt, Homo sapiens
cuugagcaaucucccuugucc

SEQ ID NO: 1805795 - RNA, 14 nt, Homo sapiens
gaguuucuuaacuu

SEQ ID NO: 1805796 - RNA, 16 nt, Homo sapiens
ugacgugccuaccucu

SEQ ID NO: 1805797 - RNA, 12 nt, Homo sapiens
aagaaucugcuc

SEQ ID NO: 1805798 - RNA, 16 nt, Homo sapiens
uucuuguacucuacaa

SEQ ID NO: 1805799 - RNA, 19 nt, Homo sapiens
acaguguguuggugcuuua

SEQ ID NO: 1805800 - RNA, 21 nt, Homo sapiens
ucuccagguccucuacuuaau

SEQ ID NO: 1805801 - RNA, 19 nt, Homo sapiens
acccaguagaugccacuag

SEQ ID NO: 1805802 - RNA, 13 nt, Homo sapiens
ggcaaaugccuga

SEQ ID NO: 1805803 - RNA, 16 nt, Homo sapiens
ccugucauuguauuca

SEQ ID NO: 1805804 - RNA, 22 nt, Homo sapiens
gcaaagauuauuuucauuuauc

SEQ ID NO: 1805805 - RNA, 22 nt, Homo sapiens
uuacaggugugagccaccacgc

SEQ ID NO: 1805806 - RNA, 16 nt, Homo sapiens
acucuuaaggcauuga

SEQ ID NO: 1805807 - RNA, 13 nt, Homo sapiens
aguucagugcuca

SEQ ID NO: 1805808 - RNA, 22 nt, Homo sapiens
cauccugcucaggaaaccacaa

SEQ ID NO: 1805809 - RNA, 19 nt, Homo sapiens
cugccuuuagccuggacca

SEQ ID NO: 1805810 - RNA, 20 nt, Homo sapiens
cagccucgcgggugucacau

SEQ ID NO: 1805811 - RNA, 19 nt, Homo sapiens
aauagacuuaauacaugca

SEQ ID NO: 1805812 - RNA, 16 nt, Homo sapiens
ucaccccccacacuca

SEQ ID NO: 1805813 - RNA, 19 nt, Homo sapiens
aucugaacacauacuagaa

SEQ ID NO: 1805814 - RNA, 21 nt, Homo sapiens
uucaggcccccgccuuggccu

SEQ ID NO: 1805815 - RNA, 18 nt, Homo sapiens
uccgccaaacacuccacc

SEQ ID NO: 1805816 - RNA, 18 nt, Homo sapiens
auguguguguguauauau

SEQ ID NO: 1805817 - RNA, 19 nt, Homo sapiens
ccccacauugcacuucugg

SEQ ID NO: 1805818 - RNA, 18 nt, Homo sapiens
gccaccacucaagcaaca

SEQ ID NO: 1805819 - RNA, 22 nt, Homo sapiens
aagaaaaguuuuguaaauuucu

SEQ ID NO: 1805820 - RNA, 18 nt, Homo sapiens
agccaaauccauccugcu

SEQ ID NO: 1805821 - RNA, 16 nt, Homo sapiens
augaugaaacauucau

SEQ ID NO: 1805822 - RNA, 14 nt, Homo sapiens
aaauuaugccauag

SEQ ID NO: 1805823 - RNA, 19 nt, Homo sapiens
accggugcaugaugcugcc

SEQ ID NO: 1805824 - RNA, 12 nt, Homo sapiens
uaugaugcaguu

SEQ ID NO: 1805825 - RNA, 22 nt, Homo sapiens
cucuauuuugugaugaugcugu

SEQ ID NO: 1805826 - RNA, 23 nt, Homo sapiens
aggccaguaaucccagugacuua

SEQ ID NO: 1805827 - RNA, 16 nt, Homo sapiens
ggcucuguauucugca

SEQ ID NO: 1805828 - RNA, 19 nt, Homo sapiens
ucagucugugccuacaugu

SEQ ID NO: 1805829 - RNA, 15 nt, Homo sapiens
cauauguauguguga

SEQ ID NO: 1805830 - RNA, 23 nt, Homo sapiens
auucagaguagaaccacuugugg

SEQ ID NO: 1805831 - RNA, 22 nt, Homo sapiens
aucacucuaauuaauuguaauc

SEQ ID NO: 1805832 - RNA, 17 nt, Homo sapiens
uucgcguauuucaggau

SEQ ID NO: 1805833 - RNA, 11 nt, Homo sapiens
cauccaagaga

SEQ ID NO: 1805834 - RNA, 22 nt, Homo sapiens
agcggaaagcccugugcuccau

SEQ ID NO: 1805835 - RNA, 17 nt, Homo sapiens
agugccacaaagcucaa

SEQ ID NO: 1805836 - RNA, 18 nt, Homo sapiens
ucuguccugauuucuaca

SEQ ID NO: 1805837 - RNA, 22 nt, Homo sapiens
ucuucuauggguuggacaaccu

SEQ ID NO: 1805838 - RNA, 14 nt, Homo sapiens
acaagcaauaacuc

SEQ ID NO: 1805839 - RNA, 13 nt, Homo sapiens
ucuggagccagag

SEQ ID NO: 1805840 - RNA, 13 nt, Homo sapiens
gaauggcucaggg

SEQ ID NO: 1805841 - RNA, 23 nt, Homo sapiens
gaacguguauguaccuaggauau

SEQ ID NO: 1805842 - RNA, 13 nt, Homo sapiens
ucaagaaagcccu

SEQ ID NO: 1805843 - RNA, 17 nt, Homo sapiens
cacuuuuuguuguucau

SEQ ID NO: 1805844 - RNA, 20 nt, Homo sapiens
aguuuaacaaccauuuaacu

SEQ ID NO: 1805845 - RNA, 18 nt, Homo sapiens
acaguccuguccucugga

SEQ ID NO: 1805846 - RNA, 22 nt, Homo sapiens
gcaggugaccuucugggaaaug

SEQ ID NO: 1805847 - RNA, 15 nt, Homo sapiens
aauaaaauguguaca

SEQ ID NO: 1805848 - RNA, 21 nt, Homo sapiens
caggcuggcgcagccaaggcc

SEQ ID NO: 1805849 - RNA, 21 nt, Homo sapiens
aagcuuuuuccuccuggaaca

SEQ ID NO: 1805850 - RNA, 21 nt, Homo sapiens
ugauggaaauacacuguuauc

SEQ ID NO: 1805851 - RNA, 14 nt, Homo sapiens
accuuuauagcuca

SEQ ID NO: 1805852 - RNA, 18 nt, Homo sapiens
augaucuuguuacuguga

SEQ ID NO: 1805853 - RNA, 15 nt, Homo sapiens
uuaccccucacaauc

SEQ ID NO: 1805854 - RNA, 15 nt, Homo sapiens
ucccuucacauaguu

SEQ ID NO: 1805855 - RNA, 22 nt, Homo sapiens
cucucacuggcugggaaacccu

SEQ ID NO: 1805856 - RNA, 13 nt, Homo sapiens
gcuuuugcauuuc

SEQ ID NO: 1805857 - RNA, 14 nt, Homo sapiens
gacauguagcuucu

SEQ ID NO: 1805858 - RNA, 17 nt, Homo sapiens
aaugaagcccuauuacu

SEQ ID NO: 1805859 - RNA, 15 nt, Homo sapiens
auuuuuaggcaaaga

SEQ ID NO: 1805860 - RNA, 23 nt, Homo sapiens
accucgcccggcccgaucuuucu

SEQ ID NO: 1805861 - RNA, 17 nt, Homo sapiens
auuauugucugauugaa

SEQ ID NO: 1805862 - RNA, 17 nt, Homo sapiens
uugucucuaguugacuu

SEQ ID NO: 1805863 - RNA, 15 nt, Homo sapiens
agaauuuccacugua

SEQ ID NO: 1805864 - RNA, 16 nt, Homo sapiens
aacauuggugcaaaga

SEQ ID NO: 1805865 - RNA, 15 nt, Homo sapiens
uacuuagaaugccau

SEQ ID NO: 1805866 - RNA, 18 nt, Homo sapiens
ugacagaacgagacucca

SEQ ID NO: 1805867 - RNA, 22 nt, Homo sapiens
cugcuccuccccuuucacaggu

SEQ ID NO: 1805868 - RNA, 14 nt, Homo sapiens
uacccugaaguguu

SEQ ID NO: 1805869 - RNA, 13 nt, Homo sapiens
agcuccugauguc

SEQ ID NO: 1805870 - RNA, 19 nt, Homo sapiens
ucuacagugauagagcaaa

SEQ ID NO: 1805871 - RNA, 14 nt, Homo sapiens
uuuuuacagcaaaa

SEQ ID NO: 1805872 - RNA, 19 nt, Homo sapiens
uucaauaugcaagcagcuu

SEQ ID NO: 1805873 - RNA, 19 nt, Homo sapiens
acgaccccugccucgaggg

SEQ ID NO: 1805874 - RNA, 19 nt, Homo sapiens
ucccaucuggaccugguac

SEQ ID NO: 1805875 - RNA, 16 nt, Homo sapiens
aucuagaaauguucac

SEQ ID NO: 1805876 - RNA, 13 nt, Homo sapiens
ugccaacauuuaa

SEQ ID NO: 1805877 - RNA, 20 nt, Homo sapiens
cuuccucuuccccuuuacca

SEQ ID NO: 1805878 - RNA, 23 nt, Homo sapiens
auacauuguauuaauaccaaagu

SEQ ID NO: 1805879 - RNA, 20 nt, Homo sapiens
cacgcuggacagcacucugc

SEQ ID NO: 1805880 - RNA, 15 nt, Homo sapiens
gcgaggccuauuguu

SEQ ID NO: 1805881 - RNA, 12 nt, Homo sapiens
cagcuucuaacu

SEQ ID NO: 1805882 - RNA, 16 nt, Homo sapiens
ugugggccaccagaga

SEQ ID NO: 1805883 - RNA, 10 nt, Homo sapiens
ggccacagac

SEQ ID NO: 1805884 - RNA, 20 nt, Homo sapiens
gaacaguuaagcagccgcca

SEQ ID NO: 1805885 - RNA, 20 nt, Homo sapiens
gucuugcuuacuguacagaa

SEQ ID NO: 1805886 - RNA, 15 nt, Homo sapiens
cucuucagugacucc

SEQ ID NO: 1805887 - RNA, 17 nt, Homo sapiens
aaggcguccuuuuggua

SEQ ID NO: 1805888 - RNA, 14 nt, Homo sapiens
aauuucuauuugau

SEQ ID NO: 1805889 - RNA, 13 nt, Homo sapiens
gcugcccaucagg

SEQ ID NO: 1805890 - RNA, 16 nt, Homo sapiens
cucucugcugggucuc

SEQ ID NO: 1805891 - RNA, 22 nt, Homo sapiens
auauaauuuauaagcauugcca

SEQ ID NO: 1805892 - RNA, 22 nt, Homo sapiens
ucugcucugugccugggaucag

SEQ ID NO: 1805893 - RNA, 15 nt, Homo sapiens
aguuuucaaaacaca

SEQ ID NO: 1805894 - RNA, 15 nt, Homo sapiens
uaucaccaugauuua

SEQ ID NO: 1805895 - RNA, 20 nt, Homo sapiens
caaaacaaaaaaacccaggg

SEQ ID NO: 1805896 - RNA, 18 nt, Homo sapiens
gauugaauuaaaacagcu

SEQ ID NO: 1805897 - RNA, 20 nt, Homo sapiens
cucaucccaacaaacuuuaa

SEQ ID NO: 1805898 - RNA, 23 nt, Homo sapiens
caagcaguuaguuccuucaugau

SEQ ID NO: 1805899 - RNA, 12 nt, Homo sapiens
cacuccaugagu

SEQ ID NO: 1805900 - RNA, 17 nt, Homo sapiens
aagcaggugaacuggga

SEQ ID NO: 1805901 - RNA, 18 nt, Homo sapiens
aaaggaagacuggagaaa

SEQ ID NO: 1805902 - RNA, 12 nt, Homo sapiens
aaacuccaaagu

SEQ ID NO: 1805903 - RNA, 14 nt, Homo sapiens
ugugaguccaaaga

SEQ ID NO: 1805904 - RNA, 15 nt, Homo sapiens
aguaggaagacuuug

SEQ ID NO: 1805905 - RNA, 22 nt, Homo sapiens
gcuucccucucagcugcuggga

SEQ ID NO: 1805906 - RNA, 22 nt, Homo sapiens
cuuaacuaaauuugucuuucaa

SEQ ID NO: 1805907 - RNA, 16 nt, Homo sapiens
ugaaaagcuccaucaa

SEQ ID NO: 1805908 - RNA, 14 nt, Homo sapiens
uaauucagcacuua

SEQ ID NO: 1805909 - RNA, 19 nt, Homo sapiens
uauuuagaaauagaacuac

SEQ ID NO: 1805910 - RNA, 20 nt, Homo sapiens
auucuaauaaugcacucagu

SEQ ID NO: 1805911 - RNA, 12 nt, Homo sapiens
auugagguucuc

SEQ ID NO: 1805912 - RNA, 17 nt, Homo sapiens
agagaaauuucucauca

SEQ ID NO: 1805913 - RNA, 13 nt, Homo sapiens
guggcagugcuug

SEQ ID NO: 1805914 - RNA, 13 nt, Homo sapiens
cuuaauguuucca

SEQ ID NO: 1805915 - RNA, 13 nt, Homo sapiens
uaccuugucauau

SEQ ID NO: 1805916 - RNA, 14 nt, Homo sapiens
aagcagcuuacuua

SEQ ID NO: 1805917 - RNA, 14 nt, Homo sapiens
aaaagagaccaaaa

SEQ ID NO: 1805918 - RNA, 20 nt, Homo sapiens
aggaggguuggagugcucuu

SEQ ID NO: 1805919 - RNA, 12 nt, Homo sapiens
aaauguaugugc

SEQ ID NO: 1805920 - RNA, 16 nt, Homo sapiens
caugucugcuugucaa

SEQ ID NO: 1805921 - RNA, 20 nt, Homo sapiens
uaaauaauuucuacucuguc

SEQ ID NO: 1805922 - RNA, 15 nt, Homo sapiens
cuagcugucucagga

SEQ ID NO: 1805923 - RNA, 16 nt, Homo sapiens
uggggagacuuggggc

SEQ ID NO: 1805924 - RNA, 18 nt, Homo sapiens
caucuucuuauuuuccaa

SEQ ID NO: 1805925 - RNA, 17 nt, Homo sapiens
ucccuccccacccaaga

SEQ ID NO: 1805926 - RNA, 15 nt, Homo sapiens
uacuuaggaauuucu

SEQ ID NO: 1805927 - RNA, 20 nt, Homo sapiens
gaaagaagccaggugcaaaa

SEQ ID NO: 1805928 - RNA, 12 nt, Homo sapiens
ugucugccaaaa

SEQ ID NO: 1805929 - RNA, 17 nt, Homo sapiens
acggccaacaaagcugu

SEQ ID NO: 1805930 - RNA, 15 nt, Homo sapiens
cucagggcagggaua

SEQ ID NO: 1805931 - RNA, 20 nt, Homo sapiens
cucagaggacuggacgugcu

SEQ ID NO: 1805932 - RNA, 13 nt, Homo sapiens
cauuucugccaug

SEQ ID NO: 1805933 - RNA, 21 nt, Homo sapiens
gcaugucugccuaugcacuga

SEQ ID NO: 1805934 - RNA, 18 nt, Homo sapiens
ugguuuggggagacaggu

SEQ ID NO: 1805935 - RNA, 14 nt, Homo sapiens
aaacagcugagggu

SEQ ID NO: 1805936 - RNA, 15 nt, Homo sapiens
uuuugauauuugaua

SEQ ID NO: 1805937 - RNA, 24 nt, Homo sapiens
aaauuaguuuaccucauccaugca

SEQ ID NO: 1805938 - RNA, 15 nt, Homo sapiens
auacaguaucucagg

SEQ ID NO: 1805939 - RNA, 18 nt, Homo sapiens
ugaggggaccaaagccac

SEQ ID NO: 1805940 - RNA, 14 nt, Homo sapiens
gcgcacacacagau

SEQ ID NO: 1805941 - RNA, 18 nt, Homo sapiens
uggcaccagaugaugucc

SEQ ID NO: 1805942 - RNA, 17 nt, Homo sapiens
caacaauauauguccua

SEQ ID NO: 1805943 - RNA, 22 nt, Homo sapiens
ugcggacuuaggcuacccccuc

SEQ ID NO: 1805944 - RNA, 14 nt, Homo sapiens
acguaaacuaugac

SEQ ID NO: 1805945 - RNA, 17 nt, Homo sapiens
aggaaacaucagcuuuc

SEQ ID NO: 1805946 - RNA, 20 nt, Homo sapiens
guuuguaauaauaaaaccaa

SEQ ID NO: 1805947 - RNA, 21 nt, Homo sapiens
gccaaggagggcagaucacuu

SEQ ID NO: 1805948 - RNA, 14 nt, Homo sapiens
aucacacucuccau

SEQ ID NO: 1805949 - RNA, 21 nt, Homo sapiens
augaggugagagaaagccaca

SEQ ID NO: 1805950 - RNA, 13 nt, Homo sapiens
gacagacccagug

SEQ ID NO: 1805951 - RNA, 15 nt, Homo sapiens
cuaaaacagacucaa

SEQ ID NO: 1805952 - RNA, 20 nt, Homo sapiens
gcaccccagcugaccuggua

SEQ ID NO: 1805953 - RNA, 12 nt, Homo sapiens
gcugcugcucau

SEQ ID NO: 1805954 - RNA, 17 nt, Homo sapiens
gaauauuagcauugcca

SEQ ID NO: 1805955 - RNA, 22 nt, Homo sapiens
uuagcuaccucacuaugcugcu

SEQ ID NO: 1805956 - RNA, 23 nt, Homo sapiens
cugaggccaagaaagaaaccaga

SEQ ID NO: 1805957 - RNA, 17 nt, Homo sapiens
gcacuccagaauccaca

SEQ ID NO: 1805958 - RNA, 17 nt, Homo sapiens
uaauuuaaacaccuccu

SEQ ID NO: 1805959 - RNA, 16 nt, Homo sapiens
guucaaagugugacau

SEQ ID NO: 1805960 - RNA, 19 nt, Homo sapiens
uaggaugaccguuucuuaa

SEQ ID NO: 1805961 - RNA, 15 nt, Homo sapiens
uuuuuaacuggugaa

SEQ ID NO: 1805962 - RNA, 20 nt, Homo sapiens
acaggacaggaaaguggcac

SEQ ID NO: 1805963 - RNA, 18 nt, Homo sapiens
aguauugugaaaguauuc

SEQ ID NO: 1805964 - RNA, 19 nt, Homo sapiens
ucucuacuaccacaaggaa

SEQ ID NO: 1805965 - RNA, 14 nt, Homo sapiens
cuacacacaguacg

SEQ ID NO: 1805966 - RNA, 21 nt, Homo sapiens
uaguggggagacuucuuggcu

SEQ ID NO: 1805967 - RNA, 22 nt, Homo sapiens
ccaaggcaaaaaaaucauauaa

SEQ ID NO: 1805968 - RNA, 21 nt, Homo sapiens
cuucauaugucaccuuugcua

SEQ ID NO: 1805969 - RNA, 17 nt, Homo sapiens
uagcucucugacugcuu

SEQ ID NO: 1805970 - RNA, 21 nt, Homo sapiens
accaugcucucucaccugcuc

SEQ ID NO: 1805971 - RNA, 22 nt, Homo sapiens
acugauccagcccugaguuccu

SEQ ID NO: 1805972 - RNA, 21 nt, Homo sapiens
caggcagcagacugaccaucu

SEQ ID NO: 1805973 - RNA, 15 nt, Homo sapiens
aucucagaguccacu

SEQ ID NO: 1805974 - RNA, 23 nt, Homo sapiens
gacuuccuugcaggagugacuca

SEQ ID NO: 1805975 - RNA, 14 nt, Homo sapiens
ggacacagugauga

SEQ ID NO: 1805976 - RNA, 11 nt, Homo sapiens
aacaugcugcc

SEQ ID NO: 1805977 - RNA, 15 nt, Homo sapiens
uuaaaucuugcaacu

SEQ ID NO: 1805978 - RNA, 22 nt, Homo sapiens
ccaauaaaauaaaagcacuuau

SEQ ID NO: 1805979 - RNA, 20 nt, Homo sapiens
cugaaauuggucacuuuccu

SEQ ID NO: 1805980 - RNA, 13 nt, Homo sapiens
ggacagcuuuauu

SEQ ID NO: 1805981 - RNA, 17 nt, Homo sapiens
ccgcugauaagcauuga

SEQ ID NO: 1805982 - RNA, 21 nt, Homo sapiens
ugcaauagaauaaaaaugaca

SEQ ID NO: 1805983 - RNA, 19 nt, Homo sapiens
uugaacagcuugcugcuaa

SEQ ID NO: 1805984 - RNA, 14 nt, Homo sapiens
gcauaaagaauuug

SEQ ID NO: 1805985 - RNA, 16 nt, Homo sapiens
caaagcccacuuuguu

SEQ ID NO: 1805986 - RNA, 22 nt, Homo sapiens
aaaccucuauauguugcugaaa

SEQ ID NO: 1805987 - RNA, 12 nt, Homo sapiens
cagacauugugc

SEQ ID NO: 1805988 - RNA, 22 nt, Homo sapiens
aagcuuuuggagggugauauaa

SEQ ID NO: 1805989 - RNA, 23 nt, Homo sapiens
acuucagguggagagcacuagaa

SEQ ID NO: 1805990 - RNA, 15 nt, Homo sapiens
aaaugauugugccuc

SEQ ID NO: 1805991 - RNA, 17 nt, Homo sapiens
cuguuuuuguaguggua

SEQ ID NO: 1805992 - RNA, 15 nt, Homo sapiens
gaccccucccugcag

SEQ ID NO: 1805993 - RNA, 14 nt, Homo sapiens
gacauccucaaaag

SEQ ID NO: 1805994 - RNA, 20 nt, Homo sapiens
aaugugaauaauggcacuga

SEQ ID NO: 1805995 - RNA, 19 nt, Homo sapiens
aaaugguuuguuuucuaca

SEQ ID NO: 1805996 - RNA, 16 nt, Homo sapiens
auaguggaaaaacaca

SEQ ID NO: 1805997 - RNA, 12 nt, Homo sapiens
ccagaucuugcc

SEQ ID NO: 1805998 - RNA, 19 nt, Homo sapiens
uguauauaaacauaucaau

SEQ ID NO: 1805999 - RNA, 19 nt, Homo sapiens
uacgugucuguguguauau

SEQ ID NO: 1806000 - RNA, 20 nt, Homo sapiens
uauuugugugugugauauau

SEQ ID NO: 1806001 - RNA, 19 nt, Homo sapiens
uuuauuacauugcugccuu

SEQ ID NO: 1806002 - RNA, 20 nt, Homo sapiens
gcacuuaaguguuagaucua

SEQ ID NO: 1806003 - RNA, 20 nt, Homo sapiens
caccgagaauguuguauuca

SEQ ID NO: 1806004 - RNA, 21 nt, Homo sapiens
ccacccucggggauguguccu

SEQ ID NO: 1806005 - RNA, 14 nt, Homo sapiens
cuccuguugccaca

SEQ ID NO: 1806006 - RNA, 20 nt, Homo sapiens
gguuaaacauuaauauuuac

SEQ ID NO: 1806007 - RNA, 22 nt, Homo sapiens
cacacagcacgggggccaagga

SEQ ID NO: 1806008 - RNA, 15 nt, Homo sapiens
caaagaaaagccaga

SEQ ID NO: 1806009 - RNA, 23 nt, Homo sapiens
aauauuuauaaaugaagaugcau

SEQ ID NO: 1806010 - RNA, 13 nt, Homo sapiens
auuucaaagggaa

SEQ ID NO: 1806011 - RNA, 13 nt, Homo sapiens
ugccucagcaauu

SEQ ID NO: 1806012 - RNA, 19 nt, Homo sapiens
acccuccucacagaccucu

SEQ ID NO: 1806013 - RNA, 19 nt, Homo sapiens
cuuuguaugugcacacaaa

SEQ ID NO: 1806014 - RNA, 19 nt, Homo sapiens
aaacacaagaauuacacua

SEQ ID NO: 1806015 - RNA, 14 nt, Homo sapiens
aaugagugcuuaaa

SEQ ID NO: 1806016 - RNA, 20 nt, Homo sapiens
cuuuaaagcguuugcacaga

SEQ ID NO: 1806017 - RNA, 15 nt, Homo sapiens
acuauaaacauuaaa

SEQ ID NO: 1806018 - RNA, 15 nt, Homo sapiens
uggcuggcacugagc

SEQ ID NO: 1806019 - RNA, 11 nt, Homo sapiens
guuucauucau

SEQ ID NO: 1806020 - RNA, 23 nt, Homo sapiens
ucuaccuuuaaaauuuaccacag

SEQ ID NO: 1806021 - RNA, 12 nt, Homo sapiens
agaacauguuaa

SEQ ID NO: 1806022 - RNA, 18 nt, Homo sapiens
uauccuuuuagucugcau

SEQ ID NO: 1806023 - RNA, 15 nt, Homo sapiens
ucccaaacuccaaga

SEQ ID NO: 1806024 - RNA, 23 nt, Homo sapiens
uucacguggccuccgcagugucu

SEQ ID NO: 1806025 - RNA, 21 nt, Homo sapiens
auuaacuacugaauaaugcua

SEQ ID NO: 1806026 - RNA, 15 nt, Homo sapiens
auaauauccagguca

SEQ ID NO: 1806027 - RNA, 21 nt, Homo sapiens
caggaucugucugugcacaug

SEQ ID NO: 1806028 - RNA, 17 nt, Homo sapiens
cuccacuggaaaacugc

SEQ ID NO: 1806029 - RNA, 14 nt, Homo sapiens
ccccuuggcuguga

SEQ ID NO: 1806030 - RNA, 15 nt, Homo sapiens
gcaaaaaaauuauuu

SEQ ID NO: 1806031 - RNA, 22 nt, Homo sapiens
aaaauauucaucuguugacaau

SEQ ID NO: 1806032 - RNA, 17 nt, Homo sapiens
cauccaggccagggcuc

SEQ ID NO: 1806033 - RNA, 13 nt, Homo sapiens
aaaccacuugccu

SEQ ID NO: 1806034 - RNA, 20 nt, Homo sapiens
gacuguguuuaauaguauau

SEQ ID NO: 1806035 - RNA, 22 nt, Homo sapiens
gcugggcccccagccuggccag

SEQ ID NO: 1806036 - RNA, 17 nt, Homo sapiens
ucaacucucuccugguc

SEQ ID NO: 1806037 - RNA, 14 nt, Homo sapiens
uucugccugugcag

SEQ ID NO: 1806038 - RNA, 13 nt, Homo sapiens
aagugaguggcau

SEQ ID NO: 1806039 - RNA, 18 nt, Homo sapiens
cucucaguggaggccaga

SEQ ID NO: 1806040 - RNA, 14 nt, Homo sapiens
uaaacaaauaacaa

SEQ ID NO: 1806041 - RNA, 18 nt, Homo sapiens
agaaguacuuuauugcaa

SEQ ID NO: 1806042 - RNA, 14 nt, Homo sapiens
uggacagcuuuauu

SEQ ID NO: 1806043 - RNA, 20 nt, Homo sapiens
aggccucuacuaggucugcu

SEQ ID NO: 1806044 - RNA, 16 nt, Homo sapiens
cccuggugugaacucu

SEQ ID NO: 1806045 - RNA, 21 nt, Homo sapiens
gcauucauuucucuugcaaua

SEQ ID NO: 1806046 - RNA, 21 nt, Homo sapiens
agccaugugaaacucaucuca

SEQ ID NO: 1806047 - RNA, 15 nt, Homo sapiens
aagcuaaaaugauuu

SEQ ID NO: 1806048 - RNA, 15 nt, Homo sapiens
uagacuuauugccaa

SEQ ID NO: 1806049 - RNA, 14 nt, Homo sapiens
uccauuucugcuca

SEQ ID NO: 1806050 - RNA, 16 nt, Homo sapiens
gccucagcaacccagg

SEQ ID NO: 1806051 - RNA, 12 nt, Homo sapiens
guaaggcugugg

SEQ ID NO: 1806052 - RNA, 17 nt, Homo sapiens
cuugaaagaaaauacca

SEQ ID NO: 1806053 - RNA, 22 nt, Homo sapiens
aguucuguauauagggcacaag

SEQ ID NO: 1806054 - RNA, 16 nt, Homo sapiens
ugccggcgaguaaagu

SEQ ID NO: 1806055 - RNA, 23 nt, Homo sapiens
gauauuugaaucuuucuuacuau

SEQ ID NO: 1806056 - RNA, 19 nt, Homo sapiens
ucuaaaugaagugcaaauu

SEQ ID NO: 1806057 - RNA, 21 nt, Homo sapiens
uccuuuauuauaaucaaagcu

SEQ ID NO: 1806058 - RNA, 16 nt, Homo sapiens
aucccuaugcugccua

SEQ ID NO: 1806059 - RNA, 18 nt, Homo sapiens
ggauaucacuuccaugac

SEQ ID NO: 1806060 - RNA, 23 nt, Homo sapiens
cagcgagaggcagagaaagaaga

SEQ ID NO: 1806061 - RNA, 13 nt, Homo sapiens
uuccuuuggguua

SEQ ID NO: 1806062 - RNA, 22 nt, Homo sapiens
cacuacaccacacacaacagcc

SEQ ID NO: 1806063 - RNA, 16 nt, Homo sapiens
guuuccaaaaccagaa

SEQ ID NO: 1806064 - RNA, 15 nt, Homo sapiens
ugagaguuccagauu

SEQ ID NO: 1806065 - RNA, 13 nt, Homo sapiens
aucagcuuucaaa

SEQ ID NO: 1806066 - RNA, 13 nt, Homo sapiens
uauuuuacacaga

SEQ ID NO: 1806067 - RNA, 12 nt, Homo sapiens
aauuugaacuuu

SEQ ID NO: 1806068 - RNA, 20 nt, Homo sapiens
cuggcagcaucuucacuucu

SEQ ID NO: 1806069 - RNA, 13 nt, Homo sapiens
uuuauauguggaa

SEQ ID NO: 1806070 - RNA, 13 nt, Homo sapiens
gcccagaugcucu

SEQ ID NO: 1806071 - RNA, 14 nt, Homo sapiens
ggggaaugaucucu

SEQ ID NO: 1806072 - RNA, 15 nt, Homo sapiens
gucaccacgugcagu

SEQ ID NO: 1806073 - RNA, 23 nt, Homo sapiens
caacaccuucuuggcuucuggga

SEQ ID NO: 1806074 - RNA, 19 nt, Homo sapiens
gggaggaagcuacccaagg

SEQ ID NO: 1806075 - RNA, 19 nt, Homo sapiens
aucuugaauguaguauuca

SEQ ID NO: 1806076 - RNA, 23 nt, Homo sapiens
uuugauacuaccagggucucuca

SEQ ID NO: 1806077 - RNA, 14 nt, Homo sapiens
gaacccuugcacua

SEQ ID NO: 1806078 - RNA, 19 nt, Homo sapiens
gaguaacaugccagcuucc

SEQ ID NO: 1806079 - RNA, 23 nt, Homo sapiens
cuucacuuacaagaaaggccuga

SEQ ID NO: 1806080 - RNA, 20 nt, Homo sapiens
guguuucaucuguucauuca

SEQ ID NO: 1806081 - RNA, 15 nt, Homo sapiens
uuagcaaauacauau

SEQ ID NO: 1806082 - RNA, 21 nt, Homo sapiens
cuucccaaaguccugggauua

SEQ ID NO: 1806083 - RNA, 16 nt, Homo sapiens
acuuaacuacuuuguu

SEQ ID NO: 1806084 - RNA, 18 nt, Homo sapiens
uguauuuuaaaauuucac

SEQ ID NO: 1806085 - RNA, 23 nt, Homo sapiens
uaaaaaacaauuaacugcccucu

SEQ ID NO: 1806086 - RNA, 19 nt, Homo sapiens
uacaaaaagccaacaaacc

SEQ ID NO: 1806087 - RNA, 20 nt, Homo sapiens
gaccauaucacaagugauug

SEQ ID NO: 1806088 - RNA, 22 nt, Homo sapiens
aaguucgaagcuccgugaguga

SEQ ID NO: 1806089 - RNA, 13 nt, Homo sapiens
ucuaauacuuugu

SEQ ID NO: 1806090 - RNA, 16 nt, Homo sapiens
aaagccauuauucucu

SEQ ID NO: 1806091 - RNA, 20 nt, Homo sapiens
ucugccauugauccagcuca

SEQ ID NO: 1806092 - RNA, 13 nt, Homo sapiens
ggacgugcucaga

SEQ ID NO: 1806093 - RNA, 21 nt, Homo sapiens
cuguagauucagguaauacaa

SEQ ID NO: 1806094 - RNA, 15 nt, Homo sapiens
acguccccacccacg

SEQ ID NO: 1806095 - RNA, 20 nt, Homo sapiens
acaauguauacaaugcacuu

SEQ ID NO: 1806096 - RNA, 17 nt, Homo sapiens
gaccagggcuuuuccca

SEQ ID NO: 1806097 - RNA, 20 nt, Homo sapiens
caggugugagccacagugcc

SEQ ID NO: 1806098 - RNA, 21 nt, Homo sapiens
auuuucccccaaucagaauca

SEQ ID NO: 1806099 - RNA, 14 nt, Homo sapiens
aaguuuaugguugu

SEQ ID NO: 1806100 - RNA, 15 nt, Homo sapiens
ccacuaccaaaagac

SEQ ID NO: 1806101 - RNA, 15 nt, Homo sapiens
caaaugccacacggc

SEQ ID NO: 1806102 - RNA, 19 nt, Homo sapiens
gugcagcccaaucugccag

SEQ ID NO: 1806103 - RNA, 19 nt, Homo sapiens
aucugucucauccaaaaag

SEQ ID NO: 1806104 - RNA, 14 nt, Homo sapiens
uaaaguugcacaug

SEQ ID NO: 1806105 - RNA, 22 nt, Homo sapiens
guuuccagcuaagccugaugau

SEQ ID NO: 1806106 - RNA, 16 nt, Homo sapiens
auuccaaguacagaau

SEQ ID NO: 1806107 - RNA, 16 nt, Homo sapiens
agacaauccacucuca

SEQ ID NO: 1806108 - RNA, 22 nt, Homo sapiens
aaacaucuuugaaauuauguaa

SEQ ID NO: 1806109 - RNA, 22 nt, Homo sapiens
aggguugauccugcaucugggu

SEQ ID NO: 1806110 - RNA, 23 nt, Homo sapiens
uacauauuuauauguauguuuua

SEQ ID NO: 1806111 - RNA, 16 nt, Homo sapiens
gcuagcgugugccagg

SEQ ID NO: 1806112 - RNA, 11 nt, Homo sapiens
gugcagggaaa

SEQ ID NO: 1806113 - RNA, 16 nt, Homo sapiens
gguauuacacuguauu

SEQ ID NO: 1806114 - RNA, 17 nt, Homo sapiens
gcuuaaaaucugugaag

SEQ ID NO: 1806115 - RNA, 19 nt, Homo sapiens
gauuguauuuaagacauaa

SEQ ID NO: 1806116 - RNA, 20 nt, Homo sapiens
gcaccaguuauguuugaaug

SEQ ID NO: 1806117 - RNA, 13 nt, Homo sapiens
uuuugagacagaa

SEQ ID NO: 1806118 - RNA, 23 nt, Homo sapiens
cugccauuaaauccgcaaacagc

SEQ ID NO: 1806119 - RNA, 20 nt, Homo sapiens
aggugcguaguccaacucuu

SEQ ID NO: 1806120 - RNA, 14 nt, Homo sapiens
caaagugugacauu

SEQ ID NO: 1806121 - RNA, 15 nt, Homo sapiens
augguuagacagcac

SEQ ID NO: 1806122 - RNA, 17 nt, Homo sapiens
auaaguucuuaauguca

SEQ ID NO: 1806123 - RNA, 19 nt, Homo sapiens
aguuccagaaaaccucucc

SEQ ID NO: 1806124 - RNA, 16 nt, Homo sapiens
aggaaccucucgccau

SEQ ID NO: 1806125 - RNA, 20 nt, Homo sapiens
ccuuuaccaaauaaagcaaa

SEQ ID NO: 1806126 - RNA, 20 nt, Homo sapiens
gucacucauuuacguaaaaa

SEQ ID NO: 1806127 - RNA, 20 nt, Homo sapiens
gcuguuauuuuaucugcuau

SEQ ID NO: 1806128 - RNA, 17 nt, Homo sapiens
cucuugaagaacugacu

SEQ ID NO: 1806129 - RNA, 12 nt, Homo sapiens
ugcuaucauuug

SEQ ID NO: 1806130 - RNA, 13 nt, Homo sapiens
caucaaauaguga

SEQ ID NO: 1806131 - RNA, 23 nt, Homo sapiens
ugccccuggugcccugagacaga

SEQ ID NO: 1806132 - RNA, 20 nt, Homo sapiens
gacccuggaccauuccagga

SEQ ID NO: 1806133 - RNA, 15 nt, Homo sapiens
uuaaaacaugcacaa

SEQ ID NO: 1806134 - RNA, 14 nt, Homo sapiens
gccuugaucaguga

SEQ ID NO: 1806135 - RNA, 20 nt, Homo sapiens
aacaacguugcuauuuccac

SEQ ID NO: 1806136 - RNA, 23 nt, Homo sapiens
auucuggaggggagagcuuugug

SEQ ID NO: 1806137 - RNA, 20 nt, Homo sapiens
gccgcugccgccuuccccau

SEQ ID NO: 1806138 - RNA, 19 nt, Homo sapiens
gagaucuauaaacagacag

SEQ ID NO: 1806139 - RNA, 20 nt, Homo sapiens
uacaaaaaucagccagacau

SEQ ID NO: 1806140 - RNA, 19 nt, Homo sapiens
ugccgggacccugcucaca

SEQ ID NO: 1806141 - RNA, 19 nt, Homo sapiens
agcaucagauuuuaccuaa

SEQ ID NO: 1806142 - RNA, 21 nt, Homo sapiens
ucgcauauugcugaguuuucu

SEQ ID NO: 1806143 - RNA, 22 nt, Homo sapiens
uagaagaaaagcccauuuucaa

SEQ ID NO: 1806144 - RNA, 21 nt, Homo sapiens
acaguuagcauggcuucacac

SEQ ID NO: 1806145 - RNA, 21 nt, Homo sapiens
gcagaaccagugacaaucuua

SEQ ID NO: 1806146 - RNA, 21 nt, Homo sapiens
aguggcauaaaaaacaugugg

SEQ ID NO: 1806147 - RNA, 11 nt, Homo sapiens
cucccauguca

SEQ ID NO: 1806148 - RNA, 21 nt, Homo sapiens
uguucaguccaacaaaccaca

SEQ ID NO: 1806149 - RNA, 22 nt, Homo sapiens
cuucagccuagccgaccucagc

SEQ ID NO: 1806150 - RNA, 21 nt, Homo sapiens
uguaggcuggggcggggccca

SEQ ID NO: 1806151 - RNA, 18 nt, Homo sapiens
cugucaaacaaagccaga

SEQ ID NO: 1806152 - RNA, 17 nt, Homo sapiens
gggcagccccaccucac

SEQ ID NO: 1806153 - RNA, 20 nt, Homo sapiens
ccaaaggguuuuaagccagg

SEQ ID NO: 1806154 - RNA, 24 nt, Homo sapiens
gaauugcggcgagacaagcaugga

SEQ ID NO: 1806155 - RNA, 15 nt, Homo sapiens
cagccaucaagggaa

SEQ ID NO: 1806156 - RNA, 23 nt, Homo sapiens
gauagagaaugcccucagcucuu

SEQ ID NO: 1806157 - RNA, 16 nt, Homo sapiens
gaaaaccucuuuccaa

SEQ ID NO: 1806158 - RNA, 17 nt, Homo sapiens
uuccauuuuacuuccau

SEQ ID NO: 1806159 - RNA, 20 nt, Homo sapiens
uuguaaauauagugaagcaa

SEQ ID NO: 1806160 - RNA, 21 nt, Homo sapiens
ccuucugacgcagccugagaa

SEQ ID NO: 1806161 - RNA, 21 nt, Homo sapiens
uuuuuguuuucauuaaagagc

SEQ ID NO: 1806162 - RNA, 23 nt, Homo sapiens
ugccauuugcuggacaaccaaca

SEQ ID NO: 1806163 - RNA, 17 nt, Homo sapiens
ggccugguuauuguuca

SEQ ID NO: 1806164 - RNA, 16 nt, Homo sapiens
aaucccuucuccacuu

SEQ ID NO: 1806165 - RNA, 16 nt, Homo sapiens
cacuaccaauuuccca

SEQ ID NO: 1806166 - RNA, 22 nt, Homo sapiens
cuuuacgaggagucucacuggg

SEQ ID NO: 1806167 - RNA, 17 nt, Homo sapiens
uuccccuucuugccauu

SEQ ID NO: 1806168 - RNA, 20 nt, Homo sapiens
auauuauuauuaauuuugcc

SEQ ID NO: 1806169 - RNA, 19 nt, Homo sapiens
cuuaaagauuuaucaaauc

SEQ ID NO: 1806170 - RNA, 18 nt, Homo sapiens
cccaugaggacaaagugu

SEQ ID NO: 1806171 - RNA, 21 nt, Homo sapiens
aaaaucauguuuuuaaaugca

SEQ ID NO: 1806172 - RNA, 15 nt, Homo sapiens
caaaagcagcacaag

SEQ ID NO: 1806173 - RNA, 19 nt, Homo sapiens
uugaauauagccugccuca

SEQ ID NO: 1806174 - RNA, 15 nt, Homo sapiens
ugcggugugucucca

SEQ ID NO: 1806175 - RNA, 16 nt, Homo sapiens
uguuaucaguaagaaa

SEQ ID NO: 1806176 - RNA, 18 nt, Homo sapiens
gccuuaauucuuaccuca

SEQ ID NO: 1806177 - RNA, 14 nt, Homo sapiens
uccuaguagcuuuc

SEQ ID NO: 1806178 - RNA, 19 nt, Homo sapiens
gcucagcacauauuugcau

SEQ ID NO: 1806179 - RNA, 17 nt, Homo sapiens
acaauaaaaugucuucu

SEQ ID NO: 1806180 - RNA, 18 nt, Homo sapiens
aaaucaugccaguauuuu

SEQ ID NO: 1806181 - RNA, 18 nt, Homo sapiens
agauucccagaccuuaag

SEQ ID NO: 1806182 - RNA, 14 nt, Homo sapiens
aguaagaugcacug

SEQ ID NO: 1806183 - RNA, 17 nt, Homo sapiens
accugauugaucacaca

SEQ ID NO: 1806184 - RNA, 17 nt, Homo sapiens
ucccuuaauaaacucac

SEQ ID NO: 1806185 - RNA, 24 nt, Homo sapiens
ccccugacgugcagccacacacag

SEQ ID NO: 1806186 - RNA, 15 nt, Homo sapiens
acugauacacuugaa

SEQ ID NO: 1806187 - RNA, 15 nt, Homo sapiens
ucaugugcucagaag

SEQ ID NO: 1806188 - RNA, 16 nt, Homo sapiens
caauuuaaauuacgua

SEQ ID NO: 1806189 - RNA, 16 nt, Homo sapiens
aguuccugcacuccag

SEQ ID NO: 1806190 - RNA, 17 nt, Homo sapiens
ccuugccucugcucugu

SEQ ID NO: 1806191 - RNA, 23 nt, Homo sapiens
gccaccgugauagaaaaaaaauc

SEQ ID NO: 1806192 - RNA, 12 nt, Homo sapiens
cagccacugcag

SEQ ID NO: 1806193 - RNA, 18 nt, Homo sapiens
auaaaggcccccacuucu

SEQ ID NO: 1806194 - RNA, 17 nt, Homo sapiens
acuuacauguguguaua

SEQ ID NO: 1806195 - RNA, 21 nt, Homo sapiens
augagcaagaggcuaacucag

SEQ ID NO: 1806196 - RNA, 15 nt, Homo sapiens
cuccccuacuucuca

SEQ ID NO: 1806197 - RNA, 19 nt, Homo sapiens
aaaugaaagggaaacuggg

SEQ ID NO: 1806198 - RNA, 20 nt, Homo sapiens
ccucgcucagucagugcacu

SEQ ID NO: 1806199 - RNA, 18 nt, Homo sapiens
ucuuucaacucauugcau

SEQ ID NO: 1806200 - RNA, 21 nt, Homo sapiens
acagauagacagugcugcccu

SEQ ID NO: 1806201 - RNA, 22 nt, Homo sapiens
cugugcaaagggagguagugug

SEQ ID NO: 1806202 - RNA, 17 nt, Homo sapiens
gcaacauuuuaaggcaa

SEQ ID NO: 1806203 - RNA, 20 nt, Homo sapiens
agcgucacugcccaccaaag

SEQ ID NO: 1806204 - RNA, 19 nt, Homo sapiens
cuacaucuaguuaaucaua

SEQ ID NO: 1806205 - RNA, 19 nt, Homo sapiens
auuaaaacuaagcacaaag

SEQ ID NO: 1806206 - RNA, 16 nt, Homo sapiens
ucuuauuguuccucuu

SEQ ID NO: 1806207 - RNA, 22 nt, Homo sapiens
uccuaugugauuuuaacucugu

SEQ ID NO: 1806208 - RNA, 19 nt, Homo sapiens
ugauggugacauugcaccu

SEQ ID NO: 1806209 - RNA, 13 nt, Homo sapiens
ccauucauuuaca

SEQ ID NO: 1806210 - RNA, 13 nt, Homo sapiens
cucuucauuccca

SEQ ID NO: 1806211 - RNA, 18 nt, Homo sapiens
aagccagccugguccaug

SEQ ID NO: 1806212 - RNA, 13 nt, Homo sapiens
ucauacugaauga

SEQ ID NO: 1806213 - RNA, 21 nt, Homo sapiens
ugcucuaugaaacugcacauu

SEQ ID NO: 1806214 - RNA, 20 nt, Homo sapiens
uauuguaaucgugugccaug

SEQ ID NO: 1806215 - RNA, 21 nt, Homo sapiens
guuucuggucuucgcagccua

SEQ ID NO: 1806216 - RNA, 18 nt, Homo sapiens
gaagcguuaugugcagua

SEQ ID NO: 1806217 - RNA, 18 nt, Homo sapiens
aggggcccuggagcagcc

SEQ ID NO: 1806218 - RNA, 19 nt, Homo sapiens
ugugagagcccagucauug

SEQ ID NO: 1806219 - RNA, 20 nt, Homo sapiens
cuccuacacuauugaccagg

SEQ ID NO: 1806220 - RNA, 20 nt, Homo sapiens
auuaaagagccauucuggca

SEQ ID NO: 1806221 - RNA, 21 nt, Homo sapiens
ggcauguaaauguaaacucag

SEQ ID NO: 1806222 - RNA, 20 nt, Homo sapiens
gaaaauuuuacacaguucau

SEQ ID NO: 1806223 - RNA, 16 nt, Homo sapiens
agaacuggacucagga

SEQ ID NO: 1806224 - RNA, 14 nt, Homo sapiens
ucuguuagccaugu

SEQ ID NO: 1806225 - RNA, 18 nt, Homo sapiens
cgguggacuugaacuuuc

SEQ ID NO: 1806226 - RNA, 12 nt, Homo sapiens
gcaugcggccca

SEQ ID NO: 1806227 - RNA, 16 nt, Homo sapiens
gaauauguauguuucu

SEQ ID NO: 1806228 - RNA, 12 nt, Homo sapiens
cccagugcucac

SEQ ID NO: 1806229 - RNA, 17 nt, Homo sapiens
aaaggggaaauacuuag

SEQ ID NO: 1806230 - RNA, 18 nt, Homo sapiens
aaguguguuucuuucuaa

SEQ ID NO: 1806231 - RNA, 19 nt, Homo sapiens
gcugaagguuguggccuuu

SEQ ID NO: 1806232 - RNA, 15 nt, Homo sapiens
aaagugcuugcuuuu

SEQ ID NO: 1806233 - RNA, 19 nt, Homo sapiens
acuaugaggagccucugau

SEQ ID NO: 1806234 - RNA, 21 nt, Homo sapiens
ucuaugaguggaaaaagccaa

SEQ ID NO: 1806235 - RNA, 19 nt, Homo sapiens
gguugcuuuuaagucuucc

SEQ ID NO: 1806236 - RNA, 24 nt, Homo sapiens
gacagaugggcauaugugucagug

SEQ ID NO: 1806237 - RNA, 19 nt, Homo sapiens
cucuguuuuguaagcuuua

SEQ ID NO: 1806238 - RNA, 16 nt, Homo sapiens
acauggcgcccugccu

SEQ ID NO: 1806239 - RNA, 15 nt, Homo sapiens
uuaggaugguuccca

SEQ ID NO: 1806240 - RNA, 18 nt, Homo sapiens
uguaguaguaauauugcu

SEQ ID NO: 1806241 - RNA, 19 nt, Homo sapiens
cacuauuuaucugugcaaa

SEQ ID NO: 1806242 - RNA, 21 nt, Homo sapiens
ugcgucaggagcagcaucauu

SEQ ID NO: 1806243 - RNA, 14 nt, Homo sapiens
acucuaagcugugu

SEQ ID NO: 1806244 - RNA, 13 nt, Homo sapiens
uaauuuucuuccc

SEQ ID NO: 1806245 - RNA, 12 nt, Homo sapiens
gucagaugucac

SEQ ID NO: 1806246 - RNA, 21 nt, Homo sapiens
uuacuauucuguaucauugau

SEQ ID NO: 1806247 - RNA, 22 nt, Homo sapiens
cuuucauucggugugaacuuuu

SEQ ID NO: 1806248 - RNA, 17 nt, Homo sapiens
caagauugaagucugau

SEQ ID NO: 1806249 - RNA, 14 nt, Homo sapiens
cugaguggugccaa

SEQ ID NO: 1806250 - RNA, 15 nt, Homo sapiens
cacuguuugccccag

SEQ ID NO: 1806251 - RNA, 12 nt, Homo sapiens
agaaaggcauga

SEQ ID NO: 1806252 - RNA, 15 nt, Homo sapiens
guucccuccuggucc

SEQ ID NO: 1806253 - RNA, 23 nt, Homo sapiens
uacaagacuuguuauccauuuaa

SEQ ID NO: 1806254 - RNA, 20 nt, Homo sapiens
uggacuccggaggacugagc

SEQ ID NO: 1806255 - RNA, 16 nt, Homo sapiens
guucuuagugucacuu

SEQ ID NO: 1806256 - RNA, 23 nt, Homo sapiens
ggcgcacuuuccuccuggcagaa

SEQ ID NO: 1806257 - RNA, 21 nt, Homo sapiens
aaucaauaaagaccacuuuac

SEQ ID NO: 1806258 - RNA, 17 nt, Homo sapiens
aaauuuuugaaauucaa

SEQ ID NO: 1806259 - RNA, 11 nt, Homo sapiens
aauucaagaaa

SEQ ID NO: 1806260 - RNA, 14 nt, Homo sapiens
gcccucuagcuucu

SEQ ID NO: 1806261 - RNA, 20 nt, Homo sapiens
caauuguuucagugccauuu

SEQ ID NO: 1806262 - RNA, 22 nt, Homo sapiens
cugccccagaacaauucugcag

SEQ ID NO: 1806263 - RNA, 16 nt, Homo sapiens
uuaaguugauggugau

SEQ ID NO: 1806264 - RNA, 14 nt, Homo sapiens
cuaaacaacccaga

SEQ ID NO: 1806265 - RNA, 19 nt, Homo sapiens
cuccagcugaucacagaca

SEQ ID NO: 1806266 - RNA, 20 nt, Homo sapiens
caauaaagugggcuuugcaa

SEQ ID NO: 1806267 - RNA, 18 nt, Homo sapiens
ugaaacauguacuuugag

SEQ ID NO: 1806268 - RNA, 14 nt, Homo sapiens
cagcuccucacuca

SEQ ID NO: 1806269 - RNA, 21 nt, Homo sapiens
agggaaugaacuagcuaugaa

SEQ ID NO: 1806270 - RNA, 20 nt, Homo sapiens
uccauccuuuacguguuuaa

SEQ ID NO: 1806271 - RNA, 10 nt, Homo sapiens
uucauugcac

SEQ ID NO: 1806272 - RNA, 20 nt, Homo sapiens
ucaggaaccucgaguacugu

SEQ ID NO: 1806273 - RNA, 16 nt, Homo sapiens
cugauggcugcuccac

SEQ ID NO: 1806274 - RNA, 16 nt, Homo sapiens
cagauguguguucuca

SEQ ID NO: 1806275 - RNA, 18 nt, Homo sapiens
caagugauccgcccaucu

SEQ ID NO: 1806276 - RNA, 19 nt, Homo sapiens
uaugcuugggcccugcauu

SEQ ID NO: 1806277 - RNA, 19 nt, Homo sapiens
guuccacuuguuugcacug

SEQ ID NO: 1806278 - RNA, 15 nt, Homo sapiens
gcaagccaagugccc

SEQ ID NO: 1806279 - RNA, 15 nt, Homo sapiens
caucucagugcagga

SEQ ID NO: 1806280 - RNA, 22 nt, Homo sapiens
auuagagaauuuucugcauuau

SEQ ID NO: 1806281 - RNA, 16 nt, Homo sapiens
aaaagcacaaguacuu

SEQ ID NO: 1806282 - RNA, 15 nt, Homo sapiens
ugcuguaugugagcu

SEQ ID NO: 1806283 - RNA, 21 nt, Homo sapiens
uggacuacacccaagccugau

SEQ ID NO: 1806284 - RNA, 15 nt, Homo sapiens
uguuagauacacaaa

SEQ ID NO: 1806285 - RNA, 20 nt, Homo sapiens
aacccacgauuuucuccagc

SEQ ID NO: 1806286 - RNA, 21 nt, Homo sapiens
cacccccugcuccaccagcag

SEQ ID NO: 1806287 - RNA, 17 nt, Homo sapiens
caagggaucugguccua

SEQ ID NO: 1806288 - RNA, 15 nt, Homo sapiens
guuuaccucuucuau

SEQ ID NO: 1806289 - RNA, 12 nt, Homo sapiens
caaaaaggcaaa

SEQ ID NO: 1806290 - RNA, 12 nt, Homo sapiens
gaagaagggaag

SEQ ID NO: 1806291 - RNA, 20 nt, Homo sapiens
cagugauaucuuucucauua

SEQ ID NO: 1806292 - RNA, 22 nt, Homo sapiens
auuuucgacguuugacuagcca

SEQ ID NO: 1806293 - RNA, 23 nt, Homo sapiens
ugguagcugggggcgcagaggac

SEQ ID NO: 1806294 - RNA, 14 nt, Homo sapiens
agcaccugcucaac

SEQ ID NO: 1806295 - RNA, 23 nt, Homo sapiens
aaauaaaaauucauaaccaaaga

SEQ ID NO: 1806296 - RNA, 15 nt, Homo sapiens
cuuuauaaaauuuac

SEQ ID NO: 1806297 - RNA, 13 nt, Homo sapiens
acggaaaucauga

SEQ ID NO: 1806298 - RNA, 17 nt, Homo sapiens
uaacuuauuuaaugaaa

SEQ ID NO: 1806299 - RNA, 21 nt, Homo sapiens
ggaaaaauccugucauggcuc

SEQ ID NO: 1806300 - RNA, 15 nt, Homo sapiens
uguuguuauucagaa

SEQ ID NO: 1806301 - RNA, 15 nt, Homo sapiens
uguucauauucacua

SEQ ID NO: 1806302 - RNA, 16 nt, Homo sapiens
auaucaguaccucuca

SEQ ID NO: 1806303 - RNA, 16 nt, Homo sapiens
augucuuuucuuccac

SEQ ID NO: 1806304 - RNA, 20 nt, Homo sapiens
cuuccuaauaugcuuuacaa

SEQ ID NO: 1806305 - RNA, 18 nt, Homo sapiens
gaacaaaacaucaaaaug

SEQ ID NO: 1806306 - RNA, 23 nt, Homo sapiens
auagaucagcaaaccggggccua

SEQ ID NO: 1806307 - RNA, 23 nt, Homo sapiens
gccgcaucucacagcuaugcaaa

SEQ ID NO: 1806308 - RNA, 10 nt, Homo sapiens
acuguugcac

SEQ ID NO: 1806309 - RNA, 21 nt, Homo sapiens
uaauuaggaaaaaaacuauua

SEQ ID NO: 1806310 - RNA, 23 nt, Homo sapiens
aauacgcagaacuaccagguggc

SEQ ID NO: 1806311 - RNA, 16 nt, Homo sapiens
acucuucccaccucag

SEQ ID NO: 1806312 - RNA, 14 nt, Homo sapiens
cacauuaagcacug

SEQ ID NO: 1806313 - RNA, 17 nt, Homo sapiens
acaccuggaugucuggg

SEQ ID NO: 1806314 - RNA, 21 nt, Homo sapiens
agacagcccuggcaaaugccu

SEQ ID NO: 1806315 - RNA, 22 nt, Homo sapiens
agcgcuccccuuaccccaguca

SEQ ID NO: 1806316 - RNA, 22 nt, Homo sapiens
agcacuugcagaccugccugaa

SEQ ID NO: 1806317 - RNA, 18 nt, Homo sapiens
cucauguucaaaguguga

SEQ ID NO: 1806318 - RNA, 15 nt, Homo sapiens
ugguauucuucugac

SEQ ID NO: 1806319 - RNA, 19 nt, Homo sapiens
aaaguuaaacuuuaucuca

SEQ ID NO: 1806320 - RNA, 15 nt, Homo sapiens
aucauuaaugcacau

SEQ ID NO: 1806321 - RNA, 15 nt, Homo sapiens
aguauaaauuuacuu

SEQ ID NO: 1806322 - RNA, 15 nt, Homo sapiens
caguuucacauauuu

SEQ ID NO: 1806323 - RNA, 14 nt, Homo sapiens
gacugacacuacua

SEQ ID NO: 1806324 - RNA, 20 nt, Homo sapiens
ugauguuuguggccucagaa

SEQ ID NO: 1806325 - RNA, 17 nt, Homo sapiens
uauauccccacuacuca

SEQ ID NO: 1806326 - RNA, 23 nt, Homo sapiens
cuuggaaaucagguagaccauau

SEQ ID NO: 1806327 - RNA, 12 nt, Homo sapiens
cugaagguccag

SEQ ID NO: 1806328 - RNA, 14 nt, Homo sapiens
ugaaccacugugua

SEQ ID NO: 1806329 - RNA, 21 nt, Homo sapiens
cacacucugaagaauccugua

SEQ ID NO: 1806330 - RNA, 21 nt, Homo sapiens
acugaaaaucuggugcucaau

SEQ ID NO: 1806331 - RNA, 16 nt, Homo sapiens
uuuucccagucuguga

SEQ ID NO: 1806332 - RNA, 14 nt, Homo sapiens
gaaagcauggcuca

SEQ ID NO: 1806333 - RNA, 14 nt, Homo sapiens
uaaauuauugcugu

SEQ ID NO: 1806334 - RNA, 19 nt, Homo sapiens
aaucaccugugggacuuga

SEQ ID NO: 1806335 - RNA, 17 nt, Homo sapiens
auguguuuuaauuccaa

SEQ ID NO: 1806336 - RNA, 15 nt, Homo sapiens
uuuggagguauucaa

SEQ ID NO: 1806337 - RNA, 23 nt, Homo sapiens
aguugaggagacauuacaaugug

SEQ ID NO: 1806338 - RNA, 15 nt, Homo sapiens
cuuggcuuccagaag

SEQ ID NO: 1806339 - RNA, 15 nt, Homo sapiens
accguggguguggcu

SEQ ID NO: 1806340 - RNA, 19 nt, Homo sapiens
uuaaaauagcauacugugu

SEQ ID NO: 1806341 - RNA, 14 nt, Homo sapiens
caguccacugcuga

SEQ ID NO: 1806342 - RNA, 11 nt, Homo sapiens
ccuagccagag

SEQ ID NO: 1806343 - RNA, 22 nt, Homo sapiens
aauugauaagcuagucccaaaa

SEQ ID NO: 1806344 - RNA, 19 nt, Homo sapiens
ucuggcccucuaccccuga

SEQ ID NO: 1806345 - RNA, 14 nt, Homo sapiens
gaaaucagcagaca

SEQ ID NO: 1806346 - RNA, 20 nt, Homo sapiens
ugagcaccaccagggcucca

SEQ ID NO: 1806347 - RNA, 21 nt, Homo sapiens
uucaguauuuucuccacuuca

SEQ ID NO: 1806348 - RNA, 16 nt, Homo sapiens
uggaauaccuaaggau

SEQ ID NO: 1806349 - RNA, 20 nt, Homo sapiens
acagggaacaagcauucucc

SEQ ID NO: 1806350 - RNA, 14 nt, Homo sapiens
uccuacaaggccua

SEQ ID NO: 1806351 - RNA, 11 nt, Homo sapiens
agccaaccuca

SEQ ID NO: 1806352 - RNA, 17 nt, Homo sapiens
cgaagaauugucuugca

SEQ ID NO: 1806353 - RNA, 18 nt, Homo sapiens
uuuaauacccugcaaugu

SEQ ID NO: 1806354 - RNA, 15 nt, Homo sapiens
ggauuucucuuucuc

SEQ ID NO: 1806355 - RNA, 14 nt, Homo sapiens
cuccaucucugucu

SEQ ID NO: 1806356 - RNA, 15 nt, Homo sapiens
uuaauacucaccucc

SEQ ID NO: 1806357 - RNA, 15 nt, Homo sapiens
uugacauacccaaag

SEQ ID NO: 1806358 - RNA, 10 nt, Homo sapiens
ucagccaggc

SEQ ID NO: 1806359 - RNA, 21 nt, Homo sapiens
uauaguuguuggccuuuuugc

SEQ ID NO: 1806360 - RNA, 17 nt, Homo sapiens
gagaugaagccuaagaa

SEQ ID NO: 1806361 - RNA, 20 nt, Homo sapiens
caugucugugaacuugaugu

SEQ ID NO: 1806362 - RNA, 12 nt, Homo sapiens
ccagcaccugcc

SEQ ID NO: 1806363 - RNA, 14 nt, Homo sapiens
gucaaaacauucag

SEQ ID NO: 1806364 - RNA, 14 nt, Homo sapiens
gcccauucuuuuca

SEQ ID NO: 1806365 - RNA, 24 nt, Homo sapiens
gccgcgcccuuuccccgacgccca

SEQ ID NO: 1806366 - RNA, 15 nt, Homo sapiens
aggauuuaaguuuca

SEQ ID NO: 1806367 - RNA, 18 nt, Homo sapiens
cgcacagagggaagccau

SEQ ID NO: 1806368 - RNA, 15 nt, Homo sapiens
cgugcgagcacacac

SEQ ID NO: 1806369 - RNA, 22 nt, Homo sapiens
aggaaaaauaauaauaacucuu

SEQ ID NO: 1806370 - RNA, 15 nt, Homo sapiens
caaaaauuacaaaga

SEQ ID NO: 1806371 - RNA, 15 nt, Homo sapiens
ccuuguuuugccagu

SEQ ID NO: 1806372 - RNA, 19 nt, Homo sapiens
gagcgagauucugccucaa

SEQ ID NO: 1806373 - RNA, 20 nt, Homo sapiens
cugaaaagaugguaucauau

SEQ ID NO: 1806374 - RNA, 22 nt, Homo sapiens
ugccuuggaggaaaugugcuca

SEQ ID NO: 1806375 - RNA, 20 nt, Homo sapiens
aucgacaccauccuggcuaa

SEQ ID NO: 1806376 - RNA, 17 nt, Homo sapiens
acaugccucucucaggc

SEQ ID NO: 1806377 - RNA, 16 nt, Homo sapiens
uguuccuuaauuugau

SEQ ID NO: 1806378 - RNA, 13 nt, Homo sapiens
guuuuuccuccau

SEQ ID NO: 1806379 - RNA, 19 nt, Homo sapiens
aguguggagucauucucau

SEQ ID NO: 1806380 - RNA, 12 nt, Homo sapiens
agauuccaccua

SEQ ID NO: 1806381 - RNA, 15 nt, Homo sapiens
auuguugauggcuuu

SEQ ID NO: 1806382 - RNA, 15 nt, Homo sapiens
ccacagcuccuugca

SEQ ID NO: 1806383 - RNA, 17 nt, Homo sapiens
uuucugcguguguauau

SEQ ID NO: 1806384 - RNA, 16 nt, Homo sapiens
aucugccuaugucaua

SEQ ID NO: 1806385 - RNA, 19 nt, Homo sapiens
gaggugagcaucaucuucu

SEQ ID NO: 1806386 - RNA, 21 nt, Homo sapiens
aaacacacgaggagcaugcag

SEQ ID NO: 1806387 - RNA, 16 nt, Homo sapiens
cacaugcccauucaca

SEQ ID NO: 1806388 - RNA, 19 nt, Homo sapiens
ugggaaggggcgugucccu

SEQ ID NO: 1806389 - RNA, 22 nt, Homo sapiens
acucugaagaccuuuaauggcu

SEQ ID NO: 1806390 - RNA, 22 nt, Homo sapiens
guuuuauccuuacaaugugaau

SEQ ID NO: 1806391 - RNA, 18 nt, Homo sapiens
auuaagaaauucacuucc

SEQ ID NO: 1806392 - RNA, 17 nt, Homo sapiens
gaaagaaggacacuugu

SEQ ID NO: 1806393 - RNA, 21 nt, Homo sapiens
gcagccaccaggucaucuccu

SEQ ID NO: 1806394 - RNA, 19 nt, Homo sapiens
caauguacaauuaugucuc

SEQ ID NO: 1806395 - RNA, 20 nt, Homo sapiens
accaaugguccuagaacuuu

SEQ ID NO: 1806396 - RNA, 17 nt, Homo sapiens
uaaccucggcuguuuac

SEQ ID NO: 1806397 - RNA, 14 nt, Homo sapiens
ucuacuacagggug

SEQ ID NO: 1806398 - RNA, 17 nt, Homo sapiens
uagucauuucauggguu

SEQ ID NO: 1806399 - RNA, 18 nt, Homo sapiens
cuauuugagacuccucag

SEQ ID NO: 1806400 - RNA, 20 nt, Homo sapiens
accugacaauuugugauauc

SEQ ID NO: 1806401 - RNA, 13 nt, Homo sapiens
ccuuuccugcaaa

SEQ ID NO: 1806402 - RNA, 18 nt, Homo sapiens
gaaccaaguaguauucau

SEQ ID NO: 1806403 - RNA, 20 nt, Homo sapiens
auggccacugggucucugca

SEQ ID NO: 1806404 - RNA, 19 nt, Homo sapiens
gucaauggacugcaccuug

SEQ ID NO: 1806405 - RNA, 16 nt, Homo sapiens
auuguugucaggccau

SEQ ID NO: 1806406 - RNA, 13 nt, Homo sapiens
acuuacaagucaa

SEQ ID NO: 1806407 - RNA, 16 nt, Homo sapiens
cucauugcuuggaauu

SEQ ID NO: 1806408 - RNA, 21 nt, Homo sapiens
aagaagggauaucuacugugg

SEQ ID NO: 1806409 - RNA, 11 nt, Homo sapiens
uaaugagggac

SEQ ID NO: 1806410 - RNA, 20 nt, Homo sapiens
uucauuuuaacaucugagaa

SEQ ID NO: 1806411 - RNA, 19 nt, Homo sapiens
aagccaauaacacacagcu

SEQ ID NO: 1806412 - RNA, 17 nt, Homo sapiens
acugaccauauugugcu

SEQ ID NO: 1806413 - RNA, 20 nt, Homo sapiens
uagagcccuggccagcccuu

SEQ ID NO: 1806414 - RNA, 12 nt, Homo sapiens
gcagugcaaugc

SEQ ID NO: 1806415 - RNA, 21 nt, Homo sapiens
ggcagggaauggggacggugu

SEQ ID NO: 1806416 - RNA, 13 nt, Homo sapiens
guuacuuaauuca

SEQ ID NO: 1806417 - RNA, 24 nt, Homo sapiens
uuugauaccauggcacugacaaug

SEQ ID NO: 1806418 - RNA, 17 nt, Homo sapiens
gaagugaaaacuuugua

SEQ ID NO: 1806419 - RNA, 21 nt, Homo sapiens
caacagccaagcuggcacaaa

SEQ ID NO: 1806420 - RNA, 22 nt, Homo sapiens
cugccacuaggcugggugccca

SEQ ID NO: 1806421 - RNA, 20 nt, Homo sapiens
aaccuugauuuaaaauauca

SEQ ID NO: 1806422 - RNA, 20 nt, Homo sapiens
cacucagaaaagaaaaccau

SEQ ID NO: 1806423 - RNA, 14 nt, Homo sapiens
augaguccuugaaa

SEQ ID NO: 1806424 - RNA, 19 nt, Homo sapiens
guccaggcccaaggaguaa

SEQ ID NO: 1806425 - RNA, 14 nt, Homo sapiens
ucuaagauucugau

SEQ ID NO: 1806426 - RNA, 13 nt, Homo sapiens
cauaaagugccag

SEQ ID NO: 1806427 - RNA, 17 nt, Homo sapiens
agccagugccauuccac

SEQ ID NO: 1806428 - RNA, 20 nt, Homo sapiens
aaaccucauuaauucugaaa

SEQ ID NO: 1806429 - RNA, 17 nt, Homo sapiens
gcugggaacagugugca

SEQ ID NO: 1806430 - RNA, 18 nt, Homo sapiens
aguacucaggcagugcaa

SEQ ID NO: 1806431 - RNA, 16 nt, Homo sapiens
ggaagcugucccucac

SEQ ID NO: 1806432 - RNA, 18 nt, Homo sapiens
uacccuuucauucagccu

SEQ ID NO: 1806433 - RNA, 23 nt, Homo sapiens
caaugcaucugaaaguuuugaua

SEQ ID NO: 1806434 - RNA, 13 nt, Homo sapiens
uaaaccacaaaag

SEQ ID NO: 1806435 - RNA, 13 nt, Homo sapiens
ucaggcacacagc

SEQ ID NO: 1806436 - RNA, 21 nt, Homo sapiens
uguacucuuugcuaguaccaa

SEQ ID NO: 1806437 - RNA, 20 nt, Homo sapiens
gaugaauugcguuggucucu

SEQ ID NO: 1806438 - RNA, 12 nt, Homo sapiens
gguuuuuugcca

SEQ ID NO: 1806439 - RNA, 12 nt, Homo sapiens
acuuggacucuc

SEQ ID NO: 1806440 - RNA, 21 nt, Homo sapiens
uaugaaugaacaaaccuguga

SEQ ID NO: 1806441 - RNA, 17 nt, Homo sapiens
uagugaccuguguuuca

SEQ ID NO: 1806442 - RNA, 21 nt, Homo sapiens
ggauuccucaccaagcucaac

SEQ ID NO: 1806443 - RNA, 16 nt, Homo sapiens
aggccaggcacagugg

SEQ ID NO: 1806444 - RNA, 15 nt, Homo sapiens
agccuggcugucacc

SEQ ID NO: 1806445 - RNA, 20 nt, Homo sapiens
cugccccggaccuaccuccc

SEQ ID NO: 1806446 - RNA, 14 nt, Homo sapiens
ucaucaaacauugg

SEQ ID NO: 1806447 - RNA, 22 nt, Homo sapiens
gggucaaccuuuguguggcucc

SEQ ID NO: 1806448 - RNA, 22 nt, Homo sapiens
accagguagaacacaaggucau

SEQ ID NO: 1806449 - RNA, 19 nt, Homo sapiens
cacacaaaaaaacaaguau

SEQ ID NO: 1806450 - RNA, 16 nt, Homo sapiens
aaacacccaugcuauc

SEQ ID NO: 1806451 - RNA, 19 nt, Homo sapiens
ucaccaccugacgcugcau

SEQ ID NO: 1806452 - RNA, 15 nt, Homo sapiens
aaacagaagacaaaa

SEQ ID NO: 1806453 - RNA, 17 nt, Homo sapiens
uguggcugccaucagaa

SEQ ID NO: 1806454 - RNA, 14 nt, Homo sapiens
uaaaauaagagauc

SEQ ID NO: 1806455 - RNA, 22 nt, Homo sapiens
agcagcuaaaaccuacucacuu

SEQ ID NO: 1806456 - RNA, 22 nt, Homo sapiens
gcacccaccaccaugcccagcu

SEQ ID NO: 1806457 - RNA, 22 nt, Homo sapiens
uccaggggccaauuuuggauga

SEQ ID NO: 1806458 - RNA, 18 nt, Homo sapiens
uucaagaagucacuguca

SEQ ID NO: 1806459 - RNA, 12 nt, Homo sapiens
caggaggaucau

SEQ ID NO: 1806460 - RNA, 19 nt, Homo sapiens
ucuccacuucuuguucccc

SEQ ID NO: 1806461 - RNA, 19 nt, Homo sapiens
cagccagugaccugaggaa

SEQ ID NO: 1806462 - RNA, 11 nt, Homo sapiens
uuaagcugcua

SEQ ID NO: 1806463 - RNA, 14 nt, Homo sapiens
uuggaaaguccaag

SEQ ID NO: 1806464 - RNA, 17 nt, Homo sapiens
agcccacagaugagaau

SEQ ID NO: 1806465 - RNA, 19 nt, Homo sapiens
uaaaacacaccuaagagaa

SEQ ID NO: 1806466 - RNA, 13 nt, Homo sapiens
aaaagagcuuuau

SEQ ID NO: 1806467 - RNA, 18 nt, Homo sapiens
ggauugugaagauuucau

SEQ ID NO: 1806468 - RNA, 18 nt, Homo sapiens
agggcugggccagugcau

SEQ ID NO: 1806469 - RNA, 18 nt, Homo sapiens
gcccacuguccagcagcc

SEQ ID NO: 1806470 - RNA, 18 nt, Homo sapiens
ucccacuaagcuuucucc

SEQ ID NO: 1806471 - RNA, 18 nt, Homo sapiens
cuuuccuccaaacccaac

SEQ ID NO: 1806472 - RNA, 17 nt, Homo sapiens
uacucaggcaaggggca

SEQ ID NO: 1806473 - RNA, 20 nt, Homo sapiens
aggcuggaaugcaguggugu

SEQ ID NO: 1806474 - RNA, 16 nt, Homo sapiens
caaauaguagacauuu

SEQ ID NO: 1806475 - RNA, 15 nt, Homo sapiens
gcaucugaccagcag

SEQ ID NO: 1806476 - RNA, 19 nt, Homo sapiens
uaaaugugacucagcauca

SEQ ID NO: 1806477 - RNA, 19 nt, Homo sapiens
auuuucuagauaccacuua

SEQ ID NO: 1806478 - RNA, 20 nt, Homo sapiens
gucugugugguggagccagg

SEQ ID NO: 1806479 - RNA, 13 nt, Homo sapiens
uuuaugcacauga

SEQ ID NO: 1806480 - RNA, 18 nt, Homo sapiens
auggaaguggcagugaaa

SEQ ID NO: 1806481 - RNA, 23 nt, Homo sapiens
aagugauugaagcccagugaauu

SEQ ID NO: 1806482 - RNA, 15 nt, Homo sapiens
cugucuaggcacaug

SEQ ID NO: 1806483 - RNA, 18 nt, Homo sapiens
gagcaagugagacccugu

SEQ ID NO: 1806484 - RNA, 20 nt, Homo sapiens
ucccucaggucccuugguca

SEQ ID NO: 1806485 - RNA, 23 nt, Homo sapiens
cacuuucauaguuauuguuucug

SEQ ID NO: 1806486 - RNA, 23 nt, Homo sapiens
agaagccccaagcaacuuuccuu

SEQ ID NO: 1806487 - RNA, 23 nt, Homo sapiens
caagcugagaaaaguauucucaa

SEQ ID NO: 1806488 - RNA, 16 nt, Homo sapiens
uagccacaauucuguc

SEQ ID NO: 1806489 - RNA, 22 nt, Homo sapiens
cccguggugagguugugcugcc

SEQ ID NO: 1806490 - RNA, 15 nt, Homo sapiens
cuauauacaugugug

SEQ ID NO: 1806491 - RNA, 17 nt, Homo sapiens
ugacugccaagccagau

SEQ ID NO: 1806492 - RNA, 20 nt, Homo sapiens
auagccuuuguuuucuaaua

SEQ ID NO: 1806493 - RNA, 18 nt, Homo sapiens
uuucaagcauuaagaaca

SEQ ID NO: 1806494 - RNA, 12 nt, Homo sapiens
gaggaacauuca

SEQ ID NO: 1806495 - RNA, 22 nt, Homo sapiens
cuguuauccuuaaggcauauac

SEQ ID NO: 1806496 - RNA, 14 nt, Homo sapiens
uaguacuauugcua

SEQ ID NO: 1806497 - RNA, 17 nt, Homo sapiens
aggauuaaaucugguca

SEQ ID NO: 1806498 - RNA, 12 nt, Homo sapiens
uuuugaaggcaa

SEQ ID NO: 1806499 - RNA, 15 nt, Homo sapiens
cagacaucaagcuca

SEQ ID NO: 1806500 - RNA, 18 nt, Homo sapiens
gcugacuguacuccuccc

SEQ ID NO: 1806501 - RNA, 16 nt, Homo sapiens
augauucuuccaagga

SEQ ID NO: 1806502 - RNA, 18 nt, Homo sapiens
aagcauacaaagcaguuu

SEQ ID NO: 1806503 - RNA, 19 nt, Homo sapiens
caauaaaauaaaagcacuu

SEQ ID NO: 1806504 - RNA, 18 nt, Homo sapiens
ccacuugccugugcuaca

SEQ ID NO: 1806505 - RNA, 13 nt, Homo sapiens
aagacauugcacc

SEQ ID NO: 1806506 - RNA, 19 nt, Homo sapiens
augccgggccaugauucuu

SEQ ID NO: 1806507 - RNA, 22 nt, Homo sapiens
uaaaaugaaccugaucacuuuu

SEQ ID NO: 1806508 - RNA, 18 nt, Homo sapiens
gcccccucccugcuccca

SEQ ID NO: 1806509 - RNA, 13 nt, Homo sapiens
ugcaagugugcau

SEQ ID NO: 1806510 - RNA, 23 nt, Homo sapiens
uguauguuuacauaucaccucau

SEQ ID NO: 1806511 - RNA, 16 nt, Homo sapiens
uagucuaucagcaucu

SEQ ID NO: 1806512 - RNA, 15 nt, Homo sapiens
acccagccucuagaa

SEQ ID NO: 1806513 - RNA, 13 nt, Homo sapiens
aacucaaaucccc

SEQ ID NO: 1806514 - RNA, 14 nt, Homo sapiens
ugccuucucaggaa

SEQ ID NO: 1806515 - RNA, 14 nt, Homo sapiens
aauagcaugucacu

SEQ ID NO: 1806516 - RNA, 20 nt, Homo sapiens
gcccaggcggucacugccca

SEQ ID NO: 1806517 - RNA, 18 nt, Homo sapiens
cugauucuucauucugua

SEQ ID NO: 1806518 - RNA, 16 nt, Homo sapiens
uugaagcuagugcauu

SEQ ID NO: 1806519 - RNA, 14 nt, Homo sapiens
cauuuuuauauuca

SEQ ID NO: 1806520 - RNA, 17 nt, Homo sapiens
caagaauuacacuaaua

SEQ ID NO: 1806521 - RNA, 22 nt, Homo sapiens
ccaugugaccgaacacugcagc

SEQ ID NO: 1806522 - RNA, 19 nt, Homo sapiens
ucucugucccuugcuguau

SEQ ID NO: 1806523 - RNA, 19 nt, Homo sapiens
cauugacgagcaugagcug

SEQ ID NO: 1806524 - RNA, 20 nt, Homo sapiens
guaucuauuagcagccauau

SEQ ID NO: 1806525 - RNA, 22 nt, Homo sapiens
augcuucugacuucauagauuu

SEQ ID NO: 1806526 - RNA, 9 nt, Homo sapiens
uguguaugu

SEQ ID NO: 1806527 - RNA, 14 nt, Homo sapiens
uucuccucugcuag

SEQ ID NO: 1806528 - RNA, 20 nt, Homo sapiens
uguucauuuuagugacugua

SEQ ID NO: 1806529 - RNA, 19 nt, Homo sapiens
cagagcaggcaauuucacc

SEQ ID NO: 1806530 - RNA, 14 nt, Homo sapiens
uacuuaacauacac

SEQ ID NO: 1806531 - RNA, 14 nt, Homo sapiens
aaacacacuucuua

SEQ ID NO: 1806532 - RNA, 18 nt, Homo sapiens
gagcaguccauuucuacc

SEQ ID NO: 1806533 - RNA, 20 nt, Homo sapiens
gacacuggugguucuacuga

SEQ ID NO: 1806534 - RNA, 23 nt, Homo sapiens
aaucagugugucuaaauuugaau

SEQ ID NO: 1806535 - RNA, 20 nt, Homo sapiens
gugcuuuuugggaccaucac

SEQ ID NO: 1806536 - RNA, 14 nt, Homo sapiens
acauccauucccaa

SEQ ID NO: 1806537 - RNA, 15 nt, Homo sapiens
ugggucucagcugcu

SEQ ID NO: 1806538 - RNA, 21 nt, Homo sapiens
aguauuuaguuauaucacuug

SEQ ID NO: 1806539 - RNA, 17 nt, Homo sapiens
aagugcaauccauguau

SEQ ID NO: 1806540 - RNA, 13 nt, Homo sapiens
ugaggauuucaag

SEQ ID NO: 1806541 - RNA, 20 nt, Homo sapiens
aggaacccccucaccaccug

SEQ ID NO: 1806542 - RNA, 19 nt, Homo sapiens
guuggaugcggaacccaaa

SEQ ID NO: 1806543 - RNA, 19 nt, Homo sapiens
uaacucuuuuggacaaagg

SEQ ID NO: 1806544 - RNA, 17 nt, Homo sapiens
ucuggauucugaaucuc

SEQ ID NO: 1806545 - RNA, 20 nt, Homo sapiens
augaagcuaccucaaacuuc

SEQ ID NO: 1806546 - RNA, 13 nt, Homo sapiens
ggaaggcucucgg

SEQ ID NO: 1806547 - RNA, 13 nt, Homo sapiens
cgaaugacacugu

SEQ ID NO: 1806548 - RNA, 12 nt, Homo sapiens
uaaauauaauua

SEQ ID NO: 1806549 - RNA, 15 nt, Homo sapiens
cgaggggcucaggaa

SEQ ID NO: 1806550 - RNA, 14 nt, Homo sapiens
caaagguugcagug

SEQ ID NO: 1806551 - RNA, 18 nt, Homo sapiens
ugccucucccugcugcuc

SEQ ID NO: 1806552 - RNA, 22 nt, Homo sapiens
uuucgcaccuaccaucagggac

SEQ ID NO: 1806553 - RNA, 16 nt, Homo sapiens
aagauaguuuucuccu

SEQ ID NO: 1806554 - RNA, 23 nt, Homo sapiens
gcaagguuuaggcugguggccca

SEQ ID NO: 1806555 - RNA, 15 nt, Homo sapiens
gaagacccaguguaa

SEQ ID NO: 1806556 - RNA, 18 nt, Homo sapiens
gcuggccucuggcucuca

SEQ ID NO: 1806557 - RNA, 23 nt, Homo sapiens
caacuucaguuuuauuuuugcca

SEQ ID NO: 1806558 - RNA, 14 nt, Homo sapiens
aauuaaaguacuuu

SEQ ID NO: 1806559 - RNA, 19 nt, Homo sapiens
gcuaaaauaacagauuucu

SEQ ID NO: 1806560 - RNA, 13 nt, Homo sapiens
uuugugaacacuu

SEQ ID NO: 1806561 - RNA, 22 nt, Homo sapiens
gcugaguuucucuuggguauaa

SEQ ID NO: 1806562 - RNA, 21 nt, Homo sapiens
cucagccucccaaagugcagg

SEQ ID NO: 1806563 - RNA, 21 nt, Homo sapiens
aauucuucucaaagauuugac

SEQ ID NO: 1806564 - RNA, 14 nt, Homo sapiens
cuuaaacugccaau

SEQ ID NO: 1806565 - RNA, 20 nt, Homo sapiens
gaaaaagcaaguguucacug

SEQ ID NO: 1806566 - RNA, 18 nt, Homo sapiens
uucuggagaucauuuaaa

SEQ ID NO: 1806567 - RNA, 18 nt, Homo sapiens
ugccgcuacaguuuuuau

SEQ ID NO: 1806568 - RNA, 23 nt, Homo sapiens
ugcaaucuuauguugaucgaugu

SEQ ID NO: 1806569 - RNA, 15 nt, Homo sapiens
guggaggccacuguu

SEQ ID NO: 1806570 - RNA, 22 nt, Homo sapiens
acaacuuuauguugcaggaaac

SEQ ID NO: 1806571 - RNA, 15 nt, Homo sapiens
uauugguuugcacaa

SEQ ID NO: 1806572 - RNA, 14 nt, Homo sapiens
guguuaacucagga

SEQ ID NO: 1806573 - RNA, 16 nt, Homo sapiens
gauagcauaggcaaag

SEQ ID NO: 1806574 - RNA, 15 nt, Homo sapiens
ccucucaguacuuug

SEQ ID NO: 1806575 - RNA, 21 nt, Homo sapiens
agguaugguuaauaaguuuca

SEQ ID NO: 1806576 - RNA, 12 nt, Homo sapiens
cugcagcccagg

SEQ ID NO: 1806577 - RNA, 15 nt, Homo sapiens
auaugaaauguauuu

SEQ ID NO: 1806578 - RNA, 18 nt, Homo sapiens
uacauuuacuggacccug

SEQ ID NO: 1806579 - RNA, 18 nt, Homo sapiens
aguccaauuuuuacucag

SEQ ID NO: 1806580 - RNA, 13 nt, Homo sapiens
cauagcuugcaca

SEQ ID NO: 1806581 - RNA, 20 nt, Homo sapiens
uauugagacauauuacugga

SEQ ID NO: 1806582 - RNA, 14 nt, Homo sapiens
cugugggaguccac

SEQ ID NO: 1806583 - RNA, 23 nt, Homo sapiens
cuuaauaaaggcccccacuucuc

SEQ ID NO: 1806584 - RNA, 20 nt, Homo sapiens
aagacaucucaaauacagua

SEQ ID NO: 1806585 - RNA, 20 nt, Homo sapiens
agugcuguccaugcuucuca

SEQ ID NO: 1806586 - RNA, 14 nt, Homo sapiens
agauuucagaucau

SEQ ID NO: 1806587 - RNA, 20 nt, Homo sapiens
ugucugggucuaccaggaac

SEQ ID NO: 1806588 - RNA, 20 nt, Homo sapiens
aagagaauuuggggcuucca

SEQ ID NO: 1806589 - RNA, 13 nt, Homo sapiens
cuuccaccugucc

SEQ ID NO: 1806590 - RNA, 13 nt, Homo sapiens
cuaaaaccugaaa

SEQ ID NO: 1806591 - RNA, 20 nt, Homo sapiens
ugguuugaacaucaaaggga

SEQ ID NO: 1806592 - RNA, 14 nt, Homo sapiens
aagaucaacauucc

SEQ ID NO: 1806593 - RNA, 20 nt, Homo sapiens
aucacucuuagaccaugcua

SEQ ID NO: 1806594 - RNA, 20 nt, Homo sapiens
ugaaaaggguacagaugugc

SEQ ID NO: 1806595 - RNA, 16 nt, Homo sapiens
cagacuccugugcaac

SEQ ID NO: 1806596 - RNA, 18 nt, Homo sapiens
acucaucccuguuccuca

SEQ ID NO: 1806597 - RNA, 20 nt, Homo sapiens
uucuuggaccccugaauuca

SEQ ID NO: 1806598 - RNA, 16 nt, Homo sapiens
caucauuuuuguaucu

SEQ ID NO: 1806599 - RNA, 17 nt, Homo sapiens
ccauaucuucuguuuca

SEQ ID NO: 1806600 - RNA, 15 nt, Homo sapiens
agauuuccacagaga

SEQ ID NO: 1806601 - RNA, 17 nt, Homo sapiens
aaauaucauaaagcauu

SEQ ID NO: 1806602 - RNA, 14 nt, Homo sapiens
gcuuuaacaaaaca

SEQ ID NO: 1806603 - RNA, 22 nt, Homo sapiens
ggaaaacaggaacccaccaaac

SEQ ID NO: 1806604 - RNA, 16 nt, Homo sapiens
aagugucacagccaua

SEQ ID NO: 1806605 - RNA, 17 nt, Homo sapiens
aaccaagucuacuucac

SEQ ID NO: 1806606 - RNA, 20 nt, Homo sapiens
ugcaugucuuaaaugcucau

SEQ ID NO: 1806607 - RNA, 14 nt, Homo sapiens
uaggaacccggcau

SEQ ID NO: 1806608 - RNA, 23 nt, Homo sapiens
ugugcccucuuaagugugcacag

SEQ ID NO: 1806609 - RNA, 14 nt, Homo sapiens
gcaugacagcuguu

SEQ ID NO: 1806610 - RNA, 16 nt, Homo sapiens
cugacagcuucaugaa

SEQ ID NO: 1806611 - RNA, 15 nt, Homo sapiens
uccuuuugguuuugg

SEQ ID NO: 1806612 - RNA, 16 nt, Homo sapiens
ucaauccgaaguauga

SEQ ID NO: 1806613 - RNA, 17 nt, Homo sapiens
auuucuggggggagaaa

SEQ ID NO: 1806614 - RNA, 20 nt, Homo sapiens
agacagggucucacuauguu

SEQ ID NO: 1806615 - RNA, 22 nt, Homo sapiens
agccaacaucacaccauugcac

SEQ ID NO: 1806616 - RNA, 23 nt, Homo sapiens
ucauauuauuuuaguguguaaaa

SEQ ID NO: 1806617 - RNA, 15 nt, Homo sapiens
acaaaguaagccaug

SEQ ID NO: 1806618 - RNA, 17 nt, Homo sapiens
agggaagagggagacca

SEQ ID NO: 1806619 - RNA, 13 nt, Homo sapiens
accagugccaagg

SEQ ID NO: 1806620 - RNA, 21 nt, Homo sapiens
aaaguuaaaacggaugucucc

SEQ ID NO: 1806621 - RNA, 16 nt, Homo sapiens
cugagccaaagccaga

SEQ ID NO: 1806622 - RNA, 14 nt, Homo sapiens
uuagaagucacaca

SEQ ID NO: 1806623 - RNA, 19 nt, Homo sapiens
cauuuuuugggcagcaauu

SEQ ID NO: 1806624 - RNA, 18 nt, Homo sapiens
auucacuagaccagaagu

SEQ ID NO: 1806625 - RNA, 15 nt, Homo sapiens
aacacugaagugcuu

SEQ ID NO: 1806626 - RNA, 16 nt, Homo sapiens
gauaccauggcacuga

SEQ ID NO: 1806627 - RNA, 17 nt, Homo sapiens
ucugacucuaagaauuc

SEQ ID NO: 1806628 - RNA, 16 nt, Homo sapiens
caaaugggacugaugu

SEQ ID NO: 1806629 - RNA, 13 nt, Homo sapiens
cuaaagagcuuua

SEQ ID NO: 1806630 - RNA, 17 nt, Homo sapiens
aggggaagggucccuuu

SEQ ID NO: 1806631 - RNA, 19 nt, Homo sapiens
auaaacauuaaacacugua

SEQ ID NO: 1806632 - RNA, 24 nt, Homo sapiens
aacuauuaaucauccucugaguua

SEQ ID NO: 1806633 - RNA, 20 nt, Homo sapiens
uaggcacccauccuagagaa

SEQ ID NO: 1806634 - RNA, 20 nt, Homo sapiens
uuaaguuauuuuauauauau

SEQ ID NO: 1806635 - RNA, 18 nt, Homo sapiens
gggcaagagaugggacaa

SEQ ID NO: 1806636 - RNA, 20 nt, Homo sapiens
augugagaccauuuagcaca

SEQ ID NO: 1806637 - RNA, 12 nt, Homo sapiens
caauggacugua

SEQ ID NO: 1806638 - RNA, 18 nt, Homo sapiens
auucucaggccaucauca

SEQ ID NO: 1806639 - RNA, 12 nt, Homo sapiens
cuccuggugacu

SEQ ID NO: 1806640 - RNA, 14 nt, Homo sapiens
uagugccacccacc

SEQ ID NO: 1806641 - RNA, 15 nt, Homo sapiens
ccagcuuaaaacacu

SEQ ID NO: 1806642 - RNA, 18 nt, Homo sapiens
ugcuuugaauaaaugugu

SEQ ID NO: 1806643 - RNA, 19 nt, Homo sapiens
uauuauugauucacuuacu

SEQ ID NO: 1806644 - RNA, 16 nt, Homo sapiens
uuuguagaacugccca

SEQ ID NO: 1806645 - RNA, 16 nt, Homo sapiens
ucgaguccaaaaucau

SEQ ID NO: 1806646 - RNA, 16 nt, Homo sapiens
uuggcugcguacucca

SEQ ID NO: 1806647 - RNA, 14 nt, Homo sapiens
uuaaaugaaccaaa

SEQ ID NO: 1806648 - RNA, 22 nt, Homo sapiens
gaguguuguuuugugguaucau

SEQ ID NO: 1806649 - RNA, 17 nt, Homo sapiens
agccugggugguaccca

SEQ ID NO: 1806650 - RNA, 19 nt, Homo sapiens
cugcccuggcugggccccu

SEQ ID NO: 1806651 - RNA, 14 nt, Homo sapiens
caacaauaaaauac

SEQ ID NO: 1806652 - RNA, 18 nt, Homo sapiens
ccucgcuccccucuggaa

SEQ ID NO: 1806653 - RNA, 19 nt, Homo sapiens
cagcacuuugggagaccaa

SEQ ID NO: 1806654 - RNA, 21 nt, Homo sapiens
aacauugacccagaaauguau

SEQ ID NO: 1806655 - RNA, 11 nt, Homo sapiens
gaggggccagu

SEQ ID NO: 1806656 - RNA, 14 nt, Homo sapiens
ucacccaggaggau

SEQ ID NO: 1806657 - RNA, 22 nt, Homo sapiens
aacuguuuugguaguuggauuu

SEQ ID NO: 1806658 - RNA, 19 nt, Homo sapiens
uggcuuuaugcaaauacaa

SEQ ID NO: 1806659 - RNA, 21 nt, Homo sapiens
aaugacaguuuuuauuugaag

SEQ ID NO: 1806660 - RNA, 15 nt, Homo sapiens
uggaguauacaugac

SEQ ID NO: 1806661 - RNA, 22 nt, Homo sapiens
cugucuguguuucuuuuugcca

SEQ ID NO: 1806662 - RNA, 15 nt, Homo sapiens
auuugaugugacuuu

SEQ ID NO: 1806663 - RNA, 15 nt, Homo sapiens
uagcugauaugucag

SEQ ID NO: 1806664 - RNA, 17 nt, Homo sapiens
ugaggugggagaugugg

SEQ ID NO: 1806665 - RNA, 12 nt, Homo sapiens
guccucuuuaca

SEQ ID NO: 1806666 - RNA, 20 nt, Homo sapiens
aaaucagcugcuacuacucc

SEQ ID NO: 1806667 - RNA, 18 nt, Homo sapiens
gauuaucaauuaccacac

SEQ ID NO: 1806668 - RNA, 12 nt, Homo sapiens
uaaaacauagca

SEQ ID NO: 1806669 - RNA, 16 nt, Homo sapiens
gaauguaguauucaau

SEQ ID NO: 1806670 - RNA, 13 nt, Homo sapiens
auaguacuauuac

SEQ ID NO: 1806671 - RNA, 13 nt, Homo sapiens
agcacggacaaua

SEQ ID NO: 1806672 - RNA, 21 nt, Homo sapiens
caaagccaauaacacacagcu

SEQ ID NO: 1806673 - RNA, 16 nt, Homo sapiens
uugugauuucuuuaaa

SEQ ID NO: 1806674 - RNA, 17 nt, Homo sapiens
augaauuaacccaaaga

SEQ ID NO: 1806675 - RNA, 13 nt, Homo sapiens
agacuaagccaga

SEQ ID NO: 1806676 - RNA, 17 nt, Homo sapiens
acucaaaggacugaccu

SEQ ID NO: 1806677 - RNA, 20 nt, Homo sapiens
ucuucaaaucucagcaaagc

SEQ ID NO: 1806678 - RNA, 17 nt, Homo sapiens
gaagcccaccacuggcc

SEQ ID NO: 1806679 - RNA, 16 nt, Homo sapiens
ugacugucccuucgac

SEQ ID NO: 1806680 - RNA, 23 nt, Homo sapiens
uccaaaccuuacucugagcucau

SEQ ID NO: 1806681 - RNA, 14 nt, Homo sapiens
gucuguacugauuc

SEQ ID NO: 1806682 - RNA, 12 nt, Homo sapiens
uagcacuuugcg

SEQ ID NO: 1806683 - RNA, 22 nt, Homo sapiens
gaugggaggagagccacugggc

SEQ ID NO: 1806684 - RNA, 21 nt, Homo sapiens
ugcaauacggaacacugucaa

SEQ ID NO: 1806685 - RNA, 14 nt, Homo sapiens
aagcccacccuggg

SEQ ID NO: 1806686 - RNA, 18 nt, Homo sapiens
uuccccaggagcucucug

SEQ ID NO: 1806687 - RNA, 14 nt, Homo sapiens
uuuaacguuuucau

SEQ ID NO: 1806688 - RNA, 15 nt, Homo sapiens
ccagccccacugcca

SEQ ID NO: 1806689 - RNA, 15 nt, Homo sapiens
ccagagacacugagc

SEQ ID NO: 1806690 - RNA, 14 nt, Homo sapiens
augucaguacuauu

SEQ ID NO: 1806691 - RNA, 21 nt, Homo sapiens
gccucuguacgcgcagaucaa

SEQ ID NO: 1806692 - RNA, 15 nt, Homo sapiens
cauuugcagugcauc

SEQ ID NO: 1806693 - RNA, 23 nt, Homo sapiens
aguacuuaauaaacuguggugcu

SEQ ID NO: 1806694 - RNA, 22 nt, Homo sapiens
uuaaaccugucuccacugugcc

SEQ ID NO: 1806695 - RNA, 19 nt, Homo sapiens
gaagugugacccugugaca

SEQ ID NO: 1806696 - RNA, 22 nt, Homo sapiens
ggugaaguccacagaagugagc

SEQ ID NO: 1806697 - RNA, 18 nt, Homo sapiens
ucauuacuguguucaauu

SEQ ID NO: 1806698 - RNA, 16 nt, Homo sapiens
uugagggaugcuggaa

SEQ ID NO: 1806699 - RNA, 16 nt, Homo sapiens
gacacacaaaucccau

SEQ ID NO: 1806700 - RNA, 18 nt, Homo sapiens
guauaccaaggcaaaaaa

SEQ ID NO: 1806701 - RNA, 21 nt, Homo sapiens
uugucggccccaccagugccu

SEQ ID NO: 1806702 - RNA, 19 nt, Homo sapiens
ccacugccuguaacagcca

SEQ ID NO: 1806703 - RNA, 23 nt, Homo sapiens
aauaacuucucugugaacuauua

SEQ ID NO: 1806704 - RNA, 14 nt, Homo sapiens
uacucuccaaccug

SEQ ID NO: 1806705 - RNA, 18 nt, Homo sapiens
cauguuauccacaagcaa

SEQ ID NO: 1806706 - RNA, 15 nt, Homo sapiens
cuuucugugaagcua

SEQ ID NO: 1806707 - RNA, 17 nt, Homo sapiens
ccuaugaaauacuuuau

SEQ ID NO: 1806708 - RNA, 19 nt, Homo sapiens
aaguucauucauacucaaa

SEQ ID NO: 1806709 - RNA, 21 nt, Homo sapiens
acauacuauagauucuuuauu

SEQ ID NO: 1806710 - RNA, 20 nt, Homo sapiens
gacugguauaccuauuucau

SEQ ID NO: 1806711 - RNA, 20 nt, Homo sapiens
aagaacccucaggucacaag

SEQ ID NO: 1806712 - RNA, 12 nt, Homo sapiens
cagagguaaaaa

SEQ ID NO: 1806713 - RNA, 14 nt, Homo sapiens
acauaccacacuua

SEQ ID NO: 1806714 - RNA, 18 nt, Homo sapiens
guuucucggugacuugga

SEQ ID NO: 1806715 - RNA, 14 nt, Homo sapiens
ccaacccagcaguu

SEQ ID NO: 1806716 - RNA, 14 nt, Homo sapiens
aagcugaaugauuc

SEQ ID NO: 1806717 - RNA, 18 nt, Homo sapiens
aacaugcaaggcacugac

SEQ ID NO: 1806718 - RNA, 18 nt, Homo sapiens
guguauggccugaagcuc

SEQ ID NO: 1806719 - RNA, 14 nt, Homo sapiens
aacagaagcaguug

SEQ ID NO: 1806720 - RNA, 11 nt, Homo sapiens
acacacugugc

SEQ ID NO: 1806721 - RNA, 14 nt, Homo sapiens
auggaacuguuggc

SEQ ID NO: 1806722 - RNA, 20 nt, Homo sapiens
acaucaaguguaauuagcuu

SEQ ID NO: 1806723 - RNA, 21 nt, Homo sapiens
uaacacuauacucuaaaaugg

SEQ ID NO: 1806724 - RNA, 13 nt, Homo sapiens
acaaaaaucagcc

SEQ ID NO: 1806725 - RNA, 21 nt, Homo sapiens
uauaaaaauaaaaaacacugg

SEQ ID NO: 1806726 - RNA, 12 nt, Homo sapiens
acgcacuugccu

SEQ ID NO: 1806727 - RNA, 23 nt, Homo sapiens
agaguuggggagaaacugaagcc

SEQ ID NO: 1806728 - RNA, 14 nt, Homo sapiens
aaaauguacacugg

SEQ ID NO: 1806729 - RNA, 21 nt, Homo sapiens
cugggaugugaagucucuggg

SEQ ID NO: 1806730 - RNA, 19 nt, Homo sapiens
uuugugugugugcaagugu

SEQ ID NO: 1806731 - RNA, 21 nt, Homo sapiens
auguucucugaaugagccuuu

SEQ ID NO: 1806732 - RNA, 16 nt, Homo sapiens
gccuccagcccucuca

SEQ ID NO: 1806733 - RNA, 20 nt, Homo sapiens
caugaagcuggaagcacugc

SEQ ID NO: 1806734 - RNA, 19 nt, Homo sapiens
ugccauccucaaacacugc

SEQ ID NO: 1806735 - RNA, 13 nt, Homo sapiens
cacuucagaauuc

SEQ ID NO: 1806736 - RNA, 18 nt, Homo sapiens
uauccuauaagaugacaa

SEQ ID NO: 1806737 - RNA, 21 nt, Homo sapiens
aguugguauuuuauaagcaca

SEQ ID NO: 1806738 - RNA, 19 nt, Homo sapiens
aauccauccugcucuucca

SEQ ID NO: 1806739 - RNA, 15 nt, Homo sapiens
aguaguuaagagcua

SEQ ID NO: 1806740 - RNA, 14 nt, Homo sapiens
gugggacaacaaag

SEQ ID NO: 1806741 - RNA, 21 nt, Homo sapiens
ugaagaacaggcuuggcaaag

SEQ ID NO: 1806742 - RNA, 15 nt, Homo sapiens
uacuaccacaaggaa

SEQ ID NO: 1806743 - RNA, 20 nt, Homo sapiens
auguucacaagguaccccaa

SEQ ID NO: 1806744 - RNA, 21 nt, Homo sapiens
uauaacuuaggccuagccucu

SEQ ID NO: 1806745 - RNA, 21 nt, Homo sapiens
aacaaauuagguuuuguacaa

SEQ ID NO: 1806746 - RNA, 20 nt, Homo sapiens
caggcucccaaacucaggcu

SEQ ID NO: 1806747 - RNA, 21 nt, Homo sapiens
cugaauucuuuuucucagcaa

SEQ ID NO: 1806748 - RNA, 19 nt, Homo sapiens
cugccaggaguagugagcu

SEQ ID NO: 1806749 - RNA, 20 nt, Homo sapiens
aaguuguugacugugauuag

SEQ ID NO: 1806750 - RNA, 16 nt, Homo sapiens
ccauccugaccagcug

SEQ ID NO: 1806751 - RNA, 21 nt, Homo sapiens
agagaugaaguuaaagguauu

SEQ ID NO: 1806752 - RNA, 18 nt, Homo sapiens
ucccauggauaggggagg

SEQ ID NO: 1806753 - RNA, 16 nt, Homo sapiens
accauuuguauccacu

SEQ ID NO: 1806754 - RNA, 12 nt, Homo sapiens
cugcauuuacag

SEQ ID NO: 1806755 - RNA, 21 nt, Homo sapiens
accugauugaucacacagugu

SEQ ID NO: 1806756 - RNA, 13 nt, Homo sapiens
ugcuguauacugu

SEQ ID NO: 1806757 - RNA, 22 nt, Homo sapiens
uuuauauuguuuuuauauauua

SEQ ID NO: 1806758 - RNA, 22 nt, Homo sapiens
uugcacuucuaagacuuuacuu

SEQ ID NO: 1806759 - RNA, 17 nt, Homo sapiens
uggagcaucugacucac

SEQ ID NO: 1806760 - RNA, 19 nt, Homo sapiens
cccuaaaacuuaaaguaua

SEQ ID NO: 1806761 - RNA, 22 nt, Homo sapiens
aaaugucuucuguauucacuua

SEQ ID NO: 1806762 - RNA, 16 nt, Homo sapiens
caaagugacuauucag

SEQ ID NO: 1806763 - RNA, 19 nt, Homo sapiens
aggagggcuuugugucugg

SEQ ID NO: 1806764 - RNA, 21 nt, Homo sapiens
cugcuuacaauucccugcugu

SEQ ID NO: 1806765 - RNA, 23 nt, Homo sapiens
uuucccugaaggaaccaaagcga

SEQ ID NO: 1806766 - RNA, 20 nt, Homo sapiens
ucuguuggauaauuagcagu

SEQ ID NO: 1806767 - RNA, 17 nt, Homo sapiens
agcaaaguuuuaccugu

SEQ ID NO: 1806768 - RNA, 15 nt, Homo sapiens
aaaaccacagccacu

SEQ ID NO: 1806769 - RNA, 23 nt, Homo sapiens
agugauugugucugcauuguuau

SEQ ID NO: 1806770 - RNA, 18 nt, Homo sapiens
ucugacuuucucuucuac

SEQ ID NO: 1806771 - RNA, 16 nt, Homo sapiens
gccaggggaccuuccu

SEQ ID NO: 1806772 - RNA, 16 nt, Homo sapiens
aaauuaaaucugaaua

SEQ ID NO: 1806773 - RNA, 15 nt, Homo sapiens
agcccugaggugaaa

SEQ ID NO: 1806774 - RNA, 14 nt, Homo sapiens
caacucugcuccca

SEQ ID NO: 1806775 - RNA, 20 nt, Homo sapiens
uuccuauggcuggccacugc

SEQ ID NO: 1806776 - RNA, 15 nt, Homo sapiens
cccucugccuuugaa

SEQ ID NO: 1806777 - RNA, 13 nt, Homo sapiens
guauuacugcugc

SEQ ID NO: 1806778 - RNA, 20 nt, Homo sapiens
acacgagcaggcuacuguca

SEQ ID NO: 1806779 - RNA, 14 nt, Homo sapiens
ucuucuuugcugca

SEQ ID NO: 1806780 - RNA, 20 nt, Homo sapiens
agcuuuauuaccaguggcgu

SEQ ID NO: 1806781 - RNA, 20 nt, Homo sapiens
agaacuaucugcauuaucua

SEQ ID NO: 1806782 - RNA, 22 nt, Homo sapiens
ggcugguuuuguaagaugcugg

SEQ ID NO: 1806783 - RNA, 14 nt, Homo sapiens
caugcugugcauuu

SEQ ID NO: 1806784 - RNA, 21 nt, Homo sapiens
cuuuguggggcucaaaaccuc

SEQ ID NO: 1806785 - RNA, 20 nt, Homo sapiens
ugaagauccccaacugcucc

SEQ ID NO: 1806786 - RNA, 19 nt, Homo sapiens
aaggaucuggaccaguuuc

SEQ ID NO: 1806787 - RNA, 23 nt, Homo sapiens
ugcucaugcccugccaagcagca

SEQ ID NO: 1806788 - RNA, 13 nt, Homo sapiens
uaugucaucauac

SEQ ID NO: 1806789 - RNA, 18 nt, Homo sapiens
cccaagcacuccacaacu

SEQ ID NO: 1806790 - RNA, 19 nt, Homo sapiens
acacccaucucaacagggu

SEQ ID NO: 1806791 - RNA, 19 nt, Homo sapiens
cagaaguuucuucuuuagg

SEQ ID NO: 1806792 - RNA, 17 nt, Homo sapiens
uccagauccuucaaaga

SEQ ID NO: 1806793 - RNA, 19 nt, Homo sapiens
uguuaauuuuuuuuacuau

SEQ ID NO: 1806794 - RNA, 18 nt, Homo sapiens
accucugggcagcuccug

SEQ ID NO: 1806795 - RNA, 21 nt, Homo sapiens
uacugcaaagucgccagucac

SEQ ID NO: 1806796 - RNA, 19 nt, Homo sapiens
agggagggcuccagacaca

SEQ ID NO: 1806797 - RNA, 21 nt, Homo sapiens
auauuccugcauuugugaaau

SEQ ID NO: 1806798 - RNA, 20 nt, Homo sapiens
ccuaagugcaaacacagcau

SEQ ID NO: 1806799 - RNA, 20 nt, Homo sapiens
uuaaaccgugauucuugaaa

SEQ ID NO: 1806800 - RNA, 12 nt, Homo sapiens
uuuuagcuguga

SEQ ID NO: 1806801 - RNA, 15 nt, Homo sapiens
caucucagugcugua

SEQ ID NO: 1806802 - RNA, 16 nt, Homo sapiens
gauggaagacaggaaa

SEQ ID NO: 1806803 - RNA, 15 nt, Homo sapiens
uccacucugcucagg

SEQ ID NO: 1806804 - RNA, 23 nt, Homo sapiens
auaacugcuacuugcucugcucu

SEQ ID NO: 1806805 - RNA, 19 nt, Homo sapiens
guuaagagaaugcuuugaa

SEQ ID NO: 1806806 - RNA, 17 nt, Homo sapiens
uucucuuuucaaacaca

SEQ ID NO: 1806807 - RNA, 22 nt, Homo sapiens
ggcaucaaacagggcaaagugu

SEQ ID NO: 1806808 - RNA, 20 nt, Homo sapiens
ucaacucuguuuauuugaug

SEQ ID NO: 1806809 - RNA, 20 nt, Homo sapiens
agcaucucagaguccaguca

SEQ ID NO: 1806810 - RNA, 14 nt, Homo sapiens
ggccuuagaacuuu

SEQ ID NO: 1806811 - RNA, 14 nt, Homo sapiens
uacuaccugucaag

SEQ ID NO: 1806812 - RNA, 23 nt, Homo sapiens
ccaacaguggcuaauaaaaugac

SEQ ID NO: 1806813 - RNA, 12 nt, Homo sapiens
aagaacaccauc

SEQ ID NO: 1806814 - RNA, 16 nt, Homo sapiens
cuuuuuuuuguagcca

SEQ ID NO: 1806815 - RNA, 17 nt, Homo sapiens
aauguuuauuuagcucu

SEQ ID NO: 1806816 - RNA, 13 nt, Homo sapiens
caaagacuuuccu

SEQ ID NO: 1806817 - RNA, 15 nt, Homo sapiens
ugaauucuaacauua

SEQ ID NO: 1806818 - RNA, 15 nt, Homo sapiens
cucugagggcuuccu

SEQ ID NO: 1806819 - RNA, 17 nt, Homo sapiens
cuuugagggacugccuc

SEQ ID NO: 1806820 - RNA, 14 nt, Homo sapiens
gaauguuucacuag

SEQ ID NO: 1806821 - RNA, 17 nt, Homo sapiens
aauggucauccaaacuc

SEQ ID NO: 1806822 - RNA, 17 nt, Homo sapiens
acauccugagugugaug

SEQ ID NO: 1806823 - RNA, 17 nt, Homo sapiens
caacauguuuccagcau

SEQ ID NO: 1806824 - RNA, 15 nt, Homo sapiens
ccaaccagacuuuga

SEQ ID NO: 1806825 - RNA, 17 nt, Homo sapiens
caaaaauuaauacacaa

SEQ ID NO: 1806826 - RNA, 24 nt, Homo sapiens
auuugaagaauuaaugacaacaaa

SEQ ID NO: 1806827 - RNA, 13 nt, Homo sapiens
aaacaacauuuau

SEQ ID NO: 1806828 - RNA, 19 nt, Homo sapiens
aagucgcuuuuggugccug

SEQ ID NO: 1806829 - RNA, 15 nt, Homo sapiens
uuugcacuuggcaaa

SEQ ID NO: 1806830 - RNA, 14 nt, Homo sapiens
auagcuaaguagca

SEQ ID NO: 1806831 - RNA, 23 nt, Homo sapiens
aaacugggauuaagaaaccuugc

SEQ ID NO: 1806832 - RNA, 20 nt, Homo sapiens
agaaaggagaccuguaucaa

SEQ ID NO: 1806833 - RNA, 20 nt, Homo sapiens
ggccagggucugugugaaug

SEQ ID NO: 1806834 - RNA, 16 nt, Homo sapiens
ccuaccgaugugugau

SEQ ID NO: 1806835 - RNA, 18 nt, Homo sapiens
cccaggucccuuguccca

SEQ ID NO: 1806836 - RNA, 13 nt, Homo sapiens
uuucuaaccuuca

SEQ ID NO: 1806837 - RNA, 16 nt, Homo sapiens
uucuccgugaugcugu

SEQ ID NO: 1806838 - RNA, 16 nt, Homo sapiens
agauuuuaaagacaaa

SEQ ID NO: 1806839 - RNA, 23 nt, Homo sapiens
gacuuauguaaucaaagccacuu

SEQ ID NO: 1806840 - RNA, 17 nt, Homo sapiens
aaguaauaaauuccaau

SEQ ID NO: 1806841 - RNA, 15 nt, Homo sapiens
aaaauauacauucaa

SEQ ID NO: 1806842 - RNA, 16 nt, Homo sapiens
uagagguuauuucugc

SEQ ID NO: 1806843 - RNA, 20 nt, Homo sapiens
acuauugugaccacaggcug

SEQ ID NO: 1806844 - RNA, 23 nt, Homo sapiens
gauacuaauaggugugugaggcu

SEQ ID NO: 1806845 - RNA, 15 nt, Homo sapiens
gggcaggaaccagac

SEQ ID NO: 1806846 - RNA, 17 nt, Homo sapiens
aaaguuuggaagcacug

SEQ ID NO: 1806847 - RNA, 17 nt, Homo sapiens
auaggaaagcauaugca

SEQ ID NO: 1806848 - RNA, 16 nt, Homo sapiens
agguuggaacuaugca

SEQ ID NO: 1806849 - RNA, 18 nt, Homo sapiens
ucuauauuuggauucaca

SEQ ID NO: 1806850 - RNA, 22 nt, Homo sapiens
uagcaggugaacucgaagccca

SEQ ID NO: 1806851 - RNA, 17 nt, Homo sapiens
ccaggcccuacuaccca

SEQ ID NO: 1806852 - RNA, 15 nt, Homo sapiens
gagcaggaacaauga

SEQ ID NO: 1806853 - RNA, 12 nt, Homo sapiens
ccugugauggca

SEQ ID NO: 1806854 - RNA, 18 nt, Homo sapiens
ucaaaccccugaccucaa

SEQ ID NO: 1806855 - RNA, 14 nt, Homo sapiens
aaccagaaagggaa

SEQ ID NO: 1806856 - RNA, 16 nt, Homo sapiens
ugcacuuaugauuuca

SEQ ID NO: 1806857 - RNA, 19 nt, Homo sapiens
ggcacucugugggugcuac

SEQ ID NO: 1806858 - RNA, 22 nt, Homo sapiens
cacagcccgugugacugcuaga

SEQ ID NO: 1806859 - RNA, 15 nt, Homo sapiens
uccacguacugcagc

SEQ ID NO: 1806860 - RNA, 18 nt, Homo sapiens
uaagggauuucuuagggg

SEQ ID NO: 1806861 - RNA, 14 nt, Homo sapiens
acaggcguucucag

SEQ ID NO: 1806862 - RNA, 15 nt, Homo sapiens
auuaauuccauguga

SEQ ID NO: 1806863 - RNA, 22 nt, Homo sapiens
gcauguccuuugcgccugugac

SEQ ID NO: 1806864 - RNA, 17 nt, Homo sapiens
auuuucuuuuuauacua

SEQ ID NO: 1806865 - RNA, 17 nt, Homo sapiens
uggagacaaggugcuaa

SEQ ID NO: 1806866 - RNA, 15 nt, Homo sapiens
guccuccaagccagc

SEQ ID NO: 1806867 - RNA, 15 nt, Homo sapiens
guccugaaagccaca

SEQ ID NO: 1806868 - RNA, 15 nt, Homo sapiens
uugaaagaaccagag

SEQ ID NO: 1806869 - RNA, 14 nt, Homo sapiens
uaauaauuugccau

SEQ ID NO: 1806870 - RNA, 17 nt, Homo sapiens
ccagcccgcagcacauu

SEQ ID NO: 1806871 - RNA, 21 nt, Homo sapiens
accacuaagaauucaaacugg

SEQ ID NO: 1806872 - RNA, 15 nt, Homo sapiens
gucuguuacacugga

SEQ ID NO: 1806873 - RNA, 15 nt, Homo sapiens
caugauaacugcaau

SEQ ID NO: 1806874 - RNA, 21 nt, Homo sapiens
gaaccuguguuaucacaguaa

SEQ ID NO: 1806875 - RNA, 15 nt, Homo sapiens
ugaaacagcugccuu

SEQ ID NO: 1806876 - RNA, 22 nt, Homo sapiens
cuuccuguguguccaaaacugc

SEQ ID NO: 1806877 - RNA, 13 nt, Homo sapiens
ucugggccagugc

SEQ ID NO: 1806878 - RNA, 22 nt, Homo sapiens
gaaaauagagaucuuaugucaa

SEQ ID NO: 1806879 - RNA, 18 nt, Homo sapiens
auucuaacccaagacaug

SEQ ID NO: 1806880 - RNA, 17 nt, Homo sapiens
gcucuugggaaauaugu

SEQ ID NO: 1806881 - RNA, 15 nt, Homo sapiens
gagagcaagauuccu

SEQ ID NO: 1806882 - RNA, 16 nt, Homo sapiens
uucccuagugcuggua

SEQ ID NO: 1806883 - RNA, 21 nt, Homo sapiens
uagugcaaggaaugacucaug

SEQ ID NO: 1806884 - RNA, 14 nt, Homo sapiens
gugaagcaggucuu

SEQ ID NO: 1806885 - RNA, 14 nt, Homo sapiens
auuggaaagcacac

SEQ ID NO: 1806886 - RNA, 16 nt, Homo sapiens
cuuuuuucaauaugca

SEQ ID NO: 1806887 - RNA, 15 nt, Homo sapiens
ccucguuaacacaug

SEQ ID NO: 1806888 - RNA, 15 nt, Homo sapiens
auuuaagacuaugau

SEQ ID NO: 1806889 - RNA, 22 nt, Homo sapiens
ucuagaauguggauuugauuca

SEQ ID NO: 1806890 - RNA, 17 nt, Homo sapiens
agagccauaugcccuca

SEQ ID NO: 1806891 - RNA, 18 nt, Homo sapiens
agaugauucaaauaucaa

SEQ ID NO: 1806892 - RNA, 19 nt, Homo sapiens
uuggaaaagcuaaguagaa

SEQ ID NO: 1806893 - RNA, 17 nt, Homo sapiens
uuccacaucauccagaa

SEQ ID NO: 1806894 - RNA, 21 nt, Homo sapiens
agugaauuacagacaaccuau

SEQ ID NO: 1806895 - RNA, 22 nt, Homo sapiens
augcugagagaccucagggaug

SEQ ID NO: 1806896 - RNA, 18 nt, Homo sapiens
ucccuuaauaaacucaca

SEQ ID NO: 1806897 - RNA, 18 nt, Homo sapiens
auacucaccucaccccac

SEQ ID NO: 1806898 - RNA, 17 nt, Homo sapiens
ugaauaucaugcaaaua

SEQ ID NO: 1806899 - RNA, 20 nt, Homo sapiens
uacuugccuaucugacuuca

SEQ ID NO: 1806900 - RNA, 17 nt, Homo sapiens
cuugaguuuucauuuca

SEQ ID NO: 1806901 - RNA, 15 nt, Homo sapiens
cucccagcugugcug

SEQ ID NO: 1806902 - RNA, 13 nt, Homo sapiens
guucaguggcauu

SEQ ID NO: 1806903 - RNA, 15 nt, Homo sapiens
caguccucacugucc

SEQ ID NO: 1806904 - RNA, 13 nt, Homo sapiens
cauggacauuuag

SEQ ID NO: 1806905 - RNA, 20 nt, Homo sapiens
ucacuggccugccaugccag

SEQ ID NO: 1806906 - RNA, 20 nt, Homo sapiens
cuuguuaaaugagcuuaaug

SEQ ID NO: 1806907 - RNA, 13 nt, Homo sapiens
uguagaaaaaccc

SEQ ID NO: 1806908 - RNA, 19 nt, Homo sapiens
agcuaaaaccuuccauguc

SEQ ID NO: 1806909 - RNA, 13 nt, Homo sapiens
uuuaaagucagau

SEQ ID NO: 1806910 - RNA, 15 nt, Homo sapiens
caguaaaauagcuga

SEQ ID NO: 1806911 - RNA, 12 nt, Homo sapiens
cuuccugcagug

SEQ ID NO: 1806912 - RNA, 14 nt, Homo sapiens
cagugauccucaaa

SEQ ID NO: 1806913 - RNA, 19 nt, Homo sapiens
agggccagguuagcacagc

SEQ ID NO: 1806914 - RNA, 17 nt, Homo sapiens
cacuugccugugcuaca

SEQ ID NO: 1806915 - RNA, 12 nt, Homo sapiens
uggaaauaugag

SEQ ID NO: 1806916 - RNA, 19 nt, Homo sapiens
uccuggcaaucaauacagc

SEQ ID NO: 1806917 - RNA, 18 nt, Homo sapiens
uggugggucugagcugga

SEQ ID NO: 1806918 - RNA, 15 nt, Homo sapiens
uuaacuggugcacuu

SEQ ID NO: 1806919 - RNA, 15 nt, Homo sapiens
caucgcucuaggaua

SEQ ID NO: 1806920 - RNA, 17 nt, Homo sapiens
gacuagugaaaaaucua

SEQ ID NO: 1806921 - RNA, 15 nt, Homo sapiens
uaauauugugcaaac

SEQ ID NO: 1806922 - RNA, 20 nt, Homo sapiens
ugcugcagguggcagaguga

SEQ ID NO: 1806923 - RNA, 17 nt, Homo sapiens
agugagcuuugcugcua

SEQ ID NO: 1806924 - RNA, 18 nt, Homo sapiens
auagucuuaacuggucuc

SEQ ID NO: 1806925 - RNA, 18 nt, Homo sapiens
caaugggaggcugugauu

SEQ ID NO: 1806926 - RNA, 17 nt, Homo sapiens
gcagaugccaaaaaaga

SEQ ID NO: 1806927 - RNA, 16 nt, Homo sapiens
caacaggaaacuggga

SEQ ID NO: 1806928 - RNA, 16 nt, Homo sapiens
aauacauuaacaagcu

SEQ ID NO: 1806929 - RNA, 19 nt, Homo sapiens
cugcuagguagaggcauuu

SEQ ID NO: 1806930 - RNA, 20 nt, Homo sapiens
ugcuugacaacaaccuaugc

SEQ ID NO: 1806931 - RNA, 16 nt, Homo sapiens
ugguaaggaggacaau

SEQ ID NO: 1806932 - RNA, 14 nt, Homo sapiens
guauuuaaacaaca

SEQ ID NO: 1806933 - RNA, 23 nt, Homo sapiens
caaaacuaugacaauuuuugcug

SEQ ID NO: 1806934 - RNA, 16 nt, Homo sapiens
ucuguauuccuagaaa

SEQ ID NO: 1806935 - RNA, 15 nt, Homo sapiens
gauaagccacugggc

SEQ ID NO: 1806936 - RNA, 16 nt, Homo sapiens
uaacuuucucuaugaa

SEQ ID NO: 1806937 - RNA, 21 nt, Homo sapiens
agccgagauugcaccacugca

SEQ ID NO: 1806938 - RNA, 21 nt, Homo sapiens
agccaagauugcgccacugca

SEQ ID NO: 1806939 - RNA, 20 nt, Homo sapiens
ccccuucucugugacccacu

SEQ ID NO: 1806940 - RNA, 15 nt, Homo sapiens
gccaucgccaaguaa

SEQ ID NO: 1806941 - RNA, 20 nt, Homo sapiens
acauuugugccgacacuguu

SEQ ID NO: 1806942 - RNA, 16 nt, Homo sapiens
caacacuguguuauau

SEQ ID NO: 1806943 - RNA, 23 nt, Homo sapiens
acuacagccaaauugcagaagaa

SEQ ID NO: 1806944 - RNA, 17 nt, Homo sapiens
ugaaaagggcagaggca

SEQ ID NO: 1806945 - RNA, 19 nt, Homo sapiens
uauccuguuuuuaaaccau

SEQ ID NO: 1806946 - RNA, 18 nt, Homo sapiens
ucucuuggggggauuugg

SEQ ID NO: 1806947 - RNA, 17 nt, Homo sapiens
aaagauucagugacgga

SEQ ID NO: 1806948 - RNA, 15 nt, Homo sapiens
cuguguccaugugau

SEQ ID NO: 1806949 - RNA, 15 nt, Homo sapiens
cugauuuacauucaa

SEQ ID NO: 1806950 - RNA, 15 nt, Homo sapiens
gagaggaagauuugu

SEQ ID NO: 1806951 - RNA, 20 nt, Homo sapiens
gaaguuaacaugaacucuug

SEQ ID NO: 1806952 - RNA, 18 nt, Homo sapiens
ucagcuuccccaguagcu

SEQ ID NO: 1806953 - RNA, 21 nt, Homo sapiens
auagugcaaggaaugacucau

SEQ ID NO: 1806954 - RNA, 22 nt, Homo sapiens
auacuguacugagacauuacag

SEQ ID NO: 1806955 - RNA, 16 nt, Homo sapiens
cccaucaagugcaguc

SEQ ID NO: 1806956 - RNA, 16 nt, Homo sapiens
aaauauagagcauuaa

SEQ ID NO: 1806957 - RNA, 15 nt, Homo sapiens
cagggugcagcccaa

SEQ ID NO: 1806958 - RNA, 18 nt, Homo sapiens
accucauguuuaugaaaa

SEQ ID NO: 1806959 - RNA, 12 nt, Homo sapiens
ucaaaugaucuu

SEQ ID NO: 1806960 - RNA, 16 nt, Homo sapiens
ccagggcucccggaga

SEQ ID NO: 1806961 - RNA, 18 nt, Homo sapiens
cuguucuaaccacuucag

SEQ ID NO: 1806962 - RNA, 18 nt, Homo sapiens
aaaguacauauauuuugc

SEQ ID NO: 1806963 - RNA, 14 nt, Homo sapiens
acuuccucagucug

SEQ ID NO: 1806964 - RNA, 13 nt, Homo sapiens
aaggcugcuguga

SEQ ID NO: 1806965 - RNA, 12 nt, Homo sapiens
ucagucuugcug

SEQ ID NO: 1806966 - RNA, 23 nt, Homo sapiens
ugaugcuuguauaaaugucagau

SEQ ID NO: 1806967 - RNA, 18 nt, Homo sapiens
aagggauccguacauuca

SEQ ID NO: 1806968 - RNA, 20 nt, Homo sapiens
gagaccccuuccuuuccucu

SEQ ID NO: 1806969 - RNA, 16 nt, Homo sapiens
ugcuaugcuauggaau

SEQ ID NO: 1806970 - RNA, 14 nt, Homo sapiens
acuguaagggauug

SEQ ID NO: 1806971 - RNA, 17 nt, Homo sapiens
uacaguaaauaaauugu

SEQ ID NO: 1806972 - RNA, 19 nt, Homo sapiens
uccaggcuggagugcaaug

SEQ ID NO: 1806973 - RNA, 17 nt, Homo sapiens
agugacgggagccuccu

SEQ ID NO: 1806974 - RNA, 21 nt, Homo sapiens
cucaguaacacagugcaguac

SEQ ID NO: 1806975 - RNA, 13 nt, Homo sapiens
ucaaaaauacuca

SEQ ID NO: 1806976 - RNA, 17 nt, Homo sapiens
aaauuuagaaagcuuaa

SEQ ID NO: 1806977 - RNA, 16 nt, Homo sapiens
uuaauaauccuuccag

SEQ ID NO: 1806978 - RNA, 18 nt, Homo sapiens
acagccccuggagccuca

SEQ ID NO: 1806979 - RNA, 22 nt, Homo sapiens
cccugagccugccccagcuggg

SEQ ID NO: 1806980 - RNA, 22 nt, Homo sapiens
uguuuccagauuacacuccagc

SEQ ID NO: 1806981 - RNA, 22 nt, Homo sapiens
uaagcccacaaucaugccuccc

SEQ ID NO: 1806982 - RNA, 13 nt, Homo sapiens
ucuaucaucucag

SEQ ID NO: 1806983 - RNA, 21 nt, Homo sapiens
acuaggugaucucaguucucu

SEQ ID NO: 1806984 - RNA, 11 nt, Homo sapiens
gcaaagccaaa

SEQ ID NO: 1806985 - RNA, 19 nt, Homo sapiens
uauuauuuuuaccuaaaga

SEQ ID NO: 1806986 - RNA, 18 nt, Homo sapiens
ugaacaguguauaggaag

SEQ ID NO: 1806987 - RNA, 15 nt, Homo sapiens
ucccacuccuggccu

SEQ ID NO: 1806988 - RNA, 19 nt, Homo sapiens
auauggacacuacacuggg

SEQ ID NO: 1806989 - RNA, 14 nt, Homo sapiens
ucugcuuacaaaga

SEQ ID NO: 1806990 - RNA, 20 nt, Homo sapiens
gagggcggggagaaucucag

SEQ ID NO: 1806991 - RNA, 17 nt, Homo sapiens
agcuguucugucccuug

SEQ ID NO: 1806992 - RNA, 19 nt, Homo sapiens
cucauucagaagaugcuua

SEQ ID NO: 1806993 - RNA, 21 nt, Homo sapiens
acugugggcaaaguccuccuu

SEQ ID NO: 1806994 - RNA, 14 nt, Homo sapiens
cugugaguucugau

SEQ ID NO: 1806995 - RNA, 14 nt, Homo sapiens
auucuccuugagga

SEQ ID NO: 1806996 - RNA, 15 nt, Homo sapiens
agacaagagcuguua

SEQ ID NO: 1806997 - RNA, 20 nt, Homo sapiens
gcagcccucagcagcugcag

SEQ ID NO: 1806998 - RNA, 14 nt, Homo sapiens
uuuaacuacccuga

SEQ ID NO: 1806999 - RNA, 14 nt, Homo sapiens
uccugcuacuuaaa

SEQ ID NO: 1807000 - RNA, 13 nt, Homo sapiens
cuguauccacaaa

SEQ ID NO: 1807001 - RNA, 18 nt, Homo sapiens
gcaguuuuguaaauaagu

SEQ ID NO: 1807002 - RNA, 11 nt, Homo sapiens
ccaaacauguu

SEQ ID NO: 1807003 - RNA, 19 nt, Homo sapiens
auuugugaaagaagacagc

SEQ ID NO: 1807004 - RNA, 13 nt, Homo sapiens
cuugcuaagcacu

SEQ ID NO: 1807005 - RNA, 13 nt, Homo sapiens
auccuucagugaa

SEQ ID NO: 1807006 - RNA, 18 nt, Homo sapiens
caacaacauccauguccu

SEQ ID NO: 1807007 - RNA, 15 nt, Homo sapiens
uuaauacuccagaga

SEQ ID NO: 1807008 - RNA, 21 nt, Homo sapiens
ccacuucuggguggggcagug

SEQ ID NO: 1807009 - RNA, 17 nt, Homo sapiens
cagugagaagccagcuu

SEQ ID NO: 1807010 - RNA, 17 nt, Homo sapiens
uucuuacaugcauuuga

SEQ ID NO: 1807011 - RNA, 15 nt, Homo sapiens
auaaaguugcuguga

SEQ ID NO: 1807012 - RNA, 21 nt, Homo sapiens
cugccccaggcucaggcugcc

SEQ ID NO: 1807013 - RNA, 21 nt, Homo sapiens
acauaaaagaauuuuuuuguc

SEQ ID NO: 1807014 - RNA, 22 nt, Homo sapiens
uuucugggagcagaaacagcca

SEQ ID NO: 1807015 - RNA, 21 nt, Homo sapiens
cuguguuuaauaguauaucua

SEQ ID NO: 1807016 - RNA, 18 nt, Homo sapiens
agccuagccugcauauca

SEQ ID NO: 1807017 - RNA, 14 nt, Homo sapiens
auuuuuaccuuuca

SEQ ID NO: 1807018 - RNA, 13 nt, Homo sapiens
gucacccaaccug

SEQ ID NO: 1807019 - RNA, 12 nt, Homo sapiens
cagguaaguggc

SEQ ID NO: 1807020 - RNA, 17 nt, Homo sapiens
acacuguggaacacuaa

SEQ ID NO: 1807021 - RNA, 19 nt, Homo sapiens
cuucuuuaaaaaaacacau

SEQ ID NO: 1807022 - RNA, 20 nt, Homo sapiens
caaaaggaacaaaaauuaca

SEQ ID NO: 1807023 - RNA, 20 nt, Homo sapiens
auaugauuuaaaacauguaa

SEQ ID NO: 1807024 - RNA, 17 nt, Homo sapiens
agggauguggagcacaa

SEQ ID NO: 1807025 - RNA, 16 nt, Homo sapiens
ugcaagucacauaaaa

SEQ ID NO: 1807026 - RNA, 17 nt, Homo sapiens
gcauguauuagcucacu

SEQ ID NO: 1807027 - RNA, 22 nt, Homo sapiens
auccauaggcgcaggugcacag

SEQ ID NO: 1807028 - RNA, 20 nt, Homo sapiens
ugcaguuucuuuucacauua

SEQ ID NO: 1807029 - RNA, 20 nt, Homo sapiens
gccaucuccucccaccagug

SEQ ID NO: 1807030 - RNA, 11 nt, Homo sapiens
uuucauaccaa

SEQ ID NO: 1807031 - RNA, 20 nt, Homo sapiens
uagagacgguguuuugccau

SEQ ID NO: 1807032 - RNA, 19 nt, Homo sapiens
gaaugcaccauggucaaaa

SEQ ID NO: 1807033 - RNA, 22 nt, Homo sapiens
gaaaaaauguaugugucuccca

SEQ ID NO: 1807034 - RNA, 13 nt, Homo sapiens
ugccaggacaaug

SEQ ID NO: 1807035 - RNA, 22 nt, Homo sapiens
gaaaauugggcaugccauuaca

SEQ ID NO: 1807036 - RNA, 16 nt, Homo sapiens
ggccuaaugcauuauu

SEQ ID NO: 1807037 - RNA, 20 nt, Homo sapiens
gaaugaaaacuguaaauauu

SEQ ID NO: 1807038 - RNA, 23 nt, Homo sapiens
ccuugcagcggcuccugcaaaag

SEQ ID NO: 1807039 - RNA, 14 nt, Homo sapiens
aacauauuauuuca

SEQ ID NO: 1807040 - RNA, 14 nt, Homo sapiens
augacucaucaauu

SEQ ID NO: 1807041 - RNA, 15 nt, Homo sapiens
augguuacuaaaaag

SEQ ID NO: 1807042 - RNA, 20 nt, Homo sapiens
acaagacuccuaccuugaga

SEQ ID NO: 1807043 - RNA, 14 nt, Homo sapiens
ggaagaaagggaaa

SEQ ID NO: 1807044 - RNA, 16 nt, Homo sapiens
ccgggcaggcauuuca

SEQ ID NO: 1807045 - RNA, 13 nt, Homo sapiens
gaaauaaaacuac

SEQ ID NO: 1807046 - RNA, 13 nt, Homo sapiens
cuuuucaccaaug

SEQ ID NO: 1807047 - RNA, 17 nt, Homo sapiens
cugcccuuuggccaaca

SEQ ID NO: 1807048 - RNA, 14 nt, Homo sapiens
cuuugccccugaga

SEQ ID NO: 1807049 - RNA, 17 nt, Homo sapiens
uucauauuucauauuca

SEQ ID NO: 1807050 - RNA, 16 nt, Homo sapiens
ucagauuacacuucuc

SEQ ID NO: 1807051 - RNA, 21 nt, Homo sapiens
acuaccauugcuguucuacuu

SEQ ID NO: 1807052 - RNA, 17 nt, Homo sapiens
ucuuucaugugugccaa

SEQ ID NO: 1807053 - RNA, 22 nt, Homo sapiens
cuggaguacaguggugugaucc

SEQ ID NO: 1807054 - RNA, 23 nt, Homo sapiens
ucccuggaggcacgcaccacugc

SEQ ID NO: 1807055 - RNA, 14 nt, Homo sapiens
uacacacagcggga

SEQ ID NO: 1807056 - RNA, 16 nt, Homo sapiens
uaaaguaaggccuuua

SEQ ID NO: 1807057 - RNA, 16 nt, Homo sapiens
cucccucucaguggag

SEQ ID NO: 1807058 - RNA, 13 nt, Homo sapiens
gcauggagcuaua

SEQ ID NO: 1807059 - RNA, 10 nt, Homo sapiens
uuaaacuggu

SEQ ID NO: 1807060 - RNA, 16 nt, Homo sapiens
ucaaaagaacauucuu

SEQ ID NO: 1807061 - RNA, 19 nt, Homo sapiens
cauccaauuuaucaaggaa

SEQ ID NO: 1807062 - RNA, 16 nt, Homo sapiens
gcaaaggagccuacuc

SEQ ID NO: 1807063 - RNA, 23 nt, Homo sapiens
gaggccaauaaaaaguucagagu

SEQ ID NO: 1807064 - RNA, 12 nt, Homo sapiens
gaccucucaggg

SEQ ID NO: 1807065 - RNA, 14 nt, Homo sapiens
cugguuuucuugcc

SEQ ID NO: 1807066 - RNA, 22 nt, Homo sapiens
aggaccggccuuugcaccucca

SEQ ID NO: 1807067 - RNA, 17 nt, Homo sapiens
ucuuccuguucugugac

SEQ ID NO: 1807068 - RNA, 16 nt, Homo sapiens
auaccagagccuucaa

SEQ ID NO: 1807069 - RNA, 15 nt, Homo sapiens
caagaacugaaacca

SEQ ID NO: 1807070 - RNA, 23 nt, Homo sapiens
caguugacccuauuuuuugacac

SEQ ID NO: 1807071 - RNA, 14 nt, Homo sapiens
cuuuaucugugaua

SEQ ID NO: 1807072 - RNA, 22 nt, Homo sapiens
augaauugggggaggacacauu

SEQ ID NO: 1807073 - RNA, 14 nt, Homo sapiens
uaggggaaugaggg

SEQ ID NO: 1807074 - RNA, 21 nt, Homo sapiens
agaguccugcacaguuuucug

SEQ ID NO: 1807075 - RNA, 14 nt, Homo sapiens
aggcuuaccaaagu

SEQ ID NO: 1807076 - RNA, 19 nt, Homo sapiens
cuuuuuuccugggccagaa

SEQ ID NO: 1807077 - RNA, 18 nt, Homo sapiens
uauguacuauccccaaac

SEQ ID NO: 1807078 - RNA, 15 nt, Homo sapiens
gcauugucugcaaug

SEQ ID NO: 1807079 - RNA, 21 nt, Homo sapiens
auguucauuguaauguuacug

SEQ ID NO: 1807080 - RNA, 19 nt, Homo sapiens
aagcuaauacaauggucau

SEQ ID NO: 1807081 - RNA, 13 nt, Homo sapiens
gagucagucuuca

SEQ ID NO: 1807082 - RNA, 19 nt, Homo sapiens
ccaccgccuucccugacac

SEQ ID NO: 1807083 - RNA, 15 nt, Homo sapiens
gaauaugcaucccac

SEQ ID NO: 1807084 - RNA, 17 nt, Homo sapiens
ucugcagaaacuacuga

SEQ ID NO: 1807085 - RNA, 19 nt, Homo sapiens
aaggacaugagacuaagag

SEQ ID NO: 1807086 - RNA, 19 nt, Homo sapiens
aggaggggcaccugccacc

SEQ ID NO: 1807087 - RNA, 15 nt, Homo sapiens
gcaagcuuugcuccu

SEQ ID NO: 1807088 - RNA, 15 nt, Homo sapiens
ccagucgagaccuca

SEQ ID NO: 1807089 - RNA, 16 nt, Homo sapiens
gucauguguuuugcca

SEQ ID NO: 1807090 - RNA, 21 nt, Homo sapiens
gcaagaaguagcagugucugu

SEQ ID NO: 1807091 - RNA, 16 nt, Homo sapiens
cucuuucacccugcca

SEQ ID NO: 1807092 - RNA, 18 nt, Homo sapiens
guuccagagggaagggaa

SEQ ID NO: 1807093 - RNA, 18 nt, Homo sapiens
ucaagcuagaaggccaca

SEQ ID NO: 1807094 - RNA, 14 nt, Homo sapiens
cauaguucacugac

SEQ ID NO: 1807095 - RNA, 17 nt, Homo sapiens
caauauuugguauuuca

SEQ ID NO: 1807096 - RNA, 17 nt, Homo sapiens
ccacacagacaggguuu

SEQ ID NO: 1807097 - RNA, 20 nt, Homo sapiens
cagcccucccuggcugugag

SEQ ID NO: 1807098 - RNA, 16 nt, Homo sapiens
uuaaaagaaugaguga

SEQ ID NO: 1807099 - RNA, 13 nt, Homo sapiens
uuccaauagcaaa

SEQ ID NO: 1807100 - RNA, 13 nt, Homo sapiens
aauaaacacuggu

SEQ ID NO: 1807101 - RNA, 23 nt, Homo sapiens
cuacaucuucugccuuagucuca

SEQ ID NO: 1807102 - RNA, 19 nt, Homo sapiens
uuccccagggugacauaca

SEQ ID NO: 1807103 - RNA, 15 nt, Homo sapiens
auuuuuuagugcauc

SEQ ID NO: 1807104 - RNA, 17 nt, Homo sapiens
uuccuugggaugaucuu

SEQ ID NO: 1807105 - RNA, 14 nt, Homo sapiens
uugaaaauguucag

SEQ ID NO: 1807106 - RNA, 20 nt, Homo sapiens
cagagaucguguauugagau

SEQ ID NO: 1807107 - RNA, 17 nt, Homo sapiens
cucuacuaaaaacacaa

SEQ ID NO: 1807108 - RNA, 14 nt, Homo sapiens
acccaccccaacuc

SEQ ID NO: 1807109 - RNA, 19 nt, Homo sapiens
gcauuuacuaugccacaga

SEQ ID NO: 1807110 - RNA, 18 nt, Homo sapiens
aaauaaguaacauauaaa

SEQ ID NO: 1807111 - RNA, 17 nt, Homo sapiens
uacuaucuuuguguugc

SEQ ID NO: 1807112 - RNA, 15 nt, Homo sapiens
cuccugccuugauga

SEQ ID NO: 1807113 - RNA, 12 nt, Homo sapiens
augaagccuuug

SEQ ID NO: 1807114 - RNA, 11 nt, Homo sapiens
uuauugaacau

SEQ ID NO: 1807115 - RNA, 15 nt, Homo sapiens
aaucuacuaauucca

SEQ ID NO: 1807116 - RNA, 18 nt, Homo sapiens
guaugugcgugugugcaa

SEQ ID NO: 1807117 - RNA, 20 nt, Homo sapiens
cuggcuuuucuggcugggga

SEQ ID NO: 1807118 - RNA, 17 nt, Homo sapiens
cuugugacauucacuca

SEQ ID NO: 1807119 - RNA, 20 nt, Homo sapiens
aauaagauaaauacgaagau

SEQ ID NO: 1807120 - RNA, 15 nt, Homo sapiens
cacacccaugcacac

SEQ ID NO: 1807121 - RNA, 15 nt, Homo sapiens
ugccccgacacccag

SEQ ID NO: 1807122 - RNA, 19 nt, Homo sapiens
gucagugccaugacugaga

SEQ ID NO: 1807123 - RNA, 22 nt, Homo sapiens
cugugggcauggucaaaggcuc

SEQ ID NO: 1807124 - RNA, 14 nt, Homo sapiens
acaaaacacugugu

SEQ ID NO: 1807125 - RNA, 15 nt, Homo sapiens
ugcacacugcacugu

SEQ ID NO: 1807126 - RNA, 17 nt, Homo sapiens
cauucaauagcauauca

SEQ ID NO: 1807127 - RNA, 21 nt, Homo sapiens
gagaaucacuugaacccagga

SEQ ID NO: 1807128 - RNA, 18 nt, Homo sapiens
caacaguuacauaauuca

SEQ ID NO: 1807129 - RNA, 13 nt, Homo sapiens
gguagaagcccuu

SEQ ID NO: 1807130 - RNA, 11 nt, Homo sapiens
aacaguuauaa

SEQ ID NO: 1807131 - RNA, 23 nt, Homo sapiens
uuuccacgcuagggcggggcaca

SEQ ID NO: 1807132 - RNA, 21 nt, Homo sapiens
cagugcuucccgagugagcau

SEQ ID NO: 1807133 - RNA, 17 nt, Homo sapiens
aucaaacuagugcauga

SEQ ID NO: 1807134 - RNA, 14 nt, Homo sapiens
aucacaccucagug

SEQ ID NO: 1807135 - RNA, 19 nt, Homo sapiens
uucuagccccucuggauuc

SEQ ID NO: 1807136 - RNA, 22 nt, Homo sapiens
cuggaaggcagcaggcauuugc

SEQ ID NO: 1807137 - RNA, 19 nt, Homo sapiens
uuucuuaacuauccuaaca

SEQ ID NO: 1807138 - RNA, 20 nt, Homo sapiens
ggcccaggagaccacgggga

SEQ ID NO: 1807139 - RNA, 21 nt, Homo sapiens
aucaauucuuagaauaucuaa

SEQ ID NO: 1807140 - RNA, 16 nt, Homo sapiens
gaccucaagugaucug

SEQ ID NO: 1807141 - RNA, 12 nt, Homo sapiens
gaugcaaaucaa

SEQ ID NO: 1807142 - RNA, 18 nt, Homo sapiens
uauaaguucuauuuuacu

SEQ ID NO: 1807143 - RNA, 16 nt, Homo sapiens
cagucugauccaggag

SEQ ID NO: 1807144 - RNA, 16 nt, Homo sapiens
ccccaguucagucugu

SEQ ID NO: 1807145 - RNA, 18 nt, Homo sapiens
acaguggcaccugggaag

SEQ ID NO: 1807146 - RNA, 18 nt, Homo sapiens
caaaacgcuacugaguca

SEQ ID NO: 1807147 - RNA, 21 nt, Homo sapiens
auagauuucgaagccacagag

SEQ ID NO: 1807148 - RNA, 21 nt, Homo sapiens
ccgguguccuguuccugccac

SEQ ID NO: 1807149 - RNA, 19 nt, Homo sapiens
aaaguucaacuuccaaagg

SEQ ID NO: 1807150 - RNA, 15 nt, Homo sapiens
ucuuuaaccuuguau

SEQ ID NO: 1807151 - RNA, 13 nt, Homo sapiens
uauaaauaaagca

SEQ ID NO: 1807152 - RNA, 19 nt, Homo sapiens
gaacuugugagaacacagc

SEQ ID NO: 1807153 - RNA, 16 nt, Homo sapiens
ccugacacugucugcu

SEQ ID NO: 1807154 - RNA, 21 nt, Homo sapiens
gacugaacauuaguugcacua

SEQ ID NO: 1807155 - RNA, 17 nt, Homo sapiens
uucauucuggucucucu

SEQ ID NO: 1807156 - RNA, 23 nt, Homo sapiens
agggugaaaauuauuuuguucau

SEQ ID NO: 1807157 - RNA, 18 nt, Homo sapiens
auuuaaaguaaggccuuu

SEQ ID NO: 1807158 - RNA, 22 nt, Homo sapiens
aacaaaugcuggggucauauaa

SEQ ID NO: 1807159 - RNA, 13 nt, Homo sapiens
aacuguuaccuaa

SEQ ID NO: 1807160 - RNA, 20 nt, Homo sapiens
cagucuugaugcaguuucau

SEQ ID NO: 1807161 - RNA, 17 nt, Homo sapiens
aagaacaugcaguuuga

SEQ ID NO: 1807162 - RNA, 15 nt, Homo sapiens
uacauugugcaauug

SEQ ID NO: 1807163 - RNA, 14 nt, Homo sapiens
cucuugaccaggcu

SEQ ID NO: 1807164 - RNA, 17 nt, Homo sapiens
ccucacugaaugccuca

SEQ ID NO: 1807165 - RNA, 21 nt, Homo sapiens
uauacauaugagaauauaccu

SEQ ID NO: 1807166 - RNA, 21 nt, Homo sapiens
gcccucugucuaccugggaga

SEQ ID NO: 1807167 - RNA, 21 nt, Homo sapiens
ggaccugagagcaucucagga

SEQ ID NO: 1807168 - RNA, 14 nt, Homo sapiens
acucaggcauuuca

SEQ ID NO: 1807169 - RNA, 13 nt, Homo sapiens
aucaagugcaguc

SEQ ID NO: 1807170 - RNA, 21 nt, Homo sapiens
accuuccuugaaauuucucag

SEQ ID NO: 1807171 - RNA, 15 nt, Homo sapiens
acaggaugaugacua

SEQ ID NO: 1807172 - RNA, 22 nt, Homo sapiens
acugcagugcuguaaacuuaac

SEQ ID NO: 1807173 - RNA, 18 nt, Homo sapiens
caauaaaauuauuugcag

SEQ ID NO: 1807174 - RNA, 18 nt, Homo sapiens
cuguuuucugaaacacac

SEQ ID NO: 1807175 - RNA, 16 nt, Homo sapiens
aaccucaaaggagcaa

SEQ ID NO: 1807176 - RNA, 13 nt, Homo sapiens
ccucaggccagug

SEQ ID NO: 1807177 - RNA, 14 nt, Homo sapiens
uagccucaccaagg

SEQ ID NO: 1807178 - RNA, 15 nt, Homo sapiens
uagugcuagucucag

SEQ ID NO: 1807179 - RNA, 20 nt, Homo sapiens
gugaaaaaccugaugcagug

SEQ ID NO: 1807180 - RNA, 15 nt, Homo sapiens
aauggugcugcagau

SEQ ID NO: 1807181 - RNA, 22 nt, Homo sapiens
caagaagcgccgacucccugag

SEQ ID NO: 1807182 - RNA, 19 nt, Homo sapiens
ccuucacugugcuccaacc

SEQ ID NO: 1807183 - RNA, 14 nt, Homo sapiens
cugaccaaaaguga

SEQ ID NO: 1807184 - RNA, 20 nt, Homo sapiens
gccuugcccagccuggaugc

SEQ ID NO: 1807185 - RNA, 15 nt, Homo sapiens
aucccaaccauccuc

SEQ ID NO: 1807186 - RNA, 20 nt, Homo sapiens
aaauuuguaaaucuuauucu

SEQ ID NO: 1807187 - RNA, 15 nt, Homo sapiens
caggucugcagcucc

SEQ ID NO: 1807188 - RNA, 15 nt, Homo sapiens
ucugucugucucucc

SEQ ID NO: 1807189 - RNA, 21 nt, Homo sapiens
gcugcaaauagccuuccugac

SEQ ID NO: 1807190 - RNA, 18 nt, Homo sapiens
uaaauggugcugcagauu

SEQ ID NO: 1807191 - RNA, 19 nt, Homo sapiens
uugcaggaggcccaaccuc

SEQ ID NO: 1807192 - RNA, 17 nt, Homo sapiens
cuggggccugugcacug

SEQ ID NO: 1807193 - RNA, 21 nt, Homo sapiens
ucaacuccgugcuuaaccaaa

SEQ ID NO: 1807194 - RNA, 15 nt, Homo sapiens
caaccacucauucaa

SEQ ID NO: 1807195 - RNA, 13 nt, Homo sapiens
acccaaauuauaa

SEQ ID NO: 1807196 - RNA, 11 nt, Homo sapiens
aaaaguuauua

SEQ ID NO: 1807197 - RNA, 13 nt, Homo sapiens
gggaucuuaccca

SEQ ID NO: 1807198 - RNA, 20 nt, Homo sapiens
caccagggaguggccauuug

SEQ ID NO: 1807199 - RNA, 19 nt, Homo sapiens
cugaagcccuaacucagcc

SEQ ID NO: 1807200 - RNA, 15 nt, Homo sapiens
uucccaacaauacuu

SEQ ID NO: 1807201 - RNA, 13 nt, Homo sapiens
gcuuacaaauguc

SEQ ID NO: 1807202 - RNA, 21 nt, Homo sapiens
uccuaccccuuccuguccugc

SEQ ID NO: 1807203 - RNA, 15 nt, Homo sapiens
ucaucaaaacaaaac

SEQ ID NO: 1807204 - RNA, 19 nt, Homo sapiens
aauaggcggggcuugccuu

SEQ ID NO: 1807205 - RNA, 22 nt, Homo sapiens
cacagacacacaagcagacaca

SEQ ID NO: 1807206 - RNA, 15 nt, Homo sapiens
ucguagaaacaagac

SEQ ID NO: 1807207 - RNA, 18 nt, Homo sapiens
ugucccuugcuguuuuca

SEQ ID NO: 1807208 - RNA, 18 nt, Homo sapiens
uaauauuguuugugaugg

SEQ ID NO: 1807209 - RNA, 12 nt, Homo sapiens
aggcagaucugu

SEQ ID NO: 1807210 - RNA, 14 nt, Homo sapiens
ugauuggugauuca

SEQ ID NO: 1807211 - RNA, 14 nt, Homo sapiens
augggggugccagg

SEQ ID NO: 1807212 - RNA, 23 nt, Homo sapiens
auaugugaacuagaaguacgugu

SEQ ID NO: 1807213 - RNA, 16 nt, Homo sapiens
cacgguggcucaggcc

SEQ ID NO: 1807214 - RNA, 20 nt, Homo sapiens
aucagauucuugcugugacc

SEQ ID NO: 1807215 - RNA, 12 nt, Homo sapiens
uaaaugaccuca

SEQ ID NO: 1807216 - RNA, 18 nt, Homo sapiens
uguaguccuaugcaauaa

SEQ ID NO: 1807217 - RNA, 20 nt, Homo sapiens
gucucugcuauggaaugccc

SEQ ID NO: 1807218 - RNA, 20 nt, Homo sapiens
acuuuuugaaaaaaguauag

SEQ ID NO: 1807219 - RNA, 20 nt, Homo sapiens
cauccccuuacccuuagaau

SEQ ID NO: 1807220 - RNA, 18 nt, Homo sapiens
uuucuauuaaaaguggga

SEQ ID NO: 1807221 - RNA, 12 nt, Homo sapiens
aucaaacagaaa

SEQ ID NO: 1807222 - RNA, 15 nt, Homo sapiens
ucuauuuuauaaggg

SEQ ID NO: 1807223 - RNA, 20 nt, Homo sapiens
caccaggggaggagccugug

SEQ ID NO: 1807224 - RNA, 22 nt, Homo sapiens
aagauguguugcuauccugaaa

SEQ ID NO: 1807225 - RNA, 21 nt, Homo sapiens
agauguacaaaacaguuugaa

SEQ ID NO: 1807226 - RNA, 13 nt, Homo sapiens
ccaaaugcugucu

SEQ ID NO: 1807227 - RNA, 15 nt, Homo sapiens
agugugccaguuuaa

SEQ ID NO: 1807228 - RNA, 21 nt, Homo sapiens
aaaacuuucucuuugccauuu

SEQ ID NO: 1807229 - RNA, 14 nt, Homo sapiens
gauagacacuggac

SEQ ID NO: 1807230 - RNA, 14 nt, Homo sapiens
cccaccagguguca

SEQ ID NO: 1807231 - RNA, 20 nt, Homo sapiens
auuucugucagaaugcuauu

SEQ ID NO: 1807232 - RNA, 15 nt, Homo sapiens
cgggggcacugccug

SEQ ID NO: 1807233 - RNA, 17 nt, Homo sapiens
cucaaggaauuugcauu

SEQ ID NO: 1807234 - RNA, 19 nt, Homo sapiens
auagaugucuguguauaca

SEQ ID NO: 1807235 - RNA, 23 nt, Homo sapiens
uaggcauugcaggaccuugggca

SEQ ID NO: 1807236 - RNA, 14 nt, Homo sapiens
guguucuguacuua

SEQ ID NO: 1807237 - RNA, 18 nt, Homo sapiens
ugcaaccuugaagacuau

SEQ ID NO: 1807238 - RNA, 18 nt, Homo sapiens
ccuuucccccaccccaga

SEQ ID NO: 1807239 - RNA, 22 nt, Homo sapiens
agcugagauugugccacuucac

SEQ ID NO: 1807240 - RNA, 13 nt, Homo sapiens
auucccauucuac

SEQ ID NO: 1807241 - RNA, 14 nt, Homo sapiens
cuauuuacuggaaa

SEQ ID NO: 1807242 - RNA, 20 nt, Homo sapiens
acucuaaaccccguguucaa

SEQ ID NO: 1807243 - RNA, 22 nt, Homo sapiens
acaagccuucagccacagggag

SEQ ID NO: 1807244 - RNA, 17 nt, Homo sapiens
ccugccagggaggccau

SEQ ID NO: 1807245 - RNA, 13 nt, Homo sapiens
cauuccaggaaac

SEQ ID NO: 1807246 - RNA, 22 nt, Homo sapiens
ccauuccaagucaacacucuuc

SEQ ID NO: 1807247 - RNA, 23 nt, Homo sapiens
ucucagaacccaucgguaggcaa

SEQ ID NO: 1807248 - RNA, 12 nt, Homo sapiens
auuuuguugcau

SEQ ID NO: 1807249 - RNA, 15 nt, Homo sapiens
uuucuggaccagauc

SEQ ID NO: 1807250 - RNA, 19 nt, Homo sapiens
aacacuaguuuugugccag

SEQ ID NO: 1807251 - RNA, 23 nt, Homo sapiens
aucuuuucucauuaaaauuguga

SEQ ID NO: 1807252 - RNA, 18 nt, Homo sapiens
ugaugaucgucaucauca

SEQ ID NO: 1807253 - RNA, 20 nt, Homo sapiens
aacaaagaugccacauucaa

SEQ ID NO: 1807254 - RNA, 19 nt, Homo sapiens
aaagugcugagauugcaga

SEQ ID NO: 1807255 - RNA, 22 nt, Homo sapiens
uaguggaaaaaaacaacccuug

SEQ ID NO: 1807256 - RNA, 21 nt, Homo sapiens
cuauuucaauacuuacauauc

SEQ ID NO: 1807257 - RNA, 16 nt, Homo sapiens
caccguaguaacacau

SEQ ID NO: 1807258 - RNA, 13 nt, Homo sapiens
cuccaggcaaaau

SEQ ID NO: 1807259 - RNA, 17 nt, Homo sapiens
agccacccugcccaguc

SEQ ID NO: 1807260 - RNA, 14 nt, Homo sapiens
augaagaccaaaga

SEQ ID NO: 1807261 - RNA, 14 nt, Homo sapiens
uaaacaugcuugca

SEQ ID NO: 1807262 - RNA, 13 nt, Homo sapiens
aacuccuguucuu

SEQ ID NO: 1807263 - RNA, 23 nt, Homo sapiens
ggucugacaccaaaacaugccgc

SEQ ID NO: 1807264 - RNA, 15 nt, Homo sapiens
uacaggggugcugca

SEQ ID NO: 1807265 - RNA, 16 nt, Homo sapiens
gcuugcucucucucac

SEQ ID NO: 1807266 - RNA, 14 nt, Homo sapiens
ucugacuuacuuaa

SEQ ID NO: 1807267 - RNA, 20 nt, Homo sapiens
aaaacagucuacauugagca

SEQ ID NO: 1807268 - RNA, 23 nt, Homo sapiens
uuagagaauuuccuuacucuuga

SEQ ID NO: 1807269 - RNA, 19 nt, Homo sapiens
accuucagauuuguguuau

SEQ ID NO: 1807270 - RNA, 22 nt, Homo sapiens
cugauuaggacuuuuauuguga

SEQ ID NO: 1807271 - RNA, 23 nt, Homo sapiens
cugaaacucccagccacagcauu

SEQ ID NO: 1807272 - RNA, 19 nt, Homo sapiens
uaauuauuuauauuuccug

SEQ ID NO: 1807273 - RNA, 16 nt, Homo sapiens
aguuuugccuuucuaa

SEQ ID NO: 1807274 - RNA, 22 nt, Homo sapiens
guugagcuucauauaccagcaa

SEQ ID NO: 1807275 - RNA, 16 nt, Homo sapiens
uucgacguuugacuag

SEQ ID NO: 1807276 - RNA, 16 nt, Homo sapiens
cugcaccuuugcacgu

SEQ ID NO: 1807277 - RNA, 21 nt, Homo sapiens
ucaauaccccuguuaagcaau

SEQ ID NO: 1807278 - RNA, 15 nt, Homo sapiens
cacaugccuugcaau

SEQ ID NO: 1807279 - RNA, 13 nt, Homo sapiens
auauucauauaca

SEQ ID NO: 1807280 - RNA, 13 nt, Homo sapiens
uguccauuccaaa

SEQ ID NO: 1807281 - RNA, 14 nt, Homo sapiens
uuugccaagggagg

SEQ ID NO: 1807282 - RNA, 15 nt, Homo sapiens
ugcccacuacgugcc

SEQ ID NO: 1807283 - RNA, 16 nt, Homo sapiens
uggaugucacugccug

SEQ ID NO: 1807284 - RNA, 12 nt, Homo sapiens
uaaaaugccaag

SEQ ID NO: 1807285 - RNA, 21 nt, Homo sapiens
accucagaguauggagcucag

SEQ ID NO: 1807286 - RNA, 15 nt, Homo sapiens
cuggaaaaugugacc

SEQ ID NO: 1807287 - RNA, 13 nt, Homo sapiens
cucagacaaaacc

SEQ ID NO: 1807288 - RNA, 12 nt, Homo sapiens
guccuacaguga

SEQ ID NO: 1807289 - RNA, 12 nt, Homo sapiens
gggauacaggcc

SEQ ID NO: 1807290 - RNA, 18 nt, Homo sapiens
uugaagugggaaagcauu

SEQ ID NO: 1807291 - RNA, 18 nt, Homo sapiens
ccccgcauuccaggcucc

SEQ ID NO: 1807292 - RNA, 23 nt, Homo sapiens
aaauugagucauuuuauauauga

SEQ ID NO: 1807293 - RNA, 21 nt, Homo sapiens
auuacaguuaaagaagcaauc

SEQ ID NO: 1807294 - RNA, 21 nt, Homo sapiens
ucuccaggcauuuagcccuca

SEQ ID NO: 1807295 - RNA, 21 nt, Homo sapiens
cgugugccaccaggagggagu

SEQ ID NO: 1807296 - RNA, 18 nt, Homo sapiens
guaagcaaagacuuuccu

SEQ ID NO: 1807297 - RNA, 17 nt, Homo sapiens
aacacucuuggggacca

SEQ ID NO: 1807298 - RNA, 14 nt, Homo sapiens
accauuccuuucau

SEQ ID NO: 1807299 - RNA, 22 nt, Homo sapiens
gauugaaccacuaaaauguuag

SEQ ID NO: 1807300 - RNA, 19 nt, Homo sapiens
gugauucaaaauguacuau

SEQ ID NO: 1807301 - RNA, 23 nt, Homo sapiens
gccagagaauagaucaguauuuc

SEQ ID NO: 1807302 - RNA, 21 nt, Homo sapiens
ucuggagaccguccuggagcu

SEQ ID NO: 1807303 - RNA, 22 nt, Homo sapiens
gguagauuuccuccucccagug

SEQ ID NO: 1807304 - RNA, 22 nt, Homo sapiens
auuaugaagugacucucacaag

SEQ ID NO: 1807305 - RNA, 22 nt, Homo sapiens
cuucugucccucacagcacuag

SEQ ID NO: 1807306 - RNA, 13 nt, Homo sapiens
agagagugaauaa

SEQ ID NO: 1807307 - RNA, 13 nt, Homo sapiens
agugugugaaaau

SEQ ID NO: 1807308 - RNA, 18 nt, Homo sapiens
gcccaugggauauguggu

SEQ ID NO: 1807309 - RNA, 22 nt, Homo sapiens
ucuguggaguuugacauuguau

SEQ ID NO: 1807310 - RNA, 22 nt, Homo sapiens
cccugcccagccccacuucucc

SEQ ID NO: 1807311 - RNA, 18 nt, Homo sapiens
uccauagccaauacauuu

SEQ ID NO: 1807312 - RNA, 13 nt, Homo sapiens
agcaguagcgcug

SEQ ID NO: 1807313 - RNA, 22 nt, Homo sapiens
cacagccagacgcauccugcca

SEQ ID NO: 1807314 - RNA, 19 nt, Homo sapiens
ccccagcucccccaggcag

SEQ ID NO: 1807315 - RNA, 18 nt, Homo sapiens
gauuccuggaagcaaacg

SEQ ID NO: 1807316 - RNA, 17 nt, Homo sapiens
acugcauuuuacuguac

SEQ ID NO: 1807317 - RNA, 18 nt, Homo sapiens
gagaaaaagcccucuuca

SEQ ID NO: 1807318 - RNA, 17 nt, Homo sapiens
uaauauguaaaauuaca

SEQ ID NO: 1807319 - RNA, 17 nt, Homo sapiens
ucagaggcccaggaauc

SEQ ID NO: 1807320 - RNA, 15 nt, Homo sapiens
agauacaaacauguu

SEQ ID NO: 1807321 - RNA, 16 nt, Homo sapiens
aauagaacagcucaua

SEQ ID NO: 1807322 - RNA, 15 nt, Homo sapiens
cagggcugugcuuga

SEQ ID NO: 1807323 - RNA, 20 nt, Homo sapiens
agcauacccuuacucugcca

SEQ ID NO: 1807324 - RNA, 14 nt, Homo sapiens
acaaggcucugcua

SEQ ID NO: 1807325 - RNA, 17 nt, Homo sapiens
acuuaaaaucuaauuca

SEQ ID NO: 1807326 - RNA, 22 nt, Homo sapiens
caugcagguggugggacacugg

SEQ ID NO: 1807327 - RNA, 22 nt, Homo sapiens
ucugcagccuccucugugacuc

SEQ ID NO: 1807328 - RNA, 15 nt, Homo sapiens
cuuuuuccucaauga

SEQ ID NO: 1807329 - RNA, 18 nt, Homo sapiens
agaugccuacaaccaucc

SEQ ID NO: 1807330 - RNA, 16 nt, Homo sapiens
uccaagccucaugucc

SEQ ID NO: 1807331 - RNA, 23 nt, Homo sapiens
gaaaaacuguucuuuugcaauaa

SEQ ID NO: 1807332 - RNA, 15 nt, Homo sapiens
acauuuaagagacag

SEQ ID NO: 1807333 - RNA, 23 nt, Homo sapiens
agggggugucugcaccuuagaaa

SEQ ID NO: 1807334 - RNA, 21 nt, Homo sapiens
uguaaggaguauaccaugaga

SEQ ID NO: 1807335 - RNA, 12 nt, Homo sapiens
ucccagcacuuu

SEQ ID NO: 1807336 - RNA, 22 nt, Homo sapiens
agcccuuauggccaauaacuuu

SEQ ID NO: 1807337 - RNA, 15 nt, Homo sapiens
cuuccguacuauggc

SEQ ID NO: 1807338 - RNA, 21 nt, Homo sapiens
aggggucuuguuaagugcagu

SEQ ID NO: 1807339 - RNA, 15 nt, Homo sapiens
ucugcgccucuccac

SEQ ID NO: 1807340 - RNA, 14 nt, Homo sapiens
uccuggugugaagg

SEQ ID NO: 1807341 - RNA, 14 nt, Homo sapiens
ucauaaugugcaaa

SEQ ID NO: 1807342 - RNA, 18 nt, Homo sapiens
ucuccugcccaagcacuu

SEQ ID NO: 1807343 - RNA, 14 nt, Homo sapiens
uuuaaacacaugcc

SEQ ID NO: 1807344 - RNA, 17 nt, Homo sapiens
auggcccugcaaaagga

SEQ ID NO: 1807345 - RNA, 20 nt, Homo sapiens
acuaguguuauacuugauga

SEQ ID NO: 1807346 - RNA, 12 nt, Homo sapiens
agcauaugcagc

SEQ ID NO: 1807347 - RNA, 13 nt, Homo sapiens
aaccuuccagcuc

SEQ ID NO: 1807348 - RNA, 19 nt, Homo sapiens
caccaucucacugcaguag

SEQ ID NO: 1807349 - RNA, 21 nt, Homo sapiens
aggcuuccagagaguccucug

SEQ ID NO: 1807350 - RNA, 17 nt, Homo sapiens
cuugcucaaguucacca

SEQ ID NO: 1807351 - RNA, 21 nt, Homo sapiens
ggaaugggucucucuugcccc

SEQ ID NO: 1807352 - RNA, 13 nt, Homo sapiens
guuagcugcucac

SEQ ID NO: 1807353 - RNA, 12 nt, Homo sapiens
auuaaaaagccu

SEQ ID NO: 1807354 - RNA, 22 nt, Homo sapiens
uaguaccuuuuuuuagaaacag

SEQ ID NO: 1807355 - RNA, 23 nt, Homo sapiens
auucaauagauaccaccguguga

SEQ ID NO: 1807356 - RNA, 16 nt, Homo sapiens
ugggaaagggcuguug

SEQ ID NO: 1807357 - RNA, 16 nt, Homo sapiens
uaaaacacccuugaaa

SEQ ID NO: 1807358 - RNA, 14 nt, Homo sapiens
gcuacucaugaggc

SEQ ID NO: 1807359 - RNA, 16 nt, Homo sapiens
cagacuagaguacagu

SEQ ID NO: 1807360 - RNA, 16 nt, Homo sapiens
caggcuggagugcaau

SEQ ID NO: 1807361 - RNA, 16 nt, Homo sapiens
caggcuagagugcagu

SEQ ID NO: 1807362 - RNA, 19 nt, Homo sapiens
ucggacggccaauggugcu

SEQ ID NO: 1807363 - RNA, 21 nt, Homo sapiens
aagcggcccgccaccugugac

SEQ ID NO: 1807364 - RNA, 23 nt, Homo sapiens
ucuacagcagcacuguucugucc

SEQ ID NO: 1807365 - RNA, 17 nt, Homo sapiens
gucucauccuccuuuca

SEQ ID NO: 1807366 - RNA, 14 nt, Homo sapiens
ugauuaaacuguau

SEQ ID NO: 1807367 - RNA, 16 nt, Homo sapiens
aaggagccccauuccu

SEQ ID NO: 1807368 - RNA, 18 nt, Homo sapiens
gacacagcccugaaucag

SEQ ID NO: 1807369 - RNA, 22 nt, Homo sapiens
cccuguggcucacaguggggcc

SEQ ID NO: 1807370 - RNA, 19 nt, Homo sapiens
cgucucggccccucugauu

SEQ ID NO: 1807371 - RNA, 18 nt, Homo sapiens
cauucuuuuucuguugaa

SEQ ID NO: 1807372 - RNA, 14 nt, Homo sapiens
uuaagcugauccug

SEQ ID NO: 1807373 - RNA, 24 nt, Homo sapiens
uaccuuggaauuggaauuacugua

SEQ ID NO: 1807374 - RNA, 19 nt, Homo sapiens
augauagcaaauggccuca

SEQ ID NO: 1807375 - RNA, 14 nt, Homo sapiens
guaggaacaagcau

SEQ ID NO: 1807376 - RNA, 15 nt, Homo sapiens
cccagacuccaggcc

SEQ ID NO: 1807377 - RNA, 15 nt, Homo sapiens
ugagcauuugcaccu

SEQ ID NO: 1807378 - RNA, 16 nt, Homo sapiens
ggcaagcguguucuca

SEQ ID NO: 1807379 - RNA, 23 nt, Homo sapiens
agcuaccagguguucuacacuca

SEQ ID NO: 1807380 - RNA, 16 nt, Homo sapiens
aaucuuaugaguauaa

SEQ ID NO: 1807381 - RNA, 19 nt, Homo sapiens
gcccccagggcacuucaca

SEQ ID NO: 1807382 - RNA, 13 nt, Homo sapiens
uuugacacacuca

SEQ ID NO: 1807383 - RNA, 18 nt, Homo sapiens
ucuguaauucacuaggcu

SEQ ID NO: 1807384 - RNA, 22 nt, Homo sapiens
aaagggccaauaaauaugaugu

SEQ ID NO: 1807385 - RNA, 18 nt, Homo sapiens
ggaacaauaaaaugucuu

SEQ ID NO: 1807386 - RNA, 22 nt, Homo sapiens
gaaaaacuaaggauaaaaucua

SEQ ID NO: 1807387 - RNA, 15 nt, Homo sapiens
guuuaaauagccuaa

SEQ ID NO: 1807388 - RNA, 17 nt, Homo sapiens
aggggcuccagcaccuu

SEQ ID NO: 1807389 - RNA, 12 nt, Homo sapiens
cagaaccugcuc

SEQ ID NO: 1807390 - RNA, 20 nt, Homo sapiens
aguuuccaaauuauggcaaa

SEQ ID NO: 1807391 - RNA, 18 nt, Homo sapiens
guugagauccagugcagu

SEQ ID NO: 1807392 - RNA, 13 nt, Homo sapiens
cuucauaauacuu

SEQ ID NO: 1807393 - RNA, 14 nt, Homo sapiens
cacggucacacggc

SEQ ID NO: 1807394 - RNA, 14 nt, Homo sapiens
gggagucagggagc

SEQ ID NO: 1807395 - RNA, 23 nt, Homo sapiens
cagugagauauuugguaccaugg

SEQ ID NO: 1807396 - RNA, 16 nt, Homo sapiens
aauaaauggccagugc

SEQ ID NO: 1807397 - RNA, 15 nt, Homo sapiens
aggguagaccaaauc

SEQ ID NO: 1807398 - RNA, 22 nt, Homo sapiens
ugaacagaaguccuuaagcaga

SEQ ID NO: 1807399 - RNA, 20 nt, Homo sapiens
uuaccugaaggacagcugaa

SEQ ID NO: 1807400 - RNA, 15 nt, Homo sapiens
cagagggaguagggc

SEQ ID NO: 1807401 - RNA, 19 nt, Homo sapiens
uugagcaagucccaucuca

SEQ ID NO: 1807402 - RNA, 13 nt, Homo sapiens
ccaguugccucca

SEQ ID NO: 1807403 - RNA, 13 nt, Homo sapiens
auccuugcacaga

SEQ ID NO: 1807404 - RNA, 15 nt, Homo sapiens
cugugugugugaaug

SEQ ID NO: 1807405 - RNA, 23 nt, Homo sapiens
cugcagaaaaagaaugugucuug

SEQ ID NO: 1807406 - RNA, 16 nt, Homo sapiens
ucucaaacuccugacc

SEQ ID NO: 1807407 - RNA, 14 nt, Homo sapiens
ggaaauccuaccuu

SEQ ID NO: 1807408 - RNA, 17 nt, Homo sapiens
acucuauguaugcaucu

SEQ ID NO: 1807409 - RNA, 20 nt, Homo sapiens
ugaggagauaacauuucaac

SEQ ID NO: 1807410 - RNA, 19 nt, Homo sapiens
gaaguuuuaugccauguua

SEQ ID NO: 1807411 - RNA, 16 nt, Homo sapiens
aucaagaggcugagac

SEQ ID NO: 1807412 - RNA, 19 nt, Homo sapiens
uagugaugagaauuguaug

SEQ ID NO: 1807413 - RNA, 17 nt, Homo sapiens
augugcugucaaaacaa

SEQ ID NO: 1807414 - RNA, 22 nt, Homo sapiens
caaguuccaugggauacaaccu

SEQ ID NO: 1807415 - RNA, 14 nt, Homo sapiens
caaaaaaguacaaa

SEQ ID NO: 1807416 - RNA, 21 nt, Homo sapiens
cacugcguguggcgcaucucu

SEQ ID NO: 1807417 - RNA, 15 nt, Homo sapiens
gcccacacacaggug

SEQ ID NO: 1807418 - RNA, 23 nt, Homo sapiens
agggaagaacuauugugcucaga

SEQ ID NO: 1807419 - RNA, 22 nt, Homo sapiens
cuuugacuuggggagaccucua

SEQ ID NO: 1807420 - RNA, 18 nt, Homo sapiens
uguggagacacugaguca

SEQ ID NO: 1807421 - RNA, 22 nt, Homo sapiens
cagcaguaacuggaacacacuu

SEQ ID NO: 1807422 - RNA, 20 nt, Homo sapiens
uccaauucccaccacuaaaa

SEQ ID NO: 1807423 - RNA, 15 nt, Homo sapiens
aggagagacuggcca

SEQ ID NO: 1807424 - RNA, 14 nt, Homo sapiens
uaaggauguugcca

SEQ ID NO: 1807425 - RNA, 17 nt, Homo sapiens
aaagcucugaacaaaag

SEQ ID NO: 1807426 - RNA, 23 nt, Homo sapiens
cgccgcuagguagagucugaggg

SEQ ID NO: 1807427 - RNA, 22 nt, Homo sapiens
cuacgguuuuauaaaagccuug

SEQ ID NO: 1807428 - RNA, 15 nt, Homo sapiens
aaccaugggcucagg

SEQ ID NO: 1807429 - RNA, 11 nt, Homo sapiens
ucaccaugcaa

SEQ ID NO: 1807430 - RNA, 11 nt, Homo sapiens
uauccaugccu

SEQ ID NO: 1807431 - RNA, 16 nt, Homo sapiens
ucugucaucucucugg

SEQ ID NO: 1807432 - RNA, 15 nt, Homo sapiens
gccaguucuccuucc

SEQ ID NO: 1807433 - RNA, 19 nt, Homo sapiens
ugaucuuaauuuacuuuaa

SEQ ID NO: 1807434 - RNA, 14 nt, Homo sapiens
cacugcagucagau

SEQ ID NO: 1807435 - RNA, 23 nt, Homo sapiens
ucauuucuuaugaaucuuuccag

SEQ ID NO: 1807436 - RNA, 23 nt, Homo sapiens
auggguuucauauuucuuaucac

SEQ ID NO: 1807437 - RNA, 22 nt, Homo sapiens
uaaguuuaagggaaaaguuauu

SEQ ID NO: 1807438 - RNA, 19 nt, Homo sapiens
auuuuaaugaagugcaaua

SEQ ID NO: 1807439 - RNA, 17 nt, Homo sapiens
auucagugguccaggau

SEQ ID NO: 1807440 - RNA, 21 nt, Homo sapiens
agugccuucaacacagcuugu

SEQ ID NO: 1807441 - RNA, 17 nt, Homo sapiens
cagccuggcaucugugc

SEQ ID NO: 1807442 - RNA, 22 nt, Homo sapiens
cacacgcuuucuuaugcaaucu

SEQ ID NO: 1807443 - RNA, 23 nt, Homo sapiens
acauuuacuuuaauuuccuugac

SEQ ID NO: 1807444 - RNA, 23 nt, Homo sapiens
gagcuagugucaccugcacaggg

SEQ ID NO: 1807445 - RNA, 16 nt, Homo sapiens
aucaaaaacaaccuga

SEQ ID NO: 1807446 - RNA, 23 nt, Homo sapiens
cuggagucugucucuuucagugc

SEQ ID NO: 1807447 - RNA, 13 nt, Homo sapiens
uacaaaaagucaa

SEQ ID NO: 1807448 - RNA, 13 nt, Homo sapiens
uucagaaagacag

SEQ ID NO: 1807449 - RNA, 14 nt, Homo sapiens
guccuccugugcua

SEQ ID NO: 1807450 - RNA, 20 nt, Homo sapiens
acuaccucgcaucauugcag

SEQ ID NO: 1807451 - RNA, 21 nt, Homo sapiens
aaauagcuuuugugucuuaca

SEQ ID NO: 1807452 - RNA, 14 nt, Homo sapiens
auccacaagccauu

SEQ ID NO: 1807453 - RNA, 16 nt, Homo sapiens
uaauuuauuucaucca

SEQ ID NO: 1807454 - RNA, 15 nt, Homo sapiens
cuuugugagcuguga

SEQ ID NO: 1807455 - RNA, 16 nt, Homo sapiens
cggcccaacgcaaauu

SEQ ID NO: 1807456 - RNA, 23 nt, Homo sapiens
aggcaaaggcccuugggcaggaa

SEQ ID NO: 1807457 - RNA, 17 nt, Homo sapiens
aaaugacgucuucacca

SEQ ID NO: 1807458 - RNA, 18 nt, Homo sapiens
caggguuuacaugaagca

SEQ ID NO: 1807459 - RNA, 16 nt, Homo sapiens
uaauggcaugagauag

SEQ ID NO: 1807460 - RNA, 21 nt, Homo sapiens
ccacagaaggaagagggaucc

SEQ ID NO: 1807461 - RNA, 18 nt, Homo sapiens
gagauccggcagcacaag

SEQ ID NO: 1807462 - RNA, 18 nt, Homo sapiens
ugucacugacacaaagga

SEQ ID NO: 1807463 - RNA, 17 nt, Homo sapiens
uggucacagaugcacaa

SEQ ID NO: 1807464 - RNA, 16 nt, Homo sapiens
guccugacacuauuca

SEQ ID NO: 1807465 - RNA, 17 nt, Homo sapiens
ucaaguaauacaaacua

SEQ ID NO: 1807466 - RNA, 11 nt, Homo sapiens
aaacaugguga

SEQ ID NO: 1807467 - RNA, 20 nt, Homo sapiens
ucuuaauuaaguaaacuaau

SEQ ID NO: 1807468 - RNA, 16 nt, Homo sapiens
cuggcaagcagggaaa

SEQ ID NO: 1807469 - RNA, 18 nt, Homo sapiens
uaaccacuggucaugccc

SEQ ID NO: 1807470 - RNA, 16 nt, Homo sapiens
aaucucggcucacugc

SEQ ID NO: 1807471 - RNA, 16 nt, Homo sapiens
gcuucugaaacuggag

SEQ ID NO: 1807472 - RNA, 17 nt, Homo sapiens
caaggccgcuucgccau

SEQ ID NO: 1807473 - RNA, 11 nt, Homo sapiens
ugcggccaaga

SEQ ID NO: 1807474 - RNA, 15 nt, Homo sapiens
uuccccuccuuggcu

SEQ ID NO: 1807475 - RNA, 19 nt, Homo sapiens
aggcaaaaauguccagcca

SEQ ID NO: 1807476 - RNA, 23 nt, Homo sapiens
uucccgccucggcuagggguccu

SEQ ID NO: 1807477 - RNA, 14 nt, Homo sapiens
agauccacgugugg

SEQ ID NO: 1807478 - RNA, 14 nt, Homo sapiens
cucaaaucuauuca

SEQ ID NO: 1807479 - RNA, 15 nt, Homo sapiens
accugaaaaugugga

SEQ ID NO: 1807480 - RNA, 15 nt, Homo sapiens
agagucuucaucugu

SEQ ID NO: 1807481 - RNA, 18 nt, Homo sapiens
uuuuuacugcucugagaa

SEQ ID NO: 1807482 - RNA, 12 nt, Homo sapiens
auguggcagcug

SEQ ID NO: 1807483 - RNA, 22 nt, Homo sapiens
agaaaaaaauucaugcaucuca

SEQ ID NO: 1807484 - RNA, 14 nt, Homo sapiens
uaccuucuuuccag

SEQ ID NO: 1807485 - RNA, 14 nt, Homo sapiens
agauacacugacuu

SEQ ID NO: 1807486 - RNA, 13 nt, Homo sapiens
ggagccaugucau

SEQ ID NO: 1807487 - RNA, 17 nt, Homo sapiens
cccucagagugcaagcc

SEQ ID NO: 1807488 - RNA, 17 nt, Homo sapiens
cuucgcagccuagauau

SEQ ID NO: 1807489 - RNA, 16 nt, Homo sapiens
agacucagccaagaca

SEQ ID NO: 1807490 - RNA, 16 nt, Homo sapiens
gaagcucagaucucua

SEQ ID NO: 1807491 - RNA, 19 nt, Homo sapiens
gaacaacagaaauuaucug

SEQ ID NO: 1807492 - RNA, 15 nt, Homo sapiens
aggaauaaagcuucu

SEQ ID NO: 1807493 - RNA, 20 nt, Homo sapiens
gaaagccugggugacauuug

SEQ ID NO: 1807494 - RNA, 21 nt, Homo sapiens
ucagugccuacccaccuguga

SEQ ID NO: 1807495 - RNA, 23 nt, Homo sapiens
acaaaucuuaccagguucacuua

SEQ ID NO: 1807496 - RNA, 17 nt, Homo sapiens
aaugauuaaaauagcau

SEQ ID NO: 1807497 - RNA, 14 nt, Homo sapiens
gagucauugcugua

SEQ ID NO: 1807498 - RNA, 14 nt, Homo sapiens
caugucgcacaaug

SEQ ID NO: 1807499 - RNA, 18 nt, Homo sapiens
acugaacuugcuauggaa

SEQ ID NO: 1807500 - RNA, 11 nt, Homo sapiens
ucauguucaau

SEQ ID NO: 1807501 - RNA, 18 nt, Homo sapiens
acuuggcuguauguugca

SEQ ID NO: 1807502 - RNA, 14 nt, Homo sapiens
agccacuguaugau

SEQ ID NO: 1807503 - RNA, 18 nt, Homo sapiens
cuagaaacccaagcuccu

SEQ ID NO: 1807504 - RNA, 18 nt, Homo sapiens
uuuacugauacuacaacu

SEQ ID NO: 1807505 - RNA, 17 nt, Homo sapiens
aaagcucagucguccca

SEQ ID NO: 1807506 - RNA, 18 nt, Homo sapiens
cugaacucaaaccagaau

SEQ ID NO: 1807507 - RNA, 20 nt, Homo sapiens
gcuggaugucuccaucucug

SEQ ID NO: 1807508 - RNA, 20 nt, Homo sapiens
cagcuucaggcaccagcauc

SEQ ID NO: 1807509 - RNA, 23 nt, Homo sapiens
ugaaaggagaugucuuggaacau

SEQ ID NO: 1807510 - RNA, 22 nt, Homo sapiens
auuugggcuacccuaaagggag

SEQ ID NO: 1807511 - RNA, 15 nt, Homo sapiens
aggcgggaaaaucau

SEQ ID NO: 1807512 - RNA, 14 nt, Homo sapiens
uacuuuuauuugca

SEQ ID NO: 1807513 - RNA, 22 nt, Homo sapiens
aacauaaaaaauaaaguaccac

SEQ ID NO: 1807514 - RNA, 23 nt, Homo sapiens
ccagccaucaugugccuggaaau

SEQ ID NO: 1807515 - RNA, 19 nt, Homo sapiens
agagagugaauacacugga

SEQ ID NO: 1807516 - RNA, 17 nt, Homo sapiens
ugaucuccaacaguuga

SEQ ID NO: 1807517 - RNA, 20 nt, Homo sapiens
auccauaucagcucugcaua

SEQ ID NO: 1807518 - RNA, 22 nt, Homo sapiens
ccuggaaauaucaguuacucag

SEQ ID NO: 1807519 - RNA, 22 nt, Homo sapiens
agcccaggaguugaagaccagc

SEQ ID NO: 1807520 - RNA, 19 nt, Homo sapiens
acuuuccauaucaagagac

SEQ ID NO: 1807521 - RNA, 18 nt, Homo sapiens
cugacucuccuccuugag

SEQ ID NO: 1807522 - RNA, 12 nt, Homo sapiens
augcuuugcccc

SEQ ID NO: 1807523 - RNA, 12 nt, Homo sapiens
acauccacagga

SEQ ID NO: 1807524 - RNA, 11 nt, Homo sapiens
agcucccauuu

SEQ ID NO: 1807525 - RNA, 20 nt, Homo sapiens
ccagaccuguucugaccuca

SEQ ID NO: 1807526 - RNA, 23 nt, Homo sapiens
agaaccugcaaauaaaguacuaa

SEQ ID NO: 1807527 - RNA, 13 nt, Homo sapiens
ugccucuacuuug

SEQ ID NO: 1807528 - RNA, 12 nt, Homo sapiens
uuuaauauguca

SEQ ID NO: 1807529 - RNA, 12 nt, Homo sapiens
uacuauaugauu

SEQ ID NO: 1807530 - RNA, 13 nt, Homo sapiens
uuaagacagaguu

SEQ ID NO: 1807531 - RNA, 17 nt, Homo sapiens
acuagaccaauugucau

SEQ ID NO: 1807532 - RNA, 20 nt, Homo sapiens
uucaacaaccggccaccaga

SEQ ID NO: 1807533 - RNA, 20 nt, Homo sapiens
aagaaaaauuuauauuucag

SEQ ID NO: 1807534 - RNA, 18 nt, Homo sapiens
gauacuuuuauuguuaua

SEQ ID NO: 1807535 - RNA, 21 nt, Homo sapiens
acaaaaaauuugagaaagccu

SEQ ID NO: 1807536 - RNA, 13 nt, Homo sapiens
ugagaacaaucau

SEQ ID NO: 1807537 - RNA, 21 nt, Homo sapiens
uaccugaaaacacugugcaca

SEQ ID NO: 1807538 - RNA, 16 nt, Homo sapiens
caagugauucucaugc

SEQ ID NO: 1807539 - RNA, 18 nt, Homo sapiens
accacugagccauccuca

SEQ ID NO: 1807540 - RNA, 22 nt, Homo sapiens
acacauccgccuuuuguauaca

SEQ ID NO: 1807541 - RNA, 15 nt, Homo sapiens
ggcuuuugauuuaua

SEQ ID NO: 1807542 - RNA, 18 nt, Homo sapiens
gcuuauaaaaucaaacag

SEQ ID NO: 1807543 - RNA, 20 nt, Homo sapiens
gccuggaaauuaaacccugc

SEQ ID NO: 1807544 - RNA, 14 nt, Homo sapiens
gaauaaucacuugg

SEQ ID NO: 1807545 - RNA, 19 nt, Homo sapiens
auuggaccugcccacaacu

SEQ ID NO: 1807546 - RNA, 13 nt, Homo sapiens
ccaccaaguuccu

SEQ ID NO: 1807547 - RNA, 20 nt, Homo sapiens
uaggauuuggggugaaugaa

SEQ ID NO: 1807548 - RNA, 16 nt, Homo sapiens
gccuggcacauuucag

SEQ ID NO: 1807549 - RNA, 14 nt, Homo sapiens
acuccccguguuca

SEQ ID NO: 1807550 - RNA, 15 nt, Homo sapiens
acuuugucacaucua

SEQ ID NO: 1807551 - RNA, 12 nt, Homo sapiens
guauugacugua

SEQ ID NO: 1807552 - RNA, 18 nt, Homo sapiens
gaaguaaccauuugcacu

SEQ ID NO: 1807553 - RNA, 13 nt, Homo sapiens
ucaagaacuauau

SEQ ID NO: 1807554 - RNA, 17 nt, Homo sapiens
uggccguguucaaagag

SEQ ID NO: 1807555 - RNA, 18 nt, Homo sapiens
ucauaaaauggaagcaau

SEQ ID NO: 1807556 - RNA, 15 nt, Homo sapiens
uaugguuuuguggau

SEQ ID NO: 1807557 - RNA, 18 nt, Homo sapiens
agaccagacucgccaaca

SEQ ID NO: 1807558 - RNA, 22 nt, Homo sapiens
uaguauaugaaaggacagggau

SEQ ID NO: 1807559 - RNA, 15 nt, Homo sapiens
augacuccuuucucu

SEQ ID NO: 1807560 - RNA, 14 nt, Homo sapiens
aggcaggcauuccu

SEQ ID NO: 1807561 - RNA, 20 nt, Homo sapiens
gcaucaagggagacaccagu

SEQ ID NO: 1807562 - RNA, 16 nt, Homo sapiens
gaggaagcccaggcuc

SEQ ID NO: 1807563 - RNA, 14 nt, Homo sapiens
gaauuuuugaagug

SEQ ID NO: 1807564 - RNA, 21 nt, Homo sapiens
aaaugaagguuaggauuuaac

SEQ ID NO: 1807565 - RNA, 16 nt, Homo sapiens
ccugggcccuuccuau

SEQ ID NO: 1807566 - RNA, 20 nt, Homo sapiens
gacacauucuccugugcccc

SEQ ID NO: 1807567 - RNA, 14 nt, Homo sapiens
gugcccacagcccg

SEQ ID NO: 1807568 - RNA, 22 nt, Homo sapiens
ucaugccacagugguacucugu

SEQ ID NO: 1807569 - RNA, 12 nt, Homo sapiens
aaugucauuugc

SEQ ID NO: 1807570 - RNA, 18 nt, Homo sapiens
caguguccugagcucagc

SEQ ID NO: 1807571 - RNA, 16 nt, Homo sapiens
agucaguggcuuugca

SEQ ID NO: 1807572 - RNA, 14 nt, Homo sapiens
ggcaggcagggcau

SEQ ID NO: 1807573 - RNA, 19 nt, Homo sapiens
uuaaauguuuauacuguau

SEQ ID NO: 1807574 - RNA, 20 nt, Homo sapiens
uucauggcuuuaacaguaau

SEQ ID NO: 1807575 - RNA, 17 nt, Homo sapiens
gacuguacacacuuuau

SEQ ID NO: 1807576 - RNA, 16 nt, Homo sapiens
agacuuggacuaugau

SEQ ID NO: 1807577 - RNA, 24 nt, Homo sapiens
aucaauauuuuuauaucaugcaaa

SEQ ID NO: 1807578 - RNA, 14 nt, Homo sapiens
gauggaagcaccua

SEQ ID NO: 1807579 - RNA, 22 nt, Homo sapiens
cauauaugaaaacaauacuaaa

SEQ ID NO: 1807580 - RNA, 13 nt, Homo sapiens
ccucuggacaaag

SEQ ID NO: 1807581 - RNA, 20 nt, Homo sapiens
gguuggggacccccucagga

SEQ ID NO: 1807582 - RNA, 13 nt, Homo sapiens
cuucaaaucaauc

SEQ ID NO: 1807583 - RNA, 16 nt, Homo sapiens
gauuauaaacaacaga

SEQ ID NO: 1807584 - RNA, 23 nt, Homo sapiens
aauguauauugauguaacugugu

SEQ ID NO: 1807585 - RNA, 14 nt, Homo sapiens
ugcaauacucagug

SEQ ID NO: 1807586 - RNA, 21 nt, Homo sapiens
cuggugggaaaaugcacacau

SEQ ID NO: 1807587 - RNA, 13 nt, Homo sapiens
acggcuuccccau

SEQ ID NO: 1807588 - RNA, 16 nt, Homo sapiens
ugaucccccaaacagc

SEQ ID NO: 1807589 - RNA, 17 nt, Homo sapiens
aaauucacaaguugugu

SEQ ID NO: 1807590 - RNA, 21 nt, Homo sapiens
agguuaggaaggcagcauucc

SEQ ID NO: 1807591 - RNA, 15 nt, Homo sapiens
agugacuaugaacuu

SEQ ID NO: 1807592 - RNA, 22 nt, Homo sapiens
acacaguuggauuuauucugcc

SEQ ID NO: 1807593 - RNA, 19 nt, Homo sapiens
uucagcuccuuccaccaca

SEQ ID NO: 1807594 - RNA, 16 nt, Homo sapiens
uauugcuugaguuaua

SEQ ID NO: 1807595 - RNA, 17 nt, Homo sapiens
uaacaaaucguccaaag

SEQ ID NO: 1807596 - RNA, 19 nt, Homo sapiens
gaucagacuuuaauuucuc

SEQ ID NO: 1807597 - RNA, 22 nt, Homo sapiens
aaugcggaccaaacuacuucau

SEQ ID NO: 1807598 - RNA, 10 nt, Homo sapiens
ugucugguaa

SEQ ID NO: 1807599 - RNA, 17 nt, Homo sapiens
uuuagcagagacuuuag

SEQ ID NO: 1807600 - RNA, 23 nt, Homo sapiens
aaagagcauacacgcguggcaaa

SEQ ID NO: 1807601 - RNA, 21 nt, Homo sapiens
uuucacuacucucuacucugu

SEQ ID NO: 1807602 - RNA, 11 nt, Homo sapiens
acagugcuuug

SEQ ID NO: 1807603 - RNA, 18 nt, Homo sapiens
uucucauuauuucaucau

SEQ ID NO: 1807604 - RNA, 15 nt, Homo sapiens
uagcaauauggauug

SEQ ID NO: 1807605 - RNA, 21 nt, Homo sapiens
gcugccaccacgucugccagg

SEQ ID NO: 1807606 - RNA, 23 nt, Homo sapiens
aaagugaaccaucucagaccuuu

SEQ ID NO: 1807607 - RNA, 16 nt, Homo sapiens
acaccuggaauguuag

SEQ ID NO: 1807608 - RNA, 14 nt, Homo sapiens
aaggaugacuuuag

SEQ ID NO: 1807609 - RNA, 17 nt, Homo sapiens
guaaacgggaacaugcc

SEQ ID NO: 1807610 - RNA, 22 nt, Homo sapiens
ugaaacccuggaccaguggucu

SEQ ID NO: 1807611 - RNA, 15 nt, Homo sapiens
uaacaucaccacugu

SEQ ID NO: 1807612 - RNA, 16 nt, Homo sapiens
cagggucugcucuuuc

SEQ ID NO: 1807613 - RNA, 11 nt, Homo sapiens
ucacagcugcu

SEQ ID NO: 1807614 - RNA, 13 nt, Homo sapiens
auaaugagcaugu

SEQ ID NO: 1807615 - RNA, 22 nt, Homo sapiens
ugagucuuuauuuuuuguuacc

SEQ ID NO: 1807616 - RNA, 13 nt, Homo sapiens
augugacccucca

SEQ ID NO: 1807617 - RNA, 13 nt, Homo sapiens
gacucugucucag

SEQ ID NO: 1807618 - RNA, 23 nt, Homo sapiens
auccauaacacccccaccccaac

SEQ ID NO: 1807619 - RNA, 22 nt, Homo sapiens
cacauugggggauccugaggga

SEQ ID NO: 1807620 - RNA, 17 nt, Homo sapiens
uuugcucucucauuccc

SEQ ID NO: 1807621 - RNA, 16 nt, Homo sapiens
ucacauugcauucuau

SEQ ID NO: 1807622 - RNA, 17 nt, Homo sapiens
cccagcucagugccaca

SEQ ID NO: 1807623 - RNA, 18 nt, Homo sapiens
agcucugaacaaacacug

SEQ ID NO: 1807624 - RNA, 20 nt, Homo sapiens
cuuggagggcucagggcagu

SEQ ID NO: 1807625 - RNA, 15 nt, Homo sapiens
uuauuccaaaguuau

SEQ ID NO: 1807626 - RNA, 23 nt, Homo sapiens
gacuuuggaggcaaaauguguug

SEQ ID NO: 1807627 - RNA, 15 nt, Homo sapiens
augggcacacacacc

SEQ ID NO: 1807628 - RNA, 23 nt, Homo sapiens
aaaaagcaucuguauuaauguaa

SEQ ID NO: 1807629 - RNA, 14 nt, Homo sapiens
uuaaucauuuccag

SEQ ID NO: 1807630 - RNA, 20 nt, Homo sapiens
cuugaugagcugugcacaaa

SEQ ID NO: 1807631 - RNA, 12 nt, Homo sapiens
gaaaaucauauu

SEQ ID NO: 1807632 - RNA, 19 nt, Homo sapiens
ugagaaaacuaagucagaa

SEQ ID NO: 1807633 - RNA, 19 nt, Homo sapiens
uuaaaaaugcaccacuuuu

SEQ ID NO: 1807634 - RNA, 19 nt, Homo sapiens
ugucauggcucugaacugc

SEQ ID NO: 1807635 - RNA, 17 nt, Homo sapiens
guguucaguguugacau

SEQ ID NO: 1807636 - RNA, 18 nt, Homo sapiens
cucugugcccacccucca

SEQ ID NO: 1807637 - RNA, 20 nt, Homo sapiens
uaaauuguauucucauaaua

SEQ ID NO: 1807638 - RNA, 16 nt, Homo sapiens
acaugacauagcacuu

SEQ ID NO: 1807639 - RNA, 17 nt, Homo sapiens
ucuggaccccaucugug

SEQ ID NO: 1807640 - RNA, 15 nt, Homo sapiens
ggccugagacccagg

SEQ ID NO: 1807641 - RNA, 20 nt, Homo sapiens
ugagcacacccgugugcaca

SEQ ID NO: 1807642 - RNA, 15 nt, Homo sapiens
ucaauuuccugaugc

SEQ ID NO: 1807643 - RNA, 20 nt, Homo sapiens
aaccuccaccuucuggguuc

SEQ ID NO: 1807644 - RNA, 19 nt, Homo sapiens
uaaaaaccccaaacuguug

SEQ ID NO: 1807645 - RNA, 15 nt, Homo sapiens
uucugcaccaacuca

SEQ ID NO: 1807646 - RNA, 19 nt, Homo sapiens
caccauucacauuugaugu

SEQ ID NO: 1807647 - RNA, 13 nt, Homo sapiens
cucuuggguucaa

SEQ ID NO: 1807648 - RNA, 14 nt, Homo sapiens
aguuauaaaccaau

SEQ ID NO: 1807649 - RNA, 13 nt, Homo sapiens
aauuucugauuau

SEQ ID NO: 1807650 - RNA, 13 nt, Homo sapiens
guuuacuggauaa

SEQ ID NO: 1807651 - RNA, 13 nt, Homo sapiens
uauuuacagugaa

SEQ ID NO: 1807652 - RNA, 12 nt, Homo sapiens
acuuucugugua

SEQ ID NO: 1807653 - RNA, 17 nt, Homo sapiens
ugcccucuuuagccaga

SEQ ID NO: 1807654 - RNA, 17 nt, Homo sapiens
ccucuuggcugccuugu

SEQ ID NO: 1807655 - RNA, 18 nt, Homo sapiens
uagcacuuugaaauaccu

SEQ ID NO: 1807656 - RNA, 16 nt, Homo sapiens
ucugccguugcugcca

SEQ ID NO: 1807657 - RNA, 20 nt, Homo sapiens
cagacugcaugacagucaca

SEQ ID NO: 1807658 - RNA, 18 nt, Homo sapiens
gugcuucuccagccucag

SEQ ID NO: 1807659 - RNA, 20 nt, Homo sapiens
aagaagauagauccaauuaa

SEQ ID NO: 1807660 - RNA, 13 nt, Homo sapiens
guaaggugcaguu

SEQ ID NO: 1807661 - RNA, 21 nt, Homo sapiens
uaugaacagcugugucugcca

SEQ ID NO: 1807662 - RNA, 24 nt, Homo sapiens
ucuaucacugcauuaucuugcuca

SEQ ID NO: 1807663 - RNA, 20 nt, Homo sapiens
ucuauacaaauuuucagaag

SEQ ID NO: 1807664 - RNA, 20 nt, Homo sapiens
gcaggagcagcugugcugca

SEQ ID NO: 1807665 - RNA, 18 nt, Homo sapiens
gaaauugcaguaacaaaa

SEQ ID NO: 1807666 - RNA, 16 nt, Homo sapiens
auauuagaugugauuu

SEQ ID NO: 1807667 - RNA, 14 nt, Homo sapiens
cucauccaaaaagu

SEQ ID NO: 1807668 - RNA, 17 nt, Homo sapiens
ugugccaaagugcauag

SEQ ID NO: 1807669 - RNA, 11 nt, Homo sapiens
ccugugccauc

SEQ ID NO: 1807670 - RNA, 20 nt, Homo sapiens
cagugucugugccauggauu

SEQ ID NO: 1807671 - RNA, 14 nt, Homo sapiens
ccucugcauuuaca

SEQ ID NO: 1807672 - RNA, 12 nt, Homo sapiens
aucauaaggaag

SEQ ID NO: 1807673 - RNA, 22 nt, Homo sapiens
cacaagaaaucaaaauccaaaa

SEQ ID NO: 1807674 - RNA, 16 nt, Homo sapiens
ugccuaucugaccaaa

SEQ ID NO: 1807675 - RNA, 16 nt, Homo sapiens
caacuuaagcugggau

SEQ ID NO: 1807676 - RNA, 18 nt, Homo sapiens
ucacgggaggaaucuuuu

SEQ ID NO: 1807677 - RNA, 16 nt, Homo sapiens
aaagugcugcacucaa

SEQ ID NO: 1807678 - RNA, 16 nt, Homo sapiens
aucaacacuaaugccu

SEQ ID NO: 1807679 - RNA, 13 nt, Homo sapiens
gagaaacuuccuu

SEQ ID NO: 1807680 - RNA, 19 nt, Homo sapiens
gcuguuuauuaaugcugaa

SEQ ID NO: 1807681 - RNA, 11 nt, Homo sapiens
caucaccgcug

SEQ ID NO: 1807682 - RNA, 17 nt, Homo sapiens
aagacuguaaugaaucu

SEQ ID NO: 1807683 - RNA, 18 nt, Homo sapiens
augcacugacccuuccag

SEQ ID NO: 1807684 - RNA, 16 nt, Homo sapiens
ugaggacuaugccaug

SEQ ID NO: 1807685 - RNA, 22 nt, Homo sapiens
ccugauccugcaauuaaagggu

SEQ ID NO: 1807686 - RNA, 18 nt, Homo sapiens
auguacuuaaauuacaca

SEQ ID NO: 1807687 - RNA, 13 nt, Homo sapiens
aagguaugguggg

SEQ ID NO: 1807688 - RNA, 22 nt, Homo sapiens
caauuauaucucccccacucca

SEQ ID NO: 1807689 - RNA, 13 nt, Homo sapiens
agagauuuucaag

SEQ ID NO: 1807690 - RNA, 15 nt, Homo sapiens
gccagugagggcagu

SEQ ID NO: 1807691 - RNA, 16 nt, Homo sapiens
ccaggaggaacaaaga

SEQ ID NO: 1807692 - RNA, 17 nt, Homo sapiens
agagcccuuuugcuaua

SEQ ID NO: 1807693 - RNA, 14 nt, Homo sapiens
aaauuaagacuuua

SEQ ID NO: 1807694 - RNA, 14 nt, Homo sapiens
acuuaaagaaauaa

SEQ ID NO: 1807695 - RNA, 20 nt, Homo sapiens
ugcuaacaagucaccaaaag

SEQ ID NO: 1807696 - RNA, 19 nt, Homo sapiens
aaguaugcacuaaucaaua

SEQ ID NO: 1807697 - RNA, 15 nt, Homo sapiens
auauuccagguuuaa

SEQ ID NO: 1807698 - RNA, 17 nt, Homo sapiens
cauucaaggaugcacag

SEQ ID NO: 1807699 - RNA, 20 nt, Homo sapiens
auguguaaauggagcuugua

SEQ ID NO: 1807700 - RNA, 19 nt, Homo sapiens
gcauagaguauagcucugu

SEQ ID NO: 1807701 - RNA, 19 nt, Homo sapiens
agccaucccauuggcaaaa

SEQ ID NO: 1807702 - RNA, 19 nt, Homo sapiens
ucauucauuuaacagagcu

SEQ ID NO: 1807703 - RNA, 21 nt, Homo sapiens
caucuuucuuccaaacaggcu

SEQ ID NO: 1807704 - RNA, 23 nt, Homo sapiens
cacugacagccuccaccuugagc

SEQ ID NO: 1807705 - RNA, 16 nt, Homo sapiens
cucugcaccugucuca

SEQ ID NO: 1807706 - RNA, 20 nt, Homo sapiens
auuuagugaaguugugcaac

SEQ ID NO: 1807707 - RNA, 19 nt, Homo sapiens
ccccagauucaugcacugu

SEQ ID NO: 1807708 - RNA, 22 nt, Homo sapiens
gcuauuucaucuauuuuuggca

SEQ ID NO: 1807709 - RNA, 13 nt, Homo sapiens
agcagugccuugu

SEQ ID NO: 1807710 - RNA, 19 nt, Homo sapiens
cauuuuucaaagcaauuga

SEQ ID NO: 1807711 - RNA, 22 nt, Homo sapiens
cucuggcaagagacuacucugc

SEQ ID NO: 1807712 - RNA, 21 nt, Homo sapiens
uugaaaaggcgguacuaguuc

SEQ ID NO: 1807713 - RNA, 16 nt, Homo sapiens
acacuuggcauacaaa

SEQ ID NO: 1807714 - RNA, 18 nt, Homo sapiens
gaaaaaucagaagcacaa

SEQ ID NO: 1807715 - RNA, 17 nt, Homo sapiens
auucuuauaguaccuca

SEQ ID NO: 1807716 - RNA, 19 nt, Homo sapiens
aaguggggaaguguuccag

SEQ ID NO: 1807717 - RNA, 20 nt, Homo sapiens
aauaaguauccaguacuuua

SEQ ID NO: 1807718 - RNA, 16 nt, Homo sapiens
cugauuuucuggaaug

SEQ ID NO: 1807719 - RNA, 19 nt, Homo sapiens
uugggaccgaaagcaaagg

SEQ ID NO: 1807720 - RNA, 14 nt, Homo sapiens
acagguucucacua

SEQ ID NO: 1807721 - RNA, 20 nt, Homo sapiens
aggucucaggagaagggaua

SEQ ID NO: 1807722 - RNA, 12 nt, Homo sapiens
ccuucacauuua

SEQ ID NO: 1807723 - RNA, 23 nt, Homo sapiens
ucuauuuaacaacugggucaugu

SEQ ID NO: 1807724 - RNA, 12 nt, Homo sapiens
agauagggaaaa

SEQ ID NO: 1807725 - RNA, 15 nt, Homo sapiens
uuccuugacuguaaa

SEQ ID NO: 1807726 - RNA, 15 nt, Homo sapiens
uguauaaacuaucag

SEQ ID NO: 1807727 - RNA, 15 nt, Homo sapiens
ucccucagacccagc

SEQ ID NO: 1807728 - RNA, 18 nt, Homo sapiens
ugaaucgagugagacaaa

SEQ ID NO: 1807729 - RNA, 15 nt, Homo sapiens
uuccauuuuacuucc

SEQ ID NO: 1807730 - RNA, 16 nt, Homo sapiens
gucagucaugauggca

SEQ ID NO: 1807731 - RNA, 22 nt, Homo sapiens
ucuucucagcuccacucugaag

SEQ ID NO: 1807732 - RNA, 20 nt, Homo sapiens
uuggacucuaaaaucucagc

SEQ ID NO: 1807733 - RNA, 17 nt, Homo sapiens
acauaguguauuuugca

SEQ ID NO: 1807734 - RNA, 23 nt, Homo sapiens
cauagaaaaggcgugcaguacua

SEQ ID NO: 1807735 - RNA, 23 nt, Homo sapiens
auucuguggugggaacauucgag

SEQ ID NO: 1807736 - RNA, 22 nt, Homo sapiens
gcuuaaagaucucaacauggaa

SEQ ID NO: 1807737 - RNA, 14 nt, Homo sapiens
uggagaacauucaa

SEQ ID NO: 1807738 - RNA, 23 nt, Homo sapiens
uucucauaauuccuacagcacua

SEQ ID NO: 1807739 - RNA, 15 nt, Homo sapiens
uauuaaggugucaua

SEQ ID NO: 1807740 - RNA, 21 nt, Homo sapiens
ggcaucuuuucuagagacaca

SEQ ID NO: 1807741 - RNA, 18 nt, Homo sapiens
uugucaugugaugggucc

SEQ ID NO: 1807742 - RNA, 17 nt, Homo sapiens
gaagcuccuccagugaa

SEQ ID NO: 1807743 - RNA, 18 nt, Homo sapiens
acucuuacuaaccaccau

SEQ ID NO: 1807744 - RNA, 16 nt, Homo sapiens
agcuuuguauguuuau

SEQ ID NO: 1807745 - RNA, 19 nt, Homo sapiens
ucccuaagugcaacugcaa

SEQ ID NO: 1807746 - RNA, 20 nt, Homo sapiens
aguuccugccuuaacugaug

SEQ ID NO: 1807747 - RNA, 20 nt, Homo sapiens
gaggcagagguugcagugag

SEQ ID NO: 1807748 - RNA, 13 nt, Homo sapiens
uguggcacuggga

SEQ ID NO: 1807749 - RNA, 21 nt, Homo sapiens
uccaccuggaaacugcucaga

SEQ ID NO: 1807750 - RNA, 16 nt, Homo sapiens
uuccaugcugacugau

SEQ ID NO: 1807751 - RNA, 13 nt, Homo sapiens
uuuccaaugaagg

SEQ ID NO: 1807752 - RNA, 19 nt, Homo sapiens
cagaggcuggcacugagcc

SEQ ID NO: 1807753 - RNA, 18 nt, Homo sapiens
uugacuguuaguugucca

SEQ ID NO: 1807754 - RNA, 19 nt, Homo sapiens
uaacauaggcuuauacaaa

SEQ ID NO: 1807755 - RNA, 16 nt, Homo sapiens
cucugauugcagcaca

SEQ ID NO: 1807756 - RNA, 13 nt, Homo sapiens
cuagauuuugcug

SEQ ID NO: 1807757 - RNA, 13 nt, Homo sapiens
agcuuuuucaaaa

SEQ ID NO: 1807758 - RNA, 18 nt, Homo sapiens
gugguggagaaccacagc

SEQ ID NO: 1807759 - RNA, 22 nt, Homo sapiens
cgucagggucggggcuagggua

SEQ ID NO: 1807760 - RNA, 15 nt, Homo sapiens
auuuagaaaucaagc

SEQ ID NO: 1807761 - RNA, 19 nt, Homo sapiens
augaauauuuaguguucau

SEQ ID NO: 1807762 - RNA, 20 nt, Homo sapiens
gugcucucugccacuggaag

SEQ ID NO: 1807763 - RNA, 15 nt, Homo sapiens
ugaaagcuagacuga

SEQ ID NO: 1807764 - RNA, 19 nt, Homo sapiens
augucuguucuacauagau

SEQ ID NO: 1807765 - RNA, 23 nt, Homo sapiens
ucuaaucaguaguucacuuuaau

SEQ ID NO: 1807766 - RNA, 20 nt, Homo sapiens
gaacacauuucuaauuugaa

SEQ ID NO: 1807767 - RNA, 15 nt, Homo sapiens
uggaggugcuggggc

SEQ ID NO: 1807768 - RNA, 22 nt, Homo sapiens
aaguucccuucuauauccucaa

SEQ ID NO: 1807769 - RNA, 23 nt, Homo sapiens
cccaccccuuccccuuguaaaaa

SEQ ID NO: 1807770 - RNA, 15 nt, Homo sapiens
gcccacggaugcuca

SEQ ID NO: 1807771 - RNA, 23 nt, Homo sapiens
caaaagagcauggaugcauuuca

SEQ ID NO: 1807772 - RNA, 11 nt, Homo sapiens
aaacucaaaau

SEQ ID NO: 1807773 - RNA, 17 nt, Homo sapiens
ugcuuucuucucugccu

SEQ ID NO: 1807774 - RNA, 22 nt, Homo sapiens
ggauucagcccucccugccgcu

SEQ ID NO: 1807775 - RNA, 14 nt, Homo sapiens
acaguaagggauau

SEQ ID NO: 1807776 - RNA, 22 nt, Homo sapiens
caugcauccuccccucuccugc

SEQ ID NO: 1807777 - RNA, 20 nt, Homo sapiens
ucaccauugugaagcaccua

SEQ ID NO: 1807778 - RNA, 22 nt, Homo sapiens
uuuuccuaaaaauaagcuuuau

SEQ ID NO: 1807779 - RNA, 15 nt, Homo sapiens
acagagauaugcaca

SEQ ID NO: 1807780 - RNA, 23 nt, Homo sapiens
agucgauuauuuccaguguucua

SEQ ID NO: 1807781 - RNA, 23 nt, Homo sapiens
aggcagcuguugcagugagccaa

SEQ ID NO: 1807782 - RNA, 18 nt, Homo sapiens
agaggaaauuguacauaa

SEQ ID NO: 1807783 - RNA, 21 nt, Homo sapiens
ucaauaucugaaucaccuuga

SEQ ID NO: 1807784 - RNA, 16 nt, Homo sapiens
auaugggaggaacaaa

SEQ ID NO: 1807785 - RNA, 15 nt, Homo sapiens
guaggcuacagagaa

SEQ ID NO: 1807786 - RNA, 22 nt, Homo sapiens
augcuccgucauuugacagggg

SEQ ID NO: 1807787 - RNA, 15 nt, Homo sapiens
cuagguuucaaagau

SEQ ID NO: 1807788 - RNA, 16 nt, Homo sapiens
acaaaaaaaucuucca

SEQ ID NO: 1807789 - RNA, 15 nt, Homo sapiens
ucauaaauauaaucu

SEQ ID NO: 1807790 - RNA, 16 nt, Homo sapiens
acuuuccugaaugugu

SEQ ID NO: 1807791 - RNA, 22 nt, Homo sapiens
auacuacaguaacugugacuga

SEQ ID NO: 1807792 - RNA, 18 nt, Homo sapiens
cagcugaaaguucuugcu

SEQ ID NO: 1807793 - RNA, 21 nt, Homo sapiens
gagaguuccucuuugcccuga

SEQ ID NO: 1807794 - RNA, 21 nt, Homo sapiens
auaaauuacuaauuaucuuau

SEQ ID NO: 1807795 - RNA, 13 nt, Homo sapiens
uuagucucuggaa

SEQ ID NO: 1807796 - RNA, 18 nt, Homo sapiens
ccuuccuuaagccaggaa

SEQ ID NO: 1807797 - RNA, 19 nt, Homo sapiens
aaaguguauuauaacagug

SEQ ID NO: 1807798 - RNA, 22 nt, Homo sapiens
aaagacgcauguuauggugcua

SEQ ID NO: 1807799 - RNA, 16 nt, Homo sapiens
uuacauaauugcaaua

SEQ ID NO: 1807800 - RNA, 16 nt, Homo sapiens
ggacaugaaaauagca

SEQ ID NO: 1807801 - RNA, 15 nt, Homo sapiens
uggaccugggguccc

SEQ ID NO: 1807802 - RNA, 21 nt, Homo sapiens
auguauuaagauggucauauu

SEQ ID NO: 1807803 - RNA, 21 nt, Homo sapiens
cuguugcuguccuccagggcg

SEQ ID NO: 1807804 - RNA, 22 nt, Homo sapiens
cagccuccagggcauugcucag

SEQ ID NO: 1807805 - RNA, 16 nt, Homo sapiens
ucuucacucuuugaag

SEQ ID NO: 1807806 - RNA, 22 nt, Homo sapiens
aaucaccaauaaauaagugcau

SEQ ID NO: 1807807 - RNA, 21 nt, Homo sapiens
gacacauucacacugggccaa

SEQ ID NO: 1807808 - RNA, 16 nt, Homo sapiens
ugcccagcacaggaau

SEQ ID NO: 1807809 - RNA, 14 nt, Homo sapiens
ucuucaaacaguuc

SEQ ID NO: 1807810 - RNA, 23 nt, Homo sapiens
ggaaggcaagauugugucccauu

SEQ ID NO: 1807811 - RNA, 17 nt, Homo sapiens
uauacauaaacaagacc

SEQ ID NO: 1807812 - RNA, 15 nt, Homo sapiens
cucauaucuuccuca

SEQ ID NO: 1807813 - RNA, 20 nt, Homo sapiens
guggaaggcaucagucccua

SEQ ID NO: 1807814 - RNA, 14 nt, Homo sapiens
uucaaccacagauu

SEQ ID NO: 1807815 - RNA, 22 nt, Homo sapiens
cucuggggacugggaacccaug

SEQ ID NO: 1807816 - RNA, 14 nt, Homo sapiens
gaaaguuuuggaaa

SEQ ID NO: 1807817 - RNA, 19 nt, Homo sapiens
aauaguauuacccauggga

SEQ ID NO: 1807818 - RNA, 15 nt, Homo sapiens
cugcauuuugcuauu

SEQ ID NO: 1807819 - RNA, 19 nt, Homo sapiens
cgacagaaaaccucaaggg

SEQ ID NO: 1807820 - RNA, 19 nt, Homo sapiens
uugaacaaccagaugguga

SEQ ID NO: 1807821 - RNA, 23 nt, Homo sapiens
ucgacucuuugcaacagcacuug

SEQ ID NO: 1807822 - RNA, 15 nt, Homo sapiens
aaaaugaacuguaaa

SEQ ID NO: 1807823 - RNA, 20 nt, Homo sapiens
gagccaaagagaaugccauu

SEQ ID NO: 1807824 - RNA, 17 nt, Homo sapiens
cuacaggccagcaccuu

SEQ ID NO: 1807825 - RNA, 17 nt, Homo sapiens
cugaaguaagcaaagac

SEQ ID NO: 1807826 - RNA, 15 nt, Homo sapiens
cuggcuagcauuccu

SEQ ID NO: 1807827 - RNA, 20 nt, Homo sapiens
gaaaauauugcugugucuuc

SEQ ID NO: 1807828 - RNA, 18 nt, Homo sapiens
auguaccacugagccuga

SEQ ID NO: 1807829 - RNA, 12 nt, Homo sapiens
agcuagccagag

SEQ ID NO: 1807830 - RNA, 18 nt, Homo sapiens
uucaaguuagcucaggag

SEQ ID NO: 1807831 - RNA, 18 nt, Homo sapiens
auaguaaauguaguucau

SEQ ID NO: 1807832 - RNA, 20 nt, Homo sapiens
uuccuauuugcacacgucca

SEQ ID NO: 1807833 - RNA, 15 nt, Homo sapiens
gauugccauuucuuc

SEQ ID NO: 1807834 - RNA, 14 nt, Homo sapiens
gaaaauggccaugc

SEQ ID NO: 1807835 - RNA, 16 nt, Homo sapiens
auucuuuuaaugccac

SEQ ID NO: 1807836 - RNA, 14 nt, Homo sapiens
ggcugcauucccau

SEQ ID NO: 1807837 - RNA, 13 nt, Homo sapiens
uaaauucagacaa

SEQ ID NO: 1807838 - RNA, 20 nt, Homo sapiens
aaaggaaucacguuagagga

SEQ ID NO: 1807839 - RNA, 16 nt, Homo sapiens
uauggacucaguuuuc

SEQ ID NO: 1807840 - RNA, 21 nt, Homo sapiens
cacccuaugauuuauucccuu

SEQ ID NO: 1807841 - RNA, 21 nt, Homo sapiens
caaaccugugcugaccaaaga

SEQ ID NO: 1807842 - RNA, 16 nt, Homo sapiens
uccaggacugggucug

SEQ ID NO: 1807843 - RNA, 21 nt, Homo sapiens
aucccuccugggaaugaagca

SEQ ID NO: 1807844 - RNA, 18 nt, Homo sapiens
gcgauucucuugccucag

SEQ ID NO: 1807845 - RNA, 19 nt, Homo sapiens
uauuuuccccuagcuuucc

SEQ ID NO: 1807846 - RNA, 16 nt, Homo sapiens
ggcucccacagagaca

SEQ ID NO: 1807847 - RNA, 21 nt, Homo sapiens
ugccaggcguuggugccacuu

SEQ ID NO: 1807848 - RNA, 15 nt, Homo sapiens
ugaagaugaugcuau

SEQ ID NO: 1807849 - RNA, 15 nt, Homo sapiens
cucccaucagggucc

SEQ ID NO: 1807850 - RNA, 15 nt, Homo sapiens
accugcccucagcuu

SEQ ID NO: 1807851 - RNA, 19 nt, Homo sapiens
acugcuuuaaacugcauuu

SEQ ID NO: 1807852 - RNA, 15 nt, Homo sapiens
guguguacaaauaca

SEQ ID NO: 1807853 - RNA, 21 nt, Homo sapiens
ugacuuccccuuaaguauaac

SEQ ID NO: 1807854 - RNA, 18 nt, Homo sapiens
uuacucucuugcaccaaa

SEQ ID NO: 1807855 - RNA, 21 nt, Homo sapiens
uguagcacucaggcucuccau

SEQ ID NO: 1807856 - RNA, 22 nt, Homo sapiens
agccagggugagagucuggguc

SEQ ID NO: 1807857 - RNA, 18 nt, Homo sapiens
uagaccugccagccacug

SEQ ID NO: 1807858 - RNA, 20 nt, Homo sapiens
uagaaauagaacacugccuc

SEQ ID NO: 1807859 - RNA, 15 nt, Homo sapiens
gcucaugucuguuaa

SEQ ID NO: 1807860 - RNA, 21 nt, Homo sapiens
cagcugguugcuccauuugag

SEQ ID NO: 1807861 - RNA, 19 nt, Homo sapiens
gccacucuaccagugcagg

SEQ ID NO: 1807862 - RNA, 14 nt, Homo sapiens
uggaaaaugcaaug

SEQ ID NO: 1807863 - RNA, 14 nt, Homo sapiens
uauccaaguuggac

SEQ ID NO: 1807864 - RNA, 17 nt, Homo sapiens
cccucccuggcauguca

SEQ ID NO: 1807865 - RNA, 14 nt, Homo sapiens
uauucaagcacuua

SEQ ID NO: 1807866 - RNA, 20 nt, Homo sapiens
uugaggugcgcucaccucag

SEQ ID NO: 1807867 - RNA, 14 nt, Homo sapiens
ugucaacacaaaga

SEQ ID NO: 1807868 - RNA, 15 nt, Homo sapiens
agcugagugcugaaa

SEQ ID NO: 1807869 - RNA, 14 nt, Homo sapiens
gagugucaucucaa

SEQ ID NO: 1807870 - RNA, 14 nt, Homo sapiens
ugcauccaugggca

SEQ ID NO: 1807871 - RNA, 22 nt, Homo sapiens
uccccgaaucacacagacaguu

SEQ ID NO: 1807872 - RNA, 21 nt, Homo sapiens
aagcugaaaauuaaauuuuag

SEQ ID NO: 1807873 - RNA, 22 nt, Homo sapiens
cccucauuuaaacccaaucaga

SEQ ID NO: 1807874 - RNA, 16 nt, Homo sapiens
guguuccuagaaugca

SEQ ID NO: 1807875 - RNA, 15 nt, Homo sapiens
agaugacauggugaa

SEQ ID NO: 1807876 - RNA, 14 nt, Homo sapiens
acacugcagcauuu

SEQ ID NO: 1807877 - RNA, 17 nt, Homo sapiens
gcacaaauuucaucucc

SEQ ID NO: 1807878 - RNA, 22 nt, Homo sapiens
gcuaccauuucaauagccccau

SEQ ID NO: 1807879 - RNA, 19 nt, Homo sapiens
gguccugcugcuggcugcc

SEQ ID NO: 1807880 - RNA, 18 nt, Homo sapiens
gaggcccugcccaaugag

SEQ ID NO: 1807881 - RNA, 16 nt, Homo sapiens
aggucgaggcuacagu

SEQ ID NO: 1807882 - RNA, 14 nt, Homo sapiens
guagaacucacaga

SEQ ID NO: 1807883 - RNA, 17 nt, Homo sapiens
caacugcaaaaaaagcc

SEQ ID NO: 1807884 - RNA, 12 nt, Homo sapiens
uuugcuugccuc

SEQ ID NO: 1807885 - RNA, 18 nt, Homo sapiens
aaucuuuagaauaguuaa

SEQ ID NO: 1807886 - RNA, 19 nt, Homo sapiens
gacagugaagcagcacugu

SEQ ID NO: 1807887 - RNA, 19 nt, Homo sapiens
cgaaaugcuaugacuguau

SEQ ID NO: 1807888 - RNA, 19 nt, Homo sapiens
uaaaaaucaugagauccuu

SEQ ID NO: 1807889 - RNA, 18 nt, Homo sapiens
ucuuuuaggccaaggaaa

SEQ ID NO: 1807890 - RNA, 14 nt, Homo sapiens
uaugcagugugcuc

SEQ ID NO: 1807891 - RNA, 23 nt, Homo sapiens
guaaaaccccgucucuacuaaaa

SEQ ID NO: 1807892 - RNA, 16 nt, Homo sapiens
uuaguguuuugccuca

SEQ ID NO: 1807893 - RNA, 14 nt, Homo sapiens
uuuuccuacauuga

SEQ ID NO: 1807894 - RNA, 15 nt, Homo sapiens
ugccuacagccaggu

SEQ ID NO: 1807895 - RNA, 16 nt, Homo sapiens
uaaauuguacuguuga

SEQ ID NO: 1807896 - RNA, 16 nt, Homo sapiens
gggccuguaaucccag

SEQ ID NO: 1807897 - RNA, 22 nt, Homo sapiens
auagcgugcaguagagagcaaa

SEQ ID NO: 1807898 - RNA, 16 nt, Homo sapiens
gaaaauagcucuuuca

SEQ ID NO: 1807899 - RNA, 15 nt, Homo sapiens
ccuuuugaagcucaa

SEQ ID NO: 1807900 - RNA, 17 nt, Homo sapiens
agaauaaaaugcaguga

SEQ ID NO: 1807901 - RNA, 16 nt, Homo sapiens
ucaaucucugauucug

SEQ ID NO: 1807902 - RNA, 17 nt, Homo sapiens
uaggcagccugcaggga

SEQ ID NO: 1807903 - RNA, 19 nt, Homo sapiens
aguuaaugauuuuacuuaa

SEQ ID NO: 1807904 - RNA, 13 nt, Homo sapiens
uggaucaaaagga

SEQ ID NO: 1807905 - RNA, 19 nt, Homo sapiens
gcuuacagggcuaggcagu

SEQ ID NO: 1807906 - RNA, 21 nt, Homo sapiens
cauacuacauugaguagacac

SEQ ID NO: 1807907 - RNA, 14 nt, Homo sapiens
ugagguaucugugu

SEQ ID NO: 1807908 - RNA, 17 nt, Homo sapiens
auauucuguaguauuuu

SEQ ID NO: 1807909 - RNA, 16 nt, Homo sapiens
ugaaaaugcaccccaa

SEQ ID NO: 1807910 - RNA, 15 nt, Homo sapiens
uuaagggaagcugau

SEQ ID NO: 1807911 - RNA, 15 nt, Homo sapiens
uuucuaagcauaaaa

SEQ ID NO: 1807912 - RNA, 23 nt, Homo sapiens
agcccguccuccucuaccucucu

SEQ ID NO: 1807913 - RNA, 18 nt, Homo sapiens
auaauauuuacuguuaga

SEQ ID NO: 1807914 - RNA, 18 nt, Homo sapiens
guuuauuuacaagggaag

SEQ ID NO: 1807915 - RNA, 13 nt, Homo sapiens
acaaaaaaaccuc

SEQ ID NO: 1807916 - RNA, 20 nt, Homo sapiens
agucaagcucugucacccag

SEQ ID NO: 1807917 - RNA, 15 nt, Homo sapiens
acucuacuucaagaa

SEQ ID NO: 1807918 - RNA, 19 nt, Homo sapiens
uaggaugugaucacuuuca

SEQ ID NO: 1807919 - RNA, 23 nt, Homo sapiens
cugcauuugccugcuucuuucca

SEQ ID NO: 1807920 - RNA, 21 nt, Homo sapiens
uuuauagcuauagucuaugca

SEQ ID NO: 1807921 - RNA, 22 nt, Homo sapiens
ucaguuugcaguauacacacuu

SEQ ID NO: 1807922 - RNA, 22 nt, Homo sapiens
cucaccucuucuuuaccagaac

SEQ ID NO: 1807923 - RNA, 20 nt, Homo sapiens
uuuuauaaugucccuucaca

SEQ ID NO: 1807924 - RNA, 21 nt, Homo sapiens
cuaaaugcacagucaugugcc

SEQ ID NO: 1807925 - RNA, 23 nt, Homo sapiens
cuaguaccaugucguaguuacuc

SEQ ID NO: 1807926 - RNA, 21 nt, Homo sapiens
ccagcuauuuucugaccaaaa

SEQ ID NO: 1807927 - RNA, 17 nt, Homo sapiens
ggugcaugaugcugccc

SEQ ID NO: 1807928 - RNA, 16 nt, Homo sapiens
auuauaugcacuagca

SEQ ID NO: 1807929 - RNA, 20 nt, Homo sapiens
gcagcuaacaugaguaucau

SEQ ID NO: 1807930 - RNA, 22 nt, Homo sapiens
uccucauauacuugaauauuau

SEQ ID NO: 1807931 - RNA, 15 nt, Homo sapiens
uuggucauauugcca

SEQ ID NO: 1807932 - RNA, 15 nt, Homo sapiens
gaacagaaaacaaca

SEQ ID NO: 1807933 - RNA, 14 nt, Homo sapiens
acaauuuauaauua

SEQ ID NO: 1807934 - RNA, 23 nt, Homo sapiens
cauagcaacuccccuacaucaaa

SEQ ID NO: 1807935 - RNA, 14 nt, Homo sapiens
caaagcaucccucu

SEQ ID NO: 1807936 - RNA, 15 nt, Homo sapiens
ucaccaaccaaaggg

SEQ ID NO: 1807937 - RNA, 14 nt, Homo sapiens
caaauaacagcuuu

SEQ ID NO: 1807938 - RNA, 19 nt, Homo sapiens
ccuccugccuccagcacuc

SEQ ID NO: 1807939 - RNA, 15 nt, Homo sapiens
gaaugauuuuugcua

SEQ ID NO: 1807940 - RNA, 19 nt, Homo sapiens
cagccugcccucagcacag

SEQ ID NO: 1807941 - RNA, 22 nt, Homo sapiens
gcaucuggauucugccuaauaa

SEQ ID NO: 1807942 - RNA, 18 nt, Homo sapiens
agacuuucuaaaucaaac

SEQ ID NO: 1807943 - RNA, 14 nt, Homo sapiens
auaacaaagcccuu

SEQ ID NO: 1807944 - RNA, 22 nt, Homo sapiens
guugguucguucuguacuguua

SEQ ID NO: 1807945 - RNA, 15 nt, Homo sapiens
gcacaccagugcaag

SEQ ID NO: 1807946 - RNA, 19 nt, Homo sapiens
cacucuauaagauuccaaa

SEQ ID NO: 1807947 - RNA, 17 nt, Homo sapiens
acuguauauacuuugcc

SEQ ID NO: 1807948 - RNA, 14 nt, Homo sapiens
ggcugcaucuucca

SEQ ID NO: 1807949 - RNA, 21 nt, Homo sapiens
uaucuaaaaauaguuaacaca

SEQ ID NO: 1807950 - RNA, 18 nt, Homo sapiens
acucaggccaacaagcca

SEQ ID NO: 1807951 - RNA, 19 nt, Homo sapiens
aauuuauuacaagcauaac

SEQ ID NO: 1807952 - RNA, 18 nt, Homo sapiens
ccaggaagcacaggucca

SEQ ID NO: 1807953 - RNA, 22 nt, Homo sapiens
gccacagaggacucacuugccc

SEQ ID NO: 1807954 - RNA, 21 nt, Homo sapiens
aucccggcugucaaggggugu

SEQ ID NO: 1807955 - RNA, 19 nt, Homo sapiens
uuagagaaagaacuaugaa

SEQ ID NO: 1807956 - RNA, 19 nt, Homo sapiens
uggaagaaauggcuaugaa

SEQ ID NO: 1807957 - RNA, 15 nt, Homo sapiens
agccuguacaaccua

SEQ ID NO: 1807958 - RNA, 15 nt, Homo sapiens
aucugcugcauagcu

SEQ ID NO: 1807959 - RNA, 16 nt, Homo sapiens
aagugauucacugugc

SEQ ID NO: 1807960 - RNA, 18 nt, Homo sapiens
gcaccaggaaguguuuau

SEQ ID NO: 1807961 - RNA, 13 nt, Homo sapiens
caacacugcucac

SEQ ID NO: 1807962 - RNA, 18 nt, Homo sapiens
uccccagaccucagggac

SEQ ID NO: 1807963 - RNA, 13 nt, Homo sapiens
cugacccuagcuc

SEQ ID NO: 1807964 - RNA, 15 nt, Homo sapiens
cauaagaauucuguu

SEQ ID NO: 1807965 - RNA, 22 nt, Homo sapiens
gaaguuauuaacgggcauguau

SEQ ID NO: 1807966 - RNA, 13 nt, Homo sapiens
cuuaaaguauaau

SEQ ID NO: 1807967 - RNA, 21 nt, Homo sapiens
cuagaauguggauuugauuca

SEQ ID NO: 1807968 - RNA, 15 nt, Homo sapiens
cugcagacaaaaaga

SEQ ID NO: 1807969 - RNA, 17 nt, Homo sapiens
uucuccagggaagaccc

SEQ ID NO: 1807970 - RNA, 21 nt, Homo sapiens
ugaagagugaacccucuuuag

SEQ ID NO: 1807971 - RNA, 13 nt, Homo sapiens
gauucuacaacac

SEQ ID NO: 1807972 - RNA, 19 nt, Homo sapiens
cguauaauuuagucccuua

SEQ ID NO: 1807973 - RNA, 19 nt, Homo sapiens
guugaucugauaagcaaga

SEQ ID NO: 1807974 - RNA, 23 nt, Homo sapiens
cauuuuguaccagggcucuguau

SEQ ID NO: 1807975 - RNA, 19 nt, Homo sapiens
aaaauugaggauguuacuc

SEQ ID NO: 1807976 - RNA, 16 nt, Homo sapiens
augcuggcaaauccag

SEQ ID NO: 1807977 - RNA, 23 nt, Homo sapiens
ccaaaaaaaaauacaugcuaaga

SEQ ID NO: 1807978 - RNA, 21 nt, Homo sapiens
uuauaucugugaauugcaggu

SEQ ID NO: 1807979 - RNA, 15 nt, Homo sapiens
aauaauagcuaauaa

SEQ ID NO: 1807980 - RNA, 21 nt, Homo sapiens
uagccaacugcuaaugcaaau

SEQ ID NO: 1807981 - RNA, 16 nt, Homo sapiens
ucuccccgauggggca

SEQ ID NO: 1807982 - RNA, 18 nt, Homo sapiens
gacaaagacaaauucugu

SEQ ID NO: 1807983 - RNA, 15 nt, Homo sapiens
gcuuaacuugaaaaa

SEQ ID NO: 1807984 - RNA, 20 nt, Homo sapiens
aaagucagugccuggagaag

SEQ ID NO: 1807985 - RNA, 15 nt, Homo sapiens
uuuuauacuaccaag

SEQ ID NO: 1807986 - RNA, 15 nt, Homo sapiens
cuaauguacaauaaa

SEQ ID NO: 1807987 - RNA, 18 nt, Homo sapiens
auauaguauucauuuucc

SEQ ID NO: 1807988 - RNA, 13 nt, Homo sapiens
aauaaaaccaaag

SEQ ID NO: 1807989 - RNA, 14 nt, Homo sapiens
uccaggaaugaucc

SEQ ID NO: 1807990 - RNA, 21 nt, Homo sapiens
aauucugcccgcuccauggaa

SEQ ID NO: 1807991 - RNA, 14 nt, Homo sapiens
ccaggcaggggugg

SEQ ID NO: 1807992 - RNA, 21 nt, Homo sapiens
uugcuugccgagccuaaugaa

SEQ ID NO: 1807993 - RNA, 16 nt, Homo sapiens
acuucagcaggggugg

SEQ ID NO: 1807994 - RNA, 16 nt, Homo sapiens
gccauuaaauugaaau

SEQ ID NO: 1807995 - RNA, 19 nt, Homo sapiens
uguauaaaugugauaugau

SEQ ID NO: 1807996 - RNA, 20 nt, Homo sapiens
ggcaggagaaucgcuugaac

SEQ ID NO: 1807997 - RNA, 20 nt, Homo sapiens
gagccucccugcagccacca

SEQ ID NO: 1807998 - RNA, 18 nt, Homo sapiens
cugcuuccacucagggcu

SEQ ID NO: 1807999 - RNA, 18 nt, Homo sapiens
ccuucccccagcaccauu

SEQ ID NO: 1808000 - RNA, 16 nt, Homo sapiens
auuuguaacuuugcau

SEQ ID NO: 1808001 - RNA, 21 nt, Homo sapiens
auccuauucucgggcugagaa

SEQ ID NO: 1808002 - RNA, 19 nt, Homo sapiens
ugaaacacacagugaccaa

SEQ ID NO: 1808003 - RNA, 22 nt, Homo sapiens
uuggcauagaaaaaaguagcaa

SEQ ID NO: 1808004 - RNA, 22 nt, Homo sapiens
gugacccccuucccgggcugca

SEQ ID NO: 1808005 - RNA, 12 nt, Homo sapiens
ggccaagccugc

SEQ ID NO: 1808006 - RNA, 20 nt, Homo sapiens
caauauacuggaaagcuuuu

SEQ ID NO: 1808007 - RNA, 14 nt, Homo sapiens
auuauuccaaaguu

SEQ ID NO: 1808008 - RNA, 14 nt, Homo sapiens
ccccagagcuguuu

SEQ ID NO: 1808009 - RNA, 16 nt, Homo sapiens
cuccugauagucuuuc

SEQ ID NO: 1808010 - RNA, 17 nt, Homo sapiens
ugauauauuccaccagg

SEQ ID NO: 1808011 - RNA, 17 nt, Homo sapiens
cacugcacagcagaucc

SEQ ID NO: 1808012 - RNA, 16 nt, Homo sapiens
gaaggccaucaucucu

SEQ ID NO: 1808013 - RNA, 14 nt, Homo sapiens
uaaaauugugaugc

SEQ ID NO: 1808014 - RNA, 16 nt, Homo sapiens
uccuggccucaaguga

SEQ ID NO: 1808015 - RNA, 16 nt, Homo sapiens
uacaauuugacauaca

SEQ ID NO: 1808016 - RNA, 13 nt, Homo sapiens
cucaggagaucug

SEQ ID NO: 1808017 - RNA, 20 nt, Homo sapiens
uagcagccuguacuagcuuu

SEQ ID NO: 1808018 - RNA, 16 nt, Homo sapiens
ucuccucacugccacu

SEQ ID NO: 1808019 - RNA, 20 nt, Homo sapiens
gaagaauuggccaucuuaaa

SEQ ID NO: 1808020 - RNA, 21 nt, Homo sapiens
aacaggcaguggaagcaguuu

SEQ ID NO: 1808021 - RNA, 18 nt, Homo sapiens
aaaaaugaagacacucaa

SEQ ID NO: 1808022 - RNA, 21 nt, Homo sapiens
acccucggugcagagugcaga

SEQ ID NO: 1808023 - RNA, 16 nt, Homo sapiens
cuucccucuccuggcu

SEQ ID NO: 1808024 - RNA, 22 nt, Homo sapiens
uaccuauaauguguguaugugu

SEQ ID NO: 1808025 - RNA, 15 nt, Homo sapiens
aacaaugacauuuau

SEQ ID NO: 1808026 - RNA, 16 nt, Homo sapiens
ucacacuuccaccagc

SEQ ID NO: 1808027 - RNA, 19 nt, Homo sapiens
ugggccucagcaagccaug

SEQ ID NO: 1808028 - RNA, 24 nt, Homo sapiens
ggcuacuuuccacauauagagcuc

SEQ ID NO: 1808029 - RNA, 14 nt, Homo sapiens
uagcauugucuugu

SEQ ID NO: 1808030 - RNA, 17 nt, Homo sapiens
gauauauuuaagccuua

SEQ ID NO: 1808031 - RNA, 11 nt, Homo sapiens
uuccacugaaa

SEQ ID NO: 1808032 - RNA, 14 nt, Homo sapiens
cauggccgcugccc

SEQ ID NO: 1808033 - RNA, 21 nt, Homo sapiens
ucgccagcagacaucagaaca

SEQ ID NO: 1808034 - RNA, 23 nt, Homo sapiens
ccuggaaugggucucucuugccc

SEQ ID NO: 1808035 - RNA, 15 nt, Homo sapiens
aaauaaauugugaaa

SEQ ID NO: 1808036 - RNA, 16 nt, Homo sapiens
ugaaaaagaacuguau

SEQ ID NO: 1808037 - RNA, 15 nt, Homo sapiens
agcuaauguaauaac

SEQ ID NO: 1808038 - RNA, 16 nt, Homo sapiens
ccuggccauccacaaa

SEQ ID NO: 1808039 - RNA, 21 nt, Homo sapiens
ccuucguuuacuaugccugug

SEQ ID NO: 1808040 - RNA, 20 nt, Homo sapiens
aaggcuuagacccucaugcu

SEQ ID NO: 1808041 - RNA, 19 nt, Homo sapiens
auacugccaaaacauuuau

SEQ ID NO: 1808042 - RNA, 18 nt, Homo sapiens
aaaguaagaggacuacuc

SEQ ID NO: 1808043 - RNA, 22 nt, Homo sapiens
gucacccaacgacccaugaccg

SEQ ID NO: 1808044 - RNA, 20 nt, Homo sapiens
agccaggagaagaccccugc

SEQ ID NO: 1808045 - RNA, 22 nt, Homo sapiens
agcuccuccucggaaccgcuca

SEQ ID NO: 1808046 - RNA, 22 nt, Homo sapiens
acucggggguauuuuggucaca

SEQ ID NO: 1808047 - RNA, 13 nt, Homo sapiens
guuaagagcucag

SEQ ID NO: 1808048 - RNA, 17 nt, Homo sapiens
uccacucguguguuucu

SEQ ID NO: 1808049 - RNA, 18 nt, Homo sapiens
uccuggggggccugaaag

SEQ ID NO: 1808050 - RNA, 21 nt, Homo sapiens
cuacaacaaauacuacaggcc

SEQ ID NO: 1808051 - RNA, 17 nt, Homo sapiens
auuggaggaccaaaaaa

SEQ ID NO: 1808052 - RNA, 17 nt, Homo sapiens
gccagauggggccucug

SEQ ID NO: 1808053 - RNA, 15 nt, Homo sapiens
uccaucaacucccaa

SEQ ID NO: 1808054 - RNA, 17 nt, Homo sapiens
aauauggaaacagagca

SEQ ID NO: 1808055 - RNA, 16 nt, Homo sapiens
caccucacucugcuac

SEQ ID NO: 1808056 - RNA, 16 nt, Homo sapiens
gcccaggggaggcaca

SEQ ID NO: 1808057 - RNA, 16 nt, Homo sapiens
cuucauuuuuccuaac

SEQ ID NO: 1808058 - RNA, 20 nt, Homo sapiens
cuuuggguccuuagugcaau

SEQ ID NO: 1808059 - RNA, 16 nt, Homo sapiens
cagagacugucccuga

SEQ ID NO: 1808060 - RNA, 15 nt, Homo sapiens
gcaaaccaaugcuau

SEQ ID NO: 1808061 - RNA, 23 nt, Homo sapiens
gcagccacagggaagcucacaca

SEQ ID NO: 1808062 - RNA, 14 nt, Homo sapiens
uuaagcaacacaag

SEQ ID NO: 1808063 - RNA, 15 nt, Homo sapiens
aacucucuagcuuaa

SEQ ID NO: 1808064 - RNA, 17 nt, Homo sapiens
gaguuucuucuaaagag

SEQ ID NO: 1808065 - RNA, 18 nt, Homo sapiens
accugguacugacccagg

SEQ ID NO: 1808066 - RNA, 19 nt, Homo sapiens
aggaccccuucccaaauag

SEQ ID NO: 1808067 - RNA, 15 nt, Homo sapiens
ucccucaugucuuua

SEQ ID NO: 1808068 - RNA, 15 nt, Homo sapiens
augguucccaauaaa

SEQ ID NO: 1808069 - RNA, 17 nt, Homo sapiens
uuuuaaauuuucuucag

SEQ ID NO: 1808070 - RNA, 21 nt, Homo sapiens
gaaggcaauuuuaguguauua

SEQ ID NO: 1808071 - RNA, 22 nt, Homo sapiens
aaucaguucuuagauucagggg

SEQ ID NO: 1808072 - RNA, 20 nt, Homo sapiens
uggcaguugcuuccuccuga

SEQ ID NO: 1808073 - RNA, 18 nt, Homo sapiens
aguaauaaauuaaaccaa

SEQ ID NO: 1808074 - RNA, 14 nt, Homo sapiens
cauggaauaguuuu

SEQ ID NO: 1808075 - RNA, 17 nt, Homo sapiens
ugagacagggucuugcu

SEQ ID NO: 1808076 - RNA, 20 nt, Homo sapiens
uuauaucuguaaugauacug

SEQ ID NO: 1808077 - RNA, 16 nt, Homo sapiens
aguaacaaaaguauag

SEQ ID NO: 1808078 - RNA, 17 nt, Homo sapiens
uugaaacuaucucaugc

SEQ ID NO: 1808079 - RNA, 17 nt, Homo sapiens
ccacaucucaguuaucu

SEQ ID NO: 1808080 - RNA, 23 nt, Homo sapiens
gcauugauggccucaauguggca

SEQ ID NO: 1808081 - RNA, 19 nt, Homo sapiens
cauaauuuggggcccugag

SEQ ID NO: 1808082 - RNA, 20 nt, Homo sapiens
ugccccucucugggccucag

SEQ ID NO: 1808083 - RNA, 14 nt, Homo sapiens
uaacuugagcuuua

SEQ ID NO: 1808084 - RNA, 17 nt, Homo sapiens
auggauaaacugagccu

SEQ ID NO: 1808085 - RNA, 23 nt, Homo sapiens
uaaaauuaauguaauaaagugaa

SEQ ID NO: 1808086 - RNA, 16 nt, Homo sapiens
ccuagcacaugcuuca

SEQ ID NO: 1808087 - RNA, 14 nt, Homo sapiens
gagaaggcugugag

SEQ ID NO: 1808088 - RNA, 22 nt, Homo sapiens
cagguguagcuaacaguugcca

SEQ ID NO: 1808089 - RNA, 14 nt, Homo sapiens
gagugucaaccaga

SEQ ID NO: 1808090 - RNA, 22 nt, Homo sapiens
uaacaacccacaccgucuuccu

SEQ ID NO: 1808091 - RNA, 20 nt, Homo sapiens
agauccucuuuacucugggc

SEQ ID NO: 1808092 - RNA, 14 nt, Homo sapiens
aucaucaaaugcau

SEQ ID NO: 1808093 - RNA, 13 nt, Homo sapiens
gugccagcacaaa

SEQ ID NO: 1808094 - RNA, 13 nt, Homo sapiens
cacacugagcaag

SEQ ID NO: 1808095 - RNA, 15 nt, Homo sapiens
aggacaaagugccaa

SEQ ID NO: 1808096 - RNA, 19 nt, Homo sapiens
acuaguugauaacuuugga

SEQ ID NO: 1808097 - RNA, 13 nt, Homo sapiens
caacauuacuguu

SEQ ID NO: 1808098 - RNA, 13 nt, Homo sapiens
caacuuuacugua

SEQ ID NO: 1808099 - RNA, 15 nt, Homo sapiens
gggccugcugcugag

SEQ ID NO: 1808100 - RNA, 18 nt, Homo sapiens
aaaguuguuuuacagcug

SEQ ID NO: 1808101 - RNA, 19 nt, Homo sapiens
acauuugauguacaugugu

SEQ ID NO: 1808102 - RNA, 13 nt, Homo sapiens
gacauugaacuga

SEQ ID NO: 1808103 - RNA, 20 nt, Homo sapiens
uaugaugcuaugguuugcca

SEQ ID NO: 1808104 - RNA, 20 nt, Homo sapiens
uuuacugggccugaacucau

SEQ ID NO: 1808105 - RNA, 16 nt, Homo sapiens
ccuuugaaaugaauau

SEQ ID NO: 1808106 - RNA, 16 nt, Homo sapiens
acugcagaaacccuga

SEQ ID NO: 1808107 - RNA, 21 nt, Homo sapiens
cugcugcagacaccugccuua

SEQ ID NO: 1808108 - RNA, 14 nt, Homo sapiens
agaacccugcugau

SEQ ID NO: 1808109 - RNA, 16 nt, Homo sapiens
ggaagcccuugccuga

SEQ ID NO: 1808110 - RNA, 14 nt, Homo sapiens
auuuugcaccagcg

SEQ ID NO: 1808111 - RNA, 18 nt, Homo sapiens
aaacacucucacuaugcu

SEQ ID NO: 1808112 - RNA, 17 nt, Homo sapiens
agggcauauacagugaa

SEQ ID NO: 1808113 - RNA, 18 nt, Homo sapiens
cauuaagcgggaucccag

SEQ ID NO: 1808114 - RNA, 14 nt, Homo sapiens
aauccaacauccag

SEQ ID NO: 1808115 - RNA, 18 nt, Homo sapiens
ugccugggaccaguggca

SEQ ID NO: 1808116 - RNA, 15 nt, Homo sapiens
uuccucagaaaccaa

SEQ ID NO: 1808117 - RNA, 23 nt, Homo sapiens
acucuauuuuuguaaaaagggaa

SEQ ID NO: 1808118 - RNA, 21 nt, Homo sapiens
caaagacuacauauugucacu

SEQ ID NO: 1808119 - RNA, 21 nt, Homo sapiens
aguccaagaggguccuuuagu

SEQ ID NO: 1808120 - RNA, 19 nt, Homo sapiens
acguagcuaguaagcauuu

SEQ ID NO: 1808121 - RNA, 17 nt, Homo sapiens
uccaaugccaauucauc

SEQ ID NO: 1808122 - RNA, 23 nt, Homo sapiens
aucuuaguuacauuucuaucagu

SEQ ID NO: 1808123 - RNA, 14 nt, Homo sapiens
uuauccaguagaaa

SEQ ID NO: 1808124 - RNA, 16 nt, Homo sapiens
uuccuggucuuugaau

SEQ ID NO: 1808125 - RNA, 15 nt, Homo sapiens
cagccugcuuucaca

SEQ ID NO: 1808126 - RNA, 17 nt, Homo sapiens
guccugcccucugggag

SEQ ID NO: 1808127 - RNA, 16 nt, Homo sapiens
ccuuggccucccagaa

SEQ ID NO: 1808128 - RNA, 16 nt, Homo sapiens
aaauauugauuucuac

SEQ ID NO: 1808129 - RNA, 15 nt, Homo sapiens
caacaagucuugaaa

SEQ ID NO: 1808130 - RNA, 13 nt, Homo sapiens
ccaggugaacaaa

SEQ ID NO: 1808131 - RNA, 21 nt, Homo sapiens
cuguaaagauguuuauuucag

SEQ ID NO: 1808132 - RNA, 16 nt, Homo sapiens
auuuauuuauuacccu

SEQ ID NO: 1808133 - RNA, 18 nt, Homo sapiens
cucaagcccgcggggaca

SEQ ID NO: 1808134 - RNA, 19 nt, Homo sapiens
gccgcauucgcacuggggg

SEQ ID NO: 1808135 - RNA, 19 nt, Homo sapiens
caacauuacauuugaacua

SEQ ID NO: 1808136 - RNA, 17 nt, Homo sapiens
uuuuagaaugucaauaa

SEQ ID NO: 1808137 - RNA, 19 nt, Homo sapiens
gggcccagaggcacagccg

SEQ ID NO: 1808138 - RNA, 18 nt, Homo sapiens
uuugggcuccacauugca

SEQ ID NO: 1808139 - RNA, 18 nt, Homo sapiens
uaacaagcaugcauaaau

SEQ ID NO: 1808140 - RNA, 12 nt, Homo sapiens
agagucaucuga

SEQ ID NO: 1808141 - RNA, 23 nt, Homo sapiens
auauuuugguucauggaccaaag

SEQ ID NO: 1808142 - RNA, 15 nt, Homo sapiens
uaagcauauuuucuc

SEQ ID NO: 1808143 - RNA, 20 nt, Homo sapiens
aguuccuauaacacugugaa

SEQ ID NO: 1808144 - RNA, 18 nt, Homo sapiens
acuugacaggguuucacc

SEQ ID NO: 1808145 - RNA, 16 nt, Homo sapiens
ugcuggcaaagacaga

SEQ ID NO: 1808146 - RNA, 20 nt, Homo sapiens
aaagugagacccccaucucu

SEQ ID NO: 1808147 - RNA, 15 nt, Homo sapiens
acaugcucuguccag

SEQ ID NO: 1808148 - RNA, 23 nt, Homo sapiens
ucuaggccucacucaacaaccaa

SEQ ID NO: 1808149 - RNA, 19 nt, Homo sapiens
accuacaagguugugcccu

SEQ ID NO: 1808150 - RNA, 15 nt, Homo sapiens
cuuaccucauuugca

SEQ ID NO: 1808151 - RNA, 16 nt, Homo sapiens
gucccagccacagugu

SEQ ID NO: 1808152 - RNA, 21 nt, Homo sapiens
aaagauaaccaguuuuugcag

SEQ ID NO: 1808153 - RNA, 16 nt, Homo sapiens
uaauuugaauggugca

SEQ ID NO: 1808154 - RNA, 14 nt, Homo sapiens
gaauuaccaagaga

SEQ ID NO: 1808155 - RNA, 13 nt, Homo sapiens
uuauauuguggaa

SEQ ID NO: 1808156 - RNA, 18 nt, Homo sapiens
acuguugcuuugggagac

SEQ ID NO: 1808157 - RNA, 23 nt, Homo sapiens
gcucaauagcuugaagcccaaga

SEQ ID NO: 1808158 - RNA, 12 nt, Homo sapiens
uuguugcacugc

SEQ ID NO: 1808159 - RNA, 15 nt, Homo sapiens
caauaauauauugua

SEQ ID NO: 1808160 - RNA, 20 nt, Homo sapiens
ggacgaggaguaauggcauu

SEQ ID NO: 1808161 - RNA, 16 nt, Homo sapiens
caauccuuccaaauga

SEQ ID NO: 1808162 - RNA, 16 nt, Homo sapiens
cuggccugccaugcca

SEQ ID NO: 1808163 - RNA, 19 nt, Homo sapiens
aaagaugaccuacagugcu

SEQ ID NO: 1808164 - RNA, 19 nt, Homo sapiens
uaacaauaugauugcacua

SEQ ID NO: 1808165 - RNA, 21 nt, Homo sapiens
ugccugaaacccauuuacuua

SEQ ID NO: 1808166 - RNA, 21 nt, Homo sapiens
cacuuauuuuuuaaugugaga

SEQ ID NO: 1808167 - RNA, 11 nt, Homo sapiens
caugcauuuga

SEQ ID NO: 1808168 - RNA, 18 nt, Homo sapiens
uugaaaaaacaccaugaa

SEQ ID NO: 1808169 - RNA, 19 nt, Homo sapiens
ccucuuccuucccugcugu

SEQ ID NO: 1808170 - RNA, 19 nt, Homo sapiens
ccagcacagccucuuagau

SEQ ID NO: 1808171 - RNA, 21 nt, Homo sapiens
auggacuggccccugacccag

SEQ ID NO: 1808172 - RNA, 17 nt, Homo sapiens
caagagcgaaacuccau

SEQ ID NO: 1808173 - RNA, 19 nt, Homo sapiens
accauaaauuggcuuuuca

SEQ ID NO: 1808174 - RNA, 16 nt, Homo sapiens
gucaccuaacucugaa

SEQ ID NO: 1808175 - RNA, 18 nt, Homo sapiens
uaaaacaaagccaugcca

SEQ ID NO: 1808176 - RNA, 21 nt, Homo sapiens
uggcagcaucuucacuucuaa

SEQ ID NO: 1808177 - RNA, 22 nt, Homo sapiens
cauauggcacuaaaugcacaaa

SEQ ID NO: 1808178 - RNA, 23 nt, Homo sapiens
gcauuaacaaggaaaaauacuga

SEQ ID NO: 1808179 - RNA, 20 nt, Homo sapiens
ugauagagugcagugauguu

SEQ ID NO: 1808180 - RNA, 24 nt, Homo sapiens
aauuuuggcccuaccuguaacuua

SEQ ID NO: 1808181 - RNA, 11 nt, Homo sapiens
gcaacauaaaa

SEQ ID NO: 1808182 - RNA, 16 nt, Homo sapiens
aagagggcccagccca

SEQ ID NO: 1808183 - RNA, 19 nt, Homo sapiens
gccugcuggcugcggcccc

SEQ ID NO: 1808184 - RNA, 16 nt, Homo sapiens
guugauguggacauga

SEQ ID NO: 1808185 - RNA, 21 nt, Homo sapiens
uuucuaugccuacugauguca

SEQ ID NO: 1808186 - RNA, 15 nt, Homo sapiens
ugucuuguucaccuu

SEQ ID NO: 1808187 - RNA, 22 nt, Homo sapiens
uuagcauauguuaguaggcuua

SEQ ID NO: 1808188 - RNA, 18 nt, Homo sapiens
ugagaccaaggcuuucuc

SEQ ID NO: 1808189 - RNA, 13 nt, Homo sapiens
gcuuuggggagcg

SEQ ID NO: 1808190 - RNA, 13 nt, Homo sapiens
acaugucuaucaa

SEQ ID NO: 1808191 - RNA, 14 nt, Homo sapiens
aagagaucuacaca

SEQ ID NO: 1808192 - RNA, 16 nt, Homo sapiens
auacuggacucaggaa

SEQ ID NO: 1808193 - RNA, 19 nt, Homo sapiens
gaaaacuucacuccaaaga

SEQ ID NO: 1808194 - RNA, 19 nt, Homo sapiens
agcuaugacugcagaucau

SEQ ID NO: 1808195 - RNA, 15 nt, Homo sapiens
cagucaccacccagc

SEQ ID NO: 1808196 - RNA, 19 nt, Homo sapiens
ucacugugcaaauauaucu

SEQ ID NO: 1808197 - RNA, 21 nt, Homo sapiens
gcugagagaguuaagugaaug

SEQ ID NO: 1808198 - RNA, 12 nt, Homo sapiens
augcucucaggc

SEQ ID NO: 1808199 - RNA, 12 nt, Homo sapiens
augaucucagga

SEQ ID NO: 1808200 - RNA, 22 nt, Homo sapiens
ccagauugacgacaagugcuga

SEQ ID NO: 1808201 - RNA, 14 nt, Homo sapiens
uacauuguaaauag

SEQ ID NO: 1808202 - RNA, 15 nt, Homo sapiens
gugucuaggcuggaa

SEQ ID NO: 1808203 - RNA, 20 nt, Homo sapiens
cucauaugauugugcacaua

SEQ ID NO: 1808204 - RNA, 22 nt, Homo sapiens
uaagaaacccccucauggaucu

SEQ ID NO: 1808205 - RNA, 23 nt, Homo sapiens
guaaucucggaaggcugaggcag

SEQ ID NO: 1808206 - RNA, 21 nt, Homo sapiens
agccaaggucaugccacugca

SEQ ID NO: 1808207 - RNA, 16 nt, Homo sapiens
ugcauccaaaccugua

SEQ ID NO: 1808208 - RNA, 21 nt, Homo sapiens
uaaacauuugagagcuaacua

SEQ ID NO: 1808209 - RNA, 14 nt, Homo sapiens
uaucauuacauaua

SEQ ID NO: 1808210 - RNA, 17 nt, Homo sapiens
gcucacuacucagugau

SEQ ID NO: 1808211 - RNA, 14 nt, Homo sapiens
ccaccuggcccucu

SEQ ID NO: 1808212 - RNA, 15 nt, Homo sapiens
auuuuagaaagcuaa

SEQ ID NO: 1808213 - RNA, 12 nt, Homo sapiens
gcaucacugggu

SEQ ID NO: 1808214 - RNA, 13 nt, Homo sapiens
aauagcuuuucac

SEQ ID NO: 1808215 - RNA, 14 nt, Homo sapiens
aagaugucauccca

SEQ ID NO: 1808216 - RNA, 23 nt, Homo sapiens
ggaaccucacucuugccaaccug

SEQ ID NO: 1808217 - RNA, 11 nt, Homo sapiens
cccugcauguu

SEQ ID NO: 1808218 - RNA, 22 nt, Homo sapiens
ccaacaagaacugcaucuggca

SEQ ID NO: 1808219 - RNA, 16 nt, Homo sapiens
caauccccaagcuggc

SEQ ID NO: 1808220 - RNA, 16 nt, Homo sapiens
uucugugacugaagaa

SEQ ID NO: 1808221 - RNA, 12 nt, Homo sapiens
augagcauuuag

SEQ ID NO: 1808222 - RNA, 16 nt, Homo sapiens
ugcagaggccacagga

SEQ ID NO: 1808223 - RNA, 16 nt, Homo sapiens
ccacacccaacuaauu

SEQ ID NO: 1808224 - RNA, 20 nt, Homo sapiens
ucuaauaaaauucagaauuc

SEQ ID NO: 1808225 - RNA, 16 nt, Homo sapiens
cuagaaugguagcacu

SEQ ID NO: 1808226 - RNA, 17 nt, Homo sapiens
cccagauucuucagcuu

SEQ ID NO: 1808227 - RNA, 13 nt, Homo sapiens
aauucuacuuuga

SEQ ID NO: 1808228 - RNA, 13 nt, Homo sapiens
auuucuacuauga

SEQ ID NO: 1808229 - RNA, 16 nt, Homo sapiens
gcaaagcuggcuuccu

SEQ ID NO: 1808230 - RNA, 13 nt, Homo sapiens
accuccucuguga

SEQ ID NO: 1808231 - RNA, 23 nt, Homo sapiens
agauccagggacugaagccaaag

SEQ ID NO: 1808232 - RNA, 16 nt, Homo sapiens
gaaaccucuacauauu

SEQ ID NO: 1808233 - RNA, 19 nt, Homo sapiens
ucgaagaaaggcagaagaa

SEQ ID NO: 1808234 - RNA, 23 nt, Homo sapiens
uguuauccuuguuccuguuacaa

SEQ ID NO: 1808235 - RNA, 20 nt, Homo sapiens
caugcugcuuuuuggcacag

SEQ ID NO: 1808236 - RNA, 21 nt, Homo sapiens
uuagauaaucaagggcacugu

SEQ ID NO: 1808237 - RNA, 21 nt, Homo sapiens
uuaaaaaugggaguacugaug

SEQ ID NO: 1808238 - RNA, 21 nt, Homo sapiens
aaugagaggcacacugcuaaa

SEQ ID NO: 1808239 - RNA, 23 nt, Homo sapiens
auauaugugugcccuggacuguu

SEQ ID NO: 1808240 - RNA, 12 nt, Homo sapiens
gauaagugcagu

SEQ ID NO: 1808241 - RNA, 14 nt, Homo sapiens
ucccgaugcugcua

SEQ ID NO: 1808242 - RNA, 17 nt, Homo sapiens
gagagagcuggaggcac

SEQ ID NO: 1808243 - RNA, 14 nt, Homo sapiens
aaaauacugauaca

SEQ ID NO: 1808244 - RNA, 22 nt, Homo sapiens
aaucuuuuucagaaacagugag

SEQ ID NO: 1808245 - RNA, 21 nt, Homo sapiens
gagcaaagucuaaaguuuaca

SEQ ID NO: 1808246 - RNA, 18 nt, Homo sapiens
ccuggucccucugcaguc

SEQ ID NO: 1808247 - RNA, 19 nt, Homo sapiens
caagugccauucauccuuu

SEQ ID NO: 1808248 - RNA, 23 nt, Homo sapiens
cuguugcaaacucaguuccaaag

SEQ ID NO: 1808249 - RNA, 16 nt, Homo sapiens
uaagagucugugcugg

SEQ ID NO: 1808250 - RNA, 23 nt, Homo sapiens
agaugacaucccuuugaccacau

SEQ ID NO: 1808251 - RNA, 16 nt, Homo sapiens
cuccugggucagggag

SEQ ID NO: 1808252 - RNA, 14 nt, Homo sapiens
ugaccccuuguccc

SEQ ID NO: 1808253 - RNA, 13 nt, Homo sapiens
uaccugggcauuc

SEQ ID NO: 1808254 - RNA, 17 nt, Homo sapiens
agauucuccacgguggu

SEQ ID NO: 1808255 - RNA, 13 nt, Homo sapiens
uugauuaccuagu

SEQ ID NO: 1808256 - RNA, 23 nt, Homo sapiens
aaauguucccuuaggagcaaaau

SEQ ID NO: 1808257 - RNA, 13 nt, Homo sapiens
cagaauguguuau

SEQ ID NO: 1808258 - RNA, 13 nt, Homo sapiens
cagcauguguucu

SEQ ID NO: 1808259 - RNA, 21 nt, Homo sapiens
gucauaguggguggauuuguu

SEQ ID NO: 1808260 - RNA, 15 nt, Homo sapiens
aauuuuugaugccca

SEQ ID NO: 1808261 - RNA, 14 nt, Homo sapiens
gggccaagucacag

SEQ ID NO: 1808262 - RNA, 14 nt, Homo sapiens
aacagggacaaaga

SEQ ID NO: 1808263 - RNA, 16 nt, Homo sapiens
cucaaaugcuggcaaa

SEQ ID NO: 1808264 - RNA, 21 nt, Homo sapiens
aggcagugauuugccaaagug

SEQ ID NO: 1808265 - RNA, 20 nt, Homo sapiens
caggcccggugaggccaagg

SEQ ID NO: 1808266 - RNA, 13 nt, Homo sapiens
ugcaaagauuucu

SEQ ID NO: 1808267 - RNA, 15 nt, Homo sapiens
caaaagcuauuuaaa

SEQ ID NO: 1808268 - RNA, 21 nt, Homo sapiens
caaaucucagucccugacuaa

SEQ ID NO: 1808269 - RNA, 18 nt, Homo sapiens
auguucugugggggucau

SEQ ID NO: 1808270 - RNA, 17 nt, Homo sapiens
cagcauuuccacaccaa

SEQ ID NO: 1808271 - RNA, 18 nt, Homo sapiens
acacuccuuuagauagca

SEQ ID NO: 1808272 - RNA, 14 nt, Homo sapiens
acucaaaagacaaa

SEQ ID NO: 1808273 - RNA, 21 nt, Homo sapiens
cacuuccuuggacuacuuguu

SEQ ID NO: 1808274 - RNA, 15 nt, Homo sapiens
uacuaauuuuacuuc

SEQ ID NO: 1808275 - RNA, 13 nt, Homo sapiens
aagaaagccucag

SEQ ID NO: 1808276 - RNA, 17 nt, Homo sapiens
ugaagauuaacacugag

SEQ ID NO: 1808277 - RNA, 14 nt, Homo sapiens
aauccauucauuca

SEQ ID NO: 1808278 - RNA, 12 nt, Homo sapiens
acagccaagggg

SEQ ID NO: 1808279 - RNA, 15 nt, Homo sapiens
cuguuugugggguga

SEQ ID NO: 1808280 - RNA, 21 nt, Homo sapiens
guauuaccuccccuacucccu

SEQ ID NO: 1808281 - RNA, 23 nt, Homo sapiens
ugcucguucaacagugugagcau

SEQ ID NO: 1808282 - RNA, 14 nt, Homo sapiens
agcugacuacggaa

SEQ ID NO: 1808283 - RNA, 20 nt, Homo sapiens
gcauugaaaugcaaugucua

SEQ ID NO: 1808284 - RNA, 14 nt, Homo sapiens
gaagggggcugugu

SEQ ID NO: 1808285 - RNA, 17 nt, Homo sapiens
cuuuguaaguaaacugc

SEQ ID NO: 1808286 - RNA, 18 nt, Homo sapiens
ucaucguucuaaaaucaa

SEQ ID NO: 1808287 - RNA, 19 nt, Homo sapiens
cucagcuauaccucauuca

SEQ ID NO: 1808288 - RNA, 16 nt, Homo sapiens
uacuuuucaagcuaua

SEQ ID NO: 1808289 - RNA, 17 nt, Homo sapiens
aacccagggugugaaca

SEQ ID NO: 1808290 - RNA, 16 nt, Homo sapiens
ucacaaaggcugaugu

SEQ ID NO: 1808291 - RNA, 14 nt, Homo sapiens
aaugcucuuuugca

SEQ ID NO: 1808292 - RNA, 13 nt, Homo sapiens
uggcaucauugca

SEQ ID NO: 1808293 - RNA, 21 nt, Homo sapiens
aaaagacugguuuguuugcuu

SEQ ID NO: 1808294 - RNA, 18 nt, Homo sapiens
ccacgcuggagugcagug

SEQ ID NO: 1808295 - RNA, 11 nt, Homo sapiens
gagaugaagga

SEQ ID NO: 1808296 - RNA, 14 nt, Homo sapiens
acagggugcuccuu

SEQ ID NO: 1808297 - RNA, 22 nt, Homo sapiens
aaaauaaagacuagagcaaaau

SEQ ID NO: 1808298 - RNA, 18 nt, Homo sapiens
cucagauugaccuauaaa

SEQ ID NO: 1808299 - RNA, 13 nt, Homo sapiens
cagauucacuucu

SEQ ID NO: 1808300 - RNA, 17 nt, Homo sapiens
ggucacauugugccuuu

SEQ ID NO: 1808301 - RNA, 20 nt, Homo sapiens
ugaaacgucccacacuuuga

SEQ ID NO: 1808302 - RNA, 17 nt, Homo sapiens
caagcauggaacaaagc

SEQ ID NO: 1808303 - RNA, 23 nt, Homo sapiens
cuuguggauggaaauguagugcu

SEQ ID NO: 1808304 - RNA, 13 nt, Homo sapiens
gauccuugcacag

SEQ ID NO: 1808305 - RNA, 17 nt, Homo sapiens
cacaaaugacugcaaaa

SEQ ID NO: 1808306 - RNA, 22 nt, Homo sapiens
cauuugcaaaggcgacaauaaa

SEQ ID NO: 1808307 - RNA, 14 nt, Homo sapiens
aauguguuggcuca

SEQ ID NO: 1808308 - RNA, 21 nt, Homo sapiens
ucaacauucccccaacauuac

SEQ ID NO: 1808309 - RNA, 17 nt, Homo sapiens
agccuacuaaaugcuca

SEQ ID NO: 1808310 - RNA, 16 nt, Homo sapiens
uucaaccuuaccaaaa

SEQ ID NO: 1808311 - RNA, 17 nt, Homo sapiens
ugcuccuggagccuuug

SEQ ID NO: 1808312 - RNA, 21 nt, Homo sapiens
aaaauauguguacacauauga

SEQ ID NO: 1808313 - RNA, 20 nt, Homo sapiens
caggacccugggaccacaga

SEQ ID NO: 1808314 - RNA, 17 nt, Homo sapiens
agacucuuguacuugau

SEQ ID NO: 1808315 - RNA, 22 nt, Homo sapiens
acaucugcacuccugaacacac

SEQ ID NO: 1808316 - RNA, 14 nt, Homo sapiens
aauucagcauuuga

SEQ ID NO: 1808317 - RNA, 14 nt, Homo sapiens
auuugagcaauuca

SEQ ID NO: 1808318 - RNA, 20 nt, Homo sapiens
ccucaugcccccucagugag

SEQ ID NO: 1808319 - RNA, 15 nt, Homo sapiens
cauugagcugugcaa

SEQ ID NO: 1808320 - RNA, 18 nt, Homo sapiens
gcaggagaaucacuggaa

SEQ ID NO: 1808321 - RNA, 15 nt, Homo sapiens
auacacaaagggaug

SEQ ID NO: 1808322 - RNA, 12 nt, Homo sapiens
cugccacuggga

SEQ ID NO: 1808323 - RNA, 19 nt, Homo sapiens
cuuggggaagcggguggug

SEQ ID NO: 1808324 - RNA, 12 nt, Homo sapiens
cucacacuggcc

SEQ ID NO: 1808325 - RNA, 22 nt, Homo sapiens
ugcagaagcacaugauggugaa

SEQ ID NO: 1808326 - RNA, 11 nt, Homo sapiens
guuucugugac

SEQ ID NO: 1808327 - RNA, 20 nt, Homo sapiens
caaacacuagcucuguauua

SEQ ID NO: 1808328 - RNA, 22 nt, Homo sapiens
uaaauuuuauaugcacaguaau

SEQ ID NO: 1808329 - RNA, 21 nt, Homo sapiens
uggaaccuuguagaggagcag

SEQ ID NO: 1808330 - RNA, 19 nt, Homo sapiens
cagggaaagucuuagcuga

SEQ ID NO: 1808331 - RNA, 12 nt, Homo sapiens
agauaaauccaa

SEQ ID NO: 1808332 - RNA, 18 nt, Homo sapiens
cccagaguccucuaugaa

SEQ ID NO: 1808333 - RNA, 10 nt, Homo sapiens
uuaaagaaga

SEQ ID NO: 1808334 - RNA, 21 nt, Homo sapiens
uguguggaaauggccaccacc

SEQ ID NO: 1808335 - RNA, 20 nt, Homo sapiens
ucuuuauaucugaaccaaga

SEQ ID NO: 1808336 - RNA, 19 nt, Homo sapiens
acagcccuuccucccauuu

SEQ ID NO: 1808337 - RNA, 12 nt, Homo sapiens
uccugugcaugg

SEQ ID NO: 1808338 - RNA, 13 nt, Homo sapiens
gaggcccuaggcg

SEQ ID NO: 1808339 - RNA, 20 nt, Homo sapiens
aacuuacagguccugcugaa

SEQ ID NO: 1808340 - RNA, 24 nt, Homo sapiens
cagccgggauuuugagaucaucag

SEQ ID NO: 1808341 - RNA, 11 nt, Homo sapiens
cuuggauccca

SEQ ID NO: 1808342 - RNA, 16 nt, Homo sapiens
accagcuguguuucuu

SEQ ID NO: 1808343 - RNA, 14 nt, Homo sapiens
uugaaaaaagaaga

SEQ ID NO: 1808344 - RNA, 15 nt, Homo sapiens
guggcaggcggguga

SEQ ID NO: 1808345 - RNA, 13 nt, Homo sapiens
cuggaugagaaac

SEQ ID NO: 1808346 - RNA, 15 nt, Homo sapiens
uaucaccucuucaca

SEQ ID NO: 1808347 - RNA, 16 nt, Homo sapiens
cacugguauuaacuuu

SEQ ID NO: 1808348 - RNA, 14 nt, Homo sapiens
cagucugggcacuu

SEQ ID NO: 1808349 - RNA, 21 nt, Homo sapiens
caucucgcuaaagagugaaug

SEQ ID NO: 1808350 - RNA, 14 nt, Homo sapiens
ucuuuccuguaaag

SEQ ID NO: 1808351 - RNA, 17 nt, Homo sapiens
ucaccacaccaaaccuc

SEQ ID NO: 1808352 - RNA, 14 nt, Homo sapiens
guaauaaacucugu

SEQ ID NO: 1808353 - RNA, 14 nt, Homo sapiens
uacuuuaacuucca

SEQ ID NO: 1808354 - RNA, 21 nt, Homo sapiens
aggggauagagagagaccacu

SEQ ID NO: 1808355 - RNA, 16 nt, Homo sapiens
ccauuucagccaaacu

SEQ ID NO: 1808356 - RNA, 17 nt, Homo sapiens
caaagaugauguuucca

SEQ ID NO: 1808357 - RNA, 13 nt, Homo sapiens
cugaucccagacc

SEQ ID NO: 1808358 - RNA, 20 nt, Homo sapiens
acuuuggcugugaugucaca

SEQ ID NO: 1808359 - RNA, 14 nt, Homo sapiens
uagugucacugaug

SEQ ID NO: 1808360 - RNA, 24 nt, Homo sapiens
aggugugugugaacugggcacaga

SEQ ID NO: 1808361 - RNA, 13 nt, Homo sapiens
aaauagacuuuug

SEQ ID NO: 1808362 - RNA, 23 nt, Homo sapiens
cucaguccagcgcucaggaauau

SEQ ID NO: 1808363 - RNA, 19 nt, Homo sapiens
uggcaaucaauacagcuuc

SEQ ID NO: 1808364 - RNA, 18 nt, Homo sapiens
aauugaguuucagaauaa

SEQ ID NO: 1808365 - RNA, 22 nt, Homo sapiens
aggaccuuccuuccucuugcag

SEQ ID NO: 1808366 - RNA, 23 nt, Homo sapiens
uuugagauauuaaugcccagaca

SEQ ID NO: 1808367 - RNA, 16 nt, Homo sapiens
cuuaauuuacuuuaag

SEQ ID NO: 1808368 - RNA, 14 nt, Homo sapiens
cacucggaaaaagc

SEQ ID NO: 1808369 - RNA, 15 nt, Homo sapiens
cuauaaaagcuuucu

SEQ ID NO: 1808370 - RNA, 16 nt, Homo sapiens
ccacucauugucuuug

SEQ ID NO: 1808371 - RNA, 19 nt, Homo sapiens
gcccaggccagagugcagu

SEQ ID NO: 1808372 - RNA, 13 nt, Homo sapiens
ucacagacuggca

SEQ ID NO: 1808373 - RNA, 16 nt, Homo sapiens
cuccaggcaguucucu

SEQ ID NO: 1808374 - RNA, 20 nt, Homo sapiens
agccucggcaggaccccugg

SEQ ID NO: 1808375 - RNA, 22 nt, Homo sapiens
ucagauguuuuacgcaaggaag

SEQ ID NO: 1808376 - RNA, 19 nt, Homo sapiens
cccugagcagaauacuggu

SEQ ID NO: 1808377 - RNA, 21 nt, Homo sapiens
cuuuccacauauagagcucca

SEQ ID NO: 1808378 - RNA, 13 nt, Homo sapiens
uuaaagaagcaau

SEQ ID NO: 1808379 - RNA, 21 nt, Homo sapiens
aaaaauuuauauuucagauuu

SEQ ID NO: 1808380 - RNA, 17 nt, Homo sapiens
ugaagaaagccagacaa

SEQ ID NO: 1808381 - RNA, 13 nt, Homo sapiens
uuuguagcacuga

SEQ ID NO: 1808382 - RNA, 15 nt, Homo sapiens
ggcccuuugaagccu

SEQ ID NO: 1808383 - RNA, 14 nt, Homo sapiens
auucucccuuuauu

SEQ ID NO: 1808384 - RNA, 20 nt, Homo sapiens
ccagaacaguaugaauuuga

SEQ ID NO: 1808385 - RNA, 16 nt, Homo sapiens
cuacuaaggugcuagg

SEQ ID NO: 1808386 - RNA, 15 nt, Homo sapiens
cuggaaugcauucac

SEQ ID NO: 1808387 - RNA, 22 nt, Homo sapiens
caccagccccacuucuggguca

SEQ ID NO: 1808388 - RNA, 14 nt, Homo sapiens
uuuauuaaagcaau

SEQ ID NO: 1808389 - RNA, 14 nt, Homo sapiens
uuuauaaaagcaaa

SEQ ID NO: 1808390 - RNA, 17 nt, Homo sapiens
gaacaaauaugauucuc

SEQ ID NO: 1808391 - RNA, 21 nt, Homo sapiens
cugccccaaacaaauaugcaa

SEQ ID NO: 1808392 - RNA, 18 nt, Homo sapiens
cccccauucacuuuguca

SEQ ID NO: 1808393 - RNA, 22 nt, Homo sapiens
uacauccguaggacaaguuuua

SEQ ID NO: 1808394 - RNA, 14 nt, Homo sapiens
uagguuuaauuuca

SEQ ID NO: 1808395 - RNA, 13 nt, Homo sapiens
uuugaauggauua

SEQ ID NO: 1808396 - RNA, 23 nt, Homo sapiens
uggucuuagagggugauggaaca

SEQ ID NO: 1808397 - RNA, 17 nt, Homo sapiens
cuuuuccuuggucucca

SEQ ID NO: 1808398 - RNA, 19 nt, Homo sapiens
uaaaccaguccuuagcaag

SEQ ID NO: 1808399 - RNA, 14 nt, Homo sapiens
aggaagugggagaa

SEQ ID NO: 1808400 - RNA, 16 nt, Homo sapiens
gaccugcccaugucca

SEQ ID NO: 1808401 - RNA, 13 nt, Homo sapiens
uagcacaccucau

SEQ ID NO: 1808402 - RNA, 17 nt, Homo sapiens
ucugcuccagguucacu

SEQ ID NO: 1808403 - RNA, 19 nt, Homo sapiens
acuuuuucugagcuuuuca

SEQ ID NO: 1808404 - RNA, 19 nt, Homo sapiens
ggcuuugggauaugcugua

SEQ ID NO: 1808405 - RNA, 20 nt, Homo sapiens
aaccaaauucuauacaugua

SEQ ID NO: 1808406 - RNA, 14 nt, Homo sapiens
agagaacucuuuca

SEQ ID NO: 1808407 - RNA, 22 nt, Homo sapiens
acccagcugacgcgacuaucau

SEQ ID NO: 1808408 - RNA, 20 nt, Homo sapiens
ugcccagguggcuguggaau

SEQ ID NO: 1808409 - RNA, 13 nt, Homo sapiens
cucacuagacuca

SEQ ID NO: 1808410 - RNA, 12 nt, Homo sapiens
ccuuccacugag

SEQ ID NO: 1808411 - RNA, 17 nt, Homo sapiens
ucuguucaguucauucc

SEQ ID NO: 1808412 - RNA, 19 nt, Homo sapiens
uauccacuuguccauguga

SEQ ID NO: 1808413 - RNA, 19 nt, Homo sapiens
ccugggugucugggcucaa

SEQ ID NO: 1808414 - RNA, 11 nt, Homo sapiens
gacauuccaau

SEQ ID NO: 1808415 - RNA, 15 nt, Homo sapiens
acaugaagagcagcu

SEQ ID NO: 1808416 - RNA, 23 nt, Homo sapiens
gcuuccacucagcaucagcgugg

SEQ ID NO: 1808417 - RNA, 17 nt, Homo sapiens
augagggcuggaugcuc

SEQ ID NO: 1808418 - RNA, 17 nt, Homo sapiens
gaauuaaacaacaaaca

SEQ ID NO: 1808419 - RNA, 16 nt, Homo sapiens
caucaugugccuggaa

SEQ ID NO: 1808420 - RNA, 16 nt, Homo sapiens
aaggugaagagaccaa

SEQ ID NO: 1808421 - RNA, 20 nt, Homo sapiens
ugcuguagaaacacauaaca

SEQ ID NO: 1808422 - RNA, 17 nt, Homo sapiens
uauauaggugugugaga

SEQ ID NO: 1808423 - RNA, 20 nt, Homo sapiens
acauauggauguuacucucu

SEQ ID NO: 1808424 - RNA, 18 nt, Homo sapiens
aguuaugggaauaccugu

SEQ ID NO: 1808425 - RNA, 20 nt, Homo sapiens
gaggacuuaguuugugaugu

SEQ ID NO: 1808426 - RNA, 17 nt, Homo sapiens
gaccucgugaucugccc

SEQ ID NO: 1808427 - RNA, 23 nt, Homo sapiens
aaaggauuuuucuguaacuguca

SEQ ID NO: 1808428 - RNA, 16 nt, Homo sapiens
ucaugugcauauaucu

SEQ ID NO: 1808429 - RNA, 19 nt, Homo sapiens
aauaucaugugcacuucaa

SEQ ID NO: 1808430 - RNA, 12 nt, Homo sapiens
ucagcacaggcc

SEQ ID NO: 1808431 - RNA, 18 nt, Homo sapiens
ccuuuaucaccucauucu

SEQ ID NO: 1808432 - RNA, 14 nt, Homo sapiens
aauuuugcauugug

SEQ ID NO: 1808433 - RNA, 12 nt, Homo sapiens
cuuuuuuacaca

SEQ ID NO: 1808434 - RNA, 16 nt, Homo sapiens
aaauauuaaguguuua

SEQ ID NO: 1808435 - RNA, 22 nt, Homo sapiens
aagggaaaaagccuugacaaua

SEQ ID NO: 1808436 - RNA, 21 nt, Homo sapiens
gggaccuggggaccucugggc

SEQ ID NO: 1808437 - RNA, 15 nt, Homo sapiens
caguacucaguaaua

SEQ ID NO: 1808438 - RNA, 22 nt, Homo sapiens
ccaaggacacgacacacaguag

SEQ ID NO: 1808439 - RNA, 16 nt, Homo sapiens
uggaaugaagguaaua

SEQ ID NO: 1808440 - RNA, 20 nt, Homo sapiens
ugcuggcgacacucagggca

SEQ ID NO: 1808441 - RNA, 20 nt, Homo sapiens
ucucuuagauuauguucaau

SEQ ID NO: 1808442 - RNA, 21 nt, Homo sapiens
aagagugagugaacaacuauu

SEQ ID NO: 1808443 - RNA, 13 nt, Homo sapiens
uagguaaaaacug

SEQ ID NO: 1808444 - RNA, 21 nt, Homo sapiens
uucucuagaagcuccagugau

SEQ ID NO: 1808445 - RNA, 17 nt, Homo sapiens
uacaggaagcaccccau

SEQ ID NO: 1808446 - RNA, 18 nt, Homo sapiens
aucaagaggcugagacag

SEQ ID NO: 1808447 - RNA, 18 nt, Homo sapiens
ccaucugaaccacuuugc

SEQ ID NO: 1808448 - RNA, 17 nt, Homo sapiens
cagcagcuagagcucag

SEQ ID NO: 1808449 - RNA, 14 nt, Homo sapiens
aaccaaaugugcau

SEQ ID NO: 1808450 - RNA, 15 nt, Homo sapiens
cuacccacaugcacu

SEQ ID NO: 1808451 - RNA, 22 nt, Homo sapiens
aagccuuagggcaggaaagaau

SEQ ID NO: 1808452 - RNA, 11 nt, Homo sapiens
gugaagccaug

SEQ ID NO: 1808453 - RNA, 11 nt, Homo sapiens
gaaaagccaaa

SEQ ID NO: 1808454 - RNA, 17 nt, Homo sapiens
agaacaacaacaaaaua

SEQ ID NO: 1808455 - RNA, 17 nt, Homo sapiens
aguagggagaaacaaaa

SEQ ID NO: 1808456 - RNA, 15 nt, Homo sapiens
uaagauuagaaugaa

SEQ ID NO: 1808457 - RNA, 16 nt, Homo sapiens
ccugaccugagacugu

SEQ ID NO: 1808458 - RNA, 13 nt, Homo sapiens
ucugauaccucaa

SEQ ID NO: 1808459 - RNA, 18 nt, Homo sapiens
ugucucuuuaaugucaca

SEQ ID NO: 1808460 - RNA, 11 nt, Homo sapiens
ccaaagccauc

SEQ ID NO: 1808461 - RNA, 14 nt, Homo sapiens
auaaucacauugac

SEQ ID NO: 1808462 - RNA, 13 nt, Homo sapiens
ugaaagcaacagc

SEQ ID NO: 1808463 - RNA, 17 nt, Homo sapiens
acacccacccugugcca

SEQ ID NO: 1808464 - RNA, 17 nt, Homo sapiens
ccagccaagcucugcag

SEQ ID NO: 1808465 - RNA, 17 nt, Homo sapiens
ugcagauagcccaggag

SEQ ID NO: 1808466 - RNA, 16 nt, Homo sapiens
uaagagauacauuccc

SEQ ID NO: 1808467 - RNA, 14 nt, Homo sapiens
uguugucaagugau

SEQ ID NO: 1808468 - RNA, 13 nt, Homo sapiens
ccugacauguccu

SEQ ID NO: 1808469 - RNA, 15 nt, Homo sapiens
guaaaaugaaggaaa

SEQ ID NO: 1808470 - RNA, 18 nt, Homo sapiens
ugacacacucaccauuua

SEQ ID NO: 1808471 - RNA, 19 nt, Homo sapiens
aauaaacuugcuuucacuu

SEQ ID NO: 1808472 - RNA, 15 nt, Homo sapiens
gucagaccaguacug

SEQ ID NO: 1808473 - RNA, 17 nt, Homo sapiens
ccucagccauucacugc

SEQ ID NO: 1808474 - RNA, 14 nt, Homo sapiens
uuaaggggcagcuu

SEQ ID NO: 1808475 - RNA, 21 nt, Homo sapiens
agugcaugacguuuaaggcca

SEQ ID NO: 1808476 - RNA, 21 nt, Homo sapiens
aaggacacuagccugugcacg

SEQ ID NO: 1808477 - RNA, 14 nt, Homo sapiens
cuccauacaaugac

SEQ ID NO: 1808478 - RNA, 13 nt, Homo sapiens
auaauacccagga

SEQ ID NO: 1808479 - RNA, 21 nt, Homo sapiens
uuccccaguucaguguugcau

SEQ ID NO: 1808480 - RNA, 21 nt, Homo sapiens
agacaggaaaaagacuaagcc

SEQ ID NO: 1808481 - RNA, 14 nt, Homo sapiens
aacugcaaaccaug

SEQ ID NO: 1808482 - RNA, 21 nt, Homo sapiens
aagcacacggagacgugauga

SEQ ID NO: 1808483 - RNA, 22 nt, Homo sapiens
aaacagauuuuagacuuaccuu

SEQ ID NO: 1808484 - RNA, 20 nt, Homo sapiens
cugagauaagaaaagccuga

SEQ ID NO: 1808485 - RNA, 15 nt, Homo sapiens
agugcugcuguggag

SEQ ID NO: 1808486 - RNA, 15 nt, Homo sapiens
acuugaauccauuga

SEQ ID NO: 1808487 - RNA, 19 nt, Homo sapiens
ucaugcccgccagugcaca

SEQ ID NO: 1808488 - RNA, 20 nt, Homo sapiens
accguggacaggcccagcgc

SEQ ID NO: 1808489 - RNA, 17 nt, Homo sapiens
caaucuacacugccuua

SEQ ID NO: 1808490 - RNA, 14 nt, Homo sapiens
gcuguuaaucugau

SEQ ID NO: 1808491 - RNA, 20 nt, Homo sapiens
cuccccuaccacugucuucu

SEQ ID NO: 1808492 - RNA, 15 nt, Homo sapiens
augaaugagauguaa

SEQ ID NO: 1808493 - RNA, 19 nt, Homo sapiens
aagagcuauggcccagaaa

SEQ ID NO: 1808494 - RNA, 15 nt, Homo sapiens
cacacaucagugcac

SEQ ID NO: 1808495 - RNA, 21 nt, Homo sapiens
auuuauuugacucagcacugu

SEQ ID NO: 1808496 - RNA, 20 nt, Homo sapiens
gggccccugggcgagacaca

SEQ ID NO: 1808497 - RNA, 21 nt, Homo sapiens
uaacacauuaaauguggaagg

SEQ ID NO: 1808498 - RNA, 21 nt, Homo sapiens
uaacuguugcuggcagucuaa

SEQ ID NO: 1808499 - RNA, 18 nt, Homo sapiens
aaacuuuggaaccagacu

SEQ ID NO: 1808500 - RNA, 15 nt, Homo sapiens
uauucucagcacuuu

SEQ ID NO: 1808501 - RNA, 17 nt, Homo sapiens
acaaguugaaauaugcu

SEQ ID NO: 1808502 - RNA, 18 nt, Homo sapiens
aaaggcaguugacuagaa

SEQ ID NO: 1808503 - RNA, 18 nt, Homo sapiens
cacacaccucaugugaga

SEQ ID NO: 1808504 - RNA, 14 nt, Homo sapiens
auuuucuguuccag

SEQ ID NO: 1808505 - RNA, 15 nt, Homo sapiens
uccuuuuguuuucca

SEQ ID NO: 1808506 - RNA, 19 nt, Homo sapiens
gauaaaccugucuaagcaa

SEQ ID NO: 1808507 - RNA, 17 nt, Homo sapiens
uugcauguggccauuac

SEQ ID NO: 1808508 - RNA, 19 nt, Homo sapiens
gaacacacugagacuugaa

SEQ ID NO: 1808509 - RNA, 14 nt, Homo sapiens
aaaaauaaccuugc

SEQ ID NO: 1808510 - RNA, 17 nt, Homo sapiens
agagugguaucuugcag

SEQ ID NO: 1808511 - RNA, 17 nt, Homo sapiens
caggaacccuucuccau

SEQ ID NO: 1808512 - RNA, 15 nt, Homo sapiens
agaauuaucucucau

SEQ ID NO: 1808513 - RNA, 17 nt, Homo sapiens
auauguauacauauaga

SEQ ID NO: 1808514 - RNA, 20 nt, Homo sapiens
gagaguuccucuuugcccug

SEQ ID NO: 1808515 - RNA, 23 nt, Homo sapiens
aucuguggagaauguacacaguu

SEQ ID NO: 1808516 - RNA, 17 nt, Homo sapiens
acaaguuaaaaaggucu

SEQ ID NO: 1808517 - RNA, 20 nt, Homo sapiens
caguccauaacuuaccucug

SEQ ID NO: 1808518 - RNA, 18 nt, Homo sapiens
ccuucaguuuauuuccac

SEQ ID NO: 1808519 - RNA, 21 nt, Homo sapiens
gugauuacccucugggucuca

SEQ ID NO: 1808520 - RNA, 11 nt, Homo sapiens
accucagggcu

SEQ ID NO: 1808521 - RNA, 20 nt, Homo sapiens
uggcugaacgcguguguaca

SEQ ID NO: 1808522 - RNA, 20 nt, Homo sapiens
acauucuuagaguuaccaca

SEQ ID NO: 1808523 - RNA, 14 nt, Homo sapiens
uccacuccuuuauu

SEQ ID NO: 1808524 - RNA, 15 nt, Homo sapiens
ggagcgaucucagca

SEQ ID NO: 1808525 - RNA, 20 nt, Homo sapiens
cauucagagucagccaggac

SEQ ID NO: 1808526 - RNA, 18 nt, Homo sapiens
agagucucugauacacag

SEQ ID NO: 1808527 - RNA, 19 nt, Homo sapiens
cccacauaauacauuccau

SEQ ID NO: 1808528 - RNA, 14 nt, Homo sapiens
ucaucaagcuccac

SEQ ID NO: 1808529 - RNA, 19 nt, Homo sapiens
ggaagacuagaggcuugca

SEQ ID NO: 1808530 - RNA, 19 nt, Homo sapiens
uagagagggugguuuuccu

SEQ ID NO: 1808531 - RNA, 16 nt, Homo sapiens
auuuuuaaaucauuca

SEQ ID NO: 1808532 - RNA, 16 nt, Homo sapiens
uguuagaaugcaagca

SEQ ID NO: 1808533 - RNA, 17 nt, Homo sapiens
ucagaauugcacaucua

SEQ ID NO: 1808534 - RNA, 16 nt, Homo sapiens
gugucccaagcuuuga

SEQ ID NO: 1808535 - RNA, 11 nt, Homo sapiens
cccagcauuca

SEQ ID NO: 1808536 - RNA, 20 nt, Homo sapiens
ugacaaggcacuucauguaa

SEQ ID NO: 1808537 - RNA, 13 nt, Homo sapiens
auagugcacucca

SEQ ID NO: 1808538 - RNA, 17 nt, Homo sapiens
caaggaaaauauugcca

SEQ ID NO: 1808539 - RNA, 18 nt, Homo sapiens
auacugcauuuacagugu

SEQ ID NO: 1808540 - RNA, 19 nt, Homo sapiens
agguucuucuaaaauugaa

SEQ ID NO: 1808541 - RNA, 22 nt, Homo sapiens
ugaccaacggugguaugcugca

SEQ ID NO: 1808542 - RNA, 15 nt, Homo sapiens
agcccugaacauuuc

SEQ ID NO: 1808543 - RNA, 16 nt, Homo sapiens
cuucaacagccaagcu

SEQ ID NO: 1808544 - RNA, 18 nt, Homo sapiens
agcgcauccaaucucaag

SEQ ID NO: 1808545 - RNA, 16 nt, Homo sapiens
cucagcucggggagcc

SEQ ID NO: 1808546 - RNA, 13 nt, Homo sapiens
uaagccagggauu

SEQ ID NO: 1808547 - RNA, 22 nt, Homo sapiens
aguuaucugagcuuaaacauuu

SEQ ID NO: 1808548 - RNA, 15 nt, Homo sapiens
cuuugagucaaguca

SEQ ID NO: 1808549 - RNA, 14 nt, Homo sapiens
caauuucuaccuuu

SEQ ID NO: 1808550 - RNA, 14 nt, Homo sapiens
agauuucauguuau

SEQ ID NO: 1808551 - RNA, 19 nt, Homo sapiens
gaagcaacccaaauguuca

SEQ ID NO: 1808552 - RNA, 17 nt, Homo sapiens
uaguuuacaaacaagau

SEQ ID NO: 1808553 - RNA, 22 nt, Homo sapiens
accuguacauucuuccaucauc

SEQ ID NO: 1808554 - RNA, 14 nt, Homo sapiens
caaaaacacagugu

SEQ ID NO: 1808555 - RNA, 15 nt, Homo sapiens
uguugaugggaugau

SEQ ID NO: 1808556 - RNA, 19 nt, Homo sapiens
ccuuuagauagcagccugg

SEQ ID NO: 1808557 - RNA, 22 nt, Homo sapiens
aagguaauaauacagccaaaga

SEQ ID NO: 1808558 - RNA, 21 nt, Homo sapiens
auacuaauugagaaacaugaa

SEQ ID NO: 1808559 - RNA, 12 nt, Homo sapiens
caccagcuccac

SEQ ID NO: 1808560 - RNA, 16 nt, Homo sapiens
ucuugaucagacauuc

SEQ ID NO: 1808561 - RNA, 18 nt, Homo sapiens
aggcggcagauccugccc

SEQ ID NO: 1808562 - RNA, 15 nt, Homo sapiens
ucauagcucacugua

SEQ ID NO: 1808563 - RNA, 23 nt, Homo sapiens
auaaaaggggaaauaacugccuu

SEQ ID NO: 1808564 - RNA, 20 nt, Homo sapiens
auggugauggagagggaugg

SEQ ID NO: 1808565 - RNA, 19 nt, Homo sapiens
agcaagcagaugaacuaau

SEQ ID NO: 1808566 - RNA, 21 nt, Homo sapiens
cacucuagccugggugacaga

SEQ ID NO: 1808567 - RNA, 19 nt, Homo sapiens
gauaacuuugugauguuuc

SEQ ID NO: 1808568 - RNA, 24 nt, Homo sapiens
cugugggguauacagcauugacuc

SEQ ID NO: 1808569 - RNA, 15 nt, Homo sapiens
cuuccacaugugcca

SEQ ID NO: 1808570 - RNA, 11 nt, Homo sapiens
aaauauguaac

SEQ ID NO: 1808571 - RNA, 18 nt, Homo sapiens
ucuggcuucuuucacuuu

SEQ ID NO: 1808572 - RNA, 15 nt, Homo sapiens
acucuaccugcaaga

SEQ ID NO: 1808573 - RNA, 16 nt, Homo sapiens
cuugaccucagugaaa

SEQ ID NO: 1808574 - RNA, 16 nt, Homo sapiens
uggcauauggaaggga

SEQ ID NO: 1808575 - RNA, 15 nt, Homo sapiens
auaugaggcuacaga

SEQ ID NO: 1808576 - RNA, 19 nt, Homo sapiens
caaucccaggauguacaag

SEQ ID NO: 1808577 - RNA, 13 nt, Homo sapiens
uaguuacuguggu

SEQ ID NO: 1808578 - RNA, 15 nt, Homo sapiens
acuuaagacugugua

SEQ ID NO: 1808579 - RNA, 14 nt, Homo sapiens
uguuucccguauug

SEQ ID NO: 1808580 - RNA, 21 nt, Homo sapiens
ccaaggugggcggaucacuug

SEQ ID NO: 1808581 - RNA, 21 nt, Homo sapiens
agagcugugcaucagcuagaa

SEQ ID NO: 1808582 - RNA, 15 nt, Homo sapiens
uacagauuguucuca

SEQ ID NO: 1808583 - RNA, 22 nt, Homo sapiens
gaaaauuguacaaccugugauc

SEQ ID NO: 1808584 - RNA, 15 nt, Homo sapiens
aagucacugaacaaa

SEQ ID NO: 1808585 - RNA, 23 nt, Homo sapiens
auacaauggguaucgcugagacu

SEQ ID NO: 1808586 - RNA, 16 nt, Homo sapiens
ggccuugugugaugau

SEQ ID NO: 1808587 - RNA, 17 nt, Homo sapiens
cuuuucccccaaagugg

SEQ ID NO: 1808588 - RNA, 15 nt, Homo sapiens
uaaggaguaacuugc

SEQ ID NO: 1808589 - RNA, 17 nt, Homo sapiens
gcuacuguuucaguccu

SEQ ID NO: 1808590 - RNA, 19 nt, Homo sapiens
aagggcagcuucagucucu

SEQ ID NO: 1808591 - RNA, 19 nt, Homo sapiens
acuucaaguuaaagugaau

SEQ ID NO: 1808592 - RNA, 14 nt, Homo sapiens
cuccacgcccuggg

SEQ ID NO: 1808593 - RNA, 18 nt, Homo sapiens
gauugagagcagccucuu

SEQ ID NO: 1808594 - RNA, 23 nt, Homo sapiens
uuuuagacaaaaaauagggauga

SEQ ID NO: 1808595 - RNA, 14 nt, Homo sapiens
ucuacaagguguuc

SEQ ID NO: 1808596 - RNA, 17 nt, Homo sapiens
cccaauaaaagugacuc

SEQ ID NO: 1808597 - RNA, 15 nt, Homo sapiens
gaaaagauugaaaau

SEQ ID NO: 1808598 - RNA, 17 nt, Homo sapiens
aagcagcaacuuguccu

SEQ ID NO: 1808599 - RNA, 23 nt, Homo sapiens
uagacugccaugcuagacaagcu

SEQ ID NO: 1808600 - RNA, 20 nt, Homo sapiens
cauaaaaaauaaaguaccac

SEQ ID NO: 1808601 - RNA, 13 nt, Homo sapiens
cagaccaccagca

SEQ ID NO: 1808602 - RNA, 13 nt, Homo sapiens
cugaccaccugca

SEQ ID NO: 1808603 - RNA, 15 nt, Homo sapiens
uucaguuuuuacuga

SEQ ID NO: 1808604 - RNA, 17 nt, Homo sapiens
aagaaggacacuuguau

SEQ ID NO: 1808605 - RNA, 16 nt, Homo sapiens
cacagcugaacuauuu

SEQ ID NO: 1808606 - RNA, 15 nt, Homo sapiens
uucuguauucacuua

SEQ ID NO: 1808607 - RNA, 18 nt, Homo sapiens
aucgagaccaucuuggcc

SEQ ID NO: 1808608 - RNA, 16 nt, Homo sapiens
aauucagcaaaguggu

SEQ ID NO: 1808609 - RNA, 15 nt, Homo sapiens
cgccagcagcuguca

SEQ ID NO: 1808610 - RNA, 23 nt, Homo sapiens
agacuauuaauaaauaagacugu

SEQ ID NO: 1808611 - RNA, 21 nt, Homo sapiens
acauucaccaacaacagucag

SEQ ID NO: 1808612 - RNA, 19 nt, Homo sapiens
gcucucugacugcuuugga

SEQ ID NO: 1808613 - RNA, 21 nt, Homo sapiens
uguuagggacuuuggcauuuc

SEQ ID NO: 1808614 - RNA, 15 nt, Homo sapiens
ggccgaguccaggag

SEQ ID NO: 1808615 - RNA, 21 nt, Homo sapiens
cuugcucagacgagacacccu

SEQ ID NO: 1808616 - RNA, 19 nt, Homo sapiens
cagaccaguagugaccaau

SEQ ID NO: 1808617 - RNA, 24 nt, Homo sapiens
uaaaugcucgugugauuuccuaca

SEQ ID NO: 1808618 - RNA, 14 nt, Homo sapiens
acagacaucaugcu

SEQ ID NO: 1808619 - RNA, 22 nt, Homo sapiens
uucuacaauuucaauuucuccc

SEQ ID NO: 1808620 - RNA, 15 nt, Homo sapiens
cacuguuucucucac

SEQ ID NO: 1808621 - RNA, 18 nt, Homo sapiens
cuuccauacacagaggag

SEQ ID NO: 1808622 - RNA, 18 nt, Homo sapiens
caauucaaugcaaugaaa

SEQ ID NO: 1808623 - RNA, 18 nt, Homo sapiens
uauuaggccucagaaaga

SEQ ID NO: 1808624 - RNA, 15 nt, Homo sapiens
aguguguugacuucu

SEQ ID NO: 1808625 - RNA, 13 nt, Homo sapiens
ccuuccagugcag

SEQ ID NO: 1808626 - RNA, 16 nt, Homo sapiens
acacuuacagaauuau

SEQ ID NO: 1808627 - RNA, 14 nt, Homo sapiens
ugaggaguguccug

SEQ ID NO: 1808628 - RNA, 14 nt, Homo sapiens
cccaguauuuugag

SEQ ID NO: 1808629 - RNA, 15 nt, Homo sapiens
aauaaucaaccuggg

SEQ ID NO: 1808630 - RNA, 23 nt, Homo sapiens
uccaguuuuauaaaaaguggaga

SEQ ID NO: 1808631 - RNA, 12 nt, Homo sapiens
gagccacaggga

SEQ ID NO: 1808632 - RNA, 14 nt, Homo sapiens
aacauugaccaaga

SEQ ID NO: 1808633 - RNA, 19 nt, Homo sapiens
cuuuguguucuuuguguca

SEQ ID NO: 1808634 - RNA, 13 nt, Homo sapiens
ucuguaguggaau

SEQ ID NO: 1808635 - RNA, 16 nt, Homo sapiens
aaugucugauuuaaca

SEQ ID NO: 1808636 - RNA, 18 nt, Homo sapiens
uuuuaccugcccaaggau

SEQ ID NO: 1808637 - RNA, 18 nt, Homo sapiens
ugaagugcccuucccuug

SEQ ID NO: 1808638 - RNA, 23 nt, Homo sapiens
aguauggauugaaggauugugaa

SEQ ID NO: 1808639 - RNA, 15 nt, Homo sapiens
acagagucgcuggca

SEQ ID NO: 1808640 - RNA, 14 nt, Homo sapiens
uuauccaacuauua

SEQ ID NO: 1808641 - RNA, 15 nt, Homo sapiens
aagaugcauuguagu

SEQ ID NO: 1808642 - RNA, 17 nt, Homo sapiens
aucugggugacugagca

SEQ ID NO: 1808643 - RNA, 19 nt, Homo sapiens
aauuugcgacugcucugau

SEQ ID NO: 1808644 - RNA, 19 nt, Homo sapiens
uuaauuuuuguacuuugcu

SEQ ID NO: 1808645 - RNA, 19 nt, Homo sapiens
uggcugccaacaugauccc

SEQ ID NO: 1808646 - RNA, 16 nt, Homo sapiens
aauucauacucagaca

SEQ ID NO: 1808647 - RNA, 13 nt, Homo sapiens
caaaauucaugug

SEQ ID NO: 1808648 - RNA, 17 nt, Homo sapiens
gucuuugggcagggaau

SEQ ID NO: 1808649 - RNA, 20 nt, Homo sapiens
guuaaacuugaugccagugg

SEQ ID NO: 1808650 - RNA, 15 nt, Homo sapiens
accagacugcacagg

SEQ ID NO: 1808651 - RNA, 22 nt, Homo sapiens
uuaugcaguaaauuaucuuggg

SEQ ID NO: 1808652 - RNA, 11 nt, Homo sapiens
ucagccuucca

SEQ ID NO: 1808653 - RNA, 17 nt, Homo sapiens
aggguaauaucaucuca

SEQ ID NO: 1808654 - RNA, 13 nt, Homo sapiens
caauaagcaucaa

SEQ ID NO: 1808655 - RNA, 13 nt, Homo sapiens
gcuccauguauau

SEQ ID NO: 1808656 - RNA, 22 nt, Homo sapiens
guaauaacauuuuauacaauuu

SEQ ID NO: 1808657 - RNA, 18 nt, Homo sapiens
aaagugccaggugaucuc

SEQ ID NO: 1808658 - RNA, 17 nt, Homo sapiens
uugacauucuucacugu

SEQ ID NO: 1808659 - RNA, 16 nt, Homo sapiens
uauuugaaucuacaaa

SEQ ID NO: 1808660 - RNA, 13 nt, Homo sapiens
agguacccaaggu

SEQ ID NO: 1808661 - RNA, 17 nt, Homo sapiens
ucuccaggcaguucucu

SEQ ID NO: 1808662 - RNA, 21 nt, Homo sapiens
gcuguacccagagaguccugu

SEQ ID NO: 1808663 - RNA, 20 nt, Homo sapiens
acuccaccuuggaccucagu

SEQ ID NO: 1808664 - RNA, 15 nt, Homo sapiens
ugugcuguccugccc

SEQ ID NO: 1808665 - RNA, 19 nt, Homo sapiens
agcggggcuggccaugagg

SEQ ID NO: 1808666 - RNA, 17 nt, Homo sapiens
cuaccuguggugauguu

SEQ ID NO: 1808667 - RNA, 19 nt, Homo sapiens
gcacacggagacgugauga

SEQ ID NO: 1808668 - RNA, 16 nt, Homo sapiens
uguacauagccuauau

SEQ ID NO: 1808669 - RNA, 16 nt, Homo sapiens
gcccuucccugacacu

SEQ ID NO: 1808670 - RNA, 16 nt, Homo sapiens
agucaacgccucggug

SEQ ID NO: 1808671 - RNA, 18 nt, Homo sapiens
cuaaauaugugacugaca

SEQ ID NO: 1808672 - RNA, 14 nt, Homo sapiens
uacgaagcauguau

SEQ ID NO: 1808673 - RNA, 22 nt, Homo sapiens
cacucuaccugaaccugcacac

SEQ ID NO: 1808674 - RNA, 19 nt, Homo sapiens
cagcucucuccuuucaggg

SEQ ID NO: 1808675 - RNA, 16 nt, Homo sapiens
aaauaguuuggauuac

SEQ ID NO: 1808676 - RNA, 20 nt, Homo sapiens
agaacaauuaaaauauucuu

SEQ ID NO: 1808677 - RNA, 14 nt, Homo sapiens
uguaugugucuccc

SEQ ID NO: 1808678 - RNA, 17 nt, Homo sapiens
aaaucuuggaaguacau

SEQ ID NO: 1808679 - RNA, 22 nt, Homo sapiens
agcagcccuacaacaaccugaa

SEQ ID NO: 1808680 - RNA, 14 nt, Homo sapiens
auaaaagauuuaca

SEQ ID NO: 1808681 - RNA, 15 nt, Homo sapiens
ucugcacacuccagg

SEQ ID NO: 1808682 - RNA, 21 nt, Homo sapiens
gugaccucugccugaagucac

SEQ ID NO: 1808683 - RNA, 19 nt, Homo sapiens
aauaguacauaaucuuuau

SEQ ID NO: 1808684 - RNA, 23 nt, Homo sapiens
cccagggagaaucugagacaucu

SEQ ID NO: 1808685 - RNA, 15 nt, Homo sapiens
cuaaaguagagcccu

SEQ ID NO: 1808686 - RNA, 20 nt, Homo sapiens
uguuauguauuccuaugaca

SEQ ID NO: 1808687 - RNA, 13 nt, Homo sapiens
ugcuuuaaccuca

SEQ ID NO: 1808688 - RNA, 21 nt, Homo sapiens
uguucuacaagguuguucaug

SEQ ID NO: 1808689 - RNA, 15 nt, Homo sapiens
acuuugaagccauaa

SEQ ID NO: 1808690 - RNA, 19 nt, Homo sapiens
gagccuggaagccaaacaa

SEQ ID NO: 1808691 - RNA, 21 nt, Homo sapiens
gagucaaaugggaaaaaaaca

SEQ ID NO: 1808692 - RNA, 23 nt, Homo sapiens
uauccuaaacuuuagacuuccca

SEQ ID NO: 1808693 - RNA, 18 nt, Homo sapiens
uaauucauugugauuuau

SEQ ID NO: 1808694 - RNA, 17 nt, Homo sapiens
uaagaaugucuauuucc

SEQ ID NO: 1808695 - RNA, 21 nt, Homo sapiens
aaauggagaaagcccaagagu

SEQ ID NO: 1808696 - RNA, 12 nt, Homo sapiens
aguuccugauga

SEQ ID NO: 1808697 - RNA, 20 nt, Homo sapiens
cucacaugccacuggaaaca

SEQ ID NO: 1808698 - RNA, 16 nt, Homo sapiens
gaugcaauuacugcug

SEQ ID NO: 1808699 - RNA, 19 nt, Homo sapiens
ggcaacguagccugggcuc

SEQ ID NO: 1808700 - RNA, 14 nt, Homo sapiens
caguagugccuuua

SEQ ID NO: 1808701 - RNA, 18 nt, Homo sapiens
cugaagguaauacuauaa

SEQ ID NO: 1808702 - RNA, 18 nt, Homo sapiens
cagcuaaguguggagcug

SEQ ID NO: 1808703 - RNA, 21 nt, Homo sapiens
gcucaaucucagcuaacauuc

SEQ ID NO: 1808704 - RNA, 21 nt, Homo sapiens
agaaucucuucaugcuugaca

SEQ ID NO: 1808705 - RNA, 22 nt, Homo sapiens
gccaugacuaggguccucaggc

SEQ ID NO: 1808706 - RNA, 14 nt, Homo sapiens
uucuuccaucugau

SEQ ID NO: 1808707 - RNA, 14 nt, Homo sapiens
ccuguucacucuac

SEQ ID NO: 1808708 - RNA, 14 nt, Homo sapiens
acuggauauguugu

SEQ ID NO: 1808709 - RNA, 13 nt, Homo sapiens
ugcaggugcuuuu

SEQ ID NO: 1808710 - RNA, 21 nt, Homo sapiens
gucuuaaacuaaaugugcaau

SEQ ID NO: 1808711 - RNA, 19 nt, Homo sapiens
uuucauuuugucagcagca

SEQ ID NO: 1808712 - RNA, 18 nt, Homo sapiens
aauucuuuccccaaagac

SEQ ID NO: 1808713 - RNA, 11 nt, Homo sapiens
auucucuggcu

SEQ ID NO: 1808714 - RNA, 21 nt, Homo sapiens
uaagcagacucagcugcuaua

SEQ ID NO: 1808715 - RNA, 15 nt, Homo sapiens
auuaugagacuguac

SEQ ID NO: 1808716 - RNA, 18 nt, Homo sapiens
agugcaagcagcacucaa

SEQ ID NO: 1808717 - RNA, 15 nt, Homo sapiens
ccaugaagacaggau

SEQ ID NO: 1808718 - RNA, 15 nt, Homo sapiens
caggaaugaaguaaa

SEQ ID NO: 1808719 - RNA, 21 nt, Homo sapiens
acugacucugacucaucccca

SEQ ID NO: 1808720 - RNA, 22 nt, Homo sapiens
aguucuuagaagcucacgccuu

SEQ ID NO: 1808721 - RNA, 16 nt, Homo sapiens
aaacagagcaaaagaa

SEQ ID NO: 1808722 - RNA, 19 nt, Homo sapiens
uucuacagaauauucuccc

SEQ ID NO: 1808723 - RNA, 18 nt, Homo sapiens
ggaugagaaagaugggca

SEQ ID NO: 1808724 - RNA, 15 nt, Homo sapiens
cucugacuccaagag

SEQ ID NO: 1808725 - RNA, 20 nt, Homo sapiens
aggccgggcucaguggcuca

SEQ ID NO: 1808726 - RNA, 20 nt, Homo sapiens
augccgggcgcaguggcuca

SEQ ID NO: 1808727 - RNA, 23 nt, Homo sapiens
agaggcagaucuggacuuggcaa

SEQ ID NO: 1808728 - RNA, 21 nt, Homo sapiens
aaggaguuuugcaaagugcaa

SEQ ID NO: 1808729 - RNA, 22 nt, Homo sapiens
cugguugcugggccucauucua

SEQ ID NO: 1808730 - RNA, 16 nt, Homo sapiens
ccuugagaagugggag

SEQ ID NO: 1808731 - RNA, 22 nt, Homo sapiens
aguaccaccccucucuccccac

SEQ ID NO: 1808732 - RNA, 23 nt, Homo sapiens
uacacuuuauuaauauaaccaua

SEQ ID NO: 1808733 - RNA, 11 nt, Homo sapiens
ccaaugguguu

SEQ ID NO: 1808734 - RNA, 14 nt, Homo sapiens
auaaucauacacag

SEQ ID NO: 1808735 - RNA, 17 nt, Homo sapiens
guaucuucaaacuuuca

SEQ ID NO: 1808736 - RNA, 15 nt, Homo sapiens
aaaaguagcuuauag

SEQ ID NO: 1808737 - RNA, 16 nt, Homo sapiens
guugcuggcaguacug

SEQ ID NO: 1808738 - RNA, 16 nt, Homo sapiens
uaugcggucuagggaa

SEQ ID NO: 1808739 - RNA, 21 nt, Homo sapiens
cagacugaccuugaugagcug

SEQ ID NO: 1808740 - RNA, 23 nt, Homo sapiens
acauacaagaugcuaguucauuu

SEQ ID NO: 1808741 - RNA, 14 nt, Homo sapiens
aauacguacauguu

SEQ ID NO: 1808742 - RNA, 15 nt, Homo sapiens
caucaggauacucaa

SEQ ID NO: 1808743 - RNA, 21 nt, Homo sapiens
cagggggcugcugcugggcuc

SEQ ID NO: 1808744 - RNA, 20 nt, Homo sapiens
agccacuagcccacucccca

SEQ ID NO: 1808745 - RNA, 13 nt, Homo sapiens
cuggcuccagaau

SEQ ID NO: 1808746 - RNA, 14 nt, Homo sapiens
auaaaaagaguaug

SEQ ID NO: 1808747 - RNA, 13 nt, Homo sapiens
aggaccugugucc

SEQ ID NO: 1808748 - RNA, 19 nt, Homo sapiens
cuagaaacaaacaucuaau

SEQ ID NO: 1808749 - RNA, 14 nt, Homo sapiens
uccacaaucugaca

SEQ ID NO: 1808750 - RNA, 19 nt, Homo sapiens
acaaccuuuccagcuacuu

SEQ ID NO: 1808751 - RNA, 16 nt, Homo sapiens
caaacagucucaggaa

SEQ ID NO: 1808752 - RNA, 12 nt, Homo sapiens
uuuaugugacug

SEQ ID NO: 1808753 - RNA, 22 nt, Homo sapiens
cacugcugggggugaggacaca

SEQ ID NO: 1808754 - RNA, 20 nt, Homo sapiens
ccucaguggccagaggauca

SEQ ID NO: 1808755 - RNA, 18 nt, Homo sapiens
cguugagaaucacugcuc

SEQ ID NO: 1808756 - RNA, 18 nt, Homo sapiens
aggagaagcacagcuccu

SEQ ID NO: 1808757 - RNA, 20 nt, Homo sapiens
gcgucccugagggcccuucc

SEQ ID NO: 1808758 - RNA, 14 nt, Homo sapiens
cuuugagguccaaa

SEQ ID NO: 1808759 - RNA, 14 nt, Homo sapiens
cuaggcugagcaau

SEQ ID NO: 1808760 - RNA, 19 nt, Homo sapiens
cuucuuugauaauguuaaa

SEQ ID NO: 1808761 - RNA, 20 nt, Homo sapiens
ccucaagguguucucuguag

SEQ ID NO: 1808762 - RNA, 20 nt, Homo sapiens
auaaacaucacaugagacaa

SEQ ID NO: 1808763 - RNA, 19 nt, Homo sapiens
agacugucccugaaaccua

SEQ ID NO: 1808764 - RNA, 18 nt, Homo sapiens
aauauuuuagaaccacaa

SEQ ID NO: 1808765 - RNA, 15 nt, Homo sapiens
cauacuuucccacag

SEQ ID NO: 1808766 - RNA, 12 nt, Homo sapiens
aguagagccagc

SEQ ID NO: 1808767 - RNA, 12 nt, Homo sapiens
cuugcacaaaca

SEQ ID NO: 1808768 - RNA, 20 nt, Homo sapiens
agcuugucugaucguucaaa

SEQ ID NO: 1808769 - RNA, 21 nt, Homo sapiens
guaagacccuuauugcugucc

SEQ ID NO: 1808770 - RNA, 20 nt, Homo sapiens
ucccuuagacuuuaguaguu

SEQ ID NO: 1808771 - RNA, 19 nt, Homo sapiens
gagaaaaaagaaguguccg

SEQ ID NO: 1808772 - RNA, 23 nt, Homo sapiens
aaaagacuugagccauccaaaga

SEQ ID NO: 1808773 - RNA, 21 nt, Homo sapiens
aaacuuugauaggauguggau

SEQ ID NO: 1808774 - RNA, 15 nt, Homo sapiens
aucaccuacucacac

SEQ ID NO: 1808775 - RNA, 16 nt, Homo sapiens
aagccucagaaaggga

SEQ ID NO: 1808776 - RNA, 20 nt, Homo sapiens
agaggccucccuggcugccu

SEQ ID NO: 1808777 - RNA, 18 nt, Homo sapiens
aaauguuaacaaugccua

SEQ ID NO: 1808778 - RNA, 22 nt, Homo sapiens
ucagcaaucacaagccaagguc

SEQ ID NO: 1808779 - RNA, 18 nt, Homo sapiens
auuuuuacagcacacacu

SEQ ID NO: 1808780 - RNA, 17 nt, Homo sapiens
cccaggacgcaugcagg

SEQ ID NO: 1808781 - RNA, 22 nt, Homo sapiens
aaggaaacauaguagcaaugga

SEQ ID NO: 1808782 - RNA, 15 nt, Homo sapiens
cugacaauaaaaaca

SEQ ID NO: 1808783 - RNA, 19 nt, Homo sapiens
aauacauucuaaaucacuu

SEQ ID NO: 1808784 - RNA, 15 nt, Homo sapiens
ugggcuauguaguca

SEQ ID NO: 1808785 - RNA, 11 nt, Homo sapiens
aggcuggugcc

SEQ ID NO: 1808786 - RNA, 18 nt, Homo sapiens
caaacacccaagcacaaa

SEQ ID NO: 1808787 - RNA, 17 nt, Homo sapiens
cuucauggaauucacaa

SEQ ID NO: 1808788 - RNA, 16 nt, Homo sapiens
ccauuuuuacuguuau

SEQ ID NO: 1808789 - RNA, 19 nt, Homo sapiens
gaaauacaccuggacaauu

SEQ ID NO: 1808790 - RNA, 18 nt, Homo sapiens
augugaaucgcaaggccu

SEQ ID NO: 1808791 - RNA, 12 nt, Homo sapiens
ccuucaugauga

SEQ ID NO: 1808792 - RNA, 21 nt, Homo sapiens
gagagcaagccaggaggacau

SEQ ID NO: 1808793 - RNA, 14 nt, Homo sapiens
aaggccacuugagu

SEQ ID NO: 1808794 - RNA, 14 nt, Homo sapiens
aaggcuacuugagc

SEQ ID NO: 1808795 - RNA, 16 nt, Homo sapiens
gcccaagagaugaaga

SEQ ID NO: 1808796 - RNA, 14 nt, Homo sapiens
aauauaacugccuu

SEQ ID NO: 1808797 - RNA, 15 nt, Homo sapiens
gacugguuguucaaa

SEQ ID NO: 1808798 - RNA, 18 nt, Homo sapiens
auuguaaggaaugauuaa

SEQ ID NO: 1808799 - RNA, 19 nt, Homo sapiens
caguccauuuccaaaugug

SEQ ID NO: 1808800 - RNA, 17 nt, Homo sapiens
ugcuggguguugcauuu

SEQ ID NO: 1808801 - RNA, 18 nt, Homo sapiens
acuaaacacgugacacaa

SEQ ID NO: 1808802 - RNA, 14 nt, Homo sapiens
aaggauccagacuc

SEQ ID NO: 1808803 - RNA, 14 nt, Homo sapiens
caaggacauuucuc

SEQ ID NO: 1808804 - RNA, 19 nt, Homo sapiens
gccuuuccaccugcuuucu

SEQ ID NO: 1808805 - RNA, 21 nt, Homo sapiens
aggcaucugucuuuuuacugg

SEQ ID NO: 1808806 - RNA, 15 nt, Homo sapiens
caagaaaaacaacuu

SEQ ID NO: 1808807 - RNA, 15 nt, Homo sapiens
uguuauccacaagca

SEQ ID NO: 1808808 - RNA, 20 nt, Homo sapiens
agcaaaaccacugagcuucu

SEQ ID NO: 1808809 - RNA, 22 nt, Homo sapiens
cauccuucccgcagcaccagcc

SEQ ID NO: 1808810 - RNA, 20 nt, Homo sapiens
aucaccaguguguggcuuuc

SEQ ID NO: 1808811 - RNA, 22 nt, Homo sapiens
uaaauuugucuuucaagugaaa

SEQ ID NO: 1808812 - RNA, 21 nt, Homo sapiens
augcuuuccuguucauggggu

SEQ ID NO: 1808813 - RNA, 12 nt, Homo sapiens
uggaagcuguuc

SEQ ID NO: 1808814 - RNA, 13 nt, Homo sapiens
cagaauaugucag

SEQ ID NO: 1808815 - RNA, 17 nt, Homo sapiens
uggaaggcucccuaaca

SEQ ID NO: 1808816 - RNA, 20 nt, Homo sapiens
ccuugugguuuguggcuuua

SEQ ID NO: 1808817 - RNA, 22 nt, Homo sapiens
cacuucccugcaaggugcaccu

SEQ ID NO: 1808818 - RNA, 19 nt, Homo sapiens
uuuccaccuuucugaaugg

SEQ ID NO: 1808819 - RNA, 21 nt, Homo sapiens
uucugggccacucaggccagu

SEQ ID NO: 1808820 - RNA, 15 nt, Homo sapiens
auaaauuauuuaacu

SEQ ID NO: 1808821 - RNA, 16 nt, Homo sapiens
cuuggcuucagguuag

SEQ ID NO: 1808822 - RNA, 23 nt, Homo sapiens
aaaaaugguauaaguaacuuuau

SEQ ID NO: 1808823 - RNA, 22 nt, Homo sapiens
gaaucaaucuuuaacaaccucu

SEQ ID NO: 1808824 - RNA, 14 nt, Homo sapiens
gccugcgucuuccg

SEQ ID NO: 1808825 - RNA, 22 nt, Homo sapiens
cacuuagaccugccagccacug

SEQ ID NO: 1808826 - RNA, 13 nt, Homo sapiens
ugaguuucucuca

SEQ ID NO: 1808827 - RNA, 18 nt, Homo sapiens
uagcucuguccacucuga

SEQ ID NO: 1808828 - RNA, 16 nt, Homo sapiens
auuauaaauaaauaga

SEQ ID NO: 1808829 - RNA, 13 nt, Homo sapiens
uaagccacuuccc

SEQ ID NO: 1808830 - RNA, 18 nt, Homo sapiens
auucaacaaacauuugcu

SEQ ID NO: 1808831 - RNA, 14 nt, Homo sapiens
acaauauuaauuca

SEQ ID NO: 1808832 - RNA, 13 nt, Homo sapiens
ggagcuuggcaga

SEQ ID NO: 1808833 - RNA, 16 nt, Homo sapiens
auaauguuaagcuuua

SEQ ID NO: 1808834 - RNA, 18 nt, Homo sapiens
aucccuuauccaacucuc

SEQ ID NO: 1808835 - RNA, 17 nt, Homo sapiens
uguuuccuaauaucaaa

SEQ ID NO: 1808836 - RNA, 21 nt, Homo sapiens
gcauucaggguuauacacaga

SEQ ID NO: 1808837 - RNA, 16 nt, Homo sapiens
gacaccuaggcuaggg

SEQ ID NO: 1808838 - RNA, 16 nt, Homo sapiens
agaagcacauaugaac

SEQ ID NO: 1808839 - RNA, 18 nt, Homo sapiens
auucuuacccuguacaua

SEQ ID NO: 1808840 - RNA, 17 nt, Homo sapiens
uccagcucccacucccu

SEQ ID NO: 1808841 - RNA, 20 nt, Homo sapiens
gacacugccacucuccccau

SEQ ID NO: 1808842 - RNA, 22 nt, Homo sapiens
uugggaagaagugauucugucc

SEQ ID NO: 1808843 - RNA, 21 nt, Homo sapiens
gauuauuggaaauuuguuaua

SEQ ID NO: 1808844 - RNA, 11 nt, Homo sapiens
ugguccagaau

SEQ ID NO: 1808845 - RNA, 11 nt, Homo sapiens
aaguccagugu

SEQ ID NO: 1808846 - RNA, 23 nt, Homo sapiens
gguugauauauucuuuccaugca

SEQ ID NO: 1808847 - RNA, 23 nt, Homo sapiens
cacaaaaggcuggaugugcuuuc

SEQ ID NO: 1808848 - RNA, 14 nt, Homo sapiens
cccucauugcauuu

SEQ ID NO: 1808849 - RNA, 18 nt, Homo sapiens
agaugacggaugccuaga

SEQ ID NO: 1808850 - RNA, 13 nt, Homo sapiens
uguuuacccagua

SEQ ID NO: 1808851 - RNA, 20 nt, Homo sapiens
agaaugucuccauuguuaaa

SEQ ID NO: 1808852 - RNA, 12 nt, Homo sapiens
caagacagcaga

SEQ ID NO: 1808853 - RNA, 20 nt, Homo sapiens
ugccuggaagagcagcccua

SEQ ID NO: 1808854 - RNA, 17 nt, Homo sapiens
gccugagcuggggccac

SEQ ID NO: 1808855 - RNA, 19 nt, Homo sapiens
guuaauaagugguaucuga

SEQ ID NO: 1808856 - RNA, 17 nt, Homo sapiens
gugucacacuuugccaa

SEQ ID NO: 1808857 - RNA, 21 nt, Homo sapiens
caucauggaaagacugggaca

SEQ ID NO: 1808858 - RNA, 14 nt, Homo sapiens
cuguaaauaaucag

SEQ ID NO: 1808859 - RNA, 22 nt, Homo sapiens
uccccaugcccacggaugcuca

SEQ ID NO: 1808860 - RNA, 19 nt, Homo sapiens
uaauuugcaauuugucagu

SEQ ID NO: 1808861 - RNA, 12 nt, Homo sapiens
aaagcagugcau

SEQ ID NO: 1808862 - RNA, 12 nt, Homo sapiens
aaaucagugcag

SEQ ID NO: 1808863 - RNA, 16 nt, Homo sapiens
gagaucgagaccaucc

SEQ ID NO: 1808864 - RNA, 21 nt, Homo sapiens
ccuucuggcugcugcagucag

SEQ ID NO: 1808865 - RNA, 16 nt, Homo sapiens
auucuuuucucagugu

SEQ ID NO: 1808866 - RNA, 21 nt, Homo sapiens
aggaucagaugacucucucca

SEQ ID NO: 1808867 - RNA, 21 nt, Homo sapiens
ugaaaaaaaaauuauuugccu

SEQ ID NO: 1808868 - RNA, 15 nt, Homo sapiens
gcaagugaaagcaag

SEQ ID NO: 1808869 - RNA, 18 nt, Homo sapiens
cagcaauccaugagauag

SEQ ID NO: 1808870 - RNA, 14 nt, Homo sapiens
uaugcaaauggaga

SEQ ID NO: 1808871 - RNA, 13 nt, Homo sapiens
cuguuagcauuau

SEQ ID NO: 1808872 - RNA, 19 nt, Homo sapiens
gccacaaugcaguucugag

SEQ ID NO: 1808873 - RNA, 14 nt, Homo sapiens
uuagccauuugacu

SEQ ID NO: 1808874 - RNA, 15 nt, Homo sapiens
agguucuugggauac

SEQ ID NO: 1808875 - RNA, 19 nt, Homo sapiens
cagcuucucucuccagggu

SEQ ID NO: 1808876 - RNA, 19 nt, Homo sapiens
gaaauacuuuaucugugac

SEQ ID NO: 1808877 - RNA, 13 nt, Homo sapiens
gggaucuugcaaa

SEQ ID NO: 1808878 - RNA, 17 nt, Homo sapiens
aacgaaaaccacaaaaa

SEQ ID NO: 1808879 - RNA, 13 nt, Homo sapiens
uaagaacagcuca

SEQ ID NO: 1808880 - RNA, 14 nt, Homo sapiens
gccucuuucaucca

SEQ ID NO: 1808881 - RNA, 16 nt, Homo sapiens
uccacauuucuuucuc

SEQ ID NO: 1808882 - RNA, 13 nt, Homo sapiens
ugaaaugucuguu

SEQ ID NO: 1808883 - RNA, 16 nt, Homo sapiens
uaccuaguuugcacua

SEQ ID NO: 1808884 - RNA, 18 nt, Homo sapiens
uucccccaauguuuaaaa

SEQ ID NO: 1808885 - RNA, 14 nt, Homo sapiens
acaccagcuguaua

SEQ ID NO: 1808886 - RNA, 20 nt, Homo sapiens
ccagguagagagaccacaag

SEQ ID NO: 1808887 - RNA, 23 nt, Homo sapiens
cgaauuuucacagccaugauucu

SEQ ID NO: 1808888 - RNA, 20 nt, Homo sapiens
uaaugaugcugucugaacag

SEQ ID NO: 1808889 - RNA, 17 nt, Homo sapiens
ggcacaguccagaccca

SEQ ID NO: 1808890 - RNA, 14 nt, Homo sapiens
gaaacuuucaaaag

SEQ ID NO: 1808891 - RNA, 22 nt, Homo sapiens
uauuucccugaaggaaccaaag

SEQ ID NO: 1808892 - RNA, 22 nt, Homo sapiens
uaaagaauaaaugaaucuuacu

SEQ ID NO: 1808893 - RNA, 13 nt, Homo sapiens
ccccagcuuugca

SEQ ID NO: 1808894 - RNA, 16 nt, Homo sapiens
aggcaggggaauguau

SEQ ID NO: 1808895 - RNA, 17 nt, Homo sapiens
ccaagguugggacccaa

SEQ ID NO: 1808896 - RNA, 16 nt, Homo sapiens
ccaagugaaugaguuu

SEQ ID NO: 1808897 - RNA, 12 nt, Homo sapiens
aaaugaacacau

SEQ ID NO: 1808898 - RNA, 15 nt, Homo sapiens
agcuucucugcugcu

SEQ ID NO: 1808899 - RNA, 13 nt, Homo sapiens
ggacuuugcacac

SEQ ID NO: 1808900 - RNA, 18 nt, Homo sapiens
acauaacacacaucaguc

SEQ ID NO: 1808901 - RNA, 17 nt, Homo sapiens
aauaauucuucaccuaa

SEQ ID NO: 1808902 - RNA, 19 nt, Homo sapiens
aaaucccugcucacugcag

SEQ ID NO: 1808903 - RNA, 16 nt, Homo sapiens
auaggagccccaggca

SEQ ID NO: 1808904 - RNA, 22 nt, Homo sapiens
auuguauuuuagcaggguacau

SEQ ID NO: 1808905 - RNA, 14 nt, Homo sapiens
agcccaagacacca

SEQ ID NO: 1808906 - RNA, 13 nt, Homo sapiens
caguucuaaccuc

SEQ ID NO: 1808907 - RNA, 18 nt, Homo sapiens
uaugcuuacugugcaccu

SEQ ID NO: 1808908 - RNA, 19 nt, Homo sapiens
cugguugccucucuugccc

SEQ ID NO: 1808909 - RNA, 18 nt, Homo sapiens
gucaauaaacaacagcug

SEQ ID NO: 1808910 - RNA, 20 nt, Homo sapiens
uguguucuaagcaaugcaaa

SEQ ID NO: 1808911 - RNA, 13 nt, Homo sapiens
auucuugcugcua

SEQ ID NO: 1808912 - RNA, 13 nt, Homo sapiens
auucaugcugcuu

SEQ ID NO: 1808913 - RNA, 15 nt, Homo sapiens
guguuauucuugccc

SEQ ID NO: 1808914 - RNA, 16 nt, Homo sapiens
aagaggcagcuugaaa

SEQ ID NO: 1808915 - RNA, 20 nt, Homo sapiens
cuggaauauaaaacagucau

SEQ ID NO: 1808916 - RNA, 17 nt, Homo sapiens
uacacauccauauacau

SEQ ID NO: 1808917 - RNA, 17 nt, Homo sapiens
uuacggucaugaugucu

SEQ ID NO: 1808918 - RNA, 19 nt, Homo sapiens
uguaccuuucugacaauaa

SEQ ID NO: 1808919 - RNA, 17 nt, Homo sapiens
aucugacguuguuaucc

SEQ ID NO: 1808920 - RNA, 18 nt, Homo sapiens
acuccucucguacuugaa

SEQ ID NO: 1808921 - RNA, 16 nt, Homo sapiens
gccugaggugugugcc

SEQ ID NO: 1808922 - RNA, 19 nt, Homo sapiens
caccucagacaauccacuc

SEQ ID NO: 1808923 - RNA, 15 nt, Homo sapiens
aauuguaaauccugu

SEQ ID NO: 1808924 - RNA, 17 nt, Homo sapiens
agauuaguaaccaguua

SEQ ID NO: 1808925 - RNA, 13 nt, Homo sapiens
ucaaccagacaga

SEQ ID NO: 1808926 - RNA, 17 nt, Homo sapiens
uggaaucccacuuauca

SEQ ID NO: 1808927 - RNA, 12 nt, Homo sapiens
aacucaucucau

SEQ ID NO: 1808928 - RNA, 20 nt, Homo sapiens
aaacuucugcuuuaauggcu

SEQ ID NO: 1808929 - RNA, 21 nt, Homo sapiens
gauggauccgugacagcacuu

SEQ ID NO: 1808930 - RNA, 15 nt, Homo sapiens
guuauguacguauau

SEQ ID NO: 1808931 - RNA, 18 nt, Homo sapiens
acaccagcaggacacuga

SEQ ID NO: 1808932 - RNA, 11 nt, Homo sapiens
caccauugcug

SEQ ID NO: 1808933 - RNA, 21 nt, Homo sapiens
ugcaucccugaaacaucucaa

SEQ ID NO: 1808934 - RNA, 19 nt, Homo sapiens
uaaaagaaggaacauugca

SEQ ID NO: 1808935 - RNA, 17 nt, Homo sapiens
cauuauuuugaauguga

SEQ ID NO: 1808936 - RNA, 23 nt, Homo sapiens
gaggccauccaagauggcaugaa

SEQ ID NO: 1808937 - RNA, 18 nt, Homo sapiens
aagucauaccuacauuca

SEQ ID NO: 1808938 - RNA, 21 nt, Homo sapiens
aaaaauacuucugcaacucau

SEQ ID NO: 1808939 - RNA, 23 nt, Homo sapiens
aggaaaaaagaaaaaagcaauua

SEQ ID NO: 1808940 - RNA, 20 nt, Homo sapiens
gggcaaacccuucucuucuc

SEQ ID NO: 1808941 - RNA, 23 nt, Homo sapiens
uccuuucucuaucccaagccaac

SEQ ID NO: 1808942 - RNA, 18 nt, Homo sapiens
acauucucuucccaguga

SEQ ID NO: 1808943 - RNA, 18 nt, Homo sapiens
cuugauaaagggccaaua

SEQ ID NO: 1808944 - RNA, 19 nt, Homo sapiens
aucccggaagggacuuacu

SEQ ID NO: 1808945 - RNA, 17 nt, Homo sapiens
cuucuaccugccacuca

SEQ ID NO: 1808946 - RNA, 16 nt, Homo sapiens
ucauuauuagucuuca

SEQ ID NO: 1808947 - RNA, 19 nt, Homo sapiens
agcauuucuuuucuggcca

SEQ ID NO: 1808948 - RNA, 13 nt, Homo sapiens
gucuauguguaca

SEQ ID NO: 1808949 - RNA, 15 nt, Homo sapiens
cauguguugcaaauu

SEQ ID NO: 1808950 - RNA, 11 nt, Homo sapiens
cccugugcuga

SEQ ID NO: 1808951 - RNA, 18 nt, Homo sapiens
caugauggugcugaccuc

SEQ ID NO: 1808952 - RNA, 19 nt, Homo sapiens
ugguuuuuugcaguucaca

SEQ ID NO: 1808953 - RNA, 13 nt, Homo sapiens
uaaaaaauacugu

SEQ ID NO: 1808954 - RNA, 23 nt, Homo sapiens
agccccugcagauucugagcaaa

SEQ ID NO: 1808955 - RNA, 19 nt, Homo sapiens
cugaauaccaaguguguug

SEQ ID NO: 1808956 - RNA, 22 nt, Homo sapiens
ugaugagccauauuaauugccu

SEQ ID NO: 1808957 - RNA, 17 nt, Homo sapiens
ccggggcugaagccaca

SEQ ID NO: 1808958 - RNA, 13 nt, Homo sapiens
ccaguauaaucuc

SEQ ID NO: 1808959 - RNA, 16 nt, Homo sapiens
uuagcaaccauaauau

SEQ ID NO: 1808960 - RNA, 14 nt, Homo sapiens
agucuauggguuua

SEQ ID NO: 1808961 - RNA, 21 nt, Homo sapiens
agcagauauauuaagugacug

SEQ ID NO: 1808962 - RNA, 21 nt, Homo sapiens
gaccucgccugcuggggaccu

SEQ ID NO: 1808963 - RNA, 17 nt, Homo sapiens
gagauuuaccagggaug

SEQ ID NO: 1808964 - RNA, 16 nt, Homo sapiens
cagcagaggacagucu

SEQ ID NO: 1808965 - RNA, 20 nt, Homo sapiens
gccaccagacuuggccucca

SEQ ID NO: 1808966 - RNA, 22 nt, Homo sapiens
cucuacccucuuagaaaaacca

SEQ ID NO: 1808967 - RNA, 19 nt, Homo sapiens
aauaugaauauauacauaa

SEQ ID NO: 1808968 - RNA, 17 nt, Homo sapiens
guggcaggaaaauggac

SEQ ID NO: 1808969 - RNA, 23 nt, Homo sapiens
augguccgccugccucagccucc

SEQ ID NO: 1808970 - RNA, 19 nt, Homo sapiens
gagccacugugcccggccu

SEQ ID NO: 1808971 - RNA, 12 nt, Homo sapiens
aaugugccccau

SEQ ID NO: 1808972 - RNA, 17 nt, Homo sapiens
gcuccaggaugcauucu

SEQ ID NO: 1808973 - RNA, 23 nt, Homo sapiens
agcgcuguguuaggcacaggcug

SEQ ID NO: 1808974 - RNA, 18 nt, Homo sapiens
cuccugggcccaagugau

SEQ ID NO: 1808975 - RNA, 12 nt, Homo sapiens
augaaucugggg

SEQ ID NO: 1808976 - RNA, 14 nt, Homo sapiens
cagaggugcuccau

SEQ ID NO: 1808977 - RNA, 20 nt, Homo sapiens
caaaggaugcgugaguaugu

SEQ ID NO: 1808978 - RNA, 20 nt, Homo sapiens
agcacuuaacagauugccau

SEQ ID NO: 1808979 - RNA, 12 nt, Homo sapiens
cacaugugaugu

SEQ ID NO: 1808980 - RNA, 17 nt, Homo sapiens
aauguaguucauacuug

SEQ ID NO: 1808981 - RNA, 24 nt, Homo sapiens
caggaggucugguccgagucucag

SEQ ID NO: 1808982 - RNA, 13 nt, Homo sapiens
gcuuaaaugcaau

SEQ ID NO: 1808983 - RNA, 16 nt, Homo sapiens
gcauuacuauucacug

SEQ ID NO: 1808984 - RNA, 12 nt, Homo sapiens
agaugcacacac

SEQ ID NO: 1808985 - RNA, 18 nt, Homo sapiens
ucacugcauccucugccu

SEQ ID NO: 1808986 - RNA, 23 nt, Homo sapiens
guucucucugccugugagccagu

SEQ ID NO: 1808987 - RNA, 12 nt, Homo sapiens
agcuaauuugca

SEQ ID NO: 1808988 - RNA, 14 nt, Homo sapiens
cauguuuaauguga

SEQ ID NO: 1808989 - RNA, 14 nt, Homo sapiens
auuugauacagguu

SEQ ID NO: 1808990 - RNA, 20 nt, Homo sapiens
uaccuaggcaccaucauuua

SEQ ID NO: 1808991 - RNA, 12 nt, Homo sapiens
acuguacauuua

SEQ ID NO: 1808992 - RNA, 15 nt, Homo sapiens
ugucccauucuagau

SEQ ID NO: 1808993 - RNA, 21 nt, Homo sapiens
gcuccaagagaauucacuuua

SEQ ID NO: 1808994 - RNA, 12 nt, Homo sapiens
uuuuuuacuuga

SEQ ID NO: 1808995 - RNA, 18 nt, Homo sapiens
gccauagccaggcucucu

SEQ ID NO: 1808996 - RNA, 18 nt, Homo sapiens
guggcacugccaccagca

SEQ ID NO: 1808997 - RNA, 15 nt, Homo sapiens
gaggaugacagugac

SEQ ID NO: 1808998 - RNA, 15 nt, Homo sapiens
uaauugccaaauacc

SEQ ID NO: 1808999 - RNA, 14 nt, Homo sapiens
aguaacaaugcaug

SEQ ID NO: 1809000 - RNA, 18 nt, Homo sapiens
uuauacauaacacauauc

SEQ ID NO: 1809001 - RNA, 19 nt, Homo sapiens
auguccuaaggacacacua

SEQ ID NO: 1809002 - RNA, 22 nt, Homo sapiens
aaaucugaagugguucagucua

SEQ ID NO: 1809003 - RNA, 18 nt, Homo sapiens
acugacugaguagcucau

SEQ ID NO: 1809004 - RNA, 23 nt, Homo sapiens
uauaauuaacauguuaaaccaug

SEQ ID NO: 1809005 - RNA, 20 nt, Homo sapiens
acugaucugcuagugcugua

SEQ ID NO: 1809006 - RNA, 16 nt, Homo sapiens
cuauagaaacaccagu

SEQ ID NO: 1809007 - RNA, 15 nt, Homo sapiens
aauguaccauguugc

SEQ ID NO: 1809008 - RNA, 22 nt, Homo sapiens
ucuacaaauggugaaauuuaau

SEQ ID NO: 1809009 - RNA, 17 nt, Homo sapiens
agugcuuuucagugaua

SEQ ID NO: 1809010 - RNA, 20 nt, Homo sapiens
cuuaggcuuacaaugugcac

SEQ ID NO: 1809011 - RNA, 18 nt, Homo sapiens
ccuccagaggagacauug

SEQ ID NO: 1809012 - RNA, 14 nt, Homo sapiens
aaucacuacuguau

SEQ ID NO: 1809013 - RNA, 13 nt, Homo sapiens
gauauuacuuuau

SEQ ID NO: 1809014 - RNA, 19 nt, Homo sapiens
gauaaaucuaguauacauu

SEQ ID NO: 1809015 - RNA, 15 nt, Homo sapiens
cuaucaacacugcag

SEQ ID NO: 1809016 - RNA, 18 nt, Homo sapiens
uccuaaucccuuccucuc

SEQ ID NO: 1809017 - RNA, 17 nt, Homo sapiens
aggagaagcagccuccu

SEQ ID NO: 1809018 - RNA, 23 nt, Homo sapiens
cuguugagaugggggacugagag

SEQ ID NO: 1809019 - RNA, 18 nt, Homo sapiens
cccucugcagucucuaua

SEQ ID NO: 1809020 - RNA, 15 nt, Homo sapiens
augugcaucuggccu

SEQ ID NO: 1809021 - RNA, 21 nt, Homo sapiens
augccccgucccccucuggcu

SEQ ID NO: 1809022 - RNA, 18 nt, Homo sapiens
cuucuggagaaagcucau

SEQ ID NO: 1809023 - RNA, 16 nt, Homo sapiens
uucuauuuuuguagaa

SEQ ID NO: 1809024 - RNA, 13 nt, Homo sapiens
acaaagcauguga

SEQ ID NO: 1809025 - RNA, 13 nt, Homo sapiens
gaagguugccagg

SEQ ID NO: 1809026 - RNA, 19 nt, Homo sapiens
uagucuuaacuggucuccu

SEQ ID NO: 1809027 - RNA, 15 nt, Homo sapiens
uaaaaggggcccaag

SEQ ID NO: 1809028 - RNA, 13 nt, Homo sapiens
guccuacaacagc

SEQ ID NO: 1809029 - RNA, 15 nt, Homo sapiens
gaacccaagagcaag

SEQ ID NO: 1809030 - RNA, 22 nt, Homo sapiens
agccuggagggaugccacccag

SEQ ID NO: 1809031 - RNA, 18 nt, Homo sapiens
agcugugguaaggguugg

SEQ ID NO: 1809032 - RNA, 14 nt, Homo sapiens
ggccgccagcgugu

SEQ ID NO: 1809033 - RNA, 14 nt, Homo sapiens
gccuccucacccac

SEQ ID NO: 1809034 - RNA, 20 nt, Homo sapiens
ccaaucugugagaaguuuuu

SEQ ID NO: 1809035 - RNA, 11 nt, Homo sapiens
cacugugcaaa

SEQ ID NO: 1809036 - RNA, 16 nt, Homo sapiens
cugaguacauugugcc

SEQ ID NO: 1809037 - RNA, 21 nt, Homo sapiens
uuccccuccuuggcuuuaugc

SEQ ID NO: 1809038 - RNA, 19 nt, Homo sapiens
accgucugagcccagcuca

SEQ ID NO: 1809039 - RNA, 22 nt, Homo sapiens
aggugcucauuguaaccauuuc

SEQ ID NO: 1809040 - RNA, 15 nt, Homo sapiens
ucccaucacuucccu

SEQ ID NO: 1809041 - RNA, 17 nt, Homo sapiens
cccaccauggugggcuu

SEQ ID NO: 1809042 - RNA, 13 nt, Homo sapiens
agcacaccccaag

SEQ ID NO: 1809043 - RNA, 15 nt, Homo sapiens
auaucccgggagcag

SEQ ID NO: 1809044 - RNA, 15 nt, Homo sapiens
aggauuagacaguca

SEQ ID NO: 1809045 - RNA, 16 nt, Homo sapiens
auucacuucauaaucc

SEQ ID NO: 1809046 - RNA, 16 nt, Homo sapiens
ugcuuucacucuuuag

SEQ ID NO: 1809047 - RNA, 16 nt, Homo sapiens
cuugugagugugugca

SEQ ID NO: 1809048 - RNA, 23 nt, Homo sapiens
acuuggcucgaaucucugugccu

SEQ ID NO: 1809049 - RNA, 15 nt, Homo sapiens
aagaaaauagucagu

SEQ ID NO: 1809050 - RNA, 14 nt, Homo sapiens
ccacagucagugga

SEQ ID NO: 1809051 - RNA, 23 nt, Homo sapiens
cagaguuggggagauaaaggaac

SEQ ID NO: 1809052 - RNA, 14 nt, Homo sapiens
uguccccaccucag

SEQ ID NO: 1809053 - RNA, 17 nt, Homo sapiens
cuccacccagugauccc

SEQ ID NO: 1809054 - RNA, 15 nt, Homo sapiens
acugaggcaagcaca

SEQ ID NO: 1809055 - RNA, 20 nt, Homo sapiens
gagaugcaggugaugccauu

SEQ ID NO: 1809056 - RNA, 15 nt, Homo sapiens
ucuuaaacaauuugu

SEQ ID NO: 1809057 - RNA, 16 nt, Homo sapiens
ucccugugucauuuca

SEQ ID NO: 1809058 - RNA, 17 nt, Homo sapiens
gcgagcugcucugcuau

SEQ ID NO: 1809059 - RNA, 16 nt, Homo sapiens
guuuccuuagcuuggu

SEQ ID NO: 1809060 - RNA, 15 nt, Homo sapiens
agcugcucaacuuag

SEQ ID NO: 1809061 - RNA, 22 nt, Homo sapiens
acgccucgguggcauacagacu

SEQ ID NO: 1809062 - RNA, 21 nt, Homo sapiens
ccccagccugcucccuagcca

SEQ ID NO: 1809063 - RNA, 22 nt, Homo sapiens
aauuugaugguauuucuuucuc

SEQ ID NO: 1809064 - RNA, 20 nt, Homo sapiens
aauucugaccuuacaaaagu

SEQ ID NO: 1809065 - RNA, 15 nt, Homo sapiens
agggacggucaguuu

SEQ ID NO: 1809066 - RNA, 19 nt, Homo sapiens
guuccugucaauacagguu

SEQ ID NO: 1809067 - RNA, 15 nt, Homo sapiens
guucacaacagugaa

SEQ ID NO: 1809068 - RNA, 21 nt, Homo sapiens
gccuuaccuccccugccaggg

SEQ ID NO: 1809069 - RNA, 14 nt, Homo sapiens
uccugggaggacuc

SEQ ID NO: 1809070 - RNA, 12 nt, Homo sapiens
ucagacuuugcu

SEQ ID NO: 1809071 - RNA, 13 nt, Homo sapiens
ccaggcugucuag

SEQ ID NO: 1809072 - RNA, 17 nt, Homo sapiens
cuauuucuucuucacau

SEQ ID NO: 1809073 - RNA, 23 nt, Homo sapiens
agggaccgcccccugucucucag

SEQ ID NO: 1809074 - RNA, 15 nt, Homo sapiens
ugacauacauggaau

SEQ ID NO: 1809075 - RNA, 22 nt, Homo sapiens
uaaauucugggugaaacccuuu

SEQ ID NO: 1809076 - RNA, 17 nt, Homo sapiens
uguguauucuagugaau

SEQ ID NO: 1809077 - RNA, 15 nt, Homo sapiens
agcacaccaaguggc

SEQ ID NO: 1809078 - RNA, 14 nt, Homo sapiens
cauugaacucacca

SEQ ID NO: 1809079 - RNA, 14 nt, Homo sapiens
ugacugcaacugua

SEQ ID NO: 1809080 - RNA, 14 nt, Homo sapiens
ucucagcaagagaa

SEQ ID NO: 1809081 - RNA, 14 nt, Homo sapiens
uguguacaacacug

SEQ ID NO: 1809082 - RNA, 12 nt, Homo sapiens
ggaggcuugaag

SEQ ID NO: 1809083 - RNA, 20 nt, Homo sapiens
gagggaguggguuaaacaca

SEQ ID NO: 1809084 - RNA, 19 nt, Homo sapiens
aagaaaucuuucucccuca

SEQ ID NO: 1809085 - RNA, 15 nt, Homo sapiens
ucagcuguaccaagc

SEQ ID NO: 1809086 - RNA, 17 nt, Homo sapiens
auguauuaucaccagca

SEQ ID NO: 1809087 - RNA, 18 nt, Homo sapiens
cuuuccagucauuucaau

SEQ ID NO: 1809088 - RNA, 14 nt, Homo sapiens
uagauuaccugcca

SEQ ID NO: 1809089 - RNA, 16 nt, Homo sapiens
gcucucaggccagcuc

SEQ ID NO: 1809090 - RNA, 19 nt, Homo sapiens
gugucacuugacucuugaa

SEQ ID NO: 1809091 - RNA, 18 nt, Homo sapiens
gacacaacuauuuuucca

SEQ ID NO: 1809092 - RNA, 17 nt, Homo sapiens
auggaggcgggaaaauc

SEQ ID NO: 1809093 - RNA, 20 nt, Homo sapiens
aaaccagagaacaacauggg

SEQ ID NO: 1809094 - RNA, 13 nt, Homo sapiens
ggaaggacaaaua

SEQ ID NO: 1809095 - RNA, 17 nt, Homo sapiens
caggguggggggccaug

SEQ ID NO: 1809096 - RNA, 13 nt, Homo sapiens
agacuaaggccau

SEQ ID NO: 1809097 - RNA, 17 nt, Homo sapiens
gcacaaaaugugacauc

SEQ ID NO: 1809098 - RNA, 16 nt, Homo sapiens
uaaacuugucagggua

SEQ ID NO: 1809099 - RNA, 14 nt, Homo sapiens
uucuuccuuucccu

SEQ ID NO: 1809100 - RNA, 22 nt, Homo sapiens
gccauuccacagccccuuccuc

SEQ ID NO: 1809101 - RNA, 22 nt, Homo sapiens
ccucccaggaacugggccaacu

SEQ ID NO: 1809102 - RNA, 23 nt, Homo sapiens
gagagaauggguuuacucucaau

SEQ ID NO: 1809103 - RNA, 15 nt, Homo sapiens
cuuuguuuacaugag

SEQ ID NO: 1809104 - RNA, 15 nt, Homo sapiens
acaucugucuuucau

SEQ ID NO: 1809105 - RNA, 15 nt, Homo sapiens
cauguuaagugccau

SEQ ID NO: 1809106 - RNA, 21 nt, Homo sapiens
ugucagacguuggucccaagu

SEQ ID NO: 1809107 - RNA, 19 nt, Homo sapiens
auccacauccucuacaggu

SEQ ID NO: 1809108 - RNA, 18 nt, Homo sapiens
gaaaccaaagugaccucc

SEQ ID NO: 1809109 - RNA, 20 nt, Homo sapiens
aguaguuucucuguaaggca

SEQ ID NO: 1809110 - RNA, 20 nt, Homo sapiens
acagacagggagaaguugag

SEQ ID NO: 1809111 - RNA, 19 nt, Homo sapiens
uuuagagauggggucuugc

SEQ ID NO: 1809112 - RNA, 17 nt, Homo sapiens
acacccaugccagagag

SEQ ID NO: 1809113 - RNA, 16 nt, Homo sapiens
agggcaggaacuugca

SEQ ID NO: 1809114 - RNA, 21 nt, Homo sapiens
caaaaauaaaaacaaaaccac

SEQ ID NO: 1809115 - RNA, 21 nt, Homo sapiens
ggacaagugguaugaccagug

SEQ ID NO: 1809116 - RNA, 15 nt, Homo sapiens
agccugcaucugucu

SEQ ID NO: 1809117 - RNA, 22 nt, Homo sapiens
cugaucaaucugcaguuuguga

SEQ ID NO: 1809118 - RNA, 17 nt, Homo sapiens
gggagguugaagcagaa

SEQ ID NO: 1809119 - RNA, 17 nt, Homo sapiens
guaaugcucugaccaag

SEQ ID NO: 1809120 - RNA, 22 nt, Homo sapiens
aaugguuugggagcaauacuuu

SEQ ID NO: 1809121 - RNA, 15 nt, Homo sapiens
cuguuguucccguga

SEQ ID NO: 1809122 - RNA, 23 nt, Homo sapiens
cuggaaaagggcucagagcugcu

SEQ ID NO: 1809123 - RNA, 14 nt, Homo sapiens
cacaguuguguuca

SEQ ID NO: 1809124 - RNA, 21 nt, Homo sapiens
gaauccagaccaaccuuccau

SEQ ID NO: 1809125 - RNA, 22 nt, Homo sapiens
acacugaagaagcaccaaucau

SEQ ID NO: 1809126 - RNA, 21 nt, Homo sapiens
cugaccccacuuaugcugcug

SEQ ID NO: 1809127 - RNA, 16 nt, Homo sapiens
aaggcugccggcugca

SEQ ID NO: 1809128 - RNA, 20 nt, Homo sapiens
gggacgcuccgcugccgugc

SEQ ID NO: 1809129 - RNA, 20 nt, Homo sapiens
augaugugaaaggaccaguu

SEQ ID NO: 1809130 - RNA, 19 nt, Homo sapiens
cugugggggaggucccugc

SEQ ID NO: 1809131 - RNA, 17 nt, Homo sapiens
acccccaccauccaggu

SEQ ID NO: 1809132 - RNA, 12 nt, Homo sapiens
gcuccagcaaca

SEQ ID NO: 1809133 - RNA, 17 nt, Homo sapiens
gacucuugccuuuccac

SEQ ID NO: 1809134 - RNA, 18 nt, Homo sapiens
uguuagccacgauggucu

SEQ ID NO: 1809135 - RNA, 18 nt, Homo sapiens
ccacagccuuugcuucca

SEQ ID NO: 1809136 - RNA, 14 nt, Homo sapiens
ugccacaaucacua

SEQ ID NO: 1809137 - RNA, 14 nt, Homo sapiens
cuuaccugugacag

SEQ ID NO: 1809138 - RNA, 12 nt, Homo sapiens
ggaaacaaagug

SEQ ID NO: 1809139 - RNA, 17 nt, Homo sapiens
aagaaaguacagaacaa

SEQ ID NO: 1809140 - RNA, 18 nt, Homo sapiens
cugugcuggucuuuagcc

SEQ ID NO: 1809141 - RNA, 16 nt, Homo sapiens
uguucugcacacagca

SEQ ID NO: 1809142 - RNA, 22 nt, Homo sapiens
ggcagcugccucugcucccucu

SEQ ID NO: 1809143 - RNA, 23 nt, Homo sapiens
ccaggaccagccuguaccuugcu

SEQ ID NO: 1809144 - RNA, 13 nt, Homo sapiens
ucguaacaagcaa

SEQ ID NO: 1809145 - RNA, 14 nt, Homo sapiens
agaccaccagggca

SEQ ID NO: 1809146 - RNA, 21 nt, Homo sapiens
uuucaaaugugucaaauacaa

SEQ ID NO: 1809147 - RNA, 20 nt, Homo sapiens
cagcccugaccccaguguac

SEQ ID NO: 1809148 - RNA, 15 nt, Homo sapiens
auacacauacauaua

SEQ ID NO: 1809149 - RNA, 21 nt, Homo sapiens
aaacucccagccacagcauuu

SEQ ID NO: 1809150 - RNA, 17 nt, Homo sapiens
uuaucccaagaaugcaa

SEQ ID NO: 1809151 - RNA, 20 nt, Homo sapiens
aauugucuuuauuaacaaac

SEQ ID NO: 1809152 - RNA, 19 nt, Homo sapiens
cuucacagagugugcugga

SEQ ID NO: 1809153 - RNA, 18 nt, Homo sapiens
ucucauagguugagcaau

SEQ ID NO: 1809154 - RNA, 14 nt, Homo sapiens
aggaaggagcugcc

SEQ ID NO: 1809155 - RNA, 19 nt, Homo sapiens
cugcuucccagcuucacaa

SEQ ID NO: 1809156 - RNA, 17 nt, Homo sapiens
cacauucauuuggauaa

SEQ ID NO: 1809157 - RNA, 14 nt, Homo sapiens
agaagaaacuaccc

SEQ ID NO: 1809158 - RNA, 14 nt, Homo sapiens
cuucuaaacacuuc

SEQ ID NO: 1809159 - RNA, 13 nt, Homo sapiens
uauuucuugaaga

SEQ ID NO: 1809160 - RNA, 20 nt, Homo sapiens
gaagauacugacuagucaua

SEQ ID NO: 1809161 - RNA, 18 nt, Homo sapiens
cuuuccaggagacauaua

SEQ ID NO: 1809162 - RNA, 17 nt, Homo sapiens
aauuccccuacaucaaa

SEQ ID NO: 1809163 - RNA, 15 nt, Homo sapiens
ccauuuaaaaauauc

SEQ ID NO: 1809164 - RNA, 22 nt, Homo sapiens
uucucuuugcugcuggugcuaa

SEQ ID NO: 1809165 - RNA, 14 nt, Homo sapiens
agguucugugcaaa

SEQ ID NO: 1809166 - RNA, 18 nt, Homo sapiens
ucccauucccccagugcg

SEQ ID NO: 1809167 - RNA, 17 nt, Homo sapiens
aaaaugcugcuucuccu

SEQ ID NO: 1809168 - RNA, 20 nt, Homo sapiens
cuacaauuuucucccaggaa

SEQ ID NO: 1809169 - RNA, 23 nt, Homo sapiens
agaggggcuccccgggucucuca

SEQ ID NO: 1809170 - RNA, 14 nt, Homo sapiens
uuuccccuagcuua

SEQ ID NO: 1809171 - RNA, 19 nt, Homo sapiens
cacauggggcugggcagcu

SEQ ID NO: 1809172 - RNA, 22 nt, Homo sapiens
agcgccaaauguucauccucau

SEQ ID NO: 1809173 - RNA, 22 nt, Homo sapiens
cauuuuuaggaagcuagacuag

SEQ ID NO: 1809174 - RNA, 20 nt, Homo sapiens
ugaagucagccacacugggc

SEQ ID NO: 1809175 - RNA, 20 nt, Homo sapiens
caugaagaauguuucuggaa

SEQ ID NO: 1809176 - RNA, 16 nt, Homo sapiens
gcagaacuaccaggug

SEQ ID NO: 1809177 - RNA, 19 nt, Homo sapiens
aaacuagucuguuggcaau

SEQ ID NO: 1809178 - RNA, 19 nt, Homo sapiens
gcuauucuaacuaaugaca

SEQ ID NO: 1809179 - RNA, 18 nt, Homo sapiens
caccuuacuucuucucau

SEQ ID NO: 1809180 - RNA, 21 nt, Homo sapiens
uacagaaagaagcaguucuca

SEQ ID NO: 1809181 - RNA, 20 nt, Homo sapiens
accuucucuuuuauaaucug

SEQ ID NO: 1809182 - RNA, 23 nt, Homo sapiens
agggcccagcggucccugcagaa

SEQ ID NO: 1809183 - RNA, 13 nt, Homo sapiens
uuucaagugccua

SEQ ID NO: 1809184 - RNA, 20 nt, Homo sapiens
uggcggcccuucugacuguu

SEQ ID NO: 1809185 - RNA, 19 nt, Homo sapiens
ugaggauguaaagaucaau

SEQ ID NO: 1809186 - RNA, 22 nt, Homo sapiens
uucuuguugugccccuuuccaa

SEQ ID NO: 1809187 - RNA, 21 nt, Homo sapiens
auucaugugagaaagcuaaaa

SEQ ID NO: 1809188 - RNA, 12 nt, Homo sapiens
ugacucuagcaa

SEQ ID NO: 1809189 - RNA, 14 nt, Homo sapiens
ugaauacuugcuau

SEQ ID NO: 1809190 - RNA, 21 nt, Homo sapiens
gccugcgcccugacaugcuaa

SEQ ID NO: 1809191 - RNA, 19 nt, Homo sapiens
ccugucaauaaauguugaa

SEQ ID NO: 1809192 - RNA, 19 nt, Homo sapiens
uguaauaauaaaaccaaag

SEQ ID NO: 1809193 - RNA, 12 nt, Homo sapiens
aaagcaucucau

SEQ ID NO: 1809194 - RNA, 21 nt, Homo sapiens
ucuuucagacuugccauguga

SEQ ID NO: 1809195 - RNA, 15 nt, Homo sapiens
uguccaggagcuaau

SEQ ID NO: 1809196 - RNA, 16 nt, Homo sapiens
gcgagugcucauuuca

SEQ ID NO: 1809197 - RNA, 16 nt, Homo sapiens
uaugcugcucauccaa

SEQ ID NO: 1809198 - RNA, 16 nt, Homo sapiens
auuuucugaccaaaau

SEQ ID NO: 1809199 - RNA, 19 nt, Homo sapiens
ccucagcuagcucugccaa

SEQ ID NO: 1809200 - RNA, 19 nt, Homo sapiens
cagucccacacuguggcca

SEQ ID NO: 1809201 - RNA, 14 nt, Homo sapiens
ggaaauaaagggau

SEQ ID NO: 1809202 - RNA, 15 nt, Homo sapiens
acaaggaagccaaag

SEQ ID NO: 1809203 - RNA, 14 nt, Homo sapiens
ucauacucaccuca

SEQ ID NO: 1809204 - RNA, 20 nt, Homo sapiens
ccuggcccacugcaucguuu

SEQ ID NO: 1809205 - RNA, 16 nt, Homo sapiens
uuuuccuaugcuauug

SEQ ID NO: 1809206 - RNA, 22 nt, Homo sapiens
ucuugagaccagccugccaggc

SEQ ID NO: 1809207 - RNA, 21 nt, Homo sapiens
acuaaagguggccacaaauuc

SEQ ID NO: 1809208 - RNA, 18 nt, Homo sapiens
gccagaaagcacuacaau

SEQ ID NO: 1809209 - RNA, 17 nt, Homo sapiens
gaaaguaagugguagcu

SEQ ID NO: 1809210 - RNA, 14 nt, Homo sapiens
cuaaaacuucaucu

SEQ ID NO: 1809211 - RNA, 17 nt, Homo sapiens
ucuucugacauuuauca

SEQ ID NO: 1809212 - RNA, 22 nt, Homo sapiens
uacacaaaauacagcacuuuga

SEQ ID NO: 1809213 - RNA, 13 nt, Homo sapiens
uccuuuugaccaa

SEQ ID NO: 1809214 - RNA, 16 nt, Homo sapiens
aaccucuacauauuua

SEQ ID NO: 1809215 - RNA, 20 nt, Homo sapiens
uuugauauaccaaauuaaaa

SEQ ID NO: 1809216 - RNA, 22 nt, Homo sapiens
acuguuaaauaaggccucaucc

SEQ ID NO: 1809217 - RNA, 13 nt, Homo sapiens
ggaagagggcuca

SEQ ID NO: 1809218 - RNA, 15 nt, Homo sapiens
auugagggccaguga

SEQ ID NO: 1809219 - RNA, 20 nt, Homo sapiens
ccacaucacuacaguacagu

SEQ ID NO: 1809220 - RNA, 15 nt, Homo sapiens
cacaaauacauuccu

SEQ ID NO: 1809221 - RNA, 13 nt, Homo sapiens
uuaaucagcauua

SEQ ID NO: 1809222 - RNA, 21 nt, Homo sapiens
aaaguuccaugaauucuugau

SEQ ID NO: 1809223 - RNA, 23 nt, Homo sapiens
gcauauuuauccaaaauguguau

SEQ ID NO: 1809224 - RNA, 24 nt, Homo sapiens
uuugaaaaccaacaccaucacagc

SEQ ID NO: 1809225 - RNA, 17 nt, Homo sapiens
caccccaucggcuucca

SEQ ID NO: 1809226 - RNA, 20 nt, Homo sapiens
acaagcaccucuccugugag

SEQ ID NO: 1809227 - RNA, 23 nt, Homo sapiens
cagagccauggucccaggcuucc

SEQ ID NO: 1809228 - RNA, 23 nt, Homo sapiens
ucaggugccuccaauuggugcuu

SEQ ID NO: 1809229 - RNA, 12 nt, Homo sapiens
aauaguauuuau

SEQ ID NO: 1809230 - RNA, 16 nt, Homo sapiens
gggagagagugcuauu

SEQ ID NO: 1809231 - RNA, 18 nt, Homo sapiens
aggaugguucccuugaug

SEQ ID NO: 1809232 - RNA, 15 nt, Homo sapiens
ucaguauuauucuac

SEQ ID NO: 1809233 - RNA, 15 nt, Homo sapiens
aguuucugugaccug

SEQ ID NO: 1809234 - RNA, 15 nt, Homo sapiens
ucagaaguuugcauc

SEQ ID NO: 1809235 - RNA, 13 nt, Homo sapiens
gagcucacaccgc

SEQ ID NO: 1809236 - RNA, 18 nt, Homo sapiens
cauugaacagcaaaguag

SEQ ID NO: 1809237 - RNA, 16 nt, Homo sapiens
gacugcaaguggccau

SEQ ID NO: 1809238 - RNA, 17 nt, Homo sapiens
gaagaaucugcucugaa

SEQ ID NO: 1809239 - RNA, 21 nt, Homo sapiens
aggucuuaggaauugaauuaa

SEQ ID NO: 1809240 - RNA, 12 nt, Homo sapiens
gcagccaccagc

SEQ ID NO: 1809241 - RNA, 21 nt, Homo sapiens
uuaauaauaccaagacuaagc

SEQ ID NO: 1809242 - RNA, 23 nt, Homo sapiens
augugggguugcugaagaugccu

SEQ ID NO: 1809243 - RNA, 22 nt, Homo sapiens
aguacauggcauugagacaucu

SEQ ID NO: 1809244 - RNA, 19 nt, Homo sapiens
guaguuuauaaaagacugu

SEQ ID NO: 1809245 - RNA, 23 nt, Homo sapiens
auucccuuuugcugccucuaaaa

SEQ ID NO: 1809246 - RNA, 18 nt, Homo sapiens
cagggcauuuugguccaa

SEQ ID NO: 1809247 - RNA, 21 nt, Homo sapiens
cagugcuguggccugggcaag

SEQ ID NO: 1809248 - RNA, 21 nt, Homo sapiens
gagucucccuaaggcaugugu

SEQ ID NO: 1809249 - RNA, 12 nt, Homo sapiens
uguccagaguuu

SEQ ID NO: 1809250 - RNA, 14 nt, Homo sapiens
gacccaccccaacu

SEQ ID NO: 1809251 - RNA, 16 nt, Homo sapiens
uuaggaaauuacaguc

SEQ ID NO: 1809252 - RNA, 21 nt, Homo sapiens
ccccgucgaggggcucucagc

SEQ ID NO: 1809253 - RNA, 15 nt, Homo sapiens
acccagagguggaug

SEQ ID NO: 1809254 - RNA, 12 nt, Homo sapiens
ucccuagcuuau

SEQ ID NO: 1809255 - RNA, 20 nt, Homo sapiens
auucuagucucugauuugca

SEQ ID NO: 1809256 - RNA, 13 nt, Homo sapiens
ccaggaacaagcu

SEQ ID NO: 1809257 - RNA, 12 nt, Homo sapiens
acucauuccugc

SEQ ID NO: 1809258 - RNA, 22 nt, Homo sapiens
agcagacacagguguagaccag

SEQ ID NO: 1809259 - RNA, 19 nt, Homo sapiens
uccucuccugcccagcucu

SEQ ID NO: 1809260 - RNA, 23 nt, Homo sapiens
cucgagcuguuuacagugaugcc

SEQ ID NO: 1809261 - RNA, 22 nt, Homo sapiens
uauaguagacaaagagccagaa

SEQ ID NO: 1809262 - RNA, 23 nt, Homo sapiens
uuugcccauccucccaaucucaa

SEQ ID NO: 1809263 - RNA, 19 nt, Homo sapiens
ccuagcugguuaauggcag

SEQ ID NO: 1809264 - RNA, 22 nt, Homo sapiens
accagccuggucaacaugguga

SEQ ID NO: 1809265 - RNA, 11 nt, Homo sapiens
uaaacuguugu

SEQ ID NO: 1809266 - RNA, 18 nt, Homo sapiens
cuggggacaccagccauc

SEQ ID NO: 1809267 - RNA, 13 nt, Homo sapiens
auaaaacacauca

SEQ ID NO: 1809268 - RNA, 15 nt, Homo sapiens
ugcauuucucugggg

SEQ ID NO: 1809269 - RNA, 13 nt, Homo sapiens
agaucaagccagu

SEQ ID NO: 1809270 - RNA, 22 nt, Homo sapiens
aagacugaauuccaaacauggu

SEQ ID NO: 1809271 - RNA, 18 nt, Homo sapiens
gaaaauauacuugacucu

SEQ ID NO: 1809272 - RNA, 17 nt, Homo sapiens
ggcuaccccacccaagu

SEQ ID NO: 1809273 - RNA, 21 nt, Homo sapiens
cuuuucaaggaaaaaugcugc

SEQ ID NO: 1809274 - RNA, 15 nt, Homo sapiens
agguucugugcaaaa

SEQ ID NO: 1809275 - RNA, 19 nt, Homo sapiens
ccuguuccuuuuucugggu

SEQ ID NO: 1809276 - RNA, 23 nt, Homo sapiens
ccaggagaagaaagaggugaccc

SEQ ID NO: 1809277 - RNA, 20 nt, Homo sapiens
uuccugggugcaucaaacaa

SEQ ID NO: 1809278 - RNA, 21 nt, Homo sapiens
aagaagggaagccuuuugcaa

SEQ ID NO: 1809279 - RNA, 22 nt, Homo sapiens
uauaagcuuuuuucucaauaaa

SEQ ID NO: 1809280 - RNA, 22 nt, Homo sapiens
cucucugagucaaauccagugg

SEQ ID NO: 1809281 - RNA, 17 nt, Homo sapiens
aacaaugguugaaugaa

SEQ ID NO: 1809282 - RNA, 18 nt, Homo sapiens
ucacaugccuugcaaugg

SEQ ID NO: 1809283 - RNA, 22 nt, Homo sapiens
cuguauuugcucccguggagcu

SEQ ID NO: 1809284 - RNA, 17 nt, Homo sapiens
cccuagccagaggcucu

SEQ ID NO: 1809285 - RNA, 18 nt, Homo sapiens
ucagccugggcaacaugg

SEQ ID NO: 1809286 - RNA, 17 nt, Homo sapiens
ucuucccacuuugccac

SEQ ID NO: 1809287 - RNA, 17 nt, Homo sapiens
aguuuuagaaaugagaa

SEQ ID NO: 1809288 - RNA, 17 nt, Homo sapiens
ccgauguggaccucuac

SEQ ID NO: 1809289 - RNA, 23 nt, Homo sapiens
augauaugugcuuguguguaugu

SEQ ID NO: 1809290 - RNA, 22 nt, Homo sapiens
uaggggucuuguuaagugcagu

SEQ ID NO: 1809291 - RNA, 23 nt, Homo sapiens
ugaccaucucuuaggucuaauga

SEQ ID NO: 1809292 - RNA, 14 nt, Homo sapiens
aggcugagaaggaa

SEQ ID NO: 1809293 - RNA, 12 nt, Homo sapiens
uaagguucaaga

SEQ ID NO: 1809294 - RNA, 14 nt, Homo sapiens
aaccgauucaucuc

SEQ ID NO: 1809295 - RNA, 22 nt, Homo sapiens
uggccgggugcgguggcucacg

SEQ ID NO: 1809296 - RNA, 13 nt, Homo sapiens
acccaccacaucu

SEQ ID NO: 1809297 - RNA, 21 nt, Homo sapiens
agggcacggggaccuggauag

SEQ ID NO: 1809298 - RNA, 21 nt, Homo sapiens
uucagacuccagccugaaugu

SEQ ID NO: 1809299 - RNA, 12 nt, Homo sapiens
augaucacagcu

SEQ ID NO: 1809300 - RNA, 21 nt, Homo sapiens
uaggcuuuguaugacagugaa

SEQ ID NO: 1809301 - RNA, 21 nt, Homo sapiens
auuuggccggcucugguggcc

SEQ ID NO: 1809302 - RNA, 11 nt, Homo sapiens
auucaaaugua

SEQ ID NO: 1809303 - RNA, 16 nt, Homo sapiens
agucacagcuacacag

SEQ ID NO: 1809304 - RNA, 23 nt, Homo sapiens
cccaagucuacagagugauagcc

SEQ ID NO: 1809305 - RNA, 13 nt, Homo sapiens
cucuaaccauuca

SEQ ID NO: 1809306 - RNA, 20 nt, Homo sapiens
cccucuucuucuuuccuucc

SEQ ID NO: 1809307 - RNA, 13 nt, Homo sapiens
gaaaaauauucag

SEQ ID NO: 1809308 - RNA, 11 nt, Homo sapiens
ccucauugugu

SEQ ID NO: 1809309 - RNA, 22 nt, Homo sapiens
agcaaauggagaaguucaggaa

SEQ ID NO: 1809310 - RNA, 21 nt, Homo sapiens
cuugaggggaagcuagucuuu

SEQ ID NO: 1809311 - RNA, 22 nt, Homo sapiens
aagcaacauggcuuugaugaua

SEQ ID NO: 1809312 - RNA, 16 nt, Homo sapiens
caaauacuaucuguca

SEQ ID NO: 1809313 - RNA, 19 nt, Homo sapiens
gcucauucuaaugauggcc

SEQ ID NO: 1809314 - RNA, 17 nt, Homo sapiens
agggguaacuugcaccu

SEQ ID NO: 1809315 - RNA, 14 nt, Homo sapiens
uccuccucugugaa

SEQ ID NO: 1809316 - RNA, 20 nt, Homo sapiens
caaaugcacaucucauggca

SEQ ID NO: 1809317 - RNA, 18 nt, Homo sapiens
cagugagauauuugguac

SEQ ID NO: 1809318 - RNA, 21 nt, Homo sapiens
uccuugugccugcuccuguac

SEQ ID NO: 1809319 - RNA, 20 nt, Homo sapiens
ugggagccaaauguggcauu

SEQ ID NO: 1809320 - RNA, 19 nt, Homo sapiens
uaugauauuuugucuccua

SEQ ID NO: 1809321 - RNA, 15 nt, Homo sapiens
cagcccaacugugag

SEQ ID NO: 1809322 - RNA, 22 nt, Homo sapiens
uaacuguauuuuugaagacuau

SEQ ID NO: 1809323 - RNA, 22 nt, Homo sapiens
cagaaagaacgugaucuccuga

SEQ ID NO: 1809324 - RNA, 21 nt, Homo sapiens
ucccaaagugccuucugagcu

SEQ ID NO: 1809325 - RNA, 16 nt, Homo sapiens
gaagacauccugagca

SEQ ID NO: 1809326 - RNA, 22 nt, Homo sapiens
aguaccuuuccauuuauucuuu

SEQ ID NO: 1809327 - RNA, 11 nt, Homo sapiens
cagaaggugac

SEQ ID NO: 1809328 - RNA, 21 nt, Homo sapiens
aacucccauuaaaaacaaaac

SEQ ID NO: 1809329 - RNA, 17 nt, Homo sapiens
cuccuugaccuaugagc

SEQ ID NO: 1809330 - RNA, 22 nt, Homo sapiens
aacucuaacugauguuccacaa

SEQ ID NO: 1809331 - RNA, 13 nt, Homo sapiens
ugcacuacuccuc

SEQ ID NO: 1809332 - RNA, 17 nt, Homo sapiens
guauaguaaucauugac

SEQ ID NO: 1809333 - RNA, 22 nt, Homo sapiens
aaguuccaguguucucucuuau

SEQ ID NO: 1809334 - RNA, 16 nt, Homo sapiens
uuccccaacaguguga

SEQ ID NO: 1809335 - RNA, 22 nt, Homo sapiens
agccuguguuagugucugucca

SEQ ID NO: 1809336 - RNA, 19 nt, Homo sapiens
ugcuugacucuacuauuaa

SEQ ID NO: 1809337 - RNA, 22 nt, Homo sapiens
ugucugaggaguaaguguacaa

SEQ ID NO: 1809338 - RNA, 16 nt, Homo sapiens
uucagggaccguccag

SEQ ID NO: 1809339 - RNA, 16 nt, Homo sapiens
ugaaguuacacaauua

SEQ ID NO: 1809340 - RNA, 18 nt, Homo sapiens
acaucccagacacauuca

SEQ ID NO: 1809341 - RNA, 16 nt, Homo sapiens
caaaaugauacuuacu

SEQ ID NO: 1809342 - RNA, 15 nt, Homo sapiens
gcuagggaguggucu

SEQ ID NO: 1809343 - RNA, 13 nt, Homo sapiens
caaauggggccag

SEQ ID NO: 1809344 - RNA, 13 nt, Homo sapiens
aucuuugcuuguu

SEQ ID NO: 1809345 - RNA, 19 nt, Homo sapiens
uccucauuucuccagauua

SEQ ID NO: 1809346 - RNA, 13 nt, Homo sapiens
caugcugugagca

SEQ ID NO: 1809347 - RNA, 18 nt, Homo sapiens
aauucuucuucucaagca

SEQ ID NO: 1809348 - RNA, 13 nt, Homo sapiens
guuuaacauuuca

SEQ ID NO: 1809349 - RNA, 18 nt, Homo sapiens
cuuuuaauguggcaaguu

SEQ ID NO: 1809350 - RNA, 17 nt, Homo sapiens
uuucaacugugcucuug

SEQ ID NO: 1809351 - RNA, 13 nt, Homo sapiens
uguacuuguuuca

SEQ ID NO: 1809352 - RNA, 21 nt, Homo sapiens
ugcucagaauugcacaucuaa

SEQ ID NO: 1809353 - RNA, 11 nt, Homo sapiens
cauuucuuaga

SEQ ID NO: 1809354 - RNA, 20 nt, Homo sapiens
ccauuacaguguaaaaauuc

SEQ ID NO: 1809355 - RNA, 21 nt, Homo sapiens
ugagcuauugcuguucucuug

SEQ ID NO: 1809356 - RNA, 20 nt, Homo sapiens
acugcauugccgaaguccag

SEQ ID NO: 1809357 - RNA, 22 nt, Homo sapiens
guucuuuaaaauguaaagccau

SEQ ID NO: 1809358 - RNA, 23 nt, Homo sapiens
acaaaggcugacauucacugagu

SEQ ID NO: 1809359 - RNA, 17 nt, Homo sapiens
gaacaaagcagccacga

SEQ ID NO: 1809360 - RNA, 21 nt, Homo sapiens
ggagcaggagccugagccuug

SEQ ID NO: 1809361 - RNA, 22 nt, Homo sapiens
ccugugcugaauguggacucaa

SEQ ID NO: 1809362 - RNA, 14 nt, Homo sapiens
gcccuccugagcac

SEQ ID NO: 1809363 - RNA, 19 nt, Homo sapiens
gugaagucgagcacucuaa

SEQ ID NO: 1809364 - RNA, 15 nt, Homo sapiens
uaaauuaauugugcc

SEQ ID NO: 1809365 - RNA, 14 nt, Homo sapiens
ccugagucccuuaa

SEQ ID NO: 1809366 - RNA, 12 nt, Homo sapiens
aaggggcacugg

SEQ ID NO: 1809367 - RNA, 16 nt, Homo sapiens
uaaaauuaacuggugg

SEQ ID NO: 1809368 - RNA, 17 nt, Homo sapiens
cgugcacacaccagagc

SEQ ID NO: 1809369 - RNA, 17 nt, Homo sapiens
cuagguuuaugacagua

SEQ ID NO: 1809370 - RNA, 17 nt, Homo sapiens
uaugguuucuccaucca

SEQ ID NO: 1809371 - RNA, 12 nt, Homo sapiens
uaucaggagaaa

SEQ ID NO: 1809372 - RNA, 15 nt, Homo sapiens
gaccuucccagcuag

SEQ ID NO: 1809373 - RNA, 13 nt, Homo sapiens
aaaaagaaugugc

SEQ ID NO: 1809374 - RNA, 15 nt, Homo sapiens
gagcccgguguucag

SEQ ID NO: 1809375 - RNA, 18 nt, Homo sapiens
uccacccucaaaugucag

SEQ ID NO: 1809376 - RNA, 23 nt, Homo sapiens
uugcauugugacaagaauuguua

SEQ ID NO: 1809377 - RNA, 18 nt, Homo sapiens
aauauauuucaagcuaua

SEQ ID NO: 1809378 - RNA, 16 nt, Homo sapiens
uaggcaccuaccacca

SEQ ID NO: 1809379 - RNA, 20 nt, Homo sapiens
gggcacagaugggaucacag

SEQ ID NO: 1809380 - RNA, 16 nt, Homo sapiens
caggugacaguggcug

SEQ ID NO: 1809381 - RNA, 23 nt, Homo sapiens
aucaacaagauuuccacaauucu

SEQ ID NO: 1809382 - RNA, 20 nt, Homo sapiens
caugugucauguaauacuga

SEQ ID NO: 1809383 - RNA, 14 nt, Homo sapiens
gccagugucuuucu

SEQ ID NO: 1809384 - RNA, 14 nt, Homo sapiens
cccaguguguuucu

SEQ ID NO: 1809385 - RNA, 20 nt, Homo sapiens
auccccacguggacaagaaa

SEQ ID NO: 1809386 - RNA, 22 nt, Homo sapiens
ugccucauuucuuccucugcau

SEQ ID NO: 1809387 - RNA, 18 nt, Homo sapiens
ugccaauucauuucucua

SEQ ID NO: 1809388 - RNA, 13 nt, Homo sapiens
uggacacacuggu

SEQ ID NO: 1809389 - RNA, 19 nt, Homo sapiens
aacugugcuguacugagca

SEQ ID NO: 1809390 - RNA, 16 nt, Homo sapiens
uaaguggacucucuga

SEQ ID NO: 1809391 - RNA, 23 nt, Homo sapiens
auuuaagguacauggaacacacg

SEQ ID NO: 1809392 - RNA, 15 nt, Homo sapiens
cuuuucauagugcuc

SEQ ID NO: 1809393 - RNA, 17 nt, Homo sapiens
gcagggaugauggcaga

SEQ ID NO: 1809394 - RNA, 19 nt, Homo sapiens
ugaaaguuuucuaaacuca

SEQ ID NO: 1809395 - RNA, 15 nt, Homo sapiens
aggaggcuggugaca

SEQ ID NO: 1809396 - RNA, 21 nt, Homo sapiens
ccuuauaaacagauaaugcuu

SEQ ID NO: 1809397 - RNA, 17 nt, Homo sapiens
cagaguucacccugugc

SEQ ID NO: 1809398 - RNA, 15 nt, Homo sapiens
cugaaauagagugaa

SEQ ID NO: 1809399 - RNA, 24 nt, Homo sapiens
aauaagcuaaacgcaaugucauuu

SEQ ID NO: 1809400 - RNA, 22 nt, Homo sapiens
ggcaggaaucuauccauugaac

SEQ ID NO: 1809401 - RNA, 20 nt, Homo sapiens
ugauuucuaugaacuugucu

SEQ ID NO: 1809402 - RNA, 15 nt, Homo sapiens
augugacuccaagag

SEQ ID NO: 1809403 - RNA, 21 nt, Homo sapiens
cuguguucgacucagccucag

SEQ ID NO: 1809404 - RNA, 13 nt, Homo sapiens
gugucaucuguca

SEQ ID NO: 1809405 - RNA, 13 nt, Homo sapiens
caggcccaguggc

SEQ ID NO: 1809406 - RNA, 13 nt, Homo sapiens
aguccuuaccucg

SEQ ID NO: 1809407 - RNA, 15 nt, Homo sapiens
ugcuucugcaucaaa

SEQ ID NO: 1809408 - RNA, 20 nt, Homo sapiens
gccacaaaacugacaguaaa

SEQ ID NO: 1809409 - RNA, 19 nt, Homo sapiens
gagaggcccggugcagcug

SEQ ID NO: 1809410 - RNA, 14 nt, Homo sapiens
aguuuaaugucucc

SEQ ID NO: 1809411 - RNA, 21 nt, Homo sapiens
cuuucccagucccauuccuca

SEQ ID NO: 1809412 - RNA, 22 nt, Homo sapiens
aaauaguugcugucauccacuu

SEQ ID NO: 1809413 - RNA, 19 nt, Homo sapiens
aagcagccuuacuauucau

SEQ ID NO: 1809414 - RNA, 18 nt, Homo sapiens
ggaccggagagugggggu

SEQ ID NO: 1809415 - RNA, 21 nt, Homo sapiens
ugccacaccagucacaugacc

SEQ ID NO: 1809416 - RNA, 22 nt, Homo sapiens
aguuuugaguguauacaugugu

SEQ ID NO: 1809417 - RNA, 15 nt, Homo sapiens
caccuacugcuuacu

SEQ ID NO: 1809418 - RNA, 18 nt, Homo sapiens
uuccauggauuccccugg

SEQ ID NO: 1809419 - RNA, 21 nt, Homo sapiens
ucuacugaaugaccucucuac

SEQ ID NO: 1809420 - RNA, 13 nt, Homo sapiens
aaaaaaccaaagu

SEQ ID NO: 1809421 - RNA, 18 nt, Homo sapiens
ugcugccgcgcagugugg

SEQ ID NO: 1809422 - RNA, 23 nt, Homo sapiens
acauuugcuuuuugcuuguguac

SEQ ID NO: 1809423 - RNA, 20 nt, Homo sapiens
ucuuuccuaaaccauucacc

SEQ ID NO: 1809424 - RNA, 22 nt, Homo sapiens
aaucuugcucuuccauaaucuu

SEQ ID NO: 1809425 - RNA, 14 nt, Homo sapiens
agugcauugaucau

SEQ ID NO: 1809426 - RNA, 15 nt, Homo sapiens
cuaugugauuacaag

SEQ ID NO: 1809427 - RNA, 15 nt, Homo sapiens
acggugacucugucc

SEQ ID NO: 1809428 - RNA, 17 nt, Homo sapiens
aagucugagauggauug

SEQ ID NO: 1809429 - RNA, 21 nt, Homo sapiens
ugugccaaaccuacuaggcca

SEQ ID NO: 1809430 - RNA, 12 nt, Homo sapiens
gccaacccugug

SEQ ID NO: 1809431 - RNA, 14 nt, Homo sapiens
uacagaacucuuaa

SEQ ID NO: 1809432 - RNA, 23 nt, Homo sapiens
ccuggauuugcauacauucuuca

SEQ ID NO: 1809433 - RNA, 17 nt, Homo sapiens
ucggaucuagccauggc

SEQ ID NO: 1809434 - RNA, 21 nt, Homo sapiens
cauuacgcuaguuaucaugca

SEQ ID NO: 1809435 - RNA, 19 nt, Homo sapiens
ccuuuggaaaauagauuuu

SEQ ID NO: 1809436 - RNA, 15 nt, Homo sapiens
cuacaucuaguuaau

SEQ ID NO: 1809437 - RNA, 18 nt, Homo sapiens
uuuugcugcacacaaucu

SEQ ID NO: 1809438 - RNA, 14 nt, Homo sapiens
auguucugcucaca

SEQ ID NO: 1809439 - RNA, 23 nt, Homo sapiens
gguacucaguaacacagugcagu

SEQ ID NO: 1809440 - RNA, 19 nt, Homo sapiens
uguugaccuuccuucaaga

SEQ ID NO: 1809441 - RNA, 23 nt, Homo sapiens
ggaguugaggucuuucuccucag

SEQ ID NO: 1809442 - RNA, 12 nt, Homo sapiens
ugauagugcaag

SEQ ID NO: 1809443 - RNA, 22 nt, Homo sapiens
ucccugguugccucucuugccc

SEQ ID NO: 1809444 - RNA, 21 nt, Homo sapiens
acugugucagggaacauauuu

SEQ ID NO: 1809445 - RNA, 19 nt, Homo sapiens
gcaaugggauguaugaaua

SEQ ID NO: 1809446 - RNA, 15 nt, Homo sapiens
uguuaaaaucaggau

SEQ ID NO: 1809447 - RNA, 16 nt, Homo sapiens
gggaugauuugccgac

SEQ ID NO: 1809448 - RNA, 16 nt, Homo sapiens
ugaagaguccaagaag

SEQ ID NO: 1809449 - RNA, 22 nt, Homo sapiens
ucuguauuuucaaagacugcca

SEQ ID NO: 1809450 - RNA, 16 nt, Homo sapiens
augggaagacugagcu

SEQ ID NO: 1809451 - RNA, 20 nt, Homo sapiens
aucauaauauaaaacaggau

SEQ ID NO: 1809452 - RNA, 13 nt, Homo sapiens
caaaagucaccca

SEQ ID NO: 1809453 - RNA, 14 nt, Homo sapiens
cugaguuugcacag

SEQ ID NO: 1809454 - RNA, 21 nt, Homo sapiens
agaguauauuuaagaagccaa

SEQ ID NO: 1809455 - RNA, 18 nt, Homo sapiens
guggccaugcuucuugcc

SEQ ID NO: 1809456 - RNA, 22 nt, Homo sapiens
cugguccuucucguuugcucua

SEQ ID NO: 1809457 - RNA, 16 nt, Homo sapiens
uggcaaucaauacagc

SEQ ID NO: 1809458 - RNA, 18 nt, Homo sapiens
cucugagcagacagggcg

SEQ ID NO: 1809459 - RNA, 16 nt, Homo sapiens
ugaggccaggacuuug

SEQ ID NO: 1809460 - RNA, 13 nt, Homo sapiens
uagcaguggugag

SEQ ID NO: 1809461 - RNA, 13 nt, Homo sapiens
gucgagaucucag

SEQ ID NO: 1809462 - RNA, 19 nt, Homo sapiens
agaacugaggucacugggu

SEQ ID NO: 1809463 - RNA, 23 nt, Homo sapiens
aaauggcccggacaugucuugcu

SEQ ID NO: 1809464 - RNA, 23 nt, Homo sapiens
gauaaaacugguuuuagacaaaa

SEQ ID NO: 1809465 - RNA, 23 nt, Homo sapiens
uuuacauguauuuaaaguagcau

SEQ ID NO: 1809466 - RNA, 13 nt, Homo sapiens
uacacuacaaaug

SEQ ID NO: 1809467 - RNA, 16 nt, Homo sapiens
acugcuuuguauccau

SEQ ID NO: 1809468 - RNA, 21 nt, Homo sapiens
accuguauagaccaugcacag

SEQ ID NO: 1809469 - RNA, 21 nt, Homo sapiens
auucaaaacuuucagcuggag

SEQ ID NO: 1809470 - RNA, 19 nt, Homo sapiens
cccucgcaugacuguuaca

SEQ ID NO: 1809471 - RNA, 22 nt, Homo sapiens
uucucccucucaugucccucca

SEQ ID NO: 1809472 - RNA, 17 nt, Homo sapiens
ccacugaugcuguucuc

SEQ ID NO: 1809473 - RNA, 18 nt, Homo sapiens
acaauggucucagccuag

SEQ ID NO: 1809474 - RNA, 15 nt, Homo sapiens
uucaagccugugcaa

SEQ ID NO: 1809475 - RNA, 20 nt, Homo sapiens
cagauggccuggcugcugcu

SEQ ID NO: 1809476 - RNA, 16 nt, Homo sapiens
gaauuaggaaggccau

SEQ ID NO: 1809477 - RNA, 16 nt, Homo sapiens
cuucugggacuggaca

SEQ ID NO: 1809478 - RNA, 23 nt, Homo sapiens
cauaaaauuuacauuuaauacag

SEQ ID NO: 1809479 - RNA, 11 nt, Homo sapiens
cuuaccugcca

SEQ ID NO: 1809480 - RNA, 16 nt, Homo sapiens
cucuggggugcacaug

SEQ ID NO: 1809481 - RNA, 17 nt, Homo sapiens
caauaaauauuugcuaa

SEQ ID NO: 1809482 - RNA, 14 nt, Homo sapiens
gcuuuggucuaucu

SEQ ID NO: 1809483 - RNA, 20 nt, Homo sapiens
aggcccuagcggcagaaagg

SEQ ID NO: 1809484 - RNA, 23 nt, Homo sapiens
uuccuccacugcgcuuacuccuc

SEQ ID NO: 1809485 - RNA, 17 nt, Homo sapiens
cgcuucagagacacaca

SEQ ID NO: 1809486 - RNA, 15 nt, Homo sapiens
gaauucuacuggaaa

SEQ ID NO: 1809487 - RNA, 10 nt, Homo sapiens
acaugggagc

SEQ ID NO: 1809488 - RNA, 17 nt, Homo sapiens
gcuuuauauauggacau

SEQ ID NO: 1809489 - RNA, 14 nt, Homo sapiens
ccaaucauugcaaa

SEQ ID NO: 1809490 - RNA, 15 nt, Homo sapiens
gcuggcugggccuuc

SEQ ID NO: 1809491 - RNA, 18 nt, Homo sapiens
cuguugcccauugcacuu

SEQ ID NO: 1809492 - RNA, 23 nt, Homo sapiens
ccuuuggagcuuuuuucuuuaag

SEQ ID NO: 1809493 - RNA, 13 nt, Homo sapiens
gucaaggacaaaa

SEQ ID NO: 1809494 - RNA, 19 nt, Homo sapiens
gccgagcggggagccagga

SEQ ID NO: 1809495 - RNA, 19 nt, Homo sapiens
caguuauucuugcaaagau

SEQ ID NO: 1809496 - RNA, 18 nt, Homo sapiens
guaaguucugugcaguuu

SEQ ID NO: 1809497 - RNA, 15 nt, Homo sapiens
ggugauauccucuca

SEQ ID NO: 1809498 - RNA, 22 nt, Homo sapiens
uggagaauuuuuggauggugau

SEQ ID NO: 1809499 - RNA, 20 nt, Homo sapiens
aaugaguuuuaaagauguaa

SEQ ID NO: 1809500 - RNA, 19 nt, Homo sapiens
auuaagcuccuucaguuug

SEQ ID NO: 1809501 - RNA, 18 nt, Homo sapiens
gcuguauuuguucaguga

SEQ ID NO: 1809502 - RNA, 23 nt, Homo sapiens
ugacugaggcaguuugaggauua

SEQ ID NO: 1809503 - RNA, 14 nt, Homo sapiens
cuuccuggacacac

SEQ ID NO: 1809504 - RNA, 14 nt, Homo sapiens
agcccaaguucaug

SEQ ID NO: 1809505 - RNA, 15 nt, Homo sapiens
ugaucauugcuggca

SEQ ID NO: 1809506 - RNA, 15 nt, Homo sapiens
caacgauuagcuuuu

SEQ ID NO: 1809507 - RNA, 15 nt, Homo sapiens
acagcuuaaucaaaa

SEQ ID NO: 1809508 - RNA, 20 nt, Homo sapiens
ccugugacauguaacagcca

SEQ ID NO: 1809509 - RNA, 19 nt, Homo sapiens
cuaacugguuaaacauuaa

SEQ ID NO: 1809510 - RNA, 16 nt, Homo sapiens
acuugauuuaaucacc

SEQ ID NO: 1809511 - RNA, 23 nt, Homo sapiens
gaaaugaaagggaaacugggaaa

SEQ ID NO: 1809512 - RNA, 19 nt, Homo sapiens
cagaggaagacuccugaaa

SEQ ID NO: 1809513 - RNA, 18 nt, Homo sapiens
cuccuguucugaaaccuu

SEQ ID NO: 1809514 - RNA, 15 nt, Homo sapiens
uuucugaacuaucag

SEQ ID NO: 1809515 - RNA, 21 nt, Homo sapiens
aagcaucacacaguggcacua

SEQ ID NO: 1809516 - RNA, 23 nt, Homo sapiens
aaauauaauucuuaguggaagac

SEQ ID NO: 1809517 - RNA, 12 nt, Homo sapiens
cacacaacugug

SEQ ID NO: 1809518 - RNA, 23 nt, Homo sapiens
cucuaaauaaacagauacauuca

SEQ ID NO: 1809519 - RNA, 18 nt, Homo sapiens
caaaauuuugucccaucu

SEQ ID NO: 1809520 - RNA, 22 nt, Homo sapiens
acccaccgucucggcccugaac

SEQ ID NO: 1809521 - RNA, 19 nt, Homo sapiens
ucugacucuugccuuucca

SEQ ID NO: 1809522 - RNA, 13 nt, Homo sapiens
cuguguauacaua

SEQ ID NO: 1809523 - RNA, 17 nt, Homo sapiens
cuaacuguaaaucacuu

SEQ ID NO: 1809524 - RNA, 16 nt, Homo sapiens
gguauauacuuugaaa

SEQ ID NO: 1809525 - RNA, 23 nt, Homo sapiens
cucccuuccuuaugcauacugag

SEQ ID NO: 1809526 - RNA, 20 nt, Homo sapiens
agaugggagcccaguuucac

SEQ ID NO: 1809527 - RNA, 19 nt, Homo sapiens
uguaaucacagcuacuugg

SEQ ID NO: 1809528 - RNA, 18 nt, Homo sapiens
uagcugaauugagccuaa

SEQ ID NO: 1809529 - RNA, 22 nt, Homo sapiens
gagucuuaauauauauauccag

SEQ ID NO: 1809530 - RNA, 22 nt, Homo sapiens
cuggaagcugauuaaaacacac

SEQ ID NO: 1809531 - RNA, 18 nt, Homo sapiens
caagccacgaaugaauga

SEQ ID NO: 1809532 - RNA, 23 nt, Homo sapiens
caaaagggccaaagaaccaaaga

SEQ ID NO: 1809533 - RNA, 17 nt, Homo sapiens
gaauuuuacuugcaccu

SEQ ID NO: 1809534 - RNA, 19 nt, Homo sapiens
ugcuuacuaugaccuucca

SEQ ID NO: 1809535 - RNA, 23 nt, Homo sapiens
aaccccugcgcucucuuugcaac

SEQ ID NO: 1809536 - RNA, 19 nt, Homo sapiens
gaaaguuuuuaauauuuau

SEQ ID NO: 1809537 - RNA, 22 nt, Homo sapiens
ccacuccugaccccucuccuca

SEQ ID NO: 1809538 - RNA, 13 nt, Homo sapiens
gaugcacuggccu

SEQ ID NO: 1809539 - RNA, 23 nt, Homo sapiens
agagucacaaguagccucuggga

SEQ ID NO: 1809540 - RNA, 21 nt, Homo sapiens
ucuuuguuauaaaugagguca

SEQ ID NO: 1809541 - RNA, 15 nt, Homo sapiens
gaaaaccagcgcaag

SEQ ID NO: 1809542 - RNA, 21 nt, Homo sapiens
caggggccugcccagugcacu

SEQ ID NO: 1809543 - RNA, 22 nt, Homo sapiens
ggccagccccucccaccacagc

SEQ ID NO: 1809544 - RNA, 13 nt, Homo sapiens
cgcaagaccagcu

SEQ ID NO: 1809545 - RNA, 20 nt, Homo sapiens
ggccaccccuugcucucugu

SEQ ID NO: 1809546 - RNA, 18 nt, Homo sapiens
cugacacauagaaaacaa

SEQ ID NO: 1809547 - RNA, 22 nt, Homo sapiens
cuaauccugaagggaagcccau

SEQ ID NO: 1809548 - RNA, 13 nt, Homo sapiens
gauuugguugguu

SEQ ID NO: 1809549 - RNA, 16 nt, Homo sapiens
uuaagugcaauuaaca

SEQ ID NO: 1809550 - RNA, 13 nt, Homo sapiens
aagcuucucucug

SEQ ID NO: 1809551 - RNA, 19 nt, Homo sapiens
caggugguggcugcaaggu

SEQ ID NO: 1809552 - RNA, 21 nt, Homo sapiens
aaauuaauguaauaaagugaa

SEQ ID NO: 1809553 - RNA, 13 nt, Homo sapiens
acagcaacaauga

SEQ ID NO: 1809554 - RNA, 13 nt, Homo sapiens
aaugaaacacagc

SEQ ID NO: 1809555 - RNA, 17 nt, Homo sapiens
caugcuuaaauauugaa

SEQ ID NO: 1809556 - RNA, 17 nt, Homo sapiens
uaggcacaaaaccagaa

SEQ ID NO: 1809557 - RNA, 22 nt, Homo sapiens
uugcauccaugcccagccaaua

SEQ ID NO: 1809558 - RNA, 22 nt, Homo sapiens
gcugaggcagaacucacugggg

SEQ ID NO: 1809559 - RNA, 16 nt, Homo sapiens
agugcuaagagccucu

SEQ ID NO: 1809560 - RNA, 18 nt, Homo sapiens
auuuaauauuuaugcucu

SEQ ID NO: 1809561 - RNA, 15 nt, Homo sapiens
gccgccaugagcaac

SEQ ID NO: 1809562 - RNA, 16 nt, Homo sapiens
caaugugaaacugaga

SEQ ID NO: 1809563 - RNA, 23 nt, Homo sapiens
gauuuuuggugcaaguagcacau

SEQ ID NO: 1809564 - RNA, 15 nt, Homo sapiens
cccacccccaguuca

SEQ ID NO: 1809565 - RNA, 17 nt, Homo sapiens
ugauaaaugauagacaa

SEQ ID NO: 1809566 - RNA, 11 nt, Homo sapiens
gacagggccag

SEQ ID NO: 1809567 - RNA, 15 nt, Homo sapiens
auacauauuaucuca

SEQ ID NO: 1809568 - RNA, 16 nt, Homo sapiens
auuauauuguccaggc

SEQ ID NO: 1809569 - RNA, 14 nt, Homo sapiens
ggucaaggcaaagc

SEQ ID NO: 1809570 - RNA, 17 nt, Homo sapiens
caggaguuugaauccau

SEQ ID NO: 1809571 - RNA, 22 nt, Homo sapiens
gagaaaaaaaaacacacaaaaa

SEQ ID NO: 1809572 - RNA, 19 nt, Homo sapiens
caugaaaaacaggugacau

SEQ ID NO: 1809573 - RNA, 23 nt, Homo sapiens
aacccuucccucaccuuggcacc

SEQ ID NO: 1809574 - RNA, 21 nt, Homo sapiens
cacacugaaucucaccugcug

SEQ ID NO: 1809575 - RNA, 17 nt, Homo sapiens
gacaaguuccuaggaaa

SEQ ID NO: 1809576 - RNA, 21 nt, Homo sapiens
uagucaccugccccagcacuc

SEQ ID NO: 1809577 - RNA, 17 nt, Homo sapiens
cuaauggucacagagca

SEQ ID NO: 1809578 - RNA, 14 nt, Homo sapiens
cagaccuucacaga

SEQ ID NO: 1809579 - RNA, 16 nt, Homo sapiens
uuguuuaaaugccuaa

SEQ ID NO: 1809580 - RNA, 13 nt, Homo sapiens
cacuccagcauca

SEQ ID NO: 1809581 - RNA, 18 nt, Homo sapiens
caaaacauugaucuggcu

SEQ ID NO: 1809582 - RNA, 22 nt, Homo sapiens
aauggaggugacggcacuccca

SEQ ID NO: 1809583 - RNA, 16 nt, Homo sapiens
aauguuguccaggaaa

SEQ ID NO: 1809584 - RNA, 19 nt, Homo sapiens
uuaagcuauccacagcuua

SEQ ID NO: 1809585 - RNA, 16 nt, Homo sapiens
caugcguccuggucaa

SEQ ID NO: 1809586 - RNA, 18 nt, Homo sapiens
cuacaucaaaugcucaag

SEQ ID NO: 1809587 - RNA, 15 nt, Homo sapiens
agggugauggaacaa

SEQ ID NO: 1809588 - RNA, 19 nt, Homo sapiens
acaucauuccacacuccuu

SEQ ID NO: 1809589 - RNA, 14 nt, Homo sapiens
gauuaaacagacuu

SEQ ID NO: 1809590 - RNA, 16 nt, Homo sapiens
auuucacaagcuauuc

SEQ ID NO: 1809591 - RNA, 23 nt, Homo sapiens
guaugacucccaaauuuucacau

SEQ ID NO: 1809592 - RNA, 22 nt, Homo sapiens
acaaguauucauuuuuucuacc

SEQ ID NO: 1809593 - RNA, 17 nt, Homo sapiens
gggcagcagcaucccag

SEQ ID NO: 1809594 - RNA, 18 nt, Homo sapiens
cuggcuugagugauccuc

SEQ ID NO: 1809595 - RNA, 19 nt, Homo sapiens
gaaacgaaguagaaagggg

SEQ ID NO: 1809596 - RNA, 15 nt, Homo sapiens
aauaaauauuacagu

SEQ ID NO: 1809597 - RNA, 22 nt, Homo sapiens
gacacagcccccacggacaaaa

SEQ ID NO: 1809598 - RNA, 22 nt, Homo sapiens
gucugggaagacuguugugcuc

SEQ ID NO: 1809599 - RNA, 14 nt, Homo sapiens
auugacaguggugg

SEQ ID NO: 1809600 - RNA, 16 nt, Homo sapiens
caaaugaaaaauucca

SEQ ID NO: 1809601 - RNA, 19 nt, Homo sapiens
agauauuagguccauucau

SEQ ID NO: 1809602 - RNA, 16 nt, Homo sapiens
uuauaaacaagaauga

SEQ ID NO: 1809603 - RNA, 12 nt, Homo sapiens
uuugcuguagaa

SEQ ID NO: 1809604 - RNA, 18 nt, Homo sapiens
cugggcucccuugugcgu

SEQ ID NO: 1809605 - RNA, 17 nt, Homo sapiens
gaagaauaucaaauaau

SEQ ID NO: 1809606 - RNA, 16 nt, Homo sapiens
aaauucccaacaaaca

SEQ ID NO: 1809607 - RNA, 16 nt, Homo sapiens
gcacuccauggccacc

SEQ ID NO: 1809608 - RNA, 16 nt, Homo sapiens
caucugcauuucuaca

SEQ ID NO: 1809609 - RNA, 17 nt, Homo sapiens
ggccacuggcaucucug

SEQ ID NO: 1809610 - RNA, 22 nt, Homo sapiens
aguauaaauaaaaugagcaaaa

SEQ ID NO: 1809611 - RNA, 21 nt, Homo sapiens
uggggucuuaggguacagccc

SEQ ID NO: 1809612 - RNA, 14 nt, Homo sapiens
uggaacacugcuga

SEQ ID NO: 1809613 - RNA, 18 nt, Homo sapiens
aaaaucuuuccaucucau

SEQ ID NO: 1809614 - RNA, 18 nt, Homo sapiens
gauauuaacaacaauaac

SEQ ID NO: 1809615 - RNA, 14 nt, Homo sapiens
cugagcaguaccag

SEQ ID NO: 1809616 - RNA, 21 nt, Homo sapiens
ggacaagaggguucacacagc

SEQ ID NO: 1809617 - RNA, 13 nt, Homo sapiens
cacgcagucugcu

SEQ ID NO: 1809618 - RNA, 19 nt, Homo sapiens
ugaggauaucaaaggacaa

SEQ ID NO: 1809619 - RNA, 21 nt, Homo sapiens
gcccacaucccacaugcggcu

SEQ ID NO: 1809620 - RNA, 20 nt, Homo sapiens
acaccaguugcgaagggaaa

SEQ ID NO: 1809621 - RNA, 12 nt, Homo sapiens
ggccgacuccac

SEQ ID NO: 1809622 - RNA, 14 nt, Homo sapiens
ucagccccuaggag

SEQ ID NO: 1809623 - RNA, 16 nt, Homo sapiens
ugggcuuugcugcuua

SEQ ID NO: 1809624 - RNA, 15 nt, Homo sapiens
uuucucccauuuaga

SEQ ID NO: 1809625 - RNA, 15 nt, Homo sapiens
aauauauguaugaaa

SEQ ID NO: 1809626 - RNA, 16 nt, Homo sapiens
auuuuauauguuucuu

SEQ ID NO: 1809627 - RNA, 16 nt, Homo sapiens
auggugauagacugaa

SEQ ID NO: 1809628 - RNA, 13 nt, Homo sapiens
aaaucaucucuca

SEQ ID NO: 1809629 - RNA, 21 nt, Homo sapiens
guaaaacuauauucucagugu

SEQ ID NO: 1809630 - RNA, 18 nt, Homo sapiens
accugagaaauggccaaa

SEQ ID NO: 1809631 - RNA, 15 nt, Homo sapiens
gccuaagcggcuguu

SEQ ID NO: 1809632 - RNA, 14 nt, Homo sapiens
ucugcggccuucca

SEQ ID NO: 1809633 - RNA, 17 nt, Homo sapiens
uguacucuuaggauauu

SEQ ID NO: 1809634 - RNA, 22 nt, Homo sapiens
ggcaaaaucuuguuaaugucau

SEQ ID NO: 1809635 - RNA, 16 nt, Homo sapiens
aacauguaauugcaga

SEQ ID NO: 1809636 - RNA, 20 nt, Homo sapiens
uugggcaaaacccaggacau

SEQ ID NO: 1809637 - RNA, 20 nt, Homo sapiens
acuugggaucugcaagaagg

SEQ ID NO: 1809638 - RNA, 17 nt, Homo sapiens
uuccagcugcugucuuc

SEQ ID NO: 1809639 - RNA, 21 nt, Homo sapiens
cuggccuauuuaucugaucaa

SEQ ID NO: 1809640 - RNA, 16 nt, Homo sapiens
aaauacuuuaacuucc

SEQ ID NO: 1809641 - RNA, 12 nt, Homo sapiens
uguugacauagc

SEQ ID NO: 1809642 - RNA, 18 nt, Homo sapiens
uaaaguuaaaagaaugua

SEQ ID NO: 1809643 - RNA, 17 nt, Homo sapiens
aucuucaaccuuaagga

SEQ ID NO: 1809644 - RNA, 16 nt, Homo sapiens
acuugaaugguuaaua

SEQ ID NO: 1809645 - RNA, 19 nt, Homo sapiens
cauuuucugaaacuaauga

SEQ ID NO: 1809646 - RNA, 22 nt, Homo sapiens
agcaaaagcccuaacuucuuau

SEQ ID NO: 1809647 - RNA, 14 nt, Homo sapiens
ucaggccagccugu

SEQ ID NO: 1809648 - RNA, 23 nt, Homo sapiens
agucacuuccuucagcaucucac

SEQ ID NO: 1809649 - RNA, 15 nt, Homo sapiens
ugugcugccuguggu

SEQ ID NO: 1809650 - RNA, 22 nt, Homo sapiens
auauacuaaaccaacucuaaua

SEQ ID NO: 1809651 - RNA, 18 nt, Homo sapiens
gauauaucuuuauacuua

SEQ ID NO: 1809652 - RNA, 14 nt, Homo sapiens
cagcgggugcugcu

SEQ ID NO: 1809653 - RNA, 15 nt, Homo sapiens
caacaucuugcaaaa

SEQ ID NO: 1809654 - RNA, 15 nt, Homo sapiens
cuccucaaaccacuu

SEQ ID NO: 1809655 - RNA, 17 nt, Homo sapiens
ucccaagggagacugac

SEQ ID NO: 1809656 - RNA, 11 nt, Homo sapiens
gaguugcacau

SEQ ID NO: 1809657 - RNA, 17 nt, Homo sapiens
aaggggugacugaacug

SEQ ID NO: 1809658 - RNA, 13 nt, Homo sapiens
cagagcugccacc

SEQ ID NO: 1809659 - RNA, 19 nt, Homo sapiens
uaauuuuucauuacagugu

SEQ ID NO: 1809660 - RNA, 16 nt, Homo sapiens
aucaagaugugacaug

SEQ ID NO: 1809661 - RNA, 20 nt, Homo sapiens
acuguccagcuuauagucuu

SEQ ID NO: 1809662 - RNA, 18 nt, Homo sapiens
uacauguacaugcauuuu

SEQ ID NO: 1809663 - RNA, 22 nt, Homo sapiens
aacacuucguucgcagagcuuu

SEQ ID NO: 1809664 - RNA, 20 nt, Homo sapiens
cuugcuggaaaacccaaagu

SEQ ID NO: 1809665 - RNA, 14 nt, Homo sapiens
ucuugcucugccac

SEQ ID NO: 1809666 - RNA, 16 nt, Homo sapiens
aucguuucacaucugu

SEQ ID NO: 1809667 - RNA, 19 nt, Homo sapiens
gacacugacuagagugaug

SEQ ID NO: 1809668 - RNA, 19 nt, Homo sapiens
gacugucacggaacagauc

SEQ ID NO: 1809669 - RNA, 18 nt, Homo sapiens
cuuuaauagaaguuuuau

SEQ ID NO: 1809670 - RNA, 16 nt, Homo sapiens
cuuauagaaaguucaa

SEQ ID NO: 1809671 - RNA, 14 nt, Homo sapiens
caacuguugccagg

SEQ ID NO: 1809672 - RNA, 15 nt, Homo sapiens
auccuacuacuuugu

SEQ ID NO: 1809673 - RNA, 16 nt, Homo sapiens
uacuuuuuguauuuag

SEQ ID NO: 1809674 - RNA, 14 nt, Homo sapiens
uuugugauugccau

SEQ ID NO: 1809675 - RNA, 17 nt, Homo sapiens
uaucacauuuaccauaa

SEQ ID NO: 1809676 - RNA, 17 nt, Homo sapiens
cauugccaauauccugu

SEQ ID NO: 1809677 - RNA, 22 nt, Homo sapiens
cuacgaaaugcuugcucaggcu

SEQ ID NO: 1809678 - RNA, 18 nt, Homo sapiens
cagucuggaucguuugac

SEQ ID NO: 1809679 - RNA, 22 nt, Homo sapiens
augcuucugagagcaaagggaa

SEQ ID NO: 1809680 - RNA, 17 nt, Homo sapiens
gcaaagaaaacacacaa

SEQ ID NO: 1809681 - RNA, 14 nt, Homo sapiens
gcccagacccagug

SEQ ID NO: 1809682 - RNA, 14 nt, Homo sapiens
gcccugacccagag

SEQ ID NO: 1809683 - RNA, 17 nt, Homo sapiens
gcucaaugcaugaaucu

SEQ ID NO: 1809684 - RNA, 23 nt, Homo sapiens
gaaagaaguguggggauuuucac

SEQ ID NO: 1809685 - RNA, 21 nt, Homo sapiens
aauacaucuccaguacauucc

SEQ ID NO: 1809686 - RNA, 19 nt, Homo sapiens
cugcucauccccaccuguc

SEQ ID NO: 1809687 - RNA, 19 nt, Homo sapiens
ucuaaguuuuguguacaga

SEQ ID NO: 1809688 - RNA, 17 nt, Homo sapiens
aacccccuuacugugcg

SEQ ID NO: 1809689 - RNA, 18 nt, Homo sapiens
cucauuuaagaauuugaa

SEQ ID NO: 1809690 - RNA, 14 nt, Homo sapiens
ucauauaagcuaua

SEQ ID NO: 1809691 - RNA, 16 nt, Homo sapiens
caugccacaaggacuu

SEQ ID NO: 1809692 - RNA, 13 nt, Homo sapiens
uuuaaugcaauga

SEQ ID NO: 1809693 - RNA, 20 nt, Homo sapiens
uggugaaaaccccaucucua

SEQ ID NO: 1809694 - RNA, 13 nt, Homo sapiens
auucuucuuccaa

SEQ ID NO: 1809695 - RNA, 23 nt, Homo sapiens
cuuucuugugcccugggccaaaa

SEQ ID NO: 1809696 - RNA, 16 nt, Homo sapiens
gcccaaggugcugaug

SEQ ID NO: 1809697 - RNA, 17 nt, Homo sapiens
aggcccacuguccagca

SEQ ID NO: 1809698 - RNA, 14 nt, Homo sapiens
aucugugaagccuu

SEQ ID NO: 1809699 - RNA, 19 nt, Homo sapiens
uugaaaagcaaaucuguau

SEQ ID NO: 1809700 - RNA, 16 nt, Homo sapiens
cagugacacuggacca

SEQ ID NO: 1809701 - RNA, 15 nt, Homo sapiens
aauggugaauggauu

SEQ ID NO: 1809702 - RNA, 16 nt, Homo sapiens
ucaaaccuuugccaac

SEQ ID NO: 1809703 - RNA, 23 nt, Homo sapiens
gcacuuauaagaaagaucaaaga

SEQ ID NO: 1809704 - RNA, 21 nt, Homo sapiens
uaucaucggaguugacaguga

SEQ ID NO: 1809705 - RNA, 15 nt, Homo sapiens
ugccccucucucagu

SEQ ID NO: 1809706 - RNA, 21 nt, Homo sapiens
acggagcucacccaugugcac

SEQ ID NO: 1809707 - RNA, 22 nt, Homo sapiens
uuugagacaaaguuuugcucuu

SEQ ID NO: 1809708 - RNA, 15 nt, Homo sapiens
gcaaauauacaauga

SEQ ID NO: 1809709 - RNA, 22 nt, Homo sapiens
ccugucagauccaggagcucca

SEQ ID NO: 1809710 - RNA, 18 nt, Homo sapiens
accugcaguuccugagua

SEQ ID NO: 1809711 - RNA, 20 nt, Homo sapiens
cuguucucauuuuauugcua

SEQ ID NO: 1809712 - RNA, 18 nt, Homo sapiens
aaauguucaagauaucag

SEQ ID NO: 1809713 - RNA, 14 nt, Homo sapiens
auugaaaagcacag

SEQ ID NO: 1809714 - RNA, 14 nt, Homo sapiens
auugagaagcacaa

SEQ ID NO: 1809715 - RNA, 17 nt, Homo sapiens
aaucuaugugcaccguu

SEQ ID NO: 1809716 - RNA, 14 nt, Homo sapiens
aucugucuuuccac

SEQ ID NO: 1809717 - RNA, 21 nt, Homo sapiens
uuuuacuuuuuuuuaugauca

SEQ ID NO: 1809718 - RNA, 17 nt, Homo sapiens
cuuucugaucuucacua

SEQ ID NO: 1809719 - RNA, 21 nt, Homo sapiens
gaaccuucauaugugcaguau

SEQ ID NO: 1809720 - RNA, 15 nt, Homo sapiens
gccucuuaucacugg

SEQ ID NO: 1809721 - RNA, 19 nt, Homo sapiens
caaggaguaacaaaacagc

SEQ ID NO: 1809722 - RNA, 13 nt, Homo sapiens
auaugccagugac

SEQ ID NO: 1809723 - RNA, 16 nt, Homo sapiens
acauauucaagugaua

SEQ ID NO: 1809724 - RNA, 15 nt, Homo sapiens
cacacaacagcagau

SEQ ID NO: 1809725 - RNA, 13 nt, Homo sapiens
cugucucuaaaaa

SEQ ID NO: 1809726 - RNA, 13 nt, Homo sapiens
uaagaugugaaaa

SEQ ID NO: 1809727 - RNA, 21 nt, Homo sapiens
ugagccacugcgcccgggcaa

SEQ ID NO: 1809728 - RNA, 21 nt, Homo sapiens
cagccaguuuuacugugauuc

SEQ ID NO: 1809729 - RNA, 17 nt, Homo sapiens
uaaccccaggcacuguu

SEQ ID NO: 1809730 - RNA, 21 nt, Homo sapiens
uagacaucuaccuauacuuaa

SEQ ID NO: 1809731 - RNA, 20 nt, Homo sapiens
cccuccucugcuugccaucc

SEQ ID NO: 1809732 - RNA, 18 nt, Homo sapiens
ccuugucucuacuaaaaa

SEQ ID NO: 1809733 - RNA, 20 nt, Homo sapiens
ugugcagguuuugaaaaugu

SEQ ID NO: 1809734 - RNA, 15 nt, Homo sapiens
cccagcuagaauuca

SEQ ID NO: 1809735 - RNA, 17 nt, Homo sapiens
cauucugacucauaucc

SEQ ID NO: 1809736 - RNA, 19 nt, Homo sapiens
acacaaguggguaguguca

SEQ ID NO: 1809737 - RNA, 14 nt, Homo sapiens
uacuuacacuguau

SEQ ID NO: 1809738 - RNA, 14 nt, Homo sapiens
agacuucuuugcaa

SEQ ID NO: 1809739 - RNA, 20 nt, Homo sapiens
guucccccuccuccaucucu

SEQ ID NO: 1809740 - RNA, 21 nt, Homo sapiens
ugagaagagugaggcagcgcc

SEQ ID NO: 1809741 - RNA, 21 nt, Homo sapiens
aauuccaucaucacuuuggac

SEQ ID NO: 1809742 - RNA, 13 nt, Homo sapiens
caggcucugacca

SEQ ID NO: 1809743 - RNA, 13 nt, Homo sapiens
ggccucaucucag

SEQ ID NO: 1809744 - RNA, 13 nt, Homo sapiens
agagcaucucugc

SEQ ID NO: 1809745 - RNA, 14 nt, Homo sapiens
acagugcuguguac

SEQ ID NO: 1809746 - RNA, 22 nt, Homo sapiens
cucccucacccaggcacugggc

SEQ ID NO: 1809747 - RNA, 22 nt, Homo sapiens
aagaaauggaaucagcuuuuaa

SEQ ID NO: 1809748 - RNA, 14 nt, Homo sapiens
aacauagcagaccu

SEQ ID NO: 1809749 - RNA, 14 nt, Homo sapiens
ucuauuuguacaau

SEQ ID NO: 1809750 - RNA, 18 nt, Homo sapiens
aaauaccuuggcugaugu

SEQ ID NO: 1809751 - RNA, 16 nt, Homo sapiens
cuccccagccaggugc

SEQ ID NO: 1809752 - RNA, 21 nt, Homo sapiens
uuuucucccaggaagcuuuga

SEQ ID NO: 1809753 - RNA, 17 nt, Homo sapiens
uauaauucacucaagca

SEQ ID NO: 1809754 - RNA, 14 nt, Homo sapiens
cccugacaugcaca

SEQ ID NO: 1809755 - RNA, 19 nt, Homo sapiens
gggaccccgagaacccuga

SEQ ID NO: 1809756 - RNA, 20 nt, Homo sapiens
uucccauuuuggaaccuaau

SEQ ID NO: 1809757 - RNA, 20 nt, Homo sapiens
cuccugaguagcugagacua

SEQ ID NO: 1809758 - RNA, 23 nt, Homo sapiens
ucuagacauggagguucuaaggc

SEQ ID NO: 1809759 - RNA, 23 nt, Homo sapiens
caauuucuugcucuaucucucaa

SEQ ID NO: 1809760 - RNA, 18 nt, Homo sapiens
gucuccaucucugucuca

SEQ ID NO: 1809761 - RNA, 20 nt, Homo sapiens
cagacucccacucaguacug

SEQ ID NO: 1809762 - RNA, 17 nt, Homo sapiens
agcagagugcacagcug

SEQ ID NO: 1809763 - RNA, 19 nt, Homo sapiens
cgagaccuucacagagaca

SEQ ID NO: 1809764 - RNA, 22 nt, Homo sapiens
aagaaacacagcaugcauuuag

SEQ ID NO: 1809765 - RNA, 16 nt, Homo sapiens
aggaggcacugcucau

SEQ ID NO: 1809766 - RNA, 22 nt, Homo sapiens
acacauuucuuugaauuuaggu

SEQ ID NO: 1809767 - RNA, 15 nt, Homo sapiens
gccccaggaccagcu

SEQ ID NO: 1809768 - RNA, 21 nt, Homo sapiens
cugagaucuauauggagcuua

SEQ ID NO: 1809769 - RNA, 16 nt, Homo sapiens
uauuccuaugacaaaa

SEQ ID NO: 1809770 - RNA, 22 nt, Homo sapiens
cuggaauuuucauacacguaaa

SEQ ID NO: 1809771 - RNA, 13 nt, Homo sapiens
cccaaaccuagcu

SEQ ID NO: 1809772 - RNA, 21 nt, Homo sapiens
cuuugaaugcuaagaaugcau

SEQ ID NO: 1809773 - RNA, 20 nt, Homo sapiens
gaccugauguccauucaucc

SEQ ID NO: 1809774 - RNA, 22 nt, Homo sapiens
uuguauaaacauaaacuguaug

SEQ ID NO: 1809775 - RNA, 19 nt, Homo sapiens
uaguguaacacugcaagaa

SEQ ID NO: 1809776 - RNA, 13 nt, Homo sapiens
uuaaacaguuaca

SEQ ID NO: 1809777 - RNA, 14 nt, Homo sapiens
acacuuuuccacau

SEQ ID NO: 1809778 - RNA, 16 nt, Homo sapiens
cgugugaacugcaaca

SEQ ID NO: 1809779 - RNA, 18 nt, Homo sapiens
cuugugguuuaugucauc

SEQ ID NO: 1809780 - RNA, 15 nt, Homo sapiens
ucucaaaaaccacag

SEQ ID NO: 1809781 - RNA, 15 nt, Homo sapiens
caguuccaaaagaga

SEQ ID NO: 1809782 - RNA, 19 nt, Homo sapiens
guaaaaugcacccaucagu

SEQ ID NO: 1809783 - RNA, 19 nt, Homo sapiens
acaugcccacaacuuguca

SEQ ID NO: 1809784 - RNA, 20 nt, Homo sapiens
gcugacaccuaacucuucuu

SEQ ID NO: 1809785 - RNA, 21 nt, Homo sapiens
cucaccuguguguacaccagc

SEQ ID NO: 1809786 - RNA, 15 nt, Homo sapiens
agcuccacucugacu

SEQ ID NO: 1809787 - RNA, 18 nt, Homo sapiens
ugaagguauuggccuguu

SEQ ID NO: 1809788 - RNA, 21 nt, Homo sapiens
aacacacuuuggucauuucuc

SEQ ID NO: 1809789 - RNA, 14 nt, Homo sapiens
auaaaaguguccau

SEQ ID NO: 1809790 - RNA, 19 nt, Homo sapiens
ugcaucucuuuagauccaa

SEQ ID NO: 1809791 - RNA, 15 nt, Homo sapiens
acauaaaugcacaaa

SEQ ID NO: 1809792 - RNA, 13 nt, Homo sapiens
caaaugcaaaaau

SEQ ID NO: 1809793 - RNA, 15 nt, Homo sapiens
cccuccccugccauu

SEQ ID NO: 1809794 - RNA, 11 nt, Homo sapiens
ugcuuuggacu

SEQ ID NO: 1809795 - RNA, 20 nt, Homo sapiens
caaacaugaauccugugaua

SEQ ID NO: 1809796 - RNA, 22 nt, Homo sapiens
ugagacaaaauuuuaguccaaa

SEQ ID NO: 1809797 - RNA, 23 nt, Homo sapiens
augcugggccgggguguggaauc

SEQ ID NO: 1809798 - RNA, 22 nt, Homo sapiens
gauuccauuuuacuuccaugau

SEQ ID NO: 1809799 - RNA, 21 nt, Homo sapiens
aaauccuuagaucuggcaugu

SEQ ID NO: 1809800 - RNA, 22 nt, Homo sapiens
uucaaaauuuuguaaauaugca

SEQ ID NO: 1809801 - RNA, 15 nt, Homo sapiens
caaguaacucaguga

SEQ ID NO: 1809802 - RNA, 16 nt, Homo sapiens
aggaaggaaaugacac

SEQ ID NO: 1809803 - RNA, 21 nt, Homo sapiens
cugugguuugcuccagaauua

SEQ ID NO: 1809804 - RNA, 21 nt, Homo sapiens
agaccuguaucaaacugcuuu

SEQ ID NO: 1809805 - RNA, 18 nt, Homo sapiens
ccaggcaucccaucccuu

SEQ ID NO: 1809806 - RNA, 23 nt, Homo sapiens
cuggugugugccucauugcuugg

SEQ ID NO: 1809807 - RNA, 20 nt, Homo sapiens
aagaaagugcgaguccucca

SEQ ID NO: 1809808 - RNA, 14 nt, Homo sapiens
ugacaaaagaaaau

SEQ ID NO: 1809809 - RNA, 15 nt, Homo sapiens
ucuucucguuuucac

SEQ ID NO: 1809810 - RNA, 19 nt, Homo sapiens
cuuguaaggcauacugccu

SEQ ID NO: 1809811 - RNA, 22 nt, Homo sapiens
auguggaccuuagaauacaguu

SEQ ID NO: 1809812 - RNA, 21 nt, Homo sapiens
uaccauggugaauuaaucacu

SEQ ID NO: 1809813 - RNA, 22 nt, Homo sapiens
uuaauggucaaugcuagcacaa

SEQ ID NO: 1809814 - RNA, 13 nt, Homo sapiens
ggcuggagggcug

SEQ ID NO: 1809815 - RNA, 13 nt, Homo sapiens
acagagagacaga

SEQ ID NO: 1809816 - RNA, 15 nt, Homo sapiens
uaugaugcuguugcc

SEQ ID NO: 1809817 - RNA, 16 nt, Homo sapiens
uugccagucacuccgu

SEQ ID NO: 1809818 - RNA, 16 nt, Homo sapiens
uuccuauacaguucua

SEQ ID NO: 1809819 - RNA, 13 nt, Homo sapiens
ggaggcaucugca

SEQ ID NO: 1809820 - RNA, 16 nt, Homo sapiens
acaaggcccuucagcc

SEQ ID NO: 1809821 - RNA, 14 nt, Homo sapiens
uucauuauguauga

SEQ ID NO: 1809822 - RNA, 15 nt, Homo sapiens
cagcauguccaacau

SEQ ID NO: 1809823 - RNA, 17 nt, Homo sapiens
guaaagauaaaaggaua

SEQ ID NO: 1809824 - RNA, 20 nt, Homo sapiens
uggagaugcagcuacuggaa

SEQ ID NO: 1809825 - RNA, 20 nt, Homo sapiens
uuugaagccguccaagaaca

SEQ ID NO: 1809826 - RNA, 16 nt, Homo sapiens
cggaagucuguucuca

SEQ ID NO: 1809827 - RNA, 22 nt, Homo sapiens
ucuagauccuaugugaaaagaa

SEQ ID NO: 1809828 - RNA, 14 nt, Homo sapiens
ggaacagaugcuaa

SEQ ID NO: 1809829 - RNA, 19 nt, Homo sapiens
cuaaauuguuguaauugca

SEQ ID NO: 1809830 - RNA, 12 nt, Homo sapiens
aaacacugccuu

SEQ ID NO: 1809831 - RNA, 14 nt, Homo sapiens
acggagucuugccc

SEQ ID NO: 1809832 - RNA, 22 nt, Homo sapiens
aucuucgggaccaggauuugca

SEQ ID NO: 1809833 - RNA, 18 nt, Homo sapiens
aauccaugagauagcuau

SEQ ID NO: 1809834 - RNA, 16 nt, Homo sapiens
ugcgagugugugcaug

SEQ ID NO: 1809835 - RNA, 14 nt, Homo sapiens
uaauagcagaaaua

SEQ ID NO: 1809836 - RNA, 12 nt, Homo sapiens
gauaucuucucc

SEQ ID NO: 1809837 - RNA, 15 nt, Homo sapiens
ugugaaguaugcacu

SEQ ID NO: 1809838 - RNA, 16 nt, Homo sapiens
uuuuucuaagguucuc

SEQ ID NO: 1809839 - RNA, 15 nt, Homo sapiens
ccacccacaaucaca

SEQ ID NO: 1809840 - RNA, 16 nt, Homo sapiens
aguguuuuuucuguca

SEQ ID NO: 1809841 - RNA, 18 nt, Homo sapiens
ucacacagaaaaauuccg

SEQ ID NO: 1809842 - RNA, 20 nt, Homo sapiens
uccuuucaccccauccacau

SEQ ID NO: 1809843 - RNA, 22 nt, Homo sapiens
accauccagaggaauaaaaagg

SEQ ID NO: 1809844 - RNA, 22 nt, Homo sapiens
uuauaagugagagaaaugaagu

SEQ ID NO: 1809845 - RNA, 23 nt, Homo sapiens
uagauauccaggcuuaccaaagu

SEQ ID NO: 1809846 - RNA, 14 nt, Homo sapiens
augucuacugcuug

SEQ ID NO: 1809847 - RNA, 13 nt, Homo sapiens
uccaaauuucuca

SEQ ID NO: 1809848 - RNA, 14 nt, Homo sapiens
ugcuggauacugga

SEQ ID NO: 1809849 - RNA, 13 nt, Homo sapiens
cugaugacuccuc

SEQ ID NO: 1809850 - RNA, 16 nt, Homo sapiens
ugcuauugacaaguca

SEQ ID NO: 1809851 - RNA, 21 nt, Homo sapiens
agaucuuuguguccagaguuu

SEQ ID NO: 1809852 - RNA, 18 nt, Homo sapiens
agcgucaggccuaccuca

SEQ ID NO: 1809853 - RNA, 20 nt, Homo sapiens
agccuggcucuaucuuccuc

SEQ ID NO: 1809854 - RNA, 19 nt, Homo sapiens
gcccauaucuacaguacuu

SEQ ID NO: 1809855 - RNA, 18 nt, Homo sapiens
acuacaggugcaagccac

SEQ ID NO: 1809856 - RNA, 12 nt, Homo sapiens
uuacaaacugca

SEQ ID NO: 1809857 - RNA, 15 nt, Homo sapiens
aauaagaucagacuc

SEQ ID NO: 1809858 - RNA, 16 nt, Homo sapiens
aacuaugacuggagua

SEQ ID NO: 1809859 - RNA, 12 nt, Homo sapiens
cucaguuuucaa

SEQ ID NO: 1809860 - RNA, 19 nt, Homo sapiens
ucauguuucugcaguauuc

SEQ ID NO: 1809861 - RNA, 19 nt, Homo sapiens
agcuccacacccucuccca

SEQ ID NO: 1809862 - RNA, 13 nt, Homo sapiens
aaaccaugacaaa

SEQ ID NO: 1809863 - RNA, 20 nt, Homo sapiens
ugacugcucagaacuugcug

SEQ ID NO: 1809864 - RNA, 13 nt, Homo sapiens
uacagauagucaa

SEQ ID NO: 1809865 - RNA, 22 nt, Homo sapiens
agaaagguugauguauuuagcu

SEQ ID NO: 1809866 - RNA, 15 nt, Homo sapiens
cuucuagaaucucgu

SEQ ID NO: 1809867 - RNA, 14 nt, Homo sapiens
gaauuuuaccauuc

SEQ ID NO: 1809868 - RNA, 11 nt, Homo sapiens
caucaccacug

SEQ ID NO: 1809869 - RNA, 11 nt, Homo sapiens
gaucaccagug

SEQ ID NO: 1809870 - RNA, 19 nt, Homo sapiens
ugcuguucuucaguccuuu

SEQ ID NO: 1809871 - RNA, 18 nt, Homo sapiens
ucaaagaaucaccuaauu

SEQ ID NO: 1809872 - RNA, 15 nt, Homo sapiens
auguggaaaagccaa

SEQ ID NO: 1809873 - RNA, 21 nt, Homo sapiens
aaggacuguaagcagauuaca

SEQ ID NO: 1809874 - RNA, 13 nt, Homo sapiens
cacuacaccacac

SEQ ID NO: 1809875 - RNA, 18 nt, Homo sapiens
caaaauguuaguggcaua

SEQ ID NO: 1809876 - RNA, 17 nt, Homo sapiens
cagauggaaaagggaga

SEQ ID NO: 1809877 - RNA, 14 nt, Homo sapiens
guuaauauacccca

SEQ ID NO: 1809878 - RNA, 13 nt, Homo sapiens
gguaggcauucca

SEQ ID NO: 1809879 - RNA, 20 nt, Homo sapiens
gagucuugcuauauugccca

SEQ ID NO: 1809880 - RNA, 21 nt, Homo sapiens
acuugggagguugaagcagaa

SEQ ID NO: 1809881 - RNA, 21 nt, Homo sapiens
gugucacuacucacagucucu

SEQ ID NO: 1809882 - RNA, 14 nt, Homo sapiens
auucauguggaaua

SEQ ID NO: 1809883 - RNA, 17 nt, Homo sapiens
gauggaaaaagcgcugu

SEQ ID NO: 1809884 - RNA, 16 nt, Homo sapiens
aaggcaggcagggcuc

SEQ ID NO: 1809885 - RNA, 17 nt, Homo sapiens
caggggcugacaaugcg

SEQ ID NO: 1809886 - RNA, 18 nt, Homo sapiens
caaacccacccauaccag

SEQ ID NO: 1809887 - RNA, 23 nt, Homo sapiens
ccggguaccgugcaugugcaguc

SEQ ID NO: 1809888 - RNA, 19 nt, Homo sapiens
aauacaacagugcauuuac

SEQ ID NO: 1809889 - RNA, 12 nt, Homo sapiens
aaacaucugcac

SEQ ID NO: 1809890 - RNA, 20 nt, Homo sapiens
acagacacaauauguaugcu

SEQ ID NO: 1809891 - RNA, 14 nt, Homo sapiens
uaacauagauuuaa

SEQ ID NO: 1809892 - RNA, 18 nt, Homo sapiens
gacauugauuucuaauga

SEQ ID NO: 1809893 - RNA, 22 nt, Homo sapiens
aagcagggacuugaacccauau

SEQ ID NO: 1809894 - RNA, 21 nt, Homo sapiens
cagcaaagucuccaacaauaa

SEQ ID NO: 1809895 - RNA, 22 nt, Homo sapiens
cugggcuucuguccaaggcaca

SEQ ID NO: 1809896 - RNA, 21 nt, Homo sapiens
caucauuuugagaaugcugac

SEQ ID NO: 1809897 - RNA, 13 nt, Homo sapiens
caccuuucugcac

SEQ ID NO: 1809898 - RNA, 18 nt, Homo sapiens
gccacugcacuccagccu

SEQ ID NO: 1809899 - RNA, 18 nt, Homo sapiens
gucucaugugguccuccu

SEQ ID NO: 1809900 - RNA, 16 nt, Homo sapiens
agcaggguacccuuug

SEQ ID NO: 1809901 - RNA, 21 nt, Homo sapiens
caaaggcauccauagugcacu

SEQ ID NO: 1809902 - RNA, 17 nt, Homo sapiens
aaauucagcauuugacc

SEQ ID NO: 1809903 - RNA, 12 nt, Homo sapiens
cuuguaugcuuc

SEQ ID NO: 1809904 - RNA, 12 nt, Homo sapiens
ucaguaugucac

SEQ ID NO: 1809905 - RNA, 12 nt, Homo sapiens
guacaucuggcc

SEQ ID NO: 1809906 - RNA, 20 nt, Homo sapiens
cccaaggcgauauaagcaaa

SEQ ID NO: 1809907 - RNA, 21 nt, Homo sapiens
ucccagggaccagcaccuuca

SEQ ID NO: 1809908 - RNA, 16 nt, Homo sapiens
aauaaaguguaacaau

SEQ ID NO: 1809909 - RNA, 18 nt, Homo sapiens
ugcucuaagaagcugcaa

SEQ ID NO: 1809910 - RNA, 16 nt, Homo sapiens
ugccgauuucaggggc

SEQ ID NO: 1809911 - RNA, 19 nt, Homo sapiens
caagcacaaagcucaagau

SEQ ID NO: 1809912 - RNA, 19 nt, Homo sapiens
cagcuauaccucauucaca

SEQ ID NO: 1809913 - RNA, 19 nt, Homo sapiens
ggagaaagacuuccuugca

SEQ ID NO: 1809914 - RNA, 14 nt, Homo sapiens
uuuaauuaugccuu

SEQ ID NO: 1809915 - RNA, 17 nt, Homo sapiens
uguaagaaguuucuuaa

SEQ ID NO: 1809916 - RNA, 18 nt, Homo sapiens
gagagcccucugcugcuu

SEQ ID NO: 1809917 - RNA, 21 nt, Homo sapiens
ggccuuaaaauuacuuggcuu

SEQ ID NO: 1809918 - RNA, 14 nt, Homo sapiens
acucuucaaggcca

SEQ ID NO: 1809919 - RNA, 23 nt, Homo sapiens
cugguuagaaaaaggacucugcu

SEQ ID NO: 1809920 - RNA, 17 nt, Homo sapiens
cccggagaaacugaggu

SEQ ID NO: 1809921 - RNA, 21 nt, Homo sapiens
ugcagacguuaugaucuugcu

SEQ ID NO: 1809922 - RNA, 21 nt, Homo sapiens
gggcaccuugaaaaaagaaca

SEQ ID NO: 1809923 - RNA, 14 nt, Homo sapiens
gugaggggcucucu

SEQ ID NO: 1809924 - RNA, 12 nt, Homo sapiens
aaaacaaugaag

SEQ ID NO: 1809925 - RNA, 16 nt, Homo sapiens
uccccuccacauccca

SEQ ID NO: 1809926 - RNA, 17 nt, Homo sapiens
ggaaaggaauccacauc

SEQ ID NO: 1809927 - RNA, 16 nt, Homo sapiens
aggaaaacacagccuc

SEQ ID NO: 1809928 - RNA, 16 nt, Homo sapiens
auuguucaucaugaca

SEQ ID NO: 1809929 - RNA, 18 nt, Homo sapiens
caucauagcaagaccuca

SEQ ID NO: 1809930 - RNA, 22 nt, Homo sapiens
uacuauacagcauaccacgcca

SEQ ID NO: 1809931 - RNA, 18 nt, Homo sapiens
ugucuauuugcacaagau

SEQ ID NO: 1809932 - RNA, 21 nt, Homo sapiens
ucauaguuacuuacugccuua

SEQ ID NO: 1809933 - RNA, 13 nt, Homo sapiens
cuaacuagcuugg

SEQ ID NO: 1809934 - RNA, 12 nt, Homo sapiens
cuuacacauaau

SEQ ID NO: 1809935 - RNA, 17 nt, Homo sapiens
auaccaccuccaccgcu

SEQ ID NO: 1809936 - RNA, 12 nt, Homo sapiens
cauucacauuaa

SEQ ID NO: 1809937 - RNA, 16 nt, Homo sapiens
uccuauuccuugcuua

SEQ ID NO: 1809938 - RNA, 15 nt, Homo sapiens
cagccuccuccuccg

SEQ ID NO: 1809939 - RNA, 19 nt, Homo sapiens
accucacccuggggccaga

SEQ ID NO: 1809940 - RNA, 23 nt, Homo sapiens
accagcuuuugcggagauuuuga

SEQ ID NO: 1809941 - RNA, 23 nt, Homo sapiens
aagcugcuggaaaccucaugcca

SEQ ID NO: 1809942 - RNA, 18 nt, Homo sapiens
aacauuucaguugccauu

SEQ ID NO: 1809943 - RNA, 20 nt, Homo sapiens
aguggcguaaucucggcuca

SEQ ID NO: 1809944 - RNA, 15 nt, Homo sapiens
caaauaaagaccuga

SEQ ID NO: 1809945 - RNA, 15 nt, Homo sapiens
uagacaaaugucuug

SEQ ID NO: 1809946 - RNA, 12 nt, Homo sapiens
agccugccuuuc

SEQ ID NO: 1809947 - RNA, 23 nt, Homo sapiens
augaucuagagccaguuacuuug

SEQ ID NO: 1809948 - RNA, 19 nt, Homo sapiens
ugucaccuggccugccacc

SEQ ID NO: 1809949 - RNA, 18 nt, Homo sapiens
ucaacuggcuacugaguc

SEQ ID NO: 1809950 - RNA, 22 nt, Homo sapiens
cuuuacaaaaagacacuugaua

SEQ ID NO: 1809951 - RNA, 17 nt, Homo sapiens
uauucacaaaacauuaa

SEQ ID NO: 1809952 - RNA, 21 nt, Homo sapiens
acgaggugguagcucugagcc

SEQ ID NO: 1809953 - RNA, 22 nt, Homo sapiens
gaaaucaguuucucaaacugag

SEQ ID NO: 1809954 - RNA, 23 nt, Homo sapiens
uccuugcuuuuauguuuguacac

SEQ ID NO: 1809955 - RNA, 22 nt, Homo sapiens
uauuuguguguucacuaaacuc

SEQ ID NO: 1809956 - RNA, 16 nt, Homo sapiens
cgugauuuugcuguag

SEQ ID NO: 1809957 - RNA, 20 nt, Homo sapiens
uugcuuucuucuccugugau

SEQ ID NO: 1809958 - RNA, 16 nt, Homo sapiens
agugcccuuccugcug

SEQ ID NO: 1809959 - RNA, 14 nt, Homo sapiens
auccagcucaaggg

SEQ ID NO: 1809960 - RNA, 14 nt, Homo sapiens
gugggguggcugca

SEQ ID NO: 1809961 - RNA, 23 nt, Homo sapiens
ucaagaauggggaucacagagac

SEQ ID NO: 1809962 - RNA, 19 nt, Homo sapiens
caacuuaaaccugugcuuu

SEQ ID NO: 1809963 - RNA, 16 nt, Homo sapiens
ucugccccagucguua

SEQ ID NO: 1809964 - RNA, 17 nt, Homo sapiens
ugcaaggggacauucca

SEQ ID NO: 1809965 - RNA, 14 nt, Homo sapiens
uccuguccagcucc

SEQ ID NO: 1809966 - RNA, 13 nt, Homo sapiens
uugaaaaugggcu

SEQ ID NO: 1809967 - RNA, 20 nt, Homo sapiens
gaagaacuugucccucaggc

SEQ ID NO: 1809968 - RNA, 17 nt, Homo sapiens
augguggccuggggcuu

SEQ ID NO: 1809969 - RNA, 18 nt, Homo sapiens
cuauuuguuguuuuuaac

SEQ ID NO: 1809970 - RNA, 20 nt, Homo sapiens
ccauuguuugaaacaaagaa

SEQ ID NO: 1809971 - RNA, 17 nt, Homo sapiens
gugagacacucugggaa

SEQ ID NO: 1809972 - RNA, 22 nt, Homo sapiens
ugaacuagauugcaugcuuccu

SEQ ID NO: 1809973 - RNA, 21 nt, Homo sapiens
cccgguugugagagccuguga

SEQ ID NO: 1809974 - RNA, 13 nt, Homo sapiens
gcucugauuucag

SEQ ID NO: 1809975 - RNA, 19 nt, Homo sapiens
aauuuaaacugcaaugcca

SEQ ID NO: 1809976 - RNA, 12 nt, Homo sapiens
agaagucucuua

SEQ ID NO: 1809977 - RNA, 18 nt, Homo sapiens
cuacauauugucuggaaa

SEQ ID NO: 1809978 - RNA, 12 nt, Homo sapiens
aacuauaccucu

SEQ ID NO: 1809979 - RNA, 19 nt, Homo sapiens
uguggcccuguccugccau

SEQ ID NO: 1809980 - RNA, 13 nt, Homo sapiens
uucauagaugaau

SEQ ID NO: 1809981 - RNA, 18 nt, Homo sapiens
cccacccgaguaccucca

SEQ ID NO: 1809982 - RNA, 16 nt, Homo sapiens
uccucgugccguccuc

SEQ ID NO: 1809983 - RNA, 14 nt, Homo sapiens
ggcaggaucaaaga

SEQ ID NO: 1809984 - RNA, 15 nt, Homo sapiens
agcgugcaggagcaa

SEQ ID NO: 1809985 - RNA, 16 nt, Homo sapiens
auccaggcaugggcug

SEQ ID NO: 1809986 - RNA, 22 nt, Homo sapiens
uuacaugcauuacugcaugcac

SEQ ID NO: 1809987 - RNA, 15 nt, Homo sapiens
aggacuuacagaucc

SEQ ID NO: 1809988 - RNA, 24 nt, Homo sapiens
gcuacacuguauaacuguucuuca

SEQ ID NO: 1809989 - RNA, 23 nt, Homo sapiens
aucuuaaccuucaaauacauucu

SEQ ID NO: 1809990 - RNA, 17 nt, Homo sapiens
auaaagugccucggaca

SEQ ID NO: 1809991 - RNA, 14 nt, Homo sapiens
uccacuaaaugagc

SEQ ID NO: 1809992 - RNA, 19 nt, Homo sapiens
aggggccugggcugugagg

SEQ ID NO: 1809993 - RNA, 18 nt, Homo sapiens
ugcuuguuuacagcacua

SEQ ID NO: 1809994 - RNA, 19 nt, Homo sapiens
uuggcguaggcuacagaga

SEQ ID NO: 1809995 - RNA, 21 nt, Homo sapiens
uaaagauggaguuucuaaggu

SEQ ID NO: 1809996 - RNA, 22 nt, Homo sapiens
uugaaucacugcucacacugcu

SEQ ID NO: 1809997 - RNA, 21 nt, Homo sapiens
uuaaaauuuugcuaccaaaga

SEQ ID NO: 1809998 - RNA, 23 nt, Homo sapiens
uacccagagaauauauacauucu

SEQ ID NO: 1809999 - RNA, 13 nt, Homo sapiens
cugcacccaugag

SEQ ID NO: 1810000 - RNA, 18 nt, Homo sapiens
cuuccucagggcccagca

SEQ ID NO: 1810001 - RNA, 23 nt, Homo sapiens
cccacuuuccuacaaaauggagg

SEQ ID NO: 1810002 - RNA, 14 nt, Homo sapiens
ucuucucauuccca

SEQ ID NO: 1810003 - RNA, 14 nt, Homo sapiens
uccucucauuucca

SEQ ID NO: 1810004 - RNA, 18 nt, Homo sapiens
cugcacugaucacccaau

SEQ ID NO: 1810005 - RNA, 16 nt, Homo sapiens
aucuacuaauuccaca

SEQ ID NO: 1810006 - RNA, 13 nt, Homo sapiens
gccccccggccug

SEQ ID NO: 1810007 - RNA, 21 nt, Homo sapiens
cugaaugguuccaugccugag

SEQ ID NO: 1810008 - RNA, 22 nt, Homo sapiens
ugaagcauuucagguugugcau

SEQ ID NO: 1810009 - RNA, 17 nt, Homo sapiens
agagggaggcaggugga

SEQ ID NO: 1810010 - RNA, 20 nt, Homo sapiens
caugauggccuuacacugaa

SEQ ID NO: 1810011 - RNA, 11 nt, Homo sapiens
caacuugcaag

SEQ ID NO: 1810012 - RNA, 15 nt, Homo sapiens
gaccaggcaguuuuu

SEQ ID NO: 1810013 - RNA, 15 nt, Homo sapiens
uccuaaagaccucca

SEQ ID NO: 1810014 - RNA, 21 nt, Homo sapiens
cagggcucccugccauuuuag

SEQ ID NO: 1810015 - RNA, 17 nt, Homo sapiens
ggcaggggaagcucuca

SEQ ID NO: 1810016 - RNA, 21 nt, Homo sapiens
aauuccuacaacuuaauggaa

SEQ ID NO: 1810017 - RNA, 21 nt, Homo sapiens
aaauaagaauaaacuuucuca

SEQ ID NO: 1810018 - RNA, 18 nt, Homo sapiens
agugcuauuugcauuucu

SEQ ID NO: 1810019 - RNA, 15 nt, Homo sapiens
uaacagaugcaaugu

SEQ ID NO: 1810020 - RNA, 19 nt, Homo sapiens
aauggcaccucugcccuuc

SEQ ID NO: 1810021 - RNA, 19 nt, Homo sapiens
ucuucacaauauccaauga

SEQ ID NO: 1810022 - RNA, 18 nt, Homo sapiens
uuuuccuauuuauuugag

SEQ ID NO: 1810023 - RNA, 22 nt, Homo sapiens
ugguaggaucaccugaggucag

SEQ ID NO: 1810024 - RNA, 17 nt, Homo sapiens
aaaacucucauuauuug

SEQ ID NO: 1810025 - RNA, 22 nt, Homo sapiens
agacucacuuguucucacuguc

SEQ ID NO: 1810026 - RNA, 14 nt, Homo sapiens
ggacaguggugaca

SEQ ID NO: 1810027 - RNA, 22 nt, Homo sapiens
guagcccugcaccugccaguga

SEQ ID NO: 1810028 - RNA, 22 nt, Homo sapiens
aauugccaagaaaaacaacuuu

SEQ ID NO: 1810029 - RNA, 18 nt, Homo sapiens
guguuugcagcugugaga

SEQ ID NO: 1810030 - RNA, 17 nt, Homo sapiens
uguauacaguacaggau

SEQ ID NO: 1810031 - RNA, 20 nt, Homo sapiens
cauguggaguggacauucaa

SEQ ID NO: 1810032 - RNA, 17 nt, Homo sapiens
cuccacaccaguaauaa

SEQ ID NO: 1810033 - RNA, 16 nt, Homo sapiens
guugcuuuuuuuccaa

SEQ ID NO: 1810034 - RNA, 20 nt, Homo sapiens
uggcauugucuguaaugaca

SEQ ID NO: 1810035 - RNA, 13 nt, Homo sapiens
cacagauggcuca

SEQ ID NO: 1810036 - RNA, 13 nt, Homo sapiens
gcuuccacaaaca

SEQ ID NO: 1810037 - RNA, 17 nt, Homo sapiens
ucccucugccccagcca

SEQ ID NO: 1810038 - RNA, 21 nt, Homo sapiens
uugagggugagggggugcugg

SEQ ID NO: 1810039 - RNA, 12 nt, Homo sapiens
aauuuguacaua

SEQ ID NO: 1810040 - RNA, 16 nt, Homo sapiens
uguuuuagucauuaau

SEQ ID NO: 1810041 - RNA, 14 nt, Homo sapiens
ugaccuauuuccag

SEQ ID NO: 1810042 - RNA, 21 nt, Homo sapiens
uccucuuugagaaaauguaaa

SEQ ID NO: 1810043 - RNA, 21 nt, Homo sapiens
guguaauguagcguguuuaca

SEQ ID NO: 1810044 - RNA, 17 nt, Homo sapiens
gauggcaugcugccuua

SEQ ID NO: 1810045 - RNA, 14 nt, Homo sapiens
ccaaaccucaauaa

SEQ ID NO: 1810046 - RNA, 17 nt, Homo sapiens
caguuccccgagaacuu

SEQ ID NO: 1810047 - RNA, 20 nt, Homo sapiens
augacuuauaugagggcaga

SEQ ID NO: 1810048 - RNA, 14 nt, Homo sapiens
uaacucaacauuug

SEQ ID NO: 1810049 - RNA, 15 nt, Homo sapiens
aaugaaggaccucaa

SEQ ID NO: 1810050 - RNA, 18 nt, Homo sapiens
ggucagagaaaaugagaa

SEQ ID NO: 1810051 - RNA, 22 nt, Homo sapiens
uguaagcaggagagaaauuucu

SEQ ID NO: 1810052 - RNA, 21 nt, Homo sapiens
uaaaaugugauguucuaaggc

SEQ ID NO: 1810053 - RNA, 14 nt, Homo sapiens
ggugauauaucuca

SEQ ID NO: 1810054 - RNA, 13 nt, Homo sapiens
ucuccugugccca

SEQ ID NO: 1810055 - RNA, 18 nt, Homo sapiens
gccaccaacuuacaaaaa

SEQ ID NO: 1810056 - RNA, 14 nt, Homo sapiens
cacugccacuuugc

SEQ ID NO: 1810057 - RNA, 14 nt, Homo sapiens
caucugcacuccug

SEQ ID NO: 1810058 - RNA, 18 nt, Homo sapiens
ucuugcuggcucugagaa

SEQ ID NO: 1810059 - RNA, 16 nt, Homo sapiens
ugguuccuccacugga

SEQ ID NO: 1810060 - RNA, 23 nt, Homo sapiens
acuugaaaaauacuuuuccuuac

SEQ ID NO: 1810061 - RNA, 14 nt, Homo sapiens
cugggcucaagcaa

SEQ ID NO: 1810062 - RNA, 16 nt, Homo sapiens
aacaggaaacugggaa

SEQ ID NO: 1810063 - RNA, 22 nt, Homo sapiens
agauucuuuuaugugaugcugg

SEQ ID NO: 1810064 - RNA, 17 nt, Homo sapiens
auacucccuuuaaagag

SEQ ID NO: 1810065 - RNA, 17 nt, Homo sapiens
acaggaaggaaccagaa

SEQ ID NO: 1810066 - RNA, 16 nt, Homo sapiens
agauggacuccagccu

SEQ ID NO: 1810067 - RNA, 17 nt, Homo sapiens
ugaaggccaucaucucu

SEQ ID NO: 1810068 - RNA, 14 nt, Homo sapiens
uccauuuugccuga

SEQ ID NO: 1810069 - RNA, 21 nt, Homo sapiens
gacauguuucacaacaggcau

SEQ ID NO: 1810070 - RNA, 15 nt, Homo sapiens
auuuuaaauucucag

SEQ ID NO: 1810071 - RNA, 17 nt, Homo sapiens
uggcaugccuuccagca

SEQ ID NO: 1810072 - RNA, 16 nt, Homo sapiens
cgaccccucagugcuc

SEQ ID NO: 1810073 - RNA, 21 nt, Homo sapiens
guauucccacucaccagcccu

SEQ ID NO: 1810074 - RNA, 19 nt, Homo sapiens
auuaauccacaaauaugcu

SEQ ID NO: 1810075 - RNA, 16 nt, Homo sapiens
ugucauuucauuccau

SEQ ID NO: 1810076 - RNA, 16 nt, Homo sapiens
ugccauuccacuccac

SEQ ID NO: 1810077 - RNA, 16 nt, Homo sapiens
aaguugauucuguccc

SEQ ID NO: 1810078 - RNA, 13 nt, Homo sapiens
uccuauuccuuca

SEQ ID NO: 1810079 - RNA, 18 nt, Homo sapiens
acaguggccccaucauag

SEQ ID NO: 1810080 - RNA, 15 nt, Homo sapiens
acucucaccuuccaa

SEQ ID NO: 1810081 - RNA, 21 nt, Homo sapiens
gcaggacuugagaagaccuca

SEQ ID NO: 1810082 - RNA, 18 nt, Homo sapiens
acccugcuacacauacag

SEQ ID NO: 1810083 - RNA, 16 nt, Homo sapiens
gacccugaacucagaa

SEQ ID NO: 1810084 - RNA, 14 nt, Homo sapiens
uguaagaguguuua

SEQ ID NO: 1810085 - RNA, 14 nt, Homo sapiens
agguagcacagcac

SEQ ID NO: 1810086 - RNA, 17 nt, Homo sapiens
cauuucaccuuucugca

SEQ ID NO: 1810087 - RNA, 17 nt, Homo sapiens
aacaucagcucacuggc

SEQ ID NO: 1810088 - RNA, 17 nt, Homo sapiens
ugcuauauuugcuaaua

SEQ ID NO: 1810089 - RNA, 19 nt, Homo sapiens
cagucucucucugccaugg

SEQ ID NO: 1810090 - RNA, 15 nt, Homo sapiens
agagcagaugcagag

SEQ ID NO: 1810091 - RNA, 10 nt, Homo sapiens
cgcuugcucg

SEQ ID NO: 1810092 - RNA, 19 nt, Homo sapiens
ugggcacacgcacaaacac

SEQ ID NO: 1810093 - RNA, 17 nt, Homo sapiens
auguguuauuacuuccu

SEQ ID NO: 1810094 - RNA, 14 nt, Homo sapiens
uaaacaaagacauu

SEQ ID NO: 1810095 - RNA, 19 nt, Homo sapiens
aaagcuacuauguacugcc

SEQ ID NO: 1810096 - RNA, 16 nt, Homo sapiens
gauuuguucacaugca

SEQ ID NO: 1810097 - RNA, 18 nt, Homo sapiens
cucaaaccgagagacuca

SEQ ID NO: 1810098 - RNA, 18 nt, Homo sapiens
cuuucuauuaccccucau

SEQ ID NO: 1810099 - RNA, 21 nt, Homo sapiens
agguaauaauaaagguugagu

SEQ ID NO: 1810100 - RNA, 15 nt, Homo sapiens
caccuccugcuccuu

SEQ ID NO: 1810101 - RNA, 19 nt, Homo sapiens
uauuaaauauauacugacu

SEQ ID NO: 1810102 - RNA, 22 nt, Homo sapiens
ucccuuaggaauauacauaguc

SEQ ID NO: 1810103 - RNA, 12 nt, Homo sapiens
aucauucuaauu

SEQ ID NO: 1810104 - RNA, 15 nt, Homo sapiens
uauaaagacaacaaa

SEQ ID NO: 1810105 - RNA, 19 nt, Homo sapiens
ucauaaaauguaucuucca

SEQ ID NO: 1810106 - RNA, 22 nt, Homo sapiens
guguacuuuguuaaaaacacug

SEQ ID NO: 1810107 - RNA, 16 nt, Homo sapiens
gcucgugugcuuagaa

SEQ ID NO: 1810108 - RNA, 13 nt, Homo sapiens
uggacauaucauc

SEQ ID NO: 1810109 - RNA, 13 nt, Homo sapiens
cucaacuagggag

SEQ ID NO: 1810110 - RNA, 18 nt, Homo sapiens
ucuuguaguguggcugug

SEQ ID NO: 1810111 - RNA, 14 nt, Homo sapiens
gcuucuaguuugca

SEQ ID NO: 1810112 - RNA, 17 nt, Homo sapiens
uguuuuugaaaagcuaa

SEQ ID NO: 1810113 - RNA, 19 nt, Homo sapiens
agccauuucuucuguucua

SEQ ID NO: 1810114 - RNA, 23 nt, Homo sapiens
ccuaggacagccuuguuccucag

SEQ ID NO: 1810115 - RNA, 15 nt, Homo sapiens
ggacuggcacuauuu

SEQ ID NO: 1810116 - RNA, 21 nt, Homo sapiens
aaacccaaucagaugccucag

SEQ ID NO: 1810117 - RNA, 17 nt, Homo sapiens
uaaauacaucacuguau

SEQ ID NO: 1810118 - RNA, 19 nt, Homo sapiens
acuucauucucgugaguca

SEQ ID NO: 1810119 - RNA, 13 nt, Homo sapiens
uggaacaccagca

SEQ ID NO: 1810120 - RNA, 16 nt, Homo sapiens
auucagucacauggca

SEQ ID NO: 1810121 - RNA, 19 nt, Homo sapiens
aucuggaacccagacucag

SEQ ID NO: 1810122 - RNA, 20 nt, Homo sapiens
cucaucaauggggccaguca

SEQ ID NO: 1810123 - RNA, 18 nt, Homo sapiens
gauauacucgaaucagac

SEQ ID NO: 1810124 - RNA, 22 nt, Homo sapiens
uuccuaggucacuugaagccaa

SEQ ID NO: 1810125 - RNA, 13 nt, Homo sapiens
aagcacagcaccc

SEQ ID NO: 1810126 - RNA, 12 nt, Homo sapiens
guagcaucucug

SEQ ID NO: 1810127 - RNA, 13 nt, Homo sapiens
uggaaaaugauua

SEQ ID NO: 1810128 - RNA, 13 nt, Homo sapiens
ugcugagagccau

SEQ ID NO: 1810129 - RNA, 19 nt, Homo sapiens
accaauggguuugccaagc

SEQ ID NO: 1810130 - RNA, 21 nt, Homo sapiens
caaacugccuuggcuucaggg

SEQ ID NO: 1810131 - RNA, 21 nt, Homo sapiens
auguucuacagaauauucucc

SEQ ID NO: 1810132 - RNA, 14 nt, Homo sapiens
aggaugcacaguca

SEQ ID NO: 1810133 - RNA, 14 nt, Homo sapiens
ccacucuccuugcu

SEQ ID NO: 1810134 - RNA, 21 nt, Homo sapiens
cuauuagacaugaaaucugag

SEQ ID NO: 1810135 - RNA, 15 nt, Homo sapiens
agccauucacaacac

SEQ ID NO: 1810136 - RNA, 19 nt, Homo sapiens
aucucuccagcuagcaaaa

SEQ ID NO: 1810137 - RNA, 18 nt, Homo sapiens
ccuguaacucacauucuc

SEQ ID NO: 1810138 - RNA, 11 nt, Homo sapiens
gugggugguga

SEQ ID NO: 1810139 - RNA, 19 nt, Homo sapiens
aucacagucucaguucucu

SEQ ID NO: 1810140 - RNA, 14 nt, Homo sapiens
accuugccaugcuu

SEQ ID NO: 1810141 - RNA, 19 nt, Homo sapiens
guaccauauguagcauuaa

SEQ ID NO: 1810142 - RNA, 13 nt, Homo sapiens
acaugcagaauaa

SEQ ID NO: 1810143 - RNA, 18 nt, Homo sapiens
gacaggagacccagagag

SEQ ID NO: 1810144 - RNA, 16 nt, Homo sapiens
ugcaggcaucacagcu

SEQ ID NO: 1810145 - RNA, 23 nt, Homo sapiens
uucuuuagaugccaaaccacaag

SEQ ID NO: 1810146 - RNA, 23 nt, Homo sapiens
agauacuguauaugucaaaaaua

SEQ ID NO: 1810147 - RNA, 18 nt, Homo sapiens
caucccuuguuuauaaau

SEQ ID NO: 1810148 - RNA, 17 nt, Homo sapiens
cagcagcacuggaacca

SEQ ID NO: 1810149 - RNA, 14 nt, Homo sapiens
cacauccauuccca

SEQ ID NO: 1810150 - RNA, 17 nt, Homo sapiens
gucccucgcgcccaaaa

SEQ ID NO: 1810151 - RNA, 14 nt, Homo sapiens
uagcugaauugagc

SEQ ID NO: 1810152 - RNA, 11 nt, Homo sapiens
cgguccagcug

SEQ ID NO: 1810153 - RNA, 17 nt, Homo sapiens
gccuugcugcugcugca

SEQ ID NO: 1810154 - RNA, 17 nt, Homo sapiens
auccuaaagaacaaagu

SEQ ID NO: 1810155 - RNA, 14 nt, Homo sapiens
uuauauuuugcagu

SEQ ID NO: 1810156 - RNA, 12 nt, Homo sapiens
aauccaguuuag

SEQ ID NO: 1810157 - RNA, 15 nt, Homo sapiens
uuuacaaugugcaau

SEQ ID NO: 1810158 - RNA, 14 nt, Homo sapiens
ugaaacagcagcug

SEQ ID NO: 1810159 - RNA, 20 nt, Homo sapiens
agauuacugaaaaaugcaaa

SEQ ID NO: 1810160 - RNA, 18 nt, Homo sapiens
agcaacccaauauugcua

SEQ ID NO: 1810161 - RNA, 14 nt, Homo sapiens
ucccaccucagccu

SEQ ID NO: 1810162 - RNA, 13 nt, Homo sapiens
uggugacauuuga

SEQ ID NO: 1810163 - RNA, 15 nt, Homo sapiens
uaguccuuuacaaac

SEQ ID NO: 1810164 - RNA, 23 nt, Homo sapiens
acauuugguuuguugagccuaau

SEQ ID NO: 1810165 - RNA, 17 nt, Homo sapiens
cuguacuaaaauaugca

SEQ ID NO: 1810166 - RNA, 23 nt, Homo sapiens
caccagggacuaugaaugggcaa

SEQ ID NO: 1810167 - RNA, 15 nt, Homo sapiens
augaucgcuaucuag

SEQ ID NO: 1810168 - RNA, 14 nt, Homo sapiens
cuccuggaagcaca

SEQ ID NO: 1810169 - RNA, 19 nt, Homo sapiens
uuacuagcagucacuugau

SEQ ID NO: 1810170 - RNA, 12 nt, Homo sapiens
ccccaaccugcu

SEQ ID NO: 1810171 - RNA, 16 nt, Homo sapiens
acucuacugcaagacu

SEQ ID NO: 1810172 - RNA, 14 nt, Homo sapiens
caccccuacuucac

SEQ ID NO: 1810173 - RNA, 15 nt, Homo sapiens
aaaauaaaccaaaua

SEQ ID NO: 1810174 - RNA, 14 nt, Homo sapiens
ccauaccagucacc

SEQ ID NO: 1810175 - RNA, 16 nt, Homo sapiens
uggauuacuauugcaa

SEQ ID NO: 1810176 - RNA, 18 nt, Homo sapiens
ugcaauaaauuauggcuc

SEQ ID NO: 1810177 - RNA, 17 nt, Homo sapiens
caguagcacaaguuauu

SEQ ID NO: 1810178 - RNA, 17 nt, Homo sapiens
cuauaaaacacaucauc

SEQ ID NO: 1810179 - RNA, 16 nt, Homo sapiens
ucucugaacacacauu

SEQ ID NO: 1810180 - RNA, 21 nt, Homo sapiens
uagacggaggugccugagggu

SEQ ID NO: 1810181 - RNA, 19 nt, Homo sapiens
auuccuucucccaucucuu

SEQ ID NO: 1810182 - RNA, 20 nt, Homo sapiens
agugaacuauuuuuaagguc

SEQ ID NO: 1810183 - RNA, 21 nt, Homo sapiens
gacccacagaacuuguggccu

SEQ ID NO: 1810184 - RNA, 18 nt, Homo sapiens
uuccaaaggaagugcuaa

SEQ ID NO: 1810185 - RNA, 18 nt, Homo sapiens
auaauaucccacugggag

SEQ ID NO: 1810186 - RNA, 16 nt, Homo sapiens
auaagagaagucucau

SEQ ID NO: 1810187 - RNA, 15 nt, Homo sapiens
uggaaagcuggugau

SEQ ID NO: 1810188 - RNA, 16 nt, Homo sapiens
agccccacucacccac

SEQ ID NO: 1810189 - RNA, 22 nt, Homo sapiens
uauaacaaucacuggcuaccga

SEQ ID NO: 1810190 - RNA, 16 nt, Homo sapiens
uuaggacaaaucugca

SEQ ID NO: 1810191 - RNA, 19 nt, Homo sapiens
cugugcacaaaacccagac

SEQ ID NO: 1810192 - RNA, 18 nt, Homo sapiens
aacucugagaucuaagga

SEQ ID NO: 1810193 - RNA, 12 nt, Homo sapiens
gauucugagcag

SEQ ID NO: 1810194 - RNA, 21 nt, Homo sapiens
uagaucuuaggcaaaauacca

SEQ ID NO: 1810195 - RNA, 23 nt, Homo sapiens
ugccagcaugguugcagauaaac

SEQ ID NO: 1810196 - RNA, 19 nt, Homo sapiens
ggaucucuuggccucauga

SEQ ID NO: 1810197 - RNA, 19 nt, Homo sapiens
augcugggacccucggggc

SEQ ID NO: 1810198 - RNA, 16 nt, Homo sapiens
aaagacacucccacca

SEQ ID NO: 1810199 - RNA, 13 nt, Homo sapiens
gguaggccaagcu

SEQ ID NO: 1810200 - RNA, 21 nt, Homo sapiens
cacaguuaauucccugcuaaa

SEQ ID NO: 1810201 - RNA, 22 nt, Homo sapiens
agcgcaguggggugaucucauc

SEQ ID NO: 1810202 - RNA, 12 nt, Homo sapiens
ucccccaugugc

SEQ ID NO: 1810203 - RNA, 20 nt, Homo sapiens
auuacaauguguaauggaaa

SEQ ID NO: 1810204 - RNA, 20 nt, Homo sapiens
uauguaucuuaguuacauuu

SEQ ID NO: 1810205 - RNA, 18 nt, Homo sapiens
caagcccuguugacacag

SEQ ID NO: 1810206 - RNA, 18 nt, Homo sapiens
agaaacuaagauuuaucu

SEQ ID NO: 1810207 - RNA, 21 nt, Homo sapiens
guucuuucuuacacaagagcu

SEQ ID NO: 1810208 - RNA, 21 nt, Homo sapiens
guccaggguggaugaucucaa

SEQ ID NO: 1810209 - RNA, 20 nt, Homo sapiens
gggucucacucuguugccca

SEQ ID NO: 1810210 - RNA, 16 nt, Homo sapiens
guccugggucuguguc

SEQ ID NO: 1810211 - RNA, 15 nt, Homo sapiens
agaaucaugggaugu

SEQ ID NO: 1810212 - RNA, 16 nt, Homo sapiens
aucaaagcuucaaaaa

SEQ ID NO: 1810213 - RNA, 16 nt, Homo sapiens
acccucccagucucau

SEQ ID NO: 1810214 - RNA, 20 nt, Homo sapiens
auaaacuauauucugugaca

SEQ ID NO: 1810215 - RNA, 21 nt, Homo sapiens
gauuuagaaaaaaguuuacaa

SEQ ID NO: 1810216 - RNA, 22 nt, Homo sapiens
gcgcguuugugcauaucugccu

SEQ ID NO: 1810217 - RNA, 20 nt, Homo sapiens
acacaugacgcaccaguuac

SEQ ID NO: 1810218 - RNA, 21 nt, Homo sapiens
aacugcaggagcaguuugcca

SEQ ID NO: 1810219 - RNA, 18 nt, Homo sapiens
ccaccugucaaccugaau

SEQ ID NO: 1810220 - RNA, 16 nt, Homo sapiens
uuguaaauauuugacu

SEQ ID NO: 1810221 - RNA, 22 nt, Homo sapiens
gccacccaaggaugucugccac

SEQ ID NO: 1810222 - RNA, 12 nt, Homo sapiens
agauugugcucc

SEQ ID NO: 1810223 - RNA, 20 nt, Homo sapiens
aacugugaaauguacgucau

SEQ ID NO: 1810224 - RNA, 10 nt, Homo sapiens
gaauuacuuu

SEQ ID NO: 1810225 - RNA, 24 nt, Homo sapiens
cagcaggaggcaagcguguucuca

SEQ ID NO: 1810226 - RNA, 17 nt, Homo sapiens
cugacuguugcuguaaa

SEQ ID NO: 1810227 - RNA, 18 nt, Homo sapiens
ucacaucuuuuucacuga

SEQ ID NO: 1810228 - RNA, 19 nt, Homo sapiens
uccacaccccaucuugcuc

SEQ ID NO: 1810229 - RNA, 19 nt, Homo sapiens
uggaugcagaaacaguuca

SEQ ID NO: 1810230 - RNA, 17 nt, Homo sapiens
auauuucuguguacaca

SEQ ID NO: 1810231 - RNA, 17 nt, Homo sapiens
ugaggauguguuuugca

SEQ ID NO: 1810232 - RNA, 17 nt, Homo sapiens
ugcucaauaaaguacaa

SEQ ID NO: 1810233 - RNA, 19 nt, Homo sapiens
aacugugauuuuuaucaca

SEQ ID NO: 1810234 - RNA, 19 nt, Homo sapiens
uguuaagcguugagccacc

SEQ ID NO: 1810235 - RNA, 14 nt, Homo sapiens
ucuaguacaaccuu

SEQ ID NO: 1810236 - RNA, 20 nt, Homo sapiens
uuuauaaaugagcaaaugga

SEQ ID NO: 1810237 - RNA, 23 nt, Homo sapiens
ucugggcaguaaauccacagcca

SEQ ID NO: 1810238 - RNA, 12 nt, Homo sapiens
acugugggcucc

SEQ ID NO: 1810239 - RNA, 13 nt, Homo sapiens
aaccgacuuuucu

SEQ ID NO: 1810240 - RNA, 21 nt, Homo sapiens
uuguggucugagccaaagaga

SEQ ID NO: 1810241 - RNA, 15 nt, Homo sapiens
aguuuuaauguagag

SEQ ID NO: 1810242 - RNA, 13 nt, Homo sapiens
accagacaaggaa

SEQ ID NO: 1810243 - RNA, 16 nt, Homo sapiens
ucacccccucccuaca

SEQ ID NO: 1810244 - RNA, 15 nt, Homo sapiens
uccuuggcuuaccug

SEQ ID NO: 1810245 - RNA, 22 nt, Homo sapiens
ggcacaaaauucuagaagcaga

SEQ ID NO: 1810246 - RNA, 16 nt, Homo sapiens
gacccucgcucucugu

SEQ ID NO: 1810247 - RNA, 12 nt, Homo sapiens
uacaacaaugaa

SEQ ID NO: 1810248 - RNA, 21 nt, Homo sapiens
aauuagccagugaaaaacuau

SEQ ID NO: 1810249 - RNA, 18 nt, Homo sapiens
uuacucuugagacuacuu

SEQ ID NO: 1810250 - RNA, 16 nt, Homo sapiens
acccucuaagggaccu

SEQ ID NO: 1810251 - RNA, 18 nt, Homo sapiens
cagucucagcugcugaaa

SEQ ID NO: 1810252 - RNA, 13 nt, Homo sapiens
gcccccugcaucu

SEQ ID NO: 1810253 - RNA, 21 nt, Homo sapiens
ggaccucacccuggggccaga

SEQ ID NO: 1810254 - RNA, 12 nt, Homo sapiens
aguuaccauuaa

SEQ ID NO: 1810255 - RNA, 19 nt, Homo sapiens
agauaauguccuugcuuua

SEQ ID NO: 1810256 - RNA, 18 nt, Homo sapiens
gcucagaaggaauggugc

SEQ ID NO: 1810257 - RNA, 22 nt, Homo sapiens
ugcacuuuagauauacauauca

SEQ ID NO: 1810258 - RNA, 20 nt, Homo sapiens
uaaguagcaacccugugaua

SEQ ID NO: 1810259 - RNA, 13 nt, Homo sapiens
cuuaugaaccuuu

SEQ ID NO: 1810260 - RNA, 14 nt, Homo sapiens
uaauauaagccaua

SEQ ID NO: 1810261 - RNA, 14 nt, Homo sapiens
gcaaaaaauacuuu

SEQ ID NO: 1810262 - RNA, 13 nt, Homo sapiens
aaggcacaggugu

SEQ ID NO: 1810263 - RNA, 23 nt, Homo sapiens
gggcucaggaggggaaguccagc

SEQ ID NO: 1810264 - RNA, 15 nt, Homo sapiens
uucaaugcauuuaaa

SEQ ID NO: 1810265 - RNA, 13 nt, Homo sapiens
gucuguagggagu

SEQ ID NO: 1810266 - RNA, 18 nt, Homo sapiens
gauagaacaaugcuauaa

SEQ ID NO: 1810267 - RNA, 15 nt, Homo sapiens
auaaagaaauaauac

SEQ ID NO: 1810268 - RNA, 24 nt, Homo sapiens
ccauucagccucgucucuuuacag

SEQ ID NO: 1810269 - RNA, 21 nt, Homo sapiens
ccuugguaggggacuaauuca

SEQ ID NO: 1810270 - RNA, 12 nt, Homo sapiens
gggccaugccuc

SEQ ID NO: 1810271 - RNA, 14 nt, Homo sapiens
agagugaugccggu

SEQ ID NO: 1810272 - RNA, 16 nt, Homo sapiens
aaguuggagugcagug

SEQ ID NO: 1810273 - RNA, 18 nt, Homo sapiens
aagucucugacucuugcc

SEQ ID NO: 1810274 - RNA, 17 nt, Homo sapiens
gauugaaauuuugcacc

SEQ ID NO: 1810275 - RNA, 17 nt, Homo sapiens
gacagagacucagcgcu

SEQ ID NO: 1810276 - RNA, 14 nt, Homo sapiens
caagcaaauggcca

SEQ ID NO: 1810277 - RNA, 23 nt, Homo sapiens
cccucuccuguagccacuggcau

SEQ ID NO: 1810278 - RNA, 18 nt, Homo sapiens
cucauccaaaaagucuga

SEQ ID NO: 1810279 - RNA, 19 nt, Homo sapiens
gcuaauaaacuguauuaaa

SEQ ID NO: 1810280 - RNA, 15 nt, Homo sapiens
aucagaucugacaug

SEQ ID NO: 1810281 - RNA, 21 nt, Homo sapiens
cucuacggaccucacauccau

SEQ ID NO: 1810282 - RNA, 23 nt, Homo sapiens
auuuaugaguuuuugauagcuuu

SEQ ID NO: 1810283 - RNA, 19 nt, Homo sapiens
uuaaugggagcuuugccug

SEQ ID NO: 1810284 - RNA, 22 nt, Homo sapiens
ugcuuccucccaacaagcagcu

SEQ ID NO: 1810285 - RNA, 12 nt, Homo sapiens
ucauuucauucc

SEQ ID NO: 1810286 - RNA, 13 nt, Homo sapiens
aaacuucaagggu

SEQ ID NO: 1810287 - RNA, 23 nt, Homo sapiens
gaacacuggaacauuccagugga

SEQ ID NO: 1810288 - RNA, 21 nt, Homo sapiens
gaaaccuuauuuuuucccaaa

SEQ ID NO: 1810289 - RNA, 13 nt, Homo sapiens
acuucugugccac

SEQ ID NO: 1810290 - RNA, 12 nt, Homo sapiens
cuccaugcugca

SEQ ID NO: 1810291 - RNA, 15 nt, Homo sapiens
cacacuuugaagcaa

SEQ ID NO: 1810292 - RNA, 12 nt, Homo sapiens
ugcaaugucaaa

SEQ ID NO: 1810293 - RNA, 17 nt, Homo sapiens
cugauagguagcauuuu

SEQ ID NO: 1810294 - RNA, 16 nt, Homo sapiens
uaaauaaaaucaugua

SEQ ID NO: 1810295 - RNA, 21 nt, Homo sapiens
uaaugagccguugugcuccag

SEQ ID NO: 1810296 - RNA, 21 nt, Homo sapiens
acccuguccggcccagugcca

SEQ ID NO: 1810297 - RNA, 15 nt, Homo sapiens
auggaggaacuuucc

SEQ ID NO: 1810298 - RNA, 18 nt, Homo sapiens
uccccugcacuguaaaau

SEQ ID NO: 1810299 - RNA, 13 nt, Homo sapiens
cugauuugcaaua

SEQ ID NO: 1810300 - RNA, 17 nt, Homo sapiens
gaacaacgccugucaca

SEQ ID NO: 1810301 - RNA, 14 nt, Homo sapiens
auaacugcuuugca

SEQ ID NO: 1810302 - RNA, 21 nt, Homo sapiens
accgcccuggcuaacauggug

SEQ ID NO: 1810303 - RNA, 16 nt, Homo sapiens
acacauuagauguuac

SEQ ID NO: 1810304 - RNA, 16 nt, Homo sapiens
caauuccaacuuucag

SEQ ID NO: 1810305 - RNA, 23 nt, Homo sapiens
gagaccccucaauccccaaaggu

SEQ ID NO: 1810306 - RNA, 17 nt, Homo sapiens
gagacaaugauaugcaa

SEQ ID NO: 1810307 - RNA, 12 nt, Homo sapiens
agccacaguaua

SEQ ID NO: 1810308 - RNA, 22 nt, Homo sapiens
cagacaauaaacccucagagcc

SEQ ID NO: 1810309 - RNA, 10 nt, Homo sapiens
cacacacagu

SEQ ID NO: 1810310 - RNA, 22 nt, Homo sapiens
ugcccuguaauuuuucugggaa

SEQ ID NO: 1810311 - RNA, 14 nt, Homo sapiens
aaugcuguuaauau

SEQ ID NO: 1810312 - RNA, 16 nt, Homo sapiens
gauugaccuuugcacg

SEQ ID NO: 1810313 - RNA, 16 nt, Homo sapiens
uacaggugcaagccac

SEQ ID NO: 1810314 - RNA, 18 nt, Homo sapiens
aggcuccaggacuccacu

SEQ ID NO: 1810315 - RNA, 21 nt, Homo sapiens
cauacaaauuuucccagugaa

SEQ ID NO: 1810316 - RNA, 14 nt, Homo sapiens
uggacucuugcucu

SEQ ID NO: 1810317 - RNA, 20 nt, Homo sapiens
cccagcagcuccuguggcca

SEQ ID NO: 1810318 - RNA, 18 nt, Homo sapiens
uugcacaaauugggccaa

SEQ ID NO: 1810319 - RNA, 14 nt, Homo sapiens
ugcuuuucaggguu

SEQ ID NO: 1810320 - RNA, 15 nt, Homo sapiens
gucuuccaaguacag

SEQ ID NO: 1810321 - RNA, 20 nt, Homo sapiens
ugaggauuuugauccaagcu

SEQ ID NO: 1810322 - RNA, 17 nt, Homo sapiens
gguuuuguuccagagac

SEQ ID NO: 1810323 - RNA, 18 nt, Homo sapiens
aggaaacccccaguguaa

SEQ ID NO: 1810324 - RNA, 20 nt, Homo sapiens
aagaauuugcauacuuaccu

SEQ ID NO: 1810325 - RNA, 16 nt, Homo sapiens
cuguauaguacuggca

SEQ ID NO: 1810326 - RNA, 21 nt, Homo sapiens
aagaauuuaucucuuuaguua

SEQ ID NO: 1810327 - RNA, 15 nt, Homo sapiens
agaaagaugaaaacu

SEQ ID NO: 1810328 - RNA, 17 nt, Homo sapiens
agaccaguauggcaaaa

SEQ ID NO: 1810329 - RNA, 14 nt, Homo sapiens
gaaaugacccuauu

SEQ ID NO: 1810330 - RNA, 12 nt, Homo sapiens
uuaaauauuucc

SEQ ID NO: 1810331 - RNA, 19 nt, Homo sapiens
gacuggggcgucaccucca

SEQ ID NO: 1810332 - RNA, 16 nt, Homo sapiens
uaaaaucaggauuuua

SEQ ID NO: 1810333 - RNA, 21 nt, Homo sapiens
aagggaaaguuuuguucugua

SEQ ID NO: 1810334 - RNA, 14 nt, Homo sapiens
agauauagcauuaa

SEQ ID NO: 1810335 - RNA, 20 nt, Homo sapiens
cauaguucuuacuacuugcc

SEQ ID NO: 1810336 - RNA, 14 nt, Homo sapiens
agagacaagcagag

SEQ ID NO: 1810337 - RNA, 14 nt, Homo sapiens
acccacaaggccag

SEQ ID NO: 1810338 - RNA, 23 nt, Homo sapiens
uucaauuguagaugaacaucucu

SEQ ID NO: 1810339 - RNA, 17 nt, Homo sapiens
ccucaggcccagcugcu

SEQ ID NO: 1810340 - RNA, 13 nt, Homo sapiens
gaguauggugcug

SEQ ID NO: 1810341 - RNA, 16 nt, Homo sapiens
aggaguaaugggauau

SEQ ID NO: 1810342 - RNA, 17 nt, Homo sapiens
auucuaguguaacacug

SEQ ID NO: 1810343 - RNA, 21 nt, Homo sapiens
gaagagggaaugagcuuccau

SEQ ID NO: 1810344 - RNA, 12 nt, Homo sapiens
uauuucaauaac

SEQ ID NO: 1810345 - RNA, 16 nt, Homo sapiens
cacuuaaggggccaag

SEQ ID NO: 1810346 - RNA, 22 nt, Homo sapiens
ucuugaaauauaggaacuuaaa

SEQ ID NO: 1810347 - RNA, 21 nt, Homo sapiens
cugcacuccaugagugcagcu

SEQ ID NO: 1810348 - RNA, 12 nt, Homo sapiens
ccaagcacccag

SEQ ID NO: 1810349 - RNA, 14 nt, Homo sapiens
aaagccuauuccau

SEQ ID NO: 1810350 - RNA, 17 nt, Homo sapiens
acacacauacaaaaugu

SEQ ID NO: 1810351 - RNA, 18 nt, Homo sapiens
ugcuuuuuggaaagucag

SEQ ID NO: 1810352 - RNA, 14 nt, Homo sapiens
gccugcuuugaaua

SEQ ID NO: 1810353 - RNA, 15 nt, Homo sapiens
augaaaggagcagug

SEQ ID NO: 1810354 - RNA, 16 nt, Homo sapiens
ccggaaggaaugucag

SEQ ID NO: 1810355 - RNA, 22 nt, Homo sapiens
cuucuuccccccaaaacugauu

SEQ ID NO: 1810356 - RNA, 23 nt, Homo sapiens
agcucuugugaacugucuuggcu

SEQ ID NO: 1810357 - RNA, 15 nt, Homo sapiens
uaaagaaaaaagcac

SEQ ID NO: 1810358 - RNA, 13 nt, Homo sapiens
caaauugcugaga

SEQ ID NO: 1810359 - RNA, 18 nt, Homo sapiens
caagcaggcgcugugcua

SEQ ID NO: 1810360 - RNA, 21 nt, Homo sapiens
uggagggcccagcccaaguga

SEQ ID NO: 1810361 - RNA, 16 nt, Homo sapiens
uggaggaacuuuccaa

SEQ ID NO: 1810362 - RNA, 20 nt, Homo sapiens
aagcagagccuccugggaac

SEQ ID NO: 1810363 - RNA, 19 nt, Homo sapiens
ggcugcaagcgcacuugau

SEQ ID NO: 1810364 - RNA, 23 nt, Homo sapiens
ucugcgcaccaaggaauggagag

SEQ ID NO: 1810365 - RNA, 18 nt, Homo sapiens
acccucagacagacuuau

SEQ ID NO: 1810366 - RNA, 15 nt, Homo sapiens
gucauauuuugccac

SEQ ID NO: 1810367 - RNA, 16 nt, Homo sapiens
aguaguuuuucagcua

SEQ ID NO: 1810368 - RNA, 18 nt, Homo sapiens
acuggacaucacagcaga

SEQ ID NO: 1810369 - RNA, 17 nt, Homo sapiens
cucuucuuuauugcacu

SEQ ID NO: 1810370 - RNA, 12 nt, Homo sapiens
agagcaucucuu

SEQ ID NO: 1810371 - RNA, 20 nt, Homo sapiens
aucuguggaaugauucacau

SEQ ID NO: 1810372 - RNA, 16 nt, Homo sapiens
ugagaugcagcuggaa

SEQ ID NO: 1810373 - RNA, 22 nt, Homo sapiens
uugaaccacgugaaacugcugu

SEQ ID NO: 1810374 - RNA, 14 nt, Homo sapiens
gaguuuacauucua

SEQ ID NO: 1810375 - RNA, 22 nt, Homo sapiens
guuaauacugagaaaaaguccu

SEQ ID NO: 1810376 - RNA, 17 nt, Homo sapiens
agcacacuuaugggcca

SEQ ID NO: 1810377 - RNA, 16 nt, Homo sapiens
acuguccaauaugaaa

SEQ ID NO: 1810378 - RNA, 18 nt, Homo sapiens
gauaggaccuugggccaa

SEQ ID NO: 1810379 - RNA, 14 nt, Homo sapiens
aagggagucucucu

SEQ ID NO: 1810380 - RNA, 19 nt, Homo sapiens
ugagggagucccugggccu

SEQ ID NO: 1810381 - RNA, 16 nt, Homo sapiens
auaaauuacacaauaa

SEQ ID NO: 1810382 - RNA, 14 nt, Homo sapiens
cagagcacauggcc

SEQ ID NO: 1810383 - RNA, 14 nt, Homo sapiens
aguuuguuaugugu

SEQ ID NO: 1810384 - RNA, 20 nt, Homo sapiens
aggcugcccccaacacucca

SEQ ID NO: 1810385 - RNA, 17 nt, Homo sapiens
cacuucgcacacaccca

SEQ ID NO: 1810386 - RNA, 21 nt, Homo sapiens
gaaugguugaguuacauuaaa

SEQ ID NO: 1810387 - RNA, 17 nt, Homo sapiens
ggguccucggcccugua

SEQ ID NO: 1810388 - RNA, 15 nt, Homo sapiens
aacacauuugcccaa

SEQ ID NO: 1810389 - RNA, 19 nt, Homo sapiens
uuccuggacaccacccaga

SEQ ID NO: 1810390 - RNA, 22 nt, Homo sapiens
aacugacaaaucaaguuuccaa

SEQ ID NO: 1810391 - RNA, 14 nt, Homo sapiens
ccauuguagcucuu

SEQ ID NO: 1810392 - RNA, 12 nt, Homo sapiens
uuaguugccaau

SEQ ID NO: 1810393 - RNA, 14 nt, Homo sapiens
uuuggaaaccaagc

SEQ ID NO: 1810394 - RNA, 16 nt, Homo sapiens
caaaugagccaugaga

SEQ ID NO: 1810395 - RNA, 14 nt, Homo sapiens
aucucucuccugua

SEQ ID NO: 1810396 - RNA, 21 nt, Homo sapiens
acccucucauguuucccuacu

SEQ ID NO: 1810397 - RNA, 15 nt, Homo sapiens
ucacugaacuuugcu

SEQ ID NO: 1810398 - RNA, 14 nt, Homo sapiens
aaggcucuuuugua

SEQ ID NO: 1810399 - RNA, 21 nt, Homo sapiens
acauuacuucaaacugagauc

SEQ ID NO: 1810400 - RNA, 20 nt, Homo sapiens
ugguaauauugacuuguaua

SEQ ID NO: 1810401 - RNA, 17 nt, Homo sapiens
ugggucaagggccaguc

SEQ ID NO: 1810402 - RNA, 14 nt, Homo sapiens
ucuuuagaugcuau

SEQ ID NO: 1810403 - RNA, 18 nt, Homo sapiens
uuguguugugcagcauua

SEQ ID NO: 1810404 - RNA, 11 nt, Homo sapiens
auuuguacaaa

SEQ ID NO: 1810405 - RNA, 16 nt, Homo sapiens
aaucuucuaauuccaa

SEQ ID NO: 1810406 - RNA, 16 nt, Homo sapiens
auugcucuugagucuu

SEQ ID NO: 1810407 - RNA, 19 nt, Homo sapiens
acagauugcugcuucugcu

SEQ ID NO: 1810408 - RNA, 17 nt, Homo sapiens
cuuauggccacaagcaa

SEQ ID NO: 1810409 - RNA, 19 nt, Homo sapiens
caaaacuaccacauucugu

SEQ ID NO: 1810410 - RNA, 19 nt, Homo sapiens
aaauuaaaccaagcagcuu

SEQ ID NO: 1810411 - RNA, 14 nt, Homo sapiens
agaaagugcagaau

SEQ ID NO: 1810412 - RNA, 21 nt, Homo sapiens
uaguuguugaaacaaaacugg

SEQ ID NO: 1810413 - RNA, 17 nt, Homo sapiens
ucuucucaggauuuaaa

SEQ ID NO: 1810414 - RNA, 16 nt, Homo sapiens
aauaagcagaagccau

SEQ ID NO: 1810415 - RNA, 20 nt, Homo sapiens
uguucuagcccccaaagagu

SEQ ID NO: 1810416 - RNA, 19 nt, Homo sapiens
gcacgcggcggacugggca

SEQ ID NO: 1810417 - RNA, 17 nt, Homo sapiens
uaagaaacacaaugcca

SEQ ID NO: 1810418 - RNA, 18 nt, Homo sapiens
acgcucaugacagcaaag

SEQ ID NO: 1810419 - RNA, 13 nt, Homo sapiens
agggaacauccug

SEQ ID NO: 1810420 - RNA, 15 nt, Homo sapiens
cagugugacuccuca

SEQ ID NO: 1810421 - RNA, 16 nt, Homo sapiens
acuugcauacagagac

SEQ ID NO: 1810422 - RNA, 15 nt, Homo sapiens
cucuuuccuugcuca

SEQ ID NO: 1810423 - RNA, 18 nt, Homo sapiens
cguggccccaaauuugcu

SEQ ID NO: 1810424 - RNA, 13 nt, Homo sapiens
uuaauacauucua

SEQ ID NO: 1810425 - RNA, 17 nt, Homo sapiens
uuugauaggauguggau

SEQ ID NO: 1810426 - RNA, 13 nt, Homo sapiens
gauaaaaaucaua

SEQ ID NO: 1810427 - RNA, 19 nt, Homo sapiens
aagagcuuagaaacuggaa

SEQ ID NO: 1810428 - RNA, 12 nt, Homo sapiens
gggagugucuaa

SEQ ID NO: 1810429 - RNA, 19 nt, Homo sapiens
acauuucccuccugggaga

SEQ ID NO: 1810430 - RNA, 18 nt, Homo sapiens
aguuucuuccauucccau

SEQ ID NO: 1810431 - RNA, 20 nt, Homo sapiens
cuucucaggacacaggccug

SEQ ID NO: 1810432 - RNA, 12 nt, Homo sapiens
cuccaaggaccg

SEQ ID NO: 1810433 - RNA, 19 nt, Homo sapiens
uggagaaggugacaugaca

SEQ ID NO: 1810434 - RNA, 18 nt, Homo sapiens
ggaccaaguaguuugccc

SEQ ID NO: 1810435 - RNA, 16 nt, Homo sapiens
gcuaggcugagaugca

SEQ ID NO: 1810436 - RNA, 19 nt, Homo sapiens
gagaucguccacugucaag

SEQ ID NO: 1810437 - RNA, 21 nt, Homo sapiens
augucugaaaaaugccugcug

SEQ ID NO: 1810438 - RNA, 20 nt, Homo sapiens
cauuuguggugauauagaau

SEQ ID NO: 1810439 - RNA, 22 nt, Homo sapiens
aguagaucuauauuagaucaaa

SEQ ID NO: 1810440 - RNA, 21 nt, Homo sapiens
ccuuuguauuuuuacuuuuaa

SEQ ID NO: 1810441 - RNA, 16 nt, Homo sapiens
aguauaaacaaaguua

SEQ ID NO: 1810442 - RNA, 19 nt, Homo sapiens
ucaaucaaaacucaguauc

SEQ ID NO: 1810443 - RNA, 12 nt, Homo sapiens
cagagauguuca

SEQ ID NO: 1810444 - RNA, 16 nt, Homo sapiens
gccuccugauguuugu

SEQ ID NO: 1810445 - RNA, 18 nt, Homo sapiens
acagaagccucacugcaa

SEQ ID NO: 1810446 - RNA, 12 nt, Homo sapiens
cuuccuagguca

SEQ ID NO: 1810447 - RNA, 19 nt, Homo sapiens
aguaauuguaauacaccaa

SEQ ID NO: 1810448 - RNA, 17 nt, Homo sapiens
ugauccuuccuacuuug

SEQ ID NO: 1810449 - RNA, 11 nt, Homo sapiens
uagcugcugaa

SEQ ID NO: 1810450 - RNA, 13 nt, Homo sapiens
cuuggcugugaaa

SEQ ID NO: 1810451 - RNA, 14 nt, Homo sapiens
gcugccugccaugu

SEQ ID NO: 1810452 - RNA, 18 nt, Homo sapiens
auuuaauuguaccauuca

SEQ ID NO: 1810453 - RNA, 21 nt, Homo sapiens
ccuggaacugucucucaugaa

SEQ ID NO: 1810454 - RNA, 17 nt, Homo sapiens
cuccccuccuugcaccg

SEQ ID NO: 1810455 - RNA, 17 nt, Homo sapiens
cuaaaggaugaacaugu

SEQ ID NO: 1810456 - RNA, 15 nt, Homo sapiens
aauguuguaauucau

SEQ ID NO: 1810457 - RNA, 11 nt, Homo sapiens
caggacugugg

SEQ ID NO: 1810458 - RNA, 14 nt, Homo sapiens
ucacuaauacuaau

SEQ ID NO: 1810459 - RNA, 14 nt, Homo sapiens
uaaaauauaaucua

SEQ ID NO: 1810460 - RNA, 19 nt, Homo sapiens
ucuaacucaaagacuuccu

SEQ ID NO: 1810461 - RNA, 17 nt, Homo sapiens
cuuuuuaaauccuaaaa

SEQ ID NO: 1810462 - RNA, 21 nt, Homo sapiens
uguucaugcugaauccaccuc

SEQ ID NO: 1810463 - RNA, 11 nt, Homo sapiens
accaucugucu

SEQ ID NO: 1810464 - RNA, 20 nt, Homo sapiens
caaccuguaauaaauaugag

SEQ ID NO: 1810465 - RNA, 13 nt, Homo sapiens
ggcaccugaccac

SEQ ID NO: 1810466 - RNA, 13 nt, Homo sapiens
uuggggggccacc

SEQ ID NO: 1810467 - RNA, 17 nt, Homo sapiens
ccugacaaaaguuccau

SEQ ID NO: 1810468 - RNA, 16 nt, Homo sapiens
aauguauguacaauac

SEQ ID NO: 1810469 - RNA, 20 nt, Homo sapiens
ccaaauuguguauauaucuu

SEQ ID NO: 1810470 - RNA, 16 nt, Homo sapiens
uggacccugacuguau

SEQ ID NO: 1810471 - RNA, 13 nt, Homo sapiens
ucuugcaugucua

SEQ ID NO: 1810472 - RNA, 12 nt, Homo sapiens
cuguuuccauag

SEQ ID NO: 1810473 - RNA, 17 nt, Homo sapiens
ccacccuucucagggac

SEQ ID NO: 1810474 - RNA, 21 nt, Homo sapiens
aaugagucugcuuucacugug

SEQ ID NO: 1810475 - RNA, 21 nt, Homo sapiens
aaacaacuuguacuuguuuca

SEQ ID NO: 1810476 - RNA, 18 nt, Homo sapiens
cuacauucuauuucauau

SEQ ID NO: 1810477 - RNA, 20 nt, Homo sapiens
guuagauuuuguauucaggg

SEQ ID NO: 1810478 - RNA, 21 nt, Homo sapiens
ggucugacaugaacacuuuuu

SEQ ID NO: 1810479 - RNA, 15 nt, Homo sapiens
acccaggaaucucaa

SEQ ID NO: 1810480 - RNA, 22 nt, Homo sapiens
aaguaccuuauucuacaucauu

SEQ ID NO: 1810481 - RNA, 14 nt, Homo sapiens
cccuacccacuucc

SEQ ID NO: 1810482 - RNA, 19 nt, Homo sapiens
uuuauauauuugaauauca

SEQ ID NO: 1810483 - RNA, 23 nt, Homo sapiens
aaaaauacugccagaugcugaug

SEQ ID NO: 1810484 - RNA, 23 nt, Homo sapiens
uuaaacacacauugcagcuucaa

SEQ ID NO: 1810485 - RNA, 22 nt, Homo sapiens
uucaucgacuuagccugaguca

SEQ ID NO: 1810486 - RNA, 16 nt, Homo sapiens
cuuuuggaacauuucu

SEQ ID NO: 1810487 - RNA, 16 nt, Homo sapiens
agggcuggcugcugga

SEQ ID NO: 1810488 - RNA, 15 nt, Homo sapiens
gaaaaacacagugca

SEQ ID NO: 1810489 - RNA, 11 nt, Homo sapiens
uaggaaaaccu

SEQ ID NO: 1810490 - RNA, 18 nt, Homo sapiens
uuuaaauaaaguaucaug

SEQ ID NO: 1810491 - RNA, 19 nt, Homo sapiens
guuggaccuauugccagga

SEQ ID NO: 1810492 - RNA, 15 nt, Homo sapiens
auccacuuugcucug

SEQ ID NO: 1810493 - RNA, 18 nt, Homo sapiens
ugcccccucccacccugc

SEQ ID NO: 1810494 - RNA, 16 nt, Homo sapiens
aucauuugagcucaug

SEQ ID NO: 1810495 - RNA, 17 nt, Homo sapiens
acagacggaaggguaaa

SEQ ID NO: 1810496 - RNA, 19 nt, Homo sapiens
gcaguggcagcaacaaagg

SEQ ID NO: 1810497 - RNA, 16 nt, Homo sapiens
uaaugcucaccuuuau

SEQ ID NO: 1810498 - RNA, 17 nt, Homo sapiens
gugacaagcucacagac

SEQ ID NO: 1810499 - RNA, 16 nt, Homo sapiens
aucagaguaaggcucu

SEQ ID NO: 1810500 - RNA, 14 nt, Homo sapiens
uauuuauagcaaag

SEQ ID NO: 1810501 - RNA, 14 nt, Homo sapiens
cagcugacacaucu

SEQ ID NO: 1810502 - RNA, 22 nt, Homo sapiens
agcuggggccccugcaaccucg

SEQ ID NO: 1810503 - RNA, 19 nt, Homo sapiens
uaugacacugagcaagauc

SEQ ID NO: 1810504 - RNA, 16 nt, Homo sapiens
uugauuaugcagaaua

SEQ ID NO: 1810505 - RNA, 18 nt, Homo sapiens
uuguuguaaaaagcccag

SEQ ID NO: 1810506 - RNA, 13 nt, Homo sapiens
agccuuagacaaa

SEQ ID NO: 1810507 - RNA, 17 nt, Homo sapiens
uauggagggaacacuga

SEQ ID NO: 1810508 - RNA, 17 nt, Homo sapiens
gcacacucuucucuuga

SEQ ID NO: 1810509 - RNA, 22 nt, Homo sapiens
uggggaccucugggcagcuccu

SEQ ID NO: 1810510 - RNA, 23 nt, Homo sapiens
cugucuucuuucuccauggagcc

SEQ ID NO: 1810511 - RNA, 15 nt, Homo sapiens
ugucauucgcuccca

SEQ ID NO: 1810512 - RNA, 17 nt, Homo sapiens
gacagaaggugccacuu

SEQ ID NO: 1810513 - RNA, 15 nt, Homo sapiens
cucaaaaauagggaa

SEQ ID NO: 1810514 - RNA, 22 nt, Homo sapiens
aaacuuuccaugacaguagcau

SEQ ID NO: 1810515 - RNA, 18 nt, Homo sapiens
uguaaacaucagcaagac

SEQ ID NO: 1810516 - RNA, 16 nt, Homo sapiens
ugaccugggaggacuc

SEQ ID NO: 1810517 - RNA, 14 nt, Homo sapiens
aauuaucucaagua

SEQ ID NO: 1810518 - RNA, 20 nt, Homo sapiens
auaaacuuuuuuucaaugug

SEQ ID NO: 1810519 - RNA, 20 nt, Homo sapiens
gacccucugacccuagcucu

SEQ ID NO: 1810520 - RNA, 14 nt, Homo sapiens
cccaacgcacagga

SEQ ID NO: 1810521 - RNA, 20 nt, Homo sapiens
aaucacccccaggaccucuu

SEQ ID NO: 1810522 - RNA, 13 nt, Homo sapiens
ucucauccaucau

SEQ ID NO: 1810523 - RNA, 18 nt, Homo sapiens
cucggcagucacuuccac

SEQ ID NO: 1810524 - RNA, 18 nt, Homo sapiens
ccagccccuuccugggua

SEQ ID NO: 1810525 - RNA, 14 nt, Homo sapiens
gcuguagaagaugg

SEQ ID NO: 1810526 - RNA, 20 nt, Homo sapiens
cuggcuuagugccacccacc

SEQ ID NO: 1810527 - RNA, 20 nt, Homo sapiens
auuuguaccuuauugaucuu

SEQ ID NO: 1810528 - RNA, 23 nt, Homo sapiens
uccuuaugauguccaacaaggaa

SEQ ID NO: 1810529 - RNA, 21 nt, Homo sapiens
ccacaaaggcauaaacuugaa

SEQ ID NO: 1810530 - RNA, 18 nt, Homo sapiens
auccagccucacuucuag

SEQ ID NO: 1810531 - RNA, 16 nt, Homo sapiens
gcuacauauacauagu

SEQ ID NO: 1810532 - RNA, 19 nt, Homo sapiens
uggcucugagauacuaaua

SEQ ID NO: 1810533 - RNA, 15 nt, Homo sapiens
gucucucccuacccu

SEQ ID NO: 1810534 - RNA, 17 nt, Homo sapiens
gaccaaagagcccucaa

SEQ ID NO: 1810535 - RNA, 16 nt, Homo sapiens
gcaucaucuucugggu

SEQ ID NO: 1810536 - RNA, 17 nt, Homo sapiens
uggccagaccacagcag

SEQ ID NO: 1810537 - RNA, 12 nt, Homo sapiens
gcauuuuccucc

SEQ ID NO: 1810538 - RNA, 15 nt, Homo sapiens
aacagccuuaaaucc

SEQ ID NO: 1810539 - RNA, 15 nt, Homo sapiens
uccugccuacauucc

SEQ ID NO: 1810540 - RNA, 15 nt, Homo sapiens
uucauuucauuucag

SEQ ID NO: 1810541 - RNA, 17 nt, Homo sapiens
gcuaugcuaaaccuccu

SEQ ID NO: 1810542 - RNA, 15 nt, Homo sapiens
uaccccaaccccagg

SEQ ID NO: 1810543 - RNA, 15 nt, Homo sapiens
uagcaccauuaacuc

SEQ ID NO: 1810544 - RNA, 17 nt, Homo sapiens
ccugauuaaagugccuu

SEQ ID NO: 1810545 - RNA, 16 nt, Homo sapiens
ggcaauuaauuccuuc

SEQ ID NO: 1810546 - RNA, 18 nt, Homo sapiens
ccaccucuuucuauuuau

SEQ ID NO: 1810547 - RNA, 17 nt, Homo sapiens
gaccucaucacugagaa

SEQ ID NO: 1810548 - RNA, 20 nt, Homo sapiens
uuaguuccccuacuacacuu

SEQ ID NO: 1810549 - RNA, 16 nt, Homo sapiens
uccgagcggcuacaaa

SEQ ID NO: 1810550 - RNA, 17 nt, Homo sapiens
uaaacaauaaaugggcc

SEQ ID NO: 1810551 - RNA, 12 nt, Homo sapiens
uaguaacacuaa

SEQ ID NO: 1810552 - RNA, 15 nt, Homo sapiens
aaguaagacuugauu

SEQ ID NO: 1810553 - RNA, 18 nt, Homo sapiens
aaaguaucucuacuuucc

SEQ ID NO: 1810554 - RNA, 11 nt, Homo sapiens
agugacaguca

SEQ ID NO: 1810555 - RNA, 22 nt, Homo sapiens
gcuucucacacuggaggagcac

SEQ ID NO: 1810556 - RNA, 15 nt, Homo sapiens
cugugcacauucucc

SEQ ID NO: 1810557 - RNA, 17 nt, Homo sapiens
ggcaaagaaaggagaua

SEQ ID NO: 1810558 - RNA, 21 nt, Homo sapiens
aaauuuuaguaguuacuaaaa

SEQ ID NO: 1810559 - RNA, 16 nt, Homo sapiens
cuuuccucuuaauucc

SEQ ID NO: 1810560 - RNA, 18 nt, Homo sapiens
uauuagcagggauucucu

SEQ ID NO: 1810561 - RNA, 15 nt, Homo sapiens
accaguguaaauuca

SEQ ID NO: 1810562 - RNA, 23 nt, Homo sapiens
augcaggaagugguggcaaaggu

SEQ ID NO: 1810563 - RNA, 19 nt, Homo sapiens
aagcugaaauuuuugugua

SEQ ID NO: 1810564 - RNA, 16 nt, Homo sapiens
uuuggcugauuccuaa

SEQ ID NO: 1810565 - RNA, 14 nt, Homo sapiens
gaaugcagggacaa

SEQ ID NO: 1810566 - RNA, 19 nt, Homo sapiens
guuuggagguccuagguca

SEQ ID NO: 1810567 - RNA, 15 nt, Homo sapiens
aauucuagagccagc

SEQ ID NO: 1810568 - RNA, 13 nt, Homo sapiens
cucagugcaucuu

SEQ ID NO: 1810569 - RNA, 19 nt, Homo sapiens
cuguaauguuaauauugau

SEQ ID NO: 1810570 - RNA, 23 nt, Homo sapiens
uuguguaugauuuugaugcacaa

SEQ ID NO: 1810571 - RNA, 13 nt, Homo sapiens
aagcccagcauca

SEQ ID NO: 1810572 - RNA, 14 nt, Homo sapiens
gguggccugggauc

SEQ ID NO: 1810573 - RNA, 14 nt, Homo sapiens
cuugggcucugaug

SEQ ID NO: 1810574 - RNA, 13 nt, Homo sapiens
uaauaaacauccu

SEQ ID NO: 1810575 - RNA, 16 nt, Homo sapiens
uacuaucauggcauau

SEQ ID NO: 1810576 - RNA, 16 nt, Homo sapiens
ccaucaauaaaacaca

SEQ ID NO: 1810577 - RNA, 15 nt, Homo sapiens
auguuaugacuaugu

SEQ ID NO: 1810578 - RNA, 20 nt, Homo sapiens
cgccucacaccccaguggau

SEQ ID NO: 1810579 - RNA, 19 nt, Homo sapiens
guuuuccucccuucugcua

SEQ ID NO: 1810580 - RNA, 15 nt, Homo sapiens
gcagggcuggcacgu

SEQ ID NO: 1810581 - RNA, 22 nt, Homo sapiens
aauccccccagggcugggcacu

SEQ ID NO: 1810582 - RNA, 22 nt, Homo sapiens
cuugauauuuaagcagcuugaa

SEQ ID NO: 1810583 - RNA, 19 nt, Homo sapiens
auguucuuuaaaggcaucu

SEQ ID NO: 1810584 - RNA, 22 nt, Homo sapiens
uaccagauauuugaaucuuucu

SEQ ID NO: 1810585 - RNA, 12 nt, Homo sapiens
gaggugcuccau

SEQ ID NO: 1810586 - RNA, 12 nt, Homo sapiens
gcuggcucugag

SEQ ID NO: 1810587 - RNA, 21 nt, Homo sapiens
uggugccucucucuugcuuac

SEQ ID NO: 1810588 - RNA, 17 nt, Homo sapiens
auuucaguaagcugugu

SEQ ID NO: 1810589 - RNA, 12 nt, Homo sapiens
ccuacccagcgu

SEQ ID NO: 1810590 - RNA, 23 nt, Homo sapiens
uccugccagggugagcaggguca

SEQ ID NO: 1810591 - RNA, 18 nt, Homo sapiens
ugcuaagugcuuauuaca

SEQ ID NO: 1810592 - RNA, 19 nt, Homo sapiens
ugauaauaaucaugaucac

SEQ ID NO: 1810593 - RNA, 17 nt, Homo sapiens
uauuuccucugugcaaa

SEQ ID NO: 1810594 - RNA, 17 nt, Homo sapiens
gucuuguuauguacaaa

SEQ ID NO: 1810595 - RNA, 23 nt, Homo sapiens
guacucaguaaggcagugcagua

SEQ ID NO: 1810596 - RNA, 15 nt, Homo sapiens
aacuuauucucugua

SEQ ID NO: 1810597 - RNA, 15 nt, Homo sapiens
uaaaagucacucuga

SEQ ID NO: 1810598 - RNA, 14 nt, Homo sapiens
aacagugugauuca

SEQ ID NO: 1810599 - RNA, 19 nt, Homo sapiens
cuuuuccaucccacuccac

SEQ ID NO: 1810600 - RNA, 12 nt, Homo sapiens
uauaaacagaca

SEQ ID NO: 1810601 - RNA, 22 nt, Homo sapiens
acaggguuuugccauguuggcc

SEQ ID NO: 1810602 - RNA, 13 nt, Homo sapiens
cagcucacucugc

SEQ ID NO: 1810603 - RNA, 16 nt, Homo sapiens
cugucuacuugcucag

SEQ ID NO: 1810604 - RNA, 16 nt, Homo sapiens
ucccauucuauguguc

SEQ ID NO: 1810605 - RNA, 15 nt, Homo sapiens
auacacuaugaagau

SEQ ID NO: 1810606 - RNA, 14 nt, Homo sapiens
agccacuaagcaga

SEQ ID NO: 1810607 - RNA, 16 nt, Homo sapiens
uucuguuuuguuaaua

SEQ ID NO: 1810608 - RNA, 19 nt, Homo sapiens
ucaggaauuuuguaaucuc

SEQ ID NO: 1810609 - RNA, 16 nt, Homo sapiens
auaaagcauucuuuaa

SEQ ID NO: 1810610 - RNA, 20 nt, Homo sapiens
gagggcucacucggcuucca

SEQ ID NO: 1810611 - RNA, 19 nt, Homo sapiens
uccucucgagcccagaugg

SEQ ID NO: 1810612 - RNA, 15 nt, Homo sapiens
cagagagcagcuuca

SEQ ID NO: 1810613 - RNA, 13 nt, Homo sapiens
ugccacacucuga

SEQ ID NO: 1810614 - RNA, 16 nt, Homo sapiens
guucauccgcacugua

SEQ ID NO: 1810615 - RNA, 16 nt, Homo sapiens
caaaggugauggucau

SEQ ID NO: 1810616 - RNA, 13 nt, Homo sapiens
uguaguagucuca

SEQ ID NO: 1810617 - RNA, 21 nt, Homo sapiens
cuggagccaucucuuccucau

SEQ ID NO: 1810618 - RNA, 18 nt, Homo sapiens
uacacagagaaauacaaa

SEQ ID NO: 1810619 - RNA, 22 nt, Homo sapiens
uagaaaguauguuuguguuggu

SEQ ID NO: 1810620 - RNA, 18 nt, Homo sapiens
ugaagcagucagcccuua

SEQ ID NO: 1810621 - RNA, 16 nt, Homo sapiens
gaaaaggaaaagccaa

SEQ ID NO: 1810622 - RNA, 23 nt, Homo sapiens
uucuucacugcagauuucucacc

SEQ ID NO: 1810623 - RNA, 18 nt, Homo sapiens
uucccauuggaugcauuu

SEQ ID NO: 1810624 - RNA, 13 nt, Homo sapiens
ugugcaacggcca

SEQ ID NO: 1810625 - RNA, 21 nt, Homo sapiens
auccauguuaguuuuuacuuu

SEQ ID NO: 1810626 - RNA, 12 nt, Homo sapiens
guuggacucuga

SEQ ID NO: 1810627 - RNA, 19 nt, Homo sapiens
uaaaaaguuagccagguau

SEQ ID NO: 1810628 - RNA, 14 nt, Homo sapiens
cacuguugcccagg

SEQ ID NO: 1810629 - RNA, 14 nt, Homo sapiens
auuuuggcgcuauu

SEQ ID NO: 1810630 - RNA, 12 nt, Homo sapiens
uccaaccuggag

SEQ ID NO: 1810631 - RNA, 13 nt, Homo sapiens
auuuauguguaua

SEQ ID NO: 1810632 - RNA, 13 nt, Homo sapiens
aaauaugugauua

SEQ ID NO: 1810633 - RNA, 17 nt, Homo sapiens
auagucaguaauuuauc

SEQ ID NO: 1810634 - RNA, 16 nt, Homo sapiens
augcauuucucugggg

SEQ ID NO: 1810635 - RNA, 17 nt, Homo sapiens
uuuuaaaacauucacac

SEQ ID NO: 1810636 - RNA, 18 nt, Homo sapiens
gcuacucgggaggcugaa

SEQ ID NO: 1810637 - RNA, 23 nt, Homo sapiens
uucuucuucaagacucugaacaa

SEQ ID NO: 1810638 - RNA, 18 nt, Homo sapiens
uuucauuguguucucuau

SEQ ID NO: 1810639 - RNA, 14 nt, Homo sapiens
aucagccucuggcc

SEQ ID NO: 1810640 - RNA, 20 nt, Homo sapiens
cugaacucuacgccacucca

SEQ ID NO: 1810641 - RNA, 15 nt, Homo sapiens
uacuauuauggaauu

SEQ ID NO: 1810642 - RNA, 22 nt, Homo sapiens
ccaugacaagaacaaagccacu

SEQ ID NO: 1810643 - RNA, 14 nt, Homo sapiens
auuuguuugugcuu

SEQ ID NO: 1810644 - RNA, 15 nt, Homo sapiens
cuaggcaauguacuc

SEQ ID NO: 1810645 - RNA, 21 nt, Homo sapiens
ugagugauuccaguauuucau

SEQ ID NO: 1810646 - RNA, 21 nt, Homo sapiens
cagugaauuucugauuucacu

SEQ ID NO: 1810647 - RNA, 11 nt, Homo sapiens
caacaaaccau

SEQ ID NO: 1810648 - RNA, 21 nt, Homo sapiens
uuugagcccacaaagccuuau

SEQ ID NO: 1810649 - RNA, 15 nt, Homo sapiens
uccccuuucacaggu

SEQ ID NO: 1810650 - RNA, 18 nt, Homo sapiens
agaaagacucugagaugu

SEQ ID NO: 1810651 - RNA, 16 nt, Homo sapiens
ccacgaccuuugaaga

SEQ ID NO: 1810652 - RNA, 16 nt, Homo sapiens
gagaugaaggaaggac

SEQ ID NO: 1810653 - RNA, 15 nt, Homo sapiens
gauuguuguuugcca

SEQ ID NO: 1810654 - RNA, 20 nt, Homo sapiens
auggugaaacccccaucucu

SEQ ID NO: 1810655 - RNA, 14 nt, Homo sapiens
acuugcaaguccca

SEQ ID NO: 1810656 - RNA, 18 nt, Homo sapiens
ccuggaggagcugugcug

SEQ ID NO: 1810657 - RNA, 16 nt, Homo sapiens
aaugaaaccaaagcca

SEQ ID NO: 1810658 - RNA, 21 nt, Homo sapiens
uaagaucucuuuguagccauc

SEQ ID NO: 1810659 - RNA, 17 nt, Homo sapiens
cuuggguucaagugauu

SEQ ID NO: 1810660 - RNA, 16 nt, Homo sapiens
gcuguggggaccacac

SEQ ID NO: 1810661 - RNA, 22 nt, Homo sapiens
gaggacucucuuaguucuuacc

SEQ ID NO: 1810662 - RNA, 22 nt, Homo sapiens
ggcaucuuugccuugggcugcu

SEQ ID NO: 1810663 - RNA, 16 nt, Homo sapiens
cugccaugaacuggag

SEQ ID NO: 1810664 - RNA, 14 nt, Homo sapiens
uaacagccuuucaa

SEQ ID NO: 1810665 - RNA, 19 nt, Homo sapiens
agccuuucuaaaaguugca

SEQ ID NO: 1810666 - RNA, 13 nt, Homo sapiens
ugcccauaccccu

SEQ ID NO: 1810667 - RNA, 17 nt, Homo sapiens
uccgcugccccaugugu

SEQ ID NO: 1810668 - RNA, 18 nt, Homo sapiens
aaaugauacuuacugaac

SEQ ID NO: 1810669 - RNA, 19 nt, Homo sapiens
acuagaaaguaauacaaua

SEQ ID NO: 1810670 - RNA, 13 nt, Homo sapiens
cucuacucuuaca

SEQ ID NO: 1810671 - RNA, 19 nt, Homo sapiens
cuggaacguuucacugcaa

SEQ ID NO: 1810672 - RNA, 20 nt, Homo sapiens
auugcuggcaucugugcuaa

SEQ ID NO: 1810673 - RNA, 13 nt, Homo sapiens
uccgccauuccaa

SEQ ID NO: 1810674 - RNA, 19 nt, Homo sapiens
uccugggaacacaucuggc

SEQ ID NO: 1810675 - RNA, 14 nt, Homo sapiens
uuuauaaauggagg

SEQ ID NO: 1810676 - RNA, 13 nt, Homo sapiens
acggaaucugccg

SEQ ID NO: 1810677 - RNA, 20 nt, Homo sapiens
gccaaggucugagcacugga

SEQ ID NO: 1810678 - RNA, 20 nt, Homo sapiens
ggccagcuuccccucacuua

SEQ ID NO: 1810679 - RNA, 14 nt, Homo sapiens
auuaaaucugguca

SEQ ID NO: 1810680 - RNA, 18 nt, Homo sapiens
uguguacagucuuugcag

SEQ ID NO: 1810681 - RNA, 19 nt, Homo sapiens
acaguacacagauaccuug

SEQ ID NO: 1810682 - RNA, 19 nt, Homo sapiens
ccagaaaaaaaaaaacuua

SEQ ID NO: 1810683 - RNA, 14 nt, Homo sapiens
cggguaccaugcug

SEQ ID NO: 1810684 - RNA, 17 nt, Homo sapiens
caccuuaagauuuugca

SEQ ID NO: 1810685 - RNA, 18 nt, Homo sapiens
auuauucccuguacaaua

SEQ ID NO: 1810686 - RNA, 17 nt, Homo sapiens
uaaaaaugucucagcaa

SEQ ID NO: 1810687 - RNA, 19 nt, Homo sapiens
ugucuuggacacuguacaa

SEQ ID NO: 1810688 - RNA, 17 nt, Homo sapiens
ccuugaguuucauauau

SEQ ID NO: 1810689 - RNA, 19 nt, Homo sapiens
cacacuuuucagcaaaaau

SEQ ID NO: 1810690 - RNA, 23 nt, Homo sapiens
gcacaauuaauuaaaagugaaac

SEQ ID NO: 1810691 - RNA, 15 nt, Homo sapiens
aaugacaagccuucu

SEQ ID NO: 1810692 - RNA, 21 nt, Homo sapiens
uggucgccaauccaugcucuc

SEQ ID NO: 1810693 - RNA, 15 nt, Homo sapiens
cauuucacauuccug

SEQ ID NO: 1810694 - RNA, 16 nt, Homo sapiens
agugacagaucacagg

SEQ ID NO: 1810695 - RNA, 19 nt, Homo sapiens
auauuuucccucucuugcc

SEQ ID NO: 1810696 - RNA, 12 nt, Homo sapiens
gucaaggaauaa

SEQ ID NO: 1810697 - RNA, 17 nt, Homo sapiens
gccucccauguucaagc

SEQ ID NO: 1810698 - RNA, 23 nt, Homo sapiens
auguuaggaaaauuucacauuaa

SEQ ID NO: 1810699 - RNA, 16 nt, Homo sapiens
uaacauauuugcacaa

SEQ ID NO: 1810700 - RNA, 14 nt, Homo sapiens
ccguaucacagugu

SEQ ID NO: 1810701 - RNA, 13 nt, Homo sapiens
cuguugaagcucu

SEQ ID NO: 1810702 - RNA, 20 nt, Homo sapiens
ucacugcucccccgugugua

SEQ ID NO: 1810703 - RNA, 12 nt, Homo sapiens
cuaccucuccag

SEQ ID NO: 1810704 - RNA, 12 nt, Homo sapiens
auuccucuacug

SEQ ID NO: 1810705 - RNA, 17 nt, Homo sapiens
gggucugagaucggccc

SEQ ID NO: 1810706 - RNA, 24 nt, Homo sapiens
agucuggcagacuuucuucucuau

SEQ ID NO: 1810707 - RNA, 20 nt, Homo sapiens
ucuugcuguuaaaucaguuc

SEQ ID NO: 1810708 - RNA, 17 nt, Homo sapiens
acauugucaaguggaaa

SEQ ID NO: 1810709 - RNA, 18 nt, Homo sapiens
gauggcuacugugccuug

SEQ ID NO: 1810710 - RNA, 22 nt, Homo sapiens
gaccauacauaauaaccaaaca

SEQ ID NO: 1810711 - RNA, 16 nt, Homo sapiens
agcccccccacccacc

SEQ ID NO: 1810712 - RNA, 10 nt, Homo sapiens
uucagucuuc

SEQ ID NO: 1810713 - RNA, 15 nt, Homo sapiens
cagcccucaggccag

SEQ ID NO: 1810714 - RNA, 23 nt, Homo sapiens
aaacuacuuuuguaccaguguga

SEQ ID NO: 1810715 - RNA, 20 nt, Homo sapiens
gucaucaucaagucaucugg

SEQ ID NO: 1810716 - RNA, 18 nt, Homo sapiens
gaacucgcuagguucuua

SEQ ID NO: 1810717 - RNA, 17 nt, Homo sapiens
augucuguaaucccagc

SEQ ID NO: 1810718 - RNA, 23 nt, Homo sapiens
aguagacuugcuuuggucacuuu

SEQ ID NO: 1810719 - RNA, 15 nt, Homo sapiens
ggcagaauagcuuau

SEQ ID NO: 1810720 - RNA, 19 nt, Homo sapiens
gggccaugcugugugagac

SEQ ID NO: 1810721 - RNA, 16 nt, Homo sapiens
agagagggaagcugag

SEQ ID NO: 1810722 - RNA, 12 nt, Homo sapiens
ucuuuauucuca

SEQ ID NO: 1810723 - RNA, 17 nt, Homo sapiens
gaaacgaagcaccauca

SEQ ID NO: 1810724 - RNA, 23 nt, Homo sapiens
acaucacuguccaccaccaccug

SEQ ID NO: 1810725 - RNA, 16 nt, Homo sapiens
ucauucaauauugaca

SEQ ID NO: 1810726 - RNA, 23 nt, Homo sapiens
ggcucuauuucggaaauacacua

SEQ ID NO: 1810727 - RNA, 13 nt, Homo sapiens
cuucccacagugg

SEQ ID NO: 1810728 - RNA, 18 nt, Homo sapiens
auucaaugugaacacugg

SEQ ID NO: 1810729 - RNA, 15 nt, Homo sapiens
agggucggccuguac

SEQ ID NO: 1810730 - RNA, 20 nt, Homo sapiens
cuuucauuuuuugaccucau

SEQ ID NO: 1810731 - RNA, 17 nt, Homo sapiens
caugagaaaaucaguaa

SEQ ID NO: 1810732 - RNA, 16 nt, Homo sapiens
ucaccccguuacagcu

SEQ ID NO: 1810733 - RNA, 14 nt, Homo sapiens
uaaaaugugcagua

SEQ ID NO: 1810734 - RNA, 20 nt, Homo sapiens
auuucuuaaaacacaugaua

SEQ ID NO: 1810735 - RNA, 19 nt, Homo sapiens
ucacaggcgccuaaaguca

SEQ ID NO: 1810736 - RNA, 22 nt, Homo sapiens
gguuuggggaccauaucaggag

SEQ ID NO: 1810737 - RNA, 21 nt, Homo sapiens
cugggugccgggcugcacaga

SEQ ID NO: 1810738 - RNA, 13 nt, Homo sapiens
gccucuagcugaa

SEQ ID NO: 1810739 - RNA, 23 nt, Homo sapiens
cuugccacaucuugaaaaugcca

SEQ ID NO: 1810740 - RNA, 17 nt, Homo sapiens
cuacuacccgagcccag

SEQ ID NO: 1810741 - RNA, 15 nt, Homo sapiens
cuccacucagguucu

SEQ ID NO: 1810742 - RNA, 21 nt, Homo sapiens
cagccaucaagagacugaguc

SEQ ID NO: 1810743 - RNA, 18 nt, Homo sapiens
caggagacccaacaauga

SEQ ID NO: 1810744 - RNA, 16 nt, Homo sapiens
caauucuuagaauauc

SEQ ID NO: 1810745 - RNA, 12 nt, Homo sapiens
agggaacacuca

SEQ ID NO: 1810746 - RNA, 14 nt, Homo sapiens
aagcuaucagcaau

SEQ ID NO: 1810747 - RNA, 21 nt, Homo sapiens
aggguauuuguggaaacuguc

SEQ ID NO: 1810748 - RNA, 20 nt, Homo sapiens
ucagcccugcaccaugcugc

SEQ ID NO: 1810749 - RNA, 21 nt, Homo sapiens
gaggcaccugcuggaaaccac

SEQ ID NO: 1810750 - RNA, 20 nt, Homo sapiens
gcuaagugaaagaagccagg

SEQ ID NO: 1810751 - RNA, 20 nt, Homo sapiens
uugaaagaaauguacuacua

SEQ ID NO: 1810752 - RNA, 20 nt, Homo sapiens
ccaaagacuuguuaaaugua

SEQ ID NO: 1810753 - RNA, 18 nt, Homo sapiens
aucauaaaggaucagaga

SEQ ID NO: 1810754 - RNA, 15 nt, Homo sapiens
cuuuuuggagagugc

SEQ ID NO: 1810755 - RNA, 16 nt, Homo sapiens
gcugcccaggaacccu

SEQ ID NO: 1810756 - RNA, 20 nt, Homo sapiens
gguucaagcuauucucaugc

SEQ ID NO: 1810757 - RNA, 16 nt, Homo sapiens
aggccuaggauucuaa

SEQ ID NO: 1810758 - RNA, 23 nt, Homo sapiens
acagcuugggaauccugcuaaag

SEQ ID NO: 1810759 - RNA, 17 nt, Homo sapiens
guaaaauggaggccagu

SEQ ID NO: 1810760 - RNA, 14 nt, Homo sapiens
augcgcaaauacaa

SEQ ID NO: 1810761 - RNA, 16 nt, Homo sapiens
acagacuggcaauaaa

SEQ ID NO: 1810762 - RNA, 15 nt, Homo sapiens
uuugugccaaccuau

SEQ ID NO: 1810763 - RNA, 14 nt, Homo sapiens
gaggcaaaggccag

SEQ ID NO: 1810764 - RNA, 15 nt, Homo sapiens
acagagagugaauac

SEQ ID NO: 1810765 - RNA, 20 nt, Homo sapiens
gcagcaccguucugugcaca

SEQ ID NO: 1810766 - RNA, 17 nt, Homo sapiens
ccagacaccaucaccac

SEQ ID NO: 1810767 - RNA, 18 nt, Homo sapiens
uauauuuguaaacuacaa

SEQ ID NO: 1810768 - RNA, 15 nt, Homo sapiens
acgcagcacaagcuc

SEQ ID NO: 1810769 - RNA, 17 nt, Homo sapiens
auacuuaaaauaucucu

SEQ ID NO: 1810770 - RNA, 14 nt, Homo sapiens
aauucaucagucau

SEQ ID NO: 1810771 - RNA, 13 nt, Homo sapiens
cggaccuaccucc

SEQ ID NO: 1810772 - RNA, 15 nt, Homo sapiens
gccacagucacugga

SEQ ID NO: 1810773 - RNA, 20 nt, Homo sapiens
auaaaaaggaacaagacuga

SEQ ID NO: 1810774 - RNA, 12 nt, Homo sapiens
acaacaacaaaa

SEQ ID NO: 1810775 - RNA, 19 nt, Homo sapiens
uaugguaaauaacugugac

SEQ ID NO: 1810776 - RNA, 15 nt, Homo sapiens
uugccauuacucaau

SEQ ID NO: 1810777 - RNA, 17 nt, Homo sapiens
aaacuccuuuugguuua

SEQ ID NO: 1810778 - RNA, 15 nt, Homo sapiens
aggcccgcucuacau

SEQ ID NO: 1810779 - RNA, 11 nt, Homo sapiens
caggugucaaa

SEQ ID NO: 1810780 - RNA, 14 nt, Homo sapiens
gacuauacugcuga

SEQ ID NO: 1810781 - RNA, 15 nt, Homo sapiens
ucucauaacucugug

SEQ ID NO: 1810782 - RNA, 17 nt, Homo sapiens
uacaccgugaggccaag

SEQ ID NO: 1810783 - RNA, 18 nt, Homo sapiens
cccagccccugccagcuu

SEQ ID NO: 1810784 - RNA, 13 nt, Homo sapiens
uucauagugcuca

SEQ ID NO: 1810785 - RNA, 20 nt, Homo sapiens
gguaccuucaggcagccagu

SEQ ID NO: 1810786 - RNA, 22 nt, Homo sapiens
ugaagcuuugugaaaacuacug

SEQ ID NO: 1810787 - RNA, 22 nt, Homo sapiens
uguuccgugccaggcauucaau

SEQ ID NO: 1810788 - RNA, 16 nt, Homo sapiens
cagcaaacccaaagau

SEQ ID NO: 1810789 - RNA, 19 nt, Homo sapiens
aucaguguuggccaugaug

SEQ ID NO: 1810790 - RNA, 13 nt, Homo sapiens
aucuauaccaccu

SEQ ID NO: 1810791 - RNA, 17 nt, Homo sapiens
ggaaggugccuggccau

SEQ ID NO: 1810792 - RNA, 23 nt, Homo sapiens
aaacacccccagauucuucgcac

SEQ ID NO: 1810793 - RNA, 16 nt, Homo sapiens
cacaggucuugcccaa

SEQ ID NO: 1810794 - RNA, 14 nt, Homo sapiens
aggagcugcaaauu

SEQ ID NO: 1810795 - RNA, 22 nt, Homo sapiens
agacucaccucauccuuaccgc

SEQ ID NO: 1810796 - RNA, 16 nt, Homo sapiens
agucugggcacuggau

SEQ ID NO: 1810797 - RNA, 20 nt, Homo sapiens
cuauucaggcuguuguuggc

SEQ ID NO: 1810798 - RNA, 14 nt, Homo sapiens
guggcucacuacug

SEQ ID NO: 1810799 - RNA, 12 nt, Homo sapiens
uagccccagcgc

SEQ ID NO: 1810800 - RNA, 12 nt, Homo sapiens
ucagcccagaag

SEQ ID NO: 1810801 - RNA, 23 nt, Homo sapiens
caaguauucauuuuuucuacccu

SEQ ID NO: 1810802 - RNA, 21 nt, Homo sapiens
cagcacuccccagagcugugc

SEQ ID NO: 1810803 - RNA, 21 nt, Homo sapiens
augccugacuagggagccaug

SEQ ID NO: 1810804 - RNA, 15 nt, Homo sapiens
caagaauacuacuua

SEQ ID NO: 1810805 - RNA, 16 nt, Homo sapiens
cccaccugcugcugua

SEQ ID NO: 1810806 - RNA, 20 nt, Homo sapiens
uauguuucuaaaaauuggua

SEQ ID NO: 1810807 - RNA, 12 nt, Homo sapiens
ucugggugcaug

SEQ ID NO: 1810808 - RNA, 19 nt, Homo sapiens
gacacaggcccucccuguu

SEQ ID NO: 1810809 - RNA, 13 nt, Homo sapiens
uuucaugcaaaag

SEQ ID NO: 1810810 - RNA, 20 nt, Homo sapiens
ucucauuuggacuugcugaa

SEQ ID NO: 1810811 - RNA, 19 nt, Homo sapiens
gaccugccaggcacacuga

SEQ ID NO: 1810812 - RNA, 15 nt, Homo sapiens
cuccaauuggugcuu

SEQ ID NO: 1810813 - RNA, 18 nt, Homo sapiens
cuucugccucuuaacuua

SEQ ID NO: 1810814 - RNA, 16 nt, Homo sapiens
ggugcuaaccuggaua

SEQ ID NO: 1810815 - RNA, 20 nt, Homo sapiens
uaagugggguugcaaccacu

SEQ ID NO: 1810816 - RNA, 20 nt, Homo sapiens
uaaauuauuagagauuuucu

SEQ ID NO: 1810817 - RNA, 20 nt, Homo sapiens
ccuuucaccccauccacaug

SEQ ID NO: 1810818 - RNA, 13 nt, Homo sapiens
gcuaaauauuuac

SEQ ID NO: 1810819 - RNA, 19 nt, Homo sapiens
acuccagguggaacaaaca

SEQ ID NO: 1810820 - RNA, 19 nt, Homo sapiens
agauaaugccaccaaagga

SEQ ID NO: 1810821 - RNA, 19 nt, Homo sapiens
uucaagaccagccugggca

SEQ ID NO: 1810822 - RNA, 14 nt, Homo sapiens
cuugggcaauaaag

SEQ ID NO: 1810823 - RNA, 20 nt, Homo sapiens
ugcugacaaugcugccaugc

SEQ ID NO: 1810824 - RNA, 12 nt, Homo sapiens
augacacuacuu

SEQ ID NO: 1810825 - RNA, 22 nt, Homo sapiens
agcaagacagcucuucuugaaa

SEQ ID NO: 1810826 - RNA, 15 nt, Homo sapiens
ucauguucugugaua

SEQ ID NO: 1810827 - RNA, 15 nt, Homo sapiens
caugcccugugcaac

SEQ ID NO: 1810828 - RNA, 16 nt, Homo sapiens
ugccccagggaccuuu

SEQ ID NO: 1810829 - RNA, 13 nt, Homo sapiens
gcagcagaauugc

SEQ ID NO: 1810830 - RNA, 13 nt, Homo sapiens
gaugugauacaaa

SEQ ID NO: 1810831 - RNA, 12 nt, Homo sapiens
ucucacacugga

SEQ ID NO: 1810832 - RNA, 23 nt, Homo sapiens
ccuugcccgccagccaguggccg

SEQ ID NO: 1810833 - RNA, 18 nt, Homo sapiens
aucauuccccgacacugc

SEQ ID NO: 1810834 - RNA, 20 nt, Homo sapiens
auucacuuuauuauuuugcu

SEQ ID NO: 1810835 - RNA, 13 nt, Homo sapiens
cagcugugcugua

SEQ ID NO: 1810836 - RNA, 15 nt, Homo sapiens
cuggcaugacacucu

SEQ ID NO: 1810837 - RNA, 13 nt, Homo sapiens
gugcuggccacac

SEQ ID NO: 1810838 - RNA, 17 nt, Homo sapiens
gccuccaccuugagcac

SEQ ID NO: 1810839 - RNA, 16 nt, Homo sapiens
agaguguuucuuccac

SEQ ID NO: 1810840 - RNA, 15 nt, Homo sapiens
cacuagaugacugua

SEQ ID NO: 1810841 - RNA, 12 nt, Homo sapiens
cagagccagaaa

SEQ ID NO: 1810842 - RNA, 16 nt, Homo sapiens
cggcuuguaaauguga

SEQ ID NO: 1810843 - RNA, 18 nt, Homo sapiens
caugaccugugaccagca

SEQ ID NO: 1810844 - RNA, 16 nt, Homo sapiens
uugagcugagugcuga

SEQ ID NO: 1810845 - RNA, 16 nt, Homo sapiens
ugauccuuccaccuca

SEQ ID NO: 1810846 - RNA, 14 nt, Homo sapiens
cagauaauuuacuu

SEQ ID NO: 1810847 - RNA, 13 nt, Homo sapiens
uacuaagaucaca

SEQ ID NO: 1810848 - RNA, 19 nt, Homo sapiens
ucagcuuguaaauagcuca

SEQ ID NO: 1810849 - RNA, 22 nt, Homo sapiens
auuuaucguauagguugaugaa

SEQ ID NO: 1810850 - RNA, 16 nt, Homo sapiens
acugaauuucuuugau

SEQ ID NO: 1810851 - RNA, 12 nt, Homo sapiens
uagaaaccauga

SEQ ID NO: 1810852 - RNA, 18 nt, Homo sapiens
ucugucaugagcauuugu

SEQ ID NO: 1810853 - RNA, 20 nt, Homo sapiens
aucuucuaaacccaauccaa

SEQ ID NO: 1810854 - RNA, 17 nt, Homo sapiens
acgauaaaagacaguga

SEQ ID NO: 1810855 - RNA, 23 nt, Homo sapiens
agaggcaugggggcccaaagggg

SEQ ID NO: 1810856 - RNA, 16 nt, Homo sapiens
acucaaguuaugucau

SEQ ID NO: 1810857 - RNA, 14 nt, Homo sapiens
aaccuucagauuaa

SEQ ID NO: 1810858 - RNA, 15 nt, Homo sapiens
ucuguuaccacauug

SEQ ID NO: 1810859 - RNA, 14 nt, Homo sapiens
gcgccugagugagu

SEQ ID NO: 1810860 - RNA, 16 nt, Homo sapiens
augcuuuguccaugau

SEQ ID NO: 1810861 - RNA, 16 nt, Homo sapiens
ugcucacaguccucau

SEQ ID NO: 1810862 - RNA, 23 nt, Homo sapiens
aaacaacacaauccguugcaaac

SEQ ID NO: 1810863 - RNA, 22 nt, Homo sapiens
acuuuuuucuaguacacuuuua

SEQ ID NO: 1810864 - RNA, 19 nt, Homo sapiens
agcuucugccuucuggaau

SEQ ID NO: 1810865 - RNA, 17 nt, Homo sapiens
gaaaugcaaauucucaa

SEQ ID NO: 1810866 - RNA, 21 nt, Homo sapiens
uugccauuccucuacugcaau

SEQ ID NO: 1810867 - RNA, 22 nt, Homo sapiens
augccuucccccaguauguccu

SEQ ID NO: 1810868 - RNA, 16 nt, Homo sapiens
gagucccuccaaaggg

SEQ ID NO: 1810869 - RNA, 16 nt, Homo sapiens
gaagcugauuuucaug

SEQ ID NO: 1810870 - RNA, 16 nt, Homo sapiens
ucccacgugucuucca

SEQ ID NO: 1810871 - RNA, 19 nt, Homo sapiens
cccaagcuggagugcagug

SEQ ID NO: 1810872 - RNA, 12 nt, Homo sapiens
gaccugagcucc

SEQ ID NO: 1810873 - RNA, 17 nt, Homo sapiens
aaggaagaguuaugcuu

SEQ ID NO: 1810874 - RNA, 19 nt, Homo sapiens
guucucuucuucauucuau

SEQ ID NO: 1810875 - RNA, 13 nt, Homo sapiens
gaugcauucgaga

SEQ ID NO: 1810876 - RNA, 15 nt, Homo sapiens
aaacgaaaaucauug

SEQ ID NO: 1810877 - RNA, 15 nt, Homo sapiens
gggaauggauccugg

SEQ ID NO: 1810878 - RNA, 22 nt, Homo sapiens
aggcacucgcuguuaucaaaua

SEQ ID NO: 1810879 - RNA, 14 nt, Homo sapiens
cucuguucauuucc

SEQ ID NO: 1810880 - RNA, 21 nt, Homo sapiens
uuucuaucagccuugcuaaag

SEQ ID NO: 1810881 - RNA, 15 nt, Homo sapiens
gaagugcauguuaaa

SEQ ID NO: 1810882 - RNA, 20 nt, Homo sapiens
uagaaguaauaugcucucau

SEQ ID NO: 1810883 - RNA, 13 nt, Homo sapiens
ugcucuugccaaa

SEQ ID NO: 1810884 - RNA, 17 nt, Homo sapiens
uguauagaccaugcaca

SEQ ID NO: 1810885 - RNA, 16 nt, Homo sapiens
cuggaaaaagacugau

SEQ ID NO: 1810886 - RNA, 22 nt, Homo sapiens
cucccauaauugcuuugccaaa

SEQ ID NO: 1810887 - RNA, 21 nt, Homo sapiens
gcccugaccaaugugugaagu

SEQ ID NO: 1810888 - RNA, 23 nt, Homo sapiens
gcgauuuuaucuguuaaccaaau

SEQ ID NO: 1810889 - RNA, 19 nt, Homo sapiens
ccaagcucuguccaaucag

SEQ ID NO: 1810890 - RNA, 15 nt, Homo sapiens
agccugcagaaucca

SEQ ID NO: 1810891 - RNA, 14 nt, Homo sapiens
ccaccacggccacu

SEQ ID NO: 1810892 - RNA, 21 nt, Homo sapiens
ccuguaaucccagcuacaugg

SEQ ID NO: 1810893 - RNA, 14 nt, Homo sapiens
agucuucuuagcau

SEQ ID NO: 1810894 - RNA, 12 nt, Homo sapiens
gaaggacugugc

SEQ ID NO: 1810895 - RNA, 13 nt, Homo sapiens
ggcucauuuuugc

SEQ ID NO: 1810896 - RNA, 22 nt, Homo sapiens
uuaaguauguuauuuucuguug

SEQ ID NO: 1810897 - RNA, 13 nt, Homo sapiens
uagagauacagua

SEQ ID NO: 1810898 - RNA, 13 nt, Homo sapiens
ccaaucaaaauca

SEQ ID NO: 1810899 - RNA, 18 nt, Homo sapiens
cucauccuccuggaaccu

SEQ ID NO: 1810900 - RNA, 23 nt, Homo sapiens
ucauuuugagcugaaaugcugca

SEQ ID NO: 1810901 - RNA, 22 nt, Homo sapiens
aaugucauuuaagggaguuaca

SEQ ID NO: 1810902 - RNA, 15 nt, Homo sapiens
cacugauaaucacac

SEQ ID NO: 1810903 - RNA, 19 nt, Homo sapiens
ugcuaacggugcucagggg

SEQ ID NO: 1810904 - RNA, 17 nt, Homo sapiens
accugaugcagagccuu

SEQ ID NO: 1810905 - RNA, 17 nt, Homo sapiens
aacuucucugugaacua

SEQ ID NO: 1810906 - RNA, 22 nt, Homo sapiens
ucauggaccacuguuucuugcu

SEQ ID NO: 1810907 - RNA, 14 nt, Homo sapiens
uccaaucuccauca

SEQ ID NO: 1810908 - RNA, 15 nt, Homo sapiens
acccauggcuguguu

SEQ ID NO: 1810909 - RNA, 20 nt, Homo sapiens
uuaggauaaccuugugccuu

SEQ ID NO: 1810910 - RNA, 14 nt, Homo sapiens
cgcguacagaucuc

SEQ ID NO: 1810911 - RNA, 13 nt, Homo sapiens
agaaaaugcaguc

SEQ ID NO: 1810912 - RNA, 18 nt, Homo sapiens
acacggugggcugaguac

SEQ ID NO: 1810913 - RNA, 16 nt, Homo sapiens
ugaaaacuuagucugu

SEQ ID NO: 1810914 - RNA, 17 nt, Homo sapiens
uucuaagucauucauaa

SEQ ID NO: 1810915 - RNA, 21 nt, Homo sapiens
acuauuuaaaggaaaaucaca

SEQ ID NO: 1810916 - RNA, 21 nt, Homo sapiens
gaaugcucuuuacuucaugga

SEQ ID NO: 1810917 - RNA, 12 nt, Homo sapiens
ugauguggcaua

SEQ ID NO: 1810918 - RNA, 23 nt, Homo sapiens
auuggccacugggucucacuccu

SEQ ID NO: 1810919 - RNA, 22 nt, Homo sapiens
cagcucaaagaguaaaacauuu

SEQ ID NO: 1810920 - RNA, 15 nt, Homo sapiens
cugggucugaccugg

SEQ ID NO: 1810921 - RNA, 20 nt, Homo sapiens
uuccuucagugcaucuggga

SEQ ID NO: 1810922 - RNA, 19 nt, Homo sapiens
uauaacccagugaguucag

SEQ ID NO: 1810923 - RNA, 12 nt, Homo sapiens
guagcacacuga

SEQ ID NO: 1810924 - RNA, 14 nt, Homo sapiens
aguugaggccagga

SEQ ID NO: 1810925 - RNA, 16 nt, Homo sapiens
ggcugcacgcggcgga

SEQ ID NO: 1810926 - RNA, 22 nt, Homo sapiens
auaaacaggaaaaugccagagc

SEQ ID NO: 1810927 - RNA, 17 nt, Homo sapiens
aggagaaucacuggaac

SEQ ID NO: 1810928 - RNA, 21 nt, Homo sapiens
ugcacagcaggaccugugcuu

SEQ ID NO: 1810929 - RNA, 21 nt, Homo sapiens
cugccacccagaguggcuucc

SEQ ID NO: 1810930 - RNA, 14 nt, Homo sapiens
cacauguggccaug

SEQ ID NO: 1810931 - RNA, 22 nt, Homo sapiens
cauugauucaguauuacaaaua

SEQ ID NO: 1810932 - RNA, 20 nt, Homo sapiens
cuguuuuguaagugcugcua

SEQ ID NO: 1810933 - RNA, 22 nt, Homo sapiens
aaaucagaagucaucuugcuac

SEQ ID NO: 1810934 - RNA, 22 nt, Homo sapiens
ugcgugacacucuccuugcagu

SEQ ID NO: 1810935 - RNA, 20 nt, Homo sapiens
cacuagaauucaugugagaa

SEQ ID NO: 1810936 - RNA, 21 nt, Homo sapiens
guaaacauugccugauuuguu

SEQ ID NO: 1810937 - RNA, 20 nt, Homo sapiens
ucugccucccagguucaagu

SEQ ID NO: 1810938 - RNA, 20 nt, Homo sapiens
caucuuuccugcccugccuu

SEQ ID NO: 1810939 - RNA, 20 nt, Homo sapiens
uuaugaaccuuuacauccag

SEQ ID NO: 1810940 - RNA, 15 nt, Homo sapiens
ccuuucauuuacugu

SEQ ID NO: 1810941 - RNA, 15 nt, Homo sapiens
gcaagcgcuguaaac

SEQ ID NO: 1810942 - RNA, 16 nt, Homo sapiens
uaaaauaaaccuugga

SEQ ID NO: 1810943 - RNA, 20 nt, Homo sapiens
uuguucauuauuggagggua

SEQ ID NO: 1810944 - RNA, 13 nt, Homo sapiens
caauuuggagcau

SEQ ID NO: 1810945 - RNA, 19 nt, Homo sapiens
caaaaacaugcuuuuccaa

SEQ ID NO: 1810946 - RNA, 17 nt, Homo sapiens
uugauauuuuuucucuc

SEQ ID NO: 1810947 - RNA, 17 nt, Homo sapiens
gggaaucucuugccugc

SEQ ID NO: 1810948 - RNA, 15 nt, Homo sapiens
aagcuccaucaauga

SEQ ID NO: 1810949 - RNA, 17 nt, Homo sapiens
aagaggcugcacugcag

SEQ ID NO: 1810950 - RNA, 15 nt, Homo sapiens
aggauguucgucuca

SEQ ID NO: 1810951 - RNA, 16 nt, Homo sapiens
ugaagaaaagaccuuu

SEQ ID NO: 1810952 - RNA, 16 nt, Homo sapiens
uuaaaggcuuuuggca

SEQ ID NO: 1810953 - RNA, 21 nt, Homo sapiens
cucacagagugcauugugagg

SEQ ID NO: 1810954 - RNA, 18 nt, Homo sapiens
cagcaucgugaucacuga

SEQ ID NO: 1810955 - RNA, 23 nt, Homo sapiens
acucaaggggcuggaaucucaug

SEQ ID NO: 1810956 - RNA, 22 nt, Homo sapiens
ucaauaccccuguuaagcaauu

SEQ ID NO: 1810957 - RNA, 13 nt, Homo sapiens
agcuuuucuugcc

SEQ ID NO: 1810958 - RNA, 18 nt, Homo sapiens
uugacaaaugacagaucu

SEQ ID NO: 1810959 - RNA, 19 nt, Homo sapiens
uaugagaaugacccuguca

SEQ ID NO: 1810960 - RNA, 15 nt, Homo sapiens
aucccaaaggacagc

SEQ ID NO: 1810961 - RNA, 17 nt, Homo sapiens
gaagggacugguccagg

SEQ ID NO: 1810962 - RNA, 14 nt, Homo sapiens
aaguuucugauagu

SEQ ID NO: 1810963 - RNA, 14 nt, Homo sapiens
auuuggcugugaug

SEQ ID NO: 1810964 - RNA, 19 nt, Homo sapiens
aggagcauccuuggcagug

SEQ ID NO: 1810965 - RNA, 18 nt, Homo sapiens
agaccgccccagggcuau

SEQ ID NO: 1810966 - RNA, 18 nt, Homo sapiens
caucauccaggagguuca

SEQ ID NO: 1810967 - RNA, 17 nt, Homo sapiens
auagauuguaauacaca

SEQ ID NO: 1810968 - RNA, 13 nt, Homo sapiens
cagaaauucucaa

SEQ ID NO: 1810969 - RNA, 17 nt, Homo sapiens
uucugcccuuccuccag

SEQ ID NO: 1810970 - RNA, 21 nt, Homo sapiens
caggaaggggugucaguacuu

SEQ ID NO: 1810971 - RNA, 16 nt, Homo sapiens
cccauccgcaucucaa

SEQ ID NO: 1810972 - RNA, 12 nt, Homo sapiens
cuuguuuugcca

SEQ ID NO: 1810973 - RNA, 18 nt, Homo sapiens
ugauaucccccagccuca

SEQ ID NO: 1810974 - RNA, 14 nt, Homo sapiens
uggaagauauuccu

SEQ ID NO: 1810975 - RNA, 22 nt, Homo sapiens
ugguagugggagguugugcaug

SEQ ID NO: 1810976 - RNA, 13 nt, Homo sapiens
ugacgccagggua

SEQ ID NO: 1810977 - RNA, 13 nt, Homo sapiens
ccguuuuccucau

SEQ ID NO: 1810978 - RNA, 10 nt, Homo sapiens
uguccaccuu

SEQ ID NO: 1810979 - RNA, 13 nt, Homo sapiens
accacauggacag

SEQ ID NO: 1810980 - RNA, 13 nt, Homo sapiens
cuucuacuccucc

SEQ ID NO: 1810981 - RNA, 20 nt, Homo sapiens
ggcccacuagcauccacuga

SEQ ID NO: 1810982 - RNA, 19 nt, Homo sapiens
aaauuaaacauauucaagg

SEQ ID NO: 1810983 - RNA, 22 nt, Homo sapiens
aacaugguaaacgcugucccua

SEQ ID NO: 1810984 - RNA, 18 nt, Homo sapiens
ugagagcuguuuuugaca

SEQ ID NO: 1810985 - RNA, 19 nt, Homo sapiens
cauauaaaagcuaugguga

SEQ ID NO: 1810986 - RNA, 12 nt, Homo sapiens
gugauguucuaa

SEQ ID NO: 1810987 - RNA, 12 nt, Homo sapiens
gagcuguucaac

SEQ ID NO: 1810988 - RNA, 16 nt, Homo sapiens
cccuacacaaaauaca

SEQ ID NO: 1810989 - RNA, 13 nt, Homo sapiens
ucugcagccugag

SEQ ID NO: 1810990 - RNA, 21 nt, Homo sapiens
uauuuggaauaauaauuuucc

SEQ ID NO: 1810991 - RNA, 12 nt, Homo sapiens
aaagaacauacc

SEQ ID NO: 1810992 - RNA, 23 nt, Homo sapiens
gcuguaaacuauaaacuacugua

SEQ ID NO: 1810993 - RNA, 14 nt, Homo sapiens
cccacccugggacc

SEQ ID NO: 1810994 - RNA, 13 nt, Homo sapiens
uguguacugccuu

SEQ ID NO: 1810995 - RNA, 20 nt, Homo sapiens
ggcuggagugcaguggcaug

SEQ ID NO: 1810996 - RNA, 18 nt, Homo sapiens
cuguagcaauuggauaga

SEQ ID NO: 1810997 - RNA, 20 nt, Homo sapiens
auauuuaauaccaccaacaa

SEQ ID NO: 1810998 - RNA, 13 nt, Homo sapiens
gaacauguaccac

SEQ ID NO: 1810999 - RNA, 15 nt, Homo sapiens
gcucccagacccagg

SEQ ID NO: 1811000 - RNA, 18 nt, Homo sapiens
uagaugugacacauucuc

SEQ ID NO: 1811001 - RNA, 18 nt, Homo sapiens
cacugccuuugucuuacu

SEQ ID NO: 1811002 - RNA, 18 nt, Homo sapiens
ugccuucugggaagggag

SEQ ID NO: 1811003 - RNA, 18 nt, Homo sapiens
agucauggagaaccaccu

SEQ ID NO: 1811004 - RNA, 13 nt, Homo sapiens
cuuuuggguauuu

SEQ ID NO: 1811005 - RNA, 21 nt, Homo sapiens
ugggauggacaggaaagggca

SEQ ID NO: 1811006 - RNA, 19 nt, Homo sapiens
aaaccuucaguuaugauuu

SEQ ID NO: 1811007 - RNA, 15 nt, Homo sapiens
aaaggaugugauaua

SEQ ID NO: 1811008 - RNA, 20 nt, Homo sapiens
ggacugagcccucucacucc

SEQ ID NO: 1811009 - RNA, 17 nt, Homo sapiens
ugcuucucccauuuccu

SEQ ID NO: 1811010 - RNA, 16 nt, Homo sapiens
gauauuuaguaauauu

SEQ ID NO: 1811011 - RNA, 19 nt, Homo sapiens
ccacaggccugagauuuca

SEQ ID NO: 1811012 - RNA, 11 nt, Homo sapiens
agugacagagg

SEQ ID NO: 1811013 - RNA, 12 nt, Homo sapiens
gugguggugcua

SEQ ID NO: 1811014 - RNA, 19 nt, Homo sapiens
cuucugaagaucucagaua

SEQ ID NO: 1811015 - RNA, 17 nt, Homo sapiens
cuccucccugauguaca

SEQ ID NO: 1811016 - RNA, 18 nt, Homo sapiens
uaauaaaaaucauggcaa

SEQ ID NO: 1811017 - RNA, 16 nt, Homo sapiens
acauggaugcacacac

SEQ ID NO: 1811018 - RNA, 16 nt, Homo sapiens
caaggcuggcagugac

SEQ ID NO: 1811019 - RNA, 18 nt, Homo sapiens
auguguucaccaucccaa

SEQ ID NO: 1811020 - RNA, 19 nt, Homo sapiens
cgggcagucgcugcaggga

SEQ ID NO: 1811021 - RNA, 17 nt, Homo sapiens
aaauaaaaacacuuaaa

SEQ ID NO: 1811022 - RNA, 15 nt, Homo sapiens
gggcugccaccagcc

SEQ ID NO: 1811023 - RNA, 20 nt, Homo sapiens
acuuggacaucucucuggcu

SEQ ID NO: 1811024 - RNA, 14 nt, Homo sapiens
agggaauaguggga

SEQ ID NO: 1811025 - RNA, 20 nt, Homo sapiens
cgacaagugcugaacagugg

SEQ ID NO: 1811026 - RNA, 15 nt, Homo sapiens
ccucauacccaugca

SEQ ID NO: 1811027 - RNA, 17 nt, Homo sapiens
uccaggaauuaaaucau

SEQ ID NO: 1811028 - RNA, 20 nt, Homo sapiens
auguugguguggaguuuuca

SEQ ID NO: 1811029 - RNA, 18 nt, Homo sapiens
ccacccgaguaccuccag

SEQ ID NO: 1811030 - RNA, 11 nt, Homo sapiens
uucacugguuu

SEQ ID NO: 1811031 - RNA, 11 nt, Homo sapiens
gccacugggcu

SEQ ID NO: 1811032 - RNA, 20 nt, Homo sapiens
uucugaaaccaaauguaacu

SEQ ID NO: 1811033 - RNA, 13 nt, Homo sapiens
ugcuccugcugau

SEQ ID NO: 1811034 - RNA, 13 nt, Homo sapiens
cucuucuguggac

SEQ ID NO: 1811035 - RNA, 15 nt, Homo sapiens
ccauuaaaacugcuu

SEQ ID NO: 1811036 - RNA, 14 nt, Homo sapiens
caguccacugagca

SEQ ID NO: 1811037 - RNA, 15 nt, Homo sapiens
gugcugaccaaagau

SEQ ID NO: 1811038 - RNA, 13 nt, Homo sapiens
gccacgugcucuc

SEQ ID NO: 1811039 - RNA, 16 nt, Homo sapiens
ucuucggggugugaug

SEQ ID NO: 1811040 - RNA, 22 nt, Homo sapiens
gcaaaaacauguaugugcauuu

SEQ ID NO: 1811041 - RNA, 13 nt, Homo sapiens
uuugcacugacaa

SEQ ID NO: 1811042 - RNA, 16 nt, Homo sapiens
aaauguuucaaauggu

SEQ ID NO: 1811043 - RNA, 13 nt, Homo sapiens
uggcaacugcuga

SEQ ID NO: 1811044 - RNA, 16 nt, Homo sapiens
gaggcguauguggcaa

SEQ ID NO: 1811045 - RNA, 17 nt, Homo sapiens
ggguccauaugagggaa

SEQ ID NO: 1811046 - RNA, 22 nt, Homo sapiens
accgaaaaguuggugucaauga

SEQ ID NO: 1811047 - RNA, 16 nt, Homo sapiens
augugucucacaucua

SEQ ID NO: 1811048 - RNA, 19 nt, Homo sapiens
agcacccucuccagaugag

SEQ ID NO: 1811049 - RNA, 23 nt, Homo sapiens
aggguuggcaccugcacacucca

SEQ ID NO: 1811050 - RNA, 14 nt, Homo sapiens
aaucaaccuaucaa

SEQ ID NO: 1811051 - RNA, 20 nt, Homo sapiens
auaccgcuggggaacagagc

SEQ ID NO: 1811052 - RNA, 14 nt, Homo sapiens
aaugucaccaugcu

SEQ ID NO: 1811053 - RNA, 19 nt, Homo sapiens
aauauaauagaauacccua

SEQ ID NO: 1811054 - RNA, 19 nt, Homo sapiens
agugaaacauugaacucau

SEQ ID NO: 1811055 - RNA, 14 nt, Homo sapiens
aaucuugaucauuc

SEQ ID NO: 1811056 - RNA, 21 nt, Homo sapiens
cacaaaugaugcaggugcaaa

SEQ ID NO: 1811057 - RNA, 16 nt, Homo sapiens
aaauccacuauuucca

SEQ ID NO: 1811058 - RNA, 14 nt, Homo sapiens
cgaucgcugugaaa

SEQ ID NO: 1811059 - RNA, 16 nt, Homo sapiens
gucaauuucaguguau

SEQ ID NO: 1811060 - RNA, 21 nt, Homo sapiens
ugugcauccgccugaaagugu

SEQ ID NO: 1811061 - RNA, 19 nt, Homo sapiens
gccuagaaacaacacugua

SEQ ID NO: 1811062 - RNA, 14 nt, Homo sapiens
caggugguaaaaau

SEQ ID NO: 1811063 - RNA, 22 nt, Homo sapiens
gagagaaaacagaccuaaugcu

SEQ ID NO: 1811064 - RNA, 16 nt, Homo sapiens
aucagccaaagcagaa

SEQ ID NO: 1811065 - RNA, 16 nt, Homo sapiens
cagcaccucucaggau

SEQ ID NO: 1811066 - RNA, 22 nt, Homo sapiens
ccugaaaacuuuagcauugggu

SEQ ID NO: 1811067 - RNA, 23 nt, Homo sapiens
acgcacacagugucuguguacau

SEQ ID NO: 1811068 - RNA, 17 nt, Homo sapiens
ugagaugcguuguuaca

SEQ ID NO: 1811069 - RNA, 19 nt, Homo sapiens
aauuaauguaauaaaguga

SEQ ID NO: 1811070 - RNA, 18 nt, Homo sapiens
accagaccccaaaccagc

SEQ ID NO: 1811071 - RNA, 21 nt, Homo sapiens
aacauccaaaagcaaccacaa

SEQ ID NO: 1811072 - RNA, 13 nt, Homo sapiens
accuguugaaaug

SEQ ID NO: 1811073 - RNA, 14 nt, Homo sapiens
cuaggaagcagcug

SEQ ID NO: 1811074 - RNA, 23 nt, Homo sapiens
augaauacacaacuccacugucu

SEQ ID NO: 1811075 - RNA, 12 nt, Homo sapiens
guaaacaguuug

SEQ ID NO: 1811076 - RNA, 17 nt, Homo sapiens
uugcgauggcgugggcu

SEQ ID NO: 1811077 - RNA, 15 nt, Homo sapiens
cuggcccaucagggu

SEQ ID NO: 1811078 - RNA, 21 nt, Homo sapiens
uauuuggugauuacauuuuaa

SEQ ID NO: 1811079 - RNA, 20 nt, Homo sapiens
gcggcccugagcuugcaggg

SEQ ID NO: 1811080 - RNA, 19 nt, Homo sapiens
gacucaaaccaacucagug

SEQ ID NO: 1811081 - RNA, 18 nt, Homo sapiens
auaacaucaacaacacag

SEQ ID NO: 1811082 - RNA, 16 nt, Homo sapiens
acacugugcuacugaa

SEQ ID NO: 1811083 - RNA, 19 nt, Homo sapiens
uaucugauggcaccuauaa

SEQ ID NO: 1811084 - RNA, 12 nt, Homo sapiens
cuccugccugag

SEQ ID NO: 1811085 - RNA, 17 nt, Homo sapiens
uuucccaucuccauugu

SEQ ID NO: 1811086 - RNA, 23 nt, Homo sapiens
caguuaacguauuaguugccaau

SEQ ID NO: 1811087 - RNA, 18 nt, Homo sapiens
ggauacagaaaugcaaaa

SEQ ID NO: 1811088 - RNA, 16 nt, Homo sapiens
cacgggaaaggagcug

SEQ ID NO: 1811089 - RNA, 13 nt, Homo sapiens
guucuaccaagca

SEQ ID NO: 1811090 - RNA, 23 nt, Homo sapiens
aucaccaucaauuuuaguuguca

SEQ ID NO: 1811091 - RNA, 21 nt, Homo sapiens
gaacaauaaaaugucuucucc

SEQ ID NO: 1811092 - RNA, 17 nt, Homo sapiens
agccuggggauuccagc

SEQ ID NO: 1811093 - RNA, 17 nt, Homo sapiens
cuuguuuugccagugau

SEQ ID NO: 1811094 - RNA, 17 nt, Homo sapiens
acaguacaguacucagu

SEQ ID NO: 1811095 - RNA, 12 nt, Homo sapiens
caauugucugcc

SEQ ID NO: 1811096 - RNA, 14 nt, Homo sapiens
agccuucauugccu

SEQ ID NO: 1811097 - RNA, 15 nt, Homo sapiens
ucuagagcacugcca

SEQ ID NO: 1811098 - RNA, 16 nt, Homo sapiens
gcagauuuuugcaaua

SEQ ID NO: 1811099 - RNA, 16 nt, Homo sapiens
cuaauaccugucaaca

SEQ ID NO: 1811100 - RNA, 18 nt, Homo sapiens
ugagucugcagaugagga

SEQ ID NO: 1811101 - RNA, 18 nt, Homo sapiens
aaucagucauuucuucau

SEQ ID NO: 1811102 - RNA, 11 nt, Homo sapiens
aaaacauauca

SEQ ID NO: 1811103 - RNA, 16 nt, Homo sapiens
aauaaaguuacuugaa

SEQ ID NO: 1811104 - RNA, 16 nt, Homo sapiens
uauaugaaaacuaagu

SEQ ID NO: 1811105 - RNA, 14 nt, Homo sapiens
cuaccuucauguca

SEQ ID NO: 1811106 - RNA, 13 nt, Homo sapiens
caaggaaaaagca

SEQ ID NO: 1811107 - RNA, 15 nt, Homo sapiens
ccaccuggcauuccu

SEQ ID NO: 1811108 - RNA, 20 nt, Homo sapiens
auuuaaaacgcaugugcagc

SEQ ID NO: 1811109 - RNA, 16 nt, Homo sapiens
agauuucaacauauca

SEQ ID NO: 1811110 - RNA, 15 nt, Homo sapiens
cuucguguauagcug

SEQ ID NO: 1811111 - RNA, 19 nt, Homo sapiens
aggggaagugugcugaggu

SEQ ID NO: 1811112 - RNA, 23 nt, Homo sapiens
gagccaggggugucccaguccca

SEQ ID NO: 1811113 - RNA, 18 nt, Homo sapiens
aaaaagacauucuuccaa

SEQ ID NO: 1811114 - RNA, 18 nt, Homo sapiens
cauaagcaaaacuuaacu

SEQ ID NO: 1811115 - RNA, 24 nt, Homo sapiens
gagcccagggcaucuugcuggcua

SEQ ID NO: 1811116 - RNA, 19 nt, Homo sapiens
uaaagcuauguuacaugga

SEQ ID NO: 1811117 - RNA, 15 nt, Homo sapiens
caggugacagugaag

SEQ ID NO: 1811118 - RNA, 20 nt, Homo sapiens
aacaucuacaggaucuuuau

SEQ ID NO: 1811119 - RNA, 20 nt, Homo sapiens
aaauggucaauaaagcuccu

SEQ ID NO: 1811120 - RNA, 16 nt, Homo sapiens
uugaggcuaccucuac

SEQ ID NO: 1811121 - RNA, 12 nt, Homo sapiens
ugcaaaccuugg

SEQ ID NO: 1811122 - RNA, 16 nt, Homo sapiens
cuguccuaagcacuuu

SEQ ID NO: 1811123 - RNA, 19 nt, Homo sapiens
aucuuuguagccuaaagac

SEQ ID NO: 1811124 - RNA, 21 nt, Homo sapiens
gaaacguuuggaacaaucuaa

SEQ ID NO: 1811125 - RNA, 16 nt, Homo sapiens
cuggaaaccacguggu

SEQ ID NO: 1811126 - RNA, 16 nt, Homo sapiens
cccagacggcuccacu

SEQ ID NO: 1811127 - RNA, 23 nt, Homo sapiens
aaacauuuaucuuuguacguucu

SEQ ID NO: 1811128 - RNA, 20 nt, Homo sapiens
cuggcaccaaaguccaggac

SEQ ID NO: 1811129 - RNA, 15 nt, Homo sapiens
cagaauguacggaaa

SEQ ID NO: 1811130 - RNA, 19 nt, Homo sapiens
aucacuucugagaacucau

SEQ ID NO: 1811131 - RNA, 12 nt, Homo sapiens
auguaagcacuc

SEQ ID NO: 1811132 - RNA, 15 nt, Homo sapiens
ccucacucuugccaa

SEQ ID NO: 1811133 - RNA, 18 nt, Homo sapiens
auuuuuuucauuguccau

SEQ ID NO: 1811134 - RNA, 23 nt, Homo sapiens
guuuugaguagauauuacuuuau

SEQ ID NO: 1811135 - RNA, 20 nt, Homo sapiens
ugcaaaugcacucaucacaa

SEQ ID NO: 1811136 - RNA, 20 nt, Homo sapiens
aucaguguccucuugcucaa

SEQ ID NO: 1811137 - RNA, 16 nt, Homo sapiens
gccugggcaacaacag

SEQ ID NO: 1811138 - RNA, 19 nt, Homo sapiens
aagugcuaugccaagccau

SEQ ID NO: 1811139 - RNA, 19 nt, Homo sapiens
uggagggucccuaauucuc

SEQ ID NO: 1811140 - RNA, 15 nt, Homo sapiens
agcuguggcuucuag

SEQ ID NO: 1811141 - RNA, 20 nt, Homo sapiens
augcuuccacuaccaaaaga

SEQ ID NO: 1811142 - RNA, 18 nt, Homo sapiens
aaaucacucagcacucca

SEQ ID NO: 1811143 - RNA, 23 nt, Homo sapiens
aagauauuuuucagcuacagcaa

SEQ ID NO: 1811144 - RNA, 22 nt, Homo sapiens
acuggcagggacgaggacaaau

SEQ ID NO: 1811145 - RNA, 18 nt, Homo sapiens
agaagcagccacaccguu

SEQ ID NO: 1811146 - RNA, 22 nt, Homo sapiens
gcccuggggucucugagcagug

SEQ ID NO: 1811147 - RNA, 19 nt, Homo sapiens
uuucucuguaaacuuccaa

SEQ ID NO: 1811148 - RNA, 16 nt, Homo sapiens
uaugagaaaccuauau

SEQ ID NO: 1811149 - RNA, 13 nt, Homo sapiens
ugcacacaccugc

SEQ ID NO: 1811150 - RNA, 13 nt, Homo sapiens
cuuccacuuugag

SEQ ID NO: 1811151 - RNA, 18 nt, Homo sapiens
ugcccacggucugagcua

SEQ ID NO: 1811152 - RNA, 22 nt, Homo sapiens
ugccagacaaauaggagugagu

SEQ ID NO: 1811153 - RNA, 15 nt, Homo sapiens
uccagcccaggacuc

SEQ ID NO: 1811154 - RNA, 17 nt, Homo sapiens
uggccagaggugucacc

SEQ ID NO: 1811155 - RNA, 21 nt, Homo sapiens
accaaauuagcaggugcaccu

SEQ ID NO: 1811156 - RNA, 21 nt, Homo sapiens
ccucauuacugccaacaguuu

SEQ ID NO: 1811157 - RNA, 18 nt, Homo sapiens
gagauuucuuguugcuca

SEQ ID NO: 1811158 - RNA, 22 nt, Homo sapiens
cacgaauauugcugauggugca

SEQ ID NO: 1811159 - RNA, 13 nt, Homo sapiens
acacaaggcacgu

SEQ ID NO: 1811160 - RNA, 20 nt, Homo sapiens
auaauuuugaauugauaccu

SEQ ID NO: 1811161 - RNA, 14 nt, Homo sapiens
caggcuccugccac

SEQ ID NO: 1811162 - RNA, 20 nt, Homo sapiens
cuccuuaacaacuguagcaa

SEQ ID NO: 1811163 - RNA, 14 nt, Homo sapiens
gguucccagcagcu

SEQ ID NO: 1811164 - RNA, 14 nt, Homo sapiens
ugugcccaucaucu

SEQ ID NO: 1811165 - RNA, 16 nt, Homo sapiens
ugccguuuaaaccacu

SEQ ID NO: 1811166 - RNA, 17 nt, Homo sapiens
uaucaccauuacuuuuu

SEQ ID NO: 1811167 - RNA, 15 nt, Homo sapiens
cucccaguccaagac

SEQ ID NO: 1811168 - RNA, 19 nt, Homo sapiens
agccauuuuucaaagcaau

SEQ ID NO: 1811169 - RNA, 19 nt, Homo sapiens
agaaaacacccuuccucaa

SEQ ID NO: 1811170 - RNA, 19 nt, Homo sapiens
uauaacauucaguucccac

SEQ ID NO: 1811171 - RNA, 19 nt, Homo sapiens
uaaacuuuccaaaaccuuc

SEQ ID NO: 1811172 - RNA, 22 nt, Homo sapiens
guuguuuaaaagagccuggaac

SEQ ID NO: 1811173 - RNA, 17 nt, Homo sapiens
auuuuaggcaaagucca

SEQ ID NO: 1811174 - RNA, 20 nt, Homo sapiens
uuaggaaaggaugaucaaaa

SEQ ID NO: 1811175 - RNA, 15 nt, Homo sapiens
gaaguauugcuaaua

SEQ ID NO: 1811176 - RNA, 19 nt, Homo sapiens
cuggagggagaacccaaag

SEQ ID NO: 1811177 - RNA, 14 nt, Homo sapiens
gcaucagaugaauu

SEQ ID NO: 1811178 - RNA, 15 nt, Homo sapiens
uaugcagugcugcuu

SEQ ID NO: 1811179 - RNA, 23 nt, Homo sapiens
gucccucuccuauguggcagcug

SEQ ID NO: 1811180 - RNA, 16 nt, Homo sapiens
gcaaucucagaugcag

SEQ ID NO: 1811181 - RNA, 16 nt, Homo sapiens
gccucugccuugcccc

SEQ ID NO: 1811182 - RNA, 18 nt, Homo sapiens
ucucuacagacuccaaaa

SEQ ID NO: 1811183 - RNA, 17 nt, Homo sapiens
gugccugauccaucccc

SEQ ID NO: 1811184 - RNA, 13 nt, Homo sapiens
caggacggggcac

SEQ ID NO: 1811185 - RNA, 20 nt, Homo sapiens
auagucuuaguaauagcauc

SEQ ID NO: 1811186 - RNA, 15 nt, Homo sapiens
ugugggcuccaugua

SEQ ID NO: 1811187 - RNA, 13 nt, Homo sapiens
accuacuagacaa

SEQ ID NO: 1811188 - RNA, 18 nt, Homo sapiens
uucacagcccagaaccac

SEQ ID NO: 1811189 - RNA, 16 nt, Homo sapiens
acaccuugacaaaauc

SEQ ID NO: 1811190 - RNA, 15 nt, Homo sapiens
uagggcuacagucuc

SEQ ID NO: 1811191 - RNA, 22 nt, Homo sapiens
aagagggugagggccuucuuaa

SEQ ID NO: 1811192 - RNA, 15 nt, Homo sapiens
gcacaugucuuguac

SEQ ID NO: 1811193 - RNA, 14 nt, Homo sapiens
gaaaaauguguauu

SEQ ID NO: 1811194 - RNA, 19 nt, Homo sapiens
aagccaauucagacaggca

SEQ ID NO: 1811195 - RNA, 19 nt, Homo sapiens
cccuuugugacuucaagaa

SEQ ID NO: 1811196 - RNA, 14 nt, Homo sapiens
ucaaaagacaauuc

SEQ ID NO: 1811197 - RNA, 15 nt, Homo sapiens
aagggacugguccag

SEQ ID NO: 1811198 - RNA, 14 nt, Homo sapiens
ccuaaauauaauua

SEQ ID NO: 1811199 - RNA, 19 nt, Homo sapiens
cugccagccccacacagcu

SEQ ID NO: 1811200 - RNA, 17 nt, Homo sapiens
cuaaugucagcacaugu

SEQ ID NO: 1811201 - RNA, 14 nt, Homo sapiens
gaguuucgagguag

SEQ ID NO: 1811202 - RNA, 19 nt, Homo sapiens
cuccaaggcaaauguccaa

SEQ ID NO: 1811203 - RNA, 21 nt, Homo sapiens
agaaacaaaaucaaaacagag

SEQ ID NO: 1811204 - RNA, 17 nt, Homo sapiens
cacugaagccacagcug

SEQ ID NO: 1811205 - RNA, 10 nt, Homo sapiens
gcucuagccc

SEQ ID NO: 1811206 - RNA, 16 nt, Homo sapiens
ugacagucuugugcuu

SEQ ID NO: 1811207 - RNA, 19 nt, Homo sapiens
cgcucccgcgggaagccag

SEQ ID NO: 1811208 - RNA, 17 nt, Homo sapiens
ccagcacauagcuugcc

SEQ ID NO: 1811209 - RNA, 19 nt, Homo sapiens
gucagcugcuguugaacuu

SEQ ID NO: 1811210 - RNA, 18 nt, Homo sapiens
agccccaccucacagcca

SEQ ID NO: 1811211 - RNA, 16 nt, Homo sapiens
ccgcccucuuccugac

SEQ ID NO: 1811212 - RNA, 14 nt, Homo sapiens
ggcggaucaucuaa

SEQ ID NO: 1811213 - RNA, 20 nt, Homo sapiens
uaggagaacugucaugagua

SEQ ID NO: 1811214 - RNA, 12 nt, Homo sapiens
gaugcugaccca

SEQ ID NO: 1811215 - RNA, 21 nt, Homo sapiens
gaaagcaacuuuacugagaca

SEQ ID NO: 1811216 - RNA, 12 nt, Homo sapiens
cuaucugugaag

SEQ ID NO: 1811217 - RNA, 19 nt, Homo sapiens
ucauccugccuucauggaa

SEQ ID NO: 1811218 - RNA, 20 nt, Homo sapiens
uguguguauaagugcacaca

SEQ ID NO: 1811219 - RNA, 16 nt, Homo sapiens
agguugcagugagcua

SEQ ID NO: 1811220 - RNA, 22 nt, Homo sapiens
gacggcacccacacacaaagag

SEQ ID NO: 1811221 - RNA, 23 nt, Homo sapiens
aaacaaccugccacaaugugaua

SEQ ID NO: 1811222 - RNA, 19 nt, Homo sapiens
cuaauaaauauacuaugaa

SEQ ID NO: 1811223 - RNA, 15 nt, Homo sapiens
cagacacagacuggc

SEQ ID NO: 1811224 - RNA, 12 nt, Homo sapiens
gucuauuuccac

SEQ ID NO: 1811225 - RNA, 15 nt, Homo sapiens
aaaaccagugaacuu

SEQ ID NO: 1811226 - RNA, 23 nt, Homo sapiens
auuuuggugaccaauacuacugu

SEQ ID NO: 1811227 - RNA, 19 nt, Homo sapiens
cucaugucuuugcugcaga

SEQ ID NO: 1811228 - RNA, 11 nt, Homo sapiens
ccuguucucua

SEQ ID NO: 1811229 - RNA, 21 nt, Homo sapiens
auauucauaccuucugaugaa

SEQ ID NO: 1811230 - RNA, 16 nt, Homo sapiens
cgggugguuaguggua

SEQ ID NO: 1811231 - RNA, 21 nt, Homo sapiens
cauaacuuggccauguucucc

SEQ ID NO: 1811232 - RNA, 15 nt, Homo sapiens
aaaagaccaugcauu

SEQ ID NO: 1811233 - RNA, 20 nt, Homo sapiens
ggauauccucccuccagaua

SEQ ID NO: 1811234 - RNA, 16 nt, Homo sapiens
guucucugguuucacc

SEQ ID NO: 1811235 - RNA, 13 nt, Homo sapiens
uggcaacaggaca

SEQ ID NO: 1811236 - RNA, 13 nt, Homo sapiens
ggaggacaugggg

SEQ ID NO: 1811237 - RNA, 13 nt, Homo sapiens
ucggaacagcaga

SEQ ID NO: 1811238 - RNA, 23 nt, Homo sapiens
auacagucucuauuugauuugca

SEQ ID NO: 1811239 - RNA, 19 nt, Homo sapiens
cauuuuucaacuuugaaua

SEQ ID NO: 1811240 - RNA, 20 nt, Homo sapiens
guuugcugccaucagucuag

SEQ ID NO: 1811241 - RNA, 21 nt, Homo sapiens
guuaagcagauggaaugcugu

SEQ ID NO: 1811242 - RNA, 13 nt, Homo sapiens
gcucgcugccauc

SEQ ID NO: 1811243 - RNA, 23 nt, Homo sapiens
agaaauacaauucuacauuguca

SEQ ID NO: 1811244 - RNA, 17 nt, Homo sapiens
aaccuaccuuaucaugu

SEQ ID NO: 1811245 - RNA, 21 nt, Homo sapiens
auagugaugugcuagaacuuu

SEQ ID NO: 1811246 - RNA, 9 nt, Homo sapiens
acagaauuu

SEQ ID NO: 1811247 - RNA, 15 nt, Homo sapiens
gcucugacauucuga

SEQ ID NO: 1811248 - RNA, 20 nt, Homo sapiens
ccaauaaaauguaucugcau

SEQ ID NO: 1811249 - RNA, 23 nt, Homo sapiens
auguccuugcuuuacaaaccaac

SEQ ID NO: 1811250 - RNA, 12 nt, Homo sapiens
cacaacucccuu

SEQ ID NO: 1811251 - RNA, 12 nt, Homo sapiens
aauaucuugcaa

SEQ ID NO: 1811252 - RNA, 15 nt, Homo sapiens
auauaauaacuuuau

SEQ ID NO: 1811253 - RNA, 15 nt, Homo sapiens
aguuuaaaaaaccau

SEQ ID NO: 1811254 - RNA, 15 nt, Homo sapiens
caugacguguuucuu

SEQ ID NO: 1811255 - RNA, 23 nt, Homo sapiens
agaauuguaucucauacugucug

SEQ ID NO: 1811256 - RNA, 22 nt, Homo sapiens
ccuucucagaccugcgcacucc

SEQ ID NO: 1811257 - RNA, 18 nt, Homo sapiens
cccagggagaggccauga

SEQ ID NO: 1811258 - RNA, 13 nt, Homo sapiens
aaaaaauacauua

SEQ ID NO: 1811259 - RNA, 21 nt, Homo sapiens
accugaaucuaucacccagga

SEQ ID NO: 1811260 - RNA, 22 nt, Homo sapiens
ucucaauguuuagcagauuuaa

SEQ ID NO: 1811261 - RNA, 21 nt, Homo sapiens
agccugggcagcauagcaaga

SEQ ID NO: 1811262 - RNA, 18 nt, Homo sapiens
caaacaaaaugaugggaa

SEQ ID NO: 1811263 - RNA, 22 nt, Homo sapiens
agcucccuguggggcaggagug

SEQ ID NO: 1811264 - RNA, 20 nt, Homo sapiens
aaaagauacggcccaugcaa

SEQ ID NO: 1811265 - RNA, 16 nt, Homo sapiens
cugaggugaaagggag

SEQ ID NO: 1811266 - RNA, 16 nt, Homo sapiens
auagaauucagaaaau

SEQ ID NO: 1811267 - RNA, 20 nt, Homo sapiens
auaaauaaaagaacagccuu

SEQ ID NO: 1811268 - RNA, 14 nt, Homo sapiens
acacuucuccuuaa

SEQ ID NO: 1811269 - RNA, 21 nt, Homo sapiens
auggaacuuuauuuacacucc

SEQ ID NO: 1811270 - RNA, 17 nt, Homo sapiens
acauuuaaauuccacag

SEQ ID NO: 1811271 - RNA, 22 nt, Homo sapiens
gaagacuucaauauuaaaugac

SEQ ID NO: 1811272 - RNA, 21 nt, Homo sapiens
cacugucuguuguuuaccuac

SEQ ID NO: 1811273 - RNA, 22 nt, Homo sapiens
acuucccgucccauauccugcc

SEQ ID NO: 1811274 - RNA, 14 nt, Homo sapiens
aauaggcauuugau

SEQ ID NO: 1811275 - RNA, 14 nt, Homo sapiens
uuaaaucaaaaggg

SEQ ID NO: 1811276 - RNA, 21 nt, Homo sapiens
uuaagaaaggcaaccaauaaa

SEQ ID NO: 1811277 - RNA, 10 nt, Homo sapiens
cucuugccuc

SEQ ID NO: 1811278 - RNA, 15 nt, Homo sapiens
aacccugugauacua

SEQ ID NO: 1811279 - RNA, 18 nt, Homo sapiens
cagugaggcugcacccac

SEQ ID NO: 1811280 - RNA, 13 nt, Homo sapiens
aacauaucuugag

SEQ ID NO: 1811281 - RNA, 15 nt, Homo sapiens
uuuuccuccuugucu

SEQ ID NO: 1811282 - RNA, 17 nt, Homo sapiens
gguucauaucaugaaga

SEQ ID NO: 1811283 - RNA, 17 nt, Homo sapiens
agcugaggccuaugcag

SEQ ID NO: 1811284 - RNA, 17 nt, Homo sapiens
acggccacacagcugcc

SEQ ID NO: 1811285 - RNA, 18 nt, Homo sapiens
cuccaccaucaccucucu

SEQ ID NO: 1811286 - RNA, 14 nt, Homo sapiens
gcucuuaaauguag

SEQ ID NO: 1811287 - RNA, 19 nt, Homo sapiens
gcauauauggacaccgacu

SEQ ID NO: 1811288 - RNA, 20 nt, Homo sapiens
ccuggggcuagggggagccc

SEQ ID NO: 1811289 - RNA, 14 nt, Homo sapiens
cugccagacacuga

SEQ ID NO: 1811290 - RNA, 21 nt, Homo sapiens
acaugcacacaggugcacaga

SEQ ID NO: 1811291 - RNA, 21 nt, Homo sapiens
gaauuuaaaaaaacgagcaau

SEQ ID NO: 1811292 - RNA, 20 nt, Homo sapiens
agauuuggaggcuaccucac

SEQ ID NO: 1811293 - RNA, 14 nt, Homo sapiens
gagcaucugcagua

SEQ ID NO: 1811294 - RNA, 17 nt, Homo sapiens
caccgcgaggccuauug

SEQ ID NO: 1811295 - RNA, 15 nt, Homo sapiens
aauaugaaugucaca

SEQ ID NO: 1811296 - RNA, 18 nt, Homo sapiens
ucagacuccagcugugaa

SEQ ID NO: 1811297 - RNA, 17 nt, Homo sapiens
gaugacauuaaagaagg

SEQ ID NO: 1811298 - RNA, 21 nt, Homo sapiens
cuuucuguguugaagcacugu

SEQ ID NO: 1811299 - RNA, 15 nt, Homo sapiens
cacacaucuaugaua

SEQ ID NO: 1811300 - RNA, 16 nt, Homo sapiens
gacagaagucuugucu

SEQ ID NO: 1811301 - RNA, 11 nt, Homo sapiens
aaacauuugcu

SEQ ID NO: 1811302 - RNA, 17 nt, Homo sapiens
cuguguuaucugugguu

SEQ ID NO: 1811303 - RNA, 20 nt, Homo sapiens
uuccaagacugaagacugca

SEQ ID NO: 1811304 - RNA, 21 nt, Homo sapiens
cauuugcugaauaacaacaau

SEQ ID NO: 1811305 - RNA, 13 nt, Homo sapiens
uccuuggugccgu

SEQ ID NO: 1811306 - RNA, 14 nt, Homo sapiens
uccuuguuccuaga

SEQ ID NO: 1811307 - RNA, 14 nt, Homo sapiens
aagagaacauuucu

SEQ ID NO: 1811308 - RNA, 12 nt, Homo sapiens
ucacaugccuuc

SEQ ID NO: 1811309 - RNA, 16 nt, Homo sapiens
aaagaaaacacaccuc

SEQ ID NO: 1811310 - RNA, 21 nt, Homo sapiens
ucagaaaaaguuucuuaagga

SEQ ID NO: 1811311 - RNA, 14 nt, Homo sapiens
agagaugggacaag

SEQ ID NO: 1811312 - RNA, 17 nt, Homo sapiens
gauuuaaaucuuuucaa

SEQ ID NO: 1811313 - RNA, 23 nt, Homo sapiens
uaccagcagugugucaggugcug

SEQ ID NO: 1811314 - RNA, 18 nt, Homo sapiens
auauauuuaugauaacua

SEQ ID NO: 1811315 - RNA, 14 nt, Homo sapiens
agcucccuggugag

SEQ ID NO: 1811316 - RNA, 17 nt, Homo sapiens
uccaaaccccaggguag

SEQ ID NO: 1811317 - RNA, 22 nt, Homo sapiens
gauggacaagauuaccccaccu

SEQ ID NO: 1811318 - RNA, 15 nt, Homo sapiens
uaagaggcugacuuu

SEQ ID NO: 1811319 - RNA, 21 nt, Homo sapiens
cuuaauuuggaaacuaauaaa

SEQ ID NO: 1811320 - RNA, 17 nt, Homo sapiens
uccuauacuauugaagu

SEQ ID NO: 1811321 - RNA, 18 nt, Homo sapiens
uaacugaggacuguuugc

SEQ ID NO: 1811322 - RNA, 17 nt, Homo sapiens
ugaggaugauguuauuc

SEQ ID NO: 1811323 - RNA, 15 nt, Homo sapiens
cgcauagcacuugca

SEQ ID NO: 1811324 - RNA, 19 nt, Homo sapiens
uauaaaaacagauucugau

SEQ ID NO: 1811325 - RNA, 22 nt, Homo sapiens
ugaaaaaccugaugcagugcuc

SEQ ID NO: 1811326 - RNA, 21 nt, Homo sapiens
cuggacuaugcugaugggcca

SEQ ID NO: 1811327 - RNA, 12 nt, Homo sapiens
ucuucaccucag

SEQ ID NO: 1811328 - RNA, 16 nt, Homo sapiens
ucaaaguaaaacuugc

SEQ ID NO: 1811329 - RNA, 17 nt, Homo sapiens
ucagggaaagcauuuaa

SEQ ID NO: 1811330 - RNA, 20 nt, Homo sapiens
agccucauugaugucaaaaa

SEQ ID NO: 1811331 - RNA, 19 nt, Homo sapiens
aguaaucaaucuacucaaa

SEQ ID NO: 1811332 - RNA, 19 nt, Homo sapiens
cacccuuccuucuguaaau

SEQ ID NO: 1811333 - RNA, 19 nt, Homo sapiens
agcguguuuacauguguag

SEQ ID NO: 1811334 - RNA, 23 nt, Homo sapiens
acucuuacaagaguggacucagu

SEQ ID NO: 1811335 - RNA, 18 nt, Homo sapiens
acugggcccgagccugaa

SEQ ID NO: 1811336 - RNA, 14 nt, Homo sapiens
auuucugauuucag

SEQ ID NO: 1811337 - RNA, 17 nt, Homo sapiens
auagauaggucagugca

SEQ ID NO: 1811338 - RNA, 17 nt, Homo sapiens
uuuaccucuucuaugca

SEQ ID NO: 1811339 - RNA, 17 nt, Homo sapiens
gagauugcaccacugca

SEQ ID NO: 1811340 - RNA, 21 nt, Homo sapiens
uccacuauaauuuuacaaagu

SEQ ID NO: 1811341 - RNA, 22 nt, Homo sapiens
acuccucagaucugaacacagu

SEQ ID NO: 1811342 - RNA, 21 nt, Homo sapiens
gcucuccccaggcauuugcca

SEQ ID NO: 1811343 - RNA, 15 nt, Homo sapiens
uagagaguuaugaac

SEQ ID NO: 1811344 - RNA, 21 nt, Homo sapiens
aguauguguauguacuuacau

SEQ ID NO: 1811345 - RNA, 12 nt, Homo sapiens
accccagaguug

SEQ ID NO: 1811346 - RNA, 15 nt, Homo sapiens
aaaguaaugaucuca

SEQ ID NO: 1811347 - RNA, 22 nt, Homo sapiens
uuuuacuuccaugauacuuuaa

SEQ ID NO: 1811348 - RNA, 18 nt, Homo sapiens
uaccacagcuauuuagaa

SEQ ID NO: 1811349 - RNA, 17 nt, Homo sapiens
uucacccaucuuaucaa

SEQ ID NO: 1811350 - RNA, 12 nt, Homo sapiens
uucaagauccuc

SEQ ID NO: 1811351 - RNA, 18 nt, Homo sapiens
gcaaaauauucuucuuug

SEQ ID NO: 1811352 - RNA, 23 nt, Homo sapiens
uguaacuuauguagauauuuggc

SEQ ID NO: 1811353 - RNA, 21 nt, Homo sapiens
gucuauuuaaaaaaaaaguca

SEQ ID NO: 1811354 - RNA, 15 nt, Homo sapiens
auaaccaaacauaac

SEQ ID NO: 1811355 - RNA, 21 nt, Homo sapiens
cugaaauggacuuuuguacau

SEQ ID NO: 1811356 - RNA, 16 nt, Homo sapiens
acaauauaucuugucu

SEQ ID NO: 1811357 - RNA, 18 nt, Homo sapiens
gcuaaacccagaugguuu

SEQ ID NO: 1811358 - RNA, 20 nt, Homo sapiens
cugcaacuuaaugcucugau

SEQ ID NO: 1811359 - RNA, 16 nt, Homo sapiens
ugcacccccuccugcu

SEQ ID NO: 1811360 - RNA, 17 nt, Homo sapiens
cugaggcagacagcagc

SEQ ID NO: 1811361 - RNA, 24 nt, Homo sapiens
ggaacacaggcccagaugacaucc

SEQ ID NO: 1811362 - RNA, 20 nt, Homo sapiens
gccuaagggccacaucccac

SEQ ID NO: 1811363 - RNA, 13 nt, Homo sapiens
agacaucucagga

SEQ ID NO: 1811364 - RNA, 14 nt, Homo sapiens
cucgggcugacccu

SEQ ID NO: 1811365 - RNA, 18 nt, Homo sapiens
cuggaagcacuacagagc

SEQ ID NO: 1811366 - RNA, 13 nt, Homo sapiens
augaugaaugaga

SEQ ID NO: 1811367 - RNA, 22 nt, Homo sapiens
agcaucauuguaaauuauuuca

SEQ ID NO: 1811368 - RNA, 14 nt, Homo sapiens
aacacaauaugaau

SEQ ID NO: 1811369 - RNA, 23 nt, Homo sapiens
aaauaugaagcucaccuguugcu

SEQ ID NO: 1811370 - RNA, 16 nt, Homo sapiens
ucaaugguagcauuua

SEQ ID NO: 1811371 - RNA, 18 nt, Homo sapiens
ggagaugaguugcaguuu

SEQ ID NO: 1811372 - RNA, 18 nt, Homo sapiens
ucaguaaacaaugaauag

SEQ ID NO: 1811373 - RNA, 15 nt, Homo sapiens
guuuccaaaaaggaa

SEQ ID NO: 1811374 - RNA, 16 nt, Homo sapiens
aaucauugcuggacug

SEQ ID NO: 1811375 - RNA, 18 nt, Homo sapiens
cuaaccaaaucucucaaa

SEQ ID NO: 1811376 - RNA, 22 nt, Homo sapiens
auaugauggggcaugugccaua

SEQ ID NO: 1811377 - RNA, 21 nt, Homo sapiens
cccagaaaaaaggacuguaua

SEQ ID NO: 1811378 - RNA, 17 nt, Homo sapiens
cuggaggugcugcucua

SEQ ID NO: 1811379 - RNA, 19 nt, Homo sapiens
uuuuaucacuuaauuugaa

SEQ ID NO: 1811380 - RNA, 16 nt, Homo sapiens
gagccaagauugcacc

SEQ ID NO: 1811381 - RNA, 18 nt, Homo sapiens
aguuuaauaacuaccuaa

SEQ ID NO: 1811382 - RNA, 17 nt, Homo sapiens
gagcagggagagcucac

SEQ ID NO: 1811383 - RNA, 16 nt, Homo sapiens
cggacgccaccuuccc

SEQ ID NO: 1811384 - RNA, 22 nt, Homo sapiens
ugaacaaaaccuacacacauac

SEQ ID NO: 1811385 - RNA, 22 nt, Homo sapiens
cuguauguaaacuguuacugaa

SEQ ID NO: 1811386 - RNA, 13 nt, Homo sapiens
uauguacuuuucc

SEQ ID NO: 1811387 - RNA, 18 nt, Homo sapiens
cagaauugacugcaguug

SEQ ID NO: 1811388 - RNA, 19 nt, Homo sapiens
aucccccaaguguccugga

SEQ ID NO: 1811389 - RNA, 18 nt, Homo sapiens
cacggugaaagugcugcu

SEQ ID NO: 1811390 - RNA, 15 nt, Homo sapiens
agcuauucaccucag

SEQ ID NO: 1811391 - RNA, 15 nt, Homo sapiens
augucucgcuaguga

SEQ ID NO: 1811392 - RNA, 15 nt, Homo sapiens
uuaacugauguuacu

SEQ ID NO: 1811393 - RNA, 20 nt, Homo sapiens
acuggguuccucuccaagcu

SEQ ID NO: 1811394 - RNA, 15 nt, Homo sapiens
aaugucaaguggcag

SEQ ID NO: 1811395 - RNA, 12 nt, Homo sapiens
ugaaggccuuca

SEQ ID NO: 1811396 - RNA, 16 nt, Homo sapiens
cucccaggaaccaaaa

SEQ ID NO: 1811397 - RNA, 16 nt, Homo sapiens
ucaaaaggagaaauga

SEQ ID NO: 1811398 - RNA, 12 nt, Homo sapiens
aagccuugcacu

SEQ ID NO: 1811399 - RNA, 14 nt, Homo sapiens
caggcagugcagua

SEQ ID NO: 1811400 - RNA, 21 nt, Homo sapiens
uuaacauaaaauaaacugaac

SEQ ID NO: 1811401 - RNA, 15 nt, Homo sapiens
cgagcacugugagca

SEQ ID NO: 1811402 - RNA, 23 nt, Homo sapiens
aaaauccaugugaccauucugcc

SEQ ID NO: 1811403 - RNA, 18 nt, Homo sapiens
gccuagcugcugucacau

SEQ ID NO: 1811404 - RNA, 9 nt, Homo sapiens
gucuucccc

SEQ ID NO: 1811405 - RNA, 16 nt, Homo sapiens
uccaguguacagugaa

SEQ ID NO: 1811406 - RNA, 20 nt, Homo sapiens
augaaaagauuaugaucuca

SEQ ID NO: 1811407 - RNA, 20 nt, Homo sapiens
uggaugccgauuucuguaaa

SEQ ID NO: 1811408 - RNA, 16 nt, Homo sapiens
agacaaauacacauac

SEQ ID NO: 1811409 - RNA, 16 nt, Homo sapiens
aaaccaggugcaauua

SEQ ID NO: 1811410 - RNA, 21 nt, Homo sapiens
gauuuagaagcaaagauuuca

SEQ ID NO: 1811411 - RNA, 19 nt, Homo sapiens
acuccagugcccaccagcc

SEQ ID NO: 1811412 - RNA, 17 nt, Homo sapiens
agucuggggaccagcuu

SEQ ID NO: 1811413 - RNA, 14 nt, Homo sapiens
gucuuaucuaccag

SEQ ID NO: 1811414 - RNA, 13 nt, Homo sapiens
uuaccugggaccu

SEQ ID NO: 1811415 - RNA, 17 nt, Homo sapiens
acauucuugguuguuaa

SEQ ID NO: 1811416 - RNA, 19 nt, Homo sapiens
accucacugaggaagggag

SEQ ID NO: 1811417 - RNA, 19 nt, Homo sapiens
agcccugagaaagaaugag

SEQ ID NO: 1811418 - RNA, 17 nt, Homo sapiens
caaccuuuaaaaaagca

SEQ ID NO: 1811419 - RNA, 19 nt, Homo sapiens
guaauguauucuaucucuc

SEQ ID NO: 1811420 - RNA, 22 nt, Homo sapiens
uaagauacaaauaaggacacaa

SEQ ID NO: 1811421 - RNA, 15 nt, Homo sapiens
aucagaacauucagc

SEQ ID NO: 1811422 - RNA, 21 nt, Homo sapiens
aacccuucaacuaugcaauga

SEQ ID NO: 1811423 - RNA, 13 nt, Homo sapiens
cacuguagccuua

SEQ ID NO: 1811424 - RNA, 18 nt, Homo sapiens
guaccuuucuagccuuag

SEQ ID NO: 1811425 - RNA, 17 nt, Homo sapiens
agaaucuugguuugccu

SEQ ID NO: 1811426 - RNA, 15 nt, Homo sapiens
acuucuaaaccaaaa

SEQ ID NO: 1811427 - RNA, 16 nt, Homo sapiens
cugccccuuaaacaca

SEQ ID NO: 1811428 - RNA, 16 nt, Homo sapiens
agcacuauuguuuaga

SEQ ID NO: 1811429 - RNA, 21 nt, Homo sapiens
acuuggagccccagugccaag

SEQ ID NO: 1811430 - RNA, 19 nt, Homo sapiens
ucuuuuucagagcuucuca

SEQ ID NO: 1811431 - RNA, 15 nt, Homo sapiens
uccuagggccacuga

SEQ ID NO: 1811432 - RNA, 13 nt, Homo sapiens
ccucccuugccac

SEQ ID NO: 1811433 - RNA, 13 nt, Homo sapiens
cuucucuugucau

SEQ ID NO: 1811434 - RNA, 13 nt, Homo sapiens
augcacagcucaa

SEQ ID NO: 1811435 - RNA, 12 nt, Homo sapiens
uguggcacucca

SEQ ID NO: 1811436 - RNA, 23 nt, Homo sapiens
acuuccugugccuuuccuaucac

SEQ ID NO: 1811437 - RNA, 12 nt, Homo sapiens
augacugugcuc

SEQ ID NO: 1811438 - RNA, 20 nt, Homo sapiens
uggcuccuuaucagugccau

SEQ ID NO: 1811439 - RNA, 15 nt, Homo sapiens
cgaggacgcauucca

SEQ ID NO: 1811440 - RNA, 23 nt, Homo sapiens
uauccacaacuuuucaaguauug

SEQ ID NO: 1811441 - RNA, 22 nt, Homo sapiens
uuuaaaaaaaaagucagagaca

SEQ ID NO: 1811442 - RNA, 21 nt, Homo sapiens
guaugccuuuaaaucugugau

SEQ ID NO: 1811443 - RNA, 14 nt, Homo sapiens
uguaugucugugua

SEQ ID NO: 1811444 - RNA, 16 nt, Homo sapiens
auuccugggcacaguu

SEQ ID NO: 1811445 - RNA, 17 nt, Homo sapiens
agccuccccgugccaaa

SEQ ID NO: 1811446 - RNA, 17 nt, Homo sapiens
accugcacuuacaggcc

SEQ ID NO: 1811447 - RNA, 21 nt, Homo sapiens
gaucuacaugaaugcaaaaca

SEQ ID NO: 1811448 - RNA, 19 nt, Homo sapiens
aucuaaucccuucaaggaa

SEQ ID NO: 1811449 - RNA, 20 nt, Homo sapiens
gcugggaggcaagaggggug

SEQ ID NO: 1811450 - RNA, 22 nt, Homo sapiens
gauccccccuuuccuucuaauu

SEQ ID NO: 1811451 - RNA, 23 nt, Homo sapiens
acuuaaacucaucuauccaggca

SEQ ID NO: 1811452 - RNA, 19 nt, Homo sapiens
aguuuuaguuuucucuuag

SEQ ID NO: 1811453 - RNA, 14 nt, Homo sapiens
gccacugcuguauu

SEQ ID NO: 1811454 - RNA, 20 nt, Homo sapiens
uacagcuucagcugccugga

SEQ ID NO: 1811455 - RNA, 23 nt, Homo sapiens
cuuaaauaaaaauaaaaauucau

SEQ ID NO: 1811456 - RNA, 18 nt, Homo sapiens
auuuagccagcguuuauu

SEQ ID NO: 1811457 - RNA, 22 nt, Homo sapiens
agagagcuuaggaagcaugagg

SEQ ID NO: 1811458 - RNA, 19 nt, Homo sapiens
gagagggacucaagggaaa

SEQ ID NO: 1811459 - RNA, 20 nt, Homo sapiens
cuguucuaauggauuauaau

SEQ ID NO: 1811460 - RNA, 17 nt, Homo sapiens
ccaaucauuugcaaugc

SEQ ID NO: 1811461 - RNA, 18 nt, Homo sapiens
agagaucucagagguuau

SEQ ID NO: 1811462 - RNA, 15 nt, Homo sapiens
cccugugcugugugg

SEQ ID NO: 1811463 - RNA, 20 nt, Homo sapiens
gcuuuggcugagaccuggga

SEQ ID NO: 1811464 - RNA, 18 nt, Homo sapiens
aggaaaccgaaacugacu

SEQ ID NO: 1811465 - RNA, 19 nt, Homo sapiens
aacuucagaaagacaguga

SEQ ID NO: 1811466 - RNA, 16 nt, Homo sapiens
ugaacacuugacaagg

SEQ ID NO: 1811467 - RNA, 13 nt, Homo sapiens
gcuucugccuaag

SEQ ID NO: 1811468 - RNA, 18 nt, Homo sapiens
cacgucuggcuucacaga

SEQ ID NO: 1811469 - RNA, 21 nt, Homo sapiens
gagugucaugaagugcacagg

SEQ ID NO: 1811470 - RNA, 16 nt, Homo sapiens
uccuucucaucuguga

SEQ ID NO: 1811471 - RNA, 13 nt, Homo sapiens
agaucuuccccaa

SEQ ID NO: 1811472 - RNA, 14 nt, Homo sapiens
ugcgggcaccugua

SEQ ID NO: 1811473 - RNA, 12 nt, Homo sapiens
aagaauaauuca

SEQ ID NO: 1811474 - RNA, 22 nt, Homo sapiens
cuuguagcggaugauucuucaa

SEQ ID NO: 1811475 - RNA, 18 nt, Homo sapiens
ccacaccugcagugccag

SEQ ID NO: 1811476 - RNA, 21 nt, Homo sapiens
gaggacaaaacuucuugucag

SEQ ID NO: 1811477 - RNA, 18 nt, Homo sapiens
ggguaaugcgugcaguuc

SEQ ID NO: 1811478 - RNA, 16 nt, Homo sapiens
cugaagaaacacagca

SEQ ID NO: 1811479 - RNA, 16 nt, Homo sapiens
uuucauauuugcacua

SEQ ID NO: 1811480 - RNA, 23 nt, Homo sapiens
uuuagucuaacaacugcccaguu

SEQ ID NO: 1811481 - RNA, 20 nt, Homo sapiens
gcucaggguggucucuucuu

SEQ ID NO: 1811482 - RNA, 17 nt, Homo sapiens
cauuccuuugucuucaa

SEQ ID NO: 1811483 - RNA, 18 nt, Homo sapiens
cacugaggggggauccag

SEQ ID NO: 1811484 - RNA, 13 nt, Homo sapiens
uaccuucugccag

SEQ ID NO: 1811485 - RNA, 13 nt, Homo sapiens
uccgugugggaga

SEQ ID NO: 1811486 - RNA, 16 nt, Homo sapiens
agcuuuuuguuugcau

SEQ ID NO: 1811487 - RNA, 18 nt, Homo sapiens
uuacauaaucuguacaau

SEQ ID NO: 1811488 - RNA, 16 nt, Homo sapiens
cugggcagaaggccaa

SEQ ID NO: 1811489 - RNA, 20 nt, Homo sapiens
uaaacaguaaaccuuaacag

SEQ ID NO: 1811490 - RNA, 14 nt, Homo sapiens
ggauaucaaaagca

SEQ ID NO: 1811491 - RNA, 21 nt, Homo sapiens
aaauuaaguuguaucauuuca

SEQ ID NO: 1811492 - RNA, 16 nt, Homo sapiens
uauuuccuuagugcca

SEQ ID NO: 1811493 - RNA, 16 nt, Homo sapiens
uguagcauuggaucaa

SEQ ID NO: 1811494 - RNA, 10 nt, Homo sapiens
gauaaacuaa

SEQ ID NO: 1811495 - RNA, 22 nt, Homo sapiens
uucacugucaggaagaaaucac

SEQ ID NO: 1811496 - RNA, 16 nt, Homo sapiens
uucaaucaaaauuuca

SEQ ID NO: 1811497 - RNA, 15 nt, Homo sapiens
ccagcagaucccagc

SEQ ID NO: 1811498 - RNA, 16 nt, Homo sapiens
ugcaggggauggugug

SEQ ID NO: 1811499 - RNA, 20 nt, Homo sapiens
ucaugugguacuugagggau

SEQ ID NO: 1811500 - RNA, 12 nt, Homo sapiens
aaagaguugaag

SEQ ID NO: 1811501 - RNA, 15 nt, Homo sapiens
agaaugcuacaagaa

SEQ ID NO: 1811502 - RNA, 21 nt, Homo sapiens
uugggaaaaaggccucugucc

SEQ ID NO: 1811503 - RNA, 18 nt, Homo sapiens
ucccuccaccagugugcu

SEQ ID NO: 1811504 - RNA, 15 nt, Homo sapiens
ugcccacucccgcca

SEQ ID NO: 1811505 - RNA, 12 nt, Homo sapiens
gacuuuaccugc

SEQ ID NO: 1811506 - RNA, 22 nt, Homo sapiens
ccacuucugggucaugcacuga

SEQ ID NO: 1811507 - RNA, 19 nt, Homo sapiens
caaggcccugcccugccca

SEQ ID NO: 1811508 - RNA, 21 nt, Homo sapiens
ugcucacccgccucuugcccc

SEQ ID NO: 1811509 - RNA, 21 nt, Homo sapiens
gaccucuauauuugcucuuuu

SEQ ID NO: 1811510 - RNA, 14 nt, Homo sapiens
auugcuagaggugg

SEQ ID NO: 1811511 - RNA, 21 nt, Homo sapiens
caguuaagcccccuccucacc

SEQ ID NO: 1811512 - RNA, 23 nt, Homo sapiens
ugaaaggauaggauugacauacc

SEQ ID NO: 1811513 - RNA, 13 nt, Homo sapiens
cuuguuuagcaua

SEQ ID NO: 1811514 - RNA, 18 nt, Homo sapiens
uucuaaugauuauagaua

SEQ ID NO: 1811515 - RNA, 21 nt, Homo sapiens
ucucagugcuucuuacuauua

SEQ ID NO: 1811516 - RNA, 20 nt, Homo sapiens
acugauggaaaauaccagug

SEQ ID NO: 1811517 - RNA, 13 nt, Homo sapiens
uauuaucaccagc

SEQ ID NO: 1811518 - RNA, 16 nt, Homo sapiens
uagccuuccucugauu

SEQ ID NO: 1811519 - RNA, 18 nt, Homo sapiens
uccauuuauaaccccagc

SEQ ID NO: 1811520 - RNA, 19 nt, Homo sapiens
uccucagacaacagccucu

SEQ ID NO: 1811521 - RNA, 15 nt, Homo sapiens
uacaagaaccaagga

SEQ ID NO: 1811522 - RNA, 17 nt, Homo sapiens
caguguugacauagccu

SEQ ID NO: 1811523 - RNA, 23 nt, Homo sapiens
agaaguggggaccccaccccuca

SEQ ID NO: 1811524 - RNA, 23 nt, Homo sapiens
aaaaaguccuugauuuagcacua

SEQ ID NO: 1811525 - RNA, 17 nt, Homo sapiens
ugucauauucgauguac

SEQ ID NO: 1811526 - RNA, 16 nt, Homo sapiens
uaucuuauacugaaaa

SEQ ID NO: 1811527 - RNA, 15 nt, Homo sapiens
acucugagcugcuag

SEQ ID NO: 1811528 - RNA, 23 nt, Homo sapiens
gcccuguggccgacucugcacuc

SEQ ID NO: 1811529 - RNA, 17 nt, Homo sapiens
guagagaauguagccau

SEQ ID NO: 1811530 - RNA, 23 nt, Homo sapiens
ugaauauaaauguuuuacucaga

SEQ ID NO: 1811531 - RNA, 18 nt, Homo sapiens
aguucaauggcugcugaa

SEQ ID NO: 1811532 - RNA, 21 nt, Homo sapiens
cguaauggggacucuccaggc

SEQ ID NO: 1811533 - RNA, 12 nt, Homo sapiens
uuaggcacuugg

SEQ ID NO: 1811534 - RNA, 16 nt, Homo sapiens
acuuucaaaauuaaau

SEQ ID NO: 1811535 - RNA, 16 nt, Homo sapiens
aauggcuaacugauga

SEQ ID NO: 1811536 - RNA, 21 nt, Homo sapiens
ucaccagaauauuucuuucau

SEQ ID NO: 1811537 - RNA, 18 nt, Homo sapiens
cccuguguuccuggagaa

SEQ ID NO: 1811538 - RNA, 19 nt, Homo sapiens
uucugucuagacuggccua

SEQ ID NO: 1811539 - RNA, 20 nt, Homo sapiens
uacagcccaugauagccucu

SEQ ID NO: 1811540 - RNA, 13 nt, Homo sapiens
gccuagauaugaa

SEQ ID NO: 1811541 - RNA, 14 nt, Homo sapiens
uucauacugaauga

SEQ ID NO: 1811542 - RNA, 18 nt, Homo sapiens
aauuugagauucuacagu

SEQ ID NO: 1811543 - RNA, 14 nt, Homo sapiens
gcuggcgugcagug

SEQ ID NO: 1811544 - RNA, 16 nt, Homo sapiens
cugcacggugggagac

SEQ ID NO: 1811545 - RNA, 22 nt, Homo sapiens
uauugaaaaaucaccacaccaa

SEQ ID NO: 1811546 - RNA, 13 nt, Homo sapiens
aacaauacuaaau

SEQ ID NO: 1811547 - RNA, 13 nt, Homo sapiens
uccuuuacacaua

SEQ ID NO: 1811548 - RNA, 22 nt, Homo sapiens
cuugaggaaaaauguccaaaau

SEQ ID NO: 1811549 - RNA, 17 nt, Homo sapiens
uagauuccauacaguga

SEQ ID NO: 1811550 - RNA, 24 nt, Homo sapiens
acuucuuacaauaauucuaugaga

SEQ ID NO: 1811551 - RNA, 17 nt, Homo sapiens
ggaagcagcagccucgc

SEQ ID NO: 1811552 - RNA, 17 nt, Homo sapiens
ugaagucugagcccauu

SEQ ID NO: 1811553 - RNA, 13 nt, Homo sapiens
ugcuaagugaaau

SEQ ID NO: 1811554 - RNA, 21 nt, Homo sapiens
ggguucaagugauucucaugc

SEQ ID NO: 1811555 - RNA, 16 nt, Homo sapiens
ucauaaagaaaugcaa

SEQ ID NO: 1811556 - RNA, 23 nt, Homo sapiens
cagaaggcaauaccaaccugaaa

SEQ ID NO: 1811557 - RNA, 15 nt, Homo sapiens
agagcaaaaugaugc

SEQ ID NO: 1811558 - RNA, 23 nt, Homo sapiens
aguaaaguaugaaacauucuuau

SEQ ID NO: 1811559 - RNA, 12 nt, Homo sapiens
aacuugggccac

SEQ ID NO: 1811560 - RNA, 21 nt, Homo sapiens
gccauguuuagauuccaggau

SEQ ID NO: 1811561 - RNA, 20 nt, Homo sapiens
cucuggaauuugcaagucau

SEQ ID NO: 1811562 - RNA, 20 nt, Homo sapiens
uccagggcuauaggguguga

SEQ ID NO: 1811563 - RNA, 20 nt, Homo sapiens
caacaaggcugcacagcuca

SEQ ID NO: 1811564 - RNA, 14 nt, Homo sapiens
agaaguggagacuu

SEQ ID NO: 1811565 - RNA, 16 nt, Homo sapiens
ccccaccucuggucca

SEQ ID NO: 1811566 - RNA, 12 nt, Homo sapiens
gaaccugucucc

SEQ ID NO: 1811567 - RNA, 19 nt, Homo sapiens
uaaauugauguugaugcaa

SEQ ID NO: 1811568 - RNA, 23 nt, Homo sapiens
ggccagcccugcagcccaaaacc

SEQ ID NO: 1811569 - RNA, 23 nt, Homo sapiens
gauuuaggccuuaacacacuggc

SEQ ID NO: 1811570 - RNA, 19 nt, Homo sapiens
cugcagcuggaaugugcca

SEQ ID NO: 1811571 - RNA, 21 nt, Homo sapiens
aacauuuaaauuccacagauu

SEQ ID NO: 1811572 - RNA, 21 nt, Homo sapiens
aaucuauaguucacugacaca

SEQ ID NO: 1811573 - RNA, 19 nt, Homo sapiens
aguccuuucuaaguauuuu

SEQ ID NO: 1811574 - RNA, 21 nt, Homo sapiens
uggauuuagacucauggaaua

SEQ ID NO: 1811575 - RNA, 20 nt, Homo sapiens
cuuucugaugacgccugucu

SEQ ID NO: 1811576 - RNA, 17 nt, Homo sapiens
acccagguucaugaaua

SEQ ID NO: 1811577 - RNA, 23 nt, Homo sapiens
cuaaauaugugacugacaauaaa

SEQ ID NO: 1811578 - RNA, 19 nt, Homo sapiens
agccaagauugcgccauug

SEQ ID NO: 1811579 - RNA, 23 nt, Homo sapiens
ucuucuccaggcuguaucccaug

SEQ ID NO: 1811580 - RNA, 13 nt, Homo sapiens
gccucacaucucc

SEQ ID NO: 1811581 - RNA, 20 nt, Homo sapiens
ugacaccuuuaaaaagcagu

SEQ ID NO: 1811582 - RNA, 19 nt, Homo sapiens
auaagccaauuuuucugca

SEQ ID NO: 1811583 - RNA, 22 nt, Homo sapiens
guccuaccacucuaaucaagaa

SEQ ID NO: 1811584 - RNA, 17 nt, Homo sapiens
agguuaauucucuaggg

SEQ ID NO: 1811585 - RNA, 14 nt, Homo sapiens
gguuuugauugaga

SEQ ID NO: 1811586 - RNA, 21 nt, Homo sapiens
cccaggaccuggagacaggau

SEQ ID NO: 1811587 - RNA, 21 nt, Homo sapiens
uaacgacagaagguugccagg

SEQ ID NO: 1811588 - RNA, 17 nt, Homo sapiens
agacaguccaagcccug

SEQ ID NO: 1811589 - RNA, 17 nt, Homo sapiens
aaggggacccuccgcuc

SEQ ID NO: 1811590 - RNA, 16 nt, Homo sapiens
caauuucaaaaugcau

SEQ ID NO: 1811591 - RNA, 21 nt, Homo sapiens
cagagccaccugacucuugca

SEQ ID NO: 1811592 - RNA, 14 nt, Homo sapiens
gcaaggaucacuug

SEQ ID NO: 1811593 - RNA, 15 nt, Homo sapiens
agaggaagugcacug

SEQ ID NO: 1811594 - RNA, 16 nt, Homo sapiens
caccaaugaaaacaug

SEQ ID NO: 1811595 - RNA, 15 nt, Homo sapiens
aaagucaaaugccaa

SEQ ID NO: 1811596 - RNA, 14 nt, Homo sapiens
acugucacauuccc

SEQ ID NO: 1811597 - RNA, 14 nt, Homo sapiens
aagaauugaggaau

SEQ ID NO: 1811598 - RNA, 14 nt, Homo sapiens
uacacaugugcaca

SEQ ID NO: 1811599 - RNA, 18 nt, Homo sapiens
accucccuccccgucuca

SEQ ID NO: 1811600 - RNA, 15 nt, Homo sapiens
acuguauacauuaca

SEQ ID NO: 1811601 - RNA, 12 nt, Homo sapiens
gguaaaguauca

SEQ ID NO: 1811602 - RNA, 22 nt, Homo sapiens
uuuggaaaagaaacaauaugcu

SEQ ID NO: 1811603 - RNA, 16 nt, Homo sapiens
cuccaguuuugccuga

SEQ ID NO: 1811604 - RNA, 19 nt, Homo sapiens
agauccuuuaguccaccca

SEQ ID NO: 1811605 - RNA, 15 nt, Homo sapiens
aguuacuuaccugca

SEQ ID NO: 1811606 - RNA, 21 nt, Homo sapiens
acuggcuaacagauguugaaa

SEQ ID NO: 1811607 - RNA, 17 nt, Homo sapiens
ugcucauuucacuauuc

SEQ ID NO: 1811608 - RNA, 17 nt, Homo sapiens
ggcucucaccacuucag

SEQ ID NO: 1811609 - RNA, 22 nt, Homo sapiens
gaccaccucucaauauucaaua

SEQ ID NO: 1811610 - RNA, 21 nt, Homo sapiens
aggcacgcuggcuugugaucu

SEQ ID NO: 1811611 - RNA, 15 nt, Homo sapiens
aggggagggaucucc

SEQ ID NO: 1811612 - RNA, 15 nt, Homo sapiens
cugcccgcacacccu

SEQ ID NO: 1811613 - RNA, 23 nt, Homo sapiens
gcccagggggagcuaucacugua

SEQ ID NO: 1811614 - RNA, 14 nt, Homo sapiens
cuuaauaguauuuu

SEQ ID NO: 1811615 - RNA, 22 nt, Homo sapiens
cauaaagagcacguuuuccauu

SEQ ID NO: 1811616 - RNA, 21 nt, Homo sapiens
ccauacagcuguccacacuga

SEQ ID NO: 1811617 - RNA, 15 nt, Homo sapiens
agaaaaaacacacuc

SEQ ID NO: 1811618 - RNA, 15 nt, Homo sapiens
ucuauuuuauaucug

SEQ ID NO: 1811619 - RNA, 19 nt, Homo sapiens
cuccuggguucaagcaaau

SEQ ID NO: 1811620 - RNA, 23 nt, Homo sapiens
agcugcugucuucuggacaggcu

SEQ ID NO: 1811621 - RNA, 21 nt, Homo sapiens
ggacugucggaggaaagggau

SEQ ID NO: 1811622 - RNA, 23 nt, Homo sapiens
gagucugagaacccccagaccaa

SEQ ID NO: 1811623 - RNA, 23 nt, Homo sapiens
guguuaguuauaaauagccuuca

SEQ ID NO: 1811624 - RNA, 16 nt, Homo sapiens
gauuacaggcaccugc

SEQ ID NO: 1811625 - RNA, 15 nt, Homo sapiens
aggaacagcacuggg

SEQ ID NO: 1811626 - RNA, 22 nt, Homo sapiens
agaggagugauugaaccagcuc

SEQ ID NO: 1811627 - RNA, 16 nt, Homo sapiens
ugacuucaacugggau

SEQ ID NO: 1811628 - RNA, 18 nt, Homo sapiens
cuucuuccccuucccuga

SEQ ID NO: 1811629 - RNA, 21 nt, Homo sapiens
aggccuagaguggcagccaag

SEQ ID NO: 1811630 - RNA, 21 nt, Homo sapiens
acaauucacauccccaaaggu

SEQ ID NO: 1811631 - RNA, 15 nt, Homo sapiens
ggaggcgguggcaga

SEQ ID NO: 1811632 - RNA, 14 nt, Homo sapiens
aaaccaaugauuca

SEQ ID NO: 1811633 - RNA, 20 nt, Homo sapiens
aaguugggcgguuucaggga

SEQ ID NO: 1811634 - RNA, 21 nt, Homo sapiens
uuucauguggcuguagauccc

SEQ ID NO: 1811635 - RNA, 15 nt, Homo sapiens
aggagagacauggaa

SEQ ID NO: 1811636 - RNA, 22 nt, Homo sapiens
auacaacauuaaggaauuugau

SEQ ID NO: 1811637 - RNA, 16 nt, Homo sapiens
caaccucaaaggagca

SEQ ID NO: 1811638 - RNA, 19 nt, Homo sapiens
aacucgaggagcucagggu

SEQ ID NO: 1811639 - RNA, 22 nt, Homo sapiens
ccaguuaaguaauaguuugaua

SEQ ID NO: 1811640 - RNA, 20 nt, Homo sapiens
agggcccccaucucaugccc

SEQ ID NO: 1811641 - RNA, 15 nt, Homo sapiens
uucccugcuuaauga

SEQ ID NO: 1811642 - RNA, 16 nt, Homo sapiens
agagaaguacagguca

SEQ ID NO: 1811643 - RNA, 20 nt, Homo sapiens
cacuggccccugagaucucu

SEQ ID NO: 1811644 - RNA, 16 nt, Homo sapiens
accuuggggucccucc

SEQ ID NO: 1811645 - RNA, 22 nt, Homo sapiens
cuuuuuuuuuuuuuccuuugaa

SEQ ID NO: 1811646 - RNA, 19 nt, Homo sapiens
ccucuaacccaggucuuga

SEQ ID NO: 1811647 - RNA, 18 nt, Homo sapiens
ugcaaaagcaaucauaga

SEQ ID NO: 1811648 - RNA, 19 nt, Homo sapiens
cuacaggugaaggcucuca

SEQ ID NO: 1811649 - RNA, 17 nt, Homo sapiens
uguaaagaagggauauu

SEQ ID NO: 1811650 - RNA, 18 nt, Homo sapiens
uucaacaaauguggguga

SEQ ID NO: 1811651 - RNA, 21 nt, Homo sapiens
acauaacucuguaaaaacacu

SEQ ID NO: 1811652 - RNA, 21 nt, Homo sapiens
uuauugcaaaguuguauucag

SEQ ID NO: 1811653 - RNA, 14 nt, Homo sapiens
gaaucaauuuccca

SEQ ID NO: 1811654 - RNA, 22 nt, Homo sapiens
uaacuugagauucaagacaaga

SEQ ID NO: 1811655 - RNA, 15 nt, Homo sapiens
ccauguauugauacu

SEQ ID NO: 1811656 - RNA, 11 nt, Homo sapiens
aaacaucucaa

SEQ ID NO: 1811657 - RNA, 12 nt, Homo sapiens
cccacaagcacc

SEQ ID NO: 1811658 - RNA, 23 nt, Homo sapiens
augagcuuuauguaauaauguga

SEQ ID NO: 1811659 - RNA, 20 nt, Homo sapiens
uggaagccucagaggccuug

SEQ ID NO: 1811660 - RNA, 23 nt, Homo sapiens
gcaggacacaagcacaguuuuaa

SEQ ID NO: 1811661 - RNA, 23 nt, Homo sapiens
ugauccacuuugggggaggagaa

SEQ ID NO: 1811662 - RNA, 19 nt, Homo sapiens
auguucccaaaacaauggu

SEQ ID NO: 1811663 - RNA, 21 nt, Homo sapiens
cagggcuccugccuucugucc

SEQ ID NO: 1811664 - RNA, 14 nt, Homo sapiens
aauuaaagccuuaa

SEQ ID NO: 1811665 - RNA, 16 nt, Homo sapiens
cuggccaccugccagg

SEQ ID NO: 1811666 - RNA, 15 nt, Homo sapiens
uuugaacaguuggau

SEQ ID NO: 1811667 - RNA, 16 nt, Homo sapiens
ugcaacuuccuuugac

SEQ ID NO: 1811668 - RNA, 21 nt, Homo sapiens
accaggaaacuagcuguuuaa

SEQ ID NO: 1811669 - RNA, 24 nt, Homo sapiens
accaugauuaaccacuucagcuga

SEQ ID NO: 1811670 - RNA, 18 nt, Homo sapiens
caccauguuguacaggcu

SEQ ID NO: 1811671 - RNA, 19 nt, Homo sapiens
uacaaucaugaacagcucu

SEQ ID NO: 1811672 - RNA, 12 nt, Homo sapiens
aaacugauuaaa

SEQ ID NO: 1811673 - RNA, 20 nt, Homo sapiens
ucuccaacuccugaccucag

SEQ ID NO: 1811674 - RNA, 22 nt, Homo sapiens
gcauuugguacacacuugaccu

SEQ ID NO: 1811675 - RNA, 23 nt, Homo sapiens
agcuagaggacuucuggcaggga

SEQ ID NO: 1811676 - RNA, 21 nt, Homo sapiens
cuguaacuuaauuuugugacc

SEQ ID NO: 1811677 - RNA, 22 nt, Homo sapiens
uuugucccggggcuccacugaa

SEQ ID NO: 1811678 - RNA, 21 nt, Homo sapiens
uucuccauuaaacuucuacug

SEQ ID NO: 1811679 - RNA, 21 nt, Homo sapiens
ugauucccauaacauaaaagu

SEQ ID NO: 1811680 - RNA, 15 nt, Homo sapiens
uugcagcccaaaggc

SEQ ID NO: 1811681 - RNA, 17 nt, Homo sapiens
ucaugugauuuacccuu

SEQ ID NO: 1811682 - RNA, 17 nt, Homo sapiens
ucugccacccuaccugu

SEQ ID NO: 1811683 - RNA, 17 nt, Homo sapiens
ugaaaauaagaauuauu

SEQ ID NO: 1811684 - RNA, 16 nt, Homo sapiens
ggaaaaguaagggaau

SEQ ID NO: 1811685 - RNA, 23 nt, Homo sapiens
ucuguagacugccaucauugaug

SEQ ID NO: 1811686 - RNA, 24 nt, Homo sapiens
agauauucauuggcagcucaaaga

SEQ ID NO: 1811687 - RNA, 14 nt, Homo sapiens
ucucaugacuccua

SEQ ID NO: 1811688 - RNA, 13 nt, Homo sapiens
agcccaaucugcc

SEQ ID NO: 1811689 - RNA, 23 nt, Homo sapiens
ucuuucaagggaccucuccauga

SEQ ID NO: 1811690 - RNA, 15 nt, Homo sapiens
gcugagcugugacau

SEQ ID NO: 1811691 - RNA, 16 nt, Homo sapiens
ucccuccaaucuugag

SEQ ID NO: 1811692 - RNA, 15 nt, Homo sapiens
auaacauacaugaga

SEQ ID NO: 1811693 - RNA, 21 nt, Homo sapiens
uacaggggccaaagccaggca

SEQ ID NO: 1811694 - RNA, 16 nt, Homo sapiens
aaugcuaaaugucaau

SEQ ID NO: 1811695 - RNA, 20 nt, Homo sapiens
guccagaaggagacaggcag

SEQ ID NO: 1811696 - RNA, 12 nt, Homo sapiens
aaaacacugugu

SEQ ID NO: 1811697 - RNA, 14 nt, Homo sapiens
cuuuuaacuccuca

SEQ ID NO: 1811698 - RNA, 18 nt, Homo sapiens
cucaggaagccucugggu

SEQ ID NO: 1811699 - RNA, 15 nt, Homo sapiens
cauuggugaaguaaa

SEQ ID NO: 1811700 - RNA, 16 nt, Homo sapiens
ugcucgucacagugug

SEQ ID NO: 1811701 - RNA, 12 nt, Homo sapiens
uacaaacauguu

SEQ ID NO: 1811702 - RNA, 19 nt, Homo sapiens
aaauaaucacacacacacu

SEQ ID NO: 1811703 - RNA, 13 nt, Homo sapiens
gaguugacugcuc

SEQ ID NO: 1811704 - RNA, 21 nt, Homo sapiens
uaguuuaguacaauaaucucu

SEQ ID NO: 1811705 - RNA, 20 nt, Homo sapiens
cuccccacucccccacccau

SEQ ID NO: 1811706 - RNA, 17 nt, Homo sapiens
cuauaugucuagcucau

SEQ ID NO: 1811707 - RNA, 16 nt, Homo sapiens
ucaucccuccaucuca

SEQ ID NO: 1811708 - RNA, 13 nt, Homo sapiens
uacccuaaccaag

SEQ ID NO: 1811709 - RNA, 20 nt, Homo sapiens
cccuguguauucaccaccaa

SEQ ID NO: 1811710 - RNA, 14 nt, Homo sapiens
ugcuaaggcugccu

SEQ ID NO: 1811711 - RNA, 15 nt, Homo sapiens
aggccaccaguuaaa

SEQ ID NO: 1811712 - RNA, 15 nt, Homo sapiens
acauucagauuuacc

SEQ ID NO: 1811713 - RNA, 23 nt, Homo sapiens
uugaaauaauaaaucugguagaa

SEQ ID NO: 1811714 - RNA, 17 nt, Homo sapiens
uacguggccauguauga

SEQ ID NO: 1811715 - RNA, 22 nt, Homo sapiens
acagcccauggugaauguaugu

SEQ ID NO: 1811716 - RNA, 21 nt, Homo sapiens
agcucaguaguauaugguguu

SEQ ID NO: 1811717 - RNA, 13 nt, Homo sapiens
gcuggcuuucaga

SEQ ID NO: 1811718 - RNA, 20 nt, Homo sapiens
uagccauguuaacaugacau

SEQ ID NO: 1811719 - RNA, 16 nt, Homo sapiens
cucugaagcauguuuc

SEQ ID NO: 1811720 - RNA, 11 nt, Homo sapiens
gauguacaauu

SEQ ID NO: 1811721 - RNA, 20 nt, Homo sapiens
cugcuacacaaaagccaaaa

SEQ ID NO: 1811722 - RNA, 16 nt, Homo sapiens
ucucuucuguccauca

SEQ ID NO: 1811723 - RNA, 17 nt, Homo sapiens
cuuuguauuucaucucu

SEQ ID NO: 1811724 - RNA, 14 nt, Homo sapiens
augccagugccuua

SEQ ID NO: 1811725 - RNA, 23 nt, Homo sapiens
gagagguucugugcaaaacuacc

SEQ ID NO: 1811726 - RNA, 21 nt, Homo sapiens
ucugcccccgcggguucuaga

SEQ ID NO: 1811727 - RNA, 15 nt, Homo sapiens
agggcccccaaagag

SEQ ID NO: 1811728 - RNA, 18 nt, Homo sapiens
uuuucaaaauucaaaaaa

SEQ ID NO: 1811729 - RNA, 14 nt, Homo sapiens
acugugcauuugag

SEQ ID NO: 1811730 - RNA, 18 nt, Homo sapiens
ugaaguaacuugucuuaa

SEQ ID NO: 1811731 - RNA, 17 nt, Homo sapiens
ucucugugggccccacc

SEQ ID NO: 1811732 - RNA, 22 nt, Homo sapiens
aucacucugugucugaguggcu

SEQ ID NO: 1811733 - RNA, 24 nt, Homo sapiens
caggcugaaaagaagccucagcuc

SEQ ID NO: 1811734 - RNA, 16 nt, Homo sapiens
ucccucaugucuuuaa

SEQ ID NO: 1811735 - RNA, 17 nt, Homo sapiens
uugagacaggaugguua

SEQ ID NO: 1811736 - RNA, 20 nt, Homo sapiens
gcuuucuucuacaaccagag

SEQ ID NO: 1811737 - RNA, 16 nt, Homo sapiens
gacacagauuggccag

SEQ ID NO: 1811738 - RNA, 19 nt, Homo sapiens
aauagcgcucccuuuucac

SEQ ID NO: 1811739 - RNA, 15 nt, Homo sapiens
guguuucuggggaca

SEQ ID NO: 1811740 - RNA, 20 nt, Homo sapiens
ggcuacacucaucugacuca

SEQ ID NO: 1811741 - RNA, 16 nt, Homo sapiens
cagcagcacgauccag

SEQ ID NO: 1811742 - RNA, 12 nt, Homo sapiens
uguugcacugcc

SEQ ID NO: 1811743 - RNA, 16 nt, Homo sapiens
uaaaagcaaaacugca

SEQ ID NO: 1811744 - RNA, 13 nt, Homo sapiens
cagcuaagcaaua

SEQ ID NO: 1811745 - RNA, 22 nt, Homo sapiens
ccuuuguuacagcuacuauaaa

SEQ ID NO: 1811746 - RNA, 23 nt, Homo sapiens
agcacauuauguuugcaacuggu

SEQ ID NO: 1811747 - RNA, 14 nt, Homo sapiens
aauugggauuugca

SEQ ID NO: 1811748 - RNA, 18 nt, Homo sapiens
caguugggauggaaaucu

SEQ ID NO: 1811749 - RNA, 16 nt, Homo sapiens
gacuguuuuuuucaca

SEQ ID NO: 1811750 - RNA, 17 nt, Homo sapiens
aagcuggggauguuuag

SEQ ID NO: 1811751 - RNA, 13 nt, Homo sapiens
gcauaugucuaua

SEQ ID NO: 1811752 - RNA, 22 nt, Homo sapiens
uaaggacgggaccauuuuuaca

SEQ ID NO: 1811753 - RNA, 22 nt, Homo sapiens
gauggacucugaaaaacauucc

SEQ ID NO: 1811754 - RNA, 15 nt, Homo sapiens
guuagugauggagcu

SEQ ID NO: 1811755 - RNA, 21 nt, Homo sapiens
aagcacaugccucucucaggc

SEQ ID NO: 1811756 - RNA, 22 nt, Homo sapiens
acacucauuuccaaucauacaa

SEQ ID NO: 1811757 - RNA, 23 nt, Homo sapiens
agugugaaacagcugcccugugu

SEQ ID NO: 1811758 - RNA, 18 nt, Homo sapiens
auacuuccaaagagucau

SEQ ID NO: 1811759 - RNA, 22 nt, Homo sapiens
agccucugcuggagaaagccac

SEQ ID NO: 1811760 - RNA, 17 nt, Homo sapiens
cuggaucucagccucug

SEQ ID NO: 1811761 - RNA, 22 nt, Homo sapiens
ucuccugggcccgcuuugccug

SEQ ID NO: 1811762 - RNA, 18 nt, Homo sapiens
cuuggacagcagccagcg

SEQ ID NO: 1811763 - RNA, 18 nt, Homo sapiens
agaggugggggaugcuga

SEQ ID NO: 1811764 - RNA, 15 nt, Homo sapiens
auuaaauuuaacucu

SEQ ID NO: 1811765 - RNA, 23 nt, Homo sapiens
aacugcaccaccgaccaacucca

SEQ ID NO: 1811766 - RNA, 12 nt, Homo sapiens
accugagcugcc

SEQ ID NO: 1811767 - RNA, 17 nt, Homo sapiens
aaccugugcuuucaugu

SEQ ID NO: 1811768 - RNA, 21 nt, Homo sapiens
uuaagguauuucgaaacugcc

SEQ ID NO: 1811769 - RNA, 16 nt, Homo sapiens
ugaaccuucugcaaca

SEQ ID NO: 1811770 - RNA, 17 nt, Homo sapiens
uaaaaaggcaguuugca

SEQ ID NO: 1811771 - RNA, 21 nt, Homo sapiens
ucccugcuuaaaaauguagca

SEQ ID NO: 1811772 - RNA, 13 nt, Homo sapiens
acaccaccaacau

SEQ ID NO: 1811773 - RNA, 22 nt, Homo sapiens
uuguucgccgcguggaauguga

SEQ ID NO: 1811774 - RNA, 16 nt, Homo sapiens
uccugcuccacagugu

SEQ ID NO: 1811775 - RNA, 21 nt, Homo sapiens
gcagacucuacagaggccaug

SEQ ID NO: 1811776 - RNA, 16 nt, Homo sapiens
cgaggcgcucaucagg

SEQ ID NO: 1811777 - RNA, 17 nt, Homo sapiens
auguggaaccuguuuaa

SEQ ID NO: 1811778 - RNA, 19 nt, Homo sapiens
agccuuuuugucaccucaa

SEQ ID NO: 1811779 - RNA, 14 nt, Homo sapiens
ucaucucugcaggu

SEQ ID NO: 1811780 - RNA, 23 nt, Homo sapiens
acggcugcucggcuugaucacag

SEQ ID NO: 1811781 - RNA, 19 nt, Homo sapiens
ucaaaucucuugcuuucuu

SEQ ID NO: 1811782 - RNA, 22 nt, Homo sapiens
cauucauaaaaguuugcaugug

SEQ ID NO: 1811783 - RNA, 14 nt, Homo sapiens
ugggcccagaucug

SEQ ID NO: 1811784 - RNA, 16 nt, Homo sapiens
uugugucagaaacaug

SEQ ID NO: 1811785 - RNA, 14 nt, Homo sapiens
caaaauguacuuaa

SEQ ID NO: 1811786 - RNA, 12 nt, Homo sapiens
uaaacaacagac

SEQ ID NO: 1811787 - RNA, 22 nt, Homo sapiens
gugggcuaagcacgggccauau

SEQ ID NO: 1811788 - RNA, 16 nt, Homo sapiens
aucacaagauggaauu

SEQ ID NO: 1811789 - RNA, 17 nt, Homo sapiens
uaugaucacggcucacu

SEQ ID NO: 1811790 - RNA, 15 nt, Homo sapiens
agauggcagcaguga

SEQ ID NO: 1811791 - RNA, 20 nt, Homo sapiens
ucuuccugcccuuuccuucc

SEQ ID NO: 1811792 - RNA, 23 nt, Homo sapiens
cuucaaucucuguucugcuccca

SEQ ID NO: 1811793 - RNA, 23 nt, Homo sapiens
cguucucugccccguuucuugcc

SEQ ID NO: 1811794 - RNA, 23 nt, Homo sapiens
aucagucuuugucaaugcucuaa

SEQ ID NO: 1811795 - RNA, 20 nt, Homo sapiens
cauucuuauggccacaagca

SEQ ID NO: 1811796 - RNA, 12 nt, Homo sapiens
agauguacugca

SEQ ID NO: 1811797 - RNA, 15 nt, Homo sapiens
uaaaaguugugcaug

SEQ ID NO: 1811798 - RNA, 22 nt, Homo sapiens
uaaguacagagaagccaucacc

SEQ ID NO: 1811799 - RNA, 17 nt, Homo sapiens
gcuuuucuaacuaagag

SEQ ID NO: 1811800 - RNA, 14 nt, Homo sapiens
uggcccaacacugu

SEQ ID NO: 1811801 - RNA, 15 nt, Homo sapiens
agaccaccagggucc

SEQ ID NO: 1811802 - RNA, 16 nt, Homo sapiens
cucccaugugcugaga

SEQ ID NO: 1811803 - RNA, 17 nt, Homo sapiens
ugggacugaugucaucu

SEQ ID NO: 1811804 - RNA, 15 nt, Homo sapiens
gcaucucugagcaau

SEQ ID NO: 1811805 - RNA, 14 nt, Homo sapiens
ucugaggaugcuga

SEQ ID NO: 1811806 - RNA, 23 nt, Homo sapiens
gucucugagaauccaaacauccu

SEQ ID NO: 1811807 - RNA, 19 nt, Homo sapiens
ccuuaugauuaaacuuccu

SEQ ID NO: 1811808 - RNA, 20 nt, Homo sapiens
cgccagcucuaccaguucuc

SEQ ID NO: 1811809 - RNA, 14 nt, Homo sapiens
aauaaacuaugagg

SEQ ID NO: 1811810 - RNA, 15 nt, Homo sapiens
cuugggaacuccacu

SEQ ID NO: 1811811 - RNA, 15 nt, Homo sapiens
gcuaggaacuuggga

SEQ ID NO: 1811812 - RNA, 21 nt, Homo sapiens
ccugaugcuggggacacagca

SEQ ID NO: 1811813 - RNA, 17 nt, Homo sapiens
acaauaccuacaauaaa

SEQ ID NO: 1811814 - RNA, 23 nt, Homo sapiens
aagugacaggacuuucauuguuc

SEQ ID NO: 1811815 - RNA, 16 nt, Homo sapiens
cagauuugcauuucag

SEQ ID NO: 1811816 - RNA, 16 nt, Homo sapiens
ucugaaaugcacuaga

SEQ ID NO: 1811817 - RNA, 17 nt, Homo sapiens
gcagcaccugauucuca

SEQ ID NO: 1811818 - RNA, 17 nt, Homo sapiens
gcaaauuuugcauuuag

SEQ ID NO: 1811819 - RNA, 17 nt, Homo sapiens
ugacaagccaaugugaa

SEQ ID NO: 1811820 - RNA, 20 nt, Homo sapiens
gagguuuagccaucuuacuu

SEQ ID NO: 1811821 - RNA, 19 nt, Homo sapiens
agcuggucaguugccaaag

SEQ ID NO: 1811822 - RNA, 21 nt, Homo sapiens
agaaacuccuguuucuccuua

SEQ ID NO: 1811823 - RNA, 15 nt, Homo sapiens
agauuggcauaucau

SEQ ID NO: 1811824 - RNA, 16 nt, Homo sapiens
ucugacccugugaaau

SEQ ID NO: 1811825 - RNA, 19 nt, Homo sapiens
agaugccugugaaauagua

SEQ ID NO: 1811826 - RNA, 23 nt, Homo sapiens
acugauucucucuuguccuucac

SEQ ID NO: 1811827 - RNA, 17 nt, Homo sapiens
uugcucugaauauguca

SEQ ID NO: 1811828 - RNA, 16 nt, Homo sapiens
ccaacucagaagggag

SEQ ID NO: 1811829 - RNA, 21 nt, Homo sapiens
ccucaguuucuucaccuguaa

SEQ ID NO: 1811830 - RNA, 22 nt, Homo sapiens
cucagaaauuuucugaucucag

SEQ ID NO: 1811831 - RNA, 15 nt, Homo sapiens
agauaucagcccaaa

SEQ ID NO: 1811832 - RNA, 20 nt, Homo sapiens
caggaucauguaaaugcuca

SEQ ID NO: 1811833 - RNA, 17 nt, Homo sapiens
gcccaggauggcuuuga

SEQ ID NO: 1811834 - RNA, 18 nt, Homo sapiens
uguuguuauuauaugaua

SEQ ID NO: 1811835 - RNA, 22 nt, Homo sapiens
uuauguacaggacauguacuga

SEQ ID NO: 1811836 - RNA, 19 nt, Homo sapiens
caauagucucucugcaaga

SEQ ID NO: 1811837 - RNA, 18 nt, Homo sapiens
gugcucuguaccugucaa

SEQ ID NO: 1811838 - RNA, 20 nt, Homo sapiens
ccgagcgggugcaagcacuc

SEQ ID NO: 1811839 - RNA, 19 nt, Homo sapiens
acuuaguauugcagccaaa

SEQ ID NO: 1811840 - RNA, 13 nt, Homo sapiens
ccaaauacauuaa

SEQ ID NO: 1811841 - RNA, 13 nt, Homo sapiens
acacauaccuuca

SEQ ID NO: 1811842 - RNA, 16 nt, Homo sapiens
caaugauggcaauuuu

SEQ ID NO: 1811843 - RNA, 16 nt, Homo sapiens
uuauucguuacucuaa

SEQ ID NO: 1811844 - RNA, 15 nt, Homo sapiens
uaaaauauucacucu

SEQ ID NO: 1811845 - RNA, 20 nt, Homo sapiens
agcaguuaguuccuucauga

SEQ ID NO: 1811846 - RNA, 19 nt, Homo sapiens
uauuucaggugaagcugga

SEQ ID NO: 1811847 - RNA, 21 nt, Homo sapiens
ugcuguagaagauggcacuua

SEQ ID NO: 1811848 - RNA, 15 nt, Homo sapiens
acugguucaccugaa

SEQ ID NO: 1811849 - RNA, 13 nt, Homo sapiens
caauacuaccucu

SEQ ID NO: 1811850 - RNA, 19 nt, Homo sapiens
caaccucugucucccgggu

SEQ ID NO: 1811851 - RNA, 15 nt, Homo sapiens
uaaaaauggcauuuu

SEQ ID NO: 1811852 - RNA, 17 nt, Homo sapiens
gagagacucacacugga

SEQ ID NO: 1811853 - RNA, 17 nt, Homo sapiens
uacauuugaacuauauc

SEQ ID NO: 1811854 - RNA, 15 nt, Homo sapiens
cuuccagggcuacgc

SEQ ID NO: 1811855 - RNA, 11 nt, Homo sapiens
uccacaaggaa

SEQ ID NO: 1811856 - RNA, 16 nt, Homo sapiens
ugaagaucaagccagu

SEQ ID NO: 1811857 - RNA, 20 nt, Homo sapiens
gcugcugacguuugacacca

SEQ ID NO: 1811858 - RNA, 21 nt, Homo sapiens
uauuuagccccauuacacuag

SEQ ID NO: 1811859 - RNA, 17 nt, Homo sapiens
uauguuuauacacacag

SEQ ID NO: 1811860 - RNA, 20 nt, Homo sapiens
aucagcugaauucacuuaag

SEQ ID NO: 1811861 - RNA, 16 nt, Homo sapiens
gaagggccgaggaaug

SEQ ID NO: 1811862 - RNA, 21 nt, Homo sapiens
uauuauaauuggaagugcagu

SEQ ID NO: 1811863 - RNA, 18 nt, Homo sapiens
gccugguagaauugggaa

SEQ ID NO: 1811864 - RNA, 18 nt, Homo sapiens
uagcccauaaggggucaa

SEQ ID NO: 1811865 - RNA, 23 nt, Homo sapiens
ugaagcacuuaagucuuccuuaa

SEQ ID NO: 1811866 - RNA, 17 nt, Homo sapiens
uaaauuuugugaugaau

SEQ ID NO: 1811867 - RNA, 14 nt, Homo sapiens
acucagcaccacuc

SEQ ID NO: 1811868 - RNA, 12 nt, Homo sapiens
gaaggaggccac

SEQ ID NO: 1811869 - RNA, 16 nt, Homo sapiens
accgaggacacagugg

SEQ ID NO: 1811870 - RNA, 16 nt, Homo sapiens
cuucuaaacacaaaua

SEQ ID NO: 1811871 - RNA, 14 nt, Homo sapiens
ucucaauuugaaac

SEQ ID NO: 1811872 - RNA, 20 nt, Homo sapiens
aaaaucaguuuguuguucag

SEQ ID NO: 1811873 - RNA, 23 nt, Homo sapiens
cugcuggagugcaguggcacaau

SEQ ID NO: 1811874 - RNA, 15 nt, Homo sapiens
cagucugccaggaga

SEQ ID NO: 1811875 - RNA, 21 nt, Homo sapiens
aauguacacuaccaaacacuc

SEQ ID NO: 1811876 - RNA, 23 nt, Homo sapiens
cuuaguuuuuaucuuugaccaac

SEQ ID NO: 1811877 - RNA, 13 nt, Homo sapiens
auguagugcaguc

SEQ ID NO: 1811878 - RNA, 15 nt, Homo sapiens
uccuggcccagguga

SEQ ID NO: 1811879 - RNA, 22 nt, Homo sapiens
agaaauauugacucaaaccaua

SEQ ID NO: 1811880 - RNA, 14 nt, Homo sapiens
accagaguguaugc

SEQ ID NO: 1811881 - RNA, 15 nt, Homo sapiens
agccugcacaguggu

SEQ ID NO: 1811882 - RNA, 23 nt, Homo sapiens
acagaaaugaggaggaugcuaaa

SEQ ID NO: 1811883 - RNA, 14 nt, Homo sapiens
aacaaggacuugga

SEQ ID NO: 1811884 - RNA, 16 nt, Homo sapiens
gcugcccagccacucc

SEQ ID NO: 1811885 - RNA, 15 nt, Homo sapiens
cccccuaacuuucuu

SEQ ID NO: 1811886 - RNA, 22 nt, Homo sapiens
aguugucaucaaacauaaugau

SEQ ID NO: 1811887 - RNA, 15 nt, Homo sapiens
agacaccugccuuaa

SEQ ID NO: 1811888 - RNA, 17 nt, Homo sapiens
aauuguuuccaaagugc

SEQ ID NO: 1811889 - RNA, 12 nt, Homo sapiens
gguggggugcac

SEQ ID NO: 1811890 - RNA, 20 nt, Homo sapiens
agacagaguuucaccauguu

SEQ ID NO: 1811891 - RNA, 14 nt, Homo sapiens
ugcccccauuucac

SEQ ID NO: 1811892 - RNA, 18 nt, Homo sapiens
uuagaguugcaacuuaag

SEQ ID NO: 1811893 - RNA, 16 nt, Homo sapiens
gaacuuguugcugauu

SEQ ID NO: 1811894 - RNA, 22 nt, Homo sapiens
cugcuuggguggagaagccauu

SEQ ID NO: 1811895 - RNA, 15 nt, Homo sapiens
gcaaacaugugcaac

SEQ ID NO: 1811896 - RNA, 13 nt, Homo sapiens
ggccuggccaugu

SEQ ID NO: 1811897 - RNA, 17 nt, Homo sapiens
gaaacuaauaaaauauu

SEQ ID NO: 1811898 - RNA, 17 nt, Homo sapiens
gaccaaaauacccaggu

SEQ ID NO: 1811899 - RNA, 14 nt, Homo sapiens
cagacauucugcca

SEQ ID NO: 1811900 - RNA, 12 nt, Homo sapiens
cccuuuacauuu

SEQ ID NO: 1811901 - RNA, 14 nt, Homo sapiens
acugcaagcacugc

SEQ ID NO: 1811902 - RNA, 18 nt, Homo sapiens
agguuucaagacuugaua

SEQ ID NO: 1811903 - RNA, 23 nt, Homo sapiens
uugauaauuuugaaaugauucau

SEQ ID NO: 1811904 - RNA, 21 nt, Homo sapiens
caucaggugaggugugcucca

SEQ ID NO: 1811905 - RNA, 13 nt, Homo sapiens
acgguuucagcuu

SEQ ID NO: 1811906 - RNA, 19 nt, Homo sapiens
aauucuaugccugucuuaa

SEQ ID NO: 1811907 - RNA, 19 nt, Homo sapiens
caagaguccugaagaucaa

SEQ ID NO: 1811908 - RNA, 23 nt, Homo sapiens
gucaggcccucugccugcacucc

SEQ ID NO: 1811909 - RNA, 23 nt, Homo sapiens
caguuccuagcacugccccacau

SEQ ID NO: 1811910 - RNA, 23 nt, Homo sapiens
uggcugugcccagcaggcccagc

SEQ ID NO: 1811911 - RNA, 23 nt, Homo sapiens
uucugcccacaccgcagggacaa

SEQ ID NO: 1811912 - RNA, 14 nt, Homo sapiens
acugaaaugcuagc

SEQ ID NO: 1811913 - RNA, 21 nt, Homo sapiens
gaaaaggacuauaagaauaau

SEQ ID NO: 1811914 - RNA, 17 nt, Homo sapiens
uccucacgccacaaauc

SEQ ID NO: 1811915 - RNA, 23 nt, Homo sapiens
gggcuuguuuucuacuuugccac

SEQ ID NO: 1811916 - RNA, 17 nt, Homo sapiens
ccuuguuuuugccaaag

SEQ ID NO: 1811917 - RNA, 23 nt, Homo sapiens
gccagcuuaaacccauacaaugu

SEQ ID NO: 1811918 - RNA, 13 nt, Homo sapiens
acacaugugcaca

SEQ ID NO: 1811919 - RNA, 12 nt, Homo sapiens
cucagacuccug

SEQ ID NO: 1811920 - RNA, 15 nt, Homo sapiens
agaaagcacuacaau

SEQ ID NO: 1811921 - RNA, 13 nt, Homo sapiens
ugauuccagaaca

SEQ ID NO: 1811922 - RNA, 15 nt, Homo sapiens
cucauggauuugaau

SEQ ID NO: 1811923 - RNA, 22 nt, Homo sapiens
caaaggcugagaacacugugaa

SEQ ID NO: 1811924 - RNA, 19 nt, Homo sapiens
agggcugcuuaggucucau

SEQ ID NO: 1811925 - RNA, 23 nt, Homo sapiens
auuccagcugucacucugugccu

SEQ ID NO: 1811926 - RNA, 13 nt, Homo sapiens
ccaagucauggag

SEQ ID NO: 1811927 - RNA, 20 nt, Homo sapiens
cuuguaaauagaaccagccc

SEQ ID NO: 1811928 - RNA, 20 nt, Homo sapiens
ggacuguugaugaaagggac

SEQ ID NO: 1811929 - RNA, 15 nt, Homo sapiens
accccaacacuucca

SEQ ID NO: 1811930 - RNA, 12 nt, Homo sapiens
agccagugccau

SEQ ID NO: 1811931 - RNA, 21 nt, Homo sapiens
ccucauuucuucaaaauauca

SEQ ID NO: 1811932 - RNA, 17 nt, Homo sapiens
ugagcagaaugccuuau

SEQ ID NO: 1811933 - RNA, 22 nt, Homo sapiens
auugaggaggacuacuauuuga

SEQ ID NO: 1811934 - RNA, 13 nt, Homo sapiens
agcugacuuucaa

SEQ ID NO: 1811935 - RNA, 16 nt, Homo sapiens
uuacgaucucuugaca

SEQ ID NO: 1811936 - RNA, 14 nt, Homo sapiens
aaacauaagccaca

SEQ ID NO: 1811937 - RNA, 19 nt, Homo sapiens
auuucugauuauaagacaa

SEQ ID NO: 1811938 - RNA, 14 nt, Homo sapiens
agccccucaugccu

SEQ ID NO: 1811939 - RNA, 23 nt, Homo sapiens
gaaaauuguauguuaaguuacuu

SEQ ID NO: 1811940 - RNA, 22 nt, Homo sapiens
auuucaaaauucuccaacagcu

SEQ ID NO: 1811941 - RNA, 12 nt, Homo sapiens
ugauacuuuuaa

SEQ ID NO: 1811942 - RNA, 13 nt, Homo sapiens
uuuauugugaucu

SEQ ID NO: 1811943 - RNA, 17 nt, Homo sapiens
ucuggugcuuucuguca

SEQ ID NO: 1811944 - RNA, 22 nt, Homo sapiens
gaagauguugguuaugguguua

SEQ ID NO: 1811945 - RNA, 16 nt, Homo sapiens
cugcaaucuuugccaa

SEQ ID NO: 1811946 - RNA, 21 nt, Homo sapiens
aggugcauuuucucaucaucc

SEQ ID NO: 1811947 - RNA, 15 nt, Homo sapiens
uauggaacauaugca

SEQ ID NO: 1811948 - RNA, 19 nt, Homo sapiens
aaacacacuguauuuuaca

SEQ ID NO: 1811949 - RNA, 14 nt, Homo sapiens
gaaagaggcaguga

SEQ ID NO: 1811950 - RNA, 18 nt, Homo sapiens
aaguuugcugcaacccaa

SEQ ID NO: 1811951 - RNA, 14 nt, Homo sapiens
acucuccccuuguc

SEQ ID NO: 1811952 - RNA, 17 nt, Homo sapiens
agcuaugggagccccag

SEQ ID NO: 1811953 - RNA, 12 nt, Homo sapiens
gaacacugagaa

SEQ ID NO: 1811954 - RNA, 15 nt, Homo sapiens
auggggcgagccagg

SEQ ID NO: 1811955 - RNA, 18 nt, Homo sapiens
uuuccaacuuuucaucca

SEQ ID NO: 1811956 - RNA, 11 nt, Homo sapiens
cacugcacugu

SEQ ID NO: 1811957 - RNA, 23 nt, Homo sapiens
aagugcauaugaaauccuugacu

SEQ ID NO: 1811958 - RNA, 20 nt, Homo sapiens
accaucccaaagccaacgaa

SEQ ID NO: 1811959 - RNA, 17 nt, Homo sapiens
acuaauauccugucucu

SEQ ID NO: 1811960 - RNA, 13 nt, Homo sapiens
ugaagacuaugaa

SEQ ID NO: 1811961 - RNA, 17 nt, Homo sapiens
gggauuggggaagacug

SEQ ID NO: 1811962 - RNA, 15 nt, Homo sapiens
aacucucugcuauga

SEQ ID NO: 1811963 - RNA, 16 nt, Homo sapiens
aggcccuuuucagggc

SEQ ID NO: 1811964 - RNA, 19 nt, Homo sapiens
ccccaguuuggggugccaa

SEQ ID NO: 1811965 - RNA, 21 nt, Homo sapiens
gugacauuugggagacaugug

SEQ ID NO: 1811966 - RNA, 21 nt, Homo sapiens
acuugaggccaggacuuugag

SEQ ID NO: 1811967 - RNA, 16 nt, Homo sapiens
auauuuugcauaguac

SEQ ID NO: 1811968 - RNA, 20 nt, Homo sapiens
uagauaaacuauacacuuaa

SEQ ID NO: 1811969 - RNA, 14 nt, Homo sapiens
acagagcagccagg

SEQ ID NO: 1811970 - RNA, 20 nt, Homo sapiens
uucagaccaugaaugaaugu

SEQ ID NO: 1811971 - RNA, 21 nt, Homo sapiens
acaaaugugauaauauauugc

SEQ ID NO: 1811972 - RNA, 17 nt, Homo sapiens
ugauguuagugaggaac

SEQ ID NO: 1811973 - RNA, 15 nt, Homo sapiens
ccugacugcacacag

SEQ ID NO: 1811974 - RNA, 13 nt, Homo sapiens
caaagauccagcg

SEQ ID NO: 1811975 - RNA, 18 nt, Homo sapiens
ggucaaccccacaagcac

SEQ ID NO: 1811976 - RNA, 17 nt, Homo sapiens
ccccucauggaucugca

SEQ ID NO: 1811977 - RNA, 22 nt, Homo sapiens
gaggcagccgaggccuggccaa

SEQ ID NO: 1811978 - RNA, 21 nt, Homo sapiens
auaacauuuaaauuccacaga

SEQ ID NO: 1811979 - RNA, 16 nt, Homo sapiens
acaaaugcuccuccuc

SEQ ID NO: 1811980 - RNA, 21 nt, Homo sapiens
acuguaauaucuuuaaaugau

SEQ ID NO: 1811981 - RNA, 15 nt, Homo sapiens
gcccaccagaccugu

SEQ ID NO: 1811982 - RNA, 12 nt, Homo sapiens
acaacgcugcug

SEQ ID NO: 1811983 - RNA, 22 nt, Homo sapiens
agcuccaagagguuuuucagcu

SEQ ID NO: 1811984 - RNA, 15 nt, Homo sapiens
ccucaucugcaaaau

SEQ ID NO: 1811985 - RNA, 17 nt, Homo sapiens
acacagcuacagcuuuc

SEQ ID NO: 1811986 - RNA, 21 nt, Homo sapiens
aaaaucuuggaaguacaugaa

SEQ ID NO: 1811987 - RNA, 20 nt, Homo sapiens
acugaccugguuguccaggu

SEQ ID NO: 1811988 - RNA, 12 nt, Homo sapiens
uaaggagcaaaa

SEQ ID NO: 1811989 - RNA, 23 nt, Homo sapiens
cucaauuuaguuuguuauuuauc

SEQ ID NO: 1811990 - RNA, 14 nt, Homo sapiens
cccaugacucuugg

SEQ ID NO: 1811991 - RNA, 12 nt, Homo sapiens
aaugugcuuuau

SEQ ID NO: 1811992 - RNA, 19 nt, Homo sapiens
cgggacaguaaacacucca

SEQ ID NO: 1811993 - RNA, 13 nt, Homo sapiens
gugucaccccaga

SEQ ID NO: 1811994 - RNA, 15 nt, Homo sapiens
aucuuggaaguacau

SEQ ID NO: 1811995 - RNA, 23 nt, Homo sapiens
acuuucuuaauaucacuuugguc

SEQ ID NO: 1811996 - RNA, 15 nt, Homo sapiens
augcugucaugugga

SEQ ID NO: 1811997 - RNA, 23 nt, Homo sapiens
auaucuugcuuucaaauuggcac

SEQ ID NO: 1811998 - RNA, 17 nt, Homo sapiens
accuaacuuucauuaaa

SEQ ID NO: 1811999 - RNA, 21 nt, Homo sapiens
uugaauuuugaaccaugugac

SEQ ID NO: 1812000 - RNA, 15 nt, Homo sapiens
auuuccagacaaauu

SEQ ID NO: 1812001 - RNA, 22 nt, Homo sapiens
cauacuguuuccuaugacauua

SEQ ID NO: 1812002 - RNA, 15 nt, Homo sapiens
ccagcucagucccau

SEQ ID NO: 1812003 - RNA, 18 nt, Homo sapiens
uagcaaccuccacauguu

SEQ ID NO: 1812004 - RNA, 22 nt, Homo sapiens
uauuugcacugaagcagaauug

SEQ ID NO: 1812005 - RNA, 19 nt, Homo sapiens
ucacuucauucacauucag

SEQ ID NO: 1812006 - RNA, 15 nt, Homo sapiens
accuuuguguggcuc

SEQ ID NO: 1812007 - RNA, 13 nt, Homo sapiens
uucaacgauguga

SEQ ID NO: 1812008 - RNA, 17 nt, Homo sapiens
ugauaaauggauauuaa

SEQ ID NO: 1812009 - RNA, 14 nt, Homo sapiens
gcuguugcauuuag

SEQ ID NO: 1812010 - RNA, 18 nt, Homo sapiens
acuaacugcaaaugcauc

SEQ ID NO: 1812011 - RNA, 20 nt, Homo sapiens
cccaggcuggagugcaaugc

SEQ ID NO: 1812012 - RNA, 22 nt, Homo sapiens
aucuaucacccaggaaucucaa

SEQ ID NO: 1812013 - RNA, 21 nt, Homo sapiens
aguuaagagaaagucaccugc

SEQ ID NO: 1812014 - RNA, 21 nt, Homo sapiens
gcucuggagcaagcccugacc

SEQ ID NO: 1812015 - RNA, 16 nt, Homo sapiens
aucccaggcagugggu

SEQ ID NO: 1812016 - RNA, 17 nt, Homo sapiens
gacauuuauguacaaaa

SEQ ID NO: 1812017 - RNA, 19 nt, Homo sapiens
ugauacuggcucagaagaa

SEQ ID NO: 1812018 - RNA, 15 nt, Homo sapiens
uauaucuugucuacu

SEQ ID NO: 1812019 - RNA, 17 nt, Homo sapiens
uacagagaagugaauaa

SEQ ID NO: 1812020 - RNA, 20 nt, Homo sapiens
uaucuuuauaauugaugaug

SEQ ID NO: 1812021 - RNA, 15 nt, Homo sapiens
aagcaggaaagggag

SEQ ID NO: 1812022 - RNA, 19 nt, Homo sapiens
gcaccucaugcagagggug

SEQ ID NO: 1812023 - RNA, 22 nt, Homo sapiens
cuucuauaccgcuucgacugga

SEQ ID NO: 1812024 - RNA, 19 nt, Homo sapiens
caggauaauauauuugcag

SEQ ID NO: 1812025 - RNA, 22 nt, Homo sapiens
uggaagguuagguuugucaaca

SEQ ID NO: 1812026 - RNA, 17 nt, Homo sapiens
uucacauuagaagacaa

SEQ ID NO: 1812027 - RNA, 17 nt, Homo sapiens
ucuagccacaguucuaa

SEQ ID NO: 1812028 - RNA, 16 nt, Homo sapiens
augaucaaaacaugcu

SEQ ID NO: 1812029 - RNA, 18 nt, Homo sapiens
auuaauauguucauuaaa

SEQ ID NO: 1812030 - RNA, 21 nt, Homo sapiens
cucugcuugccgaaacuggaa

SEQ ID NO: 1812031 - RNA, 18 nt, Homo sapiens
uuggagggucuugagggg

SEQ ID NO: 1812032 - RNA, 22 nt, Homo sapiens
ggagugggcucucuggaccuga

SEQ ID NO: 1812033 - RNA, 14 nt, Homo sapiens
cuggauugggagac

SEQ ID NO: 1812034 - RNA, 17 nt, Homo sapiens
gcucaacuguugccagg

SEQ ID NO: 1812035 - RNA, 23 nt, Homo sapiens
aguaaauagggaaaauaaucuca

SEQ ID NO: 1812036 - RNA, 17 nt, Homo sapiens
gccaugccucaagaaca

SEQ ID NO: 1812037 - RNA, 15 nt, Homo sapiens
uauccagaagccagu

SEQ ID NO: 1812038 - RNA, 21 nt, Homo sapiens
agggcauguguaugugucugc

SEQ ID NO: 1812039 - RNA, 16 nt, Homo sapiens
aaauuugaauuucagu

SEQ ID NO: 1812040 - RNA, 14 nt, Homo sapiens
caacaaguugccuc

SEQ ID NO: 1812041 - RNA, 16 nt, Homo sapiens
uaccuggaugauucag

SEQ ID NO: 1812042 - RNA, 18 nt, Homo sapiens
ugaucuuucuuuucccaa

SEQ ID NO: 1812043 - RNA, 16 nt, Homo sapiens
cagcaauaauugacaa

SEQ ID NO: 1812044 - RNA, 11 nt, Homo sapiens
cauagccucau

SEQ ID NO: 1812045 - RNA, 22 nt, Homo sapiens
ugaccaagacagguucagguag

SEQ ID NO: 1812046 - RNA, 16 nt, Homo sapiens
uuaauaaacugcaaau

SEQ ID NO: 1812047 - RNA, 14 nt, Homo sapiens
gauuugacagcauu

SEQ ID NO: 1812048 - RNA, 14 nt, Homo sapiens
cugacacauagaaa

SEQ ID NO: 1812049 - RNA, 15 nt, Homo sapiens
caagucagucauuca

SEQ ID NO: 1812050 - RNA, 21 nt, Homo sapiens
ggucacucugaccuuauuacu

SEQ ID NO: 1812051 - RNA, 17 nt, Homo sapiens
agagccggagccuccag

SEQ ID NO: 1812052 - RNA, 23 nt, Homo sapiens
ugcaauaugugaacgcccagaga

SEQ ID NO: 1812053 - RNA, 13 nt, Homo sapiens
aacaagacaugaa

SEQ ID NO: 1812054 - RNA, 16 nt, Homo sapiens
acucagggauuccuuc

SEQ ID NO: 1812055 - RNA, 16 nt, Homo sapiens
aaaccgcacucaccca

SEQ ID NO: 1812056 - RNA, 17 nt, Homo sapiens
uucuuaaucuuuucaca

SEQ ID NO: 1812057 - RNA, 18 nt, Homo sapiens
cuucgguuucugagcaua

SEQ ID NO: 1812058 - RNA, 17 nt, Homo sapiens
ugcaauuuuacugugaa

SEQ ID NO: 1812059 - RNA, 16 nt, Homo sapiens
cucuuggauaccagcu

SEQ ID NO: 1812060 - RNA, 23 nt, Homo sapiens
cacccuggggccuggaccugccu

SEQ ID NO: 1812061 - RNA, 22 nt, Homo sapiens
gaaacagauuuaagcaagacca

SEQ ID NO: 1812062 - RNA, 20 nt, Homo sapiens
cagguuggaacuaugcagug

SEQ ID NO: 1812063 - RNA, 19 nt, Homo sapiens
aggggauugaagcccucca

SEQ ID NO: 1812064 - RNA, 19 nt, Homo sapiens
aauagacacauacauguca

SEQ ID NO: 1812065 - RNA, 15 nt, Homo sapiens
ggugcugcagcaccg

SEQ ID NO: 1812066 - RNA, 13 nt, Homo sapiens
uccuuuaugaucc

SEQ ID NO: 1812067 - RNA, 18 nt, Homo sapiens
gucccuggggcuccugcu

SEQ ID NO: 1812068 - RNA, 17 nt, Homo sapiens
cuggaaggggcaaagaa

SEQ ID NO: 1812069 - RNA, 18 nt, Homo sapiens
cuuauaauuguucucaga

SEQ ID NO: 1812070 - RNA, 16 nt, Homo sapiens
aaucacaccucugggc

SEQ ID NO: 1812071 - RNA, 17 nt, Homo sapiens
ugccuucacccugaaca

SEQ ID NO: 1812072 - RNA, 19 nt, Homo sapiens
gcucuucugugcccagggu

SEQ ID NO: 1812073 - RNA, 24 nt, Homo sapiens
uuuugauaauagauaacugcucuu

SEQ ID NO: 1812074 - RNA, 23 nt, Homo sapiens
ccuggagagaaagugugugauuu

SEQ ID NO: 1812075 - RNA, 17 nt, Homo sapiens
uggaaaucauaccaguu

SEQ ID NO: 1812076 - RNA, 21 nt, Homo sapiens
aagaccuaaggguuuuaucuc

SEQ ID NO: 1812077 - RNA, 20 nt, Homo sapiens
ugucccuccugggaucugcu

SEQ ID NO: 1812078 - RNA, 14 nt, Homo sapiens
gaguccacucccag

SEQ ID NO: 1812079 - RNA, 22 nt, Homo sapiens
uccccaaaaauugacuuagaua

SEQ ID NO: 1812080 - RNA, 17 nt, Homo sapiens
aaugagccaucacuaga

SEQ ID NO: 1812081 - RNA, 13 nt, Homo sapiens
ggagcuugcagug

SEQ ID NO: 1812082 - RNA, 23 nt, Homo sapiens
cucagggcugucggugugcuguc

SEQ ID NO: 1812083 - RNA, 18 nt, Homo sapiens
uaaauugauucaagugag

SEQ ID NO: 1812084 - RNA, 15 nt, Homo sapiens
aacuguacuguguuu

SEQ ID NO: 1812085 - RNA, 19 nt, Homo sapiens
uuccucccagacuugccuu

SEQ ID NO: 1812086 - RNA, 13 nt, Homo sapiens
cacacacagcagc

SEQ ID NO: 1812087 - RNA, 16 nt, Homo sapiens
cccagagaguccagcu

SEQ ID NO: 1812088 - RNA, 18 nt, Homo sapiens
uaguuuuaagacugaaga

SEQ ID NO: 1812089 - RNA, 20 nt, Homo sapiens
ugaaguucugaaauuuaacu

SEQ ID NO: 1812090 - RNA, 20 nt, Homo sapiens
aaccucaagugauccuccca

SEQ ID NO: 1812091 - RNA, 18 nt, Homo sapiens
uucaucugcucuccuucc

SEQ ID NO: 1812092 - RNA, 15 nt, Homo sapiens
aaaaauaaauuugca

SEQ ID NO: 1812093 - RNA, 20 nt, Homo sapiens
guggagauagugccagggug

SEQ ID NO: 1812094 - RNA, 21 nt, Homo sapiens
uucccuccucccaugucacug

SEQ ID NO: 1812095 - RNA, 14 nt, Homo sapiens
guaguaucaaugau

SEQ ID NO: 1812096 - RNA, 13 nt, Homo sapiens
acaggcacugugu

SEQ ID NO: 1812097 - RNA, 13 nt, Homo sapiens
caaaacuguccag

SEQ ID NO: 1812098 - RNA, 20 nt, Homo sapiens
gaaaacauuucaaguuuacu

SEQ ID NO: 1812099 - RNA, 14 nt, Homo sapiens
ucccuaggcccuag

SEQ ID NO: 1812100 - RNA, 18 nt, Homo sapiens
cugaggcaggaggauugc

SEQ ID NO: 1812101 - RNA, 11 nt, Homo sapiens
gccagugacuu

SEQ ID NO: 1812102 - RNA, 13 nt, Homo sapiens
gccccuccuugca

SEQ ID NO: 1812103 - RNA, 21 nt, Homo sapiens
uccuuuuauucccugggucuc

SEQ ID NO: 1812104 - RNA, 12 nt, Homo sapiens
uguuuuuggaca

SEQ ID NO: 1812105 - RNA, 16 nt, Homo sapiens
ucuguuuccucuguau

SEQ ID NO: 1812106 - RNA, 17 nt, Homo sapiens
uauuaccaaagcaaggu

SEQ ID NO: 1812107 - RNA, 13 nt, Homo sapiens
cagguguggaccg

SEQ ID NO: 1812108 - RNA, 14 nt, Homo sapiens
guguuuucagcaaa

SEQ ID NO: 1812109 - RNA, 23 nt, Homo sapiens
agaugagccggguccggccucuc

SEQ ID NO: 1812110 - RNA, 13 nt, Homo sapiens
gucucucccucag

SEQ ID NO: 1812111 - RNA, 17 nt, Homo sapiens
uuaauuccaugugauac

SEQ ID NO: 1812112 - RNA, 15 nt, Homo sapiens
cucucggugcuucca

SEQ ID NO: 1812113 - RNA, 16 nt, Homo sapiens
cggcagggaaauguau

SEQ ID NO: 1812114 - RNA, 14 nt, Homo sapiens
uguuaccuucacau

SEQ ID NO: 1812115 - RNA, 21 nt, Homo sapiens
auuucuguugaggcugcagau

SEQ ID NO: 1812116 - RNA, 18 nt, Homo sapiens
cugcucccugaagccagc

SEQ ID NO: 1812117 - RNA, 18 nt, Homo sapiens
gcaucaucucagcucacu

SEQ ID NO: 1812118 - RNA, 23 nt, Homo sapiens
ucaaggaguacuccaagacagag

SEQ ID NO: 1812119 - RNA, 18 nt, Homo sapiens
gugucaugauuucaauga

SEQ ID NO: 1812120 - RNA, 21 nt, Homo sapiens
uacagguuacgugagaacaau

SEQ ID NO: 1812121 - RNA, 13 nt, Homo sapiens
cuaccugccucag

SEQ ID NO: 1812122 - RNA, 21 nt, Homo sapiens
uuguuuuaaaaagcaucagag

SEQ ID NO: 1812123 - RNA, 15 nt, Homo sapiens
uauaaaccaaucuua

SEQ ID NO: 1812124 - RNA, 21 nt, Homo sapiens
gcugcucggcuugaucacagc

SEQ ID NO: 1812125 - RNA, 17 nt, Homo sapiens
cuaacuggacaugaagg

SEQ ID NO: 1812126 - RNA, 16 nt, Homo sapiens
ccuccugugucacuga

SEQ ID NO: 1812127 - RNA, 15 nt, Homo sapiens
cuccuguguacaggg

SEQ ID NO: 1812128 - RNA, 17 nt, Homo sapiens
gcuuugccacugaagua

SEQ ID NO: 1812129 - RNA, 14 nt, Homo sapiens
cugauaagcauuga

SEQ ID NO: 1812130 - RNA, 17 nt, Homo sapiens
gucugucacuccauuua

SEQ ID NO: 1812131 - RNA, 14 nt, Homo sapiens
agcuggaggggugg

SEQ ID NO: 1812132 - RNA, 14 nt, Homo sapiens
agcugcaggggugc

SEQ ID NO: 1812133 - RNA, 17 nt, Homo sapiens
ggagcauuggcugagag

SEQ ID NO: 1812134 - RNA, 22 nt, Homo sapiens
cccagagugcugggauuacaau

SEQ ID NO: 1812135 - RNA, 17 nt, Homo sapiens
uaaaacggugcugugag

SEQ ID NO: 1812136 - RNA, 15 nt, Homo sapiens
cuggggacucaggga

SEQ ID NO: 1812137 - RNA, 15 nt, Homo sapiens
ucaugggccuguggg

SEQ ID NO: 1812138 - RNA, 15 nt, Homo sapiens
ccaccggugccaaac

SEQ ID NO: 1812139 - RNA, 21 nt, Homo sapiens
aaucauugguuauauuaccaa

SEQ ID NO: 1812140 - RNA, 22 nt, Homo sapiens
cucaaagagcaaccaguaucac

SEQ ID NO: 1812141 - RNA, 13 nt, Homo sapiens
aaauacaucaaaa

SEQ ID NO: 1812142 - RNA, 15 nt, Homo sapiens
cugucaccaagccuu

SEQ ID NO: 1812143 - RNA, 14 nt, Homo sapiens
cccaguucaucacc

SEQ ID NO: 1812144 - RNA, 18 nt, Homo sapiens
aaguauugcccuuuaaca

SEQ ID NO: 1812145 - RNA, 19 nt, Homo sapiens
uaaggccaaggccucagga

SEQ ID NO: 1812146 - RNA, 20 nt, Homo sapiens
guaggaggaacagauuugag

SEQ ID NO: 1812147 - RNA, 21 nt, Homo sapiens
augggggaucagcagggcagu

SEQ ID NO: 1812148 - RNA, 14 nt, Homo sapiens
ucccagacuugccu

SEQ ID NO: 1812149 - RNA, 15 nt, Homo sapiens
gauggugacuuccuc

SEQ ID NO: 1812150 - RNA, 15 nt, Homo sapiens
cuguuguacuaugga

SEQ ID NO: 1812151 - RNA, 18 nt, Homo sapiens
caugcagaguugugcaug

SEQ ID NO: 1812152 - RNA, 14 nt, Homo sapiens
ccacaguggcuuca

SEQ ID NO: 1812153 - RNA, 16 nt, Homo sapiens
uagucaaggaaccuca

SEQ ID NO: 1812154 - RNA, 18 nt, Homo sapiens
aguuaaaaguguugauua

SEQ ID NO: 1812155 - RNA, 20 nt, Homo sapiens
ugcaauguaucccuucucac

SEQ ID NO: 1812156 - RNA, 14 nt, Homo sapiens
cuggaaggggccac

SEQ ID NO: 1812157 - RNA, 16 nt, Homo sapiens
uuucaaccagcacauu

SEQ ID NO: 1812158 - RNA, 14 nt, Homo sapiens
cgcacaaauuccac

SEQ ID NO: 1812159 - RNA, 18 nt, Homo sapiens
cuggagacuaaagauugc

SEQ ID NO: 1812160 - RNA, 22 nt, Homo sapiens
uuauuccggaaacuaguguaca

SEQ ID NO: 1812161 - RNA, 14 nt, Homo sapiens
gaaggaaugucuuu

SEQ ID NO: 1812162 - RNA, 17 nt, Homo sapiens
ggcuggggcucucucca

SEQ ID NO: 1812163 - RNA, 18 nt, Homo sapiens
ucauaucaacuuagucaa

SEQ ID NO: 1812164 - RNA, 15 nt, Homo sapiens
uccacaguugucagu

SEQ ID NO: 1812165 - RNA, 14 nt, Homo sapiens
ugggaauacaucug

SEQ ID NO: 1812166 - RNA, 23 nt, Homo sapiens
ggaacauguacuguuacuguguc

SEQ ID NO: 1812167 - RNA, 14 nt, Homo sapiens
agcaguguuuugca

SEQ ID NO: 1812168 - RNA, 16 nt, Homo sapiens
ugucucacugaaacau

SEQ ID NO: 1812169 - RNA, 21 nt, Homo sapiens
uauucugugaaacuaaucaua

SEQ ID NO: 1812170 - RNA, 21 nt, Homo sapiens
ucuggucucuaccacugcuga

SEQ ID NO: 1812171 - RNA, 21 nt, Homo sapiens
guucacaaaauggugcccuau

SEQ ID NO: 1812172 - RNA, 12 nt, Homo sapiens
uaaaaacaaagu

SEQ ID NO: 1812173 - RNA, 17 nt, Homo sapiens
cugucucugaaguacua

SEQ ID NO: 1812174 - RNA, 18 nt, Homo sapiens
uauuuacauacaggccau

SEQ ID NO: 1812175 - RNA, 15 nt, Homo sapiens
gcaaucacauaguga

SEQ ID NO: 1812176 - RNA, 14 nt, Homo sapiens
gaagacucaguaug

SEQ ID NO: 1812177 - RNA, 19 nt, Homo sapiens
aucagaauggaaugcucug

SEQ ID NO: 1812178 - RNA, 19 nt, Homo sapiens
acaaggaauuucccugugu

SEQ ID NO: 1812179 - RNA, 19 nt, Homo sapiens
acaugaugaguugagcucu

SEQ ID NO: 1812180 - RNA, 19 nt, Homo sapiens
ugucauugauacaugcauu

SEQ ID NO: 1812181 - RNA, 21 nt, Homo sapiens
aggccuccuggcccaggugag

SEQ ID NO: 1812182 - RNA, 23 nt, Homo sapiens
ccugcaccgagagagauggaaua

SEQ ID NO: 1812183 - RNA, 20 nt, Homo sapiens
auauaacaagugggugaaug

SEQ ID NO: 1812184 - RNA, 13 nt, Homo sapiens
ccauucagcauga

SEQ ID NO: 1812185 - RNA, 15 nt, Homo sapiens
cacugccuacugcau

SEQ ID NO: 1812186 - RNA, 13 nt, Homo sapiens
uaaacucugcuca

SEQ ID NO: 1812187 - RNA, 14 nt, Homo sapiens
acuuuaacugacuu

SEQ ID NO: 1812188 - RNA, 22 nt, Homo sapiens
ugaagggacggcugugggacca

SEQ ID NO: 1812189 - RNA, 11 nt, Homo sapiens
ugcaagccaua

SEQ ID NO: 1812190 - RNA, 13 nt, Homo sapiens
aucuguuacccag

SEQ ID NO: 1812191 - RNA, 17 nt, Homo sapiens
augcagcaucuuugugg

SEQ ID NO: 1812192 - RNA, 20 nt, Homo sapiens
ccccaaggacugagggcagu

SEQ ID NO: 1812193 - RNA, 14 nt, Homo sapiens
cugaaaacuacagu

SEQ ID NO: 1812194 - RNA, 21 nt, Homo sapiens
aaagcaaaauacaucagcuug

SEQ ID NO: 1812195 - RNA, 22 nt, Homo sapiens
augugauucaccucuucuuucc

SEQ ID NO: 1812196 - RNA, 22 nt, Homo sapiens
gcaaaaugucuuaaugcaaauu

SEQ ID NO: 1812197 - RNA, 17 nt, Homo sapiens
agucucugccacccacu

SEQ ID NO: 1812198 - RNA, 14 nt, Homo sapiens
uguacaccaguuua

SEQ ID NO: 1812199 - RNA, 13 nt, Homo sapiens
cuuuccucuagcu

SEQ ID NO: 1812200 - RNA, 18 nt, Homo sapiens
uaaauaauguauuuacuu

SEQ ID NO: 1812201 - RNA, 11 nt, Homo sapiens
cacacaccagu

SEQ ID NO: 1812202 - RNA, 17 nt, Homo sapiens
ucggaggcuugggaccg

SEQ ID NO: 1812203 - RNA, 16 nt, Homo sapiens
ucagaacuggcugugg

SEQ ID NO: 1812204 - RNA, 22 nt, Homo sapiens
acagugagccaaauaaaccucu

SEQ ID NO: 1812205 - RNA, 12 nt, Homo sapiens
gauaacauggaa

SEQ ID NO: 1812206 - RNA, 17 nt, Homo sapiens
gacgaacaggggccaaa

SEQ ID NO: 1812207 - RNA, 16 nt, Homo sapiens
cugaggccuccaagga

SEQ ID NO: 1812208 - RNA, 14 nt, Homo sapiens
acuggccuugccuc

SEQ ID NO: 1812209 - RNA, 21 nt, Homo sapiens
aucauaggggcauagccaguu

SEQ ID NO: 1812210 - RNA, 21 nt, Homo sapiens
gaaaaccauucuggacacugu

SEQ ID NO: 1812211 - RNA, 18 nt, Homo sapiens
uaucuuucgauaaacaac

SEQ ID NO: 1812212 - RNA, 14 nt, Homo sapiens
ccugggaccacaga

SEQ ID NO: 1812213 - RNA, 21 nt, Homo sapiens
ggcgacaagagugagacucca

SEQ ID NO: 1812214 - RNA, 9 nt, Homo sapiens
agagaagau

SEQ ID NO: 1812215 - RNA, 21 nt, Homo sapiens
cuucaugaucaucacaaucau

SEQ ID NO: 1812216 - RNA, 16 nt, Homo sapiens
guaugaucaguacuga

SEQ ID NO: 1812217 - RNA, 14 nt, Homo sapiens
ugagucuugaucua

SEQ ID NO: 1812218 - RNA, 20 nt, Homo sapiens
cuccacaguuaggccaagaa

SEQ ID NO: 1812219 - RNA, 13 nt, Homo sapiens
ccuccccacagga

SEQ ID NO: 1812220 - RNA, 17 nt, Homo sapiens
uacagaaagaagcaguu

SEQ ID NO: 1812221 - RNA, 13 nt, Homo sapiens
ugugcucugugac

SEQ ID NO: 1812222 - RNA, 14 nt, Homo sapiens
ugcaucuuauucga

SEQ ID NO: 1812223 - RNA, 11 nt, Homo sapiens
ccacaguauau

SEQ ID NO: 1812224 - RNA, 14 nt, Homo sapiens
acuuugugcaauau

SEQ ID NO: 1812225 - RNA, 17 nt, Homo sapiens
guucuuacuuuccugaa

SEQ ID NO: 1812226 - RNA, 14 nt, Homo sapiens
uacaucugucaugg

SEQ ID NO: 1812227 - RNA, 13 nt, Homo sapiens
gcuucccacuggg

SEQ ID NO: 1812228 - RNA, 10 nt, Homo sapiens
cuaaagccag

SEQ ID NO: 1812229 - RNA, 23 nt, Homo sapiens
gccccauccuguguuaucugugg

SEQ ID NO: 1812230 - RNA, 22 nt, Homo sapiens
ggaauaugaccauuugacuguu

SEQ ID NO: 1812231 - RNA, 15 nt, Homo sapiens
ccccaggucugggaa

SEQ ID NO: 1812232 - RNA, 22 nt, Homo sapiens
cugggguggagugggaagggag

SEQ ID NO: 1812233 - RNA, 16 nt, Homo sapiens
aguccaaaugugauca

SEQ ID NO: 1812234 - RNA, 18 nt, Homo sapiens
cugucaggaaguaaaaua

SEQ ID NO: 1812235 - RNA, 15 nt, Homo sapiens
uguuuauagcaaaaa

SEQ ID NO: 1812236 - RNA, 21 nt, Homo sapiens
acccagaggcuacucuugacu

SEQ ID NO: 1812237 - RNA, 19 nt, Homo sapiens
acuaaggcugcuucaaaga

SEQ ID NO: 1812238 - RNA, 14 nt, Homo sapiens
auaaaaagaaauuu

SEQ ID NO: 1812239 - RNA, 19 nt, Homo sapiens
aaaucuuuggauuugauca

SEQ ID NO: 1812240 - RNA, 19 nt, Homo sapiens
ccagcuccaguuuccaagu

SEQ ID NO: 1812241 - RNA, 16 nt, Homo sapiens
cuuuaaaaaagcauag

SEQ ID NO: 1812242 - RNA, 17 nt, Homo sapiens
accuacuuuuucuuuga

SEQ ID NO: 1812243 - RNA, 13 nt, Homo sapiens
uguaaugcuucca

SEQ ID NO: 1812244 - RNA, 17 nt, Homo sapiens
auaaacaugaagcacaa

SEQ ID NO: 1812245 - RNA, 16 nt, Homo sapiens
gagaaaucuggcuucu

SEQ ID NO: 1812246 - RNA, 12 nt, Homo sapiens
gaacuuccccau

SEQ ID NO: 1812247 - RNA, 22 nt, Homo sapiens
ccugcuuuuuucuguuuuuaca

SEQ ID NO: 1812248 - RNA, 20 nt, Homo sapiens
aggagggucuccacacugcu

SEQ ID NO: 1812249 - RNA, 16 nt, Homo sapiens
cucucuaucccugaaa

SEQ ID NO: 1812250 - RNA, 23 nt, Homo sapiens
ucucacucccuguuuuaauucaa

SEQ ID NO: 1812251 - RNA, 15 nt, Homo sapiens
auuacuucagggcug

SEQ ID NO: 1812252 - RNA, 20 nt, Homo sapiens
uuuuugaaauuuaagcuaag

SEQ ID NO: 1812253 - RNA, 18 nt, Homo sapiens
cuuaguuauuuaccaaag

SEQ ID NO: 1812254 - RNA, 21 nt, Homo sapiens
cccagcccuguucugggugca

SEQ ID NO: 1812255 - RNA, 17 nt, Homo sapiens
gcccccagcccuccagu

SEQ ID NO: 1812256 - RNA, 16 nt, Homo sapiens
gccaguuucagcucac

SEQ ID NO: 1812257 - RNA, 16 nt, Homo sapiens
cccugaguuggcauca

SEQ ID NO: 1812258 - RNA, 21 nt, Homo sapiens
aucugccuccccuucacuccc

SEQ ID NO: 1812259 - RNA, 23 nt, Homo sapiens
uaguguuaucaggcgucccauac

SEQ ID NO: 1812260 - RNA, 22 nt, Homo sapiens
uguguacaccugcggggccacc

SEQ ID NO: 1812261 - RNA, 20 nt, Homo sapiens
uuauaacagggaacagcaaa

SEQ ID NO: 1812262 - RNA, 15 nt, Homo sapiens
aacauuacuaacaau

SEQ ID NO: 1812263 - RNA, 12 nt, Homo sapiens
aaacuuauucua

SEQ ID NO: 1812264 - RNA, 17 nt, Homo sapiens
uuucuccuuuaauugua

SEQ ID NO: 1812265 - RNA, 14 nt, Homo sapiens
ugcagcugucacag

SEQ ID NO: 1812266 - RNA, 14 nt, Homo sapiens
gucuccuugcacuu

SEQ ID NO: 1812267 - RNA, 12 nt, Homo sapiens
uuuggcaauuuc

SEQ ID NO: 1812268 - RNA, 14 nt, Homo sapiens
auucuuaaccaaga

SEQ ID NO: 1812269 - RNA, 17 nt, Homo sapiens
ucaggauguaauaaaga

SEQ ID NO: 1812270 - RNA, 19 nt, Homo sapiens
ugaaauaauuacagaauau

SEQ ID NO: 1812271 - RNA, 21 nt, Homo sapiens
ugaaacuugguucccagaaaa

SEQ ID NO: 1812272 - RNA, 18 nt, Homo sapiens
gcccuguuuauauuggua

SEQ ID NO: 1812273 - RNA, 15 nt, Homo sapiens
agaccaaagaccaag

SEQ ID NO: 1812274 - RNA, 12 nt, Homo sapiens
ucgagcaaacaa

SEQ ID NO: 1812275 - RNA, 15 nt, Homo sapiens
caggucaggggcucc

SEQ ID NO: 1812276 - RNA, 16 nt, Homo sapiens
uuuagaaaaugcaguc

SEQ ID NO: 1812277 - RNA, 19 nt, Homo sapiens
gcacacugcacacaugcac

SEQ ID NO: 1812278 - RNA, 22 nt, Homo sapiens
cugcugagagggcugcugacca

SEQ ID NO: 1812279 - RNA, 13 nt, Homo sapiens
cugggccugaugg

SEQ ID NO: 1812280 - RNA, 18 nt, Homo sapiens
auguuacaugcauucuac

SEQ ID NO: 1812281 - RNA, 14 nt, Homo sapiens
ucaagccugauuca

SEQ ID NO: 1812282 - RNA, 15 nt, Homo sapiens
ucaaguucaccagca

SEQ ID NO: 1812283 - RNA, 22 nt, Homo sapiens
aauauagaaaaaaaaacccugu

SEQ ID NO: 1812284 - RNA, 23 nt, Homo sapiens
aggauuaauggauguaagguauu

SEQ ID NO: 1812285 - RNA, 22 nt, Homo sapiens
aauagauuuuugauucagcuca

SEQ ID NO: 1812286 - RNA, 21 nt, Homo sapiens
uagacagugcccuuggugcga

SEQ ID NO: 1812287 - RNA, 19 nt, Homo sapiens
ccuguagcgccaguguaau

SEQ ID NO: 1812288 - RNA, 15 nt, Homo sapiens
cuguggcacauucuu

SEQ ID NO: 1812289 - RNA, 14 nt, Homo sapiens
gaggaacagggaag

SEQ ID NO: 1812290 - RNA, 18 nt, Homo sapiens
ucgacacuaaaaacugau

SEQ ID NO: 1812291 - RNA, 13 nt, Homo sapiens
caaaaccuuucaa

SEQ ID NO: 1812292 - RNA, 16 nt, Homo sapiens
uauuucugaaucgaga

SEQ ID NO: 1812293 - RNA, 19 nt, Homo sapiens
aauacuucaugagcauuca

SEQ ID NO: 1812294 - RNA, 16 nt, Homo sapiens
ugaugaguugauuuau

SEQ ID NO: 1812295 - RNA, 16 nt, Homo sapiens
ccuauuaaccuagaga

SEQ ID NO: 1812296 - RNA, 13 nt, Homo sapiens
cauaaagccaugu

SEQ ID NO: 1812297 - RNA, 21 nt, Homo sapiens
uagggcaugauuaacaaagca

SEQ ID NO: 1812298 - RNA, 12 nt, Homo sapiens
augccagugugc

SEQ ID NO: 1812299 - RNA, 12 nt, Homo sapiens
augacaguguga

SEQ ID NO: 1812300 - RNA, 12 nt, Homo sapiens
aaagcagugaag

SEQ ID NO: 1812301 - RNA, 15 nt, Homo sapiens
uaauaugaugccacu

SEQ ID NO: 1812302 - RNA, 16 nt, Homo sapiens
acccuccccugaggau

SEQ ID NO: 1812303 - RNA, 20 nt, Homo sapiens
ugaggcauuuuuacuacuau

SEQ ID NO: 1812304 - RNA, 20 nt, Homo sapiens
uguggacaaugaguggaaua

SEQ ID NO: 1812305 - RNA, 18 nt, Homo sapiens
ugaagcuaaugucacaau

SEQ ID NO: 1812306 - RNA, 23 nt, Homo sapiens
acuccccagcccagcaccccuuc

SEQ ID NO: 1812307 - RNA, 21 nt, Homo sapiens
augaaaagcugaauccagauc

SEQ ID NO: 1812308 - RNA, 15 nt, Homo sapiens
aaugaaauuugcaaa

SEQ ID NO: 1812309 - RNA, 22 nt, Homo sapiens
gaccucuuuggaaacuauaaca

SEQ ID NO: 1812310 - RNA, 17 nt, Homo sapiens
uucacucccugucauag

SEQ ID NO: 1812311 - RNA, 16 nt, Homo sapiens
aagauugagaagccau

SEQ ID NO: 1812312 - RNA, 20 nt, Homo sapiens
aaugugcaaguuguacugua

SEQ ID NO: 1812313 - RNA, 13 nt, Homo sapiens
agggguaguggga

SEQ ID NO: 1812314 - RNA, 17 nt, Homo sapiens
agauggauuuguaucaa

SEQ ID NO: 1812315 - RNA, 12 nt, Homo sapiens
aaugcucugaaa

SEQ ID NO: 1812316 - RNA, 23 nt, Homo sapiens
ugagccuaaaaauaaagcacaaa

SEQ ID NO: 1812317 - RNA, 20 nt, Homo sapiens
ggacaccacgauucucccaa

SEQ ID NO: 1812318 - RNA, 15 nt, Homo sapiens
ccauaagaggugauc

SEQ ID NO: 1812319 - RNA, 14 nt, Homo sapiens
ccaggcuguuucuu

SEQ ID NO: 1812320 - RNA, 19 nt, Homo sapiens
auuuucaucaaaaccaaga

SEQ ID NO: 1812321 - RNA, 21 nt, Homo sapiens
ugggagauuuggaauacacau

SEQ ID NO: 1812322 - RNA, 21 nt, Homo sapiens
gcaacagagcaagacuccauc

SEQ ID NO: 1812323 - RNA, 21 nt, Homo sapiens
ugugaggaagagguugcagug

SEQ ID NO: 1812324 - RNA, 23 nt, Homo sapiens
aguugggaugcggggcagagcca

SEQ ID NO: 1812325 - RNA, 18 nt, Homo sapiens
guucaaugcuagaacaac

SEQ ID NO: 1812326 - RNA, 22 nt, Homo sapiens
aggcacauguuguucucauuga

SEQ ID NO: 1812327 - RNA, 13 nt, Homo sapiens
uccuuuuuuauac

SEQ ID NO: 1812328 - RNA, 15 nt, Homo sapiens
acauaagacagacag

SEQ ID NO: 1812329 - RNA, 23 nt, Homo sapiens
ccccugagcccaaggcacugaga

SEQ ID NO: 1812330 - RNA, 22 nt, Homo sapiens
ucccaaugguguuuuucuugua

SEQ ID NO: 1812331 - RNA, 22 nt, Homo sapiens
uggccaugucgccaaaaauaca

SEQ ID NO: 1812332 - RNA, 17 nt, Homo sapiens
acaaugacauccagaaa

SEQ ID NO: 1812333 - RNA, 16 nt, Homo sapiens
caacaugcugccccag

SEQ ID NO: 1812334 - RNA, 19 nt, Homo sapiens
gcucugcguuggcuucucc

SEQ ID NO: 1812335 - RNA, 14 nt, Homo sapiens
acaguuggcacuuc

SEQ ID NO: 1812336 - RNA, 13 nt, Homo sapiens
aacugacaguaaa

SEQ ID NO: 1812337 - RNA, 21 nt, Homo sapiens
aaacuaauuuaguaauagccu

SEQ ID NO: 1812338 - RNA, 15 nt, Homo sapiens
agggaacugagcaca

SEQ ID NO: 1812339 - RNA, 20 nt, Homo sapiens
ucguuagccuuccucugauu

SEQ ID NO: 1812340 - RNA, 21 nt, Homo sapiens
aauaguugagccagcagacau

SEQ ID NO: 1812341 - RNA, 22 nt, Homo sapiens
ugaggaaaaguccacaagaaca

SEQ ID NO: 1812342 - RNA, 16 nt, Homo sapiens
gcuccucugcaucuug

SEQ ID NO: 1812343 - RNA, 18 nt, Homo sapiens
uguuuucuucaacaugcu

SEQ ID NO: 1812344 - RNA, 19 nt, Homo sapiens
caaggguaugggaagccau

SEQ ID NO: 1812345 - RNA, 13 nt, Homo sapiens
uugcgggggagcu

SEQ ID NO: 1812346 - RNA, 16 nt, Homo sapiens
guguccgaggggcccc

SEQ ID NO: 1812347 - RNA, 22 nt, Homo sapiens
ccccaggagggaggcaggggag

SEQ ID NO: 1812348 - RNA, 20 nt, Homo sapiens
gaaaauaauuuuauaaucca

SEQ ID NO: 1812349 - RNA, 21 nt, Homo sapiens
uguuaagugccauuacuacug

SEQ ID NO: 1812350 - RNA, 15 nt, Homo sapiens
uggcguaucaggaaa

SEQ ID NO: 1812351 - RNA, 15 nt, Homo sapiens
auccagacccggcug

SEQ ID NO: 1812352 - RNA, 19 nt, Homo sapiens
uaaacugguugucaguuac

SEQ ID NO: 1812353 - RNA, 14 nt, Homo sapiens
uaaguaucagaggu

SEQ ID NO: 1812354 - RNA, 14 nt, Homo sapiens
aauaguucuguaua

SEQ ID NO: 1812355 - RNA, 15 nt, Homo sapiens
uaaaagccucuggug

SEQ ID NO: 1812356 - RNA, 17 nt, Homo sapiens
ucagaaggguuaacuca

SEQ ID NO: 1812357 - RNA, 13 nt, Homo sapiens
accacacagcuaa

SEQ ID NO: 1812358 - RNA, 13 nt, Homo sapiens
aguagaaagcuaa

SEQ ID NO: 1812359 - RNA, 22 nt, Homo sapiens
aguauauggacacuacacuggg

SEQ ID NO: 1812360 - RNA, 18 nt, Homo sapiens
cugaagugcauccaaagg

SEQ ID NO: 1812361 - RNA, 12 nt, Homo sapiens
acacaaagggaa

SEQ ID NO: 1812362 - RNA, 17 nt, Homo sapiens
cccuuagugacucuuga

SEQ ID NO: 1812363 - RNA, 21 nt, Homo sapiens
gacuagccaggaaguacuucc

SEQ ID NO: 1812364 - RNA, 18 nt, Homo sapiens
uauuacuggcaauuucau

SEQ ID NO: 1812365 - RNA, 10 nt, Homo sapiens
gaagcauuuu

SEQ ID NO: 1812366 - RNA, 23 nt, Homo sapiens
cugaggugagcaucaucuucugg

SEQ ID NO: 1812367 - RNA, 13 nt, Homo sapiens
ugacuauccaucc

SEQ ID NO: 1812368 - RNA, 21 nt, Homo sapiens
agguaaggagggucacugggg

SEQ ID NO: 1812369 - RNA, 23 nt, Homo sapiens
cagucuaaaaaaggaauccucug

SEQ ID NO: 1812370 - RNA, 13 nt, Homo sapiens
aagaagaugguua

SEQ ID NO: 1812371 - RNA, 20 nt, Homo sapiens
guacgauggaggccuaccuc

SEQ ID NO: 1812372 - RNA, 21 nt, Homo sapiens
aguaugccccaccuaucuuug

SEQ ID NO: 1812373 - RNA, 16 nt, Homo sapiens
ccaucaccauuuggug

SEQ ID NO: 1812374 - RNA, 21 nt, Homo sapiens
guccaaggcaguucugugucc

SEQ ID NO: 1812375 - RNA, 20 nt, Homo sapiens
ccuaguagggguaccacuga

SEQ ID NO: 1812376 - RNA, 15 nt, Homo sapiens
uuggaaguacaugaa

SEQ ID NO: 1812377 - RNA, 19 nt, Homo sapiens
uucaaagcaauugaaaugc

SEQ ID NO: 1812378 - RNA, 15 nt, Homo sapiens
aucauuguuggacau

SEQ ID NO: 1812379 - RNA, 23 nt, Homo sapiens
ugcacacacacagagauaugcac

SEQ ID NO: 1812380 - RNA, 14 nt, Homo sapiens
uuaauguacuuuca

SEQ ID NO: 1812381 - RNA, 12 nt, Homo sapiens
caggcacuuuga

SEQ ID NO: 1812382 - RNA, 18 nt, Homo sapiens
ucccugcacacacaugca

SEQ ID NO: 1812383 - RNA, 21 nt, Homo sapiens
aaaucuuugguggccaaagau

SEQ ID NO: 1812384 - RNA, 21 nt, Homo sapiens
aacaaccaccaccacaaugac

SEQ ID NO: 1812385 - RNA, 21 nt, Homo sapiens
ucaguucccccaguaccucca

SEQ ID NO: 1812386 - RNA, 15 nt, Homo sapiens
aucuggaagggccaa

SEQ ID NO: 1812387 - RNA, 16 nt, Homo sapiens
cuguaccugugcacgu

SEQ ID NO: 1812388 - RNA, 22 nt, Homo sapiens
gagaccccaccagccucaccag

SEQ ID NO: 1812389 - RNA, 15 nt, Homo sapiens
auacuaaauauguga

SEQ ID NO: 1812390 - RNA, 14 nt, Homo sapiens
ucagcccuggccaa

SEQ ID NO: 1812391 - RNA, 22 nt, Homo sapiens
uacuuucuauucuuuagcugua

SEQ ID NO: 1812392 - RNA, 16 nt, Homo sapiens
cagugaugaugcaugg

SEQ ID NO: 1812393 - RNA, 13 nt, Homo sapiens
uuuaacugugaac

SEQ ID NO: 1812394 - RNA, 15 nt, Homo sapiens
aauagcgccucuuuu

SEQ ID NO: 1812395 - RNA, 17 nt, Homo sapiens
gcaaugcuucugccuca

SEQ ID NO: 1812396 - RNA, 18 nt, Homo sapiens
aucuggcuuagugccacc

SEQ ID NO: 1812397 - RNA, 23 nt, Homo sapiens
uguggaaaagccaagaggcugca

SEQ ID NO: 1812398 - RNA, 19 nt, Homo sapiens
cucuauucaauuuaauucu

SEQ ID NO: 1812399 - RNA, 23 nt, Homo sapiens
gcugcauuccuagaaauugaagu

SEQ ID NO: 1812400 - RNA, 19 nt, Homo sapiens
acccagucagacaaauuca

SEQ ID NO: 1812401 - RNA, 22 nt, Homo sapiens
gaguaaauauugucacaacacu

SEQ ID NO: 1812402 - RNA, 19 nt, Homo sapiens
gaagaacaagaaauggaug

SEQ ID NO: 1812403 - RNA, 23 nt, Homo sapiens
cuguggguuucuaaagcugccag

SEQ ID NO: 1812404 - RNA, 11 nt, Homo sapiens
cugcuugcaca

SEQ ID NO: 1812405 - RNA, 17 nt, Homo sapiens
uaacacaagccacagaa

SEQ ID NO: 1812406 - RNA, 22 nt, Homo sapiens
cagaucacccggggcuuacuua

SEQ ID NO: 1812407 - RNA, 15 nt, Homo sapiens
acgccagacuuccca

SEQ ID NO: 1812408 - RNA, 15 nt, Homo sapiens
ccugacaaauggaag

SEQ ID NO: 1812409 - RNA, 14 nt, Homo sapiens
gaacauucugucau

SEQ ID NO: 1812410 - RNA, 14 nt, Homo sapiens
acuccuagcugucc

SEQ ID NO: 1812411 - RNA, 15 nt, Homo sapiens
ugaacugaacuaauc

SEQ ID NO: 1812412 - RNA, 16 nt, Homo sapiens
aaacccagucacugug

SEQ ID NO: 1812413 - RNA, 15 nt, Homo sapiens
acaugcaccuaccca

SEQ ID NO: 1812414 - RNA, 18 nt, Homo sapiens
ucacuaccuucaugcaua

SEQ ID NO: 1812415 - RNA, 18 nt, Homo sapiens
cugugucuggcguucuca

SEQ ID NO: 1812416 - RNA, 22 nt, Homo sapiens
acucuguguggcugugcaauuu

SEQ ID NO: 1812417 - RNA, 19 nt, Homo sapiens
ugcauuaaaacaaaggaag

SEQ ID NO: 1812418 - RNA, 19 nt, Homo sapiens
accacugcuuccauuuaau

SEQ ID NO: 1812419 - RNA, 21 nt, Homo sapiens
uagguagaauuuaacaugacu

SEQ ID NO: 1812420 - RNA, 17 nt, Homo sapiens
gauggagcugauccagu

SEQ ID NO: 1812421 - RNA, 16 nt, Homo sapiens
acaagauccaggcaga

SEQ ID NO: 1812422 - RNA, 18 nt, Homo sapiens
uaaaaaaaaaauuacuuc

SEQ ID NO: 1812423 - RNA, 23 nt, Homo sapiens
ucacuccuuuuuugcaugugcaa

SEQ ID NO: 1812424 - RNA, 15 nt, Homo sapiens
caauuaaaaucucaa

SEQ ID NO: 1812425 - RNA, 21 nt, Homo sapiens
cuuuucuccucacuguaucca

SEQ ID NO: 1812426 - RNA, 21 nt, Homo sapiens
ugggagcgggggggacagugc

SEQ ID NO: 1812427 - RNA, 20 nt, Homo sapiens
uaguaauguaguauacacug

SEQ ID NO: 1812428 - RNA, 17 nt, Homo sapiens
uggaaaaugugacccag

SEQ ID NO: 1812429 - RNA, 19 nt, Homo sapiens
uccauagagcagugcacau

SEQ ID NO: 1812430 - RNA, 19 nt, Homo sapiens
aaucaaaauaauacuucau

SEQ ID NO: 1812431 - RNA, 13 nt, Homo sapiens
uagaccacugucc

SEQ ID NO: 1812432 - RNA, 14 nt, Homo sapiens
gcuuagaacaaagg

SEQ ID NO: 1812433 - RNA, 17 nt, Homo sapiens
ucuggggacaccucagg

SEQ ID NO: 1812434 - RNA, 15 nt, Homo sapiens
aucuguuuuuggaca

SEQ ID NO: 1812435 - RNA, 13 nt, Homo sapiens
acagaacacuuau

SEQ ID NO: 1812436 - RNA, 21 nt, Homo sapiens
gaauacauuuucagagccaaa

SEQ ID NO: 1812437 - RNA, 23 nt, Homo sapiens
agaauguuggcaaaucacuucaa

SEQ ID NO: 1812438 - RNA, 19 nt, Homo sapiens
uaugauuuaagacuaugau

SEQ ID NO: 1812439 - RNA, 14 nt, Homo sapiens
ugacaggaagccca

SEQ ID NO: 1812440 - RNA, 18 nt, Homo sapiens
guagucaaggugcucaau

SEQ ID NO: 1812441 - RNA, 17 nt, Homo sapiens
caguggcaguguaugcu

SEQ ID NO: 1812442 - RNA, 20 nt, Homo sapiens
aaaagaaugauuaugaauua

SEQ ID NO: 1812443 - RNA, 18 nt, Homo sapiens
aaaaaguccuucaguuua

SEQ ID NO: 1812444 - RNA, 16 nt, Homo sapiens
uaaauguaucugaaua

SEQ ID NO: 1812445 - RNA, 16 nt, Homo sapiens
cuuggcggacacuggg

SEQ ID NO: 1812446 - RNA, 19 nt, Homo sapiens
uuaaaggguguacuuauau

SEQ ID NO: 1812447 - RNA, 19 nt, Homo sapiens
gucaaccccacaagcacca

SEQ ID NO: 1812448 - RNA, 15 nt, Homo sapiens
cuuggccuaugauaa

SEQ ID NO: 1812449 - RNA, 20 nt, Homo sapiens
acaucaaaacuaaccaucug

SEQ ID NO: 1812450 - RNA, 14 nt, Homo sapiens
cauuucaugugauc

SEQ ID NO: 1812451 - RNA, 21 nt, Homo sapiens
uuucuucauuguaaucugcaa

SEQ ID NO: 1812452 - RNA, 14 nt, Homo sapiens
ugauaaacuuugcu

SEQ ID NO: 1812453 - RNA, 18 nt, Homo sapiens
gccucaggggccucaggg

SEQ ID NO: 1812454 - RNA, 18 nt, Homo sapiens
caaaauauuucagugaau

SEQ ID NO: 1812455 - RNA, 18 nt, Homo sapiens
gaaccuuccugucuccca

SEQ ID NO: 1812456 - RNA, 15 nt, Homo sapiens
aggacaguauuccug

SEQ ID NO: 1812457 - RNA, 13 nt, Homo sapiens
agacuagucucaa

SEQ ID NO: 1812458 - RNA, 17 nt, Homo sapiens
guaauuauuuucuuccu

SEQ ID NO: 1812459 - RNA, 21 nt, Homo sapiens
acuuuauauggcccugcacag

SEQ ID NO: 1812460 - RNA, 15 nt, Homo sapiens
acccagagcuguauu

SEQ ID NO: 1812461 - RNA, 19 nt, Homo sapiens
cugugagccggagcucaug

SEQ ID NO: 1812462 - RNA, 22 nt, Homo sapiens
auauuauugcuauauuugcuaa

SEQ ID NO: 1812463 - RNA, 21 nt, Homo sapiens
guuagagagggaccauguguc

SEQ ID NO: 1812464 - RNA, 21 nt, Homo sapiens
cagccgcgcaucagacuguga

SEQ ID NO: 1812465 - RNA, 21 nt, Homo sapiens
cauucccuggaauugccacau

SEQ ID NO: 1812466 - RNA, 20 nt, Homo sapiens
uauauuuuaucugugauuag

SEQ ID NO: 1812467 - RNA, 13 nt, Homo sapiens
agaaaaauuuccc

SEQ ID NO: 1812468 - RNA, 16 nt, Homo sapiens
aauagggaaguaacag

SEQ ID NO: 1812469 - RNA, 14 nt, Homo sapiens
agcaguuugcacuu

SEQ ID NO: 1812470 - RNA, 15 nt, Homo sapiens
gagaaacuguagucu

SEQ ID NO: 1812471 - RNA, 20 nt, Homo sapiens
uuaacaaaucuaaucucuua

SEQ ID NO: 1812472 - RNA, 13 nt, Homo sapiens
gcacgucaaagag

SEQ ID NO: 1812473 - RNA, 20 nt, Homo sapiens
uuaaaugucuauaaauggug

SEQ ID NO: 1812474 - RNA, 18 nt, Homo sapiens
cgagggaugggauuucau

SEQ ID NO: 1812475 - RNA, 16 nt, Homo sapiens
aaggcugcaagguuua

SEQ ID NO: 1812476 - RNA, 19 nt, Homo sapiens
aaugccuuuaaaguaugaa

SEQ ID NO: 1812477 - RNA, 16 nt, Homo sapiens
uuacuuuucaagcuau

SEQ ID NO: 1812478 - RNA, 15 nt, Homo sapiens
ccauuugcucuucag

SEQ ID NO: 1812479 - RNA, 13 nt, Homo sapiens
uacucucaggcau

SEQ ID NO: 1812480 - RNA, 23 nt, Homo sapiens
auacuggacgcuguccugagaug

SEQ ID NO: 1812481 - RNA, 23 nt, Homo sapiens
ccagcuuuucuugccagcucagc

SEQ ID NO: 1812482 - RNA, 18 nt, Homo sapiens
gcaguggcaucugagugg

SEQ ID NO: 1812483 - RNA, 18 nt, Homo sapiens
gaaaaggcaucacuuucc

SEQ ID NO: 1812484 - RNA, 18 nt, Homo sapiens
uucuuauccuuuguacug

SEQ ID NO: 1812485 - RNA, 11 nt, Homo sapiens
ugugucugcug

SEQ ID NO: 1812486 - RNA, 15 nt, Homo sapiens
cgucagugcucagaa

SEQ ID NO: 1812487 - RNA, 18 nt, Homo sapiens
ucucuaaaacagcacuau

SEQ ID NO: 1812488 - RNA, 21 nt, Homo sapiens
gccgcaguuuggagucacugu

SEQ ID NO: 1812489 - RNA, 17 nt, Homo sapiens
guggagacugauggcca

SEQ ID NO: 1812490 - RNA, 19 nt, Homo sapiens
ucuggacccuccacuucaa

SEQ ID NO: 1812491 - RNA, 11 nt, Homo sapiens
cagcacaagcu

SEQ ID NO: 1812492 - RNA, 20 nt, Homo sapiens
ccucugucauaugcagaauu

SEQ ID NO: 1812493 - RNA, 23 nt, Homo sapiens
uguuuaccuaaacuauaugccau

SEQ ID NO: 1812494 - RNA, 15 nt, Homo sapiens
cacaccuuagugcua

SEQ ID NO: 1812495 - RNA, 16 nt, Homo sapiens
gcuugcaucugcacau

SEQ ID NO: 1812496 - RNA, 16 nt, Homo sapiens
aguugaaugauaauag

SEQ ID NO: 1812497 - RNA, 14 nt, Homo sapiens
guguccccugccug

SEQ ID NO: 1812498 - RNA, 23 nt, Homo sapiens
uaauuugggaaaagaagcuguca

SEQ ID NO: 1812499 - RNA, 21 nt, Homo sapiens
cacagagacaaggagggcaca

SEQ ID NO: 1812500 - RNA, 18 nt, Homo sapiens
uaauugugugaacuugga

SEQ ID NO: 1812501 - RNA, 16 nt, Homo sapiens
cuagacuagcuguaaa

SEQ ID NO: 1812502 - RNA, 21 nt, Homo sapiens
acugcagagagacaacagauu

SEQ ID NO: 1812503 - RNA, 18 nt, Homo sapiens
auuuuguaaauaugcaaa

SEQ ID NO: 1812504 - RNA, 17 nt, Homo sapiens
aggaaccugagcaggac

SEQ ID NO: 1812505 - RNA, 14 nt, Homo sapiens
gcaggguaccugaa

SEQ ID NO: 1812506 - RNA, 17 nt, Homo sapiens
gagauaacauuuccaaa

SEQ ID NO: 1812507 - RNA, 17 nt, Homo sapiens
uugagcugcucugcaag

SEQ ID NO: 1812508 - RNA, 15 nt, Homo sapiens
cuccuuccacaugua

SEQ ID NO: 1812509 - RNA, 14 nt, Homo sapiens
acguccauguucua

SEQ ID NO: 1812510 - RNA, 15 nt, Homo sapiens
acaggauaacccuug

SEQ ID NO: 1812511 - RNA, 21 nt, Homo sapiens
gcaaauguguacgugcaugcu

SEQ ID NO: 1812512 - RNA, 11 nt, Homo sapiens
aggagcaggca

SEQ ID NO: 1812513 - RNA, 12 nt, Homo sapiens
gcagcacaggag

SEQ ID NO: 1812514 - RNA, 12 nt, Homo sapiens
gccccucagggg

SEQ ID NO: 1812515 - RNA, 17 nt, Homo sapiens
ccuggauugggagaccu

SEQ ID NO: 1812516 - RNA, 15 nt, Homo sapiens
uucaauaaacauuga

SEQ ID NO: 1812517 - RNA, 14 nt, Homo sapiens
aaccaccagguguc

SEQ ID NO: 1812518 - RNA, 19 nt, Homo sapiens
guagcuccgcgugucucau

SEQ ID NO: 1812519 - RNA, 16 nt, Homo sapiens
uggcaggagaaucaau

SEQ ID NO: 1812520 - RNA, 20 nt, Homo sapiens
uugggagagcccugcuccca

SEQ ID NO: 1812521 - RNA, 13 nt, Homo sapiens
agauuucaucugc

SEQ ID NO: 1812522 - RNA, 18 nt, Homo sapiens
cuguucugggugcagcug

SEQ ID NO: 1812523 - RNA, 18 nt, Homo sapiens
aggcccugggucuugcca

SEQ ID NO: 1812524 - RNA, 12 nt, Homo sapiens
ugaugugucacc

SEQ ID NO: 1812525 - RNA, 13 nt, Homo sapiens
auucaugcugauu

SEQ ID NO: 1812526 - RNA, 14 nt, Homo sapiens
uauuuacucauagu

SEQ ID NO: 1812527 - RNA, 22 nt, Homo sapiens
uguccuaaaauacaaacaagca

SEQ ID NO: 1812528 - RNA, 16 nt, Homo sapiens
gcucuucucauuucac

SEQ ID NO: 1812529 - RNA, 18 nt, Homo sapiens
ucaccucaccccacugug

SEQ ID NO: 1812530 - RNA, 13 nt, Homo sapiens
cgcauagcacuug

SEQ ID NO: 1812531 - RNA, 11 nt, Homo sapiens
agguggagcuu

SEQ ID NO: 1812532 - RNA, 19 nt, Homo sapiens
cuucccuuccuccauugca

SEQ ID NO: 1812533 - RNA, 15 nt, Homo sapiens
ucagcaugaauuugu

SEQ ID NO: 1812534 - RNA, 18 nt, Homo sapiens
acccauucacuacaggug

SEQ ID NO: 1812535 - RNA, 21 nt, Homo sapiens
uccccaagcuggccacuauca

SEQ ID NO: 1812536 - RNA, 21 nt, Homo sapiens
uucuguggaccacugcaugag

SEQ ID NO: 1812537 - RNA, 16 nt, Homo sapiens
uaccugcugcugcuau

SEQ ID NO: 1812538 - RNA, 14 nt, Homo sapiens
aucagaagcacuag

SEQ ID NO: 1812539 - RNA, 19 nt, Homo sapiens
acagaugggcaaggccuuu

SEQ ID NO: 1812540 - RNA, 13 nt, Homo sapiens
agagacuggagca

SEQ ID NO: 1812541 - RNA, 21 nt, Homo sapiens
guagcagagaaaggauugauu

SEQ ID NO: 1812542 - RNA, 14 nt, Homo sapiens
guagcagcucauaa

SEQ ID NO: 1812543 - RNA, 15 nt, Homo sapiens
caauauguuuaucaa

SEQ ID NO: 1812544 - RNA, 15 nt, Homo sapiens
auaaagggacuugaa

SEQ ID NO: 1812545 - RNA, 22 nt, Homo sapiens
cauagucacauggccuaugcac

SEQ ID NO: 1812546 - RNA, 21 nt, Homo sapiens
ugcccacugccgaugcccaau

SEQ ID NO: 1812547 - RNA, 15 nt, Homo sapiens
caucuccugcucacc

SEQ ID NO: 1812548 - RNA, 17 nt, Homo sapiens
ugaauugccugccaugg

SEQ ID NO: 1812549 - RNA, 17 nt, Homo sapiens
gaaauuaguuuaccuca

SEQ ID NO: 1812550 - RNA, 16 nt, Homo sapiens
gaaacacuccuugcau

SEQ ID NO: 1812551 - RNA, 23 nt, Homo sapiens
uaucacugcauuaucuugcucau

SEQ ID NO: 1812552 - RNA, 22 nt, Homo sapiens
aaauucccaacuucucuugcuu

SEQ ID NO: 1812553 - RNA, 17 nt, Homo sapiens
ucaggcaaacguccaca

SEQ ID NO: 1812554 - RNA, 18 nt, Homo sapiens
ugaagaccagcuuucuca

SEQ ID NO: 1812555 - RNA, 15 nt, Homo sapiens
uucuguccuaaucau

SEQ ID NO: 1812556 - RNA, 14 nt, Homo sapiens
uagaucaagcauua

SEQ ID NO: 1812557 - RNA, 18 nt, Homo sapiens
aaagaaaauuuuccacau

SEQ ID NO: 1812558 - RNA, 19 nt, Homo sapiens
agccagcccuggcuuccaa

SEQ ID NO: 1812559 - RNA, 14 nt, Homo sapiens
acaucacuuuguga

SEQ ID NO: 1812560 - RNA, 19 nt, Homo sapiens
ggugugagggccccugccu

SEQ ID NO: 1812561 - RNA, 12 nt, Homo sapiens
gucugggccagu

SEQ ID NO: 1812562 - RNA, 17 nt, Homo sapiens
acucuucugacugcccc

SEQ ID NO: 1812563 - RNA, 16 nt, Homo sapiens
uauuuuggacguguga

SEQ ID NO: 1812564 - RNA, 12 nt, Homo sapiens
ccagauuuacac

SEQ ID NO: 1812565 - RNA, 16 nt, Homo sapiens
gcaaaaaaaugugcau

SEQ ID NO: 1812566 - RNA, 19 nt, Homo sapiens
aaugaugcagcuguugaga

SEQ ID NO: 1812567 - RNA, 16 nt, Homo sapiens
cugugugcaagugugu

SEQ ID NO: 1812568 - RNA, 15 nt, Homo sapiens
uacaaucauugcuga

SEQ ID NO: 1812569 - RNA, 14 nt, Homo sapiens
uuugggaccugcuu

SEQ ID NO: 1812570 - RNA, 17 nt, Homo sapiens
ccucccacggugcccaa

SEQ ID NO: 1812571 - RNA, 17 nt, Homo sapiens
auaaacggacucagugg

SEQ ID NO: 1812572 - RNA, 22 nt, Homo sapiens
aucuuacagagacucucccuga

SEQ ID NO: 1812573 - RNA, 13 nt, Homo sapiens
ggccucaggagca

SEQ ID NO: 1812574 - RNA, 22 nt, Homo sapiens
aaacauuuuaauuuuaguuuca

SEQ ID NO: 1812575 - RNA, 22 nt, Homo sapiens
uguccugggccugccccugugu

SEQ ID NO: 1812576 - RNA, 20 nt, Homo sapiens
uggauuaaauggcaccugua

SEQ ID NO: 1812577 - RNA, 15 nt, Homo sapiens
ugucgugucugcugu

SEQ ID NO: 1812578 - RNA, 11 nt, Homo sapiens
aaguacaucuc

SEQ ID NO: 1812579 - RNA, 17 nt, Homo sapiens
gcucaguuggugcugcu

SEQ ID NO: 1812580 - RNA, 20 nt, Homo sapiens
cagacaccuccuucuuccua

SEQ ID NO: 1812581 - RNA, 18 nt, Homo sapiens
acugccuuccacaauuca

SEQ ID NO: 1812582 - RNA, 14 nt, Homo sapiens
gcccuaguaugaaa

SEQ ID NO: 1812583 - RNA, 21 nt, Homo sapiens
cuucgauggcauccugcagug

SEQ ID NO: 1812584 - RNA, 22 nt, Homo sapiens
cugguuguugccaaacagccac

SEQ ID NO: 1812585 - RNA, 19 nt, Homo sapiens
ugugaucagugauuuucaa

SEQ ID NO: 1812586 - RNA, 21 nt, Homo sapiens
cagugguauuguuucugucaa

SEQ ID NO: 1812587 - RNA, 18 nt, Homo sapiens
gaugguaacugcacacau

SEQ ID NO: 1812588 - RNA, 13 nt, Homo sapiens
ucaguguccuuca

SEQ ID NO: 1812589 - RNA, 19 nt, Homo sapiens
uggauuguguuugugccau

SEQ ID NO: 1812590 - RNA, 22 nt, Homo sapiens
ugcuuugggauuuaauuuccag

SEQ ID NO: 1812591 - RNA, 17 nt, Homo sapiens
uccuaagcaacuaggcc

SEQ ID NO: 1812592 - RNA, 13 nt, Homo sapiens
ucacuguugcaua

SEQ ID NO: 1812593 - RNA, 17 nt, Homo sapiens
uaauacccuguacauau

SEQ ID NO: 1812594 - RNA, 23 nt, Homo sapiens
cuacagaccuggcucucagagga

SEQ ID NO: 1812595 - RNA, 22 nt, Homo sapiens
gagaccuuguuucaaucuuugc

SEQ ID NO: 1812596 - RNA, 18 nt, Homo sapiens
gauugcucccaggaucuc

SEQ ID NO: 1812597 - RNA, 16 nt, Homo sapiens
aagagaagcauucuca

SEQ ID NO: 1812598 - RNA, 22 nt, Homo sapiens
cagagagagaagugccccugcu

SEQ ID NO: 1812599 - RNA, 21 nt, Homo sapiens
agucucugugcuuugacucac

SEQ ID NO: 1812600 - RNA, 20 nt, Homo sapiens
aaccuccgccucccagguuc

SEQ ID NO: 1812601 - RNA, 16 nt, Homo sapiens
guaaucucagcacuuu

SEQ ID NO: 1812602 - RNA, 14 nt, Homo sapiens
ugggccugcuccag

SEQ ID NO: 1812603 - RNA, 23 nt, Homo sapiens
gaagacaauggcuuacuccagga

SEQ ID NO: 1812604 - RNA, 12 nt, Homo sapiens
cgguuucacucc

SEQ ID NO: 1812605 - RNA, 22 nt, Homo sapiens
cauaauuaaacaugauccugag

SEQ ID NO: 1812606 - RNA, 16 nt, Homo sapiens
acauagcgagacucca

SEQ ID NO: 1812607 - RNA, 16 nt, Homo sapiens
cuucagaagacacugc

SEQ ID NO: 1812608 - RNA, 16 nt, Homo sapiens
aaauccuagacuugaa

SEQ ID NO: 1812609 - RNA, 18 nt, Homo sapiens
auuuuaacaaaaggacaa

SEQ ID NO: 1812610 - RNA, 16 nt, Homo sapiens
uuaaaugaacacagcu

SEQ ID NO: 1812611 - RNA, 17 nt, Homo sapiens
cgcucgaugacugugaa

SEQ ID NO: 1812612 - RNA, 16 nt, Homo sapiens
ugaauaaaccaguauc

SEQ ID NO: 1812613 - RNA, 19 nt, Homo sapiens
accgcauccucacugggcu

SEQ ID NO: 1812614 - RNA, 16 nt, Homo sapiens
ucagacgagcagugac

SEQ ID NO: 1812615 - RNA, 21 nt, Homo sapiens
auuuauugguggguugaauau

SEQ ID NO: 1812616 - RNA, 18 nt, Homo sapiens
agcuccagggccagauga

SEQ ID NO: 1812617 - RNA, 17 nt, Homo sapiens
ggccgggcacggucaca

SEQ ID NO: 1812618 - RNA, 17 nt, Homo sapiens
ggugccccucucuccau

SEQ ID NO: 1812619 - RNA, 22 nt, Homo sapiens
gauuuugaacuugaguaauuca

SEQ ID NO: 1812620 - RNA, 18 nt, Homo sapiens
cugaaaaaaaaccugaga

SEQ ID NO: 1812621 - RNA, 14 nt, Homo sapiens
acuggcugcaaagg

SEQ ID NO: 1812622 - RNA, 19 nt, Homo sapiens
ccuggcccgcuaaggugaa

SEQ ID NO: 1812623 - RNA, 19 nt, Homo sapiens
caccacggccucacccagg

SEQ ID NO: 1812624 - RNA, 15 nt, Homo sapiens
uguaacuguaaagau

SEQ ID NO: 1812625 - RNA, 14 nt, Homo sapiens
agucaugucacuga

SEQ ID NO: 1812626 - RNA, 21 nt, Homo sapiens
agacgcagcccugggggccag

SEQ ID NO: 1812627 - RNA, 14 nt, Homo sapiens
acaacagugcuaaa

SEQ ID NO: 1812628 - RNA, 13 nt, Homo sapiens
aaagcauguaugu

SEQ ID NO: 1812629 - RNA, 17 nt, Homo sapiens
caguuuggagucacugu

SEQ ID NO: 1812630 - RNA, 20 nt, Homo sapiens
agaagcacuuugauugaagu

SEQ ID NO: 1812631 - RNA, 16 nt, Homo sapiens
uccggcacacugccaa

SEQ ID NO: 1812632 - RNA, 16 nt, Homo sapiens
aaaggugugcugguca

SEQ ID NO: 1812633 - RNA, 17 nt, Homo sapiens
uuaaaaaaacacauaau

SEQ ID NO: 1812634 - RNA, 21 nt, Homo sapiens
cauuguggcuccuaucugugu

SEQ ID NO: 1812635 - RNA, 13 nt, Homo sapiens
uauuccugcauuu

SEQ ID NO: 1812636 - RNA, 20 nt, Homo sapiens
ccucugcccagauuugcccu

SEQ ID NO: 1812637 - RNA, 18 nt, Homo sapiens
aacauuuuguccaccuuu

SEQ ID NO: 1812638 - RNA, 20 nt, Homo sapiens
cuggagaugacagugaugcu

SEQ ID NO: 1812639 - RNA, 22 nt, Homo sapiens
aaaaugggaucuuucugacaca

SEQ ID NO: 1812640 - RNA, 11 nt, Homo sapiens
gggugcagcug

SEQ ID NO: 1812641 - RNA, 19 nt, Homo sapiens
cuaacuguaugugucuuua

SEQ ID NO: 1812642 - RNA, 18 nt, Homo sapiens
cuuccacaugugccaguu

SEQ ID NO: 1812643 - RNA, 16 nt, Homo sapiens
cggcaaccucugagcc

SEQ ID NO: 1812644 - RNA, 19 nt, Homo sapiens
uccucucaagcuagccaga

SEQ ID NO: 1812645 - RNA, 16 nt, Homo sapiens
caaugacugagcagca

SEQ ID NO: 1812646 - RNA, 22 nt, Homo sapiens
ugccuucuagcuguguccucac

SEQ ID NO: 1812647 - RNA, 18 nt, Homo sapiens
cauguucaaagugugaca

SEQ ID NO: 1812648 - RNA, 19 nt, Homo sapiens
aagugauggucauucauau

SEQ ID NO: 1812649 - RNA, 16 nt, Homo sapiens
acuuuaugaugcuaug

SEQ ID NO: 1812650 - RNA, 11 nt, Homo sapiens
ugaucaaguca

SEQ ID NO: 1812651 - RNA, 12 nt, Homo sapiens
uuuagcacaaaa

SEQ ID NO: 1812652 - RNA, 13 nt, Homo sapiens
cuaauugcuguug

SEQ ID NO: 1812653 - RNA, 15 nt, Homo sapiens
cuugaacccuaauaa

SEQ ID NO: 1812654 - RNA, 18 nt, Homo sapiens
auugauagucaauaucaa

SEQ ID NO: 1812655 - RNA, 19 nt, Homo sapiens
cagaucugucuccaagacc

SEQ ID NO: 1812656 - RNA, 14 nt, Homo sapiens
agucugacugugcc

SEQ ID NO: 1812657 - RNA, 22 nt, Homo sapiens
gaagacacacucagcaaccaca

SEQ ID NO: 1812658 - RNA, 18 nt, Homo sapiens
ucucuccaccucuaguca

SEQ ID NO: 1812659 - RNA, 16 nt, Homo sapiens
ugcagucacuuugaca

SEQ ID NO: 1812660 - RNA, 23 nt, Homo sapiens
ggccacccccauggaagcaauaa

SEQ ID NO: 1812661 - RNA, 23 nt, Homo sapiens
agaacuucacagugacacuggac

SEQ ID NO: 1812662 - RNA, 22 nt, Homo sapiens
caaaucucauguucaaagugug

SEQ ID NO: 1812663 - RNA, 13 nt, Homo sapiens
ggcuagacaguuc

SEQ ID NO: 1812664 - RNA, 19 nt, Homo sapiens
acuugggcgggacacaggc

SEQ ID NO: 1812665 - RNA, 14 nt, Homo sapiens
aggcggggugggca

SEQ ID NO: 1812666 - RNA, 18 nt, Homo sapiens
cugcaguuuuauugcuaa

SEQ ID NO: 1812667 - RNA, 16 nt, Homo sapiens
uguuugcccauuuuca

SEQ ID NO: 1812668 - RNA, 17 nt, Homo sapiens
aaccggccccagagugc

SEQ ID NO: 1812669 - RNA, 20 nt, Homo sapiens
accagccguauuuuacauga

SEQ ID NO: 1812670 - RNA, 23 nt, Homo sapiens
gugccuccucuggggaagggaac

SEQ ID NO: 1812671 - RNA, 23 nt, Homo sapiens
gcuguucauguuacucaugacuc

SEQ ID NO: 1812672 - RNA, 14 nt, Homo sapiens
aaagaaaaaaaagu

SEQ ID NO: 1812673 - RNA, 16 nt, Homo sapiens
agagaacaucuggaga

SEQ ID NO: 1812674 - RNA, 17 nt, Homo sapiens
acuucagaguacaucca

SEQ ID NO: 1812675 - RNA, 22 nt, Homo sapiens
cagcccagcccuccucugucaa

SEQ ID NO: 1812676 - RNA, 23 nt, Homo sapiens
aaaacauuagaagaaaacauaua

SEQ ID NO: 1812677 - RNA, 16 nt, Homo sapiens
aggcaagugguaggga

SEQ ID NO: 1812678 - RNA, 21 nt, Homo sapiens
auuaaugugauuuuggucucu

SEQ ID NO: 1812679 - RNA, 19 nt, Homo sapiens
ucaaaacagagaugugaua

SEQ ID NO: 1812680 - RNA, 19 nt, Homo sapiens
aauguaagauuucauucug

SEQ ID NO: 1812681 - RNA, 18 nt, Homo sapiens
gcucaggggacacuggcc

SEQ ID NO: 1812682 - RNA, 16 nt, Homo sapiens
gcuaguccggacccac

SEQ ID NO: 1812683 - RNA, 16 nt, Homo sapiens
uuacccuucuuuccau

SEQ ID NO: 1812684 - RNA, 20 nt, Homo sapiens
guggauaugacccacacugc

SEQ ID NO: 1812685 - RNA, 16 nt, Homo sapiens
aacauaaguuaucaug

SEQ ID NO: 1812686 - RNA, 20 nt, Homo sapiens
agcgcuucugcaccaacuca

SEQ ID NO: 1812687 - RNA, 15 nt, Homo sapiens
uuuaugaaguuaaau

SEQ ID NO: 1812688 - RNA, 12 nt, Homo sapiens
acugaaauggac

SEQ ID NO: 1812689 - RNA, 17 nt, Homo sapiens
ugcuuguugcauuucca

SEQ ID NO: 1812690 - RNA, 15 nt, Homo sapiens
cuucauucuuugcag

SEQ ID NO: 1812691 - RNA, 18 nt, Homo sapiens
ugcucuugggaagaccag

SEQ ID NO: 1812692 - RNA, 15 nt, Homo sapiens
aucuuugacugaaaa

SEQ ID NO: 1812693 - RNA, 14 nt, Homo sapiens
aauuccugaucacc

SEQ ID NO: 1812694 - RNA, 12 nt, Homo sapiens
cuaucacauaca

SEQ ID NO: 1812695 - RNA, 17 nt, Homo sapiens
gugccaguuauggcuau

SEQ ID NO: 1812696 - RNA, 20 nt, Homo sapiens
acaguggcucaugccuguaa

SEQ ID NO: 1812697 - RNA, 13 nt, Homo sapiens
uacaagacuguaa

SEQ ID NO: 1812698 - RNA, 14 nt, Homo sapiens
uggccuccaaacac

SEQ ID NO: 1812699 - RNA, 21 nt, Homo sapiens
cacccagggaaggugcugaau

SEQ ID NO: 1812700 - RNA, 20 nt, Homo sapiens
guagcguguuuacaugugua

SEQ ID NO: 1812701 - RNA, 17 nt, Homo sapiens
gcuucucuccuaucugu

SEQ ID NO: 1812702 - RNA, 19 nt, Homo sapiens
guggaucuugccacauuuc

SEQ ID NO: 1812703 - RNA, 13 nt, Homo sapiens
aauaaccaugaaa

SEQ ID NO: 1812704 - RNA, 18 nt, Homo sapiens
cagcuucccucugccuga

SEQ ID NO: 1812705 - RNA, 18 nt, Homo sapiens
gccaaucuucaguauuuu

SEQ ID NO: 1812706 - RNA, 21 nt, Homo sapiens
cuaacacaaguuuacuugucu

SEQ ID NO: 1812707 - RNA, 18 nt, Homo sapiens
uaccugaaaauucaacau

SEQ ID NO: 1812708 - RNA, 13 nt, Homo sapiens
ccuaucagaauuu

SEQ ID NO: 1812709 - RNA, 21 nt, Homo sapiens
ggcuaggcgugguggugcaug

SEQ ID NO: 1812710 - RNA, 23 nt, Homo sapiens
caugacuuuauauggaugauuca

SEQ ID NO: 1812711 - RNA, 13 nt, Homo sapiens
caccuacccagcu

SEQ ID NO: 1812712 - RNA, 21 nt, Homo sapiens
caggagcauguaugucugcag

SEQ ID NO: 1812713 - RNA, 16 nt, Homo sapiens
gaaucccaauguuuga

SEQ ID NO: 1812714 - RNA, 15 nt, Homo sapiens
uuguuaaauucaaug

SEQ ID NO: 1812715 - RNA, 23 nt, Homo sapiens
ugcucucggacucccuaccccaa

SEQ ID NO: 1812716 - RNA, 21 nt, Homo sapiens
ucuuccaaggaaauacauaug

SEQ ID NO: 1812717 - RNA, 21 nt, Homo sapiens
acagucaagacggauccacag

SEQ ID NO: 1812718 - RNA, 20 nt, Homo sapiens
auauuguggcacaagcaaaa

SEQ ID NO: 1812719 - RNA, 21 nt, Homo sapiens
aauagaaacuacccaucucaa

SEQ ID NO: 1812720 - RNA, 15 nt, Homo sapiens
uuuucuagacugucu

SEQ ID NO: 1812721 - RNA, 13 nt, Homo sapiens
aguguaacacugc

SEQ ID NO: 1812722 - RNA, 23 nt, Homo sapiens
gaugacuuucgauuaugcuuugu

SEQ ID NO: 1812723 - RNA, 22 nt, Homo sapiens
uauagaaaauaucuagcccaaa

SEQ ID NO: 1812724 - RNA, 20 nt, Homo sapiens
uguaaaugacucuacuaaaa

SEQ ID NO: 1812725 - RNA, 14 nt, Homo sapiens
cagaaacugccauu

SEQ ID NO: 1812726 - RNA, 13 nt, Homo sapiens
gaaacccagagau

SEQ ID NO: 1812727 - RNA, 16 nt, Homo sapiens
caggcuucugaaggua

SEQ ID NO: 1812728 - RNA, 12 nt, Homo sapiens
gaucuucagagc

SEQ ID NO: 1812729 - RNA, 18 nt, Homo sapiens
gauuuguuaaagggccaa

SEQ ID NO: 1812730 - RNA, 15 nt, Homo sapiens
ucucacuguugugaa

SEQ ID NO: 1812731 - RNA, 12 nt, Homo sapiens
ccacagucuuuc

SEQ ID NO: 1812732 - RNA, 14 nt, Homo sapiens
ccagguguugccau

SEQ ID NO: 1812733 - RNA, 20 nt, Homo sapiens
acccccacagaccugcucug

SEQ ID NO: 1812734 - RNA, 17 nt, Homo sapiens
ccuacacaggacagggg

SEQ ID NO: 1812735 - RNA, 20 nt, Homo sapiens
gaauacauuaacggugcuaa

SEQ ID NO: 1812736 - RNA, 18 nt, Homo sapiens
cuggcagggccaccugca

SEQ ID NO: 1812737 - RNA, 14 nt, Homo sapiens
uccugaauguaauu

SEQ ID NO: 1812738 - RNA, 15 nt, Homo sapiens
ggcaaccaauggcag

SEQ ID NO: 1812739 - RNA, 14 nt, Homo sapiens
uguagaacugagaa

SEQ ID NO: 1812740 - RNA, 12 nt, Homo sapiens
augugguacuac

SEQ ID NO: 1812741 - RNA, 24 nt, Homo sapiens
uccccagucccaaugcacauccau

SEQ ID NO: 1812742 - RNA, 22 nt, Homo sapiens
uugccauuuagcgaacaaccac

SEQ ID NO: 1812743 - RNA, 21 nt, Homo sapiens
uucagcugacuccaguauaau

SEQ ID NO: 1812744 - RNA, 13 nt, Homo sapiens
cauuucuguaacc

SEQ ID NO: 1812745 - RNA, 13 nt, Homo sapiens
cauuccuguaacu

SEQ ID NO: 1812746 - RNA, 19 nt, Homo sapiens
acucgagaccauccuggcc

SEQ ID NO: 1812747 - RNA, 20 nt, Homo sapiens
uuguaaacuuccaagucauu

SEQ ID NO: 1812748 - RNA, 12 nt, Homo sapiens
caagcacuuugg

SEQ ID NO: 1812749 - RNA, 21 nt, Homo sapiens
ccuaaccaaaugcugucucca

SEQ ID NO: 1812750 - RNA, 22 nt, Homo sapiens
cugcugccucccuuucauacaa

SEQ ID NO: 1812751 - RNA, 21 nt, Homo sapiens
aagggcaaaauucccagggaa

SEQ ID NO: 1812752 - RNA, 21 nt, Homo sapiens
gagggugggaggcaaacacgc

SEQ ID NO: 1812753 - RNA, 17 nt, Homo sapiens
auucaaaugggugauau

SEQ ID NO: 1812754 - RNA, 20 nt, Homo sapiens
gggcuguuuuaagaccagag

SEQ ID NO: 1812755 - RNA, 15 nt, Homo sapiens
uucccacugccaggg

SEQ ID NO: 1812756 - RNA, 22 nt, Homo sapiens
ccccucuccugcccaagcacuu

SEQ ID NO: 1812757 - RNA, 22 nt, Homo sapiens
ugugcacugccugcaugagcug

SEQ ID NO: 1812758 - RNA, 15 nt, Homo sapiens
cuccuggcugagaaa

SEQ ID NO: 1812759 - RNA, 17 nt, Homo sapiens
uuaagagauacauuccc

SEQ ID NO: 1812760 - RNA, 16 nt, Homo sapiens
gacuaggauaacagaa

SEQ ID NO: 1812761 - RNA, 16 nt, Homo sapiens
uauuauacaaauacua

SEQ ID NO: 1812762 - RNA, 21 nt, Homo sapiens
ccagcuuaugagcucaaagua

SEQ ID NO: 1812763 - RNA, 13 nt, Homo sapiens
ucuuaagcagaga

SEQ ID NO: 1812764 - RNA, 19 nt, Homo sapiens
uacuguguguuuucccaaa

SEQ ID NO: 1812765 - RNA, 15 nt, Homo sapiens
cguucaauaagcauu

SEQ ID NO: 1812766 - RNA, 17 nt, Homo sapiens
ccacugacgaucauucu

SEQ ID NO: 1812767 - RNA, 22 nt, Homo sapiens
uaccaugucguaguuacucuca

SEQ ID NO: 1812768 - RNA, 23 nt, Homo sapiens
acucagcagugagaguuccucuu

SEQ ID NO: 1812769 - RNA, 15 nt, Homo sapiens
ucuggauucugaauc

SEQ ID NO: 1812770 - RNA, 15 nt, Homo sapiens
cugaugggacaucaa

SEQ ID NO: 1812771 - RNA, 19 nt, Homo sapiens
agaucuuuuauuuugccaa

SEQ ID NO: 1812772 - RNA, 12 nt, Homo sapiens
gacuuugccaca

SEQ ID NO: 1812773 - RNA, 23 nt, Homo sapiens
cugcaagaaaggggacccaagaa

SEQ ID NO: 1812774 - RNA, 18 nt, Homo sapiens
uguauuuccccaaugacu

SEQ ID NO: 1812775 - RNA, 14 nt, Homo sapiens
agggcuagaaccua

SEQ ID NO: 1812776 - RNA, 21 nt, Homo sapiens
auuuuuugguuuugugcacau

SEQ ID NO: 1812777 - RNA, 14 nt, Homo sapiens
uuggaaagcagucc

SEQ ID NO: 1812778 - RNA, 15 nt, Homo sapiens
guuacuucacuuuaa

SEQ ID NO: 1812779 - RNA, 20 nt, Homo sapiens
acccagaguagccaugagga

SEQ ID NO: 1812780 - RNA, 15 nt, Homo sapiens
gaaagaaaaugaauu

SEQ ID NO: 1812781 - RNA, 16 nt, Homo sapiens
ugaaaaaaaacagugg

SEQ ID NO: 1812782 - RNA, 16 nt, Homo sapiens
ugcacuauuuccacau

SEQ ID NO: 1812783 - RNA, 13 nt, Homo sapiens
aucauauagacca

SEQ ID NO: 1812784 - RNA, 23 nt, Homo sapiens
agccaugugucauguaauacuga

SEQ ID NO: 1812785 - RNA, 14 nt, Homo sapiens
aagcucccagcuga

SEQ ID NO: 1812786 - RNA, 20 nt, Homo sapiens
uuaagguuaugcacugccug

SEQ ID NO: 1812787 - RNA, 22 nt, Homo sapiens
ucagccaagaucuugccacugu

SEQ ID NO: 1812788 - RNA, 15 nt, Homo sapiens
gccucccguccgucc

SEQ ID NO: 1812789 - RNA, 17 nt, Homo sapiens
cauccuugcaucacugg

SEQ ID NO: 1812790 - RNA, 16 nt, Homo sapiens
aucuaugauaugcuaa

SEQ ID NO: 1812791 - RNA, 16 nt, Homo sapiens
caguugggcuaugugu

SEQ ID NO: 1812792 - RNA, 20 nt, Homo sapiens
cuuaaacuuugucacuucug

SEQ ID NO: 1812793 - RNA, 17 nt, Homo sapiens
ccaugccccuggaccag

SEQ ID NO: 1812794 - RNA, 18 nt, Homo sapiens
ugaucuccauaaacauga

SEQ ID NO: 1812795 - RNA, 23 nt, Homo sapiens
ggaaagaaccaugcagaggaaua

SEQ ID NO: 1812796 - RNA, 22 nt, Homo sapiens
ccugaaugccucccccaucucc

SEQ ID NO: 1812797 - RNA, 17 nt, Homo sapiens
auugaggaugucccuga

SEQ ID NO: 1812798 - RNA, 21 nt, Homo sapiens
uuguuuauugaauucauuuca

SEQ ID NO: 1812799 - RNA, 13 nt, Homo sapiens
uuaucuucacuuu

SEQ ID NO: 1812800 - RNA, 23 nt, Homo sapiens
auuaggcuuuuaagaaacacagg

SEQ ID NO: 1812801 - RNA, 14 nt, Homo sapiens
aguuuucugugaga

SEQ ID NO: 1812802 - RNA, 19 nt, Homo sapiens
agggaaguugaacgagcau

SEQ ID NO: 1812803 - RNA, 14 nt, Homo sapiens
cucuugcauugcaa

SEQ ID NO: 1812804 - RNA, 11 nt, Homo sapiens
aaaagcaggca

SEQ ID NO: 1812805 - RNA, 16 nt, Homo sapiens
uuguguguaugcugau

SEQ ID NO: 1812806 - RNA, 18 nt, Homo sapiens
gucacaggacgauuucac

SEQ ID NO: 1812807 - RNA, 20 nt, Homo sapiens
ggcucccaagccacauucau

SEQ ID NO: 1812808 - RNA, 21 nt, Homo sapiens
uccuaacugaaagaugaucau

SEQ ID NO: 1812809 - RNA, 19 nt, Homo sapiens
cuugcugccacauucuaaa

SEQ ID NO: 1812810 - RNA, 20 nt, Homo sapiens
uaagucauuccuccagugca

SEQ ID NO: 1812811 - RNA, 16 nt, Homo sapiens
aauauuucaugauuca

SEQ ID NO: 1812812 - RNA, 19 nt, Homo sapiens
gacccagugagugaaucag

SEQ ID NO: 1812813 - RNA, 18 nt, Homo sapiens
uccuucgcccugugcacc

SEQ ID NO: 1812814 - RNA, 12 nt, Homo sapiens
gugcucuaucca

SEQ ID NO: 1812815 - RNA, 18 nt, Homo sapiens
ugcccccgggggcucaca

SEQ ID NO: 1812816 - RNA, 19 nt, Homo sapiens
cgggguugucgagaucuca

SEQ ID NO: 1812817 - RNA, 15 nt, Homo sapiens
ucuaaacuuuauucc

SEQ ID NO: 1812818 - RNA, 16 nt, Homo sapiens
ccuguucagcuacucc

SEQ ID NO: 1812819 - RNA, 19 nt, Homo sapiens
uuauauauuuauaacucau

SEQ ID NO: 1812820 - RNA, 18 nt, Homo sapiens
uacaaaaaucagccagac

SEQ ID NO: 1812821 - RNA, 15 nt, Homo sapiens
aucuuccugcugcug

SEQ ID NO: 1812822 - RNA, 19 nt, Homo sapiens
cacucaugucggucccuga

SEQ ID NO: 1812823 - RNA, 18 nt, Homo sapiens
uuuaaggugaguucucac

SEQ ID NO: 1812824 - RNA, 13 nt, Homo sapiens
cacgaugccuuug

SEQ ID NO: 1812825 - RNA, 17 nt, Homo sapiens
ggggcagucgaguuucu

SEQ ID NO: 1812826 - RNA, 23 nt, Homo sapiens
caaaaggcuggaugugcuuucau

SEQ ID NO: 1812827 - RNA, 17 nt, Homo sapiens
acagccgugcacaccag

SEQ ID NO: 1812828 - RNA, 17 nt, Homo sapiens
agugauuccuucuugcu

SEQ ID NO: 1812829 - RNA, 19 nt, Homo sapiens
gaaccagugauccaugucc

SEQ ID NO: 1812830 - RNA, 15 nt, Homo sapiens
uaaaagucuaugauc

SEQ ID NO: 1812831 - RNA, 13 nt, Homo sapiens
cuguuuaacuucu

SEQ ID NO: 1812832 - RNA, 13 nt, Homo sapiens
auuuauaaaugca

SEQ ID NO: 1812833 - RNA, 21 nt, Homo sapiens
ggcuucagcugccaguguccu

SEQ ID NO: 1812834 - RNA, 15 nt, Homo sapiens
accugggcauuccuu

SEQ ID NO: 1812835 - RNA, 18 nt, Homo sapiens
augcugaacauugcauau

SEQ ID NO: 1812836 - RNA, 15 nt, Homo sapiens
gauagauaaugccuu

SEQ ID NO: 1812837 - RNA, 20 nt, Homo sapiens
aguguaaauucagucuuuuc

SEQ ID NO: 1812838 - RNA, 20 nt, Homo sapiens
caaaugaguucaacuuugag

SEQ ID NO: 1812839 - RNA, 15 nt, Homo sapiens
uugcaaaucaguguu

SEQ ID NO: 1812840 - RNA, 20 nt, Homo sapiens
aagaaauuccuagugucuuu

SEQ ID NO: 1812841 - RNA, 18 nt, Homo sapiens
acugagagucugcacuua

SEQ ID NO: 1812842 - RNA, 18 nt, Homo sapiens
acauauaucuuauccaau

SEQ ID NO: 1812843 - RNA, 16 nt, Homo sapiens
auacuccaaccauaug

SEQ ID NO: 1812844 - RNA, 23 nt, Homo sapiens
uggcccccagcugguguccugcc

SEQ ID NO: 1812845 - RNA, 14 nt, Homo sapiens
auaaauaugaagcu

SEQ ID NO: 1812846 - RNA, 15 nt, Homo sapiens
ccaacuuuucaucca

SEQ ID NO: 1812847 - RNA, 22 nt, Homo sapiens
uuuagaaaaagaacaugcaguu

SEQ ID NO: 1812848 - RNA, 16 nt, Homo sapiens
cagcaaagcccccaga

SEQ ID NO: 1812849 - RNA, 16 nt, Homo sapiens
ccaggaacacaugcac

SEQ ID NO: 1812850 - RNA, 13 nt, Homo sapiens
cuuuguggaccaa

SEQ ID NO: 1812851 - RNA, 16 nt, Homo sapiens
aaccucugccuuccag

SEQ ID NO: 1812852 - RNA, 14 nt, Homo sapiens
uggcuccaaacccu

SEQ ID NO: 1812853 - RNA, 15 nt, Homo sapiens
ucauucugauccuca

SEQ ID NO: 1812854 - RNA, 15 nt, Homo sapiens
gccaauucaucucag

SEQ ID NO: 1812855 - RNA, 23 nt, Homo sapiens
uaaaacaguguuuccagugacac

SEQ ID NO: 1812856 - RNA, 18 nt, Homo sapiens
caguaaaucagugcagua

SEQ ID NO: 1812857 - RNA, 14 nt, Homo sapiens
cugaugaaucuugc

SEQ ID NO: 1812858 - RNA, 19 nt, Homo sapiens
agaggaaaaguaaccauca

SEQ ID NO: 1812859 - RNA, 12 nt, Homo sapiens
agaauggccaaa

SEQ ID NO: 1812860 - RNA, 20 nt, Homo sapiens
cuugaagggggauaugaaug

SEQ ID NO: 1812861 - RNA, 16 nt, Homo sapiens
uuaauuguguauuuaa

SEQ ID NO: 1812862 - RNA, 12 nt, Homo sapiens
guguaacauauu

SEQ ID NO: 1812863 - RNA, 22 nt, Homo sapiens
cccauuugugaagcuuacucaa

SEQ ID NO: 1812864 - RNA, 16 nt, Homo sapiens
aggacugaacuccauc

SEQ ID NO: 1812865 - RNA, 13 nt, Homo sapiens
aaagcugccauuu

SEQ ID NO: 1812866 - RNA, 17 nt, Homo sapiens
auguucugguaugcauu

SEQ ID NO: 1812867 - RNA, 13 nt, Homo sapiens
ugcagaacugcca

SEQ ID NO: 1812868 - RNA, 24 nt, Homo sapiens
acuaaaugcucauacacaguuaaa

SEQ ID NO: 1812869 - RNA, 13 nt, Homo sapiens
cagcuucgucuca

SEQ ID NO: 1812870 - RNA, 21 nt, Homo sapiens
uuauuuuuuuaccaauuccaa

SEQ ID NO: 1812871 - RNA, 20 nt, Homo sapiens
agugacagcucugccuguua

SEQ ID NO: 1812872 - RNA, 21 nt, Homo sapiens
uguagucuuaacuucucccca

SEQ ID NO: 1812873 - RNA, 15 nt, Homo sapiens
agccugcaccuggug

SEQ ID NO: 1812874 - RNA, 21 nt, Homo sapiens
ucucuggcugucugucugcag

SEQ ID NO: 1812875 - RNA, 16 nt, Homo sapiens
cauguaccacauaaca

SEQ ID NO: 1812876 - RNA, 21 nt, Homo sapiens
uuccuuuguagcuacuuuugc

SEQ ID NO: 1812877 - RNA, 18 nt, Homo sapiens
uuucaggaagacugacag

SEQ ID NO: 1812878 - RNA, 18 nt, Homo sapiens
gccacagaaggugaacuu

SEQ ID NO: 1812879 - RNA, 18 nt, Homo sapiens
gaggcgcguuugugcaua

SEQ ID NO: 1812880 - RNA, 23 nt, Homo sapiens
acaguugaguuucuucuaaagag

SEQ ID NO: 1812881 - RNA, 14 nt, Homo sapiens
ugaaaacaagccau

SEQ ID NO: 1812882 - RNA, 20 nt, Homo sapiens
cuggaagcauccugugcugu

SEQ ID NO: 1812883 - RNA, 16 nt, Homo sapiens
cagugcccauuccuca

SEQ ID NO: 1812884 - RNA, 18 nt, Homo sapiens
ugccccuuccacuuugag

SEQ ID NO: 1812885 - RNA, 19 nt, Homo sapiens
gaaaucuuucaaguugcau

SEQ ID NO: 1812886 - RNA, 19 nt, Homo sapiens
augugacucaagacuucca

SEQ ID NO: 1812887 - RNA, 18 nt, Homo sapiens
gagaaggguugauccugc

SEQ ID NO: 1812888 - RNA, 17 nt, Homo sapiens
uuuugcaaaacauaucu

SEQ ID NO: 1812889 - RNA, 21 nt, Homo sapiens
gcccaggccggccagccucac

SEQ ID NO: 1812890 - RNA, 16 nt, Homo sapiens
uaaauaauuccaauag

SEQ ID NO: 1812891 - RNA, 17 nt, Homo sapiens
acccucuccuugucaca

SEQ ID NO: 1812892 - RNA, 16 nt, Homo sapiens
agugaccccuucccug

SEQ ID NO: 1812893 - RNA, 23 nt, Homo sapiens
caucuaagcugugguguguuccc

SEQ ID NO: 1812894 - RNA, 15 nt, Homo sapiens
aguuuaaaguugcac

SEQ ID NO: 1812895 - RNA, 21 nt, Homo sapiens
ccucuucccgggaucacuuaa

SEQ ID NO: 1812896 - RNA, 17 nt, Homo sapiens
aagcauugguuauucaa

SEQ ID NO: 1812897 - RNA, 13 nt, Homo sapiens
uuaauaauuugcu

SEQ ID NO: 1812898 - RNA, 22 nt, Homo sapiens
agacuauuuuucuaugacuuag

SEQ ID NO: 1812899 - RNA, 20 nt, Homo sapiens
uuagcauuuucugcaucucc

SEQ ID NO: 1812900 - RNA, 21 nt, Homo sapiens
agugugugauuucucucccac

SEQ ID NO: 1812901 - RNA, 15 nt, Homo sapiens
aucgauuugucuguc

SEQ ID NO: 1812902 - RNA, 20 nt, Homo sapiens
accucugggggauaagggag

SEQ ID NO: 1812903 - RNA, 15 nt, Homo sapiens
auaaacuuucucaaa

SEQ ID NO: 1812904 - RNA, 20 nt, Homo sapiens
caacaauacaggcuagggau

SEQ ID NO: 1812905 - RNA, 15 nt, Homo sapiens
uuuguaaaaugacaa

SEQ ID NO: 1812906 - RNA, 16 nt, Homo sapiens
aaccagguuugcaccu

SEQ ID NO: 1812907 - RNA, 23 nt, Homo sapiens
caguuuguauuuagcugccaaau

SEQ ID NO: 1812908 - RNA, 14 nt, Homo sapiens
gauacacugcagcu

SEQ ID NO: 1812909 - RNA, 18 nt, Homo sapiens
cuacaagaggccacuccc

SEQ ID NO: 1812910 - RNA, 15 nt, Homo sapiens
acucgugucuggcac

SEQ ID NO: 1812911 - RNA, 11 nt, Homo sapiens
gaacacagugc

SEQ ID NO: 1812912 - RNA, 20 nt, Homo sapiens
aacaccacuaauuguguaca

SEQ ID NO: 1812913 - RNA, 17 nt, Homo sapiens
gacuucacaaaaugcaa

SEQ ID NO: 1812914 - RNA, 17 nt, Homo sapiens
aagcacaccuacagagc

SEQ ID NO: 1812915 - RNA, 22 nt, Homo sapiens
ucuuggagccugcagagcugcg

SEQ ID NO: 1812916 - RNA, 21 nt, Homo sapiens
aucuacuacaaacuucaaaga

SEQ ID NO: 1812917 - RNA, 19 nt, Homo sapiens
aauguucuauaugcauuua

SEQ ID NO: 1812918 - RNA, 19 nt, Homo sapiens
cagauguuuacagacugug

SEQ ID NO: 1812919 - RNA, 23 nt, Homo sapiens
uacacugcucuccccacccagac

SEQ ID NO: 1812920 - RNA, 17 nt, Homo sapiens
augcaagucgccaggca

SEQ ID NO: 1812921 - RNA, 14 nt, Homo sapiens
ucuugguccuguca

SEQ ID NO: 1812922 - RNA, 18 nt, Homo sapiens
agaacauccuuaaauguc

SEQ ID NO: 1812923 - RNA, 19 nt, Homo sapiens
aggaacaguauuacagugu

SEQ ID NO: 1812924 - RNA, 23 nt, Homo sapiens
ggaacacggccacaucaaagagg

SEQ ID NO: 1812925 - RNA, 17 nt, Homo sapiens
caggacuuucccugaca

SEQ ID NO: 1812926 - RNA, 14 nt, Homo sapiens
uugacgcaccugug

SEQ ID NO: 1812927 - RNA, 14 nt, Homo sapiens
guacuauuacuauu

SEQ ID NO: 1812928 - RNA, 11 nt, Homo sapiens
gcgaagggaag

SEQ ID NO: 1812929 - RNA, 16 nt, Homo sapiens
cauggaaaacagagua

SEQ ID NO: 1812930 - RNA, 14 nt, Homo sapiens
uccuacuugcacuc

SEQ ID NO: 1812931 - RNA, 16 nt, Homo sapiens
caguucaagugcucuu

SEQ ID NO: 1812932 - RNA, 17 nt, Homo sapiens
gcccuucacccagagcc

SEQ ID NO: 1812933 - RNA, 19 nt, Homo sapiens
aaacuuggcucucaauaaa

SEQ ID NO: 1812934 - RNA, 18 nt, Homo sapiens
acgccaauguuaugccag

SEQ ID NO: 1812935 - RNA, 18 nt, Homo sapiens
acuuaaggggcugggaug

SEQ ID NO: 1812936 - RNA, 22 nt, Homo sapiens
uucgcacaaucuacacugccuu

SEQ ID NO: 1812937 - RNA, 17 nt, Homo sapiens
aagguacauggaacaca

SEQ ID NO: 1812938 - RNA, 16 nt, Homo sapiens
guccuccuuuucacuu

SEQ ID NO: 1812939 - RNA, 16 nt, Homo sapiens
guauucuuuaccucag

SEQ ID NO: 1812940 - RNA, 14 nt, Homo sapiens
aauaaaaucaugua

SEQ ID NO: 1812941 - RNA, 22 nt, Homo sapiens
auacaggaggcagacaaugacc

SEQ ID NO: 1812942 - RNA, 17 nt, Homo sapiens
uugaaaaaauagaucca

SEQ ID NO: 1812943 - RNA, 17 nt, Homo sapiens
caggguaaacuagcaau

SEQ ID NO: 1812944 - RNA, 14 nt, Homo sapiens
acagggagaaaauc

SEQ ID NO: 1812945 - RNA, 18 nt, Homo sapiens
uucuccccugauuggaau

SEQ ID NO: 1812946 - RNA, 18 nt, Homo sapiens
aaccgaggacccaugaaa

SEQ ID NO: 1812947 - RNA, 15 nt, Homo sapiens
aacaaacaugcagua

SEQ ID NO: 1812948 - RNA, 18 nt, Homo sapiens
uaaagcauauuggugcua

SEQ ID NO: 1812949 - RNA, 23 nt, Homo sapiens
ggcuccacauccaccccacugga

SEQ ID NO: 1812950 - RNA, 13 nt, Homo sapiens
guauauccaaaag

SEQ ID NO: 1812951 - RNA, 19 nt, Homo sapiens
agcucccuccauaccucga

SEQ ID NO: 1812952 - RNA, 19 nt, Homo sapiens
agugccagcccuggcagac

SEQ ID NO: 1812953 - RNA, 19 nt, Homo sapiens
aauaaaguuauuacucuga

SEQ ID NO: 1812954 - RNA, 16 nt, Homo sapiens
gaaguaauuugccuaa

SEQ ID NO: 1812955 - RNA, 14 nt, Homo sapiens
accuucacucucca

SEQ ID NO: 1812956 - RNA, 15 nt, Homo sapiens
cagaguggucccugc

SEQ ID NO: 1812957 - RNA, 22 nt, Homo sapiens
ucucuccaacucccucugggaa

SEQ ID NO: 1812958 - RNA, 12 nt, Homo sapiens
uuuaagccuuuu

SEQ ID NO: 1812959 - RNA, 15 nt, Homo sapiens
aacucaagacaaugc

SEQ ID NO: 1812960 - RNA, 16 nt, Homo sapiens
caaugacgugugccua

SEQ ID NO: 1812961 - RNA, 23 nt, Homo sapiens
ucccuccugugccccagcugcca

SEQ ID NO: 1812962 - RNA, 19 nt, Homo sapiens
ugcacuagagaaacuugaa

SEQ ID NO: 1812963 - RNA, 21 nt, Homo sapiens
aacucaaggaaaucuguguca

SEQ ID NO: 1812964 - RNA, 21 nt, Homo sapiens
ccugugcccucaccaccacac

SEQ ID NO: 1812965 - RNA, 13 nt, Homo sapiens
uugugaacugucu

SEQ ID NO: 1812966 - RNA, 23 nt, Homo sapiens
ccacagagaaguuuguagccagg

SEQ ID NO: 1812967 - RNA, 19 nt, Homo sapiens
aguugaacacuagucugug

SEQ ID NO: 1812968 - RNA, 17 nt, Homo sapiens
cuaauuuuuuguuguuu

SEQ ID NO: 1812969 - RNA, 17 nt, Homo sapiens
ccagagucaaauuugaa

SEQ ID NO: 1812970 - RNA, 19 nt, Homo sapiens
cagaauguagcaucugaga

SEQ ID NO: 1812971 - RNA, 19 nt, Homo sapiens
cuggcucugucacuaaaug

SEQ ID NO: 1812972 - RNA, 15 nt, Homo sapiens
ugggauuaacauaaa

SEQ ID NO: 1812973 - RNA, 13 nt, Homo sapiens
auguaaaauaaga

SEQ ID NO: 1812974 - RNA, 20 nt, Homo sapiens
uuggcugauuggaaaauaau

SEQ ID NO: 1812975 - RNA, 18 nt, Homo sapiens
acugcaaauauugucaua

SEQ ID NO: 1812976 - RNA, 16 nt, Homo sapiens
gauugaauuucacugu

SEQ ID NO: 1812977 - RNA, 23 nt, Homo sapiens
aguggagggggcaagcuuugcuc

SEQ ID NO: 1812978 - RNA, 22 nt, Homo sapiens
cuagucccuguguucugcacau

SEQ ID NO: 1812979 - RNA, 15 nt, Homo sapiens
cugcucaaccucacc

SEQ ID NO: 1812980 - RNA, 15 nt, Homo sapiens
ucagccccucuugcc

SEQ ID NO: 1812981 - RNA, 16 nt, Homo sapiens
aguucaugucgcaaca

SEQ ID NO: 1812982 - RNA, 19 nt, Homo sapiens
aacauguaauuaaguacua

SEQ ID NO: 1812983 - RNA, 15 nt, Homo sapiens
cuuguuaagugcagu

SEQ ID NO: 1812984 - RNA, 23 nt, Homo sapiens
uuagagcacagcuucuucugccc

SEQ ID NO: 1812985 - RNA, 14 nt, Homo sapiens
uguugagauccagu

SEQ ID NO: 1812986 - RNA, 22 nt, Homo sapiens
aucuuucacacuuccaccagcc

SEQ ID NO: 1812987 - RNA, 22 nt, Homo sapiens
aacuuggcugcauuugccuguc

SEQ ID NO: 1812988 - RNA, 21 nt, Homo sapiens
ugccacguggucacugugcac

SEQ ID NO: 1812989 - RNA, 16 nt, Homo sapiens
augucaucaugcuuau

SEQ ID NO: 1812990 - RNA, 19 nt, Homo sapiens
accacuuccuuaacagcug

SEQ ID NO: 1812991 - RNA, 20 nt, Homo sapiens
ucaguccuaccuuugcugau

SEQ ID NO: 1812992 - RNA, 12 nt, Homo sapiens
ucuuuaauacuu

SEQ ID NO: 1812993 - RNA, 14 nt, Homo sapiens
uuggacuugcugaa

SEQ ID NO: 1812994 - RNA, 23 nt, Homo sapiens
uacagcuuuuaagauuguacuuu

SEQ ID NO: 1812995 - RNA, 14 nt, Homo sapiens
aaagauacacugac

SEQ ID NO: 1812996 - RNA, 16 nt, Homo sapiens
uaaaacaaaauuugac

SEQ ID NO: 1812997 - RNA, 17 nt, Homo sapiens
aagucaagcacauguaa

SEQ ID NO: 1812998 - RNA, 15 nt, Homo sapiens
auagauuaaaucaua

SEQ ID NO: 1812999 - RNA, 13 nt, Homo sapiens
accaccucaccag

SEQ ID NO: 1813000 - RNA, 17 nt, Homo sapiens
aguuugauaccugcacu

SEQ ID NO: 1813001 - RNA, 13 nt, Homo sapiens
auggccucauggg

SEQ ID NO: 1813002 - RNA, 16 nt, Homo sapiens
agcaaaaaugacaaca

SEQ ID NO: 1813003 - RNA, 16 nt, Homo sapiens
ccaaaacuuuaaugaa

SEQ ID NO: 1813004 - RNA, 21 nt, Homo sapiens
aagacuguuauuucaccauuu

SEQ ID NO: 1813005 - RNA, 16 nt, Homo sapiens
cugccagcauuucccu

SEQ ID NO: 1813006 - RNA, 17 nt, Homo sapiens
ugaauucugggaaucca

SEQ ID NO: 1813007 - RNA, 14 nt, Homo sapiens
uugguccuaagucc

SEQ ID NO: 1813008 - RNA, 17 nt, Homo sapiens
uugaccaagaacugcau

SEQ ID NO: 1813009 - RNA, 22 nt, Homo sapiens
cacugaccagcggcugcucaag

SEQ ID NO: 1813010 - RNA, 23 nt, Homo sapiens
agccagcagggcgggccaggaga

SEQ ID NO: 1813011 - RNA, 14 nt, Homo sapiens
ggaccggggacccu

SEQ ID NO: 1813012 - RNA, 14 nt, Homo sapiens
acaacuucagcagg

SEQ ID NO: 1813013 - RNA, 19 nt, Homo sapiens
auucaucccuuuucaaaag

SEQ ID NO: 1813014 - RNA, 13 nt, Homo sapiens
caaugaaaccuuc

SEQ ID NO: 1813015 - RNA, 20 nt, Homo sapiens
cagcugccucugccacugac

SEQ ID NO: 1813016 - RNA, 14 nt, Homo sapiens
agaaguucucagaa

SEQ ID NO: 1813017 - RNA, 13 nt, Homo sapiens
gaacagacaauca

SEQ ID NO: 1813018 - RNA, 21 nt, Homo sapiens
agucugggauguagaacuuca

SEQ ID NO: 1813019 - RNA, 22 nt, Homo sapiens
uccuguguaccucacuguccaa

SEQ ID NO: 1813020 - RNA, 23 nt, Homo sapiens
ggagaagcugcaggcuuugccau

SEQ ID NO: 1813021 - RNA, 18 nt, Homo sapiens
ccugaacccguccauuca

SEQ ID NO: 1813022 - RNA, 13 nt, Homo sapiens
ucucauuaaaauc

SEQ ID NO: 1813023 - RNA, 16 nt, Homo sapiens
ucagcucuggccacaa

SEQ ID NO: 1813024 - RNA, 18 nt, Homo sapiens
uguggcuucccaugucuu

SEQ ID NO: 1813025 - RNA, 22 nt, Homo sapiens
cuggaugacauuaaagaagggu

SEQ ID NO: 1813026 - RNA, 14 nt, Homo sapiens
uccccaauuauccu

SEQ ID NO: 1813027 - RNA, 23 nt, Homo sapiens
uauugaagguuuuagacccauag

SEQ ID NO: 1813028 - RNA, 20 nt, Homo sapiens
agcaugagccagcucugucc

SEQ ID NO: 1813029 - RNA, 22 nt, Homo sapiens
gcucaacagaacauauguugca

SEQ ID NO: 1813030 - RNA, 14 nt, Homo sapiens
ucucagaagguauu

SEQ ID NO: 1813031 - RNA, 17 nt, Homo sapiens
agcucaacuguugccag

SEQ ID NO: 1813032 - RNA, 16 nt, Homo sapiens
gcgugugagugaggga

SEQ ID NO: 1813033 - RNA, 16 nt, Homo sapiens
ugaaauugcuuugcug

SEQ ID NO: 1813034 - RNA, 15 nt, Homo sapiens
uaaaugucuuuucaa

SEQ ID NO: 1813035 - RNA, 12 nt, Homo sapiens
acauuccuggcc

SEQ ID NO: 1813036 - RNA, 18 nt, Homo sapiens
auaaccucucugugccau

SEQ ID NO: 1813037 - RNA, 15 nt, Homo sapiens
uaaguuuccuuccag

SEQ ID NO: 1813038 - RNA, 22 nt, Homo sapiens
gaaagagcagucagaguccagu

SEQ ID NO: 1813039 - RNA, 21 nt, Homo sapiens
aucaaccaggaagaguucuau

SEQ ID NO: 1813040 - RNA, 16 nt, Homo sapiens
ggagaaaauucaauug

SEQ ID NO: 1813041 - RNA, 14 nt, Homo sapiens
caggaaauuucuua

SEQ ID NO: 1813042 - RNA, 14 nt, Homo sapiens
cuuggcggguggga

SEQ ID NO: 1813043 - RNA, 21 nt, Homo sapiens
aggagcccccaacacaggcaa

SEQ ID NO: 1813044 - RNA, 17 nt, Homo sapiens
cagcacuaauucaacau

SEQ ID NO: 1813045 - RNA, 12 nt, Homo sapiens
uagacugauuac

SEQ ID NO: 1813046 - RNA, 17 nt, Homo sapiens
uaaugauaaaauagcca

SEQ ID NO: 1813047 - RNA, 16 nt, Homo sapiens
ccuccuagagugcagg

SEQ ID NO: 1813048 - RNA, 20 nt, Homo sapiens
aagcagacuuuucagaagau

SEQ ID NO: 1813049 - RNA, 16 nt, Homo sapiens
acccuaaagugcaaaa

SEQ ID NO: 1813050 - RNA, 14 nt, Homo sapiens
gggacagcccacug

SEQ ID NO: 1813051 - RNA, 19 nt, Homo sapiens
aacuugucucuucaucuaa

SEQ ID NO: 1813052 - RNA, 21 nt, Homo sapiens
gaagugucacagccauaguca

SEQ ID NO: 1813053 - RNA, 20 nt, Homo sapiens
caacuccugguucagccauu

SEQ ID NO: 1813054 - RNA, 21 nt, Homo sapiens
ccuuuguauuauaaaagcuca

SEQ ID NO: 1813055 - RNA, 16 nt, Homo sapiens
aaucugccugcaacuu

SEQ ID NO: 1813056 - RNA, 18 nt, Homo sapiens
ugugagccuugcugccaa

SEQ ID NO: 1813057 - RNA, 20 nt, Homo sapiens
gaaguuccauuuaagggcaa

SEQ ID NO: 1813058 - RNA, 12 nt, Homo sapiens
uugaucagugac

SEQ ID NO: 1813059 - RNA, 17 nt, Homo sapiens
gggaggcgggggcugcc

SEQ ID NO: 1813060 - RNA, 21 nt, Homo sapiens
augggcagcccaacagcacuu

SEQ ID NO: 1813061 - RNA, 22 nt, Homo sapiens
uuguagagauggggucucacag

SEQ ID NO: 1813062 - RNA, 17 nt, Homo sapiens
agauguccaaacuaauu

SEQ ID NO: 1813063 - RNA, 22 nt, Homo sapiens
ugugaauaaaaacccuguaugg

SEQ ID NO: 1813064 - RNA, 18 nt, Homo sapiens
auccccacccagucucau

SEQ ID NO: 1813065 - RNA, 16 nt, Homo sapiens
ccaaaucaaaugcuca

SEQ ID NO: 1813066 - RNA, 14 nt, Homo sapiens
agaagauucuuacc

SEQ ID NO: 1813067 - RNA, 12 nt, Homo sapiens
ugccacugcacu

SEQ ID NO: 1813068 - RNA, 17 nt, Homo sapiens
gacaggccacaccacag

SEQ ID NO: 1813069 - RNA, 17 nt, Homo sapiens
uuuacuuuauugcccua

SEQ ID NO: 1813070 - RNA, 22 nt, Homo sapiens
ccuagaccugggccaaaagggc

SEQ ID NO: 1813071 - RNA, 16 nt, Homo sapiens
uguuucaaauggacug

SEQ ID NO: 1813072 - RNA, 18 nt, Homo sapiens
auuuuaacauuuuccaaa

SEQ ID NO: 1813073 - RNA, 19 nt, Homo sapiens
cacgugaaggcaaugcuca

SEQ ID NO: 1813074 - RNA, 23 nt, Homo sapiens
cacauccugggauccaguguaua

SEQ ID NO: 1813075 - RNA, 20 nt, Homo sapiens
cuuugcugaaugucauuuua

SEQ ID NO: 1813076 - RNA, 20 nt, Homo sapiens
cuaaacccgcaccccagugc

SEQ ID NO: 1813077 - RNA, 18 nt, Homo sapiens
cgauuaaaaucacucuca

SEQ ID NO: 1813078 - RNA, 14 nt, Homo sapiens
ucuugauaaauaua

SEQ ID NO: 1813079 - RNA, 17 nt, Homo sapiens
acugccuucaccuucac

SEQ ID NO: 1813080 - RNA, 19 nt, Homo sapiens
gagaaguucaggaagguac

SEQ ID NO: 1813081 - RNA, 17 nt, Homo sapiens
agucuuguggauggaaa

SEQ ID NO: 1813082 - RNA, 14 nt, Homo sapiens
augagcuaucuacu

SEQ ID NO: 1813083 - RNA, 19 nt, Homo sapiens
cuauuuuuuuuuguuguuu

SEQ ID NO: 1813084 - RNA, 16 nt, Homo sapiens
cauuugggcacuguag

SEQ ID NO: 1813085 - RNA, 15 nt, Homo sapiens
aggcucacaacuguu

SEQ ID NO: 1813086 - RNA, 11 nt, Homo sapiens
gauuugcucag

SEQ ID NO: 1813087 - RNA, 14 nt, Homo sapiens
aauaccacuuaccu

SEQ ID NO: 1813088 - RNA, 14 nt, Homo sapiens
aaaaccacuuuccu

SEQ ID NO: 1813089 - RNA, 13 nt, Homo sapiens
aaaauacacuaau

SEQ ID NO: 1813090 - RNA, 13 nt, Homo sapiens
aagguacacuggu

SEQ ID NO: 1813091 - RNA, 23 nt, Homo sapiens
ugccauggaggcaugccaaaugu

SEQ ID NO: 1813092 - RNA, 17 nt, Homo sapiens
aagggcccuuucaucuu

SEQ ID NO: 1813093 - RNA, 22 nt, Homo sapiens
ccugccauucugcaugagcuga

SEQ ID NO: 1813094 - RNA, 18 nt, Homo sapiens
gaccacaucuguccucac

SEQ ID NO: 1813095 - RNA, 22 nt, Homo sapiens
aaagagccucacaguuacguga

SEQ ID NO: 1813096 - RNA, 20 nt, Homo sapiens
acccggcugcagaggccaga

SEQ ID NO: 1813097 - RNA, 13 nt, Homo sapiens
ucccagugaucac

SEQ ID NO: 1813098 - RNA, 22 nt, Homo sapiens
uucauucugcauugcuagauaa

SEQ ID NO: 1813099 - RNA, 22 nt, Homo sapiens
cucuugacguggcacuuaccca

SEQ ID NO: 1813100 - RNA, 12 nt, Homo sapiens
aaacucaccauu

SEQ ID NO: 1813101 - RNA, 23 nt, Homo sapiens
acuaggccugaaaugacauuuca

SEQ ID NO: 1813102 - RNA, 21 nt, Homo sapiens
aaaaaugagcauacaucuuaa

SEQ ID NO: 1813103 - RNA, 12 nt, Homo sapiens
ucuaauacaaaa

SEQ ID NO: 1813104 - RNA, 14 nt, Homo sapiens
ugaagauuagcuuu

SEQ ID NO: 1813105 - RNA, 19 nt, Homo sapiens
caggaguagcugagcucac

SEQ ID NO: 1813106 - RNA, 20 nt, Homo sapiens
aagcacuagaucucccuuaa

SEQ ID NO: 1813107 - RNA, 17 nt, Homo sapiens
acccagaccccaggcug

SEQ ID NO: 1813108 - RNA, 16 nt, Homo sapiens
cauggcucucuauucc

SEQ ID NO: 1813109 - RNA, 17 nt, Homo sapiens
auaagccacucuguccc

SEQ ID NO: 1813110 - RNA, 22 nt, Homo sapiens
uuguacauaguaggcacuaaau

SEQ ID NO: 1813111 - RNA, 15 nt, Homo sapiens
gaccaaauugggaga

SEQ ID NO: 1813112 - RNA, 17 nt, Homo sapiens
gccccucugcccagcuu

SEQ ID NO: 1813113 - RNA, 11 nt, Homo sapiens
agaaacaaagg

SEQ ID NO: 1813114 - RNA, 11 nt, Homo sapiens
auaaacaaaug

SEQ ID NO: 1813115 - RNA, 13 nt, Homo sapiens
ugcuccaccuuca

SEQ ID NO: 1813116 - RNA, 22 nt, Homo sapiens
ccuaggguugcuugggccacug

SEQ ID NO: 1813117 - RNA, 22 nt, Homo sapiens
agcugucguacauugagcaaau

SEQ ID NO: 1813118 - RNA, 17 nt, Homo sapiens
acaucauaauuacauuc

SEQ ID NO: 1813119 - RNA, 13 nt, Homo sapiens
cuuucugcacuua

SEQ ID NO: 1813120 - RNA, 12 nt, Homo sapiens
ugugugugcaua

SEQ ID NO: 1813121 - RNA, 18 nt, Homo sapiens
accucuugggcaugcuca

SEQ ID NO: 1813122 - RNA, 20 nt, Homo sapiens
aacaggguggcccagguggc

SEQ ID NO: 1813123 - RNA, 13 nt, Homo sapiens
auguaaacuacuu

SEQ ID NO: 1813124 - RNA, 15 nt, Homo sapiens
ucgauuucuaccuca

SEQ ID NO: 1813125 - RNA, 18 nt, Homo sapiens
cugaguccaacaauguug

SEQ ID NO: 1813126 - RNA, 21 nt, Homo sapiens
ugaaagggaucaucaugcagc

SEQ ID NO: 1813127 - RNA, 20 nt, Homo sapiens
cagguucuaauguguggaau

SEQ ID NO: 1813128 - RNA, 23 nt, Homo sapiens
cacuuugaagcaaauacaauuca

SEQ ID NO: 1813129 - RNA, 19 nt, Homo sapiens
uuauuuucuccaugucugu

SEQ ID NO: 1813130 - RNA, 14 nt, Homo sapiens
aauucagcaccagu

SEQ ID NO: 1813131 - RNA, 17 nt, Homo sapiens
uuuguccccacuuacag

SEQ ID NO: 1813132 - RNA, 18 nt, Homo sapiens
aacucagcugaucugauu

SEQ ID NO: 1813133 - RNA, 18 nt, Homo sapiens
agcccugcuuaccagaua

SEQ ID NO: 1813134 - RNA, 17 nt, Homo sapiens
uaucuuggacaaaucac

SEQ ID NO: 1813135 - RNA, 19 nt, Homo sapiens
uguccuccaccugccuucc

SEQ ID NO: 1813136 - RNA, 17 nt, Homo sapiens
uuuccuugccuuguuga

SEQ ID NO: 1813137 - RNA, 15 nt, Homo sapiens
caaaggguacuucca

SEQ ID NO: 1813138 - RNA, 22 nt, Homo sapiens
auugguucccccugaccacuuu

SEQ ID NO: 1813139 - RNA, 14 nt, Homo sapiens
uguguuucuuacag

SEQ ID NO: 1813140 - RNA, 13 nt, Homo sapiens
uucuuuuugccaa

SEQ ID NO: 1813141 - RNA, 22 nt, Homo sapiens
uuagacaugacugaugacauau

SEQ ID NO: 1813142 - RNA, 19 nt, Homo sapiens
gucacacagagugccugcc

SEQ ID NO: 1813143 - RNA, 24 nt, Homo sapiens
ggcucugcgucccacugagucuca

SEQ ID NO: 1813144 - RNA, 14 nt, Homo sapiens
uguggagaaggaua

SEQ ID NO: 1813145 - RNA, 23 nt, Homo sapiens
guccaagguauugagacauauua

SEQ ID NO: 1813146 - RNA, 17 nt, Homo sapiens
aagaugauuucaguuca

SEQ ID NO: 1813147 - RNA, 16 nt, Homo sapiens
gaaugggcagcucauc

SEQ ID NO: 1813148 - RNA, 19 nt, Homo sapiens
caucaaaaaaggcaguuac

SEQ ID NO: 1813149 - RNA, 14 nt, Homo sapiens
uucaccaagagcca

SEQ ID NO: 1813150 - RNA, 16 nt, Homo sapiens
aacagcaguggaguaa

SEQ ID NO: 1813151 - RNA, 20 nt, Homo sapiens
uucaaugaaucaaauccaau

SEQ ID NO: 1813152 - RNA, 20 nt, Homo sapiens
cucuguuaugcaagcacaaa

SEQ ID NO: 1813153 - RNA, 19 nt, Homo sapiens
cuucauccuuagcaacagc

SEQ ID NO: 1813154 - RNA, 15 nt, Homo sapiens
cuggccugacuccca

SEQ ID NO: 1813155 - RNA, 21 nt, Homo sapiens
cuaggacuccaaccucaggga

SEQ ID NO: 1813156 - RNA, 15 nt, Homo sapiens
augagggaagaauaa

SEQ ID NO: 1813157 - RNA, 17 nt, Homo sapiens
ugggggaaucaaaucaa

SEQ ID NO: 1813158 - RNA, 20 nt, Homo sapiens
agcuuggggaagacccauuc

SEQ ID NO: 1813159 - RNA, 18 nt, Homo sapiens
uugcugcuuaugagcaca

SEQ ID NO: 1813160 - RNA, 14 nt, Homo sapiens
caggacuugcacac

SEQ ID NO: 1813161 - RNA, 23 nt, Homo sapiens
uuaaacuuuucauuacacuaaag

SEQ ID NO: 1813162 - RNA, 13 nt, Homo sapiens
aaaguucauucaa

SEQ ID NO: 1813163 - RNA, 21 nt, Homo sapiens
cugugguguucccuuggcaaa

SEQ ID NO: 1813164 - RNA, 18 nt, Homo sapiens
aaauuuccuccacauuca

SEQ ID NO: 1813165 - RNA, 13 nt, Homo sapiens
cuagagggacaaa

SEQ ID NO: 1813166 - RNA, 11 nt, Homo sapiens
cugcucaggag

SEQ ID NO: 1813167 - RNA, 11 nt, Homo sapiens
cuccucaggac

SEQ ID NO: 1813168 - RNA, 23 nt, Homo sapiens
auuaagagaacaaagagugaaau

SEQ ID NO: 1813169 - RNA, 16 nt, Homo sapiens
aucuacucuggaccaa

SEQ ID NO: 1813170 - RNA, 18 nt, Homo sapiens
cuguuucucucacugggc

SEQ ID NO: 1813171 - RNA, 14 nt, Homo sapiens
uccaguacaguauu

SEQ ID NO: 1813172 - RNA, 19 nt, Homo sapiens
gaaaacacccuuaugaauu

SEQ ID NO: 1813173 - RNA, 19 nt, Homo sapiens
cucuauuuguucagaucuc

SEQ ID NO: 1813174 - RNA, 18 nt, Homo sapiens
uggccaguccacccugcc

SEQ ID NO: 1813175 - RNA, 12 nt, Homo sapiens
acauacaaauca

SEQ ID NO: 1813176 - RNA, 13 nt, Homo sapiens
cucuguaacuuac

SEQ ID NO: 1813177 - RNA, 22 nt, Homo sapiens
ugagaucucccgagaguuucca

SEQ ID NO: 1813178 - RNA, 14 nt, Homo sapiens
caauauccuaauaa

SEQ ID NO: 1813179 - RNA, 13 nt, Homo sapiens
cugaauagaaaca

SEQ ID NO: 1813180 - RNA, 23 nt, Homo sapiens
gauaucaggaaauaucugugaag

SEQ ID NO: 1813181 - RNA, 23 nt, Homo sapiens
caagcacuaccaggcuguggguc

SEQ ID NO: 1813182 - RNA, 22 nt, Homo sapiens
aaggccaagaggcuguucccac

SEQ ID NO: 1813183 - RNA, 20 nt, Homo sapiens
gaaucuuccaucugcaucuu

SEQ ID NO: 1813184 - RNA, 19 nt, Homo sapiens
ggagaaggaaggcuccauc

SEQ ID NO: 1813185 - RNA, 14 nt, Homo sapiens
caaauccauguguc

SEQ ID NO: 1813186 - RNA, 14 nt, Homo sapiens
cccucaucuuugac

SEQ ID NO: 1813187 - RNA, 15 nt, Homo sapiens
gcagaggcaggaaac

SEQ ID NO: 1813188 - RNA, 20 nt, Homo sapiens
ugagcagggagaccaugccu

SEQ ID NO: 1813189 - RNA, 16 nt, Homo sapiens
aguccccagacucagc

SEQ ID NO: 1813190 - RNA, 18 nt, Homo sapiens
caugcuccgccuguaaaa

SEQ ID NO: 1813191 - RNA, 20 nt, Homo sapiens
cuaugaguugucaagacuga

SEQ ID NO: 1813192 - RNA, 23 nt, Homo sapiens
agagucuccuuacucauuaauuc

SEQ ID NO: 1813193 - RNA, 14 nt, Homo sapiens
caauuaauuaucuu

SEQ ID NO: 1813194 - RNA, 22 nt, Homo sapiens
acuuuccccgugggccauggca

SEQ ID NO: 1813195 - RNA, 16 nt, Homo sapiens
cuuguaaacauugccu

SEQ ID NO: 1813196 - RNA, 13 nt, Homo sapiens
gugugccauguca

SEQ ID NO: 1813197 - RNA, 16 nt, Homo sapiens
aagggagguggcaaga

SEQ ID NO: 1813198 - RNA, 13 nt, Homo sapiens
uuaccccagcucc

SEQ ID NO: 1813199 - RNA, 15 nt, Homo sapiens
ucucuugucaaguca

SEQ ID NO: 1813200 - RNA, 14 nt, Homo sapiens
ccaguuuuucacau

SEQ ID NO: 1813201 - RNA, 15 nt, Homo sapiens
cuucacugaacaugc

SEQ ID NO: 1813202 - RNA, 17 nt, Homo sapiens
uuuccaguccccagaag

SEQ ID NO: 1813203 - RNA, 16 nt, Homo sapiens
cacuaaccacgcugga

SEQ ID NO: 1813204 - RNA, 14 nt, Homo sapiens
uacuguaguaauua

SEQ ID NO: 1813205 - RNA, 22 nt, Homo sapiens
ccuaagaauguuuugcacugac

SEQ ID NO: 1813206 - RNA, 19 nt, Homo sapiens
guccaaggcaggaggccau

SEQ ID NO: 1813207 - RNA, 12 nt, Homo sapiens
guagacuguggc

SEQ ID NO: 1813208 - RNA, 19 nt, Homo sapiens
uuguuuuuuugcagaauua

SEQ ID NO: 1813209 - RNA, 12 nt, Homo sapiens
uagaaucuggag

SEQ ID NO: 1813210 - RNA, 21 nt, Homo sapiens
ugaaaggauaugaaucugaga

SEQ ID NO: 1813211 - RNA, 21 nt, Homo sapiens
agcuauuuuuauacacuguaa

SEQ ID NO: 1813212 - RNA, 23 nt, Homo sapiens
aaauuuugaaccauucccuaguc

SEQ ID NO: 1813213 - RNA, 14 nt, Homo sapiens
cuugcaagucccau

SEQ ID NO: 1813214 - RNA, 12 nt, Homo sapiens
uauguguugcac

SEQ ID NO: 1813215 - RNA, 16 nt, Homo sapiens
aacuccaggcugggcu

SEQ ID NO: 1813216 - RNA, 23 nt, Homo sapiens
uuuauaaagggagauaacaaucu

SEQ ID NO: 1813217 - RNA, 14 nt, Homo sapiens
uaucaguuacacau

SEQ ID NO: 1813218 - RNA, 22 nt, Homo sapiens
cucagauuggaauguuacaucu

SEQ ID NO: 1813219 - RNA, 16 nt, Homo sapiens
auaagucuugguaaca

SEQ ID NO: 1813220 - RNA, 12 nt, Homo sapiens
cugagacuuuca

SEQ ID NO: 1813221 - RNA, 23 nt, Homo sapiens
gaggaagaagauguccgugagaa

SEQ ID NO: 1813222 - RNA, 18 nt, Homo sapiens
cagggauuuuuauuugua

SEQ ID NO: 1813223 - RNA, 13 nt, Homo sapiens
auacagcauuucu

SEQ ID NO: 1813224 - RNA, 12 nt, Homo sapiens
cuugaacuaaca

SEQ ID NO: 1813225 - RNA, 18 nt, Homo sapiens
ucuccugauggaagugua

SEQ ID NO: 1813226 - RNA, 21 nt, Homo sapiens
ggggcugugagaggaucaucu

SEQ ID NO: 1813227 - RNA, 16 nt, Homo sapiens
ggaccuggcaguggug

SEQ ID NO: 1813228 - RNA, 17 nt, Homo sapiens
guuuuaguucuguagaa

SEQ ID NO: 1813229 - RNA, 21 nt, Homo sapiens
ggcacuguaguucuaagacuc

SEQ ID NO: 1813230 - RNA, 21 nt, Homo sapiens
ucaugaauugcgccucagauu

SEQ ID NO: 1813231 - RNA, 14 nt, Homo sapiens
aauaguuuacaugu

SEQ ID NO: 1813232 - RNA, 15 nt, Homo sapiens
uaaaauuagcuugag

SEQ ID NO: 1813233 - RNA, 13 nt, Homo sapiens
uuaauugugcaaa

SEQ ID NO: 1813234 - RNA, 21 nt, Homo sapiens
aauggcauggagacucugaga

SEQ ID NO: 1813235 - RNA, 13 nt, Homo sapiens
caguggcgccauc

SEQ ID NO: 1813236 - RNA, 22 nt, Homo sapiens
ucacucaaucucugauucuguc

SEQ ID NO: 1813237 - RNA, 12 nt, Homo sapiens
ggugucugugac

SEQ ID NO: 1813238 - RNA, 14 nt, Homo sapiens
caucuuggagcuuu

SEQ ID NO: 1813239 - RNA, 13 nt, Homo sapiens
auaguaucuuuaa

SEQ ID NO: 1813240 - RNA, 21 nt, Homo sapiens
cagaaacccaguaacuugcaa

SEQ ID NO: 1813241 - RNA, 20 nt, Homo sapiens
aaauugcaucagugaucaua

SEQ ID NO: 1813242 - RNA, 16 nt, Homo sapiens
ccuuguaaacaugaag

SEQ ID NO: 1813243 - RNA, 17 nt, Homo sapiens
aagguggucaucugcca

SEQ ID NO: 1813244 - RNA, 21 nt, Homo sapiens
aauguuagugauccaccugcc

SEQ ID NO: 1813245 - RNA, 20 nt, Homo sapiens
ugcuucagauguggagccag

SEQ ID NO: 1813246 - RNA, 23 nt, Homo sapiens
agccaccacaucccuucauauca

SEQ ID NO: 1813247 - RNA, 15 nt, Homo sapiens
agaaaauuaguaauu

SEQ ID NO: 1813248 - RNA, 22 nt, Homo sapiens
cuaagccuuugccgugagcaug

SEQ ID NO: 1813249 - RNA, 20 nt, Homo sapiens
auugucccuguguuguccca

SEQ ID NO: 1813250 - RNA, 21 nt, Homo sapiens
aggcagcugugucugagccca

SEQ ID NO: 1813251 - RNA, 23 nt, Homo sapiens
ugcggagcuuuccaccucgccug

SEQ ID NO: 1813252 - RNA, 16 nt, Homo sapiens
ugcugaaacagaauac

SEQ ID NO: 1813253 - RNA, 15 nt, Homo sapiens
gggcacuuucauccu

SEQ ID NO: 1813254 - RNA, 19 nt, Homo sapiens
ccaucuggaauuccagucu

SEQ ID NO: 1813255 - RNA, 21 nt, Homo sapiens
caguguucagccaaacaguau

SEQ ID NO: 1813256 - RNA, 22 nt, Homo sapiens
ccagcuuggugguuauguccca

SEQ ID NO: 1813257 - RNA, 14 nt, Homo sapiens
ugcacaaugcauug

SEQ ID NO: 1813258 - RNA, 20 nt, Homo sapiens
cccaugcccuggauccauca

SEQ ID NO: 1813259 - RNA, 16 nt, Homo sapiens
ugaacuggucuuccuu

SEQ ID NO: 1813260 - RNA, 19 nt, Homo sapiens
cuuuaauucucaugugauc

SEQ ID NO: 1813261 - RNA, 19 nt, Homo sapiens
uccuugauacuaaaaguuc

SEQ ID NO: 1813262 - RNA, 20 nt, Homo sapiens
aucugccccaguagucagaa

SEQ ID NO: 1813263 - RNA, 20 nt, Homo sapiens
cauagugugagaacuuccaa

SEQ ID NO: 1813264 - RNA, 13 nt, Homo sapiens
ucccuacauguau

SEQ ID NO: 1813265 - RNA, 14 nt, Homo sapiens
gcugauccaugaga

SEQ ID NO: 1813266 - RNA, 18 nt, Homo sapiens
aauagauuuaacccuuca

SEQ ID NO: 1813267 - RNA, 20 nt, Homo sapiens
gccuggugacaggcagacac

SEQ ID NO: 1813268 - RNA, 17 nt, Homo sapiens
gcugaauuaaugugauu

SEQ ID NO: 1813269 - RNA, 14 nt, Homo sapiens
agugugauugugaa

SEQ ID NO: 1813270 - RNA, 21 nt, Homo sapiens
ggcauguggccuuuaucucaa

SEQ ID NO: 1813271 - RNA, 21 nt, Homo sapiens
acugucuuaguacaccauaaa

SEQ ID NO: 1813272 - RNA, 23 nt, Homo sapiens
cuuuaguuagugauuauauuuca

SEQ ID NO: 1813273 - RNA, 13 nt, Homo sapiens
agcugacaucucc

SEQ ID NO: 1813274 - RNA, 23 nt, Homo sapiens
acaacaugcuagguagugaccua

SEQ ID NO: 1813275 - RNA, 15 nt, Homo sapiens
uacacaaggaaggca

SEQ ID NO: 1813276 - RNA, 15 nt, Homo sapiens
ccucugaucaguuuc

SEQ ID NO: 1813277 - RNA, 13 nt, Homo sapiens
aagguauugcacu

SEQ ID NO: 1813278 - RNA, 22 nt, Homo sapiens
ccccauccagccuccagggcau

SEQ ID NO: 1813279 - RNA, 14 nt, Homo sapiens
aguaaguguacaau

SEQ ID NO: 1813280 - RNA, 20 nt, Homo sapiens
ccacucuuaucuuacaacuc

SEQ ID NO: 1813281 - RNA, 21 nt, Homo sapiens
aaauucuguuagcugcucacu

SEQ ID NO: 1813282 - RNA, 21 nt, Homo sapiens
agacaguguuuugcacaucau

SEQ ID NO: 1813283 - RNA, 14 nt, Homo sapiens
aaaguucagugugc

SEQ ID NO: 1813284 - RNA, 20 nt, Homo sapiens
ccuuguuugccuuuaggcag

SEQ ID NO: 1813285 - RNA, 15 nt, Homo sapiens
gguccacaagcuucu

SEQ ID NO: 1813286 - RNA, 19 nt, Homo sapiens
ucacugcucggaaggggaa

SEQ ID NO: 1813287 - RNA, 22 nt, Homo sapiens
ucaagcgauucuucugccucag

SEQ ID NO: 1813288 - RNA, 21 nt, Homo sapiens
ugggugcaggaaagguucaca

SEQ ID NO: 1813289 - RNA, 18 nt, Homo sapiens
gaucugcuuucuguucau

SEQ ID NO: 1813290 - RNA, 16 nt, Homo sapiens
aauaaugaauacauuu

SEQ ID NO: 1813291 - RNA, 23 nt, Homo sapiens
uaaggaucuucccacuuugccac

SEQ ID NO: 1813292 - RNA, 17 nt, Homo sapiens
ccaggcacgguggcuga

SEQ ID NO: 1813293 - RNA, 19 nt, Homo sapiens
guuguaacuaggcucagag

SEQ ID NO: 1813294 - RNA, 20 nt, Homo sapiens
acauuuuuguggcuuaugac

SEQ ID NO: 1813295 - RNA, 15 nt, Homo sapiens
augcucagguacaga

SEQ ID NO: 1813296 - RNA, 19 nt, Homo sapiens
acccagccaugcugugaua

SEQ ID NO: 1813297 - RNA, 15 nt, Homo sapiens
ugcagaauguugauu

SEQ ID NO: 1813298 - RNA, 17 nt, Homo sapiens
gguuauaacaguguuua

SEQ ID NO: 1813299 - RNA, 20 nt, Homo sapiens
augaugcagcagauguugac

SEQ ID NO: 1813300 - RNA, 15 nt, Homo sapiens
uguucauacauauuu

SEQ ID NO: 1813301 - RNA, 13 nt, Homo sapiens
aguuaacaggaca

SEQ ID NO: 1813302 - RNA, 14 nt, Homo sapiens
cacaauaaccaaga

SEQ ID NO: 1813303 - RNA, 15 nt, Homo sapiens
cagcuccagggccag

SEQ ID NO: 1813304 - RNA, 12 nt, Homo sapiens
aauuuucacuuu

SEQ ID NO: 1813305 - RNA, 19 nt, Homo sapiens
cagagaaaucugcauucua

SEQ ID NO: 1813306 - RNA, 21 nt, Homo sapiens
guaaugauguugauaauuuca

SEQ ID NO: 1813307 - RNA, 14 nt, Homo sapiens
ugcccagugugagg

SEQ ID NO: 1813308 - RNA, 15 nt, Homo sapiens
uaccaccaugcacug

SEQ ID NO: 1813309 - RNA, 23 nt, Homo sapiens
aagauccuaccccaauuccuugu

SEQ ID NO: 1813310 - RNA, 11 nt, Homo sapiens
cuuuaucucag

SEQ ID NO: 1813311 - RNA, 16 nt, Homo sapiens
gaucaauagacuguac

SEQ ID NO: 1813312 - RNA, 19 nt, Homo sapiens
caaaauaggugcugauccu

SEQ ID NO: 1813313 - RNA, 14 nt, Homo sapiens
aggcacaaagggca

SEQ ID NO: 1813314 - RNA, 21 nt, Homo sapiens
uaauguauaauuugaggugaa

SEQ ID NO: 1813315 - RNA, 17 nt, Homo sapiens
cuacaacugauugcaac

SEQ ID NO: 1813316 - RNA, 15 nt, Homo sapiens
acagcugcccuagcu

SEQ ID NO: 1813317 - RNA, 22 nt, Homo sapiens
ugacauuuaccagcaacuugaa

SEQ ID NO: 1813318 - RNA, 22 nt, Homo sapiens
gagaaaggcaugaaucuucccu

SEQ ID NO: 1813319 - RNA, 21 nt, Homo sapiens
aucauguugaauaaugcuguu

SEQ ID NO: 1813320 - RNA, 18 nt, Homo sapiens
gcagaugcugucacuggc

SEQ ID NO: 1813321 - RNA, 17 nt, Homo sapiens
ggugccgcucucucuga

SEQ ID NO: 1813322 - RNA, 18 nt, Homo sapiens
agcucagccgugcacucc

SEQ ID NO: 1813323 - RNA, 13 nt, Homo sapiens
cuguggagccauc

SEQ ID NO: 1813324 - RNA, 22 nt, Homo sapiens
uuauauugccauuucuuccaca

SEQ ID NO: 1813325 - RNA, 14 nt, Homo sapiens
guuuuuagcuggug

SEQ ID NO: 1813326 - RNA, 17 nt, Homo sapiens
gucagccauaucuccau

SEQ ID NO: 1813327 - RNA, 20 nt, Homo sapiens
agagugagagacaucaucaa

SEQ ID NO: 1813328 - RNA, 22 nt, Homo sapiens
guaggugggggaacacugagaa

SEQ ID NO: 1813329 - RNA, 17 nt, Homo sapiens
auuugguuuguuaauuc

SEQ ID NO: 1813330 - RNA, 14 nt, Homo sapiens
aaaagcaaguucgu

SEQ ID NO: 1813331 - RNA, 15 nt, Homo sapiens
uaaacaugcuguuac

SEQ ID NO: 1813332 - RNA, 18 nt, Homo sapiens
acuuuaaagauaagucua

SEQ ID NO: 1813333 - RNA, 16 nt, Homo sapiens
agacuuuaggcuuuca

SEQ ID NO: 1813334 - RNA, 15 nt, Homo sapiens
uuucaggcacaucau

SEQ ID NO: 1813335 - RNA, 19 nt, Homo sapiens
aacugacaguaaaucucac

SEQ ID NO: 1813336 - RNA, 12 nt, Homo sapiens
uccuccagacaa

SEQ ID NO: 1813337 - RNA, 24 nt, Homo sapiens
agcuggcuuguuucuuaugccaga

SEQ ID NO: 1813338 - RNA, 21 nt, Homo sapiens
gaacccugggccauccucaca

SEQ ID NO: 1813339 - RNA, 11 nt, Homo sapiens
uuggagccagg

SEQ ID NO: 1813340 - RNA, 24 nt, Homo sapiens
uagguuucagcaacaagacugcca

SEQ ID NO: 1813341 - RNA, 17 nt, Homo sapiens
ggagacggaaucugccg

SEQ ID NO: 1813342 - RNA, 18 nt, Homo sapiens
acguuccugaacauauua

SEQ ID NO: 1813343 - RNA, 17 nt, Homo sapiens
gggccccauggucacag

SEQ ID NO: 1813344 - RNA, 19 nt, Homo sapiens
augcuggacauuaacaaga

SEQ ID NO: 1813345 - RNA, 20 nt, Homo sapiens
ucacgccucuguguucagga

SEQ ID NO: 1813346 - RNA, 12 nt, Homo sapiens
ugaaacuggagu

SEQ ID NO: 1813347 - RNA, 14 nt, Homo sapiens
cagaaagucuucau

SEQ ID NO: 1813348 - RNA, 18 nt, Homo sapiens
ugacugauguucaugaua

SEQ ID NO: 1813349 - RNA, 12 nt, Homo sapiens
cauaauacauga

SEQ ID NO: 1813350 - RNA, 13 nt, Homo sapiens
uucaccuguauau

SEQ ID NO: 1813351 - RNA, 22 nt, Homo sapiens
uuuuuaauaccaggaacccagc

SEQ ID NO: 1813352 - RNA, 17 nt, Homo sapiens
cacuugccauugccagg

SEQ ID NO: 1813353 - RNA, 12 nt, Homo sapiens
cagaugcaauac

SEQ ID NO: 1813354 - RNA, 16 nt, Homo sapiens
agcgccagggcucaga

SEQ ID NO: 1813355 - RNA, 13 nt, Homo sapiens
cauucuauucucc

SEQ ID NO: 1813356 - RNA, 17 nt, Homo sapiens
ccugggcagaaaugugc

SEQ ID NO: 1813357 - RNA, 17 nt, Homo sapiens
aacauaggccugcucag

SEQ ID NO: 1813358 - RNA, 15 nt, Homo sapiens
uagauucacauacag

SEQ ID NO: 1813359 - RNA, 17 nt, Homo sapiens
cugauuuugaccuugua

SEQ ID NO: 1813360 - RNA, 18 nt, Homo sapiens
uccucaaaucagucuucc

SEQ ID NO: 1813361 - RNA, 16 nt, Homo sapiens
ccaugagggacagggu

SEQ ID NO: 1813362 - RNA, 22 nt, Homo sapiens
ugggugacagagcgagacucca

SEQ ID NO: 1813363 - RNA, 13 nt, Homo sapiens
accagucuuucaa

SEQ ID NO: 1813364 - RNA, 19 nt, Homo sapiens
gcuacuggcaucuguuauc

SEQ ID NO: 1813365 - RNA, 16 nt, Homo sapiens
aaaaccaucucuguga

SEQ ID NO: 1813366 - RNA, 23 nt, Homo sapiens
cacugguguggauuaaccugcca

SEQ ID NO: 1813367 - RNA, 18 nt, Homo sapiens
aaauuaauuugaccaucu

SEQ ID NO: 1813368 - RNA, 20 nt, Homo sapiens
uugaaccauccacuuacaua

SEQ ID NO: 1813369 - RNA, 22 nt, Homo sapiens
ugaggagauucccaccuuccau

SEQ ID NO: 1813370 - RNA, 22 nt, Homo sapiens
caaagugcuggaaccacaggcc

SEQ ID NO: 1813371 - RNA, 17 nt, Homo sapiens
uaagggaagagguccuc

SEQ ID NO: 1813372 - RNA, 17 nt, Homo sapiens
gaacauccaaccuuccc

SEQ ID NO: 1813373 - RNA, 21 nt, Homo sapiens
augaccagcagcagcuuucag

SEQ ID NO: 1813374 - RNA, 17 nt, Homo sapiens
agguguguaaaggagaa

SEQ ID NO: 1813375 - RNA, 11 nt, Homo sapiens
cagugcuccug

SEQ ID NO: 1813376 - RNA, 20 nt, Homo sapiens
ucauucccaacgugcaaagc

SEQ ID NO: 1813377 - RNA, 20 nt, Homo sapiens
cagaugagaguacaccccaa

SEQ ID NO: 1813378 - RNA, 20 nt, Homo sapiens
auuacacauuuguacagaau

SEQ ID NO: 1813379 - RNA, 21 nt, Homo sapiens
uucugugcgccuuaaacaauu

SEQ ID NO: 1813380 - RNA, 15 nt, Homo sapiens
uugccucuacuuuga

SEQ ID NO: 1813381 - RNA, 21 nt, Homo sapiens
uuuucaaagauguguugcuau

SEQ ID NO: 1813382 - RNA, 19 nt, Homo sapiens
uccucguuuuguaaugaga

SEQ ID NO: 1813383 - RNA, 18 nt, Homo sapiens
caugucagaaggagacag

SEQ ID NO: 1813384 - RNA, 12 nt, Homo sapiens
cccaagcaguug

SEQ ID NO: 1813385 - RNA, 21 nt, Homo sapiens
gaaaaaggcuaaccugagcua

SEQ ID NO: 1813386 - RNA, 12 nt, Homo sapiens
gucaugcccuua

SEQ ID NO: 1813387 - RNA, 14 nt, Homo sapiens
cacuacagauauca

SEQ ID NO: 1813388 - RNA, 17 nt, Homo sapiens
ccagaagcugagcacca

SEQ ID NO: 1813389 - RNA, 14 nt, Homo sapiens
cauccuggggcuca

SEQ ID NO: 1813390 - RNA, 22 nt, Homo sapiens
guaaaucagggugggcaauuca

SEQ ID NO: 1813391 - RNA, 19 nt, Homo sapiens
ucugaacuugcauugugau

SEQ ID NO: 1813392 - RNA, 14 nt, Homo sapiens
auguacacuacauu

SEQ ID NO: 1813393 - RNA, 20 nt, Homo sapiens
ggugugagaauaacacuggc

SEQ ID NO: 1813394 - RNA, 16 nt, Homo sapiens
ucaaaguaaccucuga

SEQ ID NO: 1813395 - RNA, 18 nt, Homo sapiens
cagcaaacucaaguugaa

SEQ ID NO: 1813396 - RNA, 22 nt, Homo sapiens
ugcccguuuccauacagggucu

SEQ ID NO: 1813397 - RNA, 13 nt, Homo sapiens
ugauggagauuaa

SEQ ID NO: 1813398 - RNA, 18 nt, Homo sapiens
cgucuugcccagcagcuc

SEQ ID NO: 1813399 - RNA, 16 nt, Homo sapiens
ugacagcgcacagcug

SEQ ID NO: 1813400 - RNA, 22 nt, Homo sapiens
uccugcaauaaaauaguagcau

SEQ ID NO: 1813401 - RNA, 23 nt, Homo sapiens
uuguggcauauccauuguggaaa

SEQ ID NO: 1813402 - RNA, 18 nt, Homo sapiens
aauguccugacaccugcu

SEQ ID NO: 1813403 - RNA, 21 nt, Homo sapiens
ugcauuugugaggguccagcu

SEQ ID NO: 1813404 - RNA, 16 nt, Homo sapiens
ucccuguucugguauu

SEQ ID NO: 1813405 - RNA, 18 nt, Homo sapiens
ccuccucccuaaugcuca

SEQ ID NO: 1813406 - RNA, 19 nt, Homo sapiens
agagugcuuggcugcugua

SEQ ID NO: 1813407 - RNA, 21 nt, Homo sapiens
ugaggauauaaugugugcuuu

SEQ ID NO: 1813408 - RNA, 18 nt, Homo sapiens
cugcuggcuggugccuga

SEQ ID NO: 1813409 - RNA, 18 nt, Homo sapiens
uccacguaagucacugaa

SEQ ID NO: 1813410 - RNA, 14 nt, Homo sapiens
caagauaccuuugc

SEQ ID NO: 1813411 - RNA, 19 nt, Homo sapiens
cuacucaggcugguggaga

SEQ ID NO: 1813412 - RNA, 23 nt, Homo sapiens
gaauauauggcauuugcagauuu

SEQ ID NO: 1813413 - RNA, 18 nt, Homo sapiens
gccuguguuucauguucu

SEQ ID NO: 1813414 - RNA, 14 nt, Homo sapiens
uugucuacucugaa

SEQ ID NO: 1813415 - RNA, 21 nt, Homo sapiens
cacuucaaaucagagcaguga

SEQ ID NO: 1813416 - RNA, 19 nt, Homo sapiens
cccagcagcgguaccccag

SEQ ID NO: 1813417 - RNA, 17 nt, Homo sapiens
acacaugacacucuucu

SEQ ID NO: 1813418 - RNA, 22 nt, Homo sapiens
aggagggaugcugccugaguca

SEQ ID NO: 1813419 - RNA, 20 nt, Homo sapiens
ggacugccuugucucuagua

SEQ ID NO: 1813420 - RNA, 16 nt, Homo sapiens
auggggacgguguaug

SEQ ID NO: 1813421 - RNA, 16 nt, Homo sapiens
ucucauugacuuuuau

SEQ ID NO: 1813422 - RNA, 22 nt, Homo sapiens
agcaaggacugcccuucauuca

SEQ ID NO: 1813423 - RNA, 19 nt, Homo sapiens
aaugaguggacaagucaug

SEQ ID NO: 1813424 - RNA, 17 nt, Homo sapiens
aauauuaguuaauggau

SEQ ID NO: 1813425 - RNA, 15 nt, Homo sapiens
agggcuagugacuug

SEQ ID NO: 1813426 - RNA, 20 nt, Homo sapiens
cauuuauuauuucaauguga

SEQ ID NO: 1813427 - RNA, 18 nt, Homo sapiens
gcuaucccgggcauccag

SEQ ID NO: 1813428 - RNA, 21 nt, Homo sapiens
aagccagcugcagcugggcug

SEQ ID NO: 1813429 - RNA, 11 nt, Homo sapiens
gaauggugcuu

SEQ ID NO: 1813430 - RNA, 18 nt, Homo sapiens
acccaugggaagggucca

SEQ ID NO: 1813431 - RNA, 23 nt, Homo sapiens
cuuuggguuaaauuaaaagcccu

SEQ ID NO: 1813432 - RNA, 13 nt, Homo sapiens
ccccagcgcgggu

SEQ ID NO: 1813433 - RNA, 22 nt, Homo sapiens
caaugacaucucaggggccaga

SEQ ID NO: 1813434 - RNA, 18 nt, Homo sapiens
aaaagugcauucaaccuu

SEQ ID NO: 1813435 - RNA, 17 nt, Homo sapiens
gugugugcagcauuguu

SEQ ID NO: 1813436 - RNA, 12 nt, Homo sapiens
uucagaacauag

SEQ ID NO: 1813437 - RNA, 22 nt, Homo sapiens
acauagagcuuuuuaauagcac

SEQ ID NO: 1813438 - RNA, 19 nt, Homo sapiens
ggaggcggagguugcagua

SEQ ID NO: 1813439 - RNA, 17 nt, Homo sapiens
cuucugcuguauacugu

SEQ ID NO: 1813440 - RNA, 21 nt, Homo sapiens
cacagcucagcagacauccac

SEQ ID NO: 1813441 - RNA, 13 nt, Homo sapiens
cugggcuguaacg

SEQ ID NO: 1813442 - RNA, 14 nt, Homo sapiens
ucauggugcaauuu

SEQ ID NO: 1813443 - RNA, 18 nt, Homo sapiens
ugcuugaacccaagaggu

SEQ ID NO: 1813444 - RNA, 20 nt, Homo sapiens
aacucccuccucacacucca

SEQ ID NO: 1813445 - RNA, 17 nt, Homo sapiens
cugagcucgguggaccc

SEQ ID NO: 1813446 - RNA, 20 nt, Homo sapiens
ucuuacuacagcuucaguga

SEQ ID NO: 1813447 - RNA, 17 nt, Homo sapiens
cagccugcuucccacaa

SEQ ID NO: 1813448 - RNA, 20 nt, Homo sapiens
cuggaguggaguggcacgau

SEQ ID NO: 1813449 - RNA, 23 nt, Homo sapiens
gggacagagccccacgcuguuga

SEQ ID NO: 1813450 - RNA, 19 nt, Homo sapiens
auagcaaacuucaggacuu

SEQ ID NO: 1813451 - RNA, 18 nt, Homo sapiens
agcuuuugaaauccagaa

SEQ ID NO: 1813452 - RNA, 17 nt, Homo sapiens
gacaaagugagacuccg

SEQ ID NO: 1813453 - RNA, 12 nt, Homo sapiens
caagucacaccc

SEQ ID NO: 1813454 - RNA, 13 nt, Homo sapiens
agccugaacacuc

SEQ ID NO: 1813455 - RNA, 19 nt, Homo sapiens
uuccuccucugcugggacu

SEQ ID NO: 1813456 - RNA, 13 nt, Homo sapiens
ugcccgagguucc

SEQ ID NO: 1813457 - RNA, 14 nt, Homo sapiens
cgucauuacagggc

SEQ ID NO: 1813458 - RNA, 18 nt, Homo sapiens
ugggcagagcugcaucau

SEQ ID NO: 1813459 - RNA, 17 nt, Homo sapiens
ucauaguuacuguguaa

SEQ ID NO: 1813460 - RNA, 16 nt, Homo sapiens
gaaaaaaaaacuuaaa

SEQ ID NO: 1813461 - RNA, 16 nt, Homo sapiens
accaauaugcauuuau

SEQ ID NO: 1813462 - RNA, 19 nt, Homo sapiens
acuuuacaaccugauguca

SEQ ID NO: 1813463 - RNA, 14 nt, Homo sapiens
uauggccaauaacu

SEQ ID NO: 1813464 - RNA, 12 nt, Homo sapiens
ccucucaccaaa

SEQ ID NO: 1813465 - RNA, 12 nt, Homo sapiens
aacuccagugaa

SEQ ID NO: 1813466 - RNA, 11 nt, Homo sapiens
agcaaaugcga

SEQ ID NO: 1813467 - RNA, 16 nt, Homo sapiens
caaauacaaguacuag

SEQ ID NO: 1813468 - RNA, 18 nt, Homo sapiens
aacuuauaaucaauacaa

SEQ ID NO: 1813469 - RNA, 14 nt, Homo sapiens
aucauuuacugugu

SEQ ID NO: 1813470 - RNA, 18 nt, Homo sapiens
cuguuguaacugcccaag

SEQ ID NO: 1813471 - RNA, 20 nt, Homo sapiens
ccaggcugugggucugcacc

SEQ ID NO: 1813472 - RNA, 20 nt, Homo sapiens
agaaggucauaagggagcau

SEQ ID NO: 1813473 - RNA, 12 nt, Homo sapiens
aaaacacaaaac

SEQ ID NO: 1813474 - RNA, 12 nt, Homo sapiens
cagccacacaga

SEQ ID NO: 1813475 - RNA, 23 nt, Homo sapiens
cuauagaaauagaacacugccuc

SEQ ID NO: 1813476 - RNA, 21 nt, Homo sapiens
cuauaauuuaccuaagauuac

SEQ ID NO: 1813477 - RNA, 18 nt, Homo sapiens
cgcugggagaaaagccag

SEQ ID NO: 1813478 - RNA, 20 nt, Homo sapiens
aauguuuucuucaucuguga

SEQ ID NO: 1813479 - RNA, 14 nt, Homo sapiens
agucccaugcacaa

SEQ ID NO: 1813480 - RNA, 22 nt, Homo sapiens
uaaaaaaagacauaauucacac

SEQ ID NO: 1813481 - RNA, 16 nt, Homo sapiens
ucucaccaaacuucau

SEQ ID NO: 1813482 - RNA, 14 nt, Homo sapiens
ggucauucauauca

SEQ ID NO: 1813483 - RNA, 17 nt, Homo sapiens
guguuacuguugcacug

SEQ ID NO: 1813484 - RNA, 23 nt, Homo sapiens
aguuccugcuacaacuucagcag

SEQ ID NO: 1813485 - RNA, 16 nt, Homo sapiens
uagagucucuguuacu

SEQ ID NO: 1813486 - RNA, 18 nt, Homo sapiens
cagugguaaauauagaac

SEQ ID NO: 1813487 - RNA, 20 nt, Homo sapiens
acagagcgagacuccaucuc

SEQ ID NO: 1813488 - RNA, 20 nt, Homo sapiens
acagagcaagacuccgucuc

SEQ ID NO: 1813489 - RNA, 20 nt, Homo sapiens
acagaguaagacucugucuc

SEQ ID NO: 1813490 - RNA, 19 nt, Homo sapiens
aucuauaacuacauauuga

SEQ ID NO: 1813491 - RNA, 22 nt, Homo sapiens
auagcagagagccaaaucugac

SEQ ID NO: 1813492 - RNA, 21 nt, Homo sapiens
acaucauuacuuaugaugaug

SEQ ID NO: 1813493 - RNA, 15 nt, Homo sapiens
ggugaacacugugac

SEQ ID NO: 1813494 - RNA, 20 nt, Homo sapiens
uacucaacccauuguuguca

SEQ ID NO: 1813495 - RNA, 14 nt, Homo sapiens
caccaaacucuuaa

SEQ ID NO: 1813496 - RNA, 22 nt, Homo sapiens
agcugaaaacuaauguacugua

SEQ ID NO: 1813497 - RNA, 22 nt, Homo sapiens
cugauauacuugagugugcaag

SEQ ID NO: 1813498 - RNA, 16 nt, Homo sapiens
ccugcuggaucuugcc

SEQ ID NO: 1813499 - RNA, 14 nt, Homo sapiens
cucuuuugcacaag

SEQ ID NO: 1813500 - RNA, 21 nt, Homo sapiens
cuggacagaugaauaccuuuu

SEQ ID NO: 1813501 - RNA, 16 nt, Homo sapiens
ucagaaacacccucac

SEQ ID NO: 1813502 - RNA, 11 nt, Homo sapiens
uaccuucucac

SEQ ID NO: 1813503 - RNA, 15 nt, Homo sapiens
ccaugacccaggcug

SEQ ID NO: 1813504 - RNA, 18 nt, Homo sapiens
aguaugccuuaagcagaa

SEQ ID NO: 1813505 - RNA, 13 nt, Homo sapiens
cugugugcugagc

SEQ ID NO: 1813506 - RNA, 19 nt, Homo sapiens
gugaagaggaaaaugccuc

SEQ ID NO: 1813507 - RNA, 18 nt, Homo sapiens
aguuaauuuaauuugcag

SEQ ID NO: 1813508 - RNA, 17 nt, Homo sapiens
gacaccuggugcuuuua

SEQ ID NO: 1813509 - RNA, 22 nt, Homo sapiens
uuguaacuugcauguauccaua

SEQ ID NO: 1813510 - RNA, 14 nt, Homo sapiens
cuggaaaugagccc

SEQ ID NO: 1813511 - RNA, 18 nt, Homo sapiens
ugaaaucuuggaguuuca

SEQ ID NO: 1813512 - RNA, 24 nt, Homo sapiens
gaccaaaugccugguaccagagga

SEQ ID NO: 1813513 - RNA, 19 nt, Homo sapiens
ccuggugggcagagaggua

SEQ ID NO: 1813514 - RNA, 18 nt, Homo sapiens
agaaauuuuacugacaga

SEQ ID NO: 1813515 - RNA, 19 nt, Homo sapiens
agaaacugaggccauuauu

SEQ ID NO: 1813516 - RNA, 13 nt, Homo sapiens
ugcuaucaaucca

SEQ ID NO: 1813517 - RNA, 13 nt, Homo sapiens
uguucucacuuau

SEQ ID NO: 1813518 - RNA, 23 nt, Homo sapiens
aauagcuuggaaaaguaacaucu

SEQ ID NO: 1813519 - RNA, 22 nt, Homo sapiens
uaaagcauguuugguuuuccaa

SEQ ID NO: 1813520 - RNA, 20 nt, Homo sapiens
cucauguauaaaacuaggaa

SEQ ID NO: 1813521 - RNA, 15 nt, Homo sapiens
cucagaucuugacag

SEQ ID NO: 1813522 - RNA, 13 nt, Homo sapiens
aacucagauccag

SEQ ID NO: 1813523 - RNA, 23 nt, Homo sapiens
cacuagaggggcacccaccaguu

SEQ ID NO: 1813524 - RNA, 16 nt, Homo sapiens
gggacagaucugauuu

SEQ ID NO: 1813525 - RNA, 22 nt, Homo sapiens
uucuccaggcuucacagucugg

SEQ ID NO: 1813526 - RNA, 18 nt, Homo sapiens
cucacaaaguccacuuua

SEQ ID NO: 1813527 - RNA, 13 nt, Homo sapiens
gcuauauugcacu

SEQ ID NO: 1813528 - RNA, 20 nt, Homo sapiens
gcagaaaaacaggcacaggc

SEQ ID NO: 1813529 - RNA, 16 nt, Homo sapiens
ggugaccaauacuacu

SEQ ID NO: 1813530 - RNA, 15 nt, Homo sapiens
cuauccaaucuguga

SEQ ID NO: 1813531 - RNA, 14 nt, Homo sapiens
aggggcaccugcca

SEQ ID NO: 1813532 - RNA, 14 nt, Homo sapiens
ggaaucacuuuuaa

SEQ ID NO: 1813533 - RNA, 20 nt, Homo sapiens
aacaaugacuaauucuugca

SEQ ID NO: 1813534 - RNA, 13 nt, Homo sapiens
augaaaaugucag

SEQ ID NO: 1813535 - RNA, 22 nt, Homo sapiens
ucuugaauguugaagaacucau

SEQ ID NO: 1813536 - RNA, 20 nt, Homo sapiens
cacaacaaaaggaagacugg

SEQ ID NO: 1813537 - RNA, 17 nt, Homo sapiens
gugccuugcucauuuga

SEQ ID NO: 1813538 - RNA, 21 nt, Homo sapiens
uuuacacagaaacacugccuu

SEQ ID NO: 1813539 - RNA, 21 nt, Homo sapiens
ggacagccaagggcagaucac

SEQ ID NO: 1813540 - RNA, 16 nt, Homo sapiens
cuuuugaaguaauccc

SEQ ID NO: 1813541 - RNA, 23 nt, Homo sapiens
aacacacuaccgaaugugucuuu

SEQ ID NO: 1813542 - RNA, 22 nt, Homo sapiens
caccauuguuccuuaccuuuac

SEQ ID NO: 1813543 - RNA, 13 nt, Homo sapiens
gaccuucaugccc

SEQ ID NO: 1813544 - RNA, 13 nt, Homo sapiens
caaggcacugacu

SEQ ID NO: 1813545 - RNA, 17 nt, Homo sapiens
uuaagaaugucgauuaa

SEQ ID NO: 1813546 - RNA, 13 nt, Homo sapiens
ccugugcugcgau

SEQ ID NO: 1813547 - RNA, 14 nt, Homo sapiens
aaaaacauacauua

SEQ ID NO: 1813548 - RNA, 18 nt, Homo sapiens
cuuuagugucugagcuuc

SEQ ID NO: 1813549 - RNA, 22 nt, Homo sapiens
uaucuuuuuucuuccuauuucc

SEQ ID NO: 1813550 - RNA, 14 nt, Homo sapiens
ccacccuugccaug

SEQ ID NO: 1813551 - RNA, 15 nt, Homo sapiens
gaauaugaaugucac

SEQ ID NO: 1813552 - RNA, 19 nt, Homo sapiens
guuauuuaugccucuguau

SEQ ID NO: 1813553 - RNA, 15 nt, Homo sapiens
auccaucgaagcaga

SEQ ID NO: 1813554 - RNA, 19 nt, Homo sapiens
guuccaagaaagauccacc

SEQ ID NO: 1813555 - RNA, 17 nt, Homo sapiens
gcaugcaugugcuugug

SEQ ID NO: 1813556 - RNA, 21 nt, Homo sapiens
uacacuuggagcccgugcagu

SEQ ID NO: 1813557 - RNA, 16 nt, Homo sapiens
ugagucagacugucag

SEQ ID NO: 1813558 - RNA, 13 nt, Homo sapiens
ucuacugcuucua

SEQ ID NO: 1813559 - RNA, 12 nt, Homo sapiens
augaagcuggaa

SEQ ID NO: 1813560 - RNA, 13 nt, Homo sapiens
uaauuaaaucaua

SEQ ID NO: 1813561 - RNA, 16 nt, Homo sapiens
agcgaauucagaaaga

SEQ ID NO: 1813562 - RNA, 19 nt, Homo sapiens
gacauugcuucugcuaaau

SEQ ID NO: 1813563 - RNA, 18 nt, Homo sapiens
uccucgagaucccaacac

SEQ ID NO: 1813564 - RNA, 13 nt, Homo sapiens
uugcucuuuggua

SEQ ID NO: 1813565 - RNA, 20 nt, Homo sapiens
acuguuuauacacuguguaa

SEQ ID NO: 1813566 - RNA, 16 nt, Homo sapiens
ucggcuccaccccagg

SEQ ID NO: 1813567 - RNA, 14 nt, Homo sapiens
ugccccuccuguac

SEQ ID NO: 1813568 - RNA, 18 nt, Homo sapiens
aaucccuuugucugucaa

SEQ ID NO: 1813569 - RNA, 21 nt, Homo sapiens
agagaaccuuuagaauaucuu

SEQ ID NO: 1813570 - RNA, 18 nt, Homo sapiens
caaauaaauaagaucaga

SEQ ID NO: 1813571 - RNA, 23 nt, Homo sapiens
guuuccaguuguuacugaaguua

SEQ ID NO: 1813572 - RNA, 14 nt, Homo sapiens
gaagucacacagua

SEQ ID NO: 1813573 - RNA, 14 nt, Homo sapiens
ucaccacucaaaaa

SEQ ID NO: 1813574 - RNA, 23 nt, Homo sapiens
ccaauaguuucuuguuaauccuu

SEQ ID NO: 1813575 - RNA, 15 nt, Homo sapiens
gaagauaaacacaaa

SEQ ID NO: 1813576 - RNA, 13 nt, Homo sapiens
auguguacagucu

SEQ ID NO: 1813577 - RNA, 12 nt, Homo sapiens
uucccucacccc

SEQ ID NO: 1813578 - RNA, 19 nt, Homo sapiens
agucuauguauguguaaaa

SEQ ID NO: 1813579 - RNA, 22 nt, Homo sapiens
aaccucugccgcccuccacacc

SEQ ID NO: 1813580 - RNA, 23 nt, Homo sapiens
uugccuccaucuuuuucuugggu

SEQ ID NO: 1813581 - RNA, 12 nt, Homo sapiens
ugcggugcauac

SEQ ID NO: 1813582 - RNA, 15 nt, Homo sapiens
ugauucccugcacac

SEQ ID NO: 1813583 - RNA, 12 nt, Homo sapiens
cauuacugcaua

SEQ ID NO: 1813584 - RNA, 12 nt, Homo sapiens
cugaacugcugu

SEQ ID NO: 1813585 - RNA, 16 nt, Homo sapiens
agugauuucagcacau

SEQ ID NO: 1813586 - RNA, 14 nt, Homo sapiens
aacacaauuuucac

SEQ ID NO: 1813587 - RNA, 14 nt, Homo sapiens
auuccuaaaacacc

SEQ ID NO: 1813588 - RNA, 23 nt, Homo sapiens
cagccaagagccaucugaagcca

SEQ ID NO: 1813589 - RNA, 18 nt, Homo sapiens
aacaucuuuuacauucug

SEQ ID NO: 1813590 - RNA, 13 nt, Homo sapiens
cuccguccuguca

SEQ ID NO: 1813591 - RNA, 14 nt, Homo sapiens
auguuacuccaaaa

SEQ ID NO: 1813592 - RNA, 23 nt, Homo sapiens
aauugggccaaagaaacauugcc

SEQ ID NO: 1813593 - RNA, 17 nt, Homo sapiens
acguaugcaugugaaga

SEQ ID NO: 1813594 - RNA, 14 nt, Homo sapiens
gauuccucaggguu

SEQ ID NO: 1813595 - RNA, 18 nt, Homo sapiens
ccugugggugugucucuc

SEQ ID NO: 1813596 - RNA, 22 nt, Homo sapiens
cagugcuguacuugaugacaga

SEQ ID NO: 1813597 - RNA, 13 nt, Homo sapiens
ugaaauaugugaa

SEQ ID NO: 1813598 - RNA, 19 nt, Homo sapiens
acuuggcuacacagggaug

SEQ ID NO: 1813599 - RNA, 17 nt, Homo sapiens
ggccuuccuccucucaa

SEQ ID NO: 1813600 - RNA, 20 nt, Homo sapiens
augcgcacgaccuacauuaa

SEQ ID NO: 1813601 - RNA, 16 nt, Homo sapiens
ucguguccagccugac

SEQ ID NO: 1813602 - RNA, 17 nt, Homo sapiens
uuacaaaccucaagcca

SEQ ID NO: 1813603 - RNA, 17 nt, Homo sapiens
caaauguuuugacauga

SEQ ID NO: 1813604 - RNA, 21 nt, Homo sapiens
accuuccagcccggggccagc

SEQ ID NO: 1813605 - RNA, 19 nt, Homo sapiens
aucguuaucuacugacuau

SEQ ID NO: 1813606 - RNA, 16 nt, Homo sapiens
agcuuugacucaggag

SEQ ID NO: 1813607 - RNA, 22 nt, Homo sapiens
cgcacacacccauguaaccacu

SEQ ID NO: 1813608 - RNA, 22 nt, Homo sapiens
ccaacguucgauuucuaccuca

SEQ ID NO: 1813609 - RNA, 17 nt, Homo sapiens
agaggcugagcaccuuu

SEQ ID NO: 1813610 - RNA, 21 nt, Homo sapiens
auaugguucuuauucacugag

SEQ ID NO: 1813611 - RNA, 22 nt, Homo sapiens
aauaaagaccuauguacuuaau

SEQ ID NO: 1813612 - RNA, 17 nt, Homo sapiens
guacucaagggcuuuau

SEQ ID NO: 1813613 - RNA, 15 nt, Homo sapiens
ugaugaaauaucacu

SEQ ID NO: 1813614 - RNA, 23 nt, Homo sapiens
ucuggaggagcaagggggccaca

SEQ ID NO: 1813615 - RNA, 17 nt, Homo sapiens
ugaccuccgccauccac

SEQ ID NO: 1813616 - RNA, 20 nt, Homo sapiens
ugaucagcgccgcaccagcc

SEQ ID NO: 1813617 - RNA, 13 nt, Homo sapiens
gacaacaaggccc

SEQ ID NO: 1813618 - RNA, 15 nt, Homo sapiens
ugacggcccugcaau

SEQ ID NO: 1813619 - RNA, 13 nt, Homo sapiens
acucuuuguucaa

SEQ ID NO: 1813620 - RNA, 19 nt, Homo sapiens
aggccacacuggcaucucc

SEQ ID NO: 1813621 - RNA, 22 nt, Homo sapiens
uaaaaacucuuauaaauuucua

SEQ ID NO: 1813622 - RNA, 15 nt, Homo sapiens
cuuccuguccagcuc

SEQ ID NO: 1813623 - RNA, 15 nt, Homo sapiens
cuccuuuguucugua

SEQ ID NO: 1813624 - RNA, 22 nt, Homo sapiens
ccaaaaagauuuauuaauuaaa

SEQ ID NO: 1813625 - RNA, 21 nt, Homo sapiens
augguccuggggcucugugca

SEQ ID NO: 1813626 - RNA, 16 nt, Homo sapiens
ccugaauccagcauug

SEQ ID NO: 1813627 - RNA, 13 nt, Homo sapiens
aauauuaagcaca

SEQ ID NO: 1813628 - RNA, 16 nt, Homo sapiens
cagcgagcccuggugg

SEQ ID NO: 1813629 - RNA, 17 nt, Homo sapiens
ucucuugcuugugggac

SEQ ID NO: 1813630 - RNA, 23 nt, Homo sapiens
ugguuucacaugguuacauauca

SEQ ID NO: 1813631 - RNA, 20 nt, Homo sapiens
aaauggcuuuccacaucccc

SEQ ID NO: 1813632 - RNA, 11 nt, Homo sapiens
gcccucugaaa

SEQ ID NO: 1813633 - RNA, 14 nt, Homo sapiens
guuucucagucuca

SEQ ID NO: 1813634 - RNA, 14 nt, Homo sapiens
cugauaguauuccu

SEQ ID NO: 1813635 - RNA, 18 nt, Homo sapiens
caguuaagagaaaugagc

SEQ ID NO: 1813636 - RNA, 22 nt, Homo sapiens
uggggcaggucacuuuaccucu

SEQ ID NO: 1813637 - RNA, 17 nt, Homo sapiens
accaaucuuacuuugua

SEQ ID NO: 1813638 - RNA, 21 nt, Homo sapiens
agggccagagggagcuggaac

SEQ ID NO: 1813639 - RNA, 15 nt, Homo sapiens
cccagcuacucggga

SEQ ID NO: 1813640 - RNA, 18 nt, Homo sapiens
ucaguagcaggaccugcc

SEQ ID NO: 1813641 - RNA, 21 nt, Homo sapiens
cuucuccagccuggaccccca

SEQ ID NO: 1813642 - RNA, 22 nt, Homo sapiens
uuacauauguuaauaaacugca

SEQ ID NO: 1813643 - RNA, 22 nt, Homo sapiens
cacacacggaugcacacacaga

SEQ ID NO: 1813644 - RNA, 18 nt, Homo sapiens
gcaagacuguugcucaaa

SEQ ID NO: 1813645 - RNA, 16 nt, Homo sapiens
auuauucauaauguga

SEQ ID NO: 1813646 - RNA, 24 nt, Homo sapiens
uuagagacccuuugucucugagaa

SEQ ID NO: 1813647 - RNA, 20 nt, Homo sapiens
acccuuucagaaucuuuuca

SEQ ID NO: 1813648 - RNA, 21 nt, Homo sapiens
acuacacacuguguacugcag

SEQ ID NO: 1813649 - RNA, 18 nt, Homo sapiens
cuacuguaaggcaaucau

SEQ ID NO: 1813650 - RNA, 19 nt, Homo sapiens
uuuuucaagaaaacuggaa

SEQ ID NO: 1813651 - RNA, 15 nt, Homo sapiens
ccccagccuggccca

SEQ ID NO: 1813652 - RNA, 19 nt, Homo sapiens
ugccacuuuacccaccuag

SEQ ID NO: 1813653 - RNA, 16 nt, Homo sapiens
uaccuauuucugauga

SEQ ID NO: 1813654 - RNA, 13 nt, Homo sapiens
gcuuccuccugcc

SEQ ID NO: 1813655 - RNA, 15 nt, Homo sapiens
ccaugcuuuaugugg

SEQ ID NO: 1813656 - RNA, 22 nt, Homo sapiens
ucuauugcuggcaaagacagaa

SEQ ID NO: 1813657 - RNA, 19 nt, Homo sapiens
ccucggccucccaaagugc

SEQ ID NO: 1813658 - RNA, 20 nt, Homo sapiens
caggcucucccucucugcac

SEQ ID NO: 1813659 - RNA, 15 nt, Homo sapiens
uaugucucagaccac

SEQ ID NO: 1813660 - RNA, 13 nt, Homo sapiens
uccagccuucuac

SEQ ID NO: 1813661 - RNA, 18 nt, Homo sapiens
auacuuugcaauccaaau

SEQ ID NO: 1813662 - RNA, 19 nt, Homo sapiens
ucaccuagaacgugcaucc

SEQ ID NO: 1813663 - RNA, 20 nt, Homo sapiens
uguggcagcugcaacagugg

SEQ ID NO: 1813664 - RNA, 19 nt, Homo sapiens
aacuauacuugaacaaaag

SEQ ID NO: 1813665 - RNA, 16 nt, Homo sapiens
ccaucucaaaaaaaca

SEQ ID NO: 1813666 - RNA, 23 nt, Homo sapiens
ccuuguuauuucucagacuuugg

SEQ ID NO: 1813667 - RNA, 15 nt, Homo sapiens
aggcuuugugucagg

SEQ ID NO: 1813668 - RNA, 18 nt, Homo sapiens
ucuucguagguugugaug

SEQ ID NO: 1813669 - RNA, 16 nt, Homo sapiens
aaacucugccagaaaa

SEQ ID NO: 1813670 - RNA, 14 nt, Homo sapiens
cuucccuaaugaag

SEQ ID NO: 1813671 - RNA, 22 nt, Homo sapiens
cucaugaacuauuuacauuuuc

SEQ ID NO: 1813672 - RNA, 14 nt, Homo sapiens
uugggcaugccauu

SEQ ID NO: 1813673 - RNA, 21 nt, Homo sapiens
acugguuuuacuagugugcaa

SEQ ID NO: 1813674 - RNA, 17 nt, Homo sapiens
caaggagcacaagccac

SEQ ID NO: 1813675 - RNA, 13 nt, Homo sapiens
auugaaaaugcau

SEQ ID NO: 1813676 - RNA, 17 nt, Homo sapiens
uaaagauuauugugacu

SEQ ID NO: 1813677 - RNA, 16 nt, Homo sapiens
accuagaauagucuca

SEQ ID NO: 1813678 - RNA, 22 nt, Homo sapiens
aaauuaguauagcuacuuugga

SEQ ID NO: 1813679 - RNA, 19 nt, Homo sapiens
ccuucccaauaggugaucu

SEQ ID NO: 1813680 - RNA, 21 nt, Homo sapiens
agacucuggggaugggaauga

SEQ ID NO: 1813681 - RNA, 16 nt, Homo sapiens
cagcuugguguacuua

SEQ ID NO: 1813682 - RNA, 15 nt, Homo sapiens
gacgcuguccauugc

SEQ ID NO: 1813683 - RNA, 13 nt, Homo sapiens
uggugugaucucg

SEQ ID NO: 1813684 - RNA, 19 nt, Homo sapiens
uccuagcagacaugccaca

SEQ ID NO: 1813685 - RNA, 16 nt, Homo sapiens
uauuuaauaugucaaa

SEQ ID NO: 1813686 - RNA, 19 nt, Homo sapiens
aacauuccaaauaauucca

SEQ ID NO: 1813687 - RNA, 14 nt, Homo sapiens
aaauagcaucugcu

SEQ ID NO: 1813688 - RNA, 13 nt, Homo sapiens
guaaauucagucu

SEQ ID NO: 1813689 - RNA, 14 nt, Homo sapiens
ugcuccuaaaggca

SEQ ID NO: 1813690 - RNA, 14 nt, Homo sapiens
ucugucccuaccuu

SEQ ID NO: 1813691 - RNA, 16 nt, Homo sapiens
acaccagcccagcucc

SEQ ID NO: 1813692 - RNA, 14 nt, Homo sapiens
gcuuccacugucag

SEQ ID NO: 1813693 - RNA, 18 nt, Homo sapiens
gccccagacugagcucuc

SEQ ID NO: 1813694 - RNA, 13 nt, Homo sapiens
ucucacuacuuga

SEQ ID NO: 1813695 - RNA, 13 nt, Homo sapiens
uuagugauuccau

SEQ ID NO: 1813696 - RNA, 22 nt, Homo sapiens
cuaaagcaucacacaguggcac

SEQ ID NO: 1813697 - RNA, 21 nt, Homo sapiens
accaauuucccauuuuggaac

SEQ ID NO: 1813698 - RNA, 10 nt, Homo sapiens
gggaauuuaa

SEQ ID NO: 1813699 - RNA, 23 nt, Homo sapiens
cuaaaucacuuugagccugggaa

SEQ ID NO: 1813700 - RNA, 14 nt, Homo sapiens
auugucacagauga

SEQ ID NO: 1813701 - RNA, 14 nt, Homo sapiens
cggguugccagcuc

SEQ ID NO: 1813702 - RNA, 15 nt, Homo sapiens
agaggaauguguucg

SEQ ID NO: 1813703 - RNA, 22 nt, Homo sapiens
agucauauuuugauuauuguau

SEQ ID NO: 1813704 - RNA, 15 nt, Homo sapiens
auucaaugaaaugga

SEQ ID NO: 1813705 - RNA, 16 nt, Homo sapiens
ccuacucuucaggguc

SEQ ID NO: 1813706 - RNA, 19 nt, Homo sapiens
auggcccagccacugcagc

SEQ ID NO: 1813707 - RNA, 18 nt, Homo sapiens
ggcagauaucuauggcag

SEQ ID NO: 1813708 - RNA, 15 nt, Homo sapiens
ucccccaaugucuuc

SEQ ID NO: 1813709 - RNA, 17 nt, Homo sapiens
gcccuccuuagaccuga

SEQ ID NO: 1813710 - RNA, 12 nt, Homo sapiens
uacaguagcuug

SEQ ID NO: 1813711 - RNA, 19 nt, Homo sapiens
uggcaacggaagaaugaga

SEQ ID NO: 1813712 - RNA, 23 nt, Homo sapiens
gguccucacaagccucuucugaa

SEQ ID NO: 1813713 - RNA, 18 nt, Homo sapiens
acacuaaaaaggcaugua

SEQ ID NO: 1813714 - RNA, 21 nt, Homo sapiens
aaguacucuaauauacagugu

SEQ ID NO: 1813715 - RNA, 19 nt, Homo sapiens
guccucacauggcguccug

SEQ ID NO: 1813716 - RNA, 21 nt, Homo sapiens
acagcaaagcagcagugucca

SEQ ID NO: 1813717 - RNA, 21 nt, Homo sapiens
cuuaauaagcccacauauaaa

SEQ ID NO: 1813718 - RNA, 20 nt, Homo sapiens
aguugguucuuuuaccccac

SEQ ID NO: 1813719 - RNA, 13 nt, Homo sapiens
ucaguauuguggg

SEQ ID NO: 1813720 - RNA, 14 nt, Homo sapiens
uuauggaccaugaa

SEQ ID NO: 1813721 - RNA, 21 nt, Homo sapiens
acuaaccccaacgcacaggaa

SEQ ID NO: 1813722 - RNA, 21 nt, Homo sapiens
caagugaucugcccaccucag

SEQ ID NO: 1813723 - RNA, 14 nt, Homo sapiens
uugagagcuuucug

SEQ ID NO: 1813724 - RNA, 16 nt, Homo sapiens
uacccacagagugugg

SEQ ID NO: 1813725 - RNA, 23 nt, Homo sapiens
uggaauuuucucacgcaggagcc

SEQ ID NO: 1813726 - RNA, 18 nt, Homo sapiens
acaauaacucacucucac

SEQ ID NO: 1813727 - RNA, 13 nt, Homo sapiens
ggguguguguaug

SEQ ID NO: 1813728 - RNA, 16 nt, Homo sapiens
gcuggucuuuagcccc

SEQ ID NO: 1813729 - RNA, 22 nt, Homo sapiens
cagguccugcuccgcugccugg

SEQ ID NO: 1813730 - RNA, 16 nt, Homo sapiens
uugaaacugcauuugu

SEQ ID NO: 1813731 - RNA, 15 nt, Homo sapiens
gucggcacccuggug

SEQ ID NO: 1813732 - RNA, 17 nt, Homo sapiens
auuaauagcuuuugauu

SEQ ID NO: 1813733 - RNA, 16 nt, Homo sapiens
aaugcacaccaaaaaa

SEQ ID NO: 1813734 - RNA, 17 nt, Homo sapiens
aauauguugaguguuca

SEQ ID NO: 1813735 - RNA, 18 nt, Homo sapiens
ccuguaugucuaccucug

SEQ ID NO: 1813736 - RNA, 23 nt, Homo sapiens
uggaacuccuaaauaaacuagua

SEQ ID NO: 1813737 - RNA, 22 nt, Homo sapiens
gaagaauacccaggaagacuuu

SEQ ID NO: 1813738 - RNA, 22 nt, Homo sapiens
cucagaauauugucugccuuaa

SEQ ID NO: 1813739 - RNA, 15 nt, Homo sapiens
uguguuuucaaugca

SEQ ID NO: 1813740 - RNA, 21 nt, Homo sapiens
gcccaaaugucaggguucugc

SEQ ID NO: 1813741 - RNA, 14 nt, Homo sapiens
cucuucaaaugccu

SEQ ID NO: 1813742 - RNA, 17 nt, Homo sapiens
accaaguaagacaucuc

SEQ ID NO: 1813743 - RNA, 15 nt, Homo sapiens
uacaguugaauuuua

SEQ ID NO: 1813744 - RNA, 14 nt, Homo sapiens
uaaacacgccugca

SEQ ID NO: 1813745 - RNA, 19 nt, Homo sapiens
auuuagaaaaaaacaugaa

SEQ ID NO: 1813746 - RNA, 19 nt, Homo sapiens
agggaugguaauccuuuaa

SEQ ID NO: 1813747 - RNA, 20 nt, Homo sapiens
uccccaacucccugccauuu

SEQ ID NO: 1813748 - RNA, 13 nt, Homo sapiens
uuaacauguguua

SEQ ID NO: 1813749 - RNA, 13 nt, Homo sapiens
ggcuucuugccca

SEQ ID NO: 1813750 - RNA, 19 nt, Homo sapiens
cugaccuuuaaaaggccau

SEQ ID NO: 1813751 - RNA, 23 nt, Homo sapiens
aauccagauuuucacuguuccag

SEQ ID NO: 1813752 - RNA, 18 nt, Homo sapiens
aauaaacugaaaauggac

SEQ ID NO: 1813753 - RNA, 16 nt, Homo sapiens
aagaugguuagaacca

SEQ ID NO: 1813754 - RNA, 18 nt, Homo sapiens
uuuagcauugaagugucg

SEQ ID NO: 1813755 - RNA, 13 nt, Homo sapiens
acuccaucucuac

SEQ ID NO: 1813756 - RNA, 13 nt, Homo sapiens
augaaaucuugca

SEQ ID NO: 1813757 - RNA, 13 nt, Homo sapiens
uuccucuggagac

SEQ ID NO: 1813758 - RNA, 15 nt, Homo sapiens
cagugaaguacaccu

SEQ ID NO: 1813759 - RNA, 14 nt, Homo sapiens
cuauauugcacugu

SEQ ID NO: 1813760 - RNA, 13 nt, Homo sapiens
cugccucugccac

SEQ ID NO: 1813761 - RNA, 17 nt, Homo sapiens
uagacacauacauguca

SEQ ID NO: 1813762 - RNA, 16 nt, Homo sapiens
gcagcuggcacugaca

SEQ ID NO: 1813763 - RNA, 18 nt, Homo sapiens
caauuauuacauuuauac

SEQ ID NO: 1813764 - RNA, 15 nt, Homo sapiens
guaaggaaauggaau

SEQ ID NO: 1813765 - RNA, 20 nt, Homo sapiens
agugaauuuagucauuuuac

SEQ ID NO: 1813766 - RNA, 14 nt, Homo sapiens
uccaugcucccuua

SEQ ID NO: 1813767 - RNA, 13 nt, Homo sapiens
ccaggugcuaggg

SEQ ID NO: 1813768 - RNA, 16 nt, Homo sapiens
ggccagugcugugagc

SEQ ID NO: 1813769 - RNA, 19 nt, Homo sapiens
cagaucugcaccaccaugc

SEQ ID NO: 1813770 - RNA, 17 nt, Homo sapiens
ugggacacccacagcug

SEQ ID NO: 1813771 - RNA, 19 nt, Homo sapiens
acacaaaguguauacaugu

SEQ ID NO: 1813772 - RNA, 21 nt, Homo sapiens
gggccuggcaggccagugucu

SEQ ID NO: 1813773 - RNA, 18 nt, Homo sapiens
auggcuggagugauucug

SEQ ID NO: 1813774 - RNA, 16 nt, Homo sapiens
ggaggaccugagccug

SEQ ID NO: 1813775 - RNA, 17 nt, Homo sapiens
agacagagucucacuuu

SEQ ID NO: 1813776 - RNA, 15 nt, Homo sapiens
uccgcaccagcugcu

SEQ ID NO: 1813777 - RNA, 15 nt, Homo sapiens
ugggaaacuugucac

SEQ ID NO: 1813778 - RNA, 15 nt, Homo sapiens
accuuugggcaaagg

SEQ ID NO: 1813779 - RNA, 20 nt, Homo sapiens
ugacaugugacaucuaccuc

SEQ ID NO: 1813780 - RNA, 20 nt, Homo sapiens
ccucuuuuguuguccuugcc

SEQ ID NO: 1813781 - RNA, 18 nt, Homo sapiens
cagaacagcaucauguca

SEQ ID NO: 1813782 - RNA, 22 nt, Homo sapiens
cucuagguacgaugacaguguu

SEQ ID NO: 1813783 - RNA, 13 nt, Homo sapiens
gucccacaggcca

SEQ ID NO: 1813784 - RNA, 17 nt, Homo sapiens
aggagaaucacugcagc

SEQ ID NO: 1813785 - RNA, 19 nt, Homo sapiens
aaugauuuuagauuuucca

SEQ ID NO: 1813786 - RNA, 19 nt, Homo sapiens
uagacugaauucagcacca

SEQ ID NO: 1813787 - RNA, 16 nt, Homo sapiens
acacuguuacgaugca

SEQ ID NO: 1813788 - RNA, 21 nt, Homo sapiens
acaaauaaagcugcugugaac

SEQ ID NO: 1813789 - RNA, 23 nt, Homo sapiens
cuguaaacuuaacuguucuuugc

SEQ ID NO: 1813790 - RNA, 16 nt, Homo sapiens
uaaaaugggaagacug

SEQ ID NO: 1813791 - RNA, 21 nt, Homo sapiens
aaauaguauuccaaucacugu

SEQ ID NO: 1813792 - RNA, 17 nt, Homo sapiens
ggacuugcugguggaug

SEQ ID NO: 1813793 - RNA, 12 nt, Homo sapiens
gaacugugacag

SEQ ID NO: 1813794 - RNA, 21 nt, Homo sapiens
gcuucuguccucuucugugag

SEQ ID NO: 1813795 - RNA, 15 nt, Homo sapiens
aaggaguaugcaggg

SEQ ID NO: 1813796 - RNA, 17 nt, Homo sapiens
ucacucacauuuucuca

SEQ ID NO: 1813797 - RNA, 15 nt, Homo sapiens
aaaaacaggauacga

SEQ ID NO: 1813798 - RNA, 22 nt, Homo sapiens
cauccaaugcauaguuuguuca

SEQ ID NO: 1813799 - RNA, 15 nt, Homo sapiens
aaucaacuuuacugu

SEQ ID NO: 1813800 - RNA, 21 nt, Homo sapiens
augaaaauuuauuuuuaguga

SEQ ID NO: 1813801 - RNA, 17 nt, Homo sapiens
auacaaccuucauuuaa

SEQ ID NO: 1813802 - RNA, 12 nt, Homo sapiens
gccaucaagaaa

SEQ ID NO: 1813803 - RNA, 12 nt, Homo sapiens
uaaguaauugca

SEQ ID NO: 1813804 - RNA, 14 nt, Homo sapiens
aaccugcugugaua

SEQ ID NO: 1813805 - RNA, 16 nt, Homo sapiens
uaagaccccacuggag

SEQ ID NO: 1813806 - RNA, 19 nt, Homo sapiens
uggauugugaagauuucau

SEQ ID NO: 1813807 - RNA, 14 nt, Homo sapiens
uggaaagcugcuuc

SEQ ID NO: 1813808 - RNA, 13 nt, Homo sapiens
gaaggaaaugaca

SEQ ID NO: 1813809 - RNA, 14 nt, Homo sapiens
ugaaugcaaaguag

SEQ ID NO: 1813810 - RNA, 13 nt, Homo sapiens
gauaccugcacug

SEQ ID NO: 1813811 - RNA, 15 nt, Homo sapiens
gaaggauuacucucc

SEQ ID NO: 1813812 - RNA, 15 nt, Homo sapiens
uuuucucucacccau

SEQ ID NO: 1813813 - RNA, 15 nt, Homo sapiens
gacuaaugcaugugg

SEQ ID NO: 1813814 - RNA, 12 nt, Homo sapiens
cauucacauuca

SEQ ID NO: 1813815 - RNA, 18 nt, Homo sapiens
ugcuagaaaaauguucuu

SEQ ID NO: 1813816 - RNA, 14 nt, Homo sapiens
cuuuucccauuuca

SEQ ID NO: 1813817 - RNA, 14 nt, Homo sapiens
cucuucccaucuca

SEQ ID NO: 1813818 - RNA, 22 nt, Homo sapiens
uggggagaaaagacaugaauau

SEQ ID NO: 1813819 - RNA, 15 nt, Homo sapiens
ccuuuuuuauaacua

SEQ ID NO: 1813820 - RNA, 20 nt, Homo sapiens
ugucagacuuugcugcauuu

SEQ ID NO: 1813821 - RNA, 17 nt, Homo sapiens
guugcccagcacugucu

SEQ ID NO: 1813822 - RNA, 15 nt, Homo sapiens
uuauuaaauaaucuc

SEQ ID NO: 1813823 - RNA, 20 nt, Homo sapiens
aacacgccuuguuccugcuc

SEQ ID NO: 1813824 - RNA, 12 nt, Homo sapiens
gaacagccagac

SEQ ID NO: 1813825 - RNA, 14 nt, Homo sapiens
gcacuucauaucca

SEQ ID NO: 1813826 - RNA, 14 nt, Homo sapiens
cuaacaagauuugu

SEQ ID NO: 1813827 - RNA, 19 nt, Homo sapiens
agccuugaugccauaugcc

SEQ ID NO: 1813828 - RNA, 19 nt, Homo sapiens
cagagcggguaaagugcaa

SEQ ID NO: 1813829 - RNA, 19 nt, Homo sapiens
ucuggcagagccucugaga

SEQ ID NO: 1813830 - RNA, 22 nt, Homo sapiens
cauucaauguuuaugcaaggaa

SEQ ID NO: 1813831 - RNA, 11 nt, Homo sapiens
caaagugugac

SEQ ID NO: 1813832 - RNA, 14 nt, Homo sapiens
ggcuugcaugccaa

SEQ ID NO: 1813833 - RNA, 12 nt, Homo sapiens
uaaccucuuguu

SEQ ID NO: 1813834 - RNA, 18 nt, Homo sapiens
aucaagugucuuccauca

SEQ ID NO: 1813835 - RNA, 19 nt, Homo sapiens
uaggcccacacacaggugg

SEQ ID NO: 1813836 - RNA, 23 nt, Homo sapiens
gcccacguacccaggucugggug

SEQ ID NO: 1813837 - RNA, 21 nt, Homo sapiens
gcucaguagucagacuggaua

SEQ ID NO: 1813838 - RNA, 21 nt, Homo sapiens
aaaacaauguccuuacuugua

SEQ ID NO: 1813839 - RNA, 12 nt, Homo sapiens
auucuacugugu

SEQ ID NO: 1813840 - RNA, 20 nt, Homo sapiens
uacauacaggccauacuuua

SEQ ID NO: 1813841 - RNA, 17 nt, Homo sapiens
gauguuuuacgugcaaa

SEQ ID NO: 1813842 - RNA, 16 nt, Homo sapiens
gcagagcaugaccuga

SEQ ID NO: 1813843 - RNA, 15 nt, Homo sapiens
auuuucuggaaugga

SEQ ID NO: 1813844 - RNA, 14 nt, Homo sapiens
ccugucugucccag

SEQ ID NO: 1813845 - RNA, 13 nt, Homo sapiens
aguggacuguauu

SEQ ID NO: 1813846 - RNA, 18 nt, Homo sapiens
cuugugcauuguguguca

SEQ ID NO: 1813847 - RNA, 21 nt, Homo sapiens
cuuucucaaucuugaacucau

SEQ ID NO: 1813848 - RNA, 15 nt, Homo sapiens
auuugcuuuuugcua

SEQ ID NO: 1813849 - RNA, 19 nt, Homo sapiens
acauguugggcaugauucu

SEQ ID NO: 1813850 - RNA, 14 nt, Homo sapiens
uauuuguuacugua

SEQ ID NO: 1813851 - RNA, 18 nt, Homo sapiens
ucugggcugccaugugaa

SEQ ID NO: 1813852 - RNA, 21 nt, Homo sapiens
aaauguucuccuuagauguga

SEQ ID NO: 1813853 - RNA, 22 nt, Homo sapiens
uucaucagacuccugugcaacu

SEQ ID NO: 1813854 - RNA, 21 nt, Homo sapiens
ugccagaggccccaggucacc

SEQ ID NO: 1813855 - RNA, 17 nt, Homo sapiens
uggagugagacccagga

SEQ ID NO: 1813856 - RNA, 23 nt, Homo sapiens
aaaugagucccuguccccaccuc

SEQ ID NO: 1813857 - RNA, 14 nt, Homo sapiens
uuggcucacugcaa

SEQ ID NO: 1813858 - RNA, 19 nt, Homo sapiens
agucagggaaggugccucu

SEQ ID NO: 1813859 - RNA, 22 nt, Homo sapiens
ucauaccacuugaauuuauuga

SEQ ID NO: 1813860 - RNA, 21 nt, Homo sapiens
ucaaaaaccuggagugcucaa

SEQ ID NO: 1813861 - RNA, 23 nt, Homo sapiens
acaucaguccacccccauuguga

SEQ ID NO: 1813862 - RNA, 17 nt, Homo sapiens
caacucugggaaaacca

SEQ ID NO: 1813863 - RNA, 18 nt, Homo sapiens
accuaagucucugugaau

SEQ ID NO: 1813864 - RNA, 19 nt, Homo sapiens
cugucuaagauuaauagca

SEQ ID NO: 1813865 - RNA, 21 nt, Homo sapiens
cuuuaguucuaguuagucauc

SEQ ID NO: 1813866 - RNA, 22 nt, Homo sapiens
uccuucuuggaguuacaacaga

SEQ ID NO: 1813867 - RNA, 17 nt, Homo sapiens
ggggcugggagcugccu

SEQ ID NO: 1813868 - RNA, 19 nt, Homo sapiens
ucuuccuccugacacccca

SEQ ID NO: 1813869 - RNA, 19 nt, Homo sapiens
ugguaagcauuagcacaua

SEQ ID NO: 1813870 - RNA, 20 nt, Homo sapiens
aacaaacauggauacuuccu

SEQ ID NO: 1813871 - RNA, 15 nt, Homo sapiens
ugguggccagcagca

SEQ ID NO: 1813872 - RNA, 14 nt, Homo sapiens
gauuuccuugacuu

SEQ ID NO: 1813873 - RNA, 21 nt, Homo sapiens
uugaaaaugaaaugacugucu

SEQ ID NO: 1813874 - RNA, 23 nt, Homo sapiens
gagccccccuagcaauacaggga

SEQ ID NO: 1813875 - RNA, 14 nt, Homo sapiens
aguuacaacagaag

SEQ ID NO: 1813876 - RNA, 15 nt, Homo sapiens
cauuugugguccuga

SEQ ID NO: 1813877 - RNA, 16 nt, Homo sapiens
accccaugugccuuua

SEQ ID NO: 1813878 - RNA, 18 nt, Homo sapiens
auacaauuagccaggugu

SEQ ID NO: 1813879 - RNA, 16 nt, Homo sapiens
ucuaacccuguggaag

SEQ ID NO: 1813880 - RNA, 18 nt, Homo sapiens
gaagcggauuuccaggga

SEQ ID NO: 1813881 - RNA, 22 nt, Homo sapiens
ucucuaauuggaagaaauuccu

SEQ ID NO: 1813882 - RNA, 20 nt, Homo sapiens
gggcuucugcguccaccagg

SEQ ID NO: 1813883 - RNA, 16 nt, Homo sapiens
gcaaugacuuuccuag

SEQ ID NO: 1813884 - RNA, 9 nt, Homo sapiens
uugcugcug

SEQ ID NO: 1813885 - RNA, 22 nt, Homo sapiens
gaguuugccuguucuaugccuu

SEQ ID NO: 1813886 - RNA, 17 nt, Homo sapiens
agacacagaagccuuug

SEQ ID NO: 1813887 - RNA, 16 nt, Homo sapiens
accauguagcagugag

SEQ ID NO: 1813888 - RNA, 21 nt, Homo sapiens
cuaugauuaaaagccacuguu

SEQ ID NO: 1813889 - RNA, 20 nt, Homo sapiens
ggacugacagcaugugcccu

SEQ ID NO: 1813890 - RNA, 21 nt, Homo sapiens
ccauaaaucaauucauugugu

SEQ ID NO: 1813891 - RNA, 13 nt, Homo sapiens
ggaugaggucaua

SEQ ID NO: 1813892 - RNA, 14 nt, Homo sapiens
uuaaaaugagaucg

SEQ ID NO: 1813893 - RNA, 16 nt, Homo sapiens
auguuccuacgggcuu

SEQ ID NO: 1813894 - RNA, 20 nt, Homo sapiens
gacauagauauuuucacaau

SEQ ID NO: 1813895 - RNA, 18 nt, Homo sapiens
ggacuaggagcacuguag

SEQ ID NO: 1813896 - RNA, 20 nt, Homo sapiens
cagcuauguagcaaagggaa

SEQ ID NO: 1813897 - RNA, 13 nt, Homo sapiens
ucagccucugauc

SEQ ID NO: 1813898 - RNA, 22 nt, Homo sapiens
cgggggugugucuguagguguc

SEQ ID NO: 1813899 - RNA, 18 nt, Homo sapiens
guguugccucuugcaaug

SEQ ID NO: 1813900 - RNA, 16 nt, Homo sapiens
ucuaaguaaaaccaca

SEQ ID NO: 1813901 - RNA, 14 nt, Homo sapiens
agaaccuucaaccc

SEQ ID NO: 1813902 - RNA, 14 nt, Homo sapiens
uaauaguacuauug

SEQ ID NO: 1813903 - RNA, 13 nt, Homo sapiens
uaaacuugcauca

SEQ ID NO: 1813904 - RNA, 13 nt, Homo sapiens
ucucucaucucuu

SEQ ID NO: 1813905 - RNA, 17 nt, Homo sapiens
gacccacacugcuacac

SEQ ID NO: 1813906 - RNA, 17 nt, Homo sapiens
ucccuacacagggccug

SEQ ID NO: 1813907 - RNA, 22 nt, Homo sapiens
gcaaauacaaucagcccagugc

SEQ ID NO: 1813908 - RNA, 16 nt, Homo sapiens
gacuccuuccuugaac

SEQ ID NO: 1813909 - RNA, 18 nt, Homo sapiens
cuuagaguguagcuguaa

SEQ ID NO: 1813910 - RNA, 21 nt, Homo sapiens
accugcuagucgccccucaga

SEQ ID NO: 1813911 - RNA, 16 nt, Homo sapiens
cagcaucugcuccauc

SEQ ID NO: 1813912 - RNA, 21 nt, Homo sapiens
uguggaucaaccaucgcuuua

SEQ ID NO: 1813913 - RNA, 19 nt, Homo sapiens
uuccacugccuccugugac

SEQ ID NO: 1813914 - RNA, 20 nt, Homo sapiens
gccugcuuuucacugcugca

SEQ ID NO: 1813915 - RNA, 21 nt, Homo sapiens
uucacaaggucaguaaugcug

SEQ ID NO: 1813916 - RNA, 21 nt, Homo sapiens
cauggagacguggugggacuc

SEQ ID NO: 1813917 - RNA, 20 nt, Homo sapiens
agggcuacaaaggaggacaa

SEQ ID NO: 1813918 - RNA, 17 nt, Homo sapiens
aauucguaaucaucccc

SEQ ID NO: 1813919 - RNA, 15 nt, Homo sapiens
cccaguguguguuua

SEQ ID NO: 1813920 - RNA, 18 nt, Homo sapiens
ccugaggggagacagagc

SEQ ID NO: 1813921 - RNA, 17 nt, Homo sapiens
uagcucuggugaccuug

SEQ ID NO: 1813922 - RNA, 20 nt, Homo sapiens
acgccaacauggcacaugua

SEQ ID NO: 1813923 - RNA, 22 nt, Homo sapiens
cacgauaugcaaguucauccaa

SEQ ID NO: 1813924 - RNA, 17 nt, Homo sapiens
guuucugaagugcucuu

SEQ ID NO: 1813925 - RNA, 18 nt, Homo sapiens
auaugaucaaacuuccau

SEQ ID NO: 1813926 - RNA, 16 nt, Homo sapiens
uucaacaaauuucauu

SEQ ID NO: 1813927 - RNA, 21 nt, Homo sapiens
caucccuagaaagccaugugc

SEQ ID NO: 1813928 - RNA, 20 nt, Homo sapiens
cacagauggucacacagaga

SEQ ID NO: 1813929 - RNA, 12 nt, Homo sapiens
ucauuaauguga

SEQ ID NO: 1813930 - RNA, 19 nt, Homo sapiens
gccauguguggagugugcu

SEQ ID NO: 1813931 - RNA, 18 nt, Homo sapiens
ugaauuuggccagacaca

SEQ ID NO: 1813932 - RNA, 17 nt, Homo sapiens
uuacaaguuucuagcuc

SEQ ID NO: 1813933 - RNA, 12 nt, Homo sapiens
uuucaacaaaua

SEQ ID NO: 1813934 - RNA, 16 nt, Homo sapiens
cugugugacaucacag

SEQ ID NO: 1813935 - RNA, 16 nt, Homo sapiens
gcuuguaucaacacug

SEQ ID NO: 1813936 - RNA, 21 nt, Homo sapiens
uucuuaaauaauaaagaucau

SEQ ID NO: 1813937 - RNA, 21 nt, Homo sapiens
auagcucacuguaaccucaaa

SEQ ID NO: 1813938 - RNA, 21 nt, Homo sapiens
aauuuacuuuucaagcuauaa

SEQ ID NO: 1813939 - RNA, 19 nt, Homo sapiens
cgcugucucugaggggugg

SEQ ID NO: 1813940 - RNA, 16 nt, Homo sapiens
cagugaccagucacug

SEQ ID NO: 1813941 - RNA, 13 nt, Homo sapiens
agaaucucugagc

SEQ ID NO: 1813942 - RNA, 19 nt, Homo sapiens
uuaauaucccuacauguau

SEQ ID NO: 1813943 - RNA, 16 nt, Homo sapiens
ucccugggccaacaga

SEQ ID NO: 1813944 - RNA, 22 nt, Homo sapiens
auuuaagcaauaaaacugcuag

SEQ ID NO: 1813945 - RNA, 17 nt, Homo sapiens
cauugacuucaagaugc

SEQ ID NO: 1813946 - RNA, 18 nt, Homo sapiens
ccagggugguggugcaca

SEQ ID NO: 1813947 - RNA, 16 nt, Homo sapiens
caucucuuucugcaaa

SEQ ID NO: 1813948 - RNA, 14 nt, Homo sapiens
cuuugugugcucuc

SEQ ID NO: 1813949 - RNA, 21 nt, Homo sapiens
uaauuuagauauuuuccauau

SEQ ID NO: 1813950 - RNA, 12 nt, Homo sapiens
auuagcugugau

SEQ ID NO: 1813951 - RNA, 13 nt, Homo sapiens
agcugugugagaa

SEQ ID NO: 1813952 - RNA, 21 nt, Homo sapiens
aaaccuguaagcccagcauuu

SEQ ID NO: 1813953 - RNA, 19 nt, Homo sapiens
guauucuuuuuccaucccu

SEQ ID NO: 1813954 - RNA, 15 nt, Homo sapiens
cccucuaagggaccu

SEQ ID NO: 1813955 - RNA, 17 nt, Homo sapiens
aggccagagccaugcca

SEQ ID NO: 1813956 - RNA, 23 nt, Homo sapiens
cacuuuaaaaccaguuacccaaa

SEQ ID NO: 1813957 - RNA, 13 nt, Homo sapiens
gugaaaaugccac

SEQ ID NO: 1813958 - RNA, 17 nt, Homo sapiens
uuuuggagaaaugucau

SEQ ID NO: 1813959 - RNA, 18 nt, Homo sapiens
augcagccagccaucaaa

SEQ ID NO: 1813960 - RNA, 15 nt, Homo sapiens
ugacuuucugauuac

SEQ ID NO: 1813961 - RNA, 14 nt, Homo sapiens
aaaaucccaugaga

SEQ ID NO: 1813962 - RNA, 22 nt, Homo sapiens
guuuuguaaugagauuuacuua

SEQ ID NO: 1813963 - RNA, 14 nt, Homo sapiens
gagacuuaggccag

SEQ ID NO: 1813964 - RNA, 12 nt, Homo sapiens
cuguccuagugg

SEQ ID NO: 1813965 - RNA, 20 nt, Homo sapiens
auggcucaagucugcacaga

SEQ ID NO: 1813966 - RNA, 15 nt, Homo sapiens
aaagccagucaaaac

SEQ ID NO: 1813967 - RNA, 20 nt, Homo sapiens
cuacuccccauuguucugga

SEQ ID NO: 1813968 - RNA, 17 nt, Homo sapiens
uggcaguccagccagcu

SEQ ID NO: 1813969 - RNA, 21 nt, Homo sapiens
cgagaggcucugagggucuga

SEQ ID NO: 1813970 - RNA, 20 nt, Homo sapiens
ggaaccacaccacaucuaag

SEQ ID NO: 1813971 - RNA, 20 nt, Homo sapiens
agaagaugcaguucaaaaac

SEQ ID NO: 1813972 - RNA, 11 nt, Homo sapiens
ggggggcuccc

SEQ ID NO: 1813973 - RNA, 14 nt, Homo sapiens
uggaacacuuucag

SEQ ID NO: 1813974 - RNA, 14 nt, Homo sapiens
gaggagaaacugag

SEQ ID NO: 1813975 - RNA, 21 nt, Homo sapiens
aaaaacaauaaagauacauga

SEQ ID NO: 1813976 - RNA, 17 nt, Homo sapiens
gacucaauaaaaucaug

SEQ ID NO: 1813977 - RNA, 20 nt, Homo sapiens
guaaucccagcuacuuggga

SEQ ID NO: 1813978 - RNA, 13 nt, Homo sapiens
cauuuuuggugua

SEQ ID NO: 1813979 - RNA, 15 nt, Homo sapiens
uaccagcucacuccc

SEQ ID NO: 1813980 - RNA, 21 nt, Homo sapiens
uugauguaaugaaauuccaga

SEQ ID NO: 1813981 - RNA, 18 nt, Homo sapiens
uguuuacaaagcaucuca

SEQ ID NO: 1813982 - RNA, 15 nt, Homo sapiens
aaauauuuccaucag

SEQ ID NO: 1813983 - RNA, 23 nt, Homo sapiens
ucucugcucuuguuucacuccac

SEQ ID NO: 1813984 - RNA, 12 nt, Homo sapiens
aauuuugugcua

SEQ ID NO: 1813985 - RNA, 16 nt, Homo sapiens
auucuuguuggcuuuu

SEQ ID NO: 1813986 - RNA, 22 nt, Homo sapiens
cgauauacauuuauuuacacuc

SEQ ID NO: 1813987 - RNA, 14 nt, Homo sapiens
cauugaauucauua

SEQ ID NO: 1813988 - RNA, 13 nt, Homo sapiens
aaaaauaucugaa

SEQ ID NO: 1813989 - RNA, 19 nt, Homo sapiens
gaaaauuagagaucaugaa

SEQ ID NO: 1813990 - RNA, 19 nt, Homo sapiens
aaaaauaaaagaucuugaa

SEQ ID NO: 1813991 - RNA, 19 nt, Homo sapiens
ggcugcagcagccggaaua

SEQ ID NO: 1813992 - RNA, 14 nt, Homo sapiens
uauuuauacuguau

SEQ ID NO: 1813993 - RNA, 19 nt, Homo sapiens
gagggaaguuuaaaaccca

SEQ ID NO: 1813994 - RNA, 20 nt, Homo sapiens
uuucugacacagucaauucu

SEQ ID NO: 1813995 - RNA, 19 nt, Homo sapiens
acauuauuuaauauaguaa

SEQ ID NO: 1813996 - RNA, 20 nt, Homo sapiens
agcacuuagcaggcaccgcc

SEQ ID NO: 1813997 - RNA, 20 nt, Homo sapiens
agacugucauuagaauugaa

SEQ ID NO: 1813998 - RNA, 21 nt, Homo sapiens
caaucuuuccuugucucucau

SEQ ID NO: 1813999 - RNA, 14 nt, Homo sapiens
uccggcggggaccc

SEQ ID NO: 1814000 - RNA, 19 nt, Homo sapiens
cgaguaguugggauuacag

SEQ ID NO: 1814001 - RNA, 22 nt, Homo sapiens
ugaaacgcaaccaccaccaacc

SEQ ID NO: 1814002 - RNA, 16 nt, Homo sapiens
uucacuaggaggucau

SEQ ID NO: 1814003 - RNA, 16 nt, Homo sapiens
caaauuucauugcacu

SEQ ID NO: 1814004 - RNA, 19 nt, Homo sapiens
uuguuuuuagagacagggu

SEQ ID NO: 1814005 - RNA, 17 nt, Homo sapiens
aaagcauaacaaaaaga

SEQ ID NO: 1814006 - RNA, 12 nt, Homo sapiens
ugggcagcugcc

SEQ ID NO: 1814007 - RNA, 14 nt, Homo sapiens
gaccuggacacagg

SEQ ID NO: 1814008 - RNA, 19 nt, Homo sapiens
gucucuacuaaaaauacaa

SEQ ID NO: 1814009 - RNA, 19 nt, Homo sapiens
cuuuuauuaaugcacuuuc

SEQ ID NO: 1814010 - RNA, 22 nt, Homo sapiens
uccugaaguucacucagaggga

SEQ ID NO: 1814011 - RNA, 18 nt, Homo sapiens
uggcuacacacaaaccag

SEQ ID NO: 1814012 - RNA, 16 nt, Homo sapiens
acuccagccugaguca

SEQ ID NO: 1814013 - RNA, 18 nt, Homo sapiens
cauauaucucccaacaga

SEQ ID NO: 1814014 - RNA, 22 nt, Homo sapiens
uaguccccaucagcaccaugga

SEQ ID NO: 1814015 - RNA, 15 nt, Homo sapiens
ggaugucuuccuugg

SEQ ID NO: 1814016 - RNA, 23 nt, Homo sapiens
acuaguauguuuucaagucuccu

SEQ ID NO: 1814017 - RNA, 17 nt, Homo sapiens
uuccucagauggacaag

SEQ ID NO: 1814018 - RNA, 16 nt, Homo sapiens
acuuacaaagggucua

SEQ ID NO: 1814019 - RNA, 16 nt, Homo sapiens
ugagacauauuuacaa

SEQ ID NO: 1814020 - RNA, 16 nt, Homo sapiens
uagaacccaggucuga

SEQ ID NO: 1814021 - RNA, 23 nt, Homo sapiens
aacagcuuugugaacguggcagu

SEQ ID NO: 1814022 - RNA, 23 nt, Homo sapiens
uguagccugaguguccacaggga

SEQ ID NO: 1814023 - RNA, 17 nt, Homo sapiens
ccaagugugaugcauug

SEQ ID NO: 1814024 - RNA, 17 nt, Homo sapiens
acagcaauaacucggug

SEQ ID NO: 1814025 - RNA, 13 nt, Homo sapiens
cagcuacucagga

SEQ ID NO: 1814026 - RNA, 21 nt, Homo sapiens
uagaguuuacuauuuuagcag

SEQ ID NO: 1814027 - RNA, 22 nt, Homo sapiens
ggagugcaguggcgugaucucg

SEQ ID NO: 1814028 - RNA, 16 nt, Homo sapiens
acucaacuaggcucau

SEQ ID NO: 1814029 - RNA, 11 nt, Homo sapiens
aauaagcacua

SEQ ID NO: 1814030 - RNA, 20 nt, Homo sapiens
agcucacucuggauuccaca

SEQ ID NO: 1814031 - RNA, 22 nt, Homo sapiens
agaauggaugugcucacugggg

SEQ ID NO: 1814032 - RNA, 23 nt, Homo sapiens
agccugggaguguuugucccauc

SEQ ID NO: 1814033 - RNA, 15 nt, Homo sapiens
agccauggcccuccc

SEQ ID NO: 1814034 - RNA, 16 nt, Homo sapiens
gcauacuuucccucau

SEQ ID NO: 1814035 - RNA, 19 nt, Homo sapiens
aaaaugauuggccccaguc

SEQ ID NO: 1814036 - RNA, 14 nt, Homo sapiens
cggaggauauuaaa

SEQ ID NO: 1814037 - RNA, 20 nt, Homo sapiens
uuccccccaucuccauugca

SEQ ID NO: 1814038 - RNA, 21 nt, Homo sapiens
uuguaaauauucuacacaugu

SEQ ID NO: 1814039 - RNA, 17 nt, Homo sapiens
cugaagaaugaagacca

SEQ ID NO: 1814040 - RNA, 23 nt, Homo sapiens
aagugagacccccaucucuacaa

SEQ ID NO: 1814041 - RNA, 20 nt, Homo sapiens
gcgaaugauuuaaauagaac

SEQ ID NO: 1814042 - RNA, 21 nt, Homo sapiens
auucuauuucaacuucaggaa

SEQ ID NO: 1814043 - RNA, 18 nt, Homo sapiens
agauuugaugggccacaa

SEQ ID NO: 1814044 - RNA, 14 nt, Homo sapiens
acaucuauucucaa

SEQ ID NO: 1814045 - RNA, 22 nt, Homo sapiens
ugugacucuaagcucagugcuc

SEQ ID NO: 1814046 - RNA, 21 nt, Homo sapiens
gugacucuuuccuaaagccaa

SEQ ID NO: 1814047 - RNA, 23 nt, Homo sapiens
cagcucuuuuccagaucaaagaa

SEQ ID NO: 1814048 - RNA, 14 nt, Homo sapiens
caucaagaugugac

SEQ ID NO: 1814049 - RNA, 13 nt, Homo sapiens
uauuugcuaugaa

SEQ ID NO: 1814050 - RNA, 16 nt, Homo sapiens
agaaaauuaguaauug

SEQ ID NO: 1814051 - RNA, 15 nt, Homo sapiens
ugauuguguagccau

SEQ ID NO: 1814052 - RNA, 17 nt, Homo sapiens
gguguucccuuggcaaa

SEQ ID NO: 1814053 - RNA, 17 nt, Homo sapiens
ucuaugauaauuacaau

SEQ ID NO: 1814054 - RNA, 15 nt, Homo sapiens
cuugcucaaagggaa

SEQ ID NO: 1814055 - RNA, 18 nt, Homo sapiens
uccgcgggcugacugggc

SEQ ID NO: 1814056 - RNA, 11 nt, Homo sapiens
agacacagacu

SEQ ID NO: 1814057 - RNA, 11 nt, Homo sapiens
ucacacagugu

SEQ ID NO: 1814058 - RNA, 21 nt, Homo sapiens
aauagacuaaccucuaccagc

SEQ ID NO: 1814059 - RNA, 16 nt, Homo sapiens
cccaggucuuccagac

SEQ ID NO: 1814060 - RNA, 13 nt, Homo sapiens
ugcuagcuguaga

SEQ ID NO: 1814061 - RNA, 22 nt, Homo sapiens
ucucauucuucuaaaacuacug

SEQ ID NO: 1814062 - RNA, 22 nt, Homo sapiens
aauaaauagcuauauccaugua

SEQ ID NO: 1814063 - RNA, 22 nt, Homo sapiens
auuugugacuaauuguauaaca

SEQ ID NO: 1814064 - RNA, 16 nt, Homo sapiens
acaaguauuacacauc

SEQ ID NO: 1814065 - RNA, 23 nt, Homo sapiens
cuucugagacaucccugauucuc

SEQ ID NO: 1814066 - RNA, 14 nt, Homo sapiens
aagacuuauuuuca

SEQ ID NO: 1814067 - RNA, 19 nt, Homo sapiens
aggcauugagggcucuaaa

SEQ ID NO: 1814068 - RNA, 15 nt, Homo sapiens
acaguuuuuggcaaa

SEQ ID NO: 1814069 - RNA, 18 nt, Homo sapiens
gagacgguuuccagggag

SEQ ID NO: 1814070 - RNA, 19 nt, Homo sapiens
guuuucaggacaacacuuc

SEQ ID NO: 1814071 - RNA, 16 nt, Homo sapiens
acuagucucaccagcc

SEQ ID NO: 1814072 - RNA, 19 nt, Homo sapiens
guaaaauagaugaguguua

SEQ ID NO: 1814073 - RNA, 18 nt, Homo sapiens
cugguggcugcaggcacc

SEQ ID NO: 1814074 - RNA, 20 nt, Homo sapiens
ccugcucaggagcagcacuc

SEQ ID NO: 1814075 - RNA, 14 nt, Homo sapiens
uugggcccaggacu

SEQ ID NO: 1814076 - RNA, 11 nt, Homo sapiens
ugcaagggaau

SEQ ID NO: 1814077 - RNA, 16 nt, Homo sapiens
cagugugucacacuga

SEQ ID NO: 1814078 - RNA, 17 nt, Homo sapiens
ucagugguuagaagcau

SEQ ID NO: 1814079 - RNA, 20 nt, Homo sapiens
gcugaggcccccagcugccu

SEQ ID NO: 1814080 - RNA, 16 nt, Homo sapiens
gccagugggaccccac

SEQ ID NO: 1814081 - RNA, 16 nt, Homo sapiens
uguguccuugcauggc

SEQ ID NO: 1814082 - RNA, 19 nt, Homo sapiens
uuuagguggcauaguggcu

SEQ ID NO: 1814083 - RNA, 19 nt, Homo sapiens
aguagacauuuuaacaaga

SEQ ID NO: 1814084 - RNA, 22 nt, Homo sapiens
agcaaacugaauggcaaugaaa

SEQ ID NO: 1814085 - RNA, 15 nt, Homo sapiens
cuggggccuguugaa

SEQ ID NO: 1814086 - RNA, 23 nt, Homo sapiens
agacauuucucuaacuccugcca

SEQ ID NO: 1814087 - RNA, 20 nt, Homo sapiens
acagugugggacaggcucuu

SEQ ID NO: 1814088 - RNA, 15 nt, Homo sapiens
uauauaaguguacau

SEQ ID NO: 1814089 - RNA, 19 nt, Homo sapiens
aaaugggagacagccucuu

SEQ ID NO: 1814090 - RNA, 21 nt, Homo sapiens
guauacuuguauaacuuugua

SEQ ID NO: 1814091 - RNA, 16 nt, Homo sapiens
uaugucaguuugcagu

SEQ ID NO: 1814092 - RNA, 12 nt, Homo sapiens
gcuucaguccac

SEQ ID NO: 1814093 - RNA, 14 nt, Homo sapiens
gaaacagcugccac

SEQ ID NO: 1814094 - RNA, 23 nt, Homo sapiens
auguguugugaaaauuuaaucuu

SEQ ID NO: 1814095 - RNA, 14 nt, Homo sapiens
acaucuguucuuug

SEQ ID NO: 1814096 - RNA, 23 nt, Homo sapiens
ucuguagccuggucugugcauug

SEQ ID NO: 1814097 - RNA, 19 nt, Homo sapiens
ucuguccacgauucacuca

SEQ ID NO: 1814098 - RNA, 22 nt, Homo sapiens
caggguguuugcagcugugaga

SEQ ID NO: 1814099 - RNA, 20 nt, Homo sapiens
uccuuuugcuucaucuggag

SEQ ID NO: 1814100 - RNA, 17 nt, Homo sapiens
ggccaaugcuacuuuca

SEQ ID NO: 1814101 - RNA, 23 nt, Homo sapiens
gcuggucuaagaaugacgaugcc

SEQ ID NO: 1814102 - RNA, 22 nt, Homo sapiens
cuggagccagagagaacaacag

SEQ ID NO: 1814103 - RNA, 20 nt, Homo sapiens
aacuguacuacaucuaguua

SEQ ID NO: 1814104 - RNA, 11 nt, Homo sapiens
guauggugcug

SEQ ID NO: 1814105 - RNA, 16 nt, Homo sapiens
ggcuuccucaggggca

SEQ ID NO: 1814106 - RNA, 16 nt, Homo sapiens
ugcaaacugcuuuauu

SEQ ID NO: 1814107 - RNA, 21 nt, Homo sapiens
cuggauaucgucauuuugcag

SEQ ID NO: 1814108 - RNA, 13 nt, Homo sapiens
uagagaugagcuu

SEQ ID NO: 1814109 - RNA, 23 nt, Homo sapiens
caggcugcuggagugcaguggca

SEQ ID NO: 1814110 - RNA, 19 nt, Homo sapiens
gugaacauuuuuuauuuga

SEQ ID NO: 1814111 - RNA, 17 nt, Homo sapiens
auguaaacccucaaggg

SEQ ID NO: 1814112 - RNA, 23 nt, Homo sapiens
ucugcuguuuuuuuugcugcuaa

SEQ ID NO: 1814113 - RNA, 23 nt, Homo sapiens
uugauguauauuugaacuccucu

SEQ ID NO: 1814114 - RNA, 15 nt, Homo sapiens
agaaauaaaucagua

SEQ ID NO: 1814115 - RNA, 18 nt, Homo sapiens
cugcuuuuugcuucuuga

SEQ ID NO: 1814116 - RNA, 16 nt, Homo sapiens
ccacaucccaguuucu

SEQ ID NO: 1814117 - RNA, 20 nt, Homo sapiens
ucuuaacagaucuuuacucu

SEQ ID NO: 1814118 - RNA, 22 nt, Homo sapiens
cagaaacggucuuuaugaauua

SEQ ID NO: 1814119 - RNA, 17 nt, Homo sapiens
aaggucuggccucaggu

SEQ ID NO: 1814120 - RNA, 23 nt, Homo sapiens
gccaaauccauccugcucuucca

SEQ ID NO: 1814121 - RNA, 13 nt, Homo sapiens
aauucuugcuuga

SEQ ID NO: 1814122 - RNA, 20 nt, Homo sapiens
gggaggugggauuuagccag

SEQ ID NO: 1814123 - RNA, 20 nt, Homo sapiens
cggcugucuccuugaagguu

SEQ ID NO: 1814124 - RNA, 23 nt, Homo sapiens
ugcagugugaaacuuaccauuca

SEQ ID NO: 1814125 - RNA, 17 nt, Homo sapiens
augagugucaacuccag

SEQ ID NO: 1814126 - RNA, 15 nt, Homo sapiens
aaugaaauaaaagca

SEQ ID NO: 1814127 - RNA, 22 nt, Homo sapiens
augguguaggaaaaaugcaagc

SEQ ID NO: 1814128 - RNA, 14 nt, Homo sapiens
aauaagcucaguga

SEQ ID NO: 1814129 - RNA, 14 nt, Homo sapiens
cacagaacucagcc

SEQ ID NO: 1814130 - RNA, 20 nt, Homo sapiens
uagcacugcagaaaccuuua

SEQ ID NO: 1814131 - RNA, 15 nt, Homo sapiens
ugggcccuaugucuc

SEQ ID NO: 1814132 - RNA, 13 nt, Homo sapiens
accguugcuaaga

SEQ ID NO: 1814133 - RNA, 13 nt, Homo sapiens
accacagugcccc

SEQ ID NO: 1814134 - RNA, 13 nt, Homo sapiens
guucaaguauuaa

SEQ ID NO: 1814135 - RNA, 15 nt, Homo sapiens
uaaaguauauugaaa

SEQ ID NO: 1814136 - RNA, 19 nt, Homo sapiens
gcccccgacggcugugacg

SEQ ID NO: 1814137 - RNA, 17 nt, Homo sapiens
cauuaauauauccuaaa

SEQ ID NO: 1814138 - RNA, 23 nt, Homo sapiens
ccugcuggcacuauccagaugga

SEQ ID NO: 1814139 - RNA, 17 nt, Homo sapiens
aggcacauggaauauau

SEQ ID NO: 1814140 - RNA, 15 nt, Homo sapiens
aaucagaucauuuca

SEQ ID NO: 1814141 - RNA, 18 nt, Homo sapiens
guaaauuuucaagcagca

SEQ ID NO: 1814142 - RNA, 16 nt, Homo sapiens
guucgauuuaagccau

SEQ ID NO: 1814143 - RNA, 18 nt, Homo sapiens
ucaccacguggggcucac

SEQ ID NO: 1814144 - RNA, 11 nt, Homo sapiens
uuaugugcaau

SEQ ID NO: 1814145 - RNA, 22 nt, Homo sapiens
auguugaaaaagaaaacaacca

SEQ ID NO: 1814146 - RNA, 13 nt, Homo sapiens
auuagggacacuu

SEQ ID NO: 1814147 - RNA, 12 nt, Homo sapiens
uucacagugugu

SEQ ID NO: 1814148 - RNA, 17 nt, Homo sapiens
cagggaaggagacacca

SEQ ID NO: 1814149 - RNA, 20 nt, Homo sapiens
uaauuaggcaaagacaggag

SEQ ID NO: 1814150 - RNA, 19 nt, Homo sapiens
aaguucugguaugaacuug

SEQ ID NO: 1814151 - RNA, 16 nt, Homo sapiens
aucucaccccauccca

SEQ ID NO: 1814152 - RNA, 18 nt, Homo sapiens
ucuuuuuucccaagagca

SEQ ID NO: 1814153 - RNA, 18 nt, Homo sapiens
guaggggcacagugaaug

SEQ ID NO: 1814154 - RNA, 17 nt, Homo sapiens
uccuguggcagcugccc

SEQ ID NO: 1814155 - RNA, 21 nt, Homo sapiens
uuuugcagaaugagccagagu

SEQ ID NO: 1814156 - RNA, 19 nt, Homo sapiens
uggccagaagggggccaug

SEQ ID NO: 1814157 - RNA, 21 nt, Homo sapiens
uuacauuuccaaaugaaugac

SEQ ID NO: 1814158 - RNA, 21 nt, Homo sapiens
uacagaauugacugcaguuga

SEQ ID NO: 1814159 - RNA, 22 nt, Homo sapiens
gccaugugauuacccucugggu

SEQ ID NO: 1814160 - RNA, 21 nt, Homo sapiens
cuguguaaaacuauauucuca

SEQ ID NO: 1814161 - RNA, 14 nt, Homo sapiens
auuuggaaccaaag

SEQ ID NO: 1814162 - RNA, 18 nt, Homo sapiens
gagauauuugguaccaug

SEQ ID NO: 1814163 - RNA, 17 nt, Homo sapiens
uaauucuuaaaagggaa

SEQ ID NO: 1814164 - RNA, 19 nt, Homo sapiens
aauaugaguuuuauugucc

SEQ ID NO: 1814165 - RNA, 24 nt, Homo sapiens
cugcucuauauuacaaguugugca

SEQ ID NO: 1814166 - RNA, 16 nt, Homo sapiens
gauggaauaaggagcu

SEQ ID NO: 1814167 - RNA, 20 nt, Homo sapiens
ucugaaagauaagaaucacu

SEQ ID NO: 1814168 - RNA, 17 nt, Homo sapiens
guggccagcacucugaa

SEQ ID NO: 1814169 - RNA, 17 nt, Homo sapiens
uggauuccacacugcac

SEQ ID NO: 1814170 - RNA, 19 nt, Homo sapiens
uccagccgaagcugcaggg

SEQ ID NO: 1814171 - RNA, 22 nt, Homo sapiens
aagcaaggaagcagagcacugu

SEQ ID NO: 1814172 - RNA, 20 nt, Homo sapiens
ccuguaaggggccagagccu

SEQ ID NO: 1814173 - RNA, 19 nt, Homo sapiens
uuuacaagggcauaaagua

SEQ ID NO: 1814174 - RNA, 17 nt, Homo sapiens
uuucuauucucuccuca

SEQ ID NO: 1814175 - RNA, 14 nt, Homo sapiens
agcaguuuacucua

SEQ ID NO: 1814176 - RNA, 15 nt, Homo sapiens
cucuucccuugcuca

SEQ ID NO: 1814177 - RNA, 16 nt, Homo sapiens
aucaaaggcacacagc

SEQ ID NO: 1814178 - RNA, 17 nt, Homo sapiens
uggggagauaguccaua

SEQ ID NO: 1814179 - RNA, 22 nt, Homo sapiens
cuggguggcacugccaugcagg

SEQ ID NO: 1814180 - RNA, 17 nt, Homo sapiens
cacagaggcaguaggaa

SEQ ID NO: 1814181 - RNA, 15 nt, Homo sapiens
cugaugcugggcaau

SEQ ID NO: 1814182 - RNA, 22 nt, Homo sapiens
ugugucagaaacugaagcuguu

SEQ ID NO: 1814183 - RNA, 15 nt, Homo sapiens
accuacucuugccug

SEQ ID NO: 1814184 - RNA, 16 nt, Homo sapiens
uugacuguucaaugau

SEQ ID NO: 1814185 - RNA, 13 nt, Homo sapiens
auaacuauggaau

SEQ ID NO: 1814186 - RNA, 21 nt, Homo sapiens
cuuaauuauugauguuuucau

SEQ ID NO: 1814187 - RNA, 22 nt, Homo sapiens
ccggaucagagcaggaccuccc

SEQ ID NO: 1814188 - RNA, 14 nt, Homo sapiens
uagugccugagaug

SEQ ID NO: 1814189 - RNA, 14 nt, Homo sapiens
uuugacuguuucca

SEQ ID NO: 1814190 - RNA, 22 nt, Homo sapiens
uucuuugaaauucauccuccac

SEQ ID NO: 1814191 - RNA, 18 nt, Homo sapiens
ugcagagauuaacauuuc

SEQ ID NO: 1814192 - RNA, 19 nt, Homo sapiens
gcaauugggauggcgcuag

SEQ ID NO: 1814193 - RNA, 14 nt, Homo sapiens
ucaaagaacaaaca

SEQ ID NO: 1814194 - RNA, 12 nt, Homo sapiens
agcuuggcacuu

SEQ ID NO: 1814195 - RNA, 17 nt, Homo sapiens
gauguccacagaugccu

SEQ ID NO: 1814196 - RNA, 22 nt, Homo sapiens
acccucaccuuccuucugccca

SEQ ID NO: 1814197 - RNA, 22 nt, Homo sapiens
gucuucaagccuggcccaguga

SEQ ID NO: 1814198 - RNA, 19 nt, Homo sapiens
ggcuuguagaccacugucc

SEQ ID NO: 1814199 - RNA, 19 nt, Homo sapiens
gcuaaaauugaacuacuug

SEQ ID NO: 1814200 - RNA, 13 nt, Homo sapiens
gaaaauaaauaca

SEQ ID NO: 1814201 - RNA, 20 nt, Homo sapiens
caggguuuugccauguuggc

SEQ ID NO: 1814202 - RNA, 18 nt, Homo sapiens
gucuacucccuccucacc

SEQ ID NO: 1814203 - RNA, 12 nt, Homo sapiens
ucugaacuucca

SEQ ID NO: 1814204 - RNA, 17 nt, Homo sapiens
cuagaauccacacuucc

SEQ ID NO: 1814205 - RNA, 19 nt, Homo sapiens
aucucuuuucuacauacau

SEQ ID NO: 1814206 - RNA, 18 nt, Homo sapiens
uaaaucuagaguuuauac

SEQ ID NO: 1814207 - RNA, 23 nt, Homo sapiens
uguugagaaaaaagacccuauca

SEQ ID NO: 1814208 - RNA, 17 nt, Homo sapiens
ucuggccggagcugccu

SEQ ID NO: 1814209 - RNA, 16 nt, Homo sapiens
aaaagcaauguuuaaa

SEQ ID NO: 1814210 - RNA, 21 nt, Homo sapiens
aguaucucuucagucucuaua

SEQ ID NO: 1814211 - RNA, 18 nt, Homo sapiens
cuacucucagguuuuuga

SEQ ID NO: 1814212 - RNA, 15 nt, Homo sapiens
uuaagcaugugaugu

SEQ ID NO: 1814213 - RNA, 22 nt, Homo sapiens
uccugaccucaggugauccacc

SEQ ID NO: 1814214 - RNA, 22 nt, Homo sapiens
ggcuccauccguggcugcaggg

SEQ ID NO: 1814215 - RNA, 21 nt, Homo sapiens
ccuggaguaacacaaagugaa

SEQ ID NO: 1814216 - RNA, 16 nt, Homo sapiens
guucuguuauacccca

SEQ ID NO: 1814217 - RNA, 23 nt, Homo sapiens
cgcacccuccuuucucaccagcc

SEQ ID NO: 1814218 - RNA, 17 nt, Homo sapiens
ugggcaaguagcaggac

SEQ ID NO: 1814219 - RNA, 15 nt, Homo sapiens
ucccagcccaucuga

SEQ ID NO: 1814220 - RNA, 23 nt, Homo sapiens
gaaacucuuucauucuucucaca

SEQ ID NO: 1814221 - RNA, 13 nt, Homo sapiens
ccuuacacagggc

SEQ ID NO: 1814222 - RNA, 20 nt, Homo sapiens
aucaagaacaugucagcaau

SEQ ID NO: 1814223 - RNA, 17 nt, Homo sapiens
cucauuuuuguuuucau

SEQ ID NO: 1814224 - RNA, 22 nt, Homo sapiens
cuccaaaacuggaccaccagag

SEQ ID NO: 1814225 - RNA, 15 nt, Homo sapiens
accgugaccaggaac

SEQ ID NO: 1814226 - RNA, 12 nt, Homo sapiens
uaacaugucaca

SEQ ID NO: 1814227 - RNA, 14 nt, Homo sapiens
uauacuuuugugaa

SEQ ID NO: 1814228 - RNA, 14 nt, Homo sapiens
aucaagugcagucg

SEQ ID NO: 1814229 - RNA, 20 nt, Homo sapiens
ccgggcacuggcacugcgau

SEQ ID NO: 1814230 - RNA, 22 nt, Homo sapiens
aguucucuacucccucuuguca

SEQ ID NO: 1814231 - RNA, 16 nt, Homo sapiens
aacuuuccaaacacca

SEQ ID NO: 1814232 - RNA, 17 nt, Homo sapiens
ccagcugccaggcugaa

SEQ ID NO: 1814233 - RNA, 13 nt, Homo sapiens
uucaguugccaag

SEQ ID NO: 1814234 - RNA, 17 nt, Homo sapiens
caguccucaaagcuuuu

SEQ ID NO: 1814235 - RNA, 16 nt, Homo sapiens
agccugugcaaugcau

SEQ ID NO: 1814236 - RNA, 18 nt, Homo sapiens
uuuaguaaccguccagca

SEQ ID NO: 1814237 - RNA, 15 nt, Homo sapiens
caucacuuguaccuu

SEQ ID NO: 1814238 - RNA, 14 nt, Homo sapiens
uaguauuccaauca

SEQ ID NO: 1814239 - RNA, 14 nt, Homo sapiens
uuccucaucugggu

SEQ ID NO: 1814240 - RNA, 18 nt, Homo sapiens
guuccccgauaccaugcu

SEQ ID NO: 1814241 - RNA, 20 nt, Homo sapiens
ggagcagguuccccaagggc

SEQ ID NO: 1814242 - RNA, 21 nt, Homo sapiens
agacaguuuuccaaacugugu

SEQ ID NO: 1814243 - RNA, 13 nt, Homo sapiens
ucccgauaccuca

SEQ ID NO: 1814244 - RNA, 17 nt, Homo sapiens
cugcuaauauuaaaccu

SEQ ID NO: 1814245 - RNA, 16 nt, Homo sapiens
ucaccuguuggcuaca

SEQ ID NO: 1814246 - RNA, 21 nt, Homo sapiens
ugccagagcccaagugccauc

SEQ ID NO: 1814247 - RNA, 21 nt, Homo sapiens
uuaaaaauuguuaauuuuucc

SEQ ID NO: 1814248 - RNA, 21 nt, Homo sapiens
uggagcaggggugcugggacc

SEQ ID NO: 1814249 - RNA, 13 nt, Homo sapiens
ucacuuguacaaa

SEQ ID NO: 1814250 - RNA, 22 nt, Homo sapiens
cugugcccccaggguccuggga

SEQ ID NO: 1814251 - RNA, 20 nt, Homo sapiens
uacaguuugauuuuugacca

SEQ ID NO: 1814252 - RNA, 13 nt, Homo sapiens
uuacgguguacag

SEQ ID NO: 1814253 - RNA, 20 nt, Homo sapiens
auguaauuaauaacuuucuc

SEQ ID NO: 1814254 - RNA, 21 nt, Homo sapiens
ucugagcacagcugcauuaaa

SEQ ID NO: 1814255 - RNA, 16 nt, Homo sapiens
aaguuguugcauuccc

SEQ ID NO: 1814256 - RNA, 12 nt, Homo sapiens
gaccugcugcuc

SEQ ID NO: 1814257 - RNA, 22 nt, Homo sapiens
caguuagcccggccaaggacac

SEQ ID NO: 1814258 - RNA, 17 nt, Homo sapiens
aaucaaaucugugcucu

SEQ ID NO: 1814259 - RNA, 14 nt, Homo sapiens
uagcagcaacugaa

SEQ ID NO: 1814260 - RNA, 21 nt, Homo sapiens
ucugucaaagaaaacuuccaa

SEQ ID NO: 1814261 - RNA, 15 nt, Homo sapiens
uauuauacuaagaaa

SEQ ID NO: 1814262 - RNA, 15 nt, Homo sapiens
uucuuuuuuuaugac

SEQ ID NO: 1814263 - RNA, 23 nt, Homo sapiens
uagucauaccuggaaugugucaa

SEQ ID NO: 1814264 - RNA, 17 nt, Homo sapiens
auauacacauacauaca

SEQ ID NO: 1814265 - RNA, 17 nt, Homo sapiens
ccaucccaacaccucac

SEQ ID NO: 1814266 - RNA, 22 nt, Homo sapiens
aauagauacaaaugucuaucaa

SEQ ID NO: 1814267 - RNA, 21 nt, Homo sapiens
accugaggauaacucaauaua

SEQ ID NO: 1814268 - RNA, 18 nt, Homo sapiens
guauuuuuaacaccagaa

SEQ ID NO: 1814269 - RNA, 16 nt, Homo sapiens
aauccuuaaacugcca

SEQ ID NO: 1814270 - RNA, 21 nt, Homo sapiens
cagaaaugcccccauucuccc

SEQ ID NO: 1814271 - RNA, 15 nt, Homo sapiens
uaauguguuugcaau

SEQ ID NO: 1814272 - RNA, 17 nt, Homo sapiens
augcacaagaauggauc

SEQ ID NO: 1814273 - RNA, 14 nt, Homo sapiens
auuauucaaaauga

SEQ ID NO: 1814274 - RNA, 17 nt, Homo sapiens
uaaugaauaugccaucu

SEQ ID NO: 1814275 - RNA, 20 nt, Homo sapiens
aauuuuuuugcauuuucaca

SEQ ID NO: 1814276 - RNA, 19 nt, Homo sapiens
acagaauguucauacugau

SEQ ID NO: 1814277 - RNA, 17 nt, Homo sapiens
uccacaaaaucugucca

SEQ ID NO: 1814278 - RNA, 16 nt, Homo sapiens
cgccucucucagccca

SEQ ID NO: 1814279 - RNA, 20 nt, Homo sapiens
cgguguuuggcaaugcuaau

SEQ ID NO: 1814280 - RNA, 14 nt, Homo sapiens
cagaagucccuuca

SEQ ID NO: 1814281 - RNA, 19 nt, Homo sapiens
gagccugagguacagagaa

SEQ ID NO: 1814282 - RNA, 22 nt, Homo sapiens
gacugugcauacuuucccucau

SEQ ID NO: 1814283 - RNA, 23 nt, Homo sapiens
guggagaaaggggaaguggucca

SEQ ID NO: 1814284 - RNA, 15 nt, Homo sapiens
caacauucuguguuc

SEQ ID NO: 1814285 - RNA, 12 nt, Homo sapiens
guucugugcaca

SEQ ID NO: 1814286 - RNA, 12 nt, Homo sapiens
gaucugugcuca

SEQ ID NO: 1814287 - RNA, 13 nt, Homo sapiens
caggcuguucacc

SEQ ID NO: 1814288 - RNA, 23 nt, Homo sapiens
aauguggaagucaguacgaucaa

SEQ ID NO: 1814289 - RNA, 16 nt, Homo sapiens
guaacaguuugauauu

SEQ ID NO: 1814290 - RNA, 22 nt, Homo sapiens
ugugcgcucuguggaugccagg

SEQ ID NO: 1814291 - RNA, 22 nt, Homo sapiens
aggaaggugccuggccauguca

SEQ ID NO: 1814292 - RNA, 23 nt, Homo sapiens
cgggcucccccauaguucacuga

SEQ ID NO: 1814293 - RNA, 21 nt, Homo sapiens
guugugcccuccaccuaccug

SEQ ID NO: 1814294 - RNA, 19 nt, Homo sapiens
agauuggcaugccauugaa

SEQ ID NO: 1814295 - RNA, 21 nt, Homo sapiens
guuauccuuucauuaggcaaa

SEQ ID NO: 1814296 - RNA, 20 nt, Homo sapiens
gauauguugaauuaacauaa

SEQ ID NO: 1814297 - RNA, 12 nt, Homo sapiens
agcaucucagga

SEQ ID NO: 1814298 - RNA, 20 nt, Homo sapiens
uucucucacuuugauuugcu

SEQ ID NO: 1814299 - RNA, 10 nt, Homo sapiens
gcuauauucc

SEQ ID NO: 1814300 - RNA, 23 nt, Homo sapiens
cuugcauccccaacuuagcuguc

SEQ ID NO: 1814301 - RNA, 16 nt, Homo sapiens
ccacauuccaugacgc

SEQ ID NO: 1814302 - RNA, 18 nt, Homo sapiens
auugagacagugcacaug

SEQ ID NO: 1814303 - RNA, 23 nt, Homo sapiens
gaacgcaguaaacagcuuuccca

SEQ ID NO: 1814304 - RNA, 18 nt, Homo sapiens
gcuacaguaaccaaaaca

SEQ ID NO: 1814305 - RNA, 21 nt, Homo sapiens
aucucagcgccagcucuacca

SEQ ID NO: 1814306 - RNA, 17 nt, Homo sapiens
aagauggaacaggcuca

SEQ ID NO: 1814307 - RNA, 17 nt, Homo sapiens
gccugcuacgaacgcuc

SEQ ID NO: 1814308 - RNA, 19 nt, Homo sapiens
uuauauaugaaaacuaagu

SEQ ID NO: 1814309 - RNA, 19 nt, Homo sapiens
uuaaauaaaguuacuugaa

SEQ ID NO: 1814310 - RNA, 20 nt, Homo sapiens
ucuucuaaaauagcaauaac

SEQ ID NO: 1814311 - RNA, 12 nt, Homo sapiens
uaggagauguca

SEQ ID NO: 1814312 - RNA, 12 nt, Homo sapiens
ugucaaauccau

SEQ ID NO: 1814313 - RNA, 23 nt, Homo sapiens
aauguguauggguuaaaucaaag

SEQ ID NO: 1814314 - RNA, 23 nt, Homo sapiens
uaaucuucagggcacugcugcug

SEQ ID NO: 1814315 - RNA, 10 nt, Homo sapiens
agacugcugc

SEQ ID NO: 1814316 - RNA, 21 nt, Homo sapiens
uagagaaaugguucuggauau

SEQ ID NO: 1814317 - RNA, 17 nt, Homo sapiens
cacugggucucacuccu

SEQ ID NO: 1814318 - RNA, 21 nt, Homo sapiens
gcgccugccaucaugccugac

SEQ ID NO: 1814319 - RNA, 14 nt, Homo sapiens
cauagcacuugcag

SEQ ID NO: 1814320 - RNA, 21 nt, Homo sapiens
accugucaucauggaggucau

SEQ ID NO: 1814321 - RNA, 16 nt, Homo sapiens
cuaaaucuacucuuaa

SEQ ID NO: 1814322 - RNA, 17 nt, Homo sapiens
agaaaauagagcuuuua

SEQ ID NO: 1814323 - RNA, 17 nt, Homo sapiens
uguccccacugccccac

SEQ ID NO: 1814324 - RNA, 18 nt, Homo sapiens
aagcuugguccacuugcu

SEQ ID NO: 1814325 - RNA, 11 nt, Homo sapiens
cccacuuugaa

SEQ ID NO: 1814326 - RNA, 11 nt, Homo sapiens
gccacuuucaa

SEQ ID NO: 1814327 - RNA, 21 nt, Homo sapiens
acccuaaaguauaacaugucg

SEQ ID NO: 1814328 - RNA, 16 nt, Homo sapiens
ucagucuauccacaga

SEQ ID NO: 1814329 - RNA, 12 nt, Homo sapiens
cagccacaggca

SEQ ID NO: 1814330 - RNA, 20 nt, Homo sapiens
aguaaauacaguagaagcuc

SEQ ID NO: 1814331 - RNA, 16 nt, Homo sapiens
accuggagaugaugau

SEQ ID NO: 1814332 - RNA, 15 nt, Homo sapiens
cccuacuccacugcc

SEQ ID NO: 1814333 - RNA, 20 nt, Homo sapiens
ugccuuguuuggauuggcac

SEQ ID NO: 1814334 - RNA, 19 nt, Homo sapiens
guuuuuguucuuaauugca

SEQ ID NO: 1814335 - RNA, 22 nt, Homo sapiens
uacgucuugaucagacauucag

SEQ ID NO: 1814336 - RNA, 13 nt, Homo sapiens
cauacaacaaaga

SEQ ID NO: 1814337 - RNA, 14 nt, Homo sapiens
agagagauggaaua

SEQ ID NO: 1814338 - RNA, 12 nt, Homo sapiens
agagaauggaca

SEQ ID NO: 1814339 - RNA, 15 nt, Homo sapiens
uucccuaaacuuuag

SEQ ID NO: 1814340 - RNA, 21 nt, Homo sapiens
ucuuacaauaauucuaugaga

SEQ ID NO: 1814341 - RNA, 24 nt, Homo sapiens
cuuugaggcucugucacugagcaa

SEQ ID NO: 1814342 - RNA, 15 nt, Homo sapiens
ucugaagacagucuu

SEQ ID NO: 1814343 - RNA, 22 nt, Homo sapiens
caauuauacuaaaccucacaaa

SEQ ID NO: 1814344 - RNA, 23 nt, Homo sapiens
uaaaacaugcugaaaacuacaca

SEQ ID NO: 1814345 - RNA, 20 nt, Homo sapiens
cauacuuugaacaaccaaau

SEQ ID NO: 1814346 - RNA, 19 nt, Homo sapiens
aaaaacugaagguacuuua

SEQ ID NO: 1814347 - RNA, 14 nt, Homo sapiens
gcgcgguggcucac

SEQ ID NO: 1814348 - RNA, 16 nt, Homo sapiens
gcgauucuggauaaag

SEQ ID NO: 1814349 - RNA, 15 nt, Homo sapiens
uaaugcaagcaaagu

SEQ ID NO: 1814350 - RNA, 23 nt, Homo sapiens
cuggagugauagcuacuguagaa

SEQ ID NO: 1814351 - RNA, 13 nt, Homo sapiens
cucucaaaccugu

SEQ ID NO: 1814352 - RNA, 19 nt, Homo sapiens
ucaggucccccccaggugc

SEQ ID NO: 1814353 - RNA, 21 nt, Homo sapiens
ccucaccaauacacggacaca

SEQ ID NO: 1814354 - RNA, 13 nt, Homo sapiens
gaaauaagccaga

SEQ ID NO: 1814355 - RNA, 15 nt, Homo sapiens
ggauuuuaccaaagc

SEQ ID NO: 1814356 - RNA, 12 nt, Homo sapiens
acagugcuuuau

SEQ ID NO: 1814357 - RNA, 23 nt, Homo sapiens
aacauuguucugaacacuuuagg

SEQ ID NO: 1814358 - RNA, 14 nt, Homo sapiens
uguuuaacuugucu

SEQ ID NO: 1814359 - RNA, 13 nt, Homo sapiens
ccccaacacuucc

SEQ ID NO: 1814360 - RNA, 17 nt, Homo sapiens
gucaauguccuacugag

SEQ ID NO: 1814361 - RNA, 18 nt, Homo sapiens
uugcaauguggcuugaau

SEQ ID NO: 1814362 - RNA, 19 nt, Homo sapiens
agagguguaacacuuguca

SEQ ID NO: 1814363 - RNA, 15 nt, Homo sapiens
gccucucuguuugua

SEQ ID NO: 1814364 - RNA, 14 nt, Homo sapiens
ccgcccaccugggc

SEQ ID NO: 1814365 - RNA, 14 nt, Homo sapiens
acuggaacauucca

SEQ ID NO: 1814366 - RNA, 16 nt, Homo sapiens
uauaaucuaauuacau

SEQ ID NO: 1814367 - RNA, 22 nt, Homo sapiens
ggagauggguguggcaguguau

SEQ ID NO: 1814368 - RNA, 17 nt, Homo sapiens
agcauucucuccauuuc

SEQ ID NO: 1814369 - RNA, 23 nt, Homo sapiens
uuccuauaugcacuuauucucaa

SEQ ID NO: 1814370 - RNA, 14 nt, Homo sapiens
aaccugugaggaag

SEQ ID NO: 1814371 - RNA, 18 nt, Homo sapiens
cuugggagaccuguaauc

SEQ ID NO: 1814372 - RNA, 18 nt, Homo sapiens
uuuucuuguugcaaaaaa

SEQ ID NO: 1814373 - RNA, 19 nt, Homo sapiens
cugaauuuguagacauacu

SEQ ID NO: 1814374 - RNA, 18 nt, Homo sapiens
gucccuguuuuugcagua

SEQ ID NO: 1814375 - RNA, 19 nt, Homo sapiens
uaauuuugugaaagaagga

SEQ ID NO: 1814376 - RNA, 16 nt, Homo sapiens
acccccaucaccuucu

SEQ ID NO: 1814377 - RNA, 19 nt, Homo sapiens
gccccuuaguccccaagcc

SEQ ID NO: 1814378 - RNA, 15 nt, Homo sapiens
ugggaggaacaaaga

SEQ ID NO: 1814379 - RNA, 18 nt, Homo sapiens
augaugccucaugauaug

SEQ ID NO: 1814380 - RNA, 14 nt, Homo sapiens
cggauaaguuugaa

SEQ ID NO: 1814381 - RNA, 20 nt, Homo sapiens
ugcacccaccucagccuccc

SEQ ID NO: 1814382 - RNA, 21 nt, Homo sapiens
aaaacuccacagucaauauua

SEQ ID NO: 1814383 - RNA, 22 nt, Homo sapiens
cagcauuuacuaugcacaacag

SEQ ID NO: 1814384 - RNA, 14 nt, Homo sapiens
uaauaauacugucu

SEQ ID NO: 1814385 - RNA, 17 nt, Homo sapiens
gucuucuugcugcagcc

SEQ ID NO: 1814386 - RNA, 20 nt, Homo sapiens
cguguccucucccugccaag

SEQ ID NO: 1814387 - RNA, 17 nt, Homo sapiens
gaaccaaaaagaggcua

SEQ ID NO: 1814388 - RNA, 14 nt, Homo sapiens
ugaugaauguuaaa

SEQ ID NO: 1814389 - RNA, 17 nt, Homo sapiens
gcauagguuuagcagua

SEQ ID NO: 1814390 - RNA, 19 nt, Homo sapiens
aggcccagugacaaagacu

SEQ ID NO: 1814391 - RNA, 13 nt, Homo sapiens
acugucaguucuc

SEQ ID NO: 1814392 - RNA, 15 nt, Homo sapiens
ucuguacugcacuua

SEQ ID NO: 1814393 - RNA, 20 nt, Homo sapiens
agcguuucuuuacuucucac

SEQ ID NO: 1814394 - RNA, 15 nt, Homo sapiens
ccagaugugggcuca

SEQ ID NO: 1814395 - RNA, 16 nt, Homo sapiens
gcccuagcccagacuc

SEQ ID NO: 1814396 - RNA, 13 nt, Homo sapiens
acuccuucccaaa

SEQ ID NO: 1814397 - RNA, 20 nt, Homo sapiens
uuugagcugcugacugccaa

SEQ ID NO: 1814398 - RNA, 16 nt, Homo sapiens
caaaugcacaucucau

SEQ ID NO: 1814399 - RNA, 13 nt, Homo sapiens
ucuggaacaaagu

SEQ ID NO: 1814400 - RNA, 20 nt, Homo sapiens
ggcucaagcuguccucccac

SEQ ID NO: 1814401 - RNA, 22 nt, Homo sapiens
uacaagaacaaugacaccacac

SEQ ID NO: 1814402 - RNA, 16 nt, Homo sapiens
ccugccucucugcucc

SEQ ID NO: 1814403 - RNA, 12 nt, Homo sapiens
uauaagcuuaaa

SEQ ID NO: 1814404 - RNA, 17 nt, Homo sapiens
aacuacagaaguggaag

SEQ ID NO: 1814405 - RNA, 19 nt, Homo sapiens
acuggcaauaaacuccuac

SEQ ID NO: 1814406 - RNA, 20 nt, Homo sapiens
ggaaauucuucccugggggu

SEQ ID NO: 1814407 - RNA, 21 nt, Homo sapiens
aaaccccgguggaaucccacc

SEQ ID NO: 1814408 - RNA, 14 nt, Homo sapiens
uagcagauggagua

SEQ ID NO: 1814409 - RNA, 18 nt, Homo sapiens
ccacaggaggcaagcaag

SEQ ID NO: 1814410 - RNA, 17 nt, Homo sapiens
acacucuccaaacaguc

SEQ ID NO: 1814411 - RNA, 21 nt, Homo sapiens
cccaaaucugccuauugcagc

SEQ ID NO: 1814412 - RNA, 12 nt, Homo sapiens
guaaaugauuca

SEQ ID NO: 1814413 - RNA, 22 nt, Homo sapiens
agcuuuuuguuugcaucauuua

SEQ ID NO: 1814414 - RNA, 16 nt, Homo sapiens
guccuggcugcacucu

SEQ ID NO: 1814415 - RNA, 12 nt, Homo sapiens
ucuucauuucua

SEQ ID NO: 1814416 - RNA, 21 nt, Homo sapiens
cagagacuggcagccagggag

SEQ ID NO: 1814417 - RNA, 20 nt, Homo sapiens
uaggaaaaccagagccuaua

SEQ ID NO: 1814418 - RNA, 22 nt, Homo sapiens
ccuugggcgggccauuucacau

SEQ ID NO: 1814419 - RNA, 20 nt, Homo sapiens
uugugaugauagcacugguu

SEQ ID NO: 1814420 - RNA, 21 nt, Homo sapiens
cuuucuuggagugccaaguuu

SEQ ID NO: 1814421 - RNA, 12 nt, Homo sapiens
aaggguucuugg

SEQ ID NO: 1814422 - RNA, 22 nt, Homo sapiens
uaccagguuaccucacuuuuaa

SEQ ID NO: 1814423 - RNA, 12 nt, Homo sapiens
ggcccucagagg

SEQ ID NO: 1814424 - RNA, 12 nt, Homo sapiens
cccaauggugcu

SEQ ID NO: 1814425 - RNA, 13 nt, Homo sapiens
uuuucuccagggu

SEQ ID NO: 1814426 - RNA, 12 nt, Homo sapiens
gcuuuagucacu

SEQ ID NO: 1814427 - RNA, 20 nt, Homo sapiens
gaaaaucuuuaggcuuucaa

SEQ ID NO: 1814428 - RNA, 13 nt, Homo sapiens
agcuggcccucca

SEQ ID NO: 1814429 - RNA, 14 nt, Homo sapiens
cucuaguaucacuu

SEQ ID NO: 1814430 - RNA, 22 nt, Homo sapiens
cauauguuguguuugguucaau

SEQ ID NO: 1814431 - RNA, 22 nt, Homo sapiens
aucugcaguguucugugaauag

SEQ ID NO: 1814432 - RNA, 19 nt, Homo sapiens
cauaaugcauguggcacuu

SEQ ID NO: 1814433 - RNA, 18 nt, Homo sapiens
gcugauaaauauaaccau

SEQ ID NO: 1814434 - RNA, 16 nt, Homo sapiens
ccucauagguaugauu

SEQ ID NO: 1814435 - RNA, 19 nt, Homo sapiens
uuuaaagagaguuugccac

SEQ ID NO: 1814436 - RNA, 13 nt, Homo sapiens
acaauuuacuuuu

SEQ ID NO: 1814437 - RNA, 17 nt, Homo sapiens
aaauaugucacuagaga

SEQ ID NO: 1814438 - RNA, 20 nt, Homo sapiens
ugauauauuccaccaggaua

SEQ ID NO: 1814439 - RNA, 21 nt, Homo sapiens
gagauugugccccugcacucc

SEQ ID NO: 1814440 - RNA, 20 nt, Homo sapiens
gccaaugcacacacacagag

SEQ ID NO: 1814441 - RNA, 20 nt, Homo sapiens
gggacaaaggagccugugaa

SEQ ID NO: 1814442 - RNA, 18 nt, Homo sapiens
uuuucaccuccaugucau

SEQ ID NO: 1814443 - RNA, 19 nt, Homo sapiens
aauucccaaauguauucua

SEQ ID NO: 1814444 - RNA, 18 nt, Homo sapiens
acuagguccccuucccuc

SEQ ID NO: 1814445 - RNA, 13 nt, Homo sapiens
uaaguaaacaaca

SEQ ID NO: 1814446 - RNA, 12 nt, Homo sapiens
acugucaaguca

SEQ ID NO: 1814447 - RNA, 13 nt, Homo sapiens
uuuccuccccacc

SEQ ID NO: 1814448 - RNA, 15 nt, Homo sapiens
cuacaaacacaagca

SEQ ID NO: 1814449 - RNA, 16 nt, Homo sapiens
uccagccuucugucag

SEQ ID NO: 1814450 - RNA, 16 nt, Homo sapiens
uacaacuucagcagua

SEQ ID NO: 1814451 - RNA, 17 nt, Homo sapiens
ccuccacaguagcauuu

SEQ ID NO: 1814452 - RNA, 21 nt, Homo sapiens
ugccuucuccuauuucuccaa

SEQ ID NO: 1814453 - RNA, 13 nt, Homo sapiens
ggccuaggaccuc

SEQ ID NO: 1814454 - RNA, 21 nt, Homo sapiens
uuuaauaccuuuaaauaucau

SEQ ID NO: 1814455 - RNA, 14 nt, Homo sapiens
aggauuuauucuca

SEQ ID NO: 1814456 - RNA, 16 nt, Homo sapiens
acuacuuuuacuacag

SEQ ID NO: 1814457 - RNA, 22 nt, Homo sapiens
cauguaucuaccucacuauuca

SEQ ID NO: 1814458 - RNA, 14 nt, Homo sapiens
auagucaaucaaac

SEQ ID NO: 1814459 - RNA, 22 nt, Homo sapiens
cuuggcagccuugugaugucau

SEQ ID NO: 1814460 - RNA, 15 nt, Homo sapiens
gaacaaaaagguaaa

SEQ ID NO: 1814461 - RNA, 16 nt, Homo sapiens
cugucacacacuggac

SEQ ID NO: 1814462 - RNA, 19 nt, Homo sapiens
cuucuccuguuccauuuca

SEQ ID NO: 1814463 - RNA, 21 nt, Homo sapiens
aauaguuugguucuucaaauc

SEQ ID NO: 1814464 - RNA, 18 nt, Homo sapiens
gcuggauccggucugccu

SEQ ID NO: 1814465 - RNA, 14 nt, Homo sapiens
guuccauguuaaaa

SEQ ID NO: 1814466 - RNA, 13 nt, Homo sapiens
uccaagugccaau

SEQ ID NO: 1814467 - RNA, 14 nt, Homo sapiens
cuuauguuauacaa

SEQ ID NO: 1814468 - RNA, 15 nt, Homo sapiens
uauaaauucuacuaa

SEQ ID NO: 1814469 - RNA, 13 nt, Homo sapiens
ugcuucaguccac

SEQ ID NO: 1814470 - RNA, 13 nt, Homo sapiens
gccuccagggcau

SEQ ID NO: 1814471 - RNA, 20 nt, Homo sapiens
aucccugugccucuucccau

SEQ ID NO: 1814472 - RNA, 22 nt, Homo sapiens
agaggugcagcuggaggcugcu

SEQ ID NO: 1814473 - RNA, 20 nt, Homo sapiens
gguucagccuucguguggcu

SEQ ID NO: 1814474 - RNA, 17 nt, Homo sapiens
ucuguuugcguacuugu

SEQ ID NO: 1814475 - RNA, 13 nt, Homo sapiens
gucugugcacaug

SEQ ID NO: 1814476 - RNA, 17 nt, Homo sapiens
aguguucuccacuaaua

SEQ ID NO: 1814477 - RNA, 18 nt, Homo sapiens
uauuuuuuagugaugaga

SEQ ID NO: 1814478 - RNA, 12 nt, Homo sapiens
aggcacugagcg

SEQ ID NO: 1814479 - RNA, 23 nt, Homo sapiens
acuuuccacccucucuccaccug

SEQ ID NO: 1814480 - RNA, 20 nt, Homo sapiens
acguccacgcggccaccuca

SEQ ID NO: 1814481 - RNA, 17 nt, Homo sapiens
gagguggcugccuggag

SEQ ID NO: 1814482 - RNA, 20 nt, Homo sapiens
agaaauacucaugugcaaua

SEQ ID NO: 1814483 - RNA, 18 nt, Homo sapiens
gaaaacauuccagaugca

SEQ ID NO: 1814484 - RNA, 14 nt, Homo sapiens
augauucauaacaa

SEQ ID NO: 1814485 - RNA, 23 nt, Homo sapiens
acuguaggaauuuucuugaaacu

SEQ ID NO: 1814486 - RNA, 13 nt, Homo sapiens
caagaucacgcca

SEQ ID NO: 1814487 - RNA, 13 nt, Homo sapiens
uucaauaauguga

SEQ ID NO: 1814488 - RNA, 20 nt, Homo sapiens
agcugcccugaggguuuccu

SEQ ID NO: 1814489 - RNA, 13 nt, Homo sapiens
gguggggggucca

SEQ ID NO: 1814490 - RNA, 14 nt, Homo sapiens
ccguggcuuggcau

SEQ ID NO: 1814491 - RNA, 16 nt, Homo sapiens
gaguguaguuuacaga

SEQ ID NO: 1814492 - RNA, 16 nt, Homo sapiens
cugccuuagccucuug

SEQ ID NO: 1814493 - RNA, 21 nt, Homo sapiens
cagagaggccaggugcagguu

SEQ ID NO: 1814494 - RNA, 21 nt, Homo sapiens
cccaugugacuguggcauuuu

SEQ ID NO: 1814495 - RNA, 18 nt, Homo sapiens
aaucacuauugcuuccua

SEQ ID NO: 1814496 - RNA, 17 nt, Homo sapiens
ugaaaucccaucagguc

SEQ ID NO: 1814497 - RNA, 15 nt, Homo sapiens
uauuuagaugcauau

SEQ ID NO: 1814498 - RNA, 22 nt, Homo sapiens
cauucaaauucuuuuuuuauua

SEQ ID NO: 1814499 - RNA, 15 nt, Homo sapiens
cuccugugucacuga

SEQ ID NO: 1814500 - RNA, 17 nt, Homo sapiens
agacuuugauccaugua

SEQ ID NO: 1814501 - RNA, 16 nt, Homo sapiens
uugagcaggucucaua

SEQ ID NO: 1814502 - RNA, 23 nt, Homo sapiens
uggauugggacgcacagugcagu

SEQ ID NO: 1814503 - RNA, 21 nt, Homo sapiens
acugaggcuuagaaagguuaa

SEQ ID NO: 1814504 - RNA, 15 nt, Homo sapiens
cucugacagcugucc

SEQ ID NO: 1814505 - RNA, 18 nt, Homo sapiens
gucugacuacaacaugca

SEQ ID NO: 1814506 - RNA, 18 nt, Homo sapiens
acuuguccuuuuguacca

SEQ ID NO: 1814507 - RNA, 14 nt, Homo sapiens
ggaacagaccagug

SEQ ID NO: 1814508 - RNA, 12 nt, Homo sapiens
ccccaccaguga

SEQ ID NO: 1814509 - RNA, 19 nt, Homo sapiens
uaauauauuguacacuaca

SEQ ID NO: 1814510 - RNA, 17 nt, Homo sapiens
gcaucaguagauuucug

SEQ ID NO: 1814511 - RNA, 21 nt, Homo sapiens
ccugaggagggcccugaggaa

SEQ ID NO: 1814512 - RNA, 22 nt, Homo sapiens
uccuaguguuucuuuguggucu

SEQ ID NO: 1814513 - RNA, 23 nt, Homo sapiens
uuacaauccuugaccucagugaa

SEQ ID NO: 1814514 - RNA, 18 nt, Homo sapiens
aguggcuaccuacauaca

SEQ ID NO: 1814515 - RNA, 19 nt, Homo sapiens
cuaaauaaaaaaaugaaua

SEQ ID NO: 1814516 - RNA, 16 nt, Homo sapiens
gggccaugccaggcca

SEQ ID NO: 1814517 - RNA, 18 nt, Homo sapiens
aaaguucuugguggugga

SEQ ID NO: 1814518 - RNA, 20 nt, Homo sapiens
acuucaucaaaaucauggau

SEQ ID NO: 1814519 - RNA, 16 nt, Homo sapiens
guuuccgugagcucaa

SEQ ID NO: 1814520 - RNA, 16 nt, Homo sapiens
cugccggucauuugaa

SEQ ID NO: 1814521 - RNA, 14 nt, Homo sapiens
aggggcccuuggga

SEQ ID NO: 1814522 - RNA, 20 nt, Homo sapiens
cuauuuaacuugagcuuuaa

SEQ ID NO: 1814523 - RNA, 19 nt, Homo sapiens
ugaaagaugcaucaucucu

SEQ ID NO: 1814524 - RNA, 15 nt, Homo sapiens
cuguaaacaguucug

SEQ ID NO: 1814525 - RNA, 23 nt, Homo sapiens
uuacaagcauugaacuucuuuag

SEQ ID NO: 1814526 - RNA, 20 nt, Homo sapiens
cuaaggcucugagagucuag

SEQ ID NO: 1814527 - RNA, 18 nt, Homo sapiens
ugaaaugcagauugcuac

SEQ ID NO: 1814528 - RNA, 14 nt, Homo sapiens
aagccugugaaagg

SEQ ID NO: 1814529 - RNA, 19 nt, Homo sapiens
ugggcgugaguggacgugu

SEQ ID NO: 1814530 - RNA, 19 nt, Homo sapiens
guguccauugacauguaca

SEQ ID NO: 1814531 - RNA, 12 nt, Homo sapiens
gucaaugaacuu

SEQ ID NO: 1814532 - RNA, 13 nt, Homo sapiens
agagaaaacagac

SEQ ID NO: 1814533 - RNA, 18 nt, Homo sapiens
cacugcagacuuguccag

SEQ ID NO: 1814534 - RNA, 12 nt, Homo sapiens
gccaggcacugu

SEQ ID NO: 1814535 - RNA, 17 nt, Homo sapiens
ucuucccuuccuccauu

SEQ ID NO: 1814536 - RNA, 18 nt, Homo sapiens
gcuacaaauagugcuaau

SEQ ID NO: 1814537 - RNA, 18 nt, Homo sapiens
agacacuaguagagcaaa

SEQ ID NO: 1814538 - RNA, 22 nt, Homo sapiens
gaagcucagguucccugccaca

SEQ ID NO: 1814539 - RNA, 16 nt, Homo sapiens
ucccuccccugccauu

SEQ ID NO: 1814540 - RNA, 13 nt, Homo sapiens
cguguguuuauuu

SEQ ID NO: 1814541 - RNA, 15 nt, Homo sapiens
ggaaauguagcacuu

SEQ ID NO: 1814542 - RNA, 14 nt, Homo sapiens
cuucacugccauga

SEQ ID NO: 1814543 - RNA, 18 nt, Homo sapiens
auggagaaucugcugcau

SEQ ID NO: 1814544 - RNA, 21 nt, Homo sapiens
cuuuagacacuggcugccagc

SEQ ID NO: 1814545 - RNA, 18 nt, Homo sapiens
ugacgcggcucaaaagga

SEQ ID NO: 1814546 - RNA, 20 nt, Homo sapiens
aauggccuucauaucaucca

SEQ ID NO: 1814547 - RNA, 15 nt, Homo sapiens
aguauccaugcucuu

SEQ ID NO: 1814548 - RNA, 22 nt, Homo sapiens
aagaagguuggugaauuucaca

SEQ ID NO: 1814549 - RNA, 20 nt, Homo sapiens
cuaagccaacuugaugugaa

SEQ ID NO: 1814550 - RNA, 13 nt, Homo sapiens
ugugcuacagaug

SEQ ID NO: 1814551 - RNA, 19 nt, Homo sapiens
gccaaaagcugcucaggga

SEQ ID NO: 1814552 - RNA, 16 nt, Homo sapiens
uacuaccuguaaugac

SEQ ID NO: 1814553 - RNA, 13 nt, Homo sapiens
cucagcauccacu

SEQ ID NO: 1814554 - RNA, 21 nt, Homo sapiens
ccugugcccgcugcgcugccc

SEQ ID NO: 1814555 - RNA, 16 nt, Homo sapiens
gaacaguaacugccau

SEQ ID NO: 1814556 - RNA, 22 nt, Homo sapiens
cuacacaguaaaaacuuguacu

SEQ ID NO: 1814557 - RNA, 17 nt, Homo sapiens
caggauacuuaguucau

SEQ ID NO: 1814558 - RNA, 11 nt, Homo sapiens
agaaccucagg

SEQ ID NO: 1814559 - RNA, 16 nt, Homo sapiens
agaauagugccucagc

SEQ ID NO: 1814560 - RNA, 16 nt, Homo sapiens
ugcagcggcagagcaa

SEQ ID NO: 1814561 - RNA, 18 nt, Homo sapiens
uaacagauuaguaguuac

SEQ ID NO: 1814562 - RNA, 14 nt, Homo sapiens
uuuagucugcauug

SEQ ID NO: 1814563 - RNA, 20 nt, Homo sapiens
auuuucauucaucauguuca

SEQ ID NO: 1814564 - RNA, 18 nt, Homo sapiens
gaagacuugaagcacaga

SEQ ID NO: 1814565 - RNA, 20 nt, Homo sapiens
auuuuacuuuucugccaaaa

SEQ ID NO: 1814566 - RNA, 19 nt, Homo sapiens
aauugaaagagauccaggg

SEQ ID NO: 1814567 - RNA, 22 nt, Homo sapiens
ggcaaaggauccagauagccua

SEQ ID NO: 1814568 - RNA, 19 nt, Homo sapiens
uaaaguauauuuaacucau

SEQ ID NO: 1814569 - RNA, 23 nt, Homo sapiens
agaccaguccuguuugcagggaa

SEQ ID NO: 1814570 - RNA, 14 nt, Homo sapiens
aguagagucacugg

SEQ ID NO: 1814571 - RNA, 13 nt, Homo sapiens
uggaaaagccaag

SEQ ID NO: 1814572 - RNA, 19 nt, Homo sapiens
agggaucuugcauucccag

SEQ ID NO: 1814573 - RNA, 14 nt, Homo sapiens
uacauuauucuuca

SEQ ID NO: 1814574 - RNA, 14 nt, Homo sapiens
ucaucgacuuagcc

SEQ ID NO: 1814575 - RNA, 22 nt, Homo sapiens
aggcuuucaagaagugccaguu

SEQ ID NO: 1814576 - RNA, 22 nt, Homo sapiens
ggccagcuucgagcuacaugca

SEQ ID NO: 1814577 - RNA, 21 nt, Homo sapiens
cuggaccaaccccaggcagaa

SEQ ID NO: 1814578 - RNA, 21 nt, Homo sapiens
uuuagaagauagaugcacuua

SEQ ID NO: 1814579 - RNA, 15 nt, Homo sapiens
acccagaggucucau

SEQ ID NO: 1814580 - RNA, 19 nt, Homo sapiens
ucgacaucuuccuccucua

SEQ ID NO: 1814581 - RNA, 22 nt, Homo sapiens
uggcuuccagguaucuccagga

SEQ ID NO: 1814582 - RNA, 20 nt, Homo sapiens
ugcuaaucacauccacaaaa

SEQ ID NO: 1814583 - RNA, 16 nt, Homo sapiens
aagaagagcucacuau

SEQ ID NO: 1814584 - RNA, 22 nt, Homo sapiens
ccuuaaaaaucaagacacuagu

SEQ ID NO: 1814585 - RNA, 18 nt, Homo sapiens
acgcgcguacagaucucu

SEQ ID NO: 1814586 - RNA, 22 nt, Homo sapiens
guucaagaaguaaucaguaugc

SEQ ID NO: 1814587 - RNA, 14 nt, Homo sapiens
ucucuguaaucucu

SEQ ID NO: 1814588 - RNA, 15 nt, Homo sapiens
uuccaaugaugcuua

SEQ ID NO: 1814589 - RNA, 19 nt, Homo sapiens
uucccugaccucccaacuc

SEQ ID NO: 1814590 - RNA, 23 nt, Homo sapiens
acuggccucccuuugugugcaua

SEQ ID NO: 1814591 - RNA, 13 nt, Homo sapiens
ucuggcaucucuu

SEQ ID NO: 1814592 - RNA, 13 nt, Homo sapiens
cuggcuggcacag

SEQ ID NO: 1814593 - RNA, 17 nt, Homo sapiens
cuucgaggacagcaaug

SEQ ID NO: 1814594 - RNA, 14 nt, Homo sapiens
auaaagugaacuuu

SEQ ID NO: 1814595 - RNA, 20 nt, Homo sapiens
auguugaccuuugcaaaaug

SEQ ID NO: 1814596 - RNA, 16 nt, Homo sapiens
ucugcaccuuaucuua

SEQ ID NO: 1814597 - RNA, 19 nt, Homo sapiens
agccagcaaccagcacauc

SEQ ID NO: 1814598 - RNA, 19 nt, Homo sapiens
uccaaauaaguugcgcuua

SEQ ID NO: 1814599 - RNA, 13 nt, Homo sapiens
cugggccaugucc

SEQ ID NO: 1814600 - RNA, 15 nt, Homo sapiens
accgcagggacaagc

SEQ ID NO: 1814601 - RNA, 23 nt, Homo sapiens
caggaaaauuguuugaacccagg

SEQ ID NO: 1814602 - RNA, 21 nt, Homo sapiens
cuuuggggucuacacugcaau

SEQ ID NO: 1814603 - RNA, 19 nt, Homo sapiens
cccccuaagaggcagugag

SEQ ID NO: 1814604 - RNA, 14 nt, Homo sapiens
uaauuauuuugaca

SEQ ID NO: 1814605 - RNA, 16 nt, Homo sapiens
caugaguuacacugga

SEQ ID NO: 1814606 - RNA, 18 nt, Homo sapiens
cuuuccuacacacucuga

SEQ ID NO: 1814607 - RNA, 15 nt, Homo sapiens
ucauucuuugaagga

SEQ ID NO: 1814608 - RNA, 18 nt, Homo sapiens
cgacagaagguugccagg

SEQ ID NO: 1814609 - RNA, 20 nt, Homo sapiens
cagggugacccugaagugag

SEQ ID NO: 1814610 - RNA, 19 nt, Homo sapiens
gggccucugcucccaugcu

SEQ ID NO: 1814611 - RNA, 18 nt, Homo sapiens
auucugcugaugcuacug

SEQ ID NO: 1814612 - RNA, 14 nt, Homo sapiens
aaugaaccccaguc

SEQ ID NO: 1814613 - RNA, 17 nt, Homo sapiens
agucuuaauuguguuua

SEQ ID NO: 1814614 - RNA, 15 nt, Homo sapiens
uccugugucagaaac

SEQ ID NO: 1814615 - RNA, 17 nt, Homo sapiens
uucugcugagagaucac

SEQ ID NO: 1814616 - RNA, 15 nt, Homo sapiens
cccauccccaccagc

SEQ ID NO: 1814617 - RNA, 11 nt, Homo sapiens
uuggucuguag

SEQ ID NO: 1814618 - RNA, 11 nt, Homo sapiens
caggucugcug

SEQ ID NO: 1814619 - RNA, 18 nt, Homo sapiens
caugccaagcacugugcu

SEQ ID NO: 1814620 - RNA, 21 nt, Homo sapiens
auuuauugaaaugauuucaca

SEQ ID NO: 1814621 - RNA, 22 nt, Homo sapiens
gaaguugccauuuugucucauu

SEQ ID NO: 1814622 - RNA, 21 nt, Homo sapiens
uccgcagaccugcugugauga

SEQ ID NO: 1814623 - RNA, 15 nt, Homo sapiens
caugggccucaguca

SEQ ID NO: 1814624 - RNA, 12 nt, Homo sapiens
uugaccucaggu

SEQ ID NO: 1814625 - RNA, 14 nt, Homo sapiens
auuuuuucuugaca

SEQ ID NO: 1814626 - RNA, 20 nt, Homo sapiens
aguguugucaccagaucuga

SEQ ID NO: 1814627 - RNA, 21 nt, Homo sapiens
guugaagccaugucuacauga

SEQ ID NO: 1814628 - RNA, 14 nt, Homo sapiens
uagcccacucugcu

SEQ ID NO: 1814629 - RNA, 22 nt, Homo sapiens
caauuaaggauuuuaugcuuua

SEQ ID NO: 1814630 - RNA, 13 nt, Homo sapiens
agauagugauauu

SEQ ID NO: 1814631 - RNA, 23 nt, Homo sapiens
uuaauuuuucuguuggucuuaac

SEQ ID NO: 1814632 - RNA, 19 nt, Homo sapiens
aauuuguuuuauauucucu

SEQ ID NO: 1814633 - RNA, 18 nt, Homo sapiens
cccucaggucagcucacu

SEQ ID NO: 1814634 - RNA, 21 nt, Homo sapiens
gguacuugaucauuuuuacca

SEQ ID NO: 1814635 - RNA, 15 nt, Homo sapiens
aaggaaaucucaccc

SEQ ID NO: 1814636 - RNA, 14 nt, Homo sapiens
cauccuguuugaaa

SEQ ID NO: 1814637 - RNA, 19 nt, Homo sapiens
uugauacuuuuauuguuau

SEQ ID NO: 1814638 - RNA, 20 nt, Homo sapiens
uucugagcuguaucuugaug

SEQ ID NO: 1814639 - RNA, 20 nt, Homo sapiens
auuccuguuugucuacauau

SEQ ID NO: 1814640 - RNA, 22 nt, Homo sapiens
uuuauauaaagaaaaucaauga

SEQ ID NO: 1814641 - RNA, 11 nt, Homo sapiens
cagcacagcaa

SEQ ID NO: 1814642 - RNA, 21 nt, Homo sapiens
uccaucugggagccccaagag

SEQ ID NO: 1814643 - RNA, 12 nt, Homo sapiens
cucucccaguga

SEQ ID NO: 1814644 - RNA, 15 nt, Homo sapiens
uacuucagucuugga

SEQ ID NO: 1814645 - RNA, 14 nt, Homo sapiens
cuccccuccugucc

SEQ ID NO: 1814646 - RNA, 20 nt, Homo sapiens
uaagaagaaugcuuaaucag

SEQ ID NO: 1814647 - RNA, 17 nt, Homo sapiens
guauagacaguuuguaa

SEQ ID NO: 1814648 - RNA, 14 nt, Homo sapiens
agcuguacugagga

SEQ ID NO: 1814649 - RNA, 21 nt, Homo sapiens
ucccacugcggggagacagaa

SEQ ID NO: 1814650 - RNA, 22 nt, Homo sapiens
augacgguaaguguucucauga

SEQ ID NO: 1814651 - RNA, 23 nt, Homo sapiens
ugugcaccuauggcccagccacu

SEQ ID NO: 1814652 - RNA, 20 nt, Homo sapiens
cccuggaucuaccagcauaa

SEQ ID NO: 1814653 - RNA, 16 nt, Homo sapiens
cagacuacagccagaa

SEQ ID NO: 1814654 - RNA, 13 nt, Homo sapiens
uuucuagagccug

SEQ ID NO: 1814655 - RNA, 11 nt, Homo sapiens
uccacuuuuau

SEQ ID NO: 1814656 - RNA, 13 nt, Homo sapiens
cucagagccucag

SEQ ID NO: 1814657 - RNA, 13 nt, Homo sapiens
cucaaagccucaa

SEQ ID NO: 1814658 - RNA, 13 nt, Homo sapiens
agggaagcaggga

SEQ ID NO: 1814659 - RNA, 13 nt, Homo sapiens
aggggagcagggg

SEQ ID NO: 1814660 - RNA, 13 nt, Homo sapiens
ucccaagcuccca

SEQ ID NO: 1814661 - RNA, 22 nt, Homo sapiens
agucccaaagaggcuacuguaa

SEQ ID NO: 1814662 - RNA, 13 nt, Homo sapiens
agccaaaauacuu

SEQ ID NO: 1814663 - RNA, 15 nt, Homo sapiens
ccaugcugggcucac

SEQ ID NO: 1814664 - RNA, 14 nt, Homo sapiens
aagaaucuuuacaa

SEQ ID NO: 1814665 - RNA, 15 nt, Homo sapiens
caagugucaucacuu

SEQ ID NO: 1814666 - RNA, 23 nt, Homo sapiens
guuacuaauuuguauaacccaua

SEQ ID NO: 1814667 - RNA, 12 nt, Homo sapiens
uugauguaucug

SEQ ID NO: 1814668 - RNA, 13 nt, Homo sapiens
augagacuuugaa

SEQ ID NO: 1814669 - RNA, 13 nt, Homo sapiens
acaagacuucaaa

SEQ ID NO: 1814670 - RNA, 15 nt, Homo sapiens
caagucuguggcuug

SEQ ID NO: 1814671 - RNA, 16 nt, Homo sapiens
gagcgagaaccaggcu

SEQ ID NO: 1814672 - RNA, 18 nt, Homo sapiens
cacagagcaaguccucac

SEQ ID NO: 1814673 - RNA, 15 nt, Homo sapiens
ugaaacuuauaguua

SEQ ID NO: 1814674 - RNA, 19 nt, Homo sapiens
acacugggagaggugccag

SEQ ID NO: 1814675 - RNA, 16 nt, Homo sapiens
cagccuugccagagau

SEQ ID NO: 1814676 - RNA, 12 nt, Homo sapiens
acauggagcucu

SEQ ID NO: 1814677 - RNA, 13 nt, Homo sapiens
ucuguauguguau

SEQ ID NO: 1814678 - RNA, 16 nt, Homo sapiens
uuacaucuaucccaga

SEQ ID NO: 1814679 - RNA, 22 nt, Homo sapiens
uggguugaacuauaacuguugg

SEQ ID NO: 1814680 - RNA, 15 nt, Homo sapiens
gagaaggaggggagc

SEQ ID NO: 1814681 - RNA, 15 nt, Homo sapiens
aggaaaaauguguaa

SEQ ID NO: 1814682 - RNA, 15 nt, Homo sapiens
uggauucaagugauc

SEQ ID NO: 1814683 - RNA, 23 nt, Homo sapiens
uuugcgugaaaguguuacauauu

SEQ ID NO: 1814684 - RNA, 16 nt, Homo sapiens
cuuuuaaaugcauaaa

SEQ ID NO: 1814685 - RNA, 14 nt, Homo sapiens
uauuaaaacagugu

SEQ ID NO: 1814686 - RNA, 22 nt, Homo sapiens
agucuaccugccuugccuguua

SEQ ID NO: 1814687 - RNA, 20 nt, Homo sapiens
acccuugcccggcugugauu

SEQ ID NO: 1814688 - RNA, 15 nt, Homo sapiens
ugcguggacucugca

SEQ ID NO: 1814689 - RNA, 17 nt, Homo sapiens
cugcuaugaccaugaca

SEQ ID NO: 1814690 - RNA, 14 nt, Homo sapiens
aauuuugcaccagc

SEQ ID NO: 1814691 - RNA, 16 nt, Homo sapiens
aauugaacgacuguau

SEQ ID NO: 1814692 - RNA, 13 nt, Homo sapiens
ucuucugacuuaa

SEQ ID NO: 1814693 - RNA, 19 nt, Homo sapiens
aguaccccugauaagcaaa

SEQ ID NO: 1814694 - RNA, 19 nt, Homo sapiens
uccuccaucaauucuguau

SEQ ID NO: 1814695 - RNA, 13 nt, Homo sapiens
gacagaacacugu

SEQ ID NO: 1814696 - RNA, 17 nt, Homo sapiens
uugcccaguguucuccu

SEQ ID NO: 1814697 - RNA, 18 nt, Homo sapiens
accugcacuucauaucua

SEQ ID NO: 1814698 - RNA, 16 nt, Homo sapiens
ccacagaggacucacu

SEQ ID NO: 1814699 - RNA, 14 nt, Homo sapiens
agacaugaaugcac

SEQ ID NO: 1814700 - RNA, 22 nt, Homo sapiens
acacaauuauaagagacuuauc

SEQ ID NO: 1814701 - RNA, 13 nt, Homo sapiens
gaauaucuuccac

SEQ ID NO: 1814702 - RNA, 18 nt, Homo sapiens
ucuauaugaaugcuauuu

SEQ ID NO: 1814703 - RNA, 18 nt, Homo sapiens
auucauauuuaugaaucu

SEQ ID NO: 1814704 - RNA, 16 nt, Homo sapiens
cccgagagcugggacu

SEQ ID NO: 1814705 - RNA, 22 nt, Homo sapiens
accucagguugaaauaccaggg

SEQ ID NO: 1814706 - RNA, 18 nt, Homo sapiens
uccggaaagaugagcuuu

SEQ ID NO: 1814707 - RNA, 17 nt, Homo sapiens
agucugcucaacacgac

SEQ ID NO: 1814708 - RNA, 14 nt, Homo sapiens
ucaaugaacugugc

SEQ ID NO: 1814709 - RNA, 14 nt, Homo sapiens
auaaauauacagua

SEQ ID NO: 1814710 - RNA, 11 nt, Homo sapiens
uuuuuugccag

SEQ ID NO: 1814711 - RNA, 18 nt, Homo sapiens
ugagcuaaugguucauau

SEQ ID NO: 1814712 - RNA, 23 nt, Homo sapiens
ucauucucuagacaaaauccauc

SEQ ID NO: 1814713 - RNA, 15 nt, Homo sapiens
caagauacauuucau

SEQ ID NO: 1814714 - RNA, 13 nt, Homo sapiens
caaccacaauuca

SEQ ID NO: 1814715 - RNA, 21 nt, Homo sapiens
cacgccucccugagcacugac

SEQ ID NO: 1814716 - RNA, 17 nt, Homo sapiens
guacugaaaaaaaaaga

SEQ ID NO: 1814717 - RNA, 14 nt, Homo sapiens
cccucuccuuccaa

SEQ ID NO: 1814718 - RNA, 14 nt, Homo sapiens
uguccaaguucagg

SEQ ID NO: 1814719 - RNA, 22 nt, Homo sapiens
ugcagcccccauuguggucaca

SEQ ID NO: 1814720 - RNA, 19 nt, Homo sapiens
cuugcauuuauuauucuca

SEQ ID NO: 1814721 - RNA, 17 nt, Homo sapiens
acaaaaaagguaaucca

SEQ ID NO: 1814722 - RNA, 19 nt, Homo sapiens
acugagaacagaucuccaa

SEQ ID NO: 1814723 - RNA, 14 nt, Homo sapiens
accgcccuccucac

SEQ ID NO: 1814724 - RNA, 21 nt, Homo sapiens
aggauauaguuaucaaucucu

SEQ ID NO: 1814725 - RNA, 18 nt, Homo sapiens
gaagcagacuuuucagaa

SEQ ID NO: 1814726 - RNA, 19 nt, Homo sapiens
uguaucgcugauguucacc

SEQ ID NO: 1814727 - RNA, 15 nt, Homo sapiens
agaagccaucaccuc

SEQ ID NO: 1814728 - RNA, 14 nt, Homo sapiens
uaccugacacuccc

SEQ ID NO: 1814729 - RNA, 17 nt, Homo sapiens
gcugccuggcacagacc

SEQ ID NO: 1814730 - RNA, 14 nt, Homo sapiens
uauaauuacuuaau

SEQ ID NO: 1814731 - RNA, 13 nt, Homo sapiens
ccaaaauguuaau

SEQ ID NO: 1814732 - RNA, 13 nt, Homo sapiens
uuaaaaugccaau

SEQ ID NO: 1814733 - RNA, 16 nt, Homo sapiens
ccagcuguagccaugg

SEQ ID NO: 1814734 - RNA, 12 nt, Homo sapiens
gaacauccucca

SEQ ID NO: 1814735 - RNA, 21 nt, Homo sapiens
aggacauauucacagugaaca

SEQ ID NO: 1814736 - RNA, 15 nt, Homo sapiens
gcacagccucgggga

SEQ ID NO: 1814737 - RNA, 22 nt, Homo sapiens
uuuuaguuccuucuauacaugu

SEQ ID NO: 1814738 - RNA, 19 nt, Homo sapiens
auucauuguguuaccugua

SEQ ID NO: 1814739 - RNA, 18 nt, Homo sapiens
gcuguuuuagcugaggga

SEQ ID NO: 1814740 - RNA, 14 nt, Homo sapiens
gcucagugcucucu

SEQ ID NO: 1814741 - RNA, 16 nt, Homo sapiens
auuacccccuccucca

SEQ ID NO: 1814742 - RNA, 16 nt, Homo sapiens
cagaaccaaagcucaa

SEQ ID NO: 1814743 - RNA, 22 nt, Homo sapiens
cacuuucauuggacccugacug

SEQ ID NO: 1814744 - RNA, 19 nt, Homo sapiens
uaauauaacugucuuagua

SEQ ID NO: 1814745 - RNA, 22 nt, Homo sapiens
uacaggaggggucucauguccu

SEQ ID NO: 1814746 - RNA, 14 nt, Homo sapiens
uagaccaugcacag

SEQ ID NO: 1814747 - RNA, 15 nt, Homo sapiens
gaaauauuacuauaa

SEQ ID NO: 1814748 - RNA, 13 nt, Homo sapiens
auaaaagguagua

SEQ ID NO: 1814749 - RNA, 14 nt, Homo sapiens
aaaagcuguggaau

SEQ ID NO: 1814750 - RNA, 17 nt, Homo sapiens
ugccuauggaguagcca

SEQ ID NO: 1814751 - RNA, 18 nt, Homo sapiens
cuuuuucuaagcuguuuc

SEQ ID NO: 1814752 - RNA, 22 nt, Homo sapiens
gagaaaugaaaucgaauggaga

SEQ ID NO: 1814753 - RNA, 18 nt, Homo sapiens
caggggccggccaguggc

SEQ ID NO: 1814754 - RNA, 18 nt, Homo sapiens
aacuuuuauuacagucaa

SEQ ID NO: 1814755 - RNA, 23 nt, Homo sapiens
cgacgguuucaaaccaggauuuu

SEQ ID NO: 1814756 - RNA, 21 nt, Homo sapiens
cucgggaaacuuagaucauca

SEQ ID NO: 1814757 - RNA, 13 nt, Homo sapiens
uucauguguacag

SEQ ID NO: 1814758 - RNA, 19 nt, Homo sapiens
auuguguguccaucuguua

SEQ ID NO: 1814759 - RNA, 14 nt, Homo sapiens
uaucuucuacugua

SEQ ID NO: 1814760 - RNA, 16 nt, Homo sapiens
ucaagacacagacaaa

SEQ ID NO: 1814761 - RNA, 18 nt, Homo sapiens
uauauauuuuugugcaca

SEQ ID NO: 1814762 - RNA, 17 nt, Homo sapiens
agaucugugagcacguu

SEQ ID NO: 1814763 - RNA, 21 nt, Homo sapiens
auauuuaauguggaaugucaa

SEQ ID NO: 1814764 - RNA, 23 nt, Homo sapiens
uuuaaagaaaaauaugauacucu

SEQ ID NO: 1814765 - RNA, 17 nt, Homo sapiens
ugcccucucccaaaaaa

SEQ ID NO: 1814766 - RNA, 17 nt, Homo sapiens
aagcaacaaauuaacua

SEQ ID NO: 1814767 - RNA, 15 nt, Homo sapiens
accugcuaggccaga

SEQ ID NO: 1814768 - RNA, 20 nt, Homo sapiens
ucuuucuuugcaccaaagac

SEQ ID NO: 1814769 - RNA, 17 nt, Homo sapiens
caaugucuaaaauggac

SEQ ID NO: 1814770 - RNA, 19 nt, Homo sapiens
ugccccgugcagacuggag

SEQ ID NO: 1814771 - RNA, 18 nt, Homo sapiens
uaagugucagacuaucca

SEQ ID NO: 1814772 - RNA, 20 nt, Homo sapiens
uuccucggcagucacuucca

SEQ ID NO: 1814773 - RNA, 16 nt, Homo sapiens
aaccacugcuaugcca

SEQ ID NO: 1814774 - RNA, 23 nt, Homo sapiens
ucucauagaacugccuggauucc

SEQ ID NO: 1814775 - RNA, 15 nt, Homo sapiens
cugcuccgagucuuc

SEQ ID NO: 1814776 - RNA, 18 nt, Homo sapiens
uggauuguagaacuuguu

SEQ ID NO: 1814777 - RNA, 15 nt, Homo sapiens
aagaugugucuucaa

SEQ ID NO: 1814778 - RNA, 17 nt, Homo sapiens
agcucacugcaaccucu

SEQ ID NO: 1814779 - RNA, 19 nt, Homo sapiens
uacaucacugcuugaugaa

SEQ ID NO: 1814780 - RNA, 17 nt, Homo sapiens
acccugccugcaccucc

SEQ ID NO: 1814781 - RNA, 21 nt, Homo sapiens
ccauuugggagaagaucucaa

SEQ ID NO: 1814782 - RNA, 16 nt, Homo sapiens
aauaagagcucaggau

SEQ ID NO: 1814783 - RNA, 19 nt, Homo sapiens
aggcacccgccaccaugcc

SEQ ID NO: 1814784 - RNA, 13 nt, Homo sapiens
gucuucaacaucc

SEQ ID NO: 1814785 - RNA, 12 nt, Homo sapiens
uggggacagggc

SEQ ID NO: 1814786 - RNA, 17 nt, Homo sapiens
gacaaaauaaacauuuu

SEQ ID NO: 1814787 - RNA, 22 nt, Homo sapiens
caggcaauuucaccaccaaaug

SEQ ID NO: 1814788 - RNA, 14 nt, Homo sapiens
aggcaugcuggagu

SEQ ID NO: 1814789 - RNA, 20 nt, Homo sapiens
gauuugcaggugaacagccu

SEQ ID NO: 1814790 - RNA, 16 nt, Homo sapiens
cugcugcuccagugca

SEQ ID NO: 1814791 - RNA, 22 nt, Homo sapiens
auuccuugggacucaggagcug

SEQ ID NO: 1814792 - RNA, 19 nt, Homo sapiens
cucugcaggucccuaauaa

SEQ ID NO: 1814793 - RNA, 18 nt, Homo sapiens
ccaaagggagggugacau

SEQ ID NO: 1814794 - RNA, 21 nt, Homo sapiens
auuaccgucugugauugccau

SEQ ID NO: 1814795 - RNA, 15 nt, Homo sapiens
ccagucacugcugca

SEQ ID NO: 1814796 - RNA, 21 nt, Homo sapiens
uuuugagaguaaugcauacag

SEQ ID NO: 1814797 - RNA, 19 nt, Homo sapiens
caugccaaguaucuuucca

SEQ ID NO: 1814798 - RNA, 18 nt, Homo sapiens
auaaauacaagaguuuca

SEQ ID NO: 1814799 - RNA, 16 nt, Homo sapiens
auucaucucaaggaau

SEQ ID NO: 1814800 - RNA, 14 nt, Homo sapiens
uacuaaaacauaca

SEQ ID NO: 1814801 - RNA, 16 nt, Homo sapiens
ugccaagaaaguauuu

SEQ ID NO: 1814802 - RNA, 15 nt, Homo sapiens
augcuacaacuacua

SEQ ID NO: 1814803 - RNA, 12 nt, Homo sapiens
uagcugccaaau

SEQ ID NO: 1814804 - RNA, 17 nt, Homo sapiens
uucaucuaacgugcauu

SEQ ID NO: 1814805 - RNA, 18 nt, Homo sapiens
acauaguugcuucuuucc

SEQ ID NO: 1814806 - RNA, 16 nt, Homo sapiens
uuuaaaaaaauaacau

SEQ ID NO: 1814807 - RNA, 20 nt, Homo sapiens
cucuucagacuuaaagcacu

SEQ ID NO: 1814808 - RNA, 14 nt, Homo sapiens
cuccgucaccucag

SEQ ID NO: 1814809 - RNA, 13 nt, Homo sapiens
aaacuuccucuaa

SEQ ID NO: 1814810 - RNA, 22 nt, Homo sapiens
guggugcucuuugcugcacuau

SEQ ID NO: 1814811 - RNA, 12 nt, Homo sapiens
ugagacacuguc

SEQ ID NO: 1814812 - RNA, 18 nt, Homo sapiens
aacucuucaggcaccuga

SEQ ID NO: 1814813 - RNA, 20 nt, Homo sapiens
uaaagaaagaaugcauucca

SEQ ID NO: 1814814 - RNA, 23 nt, Homo sapiens
uggaacaugcccacaacuuguca

SEQ ID NO: 1814815 - RNA, 17 nt, Homo sapiens
uccucuuccaugcugug

SEQ ID NO: 1814816 - RNA, 19 nt, Homo sapiens
aaugcuacugucucacuga

SEQ ID NO: 1814817 - RNA, 13 nt, Homo sapiens
gcaagaugaccua

SEQ ID NO: 1814818 - RNA, 19 nt, Homo sapiens
cucagcuagacauugcaau

SEQ ID NO: 1814819 - RNA, 19 nt, Homo sapiens
cuacaaucagcuagggacu

SEQ ID NO: 1814820 - RNA, 16 nt, Homo sapiens
auuugcacuaaaucag

SEQ ID NO: 1814821 - RNA, 20 nt, Homo sapiens
accccucccacggugcccaa

SEQ ID NO: 1814822 - RNA, 9 nt, Homo sapiens
ucucagcuu

SEQ ID NO: 1814823 - RNA, 22 nt, Homo sapiens
ccccgagcugggggccaugagc

SEQ ID NO: 1814824 - RNA, 13 nt, Homo sapiens
aucucacaaauaa

SEQ ID NO: 1814825 - RNA, 17 nt, Homo sapiens
cagcuccuuccaccaca

SEQ ID NO: 1814826 - RNA, 18 nt, Homo sapiens
ucccuuuggagaugcuga

SEQ ID NO: 1814827 - RNA, 15 nt, Homo sapiens
agaaccuaaaguagc

SEQ ID NO: 1814828 - RNA, 19 nt, Homo sapiens
aacacacuuaucugucucu

SEQ ID NO: 1814829 - RNA, 13 nt, Homo sapiens
accccaccacuuc

SEQ ID NO: 1814830 - RNA, 23 nt, Homo sapiens
uaaagugucaccccucacuguga

SEQ ID NO: 1814831 - RNA, 12 nt, Homo sapiens
uacacugugaua

SEQ ID NO: 1814832 - RNA, 22 nt, Homo sapiens
ggcaguggccacguucagggag

SEQ ID NO: 1814833 - RNA, 17 nt, Homo sapiens
gaagaaaaucaaccagc

SEQ ID NO: 1814834 - RNA, 19 nt, Homo sapiens
gaaguuucuggugccauuu

SEQ ID NO: 1814835 - RNA, 21 nt, Homo sapiens
ggauuaaaaaaaugugguaca

SEQ ID NO: 1814836 - RNA, 20 nt, Homo sapiens
aaaaguuaagugucauuucu

SEQ ID NO: 1814837 - RNA, 14 nt, Homo sapiens
accuguaaaacuuu

SEQ ID NO: 1814838 - RNA, 14 nt, Homo sapiens
gaugucaagcuggc

SEQ ID NO: 1814839 - RNA, 16 nt, Homo sapiens
guagcucuccugacuu

SEQ ID NO: 1814840 - RNA, 17 nt, Homo sapiens
gcccucccccugccaga

SEQ ID NO: 1814841 - RNA, 13 nt, Homo sapiens
guacaaugacacu

SEQ ID NO: 1814842 - RNA, 12 nt, Homo sapiens
cauacaggccau

SEQ ID NO: 1814843 - RNA, 21 nt, Homo sapiens
aagaaaauaagugcucuguca

SEQ ID NO: 1814844 - RNA, 22 nt, Homo sapiens
ucccuuccacugccucugccuu

SEQ ID NO: 1814845 - RNA, 17 nt, Homo sapiens
uacgaccgggaggucca

SEQ ID NO: 1814846 - RNA, 20 nt, Homo sapiens
caagaugaaacagggcaccc

SEQ ID NO: 1814847 - RNA, 13 nt, Homo sapiens
gacugcuaguguu

SEQ ID NO: 1814848 - RNA, 17 nt, Homo sapiens
cagaacagacacuuuaa

SEQ ID NO: 1814849 - RNA, 15 nt, Homo sapiens
guacuuguuugcuau

SEQ ID NO: 1814850 - RNA, 15 nt, Homo sapiens
uaaaaaugcugcucu

SEQ ID NO: 1814851 - RNA, 16 nt, Homo sapiens
acuguuaggaacagca

SEQ ID NO: 1814852 - RNA, 19 nt, Homo sapiens
caauugcuaccgagaaggu

SEQ ID NO: 1814853 - RNA, 20 nt, Homo sapiens
cagcuggccaccauggcacc

SEQ ID NO: 1814854 - RNA, 17 nt, Homo sapiens
acacauauacauauaua

SEQ ID NO: 1814855 - RNA, 17 nt, Homo sapiens
aaauacuguaacacugu

SEQ ID NO: 1814856 - RNA, 15 nt, Homo sapiens
cugcauuuccucgca

SEQ ID NO: 1814857 - RNA, 23 nt, Homo sapiens
cggacugcaagcagggcucugcc

SEQ ID NO: 1814858 - RNA, 16 nt, Homo sapiens
ccacagaguuuuucag

SEQ ID NO: 1814859 - RNA, 20 nt, Homo sapiens
uacugacagaggcucacuga

SEQ ID NO: 1814860 - RNA, 14 nt, Homo sapiens
aaaaccugugccag

SEQ ID NO: 1814861 - RNA, 17 nt, Homo sapiens
uguaaggaaggugcuca

SEQ ID NO: 1814862 - RNA, 20 nt, Homo sapiens
cccacacccaccucugccac

SEQ ID NO: 1814863 - RNA, 21 nt, Homo sapiens
cuaagauauagaaacucucau

SEQ ID NO: 1814864 - RNA, 16 nt, Homo sapiens
ccgagucugucucugu

SEQ ID NO: 1814865 - RNA, 18 nt, Homo sapiens
gaaagcaaggacugcccu

SEQ ID NO: 1814866 - RNA, 20 nt, Homo sapiens
acuauuaaaguaacauuuaa

SEQ ID NO: 1814867 - RNA, 21 nt, Homo sapiens
agagccaccagggcacugucu

SEQ ID NO: 1814868 - RNA, 12 nt, Homo sapiens
uagaucuagaaa

SEQ ID NO: 1814869 - RNA, 21 nt, Homo sapiens
caguugagagggugcagucca

SEQ ID NO: 1814870 - RNA, 16 nt, Homo sapiens
ucacacauuuacugua

SEQ ID NO: 1814871 - RNA, 20 nt, Homo sapiens
uccaaaacacucuggaucuu

SEQ ID NO: 1814872 - RNA, 16 nt, Homo sapiens
cugagcauaaugcucc

SEQ ID NO: 1814873 - RNA, 14 nt, Homo sapiens
gcugccugccuugg

SEQ ID NO: 1814874 - RNA, 14 nt, Homo sapiens
ucaaauacauacaa

SEQ ID NO: 1814875 - RNA, 18 nt, Homo sapiens
ugcaaccagcaucucugu

SEQ ID NO: 1814876 - RNA, 15 nt, Homo sapiens
caauuguacauuccc

SEQ ID NO: 1814877 - RNA, 16 nt, Homo sapiens
gccucaagaacaaaca

SEQ ID NO: 1814878 - RNA, 21 nt, Homo sapiens
ccaggagccggacacuucuca

SEQ ID NO: 1814879 - RNA, 21 nt, Homo sapiens
caagaaaggccugaauggagg

SEQ ID NO: 1814880 - RNA, 14 nt, Homo sapiens
agggagcucugggg

SEQ ID NO: 1814881 - RNA, 17 nt, Homo sapiens
agaggagagaggcucag

SEQ ID NO: 1814882 - RNA, 21 nt, Homo sapiens
cugggugauuuauaugaaaag

SEQ ID NO: 1814883 - RNA, 14 nt, Homo sapiens
uuugagacuuagaa

SEQ ID NO: 1814884 - RNA, 19 nt, Homo sapiens
ggggcucacaccuguaauc

SEQ ID NO: 1814885 - RNA, 14 nt, Homo sapiens
aaauuacuuaguau

SEQ ID NO: 1814886 - RNA, 15 nt, Homo sapiens
aguaccaaugcucuu

SEQ ID NO: 1814887 - RNA, 16 nt, Homo sapiens
cagaccucuucuaaga

SEQ ID NO: 1814888 - RNA, 14 nt, Homo sapiens
uuuggaaacaacau

SEQ ID NO: 1814889 - RNA, 19 nt, Homo sapiens
cucccggggacgcuuuuga

SEQ ID NO: 1814890 - RNA, 16 nt, Homo sapiens
accauuucagccaaac

SEQ ID NO: 1814891 - RNA, 22 nt, Homo sapiens
cuuccaugacauaagugcuauu

SEQ ID NO: 1814892 - RNA, 20 nt, Homo sapiens
caauuccucugugcucuccu

SEQ ID NO: 1814893 - RNA, 13 nt, Homo sapiens
uucccacacggca

SEQ ID NO: 1814894 - RNA, 21 nt, Homo sapiens
ccugaugacagagcgagauuc

SEQ ID NO: 1814895 - RNA, 21 nt, Homo sapiens
ucccaggagaccugauucccu

SEQ ID NO: 1814896 - RNA, 20 nt, Homo sapiens
agcucuguuuauaaaaacaa

SEQ ID NO: 1814897 - RNA, 17 nt, Homo sapiens
auaaagcuuuuccugca

SEQ ID NO: 1814898 - RNA, 20 nt, Homo sapiens
cagguaaaugguaugaucaa

SEQ ID NO: 1814899 - RNA, 21 nt, Homo sapiens
caacauuugcuuuuugcuugu

SEQ ID NO: 1814900 - RNA, 12 nt, Homo sapiens
gucugucccaaa

SEQ ID NO: 1814901 - RNA, 20 nt, Homo sapiens
gaaaguaaaaguuauaucua

SEQ ID NO: 1814902 - RNA, 20 nt, Homo sapiens
uaauaaaauauuuucugugu

SEQ ID NO: 1814903 - RNA, 20 nt, Homo sapiens
gaaccuaaauugaacugcca

SEQ ID NO: 1814904 - RNA, 16 nt, Homo sapiens
gcauguggagacacuc

SEQ ID NO: 1814905 - RNA, 20 nt, Homo sapiens
cuaccuaaaaguugguuaaa

SEQ ID NO: 1814906 - RNA, 16 nt, Homo sapiens
acucauagcacuuccc

SEQ ID NO: 1814907 - RNA, 13 nt, Homo sapiens
aacuguccaccaa

SEQ ID NO: 1814908 - RNA, 14 nt, Homo sapiens
cccaggacucuggc

SEQ ID NO: 1814909 - RNA, 13 nt, Homo sapiens
aaugacuaaagac

SEQ ID NO: 1814910 - RNA, 21 nt, Homo sapiens
ccuuuucuccucuuugaacau

SEQ ID NO: 1814911 - RNA, 23 nt, Homo sapiens
auucucaagccagagacaaucua

SEQ ID NO: 1814912 - RNA, 16 nt, Homo sapiens
uagaaauaauaugcau

SEQ ID NO: 1814913 - RNA, 22 nt, Homo sapiens
gccuccugggaacacaucuggc

SEQ ID NO: 1814914 - RNA, 19 nt, Homo sapiens
gaagugcuuucuucuccca

SEQ ID NO: 1814915 - RNA, 12 nt, Homo sapiens
uugaugcuugua

SEQ ID NO: 1814916 - RNA, 13 nt, Homo sapiens
aagaauuggccag

SEQ ID NO: 1814917 - RNA, 21 nt, Homo sapiens
aagacuccucugggccugggg

SEQ ID NO: 1814918 - RNA, 20 nt, Homo sapiens
uauuccuuugccaauucauu

SEQ ID NO: 1814919 - RNA, 23 nt, Homo sapiens
uauguaauuuagcaguccaaaga

SEQ ID NO: 1814920 - RNA, 22 nt, Homo sapiens
auagaauucaauuugaacucag

SEQ ID NO: 1814921 - RNA, 13 nt, Homo sapiens
uccccuccagacc

SEQ ID NO: 1814922 - RNA, 13 nt, Homo sapiens
cgcaccuaucacc

SEQ ID NO: 1814923 - RNA, 18 nt, Homo sapiens
ccauuuugugaauuguga

SEQ ID NO: 1814924 - RNA, 18 nt, Homo sapiens
accuccuucucugucuca

SEQ ID NO: 1814925 - RNA, 14 nt, Homo sapiens
acgguccaugccuu

SEQ ID NO: 1814926 - RNA, 16 nt, Homo sapiens
ugaugcuuuacauuua

SEQ ID NO: 1814927 - RNA, 23 nt, Homo sapiens
cauuucuuauuuaauuagaaugg

SEQ ID NO: 1814928 - RNA, 15 nt, Homo sapiens
uagacaaaaaguaua

SEQ ID NO: 1814929 - RNA, 18 nt, Homo sapiens
aguucaugcucccagcca

SEQ ID NO: 1814930 - RNA, 15 nt, Homo sapiens
acaacauaucucagg

SEQ ID NO: 1814931 - RNA, 18 nt, Homo sapiens
gaauauuuaagaaaagca

SEQ ID NO: 1814932 - RNA, 15 nt, Homo sapiens
aauugccugccaugg

SEQ ID NO: 1814933 - RNA, 19 nt, Homo sapiens
guauuuuccuggauuuaua

SEQ ID NO: 1814934 - RNA, 15 nt, Homo sapiens
ucuguugauugauga

SEQ ID NO: 1814935 - RNA, 13 nt, Homo sapiens
auuuaucaaucuc

SEQ ID NO: 1814936 - RNA, 22 nt, Homo sapiens
aguugugagcacucuacugcaa

SEQ ID NO: 1814937 - RNA, 16 nt, Homo sapiens
agcauucugucuugaa

SEQ ID NO: 1814938 - RNA, 14 nt, Homo sapiens
uaggguuuaggaaa

SEQ ID NO: 1814939 - RNA, 14 nt, Homo sapiens
aggaaacugcuacu

SEQ ID NO: 1814940 - RNA, 15 nt, Homo sapiens
uguaaacaucauaaa

SEQ ID NO: 1814941 - RNA, 17 nt, Homo sapiens
gugcauuggagauucuu

SEQ ID NO: 1814942 - RNA, 23 nt, Homo sapiens
ucacgggucacuugaaauucuuu

SEQ ID NO: 1814943 - RNA, 18 nt, Homo sapiens
agccaugccucaugccac

SEQ ID NO: 1814944 - RNA, 17 nt, Homo sapiens
uuuuuaacugcauaaua

SEQ ID NO: 1814945 - RNA, 13 nt, Homo sapiens
gacuggccacuga

SEQ ID NO: 1814946 - RNA, 12 nt, Homo sapiens
ucccugcaguaa

SEQ ID NO: 1814947 - RNA, 22 nt, Homo sapiens
ccaaaggugugcccuguacaca

SEQ ID NO: 1814948 - RNA, 13 nt, Homo sapiens
auacacugucacg

SEQ ID NO: 1814949 - RNA, 16 nt, Homo sapiens
ccaaccagacagcaca

SEQ ID NO: 1814950 - RNA, 19 nt, Homo sapiens
aguuggacccauugccagu

SEQ ID NO: 1814951 - RNA, 15 nt, Homo sapiens
uuuauuucugaucua

SEQ ID NO: 1814952 - RNA, 15 nt, Homo sapiens
uuuguaacuugccau

SEQ ID NO: 1814953 - RNA, 19 nt, Homo sapiens
cuuuccuguagucccauug

SEQ ID NO: 1814954 - RNA, 14 nt, Homo sapiens
acuccugcuuaauc

SEQ ID NO: 1814955 - RNA, 16 nt, Homo sapiens
augcaaagucaugcaa

SEQ ID NO: 1814956 - RNA, 13 nt, Homo sapiens
cacuucagccucc

SEQ ID NO: 1814957 - RNA, 15 nt, Homo sapiens
acagucagaaccacu

SEQ ID NO: 1814958 - RNA, 14 nt, Homo sapiens
cggagcgcaccugc

SEQ ID NO: 1814959 - RNA, 17 nt, Homo sapiens
cccugcaccaggccauc

SEQ ID NO: 1814960 - RNA, 12 nt, Homo sapiens
ccuacagagcag

SEQ ID NO: 1814961 - RNA, 16 nt, Homo sapiens
gcucuguccacucuga

SEQ ID NO: 1814962 - RNA, 17 nt, Homo sapiens
aggggccuaagugccac

SEQ ID NO: 1814963 - RNA, 16 nt, Homo sapiens
cuguccagguagaaaa

SEQ ID NO: 1814964 - RNA, 13 nt, Homo sapiens
caccaaaugaauu

SEQ ID NO: 1814965 - RNA, 19 nt, Homo sapiens
aaguccuacaagcuaaaau

SEQ ID NO: 1814966 - RNA, 19 nt, Homo sapiens
agaaaauccauucauucaa

SEQ ID NO: 1814967 - RNA, 21 nt, Homo sapiens
aagggccaaaaguauccaagg

SEQ ID NO: 1814968 - RNA, 20 nt, Homo sapiens
augcuaccaugccucuccaa

SEQ ID NO: 1814969 - RNA, 21 nt, Homo sapiens
aaugagaaauuuuguugauau

SEQ ID NO: 1814970 - RNA, 15 nt, Homo sapiens
aucaaauugcuacau

SEQ ID NO: 1814971 - RNA, 16 nt, Homo sapiens
auugcaaggucacuuu

SEQ ID NO: 1814972 - RNA, 15 nt, Homo sapiens
acccacaaacugccu

SEQ ID NO: 1814973 - RNA, 19 nt, Homo sapiens
aauucuccugccucagccu

SEQ ID NO: 1814974 - RNA, 16 nt, Homo sapiens
ucaguggugucuguga

SEQ ID NO: 1814975 - RNA, 18 nt, Homo sapiens
aauuaaaugcauguccuc

SEQ ID NO: 1814976 - RNA, 15 nt, Homo sapiens
ggggcaggaaccaga

SEQ ID NO: 1814977 - RNA, 18 nt, Homo sapiens
ugccagugggcagugcau

SEQ ID NO: 1814978 - RNA, 17 nt, Homo sapiens
agagcgagaccgucuca

SEQ ID NO: 1814979 - RNA, 12 nt, Homo sapiens
ggccuuuccuug

SEQ ID NO: 1814980 - RNA, 20 nt, Homo sapiens
ccaagaucccaucucuccau

SEQ ID NO: 1814981 - RNA, 14 nt, Homo sapiens
caugaacagcauua

SEQ ID NO: 1814982 - RNA, 17 nt, Homo sapiens
caguggccuugcuucuu

SEQ ID NO: 1814983 - RNA, 17 nt, Homo sapiens
uucuugaagaaaggcaa

SEQ ID NO: 1814984 - RNA, 22 nt, Homo sapiens
cacgucgggcuucccuggccuc

SEQ ID NO: 1814985 - RNA, 14 nt, Homo sapiens
acauuucucugagc

SEQ ID NO: 1814986 - RNA, 22 nt, Homo sapiens
uaaauauuuauuuaacuauuca

SEQ ID NO: 1814987 - RNA, 21 nt, Homo sapiens
caaacuuggucuuacaucugu

SEQ ID NO: 1814988 - RNA, 14 nt, Homo sapiens
gucuaaucagugau

SEQ ID NO: 1814989 - RNA, 14 nt, Homo sapiens
guuuaaucagcgau

SEQ ID NO: 1814990 - RNA, 21 nt, Homo sapiens
auuuauugugcuucgagugac

SEQ ID NO: 1814991 - RNA, 15 nt, Homo sapiens
acaguacagaaggca

SEQ ID NO: 1814992 - RNA, 15 nt, Homo sapiens
cugcaagauggacac

SEQ ID NO: 1814993 - RNA, 22 nt, Homo sapiens
ugucaccucccugaaauugcau

SEQ ID NO: 1814994 - RNA, 18 nt, Homo sapiens
augugcuugccaugugua

SEQ ID NO: 1814995 - RNA, 19 nt, Homo sapiens
cuccacaaagccaaucuca

SEQ ID NO: 1814996 - RNA, 18 nt, Homo sapiens
ucauucucgaaaaaagag

SEQ ID NO: 1814997 - RNA, 14 nt, Homo sapiens
agauccagcagcug

SEQ ID NO: 1814998 - RNA, 19 nt, Homo sapiens
aaagacauuucauccacca

SEQ ID NO: 1814999 - RNA, 18 nt, Homo sapiens
acuggcuuugucccacag

SEQ ID NO: 1815000 - RNA, 18 nt, Homo sapiens
uucaaaguuaaaagcaaa

SEQ ID NO: 1815001 - RNA, 21 nt, Homo sapiens
cagaauggugggcuccagagu

SEQ ID NO: 1815002 - RNA, 18 nt, Homo sapiens
accuaaaacaucucauca

SEQ ID NO: 1815003 - RNA, 19 nt, Homo sapiens
ggccagaagggggccauga

SEQ ID NO: 1815004 - RNA, 13 nt, Homo sapiens
cacucaauuuucc

SEQ ID NO: 1815005 - RNA, 17 nt, Homo sapiens
aggucuugggagcucuu

SEQ ID NO: 1815006 - RNA, 15 nt, Homo sapiens
acuauuuucaaagaa

SEQ ID NO: 1815007 - RNA, 18 nt, Homo sapiens
acccucacuuaaacuuuu

SEQ ID NO: 1815008 - RNA, 16 nt, Homo sapiens
auagugagcauauaua

SEQ ID NO: 1815009 - RNA, 15 nt, Homo sapiens
uggaaagaacauuua

SEQ ID NO: 1815010 - RNA, 18 nt, Homo sapiens
ugaaaccccaaacaguga

SEQ ID NO: 1815011 - RNA, 15 nt, Homo sapiens
uaaauugucugccau

SEQ ID NO: 1815012 - RNA, 15 nt, Homo sapiens
aggcaggcagggcau

SEQ ID NO: 1815013 - RNA, 11 nt, Homo sapiens
uccuuuuccau

SEQ ID NO: 1815014 - RNA, 19 nt, Homo sapiens
gcauacaccacugcaaaau

SEQ ID NO: 1815015 - RNA, 20 nt, Homo sapiens
ccaugaacacguuuuuucac

SEQ ID NO: 1815016 - RNA, 17 nt, Homo sapiens
cuaggauugugccugua

SEQ ID NO: 1815017 - RNA, 17 nt, Homo sapiens
gcagagagcacagugau

SEQ ID NO: 1815018 - RNA, 16 nt, Homo sapiens
cuguguccgaugcugg

SEQ ID NO: 1815019 - RNA, 12 nt, Homo sapiens
aaaauauaucau

SEQ ID NO: 1815020 - RNA, 19 nt, Homo sapiens
aaaagccuuacggucauga

SEQ ID NO: 1815021 - RNA, 18 nt, Homo sapiens
uccuuccacaaugacugc

SEQ ID NO: 1815022 - RNA, 13 nt, Homo sapiens
uuguuccugcuuu

SEQ ID NO: 1815023 - RNA, 21 nt, Homo sapiens
auccuccacuuguucagggcu

SEQ ID NO: 1815024 - RNA, 24 nt, Homo sapiens
ggcagccucucuucacugcuacau

SEQ ID NO: 1815025 - RNA, 23 nt, Homo sapiens
cagggacuugaaguuguuacuaa

SEQ ID NO: 1815026 - RNA, 18 nt, Homo sapiens
cccuguaucuacuaaaaa

SEQ ID NO: 1815027 - RNA, 22 nt, Homo sapiens
aaaaagaagaacuauaugugaa

SEQ ID NO: 1815028 - RNA, 11 nt, Homo sapiens
guagcucuuug

SEQ ID NO: 1815029 - RNA, 16 nt, Homo sapiens
acaaaaauauauuaaa

SEQ ID NO: 1815030 - RNA, 18 nt, Homo sapiens
ucacuuccuuugcccuuc

SEQ ID NO: 1815031 - RNA, 15 nt, Homo sapiens
auucugugcauaaaa

SEQ ID NO: 1815032 - RNA, 20 nt, Homo sapiens
cuuaccuggcagcaaacugc

SEQ ID NO: 1815033 - RNA, 12 nt, Homo sapiens
ugauuguggcau

SEQ ID NO: 1815034 - RNA, 19 nt, Homo sapiens
uguagacaggaaagccagg

SEQ ID NO: 1815035 - RNA, 16 nt, Homo sapiens
gggcauggcuugcccc

SEQ ID NO: 1815036 - RNA, 14 nt, Homo sapiens
cccauccuacucuc

SEQ ID NO: 1815037 - RNA, 17 nt, Homo sapiens
aaguagccgcucugguu

SEQ ID NO: 1815038 - RNA, 17 nt, Homo sapiens
augaccaaggacugcua

SEQ ID NO: 1815039 - RNA, 16 nt, Homo sapiens
augacugccuugccuc

SEQ ID NO: 1815040 - RNA, 10 nt, Homo sapiens
ccugcuggag

SEQ ID NO: 1815041 - RNA, 19 nt, Homo sapiens
uagaaauguaaacugccau

SEQ ID NO: 1815042 - RNA, 18 nt, Homo sapiens
uuuugcacacuuugccau

SEQ ID NO: 1815043 - RNA, 17 nt, Homo sapiens
cauggagccagugccug

SEQ ID NO: 1815044 - RNA, 16 nt, Homo sapiens
gagaaaauauuacuua

SEQ ID NO: 1815045 - RNA, 19 nt, Homo sapiens
aagaaacacauaaacacca

SEQ ID NO: 1815046 - RNA, 13 nt, Homo sapiens
uguuuuuccaaaa

SEQ ID NO: 1815047 - RNA, 15 nt, Homo sapiens
caccccuacacacac

SEQ ID NO: 1815048 - RNA, 13 nt, Homo sapiens
agagaaguuugaa

SEQ ID NO: 1815049 - RNA, 17 nt, Homo sapiens
uauuuccccagccacag

SEQ ID NO: 1815050 - RNA, 16 nt, Homo sapiens
ucccauggaugaguaa

SEQ ID NO: 1815051 - RNA, 14 nt, Homo sapiens
gaggcuugugugaa

SEQ ID NO: 1815052 - RNA, 17 nt, Homo sapiens
guuauuauuuugcacug

SEQ ID NO: 1815053 - RNA, 12 nt, Homo sapiens
cccacuucaggg

SEQ ID NO: 1815054 - RNA, 19 nt, Homo sapiens
cccaucgucucggccuuca

SEQ ID NO: 1815055 - RNA, 15 nt, Homo sapiens
aauaaacccuuccug

SEQ ID NO: 1815056 - RNA, 19 nt, Homo sapiens
acaaaggacagaguaugaa

SEQ ID NO: 1815057 - RNA, 13 nt, Homo sapiens
auaaaagcaauaa

SEQ ID NO: 1815058 - RNA, 13 nt, Homo sapiens
aaauaagcauuua

SEQ ID NO: 1815059 - RNA, 13 nt, Homo sapiens
guuccccacaggu

SEQ ID NO: 1815060 - RNA, 19 nt, Homo sapiens
gaauucuuuuucauuugag

SEQ ID NO: 1815061 - RNA, 16 nt, Homo sapiens
agcaacaagacugcca

SEQ ID NO: 1815062 - RNA, 17 nt, Homo sapiens
gcuacuuaacaaaguaa

SEQ ID NO: 1815063 - RNA, 19 nt, Homo sapiens
cgggacccccucaccaucc

SEQ ID NO: 1815064 - RNA, 23 nt, Homo sapiens
cacuuuccacuggaguucacuuu

SEQ ID NO: 1815065 - RNA, 22 nt, Homo sapiens
aacccggccugauuaaaguuaa

SEQ ID NO: 1815066 - RNA, 19 nt, Homo sapiens
aaaaucauccuauuacuua

SEQ ID NO: 1815067 - RNA, 21 nt, Homo sapiens
gaaaagaaagugaaaguuuua

SEQ ID NO: 1815068 - RNA, 21 nt, Homo sapiens
uggcuuaugaugagccauauu

SEQ ID NO: 1815069 - RNA, 17 nt, Homo sapiens
aauaaagcauuuugcaa

SEQ ID NO: 1815070 - RNA, 16 nt, Homo sapiens
aucugcugccaugaga

SEQ ID NO: 1815071 - RNA, 17 nt, Homo sapiens
acccagaggcagcagag

SEQ ID NO: 1815072 - RNA, 14 nt, Homo sapiens
cuaugcugcuucca

SEQ ID NO: 1815073 - RNA, 16 nt, Homo sapiens
cuggagaugaugauga

SEQ ID NO: 1815074 - RNA, 11 nt, Homo sapiens
ugucuaccugg

SEQ ID NO: 1815075 - RNA, 20 nt, Homo sapiens
uuucagcuggagauacugau

SEQ ID NO: 1815076 - RNA, 14 nt, Homo sapiens
aguuacuucuugua

SEQ ID NO: 1815077 - RNA, 21 nt, Homo sapiens
uccccagggcccuuguacaac

SEQ ID NO: 1815078 - RNA, 15 nt, Homo sapiens
gaugaugacguccuc

SEQ ID NO: 1815079 - RNA, 17 nt, Homo sapiens
uuucuguucgaaguuca

SEQ ID NO: 1815080 - RNA, 16 nt, Homo sapiens
gccagccagugccauu

SEQ ID NO: 1815081 - RNA, 13 nt, Homo sapiens
ggcuucugaugaa

SEQ ID NO: 1815082 - RNA, 14 nt, Homo sapiens
acuucaaauguggu

SEQ ID NO: 1815083 - RNA, 22 nt, Homo sapiens
ccucaggcagguaaccccagau

SEQ ID NO: 1815084 - RNA, 13 nt, Homo sapiens
uuauauacaaugc

SEQ ID NO: 1815085 - RNA, 23 nt, Homo sapiens
ucaacauaugcaaaauacuguac

SEQ ID NO: 1815086 - RNA, 12 nt, Homo sapiens
uuccccacuccu

SEQ ID NO: 1815087 - RNA, 15 nt, Homo sapiens
acaacauccacuguu

SEQ ID NO: 1815088 - RNA, 15 nt, Homo sapiens
uucugugugaacuga

SEQ ID NO: 1815089 - RNA, 21 nt, Homo sapiens
caucaaagcucacaccaaauu

SEQ ID NO: 1815090 - RNA, 21 nt, Homo sapiens
ggcaucuggcccgcacguguc

SEQ ID NO: 1815091 - RNA, 17 nt, Homo sapiens
ccauauggaaugccaaa

SEQ ID NO: 1815092 - RNA, 20 nt, Homo sapiens
ucaagauaaaucaaaguaau

SEQ ID NO: 1815093 - RNA, 20 nt, Homo sapiens
uaguaaugcuacgugugauu

SEQ ID NO: 1815094 - RNA, 17 nt, Homo sapiens
uaaggacggacucacuu

SEQ ID NO: 1815095 - RNA, 17 nt, Homo sapiens
uucucuggguagguguu

SEQ ID NO: 1815096 - RNA, 12 nt, Homo sapiens
acuggagcugca

SEQ ID NO: 1815097 - RNA, 19 nt, Homo sapiens
auuuuaagaauuucacaag

SEQ ID NO: 1815098 - RNA, 19 nt, Homo sapiens
gaggcgggggauccuggag

SEQ ID NO: 1815099 - RNA, 13 nt, Homo sapiens
caggcacacugag

SEQ ID NO: 1815100 - RNA, 18 nt, Homo sapiens
uaaauauuuauguagaug

SEQ ID NO: 1815101 - RNA, 21 nt, Homo sapiens
agccugggcgacagagcaaga

SEQ ID NO: 1815102 - RNA, 14 nt, Homo sapiens
gcaaguuagaacua

SEQ ID NO: 1815103 - RNA, 13 nt, Homo sapiens
caaacacaagcaa

SEQ ID NO: 1815104 - RNA, 18 nt, Homo sapiens
aagucacacccacucccu

SEQ ID NO: 1815105 - RNA, 23 nt, Homo sapiens
caagcugacucgacaccguguca

SEQ ID NO: 1815106 - RNA, 18 nt, Homo sapiens
ccaugugucauguaauac

SEQ ID NO: 1815107 - RNA, 13 nt, Homo sapiens
gaccccacucccc

SEQ ID NO: 1815108 - RNA, 23 nt, Homo sapiens
cuguggugugucccccucugucc

SEQ ID NO: 1815109 - RNA, 17 nt, Homo sapiens
auccaaugcacugaugu

SEQ ID NO: 1815110 - RNA, 12 nt, Homo sapiens
aacuacaucuug

SEQ ID NO: 1815111 - RNA, 18 nt, Homo sapiens
gcuugauagaaaugccaa

SEQ ID NO: 1815112 - RNA, 15 nt, Homo sapiens
cucauauguggaauc

SEQ ID NO: 1815113 - RNA, 13 nt, Homo sapiens
uugagcugaccca

SEQ ID NO: 1815114 - RNA, 14 nt, Homo sapiens
ugggccauccucac

SEQ ID NO: 1815115 - RNA, 19 nt, Homo sapiens
caguggagaagacauucug

SEQ ID NO: 1815116 - RNA, 15 nt, Homo sapiens
agagcuuuaucccua

SEQ ID NO: 1815117 - RNA, 14 nt, Homo sapiens
caccuugaccaaaa

SEQ ID NO: 1815118 - RNA, 13 nt, Homo sapiens
uuguacuuuucau

SEQ ID NO: 1815119 - RNA, 14 nt, Homo sapiens
uucagcaccaguua

SEQ ID NO: 1815120 - RNA, 18 nt, Homo sapiens
cugaagucuuuguacaga

SEQ ID NO: 1815121 - RNA, 16 nt, Homo sapiens
cugagcuuuccgggga

SEQ ID NO: 1815122 - RNA, 19 nt, Homo sapiens
cagacaucuggacacuggg

SEQ ID NO: 1815123 - RNA, 23 nt, Homo sapiens
cacagacacacaaaaugucacaa

SEQ ID NO: 1815124 - RNA, 21 nt, Homo sapiens
cauaguuugauaaaaagauca

SEQ ID NO: 1815125 - RNA, 19 nt, Homo sapiens
acaagguugguugcuaaga

SEQ ID NO: 1815126 - RNA, 16 nt, Homo sapiens
auguugcccacaccua

SEQ ID NO: 1815127 - RNA, 15 nt, Homo sapiens
ucuucagucucuaua

SEQ ID NO: 1815128 - RNA, 15 nt, Homo sapiens
agggccacgacaaag

SEQ ID NO: 1815129 - RNA, 14 nt, Homo sapiens
aggauaucuucucc

SEQ ID NO: 1815130 - RNA, 22 nt, Homo sapiens
cuccccauuggugcuaccuggc

SEQ ID NO: 1815131 - RNA, 14 nt, Homo sapiens
ggaacuaugcagug

SEQ ID NO: 1815132 - RNA, 16 nt, Homo sapiens
gagaucucccuucuca

SEQ ID NO: 1815133 - RNA, 23 nt, Homo sapiens
cauucuuguccuggcuggaccag

SEQ ID NO: 1815134 - RNA, 13 nt, Homo sapiens
agauuucaaauaa

SEQ ID NO: 1815135 - RNA, 14 nt, Homo sapiens
aaccucuaugcaau

SEQ ID NO: 1815136 - RNA, 13 nt, Homo sapiens
aagugugucuccu

SEQ ID NO: 1815137 - RNA, 14 nt, Homo sapiens
ucuucuaagcaaaa

SEQ ID NO: 1815138 - RNA, 18 nt, Homo sapiens
aguuuaagguacacuguu

SEQ ID NO: 1815139 - RNA, 18 nt, Homo sapiens
guauaaagugaucaguau

SEQ ID NO: 1815140 - RNA, 22 nt, Homo sapiens
cccaagaaugagcuuacaaagu

SEQ ID NO: 1815141 - RNA, 19 nt, Homo sapiens
uggguacugaaagccuuag

SEQ ID NO: 1815142 - RNA, 20 nt, Homo sapiens
auccucacccagcacccaca

SEQ ID NO: 1815143 - RNA, 17 nt, Homo sapiens
ggccagagucuguuuca

SEQ ID NO: 1815144 - RNA, 22 nt, Homo sapiens
aauaucuacagcuucuauucau

SEQ ID NO: 1815145 - RNA, 15 nt, Homo sapiens
ccacauuagugaauu

SEQ ID NO: 1815146 - RNA, 20 nt, Homo sapiens
cuacuguuccuuucagauga

SEQ ID NO: 1815147 - RNA, 16 nt, Homo sapiens
ugucccugcacuugca

SEQ ID NO: 1815148 - RNA, 16 nt, Homo sapiens
ucauuaccagugacua

SEQ ID NO: 1815149 - RNA, 14 nt, Homo sapiens
caaacaggcugaua

SEQ ID NO: 1815150 - RNA, 19 nt, Homo sapiens
uuuauauaacauuagauaa

SEQ ID NO: 1815151 - RNA, 16 nt, Homo sapiens
cacaguuacugacuua

SEQ ID NO: 1815152 - RNA, 20 nt, Homo sapiens
auuacuagaaauauuuaacu

SEQ ID NO: 1815153 - RNA, 16 nt, Homo sapiens
uccucaaaaugggaga

SEQ ID NO: 1815154 - RNA, 20 nt, Homo sapiens
aguguguugggaauugcaug

SEQ ID NO: 1815155 - RNA, 23 nt, Homo sapiens
uagcuuggguccaccaugcagaa

SEQ ID NO: 1815156 - RNA, 17 nt, Homo sapiens
uaaaauucagaugcugu

SEQ ID NO: 1815157 - RNA, 20 nt, Homo sapiens
cgcaaagggcugaaagccau

SEQ ID NO: 1815158 - RNA, 19 nt, Homo sapiens
gcuauuucaucugguuucu

SEQ ID NO: 1815159 - RNA, 16 nt, Homo sapiens
uagugacacacacugu

SEQ ID NO: 1815160 - RNA, 14 nt, Homo sapiens
uaaguuaugacugu

SEQ ID NO: 1815161 - RNA, 17 nt, Homo sapiens
cacaacauuuacuuaac

SEQ ID NO: 1815162 - RNA, 16 nt, Homo sapiens
cuacucuucagggucu

SEQ ID NO: 1815163 - RNA, 15 nt, Homo sapiens
cuuaaaaaugcacac

SEQ ID NO: 1815164 - RNA, 16 nt, Homo sapiens
aacaagcaaacccaga

SEQ ID NO: 1815165 - RNA, 16 nt, Homo sapiens
aaggaacucuacuuca

SEQ ID NO: 1815166 - RNA, 18 nt, Homo sapiens
gucccuccucagaccucc

SEQ ID NO: 1815167 - RNA, 17 nt, Homo sapiens
uaagggaaaaaugggaa

SEQ ID NO: 1815168 - RNA, 14 nt, Homo sapiens
gaccccuuacacaa

SEQ ID NO: 1815169 - RNA, 23 nt, Homo sapiens
gagcaguuucauugugaucacug

SEQ ID NO: 1815170 - RNA, 18 nt, Homo sapiens
gucaauaaaauccauaca

SEQ ID NO: 1815171 - RNA, 13 nt, Homo sapiens
ucacgcggcagcu

SEQ ID NO: 1815172 - RNA, 16 nt, Homo sapiens
auauuuacaaccuaga

SEQ ID NO: 1815173 - RNA, 12 nt, Homo sapiens
acuaaacucaac

SEQ ID NO: 1815174 - RNA, 14 nt, Homo sapiens
agauaauacauucc

SEQ ID NO: 1815175 - RNA, 23 nt, Homo sapiens
agcauuuaggagaauagcagaga

SEQ ID NO: 1815176 - RNA, 15 nt, Homo sapiens
ugaaggggaggucac

SEQ ID NO: 1815177 - RNA, 18 nt, Homo sapiens
agcauuagucacuuugaa

SEQ ID NO: 1815178 - RNA, 13 nt, Homo sapiens
uacauuuccaaau

SEQ ID NO: 1815179 - RNA, 21 nt, Homo sapiens
agcacuguauuccugucauug

SEQ ID NO: 1815180 - RNA, 18 nt, Homo sapiens
ugcagggauauugccuua

SEQ ID NO: 1815181 - RNA, 18 nt, Homo sapiens
gugggcccagggccuagg

SEQ ID NO: 1815182 - RNA, 20 nt, Homo sapiens
gaaaacaauggggcugguuu

SEQ ID NO: 1815183 - RNA, 21 nt, Homo sapiens
auaagacauuuguuaggccau

SEQ ID NO: 1815184 - RNA, 17 nt, Homo sapiens
guggucuccaccuguca

SEQ ID NO: 1815185 - RNA, 16 nt, Homo sapiens
cuucucuuuaaucuca

SEQ ID NO: 1815186 - RNA, 15 nt, Homo sapiens
uaauggcaucaauau

SEQ ID NO: 1815187 - RNA, 13 nt, Homo sapiens
cuaaaacaucuca

SEQ ID NO: 1815188 - RNA, 20 nt, Homo sapiens
ccccucgugaccuacaggga

SEQ ID NO: 1815189 - RNA, 16 nt, Homo sapiens
ucguaucucuagaaag

SEQ ID NO: 1815190 - RNA, 15 nt, Homo sapiens
ccugagaagagucga

SEQ ID NO: 1815191 - RNA, 15 nt, Homo sapiens
ccucugguucuucau

SEQ ID NO: 1815192 - RNA, 17 nt, Homo sapiens
aauaccagugaaccaaa

SEQ ID NO: 1815193 - RNA, 15 nt, Homo sapiens
gugcucuccuacccc

SEQ ID NO: 1815194 - RNA, 14 nt, Homo sapiens
acaccauuuuggca

SEQ ID NO: 1815195 - RNA, 16 nt, Homo sapiens
cuugauaaaugccuca

SEQ ID NO: 1815196 - RNA, 18 nt, Homo sapiens
cuaaggaguaacuugcaa

SEQ ID NO: 1815197 - RNA, 21 nt, Homo sapiens
caaaggcccccaucacacucg

SEQ ID NO: 1815198 - RNA, 15 nt, Homo sapiens
ugccuaguaacacau

SEQ ID NO: 1815199 - RNA, 14 nt, Homo sapiens
ugugcaacagguaa

SEQ ID NO: 1815200 - RNA, 14 nt, Homo sapiens
caaaacuaguucaa

SEQ ID NO: 1815201 - RNA, 13 nt, Homo sapiens
agauaaagaccuu

SEQ ID NO: 1815202 - RNA, 16 nt, Homo sapiens
agaguacaguguaaca

SEQ ID NO: 1815203 - RNA, 15 nt, Homo sapiens
caugaugucaacuca

SEQ ID NO: 1815204 - RNA, 21 nt, Homo sapiens
ucggcauuuaacuuacauuug

SEQ ID NO: 1815205 - RNA, 21 nt, Homo sapiens
cuuguuuuuuauccugccuca

SEQ ID NO: 1815206 - RNA, 20 nt, Homo sapiens
aggcuggucuugaacucuug

SEQ ID NO: 1815207 - RNA, 17 nt, Homo sapiens
uuuacugcgaauaagcu

SEQ ID NO: 1815208 - RNA, 13 nt, Homo sapiens
ggggcaucccaga

SEQ ID NO: 1815209 - RNA, 12 nt, Homo sapiens
aagauacaugau

SEQ ID NO: 1815210 - RNA, 15 nt, Homo sapiens
aguauacaagauaag

SEQ ID NO: 1815211 - RNA, 15 nt, Homo sapiens
ugcacacauauacau

SEQ ID NO: 1815212 - RNA, 16 nt, Homo sapiens
aacccuucacacccca

SEQ ID NO: 1815213 - RNA, 20 nt, Homo sapiens
ucuggaagcauccugugcug

SEQ ID NO: 1815214 - RNA, 20 nt, Homo sapiens
auggaauauacauguaaaaa

SEQ ID NO: 1815215 - RNA, 15 nt, Homo sapiens
uggaacuucuaauau

SEQ ID NO: 1815216 - RNA, 19 nt, Homo sapiens
auguugacuggccaaaaau

SEQ ID NO: 1815217 - RNA, 20 nt, Homo sapiens
ugacagcggaaagcccugug

SEQ ID NO: 1815218 - RNA, 18 nt, Homo sapiens
caugccaguaacugugcu

SEQ ID NO: 1815219 - RNA, 17 nt, Homo sapiens
cagaauucuaggcagca

SEQ ID NO: 1815220 - RNA, 22 nt, Homo sapiens
gaagccucuaacaaaugaucua

SEQ ID NO: 1815221 - RNA, 22 nt, Homo sapiens
auuacauaaucuguacaaugaa

SEQ ID NO: 1815222 - RNA, 17 nt, Homo sapiens
uaccaaaucugacauau

SEQ ID NO: 1815223 - RNA, 17 nt, Homo sapiens
cucaggacccagggaau

SEQ ID NO: 1815224 - RNA, 12 nt, Homo sapiens
auguaugugcac

SEQ ID NO: 1815225 - RNA, 23 nt, Homo sapiens
aggaugguggacuacaaaauaca

SEQ ID NO: 1815226 - RNA, 15 nt, Homo sapiens
gccuuugccagguga

SEQ ID NO: 1815227 - RNA, 19 nt, Homo sapiens
auucuguuagcugcucacu

SEQ ID NO: 1815228 - RNA, 13 nt, Homo sapiens
uaaauaguucuuc

SEQ ID NO: 1815229 - RNA, 22 nt, Homo sapiens
uuuaaugguuaagaacugugaa

SEQ ID NO: 1815230 - RNA, 13 nt, Homo sapiens
gcuucagugaaau

SEQ ID NO: 1815231 - RNA, 22 nt, Homo sapiens
auuuugugaauuugggacauaa

SEQ ID NO: 1815232 - RNA, 18 nt, Homo sapiens
acccgguguaugccaagu

SEQ ID NO: 1815233 - RNA, 21 nt, Homo sapiens
cugcuuugccaaauaaaguua

SEQ ID NO: 1815234 - RNA, 21 nt, Homo sapiens
aagccuguccucaccgucucg

SEQ ID NO: 1815235 - RNA, 19 nt, Homo sapiens
cgguccuguguuccuguga

SEQ ID NO: 1815236 - RNA, 22 nt, Homo sapiens
cuuccucucaagcuagccagag

SEQ ID NO: 1815237 - RNA, 22 nt, Homo sapiens
ccagugcugcucuaagcaccgu

SEQ ID NO: 1815238 - RNA, 14 nt, Homo sapiens
acaagaaccugcua

SEQ ID NO: 1815239 - RNA, 13 nt, Homo sapiens
aaaaugcaugaua

SEQ ID NO: 1815240 - RNA, 21 nt, Homo sapiens
ggcuucagucuuuuccaugaa

SEQ ID NO: 1815241 - RNA, 14 nt, Homo sapiens
uguugagaugauau

SEQ ID NO: 1815242 - RNA, 17 nt, Homo sapiens
aaccuuuagaauaucuu

SEQ ID NO: 1815243 - RNA, 11 nt, Homo sapiens
aagcuacauau

SEQ ID NO: 1815244 - RNA, 12 nt, Homo sapiens
ucgaacuggggg

SEQ ID NO: 1815245 - RNA, 14 nt, Homo sapiens
aaacuguguugcca

SEQ ID NO: 1815246 - RNA, 17 nt, Homo sapiens
cucccugggcagugcuc

SEQ ID NO: 1815247 - RNA, 14 nt, Homo sapiens
uguauguguggcug

SEQ ID NO: 1815248 - RNA, 21 nt, Homo sapiens
gcugaggcuggcacaggacau

SEQ ID NO: 1815249 - RNA, 21 nt, Homo sapiens
uucagaacucguuaaagcaaa

SEQ ID NO: 1815250 - RNA, 15 nt, Homo sapiens
gcuguaaauacaugu

SEQ ID NO: 1815251 - RNA, 17 nt, Homo sapiens
uuccugagauucuggga

SEQ ID NO: 1815252 - RNA, 17 nt, Homo sapiens
gcacuuugagauguguu

SEQ ID NO: 1815253 - RNA, 23 nt, Homo sapiens
cccauaacaaccugggcauuccu

SEQ ID NO: 1815254 - RNA, 18 nt, Homo sapiens
ugccccaggccugaaaga

SEQ ID NO: 1815255 - RNA, 13 nt, Homo sapiens
ggccuccaccucu

SEQ ID NO: 1815256 - RNA, 14 nt, Homo sapiens
ucacucaaccuuau

SEQ ID NO: 1815257 - RNA, 19 nt, Homo sapiens
ucucugagcagugaaugau

SEQ ID NO: 1815258 - RNA, 20 nt, Homo sapiens
gucuuuuccccucauugcau

SEQ ID NO: 1815259 - RNA, 16 nt, Homo sapiens
gcccaaaccaccagaa

SEQ ID NO: 1815260 - RNA, 18 nt, Homo sapiens
ccugcacucacaggcuac

SEQ ID NO: 1815261 - RNA, 22 nt, Homo sapiens
gggacacggccucuggggagac

SEQ ID NO: 1815262 - RNA, 17 nt, Homo sapiens
gccucacucaccaucug

SEQ ID NO: 1815263 - RNA, 19 nt, Homo sapiens
uccaagggaucugcuugau

SEQ ID NO: 1815264 - RNA, 18 nt, Homo sapiens
cauuguggucauagcacc

SEQ ID NO: 1815265 - RNA, 16 nt, Homo sapiens
uuaagaguauuuucug

SEQ ID NO: 1815266 - RNA, 14 nt, Homo sapiens
guccuucuugucca

SEQ ID NO: 1815267 - RNA, 22 nt, Homo sapiens
gcccuaggcuccgucaguauca

SEQ ID NO: 1815268 - RNA, 14 nt, Homo sapiens
auuucacuucagga

SEQ ID NO: 1815269 - RNA, 17 nt, Homo sapiens
aguucagugcucauacg

SEQ ID NO: 1815270 - RNA, 21 nt, Homo sapiens
ucauuaacaacucauucugau

SEQ ID NO: 1815271 - RNA, 21 nt, Homo sapiens
ugugugauuaaaugacacauu

SEQ ID NO: 1815272 - RNA, 16 nt, Homo sapiens
accugguuaccacagu

SEQ ID NO: 1815273 - RNA, 18 nt, Homo sapiens
ggugaacaaaguuuacca

SEQ ID NO: 1815274 - RNA, 19 nt, Homo sapiens
ggacaugcuucagugcugc

SEQ ID NO: 1815275 - RNA, 23 nt, Homo sapiens
ucuuugaaaacaaaggugccaug

SEQ ID NO: 1815276 - RNA, 18 nt, Homo sapiens
accgagcacauaccaugu

SEQ ID NO: 1815277 - RNA, 14 nt, Homo sapiens
ugaggugggcugaa

SEQ ID NO: 1815278 - RNA, 22 nt, Homo sapiens
uguaugaaaauuccugugauuu

SEQ ID NO: 1815279 - RNA, 20 nt, Homo sapiens
aucaucaggaagccuguggu

SEQ ID NO: 1815280 - RNA, 16 nt, Homo sapiens
uuugccaccuuuccug

SEQ ID NO: 1815281 - RNA, 16 nt, Homo sapiens
augugaccauucugcc

SEQ ID NO: 1815282 - RNA, 16 nt, Homo sapiens
gcuggccacugcugga

SEQ ID NO: 1815283 - RNA, 19 nt, Homo sapiens
gagcuccugcugcggagga

SEQ ID NO: 1815284 - RNA, 17 nt, Homo sapiens
uaugugucaguggggcu

SEQ ID NO: 1815285 - RNA, 16 nt, Homo sapiens
auggagucuugcucug

SEQ ID NO: 1815286 - RNA, 17 nt, Homo sapiens
gaugcuuuuagcucaaa

SEQ ID NO: 1815287 - RNA, 14 nt, Homo sapiens
acaaaaagacaugg

SEQ ID NO: 1815288 - RNA, 15 nt, Homo sapiens
ugccuagacuguuac

SEQ ID NO: 1815289 - RNA, 21 nt, Homo sapiens
augacuuuuuuucugauucaa

SEQ ID NO: 1815290 - RNA, 20 nt, Homo sapiens
ucagucgguguguaaucacg

SEQ ID NO: 1815291 - RNA, 23 nt, Homo sapiens
gccccugaguucugacacugugu

SEQ ID NO: 1815292 - RNA, 14 nt, Homo sapiens
auagacauugcaaa

SEQ ID NO: 1815293 - RNA, 14 nt, Homo sapiens
gcuuugaaugcaga

SEQ ID NO: 1815294 - RNA, 14 nt, Homo sapiens
ugaagagagauaua

SEQ ID NO: 1815295 - RNA, 16 nt, Homo sapiens
caucucugagcaauug

SEQ ID NO: 1815296 - RNA, 13 nt, Homo sapiens
ucuggaagaccug

SEQ ID NO: 1815297 - RNA, 14 nt, Homo sapiens
agggagcccggggc

SEQ ID NO: 1815298 - RNA, 10 nt, Homo sapiens
cuuugcugca

SEQ ID NO: 1815299 - RNA, 19 nt, Homo sapiens
uaaguaguauugccuucca

SEQ ID NO: 1815300 - RNA, 16 nt, Homo sapiens
uccacucuugugguca

SEQ ID NO: 1815301 - RNA, 16 nt, Homo sapiens
ucugcuuaugcaguuu

SEQ ID NO: 1815302 - RNA, 20 nt, Homo sapiens
caauaucaugucuugugcau

SEQ ID NO: 1815303 - RNA, 15 nt, Homo sapiens
agguucuucugguga

SEQ ID NO: 1815304 - RNA, 19 nt, Homo sapiens
acacagauggucacacaga

SEQ ID NO: 1815305 - RNA, 20 nt, Homo sapiens
ccaugugugagugugugcaa

SEQ ID NO: 1815306 - RNA, 19 nt, Homo sapiens
aaaaaaagaaaagugugua

SEQ ID NO: 1815307 - RNA, 12 nt, Homo sapiens
ggcagcuccuca

SEQ ID NO: 1815308 - RNA, 21 nt, Homo sapiens
ucugacuacuuguuguaucug

SEQ ID NO: 1815309 - RNA, 22 nt, Homo sapiens
uauuauauuuggaugcagaguu

SEQ ID NO: 1815310 - RNA, 12 nt, Homo sapiens
aaggcucagacu

SEQ ID NO: 1815311 - RNA, 13 nt, Homo sapiens
cccuugcagcuag

SEQ ID NO: 1815312 - RNA, 22 nt, Homo sapiens
cuggagcaggcccaaugcugcu

SEQ ID NO: 1815313 - RNA, 17 nt, Homo sapiens
auuggaccauccuauuu

SEQ ID NO: 1815314 - RNA, 12 nt, Homo sapiens
augacugugcua

SEQ ID NO: 1815315 - RNA, 18 nt, Homo sapiens
auggcucugaacugcaca

SEQ ID NO: 1815316 - RNA, 20 nt, Homo sapiens
uccaauguaccguuuccuua

SEQ ID NO: 1815317 - RNA, 11 nt, Homo sapiens
aguuucccaaa

SEQ ID NO: 1815318 - RNA, 16 nt, Homo sapiens
aacggagagugcuugg

SEQ ID NO: 1815319 - RNA, 14 nt, Homo sapiens
aaccacagcacuau

SEQ ID NO: 1815320 - RNA, 13 nt, Homo sapiens
cagcuaaaaccua

SEQ ID NO: 1815321 - RNA, 14 nt, Homo sapiens
gaaaucacugugaa

SEQ ID NO: 1815322 - RNA, 13 nt, Homo sapiens
auacuccauauuc

SEQ ID NO: 1815323 - RNA, 21 nt, Homo sapiens
ugaaauuguguuugacauucu

SEQ ID NO: 1815324 - RNA, 21 nt, Homo sapiens
uaacuguggcuaauucacaua

SEQ ID NO: 1815325 - RNA, 14 nt, Homo sapiens
ccuaagaaaaggca

SEQ ID NO: 1815326 - RNA, 21 nt, Homo sapiens
gcccuaccccgccccaguauc

SEQ ID NO: 1815327 - RNA, 21 nt, Homo sapiens
cugugaaaugcuggcauuugc

SEQ ID NO: 1815328 - RNA, 11 nt, Homo sapiens
ccccaccagau

SEQ ID NO: 1815329 - RNA, 19 nt, Homo sapiens
agaccuuggcauccugugc

SEQ ID NO: 1815330 - RNA, 16 nt, Homo sapiens
ugucuaauaaagagau

SEQ ID NO: 1815331 - RNA, 13 nt, Homo sapiens
ugccuucacccau

SEQ ID NO: 1815332 - RNA, 22 nt, Homo sapiens
caauaugaggggacugcaugca

SEQ ID NO: 1815333 - RNA, 20 nt, Homo sapiens
cugaaaaaaacauauccaaa

SEQ ID NO: 1815334 - RNA, 13 nt, Homo sapiens
uuuccguuuccag

SEQ ID NO: 1815335 - RNA, 22 nt, Homo sapiens
gcuguaggugguaugugacacc

SEQ ID NO: 1815336 - RNA, 19 nt, Homo sapiens
cucugagucccagagccaa

SEQ ID NO: 1815337 - RNA, 23 nt, Homo sapiens
cauucuuuucagcuuguuucuau

SEQ ID NO: 1815338 - RNA, 19 nt, Homo sapiens
uggaauaucaucugucauu

SEQ ID NO: 1815339 - RNA, 15 nt, Homo sapiens
aggaauuccagcauc

SEQ ID NO: 1815340 - RNA, 13 nt, Homo sapiens
aacauugcacuuu

SEQ ID NO: 1815341 - RNA, 21 nt, Homo sapiens
aacucuccuggacugccuuga

SEQ ID NO: 1815342 - RNA, 20 nt, Homo sapiens
cuuuucuggggaaagacacu

SEQ ID NO: 1815343 - RNA, 21 nt, Homo sapiens
aggcagagggccuuugcuaca

SEQ ID NO: 1815344 - RNA, 20 nt, Homo sapiens
aucaaauaugcaaagcacug

SEQ ID NO: 1815345 - RNA, 20 nt, Homo sapiens
caauaauaaaguacuugacu

SEQ ID NO: 1815346 - RNA, 17 nt, Homo sapiens
cuggcaggaugcugagc

SEQ ID NO: 1815347 - RNA, 19 nt, Homo sapiens
cuuaggaagaaaucacuua

SEQ ID NO: 1815348 - RNA, 16 nt, Homo sapiens
acuaaaggaaucugaa

SEQ ID NO: 1815349 - RNA, 14 nt, Homo sapiens
agccagaugcuaga

SEQ ID NO: 1815350 - RNA, 16 nt, Homo sapiens
gcuucuauaaguguga

SEQ ID NO: 1815351 - RNA, 17 nt, Homo sapiens
auauacaauaacauaau

SEQ ID NO: 1815352 - RNA, 15 nt, Homo sapiens
auuuuuuugagacag

SEQ ID NO: 1815353 - RNA, 16 nt, Homo sapiens
uagucaccugccccag

SEQ ID NO: 1815354 - RNA, 17 nt, Homo sapiens
gugccuaguugacuuac

SEQ ID NO: 1815355 - RNA, 19 nt, Homo sapiens
uuacagguuacgugagaac

SEQ ID NO: 1815356 - RNA, 23 nt, Homo sapiens
agaagaggggucaagaguuaaac

SEQ ID NO: 1815357 - RNA, 16 nt, Homo sapiens
cuuccuauuucagaag

SEQ ID NO: 1815358 - RNA, 21 nt, Homo sapiens
uaacuacuuuuuauacuccau

SEQ ID NO: 1815359 - RNA, 14 nt, Homo sapiens
gguacacagacuau

SEQ ID NO: 1815360 - RNA, 18 nt, Homo sapiens
ggcugcgagagaaaggga

SEQ ID NO: 1815361 - RNA, 17 nt, Homo sapiens
acauugugagcucuggu

SEQ ID NO: 1815362 - RNA, 20 nt, Homo sapiens
ucauggaugggggaacucag

SEQ ID NO: 1815363 - RNA, 17 nt, Homo sapiens
gaugcagccgugcagga

SEQ ID NO: 1815364 - RNA, 18 nt, Homo sapiens
guuuacauaauacuugaa

SEQ ID NO: 1815365 - RNA, 12 nt, Homo sapiens
aaacuacuucuu

SEQ ID NO: 1815366 - RNA, 22 nt, Homo sapiens
aggccgagagcagacaccagca

SEQ ID NO: 1815367 - RNA, 22 nt, Homo sapiens
ggcacugcugggggugaggaca

SEQ ID NO: 1815368 - RNA, 14 nt, Homo sapiens
uauuuguaucacaa

SEQ ID NO: 1815369 - RNA, 19 nt, Homo sapiens
uugccugaggggaaagaga

SEQ ID NO: 1815370 - RNA, 12 nt, Homo sapiens
gaaauauauuca

SEQ ID NO: 1815371 - RNA, 19 nt, Homo sapiens
cuagagggagaagacugug

SEQ ID NO: 1815372 - RNA, 22 nt, Homo sapiens
cuggccuuuauaauuuuacuca

SEQ ID NO: 1815373 - RNA, 18 nt, Homo sapiens
uguaccauacacauugga

SEQ ID NO: 1815374 - RNA, 21 nt, Homo sapiens
aauuauuuauuacuugugcac

SEQ ID NO: 1815375 - RNA, 20 nt, Homo sapiens
aauaguuugagaaaugcaua

SEQ ID NO: 1815376 - RNA, 14 nt, Homo sapiens
ugcuaugacagagg

SEQ ID NO: 1815377 - RNA, 21 nt, Homo sapiens
aaaagauguugugucuugugu

SEQ ID NO: 1815378 - RNA, 18 nt, Homo sapiens
aguuaaaaucacauuuua

SEQ ID NO: 1815379 - RNA, 21 nt, Homo sapiens
ucucccagugacaacaucgca

SEQ ID NO: 1815380 - RNA, 19 nt, Homo sapiens
cgaggacauuugugggcaa

SEQ ID NO: 1815381 - RNA, 13 nt, Homo sapiens
ccuacgugccacu

SEQ ID NO: 1815382 - RNA, 17 nt, Homo sapiens
gaaucaacauuucucaa

SEQ ID NO: 1815383 - RNA, 15 nt, Homo sapiens
caacaaggugcacag

SEQ ID NO: 1815384 - RNA, 21 nt, Homo sapiens
aaguagcaugaucaguguaug

SEQ ID NO: 1815385 - RNA, 15 nt, Homo sapiens
ccucuugcuauauaa

SEQ ID NO: 1815386 - RNA, 18 nt, Homo sapiens
auguggugggagcacagc

SEQ ID NO: 1815387 - RNA, 18 nt, Homo sapiens
aaaugccugucucuagcu

SEQ ID NO: 1815388 - RNA, 17 nt, Homo sapiens
aaucagauuagccugua

SEQ ID NO: 1815389 - RNA, 11 nt, Homo sapiens
gaaauugcaau

SEQ ID NO: 1815390 - RNA, 18 nt, Homo sapiens
ucucagaauaacuaccuc

SEQ ID NO: 1815391 - RNA, 18 nt, Homo sapiens
gcauuucugaaguggacu

SEQ ID NO: 1815392 - RNA, 17 nt, Homo sapiens
gaacauccuccacugac

SEQ ID NO: 1815393 - RNA, 15 nt, Homo sapiens
ccgccagaguguccu

SEQ ID NO: 1815394 - RNA, 16 nt, Homo sapiens
uuucagaaagccuuuc

SEQ ID NO: 1815395 - RNA, 15 nt, Homo sapiens
uaguauaauaugcag

SEQ ID NO: 1815396 - RNA, 20 nt, Homo sapiens
aauccucaacacuauuguaa

SEQ ID NO: 1815397 - RNA, 22 nt, Homo sapiens
aucugccuuaaaaaaacacgga

SEQ ID NO: 1815398 - RNA, 16 nt, Homo sapiens
caauccagcuauguua

SEQ ID NO: 1815399 - RNA, 23 nt, Homo sapiens
auggugcaccgagugauuuccau

SEQ ID NO: 1815400 - RNA, 13 nt, Homo sapiens
caagaaaagaguu

SEQ ID NO: 1815401 - RNA, 17 nt, Homo sapiens
gcugggggcgcagagga

SEQ ID NO: 1815402 - RNA, 15 nt, Homo sapiens
cuugcuuauguguag

SEQ ID NO: 1815403 - RNA, 21 nt, Homo sapiens
acaggcccuuccucuccacug

SEQ ID NO: 1815404 - RNA, 21 nt, Homo sapiens
uauguauuuuugucauaugua

SEQ ID NO: 1815405 - RNA, 21 nt, Homo sapiens
gaaaggaccaguaugcuugga

SEQ ID NO: 1815406 - RNA, 13 nt, Homo sapiens
uuguuaugccaug

SEQ ID NO: 1815407 - RNA, 18 nt, Homo sapiens
uguauucuucaaccucau

SEQ ID NO: 1815408 - RNA, 16 nt, Homo sapiens
uaaauuguaccaucau

SEQ ID NO: 1815409 - RNA, 20 nt, Homo sapiens
gccauuugacuaauaauacu

SEQ ID NO: 1815410 - RNA, 16 nt, Homo sapiens
aagguugccagguaaa

SEQ ID NO: 1815411 - RNA, 18 nt, Homo sapiens
ucaugucaguuccaauga

SEQ ID NO: 1815412 - RNA, 13 nt, Homo sapiens
cccuccugugacu

SEQ ID NO: 1815413 - RNA, 13 nt, Homo sapiens
auguuaugugcuc

SEQ ID NO: 1815414 - RNA, 21 nt, Homo sapiens
uuccgcgcccagcgcucgcca

SEQ ID NO: 1815415 - RNA, 12 nt, Homo sapiens
cuguugcugaaa

SEQ ID NO: 1815416 - RNA, 17 nt, Homo sapiens
gaguuccggaaagccuu

SEQ ID NO: 1815417 - RNA, 21 nt, Homo sapiens
auuuccugacagaaggacuca

SEQ ID NO: 1815418 - RNA, 21 nt, Homo sapiens
acacagcugcagagacagaga

SEQ ID NO: 1815419 - RNA, 23 nt, Homo sapiens
gaauaaaaaaugggaacauacag

SEQ ID NO: 1815420 - RNA, 15 nt, Homo sapiens
uuuaguaaguguucu

SEQ ID NO: 1815421 - RNA, 22 nt, Homo sapiens
uaaaauuuaaccuacuagacaa

SEQ ID NO: 1815422 - RNA, 23 nt, Homo sapiens
ccauucagaugaauagauggaau

SEQ ID NO: 1815423 - RNA, 15 nt, Homo sapiens
uggccagguaugcau

SEQ ID NO: 1815424 - RNA, 10 nt, Homo sapiens
acuugcugag

SEQ ID NO: 1815425 - RNA, 15 nt, Homo sapiens
aucaucacccagcac

SEQ ID NO: 1815426 - RNA, 21 nt, Homo sapiens
aaugguuucaaguuauucaaa

SEQ ID NO: 1815427 - RNA, 14 nt, Homo sapiens
ccuggccuacccag

SEQ ID NO: 1815428 - RNA, 19 nt, Homo sapiens
ggcugccgcccugcuccac

SEQ ID NO: 1815429 - RNA, 21 nt, Homo sapiens
ucaucagacuaguaucaagug

SEQ ID NO: 1815430 - RNA, 16 nt, Homo sapiens
ugcaucugucuguccu

SEQ ID NO: 1815431 - RNA, 21 nt, Homo sapiens
cucucagucucugagcaguga

SEQ ID NO: 1815432 - RNA, 16 nt, Homo sapiens
ugcacaaggaaauaaa

SEQ ID NO: 1815433 - RNA, 13 nt, Homo sapiens
cucaaaucagucu

SEQ ID NO: 1815434 - RNA, 14 nt, Homo sapiens
gauacuacaugcuu

SEQ ID NO: 1815435 - RNA, 17 nt, Homo sapiens
ccacgcccuggggagug

SEQ ID NO: 1815436 - RNA, 15 nt, Homo sapiens
cugcucaaaaugcca

SEQ ID NO: 1815437 - RNA, 16 nt, Homo sapiens
aaauguuuugcucaau

SEQ ID NO: 1815438 - RNA, 13 nt, Homo sapiens
cuggcaauggaug

SEQ ID NO: 1815439 - RNA, 23 nt, Homo sapiens
ucuccuuuugcgcuuauuuggaa

SEQ ID NO: 1815440 - RNA, 15 nt, Homo sapiens
ucacugcuguuauau

SEQ ID NO: 1815441 - RNA, 23 nt, Homo sapiens
agauguuuguuuucaaaauacuu

SEQ ID NO: 1815442 - RNA, 18 nt, Homo sapiens
gagacagggcugcucccc

SEQ ID NO: 1815443 - RNA, 15 nt, Homo sapiens
ucugacuuacuguca

SEQ ID NO: 1815444 - RNA, 15 nt, Homo sapiens
augcucuuuugcaca

SEQ ID NO: 1815445 - RNA, 18 nt, Homo sapiens
acucugcacaugucuugu

SEQ ID NO: 1815446 - RNA, 12 nt, Homo sapiens
cacaaauuccac

SEQ ID NO: 1815447 - RNA, 19 nt, Homo sapiens
cucuuuggcaguugcauua

SEQ ID NO: 1815448 - RNA, 21 nt, Homo sapiens
gcaguaacuccccaacucccu

SEQ ID NO: 1815449 - RNA, 13 nt, Homo sapiens
acgaaagcacagu

SEQ ID NO: 1815450 - RNA, 17 nt, Homo sapiens
gugacuugauugccaag

SEQ ID NO: 1815451 - RNA, 19 nt, Homo sapiens
uaauuaggguccacgccca

SEQ ID NO: 1815452 - RNA, 14 nt, Homo sapiens
uaaagacagcugac

SEQ ID NO: 1815453 - RNA, 14 nt, Homo sapiens
aauuauuauauuga

SEQ ID NO: 1815454 - RNA, 16 nt, Homo sapiens
uuuggaggaaagucaa

SEQ ID NO: 1815455 - RNA, 23 nt, Homo sapiens
uugauagaaaugccaagcacuuc

SEQ ID NO: 1815456 - RNA, 21 nt, Homo sapiens
cgcaaguccccagccccucaa

SEQ ID NO: 1815457 - RNA, 15 nt, Homo sapiens
acguggguugcacug

SEQ ID NO: 1815458 - RNA, 14 nt, Homo sapiens
gguggcaugugccu

SEQ ID NO: 1815459 - RNA, 19 nt, Homo sapiens
acuucucugaaauauuuag

SEQ ID NO: 1815460 - RNA, 17 nt, Homo sapiens
uaaauaagaucagacuc

SEQ ID NO: 1815461 - RNA, 19 nt, Homo sapiens
aacggagagcgccugcccc

SEQ ID NO: 1815462 - RNA, 19 nt, Homo sapiens
gagccagaaagggugccag

SEQ ID NO: 1815463 - RNA, 15 nt, Homo sapiens
cucagcaaguguaca

SEQ ID NO: 1815464 - RNA, 22 nt, Homo sapiens
agugcugucgggaccacaucug

SEQ ID NO: 1815465 - RNA, 16 nt, Homo sapiens
ugaccuugacuacuca

SEQ ID NO: 1815466 - RNA, 21 nt, Homo sapiens
gcucucugugucugagagcaa

SEQ ID NO: 1815467 - RNA, 13 nt, Homo sapiens
aucagaauaucag

SEQ ID NO: 1815468 - RNA, 13 nt, Homo sapiens
ucucaaauucuca

SEQ ID NO: 1815469 - RNA, 13 nt, Homo sapiens
ggauuaauggauu

SEQ ID NO: 1815470 - RNA, 13 nt, Homo sapiens
gucauaaugucau

SEQ ID NO: 1815471 - RNA, 14 nt, Homo sapiens
ugugucacacugag

SEQ ID NO: 1815472 - RNA, 16 nt, Homo sapiens
augauacacaccuuuc

SEQ ID NO: 1815473 - RNA, 24 nt, Homo sapiens
ccagcacugcaccccaggcagcca

SEQ ID NO: 1815474 - RNA, 14 nt, Homo sapiens
cacaugaacauaug

SEQ ID NO: 1815475 - RNA, 14 nt, Homo sapiens
uuuuuaauucauuc

SEQ ID NO: 1815476 - RNA, 14 nt, Homo sapiens
ucuagugacuuccu

SEQ ID NO: 1815477 - RNA, 14 nt, Homo sapiens
gauuuuaugcugcu

SEQ ID NO: 1815478 - RNA, 19 nt, Homo sapiens
uggggcaggcugggccaug

SEQ ID NO: 1815479 - RNA, 20 nt, Homo sapiens
uuacaauucccucuacugug

SEQ ID NO: 1815480 - RNA, 12 nt, Homo sapiens
ugcaccaaagau

SEQ ID NO: 1815481 - RNA, 19 nt, Homo sapiens
ucacucuaagucauguaug

SEQ ID NO: 1815482 - RNA, 22 nt, Homo sapiens
gucagcuaaagaaguuugaaca

SEQ ID NO: 1815483 - RNA, 20 nt, Homo sapiens
aggcugggcagccccagaga

SEQ ID NO: 1815484 - RNA, 17 nt, Homo sapiens
cuuccgauggaugaauc

SEQ ID NO: 1815485 - RNA, 19 nt, Homo sapiens
ccgcgugucucauuugcca

SEQ ID NO: 1815486 - RNA, 12 nt, Homo sapiens
cuaacuccaugu

SEQ ID NO: 1815487 - RNA, 15 nt, Homo sapiens
gcagaaggaaaugau

SEQ ID NO: 1815488 - RNA, 14 nt, Homo sapiens
guacaaaagggaca

SEQ ID NO: 1815489 - RNA, 21 nt, Homo sapiens
uagccuguggccuuugcaauu

SEQ ID NO: 1815490 - RNA, 21 nt, Homo sapiens
aacaguacuuggguuugcaac

SEQ ID NO: 1815491 - RNA, 16 nt, Homo sapiens
gguuaaaacaaaaaca

SEQ ID NO: 1815492 - RNA, 11 nt, Homo sapiens
guccuuuaugu

SEQ ID NO: 1815493 - RNA, 15 nt, Homo sapiens
accuucagagccagc

SEQ ID NO: 1815494 - RNA, 13 nt, Homo sapiens
ccauagaaacuga

SEQ ID NO: 1815495 - RNA, 19 nt, Homo sapiens
aggcaucgcaauguaagac

SEQ ID NO: 1815496 - RNA, 17 nt, Homo sapiens
aguggucccagaaccua

SEQ ID NO: 1815497 - RNA, 16 nt, Homo sapiens
uacuuacaugcauuac

SEQ ID NO: 1815498 - RNA, 21 nt, Homo sapiens
gaaccagggccagauaaggaa

SEQ ID NO: 1815499 - RNA, 18 nt, Homo sapiens
aauucuuaccucauuugc

SEQ ID NO: 1815500 - RNA, 18 nt, Homo sapiens
aagucccagagcaccuca

SEQ ID NO: 1815501 - RNA, 13 nt, Homo sapiens
auauuaguauuaa

SEQ ID NO: 1815502 - RNA, 15 nt, Homo sapiens
aguuuguccuacaau

SEQ ID NO: 1815503 - RNA, 13 nt, Homo sapiens
ucuacuuccucug

SEQ ID NO: 1815504 - RNA, 21 nt, Homo sapiens
acuucaauugcuuugcacuuu

SEQ ID NO: 1815505 - RNA, 18 nt, Homo sapiens
uggacacugugcuacuga

SEQ ID NO: 1815506 - RNA, 16 nt, Homo sapiens
cugagcugcuucacua

SEQ ID NO: 1815507 - RNA, 12 nt, Homo sapiens
cggacucagugg

SEQ ID NO: 1815508 - RNA, 15 nt, Homo sapiens
cuuggccuuacugua

SEQ ID NO: 1815509 - RNA, 15 nt, Homo sapiens
aacauuagugcuaug

SEQ ID NO: 1815510 - RNA, 15 nt, Homo sapiens
gcucaagcagucuac

SEQ ID NO: 1815511 - RNA, 23 nt, Homo sapiens
ugagagcaaaaugcauguaauca

SEQ ID NO: 1815512 - RNA, 14 nt, Homo sapiens
cacugcagcagaaa

SEQ ID NO: 1815513 - RNA, 15 nt, Homo sapiens
uacccagagaguccu

SEQ ID NO: 1815514 - RNA, 22 nt, Homo sapiens
ggacuuugguucucuccaggaa

SEQ ID NO: 1815515 - RNA, 20 nt, Homo sapiens
aaauccagugagcacuagaa

SEQ ID NO: 1815516 - RNA, 20 nt, Homo sapiens
gacuccugccgcagugauca

SEQ ID NO: 1815517 - RNA, 21 nt, Homo sapiens
caugauuucacgaaggcaaga

SEQ ID NO: 1815518 - RNA, 15 nt, Homo sapiens
agccccauacagggc

SEQ ID NO: 1815519 - RNA, 20 nt, Homo sapiens
caaaaaaaaccuucagugaa

SEQ ID NO: 1815520 - RNA, 16 nt, Homo sapiens
uuuaaagacucaaggu

SEQ ID NO: 1815521 - RNA, 18 nt, Homo sapiens
aauauacuaaccauuucu

SEQ ID NO: 1815522 - RNA, 16 nt, Homo sapiens
gggcagaugggcggac

SEQ ID NO: 1815523 - RNA, 14 nt, Homo sapiens
caaaacaguucuca

SEQ ID NO: 1815524 - RNA, 17 nt, Homo sapiens
caaccuaaaauuucaag

SEQ ID NO: 1815525 - RNA, 22 nt, Homo sapiens
aaccuauuugacugcuucacgg

SEQ ID NO: 1815526 - RNA, 16 nt, Homo sapiens
gcuucuuugcagcuuc

SEQ ID NO: 1815527 - RNA, 14 nt, Homo sapiens
auucccugcaucca

SEQ ID NO: 1815528 - RNA, 21 nt, Homo sapiens
ugguagaacuaaacaauaagc

SEQ ID NO: 1815529 - RNA, 15 nt, Homo sapiens
auugcuuuacuggcu

SEQ ID NO: 1815530 - RNA, 12 nt, Homo sapiens
uacaugcuuauu

SEQ ID NO: 1815531 - RNA, 17 nt, Homo sapiens
cuuagugugagcaucuu

SEQ ID NO: 1815532 - RNA, 14 nt, Homo sapiens
ccaaagauuugagc

SEQ ID NO: 1815533 - RNA, 16 nt, Homo sapiens
uccccaccucuucccu

SEQ ID NO: 1815534 - RNA, 13 nt, Homo sapiens
aaaauauaugccu

SEQ ID NO: 1815535 - RNA, 13 nt, Homo sapiens
agacaauauacaa

SEQ ID NO: 1815536 - RNA, 13 nt, Homo sapiens
agacuauauacau

SEQ ID NO: 1815537 - RNA, 22 nt, Homo sapiens
gaggugaaaagggcagaggcaa

SEQ ID NO: 1815538 - RNA, 20 nt, Homo sapiens
accuccagcucucaguuaca

SEQ ID NO: 1815539 - RNA, 23 nt, Homo sapiens
gaccuccaggcuccagcacaucc

SEQ ID NO: 1815540 - RNA, 15 nt, Homo sapiens
auuugauaguauugu

SEQ ID NO: 1815541 - RNA, 21 nt, Homo sapiens
ccuccccaauuccccagggaa

SEQ ID NO: 1815542 - RNA, 16 nt, Homo sapiens
gacaguaacacuggcg

SEQ ID NO: 1815543 - RNA, 15 nt, Homo sapiens
ucugaauugacugua

SEQ ID NO: 1815544 - RNA, 19 nt, Homo sapiens
ccuuuugucuucucugucu

SEQ ID NO: 1815545 - RNA, 18 nt, Homo sapiens
aauaaaaaagcucuuuua

SEQ ID NO: 1815546 - RNA, 15 nt, Homo sapiens
aagaguggacugaau

SEQ ID NO: 1815547 - RNA, 14 nt, Homo sapiens
ggcauaguggcacu

SEQ ID NO: 1815548 - RNA, 14 nt, Homo sapiens
cacacagucacauu

SEQ ID NO: 1815549 - RNA, 14 nt, Homo sapiens
agcaaagagugggc

SEQ ID NO: 1815550 - RNA, 21 nt, Homo sapiens
augucuuccuuggagggggga

SEQ ID NO: 1815551 - RNA, 15 nt, Homo sapiens
uaaaauaagcauuua

SEQ ID NO: 1815552 - RNA, 20 nt, Homo sapiens
cacacaccugucugugcaga

SEQ ID NO: 1815553 - RNA, 18 nt, Homo sapiens
cugcagccccugggacca

SEQ ID NO: 1815554 - RNA, 19 nt, Homo sapiens
caacauccucagaaccauu

SEQ ID NO: 1815555 - RNA, 13 nt, Homo sapiens
uuguguguucuaa

SEQ ID NO: 1815556 - RNA, 16 nt, Homo sapiens
cacuuauuucagccaa

SEQ ID NO: 1815557 - RNA, 17 nt, Homo sapiens
gcagauucgagucacgu

SEQ ID NO: 1815558 - RNA, 13 nt, Homo sapiens
ggaauugcucaga

SEQ ID NO: 1815559 - RNA, 13 nt, Homo sapiens
aaggaaaugaugg

SEQ ID NO: 1815560 - RNA, 20 nt, Homo sapiens
uucaccauguuggccaggau

SEQ ID NO: 1815561 - RNA, 21 nt, Homo sapiens
ggcucucgcugcccuguggac

SEQ ID NO: 1815562 - RNA, 16 nt, Homo sapiens
uucuuacaauugcacu

SEQ ID NO: 1815563 - RNA, 21 nt, Homo sapiens
cccaugagaguagagggcacu

SEQ ID NO: 1815564 - RNA, 22 nt, Homo sapiens
uguauuuuuuccuguaagacaa

SEQ ID NO: 1815565 - RNA, 14 nt, Homo sapiens
gagaagugcccuua

SEQ ID NO: 1815566 - RNA, 19 nt, Homo sapiens
agugaucaguaugcuguuu

SEQ ID NO: 1815567 - RNA, 12 nt, Homo sapiens
gauuucauucaa

SEQ ID NO: 1815568 - RNA, 19 nt, Homo sapiens
gcucugcaggccacuguga

SEQ ID NO: 1815569 - RNA, 22 nt, Homo sapiens
ugucugcccugaacccacugcu

SEQ ID NO: 1815570 - RNA, 17 nt, Homo sapiens
cuuauuaggacuuugaa

SEQ ID NO: 1815571 - RNA, 17 nt, Homo sapiens
cugggucaugcacugag

SEQ ID NO: 1815572 - RNA, 19 nt, Homo sapiens
aguuccacaauuuugucuc

SEQ ID NO: 1815573 - RNA, 21 nt, Homo sapiens
augccaaccccgcccuaggcc

SEQ ID NO: 1815574 - RNA, 16 nt, Homo sapiens
cuuggcugcagccauc

SEQ ID NO: 1815575 - RNA, 11 nt, Homo sapiens
ucuaugccaca

SEQ ID NO: 1815576 - RNA, 14 nt, Homo sapiens
uggcuuugcuguug

SEQ ID NO: 1815577 - RNA, 18 nt, Homo sapiens
gcagcuuguugguuguca

SEQ ID NO: 1815578 - RNA, 18 nt, Homo sapiens
cuuaauuaugcuaacaaa

SEQ ID NO: 1815579 - RNA, 23 nt, Homo sapiens
uuucaauaguggcauaccaaaug

SEQ ID NO: 1815580 - RNA, 21 nt, Homo sapiens
aagguuuuugucuaugaauau

SEQ ID NO: 1815581 - RNA, 19 nt, Homo sapiens
gcuggaugcugcuguacaa

SEQ ID NO: 1815582 - RNA, 21 nt, Homo sapiens
aacaccguguuuucugacaca

SEQ ID NO: 1815583 - RNA, 16 nt, Homo sapiens
uggcaccgaagcccag

SEQ ID NO: 1815584 - RNA, 14 nt, Homo sapiens
gcauaggcucuuaa

SEQ ID NO: 1815585 - RNA, 22 nt, Homo sapiens
aguuucacaugagcuauuucca

SEQ ID NO: 1815586 - RNA, 11 nt, Homo sapiens
agcacuuuauc

SEQ ID NO: 1815587 - RNA, 23 nt, Homo sapiens
uggagucuugugccaaaccuacu

SEQ ID NO: 1815588 - RNA, 14 nt, Homo sapiens
aacuauuuauuuca

SEQ ID NO: 1815589 - RNA, 21 nt, Homo sapiens
gcacuucacagagugugcugg

SEQ ID NO: 1815590 - RNA, 17 nt, Homo sapiens
auaggaguucacuucau

SEQ ID NO: 1815591 - RNA, 15 nt, Homo sapiens
aaggggagagggaag

SEQ ID NO: 1815592 - RNA, 20 nt, Homo sapiens
uauucuguuugcguacuugu

SEQ ID NO: 1815593 - RNA, 19 nt, Homo sapiens
ucacuuuuuacauauaguu

SEQ ID NO: 1815594 - RNA, 11 nt, Homo sapiens
uuaaaaucaca

SEQ ID NO: 1815595 - RNA, 16 nt, Homo sapiens
gcccugcccacaccuc

SEQ ID NO: 1815596 - RNA, 15 nt, Homo sapiens
aggugcccaggagaa

SEQ ID NO: 1815597 - RNA, 12 nt, Homo sapiens
gagacaguauug

SEQ ID NO: 1815598 - RNA, 16 nt, Homo sapiens
uaaaacagaaucuucu

SEQ ID NO: 1815599 - RNA, 17 nt, Homo sapiens
cuuaucuaaucaugaaa

SEQ ID NO: 1815600 - RNA, 13 nt, Homo sapiens
uaaaacaaaagag

SEQ ID NO: 1815601 - RNA, 18 nt, Homo sapiens
aacugaugagauacauuu

SEQ ID NO: 1815602 - RNA, 21 nt, Homo sapiens
ugcuccgaggacccaggaaag

SEQ ID NO: 1815603 - RNA, 17 nt, Homo sapiens
acauaaucuaguuuaca

SEQ ID NO: 1815604 - RNA, 17 nt, Homo sapiens
uucugaguagcauauau

SEQ ID NO: 1815605 - RNA, 18 nt, Homo sapiens
caguacaggcagcacaga

SEQ ID NO: 1815606 - RNA, 22 nt, Homo sapiens
uucuaagguccgguguucuaag

SEQ ID NO: 1815607 - RNA, 19 nt, Homo sapiens
ccugcaucagccucuggcc

SEQ ID NO: 1815608 - RNA, 20 nt, Homo sapiens
cagugagccgagauugcgcc

SEQ ID NO: 1815609 - RNA, 12 nt, Homo sapiens
agucugucacac

SEQ ID NO: 1815610 - RNA, 16 nt, Homo sapiens
aggccugcaggggcaa

SEQ ID NO: 1815611 - RNA, 22 nt, Homo sapiens
gcaaugccaaucuucaguauuu

SEQ ID NO: 1815612 - RNA, 17 nt, Homo sapiens
auugaagucuuauccaa

SEQ ID NO: 1815613 - RNA, 20 nt, Homo sapiens
auauguaaaaagucauaaaa

SEQ ID NO: 1815614 - RNA, 20 nt, Homo sapiens
cucuuccgcagacuugguca

SEQ ID NO: 1815615 - RNA, 21 nt, Homo sapiens
cugagagccauaaaugaccua

SEQ ID NO: 1815616 - RNA, 19 nt, Homo sapiens
ugucuugcaaagccuuuaa

SEQ ID NO: 1815617 - RNA, 23 nt, Homo sapiens
ggagcaggugcccccaggugaga

SEQ ID NO: 1815618 - RNA, 19 nt, Homo sapiens
cuaauagagacacagagau

SEQ ID NO: 1815619 - RNA, 19 nt, Homo sapiens
uaguuaaaaaaaaauuccc

SEQ ID NO: 1815620 - RNA, 16 nt, Homo sapiens
aagcaucaccucaggc

SEQ ID NO: 1815621 - RNA, 12 nt, Homo sapiens
caaaaccugcuu

SEQ ID NO: 1815622 - RNA, 16 nt, Homo sapiens
acuagccugugcacgc

SEQ ID NO: 1815623 - RNA, 15 nt, Homo sapiens
ggucuuaucuguuca

SEQ ID NO: 1815624 - RNA, 17 nt, Homo sapiens
gacccaacagcagugau

SEQ ID NO: 1815625 - RNA, 13 nt, Homo sapiens
ucacugcugucaa

SEQ ID NO: 1815626 - RNA, 22 nt, Homo sapiens
uucaagggcugcuucaaacuca

SEQ ID NO: 1815627 - RNA, 19 nt, Homo sapiens
cuuuuuaugaucugccauu

SEQ ID NO: 1815628 - RNA, 18 nt, Homo sapiens
aaacaaaaaucuguguaa

SEQ ID NO: 1815629 - RNA, 19 nt, Homo sapiens
cagucagggcccagaguug

SEQ ID NO: 1815630 - RNA, 21 nt, Homo sapiens
gauuucauugacugaacugca

SEQ ID NO: 1815631 - RNA, 19 nt, Homo sapiens
agucccuguucucagcucc

SEQ ID NO: 1815632 - RNA, 18 nt, Homo sapiens
acagaauucucccagcgu

SEQ ID NO: 1815633 - RNA, 15 nt, Homo sapiens
aaagaggccagcucu

SEQ ID NO: 1815634 - RNA, 20 nt, Homo sapiens
acaugcaaagauccccaaaa

SEQ ID NO: 1815635 - RNA, 22 nt, Homo sapiens
ccauccuugccaauagugucau

SEQ ID NO: 1815636 - RNA, 19 nt, Homo sapiens
gucaaaugaugugcaaaac

SEQ ID NO: 1815637 - RNA, 21 nt, Homo sapiens
aaguaacacaguggacuuccu

SEQ ID NO: 1815638 - RNA, 16 nt, Homo sapiens
acccccagcacagggg

SEQ ID NO: 1815639 - RNA, 11 nt, Homo sapiens
uggagcucaag

SEQ ID NO: 1815640 - RNA, 21 nt, Homo sapiens
gauuucucuuugaaacaugcu

SEQ ID NO: 1815641 - RNA, 20 nt, Homo sapiens
uguuggccaaagccaaagcu

SEQ ID NO: 1815642 - RNA, 15 nt, Homo sapiens
cacauaggcuggugg

SEQ ID NO: 1815643 - RNA, 13 nt, Homo sapiens
uaacucugcauag

SEQ ID NO: 1815644 - RNA, 16 nt, Homo sapiens
gcccaucaagugcagu

SEQ ID NO: 1815645 - RNA, 21 nt, Homo sapiens
cuauuuaagugaaaaaagcaa

SEQ ID NO: 1815646 - RNA, 14 nt, Homo sapiens
ccucacucuugcca

SEQ ID NO: 1815647 - RNA, 19 nt, Homo sapiens
gcggagucuguccugugac

SEQ ID NO: 1815648 - RNA, 19 nt, Homo sapiens
agcaaaguuaaggcuugau

SEQ ID NO: 1815649 - RNA, 16 nt, Homo sapiens
gaagucucuuccaguu

SEQ ID NO: 1815650 - RNA, 21 nt, Homo sapiens
gugguuuaugucaucauacau

SEQ ID NO: 1815651 - RNA, 14 nt, Homo sapiens
cucuucccaucugu

SEQ ID NO: 1815652 - RNA, 14 nt, Homo sapiens
cuuuucccauuugu

SEQ ID NO: 1815653 - RNA, 10 nt, Homo sapiens
uacaguauua

SEQ ID NO: 1815654 - RNA, 18 nt, Homo sapiens
ucaacaguuuccagucau

SEQ ID NO: 1815655 - RNA, 14 nt, Homo sapiens
acagguccuccauc

SEQ ID NO: 1815656 - RNA, 15 nt, Homo sapiens
agagccucacaguua

SEQ ID NO: 1815657 - RNA, 22 nt, Homo sapiens
aaaaauaaaagucgcauuccau

SEQ ID NO: 1815658 - RNA, 16 nt, Homo sapiens
aaugagaucauuguga

SEQ ID NO: 1815659 - RNA, 22 nt, Homo sapiens
caggaucggcuuccucaggggc

SEQ ID NO: 1815660 - RNA, 15 nt, Homo sapiens
acacaugguuuccaa

SEQ ID NO: 1815661 - RNA, 18 nt, Homo sapiens
aauaaaaugcagagacau

SEQ ID NO: 1815662 - RNA, 15 nt, Homo sapiens
ugauaagacaugaaa

SEQ ID NO: 1815663 - RNA, 18 nt, Homo sapiens
cugggguuuacugaggug

SEQ ID NO: 1815664 - RNA, 21 nt, Homo sapiens
cucugaauaaauacccauuga

SEQ ID NO: 1815665 - RNA, 17 nt, Homo sapiens
aggauggaugcaucaca

SEQ ID NO: 1815666 - RNA, 13 nt, Homo sapiens
cccaacaguucau

SEQ ID NO: 1815667 - RNA, 14 nt, Homo sapiens
acacagacccgcug

SEQ ID NO: 1815668 - RNA, 18 nt, Homo sapiens
ucaugcccucucucggga

SEQ ID NO: 1815669 - RNA, 16 nt, Homo sapiens
cuuagggcaggaaaga

SEQ ID NO: 1815670 - RNA, 15 nt, Homo sapiens
aaagaagugaaacua

SEQ ID NO: 1815671 - RNA, 16 nt, Homo sapiens
aucuuaaaacaaauuc

SEQ ID NO: 1815672 - RNA, 18 nt, Homo sapiens
auagauuuccugugagua

SEQ ID NO: 1815673 - RNA, 14 nt, Homo sapiens
cuuccaaggucccg

SEQ ID NO: 1815674 - RNA, 21 nt, Homo sapiens
ugaaguuagggaugacuguga

SEQ ID NO: 1815675 - RNA, 21 nt, Homo sapiens
ccacagacucaaaugcucaga

SEQ ID NO: 1815676 - RNA, 16 nt, Homo sapiens
aagauuguuaaauuca

SEQ ID NO: 1815677 - RNA, 18 nt, Homo sapiens
agugucacugcuuguuau

SEQ ID NO: 1815678 - RNA, 21 nt, Homo sapiens
auuaaccagauauauauucau

SEQ ID NO: 1815679 - RNA, 18 nt, Homo sapiens
aucuacugagacaugacu

SEQ ID NO: 1815680 - RNA, 22 nt, Homo sapiens
acgcuguaauauggcuguauca

SEQ ID NO: 1815681 - RNA, 17 nt, Homo sapiens
cguccugcagugugaga

SEQ ID NO: 1815682 - RNA, 22 nt, Homo sapiens
agcccacccgccccagagacug

SEQ ID NO: 1815683 - RNA, 13 nt, Homo sapiens
gauuuagcauuca

SEQ ID NO: 1815684 - RNA, 11 nt, Homo sapiens
uacacagagaa

SEQ ID NO: 1815685 - RNA, 13 nt, Homo sapiens
guucguauuacaa

SEQ ID NO: 1815686 - RNA, 21 nt, Homo sapiens
cccaccugucaaccugaauua

SEQ ID NO: 1815687 - RNA, 19 nt, Homo sapiens
auuccaggaaaacugggac

SEQ ID NO: 1815688 - RNA, 21 nt, Homo sapiens
uagcgauaauuuuuagacuaa

SEQ ID NO: 1815689 - RNA, 12 nt, Homo sapiens
gccaaggccuca

SEQ ID NO: 1815690 - RNA, 19 nt, Homo sapiens
cccagcaccucaugcagag

SEQ ID NO: 1815691 - RNA, 21 nt, Homo sapiens
aggcaggggcuuccuggugcu

SEQ ID NO: 1815692 - RNA, 21 nt, Homo sapiens
uuauaguuauuaaauguuuca

SEQ ID NO: 1815693 - RNA, 13 nt, Homo sapiens
gucuggggaccag

SEQ ID NO: 1815694 - RNA, 17 nt, Homo sapiens
caucaguauucugccau

SEQ ID NO: 1815695 - RNA, 16 nt, Homo sapiens
uuuuauuuagugccua

SEQ ID NO: 1815696 - RNA, 14 nt, Homo sapiens
aaaaaguauugcau

SEQ ID NO: 1815697 - RNA, 16 nt, Homo sapiens
acuaauuaaacugaug

SEQ ID NO: 1815698 - RNA, 20 nt, Homo sapiens
caggccaccccgcugaugga

SEQ ID NO: 1815699 - RNA, 19 nt, Homo sapiens
gcuuugcuuacaauggagu

SEQ ID NO: 1815700 - RNA, 15 nt, Homo sapiens
ccagucccagagcag

SEQ ID NO: 1815701 - RNA, 17 nt, Homo sapiens
ggaaccucacucuugcc

SEQ ID NO: 1815702 - RNA, 15 nt, Homo sapiens
aacucugggcacuuu

SEQ ID NO: 1815703 - RNA, 13 nt, Homo sapiens
auagacaaaauca

SEQ ID NO: 1815704 - RNA, 22 nt, Homo sapiens
uuucacaggacucugcagauag

SEQ ID NO: 1815705 - RNA, 15 nt, Homo sapiens
uggacuaugauuauc

SEQ ID NO: 1815706 - RNA, 16 nt, Homo sapiens
guauacauuacaauca

SEQ ID NO: 1815707 - RNA, 20 nt, Homo sapiens
aaacugcagccucucuggcu

SEQ ID NO: 1815708 - RNA, 18 nt, Homo sapiens
ggaccauuuuuacaucca

SEQ ID NO: 1815709 - RNA, 12 nt, Homo sapiens
cugacaccuacc

SEQ ID NO: 1815710 - RNA, 14 nt, Homo sapiens
uauauaauugccaa

SEQ ID NO: 1815711 - RNA, 13 nt, Homo sapiens
cauagccaaacag

SEQ ID NO: 1815712 - RNA, 18 nt, Homo sapiens
uacacacacagaugcaca

SEQ ID NO: 1815713 - RNA, 22 nt, Homo sapiens
gguagaccaaaucaaaugcuca

SEQ ID NO: 1815714 - RNA, 17 nt, Homo sapiens
aaacuuuguuugucaca

SEQ ID NO: 1815715 - RNA, 15 nt, Homo sapiens
uacuguauauauaau

SEQ ID NO: 1815716 - RNA, 17 nt, Homo sapiens
agacauccugagcagug

SEQ ID NO: 1815717 - RNA, 14 nt, Homo sapiens
cucuccucuugcca

SEQ ID NO: 1815718 - RNA, 14 nt, Homo sapiens
uaaaugacacauuu

SEQ ID NO: 1815719 - RNA, 16 nt, Homo sapiens
acaauauuaaguccaa

SEQ ID NO: 1815720 - RNA, 22 nt, Homo sapiens
gccgcugggagaaaagccagau

SEQ ID NO: 1815721 - RNA, 16 nt, Homo sapiens
cuauaagcaugaucuu

SEQ ID NO: 1815722 - RNA, 14 nt, Homo sapiens
gugguggucuucaa

SEQ ID NO: 1815723 - RNA, 19 nt, Homo sapiens
uuaacaguuguauuuaaca

SEQ ID NO: 1815724 - RNA, 15 nt, Homo sapiens
aaagcuucauucuca

SEQ ID NO: 1815725 - RNA, 13 nt, Homo sapiens
gacuuaucuacca

SEQ ID NO: 1815726 - RNA, 20 nt, Homo sapiens
augugaaccauuaaccagau

SEQ ID NO: 1815727 - RNA, 15 nt, Homo sapiens
uguuaguuguccaca

SEQ ID NO: 1815728 - RNA, 17 nt, Homo sapiens
caaguuuaacauauaca

SEQ ID NO: 1815729 - RNA, 22 nt, Homo sapiens
cuauugcagagacucauuucac

SEQ ID NO: 1815730 - RNA, 15 nt, Homo sapiens
guugguuuaaugcaa

SEQ ID NO: 1815731 - RNA, 18 nt, Homo sapiens
cucagaggccuugcugug

SEQ ID NO: 1815732 - RNA, 20 nt, Homo sapiens
acugauacauccauuuugau

SEQ ID NO: 1815733 - RNA, 13 nt, Homo sapiens
uaaacaagugcac

SEQ ID NO: 1815734 - RNA, 16 nt, Homo sapiens
ucacacucauccacac

SEQ ID NO: 1815735 - RNA, 15 nt, Homo sapiens
caauaccaaauagcu

SEQ ID NO: 1815736 - RNA, 15 nt, Homo sapiens
uaucucaaaucugcu

SEQ ID NO: 1815737 - RNA, 11 nt, Homo sapiens
cugugcugguu

SEQ ID NO: 1815738 - RNA, 12 nt, Homo sapiens
gaagacuguggc

SEQ ID NO: 1815739 - RNA, 12 nt, Homo sapiens
ugagacuggagc

SEQ ID NO: 1815740 - RNA, 12 nt, Homo sapiens
gagcacugugag

SEQ ID NO: 1815741 - RNA, 14 nt, Homo sapiens
cuaacaaagaccau

SEQ ID NO: 1815742 - RNA, 21 nt, Homo sapiens
ucuguuuguuuggcuguccag

SEQ ID NO: 1815743 - RNA, 21 nt, Homo sapiens
uaugagcuccauguugcuuca

SEQ ID NO: 1815744 - RNA, 13 nt, Homo sapiens
uguaaaguagcug

SEQ ID NO: 1815745 - RNA, 17 nt, Homo sapiens
uuugaaaguacuccuua

SEQ ID NO: 1815746 - RNA, 20 nt, Homo sapiens
cacagucuucccagcaauua

SEQ ID NO: 1815747 - RNA, 12 nt, Homo sapiens
ccgauaccaugc

SEQ ID NO: 1815748 - RNA, 16 nt, Homo sapiens
uaauacagccaaagau

SEQ ID NO: 1815749 - RNA, 13 nt, Homo sapiens
uccccagccuacc

SEQ ID NO: 1815750 - RNA, 21 nt, Homo sapiens
gcacauauggacucugcacau

SEQ ID NO: 1815751 - RNA, 16 nt, Homo sapiens
ggaugcacacacagau

SEQ ID NO: 1815752 - RNA, 15 nt, Homo sapiens
aacacauuaagccuu

SEQ ID NO: 1815753 - RNA, 15 nt, Homo sapiens
uggauauuugccuuu

SEQ ID NO: 1815754 - RNA, 21 nt, Homo sapiens
acaagaauuguccaugugcuu

SEQ ID NO: 1815755 - RNA, 15 nt, Homo sapiens
gcugacuucaucugg

SEQ ID NO: 1815756 - RNA, 11 nt, Homo sapiens
ucguacuugaa

SEQ ID NO: 1815757 - RNA, 13 nt, Homo sapiens
augcaguauaaaa

SEQ ID NO: 1815758 - RNA, 16 nt, Homo sapiens
uugagccggacaccaa

SEQ ID NO: 1815759 - RNA, 17 nt, Homo sapiens
cuccaucauuaauguga

SEQ ID NO: 1815760 - RNA, 20 nt, Homo sapiens
ccgggccggacgcaggugcu

SEQ ID NO: 1815761 - RNA, 14 nt, Homo sapiens
aauuucuucuuuau

SEQ ID NO: 1815762 - RNA, 14 nt, Homo sapiens
gcuuuccuucaucu

SEQ ID NO: 1815763 - RNA, 16 nt, Homo sapiens
uuaaaauagccauaaa

SEQ ID NO: 1815764 - RNA, 16 nt, Homo sapiens
aauuguuuugagcuuu

SEQ ID NO: 1815765 - RNA, 20 nt, Homo sapiens
ugaagacccuggaguucaaa

SEQ ID NO: 1815766 - RNA, 16 nt, Homo sapiens
agccagccacacuuga

SEQ ID NO: 1815767 - RNA, 15 nt, Homo sapiens
auugugugucacaaa

SEQ ID NO: 1815768 - RNA, 14 nt, Homo sapiens
acccaggacaucuc

SEQ ID NO: 1815769 - RNA, 20 nt, Homo sapiens
cucuuccccauaaucacuga

SEQ ID NO: 1815770 - RNA, 14 nt, Homo sapiens
ucaagaaugcagua

SEQ ID NO: 1815771 - RNA, 13 nt, Homo sapiens
ccagucauugcac

SEQ ID NO: 1815772 - RNA, 14 nt, Homo sapiens
augggagcagucca

SEQ ID NO: 1815773 - RNA, 23 nt, Homo sapiens
accauagaguccagaucuugccu

SEQ ID NO: 1815774 - RNA, 20 nt, Homo sapiens
ucacccagguuggagugcag

SEQ ID NO: 1815775 - RNA, 22 nt, Homo sapiens
caugguggaaaacgaagcucau

SEQ ID NO: 1815776 - RNA, 15 nt, Homo sapiens
ugagacggagucuug

SEQ ID NO: 1815777 - RNA, 15 nt, Homo sapiens
ugagauggagucucg

SEQ ID NO: 1815778 - RNA, 11 nt, Homo sapiens
gguagccagca

SEQ ID NO: 1815779 - RNA, 21 nt, Homo sapiens
uuccucccaggaagcccagga

SEQ ID NO: 1815780 - RNA, 15 nt, Homo sapiens
uauuguuguugccaa

SEQ ID NO: 1815781 - RNA, 23 nt, Homo sapiens
cagcugugcugcaccccaugugg

SEQ ID NO: 1815782 - RNA, 19 nt, Homo sapiens
gagagaauagaagaagcua

SEQ ID NO: 1815783 - RNA, 23 nt, Homo sapiens
cuuuuacaaaaaaguaaccugaa

SEQ ID NO: 1815784 - RNA, 15 nt, Homo sapiens
gguuaacagauuuau

SEQ ID NO: 1815785 - RNA, 23 nt, Homo sapiens
cacuaccaaauucauuugacuuu

SEQ ID NO: 1815786 - RNA, 16 nt, Homo sapiens
auucucggcucagguu

SEQ ID NO: 1815787 - RNA, 13 nt, Homo sapiens
cucagagugcaag

SEQ ID NO: 1815788 - RNA, 13 nt, Homo sapiens
guuuguguuugaa

SEQ ID NO: 1815789 - RNA, 21 nt, Homo sapiens
agaccucuccuuccuacccuc

SEQ ID NO: 1815790 - RNA, 19 nt, Homo sapiens
aaagguuuaaugucagggu

SEQ ID NO: 1815791 - RNA, 20 nt, Homo sapiens
caacuacccgggccugaccc

SEQ ID NO: 1815792 - RNA, 23 nt, Homo sapiens
cggcuuccaccccucuccucaga

SEQ ID NO: 1815793 - RNA, 23 nt, Homo sapiens
gcggauuccucaccaagcucaac

SEQ ID NO: 1815794 - RNA, 10 nt, Homo sapiens
ucuaccccag

SEQ ID NO: 1815795 - RNA, 16 nt, Homo sapiens
auucacaaaaauugac

SEQ ID NO: 1815796 - RNA, 17 nt, Homo sapiens
gucauuuuuaacagcau

SEQ ID NO: 1815797 - RNA, 17 nt, Homo sapiens
ucucuguuuuguaagcu

SEQ ID NO: 1815798 - RNA, 15 nt, Homo sapiens
aguaagaugcacuga

SEQ ID NO: 1815799 - RNA, 17 nt, Homo sapiens
cauacuuaacauuucau

SEQ ID NO: 1815800 - RNA, 16 nt, Homo sapiens
uaguggaagcuucuaa

SEQ ID NO: 1815801 - RNA, 18 nt, Homo sapiens
ugaugccccuuccccaag

SEQ ID NO: 1815802 - RNA, 19 nt, Homo sapiens
uggaacucuugacagcuau

SEQ ID NO: 1815803 - RNA, 19 nt, Homo sapiens
gcuuccuccugguguggaa

SEQ ID NO: 1815804 - RNA, 18 nt, Homo sapiens
auaaaaagcgcugcagua

SEQ ID NO: 1815805 - RNA, 16 nt, Homo sapiens
caggaaucaugaucug

SEQ ID NO: 1815806 - RNA, 20 nt, Homo sapiens
ucacuuggaagauuuguaua

SEQ ID NO: 1815807 - RNA, 15 nt, Homo sapiens
uuuuaggacaucuua

SEQ ID NO: 1815808 - RNA, 13 nt, Homo sapiens
aguguuaaacuag

SEQ ID NO: 1815809 - RNA, 20 nt, Homo sapiens
cuaacaagccuuggaccaaa

SEQ ID NO: 1815810 - RNA, 18 nt, Homo sapiens
uuuccuaaacccagugcu

SEQ ID NO: 1815811 - RNA, 22 nt, Homo sapiens
uagaagaauuugagaagaaaua

SEQ ID NO: 1815812 - RNA, 14 nt, Homo sapiens
aauaaugacaugua

SEQ ID NO: 1815813 - RNA, 20 nt, Homo sapiens
aaauagcagcacagcugcca

SEQ ID NO: 1815814 - RNA, 20 nt, Homo sapiens
aaggcaugcuuguggaugac

SEQ ID NO: 1815815 - RNA, 11 nt, Homo sapiens
aacaaugccau

SEQ ID NO: 1815816 - RNA, 14 nt, Homo sapiens
aacuucccaaagca

SEQ ID NO: 1815817 - RNA, 17 nt, Homo sapiens
guggaccacugcaugag

SEQ ID NO: 1815818 - RNA, 13 nt, Homo sapiens
ggguuuacuugac

SEQ ID NO: 1815819 - RNA, 17 nt, Homo sapiens
caaaauaaagaucacag

SEQ ID NO: 1815820 - RNA, 16 nt, Homo sapiens
uguaaaucccauuauu

SEQ ID NO: 1815821 - RNA, 23 nt, Homo sapiens
acucuccaaacgggauacaggag

SEQ ID NO: 1815822 - RNA, 23 nt, Homo sapiens
cuucuccacagggacacagucug

SEQ ID NO: 1815823 - RNA, 15 nt, Homo sapiens
cacacaaaaugucac

SEQ ID NO: 1815824 - RNA, 20 nt, Homo sapiens
uggagaccguccuggagcug

SEQ ID NO: 1815825 - RNA, 15 nt, Homo sapiens
cuaugacuguaucuu

SEQ ID NO: 1815826 - RNA, 22 nt, Homo sapiens
cuaagguccaacaagaaugcau

SEQ ID NO: 1815827 - RNA, 22 nt, Homo sapiens
ccuuaaagucaguaacuuaccc

SEQ ID NO: 1815828 - RNA, 13 nt, Homo sapiens
cuagagaugugca

SEQ ID NO: 1815829 - RNA, 14 nt, Homo sapiens
auaacaacuuugaa

SEQ ID NO: 1815830 - RNA, 22 nt, Homo sapiens
ccauggacacuccagugccagc

SEQ ID NO: 1815831 - RNA, 22 nt, Homo sapiens
auauaauguaguaugauguaau

SEQ ID NO: 1815832 - RNA, 15 nt, Homo sapiens
cugggugagggcuau

SEQ ID NO: 1815833 - RNA, 14 nt, Homo sapiens
ucgcauuugucaau

SEQ ID NO: 1815834 - RNA, 16 nt, Homo sapiens
ccuaaacccuguuccu

SEQ ID NO: 1815835 - RNA, 13 nt, Homo sapiens
uugcaauuguuaa

SEQ ID NO: 1815836 - RNA, 14 nt, Homo sapiens
ccucaguuccugca

SEQ ID NO: 1815837 - RNA, 15 nt, Homo sapiens
gaaucaacagaugau

SEQ ID NO: 1815838 - RNA, 9 nt, Homo sapiens
cacugccuc

SEQ ID NO: 1815839 - RNA, 15 nt, Homo sapiens
agauccuuaaaaccu

SEQ ID NO: 1815840 - RNA, 23 nt, Homo sapiens
gaggcgacggcuuccaucugccc

SEQ ID NO: 1815841 - RNA, 14 nt, Homo sapiens
cuaguaagugccug

SEQ ID NO: 1815842 - RNA, 16 nt, Homo sapiens
agaucagguuugccca

SEQ ID NO: 1815843 - RNA, 22 nt, Homo sapiens
uggaccgaggaacaacuuggaa

SEQ ID NO: 1815844 - RNA, 13 nt, Homo sapiens
agccaacgugugu

SEQ ID NO: 1815845 - RNA, 19 nt, Homo sapiens
accucauguccacucagua

SEQ ID NO: 1815846 - RNA, 12 nt, Homo sapiens
auuaaauggugc

SEQ ID NO: 1815847 - RNA, 15 nt, Homo sapiens
ugccuccaagccauu

SEQ ID NO: 1815848 - RNA, 16 nt, Homo sapiens
ggugccaaguuccacu

SEQ ID NO: 1815849 - RNA, 13 nt, Homo sapiens
acuuaacaagcuc

SEQ ID NO: 1815850 - RNA, 19 nt, Homo sapiens
ccaaaacucucauuauucu

SEQ ID NO: 1815851 - RNA, 15 nt, Homo sapiens
augaaugacaacauu

SEQ ID NO: 1815852 - RNA, 21 nt, Homo sapiens
uuagaugagggugacugucaa

SEQ ID NO: 1815853 - RNA, 14 nt, Homo sapiens
ucuccagaaucuug

SEQ ID NO: 1815854 - RNA, 20 nt, Homo sapiens
ccuggcagggggugaaggca

SEQ ID NO: 1815855 - RNA, 21 nt, Homo sapiens
ggagacaaucuaaaaaauauc

SEQ ID NO: 1815856 - RNA, 14 nt, Homo sapiens
uguauuuguuccca

SEQ ID NO: 1815857 - RNA, 17 nt, Homo sapiens
gcaaucuauguuugcac

SEQ ID NO: 1815858 - RNA, 23 nt, Homo sapiens
agagcccuguggccgacucugca

SEQ ID NO: 1815859 - RNA, 22 nt, Homo sapiens
gugauugggaauaaauaugccu

SEQ ID NO: 1815860 - RNA, 23 nt, Homo sapiens
ccagauugacgacaagugcugaa

SEQ ID NO: 1815861 - RNA, 12 nt, Homo sapiens
ccuucaugcccu

SEQ ID NO: 1815862 - RNA, 12 nt, Homo sapiens
cacacaugcaua

SEQ ID NO: 1815863 - RNA, 12 nt, Homo sapiens
aauccaugaacc

SEQ ID NO: 1815864 - RNA, 14 nt, Homo sapiens
aauugacucucaca

SEQ ID NO: 1815865 - RNA, 13 nt, Homo sapiens
gaaaucugccaau

SEQ ID NO: 1815866 - RNA, 19 nt, Homo sapiens
aggcuacauauacauaguu

SEQ ID NO: 1815867 - RNA, 17 nt, Homo sapiens
guucuaacugcuguuaa

SEQ ID NO: 1815868 - RNA, 17 nt, Homo sapiens
aauguauuugugcacau

SEQ ID NO: 1815869 - RNA, 22 nt, Homo sapiens
gaauaagcauuccuucuuucac

SEQ ID NO: 1815870 - RNA, 20 nt, Homo sapiens
caggacuugagaagaccuca

SEQ ID NO: 1815871 - RNA, 22 nt, Homo sapiens
cauccaucauaaccaccccagc

SEQ ID NO: 1815872 - RNA, 18 nt, Homo sapiens
caaguuaucaucucacca

SEQ ID NO: 1815873 - RNA, 14 nt, Homo sapiens
uacaguuuaucuau

SEQ ID NO: 1815874 - RNA, 14 nt, Homo sapiens
ugaucaguaaguca

SEQ ID NO: 1815875 - RNA, 16 nt, Homo sapiens
cuauguccauucucau

SEQ ID NO: 1815876 - RNA, 22 nt, Homo sapiens
ggcuccugggagggagacucag

SEQ ID NO: 1815877 - RNA, 15 nt, Homo sapiens
uaauaagcuaaagag

SEQ ID NO: 1815878 - RNA, 19 nt, Homo sapiens
caggaugguggacuacaaa

SEQ ID NO: 1815879 - RNA, 15 nt, Homo sapiens
ccauaugaacauaua

SEQ ID NO: 1815880 - RNA, 15 nt, Homo sapiens
cgccaggaagccaga

SEQ ID NO: 1815881 - RNA, 15 nt, Homo sapiens
acucuagaaaaaagg

SEQ ID NO: 1815882 - RNA, 20 nt, Homo sapiens
ugaaauaacacagcaguuuc

SEQ ID NO: 1815883 - RNA, 14 nt, Homo sapiens
auuagaaacuacca

SEQ ID NO: 1815884 - RNA, 14 nt, Homo sapiens
aauauuucagugaa

SEQ ID NO: 1815885 - RNA, 16 nt, Homo sapiens
cauccaauucuuugaa

SEQ ID NO: 1815886 - RNA, 16 nt, Homo sapiens
cagcuauuuagugaua

SEQ ID NO: 1815887 - RNA, 14 nt, Homo sapiens
accguguacaauac

SEQ ID NO: 1815888 - RNA, 17 nt, Homo sapiens
uuaaugaacugugacag

SEQ ID NO: 1815889 - RNA, 20 nt, Homo sapiens
cgcgaagugggcauugcaaa

SEQ ID NO: 1815890 - RNA, 21 nt, Homo sapiens
gagggcuuugugucuggccag

SEQ ID NO: 1815891 - RNA, 21 nt, Homo sapiens
ugcucccuggaggcacgcacc

SEQ ID NO: 1815892 - RNA, 21 nt, Homo sapiens
ugcuugagcccaggaauuuga

SEQ ID NO: 1815893 - RNA, 16 nt, Homo sapiens
ccuggcagagccaugg

SEQ ID NO: 1815894 - RNA, 21 nt, Homo sapiens
accucaccccacuguggcuga

SEQ ID NO: 1815895 - RNA, 22 nt, Homo sapiens
uuguaaaaagcccagcacuuga

SEQ ID NO: 1815896 - RNA, 13 nt, Homo sapiens
gagauaaacuaca

SEQ ID NO: 1815897 - RNA, 16 nt, Homo sapiens
ugccguugcuccggcc

SEQ ID NO: 1815898 - RNA, 19 nt, Homo sapiens
gagucucugauacacagua

SEQ ID NO: 1815899 - RNA, 22 nt, Homo sapiens
cgugaucuuggcucacugcaac

SEQ ID NO: 1815900 - RNA, 14 nt, Homo sapiens
uccaacaguagcau

SEQ ID NO: 1815901 - RNA, 13 nt, Homo sapiens
acggcaaccacau

SEQ ID NO: 1815902 - RNA, 18 nt, Homo sapiens
agauuuggagaugucucu

SEQ ID NO: 1815903 - RNA, 18 nt, Homo sapiens
auccacuucucucaggau

SEQ ID NO: 1815904 - RNA, 14 nt, Homo sapiens
cugaggacaaagug

SEQ ID NO: 1815905 - RNA, 15 nt, Homo sapiens
acucucucacccacc

SEQ ID NO: 1815906 - RNA, 17 nt, Homo sapiens
ccuauaaaacaggucaa

SEQ ID NO: 1815907 - RNA, 13 nt, Homo sapiens
cuuuucacugcug

SEQ ID NO: 1815908 - RNA, 21 nt, Homo sapiens
aagccugccgaaaacaggagc

SEQ ID NO: 1815909 - RNA, 21 nt, Homo sapiens
aggucugagauaaaacgaucu

SEQ ID NO: 1815910 - RNA, 22 nt, Homo sapiens
uccuagccccucucucacacau

SEQ ID NO: 1815911 - RNA, 22 nt, Homo sapiens
uuagugaccccugccuacuucc

SEQ ID NO: 1815912 - RNA, 21 nt, Homo sapiens
aauucuuauaacucaacauuu

SEQ ID NO: 1815913 - RNA, 17 nt, Homo sapiens
cuuuucaaguuucccca

SEQ ID NO: 1815914 - RNA, 16 nt, Homo sapiens
gccucugguugccucc

SEQ ID NO: 1815915 - RNA, 22 nt, Homo sapiens
uggccacugggucucugcaaac

SEQ ID NO: 1815916 - RNA, 18 nt, Homo sapiens
cuuuccauaaauccuuga

SEQ ID NO: 1815917 - RNA, 19 nt, Homo sapiens
ucuccauggaguugcuaag

SEQ ID NO: 1815918 - RNA, 15 nt, Homo sapiens
uggaccaugccagau

SEQ ID NO: 1815919 - RNA, 19 nt, Homo sapiens
cuagaaccuggaagggcua

SEQ ID NO: 1815920 - RNA, 16 nt, Homo sapiens
ccucuuucacauugaa

SEQ ID NO: 1815921 - RNA, 11 nt, Homo sapiens
gaaccucaguu

SEQ ID NO: 1815922 - RNA, 16 nt, Homo sapiens
acaguucuuguuagaa

SEQ ID NO: 1815923 - RNA, 18 nt, Homo sapiens
cuguggacaugugggugg

SEQ ID NO: 1815924 - RNA, 17 nt, Homo sapiens
ucuguccuacucugugu

SEQ ID NO: 1815925 - RNA, 21 nt, Homo sapiens
cccagccaaguccaagagggc

SEQ ID NO: 1815926 - RNA, 16 nt, Homo sapiens
ugauugccauuucuuc

SEQ ID NO: 1815927 - RNA, 16 nt, Homo sapiens
uuggagaaaagcacuu

SEQ ID NO: 1815928 - RNA, 16 nt, Homo sapiens
aauugcaugaaacuag

SEQ ID NO: 1815929 - RNA, 17 nt, Homo sapiens
cugauauagaucacaua

SEQ ID NO: 1815930 - RNA, 17 nt, Homo sapiens
augaggagcugcagauu

SEQ ID NO: 1815931 - RNA, 15 nt, Homo sapiens
ccauuuuacuuccau

SEQ ID NO: 1815932 - RNA, 19 nt, Homo sapiens
auauauuauauauaaucua

SEQ ID NO: 1815933 - RNA, 22 nt, Homo sapiens
ucagauaaucauuucuacuuca

SEQ ID NO: 1815934 - RNA, 23 nt, Homo sapiens
ucucuauaacagauccuuucaaa

SEQ ID NO: 1815935 - RNA, 14 nt, Homo sapiens
caccuguaauccca

SEQ ID NO: 1815936 - RNA, 22 nt, Homo sapiens
cccagaaagccucagaguccug

SEQ ID NO: 1815937 - RNA, 18 nt, Homo sapiens
cgcacaccaaauuuggca

SEQ ID NO: 1815938 - RNA, 16 nt, Homo sapiens
cuucuuuccucaaaga

SEQ ID NO: 1815939 - RNA, 15 nt, Homo sapiens
aaugucacgggacca

SEQ ID NO: 1815940 - RNA, 18 nt, Homo sapiens
uucuucccaguucuugac

SEQ ID NO: 1815941 - RNA, 12 nt, Homo sapiens
cgcacccggcuc

SEQ ID NO: 1815942 - RNA, 14 nt, Homo sapiens
ggcuucucugucuc

SEQ ID NO: 1815943 - RNA, 16 nt, Homo sapiens
uaacagaaaauguguc

SEQ ID NO: 1815944 - RNA, 20 nt, Homo sapiens
guagcuuucaguauuguaaa

SEQ ID NO: 1815945 - RNA, 15 nt, Homo sapiens
ugauauguccucaga

SEQ ID NO: 1815946 - RNA, 15 nt, Homo sapiens
uagagcagaauucau

SEQ ID NO: 1815947 - RNA, 22 nt, Homo sapiens
auauauaugauguggacauaug

SEQ ID NO: 1815948 - RNA, 12 nt, Homo sapiens
acuccugacccc

SEQ ID NO: 1815949 - RNA, 19 nt, Homo sapiens
uucucccucacuccugcca

SEQ ID NO: 1815950 - RNA, 11 nt, Homo sapiens
agggguccagg

SEQ ID NO: 1815951 - RNA, 20 nt, Homo sapiens
uuucacagucaccaagugua

SEQ ID NO: 1815952 - RNA, 14 nt, Homo sapiens
aauaagauuccaga

SEQ ID NO: 1815953 - RNA, 13 nt, Homo sapiens
ccuggggugaccc

SEQ ID NO: 1815954 - RNA, 16 nt, Homo sapiens
acaaauuuugcauauu

SEQ ID NO: 1815955 - RNA, 15 nt, Homo sapiens
ugcaaucuuugccaa

SEQ ID NO: 1815956 - RNA, 22 nt, Homo sapiens
uuaggacauaaacccuugccag

SEQ ID NO: 1815957 - RNA, 18 nt, Homo sapiens
ucaauaugagucucaaua

SEQ ID NO: 1815958 - RNA, 11 nt, Homo sapiens
uacaucaaaaa

SEQ ID NO: 1815959 - RNA, 18 nt, Homo sapiens
ucaucaacagugagagac

SEQ ID NO: 1815960 - RNA, 14 nt, Homo sapiens
agagguggggugcu

SEQ ID NO: 1815961 - RNA, 16 nt, Homo sapiens
acagcuacagcuuucu

SEQ ID NO: 1815962 - RNA, 17 nt, Homo sapiens
aggguugaggggaccaa

SEQ ID NO: 1815963 - RNA, 12 nt, Homo sapiens
gggaaugcugcc

SEQ ID NO: 1815964 - RNA, 15 nt, Homo sapiens
ccugcgucauuucag

SEQ ID NO: 1815965 - RNA, 21 nt, Homo sapiens
uauauuccaccaggauauccu

SEQ ID NO: 1815966 - RNA, 16 nt, Homo sapiens
gaaauccaguuuccca

SEQ ID NO: 1815967 - RNA, 22 nt, Homo sapiens
agaaugguugaguuacauuaaa

SEQ ID NO: 1815968 - RNA, 17 nt, Homo sapiens
cauugauggccucaaug

SEQ ID NO: 1815969 - RNA, 13 nt, Homo sapiens
acaaaauauagcu

SEQ ID NO: 1815970 - RNA, 17 nt, Homo sapiens
uaauggccggcuggaaa

SEQ ID NO: 1815971 - RNA, 23 nt, Homo sapiens
gaggaguugucuguccuggucag

SEQ ID NO: 1815972 - RNA, 20 nt, Homo sapiens
aucccuuccucucaggcucu

SEQ ID NO: 1815973 - RNA, 17 nt, Homo sapiens
aguuuugcaaagugcaa

SEQ ID NO: 1815974 - RNA, 21 nt, Homo sapiens
cagaaagcaguucugaugcuu

SEQ ID NO: 1815975 - RNA, 14 nt, Homo sapiens
acagccguuugaau

SEQ ID NO: 1815976 - RNA, 23 nt, Homo sapiens
aagugcuggcauuacagguguga

SEQ ID NO: 1815977 - RNA, 18 nt, Homo sapiens
agucaaacuuucaccuca

SEQ ID NO: 1815978 - RNA, 18 nt, Homo sapiens
accccuccugcgcugccc

SEQ ID NO: 1815979 - RNA, 16 nt, Homo sapiens
gccuucucaccagcug

SEQ ID NO: 1815980 - RNA, 18 nt, Homo sapiens
aucuuguggcauauccau

SEQ ID NO: 1815981 - RNA, 16 nt, Homo sapiens
gcugccgagugcugug

SEQ ID NO: 1815982 - RNA, 22 nt, Homo sapiens
caacccugugaucuauaccacc

SEQ ID NO: 1815983 - RNA, 18 nt, Homo sapiens
acuucgacucaggaucca

SEQ ID NO: 1815984 - RNA, 19 nt, Homo sapiens
uggccgacucugcacucuc

SEQ ID NO: 1815985 - RNA, 16 nt, Homo sapiens
cuaaaugagauacacu

SEQ ID NO: 1815986 - RNA, 15 nt, Homo sapiens
cuguuugaacccagg

SEQ ID NO: 1815987 - RNA, 17 nt, Homo sapiens
uuuuuacuccaguggug

SEQ ID NO: 1815988 - RNA, 16 nt, Homo sapiens
uggcaggaaaauggac

SEQ ID NO: 1815989 - RNA, 13 nt, Homo sapiens
augacccacuguc

SEQ ID NO: 1815990 - RNA, 23 nt, Homo sapiens
cgggagcccuagcccugcuccaa

SEQ ID NO: 1815991 - RNA, 24 nt, Homo sapiens
gauggagcugcguuuccugugcau

SEQ ID NO: 1815992 - RNA, 14 nt, Homo sapiens
ucagaauugcacau

SEQ ID NO: 1815993 - RNA, 23 nt, Homo sapiens
gaggguccucaguccacugcuga

SEQ ID NO: 1815994 - RNA, 12 nt, Homo sapiens
acagagugcccu

SEQ ID NO: 1815995 - RNA, 19 nt, Homo sapiens
ucucucaucucuuagcucc

SEQ ID NO: 1815996 - RNA, 17 nt, Homo sapiens
cccaauuuacuugccau

SEQ ID NO: 1815997 - RNA, 15 nt, Homo sapiens
gcucguuucucucaa

SEQ ID NO: 1815998 - RNA, 12 nt, Homo sapiens
caccuguuggcu

SEQ ID NO: 1815999 - RNA, 11 nt, Homo sapiens
aaacuguacag

SEQ ID NO: 1816000 - RNA, 23 nt, Homo sapiens
uugauaauaaauuauacacuaug

SEQ ID NO: 1816001 - RNA, 18 nt, Homo sapiens
ccuggggaagcugugaaa

SEQ ID NO: 1816002 - RNA, 20 nt, Homo sapiens
gagauggggucuugcuauau

SEQ ID NO: 1816003 - RNA, 14 nt, Homo sapiens
gcuaaucuucaggg

SEQ ID NO: 1816004 - RNA, 11 nt, Homo sapiens
ucuguuuuccc

SEQ ID NO: 1816005 - RNA, 13 nt, Homo sapiens
uggaacaccuguc

SEQ ID NO: 1816006 - RNA, 18 nt, Homo sapiens
agagggcacacacugugu

SEQ ID NO: 1816007 - RNA, 13 nt, Homo sapiens
ugcccacagggaa

SEQ ID NO: 1816008 - RNA, 13 nt, Homo sapiens
aguaucuuaccug

SEQ ID NO: 1816009 - RNA, 20 nt, Homo sapiens
cuggagaccgcuucaccccu

SEQ ID NO: 1816010 - RNA, 22 nt, Homo sapiens
aagcagaaauccugcaaugaaa

SEQ ID NO: 1816011 - RNA, 12 nt, Homo sapiens
ugcuccaccagc

SEQ ID NO: 1816012 - RNA, 13 nt, Homo sapiens
gagcugcucagaa

SEQ ID NO: 1816013 - RNA, 21 nt, Homo sapiens
ucccaugguagacugugacac

SEQ ID NO: 1816014 - RNA, 14 nt, Homo sapiens
guaaaagugacaug

SEQ ID NO: 1816015 - RNA, 22 nt, Homo sapiens
cagaucuuugcugccagccacu

SEQ ID NO: 1816016 - RNA, 15 nt, Homo sapiens
gcugguuuucucuga

SEQ ID NO: 1816017 - RNA, 21 nt, Homo sapiens
gcauuuacagaaacgcaucca

SEQ ID NO: 1816018 - RNA, 17 nt, Homo sapiens
acaacauuauaacugua

SEQ ID NO: 1816019 - RNA, 21 nt, Homo sapiens
aggccacuuugagagggcuga

SEQ ID NO: 1816020 - RNA, 14 nt, Homo sapiens
caucccggggccau

SEQ ID NO: 1816021 - RNA, 19 nt, Homo sapiens
ucugggugaccucacuuua

SEQ ID NO: 1816022 - RNA, 18 nt, Homo sapiens
gccaauaacacacagcua

SEQ ID NO: 1816023 - RNA, 18 nt, Homo sapiens
gcaucuacuacucugucu

SEQ ID NO: 1816024 - RNA, 19 nt, Homo sapiens
gcacucagaaguugugcua

SEQ ID NO: 1816025 - RNA, 15 nt, Homo sapiens
aauauuuaucugauu

SEQ ID NO: 1816026 - RNA, 14 nt, Homo sapiens
cuacuacccauugu

SEQ ID NO: 1816027 - RNA, 23 nt, Homo sapiens
acuccuagauuuuguugaccuca

SEQ ID NO: 1816028 - RNA, 14 nt, Homo sapiens
agaugacaguauuu

SEQ ID NO: 1816029 - RNA, 21 nt, Homo sapiens
accaucuggcagacuuacaaa

SEQ ID NO: 1816030 - RNA, 18 nt, Homo sapiens
uagaacauggacuacaca

SEQ ID NO: 1816031 - RNA, 18 nt, Homo sapiens
uggcacugagaaagccaa

SEQ ID NO: 1816032 - RNA, 21 nt, Homo sapiens
gcuucagcccccaccagggga

SEQ ID NO: 1816033 - RNA, 20 nt, Homo sapiens
guugauaaauuccacuggac

SEQ ID NO: 1816034 - RNA, 16 nt, Homo sapiens
aacuucuaaacacaaa

SEQ ID NO: 1816035 - RNA, 16 nt, Homo sapiens
gucagccaagugcaga

SEQ ID NO: 1816036 - RNA, 16 nt, Homo sapiens
uaaguccaguguuucu

SEQ ID NO: 1816037 - RNA, 15 nt, Homo sapiens
ggcuguugcucagga

SEQ ID NO: 1816038 - RNA, 23 nt, Homo sapiens
ccugucuuggccucccaaagugc

SEQ ID NO: 1816039 - RNA, 23 nt, Homo sapiens
aacuuagagacuuuagagucuaa

SEQ ID NO: 1816040 - RNA, 23 nt, Homo sapiens
uaugcacaccuaagcccaaauau

SEQ ID NO: 1816041 - RNA, 13 nt, Homo sapiens
uuuguguuuacau

SEQ ID NO: 1816042 - RNA, 19 nt, Homo sapiens
ugcccacaagucccagcgc

SEQ ID NO: 1816043 - RNA, 15 nt, Homo sapiens
ccaaauucaccuucc

SEQ ID NO: 1816044 - RNA, 23 nt, Homo sapiens
cuggcuuuacauggguucaauug

SEQ ID NO: 1816045 - RNA, 17 nt, Homo sapiens
acuaacuuacuguccac

SEQ ID NO: 1816046 - RNA, 11 nt, Homo sapiens
guguacaggga

SEQ ID NO: 1816047 - RNA, 19 nt, Homo sapiens
uaaugauucugauauguau

SEQ ID NO: 1816048 - RNA, 11 nt, Homo sapiens
gacuguguuca

SEQ ID NO: 1816049 - RNA, 22 nt, Homo sapiens
ugguuuaccuggggauccaauu

SEQ ID NO: 1816050 - RNA, 22 nt, Homo sapiens
cuuucaucuugaaguuacacau

SEQ ID NO: 1816051 - RNA, 14 nt, Homo sapiens
uaagucucugugaa

SEQ ID NO: 1816052 - RNA, 13 nt, Homo sapiens
gucuagugucugg

SEQ ID NO: 1816053 - RNA, 14 nt, Homo sapiens
aagcuaaugucaca

SEQ ID NO: 1816054 - RNA, 21 nt, Homo sapiens
ucucauuuauauugcagauug

SEQ ID NO: 1816055 - RNA, 13 nt, Homo sapiens
uuuucuaaucuug

SEQ ID NO: 1816056 - RNA, 21 nt, Homo sapiens
ggauguuaugaacagcugugu

SEQ ID NO: 1816057 - RNA, 23 nt, Homo sapiens
uacaaguuguuauuguugaacau

SEQ ID NO: 1816058 - RNA, 15 nt, Homo sapiens
auggcauccugugaa

SEQ ID NO: 1816059 - RNA, 22 nt, Homo sapiens
agcuuucaaggauaggcuuuau

SEQ ID NO: 1816060 - RNA, 21 nt, Homo sapiens
ccccagguaucugaugauguu

SEQ ID NO: 1816061 - RNA, 16 nt, Homo sapiens
acccccaggucugcag

SEQ ID NO: 1816062 - RNA, 17 nt, Homo sapiens
aauuauuacaucuuuau

SEQ ID NO: 1816063 - RNA, 17 nt, Homo sapiens
agugggugguagcagag

SEQ ID NO: 1816064 - RNA, 14 nt, Homo sapiens
uucaacuacaguga

SEQ ID NO: 1816065 - RNA, 13 nt, Homo sapiens
cuggaaagcacaa

SEQ ID NO: 1816066 - RNA, 12 nt, Homo sapiens
uaaaacaauucu

SEQ ID NO: 1816067 - RNA, 11 nt, Homo sapiens
uuacacaggag

SEQ ID NO: 1816068 - RNA, 19 nt, Homo sapiens
uuuucaagcaaaacaguuc

SEQ ID NO: 1816069 - RNA, 16 nt, Homo sapiens
aaaugcuuuuagaaug

SEQ ID NO: 1816070 - RNA, 21 nt, Homo sapiens
aaacuagcagaagaacuagua

SEQ ID NO: 1816071 - RNA, 20 nt, Homo sapiens
cacuugguucuuguacucua

SEQ ID NO: 1816072 - RNA, 12 nt, Homo sapiens
aacuuaauguuc

SEQ ID NO: 1816073 - RNA, 12 nt, Homo sapiens
auuaacaugaug

SEQ ID NO: 1816074 - RNA, 18 nt, Homo sapiens
uucuuauuggccaaaugc

SEQ ID NO: 1816075 - RNA, 21 nt, Homo sapiens
cucuacccugugcuaagcacg

SEQ ID NO: 1816076 - RNA, 16 nt, Homo sapiens
aaaucacucucagugc

SEQ ID NO: 1816077 - RNA, 18 nt, Homo sapiens
uacucuuaacuccuagcc

SEQ ID NO: 1816078 - RNA, 21 nt, Homo sapiens
caucccucaacugagggccag

SEQ ID NO: 1816079 - RNA, 19 nt, Homo sapiens
ugugacaacacucaucaca

SEQ ID NO: 1816080 - RNA, 23 nt, Homo sapiens
uucucccacaugaggccaucuca

SEQ ID NO: 1816081 - RNA, 19 nt, Homo sapiens
gauucccuguucuuugaag

SEQ ID NO: 1816082 - RNA, 18 nt, Homo sapiens
agcagcacgauuuugcac

SEQ ID NO: 1816083 - RNA, 14 nt, Homo sapiens
uaaaauugcacuuu

SEQ ID NO: 1816084 - RNA, 17 nt, Homo sapiens
uaucaaaaagacugugg

SEQ ID NO: 1816085 - RNA, 16 nt, Homo sapiens
aaccaagaaaaaggaa

SEQ ID NO: 1816086 - RNA, 22 nt, Homo sapiens
ucccugcccagccuguggugcu

SEQ ID NO: 1816087 - RNA, 17 nt, Homo sapiens
uccuuaaacuccuguga

SEQ ID NO: 1816088 - RNA, 16 nt, Homo sapiens
aaagaucucugucaca

SEQ ID NO: 1816089 - RNA, 17 nt, Homo sapiens
aauuguuuuuugcucuu

SEQ ID NO: 1816090 - RNA, 15 nt, Homo sapiens
gcagagcucagagga

SEQ ID NO: 1816091 - RNA, 23 nt, Homo sapiens
ccacggagggaggcaccaugcaa

SEQ ID NO: 1816092 - RNA, 16 nt, Homo sapiens
ccaaagaagccuugcc

SEQ ID NO: 1816093 - RNA, 22 nt, Homo sapiens
cgaucaaguuguugacugugau

SEQ ID NO: 1816094 - RNA, 21 nt, Homo sapiens
cuuaagggaacugaaucacuu

SEQ ID NO: 1816095 - RNA, 15 nt, Homo sapiens
aggucacacagugau

SEQ ID NO: 1816096 - RNA, 14 nt, Homo sapiens
uccaggaacugccu

SEQ ID NO: 1816097 - RNA, 20 nt, Homo sapiens
guauauagaugucuguguau

SEQ ID NO: 1816098 - RNA, 24 nt, Homo sapiens
auuauaguaacuauaagauacaau

SEQ ID NO: 1816099 - RNA, 20 nt, Homo sapiens
cucagcuuggcacucaggug

SEQ ID NO: 1816100 - RNA, 16 nt, Homo sapiens
gcucuguggaugccag

SEQ ID NO: 1816101 - RNA, 16 nt, Homo sapiens
cagcugacccggccuc

SEQ ID NO: 1816102 - RNA, 19 nt, Homo sapiens
ucuuucucccucaccccca

SEQ ID NO: 1816103 - RNA, 14 nt, Homo sapiens
uauuuaaguucaca

SEQ ID NO: 1816104 - RNA, 14 nt, Homo sapiens
ggguuagagccaag

SEQ ID NO: 1816105 - RNA, 19 nt, Homo sapiens
uagcuuuagaaacagugca

SEQ ID NO: 1816106 - RNA, 15 nt, Homo sapiens
ucagugucagcacuc

SEQ ID NO: 1816107 - RNA, 17 nt, Homo sapiens
caaccaggccuucaucc

SEQ ID NO: 1816108 - RNA, 16 nt, Homo sapiens
acagcaugguaaugaa

SEQ ID NO: 1816109 - RNA, 14 nt, Homo sapiens
aggccaccucugcc

SEQ ID NO: 1816110 - RNA, 18 nt, Homo sapiens
acauuagaagacaauuga

SEQ ID NO: 1816111 - RNA, 13 nt, Homo sapiens
uaauaaaaagcca

SEQ ID NO: 1816112 - RNA, 21 nt, Homo sapiens
cgaccgcccaacguuugccuc

SEQ ID NO: 1816113 - RNA, 15 nt, Homo sapiens
gcucccugacugggg

SEQ ID NO: 1816114 - RNA, 22 nt, Homo sapiens
ugugacaaagaagaccacaaau

SEQ ID NO: 1816115 - RNA, 18 nt, Homo sapiens
cagaaugaacccuccucc

SEQ ID NO: 1816116 - RNA, 14 nt, Homo sapiens
uuuccaccaagugu

SEQ ID NO: 1816117 - RNA, 11 nt, Homo sapiens
gaguucucacu

SEQ ID NO: 1816118 - RNA, 14 nt, Homo sapiens
caguugacuuuaag

SEQ ID NO: 1816119 - RNA, 22 nt, Homo sapiens
gccgggaaugagcuugugugcc

SEQ ID NO: 1816120 - RNA, 14 nt, Homo sapiens
auuuccauauucug

SEQ ID NO: 1816121 - RNA, 13 nt, Homo sapiens
caaaggaccucag

SEQ ID NO: 1816122 - RNA, 20 nt, Homo sapiens
uugccuuuugcaaccaggaa

SEQ ID NO: 1816123 - RNA, 16 nt, Homo sapiens
uccaggcugcauuugu

SEQ ID NO: 1816124 - RNA, 20 nt, Homo sapiens
uaauacuaaguccucagagc

SEQ ID NO: 1816125 - RNA, 23 nt, Homo sapiens
gauuuuuagaaaucagcuaccca

SEQ ID NO: 1816126 - RNA, 14 nt, Homo sapiens
acuugccauugcca

SEQ ID NO: 1816127 - RNA, 13 nt, Homo sapiens
gguagacugaggg

SEQ ID NO: 1816128 - RNA, 21 nt, Homo sapiens
agacauaguaccgaauuuagu

SEQ ID NO: 1816129 - RNA, 17 nt, Homo sapiens
ccuguuugucuacauau

SEQ ID NO: 1816130 - RNA, 13 nt, Homo sapiens
cucccucauucca

SEQ ID NO: 1816131 - RNA, 14 nt, Homo sapiens
ccagccacugugau

SEQ ID NO: 1816132 - RNA, 16 nt, Homo sapiens
cccuuaauaaacucac

SEQ ID NO: 1816133 - RNA, 18 nt, Homo sapiens
gcugccucucuucugugu

SEQ ID NO: 1816134 - RNA, 11 nt, Homo sapiens
gggaaccauga

SEQ ID NO: 1816135 - RNA, 22 nt, Homo sapiens
uucaaguaauucugcugucuca

SEQ ID NO: 1816136 - RNA, 14 nt, Homo sapiens
ucagaagcacaaag

SEQ ID NO: 1816137 - RNA, 23 nt, Homo sapiens
caacaaaagaauuuuuguuugga

SEQ ID NO: 1816138 - RNA, 14 nt, Homo sapiens
uaaagggcaaagga

SEQ ID NO: 1816139 - RNA, 22 nt, Homo sapiens
cugggagccggaggcugcagug

SEQ ID NO: 1816140 - RNA, 12 nt, Homo sapiens
uaugaacacaga

SEQ ID NO: 1816141 - RNA, 14 nt, Homo sapiens
gauucaaagcccaa

SEQ ID NO: 1816142 - RNA, 15 nt, Homo sapiens
uaacuuucucuguga

SEQ ID NO: 1816143 - RNA, 19 nt, Homo sapiens
cuggacacccucaccaccc

SEQ ID NO: 1816144 - RNA, 17 nt, Homo sapiens
cacauugaaacuguauu

SEQ ID NO: 1816145 - RNA, 20 nt, Homo sapiens
uuggaaaucaguugugaaua

SEQ ID NO: 1816146 - RNA, 15 nt, Homo sapiens
ccuuuagucuguugu

SEQ ID NO: 1816147 - RNA, 22 nt, Homo sapiens
gaaauuaaauguuuauaauuua

SEQ ID NO: 1816148 - RNA, 15 nt, Homo sapiens
acauccaagccagag

SEQ ID NO: 1816149 - RNA, 16 nt, Homo sapiens
gcucccagagaccuug

SEQ ID NO: 1816150 - RNA, 17 nt, Homo sapiens
cagggcagggcucugau

SEQ ID NO: 1816151 - RNA, 17 nt, Homo sapiens
caggccagugcugugag

SEQ ID NO: 1816152 - RNA, 14 nt, Homo sapiens
cuuugaauguauug

SEQ ID NO: 1816153 - RNA, 15 nt, Homo sapiens
uagucaauguaaaaa

SEQ ID NO: 1816154 - RNA, 23 nt, Homo sapiens
caguggugugugaaguuuggaga

SEQ ID NO: 1816155 - RNA, 17 nt, Homo sapiens
gcagaggugagaacuca

SEQ ID NO: 1816156 - RNA, 17 nt, Homo sapiens
auaaugucccuucacaa

SEQ ID NO: 1816157 - RNA, 17 nt, Homo sapiens
cccaucagcaccaugga

SEQ ID NO: 1816158 - RNA, 18 nt, Homo sapiens
uggaagggaaaagcccau

SEQ ID NO: 1816159 - RNA, 17 nt, Homo sapiens
cuugacagaacacuguc

SEQ ID NO: 1816160 - RNA, 19 nt, Homo sapiens
cauggccuaugcacauaug

SEQ ID NO: 1816161 - RNA, 16 nt, Homo sapiens
cuuuuccaagcuccuu

SEQ ID NO: 1816162 - RNA, 14 nt, Homo sapiens
auaucaacucugaa

SEQ ID NO: 1816163 - RNA, 14 nt, Homo sapiens
ggaggagcugugcu

SEQ ID NO: 1816164 - RNA, 20 nt, Homo sapiens
guaucuagcucuaguucaaa

SEQ ID NO: 1816165 - RNA, 13 nt, Homo sapiens
uuuugucuuucaa

SEQ ID NO: 1816166 - RNA, 14 nt, Homo sapiens
uggauucaacacug

SEQ ID NO: 1816167 - RNA, 22 nt, Homo sapiens
cugggauuauaggcaugagcca

SEQ ID NO: 1816168 - RNA, 20 nt, Homo sapiens
gagagaugaaccacauuaua

SEQ ID NO: 1816169 - RNA, 12 nt, Homo sapiens
gccuugaugaaa

SEQ ID NO: 1816170 - RNA, 17 nt, Homo sapiens
agccccugccucgagga

SEQ ID NO: 1816171 - RNA, 23 nt, Homo sapiens
ugggacucggagacuauggccuc

SEQ ID NO: 1816172 - RNA, 18 nt, Homo sapiens
uaaggcagcuaagacaua

SEQ ID NO: 1816173 - RNA, 17 nt, Homo sapiens
caggcagauaacugcug

SEQ ID NO: 1816174 - RNA, 21 nt, Homo sapiens
cauucuuaaauauuuccauca

SEQ ID NO: 1816175 - RNA, 14 nt, Homo sapiens
gacacccaacacuu

SEQ ID NO: 1816176 - RNA, 21 nt, Homo sapiens
gaaaaauacguuuuguguaua

SEQ ID NO: 1816177 - RNA, 21 nt, Homo sapiens
gucuugagaggagacuuguga

SEQ ID NO: 1816178 - RNA, 22 nt, Homo sapiens
auacgcaaacacaccgaugcac

SEQ ID NO: 1816179 - RNA, 22 nt, Homo sapiens
cucaagcaugaagauaaacaca

SEQ ID NO: 1816180 - RNA, 16 nt, Homo sapiens
acucugcauacccuca

SEQ ID NO: 1816181 - RNA, 23 nt, Homo sapiens
ggacauaaugggguccuggccau

SEQ ID NO: 1816182 - RNA, 17 nt, Homo sapiens
cauacuagaguucaugg

SEQ ID NO: 1816183 - RNA, 21 nt, Homo sapiens
agcacagauggccagccccuu

SEQ ID NO: 1816184 - RNA, 19 nt, Homo sapiens
uccauacagucaagauaca

SEQ ID NO: 1816185 - RNA, 19 nt, Homo sapiens
ccauuugcagaguccugca

SEQ ID NO: 1816186 - RNA, 21 nt, Homo sapiens
aucaaauauauuauuuaguca

SEQ ID NO: 1816187 - RNA, 17 nt, Homo sapiens
agccugguuucugggug

SEQ ID NO: 1816188 - RNA, 14 nt, Homo sapiens
uugaaacacaagaa

SEQ ID NO: 1816189 - RNA, 21 nt, Homo sapiens
acacgaucaccugcaucacag

SEQ ID NO: 1816190 - RNA, 17 nt, Homo sapiens
agaugccuggugagcag

SEQ ID NO: 1816191 - RNA, 14 nt, Homo sapiens
gaccguuguuaaca

SEQ ID NO: 1816192 - RNA, 16 nt, Homo sapiens
cugggagaaccucagg

SEQ ID NO: 1816193 - RNA, 13 nt, Homo sapiens
cacuugacaucaa

SEQ ID NO: 1816194 - RNA, 16 nt, Homo sapiens
aaaacacagccucccu

SEQ ID NO: 1816195 - RNA, 20 nt, Homo sapiens
aaucuucaagguguaaaaua

SEQ ID NO: 1816196 - RNA, 20 nt, Homo sapiens
aggcgccugccaucaugccu

SEQ ID NO: 1816197 - RNA, 19 nt, Homo sapiens
auauuuuugguugucaaua

SEQ ID NO: 1816198 - RNA, 14 nt, Homo sapiens
ggguuacuauuucu

SEQ ID NO: 1816199 - RNA, 22 nt, Homo sapiens
augccagggcuggaagcuuuca

SEQ ID NO: 1816200 - RNA, 17 nt, Homo sapiens
aaauuucuaucagccuu

SEQ ID NO: 1816201 - RNA, 22 nt, Homo sapiens
uaguuguaauuuuuuuguggga

SEQ ID NO: 1816202 - RNA, 16 nt, Homo sapiens
ugauagagccuuugau

SEQ ID NO: 1816203 - RNA, 18 nt, Homo sapiens
ugaggcuggcacaggaca

SEQ ID NO: 1816204 - RNA, 23 nt, Homo sapiens
augaggucuucccgcaaggccuc

SEQ ID NO: 1816205 - RNA, 12 nt, Homo sapiens
ugcugcugauac

SEQ ID NO: 1816206 - RNA, 21 nt, Homo sapiens
uuaaaaaagauaaacacaaga

SEQ ID NO: 1816207 - RNA, 14 nt, Homo sapiens
ugaguggucuucaa

SEQ ID NO: 1816208 - RNA, 16 nt, Homo sapiens
gcaguucugcacccag

SEQ ID NO: 1816209 - RNA, 19 nt, Homo sapiens
cuuagcccuuccccucugc

SEQ ID NO: 1816210 - RNA, 23 nt, Homo sapiens
cuacugaaaggcaguagucauuu

SEQ ID NO: 1816211 - RNA, 17 nt, Homo sapiens
acagagauguccaaacu

SEQ ID NO: 1816212 - RNA, 23 nt, Homo sapiens
uaugugaguguguccaagugugu

SEQ ID NO: 1816213 - RNA, 13 nt, Homo sapiens
uagacccucucaa

SEQ ID NO: 1816214 - RNA, 20 nt, Homo sapiens
cuucucagagcagcacuggg

SEQ ID NO: 1816215 - RNA, 23 nt, Homo sapiens
aggauuauuuuaaauacaaaagg

SEQ ID NO: 1816216 - RNA, 20 nt, Homo sapiens
cgcuaccagcagacucugga

SEQ ID NO: 1816217 - RNA, 13 nt, Homo sapiens
cucugaacugcac

SEQ ID NO: 1816218 - RNA, 13 nt, Homo sapiens
uaucaacuguuga

SEQ ID NO: 1816219 - RNA, 15 nt, Homo sapiens
gagggaguuacugaa

SEQ ID NO: 1816220 - RNA, 21 nt, Homo sapiens
aaagaggcagucuucuuagca

SEQ ID NO: 1816221 - RNA, 18 nt, Homo sapiens
ugggaacccgacugugaa

SEQ ID NO: 1816222 - RNA, 20 nt, Homo sapiens
cuguauacuuuaguaugacg

SEQ ID NO: 1816223 - RNA, 19 nt, Homo sapiens
agugaaugaaacacucagu

SEQ ID NO: 1816224 - RNA, 13 nt, Homo sapiens
uaacaugcaccuu

SEQ ID NO: 1816225 - RNA, 13 nt, Homo sapiens
ucuucucauuuca

SEQ ID NO: 1816226 - RNA, 20 nt, Homo sapiens
gagcauuugguacacacuug

SEQ ID NO: 1816227 - RNA, 15 nt, Homo sapiens
auuucuauuccuuau

SEQ ID NO: 1816228 - RNA, 13 nt, Homo sapiens
gagacccugccac

SEQ ID NO: 1816229 - RNA, 23 nt, Homo sapiens
cuuggggaggcugauuucucaca

SEQ ID NO: 1816230 - RNA, 21 nt, Homo sapiens
gugcaggauauuugcacuauu

SEQ ID NO: 1816231 - RNA, 17 nt, Homo sapiens
acgcagacacugagauc

SEQ ID NO: 1816232 - RNA, 18 nt, Homo sapiens
auagcauuuguguaaaga

SEQ ID NO: 1816233 - RNA, 17 nt, Homo sapiens
cccugcaguuugagaca

SEQ ID NO: 1816234 - RNA, 17 nt, Homo sapiens
uaaaauggaauaacaua

SEQ ID NO: 1816235 - RNA, 16 nt, Homo sapiens
uaccacuaacuccuga

SEQ ID NO: 1816236 - RNA, 19 nt, Homo sapiens
ugaagcuccuacacagguc

SEQ ID NO: 1816237 - RNA, 18 nt, Homo sapiens
ggaauggcaggugucaua

SEQ ID NO: 1816238 - RNA, 18 nt, Homo sapiens
ugguuccuuggggggcca

SEQ ID NO: 1816239 - RNA, 20 nt, Homo sapiens
aauagcaaccuuuuuaucuc

SEQ ID NO: 1816240 - RNA, 18 nt, Homo sapiens
augaaaaagauauaugaa

SEQ ID NO: 1816241 - RNA, 19 nt, Homo sapiens
uccuuuucuuuuguuacug

SEQ ID NO: 1816242 - RNA, 17 nt, Homo sapiens
ccccaacccuuccacac

SEQ ID NO: 1816243 - RNA, 17 nt, Homo sapiens
agggaagcagccuggaa

SEQ ID NO: 1816244 - RNA, 14 nt, Homo sapiens
cacaaaugcagaca

SEQ ID NO: 1816245 - RNA, 20 nt, Homo sapiens
aacgacugccgugacaucau

SEQ ID NO: 1816246 - RNA, 15 nt, Homo sapiens
uauuaacccuaccug

SEQ ID NO: 1816247 - RNA, 13 nt, Homo sapiens
uucuuuaaucaca

SEQ ID NO: 1816248 - RNA, 13 nt, Homo sapiens
aucuauaaacacu

SEQ ID NO: 1816249 - RNA, 23 nt, Homo sapiens
ucccggcaagcgcuucugcugaa

SEQ ID NO: 1816250 - RNA, 19 nt, Homo sapiens
uguacaggugucaccauca

SEQ ID NO: 1816251 - RNA, 14 nt, Homo sapiens
ugugugggcuguga

SEQ ID NO: 1816252 - RNA, 22 nt, Homo sapiens
ucucaacuucucagacguucca

SEQ ID NO: 1816253 - RNA, 16 nt, Homo sapiens
ugaccuucagagccag

SEQ ID NO: 1816254 - RNA, 15 nt, Homo sapiens
uuucuccccauuugg

SEQ ID NO: 1816255 - RNA, 18 nt, Homo sapiens
ucacagaagcacagcacc

SEQ ID NO: 1816256 - RNA, 20 nt, Homo sapiens
aagcacaugccucucucagg

SEQ ID NO: 1816257 - RNA, 18 nt, Homo sapiens
gaaugguuucaacaaaga

SEQ ID NO: 1816258 - RNA, 17 nt, Homo sapiens
caaaguaccuugaacuc

SEQ ID NO: 1816259 - RNA, 16 nt, Homo sapiens
auccagagcagaguuu

SEQ ID NO: 1816260 - RNA, 12 nt, Homo sapiens
aacgaccaaacu

SEQ ID NO: 1816261 - RNA, 14 nt, Homo sapiens
auauuuuucaacca

SEQ ID NO: 1816262 - RNA, 20 nt, Homo sapiens
gaaacccguguaucugggau

SEQ ID NO: 1816263 - RNA, 14 nt, Homo sapiens
gucagaaguucaag

SEQ ID NO: 1816264 - RNA, 16 nt, Homo sapiens
cccaggucugaucugg

SEQ ID NO: 1816265 - RNA, 18 nt, Homo sapiens
augccuaguuucuuacac

SEQ ID NO: 1816266 - RNA, 15 nt, Homo sapiens
agcugaaaauggaga

SEQ ID NO: 1816267 - RNA, 23 nt, Homo sapiens
uugcagacgggcaagaagcugcu

SEQ ID NO: 1816268 - RNA, 14 nt, Homo sapiens
uuauuuugauugau

SEQ ID NO: 1816269 - RNA, 21 nt, Homo sapiens
uguacaaauaauauugccuug

SEQ ID NO: 1816270 - RNA, 16 nt, Homo sapiens
ggcucucaacagggga

SEQ ID NO: 1816271 - RNA, 15 nt, Homo sapiens
ucuuguuaagugcag

SEQ ID NO: 1816272 - RNA, 19 nt, Homo sapiens
cacccucuggggacaggau

SEQ ID NO: 1816273 - RNA, 22 nt, Homo sapiens
ccagaaacuuuccaucccaaag

SEQ ID NO: 1816274 - RNA, 21 nt, Homo sapiens
uuuagacucaaagaauauaau

SEQ ID NO: 1816275 - RNA, 15 nt, Homo sapiens
uuuagaauaaaucaa

SEQ ID NO: 1816276 - RNA, 13 nt, Homo sapiens
cucaccugaauaa

SEQ ID NO: 1816277 - RNA, 19 nt, Homo sapiens
cagugcugcccaugagcaa

SEQ ID NO: 1816278 - RNA, 14 nt, Homo sapiens
uccauccaguuccu

SEQ ID NO: 1816279 - RNA, 13 nt, Homo sapiens
gacacugggagaa

SEQ ID NO: 1816280 - RNA, 14 nt, Homo sapiens
cuaggccuaguccu

SEQ ID NO: 1816281 - RNA, 15 nt, Homo sapiens
ucacaguuggcacuu

SEQ ID NO: 1816282 - RNA, 22 nt, Homo sapiens
cuuuacuaagaugacauugcua

SEQ ID NO: 1816283 - RNA, 22 nt, Homo sapiens
cugugccccuugacaacuggca

SEQ ID NO: 1816284 - RNA, 16 nt, Homo sapiens
aucuaugauuccaggu

SEQ ID NO: 1816285 - RNA, 16 nt, Homo sapiens
auauuuuauuacuguu

SEQ ID NO: 1816286 - RNA, 19 nt, Homo sapiens
gcuaauuguacuaaucuga

SEQ ID NO: 1816287 - RNA, 23 nt, Homo sapiens
acuuccugguugagcuucugcua

SEQ ID NO: 1816288 - RNA, 19 nt, Homo sapiens
gugggucuaccucaucucu

SEQ ID NO: 1816289 - RNA, 16 nt, Homo sapiens
uggccaaugcauccaa

SEQ ID NO: 1816290 - RNA, 17 nt, Homo sapiens
uguguuuuugccacuga

SEQ ID NO: 1816291 - RNA, 17 nt, Homo sapiens
uacaaagaaaaagccaa

SEQ ID NO: 1816292 - RNA, 23 nt, Homo sapiens
uggucgccugcauuucuccgugc

SEQ ID NO: 1816293 - RNA, 18 nt, Homo sapiens
gaacacucuuuugcuuua

SEQ ID NO: 1816294 - RNA, 22 nt, Homo sapiens
gaauacaggaggcagacaauga

SEQ ID NO: 1816295 - RNA, 16 nt, Homo sapiens
uucauuuucuuuccuu

SEQ ID NO: 1816296 - RNA, 22 nt, Homo sapiens
caggcagguaaccccagauuca

SEQ ID NO: 1816297 - RNA, 13 nt, Homo sapiens
ugcuucgagccau

SEQ ID NO: 1816298 - RNA, 18 nt, Homo sapiens
ggccucaucucugccuga

SEQ ID NO: 1816299 - RNA, 16 nt, Homo sapiens
uuugcccuucacuguu

SEQ ID NO: 1816300 - RNA, 19 nt, Homo sapiens
cucaggcacacagcuacuc

SEQ ID NO: 1816301 - RNA, 11 nt, Homo sapiens
acucaccugcg

SEQ ID NO: 1816302 - RNA, 22 nt, Homo sapiens
gauugcaaggaaggaaacaaug

SEQ ID NO: 1816303 - RNA, 15 nt, Homo sapiens
ugaacuuacacugua

SEQ ID NO: 1816304 - RNA, 17 nt, Homo sapiens
uucaaauuauaaaccaa

SEQ ID NO: 1816305 - RNA, 20 nt, Homo sapiens
gagcccuucacuccugagaa

SEQ ID NO: 1816306 - RNA, 20 nt, Homo sapiens
gucuucagaggcucaucuaa

SEQ ID NO: 1816307 - RNA, 22 nt, Homo sapiens
cuacugucagcgagcugugcaa

SEQ ID NO: 1816308 - RNA, 22 nt, Homo sapiens
cacagggggauucugagcagug

SEQ ID NO: 1816309 - RNA, 20 nt, Homo sapiens
aauguuuagcaaauacauau

SEQ ID NO: 1816310 - RNA, 23 nt, Homo sapiens
cugggggcgcuguuccacaguga

SEQ ID NO: 1816311 - RNA, 15 nt, Homo sapiens
uccuucaccaaagau

SEQ ID NO: 1816312 - RNA, 13 nt, Homo sapiens
gucauuguucucc

SEQ ID NO: 1816313 - RNA, 23 nt, Homo sapiens
uacagaugacucacuccauuccu

SEQ ID NO: 1816314 - RNA, 16 nt, Homo sapiens
agaaaaaaaguaggaa

SEQ ID NO: 1816315 - RNA, 22 nt, Homo sapiens
gcuucagccaggucugacucca

SEQ ID NO: 1816316 - RNA, 15 nt, Homo sapiens
ucaggggcucugugu

SEQ ID NO: 1816317 - RNA, 13 nt, Homo sapiens
ucuauaaauaacc

SEQ ID NO: 1816318 - RNA, 15 nt, Homo sapiens
ucuggggcucaagca

SEQ ID NO: 1816319 - RNA, 23 nt, Homo sapiens
gaaaaauauugcugaacuacuuu

SEQ ID NO: 1816320 - RNA, 22 nt, Homo sapiens
auacuugcauccaagguucuag

SEQ ID NO: 1816321 - RNA, 20 nt, Homo sapiens
uuuacgaucuguuuccaaau

SEQ ID NO: 1816322 - RNA, 13 nt, Homo sapiens
gccaugggccagc

SEQ ID NO: 1816323 - RNA, 20 nt, Homo sapiens
gaacuccccuugaaaacugc

SEQ ID NO: 1816324 - RNA, 17 nt, Homo sapiens
aguucugauucauuuga

SEQ ID NO: 1816325 - RNA, 12 nt, Homo sapiens
gcauagccuuuc

SEQ ID NO: 1816326 - RNA, 17 nt, Homo sapiens
auauauuucagauauca

SEQ ID NO: 1816327 - RNA, 18 nt, Homo sapiens
guuugcagaaaagcaccu

SEQ ID NO: 1816328 - RNA, 22 nt, Homo sapiens
aguuuccaauuauuugacuuua

SEQ ID NO: 1816329 - RNA, 19 nt, Homo sapiens
ugaaugucaaacagugcca

SEQ ID NO: 1816330 - RNA, 21 nt, Homo sapiens
ugaggaaaaaaaaucaggcau

SEQ ID NO: 1816331 - RNA, 18 nt, Homo sapiens
cuuuuaaaugaccaaaga

SEQ ID NO: 1816332 - RNA, 16 nt, Homo sapiens
gguucaaaccugugaa

SEQ ID NO: 1816333 - RNA, 15 nt, Homo sapiens
gaggcuccagcaucu

SEQ ID NO: 1816334 - RNA, 20 nt, Homo sapiens
aaggaguacaaugcccagau

SEQ ID NO: 1816335 - RNA, 12 nt, Homo sapiens
caugugugcaaa

SEQ ID NO: 1816336 - RNA, 20 nt, Homo sapiens
gacuuucuguguaccacugg

SEQ ID NO: 1816337 - RNA, 19 nt, Homo sapiens
aggugggcagaucauuuga

SEQ ID NO: 1816338 - RNA, 16 nt, Homo sapiens
agaauacuuugcuuca

SEQ ID NO: 1816339 - RNA, 18 nt, Homo sapiens
auuguccauuacuugcca

SEQ ID NO: 1816340 - RNA, 13 nt, Homo sapiens
ucccucuuguccu

SEQ ID NO: 1816341 - RNA, 20 nt, Homo sapiens
ugcacagccauggcuggaau

SEQ ID NO: 1816342 - RNA, 23 nt, Homo sapiens
acccccuccagcuccaguuucca

SEQ ID NO: 1816343 - RNA, 18 nt, Homo sapiens
uaaagcuccuuuggcaga

SEQ ID NO: 1816344 - RNA, 14 nt, Homo sapiens
ucucaauguacaua

SEQ ID NO: 1816345 - RNA, 16 nt, Homo sapiens
ucuauucaagcacuua

SEQ ID NO: 1816346 - RNA, 20 nt, Homo sapiens
acucuuuccccagcugauua

SEQ ID NO: 1816347 - RNA, 23 nt, Homo sapiens
gcuuauguuacagguuacgugag

SEQ ID NO: 1816348 - RNA, 15 nt, Homo sapiens
uaugaagaguauuaa

SEQ ID NO: 1816349 - RNA, 22 nt, Homo sapiens
aaggcaggaggaucacuugagc

SEQ ID NO: 1816350 - RNA, 18 nt, Homo sapiens
cagaccuucaacuuccaa

SEQ ID NO: 1816351 - RNA, 20 nt, Homo sapiens
augaagccaagugggauuug

SEQ ID NO: 1816352 - RNA, 20 nt, Homo sapiens
ccuccuuucccaacacuuca

SEQ ID NO: 1816353 - RNA, 21 nt, Homo sapiens
cuaggauaagcacuagaucuc

SEQ ID NO: 1816354 - RNA, 16 nt, Homo sapiens
gagaauguuccagaca

SEQ ID NO: 1816355 - RNA, 16 nt, Homo sapiens
gcugaggcagaacuca

SEQ ID NO: 1816356 - RNA, 16 nt, Homo sapiens
augcuggcuguuggcu

SEQ ID NO: 1816357 - RNA, 17 nt, Homo sapiens
gaaaauccaggucaugc

SEQ ID NO: 1816358 - RNA, 17 nt, Homo sapiens
auuaucucuuugaucua

SEQ ID NO: 1816359 - RNA, 15 nt, Homo sapiens
acugugaaaccacua

SEQ ID NO: 1816360 - RNA, 15 nt, Homo sapiens
uuucauugcacuuuc

SEQ ID NO: 1816361 - RNA, 22 nt, Homo sapiens
cagugugccccccauccuggcc

SEQ ID NO: 1816362 - RNA, 16 nt, Homo sapiens
agcagcaccucagcca

SEQ ID NO: 1816363 - RNA, 20 nt, Homo sapiens
aacaaaaaagaaaaguagaa

SEQ ID NO: 1816364 - RNA, 16 nt, Homo sapiens
caaauaaaaugaaaua

SEQ ID NO: 1816365 - RNA, 21 nt, Homo sapiens
auggcuaacaccucccugggc

SEQ ID NO: 1816366 - RNA, 22 nt, Homo sapiens
uggccaggagguuggugacuga

SEQ ID NO: 1816367 - RNA, 21 nt, Homo sapiens
cccaguguuugggguguuuca

SEQ ID NO: 1816368 - RNA, 20 nt, Homo sapiens
gaaaauuggaacucuacuca

SEQ ID NO: 1816369 - RNA, 21 nt, Homo sapiens
cugaaugcaccauggucaaaa

SEQ ID NO: 1816370 - RNA, 16 nt, Homo sapiens
accaccccuugcccaa

SEQ ID NO: 1816371 - RNA, 15 nt, Homo sapiens
cugauggcacucugu

SEQ ID NO: 1816372 - RNA, 14 nt, Homo sapiens
cgacugcaaagcca

SEQ ID NO: 1816373 - RNA, 16 nt, Homo sapiens
cugccuuggacaccau

SEQ ID NO: 1816374 - RNA, 14 nt, Homo sapiens
uaagaaagugcgag

SEQ ID NO: 1816375 - RNA, 12 nt, Homo sapiens
ggacuaccucug

SEQ ID NO: 1816376 - RNA, 20 nt, Homo sapiens
cuggacuggcccuugcccaa

SEQ ID NO: 1816377 - RNA, 11 nt, Homo sapiens
uauaacagugu

SEQ ID NO: 1816378 - RNA, 20 nt, Homo sapiens
guccccaaauugcuaccucu

SEQ ID NO: 1816379 - RNA, 16 nt, Homo sapiens
ccugcaccgccgccac

SEQ ID NO: 1816380 - RNA, 12 nt, Homo sapiens
gccaugcccuua

SEQ ID NO: 1816381 - RNA, 15 nt, Homo sapiens
gcauccuucaucaca

SEQ ID NO: 1816382 - RNA, 19 nt, Homo sapiens
acagcuucauguucccaaa

SEQ ID NO: 1816383 - RNA, 17 nt, Homo sapiens
cacuuuaaacaccccca

SEQ ID NO: 1816384 - RNA, 13 nt, Homo sapiens
gcauuuuacacau

SEQ ID NO: 1816385 - RNA, 14 nt, Homo sapiens
augcacagaacaag

SEQ ID NO: 1816386 - RNA, 19 nt, Homo sapiens
aacucauuuggggugcaaa

SEQ ID NO: 1816387 - RNA, 20 nt, Homo sapiens
cauuuucucuguaguuacau

SEQ ID NO: 1816388 - RNA, 17 nt, Homo sapiens
ugcuggagucaugugcc

SEQ ID NO: 1816389 - RNA, 22 nt, Homo sapiens
agugguagaggugugugccuag

SEQ ID NO: 1816390 - RNA, 16 nt, Homo sapiens
aaauacuacacaucca

SEQ ID NO: 1816391 - RNA, 19 nt, Homo sapiens
caccugacaauggcagcua

SEQ ID NO: 1816392 - RNA, 22 nt, Homo sapiens
ccagaccuuaagacacugugag

SEQ ID NO: 1816393 - RNA, 13 nt, Homo sapiens
gaaaugaauauuc

SEQ ID NO: 1816394 - RNA, 17 nt, Homo sapiens
caggacagaaccacuga

SEQ ID NO: 1816395 - RNA, 17 nt, Homo sapiens
ugagucuuagugguuaa

SEQ ID NO: 1816396 - RNA, 22 nt, Homo sapiens
cuaagucuuauauauuguagau

SEQ ID NO: 1816397 - RNA, 19 nt, Homo sapiens
uaccucuuggcugccuugu

SEQ ID NO: 1816398 - RNA, 12 nt, Homo sapiens
caucuaauauga

SEQ ID NO: 1816399 - RNA, 24 nt, Homo sapiens
guuccugugcagaugcugcugaag

SEQ ID NO: 1816400 - RNA, 16 nt, Homo sapiens
ccauaguaccauuuau

SEQ ID NO: 1816401 - RNA, 15 nt, Homo sapiens
ugcuuccccacggga

SEQ ID NO: 1816402 - RNA, 19 nt, Homo sapiens
ccgggaccauugaccucag

SEQ ID NO: 1816403 - RNA, 18 nt, Homo sapiens
cugaauuggauccagggg

SEQ ID NO: 1816404 - RNA, 13 nt, Homo sapiens
acuuuguaaaaua

SEQ ID NO: 1816405 - RNA, 14 nt, Homo sapiens
uaaaugcaauauuc

SEQ ID NO: 1816406 - RNA, 13 nt, Homo sapiens
ucugauacgugua

SEQ ID NO: 1816407 - RNA, 21 nt, Homo sapiens
gccuuacagugggccauucau

SEQ ID NO: 1816408 - RNA, 15 nt, Homo sapiens
uaaaacacaucauca

SEQ ID NO: 1816409 - RNA, 18 nt, Homo sapiens
uuaaaccugaacucagac

SEQ ID NO: 1816410 - RNA, 18 nt, Homo sapiens
ggauacuguaacacuuua

SEQ ID NO: 1816411 - RNA, 18 nt, Homo sapiens
acuaagagaaugugcuca

SEQ ID NO: 1816412 - RNA, 15 nt, Homo sapiens
gcaaucuaugacuca

SEQ ID NO: 1816413 - RNA, 19 nt, Homo sapiens
cagaguaacgagaagacaa

SEQ ID NO: 1816414 - RNA, 18 nt, Homo sapiens
ucugauauacaaagggau

SEQ ID NO: 1816415 - RNA, 21 nt, Homo sapiens
uuauagaagagaaaugcugcu

SEQ ID NO: 1816416 - RNA, 17 nt, Homo sapiens
agauugauuaaugaacu

SEQ ID NO: 1816417 - RNA, 17 nt, Homo sapiens
uucucccucacccaagu

SEQ ID NO: 1816418 - RNA, 20 nt, Homo sapiens
caagaacuuucucugccauc

SEQ ID NO: 1816419 - RNA, 23 nt, Homo sapiens
uaaauaaacacauagauucaccu

SEQ ID NO: 1816420 - RNA, 15 nt, Homo sapiens
uaacagccucuguga

SEQ ID NO: 1816421 - RNA, 14 nt, Homo sapiens
guacauaauacuga

SEQ ID NO: 1816422 - RNA, 18 nt, Homo sapiens
cauguauaaagugauuga

SEQ ID NO: 1816423 - RNA, 20 nt, Homo sapiens
gaaccuucauaugugcagua

SEQ ID NO: 1816424 - RNA, 22 nt, Homo sapiens
gacugaugguuaaauaauguga

SEQ ID NO: 1816425 - RNA, 13 nt, Homo sapiens
aggaaccuguguu

SEQ ID NO: 1816426 - RNA, 23 nt, Homo sapiens
cccuaaaauauuacaaaauaagu

SEQ ID NO: 1816427 - RNA, 13 nt, Homo sapiens
gcagaaguauucu

SEQ ID NO: 1816428 - RNA, 17 nt, Homo sapiens
caauaaauaaucuguac

SEQ ID NO: 1816429 - RNA, 15 nt, Homo sapiens
ugggucaugcacuga

SEQ ID NO: 1816430 - RNA, 15 nt, Homo sapiens
caugaggccaucuca

SEQ ID NO: 1816431 - RNA, 14 nt, Homo sapiens
acaauaugcaaugu

SEQ ID NO: 1816432 - RNA, 18 nt, Homo sapiens
cacguaaaucuguucaag

SEQ ID NO: 1816433 - RNA, 10 nt, Homo sapiens
uccacuauuu

SEQ ID NO: 1816434 - RNA, 23 nt, Homo sapiens
uaaaacagguggagaaauuccuu

SEQ ID NO: 1816435 - RNA, 17 nt, Homo sapiens
guuucuuaaaauacuca

SEQ ID NO: 1816436 - RNA, 20 nt, Homo sapiens
gguuuauuuucauucugcca

SEQ ID NO: 1816437 - RNA, 13 nt, Homo sapiens
uacugcacugagu

SEQ ID NO: 1816438 - RNA, 15 nt, Homo sapiens
ugcauucaauuuaca

SEQ ID NO: 1816439 - RNA, 20 nt, Homo sapiens
ggugccucagacuccgcccu

SEQ ID NO: 1816440 - RNA, 17 nt, Homo sapiens
gggcagggccccugacc

SEQ ID NO: 1816441 - RNA, 19 nt, Homo sapiens
ucagguggcccuacuggga

SEQ ID NO: 1816442 - RNA, 14 nt, Homo sapiens
cuugcuuagccugu

SEQ ID NO: 1816443 - RNA, 21 nt, Homo sapiens
ugcucaaggaagggacaagac

SEQ ID NO: 1816444 - RNA, 21 nt, Homo sapiens
augacugaaaaugaacuguaa

SEQ ID NO: 1816445 - RNA, 13 nt, Homo sapiens
uguguacagggaa

SEQ ID NO: 1816446 - RNA, 22 nt, Homo sapiens
uauuuaauuuuuuaguuucccc

SEQ ID NO: 1816447 - RNA, 22 nt, Homo sapiens
cuucccagcucugacccuucua

SEQ ID NO: 1816448 - RNA, 22 nt, Homo sapiens
gucaguggaagccccaacggga

SEQ ID NO: 1816449 - RNA, 23 nt, Homo sapiens
uuacaacuugaaauugcuuugcu

SEQ ID NO: 1816450 - RNA, 21 nt, Homo sapiens
uucuucucccuguguggcugc

SEQ ID NO: 1816451 - RNA, 15 nt, Homo sapiens
ucugaaccucuucaa

SEQ ID NO: 1816452 - RNA, 22 nt, Homo sapiens
cagggauuuagacuuacuauua

SEQ ID NO: 1816453 - RNA, 21 nt, Homo sapiens
cacucacauuuauucugcuca

SEQ ID NO: 1816454 - RNA, 22 nt, Homo sapiens
ugcgugaaguaggcauauauca

SEQ ID NO: 1816455 - RNA, 15 nt, Homo sapiens
cauucauucaaucau

SEQ ID NO: 1816456 - RNA, 23 nt, Homo sapiens
ugugacuccuuaucucuuuccac

SEQ ID NO: 1816457 - RNA, 12 nt, Homo sapiens
gcuacagggcca

SEQ ID NO: 1816458 - RNA, 15 nt, Homo sapiens
aauucaagugacaca

SEQ ID NO: 1816459 - RNA, 13 nt, Homo sapiens
aaacaaucuccca

SEQ ID NO: 1816460 - RNA, 12 nt, Homo sapiens
agaauacuguau

SEQ ID NO: 1816461 - RNA, 17 nt, Homo sapiens
cacugggaagcuggagu

SEQ ID NO: 1816462 - RNA, 21 nt, Homo sapiens
agucaagucuaccugccuugc

SEQ ID NO: 1816463 - RNA, 14 nt, Homo sapiens
ucuacaggcauuua

SEQ ID NO: 1816464 - RNA, 15 nt, Homo sapiens
cuuaaugucuuugag

SEQ ID NO: 1816465 - RNA, 10 nt, Homo sapiens
uacaaaagga

SEQ ID NO: 1816466 - RNA, 12 nt, Homo sapiens
agucaucaaagu

SEQ ID NO: 1816467 - RNA, 18 nt, Homo sapiens
cucccccuuucacacugg

SEQ ID NO: 1816468 - RNA, 18 nt, Homo sapiens
augccuacugaguagggg

SEQ ID NO: 1816469 - RNA, 18 nt, Homo sapiens
aucuacaagcauuugccc

SEQ ID NO: 1816470 - RNA, 21 nt, Homo sapiens
auaucugugaggugcugauga

SEQ ID NO: 1816471 - RNA, 19 nt, Homo sapiens
acgacucugaccucuuggc

SEQ ID NO: 1816472 - RNA, 17 nt, Homo sapiens
ggccagugccauuucag

SEQ ID NO: 1816473 - RNA, 22 nt, Homo sapiens
gagacaaaauauuuuccugcca

SEQ ID NO: 1816474 - RNA, 12 nt, Homo sapiens
gauucuccuuca

SEQ ID NO: 1816475 - RNA, 20 nt, Homo sapiens
gauauaauggauaauuuuca

SEQ ID NO: 1816476 - RNA, 11 nt, Homo sapiens
ccaaaagcuag

SEQ ID NO: 1816477 - RNA, 17 nt, Homo sapiens
ucuccaucacaaccaga

SEQ ID NO: 1816478 - RNA, 15 nt, Homo sapiens
cccagagguggcccu

SEQ ID NO: 1816479 - RNA, 22 nt, Homo sapiens
agugguggugaacagaacaaaa

SEQ ID NO: 1816480 - RNA, 14 nt, Homo sapiens
ugagauguguucag

SEQ ID NO: 1816481 - RNA, 15 nt, Homo sapiens
aucauaaccauguga

SEQ ID NO: 1816482 - RNA, 15 nt, Homo sapiens
auguuucauacagcu

SEQ ID NO: 1816483 - RNA, 17 nt, Homo sapiens
uaagcuaccuugucaua

SEQ ID NO: 1816484 - RNA, 17 nt, Homo sapiens
ccagggaagugcucuga

SEQ ID NO: 1816485 - RNA, 21 nt, Homo sapiens
auuauuugagaagcugcucaa

SEQ ID NO: 1816486 - RNA, 16 nt, Homo sapiens
agacccugucucaaaa

SEQ ID NO: 1816487 - RNA, 16 nt, Homo sapiens
cugggugacccuggca

SEQ ID NO: 1816488 - RNA, 18 nt, Homo sapiens
gauauuacuacuuaccau

SEQ ID NO: 1816489 - RNA, 13 nt, Homo sapiens
gcuccagccugac

SEQ ID NO: 1816490 - RNA, 23 nt, Homo sapiens
ggcucauauuucuuuucuuucuc

SEQ ID NO: 1816491 - RNA, 18 nt, Homo sapiens
cccaacccugagcacucu

SEQ ID NO: 1816492 - RNA, 18 nt, Homo sapiens
gaagccacccucccagcu

SEQ ID NO: 1816493 - RNA, 18 nt, Homo sapiens
ucccuggaaaaggagcuu

SEQ ID NO: 1816494 - RNA, 15 nt, Homo sapiens
aaucccagugacuua

SEQ ID NO: 1816495 - RNA, 16 nt, Homo sapiens
uucuuucaaccuauac

SEQ ID NO: 1816496 - RNA, 23 nt, Homo sapiens
agaucccauccaucagcucccuu

SEQ ID NO: 1816497 - RNA, 20 nt, Homo sapiens
cugguagaaaggcaguucag

SEQ ID NO: 1816498 - RNA, 15 nt, Homo sapiens
ccugaaaguuccuuc

SEQ ID NO: 1816499 - RNA, 15 nt, Homo sapiens
aaauuuaucuuucaa

SEQ ID NO: 1816500 - RNA, 12 nt, Homo sapiens
cuggggcuccag

SEQ ID NO: 1816501 - RNA, 22 nt, Homo sapiens
ccuuccugcccaggggacgugg

SEQ ID NO: 1816502 - RNA, 18 nt, Homo sapiens
cccagccauccagggggc

SEQ ID NO: 1816503 - RNA, 17 nt, Homo sapiens
uuuucuggugaugccca

SEQ ID NO: 1816504 - RNA, 23 nt, Homo sapiens
ccccgcuugguggccugggaucu

SEQ ID NO: 1816505 - RNA, 22 nt, Homo sapiens
gcagagcuagguggaaaagccu

SEQ ID NO: 1816506 - RNA, 21 nt, Homo sapiens
aaaggcuagguacacagcucu

SEQ ID NO: 1816507 - RNA, 22 nt, Homo sapiens
agggucucacuguguugcccag

SEQ ID NO: 1816508 - RNA, 15 nt, Homo sapiens
agcccccaccugccu

SEQ ID NO: 1816509 - RNA, 19 nt, Homo sapiens
aaaccaacucuugcucuca

SEQ ID NO: 1816510 - RNA, 18 nt, Homo sapiens
caaccgugguuacuguau

SEQ ID NO: 1816511 - RNA, 22 nt, Homo sapiens
cacucuuaucuacauaaggaug

SEQ ID NO: 1816512 - RNA, 17 nt, Homo sapiens
cccugcagacucuggca

SEQ ID NO: 1816513 - RNA, 15 nt, Homo sapiens
ccuaaacuccagggg

SEQ ID NO: 1816514 - RNA, 19 nt, Homo sapiens
gccgugccuucagcucuac

SEQ ID NO: 1816515 - RNA, 14 nt, Homo sapiens
acccgacaugugua

SEQ ID NO: 1816516 - RNA, 15 nt, Homo sapiens
ccagugaacagugug

SEQ ID NO: 1816517 - RNA, 18 nt, Homo sapiens
cuuuuuguuuuuuagcau

SEQ ID NO: 1816518 - RNA, 23 nt, Homo sapiens
cugcaucuaagcccaugggacaa

SEQ ID NO: 1816519 - RNA, 18 nt, Homo sapiens
auucugcaggaacaugac

SEQ ID NO: 1816520 - RNA, 22 nt, Homo sapiens
caggggaguggagagagcuccu

SEQ ID NO: 1816521 - RNA, 22 nt, Homo sapiens
uacagccugccccugacugugu

SEQ ID NO: 1816522 - RNA, 19 nt, Homo sapiens
ugcuuuauccagcagucaa

SEQ ID NO: 1816523 - RNA, 15 nt, Homo sapiens
cauuaggguaauauc

SEQ ID NO: 1816524 - RNA, 13 nt, Homo sapiens
ugcacacaggaca

SEQ ID NO: 1816525 - RNA, 17 nt, Homo sapiens
agcguucccagcagggg

SEQ ID NO: 1816526 - RNA, 14 nt, Homo sapiens
gcagcaggugcuuu

SEQ ID NO: 1816527 - RNA, 21 nt, Homo sapiens
cugauguuuauguacuguaaa

SEQ ID NO: 1816528 - RNA, 18 nt, Homo sapiens
aaugugguuuguacauau

SEQ ID NO: 1816529 - RNA, 17 nt, Homo sapiens
caaguugcacacucacu

SEQ ID NO: 1816530 - RNA, 16 nt, Homo sapiens
uacacagaucacagcu

SEQ ID NO: 1816531 - RNA, 20 nt, Homo sapiens
cugccuauuaguaguuaauu

SEQ ID NO: 1816532 - RNA, 16 nt, Homo sapiens
aauuucuuuugguuca

SEQ ID NO: 1816533 - RNA, 17 nt, Homo sapiens
auguaucugaguugcca

SEQ ID NO: 1816534 - RNA, 21 nt, Homo sapiens
gggaacccugcccacucccag

SEQ ID NO: 1816535 - RNA, 15 nt, Homo sapiens
gaacuacgggcugcu

SEQ ID NO: 1816536 - RNA, 14 nt, Homo sapiens
accuccucuguucu

SEQ ID NO: 1816537 - RNA, 18 nt, Homo sapiens
ucuccgcaucgcauccuc

SEQ ID NO: 1816538 - RNA, 16 nt, Homo sapiens
ucuucaucuuugccau

SEQ ID NO: 1816539 - RNA, 15 nt, Homo sapiens
ugaaccaugaaguca

SEQ ID NO: 1816540 - RNA, 13 nt, Homo sapiens
ucuguuacuccaa

SEQ ID NO: 1816541 - RNA, 20 nt, Homo sapiens
ugucccagcgauggugccug

SEQ ID NO: 1816542 - RNA, 20 nt, Homo sapiens
aggacauccccccgccaaaa

SEQ ID NO: 1816543 - RNA, 19 nt, Homo sapiens
ugcagggcacagaugacca

SEQ ID NO: 1816544 - RNA, 20 nt, Homo sapiens
guaucugacaaugcugaggu

SEQ ID NO: 1816545 - RNA, 18 nt, Homo sapiens
uucacauaguuugauaaa

SEQ ID NO: 1816546 - RNA, 15 nt, Homo sapiens
uuuggaaggcaaaga

SEQ ID NO: 1816547 - RNA, 16 nt, Homo sapiens
uuuacugauuccagca

SEQ ID NO: 1816548 - RNA, 18 nt, Homo sapiens
uaaaugaccccacugcag

SEQ ID NO: 1816549 - RNA, 17 nt, Homo sapiens
uagcugagcgugguggc

SEQ ID NO: 1816550 - RNA, 20 nt, Homo sapiens
aagaguucuaaauacaggaa

SEQ ID NO: 1816551 - RNA, 23 nt, Homo sapiens
acaguucuaugcagaacagugag

SEQ ID NO: 1816552 - RNA, 21 nt, Homo sapiens
ucauggauauguuauacugaa

SEQ ID NO: 1816553 - RNA, 19 nt, Homo sapiens
aagcccacacuaugcacag

SEQ ID NO: 1816554 - RNA, 20 nt, Homo sapiens
acuuaaaaugacaaagccau

SEQ ID NO: 1816555 - RNA, 20 nt, Homo sapiens
gccccacugcccuccagggc

SEQ ID NO: 1816556 - RNA, 10 nt, Homo sapiens
accacuccag

SEQ ID NO: 1816557 - RNA, 21 nt, Homo sapiens
cuauugcagauauuugaugua

SEQ ID NO: 1816558 - RNA, 18 nt, Homo sapiens
ccuuguucugauaaugaa

SEQ ID NO: 1816559 - RNA, 16 nt, Homo sapiens
gaaggaaauaacauug

SEQ ID NO: 1816560 - RNA, 22 nt, Homo sapiens
guuuauuucaggcauuggauau

SEQ ID NO: 1816561 - RNA, 15 nt, Homo sapiens
cgcagcccuaccuua

SEQ ID NO: 1816562 - RNA, 17 nt, Homo sapiens
agccuccgccauuccaa

SEQ ID NO: 1816563 - RNA, 16 nt, Homo sapiens
gauaguuaaaagacug

SEQ ID NO: 1816564 - RNA, 22 nt, Homo sapiens
aggggccucccccagcacagau

SEQ ID NO: 1816565 - RNA, 17 nt, Homo sapiens
ucuggggaaaaaaaaga

SEQ ID NO: 1816566 - RNA, 15 nt, Homo sapiens
aucuauugcucauca

SEQ ID NO: 1816567 - RNA, 22 nt, Homo sapiens
uaguggcuguccagugcccauu

SEQ ID NO: 1816568 - RNA, 15 nt, Homo sapiens
auaaucacauuauca

SEQ ID NO: 1816569 - RNA, 15 nt, Homo sapiens
agucacacagacaca

SEQ ID NO: 1816570 - RNA, 15 nt, Homo sapiens
auagcaccauugcac

SEQ ID NO: 1816571 - RNA, 20 nt, Homo sapiens
aucuggaaaccucuacauau

SEQ ID NO: 1816572 - RNA, 14 nt, Homo sapiens
aucuuaaaugacag

SEQ ID NO: 1816573 - RNA, 19 nt, Homo sapiens
ugggacacaacacagauaa

SEQ ID NO: 1816574 - RNA, 19 nt, Homo sapiens
ggugacguagaauugaguc

SEQ ID NO: 1816575 - RNA, 20 nt, Homo sapiens
uaaaauaaauucucuccuaa

SEQ ID NO: 1816576 - RNA, 14 nt, Homo sapiens
uugggucucucaua

SEQ ID NO: 1816577 - RNA, 22 nt, Homo sapiens
auaccaauuacauggaacuuuu

SEQ ID NO: 1816578 - RNA, 21 nt, Homo sapiens
augagacaggaggucagcaca

SEQ ID NO: 1816579 - RNA, 22 nt, Homo sapiens
aggcauaagacccuaagccucc

SEQ ID NO: 1816580 - RNA, 13 nt, Homo sapiens
cuuugcuccagac

SEQ ID NO: 1816581 - RNA, 17 nt, Homo sapiens
aaucugauguuaaccaa

SEQ ID NO: 1816582 - RNA, 21 nt, Homo sapiens
uucaaaaaauuauaugaccau

SEQ ID NO: 1816583 - RNA, 21 nt, Homo sapiens
ccucuauauaccaaagcacau

SEQ ID NO: 1816584 - RNA, 15 nt, Homo sapiens
aaacauuacuuauuu

SEQ ID NO: 1816585 - RNA, 11 nt, Homo sapiens
cucccauuucc

SEQ ID NO: 1816586 - RNA, 20 nt, Homo sapiens
ucuccucuucauggcaucuu

SEQ ID NO: 1816587 - RNA, 18 nt, Homo sapiens
agucucuuuuuuacaaag

SEQ ID NO: 1816588 - RNA, 21 nt, Homo sapiens
uccugggaauaacauggugag

SEQ ID NO: 1816589 - RNA, 18 nt, Homo sapiens
cugcaaauguaauugauu

SEQ ID NO: 1816590 - RNA, 18 nt, Homo sapiens
aauaggcugaugggcaaa

SEQ ID NO: 1816591 - RNA, 18 nt, Homo sapiens
uauaguaguaccuuucag

SEQ ID NO: 1816592 - RNA, 16 nt, Homo sapiens
ccugggcccuaggcau

SEQ ID NO: 1816593 - RNA, 19 nt, Homo sapiens
ggcgugagaggcaaugacu

SEQ ID NO: 1816594 - RNA, 16 nt, Homo sapiens
cggagaagagcgcagu

SEQ ID NO: 1816595 - RNA, 18 nt, Homo sapiens
ggcacaagaaucacuuga

SEQ ID NO: 1816596 - RNA, 14 nt, Homo sapiens
uuuccuugcucaac

SEQ ID NO: 1816597 - RNA, 15 nt, Homo sapiens
cuggagucugucaau

SEQ ID NO: 1816598 - RNA, 13 nt, Homo sapiens
uaagcauaacuua

SEQ ID NO: 1816599 - RNA, 16 nt, Homo sapiens
uguuuuugacagccuu

SEQ ID NO: 1816600 - RNA, 16 nt, Homo sapiens
aauggaaagguccugc

SEQ ID NO: 1816601 - RNA, 17 nt, Homo sapiens
uuauaaaagaugcauua

SEQ ID NO: 1816602 - RNA, 19 nt, Homo sapiens
gugccaugggggcaacagc

SEQ ID NO: 1816603 - RNA, 14 nt, Homo sapiens
acuuacaugauuca

SEQ ID NO: 1816604 - RNA, 14 nt, Homo sapiens
acccccaugaccaa

SEQ ID NO: 1816605 - RNA, 21 nt, Homo sapiens
cuuuccauccauuaccuccau

SEQ ID NO: 1816606 - RNA, 17 nt, Homo sapiens
cucgccggaucugaggg

SEQ ID NO: 1816607 - RNA, 16 nt, Homo sapiens
cuauauguagcuuuau

SEQ ID NO: 1816608 - RNA, 15 nt, Homo sapiens
agauuaucaguagaa

SEQ ID NO: 1816609 - RNA, 15 nt, Homo sapiens
uccaggacagggaag

SEQ ID NO: 1816610 - RNA, 15 nt, Homo sapiens
gcucuuuuauacugu

SEQ ID NO: 1816611 - RNA, 12 nt, Homo sapiens
augugaauguga

SEQ ID NO: 1816612 - RNA, 22 nt, Homo sapiens
cucaugcccgccagugcacagg

SEQ ID NO: 1816613 - RNA, 13 nt, Homo sapiens
cugugacagcagc

SEQ ID NO: 1816614 - RNA, 15 nt, Homo sapiens
guugcugcugugaau

SEQ ID NO: 1816615 - RNA, 18 nt, Homo sapiens
gagaggaccccacuggac

SEQ ID NO: 1816616 - RNA, 23 nt, Homo sapiens
caguacaacccauaaucauguaa

SEQ ID NO: 1816617 - RNA, 14 nt, Homo sapiens
ucaacucacagcuu

SEQ ID NO: 1816618 - RNA, 18 nt, Homo sapiens
gcuccuaguuugaccuca

SEQ ID NO: 1816619 - RNA, 15 nt, Homo sapiens
ccaagaccuggugug

SEQ ID NO: 1816620 - RNA, 23 nt, Homo sapiens
acauucaagauuaaacugaguga

SEQ ID NO: 1816621 - RNA, 20 nt, Homo sapiens
cucaacaagcaagaucugcu

SEQ ID NO: 1816622 - RNA, 21 nt, Homo sapiens
uagagccagcccauggcuuua

SEQ ID NO: 1816623 - RNA, 15 nt, Homo sapiens
uccaaaagcacuuac

SEQ ID NO: 1816624 - RNA, 15 nt, Homo sapiens
aguauuacugaguau

SEQ ID NO: 1816625 - RNA, 18 nt, Homo sapiens
aaagcauaaaaagguuuu

SEQ ID NO: 1816626 - RNA, 12 nt, Homo sapiens
ucccaaggcagc

SEQ ID NO: 1816627 - RNA, 12 nt, Homo sapiens
ucaccaugcaag

SEQ ID NO: 1816628 - RNA, 18 nt, Homo sapiens
uuauguaaaacccuuuaa

SEQ ID NO: 1816629 - RNA, 20 nt, Homo sapiens
agucucugaaugaagcugaa

SEQ ID NO: 1816630 - RNA, 21 nt, Homo sapiens
cuaucaaaggaaaugagaaug

SEQ ID NO: 1816631 - RNA, 21 nt, Homo sapiens
uggcccaagcugggcucccuu

SEQ ID NO: 1816632 - RNA, 22 nt, Homo sapiens
cuuuauauggccucaagaucaa

SEQ ID NO: 1816633 - RNA, 17 nt, Homo sapiens
acuauggccauggcuca

SEQ ID NO: 1816634 - RNA, 14 nt, Homo sapiens
ugcacaugaaaguu

SEQ ID NO: 1816635 - RNA, 15 nt, Homo sapiens
aucuucuuaugcaau

SEQ ID NO: 1816636 - RNA, 22 nt, Homo sapiens
agaaaaccacaacuaaaacugg

SEQ ID NO: 1816637 - RNA, 21 nt, Homo sapiens
gaaugagucaaucagccuuua

SEQ ID NO: 1816638 - RNA, 17 nt, Homo sapiens
guugauuacagugcagu

SEQ ID NO: 1816639 - RNA, 18 nt, Homo sapiens
cucccugccucacaucuc

SEQ ID NO: 1816640 - RNA, 19 nt, Homo sapiens
ucauucuuuuaacaaaagg

SEQ ID NO: 1816641 - RNA, 20 nt, Homo sapiens
auaucuuuaugggcucuguu

SEQ ID NO: 1816642 - RNA, 17 nt, Homo sapiens
guauagcuggcaccuua

SEQ ID NO: 1816643 - RNA, 15 nt, Homo sapiens
ugagagugaaaccau

SEQ ID NO: 1816644 - RNA, 15 nt, Homo sapiens
acuggcaugcuaaag

SEQ ID NO: 1816645 - RNA, 19 nt, Homo sapiens
uugucaaagaagucauucu

SEQ ID NO: 1816646 - RNA, 15 nt, Homo sapiens
aagaccuaacuccug

SEQ ID NO: 1816647 - RNA, 13 nt, Homo sapiens
ucccagugaaaua

SEQ ID NO: 1816648 - RNA, 22 nt, Homo sapiens
gacguuugacuagccaucucaa

SEQ ID NO: 1816649 - RNA, 20 nt, Homo sapiens
uguuccugcuaauaauuugc

SEQ ID NO: 1816650 - RNA, 19 nt, Homo sapiens
gaaaaauguuugucucagu

SEQ ID NO: 1816651 - RNA, 22 nt, Homo sapiens
cuacaaaggagacgggggagca

SEQ ID NO: 1816652 - RNA, 16 nt, Homo sapiens
aauuaugugcauauua

SEQ ID NO: 1816653 - RNA, 22 nt, Homo sapiens
agacauaaagccuuuugcuuua

SEQ ID NO: 1816654 - RNA, 18 nt, Homo sapiens
uuugaacuccucucagcu

SEQ ID NO: 1816655 - RNA, 14 nt, Homo sapiens
guuacagcacaaaa

SEQ ID NO: 1816656 - RNA, 20 nt, Homo sapiens
uagaauguugaaaaguaauu

SEQ ID NO: 1816657 - RNA, 16 nt, Homo sapiens
aaagccugaguuugcu

SEQ ID NO: 1816658 - RNA, 12 nt, Homo sapiens
gcaccagcaaaa

SEQ ID NO: 1816659 - RNA, 21 nt, Homo sapiens
aauauauaguccagacacuua

SEQ ID NO: 1816660 - RNA, 19 nt, Homo sapiens
uuugcuuuguguaaauaca

SEQ ID NO: 1816661 - RNA, 20 nt, Homo sapiens
uuggcaggcuuuuuuccaga

SEQ ID NO: 1816662 - RNA, 14 nt, Homo sapiens
gcaaaacuuuccaa

SEQ ID NO: 1816663 - RNA, 15 nt, Homo sapiens
agccaggaaagaaga

SEQ ID NO: 1816664 - RNA, 20 nt, Homo sapiens
cagguguugccauuucucug

SEQ ID NO: 1816665 - RNA, 17 nt, Homo sapiens
aucucauuuaauccucu

SEQ ID NO: 1816666 - RNA, 15 nt, Homo sapiens
cuccagccuggguca

SEQ ID NO: 1816667 - RNA, 18 nt, Homo sapiens
ccuuugcuucaaauucaa

SEQ ID NO: 1816668 - RNA, 14 nt, Homo sapiens
ucuagacuagcaau

SEQ ID NO: 1816669 - RNA, 18 nt, Homo sapiens
ucuaugaguuggacuuca

SEQ ID NO: 1816670 - RNA, 12 nt, Homo sapiens
ugcacacaugca

SEQ ID NO: 1816671 - RNA, 12 nt, Homo sapiens
uucacacauuca

SEQ ID NO: 1816672 - RNA, 12 nt, Homo sapiens
gauacacagaua

SEQ ID NO: 1816673 - RNA, 22 nt, Homo sapiens
aaucuagagcuaugcacaccaa

SEQ ID NO: 1816674 - RNA, 15 nt, Homo sapiens
cuauuucuaucccaa

SEQ ID NO: 1816675 - RNA, 23 nt, Homo sapiens
aggaaauauuaagagcuauuuua

SEQ ID NO: 1816676 - RNA, 16 nt, Homo sapiens
caguucaugucugaaa

SEQ ID NO: 1816677 - RNA, 18 nt, Homo sapiens
aaacucgggcacucccua

SEQ ID NO: 1816678 - RNA, 15 nt, Homo sapiens
uauauuuuaccauac

SEQ ID NO: 1816679 - RNA, 20 nt, Homo sapiens
agaagaccuucguauccccu

SEQ ID NO: 1816680 - RNA, 13 nt, Homo sapiens
auguuguguuguu

SEQ ID NO: 1816681 - RNA, 17 nt, Homo sapiens
gccaaacccaugaggca

SEQ ID NO: 1816682 - RNA, 19 nt, Homo sapiens
aagacccaacaggugcuga

SEQ ID NO: 1816683 - RNA, 19 nt, Homo sapiens
cacugagaagauggcacug

SEQ ID NO: 1816684 - RNA, 17 nt, Homo sapiens
uggaauuuguaaguuua

SEQ ID NO: 1816685 - RNA, 22 nt, Homo sapiens
agagugacagcuguauauugcu

SEQ ID NO: 1816686 - RNA, 15 nt, Homo sapiens
gcaucucaagcccca

SEQ ID NO: 1816687 - RNA, 16 nt, Homo sapiens
cacgugaaauuugccu

SEQ ID NO: 1816688 - RNA, 17 nt, Homo sapiens
aagucuagagucucaga

SEQ ID NO: 1816689 - RNA, 21 nt, Homo sapiens
ugagucagagccaugucuucu

SEQ ID NO: 1816690 - RNA, 17 nt, Homo sapiens
guuugggugucugcuaa

SEQ ID NO: 1816691 - RNA, 21 nt, Homo sapiens
acaauugucuuaaaaccagag

SEQ ID NO: 1816692 - RNA, 16 nt, Homo sapiens
cuacacguaaguauaa

SEQ ID NO: 1816693 - RNA, 23 nt, Homo sapiens
aauaaacuucuggugugauacuu

SEQ ID NO: 1816694 - RNA, 19 nt, Homo sapiens
auaugcauugucugcaaug

SEQ ID NO: 1816695 - RNA, 10 nt, Homo sapiens
cuuuuccauu

SEQ ID NO: 1816696 - RNA, 12 nt, Homo sapiens
uuuaaacccaau

SEQ ID NO: 1816697 - RNA, 21 nt, Homo sapiens
ugaugggaggaaaagcccagg

SEQ ID NO: 1816698 - RNA, 16 nt, Homo sapiens
cuuggagugcauuuga

SEQ ID NO: 1816699 - RNA, 13 nt, Homo sapiens
uaugggcuuucuc

SEQ ID NO: 1816700 - RNA, 17 nt, Homo sapiens
cuucacccuggagccca

SEQ ID NO: 1816701 - RNA, 16 nt, Homo sapiens
ucuuucuuacaaggaa

SEQ ID NO: 1816702 - RNA, 15 nt, Homo sapiens
aaacuacaagccacg

SEQ ID NO: 1816703 - RNA, 14 nt, Homo sapiens
ggaaggacauaaaa

SEQ ID NO: 1816704 - RNA, 14 nt, Homo sapiens
aaguccacuggggc

SEQ ID NO: 1816705 - RNA, 16 nt, Homo sapiens
uuuaaaacaagcugau

SEQ ID NO: 1816706 - RNA, 17 nt, Homo sapiens
auccugaccuugcacaa

SEQ ID NO: 1816707 - RNA, 17 nt, Homo sapiens
acaccuguaaucccagc

SEQ ID NO: 1816708 - RNA, 22 nt, Homo sapiens
cuaugauaagauugaaauucca

SEQ ID NO: 1816709 - RNA, 22 nt, Homo sapiens
ucugcggaaaaacaaacaugaa

SEQ ID NO: 1816710 - RNA, 19 nt, Homo sapiens
cuguuacugaaauugguau

SEQ ID NO: 1816711 - RNA, 20 nt, Homo sapiens
cuggagugcaguggcgugau

SEQ ID NO: 1816712 - RNA, 20 nt, Homo sapiens
cuggaguguaguggcgcgau

SEQ ID NO: 1816713 - RNA, 16 nt, Homo sapiens
agguuuguaugaugua

SEQ ID NO: 1816714 - RNA, 14 nt, Homo sapiens
auagagaaugcccu

SEQ ID NO: 1816715 - RNA, 21 nt, Homo sapiens
agcacuuuagcagaugugguu

SEQ ID NO: 1816716 - RNA, 14 nt, Homo sapiens
ccagggucuuuacu

SEQ ID NO: 1816717 - RNA, 19 nt, Homo sapiens
cuggagugcaguggcguga

SEQ ID NO: 1816718 - RNA, 13 nt, Homo sapiens
aagagaaugaacu

SEQ ID NO: 1816719 - RNA, 13 nt, Homo sapiens
ucccucuaugucg

SEQ ID NO: 1816720 - RNA, 20 nt, Homo sapiens
ccuuuucuauuuaccuccua

SEQ ID NO: 1816721 - RNA, 20 nt, Homo sapiens
aaaaauauuuauucauuauu

SEQ ID NO: 1816722 - RNA, 14 nt, Homo sapiens
uucuuaacuuugaa

SEQ ID NO: 1816723 - RNA, 23 nt, Homo sapiens
ucccagguucaagcgauucucau

SEQ ID NO: 1816724 - RNA, 21 nt, Homo sapiens
cacaagaccccugcuccugac

SEQ ID NO: 1816725 - RNA, 18 nt, Homo sapiens
augcagcgaauucagaaa

SEQ ID NO: 1816726 - RNA, 11 nt, Homo sapiens
accuguagcug

SEQ ID NO: 1816727 - RNA, 21 nt, Homo sapiens
caagggaauucggugugcacc

SEQ ID NO: 1816728 - RNA, 15 nt, Homo sapiens
ucauacuacauuuga

SEQ ID NO: 1816729 - RNA, 19 nt, Homo sapiens
uccucuauuuaagauauau

SEQ ID NO: 1816730 - RNA, 17 nt, Homo sapiens
aacucugugaucuugcu

SEQ ID NO: 1816731 - RNA, 14 nt, Homo sapiens
cacuauguauauac

SEQ ID NO: 1816732 - RNA, 20 nt, Homo sapiens
augaugaucgucaucaucaa

SEQ ID NO: 1816733 - RNA, 21 nt, Homo sapiens
aauaugaaacucaucuguaaa

SEQ ID NO: 1816734 - RNA, 16 nt, Homo sapiens
uuucaaaaccuuuuga

SEQ ID NO: 1816735 - RNA, 19 nt, Homo sapiens
gaagcuccugcuacuuccc

SEQ ID NO: 1816736 - RNA, 23 nt, Homo sapiens
ccaggcuucuaaauuucuaggcc

SEQ ID NO: 1816737 - RNA, 16 nt, Homo sapiens
cucuggaagccucuau

SEQ ID NO: 1816738 - RNA, 14 nt, Homo sapiens
uuacuuuuucauuc

SEQ ID NO: 1816739 - RNA, 17 nt, Homo sapiens
agugacuuuacaggagg

SEQ ID NO: 1816740 - RNA, 19 nt, Homo sapiens
gccgggugugguggcucac

SEQ ID NO: 1816741 - RNA, 23 nt, Homo sapiens
gaaucugggugggauaauggacu

SEQ ID NO: 1816742 - RNA, 18 nt, Homo sapiens
cuauucaggagaguagaa

SEQ ID NO: 1816743 - RNA, 12 nt, Homo sapiens
ggucacccagga

SEQ ID NO: 1816744 - RNA, 20 nt, Homo sapiens
uuuuaggcaaaaccuuguga

SEQ ID NO: 1816745 - RNA, 18 nt, Homo sapiens
uguuaagauaugcacagu

SEQ ID NO: 1816746 - RNA, 15 nt, Homo sapiens
uaaucaucaaaaaga

SEQ ID NO: 1816747 - RNA, 23 nt, Homo sapiens
agcacaaggagugcccgccuuga

SEQ ID NO: 1816748 - RNA, 14 nt, Homo sapiens
ccacuuaccucaaa

SEQ ID NO: 1816749 - RNA, 17 nt, Homo sapiens
gaacaaccagaugguga

SEQ ID NO: 1816750 - RNA, 21 nt, Homo sapiens
gaggcaaaaggucuauggcuc

SEQ ID NO: 1816751 - RNA, 15 nt, Homo sapiens
acuggauagaaccac

SEQ ID NO: 1816752 - RNA, 14 nt, Homo sapiens
caaaaagcucugaa

SEQ ID NO: 1816753 - RNA, 11 nt, Homo sapiens
uagacuguaac

SEQ ID NO: 1816754 - RNA, 23 nt, Homo sapiens
uccucugccuuuguucacuguga

SEQ ID NO: 1816755 - RNA, 21 nt, Homo sapiens
acauggcuaaagaagguuuca

SEQ ID NO: 1816756 - RNA, 19 nt, Homo sapiens
ugggguucgagacuccauc

SEQ ID NO: 1816757 - RNA, 21 nt, Homo sapiens
aguugagccagcagacauugu

SEQ ID NO: 1816758 - RNA, 19 nt, Homo sapiens
gcgccuguaauuccagcua

SEQ ID NO: 1816759 - RNA, 23 nt, Homo sapiens
gugccaagcagagguugggaggc

SEQ ID NO: 1816760 - RNA, 19 nt, Homo sapiens
gagcaugcucccucaugca

SEQ ID NO: 1816761 - RNA, 18 nt, Homo sapiens
cagcaucuuuaacacagc

SEQ ID NO: 1816762 - RNA, 16 nt, Homo sapiens
cucuuuaacacauucu

SEQ ID NO: 1816763 - RNA, 13 nt, Homo sapiens
uuauuugaucugg

SEQ ID NO: 1816764 - RNA, 22 nt, Homo sapiens
uugauauacuauuuucauucuc

SEQ ID NO: 1816765 - RNA, 18 nt, Homo sapiens
uguaaaauggacaguacu

SEQ ID NO: 1816766 - RNA, 19 nt, Homo sapiens
uggggcuggguguguuuca

SEQ ID NO: 1816767 - RNA, 21 nt, Homo sapiens
caggugauccgcccaccucag

SEQ ID NO: 1816768 - RNA, 16 nt, Homo sapiens
gacccugcaagaccac

SEQ ID NO: 1816769 - RNA, 19 nt, Homo sapiens
ugccagcuuaucucagggg

SEQ ID NO: 1816770 - RNA, 11 nt, Homo sapiens
ggagggggccc

SEQ ID NO: 1816771 - RNA, 14 nt, Homo sapiens
auuugcaacauaua

SEQ ID NO: 1816772 - RNA, 15 nt, Homo sapiens
uucugacuuuuacag

SEQ ID NO: 1816773 - RNA, 16 nt, Homo sapiens
cugaaaaagacauaaa

SEQ ID NO: 1816774 - RNA, 16 nt, Homo sapiens
ugcugcauugauccag

SEQ ID NO: 1816775 - RNA, 20 nt, Homo sapiens
ggagccaugggucugugcug

SEQ ID NO: 1816776 - RNA, 23 nt, Homo sapiens
caccugugauggcagggcuguga

SEQ ID NO: 1816777 - RNA, 23 nt, Homo sapiens
caguuacaguggcaguauugaca

SEQ ID NO: 1816778 - RNA, 20 nt, Homo sapiens
uguccccuucucucaucucu

SEQ ID NO: 1816779 - RNA, 16 nt, Homo sapiens
cauaauucacacauua

SEQ ID NO: 1816780 - RNA, 17 nt, Homo sapiens
acugucauccucaaaga

SEQ ID NO: 1816781 - RNA, 14 nt, Homo sapiens
aaucaaguuccagu

SEQ ID NO: 1816782 - RNA, 21 nt, Homo sapiens
augauucaccagguccaaugu

SEQ ID NO: 1816783 - RNA, 21 nt, Homo sapiens
agaagacucuccacugaccug

SEQ ID NO: 1816784 - RNA, 13 nt, Homo sapiens
gaaugaaacugau

SEQ ID NO: 1816785 - RNA, 23 nt, Homo sapiens
ccuccugccugcgggcaccuaca

SEQ ID NO: 1816786 - RNA, 16 nt, Homo sapiens
uaaaagagaauuuacu

SEQ ID NO: 1816787 - RNA, 16 nt, Homo sapiens
aaaaugacaccaucuu

SEQ ID NO: 1816788 - RNA, 19 nt, Homo sapiens
gccggcucuucaaagacaa

SEQ ID NO: 1816789 - RNA, 17 nt, Homo sapiens
cccacuguaugauuuau

SEQ ID NO: 1816790 - RNA, 22 nt, Homo sapiens
ccuugauuuaucacacaaagca

SEQ ID NO: 1816791 - RNA, 18 nt, Homo sapiens
cuuuucucagacucacca

SEQ ID NO: 1816792 - RNA, 22 nt, Homo sapiens
uuucugaugggaggaaaguagc

SEQ ID NO: 1816793 - RNA, 19 nt, Homo sapiens
cccuucucugcccauuccc

SEQ ID NO: 1816794 - RNA, 16 nt, Homo sapiens
gaauugcacaguagga

SEQ ID NO: 1816795 - RNA, 14 nt, Homo sapiens
cuggacacugucca

SEQ ID NO: 1816796 - RNA, 14 nt, Homo sapiens
cuggccacugucaa

SEQ ID NO: 1816797 - RNA, 13 nt, Homo sapiens
cccgucugaccaa

SEQ ID NO: 1816798 - RNA, 17 nt, Homo sapiens
gacugaacuuacacugu

SEQ ID NO: 1816799 - RNA, 17 nt, Homo sapiens
ucacauaaugcucauac

SEQ ID NO: 1816800 - RNA, 16 nt, Homo sapiens
gaacucccucuguguc

SEQ ID NO: 1816801 - RNA, 21 nt, Homo sapiens
ugggguggggggggguccuaa

SEQ ID NO: 1816802 - RNA, 17 nt, Homo sapiens
cucccgugggcaucuca

SEQ ID NO: 1816803 - RNA, 20 nt, Homo sapiens
auagcauguucguauuacaa

SEQ ID NO: 1816804 - RNA, 23 nt, Homo sapiens
ccugcugcucucaggaccagaga

SEQ ID NO: 1816805 - RNA, 19 nt, Homo sapiens
ugcacguguguguguuuca

SEQ ID NO: 1816806 - RNA, 13 nt, Homo sapiens
ucagcuuugccuu

SEQ ID NO: 1816807 - RNA, 19 nt, Homo sapiens
uucaccuaagucucuguga

SEQ ID NO: 1816808 - RNA, 13 nt, Homo sapiens
accaugguaauaa

SEQ ID NO: 1816809 - RNA, 20 nt, Homo sapiens
cagcucagcuuccccaacac

SEQ ID NO: 1816810 - RNA, 15 nt, Homo sapiens
aggagcacuacagau

SEQ ID NO: 1816811 - RNA, 13 nt, Homo sapiens
auuuggcucacuu

SEQ ID NO: 1816812 - RNA, 13 nt, Homo sapiens
aagucaagcacau

SEQ ID NO: 1816813 - RNA, 15 nt, Homo sapiens
acaaccucauccagg

SEQ ID NO: 1816814 - RNA, 19 nt, Homo sapiens
cauacccucacuuaaacuu

SEQ ID NO: 1816815 - RNA, 13 nt, Homo sapiens
aggagccacaggg

SEQ ID NO: 1816816 - RNA, 18 nt, Homo sapiens
auauagcuugaaacauag

SEQ ID NO: 1816817 - RNA, 19 nt, Homo sapiens
cgaagaaggaccagugaag

SEQ ID NO: 1816818 - RNA, 12 nt, Homo sapiens
ugauuccaugga

SEQ ID NO: 1816819 - RNA, 18 nt, Homo sapiens
agcuuguccaucacucua

SEQ ID NO: 1816820 - RNA, 22 nt, Homo sapiens
cauuuguucuuugccagucuca

SEQ ID NO: 1816821 - RNA, 13 nt, Homo sapiens
ggacuacaggcac

SEQ ID NO: 1816822 - RNA, 17 nt, Homo sapiens
agaaaugugucacccca

SEQ ID NO: 1816823 - RNA, 12 nt, Homo sapiens
cagauccaggga

SEQ ID NO: 1816824 - RNA, 13 nt, Homo sapiens
uaaauaugaagga

SEQ ID NO: 1816825 - RNA, 16 nt, Homo sapiens
uccgcacuuuccacuu

SEQ ID NO: 1816826 - RNA, 18 nt, Homo sapiens
ccaggcuggagugcaacg

SEQ ID NO: 1816827 - RNA, 15 nt, Homo sapiens
acuuugcacagcucu

SEQ ID NO: 1816828 - RNA, 12 nt, Homo sapiens
uucacacuauca

SEQ ID NO: 1816829 - RNA, 13 nt, Homo sapiens
aagcauuagcaca

SEQ ID NO: 1816830 - RNA, 18 nt, Homo sapiens
ccugggcaacaaagugag

SEQ ID NO: 1816831 - RNA, 17 nt, Homo sapiens
aggagcaugagugccgu

SEQ ID NO: 1816832 - RNA, 14 nt, Homo sapiens
caaacaaccugccc

SEQ ID NO: 1816833 - RNA, 17 nt, Homo sapiens
ucauugggccaguuccu

SEQ ID NO: 1816834 - RNA, 18 nt, Homo sapiens
augcuacauauaugcaau

SEQ ID NO: 1816835 - RNA, 12 nt, Homo sapiens
ucagcauaccuu

SEQ ID NO: 1816836 - RNA, 16 nt, Homo sapiens
cucuuuagauauuuac

SEQ ID NO: 1816837 - RNA, 16 nt, Homo sapiens
agagagauauaucuga

SEQ ID NO: 1816838 - RNA, 19 nt, Homo sapiens
gguagcuggggcuacagga

SEQ ID NO: 1816839 - RNA, 20 nt, Homo sapiens
auaacauaaaagugcuacuu

SEQ ID NO: 1816840 - RNA, 17 nt, Homo sapiens
ugaaggcuuacuucaga

SEQ ID NO: 1816841 - RNA, 14 nt, Homo sapiens
acccuuaccaaaaa

SEQ ID NO: 1816842 - RNA, 15 nt, Homo sapiens
gcuucccugacucau

SEQ ID NO: 1816843 - RNA, 17 nt, Homo sapiens
gcacuauugagucuuca

SEQ ID NO: 1816844 - RNA, 15 nt, Homo sapiens
gcuggagaauuccag

SEQ ID NO: 1816845 - RNA, 14 nt, Homo sapiens
aauaaugacacucc

SEQ ID NO: 1816846 - RNA, 23 nt, Homo sapiens
uuuuugucugcuaguaguguucu

SEQ ID NO: 1816847 - RNA, 18 nt, Homo sapiens
guuuacgguacuugguaa

SEQ ID NO: 1816848 - RNA, 18 nt, Homo sapiens
agagaauuuacuuuucaa

SEQ ID NO: 1816849 - RNA, 19 nt, Homo sapiens
auucagagcaaguuccuga

SEQ ID NO: 1816850 - RNA, 14 nt, Homo sapiens
uccccuucugcaau

SEQ ID NO: 1816851 - RNA, 21 nt, Homo sapiens
caggaggcccugguccuggcc

SEQ ID NO: 1816852 - RNA, 19 nt, Homo sapiens
gucauucagcuaauacaaa

SEQ ID NO: 1816853 - RNA, 15 nt, Homo sapiens
ggcgguggagccgag

SEQ ID NO: 1816854 - RNA, 15 nt, Homo sapiens
cuuuguucuucuacc

SEQ ID NO: 1816855 - RNA, 24 nt, Homo sapiens
ucuuugccacugauuagcaguauu

SEQ ID NO: 1816856 - RNA, 18 nt, Homo sapiens
cauguggccuuuaucuca

SEQ ID NO: 1816857 - RNA, 18 nt, Homo sapiens
ccaugugcuagucacugg

SEQ ID NO: 1816858 - RNA, 18 nt, Homo sapiens
auucuccacucacugcau

SEQ ID NO: 1816859 - RNA, 14 nt, Homo sapiens
auuaaauucacaaa

SEQ ID NO: 1816860 - RNA, 21 nt, Homo sapiens
gaaguauuuuccuccaggcaa

SEQ ID NO: 1816861 - RNA, 19 nt, Homo sapiens
caagagugccuuauuuccu

SEQ ID NO: 1816862 - RNA, 20 nt, Homo sapiens
cacacaugcuuuucuuccua

SEQ ID NO: 1816863 - RNA, 21 nt, Homo sapiens
gaagcauguacuguacuuccc

SEQ ID NO: 1816864 - RNA, 16 nt, Homo sapiens
ggcucucaggccagcu

SEQ ID NO: 1816865 - RNA, 22 nt, Homo sapiens
caaacaggacaagagcagccug

SEQ ID NO: 1816866 - RNA, 16 nt, Homo sapiens
guguauuuugagauaa

SEQ ID NO: 1816867 - RNA, 19 nt, Homo sapiens
ugacauaaacccaucugua

SEQ ID NO: 1816868 - RNA, 18 nt, Homo sapiens
guuaaauccuuugcuuca

SEQ ID NO: 1816869 - RNA, 21 nt, Homo sapiens
uucccagaagggaguugcuca

SEQ ID NO: 1816870 - RNA, 22 nt, Homo sapiens
uaaucuagagaaggcauuucau

SEQ ID NO: 1816871 - RNA, 17 nt, Homo sapiens
acauuaagaaaaucaua

SEQ ID NO: 1816872 - RNA, 17 nt, Homo sapiens
auuauguaacuccucca

SEQ ID NO: 1816873 - RNA, 13 nt, Homo sapiens
accugacucuugc

SEQ ID NO: 1816874 - RNA, 16 nt, Homo sapiens
uaaucuguauucuugc

SEQ ID NO: 1816875 - RNA, 16 nt, Homo sapiens
auaaaauguaugacca

SEQ ID NO: 1816876 - RNA, 18 nt, Homo sapiens
uacuggcaucuguuaucu

SEQ ID NO: 1816877 - RNA, 23 nt, Homo sapiens
acaaacuacugugucacugucca

SEQ ID NO: 1816878 - RNA, 13 nt, Homo sapiens
aaauggcaagaga

SEQ ID NO: 1816879 - RNA, 19 nt, Homo sapiens
uuauuguacaaguugaaau

SEQ ID NO: 1816880 - RNA, 20 nt, Homo sapiens
cagggcugggccagugcauc

SEQ ID NO: 1816881 - RNA, 20 nt, Homo sapiens
guucaucccugagaggucug

SEQ ID NO: 1816882 - RNA, 16 nt, Homo sapiens
caccacccucccgcug

SEQ ID NO: 1816883 - RNA, 14 nt, Homo sapiens
acgcagguguaccu

SEQ ID NO: 1816884 - RNA, 15 nt, Homo sapiens
uuauugaguaugagu

SEQ ID NO: 1816885 - RNA, 17 nt, Homo sapiens
cuaaauuuuuacuuaac

SEQ ID NO: 1816886 - RNA, 22 nt, Homo sapiens
ggaccccaccccucaucaggag

SEQ ID NO: 1816887 - RNA, 17 nt, Homo sapiens
ucaguagacugugauuc

SEQ ID NO: 1816888 - RNA, 17 nt, Homo sapiens
gauguucuggaccuccc

SEQ ID NO: 1816889 - RNA, 18 nt, Homo sapiens
ggcugucaccacgugcag

SEQ ID NO: 1816890 - RNA, 20 nt, Homo sapiens
cccaggcccgagaugugacc

SEQ ID NO: 1816891 - RNA, 19 nt, Homo sapiens
cauguuaguuuugcuccuu

SEQ ID NO: 1816892 - RNA, 19 nt, Homo sapiens
guaucuuuuugaaaauguu

SEQ ID NO: 1816893 - RNA, 19 nt, Homo sapiens
cuguuuucuuuugguaaag

SEQ ID NO: 1816894 - RNA, 22 nt, Homo sapiens
uuacaggggagaaggaaaugca

SEQ ID NO: 1816895 - RNA, 19 nt, Homo sapiens
aaucuuguuaaauugcuua

SEQ ID NO: 1816896 - RNA, 20 nt, Homo sapiens
auuuugaguucuacauaagu

SEQ ID NO: 1816897 - RNA, 21 nt, Homo sapiens
uacaguauuuuucugugacca

SEQ ID NO: 1816898 - RNA, 11 nt, Homo sapiens
cuuaggaccag

SEQ ID NO: 1816899 - RNA, 14 nt, Homo sapiens
cuucagucucauau

SEQ ID NO: 1816900 - RNA, 13 nt, Homo sapiens
aggccucugcucu

SEQ ID NO: 1816901 - RNA, 19 nt, Homo sapiens
ucccugauaacaaccugga

SEQ ID NO: 1816902 - RNA, 13 nt, Homo sapiens
uuugggggauuca

SEQ ID NO: 1816903 - RNA, 18 nt, Homo sapiens
acuucucuauuaucucaa

SEQ ID NO: 1816904 - RNA, 23 nt, Homo sapiens
accugcucuuguucuacugagaa

SEQ ID NO: 1816905 - RNA, 17 nt, Homo sapiens
uaauuuuugugagguau

SEQ ID NO: 1816906 - RNA, 15 nt, Homo sapiens
cugcaggauggacug

SEQ ID NO: 1816907 - RNA, 17 nt, Homo sapiens
guguguauccgacucua

SEQ ID NO: 1816908 - RNA, 13 nt, Homo sapiens
acaucugcaauau

SEQ ID NO: 1816909 - RNA, 18 nt, Homo sapiens
acagaggagaagcaaugg

SEQ ID NO: 1816910 - RNA, 12 nt, Homo sapiens
uuucaaagggaa

SEQ ID NO: 1816911 - RNA, 16 nt, Homo sapiens
uaagauagaacacaaa

SEQ ID NO: 1816912 - RNA, 22 nt, Homo sapiens
gggaaaaggaugauggaaaaau

SEQ ID NO: 1816913 - RNA, 13 nt, Homo sapiens
ggcccugaggaau

SEQ ID NO: 1816914 - RNA, 13 nt, Homo sapiens
ugaagcuaaaaaa

SEQ ID NO: 1816915 - RNA, 18 nt, Homo sapiens
ugucauccucaugcugcu

SEQ ID NO: 1816916 - RNA, 20 nt, Homo sapiens
ugcagcggcuccugcaaaag

SEQ ID NO: 1816917 - RNA, 17 nt, Homo sapiens
caccaucuacaccagug

SEQ ID NO: 1816918 - RNA, 14 nt, Homo sapiens
gccacggcacucca

SEQ ID NO: 1816919 - RNA, 16 nt, Homo sapiens
augcacacacauggau

SEQ ID NO: 1816920 - RNA, 24 nt, Homo sapiens
auuugauaccauggcacugacaau

SEQ ID NO: 1816921 - RNA, 16 nt, Homo sapiens
aagaugcuaguucauu

SEQ ID NO: 1816922 - RNA, 12 nt, Homo sapiens
cagacccagugg

SEQ ID NO: 1816923 - RNA, 20 nt, Homo sapiens
aauacuugaaaacuucucau

SEQ ID NO: 1816924 - RNA, 14 nt, Homo sapiens
uaaugucucacugu

SEQ ID NO: 1816925 - RNA, 16 nt, Homo sapiens
aaccacaaacggagcc

SEQ ID NO: 1816926 - RNA, 17 nt, Homo sapiens
caauuugaaacacaaga

SEQ ID NO: 1816927 - RNA, 22 nt, Homo sapiens
acaggaagaugggagguggaag

SEQ ID NO: 1816928 - RNA, 19 nt, Homo sapiens
gacagggccuagcuuucau

SEQ ID NO: 1816929 - RNA, 15 nt, Homo sapiens
agcuacuauaugcau

SEQ ID NO: 1816930 - RNA, 22 nt, Homo sapiens
cuuugggcacggcccuccuucu

SEQ ID NO: 1816931 - RNA, 18 nt, Homo sapiens
auggaaagaaugugggau

SEQ ID NO: 1816932 - RNA, 20 nt, Homo sapiens
auuuggugaauuugaaucuc

SEQ ID NO: 1816933 - RNA, 22 nt, Homo sapiens
uaacaauguuuuuuauacuuca

SEQ ID NO: 1816934 - RNA, 22 nt, Homo sapiens
uuaccugauuugaugauacauu

SEQ ID NO: 1816935 - RNA, 19 nt, Homo sapiens
aaugacguugagcaucuau

SEQ ID NO: 1816936 - RNA, 22 nt, Homo sapiens
ugaaccaagaccauugaauucu

SEQ ID NO: 1816937 - RNA, 18 nt, Homo sapiens
guaugcuuccagggacaa

SEQ ID NO: 1816938 - RNA, 23 nt, Homo sapiens
accagaagaaagggccuucacag

SEQ ID NO: 1816939 - RNA, 23 nt, Homo sapiens
ugcagggaggugcggacucuccu

SEQ ID NO: 1816940 - RNA, 22 nt, Homo sapiens
gaugauuuccuaguagaacuca

SEQ ID NO: 1816941 - RNA, 22 nt, Homo sapiens
ugcuuaauugugaacagccaaa

SEQ ID NO: 1816942 - RNA, 18 nt, Homo sapiens
ggauguggacuuggaugc

SEQ ID NO: 1816943 - RNA, 12 nt, Homo sapiens
uaaucauuccau

SEQ ID NO: 1816944 - RNA, 16 nt, Homo sapiens
cuaagcaaugcaaaug

SEQ ID NO: 1816945 - RNA, 23 nt, Homo sapiens
agugagcacacccgugugcacac

SEQ ID NO: 1816946 - RNA, 20 nt, Homo sapiens
caaucaugugcuucauagaa

SEQ ID NO: 1816947 - RNA, 17 nt, Homo sapiens
ucacugcccaccaaagg

SEQ ID NO: 1816948 - RNA, 15 nt, Homo sapiens
auacagaagcccaug

SEQ ID NO: 1816949 - RNA, 11 nt, Homo sapiens
aaaccacuucu

SEQ ID NO: 1816950 - RNA, 16 nt, Homo sapiens
cuaaauaauacaggau

SEQ ID NO: 1816951 - RNA, 19 nt, Homo sapiens
uguuacugucugacuacaa

SEQ ID NO: 1816952 - RNA, 20 nt, Homo sapiens
aagauggcgacaaaagugau

SEQ ID NO: 1816953 - RNA, 22 nt, Homo sapiens
ucacccaccccugcacaguuga

SEQ ID NO: 1816954 - RNA, 13 nt, Homo sapiens
cauuuacaaagca

SEQ ID NO: 1816955 - RNA, 19 nt, Homo sapiens
cuugaauuccugaccucag

SEQ ID NO: 1816956 - RNA, 12 nt, Homo sapiens
ucuccagcacuu

SEQ ID NO: 1816957 - RNA, 12 nt, Homo sapiens
accccagcuccu

SEQ ID NO: 1816958 - RNA, 15 nt, Homo sapiens
uaaaauauuauugaa

SEQ ID NO: 1816959 - RNA, 15 nt, Homo sapiens
gcuugugugcaaaag

SEQ ID NO: 1816960 - RNA, 13 nt, Homo sapiens
auuuaacuugagg

SEQ ID NO: 1816961 - RNA, 14 nt, Homo sapiens
gugucugugcccuc

SEQ ID NO: 1816962 - RNA, 18 nt, Homo sapiens
cucuggggaagucagggg

SEQ ID NO: 1816963 - RNA, 24 nt, Homo sapiens
ugcuacugauuguuucauugcgaa

SEQ ID NO: 1816964 - RNA, 13 nt, Homo sapiens
cagaagugugacu

SEQ ID NO: 1816965 - RNA, 16 nt, Homo sapiens
cuggcucuuugcugug

SEQ ID NO: 1816966 - RNA, 23 nt, Homo sapiens
agucaccuauccacccucugcau

SEQ ID NO: 1816967 - RNA, 21 nt, Homo sapiens
cauaagguuuuauucauauau

SEQ ID NO: 1816968 - RNA, 21 nt, Homo sapiens
aauguuauuaagcaguuaaua

SEQ ID NO: 1816969 - RNA, 20 nt, Homo sapiens
caggacacugcagaacagcu

SEQ ID NO: 1816970 - RNA, 18 nt, Homo sapiens
aaacauguaauauaaaga

SEQ ID NO: 1816971 - RNA, 15 nt, Homo sapiens
ucucucuugcaggaa

SEQ ID NO: 1816972 - RNA, 19 nt, Homo sapiens
aauuuauaagcauugccau

SEQ ID NO: 1816973 - RNA, 22 nt, Homo sapiens
acagcugugucugccaaacaca

SEQ ID NO: 1816974 - RNA, 14 nt, Homo sapiens
ccuggcuucuggga

SEQ ID NO: 1816975 - RNA, 16 nt, Homo sapiens
acugaaaugccugcuu

SEQ ID NO: 1816976 - RNA, 14 nt, Homo sapiens
aaaagagauugaga

SEQ ID NO: 1816977 - RNA, 15 nt, Homo sapiens
uaaaauuacauucua

SEQ ID NO: 1816978 - RNA, 22 nt, Homo sapiens
ggagguugcauugagcugagau

SEQ ID NO: 1816979 - RNA, 14 nt, Homo sapiens
ugaauuucaguccu

SEQ ID NO: 1816980 - RNA, 23 nt, Homo sapiens
uugggagggugguucaacaaaga

SEQ ID NO: 1816981 - RNA, 15 nt, Homo sapiens
gugaaaggaaagagg

SEQ ID NO: 1816982 - RNA, 17 nt, Homo sapiens
agcuguccuccuggcac

SEQ ID NO: 1816983 - RNA, 17 nt, Homo sapiens
aagacauucaccaacaa

SEQ ID NO: 1816984 - RNA, 18 nt, Homo sapiens
agcccaagcuucccucca

SEQ ID NO: 1816985 - RNA, 18 nt, Homo sapiens
acaaauuuucuggugcua

SEQ ID NO: 1816986 - RNA, 22 nt, Homo sapiens
uuucuuuuuacuguugaacuua

SEQ ID NO: 1816987 - RNA, 18 nt, Homo sapiens
uucuuuaucgcccugaga

SEQ ID NO: 1816988 - RNA, 19 nt, Homo sapiens
ggccaccccacucuaccuc

SEQ ID NO: 1816989 - RNA, 16 nt, Homo sapiens
uaaugcuuuguuaaau

SEQ ID NO: 1816990 - RNA, 17 nt, Homo sapiens
uagaauugcaaucuaua

SEQ ID NO: 1816991 - RNA, 23 nt, Homo sapiens
gauuccauuuuacuuccaugaua

SEQ ID NO: 1816992 - RNA, 17 nt, Homo sapiens
uguuggauuucagugau

SEQ ID NO: 1816993 - RNA, 21 nt, Homo sapiens
gacuccgggcacggcuuccca

SEQ ID NO: 1816994 - RNA, 21 nt, Homo sapiens
uaaugcuuuccucccuggcau

SEQ ID NO: 1816995 - RNA, 22 nt, Homo sapiens
cacugugugccuucugccaacg

SEQ ID NO: 1816996 - RNA, 18 nt, Homo sapiens
aguucauaacagugccau

SEQ ID NO: 1816997 - RNA, 14 nt, Homo sapiens
cauucaugaugaac

SEQ ID NO: 1816998 - RNA, 20 nt, Homo sapiens
ugcgcagucauuggcccaac

SEQ ID NO: 1816999 - RNA, 19 nt, Homo sapiens
aauaaaagaugauuucuca

SEQ ID NO: 1817000 - RNA, 21 nt, Homo sapiens
gagucaggacuugaacccagg

SEQ ID NO: 1817001 - RNA, 17 nt, Homo sapiens
auguuuauagcauuccu

SEQ ID NO: 1817002 - RNA, 22 nt, Homo sapiens
uaaaagccccaaauggugguaa

SEQ ID NO: 1817003 - RNA, 13 nt, Homo sapiens
ugcgcguccugcc

SEQ ID NO: 1817004 - RNA, 22 nt, Homo sapiens
uaaaaauauauagcgacauccu

SEQ ID NO: 1817005 - RNA, 22 nt, Homo sapiens
ggacuauuauaauuuaaugcau

SEQ ID NO: 1817006 - RNA, 22 nt, Homo sapiens
ggaggacagaauucucccagcg

SEQ ID NO: 1817007 - RNA, 12 nt, Homo sapiens
acuccuucagga

SEQ ID NO: 1817008 - RNA, 13 nt, Homo sapiens
cugacaaauggaa

SEQ ID NO: 1817009 - RNA, 15 nt, Homo sapiens
aguguauaugaauga

SEQ ID NO: 1817010 - RNA, 20 nt, Homo sapiens
uuaagccuuauaaaccaauc

SEQ ID NO: 1817011 - RNA, 23 nt, Homo sapiens
cacagggacacacgugagccaca

SEQ ID NO: 1817012 - RNA, 14 nt, Homo sapiens
aauggacugggaaa

SEQ ID NO: 1817013 - RNA, 22 nt, Homo sapiens
agugguaaauauagaaccauga

SEQ ID NO: 1817014 - RNA, 16 nt, Homo sapiens
aggagcuuugacucag

SEQ ID NO: 1817015 - RNA, 16 nt, Homo sapiens
cugaguggucugacac

SEQ ID NO: 1817016 - RNA, 14 nt, Homo sapiens
gucuaccugagauc

SEQ ID NO: 1817017 - RNA, 16 nt, Homo sapiens
auuagcaucccauacu

SEQ ID NO: 1817018 - RNA, 19 nt, Homo sapiens
ucaaggcuuccacugcaaa

SEQ ID NO: 1817019 - RNA, 15 nt, Homo sapiens
ucuucuggaucugcu

SEQ ID NO: 1817020 - RNA, 15 nt, Homo sapiens
cagacgagcagugac

SEQ ID NO: 1817021 - RNA, 19 nt, Homo sapiens
uagccaucuugaagugaug

SEQ ID NO: 1817022 - RNA, 13 nt, Homo sapiens
uccaacccacugg

SEQ ID NO: 1817023 - RNA, 12 nt, Homo sapiens
ucuucaauguca

SEQ ID NO: 1817024 - RNA, 23 nt, Homo sapiens
guuugcucuuuuaagcagucuca

SEQ ID NO: 1817025 - RNA, 22 nt, Homo sapiens
caaagaaugaaacaauccaaaa

SEQ ID NO: 1817026 - RNA, 17 nt, Homo sapiens
agcuauaagagaacuuu

SEQ ID NO: 1817027 - RNA, 20 nt, Homo sapiens
acucacuaaaaguucucaaa

SEQ ID NO: 1817028 - RNA, 13 nt, Homo sapiens
gcugccucucuuu

SEQ ID NO: 1817029 - RNA, 14 nt, Homo sapiens
uccacccauccagu

SEQ ID NO: 1817030 - RNA, 14 nt, Homo sapiens
cacugccacacucu

SEQ ID NO: 1817031 - RNA, 11 nt, Homo sapiens
ucuccaugugu

SEQ ID NO: 1817032 - RNA, 16 nt, Homo sapiens
uaggggaacaucaccc

SEQ ID NO: 1817033 - RNA, 20 nt, Homo sapiens
gccuuuuuguauaaaauaga

SEQ ID NO: 1817034 - RNA, 17 nt, Homo sapiens
gccgacuccacuuucau

SEQ ID NO: 1817035 - RNA, 14 nt, Homo sapiens
acacaggcaaaauc

SEQ ID NO: 1817036 - RNA, 14 nt, Homo sapiens
agccagcugcuuga

SEQ ID NO: 1817037 - RNA, 16 nt, Homo sapiens
uccagauggcaugugu

SEQ ID NO: 1817038 - RNA, 20 nt, Homo sapiens
agcuuccccaggagcucucu

SEQ ID NO: 1817039 - RNA, 17 nt, Homo sapiens
aacaagucccuuuaugc

SEQ ID NO: 1817040 - RNA, 16 nt, Homo sapiens
uuguucauucugugac

SEQ ID NO: 1817041 - RNA, 13 nt, Homo sapiens
acuuuauguucua

SEQ ID NO: 1817042 - RNA, 16 nt, Homo sapiens
ccagaguggagucuga

SEQ ID NO: 1817043 - RNA, 17 nt, Homo sapiens
auaaguguucaguguug

SEQ ID NO: 1817044 - RNA, 13 nt, Homo sapiens
aauaucaucucaa

SEQ ID NO: 1817045 - RNA, 18 nt, Homo sapiens
uuacauuuucaguaccaa

SEQ ID NO: 1817046 - RNA, 14 nt, Homo sapiens
gugauccuguucug

SEQ ID NO: 1817047 - RNA, 15 nt, Homo sapiens
caauuuugucuauua

SEQ ID NO: 1817048 - RNA, 13 nt, Homo sapiens
auuaaaagaauga

SEQ ID NO: 1817049 - RNA, 12 nt, Homo sapiens
cauggacaugca

SEQ ID NO: 1817050 - RNA, 18 nt, Homo sapiens
uucucacccuacucugga

SEQ ID NO: 1817051 - RNA, 13 nt, Homo sapiens
uacauauuuggag

SEQ ID NO: 1817052 - RNA, 19 nt, Homo sapiens
uacaaagguugcagugcug

SEQ ID NO: 1817053 - RNA, 15 nt, Homo sapiens
ucaguuucugccugg

SEQ ID NO: 1817054 - RNA, 13 nt, Homo sapiens
cagaccaccugcc

SEQ ID NO: 1817055 - RNA, 22 nt, Homo sapiens
cugaagaauaaucuaaauucau

SEQ ID NO: 1817056 - RNA, 15 nt, Homo sapiens
ucuugacuggcucaa

SEQ ID NO: 1817057 - RNA, 15 nt, Homo sapiens
acuaauacaauucau

SEQ ID NO: 1817058 - RNA, 16 nt, Homo sapiens
uauauggacagcuuua

SEQ ID NO: 1817059 - RNA, 20 nt, Homo sapiens
cacagccccuggagccucag

SEQ ID NO: 1817060 - RNA, 15 nt, Homo sapiens
gugauaaugcagacu

SEQ ID NO: 1817061 - RNA, 19 nt, Homo sapiens
caaggcugaugcauucccg

SEQ ID NO: 1817062 - RNA, 16 nt, Homo sapiens
gccugaaaccagugac

SEQ ID NO: 1817063 - RNA, 21 nt, Homo sapiens
cugcuuuaguuucacauugca

SEQ ID NO: 1817064 - RNA, 18 nt, Homo sapiens
uuugcauaauaugcauau

SEQ ID NO: 1817065 - RNA, 12 nt, Homo sapiens
aacaggcaguug

SEQ ID NO: 1817066 - RNA, 14 nt, Homo sapiens
aaaugacuauugua

SEQ ID NO: 1817067 - RNA, 21 nt, Homo sapiens
cauacacaccccggacuccuc

SEQ ID NO: 1817068 - RNA, 11 nt, Homo sapiens
aguugcaagac

SEQ ID NO: 1817069 - RNA, 23 nt, Homo sapiens
cauaugaaugcagcacugcugcc

SEQ ID NO: 1817070 - RNA, 20 nt, Homo sapiens
cuguuaacuuaauaguauuu

SEQ ID NO: 1817071 - RNA, 11 nt, Homo sapiens
agccugucacc

SEQ ID NO: 1817072 - RNA, 21 nt, Homo sapiens
ugccagaggcuggaccacaca

SEQ ID NO: 1817073 - RNA, 20 nt, Homo sapiens
ccaaaggacccaaguacuuu

SEQ ID NO: 1817074 - RNA, 23 nt, Homo sapiens
aaaauaaccggauauauacauag

SEQ ID NO: 1817075 - RNA, 16 nt, Homo sapiens
ugaacucacccuggga

SEQ ID NO: 1817076 - RNA, 18 nt, Homo sapiens
caagccgggaaugagcuu

SEQ ID NO: 1817077 - RNA, 23 nt, Homo sapiens
cuccugguguggguaaagggaca

SEQ ID NO: 1817078 - RNA, 19 nt, Homo sapiens
uaaggaaaaguaagggaau

SEQ ID NO: 1817079 - RNA, 16 nt, Homo sapiens
aaguagcacacugagu

SEQ ID NO: 1817080 - RNA, 23 nt, Homo sapiens
ucucuccugugugcuugucagug

SEQ ID NO: 1817081 - RNA, 11 nt, Homo sapiens
gucacaugaug

SEQ ID NO: 1817082 - RNA, 12 nt, Homo sapiens
agagaaagggag

SEQ ID NO: 1817083 - RNA, 18 nt, Homo sapiens
cauaucaguugagcuuca

SEQ ID NO: 1817084 - RNA, 12 nt, Homo sapiens
guaaaacaaaga

SEQ ID NO: 1817085 - RNA, 16 nt, Homo sapiens
caucagcuaaacacca

SEQ ID NO: 1817086 - RNA, 13 nt, Homo sapiens
uuucuuuauauca

SEQ ID NO: 1817087 - RNA, 15 nt, Homo sapiens
ucagugggcucucuu

SEQ ID NO: 1817088 - RNA, 17 nt, Homo sapiens
uugacuggcuugcuccc

SEQ ID NO: 1817089 - RNA, 19 nt, Homo sapiens
ccccagaggccucucucuc

SEQ ID NO: 1817090 - RNA, 13 nt, Homo sapiens
caucuaauaugau

SEQ ID NO: 1817091 - RNA, 19 nt, Homo sapiens
ggacugcugacauuuugca

SEQ ID NO: 1817092 - RNA, 19 nt, Homo sapiens
cuccucccaggaacugggc

SEQ ID NO: 1817093 - RNA, 11 nt, Homo sapiens
cagagcugccu

SEQ ID NO: 1817094 - RNA, 22 nt, Homo sapiens
gaugacuuucuuuuuguagcug

SEQ ID NO: 1817095 - RNA, 21 nt, Homo sapiens
cucuucccuucccagaccagg

SEQ ID NO: 1817096 - RNA, 21 nt, Homo sapiens
cuugcaauaccaauguucuaa

SEQ ID NO: 1817097 - RNA, 22 nt, Homo sapiens
cuggcucuugaggcauuuccag

SEQ ID NO: 1817098 - RNA, 20 nt, Homo sapiens
uguaauagaaauaaaccuau

SEQ ID NO: 1817099 - RNA, 15 nt, Homo sapiens
ugggaucccagacuu

SEQ ID NO: 1817100 - RNA, 15 nt, Homo sapiens
agcccuacucacaca

SEQ ID NO: 1817101 - RNA, 15 nt, Homo sapiens
auacugaggggucua

SEQ ID NO: 1817102 - RNA, 12 nt, Homo sapiens
ugcugugucaca

SEQ ID NO: 1817103 - RNA, 12 nt, Homo sapiens
ccauccuuguga

SEQ ID NO: 1817104 - RNA, 21 nt, Homo sapiens
acaacuccuuccauccuugac

SEQ ID NO: 1817105 - RNA, 12 nt, Homo sapiens
gccucaucucag

SEQ ID NO: 1817106 - RNA, 23 nt, Homo sapiens
cagagaccuuuucucucccauac

SEQ ID NO: 1817107 - RNA, 20 nt, Homo sapiens
auuauaucugaggcacugau

SEQ ID NO: 1817108 - RNA, 18 nt, Homo sapiens
uacaucuguacaugacug

SEQ ID NO: 1817109 - RNA, 20 nt, Homo sapiens
cuuccguggucagagugcca

SEQ ID NO: 1817110 - RNA, 14 nt, Homo sapiens
cuucagguggaaaa

SEQ ID NO: 1817111 - RNA, 16 nt, Homo sapiens
caucuagccagaggcu

SEQ ID NO: 1817112 - RNA, 23 nt, Homo sapiens
aauuuuagaugccugugaaauag

SEQ ID NO: 1817113 - RNA, 20 nt, Homo sapiens
ggacaaacagcucaguucua

SEQ ID NO: 1817114 - RNA, 21 nt, Homo sapiens
agugguuguccccguaccacc

SEQ ID NO: 1817115 - RNA, 22 nt, Homo sapiens
cuaaaaugauacuguguucccu

SEQ ID NO: 1817116 - RNA, 22 nt, Homo sapiens
agcagugugaccuccugugacc

SEQ ID NO: 1817117 - RNA, 18 nt, Homo sapiens
acucuagugcuacaugau

SEQ ID NO: 1817118 - RNA, 23 nt, Homo sapiens
gcguguggcucacgugugugacu

SEQ ID NO: 1817119 - RNA, 13 nt, Homo sapiens
cuuuuucaaaaau

SEQ ID NO: 1817120 - RNA, 21 nt, Homo sapiens
auauguucacaccuagcguca

SEQ ID NO: 1817121 - RNA, 18 nt, Homo sapiens
uuuaacccauuugucucu

SEQ ID NO: 1817122 - RNA, 23 nt, Homo sapiens
gcacauauccaggcaccaggacu

SEQ ID NO: 1817123 - RNA, 19 nt, Homo sapiens
ugcuggaaacauucacuuu

SEQ ID NO: 1817124 - RNA, 14 nt, Homo sapiens
aucacaccacuaca

SEQ ID NO: 1817125 - RNA, 23 nt, Homo sapiens
aaggagagguuggggacacgcac

SEQ ID NO: 1817126 - RNA, 15 nt, Homo sapiens
acaauauucaaucaa

SEQ ID NO: 1817127 - RNA, 13 nt, Homo sapiens
aagaaaagcuggu

SEQ ID NO: 1817128 - RNA, 13 nt, Homo sapiens
augacacauuuga

SEQ ID NO: 1817129 - RNA, 13 nt, Homo sapiens
uuugauacuaaaa

SEQ ID NO: 1817130 - RNA, 15 nt, Homo sapiens
acuuugaaagagcuu

SEQ ID NO: 1817131 - RNA, 20 nt, Homo sapiens
ucuugaauccuuccauucca

SEQ ID NO: 1817132 - RNA, 20 nt, Homo sapiens
gcggucauucuacacugagg

SEQ ID NO: 1817133 - RNA, 21 nt, Homo sapiens
cuccaguguaucucaaaagac

SEQ ID NO: 1817134 - RNA, 15 nt, Homo sapiens
acccaccucagccuc

SEQ ID NO: 1817135 - RNA, 14 nt, Homo sapiens
caucaggcucagcu

SEQ ID NO: 1817136 - RNA, 22 nt, Homo sapiens
caacagaacucccgggccccaa

SEQ ID NO: 1817137 - RNA, 23 nt, Homo sapiens
gcaugaccugugaccagcacugu

SEQ ID NO: 1817138 - RNA, 16 nt, Homo sapiens
gacugucucacuuaau

SEQ ID NO: 1817139 - RNA, 13 nt, Homo sapiens
caacuguugacau

SEQ ID NO: 1817140 - RNA, 18 nt, Homo sapiens
ugcccuccaagaggcucc

SEQ ID NO: 1817141 - RNA, 17 nt, Homo sapiens
cugaaaacuacacaaau

SEQ ID NO: 1817142 - RNA, 16 nt, Homo sapiens
ugcauuuggucagggg

SEQ ID NO: 1817143 - RNA, 22 nt, Homo sapiens
uccuggggcuggguguguuuca

SEQ ID NO: 1817144 - RNA, 21 nt, Homo sapiens
uaaaucuuucuuuugauucuu

SEQ ID NO: 1817145 - RNA, 18 nt, Homo sapiens
ucauuuucaaugcacauu

SEQ ID NO: 1817146 - RNA, 16 nt, Homo sapiens
ugcuuucagauccauc

SEQ ID NO: 1817147 - RNA, 13 nt, Homo sapiens
cacugcaaacccu

SEQ ID NO: 1817148 - RNA, 16 nt, Homo sapiens
gcucagggcugacacg

SEQ ID NO: 1817149 - RNA, 18 nt, Homo sapiens
ugauguggcaacugcuga

SEQ ID NO: 1817150 - RNA, 20 nt, Homo sapiens
cagauaugcacacacaugga

SEQ ID NO: 1817151 - RNA, 20 nt, Homo sapiens
cuaguuugaccucacaguga

SEQ ID NO: 1817152 - RNA, 22 nt, Homo sapiens
ugaaggaucaucuauguauuca

SEQ ID NO: 1817153 - RNA, 20 nt, Homo sapiens
agcuggagggagguggggca

SEQ ID NO: 1817154 - RNA, 12 nt, Homo sapiens
agaaaugggaga

SEQ ID NO: 1817155 - RNA, 15 nt, Homo sapiens
aagcgccgacucccu

SEQ ID NO: 1817156 - RNA, 15 nt, Homo sapiens
uucauuugcuugcaa

SEQ ID NO: 1817157 - RNA, 18 nt, Homo sapiens
uaccuuucagaagguguu

SEQ ID NO: 1817158 - RNA, 13 nt, Homo sapiens
uucaggguuuuau

SEQ ID NO: 1817159 - RNA, 16 nt, Homo sapiens
gggaccacagacucac

SEQ ID NO: 1817160 - RNA, 13 nt, Homo sapiens
cggguccccggca

SEQ ID NO: 1817161 - RNA, 16 nt, Homo sapiens
gaacaggauuccagaa

SEQ ID NO: 1817162 - RNA, 14 nt, Homo sapiens
agcuuucucucaga

SEQ ID NO: 1817163 - RNA, 11 nt, Homo sapiens
uagcccagaaa

SEQ ID NO: 1817164 - RNA, 20 nt, Homo sapiens
agagaaaguuucagauuugc

SEQ ID NO: 1817165 - RNA, 12 nt, Homo sapiens
uaugugggacac

SEQ ID NO: 1817166 - RNA, 18 nt, Homo sapiens
uuaccuaaaucuguuuga

SEQ ID NO: 1817167 - RNA, 23 nt, Homo sapiens
cccuacccuccugcugagcugcc

SEQ ID NO: 1817168 - RNA, 19 nt, Homo sapiens
uucauguuaguuaccuuau

SEQ ID NO: 1817169 - RNA, 20 nt, Homo sapiens
ucauuaauaaaaauucuuau

SEQ ID NO: 1817170 - RNA, 23 nt, Homo sapiens
acaagaccccugcuccugacuua

SEQ ID NO: 1817171 - RNA, 12 nt, Homo sapiens
acucugguggca

SEQ ID NO: 1817172 - RNA, 15 nt, Homo sapiens
uguauguagccuuag

SEQ ID NO: 1817173 - RNA, 21 nt, Homo sapiens
cuuaaugucagucuacaggcc

SEQ ID NO: 1817174 - RNA, 22 nt, Homo sapiens
cucugagguaaagguccaugaa

SEQ ID NO: 1817175 - RNA, 15 nt, Homo sapiens
uucaccagauuugcu

SEQ ID NO: 1817176 - RNA, 23 nt, Homo sapiens
acaaauagucuaucaaccccaga

SEQ ID NO: 1817177 - RNA, 18 nt, Homo sapiens
uuuauacaccauuguucc

SEQ ID NO: 1817178 - RNA, 14 nt, Homo sapiens
gaggccuuagcaau

SEQ ID NO: 1817179 - RNA, 16 nt, Homo sapiens
aggagaccuccagcua

SEQ ID NO: 1817180 - RNA, 17 nt, Homo sapiens
uuccaaagaacagccug

SEQ ID NO: 1817181 - RNA, 15 nt, Homo sapiens
auggagccaugacaa

SEQ ID NO: 1817182 - RNA, 22 nt, Homo sapiens
cgaaggaaccuguguuaucaca

SEQ ID NO: 1817183 - RNA, 15 nt, Homo sapiens
auuugaaugaacacu

SEQ ID NO: 1817184 - RNA, 21 nt, Homo sapiens
ugccuucuguugagaauuauc

SEQ ID NO: 1817185 - RNA, 22 nt, Homo sapiens
ccagugaaauagaacacagaac

SEQ ID NO: 1817186 - RNA, 18 nt, Homo sapiens
ccucaccacagccuucua

SEQ ID NO: 1817187 - RNA, 17 nt, Homo sapiens
caaaaauguccagccac

SEQ ID NO: 1817188 - RNA, 14 nt, Homo sapiens
auggcaccucugcc

SEQ ID NO: 1817189 - RNA, 15 nt, Homo sapiens
aaggcggcagguggg

SEQ ID NO: 1817190 - RNA, 23 nt, Homo sapiens
acuaccccuccucagacaacagc

SEQ ID NO: 1817191 - RNA, 21 nt, Homo sapiens
gucaaagaaaacuuccaaaaa

SEQ ID NO: 1817192 - RNA, 22 nt, Homo sapiens
caggcugcugcauggcacugac

SEQ ID NO: 1817193 - RNA, 19 nt, Homo sapiens
gcaauacaacuuuaccaua

SEQ ID NO: 1817194 - RNA, 18 nt, Homo sapiens
auuucaguccagaagaau

SEQ ID NO: 1817195 - RNA, 16 nt, Homo sapiens
uacuggaaauguagca

SEQ ID NO: 1817196 - RNA, 19 nt, Homo sapiens
ucgcgucucauuuugucca

SEQ ID NO: 1817197 - RNA, 22 nt, Homo sapiens
uacagguuacagugagcaaaga

SEQ ID NO: 1817198 - RNA, 17 nt, Homo sapiens
agcuuuuugauguauaa

SEQ ID NO: 1817199 - RNA, 17 nt, Homo sapiens
augggaagcauguggau

SEQ ID NO: 1817200 - RNA, 21 nt, Homo sapiens
auuccugguugauacaguuca

SEQ ID NO: 1817201 - RNA, 21 nt, Homo sapiens
cuuucauaccacuugaauuua

SEQ ID NO: 1817202 - RNA, 19 nt, Homo sapiens
caaagagaaaucacagggg

SEQ ID NO: 1817203 - RNA, 19 nt, Homo sapiens
augcauucccggugcagaa

SEQ ID NO: 1817204 - RNA, 19 nt, Homo sapiens
agugccuucaacacagcuu

SEQ ID NO: 1817205 - RNA, 18 nt, Homo sapiens
aauguguucugucacuca

SEQ ID NO: 1817206 - RNA, 20 nt, Homo sapiens
cagcugaggccuugccuuga

SEQ ID NO: 1817207 - RNA, 15 nt, Homo sapiens
aauguauauacccac

SEQ ID NO: 1817208 - RNA, 21 nt, Homo sapiens
auucccuuuuuaaaugagcuu

SEQ ID NO: 1817209 - RNA, 19 nt, Homo sapiens
gcuggguauuggaaaugga

SEQ ID NO: 1817210 - RNA, 22 nt, Homo sapiens
cuggucaaccccacaagcacca

SEQ ID NO: 1817211 - RNA, 21 nt, Homo sapiens
auuucagaggggaggcucagg

SEQ ID NO: 1817212 - RNA, 19 nt, Homo sapiens
gaaaagcaguggcuccauu

SEQ ID NO: 1817213 - RNA, 23 nt, Homo sapiens
ucccuaaguccacucuaguugug

SEQ ID NO: 1817214 - RNA, 17 nt, Homo sapiens
ugauucacugccuuccu

SEQ ID NO: 1817215 - RNA, 17 nt, Homo sapiens
auacuaaauuauagugu

SEQ ID NO: 1817216 - RNA, 20 nt, Homo sapiens
ggguccuagaugccaaaggg

SEQ ID NO: 1817217 - RNA, 12 nt, Homo sapiens
guaaaaccugag

SEQ ID NO: 1817218 - RNA, 22 nt, Homo sapiens
ucccgccacucgccuucuuaga

SEQ ID NO: 1817219 - RNA, 22 nt, Homo sapiens
aaugcucuucaaaauaaaacau

SEQ ID NO: 1817220 - RNA, 22 nt, Homo sapiens
auaucuacagcuucuauucauu

SEQ ID NO: 1817221 - RNA, 21 nt, Homo sapiens
caguuuucggaaacacugacu

SEQ ID NO: 1817222 - RNA, 18 nt, Homo sapiens
guaaaacaugcuggugaa

SEQ ID NO: 1817223 - RNA, 15 nt, Homo sapiens
ucccaauuauuuauu

SEQ ID NO: 1817224 - RNA, 19 nt, Homo sapiens
aguggguaauccaggcaca

SEQ ID NO: 1817225 - RNA, 19 nt, Homo sapiens
cuaaauaucuagugcuaaa

SEQ ID NO: 1817226 - RNA, 22 nt, Homo sapiens
ccaaggaacuaauuucuucucc

SEQ ID NO: 1817227 - RNA, 17 nt, Homo sapiens
cuccugaaucccuuuca

SEQ ID NO: 1817228 - RNA, 14 nt, Homo sapiens
gcugagaaggacac

SEQ ID NO: 1817229 - RNA, 18 nt, Homo sapiens
aaaccuuauuuuuuccca

SEQ ID NO: 1817230 - RNA, 21 nt, Homo sapiens
agagaucaugaauuauauaau

SEQ ID NO: 1817231 - RNA, 13 nt, Homo sapiens
uaaaagcaguuga

SEQ ID NO: 1817232 - RNA, 21 nt, Homo sapiens
ugaacacuuuugaaaauguac

SEQ ID NO: 1817233 - RNA, 17 nt, Homo sapiens
ucaauagcaaaugaagg

SEQ ID NO: 1817234 - RNA, 22 nt, Homo sapiens
ucacuugaugggccacacaagu

SEQ ID NO: 1817235 - RNA, 14 nt, Homo sapiens
ccagaacccaaauc

SEQ ID NO: 1817236 - RNA, 17 nt, Homo sapiens
gcauuaauagucccauu

SEQ ID NO: 1817237 - RNA, 22 nt, Homo sapiens
ccagaugaacauuucaaauuga

SEQ ID NO: 1817238 - RNA, 20 nt, Homo sapiens
aggcugagaaucagacugac

SEQ ID NO: 1817239 - RNA, 16 nt, Homo sapiens
augcagaaauguggau

SEQ ID NO: 1817240 - RNA, 16 nt, Homo sapiens
uuuugcauuuucacaa

SEQ ID NO: 1817241 - RNA, 18 nt, Homo sapiens
caaguccagauuuacacu

SEQ ID NO: 1817242 - RNA, 14 nt, Homo sapiens
gaaggccaggaaaa

SEQ ID NO: 1817243 - RNA, 22 nt, Homo sapiens
auauccaagauuuaaaugccau

SEQ ID NO: 1817244 - RNA, 15 nt, Homo sapiens
uuccagcaaaauaua

SEQ ID NO: 1817245 - RNA, 22 nt, Homo sapiens
cugccucauuuucacagcacua

SEQ ID NO: 1817246 - RNA, 22 nt, Homo sapiens
ccugugccucuucccaucucaa

SEQ ID NO: 1817247 - RNA, 13 nt, Homo sapiens
acugaugucuccu

SEQ ID NO: 1817248 - RNA, 15 nt, Homo sapiens
uccuccauccaugug

SEQ ID NO: 1817249 - RNA, 22 nt, Homo sapiens
uugaaggguguugcacccuuuu

SEQ ID NO: 1817250 - RNA, 15 nt, Homo sapiens
uggagggcaagcccu

SEQ ID NO: 1817251 - RNA, 18 nt, Homo sapiens
uaucaacauaccuuggcc

SEQ ID NO: 1817252 - RNA, 14 nt, Homo sapiens
gaguccuuacugaa

SEQ ID NO: 1817253 - RNA, 14 nt, Homo sapiens
ugucagaauauucu

SEQ ID NO: 1817254 - RNA, 15 nt, Homo sapiens
gaaaaauauggccuu

SEQ ID NO: 1817255 - RNA, 14 nt, Homo sapiens
caaguuuagugcau

SEQ ID NO: 1817256 - RNA, 20 nt, Homo sapiens
ugagugaaucugcauuuucu

SEQ ID NO: 1817257 - RNA, 21 nt, Homo sapiens
uaaacuguaucaaaucuguau

SEQ ID NO: 1817258 - RNA, 20 nt, Homo sapiens
auuuuaucuugguaguacau

SEQ ID NO: 1817259 - RNA, 20 nt, Homo sapiens
cagauaagacauaucucuaa

SEQ ID NO: 1817260 - RNA, 15 nt, Homo sapiens
acagcucccuaggua

SEQ ID NO: 1817261 - RNA, 18 nt, Homo sapiens
ccgcguggcauccuguga

SEQ ID NO: 1817262 - RNA, 13 nt, Homo sapiens
cccagaaauguau

SEQ ID NO: 1817263 - RNA, 17 nt, Homo sapiens
uuagggcagauuuuggu

SEQ ID NO: 1817264 - RNA, 17 nt, Homo sapiens
ucccgugagccaggcaa

SEQ ID NO: 1817265 - RNA, 21 nt, Homo sapiens
acugcacgguacaaacccaaa

SEQ ID NO: 1817266 - RNA, 21 nt, Homo sapiens
ugacccucaucuuucuuccaa

SEQ ID NO: 1817267 - RNA, 15 nt, Homo sapiens
cuuccuuacccaaac

SEQ ID NO: 1817268 - RNA, 23 nt, Homo sapiens
aaaucucacuuuucuccaugagu

SEQ ID NO: 1817269 - RNA, 15 nt, Homo sapiens
auaacaaugacacua

SEQ ID NO: 1817270 - RNA, 17 nt, Homo sapiens
uauaaacuguaugcuca

SEQ ID NO: 1817271 - RNA, 14 nt, Homo sapiens
accaaguccuggga

SEQ ID NO: 1817272 - RNA, 17 nt, Homo sapiens
aggguggaugaucucaa

SEQ ID NO: 1817273 - RNA, 17 nt, Homo sapiens
uuuccuuaccauuguga

SEQ ID NO: 1817274 - RNA, 19 nt, Homo sapiens
uuuucaagagugcaguuga

SEQ ID NO: 1817275 - RNA, 22 nt, Homo sapiens
gcccauaaucccagcacuuugg

SEQ ID NO: 1817276 - RNA, 14 nt, Homo sapiens
cagucuuucaacuc

SEQ ID NO: 1817277 - RNA, 22 nt, Homo sapiens
uuaaagcaaauaaaugaacuga

SEQ ID NO: 1817278 - RNA, 23 nt, Homo sapiens
acaauuuaugcgaaccuaugucu

SEQ ID NO: 1817279 - RNA, 20 nt, Homo sapiens
gccuacaaccaucccugcca

SEQ ID NO: 1817280 - RNA, 19 nt, Homo sapiens
uaaaucuauucauaagucu

SEQ ID NO: 1817281 - RNA, 13 nt, Homo sapiens
uguccuaugcgcu

SEQ ID NO: 1817282 - RNA, 21 nt, Homo sapiens
gggaucucaaugcuuuccaca

SEQ ID NO: 1817283 - RNA, 14 nt, Homo sapiens
uauccuuguagcaa

SEQ ID NO: 1817284 - RNA, 17 nt, Homo sapiens
aaccucuuaucacuaag

SEQ ID NO: 1817285 - RNA, 22 nt, Homo sapiens
augaugucccuauggaagcaua

SEQ ID NO: 1817286 - RNA, 15 nt, Homo sapiens
uauccuuuugcuaca

SEQ ID NO: 1817287 - RNA, 17 nt, Homo sapiens
auuauuacuccuugcca

SEQ ID NO: 1817288 - RNA, 22 nt, Homo sapiens
cuagcaaugccugagccugaac

SEQ ID NO: 1817289 - RNA, 15 nt, Homo sapiens
aaaauguaaauacuc

SEQ ID NO: 1817290 - RNA, 16 nt, Homo sapiens
cuaccuuuucucuuca

SEQ ID NO: 1817291 - RNA, 17 nt, Homo sapiens
cuacauggacucagaga

SEQ ID NO: 1817292 - RNA, 22 nt, Homo sapiens
aacuguggaaggcacacugagc

SEQ ID NO: 1817293 - RNA, 12 nt, Homo sapiens
caaauaauagca

SEQ ID NO: 1817294 - RNA, 23 nt, Homo sapiens
cucgguaaaccgaggacccauga

SEQ ID NO: 1817295 - RNA, 17 nt, Homo sapiens
cacagggcaugaaauga

SEQ ID NO: 1817296 - RNA, 19 nt, Homo sapiens
cccuuggcaguguggcagu

SEQ ID NO: 1817297 - RNA, 12 nt, Homo sapiens
aaugcuccccac

SEQ ID NO: 1817298 - RNA, 19 nt, Homo sapiens
uaauuuaaaaaauaacuac

SEQ ID NO: 1817299 - RNA, 13 nt, Homo sapiens
gcccuagcauuuc

SEQ ID NO: 1817300 - RNA, 22 nt, Homo sapiens
gcucacugaaaagacuauugug

SEQ ID NO: 1817301 - RNA, 21 nt, Homo sapiens
caggagacccuagaugugcuc

SEQ ID NO: 1817302 - RNA, 21 nt, Homo sapiens
uccagaaguccuuauguuaag

SEQ ID NO: 1817303 - RNA, 15 nt, Homo sapiens
cuagucucuacccag

SEQ ID NO: 1817304 - RNA, 16 nt, Homo sapiens
ccuugccuggaacuca

SEQ ID NO: 1817305 - RNA, 21 nt, Homo sapiens
guaguuucucuguaaggcaaa

SEQ ID NO: 1817306 - RNA, 15 nt, Homo sapiens
acagauuaaacuuca

SEQ ID NO: 1817307 - RNA, 15 nt, Homo sapiens
ugcccucuagagccu

SEQ ID NO: 1817308 - RNA, 13 nt, Homo sapiens
augcauacuacaa

SEQ ID NO: 1817309 - RNA, 20 nt, Homo sapiens
ccugcccuucaacaauggcc

SEQ ID NO: 1817310 - RNA, 22 nt, Homo sapiens
uaaguaucucaacaacauguca

SEQ ID NO: 1817311 - RNA, 20 nt, Homo sapiens
auaguucccuagucuauuca

SEQ ID NO: 1817312 - RNA, 17 nt, Homo sapiens
uaggaaauuccuucaua

SEQ ID NO: 1817313 - RNA, 17 nt, Homo sapiens
acaugcccuguguggcu

SEQ ID NO: 1817314 - RNA, 14 nt, Homo sapiens
uccuugccugauga

SEQ ID NO: 1817315 - RNA, 15 nt, Homo sapiens
gcuacucucuugcca

SEQ ID NO: 1817316 - RNA, 22 nt, Homo sapiens
guuuaugcauagauaaucucuc

SEQ ID NO: 1817317 - RNA, 20 nt, Homo sapiens
auccaucguaauuguucucu

SEQ ID NO: 1817318 - RNA, 18 nt, Homo sapiens
gaaagcaucaccucaggc

SEQ ID NO: 1817319 - RNA, 20 nt, Homo sapiens
gaguaacuugcaaguuuuca

SEQ ID NO: 1817320 - RNA, 16 nt, Homo sapiens
ggaccugagaccugaa

SEQ ID NO: 1817321 - RNA, 15 nt, Homo sapiens
uuccagaucuuucag

SEQ ID NO: 1817322 - RNA, 14 nt, Homo sapiens
caguagaacuccag

SEQ ID NO: 1817323 - RNA, 14 nt, Homo sapiens
augcgcaaaacugc

SEQ ID NO: 1817324 - RNA, 13 nt, Homo sapiens
cauguguguacau

SEQ ID NO: 1817325 - RNA, 17 nt, Homo sapiens
cuagaugugucuuacca

SEQ ID NO: 1817326 - RNA, 19 nt, Homo sapiens
aaauugagaccugagugaa

SEQ ID NO: 1817327 - RNA, 16 nt, Homo sapiens
caggcaagugggacca

SEQ ID NO: 1817328 - RNA, 17 nt, Homo sapiens
gagccugacuguguuca

SEQ ID NO: 1817329 - RNA, 15 nt, Homo sapiens
ccucaacaucuggua

SEQ ID NO: 1817330 - RNA, 18 nt, Homo sapiens
acccaucgugguauguga

SEQ ID NO: 1817331 - RNA, 18 nt, Homo sapiens
acacuccugggcucugaa

SEQ ID NO: 1817332 - RNA, 13 nt, Homo sapiens
gcccacauuaagc

SEQ ID NO: 1817333 - RNA, 19 nt, Homo sapiens
gcccuuugcuaaaauauaa

SEQ ID NO: 1817334 - RNA, 13 nt, Homo sapiens
agcuuucuaacuc

SEQ ID NO: 1817335 - RNA, 16 nt, Homo sapiens
cuggacucuucaaaaa

SEQ ID NO: 1817336 - RNA, 14 nt, Homo sapiens
ccaggccuccagcu

SEQ ID NO: 1817337 - RNA, 15 nt, Homo sapiens
acugcuguuguugaa

SEQ ID NO: 1817338 - RNA, 20 nt, Homo sapiens
cagcccugcaccaugcugcu

SEQ ID NO: 1817339 - RNA, 18 nt, Homo sapiens
cucugcauggaacagcau

SEQ ID NO: 1817340 - RNA, 16 nt, Homo sapiens
ucagcaauacucauca

SEQ ID NO: 1817341 - RNA, 16 nt, Homo sapiens
gauauuuuuccauuuu

SEQ ID NO: 1817342 - RNA, 12 nt, Homo sapiens
auggaguugcca

SEQ ID NO: 1817343 - RNA, 14 nt, Homo sapiens
agagggagggagca

SEQ ID NO: 1817344 - RNA, 23 nt, Homo sapiens
gcuuucugucuccuuaacacuga

SEQ ID NO: 1817345 - RNA, 19 nt, Homo sapiens
ggcccugcugcccaaucuc

SEQ ID NO: 1817346 - RNA, 17 nt, Homo sapiens
uguaacccaccuugacc

SEQ ID NO: 1817347 - RNA, 17 nt, Homo sapiens
cugagugaauacuuuga

SEQ ID NO: 1817348 - RNA, 21 nt, Homo sapiens
uuaacugugaaauaccacaag

SEQ ID NO: 1817349 - RNA, 16 nt, Homo sapiens
ccaaagcucagacuug

SEQ ID NO: 1817350 - RNA, 14 nt, Homo sapiens
gaacuccaggcaug

SEQ ID NO: 1817351 - RNA, 18 nt, Homo sapiens
ucaggaaauaucugugaa

SEQ ID NO: 1817352 - RNA, 14 nt, Homo sapiens
gguuucacuauucc

SEQ ID NO: 1817353 - RNA, 12 nt, Homo sapiens
uauuuuuugcaa

SEQ ID NO: 1817354 - RNA, 15 nt, Homo sapiens
agaccugagguuggg

SEQ ID NO: 1817355 - RNA, 11 nt, Homo sapiens
gucuucuucca

SEQ ID NO: 1817356 - RNA, 17 nt, Homo sapiens
augcagcaaaaugugaa

SEQ ID NO: 1817357 - RNA, 22 nt, Homo sapiens
uaaauaaagaagaaaauaaccu

SEQ ID NO: 1817358 - RNA, 15 nt, Homo sapiens
acaaaugacuccuaa

SEQ ID NO: 1817359 - RNA, 13 nt, Homo sapiens
agaaacacauaac

SEQ ID NO: 1817360 - RNA, 13 nt, Homo sapiens
ugugccacuuuga

SEQ ID NO: 1817361 - RNA, 14 nt, Homo sapiens
aaaggaaacauaua

SEQ ID NO: 1817362 - RNA, 16 nt, Homo sapiens
uacuuaccauuugcua

SEQ ID NO: 1817363 - RNA, 21 nt, Homo sapiens
aggaugccaaguggcccucag

SEQ ID NO: 1817364 - RNA, 20 nt, Homo sapiens
gcucauuccaugacucugcc

SEQ ID NO: 1817365 - RNA, 19 nt, Homo sapiens
cuugccuccaggugcagag

SEQ ID NO: 1817366 - RNA, 19 nt, Homo sapiens
uuuguguaauauuacuuua

SEQ ID NO: 1817367 - RNA, 19 nt, Homo sapiens
acauuuggcuuacaguaaa

SEQ ID NO: 1817368 - RNA, 11 nt, Homo sapiens
aauaauuuccu

SEQ ID NO: 1817369 - RNA, 17 nt, Homo sapiens
gaagcagauguggugau

SEQ ID NO: 1817370 - RNA, 19 nt, Homo sapiens
cccacaauugaacuuccag

SEQ ID NO: 1817371 - RNA, 18 nt, Homo sapiens
uaaaugcuacauacucca

SEQ ID NO: 1817372 - RNA, 23 nt, Homo sapiens
agaaaugacugccggucauuuga

SEQ ID NO: 1817373 - RNA, 15 nt, Homo sapiens
ccccuggcucugggc

SEQ ID NO: 1817374 - RNA, 14 nt, Homo sapiens
gcuggaaugaugaa

SEQ ID NO: 1817375 - RNA, 15 nt, Homo sapiens
agaaccaauucacuu

SEQ ID NO: 1817376 - RNA, 18 nt, Homo sapiens
aagacaauucuuuauaca

SEQ ID NO: 1817377 - RNA, 18 nt, Homo sapiens
gcacaaggcugaccaaga

SEQ ID NO: 1817378 - RNA, 18 nt, Homo sapiens
uuaagaaucaagauauaa

SEQ ID NO: 1817379 - RNA, 20 nt, Homo sapiens
cucuacaucucguauggauu

SEQ ID NO: 1817380 - RNA, 22 nt, Homo sapiens
ugggcugugauuacugcaauca

SEQ ID NO: 1817381 - RNA, 22 nt, Homo sapiens
caccuguauagaccaugcacag

SEQ ID NO: 1817382 - RNA, 22 nt, Homo sapiens
guuaccaguaacggaacaguau

SEQ ID NO: 1817383 - RNA, 23 nt, Homo sapiens
cccacggggaucacagcguuuca

SEQ ID NO: 1817384 - RNA, 12 nt, Homo sapiens
aacauacuucuu

SEQ ID NO: 1817385 - RNA, 12 nt, Homo sapiens
aaagcauuauua

SEQ ID NO: 1817386 - RNA, 21 nt, Homo sapiens
acugggaccgugcgagcugcc

SEQ ID NO: 1817387 - RNA, 22 nt, Homo sapiens
ccagaugaucccagucacuccu

SEQ ID NO: 1817388 - RNA, 18 nt, Homo sapiens
gugaagagauacagccuu

SEQ ID NO: 1817389 - RNA, 19 nt, Homo sapiens
aauuuuuuaaauaaaugga

SEQ ID NO: 1817390 - RNA, 17 nt, Homo sapiens
cucccaccccacuccag

SEQ ID NO: 1817391 - RNA, 21 nt, Homo sapiens
gaguuauuuuuauuuauuuaa

SEQ ID NO: 1817392 - RNA, 22 nt, Homo sapiens
uguaggaaaagaggccagcucu

SEQ ID NO: 1817393 - RNA, 20 nt, Homo sapiens
cagaauuguagccaguuucu

SEQ ID NO: 1817394 - RNA, 20 nt, Homo sapiens
uucaccguauuagccaggau

SEQ ID NO: 1817395 - RNA, 15 nt, Homo sapiens
acaaauugcauuugu

SEQ ID NO: 1817396 - RNA, 18 nt, Homo sapiens
aagguccucugucaguca

SEQ ID NO: 1817397 - RNA, 17 nt, Homo sapiens
gugcaaguggaugcauu

SEQ ID NO: 1817398 - RNA, 23 nt, Homo sapiens
uggaacaggaugauggcacugag

SEQ ID NO: 1817399 - RNA, 21 nt, Homo sapiens
ugcucaggcugcagcuggaca

SEQ ID NO: 1817400 - RNA, 13 nt, Homo sapiens
guucuugcugcua

SEQ ID NO: 1817401 - RNA, 21 nt, Homo sapiens
aggcagaggcuguggugagcc

SEQ ID NO: 1817402 - RNA, 17 nt, Homo sapiens
caagaagggacugagag

SEQ ID NO: 1817403 - RNA, 18 nt, Homo sapiens
ugguaaacauucucucag

SEQ ID NO: 1817404 - RNA, 18 nt, Homo sapiens
uagcugugcaagaccuag

SEQ ID NO: 1817405 - RNA, 22 nt, Homo sapiens
aagaagcugcuguucuuagcaa

SEQ ID NO: 1817406 - RNA, 15 nt, Homo sapiens
cuucucuuuaacuca

SEQ ID NO: 1817407 - RNA, 15 nt, Homo sapiens
cauuccauuuauccu

SEQ ID NO: 1817408 - RNA, 13 nt, Homo sapiens
auaaacaguuuua

SEQ ID NO: 1817409 - RNA, 17 nt, Homo sapiens
gaaauaucaugcuccau

SEQ ID NO: 1817410 - RNA, 23 nt, Homo sapiens
acggcuuccucauuccuugucuu

SEQ ID NO: 1817411 - RNA, 18 nt, Homo sapiens
gaccuaguagaguguaau

SEQ ID NO: 1817412 - RNA, 19 nt, Homo sapiens
gggccaccgccuugcccag

SEQ ID NO: 1817413 - RNA, 15 nt, Homo sapiens
gaaaaaugcugcuuc

SEQ ID NO: 1817414 - RNA, 19 nt, Homo sapiens
aauacuaagagauuugcuu

SEQ ID NO: 1817415 - RNA, 23 nt, Homo sapiens
ccccauggguuuugcuuaggcac

SEQ ID NO: 1817416 - RNA, 14 nt, Homo sapiens
ggcacguccuccac

SEQ ID NO: 1817417 - RNA, 13 nt, Homo sapiens
cucauuugucaca

SEQ ID NO: 1817418 - RNA, 21 nt, Homo sapiens
cuguugaugguaggcuguaua

SEQ ID NO: 1817419 - RNA, 20 nt, Homo sapiens
ugccucaggccagggcucac

SEQ ID NO: 1817420 - RNA, 14 nt, Homo sapiens
ccuuuaaaaagcag

SEQ ID NO: 1817421 - RNA, 17 nt, Homo sapiens
ccugcugcuggugcaca

SEQ ID NO: 1817422 - RNA, 13 nt, Homo sapiens
augaauacauuuc

SEQ ID NO: 1817423 - RNA, 17 nt, Homo sapiens
accaugacaccugccau

SEQ ID NO: 1817424 - RNA, 20 nt, Homo sapiens
ggaagugugucaaaucaaua

SEQ ID NO: 1817425 - RNA, 22 nt, Homo sapiens
cuugaaaugaguaaaaacuaga

SEQ ID NO: 1817426 - RNA, 18 nt, Homo sapiens
acaugcacgcuugcacac

SEQ ID NO: 1817427 - RNA, 18 nt, Homo sapiens
gcuugcacacaugcacac

SEQ ID NO: 1817428 - RNA, 20 nt, Homo sapiens
caaguucuuaguugcuguau

SEQ ID NO: 1817429 - RNA, 16 nt, Homo sapiens
aaucuuuuacugugga

SEQ ID NO: 1817430 - RNA, 20 nt, Homo sapiens
uucauagugucaagaaggaa

SEQ ID NO: 1817431 - RNA, 13 nt, Homo sapiens
aagcacugcucac

SEQ ID NO: 1817432 - RNA, 20 nt, Homo sapiens
auauaguaacuacuuuuuau

SEQ ID NO: 1817433 - RNA, 15 nt, Homo sapiens
ugacgaaagagucau

SEQ ID NO: 1817434 - RNA, 22 nt, Homo sapiens
cuaugacucaaagaugaaagcu

SEQ ID NO: 1817435 - RNA, 13 nt, Homo sapiens
uuuaaaaagcaaa

SEQ ID NO: 1817436 - RNA, 18 nt, Homo sapiens
agaacugcacgguacaaa

SEQ ID NO: 1817437 - RNA, 13 nt, Homo sapiens
aagaaacccaagu

SEQ ID NO: 1817438 - RNA, 13 nt, Homo sapiens
cagaaaccaaagu

SEQ ID NO: 1817439 - RNA, 18 nt, Homo sapiens
ugaaucagcugggaugac

SEQ ID NO: 1817440 - RNA, 16 nt, Homo sapiens
gugucuuuuguucucu

SEQ ID NO: 1817441 - RNA, 21 nt, Homo sapiens
gaaauauuacaguagugcauu

SEQ ID NO: 1817442 - RNA, 16 nt, Homo sapiens
aaagggugucuaucau

SEQ ID NO: 1817443 - RNA, 17 nt, Homo sapiens
cagcucacugagcuggg

SEQ ID NO: 1817444 - RNA, 15 nt, Homo sapiens
gcauguccucaaaac

SEQ ID NO: 1817445 - RNA, 18 nt, Homo sapiens
uuaaaauuguaagcuccu

SEQ ID NO: 1817446 - RNA, 16 nt, Homo sapiens
ugauuucaagucuucu

SEQ ID NO: 1817447 - RNA, 17 nt, Homo sapiens
gcgaguucagcaaagag

SEQ ID NO: 1817448 - RNA, 21 nt, Homo sapiens
uauuuccauagcuuuuggcug

SEQ ID NO: 1817449 - RNA, 14 nt, Homo sapiens
aacggguaucuuuu

SEQ ID NO: 1817450 - RNA, 19 nt, Homo sapiens
cgaagccuuauuucuagaa

SEQ ID NO: 1817451 - RNA, 15 nt, Homo sapiens
acucauuuauuucca

SEQ ID NO: 1817452 - RNA, 16 nt, Homo sapiens
acauugggagucugua

SEQ ID NO: 1817453 - RNA, 12 nt, Homo sapiens
uguuugaauuua

SEQ ID NO: 1817454 - RNA, 13 nt, Homo sapiens
gccacuugcucag

SEQ ID NO: 1817455 - RNA, 20 nt, Homo sapiens
acuauaugaaaagagcaaaa

SEQ ID NO: 1817456 - RNA, 13 nt, Homo sapiens
auuuauaacucau

SEQ ID NO: 1817457 - RNA, 19 nt, Homo sapiens
ccuuggggcucagccacag

SEQ ID NO: 1817458 - RNA, 16 nt, Homo sapiens
cuuuuuccuccuggaa

SEQ ID NO: 1817459 - RNA, 15 nt, Homo sapiens
aguucccacccaagc

SEQ ID NO: 1817460 - RNA, 19 nt, Homo sapiens
acugucucucuugucacau

SEQ ID NO: 1817461 - RNA, 14 nt, Homo sapiens
cuuccucuucucaa

SEQ ID NO: 1817462 - RNA, 13 nt, Homo sapiens
uccuugauucaca

SEQ ID NO: 1817463 - RNA, 13 nt, Homo sapiens
ucauuuccuaccc

SEQ ID NO: 1817464 - RNA, 17 nt, Homo sapiens
gaaacauauguucuccc

SEQ ID NO: 1817465 - RNA, 13 nt, Homo sapiens
gcugcuccgcccg

SEQ ID NO: 1817466 - RNA, 21 nt, Homo sapiens
gucaaagaaggugcugauccu

SEQ ID NO: 1817467 - RNA, 16 nt, Homo sapiens
aagaaagaaacuucau

SEQ ID NO: 1817468 - RNA, 13 nt, Homo sapiens
ccaccccagcuca

SEQ ID NO: 1817469 - RNA, 14 nt, Homo sapiens
cacuagacuguauc

SEQ ID NO: 1817470 - RNA, 17 nt, Homo sapiens
aaggacuugacuugcaa

SEQ ID NO: 1817471 - RNA, 14 nt, Homo sapiens
aaaaauuauggaau

SEQ ID NO: 1817472 - RNA, 21 nt, Homo sapiens
uccccucacacacaaauugac

SEQ ID NO: 1817473 - RNA, 22 nt, Homo sapiens
guauugaugacaguaguaccaa

SEQ ID NO: 1817474 - RNA, 20 nt, Homo sapiens
cugaauauuaaagcucuuca

SEQ ID NO: 1817475 - RNA, 18 nt, Homo sapiens
gacagugauaggcccaag

SEQ ID NO: 1817476 - RNA, 16 nt, Homo sapiens
uaacaggaaaauuuua

SEQ ID NO: 1817477 - RNA, 17 nt, Homo sapiens
cauauuaaaauuacaga

SEQ ID NO: 1817478 - RNA, 23 nt, Homo sapiens
acaaaugcuccuccuccaugcuc

SEQ ID NO: 1817479 - RNA, 17 nt, Homo sapiens
gaccuggagacugacaa

SEQ ID NO: 1817480 - RNA, 15 nt, Homo sapiens
aaaagacacagaaca

SEQ ID NO: 1817481 - RNA, 14 nt, Homo sapiens
gcuaaucuuuaaua

SEQ ID NO: 1817482 - RNA, 16 nt, Homo sapiens
cuuugguggcauggaa

SEQ ID NO: 1817483 - RNA, 17 nt, Homo sapiens
cuuuuccccagucccag

SEQ ID NO: 1817484 - RNA, 18 nt, Homo sapiens
ucucauauaagacaaaua

SEQ ID NO: 1817485 - RNA, 14 nt, Homo sapiens
caacugacuuguau

SEQ ID NO: 1817486 - RNA, 19 nt, Homo sapiens
agaaagagacuccgucuca

SEQ ID NO: 1817487 - RNA, 23 nt, Homo sapiens
aguguccccccuugaagcaauaa

SEQ ID NO: 1817488 - RNA, 19 nt, Homo sapiens
uccugauguuuuucugugu

SEQ ID NO: 1817489 - RNA, 18 nt, Homo sapiens
gagacacaugggugcuau

SEQ ID NO: 1817490 - RNA, 21 nt, Homo sapiens
ugugaaggggagagacagggg

SEQ ID NO: 1817491 - RNA, 23 nt, Homo sapiens
cuuuacucacacuaugugcaaaa

SEQ ID NO: 1817492 - RNA, 13 nt, Homo sapiens
aaaacaaauucau

SEQ ID NO: 1817493 - RNA, 24 nt, Homo sapiens
aauaaauaaaacagcagcagcaaa

SEQ ID NO: 1817494 - RNA, 20 nt, Homo sapiens
gaaucagauggugucauuua

SEQ ID NO: 1817495 - RNA, 11 nt, Homo sapiens
accugcacaac

SEQ ID NO: 1817496 - RNA, 22 nt, Homo sapiens
cuugaggguaauaaacuuagaa

SEQ ID NO: 1817497 - RNA, 13 nt, Homo sapiens
gaaaaauuauagu

SEQ ID NO: 1817498 - RNA, 21 nt, Homo sapiens
aguugcacuucaguuccuuuc

SEQ ID NO: 1817499 - RNA, 10 nt, Homo sapiens
uaugcaaaag

SEQ ID NO: 1817500 - RNA, 21 nt, Homo sapiens
ggaggauugcuucuugugaaa

SEQ ID NO: 1817501 - RNA, 23 nt, Homo sapiens
agacaugaaauugagucauuuua

SEQ ID NO: 1817502 - RNA, 15 nt, Homo sapiens
cagcugaacagccaa

SEQ ID NO: 1817503 - RNA, 15 nt, Homo sapiens
cacaugcacacacac

SEQ ID NO: 1817504 - RNA, 14 nt, Homo sapiens
cugcagaaggccaa

SEQ ID NO: 1817505 - RNA, 15 nt, Homo sapiens
cucccagcuccagcu

SEQ ID NO: 1817506 - RNA, 20 nt, Homo sapiens
ugauuagucagaaacugcca

SEQ ID NO: 1817507 - RNA, 21 nt, Homo sapiens
cuugguuguauaaagcaaaag

SEQ ID NO: 1817508 - RNA, 16 nt, Homo sapiens
cauuuucugcauuuaa

SEQ ID NO: 1817509 - RNA, 22 nt, Homo sapiens
ucuucacgguuucacuuuuaag

SEQ ID NO: 1817510 - RNA, 21 nt, Homo sapiens
acuacuuuuacuacagugaca

SEQ ID NO: 1817511 - RNA, 12 nt, Homo sapiens
gauuuccuugac

SEQ ID NO: 1817512 - RNA, 19 nt, Homo sapiens
auuuuggaaaaaugucacu

SEQ ID NO: 1817513 - RNA, 17 nt, Homo sapiens
auucuuucaacuugcaa

SEQ ID NO: 1817514 - RNA, 22 nt, Homo sapiens
gggucucggugguaccaggucu

SEQ ID NO: 1817515 - RNA, 18 nt, Homo sapiens
augccgguuaaauuccau

SEQ ID NO: 1817516 - RNA, 17 nt, Homo sapiens
uagguuucaacauauga

SEQ ID NO: 1817517 - RNA, 20 nt, Homo sapiens
gcuacccgagguuugcaaau

SEQ ID NO: 1817518 - RNA, 17 nt, Homo sapiens
agauguaaaugccacaa

SEQ ID NO: 1817519 - RNA, 13 nt, Homo sapiens
auucucaccuaaa

SEQ ID NO: 1817520 - RNA, 18 nt, Homo sapiens
uccaccaaauacaauuca

SEQ ID NO: 1817521 - RNA, 23 nt, Homo sapiens
ccuucauuuccuccgucaccuca

SEQ ID NO: 1817522 - RNA, 16 nt, Homo sapiens
gcccagagccucugcu

SEQ ID NO: 1817523 - RNA, 17 nt, Homo sapiens
ugcccgaccccaucuca

SEQ ID NO: 1817524 - RNA, 19 nt, Homo sapiens
uguaaauacuguaaaugca

SEQ ID NO: 1817525 - RNA, 16 nt, Homo sapiens
ugcuguaaauacagga

SEQ ID NO: 1817526 - RNA, 15 nt, Homo sapiens
acaugcuuuuccaaa

SEQ ID NO: 1817527 - RNA, 13 nt, Homo sapiens
uuugcagagccuu

SEQ ID NO: 1817528 - RNA, 21 nt, Homo sapiens
ccauuuagcgaacaaccacag

SEQ ID NO: 1817529 - RNA, 18 nt, Homo sapiens
aucccaagugucucuuga

SEQ ID NO: 1817530 - RNA, 15 nt, Homo sapiens
ccaggccaaugucag

SEQ ID NO: 1817531 - RNA, 21 nt, Homo sapiens
uccuggacccuggccuaaaga

SEQ ID NO: 1817532 - RNA, 15 nt, Homo sapiens
aaauuauccauggua

SEQ ID NO: 1817533 - RNA, 19 nt, Homo sapiens
ccuucaucuucacugcaau

SEQ ID NO: 1817534 - RNA, 19 nt, Homo sapiens
cccagcaucccuggagcag

SEQ ID NO: 1817535 - RNA, 17 nt, Homo sapiens
gugcagcugcugugccu

SEQ ID NO: 1817536 - RNA, 22 nt, Homo sapiens
cacagcaggugcugagcaaagg

SEQ ID NO: 1817537 - RNA, 24 nt, Homo sapiens
uagguuaguagcccuucagucuua

SEQ ID NO: 1817538 - RNA, 17 nt, Homo sapiens
uaugccugccucaaagg

SEQ ID NO: 1817539 - RNA, 14 nt, Homo sapiens
aauaaaaaaauuaa

SEQ ID NO: 1817540 - RNA, 18 nt, Homo sapiens
aaaauguagcagcuucuu

SEQ ID NO: 1817541 - RNA, 15 nt, Homo sapiens
caucaccacagggau

SEQ ID NO: 1817542 - RNA, 17 nt, Homo sapiens
uccugaagagcauuugg

SEQ ID NO: 1817543 - RNA, 11 nt, Homo sapiens
uuguauacaca

SEQ ID NO: 1817544 - RNA, 18 nt, Homo sapiens
ugagggaaauugcuauuu

SEQ ID NO: 1817545 - RNA, 15 nt, Homo sapiens
cuggcgccucugcaa

SEQ ID NO: 1817546 - RNA, 22 nt, Homo sapiens
cccagacauauuguacucuuuc

SEQ ID NO: 1817547 - RNA, 20 nt, Homo sapiens
ccaucagcaaauauuauucu

SEQ ID NO: 1817548 - RNA, 13 nt, Homo sapiens
uucuuaaaacacu

SEQ ID NO: 1817549 - RNA, 13 nt, Homo sapiens
uccuaaaaauaca

SEQ ID NO: 1817550 - RNA, 20 nt, Homo sapiens
acuacauacaagcauaagca

SEQ ID NO: 1817551 - RNA, 21 nt, Homo sapiens
acugucacguggcuucaucag

SEQ ID NO: 1817552 - RNA, 20 nt, Homo sapiens
ucaugugagugggugggaug

SEQ ID NO: 1817553 - RNA, 15 nt, Homo sapiens
auauuuaaaauucau

SEQ ID NO: 1817554 - RNA, 18 nt, Homo sapiens
gaagacccauuccuuccc

SEQ ID NO: 1817555 - RNA, 16 nt, Homo sapiens
agacaguuucuugcaa

SEQ ID NO: 1817556 - RNA, 19 nt, Homo sapiens
acauaucaauucaacacau

SEQ ID NO: 1817557 - RNA, 14 nt, Homo sapiens
auguuuccuugccu

SEQ ID NO: 1817558 - RNA, 10 nt, Homo sapiens
cucuucacau

SEQ ID NO: 1817559 - RNA, 20 nt, Homo sapiens
cacagaacacagcaauuccu

SEQ ID NO: 1817560 - RNA, 14 nt, Homo sapiens
uccaaacauuucau

SEQ ID NO: 1817561 - RNA, 17 nt, Homo sapiens
ugaaaauguccaggaaa

SEQ ID NO: 1817562 - RNA, 16 nt, Homo sapiens
uaauuuagacauugag

SEQ ID NO: 1817563 - RNA, 15 nt, Homo sapiens
aauaaaugucuugcc

SEQ ID NO: 1817564 - RNA, 15 nt, Homo sapiens
ccauucccuucucaa

SEQ ID NO: 1817565 - RNA, 21 nt, Homo sapiens
ggccugcccucacgcucucca

SEQ ID NO: 1817566 - RNA, 22 nt, Homo sapiens
cugaguggccagccagugccau

SEQ ID NO: 1817567 - RNA, 15 nt, Homo sapiens
ucccacugggacaca

SEQ ID NO: 1817568 - RNA, 11 nt, Homo sapiens
ucugugacauu

SEQ ID NO: 1817569 - RNA, 15 nt, Homo sapiens
uaauauaaauucacu

SEQ ID NO: 1817570 - RNA, 17 nt, Homo sapiens
cugcccaaccugacuuu

SEQ ID NO: 1817571 - RNA, 17 nt, Homo sapiens
uuuuguucucaacuuca

SEQ ID NO: 1817572 - RNA, 23 nt, Homo sapiens
uuugggaggagccauagauuccu

SEQ ID NO: 1817573 - RNA, 15 nt, Homo sapiens
augcuuccuugccug

SEQ ID NO: 1817574 - RNA, 15 nt, Homo sapiens
augguuuggaaaaua

SEQ ID NO: 1817575 - RNA, 17 nt, Homo sapiens
gauagcaaauggccuca

SEQ ID NO: 1817576 - RNA, 15 nt, Homo sapiens
agaaaaguugcagau

SEQ ID NO: 1817577 - RNA, 19 nt, Homo sapiens
agauguacaauuuagcuua

SEQ ID NO: 1817578 - RNA, 12 nt, Homo sapiens
uugaagcaaaca

SEQ ID NO: 1817579 - RNA, 21 nt, Homo sapiens
gcugccugugugcauguuccc

SEQ ID NO: 1817580 - RNA, 19 nt, Homo sapiens
cacuccggcccuccagagc

SEQ ID NO: 1817581 - RNA, 20 nt, Homo sapiens
ugcggaaaugugucuugucu

SEQ ID NO: 1817582 - RNA, 13 nt, Homo sapiens
gauauaaucuuuc

SEQ ID NO: 1817583 - RNA, 15 nt, Homo sapiens
aagguucugcccuua

SEQ ID NO: 1817584 - RNA, 16 nt, Homo sapiens
augaccacucuuggcu

SEQ ID NO: 1817585 - RNA, 23 nt, Homo sapiens
ugcauugucuccuuccacaauga

SEQ ID NO: 1817586 - RNA, 23 nt, Homo sapiens
uccacugaggugggagcaucucc

SEQ ID NO: 1817587 - RNA, 18 nt, Homo sapiens
guaaucccagcuauucag

SEQ ID NO: 1817588 - RNA, 18 nt, Homo sapiens
guaauuccagcuacucag

SEQ ID NO: 1817589 - RNA, 15 nt, Homo sapiens
ugccaugagaguucu

SEQ ID NO: 1817590 - RNA, 13 nt, Homo sapiens
ccugaacacucau

SEQ ID NO: 1817591 - RNA, 12 nt, Homo sapiens
gauggccaaagc

SEQ ID NO: 1817592 - RNA, 12 nt, Homo sapiens
ugcuauugugau

SEQ ID NO: 1817593 - RNA, 20 nt, Homo sapiens
auuuccuacagaaauacugc

SEQ ID NO: 1817594 - RNA, 22 nt, Homo sapiens
ucagaccuugcaaucacaaaag

SEQ ID NO: 1817595 - RNA, 19 nt, Homo sapiens
aguggccccggcugcauga

SEQ ID NO: 1817596 - RNA, 15 nt, Homo sapiens
uacuuguuuuuccca

SEQ ID NO: 1817597 - RNA, 16 nt, Homo sapiens
aucuucaucccaacag

SEQ ID NO: 1817598 - RNA, 21 nt, Homo sapiens
gccuccaagccauucacuucc

SEQ ID NO: 1817599 - RNA, 13 nt, Homo sapiens
gaccaucccggcc

SEQ ID NO: 1817600 - RNA, 11 nt, Homo sapiens
ccccugccauu

SEQ ID NO: 1817601 - RNA, 23 nt, Homo sapiens
guuuacauuguaaauaguauuug

SEQ ID NO: 1817602 - RNA, 14 nt, Homo sapiens
ugaaucaggggcaa

SEQ ID NO: 1817603 - RNA, 19 nt, Homo sapiens
aauguauaguuagcuuuau

SEQ ID NO: 1817604 - RNA, 20 nt, Homo sapiens
acccagcacaaccuuggaca

SEQ ID NO: 1817605 - RNA, 23 nt, Homo sapiens
cuauuucgaguguuguguuaaaa

SEQ ID NO: 1817606 - RNA, 20 nt, Homo sapiens
ugaggcaggagaaucacuug

SEQ ID NO: 1817607 - RNA, 16 nt, Homo sapiens
aacucccgaccucagg

SEQ ID NO: 1817608 - RNA, 22 nt, Homo sapiens
gcccugggugcaggacacuggu

SEQ ID NO: 1817609 - RNA, 14 nt, Homo sapiens
ucccuggagggcaa

SEQ ID NO: 1817610 - RNA, 16 nt, Homo sapiens
acaguuaagacaacag

SEQ ID NO: 1817611 - RNA, 18 nt, Homo sapiens
ugugcaauugauuucuuu

SEQ ID NO: 1817612 - RNA, 17 nt, Homo sapiens
cugguggggcugccagg

SEQ ID NO: 1817613 - RNA, 15 nt, Homo sapiens
cagugggaccaauga

SEQ ID NO: 1817614 - RNA, 11 nt, Homo sapiens
gauauguuugu

SEQ ID NO: 1817615 - RNA, 21 nt, Homo sapiens
uuuucaugaccaauccuaugu

SEQ ID NO: 1817616 - RNA, 20 nt, Homo sapiens
cacagucccccacccaccuc

SEQ ID NO: 1817617 - RNA, 14 nt, Homo sapiens
uucuccuugaauau

SEQ ID NO: 1817618 - RNA, 17 nt, Homo sapiens
acagacaugugcaacca

SEQ ID NO: 1817619 - RNA, 14 nt, Homo sapiens
cuaauuauuauuaa

SEQ ID NO: 1817620 - RNA, 15 nt, Homo sapiens
cugccucugacacac

SEQ ID NO: 1817621 - RNA, 20 nt, Homo sapiens
aacaauacgugaaagaugca

SEQ ID NO: 1817622 - RNA, 20 nt, Homo sapiens
agcucccagccucuucccau

SEQ ID NO: 1817623 - RNA, 18 nt, Homo sapiens
gccauaucuucaggccau

SEQ ID NO: 1817624 - RNA, 15 nt, Homo sapiens
cccacagacacuuac

SEQ ID NO: 1817625 - RNA, 23 nt, Homo sapiens
cugugaccugcugagcucugaga

SEQ ID NO: 1817626 - RNA, 15 nt, Homo sapiens
ugcaccucauuccaa

SEQ ID NO: 1817627 - RNA, 16 nt, Homo sapiens
agacaggcucuuagca

SEQ ID NO: 1817628 - RNA, 16 nt, Homo sapiens
aucuccaguacuugag

SEQ ID NO: 1817629 - RNA, 12 nt, Homo sapiens
caggccaaagau

SEQ ID NO: 1817630 - RNA, 14 nt, Homo sapiens
uauuuuauaugauu

SEQ ID NO: 1817631 - RNA, 15 nt, Homo sapiens
uuguuucaaucuuug

SEQ ID NO: 1817632 - RNA, 21 nt, Homo sapiens
uuaggucagcagccucccuga

SEQ ID NO: 1817633 - RNA, 18 nt, Homo sapiens
aacugaucauuugcagcu

SEQ ID NO: 1817634 - RNA, 20 nt, Homo sapiens
gaaaauagaauugacauuga

SEQ ID NO: 1817635 - RNA, 17 nt, Homo sapiens
cuugaaagcaguuaaac

SEQ ID NO: 1817636 - RNA, 22 nt, Homo sapiens
aguguuaggccuggcacagugu

SEQ ID NO: 1817637 - RNA, 15 nt, Homo sapiens
uuaggucacauuaca

SEQ ID NO: 1817638 - RNA, 19 nt, Homo sapiens
uguaaaauccacagcuaua

SEQ ID NO: 1817639 - RNA, 16 nt, Homo sapiens
gauggaaacaaagugg

SEQ ID NO: 1817640 - RNA, 20 nt, Homo sapiens
ucaaguuuuauuauugcaau

SEQ ID NO: 1817641 - RNA, 20 nt, Homo sapiens
auaauuuacugugacuuuau

SEQ ID NO: 1817642 - RNA, 13 nt, Homo sapiens
uucgucuacugca

SEQ ID NO: 1817643 - RNA, 13 nt, Homo sapiens
acaggcaccugcc

SEQ ID NO: 1817644 - RNA, 20 nt, Homo sapiens
agugccucucccugcugcuc

SEQ ID NO: 1817645 - RNA, 17 nt, Homo sapiens
guggaauauggcaauag

SEQ ID NO: 1817646 - RNA, 13 nt, Homo sapiens
gcugaguguccag

SEQ ID NO: 1817647 - RNA, 23 nt, Homo sapiens
cucaagcuguccucccaccucag

SEQ ID NO: 1817648 - RNA, 15 nt, Homo sapiens
cuccucccacagccu

SEQ ID NO: 1817649 - RNA, 18 nt, Homo sapiens
gucaaauagcaaggccag

SEQ ID NO: 1817650 - RNA, 19 nt, Homo sapiens
guauccauuaucaugugua

SEQ ID NO: 1817651 - RNA, 15 nt, Homo sapiens
ugaagcauccaggca

SEQ ID NO: 1817652 - RNA, 13 nt, Homo sapiens
aaaaauccuugaa

SEQ ID NO: 1817653 - RNA, 17 nt, Homo sapiens
acucacaacucucuggu

SEQ ID NO: 1817654 - RNA, 19 nt, Homo sapiens
caccauacacauucuuaga

SEQ ID NO: 1817655 - RNA, 17 nt, Homo sapiens
caucuacaucuccuuca

SEQ ID NO: 1817656 - RNA, 18 nt, Homo sapiens
auaaaccagcuacuugau

SEQ ID NO: 1817657 - RNA, 24 nt, Homo sapiens
guuuucuugauuuuuacguuugaa

SEQ ID NO: 1817658 - RNA, 15 nt, Homo sapiens
ugaaccccaccuccc

SEQ ID NO: 1817659 - RNA, 17 nt, Homo sapiens
cuguuuaguuuuacacu

SEQ ID NO: 1817660 - RNA, 15 nt, Homo sapiens
gaccuccugaugucu

SEQ ID NO: 1817661 - RNA, 18 nt, Homo sapiens
cugagcaaaaagaccagc

SEQ ID NO: 1817662 - RNA, 18 nt, Homo sapiens
uauacaugggugaauuau

SEQ ID NO: 1817663 - RNA, 13 nt, Homo sapiens
aucagcauuaguc

SEQ ID NO: 1817664 - RNA, 19 nt, Homo sapiens
gguuuaacaagcugucuac

SEQ ID NO: 1817665 - RNA, 17 nt, Homo sapiens
guuggacagacacuguu

SEQ ID NO: 1817666 - RNA, 20 nt, Homo sapiens
ucaagcaauccuccuaccuc

SEQ ID NO: 1817667 - RNA, 13 nt, Homo sapiens
cauaugauuuauc

SEQ ID NO: 1817668 - RNA, 16 nt, Homo sapiens
cucuuaggcaaucaca

SEQ ID NO: 1817669 - RNA, 21 nt, Homo sapiens
cauuuguaaucuaguugucaa

SEQ ID NO: 1817670 - RNA, 18 nt, Homo sapiens
caacaguuuuuuaugcua

SEQ ID NO: 1817671 - RNA, 14 nt, Homo sapiens
auaaaugacaaugu

SEQ ID NO: 1817672 - RNA, 13 nt, Homo sapiens
aguuguuggcaag

SEQ ID NO: 1817673 - RNA, 17 nt, Homo sapiens
aaauauggccuuucuuc

SEQ ID NO: 1817674 - RNA, 16 nt, Homo sapiens
ccugggccuguucacg

SEQ ID NO: 1817675 - RNA, 16 nt, Homo sapiens
uccuccagcaccauag

SEQ ID NO: 1817676 - RNA, 16 nt, Homo sapiens
agccaccccaugagcu

SEQ ID NO: 1817677 - RNA, 17 nt, Homo sapiens
gggagccauggggagca

SEQ ID NO: 1817678 - RNA, 16 nt, Homo sapiens
gguccaauccuaggac

SEQ ID NO: 1817679 - RNA, 14 nt, Homo sapiens
uguaaacaaaccac

SEQ ID NO: 1817680 - RNA, 16 nt, Homo sapiens
ucagacuucaucuuca

SEQ ID NO: 1817681 - RNA, 12 nt, Homo sapiens
ugugauaugauu

SEQ ID NO: 1817682 - RNA, 16 nt, Homo sapiens
ucagggaccacagcaa

SEQ ID NO: 1817683 - RNA, 18 nt, Homo sapiens
cauuccuucuuucacagg

SEQ ID NO: 1817684 - RNA, 13 nt, Homo sapiens
cagcugugcugca

SEQ ID NO: 1817685 - RNA, 13 nt, Homo sapiens
cuuuugugcauua

SEQ ID NO: 1817686 - RNA, 20 nt, Homo sapiens
gauuuuauuuucaagcaaau

SEQ ID NO: 1817687 - RNA, 19 nt, Homo sapiens
cuuccucguuuuguaauga

SEQ ID NO: 1817688 - RNA, 17 nt, Homo sapiens
auucuugaggucuugag

SEQ ID NO: 1817689 - RNA, 18 nt, Homo sapiens
ucaaucccagcuacucaa

SEQ ID NO: 1817690 - RNA, 18 nt, Homo sapiens
aucacggauguuggcucc

SEQ ID NO: 1817691 - RNA, 19 nt, Homo sapiens
ucccauaauugcuuugcca

SEQ ID NO: 1817692 - RNA, 17 nt, Homo sapiens
cauauuaacaaauugca

SEQ ID NO: 1817693 - RNA, 13 nt, Homo sapiens
uauguaaaccaca

SEQ ID NO: 1817694 - RNA, 19 nt, Homo sapiens
ugucugauuuaacacuauc

SEQ ID NO: 1817695 - RNA, 21 nt, Homo sapiens
ucaaacccaaguuaguucaau

SEQ ID NO: 1817696 - RNA, 20 nt, Homo sapiens
caaaggagggucaggaagga

SEQ ID NO: 1817697 - RNA, 17 nt, Homo sapiens
aucuuuuauuucauuca

SEQ ID NO: 1817698 - RNA, 21 nt, Homo sapiens
caagauaauccuagagucuua

SEQ ID NO: 1817699 - RNA, 17 nt, Homo sapiens
accuuccaaaccucaau

SEQ ID NO: 1817700 - RNA, 13 nt, Homo sapiens
gccuuaccaaagc

SEQ ID NO: 1817701 - RNA, 13 nt, Homo sapiens
ccauugaacagcu

SEQ ID NO: 1817702 - RNA, 20 nt, Homo sapiens
gcaaaccuguucaucuugcc

SEQ ID NO: 1817703 - RNA, 18 nt, Homo sapiens
ucccuccuggugaagugu

SEQ ID NO: 1817704 - RNA, 21 nt, Homo sapiens
gguccuagaaguucaguuuuu

SEQ ID NO: 1817705 - RNA, 21 nt, Homo sapiens
cacuucccacuauugcuugca

SEQ ID NO: 1817706 - RNA, 13 nt, Homo sapiens
uuuaacacuguca

SEQ ID NO: 1817707 - RNA, 21 nt, Homo sapiens
ccuagaaguuacugaaugcac

SEQ ID NO: 1817708 - RNA, 17 nt, Homo sapiens
cuauucuuuccaugaca

SEQ ID NO: 1817709 - RNA, 13 nt, Homo sapiens
auuaaauguacuu

SEQ ID NO: 1817710 - RNA, 13 nt, Homo sapiens
auauuuacuaccu

SEQ ID NO: 1817711 - RNA, 20 nt, Homo sapiens
agguggagugucacaucucu

SEQ ID NO: 1817712 - RNA, 17 nt, Homo sapiens
guaacaguuugauauuu

SEQ ID NO: 1817713 - RNA, 16 nt, Homo sapiens
uucacagauuguucua

SEQ ID NO: 1817714 - RNA, 14 nt, Homo sapiens
caggaaguacucau

SEQ ID NO: 1817715 - RNA, 15 nt, Homo sapiens
uccaaaccaguuuau

SEQ ID NO: 1817716 - RNA, 13 nt, Homo sapiens
aaagcaguucaug

SEQ ID NO: 1817717 - RNA, 19 nt, Homo sapiens
ggugaacguguccuucuca

SEQ ID NO: 1817718 - RNA, 19 nt, Homo sapiens
cuaccucacuaugcugcuu

SEQ ID NO: 1817719 - RNA, 15 nt, Homo sapiens
aggccaccuaugcca

SEQ ID NO: 1817720 - RNA, 19 nt, Homo sapiens
acuuaacagaucacaugcc

SEQ ID NO: 1817721 - RNA, 23 nt, Homo sapiens
aauagcugggacuacagguguga

SEQ ID NO: 1817722 - RNA, 19 nt, Homo sapiens
cucagccucaaaugcagua

SEQ ID NO: 1817723 - RNA, 16 nt, Homo sapiens
auugguguacuguaau

SEQ ID NO: 1817724 - RNA, 18 nt, Homo sapiens
cccuccaucucagccauu

SEQ ID NO: 1817725 - RNA, 16 nt, Homo sapiens
caguaccaucuacauc

SEQ ID NO: 1817726 - RNA, 22 nt, Homo sapiens
gagcugcacugaucacccaaug

SEQ ID NO: 1817727 - RNA, 21 nt, Homo sapiens
ugaccuguguguaagucccaa

SEQ ID NO: 1817728 - RNA, 16 nt, Homo sapiens
cccauuucccauuaaa

SEQ ID NO: 1817729 - RNA, 16 nt, Homo sapiens
ccagccucugcucuua

SEQ ID NO: 1817730 - RNA, 19 nt, Homo sapiens
uggcccauagaaacaugac

SEQ ID NO: 1817731 - RNA, 20 nt, Homo sapiens
cagugaggcucuauugagcc

SEQ ID NO: 1817732 - RNA, 14 nt, Homo sapiens
gaaauaaagucaaa

SEQ ID NO: 1817733 - RNA, 21 nt, Homo sapiens
ggcucugcaaugggcacuggg

SEQ ID NO: 1817734 - RNA, 18 nt, Homo sapiens
auuuuuccucuguucaca

SEQ ID NO: 1817735 - RNA, 15 nt, Homo sapiens
acaacaaaagcuuuu

SEQ ID NO: 1817736 - RNA, 14 nt, Homo sapiens
uccaauugcugcuu

SEQ ID NO: 1817737 - RNA, 16 nt, Homo sapiens
ugcuuccugacaauca

SEQ ID NO: 1817738 - RNA, 15 nt, Homo sapiens
guuucagagucagaa

SEQ ID NO: 1817739 - RNA, 12 nt, Homo sapiens
gcggggugggca

SEQ ID NO: 1817740 - RNA, 20 nt, Homo sapiens
cugcuggggaagaacagccc

SEQ ID NO: 1817741 - RNA, 17 nt, Homo sapiens
uacaaccuccgccuccc

SEQ ID NO: 1817742 - RNA, 14 nt, Homo sapiens
cccacucaccugcc

SEQ ID NO: 1817743 - RNA, 13 nt, Homo sapiens
cuccacucagguu

SEQ ID NO: 1817744 - RNA, 18 nt, Homo sapiens
aagcccauagcacugggc

SEQ ID NO: 1817745 - RNA, 9 nt, Homo sapiens
acaaugcca

SEQ ID NO: 1817746 - RNA, 19 nt, Homo sapiens
ggccacaugagucccagug

SEQ ID NO: 1817747 - RNA, 17 nt, Homo sapiens
uguaaaucaaauuugaa

SEQ ID NO: 1817748 - RNA, 17 nt, Homo sapiens
auuggcucacacugaga

SEQ ID NO: 1817749 - RNA, 21 nt, Homo sapiens
aaacuucccucucuagacagu

SEQ ID NO: 1817750 - RNA, 19 nt, Homo sapiens
gaaaggcaugaaucuuccc

SEQ ID NO: 1817751 - RNA, 15 nt, Homo sapiens
aauaggcaucaucaa

SEQ ID NO: 1817752 - RNA, 20 nt, Homo sapiens
ggaaaaggggugaccuagua

SEQ ID NO: 1817753 - RNA, 16 nt, Homo sapiens
caaaauuaauagcuuu

SEQ ID NO: 1817754 - RNA, 16 nt, Homo sapiens
acaaaaaagaaggcuu

SEQ ID NO: 1817755 - RNA, 14 nt, Homo sapiens
cuaggaacaaaucu

SEQ ID NO: 1817756 - RNA, 15 nt, Homo sapiens
uuuugguacugugau

SEQ ID NO: 1817757 - RNA, 15 nt, Homo sapiens
cgugaggaugggaag

SEQ ID NO: 1817758 - RNA, 15 nt, Homo sapiens
gacauguagcuucuu

SEQ ID NO: 1817759 - RNA, 21 nt, Homo sapiens
guuaaauuaagcucuugcuaa

SEQ ID NO: 1817760 - RNA, 15 nt, Homo sapiens
uuugugaaacuuuaa

SEQ ID NO: 1817761 - RNA, 13 nt, Homo sapiens
ggggaggggcgcu

SEQ ID NO: 1817762 - RNA, 17 nt, Homo sapiens
gacccuauacauuuuga

SEQ ID NO: 1817763 - RNA, 16 nt, Homo sapiens
caacgucauuccuuca

SEQ ID NO: 1817764 - RNA, 20 nt, Homo sapiens
auuguuaaaaccuuacuuaa

SEQ ID NO: 1817765 - RNA, 14 nt, Homo sapiens
cauuuucagccaaa

SEQ ID NO: 1817766 - RNA, 13 nt, Homo sapiens
uaugccuucuuau

SEQ ID NO: 1817767 - RNA, 23 nt, Homo sapiens
ucuuuccccaaaaauugacuuag

SEQ ID NO: 1817768 - RNA, 13 nt, Homo sapiens
aagaaauauucug

SEQ ID NO: 1817769 - RNA, 21 nt, Homo sapiens
cuacuuuaguauuccuguaau

SEQ ID NO: 1817770 - RNA, 21 nt, Homo sapiens
caacuugaaauuauaucugug

SEQ ID NO: 1817771 - RNA, 14 nt, Homo sapiens
ccagagcugugcca

SEQ ID NO: 1817772 - RNA, 19 nt, Homo sapiens
uuuccaaaaguacuagcaa

SEQ ID NO: 1817773 - RNA, 21 nt, Homo sapiens
cccacccccuucucugcucca

SEQ ID NO: 1817774 - RNA, 12 nt, Homo sapiens
aagaacuucauu

SEQ ID NO: 1817775 - RNA, 18 nt, Homo sapiens
gugccacuacacuccagc

SEQ ID NO: 1817776 - RNA, 16 nt, Homo sapiens
aaugugguuacuuccu

SEQ ID NO: 1817777 - RNA, 20 nt, Homo sapiens
cuauuaagucaucaucucca

SEQ ID NO: 1817778 - RNA, 22 nt, Homo sapiens
cccugguuuucagucuugcuga

SEQ ID NO: 1817779 - RNA, 20 nt, Homo sapiens
gcugggcagaggaaagcaaa

SEQ ID NO: 1817780 - RNA, 17 nt, Homo sapiens
caagaguuguugugcaa

SEQ ID NO: 1817781 - RNA, 20 nt, Homo sapiens
ccucucagcugcuggaugac

SEQ ID NO: 1817782 - RNA, 23 nt, Homo sapiens
uccaggcuugggcuccauuccca

SEQ ID NO: 1817783 - RNA, 20 nt, Homo sapiens
acaggccauccauucacagc

SEQ ID NO: 1817784 - RNA, 20 nt, Homo sapiens
agggucucuagugcugugaa

SEQ ID NO: 1817785 - RNA, 15 nt, Homo sapiens
cucaaaggagucagg

SEQ ID NO: 1817786 - RNA, 21 nt, Homo sapiens
guuuaccgaaaaucauauaau

SEQ ID NO: 1817787 - RNA, 15 nt, Homo sapiens
caaagagaaaccuau

SEQ ID NO: 1817788 - RNA, 15 nt, Homo sapiens
caagugaauacauuu

SEQ ID NO: 1817789 - RNA, 17 nt, Homo sapiens
acucaauaaacagucac

SEQ ID NO: 1817790 - RNA, 14 nt, Homo sapiens
uucuccuucagccc

SEQ ID NO: 1817791 - RNA, 11 nt, Homo sapiens
gaaauggccaa

SEQ ID NO: 1817792 - RNA, 19 nt, Homo sapiens
uggagagggaaugugaaau

SEQ ID NO: 1817793 - RNA, 14 nt, Homo sapiens
guaaaugccacaaa

SEQ ID NO: 1817794 - RNA, 20 nt, Homo sapiens
aucugaaaggcacacuuuga

SEQ ID NO: 1817795 - RNA, 22 nt, Homo sapiens
uguuuccuguggaaauaugcaa

SEQ ID NO: 1817796 - RNA, 22 nt, Homo sapiens
gcagucugcucugcugcucuga

SEQ ID NO: 1817797 - RNA, 18 nt, Homo sapiens
agccuagcccacuuguca

SEQ ID NO: 1817798 - RNA, 17 nt, Homo sapiens
agccccauccuguguua

SEQ ID NO: 1817799 - RNA, 21 nt, Homo sapiens
ucccaacccauucacuacagg

SEQ ID NO: 1817800 - RNA, 14 nt, Homo sapiens
ugagaauauaaaaa

SEQ ID NO: 1817801 - RNA, 18 nt, Homo sapiens
uaaaagauaaauuuguug

SEQ ID NO: 1817802 - RNA, 15 nt, Homo sapiens
ucucugacauaugcu

SEQ ID NO: 1817803 - RNA, 17 nt, Homo sapiens
gccucugccugcauucu

SEQ ID NO: 1817804 - RNA, 15 nt, Homo sapiens
ccaggaaagagcagu

SEQ ID NO: 1817805 - RNA, 23 nt, Homo sapiens
ucagcauagugacuaaacuacau

SEQ ID NO: 1817806 - RNA, 13 nt, Homo sapiens
aagagugagaaaa

SEQ ID NO: 1817807 - RNA, 16 nt, Homo sapiens
agugcaguugugauuu

SEQ ID NO: 1817808 - RNA, 23 nt, Homo sapiens
aacagcuuucuuauucagugaaa

SEQ ID NO: 1817809 - RNA, 19 nt, Homo sapiens
uuccagugguuugagacac

SEQ ID NO: 1817810 - RNA, 19 nt, Homo sapiens
guuuugcauggaguauuau

SEQ ID NO: 1817811 - RNA, 12 nt, Homo sapiens
guaauugcacau

SEQ ID NO: 1817812 - RNA, 18 nt, Homo sapiens
uacuuuuaugcaaccaua

SEQ ID NO: 1817813 - RNA, 22 nt, Homo sapiens
caccguggugagcauacagagu

SEQ ID NO: 1817814 - RNA, 21 nt, Homo sapiens
uucaggaagcauaaagcaauu

SEQ ID NO: 1817815 - RNA, 18 nt, Homo sapiens
ggugcugguuccaugccu

SEQ ID NO: 1817816 - RNA, 20 nt, Homo sapiens
aguuccucgcucugggaugc

SEQ ID NO: 1817817 - RNA, 23 nt, Homo sapiens
gacaguugauucaacaaaguauu

SEQ ID NO: 1817818 - RNA, 15 nt, Homo sapiens
uaauagacugaguca

SEQ ID NO: 1817819 - RNA, 19 nt, Homo sapiens
agauggaaaagaaauugca

SEQ ID NO: 1817820 - RNA, 14 nt, Homo sapiens
ugugguuacaagaa

SEQ ID NO: 1817821 - RNA, 21 nt, Homo sapiens
uggaauccaguguggcuccca

SEQ ID NO: 1817822 - RNA, 23 nt, Homo sapiens
cuucuauuuuuaucaugaauucc

SEQ ID NO: 1817823 - RNA, 12 nt, Homo sapiens
uuacagcuuucu

SEQ ID NO: 1817824 - RNA, 18 nt, Homo sapiens
uaaaguuuaaaguugcac

SEQ ID NO: 1817825 - RNA, 16 nt, Homo sapiens
uauuaagugugcuuau

SEQ ID NO: 1817826 - RNA, 19 nt, Homo sapiens
ucucacaaggaaaaggcca

SEQ ID NO: 1817827 - RNA, 17 nt, Homo sapiens
aucuugcucugcugaca

SEQ ID NO: 1817828 - RNA, 17 nt, Homo sapiens
gauggcccaagggaugg

SEQ ID NO: 1817829 - RNA, 14 nt, Homo sapiens
acauggaugcacac

SEQ ID NO: 1817830 - RNA, 22 nt, Homo sapiens
cuuuaugguccuaaaagcaaaa

SEQ ID NO: 1817831 - RNA, 18 nt, Homo sapiens
uuuuaaguuuccuuccag

SEQ ID NO: 1817832 - RNA, 19 nt, Homo sapiens
ugguaccuauuuggugcua

SEQ ID NO: 1817833 - RNA, 19 nt, Homo sapiens
cuaacuuuuauuacaguca

SEQ ID NO: 1817834 - RNA, 11 nt, Homo sapiens
aaaacacugcc

SEQ ID NO: 1817835 - RNA, 23 nt, Homo sapiens
cugacuuauguaaucaaagccac

SEQ ID NO: 1817836 - RNA, 13 nt, Homo sapiens
uuauaucaugcaa

SEQ ID NO: 1817837 - RNA, 21 nt, Homo sapiens
acccugugugguauuuuggca

SEQ ID NO: 1817838 - RNA, 18 nt, Homo sapiens
auacacuaaaaaucugag

SEQ ID NO: 1817839 - RNA, 17 nt, Homo sapiens
caggccugugcgugcca

SEQ ID NO: 1817840 - RNA, 17 nt, Homo sapiens
accuaaauaugagccca

SEQ ID NO: 1817841 - RNA, 15 nt, Homo sapiens
uuagggguucauucu

SEQ ID NO: 1817842 - RNA, 20 nt, Homo sapiens
guaaauuauuuuaugucaua

SEQ ID NO: 1817843 - RNA, 14 nt, Homo sapiens
guuuggaagaccag

SEQ ID NO: 1817844 - RNA, 17 nt, Homo sapiens
augaagaugggcuucau

SEQ ID NO: 1817845 - RNA, 18 nt, Homo sapiens
uuguuuucuguucuccuu

SEQ ID NO: 1817846 - RNA, 14 nt, Homo sapiens
gucauuuccucuag

SEQ ID NO: 1817847 - RNA, 23 nt, Homo sapiens
gaacacuucgaguucccaggguu

SEQ ID NO: 1817848 - RNA, 21 nt, Homo sapiens
ugaaaauaaagcagaagcaac

SEQ ID NO: 1817849 - RNA, 19 nt, Homo sapiens
agugcaucuaaucacuuag

SEQ ID NO: 1817850 - RNA, 15 nt, Homo sapiens
cuauacacaagcaau

SEQ ID NO: 1817851 - RNA, 20 nt, Homo sapiens
acucacuuaucccaagagaa

SEQ ID NO: 1817852 - RNA, 15 nt, Homo sapiens
guccgaucuuugacu

SEQ ID NO: 1817853 - RNA, 17 nt, Homo sapiens
cagagagcgaccagcag

SEQ ID NO: 1817854 - RNA, 15 nt, Homo sapiens
cagaaaagugccuga

SEQ ID NO: 1817855 - RNA, 11 nt, Homo sapiens
cuucucaaaag

SEQ ID NO: 1817856 - RNA, 11 nt, Homo sapiens
acaccaaaaau

SEQ ID NO: 1817857 - RNA, 15 nt, Homo sapiens
ggcaccaccauggcu

SEQ ID NO: 1817858 - RNA, 22 nt, Homo sapiens
cccgccuccacucuaguucuag

SEQ ID NO: 1817859 - RNA, 16 nt, Homo sapiens
ugggaguuuugcucuc

SEQ ID NO: 1817860 - RNA, 13 nt, Homo sapiens
gcccaaugcugcu

SEQ ID NO: 1817861 - RNA, 12 nt, Homo sapiens
aacuagugcucu

SEQ ID NO: 1817862 - RNA, 18 nt, Homo sapiens
agagacugugcugggaac

SEQ ID NO: 1817863 - RNA, 22 nt, Homo sapiens
uugccuuccugccuagucucac

SEQ ID NO: 1817864 - RNA, 12 nt, Homo sapiens
aaugugaacuuc

SEQ ID NO: 1817865 - RNA, 22 nt, Homo sapiens
uucagaaaauaaaugguuucau

SEQ ID NO: 1817866 - RNA, 22 nt, Homo sapiens
caaccauuuguaaaacauucca

SEQ ID NO: 1817867 - RNA, 22 nt, Homo sapiens
gagaaugggaugugugaugcaa

SEQ ID NO: 1817868 - RNA, 15 nt, Homo sapiens
gagugaaucauccag

SEQ ID NO: 1817869 - RNA, 11 nt, Homo sapiens
auggagugugc

SEQ ID NO: 1817870 - RNA, 20 nt, Homo sapiens
agucaucagucaucaggugu

SEQ ID NO: 1817871 - RNA, 18 nt, Homo sapiens
cuagagcacacuguagca

SEQ ID NO: 1817872 - RNA, 21 nt, Homo sapiens
guggccucaacccucccucag

SEQ ID NO: 1817873 - RNA, 13 nt, Homo sapiens
aggaaaacaguaa

SEQ ID NO: 1817874 - RNA, 13 nt, Homo sapiens
uuuuguucauaca

SEQ ID NO: 1817875 - RNA, 13 nt, Homo sapiens
ugugaaacuggga

SEQ ID NO: 1817876 - RNA, 18 nt, Homo sapiens
gagcaguaaaagucacau

SEQ ID NO: 1817877 - RNA, 13 nt, Homo sapiens
cugcugugccuga

SEQ ID NO: 1817878 - RNA, 15 nt, Homo sapiens
caccucacuagcucc

SEQ ID NO: 1817879 - RNA, 16 nt, Homo sapiens
agccaacccuggaaaa

SEQ ID NO: 1817880 - RNA, 23 nt, Homo sapiens
aaugauuucaugcuaucucugug

SEQ ID NO: 1817881 - RNA, 13 nt, Homo sapiens
ccucuuugcuuug

SEQ ID NO: 1817882 - RNA, 22 nt, Homo sapiens
gcccucuaugguguggcaaagc

SEQ ID NO: 1817883 - RNA, 22 nt, Homo sapiens
cccugucucuacuaaaaauaca

SEQ ID NO: 1817884 - RNA, 17 nt, Homo sapiens
ggaaccuaaauugaacu

SEQ ID NO: 1817885 - RNA, 13 nt, Homo sapiens
uggaucagaaaga

SEQ ID NO: 1817886 - RNA, 21 nt, Homo sapiens
uaguggcuuccccucugucaa

SEQ ID NO: 1817887 - RNA, 21 nt, Homo sapiens
auaaauccaaaacaaacaugc

SEQ ID NO: 1817888 - RNA, 19 nt, Homo sapiens
auuccaaggccugugaaug

SEQ ID NO: 1817889 - RNA, 20 nt, Homo sapiens
gaaauccuaguggccuccca

SEQ ID NO: 1817890 - RNA, 18 nt, Homo sapiens
gaucauccacugugccau

SEQ ID NO: 1817891 - RNA, 18 nt, Homo sapiens
accaacauacucccaucu

SEQ ID NO: 1817892 - RNA, 23 nt, Homo sapiens
ggcccaggagcgcagcugcauuu

SEQ ID NO: 1817893 - RNA, 20 nt, Homo sapiens
ccgacggagccacuggggug

SEQ ID NO: 1817894 - RNA, 19 nt, Homo sapiens
aaaguacacuaaguuugca

SEQ ID NO: 1817895 - RNA, 19 nt, Homo sapiens
ggagucaggggcucugugu

SEQ ID NO: 1817896 - RNA, 16 nt, Homo sapiens
ccaaacuugucuugca

SEQ ID NO: 1817897 - RNA, 14 nt, Homo sapiens
aacaugagaugugu

SEQ ID NO: 1817898 - RNA, 19 nt, Homo sapiens
uucuuggaguuacaacaga

SEQ ID NO: 1817899 - RNA, 13 nt, Homo sapiens
cggcuguggagca

SEQ ID NO: 1817900 - RNA, 22 nt, Homo sapiens
ccacagaaagcuccuuccagac

SEQ ID NO: 1817901 - RNA, 22 nt, Homo sapiens
cuuuuaaagaauuucuuuauaa

SEQ ID NO: 1817902 - RNA, 17 nt, Homo sapiens
caaagaggcuccagaaa

SEQ ID NO: 1817903 - RNA, 18 nt, Homo sapiens
ugcuucaugugaacaucc

SEQ ID NO: 1817904 - RNA, 15 nt, Homo sapiens
cacaccaucuuucca

SEQ ID NO: 1817905 - RNA, 23 nt, Homo sapiens
uaagaacuuugagcuacugccgu

SEQ ID NO: 1817906 - RNA, 18 nt, Homo sapiens
ugaccuuuguaguagaau

SEQ ID NO: 1817907 - RNA, 22 nt, Homo sapiens
auugagauguguucacaaugga

SEQ ID NO: 1817908 - RNA, 18 nt, Homo sapiens
acagaauuaagaaauacu

SEQ ID NO: 1817909 - RNA, 17 nt, Homo sapiens
cggucagggucagggcc

SEQ ID NO: 1817910 - RNA, 16 nt, Homo sapiens
gaguuuucugugcaaa

SEQ ID NO: 1817911 - RNA, 22 nt, Homo sapiens
gauuuauuuuuuguaacucuuu

SEQ ID NO: 1817912 - RNA, 20 nt, Homo sapiens
auuauuuucucuuaacaaga

SEQ ID NO: 1817913 - RNA, 16 nt, Homo sapiens
uuagcuguacuguaau

SEQ ID NO: 1817914 - RNA, 21 nt, Homo sapiens
aauggcugaagugcauggguc

SEQ ID NO: 1817915 - RNA, 18 nt, Homo sapiens
caggacauucaccaagcc

SEQ ID NO: 1817916 - RNA, 14 nt, Homo sapiens
ugugcuuuugcaaa

SEQ ID NO: 1817917 - RNA, 19 nt, Homo sapiens
gaggauugcuugagcucag

SEQ ID NO: 1817918 - RNA, 18 nt, Homo sapiens
uuucaggaguuacuggau

SEQ ID NO: 1817919 - RNA, 20 nt, Homo sapiens
uuaaauaaugugaaacugga

SEQ ID NO: 1817920 - RNA, 16 nt, Homo sapiens
ucuucucauuacuugu

SEQ ID NO: 1817921 - RNA, 12 nt, Homo sapiens
uccuuacauuuu

SEQ ID NO: 1817922 - RNA, 16 nt, Homo sapiens
uaaaaaugagugcuua

SEQ ID NO: 1817923 - RNA, 20 nt, Homo sapiens
uuuccuguuugaaauaucau

SEQ ID NO: 1817924 - RNA, 16 nt, Homo sapiens
aguaauuuugcacaga

SEQ ID NO: 1817925 - RNA, 23 nt, Homo sapiens
aauguacuuuuccuuccagaaaa

SEQ ID NO: 1817926 - RNA, 15 nt, Homo sapiens
uaaauguuugcaaug

SEQ ID NO: 1817927 - RNA, 21 nt, Homo sapiens
cuauuccccccaccuaacuca

SEQ ID NO: 1817928 - RNA, 17 nt, Homo sapiens
cccucaaaucugaggga

SEQ ID NO: 1817929 - RNA, 15 nt, Homo sapiens
ugcacuagccuguga

SEQ ID NO: 1817930 - RNA, 17 nt, Homo sapiens
ugcgugcgagcacacac

SEQ ID NO: 1817931 - RNA, 19 nt, Homo sapiens
ggccacuggccaucuccac

SEQ ID NO: 1817932 - RNA, 16 nt, Homo sapiens
aguguagccuugcccg

SEQ ID NO: 1817933 - RNA, 18 nt, Homo sapiens
ucagcuggaucuccauuc

SEQ ID NO: 1817934 - RNA, 20 nt, Homo sapiens
aucuccuguaaaacugaccu

SEQ ID NO: 1817935 - RNA, 20 nt, Homo sapiens
guaaacagaaauccuuucau

SEQ ID NO: 1817936 - RNA, 17 nt, Homo sapiens
agcuggguguguuggca

SEQ ID NO: 1817937 - RNA, 19 nt, Homo sapiens
ccccacagagacacuuuac

SEQ ID NO: 1817938 - RNA, 16 nt, Homo sapiens
uaaagugcaguucuua

SEQ ID NO: 1817939 - RNA, 23 nt, Homo sapiens
aaaaauaaagcuacugaauuuau

SEQ ID NO: 1817940 - RNA, 21 nt, Homo sapiens
ugaguagaugggacuacaggc

SEQ ID NO: 1817941 - RNA, 16 nt, Homo sapiens
ggauaccacuuuucau

SEQ ID NO: 1817942 - RNA, 18 nt, Homo sapiens
gagguagauuucauugaa

SEQ ID NO: 1817943 - RNA, 11 nt, Homo sapiens
gggacugcugg

SEQ ID NO: 1817944 - RNA, 16 nt, Homo sapiens
ccagcggccucagggu

SEQ ID NO: 1817945 - RNA, 23 nt, Homo sapiens
ccugcuccaagggacccuuugcc

SEQ ID NO: 1817946 - RNA, 14 nt, Homo sapiens
ucuugagaaugauu

SEQ ID NO: 1817947 - RNA, 19 nt, Homo sapiens
aucaauucuuagaauaucu

SEQ ID NO: 1817948 - RNA, 17 nt, Homo sapiens
cugacccagagccuagg

SEQ ID NO: 1817949 - RNA, 22 nt, Homo sapiens
uuaugccuugguaaaaacugca

SEQ ID NO: 1817950 - RNA, 13 nt, Homo sapiens
aguguuguguuaa

SEQ ID NO: 1817951 - RNA, 18 nt, Homo sapiens
uuaugaucugccauuuca

SEQ ID NO: 1817952 - RNA, 16 nt, Homo sapiens
cuacugaugguuacau

SEQ ID NO: 1817953 - RNA, 19 nt, Homo sapiens
uauccaaaauaaugaggaa

SEQ ID NO: 1817954 - RNA, 16 nt, Homo sapiens
aggucaaggcugcagu

SEQ ID NO: 1817955 - RNA, 22 nt, Homo sapiens
cugugcaguggcccccacagaa

SEQ ID NO: 1817956 - RNA, 23 nt, Homo sapiens
uucacaaacaaauggcuguaaaa

SEQ ID NO: 1817957 - RNA, 15 nt, Homo sapiens
uaagcaaagacuuuc

SEQ ID NO: 1817958 - RNA, 18 nt, Homo sapiens
ccacagggagcuccguca

SEQ ID NO: 1817959 - RNA, 21 nt, Homo sapiens
ggaugacgugaagccacagga

SEQ ID NO: 1817960 - RNA, 12 nt, Homo sapiens
gagggggccaga

SEQ ID NO: 1817961 - RNA, 16 nt, Homo sapiens
auuguaaaaugcaccc

SEQ ID NO: 1817962 - RNA, 19 nt, Homo sapiens
ccugcagugcucauucauc

SEQ ID NO: 1817963 - RNA, 15 nt, Homo sapiens
ugccuccuguggucu

SEQ ID NO: 1817964 - RNA, 21 nt, Homo sapiens
acagaaccaacgggucugugg

SEQ ID NO: 1817965 - RNA, 12 nt, Homo sapiens
uacuaccccaga

SEQ ID NO: 1817966 - RNA, 20 nt, Homo sapiens
ugccuacagagggauuuauu

SEQ ID NO: 1817967 - RNA, 14 nt, Homo sapiens
ucauaaugacuuaa

SEQ ID NO: 1817968 - RNA, 16 nt, Homo sapiens
ugaccagcaacuuguc

SEQ ID NO: 1817969 - RNA, 12 nt, Homo sapiens
gcauaccuuuau

SEQ ID NO: 1817970 - RNA, 14 nt, Homo sapiens
gaucucagcucacu

SEQ ID NO: 1817971 - RNA, 19 nt, Homo sapiens
gucuucaugugucuugcaa

SEQ ID NO: 1817972 - RNA, 18 nt, Homo sapiens
aaccgaauaaauguuuua

SEQ ID NO: 1817973 - RNA, 21 nt, Homo sapiens
uucccgcagcaccagccugag

SEQ ID NO: 1817974 - RNA, 12 nt, Homo sapiens
ggacgcaugcag

SEQ ID NO: 1817975 - RNA, 14 nt, Homo sapiens
uaagaaacauuuau

SEQ ID NO: 1817976 - RNA, 19 nt, Homo sapiens
cccuggugucccugccugg

SEQ ID NO: 1817977 - RNA, 23 nt, Homo sapiens
ugugugcaagugugugcaugugu

SEQ ID NO: 1817978 - RNA, 15 nt, Homo sapiens
ucccgucgugcaguc

SEQ ID NO: 1817979 - RNA, 15 nt, Homo sapiens
ucacauagugaaaua

SEQ ID NO: 1817980 - RNA, 19 nt, Homo sapiens
uguucugaggauucagggg

SEQ ID NO: 1817981 - RNA, 16 nt, Homo sapiens
ucgacagcucucuggg

SEQ ID NO: 1817982 - RNA, 22 nt, Homo sapiens
auaaaacuuaacuuccaaugaa

SEQ ID NO: 1817983 - RNA, 22 nt, Homo sapiens
gcccauuggcucccaucugaac

SEQ ID NO: 1817984 - RNA, 19 nt, Homo sapiens
aagucauuguccucugagc

SEQ ID NO: 1817985 - RNA, 18 nt, Homo sapiens
cuguuauggggacuuuau

SEQ ID NO: 1817986 - RNA, 15 nt, Homo sapiens
cuugcauagugccug

SEQ ID NO: 1817987 - RNA, 23 nt, Homo sapiens
agcuuuuuaccguucacuucccc

SEQ ID NO: 1817988 - RNA, 22 nt, Homo sapiens
cagugccuacccaccugugagg

SEQ ID NO: 1817989 - RNA, 17 nt, Homo sapiens
ugcacgucaccaaguaa

SEQ ID NO: 1817990 - RNA, 19 nt, Homo sapiens
gcacacgcguuauaguaac

SEQ ID NO: 1817991 - RNA, 18 nt, Homo sapiens
ucuacuggacuguaaaau

SEQ ID NO: 1817992 - RNA, 14 nt, Homo sapiens
aaauuuaaauggag

SEQ ID NO: 1817993 - RNA, 17 nt, Homo sapiens
gaauucauugucucagu

SEQ ID NO: 1817994 - RNA, 12 nt, Homo sapiens
uucucuugaaua

SEQ ID NO: 1817995 - RNA, 18 nt, Homo sapiens
ccuccucccgacugacca

SEQ ID NO: 1817996 - RNA, 14 nt, Homo sapiens
auacccagucccag

SEQ ID NO: 1817997 - RNA, 22 nt, Homo sapiens
acuuuccucccauuuuaccacu

SEQ ID NO: 1817998 - RNA, 12 nt, Homo sapiens
auuguaauauua

SEQ ID NO: 1817999 - RNA, 15 nt, Homo sapiens
agcacuuugccaugc

SEQ ID NO: 1818000 - RNA, 22 nt, Homo sapiens
guaucagucagugcuggagaaa

SEQ ID NO: 1818001 - RNA, 20 nt, Homo sapiens
caguagcauggcucuuucau

SEQ ID NO: 1818002 - RNA, 23 nt, Homo sapiens
aauaguaaaagauaacaagaucu

SEQ ID NO: 1818003 - RNA, 13 nt, Homo sapiens
ugauuguauuugu

SEQ ID NO: 1818004 - RNA, 19 nt, Homo sapiens
cggacauggucuguccuga

SEQ ID NO: 1818005 - RNA, 16 nt, Homo sapiens
gcaguccacaaagcau

SEQ ID NO: 1818006 - RNA, 15 nt, Homo sapiens
gccauugcauuccag

SEQ ID NO: 1818007 - RNA, 14 nt, Homo sapiens
uaagggaagcugau

SEQ ID NO: 1818008 - RNA, 17 nt, Homo sapiens
ggcuggagauggcugcu

SEQ ID NO: 1818009 - RNA, 17 nt, Homo sapiens
acuguuaaucauggguu

SEQ ID NO: 1818010 - RNA, 19 nt, Homo sapiens
gcuccuuagcugccaagcc

SEQ ID NO: 1818011 - RNA, 16 nt, Homo sapiens
uuuccuaacugugauu

SEQ ID NO: 1818012 - RNA, 11 nt, Homo sapiens
cuguccagugc

SEQ ID NO: 1818013 - RNA, 22 nt, Homo sapiens
agaguuucuccuuuugaccaaa

SEQ ID NO: 1818014 - RNA, 14 nt, Homo sapiens
auuucaaagcaagu

SEQ ID NO: 1818015 - RNA, 22 nt, Homo sapiens
aaccgaugcuccagccaacccc

SEQ ID NO: 1818016 - RNA, 13 nt, Homo sapiens
auauacuaugaaa

SEQ ID NO: 1818017 - RNA, 14 nt, Homo sapiens
ucgcugacaucugg

SEQ ID NO: 1818018 - RNA, 21 nt, Homo sapiens
aguggcuuugcauagcuuuca

SEQ ID NO: 1818019 - RNA, 23 nt, Homo sapiens
gaucuugagcucugcucucagca

SEQ ID NO: 1818020 - RNA, 16 nt, Homo sapiens
gaaaacuguuaccuaa

SEQ ID NO: 1818021 - RNA, 18 nt, Homo sapiens
uuucagaugcaaucacuu

SEQ ID NO: 1818022 - RNA, 21 nt, Homo sapiens
acaaaguccacuuuacucaaa

SEQ ID NO: 1818023 - RNA, 17 nt, Homo sapiens
accuagacaaccagagg

SEQ ID NO: 1818024 - RNA, 18 nt, Homo sapiens
uauuauucuucauaacaa

SEQ ID NO: 1818025 - RNA, 22 nt, Homo sapiens
uucucuugagaggguggaauau

SEQ ID NO: 1818026 - RNA, 22 nt, Homo sapiens
gcacugaccccgaccucagaga

SEQ ID NO: 1818027 - RNA, 19 nt, Homo sapiens
aagaacacaugugcaguca

SEQ ID NO: 1818028 - RNA, 20 nt, Homo sapiens
aaccaaaggaaucguuucaa

SEQ ID NO: 1818029 - RNA, 21 nt, Homo sapiens
cauguuugacuuuagacugua

SEQ ID NO: 1818030 - RNA, 22 nt, Homo sapiens
ucacucauucccauguugucaa

SEQ ID NO: 1818031 - RNA, 19 nt, Homo sapiens
agagguggccccaccugag

SEQ ID NO: 1818032 - RNA, 23 nt, Homo sapiens
gaaccgcaggaugaaaaugaaga

SEQ ID NO: 1818033 - RNA, 20 nt, Homo sapiens
aagauuaugugacuugcaau

SEQ ID NO: 1818034 - RNA, 21 nt, Homo sapiens
gauugagagcagccucuugaa

SEQ ID NO: 1818035 - RNA, 18 nt, Homo sapiens
aaaggagaacacugguua

SEQ ID NO: 1818036 - RNA, 20 nt, Homo sapiens
aagcuuacaugccuaccaau

SEQ ID NO: 1818037 - RNA, 14 nt, Homo sapiens
cuucaugaugugug

SEQ ID NO: 1818038 - RNA, 19 nt, Homo sapiens
gccgggcaccaacuccaug

SEQ ID NO: 1818039 - RNA, 22 nt, Homo sapiens
ugucuguuuuuguaacuuaaaa

SEQ ID NO: 1818040 - RNA, 13 nt, Homo sapiens
caaaauguagcau

SEQ ID NO: 1818041 - RNA, 18 nt, Homo sapiens
aaacacccuucagcaaug

SEQ ID NO: 1818042 - RNA, 16 nt, Homo sapiens
gaaaugguacugccca

SEQ ID NO: 1818043 - RNA, 21 nt, Homo sapiens
guguuauuguauuagguguca

SEQ ID NO: 1818044 - RNA, 16 nt, Homo sapiens
gcauaaacaacaguac

SEQ ID NO: 1818045 - RNA, 22 nt, Homo sapiens
ggaacugaagagggcccaaguc

SEQ ID NO: 1818046 - RNA, 13 nt, Homo sapiens
aaaggccacccua

SEQ ID NO: 1818047 - RNA, 21 nt, Homo sapiens
uucacuguauucaauaacuga

SEQ ID NO: 1818048 - RNA, 23 nt, Homo sapiens
agccagaggcucuaauguacaau

SEQ ID NO: 1818049 - RNA, 16 nt, Homo sapiens
caguucucccagggag

SEQ ID NO: 1818050 - RNA, 18 nt, Homo sapiens
ucuggggugcugccugaa

SEQ ID NO: 1818051 - RNA, 22 nt, Homo sapiens
acccugcccaggguuggcauga

SEQ ID NO: 1818052 - RNA, 20 nt, Homo sapiens
agcuaggaagagcaggacuc

SEQ ID NO: 1818053 - RNA, 21 nt, Homo sapiens
cuaaugguaacuuuuguaguc

SEQ ID NO: 1818054 - RNA, 15 nt, Homo sapiens
acacuuucucuucaa

SEQ ID NO: 1818055 - RNA, 16 nt, Homo sapiens
uagcaagcuuuugcuc

SEQ ID NO: 1818056 - RNA, 14 nt, Homo sapiens
uauuuuucaggaaa

SEQ ID NO: 1818057 - RNA, 16 nt, Homo sapiens
gagcuuuucacuguga

SEQ ID NO: 1818058 - RNA, 22 nt, Homo sapiens
uuggcaccagacacccaggacu

SEQ ID NO: 1818059 - RNA, 12 nt, Homo sapiens
auuguguuuauu

SEQ ID NO: 1818060 - RNA, 15 nt, Homo sapiens
guuauugugaaugau

SEQ ID NO: 1818061 - RNA, 21 nt, Homo sapiens
uacacuaaaaggugaccaaug

SEQ ID NO: 1818062 - RNA, 23 nt, Homo sapiens
cucuagccccagcgccaaaggag

SEQ ID NO: 1818063 - RNA, 17 nt, Homo sapiens
cagcaauuucagaacca

SEQ ID NO: 1818064 - RNA, 20 nt, Homo sapiens
augaucuuugcagacaggca

SEQ ID NO: 1818065 - RNA, 15 nt, Homo sapiens
ucuugcacuguccag

SEQ ID NO: 1818066 - RNA, 24 nt, Homo sapiens
ccuugaugacuuccuauccauucu

SEQ ID NO: 1818067 - RNA, 16 nt, Homo sapiens
aacaguaucuuugcac

SEQ ID NO: 1818068 - RNA, 14 nt, Homo sapiens
acaagucuuccaga

SEQ ID NO: 1818069 - RNA, 16 nt, Homo sapiens
guguacuuucuucccu

SEQ ID NO: 1818070 - RNA, 15 nt, Homo sapiens
uucagugauacucac

SEQ ID NO: 1818071 - RNA, 15 nt, Homo sapiens
cagccugaccccgcc

SEQ ID NO: 1818072 - RNA, 19 nt, Homo sapiens
aauaugcacaauagcaguu

SEQ ID NO: 1818073 - RNA, 20 nt, Homo sapiens
gaaaaacgaucgcugugaaa

SEQ ID NO: 1818074 - RNA, 15 nt, Homo sapiens
ccaccaaucacgugg

SEQ ID NO: 1818075 - RNA, 18 nt, Homo sapiens
acgcucgcugccaucacc

SEQ ID NO: 1818076 - RNA, 17 nt, Homo sapiens
gugaaugggacuauuca

SEQ ID NO: 1818077 - RNA, 20 nt, Homo sapiens
auccccuguguggucuccau

SEQ ID NO: 1818078 - RNA, 13 nt, Homo sapiens
ugucaaugcauca

SEQ ID NO: 1818079 - RNA, 15 nt, Homo sapiens
uccacgggcucuccu

SEQ ID NO: 1818080 - RNA, 14 nt, Homo sapiens
ccagagucccugcc

SEQ ID NO: 1818081 - RNA, 20 nt, Homo sapiens
cucgauagccugagguggga

SEQ ID NO: 1818082 - RNA, 17 nt, Homo sapiens
accuucaaaagcacuga

SEQ ID NO: 1818083 - RNA, 14 nt, Homo sapiens
ggugcacaccugug

SEQ ID NO: 1818084 - RNA, 20 nt, Homo sapiens
aucuccugugauccuuugau

SEQ ID NO: 1818085 - RNA, 12 nt, Homo sapiens
agucagcugcug

SEQ ID NO: 1818086 - RNA, 15 nt, Homo sapiens
uuccaggaaccaaaa

SEQ ID NO: 1818087 - RNA, 14 nt, Homo sapiens
ucuaaaaucaugaa

SEQ ID NO: 1818088 - RNA, 15 nt, Homo sapiens
ggaggccagccucac

SEQ ID NO: 1818089 - RNA, 19 nt, Homo sapiens
cggggccacgugugcugug

SEQ ID NO: 1818090 - RNA, 10 nt, Homo sapiens
aaucacuguc

SEQ ID NO: 1818091 - RNA, 23 nt, Homo sapiens
ccggaaugaaugagcauucugca

SEQ ID NO: 1818092 - RNA, 15 nt, Homo sapiens
cugcuggacaggggc

SEQ ID NO: 1818093 - RNA, 19 nt, Homo sapiens
aagcauucacaacuuguuu

SEQ ID NO: 1818094 - RNA, 13 nt, Homo sapiens
aaggcugugagcc

SEQ ID NO: 1818095 - RNA, 18 nt, Homo sapiens
aaaaagaucuacauacaa

SEQ ID NO: 1818096 - RNA, 23 nt, Homo sapiens
cuacuugggagguugaagcagaa

SEQ ID NO: 1818097 - RNA, 20 nt, Homo sapiens
caaacaaagccagaagcuga

SEQ ID NO: 1818098 - RNA, 23 nt, Homo sapiens
gagguuuuuuugucaacauugug

SEQ ID NO: 1818099 - RNA, 17 nt, Homo sapiens
gaaugggcacagcacag

SEQ ID NO: 1818100 - RNA, 16 nt, Homo sapiens
gucuaccugagaucua

SEQ ID NO: 1818101 - RNA, 13 nt, Homo sapiens
cucccacagugac

SEQ ID NO: 1818102 - RNA, 15 nt, Homo sapiens
gaggugccacuggag

SEQ ID NO: 1818103 - RNA, 22 nt, Homo sapiens
gggcuuguuuuucuucagcauu

SEQ ID NO: 1818104 - RNA, 11 nt, Homo sapiens
uuagacauuua

SEQ ID NO: 1818105 - RNA, 16 nt, Homo sapiens
ucagccagccuccagc

SEQ ID NO: 1818106 - RNA, 15 nt, Homo sapiens
guacuacauaccuca

SEQ ID NO: 1818107 - RNA, 18 nt, Homo sapiens
agugguacaaucuggcuc

SEQ ID NO: 1818108 - RNA, 14 nt, Homo sapiens
ugaaagcacaugaa

SEQ ID NO: 1818109 - RNA, 13 nt, Homo sapiens
gaaaaggacaaau

SEQ ID NO: 1818110 - RNA, 20 nt, Homo sapiens
aaucauaaauacugcuguau

SEQ ID NO: 1818111 - RNA, 21 nt, Homo sapiens
ccauuuauuauuuuguaacuu

SEQ ID NO: 1818112 - RNA, 17 nt, Homo sapiens
aauaaacuagacucuga

SEQ ID NO: 1818113 - RNA, 16 nt, Homo sapiens
gagggcgcaggccgug

SEQ ID NO: 1818114 - RNA, 15 nt, Homo sapiens
guauuuuaacuacuu

SEQ ID NO: 1818115 - RNA, 22 nt, Homo sapiens
uuuccugaauuuccccaucugc

SEQ ID NO: 1818116 - RNA, 15 nt, Homo sapiens
uggaaagaaaaccau

SEQ ID NO: 1818117 - RNA, 21 nt, Homo sapiens
gacauauguuaggaauacucu

SEQ ID NO: 1818118 - RNA, 15 nt, Homo sapiens
gagaaauugugccaa

SEQ ID NO: 1818119 - RNA, 16 nt, Homo sapiens
aaguaccaaugcuguu

SEQ ID NO: 1818120 - RNA, 20 nt, Homo sapiens
ugccugccccccucaucuca

SEQ ID NO: 1818121 - RNA, 14 nt, Homo sapiens
cuugagaagcugcc

SEQ ID NO: 1818122 - RNA, 14 nt, Homo sapiens
ugucccugccuuca

SEQ ID NO: 1818123 - RNA, 20 nt, Homo sapiens
cuauaacauucaauuugcua

SEQ ID NO: 1818124 - RNA, 20 nt, Homo sapiens
aguggggccuccuuguccag

SEQ ID NO: 1818125 - RNA, 16 nt, Homo sapiens
guuguguggacuuuga

SEQ ID NO: 1818126 - RNA, 24 nt, Homo sapiens
accccaauggcuacucugcucaca

SEQ ID NO: 1818127 - RNA, 16 nt, Homo sapiens
uucagcucacuuccuc

SEQ ID NO: 1818128 - RNA, 18 nt, Homo sapiens
acugcuuuucaguucugu

SEQ ID NO: 1818129 - RNA, 11 nt, Homo sapiens
ugucauaugaa

SEQ ID NO: 1818130 - RNA, 15 nt, Homo sapiens
aaaaugaacagugau

SEQ ID NO: 1818131 - RNA, 15 nt, Homo sapiens
cucccuggcugugag

SEQ ID NO: 1818132 - RNA, 15 nt, Homo sapiens
gacccugggagugag

SEQ ID NO: 1818133 - RNA, 18 nt, Homo sapiens
auauggacuuucuugcaa

SEQ ID NO: 1818134 - RNA, 22 nt, Homo sapiens
gaaugccauuggaaccuguuaa

SEQ ID NO: 1818135 - RNA, 13 nt, Homo sapiens
cuccauggcucug

SEQ ID NO: 1818136 - RNA, 18 nt, Homo sapiens
gcuccacuuggucuguga

SEQ ID NO: 1818137 - RNA, 15 nt, Homo sapiens
gacccacuggacuca

SEQ ID NO: 1818138 - RNA, 12 nt, Homo sapiens
aacaaccugcug

SEQ ID NO: 1818139 - RNA, 17 nt, Homo sapiens
cuuuguuuaaaugccaa

SEQ ID NO: 1818140 - RNA, 12 nt, Homo sapiens
aagcaauucugc

SEQ ID NO: 1818141 - RNA, 18 nt, Homo sapiens
ugcggaugcaagagcacc

SEQ ID NO: 1818142 - RNA, 19 nt, Homo sapiens
agcauccuuuugcucuguc

SEQ ID NO: 1818143 - RNA, 20 nt, Homo sapiens
uuaaauugaauaaaauacuc

SEQ ID NO: 1818144 - RNA, 19 nt, Homo sapiens
gauuccuuuggccacugua

SEQ ID NO: 1818145 - RNA, 17 nt, Homo sapiens
auauaguaaacacucaa

SEQ ID NO: 1818146 - RNA, 14 nt, Homo sapiens
agacccuugugcau

SEQ ID NO: 1818147 - RNA, 12 nt, Homo sapiens
aaaucuauuuca

SEQ ID NO: 1818148 - RNA, 22 nt, Homo sapiens
ccuaccgaugugugaugucucc

SEQ ID NO: 1818149 - RNA, 22 nt, Homo sapiens
auguaaaauuuggaguaaauau

SEQ ID NO: 1818150 - RNA, 18 nt, Homo sapiens
aauuuggaaaggaccaaa

SEQ ID NO: 1818151 - RNA, 22 nt, Homo sapiens
guccucugucagucacagccac

SEQ ID NO: 1818152 - RNA, 22 nt, Homo sapiens
gcaucagcguggcagucaccac

SEQ ID NO: 1818153 - RNA, 11 nt, Homo sapiens
aaaauccacua

SEQ ID NO: 1818154 - RNA, 16 nt, Homo sapiens
agacagggucuugcua

SEQ ID NO: 1818155 - RNA, 13 nt, Homo sapiens
gacucaaacugcc

SEQ ID NO: 1818156 - RNA, 21 nt, Homo sapiens
auauucauaauauauaaaaga

SEQ ID NO: 1818157 - RNA, 13 nt, Homo sapiens
caugaagcacaaa

SEQ ID NO: 1818158 - RNA, 22 nt, Homo sapiens
ccugaguuugggagagugguga

SEQ ID NO: 1818159 - RNA, 16 nt, Homo sapiens
uuauacugcacuuuag

SEQ ID NO: 1818160 - RNA, 18 nt, Homo sapiens
aguuggaauucaccaaga

SEQ ID NO: 1818161 - RNA, 18 nt, Homo sapiens
aagucuuaguacauccuc

SEQ ID NO: 1818162 - RNA, 20 nt, Homo sapiens
acacaugcuccgucugacaa

SEQ ID NO: 1818163 - RNA, 16 nt, Homo sapiens
uccaggauagacuuuu

SEQ ID NO: 1818164 - RNA, 12 nt, Homo sapiens
ucuggacacuug

SEQ ID NO: 1818165 - RNA, 14 nt, Homo sapiens
guuaagaauggaag

SEQ ID NO: 1818166 - RNA, 19 nt, Homo sapiens
gagaagaaagaagcacucu

SEQ ID NO: 1818167 - RNA, 15 nt, Homo sapiens
uggucggugggaccc

SEQ ID NO: 1818168 - RNA, 20 nt, Homo sapiens
ccgugaaauugaugccagug

SEQ ID NO: 1818169 - RNA, 15 nt, Homo sapiens
ucggggaacuccugg

SEQ ID NO: 1818170 - RNA, 16 nt, Homo sapiens
gguuauguaucagaag

SEQ ID NO: 1818171 - RNA, 19 nt, Homo sapiens
aaggaacaagaauugcuaa

SEQ ID NO: 1818172 - RNA, 18 nt, Homo sapiens
ucccaugaauacacaacu

SEQ ID NO: 1818173 - RNA, 16 nt, Homo sapiens
uuuacaagugcugcaa

SEQ ID NO: 1818174 - RNA, 16 nt, Homo sapiens
aaagaauagugccuca

SEQ ID NO: 1818175 - RNA, 22 nt, Homo sapiens
ugaacccagaaacaacacaauc

SEQ ID NO: 1818176 - RNA, 22 nt, Homo sapiens
aauguugaaugucuuuggcuca

SEQ ID NO: 1818177 - RNA, 13 nt, Homo sapiens
gcucacuuuucau

SEQ ID NO: 1818178 - RNA, 15 nt, Homo sapiens
uaauuauauacuccu

SEQ ID NO: 1818179 - RNA, 15 nt, Homo sapiens
aacguauaaaagccu

SEQ ID NO: 1818180 - RNA, 19 nt, Homo sapiens
ugaggccuacucuaaagaa

SEQ ID NO: 1818181 - RNA, 13 nt, Homo sapiens
acauaaguuauca

SEQ ID NO: 1818182 - RNA, 18 nt, Homo sapiens
uuucucccuuuguuuaaa

SEQ ID NO: 1818183 - RNA, 23 nt, Homo sapiens
gauauaauaauuacuuaaugugg

SEQ ID NO: 1818184 - RNA, 12 nt, Homo sapiens
ucaguacagggc

SEQ ID NO: 1818185 - RNA, 22 nt, Homo sapiens
cugaacuguaacuuaaauucca

SEQ ID NO: 1818186 - RNA, 23 nt, Homo sapiens
gacagagugagacccugucucaa

SEQ ID NO: 1818187 - RNA, 23 nt, Homo sapiens
gacagagcaagaccccaucucaa

SEQ ID NO: 1818188 - RNA, 18 nt, Homo sapiens
cuucccuguccaccucac

SEQ ID NO: 1818189 - RNA, 14 nt, Homo sapiens
uuuguaagugcugc

SEQ ID NO: 1818190 - RNA, 15 nt, Homo sapiens
uggaacaaacaauga

SEQ ID NO: 1818191 - RNA, 14 nt, Homo sapiens
ugcuucuccaguuu

SEQ ID NO: 1818192 - RNA, 17 nt, Homo sapiens
uguucucgcaaaaacgu

SEQ ID NO: 1818193 - RNA, 17 nt, Homo sapiens
ugugaauguggauucuu

SEQ ID NO: 1818194 - RNA, 13 nt, Homo sapiens
uagaauuuauuca

SEQ ID NO: 1818195 - RNA, 15 nt, Homo sapiens
acuguacauuucaca

SEQ ID NO: 1818196 - RNA, 17 nt, Homo sapiens
ucagagacagauaccuc

SEQ ID NO: 1818197 - RNA, 17 nt, Homo sapiens
ugaagcaaagugcccau

SEQ ID NO: 1818198 - RNA, 17 nt, Homo sapiens
cccucuuucacuucaua

SEQ ID NO: 1818199 - RNA, 19 nt, Homo sapiens
aaccaucuucguacaugaa

SEQ ID NO: 1818200 - RNA, 13 nt, Homo sapiens
uuguuguuugcuu

SEQ ID NO: 1818201 - RNA, 14 nt, Homo sapiens
aauuuguaagcaaa

SEQ ID NO: 1818202 - RNA, 21 nt, Homo sapiens
accgcuggccgagcugaagaa

SEQ ID NO: 1818203 - RNA, 23 nt, Homo sapiens
caucuagggaaugggacugugag

SEQ ID NO: 1818204 - RNA, 21 nt, Homo sapiens
ucacggagauaugaagagcaa

SEQ ID NO: 1818205 - RNA, 17 nt, Homo sapiens
ugcuuucucaugcauag

SEQ ID NO: 1818206 - RNA, 19 nt, Homo sapiens
uaaaauuaagaaguacaau

SEQ ID NO: 1818207 - RNA, 21 nt, Homo sapiens
guuuccacugccuccugugac

SEQ ID NO: 1818208 - RNA, 21 nt, Homo sapiens
guuuaacacgguuacugacuu

SEQ ID NO: 1818209 - RNA, 19 nt, Homo sapiens
ucauaauacaaaggugcua

SEQ ID NO: 1818210 - RNA, 22 nt, Homo sapiens
uaaacucuagggggacuuucuu

SEQ ID NO: 1818211 - RNA, 14 nt, Homo sapiens
gaacccuucuccau

SEQ ID NO: 1818212 - RNA, 15 nt, Homo sapiens
cauugcuuuccacug

SEQ ID NO: 1818213 - RNA, 16 nt, Homo sapiens
cugagcaggggaacaa

SEQ ID NO: 1818214 - RNA, 18 nt, Homo sapiens
cucacuuuuuacccagaa

SEQ ID NO: 1818215 - RNA, 22 nt, Homo sapiens
auuaggcugugucaccauugug

SEQ ID NO: 1818216 - RNA, 15 nt, Homo sapiens
aucuugaccaacaga

SEQ ID NO: 1818217 - RNA, 22 nt, Homo sapiens
aauucauuguguuaccuguaga

SEQ ID NO: 1818218 - RNA, 15 nt, Homo sapiens
ccgaacacugagaaa

SEQ ID NO: 1818219 - RNA, 18 nt, Homo sapiens
aauuucuauuuuuaucug

SEQ ID NO: 1818220 - RNA, 17 nt, Homo sapiens
cugcauagcuugcacaa

SEQ ID NO: 1818221 - RNA, 23 nt, Homo sapiens
uaagcagacccauaccuuuccag

SEQ ID NO: 1818222 - RNA, 21 nt, Homo sapiens
cacuucucuagagaacaugcc

SEQ ID NO: 1818223 - RNA, 15 nt, Homo sapiens
ucugaagacuaguua

SEQ ID NO: 1818224 - RNA, 19 nt, Homo sapiens
cauauauugcauuucugua

SEQ ID NO: 1818225 - RNA, 17 nt, Homo sapiens
aaucugagagauuugaa

SEQ ID NO: 1818226 - RNA, 15 nt, Homo sapiens
auuugcuagauuucu

SEQ ID NO: 1818227 - RNA, 16 nt, Homo sapiens
ucuucacucucugaag

SEQ ID NO: 1818228 - RNA, 15 nt, Homo sapiens
gcuguuaccauucac

SEQ ID NO: 1818229 - RNA, 16 nt, Homo sapiens
cauuuaaaccaguauc

SEQ ID NO: 1818230 - RNA, 16 nt, Homo sapiens
ucagaacugugccaca

SEQ ID NO: 1818231 - RNA, 17 nt, Homo sapiens
acuuauuuucagugcau

SEQ ID NO: 1818232 - RNA, 21 nt, Homo sapiens
ccacuaauuugucacuggaac

SEQ ID NO: 1818233 - RNA, 19 nt, Homo sapiens
aauugugcuggaaauggac

SEQ ID NO: 1818234 - RNA, 12 nt, Homo sapiens
cuucacugacag

SEQ ID NO: 1818235 - RNA, 19 nt, Homo sapiens
uucccauuguaacaauaaa

SEQ ID NO: 1818236 - RNA, 16 nt, Homo sapiens
cccuccaaaccuccag

SEQ ID NO: 1818237 - RNA, 15 nt, Homo sapiens
gagucagccccacuc

SEQ ID NO: 1818238 - RNA, 12 nt, Homo sapiens
gcggccacugcg

SEQ ID NO: 1818239 - RNA, 12 nt, Homo sapiens
acugacugugaa

SEQ ID NO: 1818240 - RNA, 13 nt, Homo sapiens
ccuuuuguauaca

SEQ ID NO: 1818241 - RNA, 16 nt, Homo sapiens
uguugucagcacugua

SEQ ID NO: 1818242 - RNA, 20 nt, Homo sapiens
ucaauuacuugaaguugcuu

SEQ ID NO: 1818243 - RNA, 18 nt, Homo sapiens
cugagucuggaccuccau

SEQ ID NO: 1818244 - RNA, 21 nt, Homo sapiens
uugccgaaccaggagcugcuc

SEQ ID NO: 1818245 - RNA, 16 nt, Homo sapiens
aauuuuucaguguuga

SEQ ID NO: 1818246 - RNA, 20 nt, Homo sapiens
aauaaaucuauucugcuaag

SEQ ID NO: 1818247 - RNA, 15 nt, Homo sapiens
cuugugcaugcaaaa

SEQ ID NO: 1818248 - RNA, 20 nt, Homo sapiens
cugcaaaaguucucaauguu

SEQ ID NO: 1818249 - RNA, 22 nt, Homo sapiens
auuaacuccuccugagcucuga

SEQ ID NO: 1818250 - RNA, 13 nt, Homo sapiens
auguucaauauga

SEQ ID NO: 1818251 - RNA, 15 nt, Homo sapiens
guugaagaaggcaaa

SEQ ID NO: 1818252 - RNA, 12 nt, Homo sapiens
cucacuuuacau

SEQ ID NO: 1818253 - RNA, 23 nt, Homo sapiens
uauaagugaagugauacuaucca

SEQ ID NO: 1818254 - RNA, 11 nt, Homo sapiens
ggcgcgguggc

SEQ ID NO: 1818255 - RNA, 16 nt, Homo sapiens
ugagaaaagcuuugaa

SEQ ID NO: 1818256 - RNA, 22 nt, Homo sapiens
gcuuguaccacuuuugcaaaua

SEQ ID NO: 1818257 - RNA, 14 nt, Homo sapiens
uucuguacaugcau

SEQ ID NO: 1818258 - RNA, 22 nt, Homo sapiens
gacgugcugggcggcugugcuu

SEQ ID NO: 1818259 - RNA, 15 nt, Homo sapiens
acuauuugaagcaau

SEQ ID NO: 1818260 - RNA, 17 nt, Homo sapiens
gccagccggcuaugaaa

SEQ ID NO: 1818261 - RNA, 12 nt, Homo sapiens
gacugcugugaa

SEQ ID NO: 1818262 - RNA, 16 nt, Homo sapiens
acaauuccuagauaaa

SEQ ID NO: 1818263 - RNA, 18 nt, Homo sapiens
uucccaaguaugccuuaa

SEQ ID NO: 1818264 - RNA, 12 nt, Homo sapiens
uagaaaccugaa

SEQ ID NO: 1818265 - RNA, 12 nt, Homo sapiens
agauaaccaagu

SEQ ID NO: 1818266 - RNA, 12 nt, Homo sapiens
aaaaaaccagga

SEQ ID NO: 1818267 - RNA, 21 nt, Homo sapiens
uuaucugcaagguuguaguca

SEQ ID NO: 1818268 - RNA, 16 nt, Homo sapiens
aacacuaaaaaggcau

SEQ ID NO: 1818269 - RNA, 23 nt, Homo sapiens
ccucuuugaacauggucuaguga

SEQ ID NO: 1818270 - RNA, 21 nt, Homo sapiens
cagcgauucccuguguagcuc

SEQ ID NO: 1818271 - RNA, 14 nt, Homo sapiens
auugcuuucugcuc

SEQ ID NO: 1818272 - RNA, 22 nt, Homo sapiens
auguuuguacacaacaccuaaa

SEQ ID NO: 1818273 - RNA, 13 nt, Homo sapiens
aguugaagacaga

SEQ ID NO: 1818274 - RNA, 19 nt, Homo sapiens
gaugggguugggcucugcg

SEQ ID NO: 1818275 - RNA, 20 nt, Homo sapiens
uuguaaguuuuugauucuac

SEQ ID NO: 1818276 - RNA, 18 nt, Homo sapiens
agcuacagcuuucuugcu

SEQ ID NO: 1818277 - RNA, 14 nt, Homo sapiens
cgcagccuuaccca

SEQ ID NO: 1818278 - RNA, 21 nt, Homo sapiens
ucagcaugauguguuguguau

SEQ ID NO: 1818279 - RNA, 23 nt, Homo sapiens
cugucuuauuaagacuggcuuua

SEQ ID NO: 1818280 - RNA, 14 nt, Homo sapiens
gaggauuucugcuu

SEQ ID NO: 1818281 - RNA, 19 nt, Homo sapiens
auaacuauauaaaugacau

SEQ ID NO: 1818282 - RNA, 22 nt, Homo sapiens
gcauuuauuuauacagugccuu

SEQ ID NO: 1818283 - RNA, 22 nt, Homo sapiens
aauauagagacuguguucaugu

SEQ ID NO: 1818284 - RNA, 18 nt, Homo sapiens
acagugaauuuaagcaug

SEQ ID NO: 1818285 - RNA, 17 nt, Homo sapiens
cgucuccggaauccuug

SEQ ID NO: 1818286 - RNA, 22 nt, Homo sapiens
ccuuuggauugacucugcauuu

SEQ ID NO: 1818287 - RNA, 19 nt, Homo sapiens
gcaguggguucaggcccau

SEQ ID NO: 1818288 - RNA, 15 nt, Homo sapiens
uuauaauaacugaac

SEQ ID NO: 1818289 - RNA, 24 nt, Homo sapiens
caccgagugccuucaacacagcuu

SEQ ID NO: 1818290 - RNA, 16 nt, Homo sapiens
caaggugcucuucuca

SEQ ID NO: 1818291 - RNA, 14 nt, Homo sapiens
guuuucaaguugca

SEQ ID NO: 1818292 - RNA, 16 nt, Homo sapiens
ugagcuagcaaauaca

SEQ ID NO: 1818293 - RNA, 21 nt, Homo sapiens
cuaaagaaauaaucucuaugu

SEQ ID NO: 1818294 - RNA, 13 nt, Homo sapiens
cuguaacagcauu

SEQ ID NO: 1818295 - RNA, 14 nt, Homo sapiens
ggaaugaacugucc

SEQ ID NO: 1818296 - RNA, 23 nt, Homo sapiens
ugaccucacuuuaggcagcugua

SEQ ID NO: 1818297 - RNA, 21 nt, Homo sapiens
guguucuucucaaggacacau

SEQ ID NO: 1818298 - RNA, 15 nt, Homo sapiens
uccaaauucuuuauu

SEQ ID NO: 1818299 - RNA, 22 nt, Homo sapiens
accuucaugugauucacugccu

SEQ ID NO: 1818300 - RNA, 22 nt, Homo sapiens
gccuguuagacucuuacuuuuu

SEQ ID NO: 1818301 - RNA, 16 nt, Homo sapiens
agaaagaagacugugu

SEQ ID NO: 1818302 - RNA, 15 nt, Homo sapiens
agguauauaccucca

SEQ ID NO: 1818303 - RNA, 21 nt, Homo sapiens
cuuauuacagcauuugauaaa

SEQ ID NO: 1818304 - RNA, 14 nt, Homo sapiens
cuauugacaucagc

SEQ ID NO: 1818305 - RNA, 21 nt, Homo sapiens
ucaagccuccccaguucuacu

SEQ ID NO: 1818306 - RNA, 18 nt, Homo sapiens
acucgcccucgccagugg

SEQ ID NO: 1818307 - RNA, 14 nt, Homo sapiens
uucaauuugaacuc

SEQ ID NO: 1818308 - RNA, 23 nt, Homo sapiens
guggcaaaaauaaugacauguag

SEQ ID NO: 1818309 - RNA, 13 nt, Homo sapiens
uaccuaccaccuu

SEQ ID NO: 1818310 - RNA, 15 nt, Homo sapiens
aacauagcugucaca

SEQ ID NO: 1818311 - RNA, 19 nt, Homo sapiens
aacuuuagugaaacauaau

SEQ ID NO: 1818312 - RNA, 20 nt, Homo sapiens
gagaaaaagccuccagucca

SEQ ID NO: 1818313 - RNA, 23 nt, Homo sapiens
gugauauuaaccaggggccauga

SEQ ID NO: 1818314 - RNA, 15 nt, Homo sapiens
gauuauuacuggcaa

SEQ ID NO: 1818315 - RNA, 15 nt, Homo sapiens
ucuucagggccaguc

SEQ ID NO: 1818316 - RNA, 16 nt, Homo sapiens
aaaauaccacuguaau

SEQ ID NO: 1818317 - RNA, 14 nt, Homo sapiens
aaugaauacaauua

SEQ ID NO: 1818318 - RNA, 13 nt, Homo sapiens
uaaaacagacuca

SEQ ID NO: 1818319 - RNA, 15 nt, Homo sapiens
aaauguuucaaagac

SEQ ID NO: 1818320 - RNA, 15 nt, Homo sapiens
ucgagauugcacugc

SEQ ID NO: 1818321 - RNA, 16 nt, Homo sapiens
guuuggagucacugua

SEQ ID NO: 1818322 - RNA, 16 nt, Homo sapiens
acacugugaagacaau

SEQ ID NO: 1818323 - RNA, 13 nt, Homo sapiens
uccaccaaauaca

SEQ ID NO: 1818324 - RNA, 19 nt, Homo sapiens
uuuuaguugcucaaagagc

SEQ ID NO: 1818325 - RNA, 16 nt, Homo sapiens
aguuggccaagcagaa

SEQ ID NO: 1818326 - RNA, 23 nt, Homo sapiens
gagaguuucuauggauucacuuc

SEQ ID NO: 1818327 - RNA, 12 nt, Homo sapiens
caacugcaaaaa

SEQ ID NO: 1818328 - RNA, 16 nt, Homo sapiens
auucaaaaauguacaa

SEQ ID NO: 1818329 - RNA, 18 nt, Homo sapiens
cugccuuaucaaaagagc

SEQ ID NO: 1818330 - RNA, 17 nt, Homo sapiens
auuaacucugcauagac

SEQ ID NO: 1818331 - RNA, 23 nt, Homo sapiens
cacgaauugauuuaaagugaaca

SEQ ID NO: 1818332 - RNA, 21 nt, Homo sapiens
agucagagacagauaccucca

SEQ ID NO: 1818333 - RNA, 18 nt, Homo sapiens
cagccuccugaguagcug

SEQ ID NO: 1818334 - RNA, 20 nt, Homo sapiens
ucacugggcucacugcaggc

SEQ ID NO: 1818335 - RNA, 19 nt, Homo sapiens
auccuacaguacaaucagc

SEQ ID NO: 1818336 - RNA, 16 nt, Homo sapiens
ucuucuugaacacuca

SEQ ID NO: 1818337 - RNA, 13 nt, Homo sapiens
gccauaccuugag

SEQ ID NO: 1818338 - RNA, 20 nt, Homo sapiens
aacacagaacucagccuuaa

SEQ ID NO: 1818339 - RNA, 23 nt, Homo sapiens
guuuuugugaaaagcuccauuuu

SEQ ID NO: 1818340 - RNA, 11 nt, Homo sapiens
agacacugagu

SEQ ID NO: 1818341 - RNA, 21 nt, Homo sapiens
cuguuuccuacagacacccau

SEQ ID NO: 1818342 - RNA, 21 nt, Homo sapiens
aaauaaacucuucaaggccaa

SEQ ID NO: 1818343 - RNA, 15 nt, Homo sapiens
uucuaaugugcauua

SEQ ID NO: 1818344 - RNA, 17 nt, Homo sapiens
auccugugacugucuca

SEQ ID NO: 1818345 - RNA, 17 nt, Homo sapiens
cagggucugugugaaug

SEQ ID NO: 1818346 - RNA, 24 nt, Homo sapiens
gacccuccccaaggaugaccacac

SEQ ID NO: 1818347 - RNA, 14 nt, Homo sapiens
auuuacagagccug

SEQ ID NO: 1818348 - RNA, 17 nt, Homo sapiens
caagccauucacuuccc

SEQ ID NO: 1818349 - RNA, 14 nt, Homo sapiens
cucagagcauuuca

SEQ ID NO: 1818350 - RNA, 15 nt, Homo sapiens
caauauuuucucuca

SEQ ID NO: 1818351 - RNA, 20 nt, Homo sapiens
gcacacaugguuuccaaggg

SEQ ID NO: 1818352 - RNA, 23 nt, Homo sapiens
uugcuuuuagguugaaggcaaaa

SEQ ID NO: 1818353 - RNA, 22 nt, Homo sapiens
uuugagauggacacacuggugu

SEQ ID NO: 1818354 - RNA, 22 nt, Homo sapiens
cguuugacuagccaucucaagc

SEQ ID NO: 1818355 - RNA, 14 nt, Homo sapiens
aagacagagcagau

SEQ ID NO: 1818356 - RNA, 14 nt, Homo sapiens
aagacugagcagaa

SEQ ID NO: 1818357 - RNA, 22 nt, Homo sapiens
ugauguuguuacugauucuccu

SEQ ID NO: 1818358 - RNA, 22 nt, Homo sapiens
aacauuuauuuugagaagcucu

SEQ ID NO: 1818359 - RNA, 13 nt, Homo sapiens
ugccucucucagg

SEQ ID NO: 1818360 - RNA, 15 nt, Homo sapiens
agaaccacuacaucu

SEQ ID NO: 1818361 - RNA, 21 nt, Homo sapiens
agcgcaacggcuccuuugcca

SEQ ID NO: 1818362 - RNA, 21 nt, Homo sapiens
ggcugauuucucacacacugg

SEQ ID NO: 1818363 - RNA, 21 nt, Homo sapiens
gacacagaggacggcuucccc

SEQ ID NO: 1818364 - RNA, 18 nt, Homo sapiens
gucuuacuaaaugcagaa

SEQ ID NO: 1818365 - RNA, 18 nt, Homo sapiens
gaccagagugggaccaag

SEQ ID NO: 1818366 - RNA, 19 nt, Homo sapiens
cuucacgggcaaucaugag

SEQ ID NO: 1818367 - RNA, 20 nt, Homo sapiens
uauguuucucuacagcaccu

SEQ ID NO: 1818368 - RNA, 21 nt, Homo sapiens
ugaaaauggagaaaaccagag

SEQ ID NO: 1818369 - RNA, 12 nt, Homo sapiens
acuucauucucg

SEQ ID NO: 1818370 - RNA, 13 nt, Homo sapiens
gucuccucuucca

SEQ ID NO: 1818371 - RNA, 15 nt, Homo sapiens
cacuaccaauuuccc

SEQ ID NO: 1818372 - RNA, 12 nt, Homo sapiens
aggugagcucag

SEQ ID NO: 1818373 - RNA, 18 nt, Homo sapiens
ggugcccuuugggguccc

SEQ ID NO: 1818374 - RNA, 15 nt, Homo sapiens
cagacuggcaauaaa

SEQ ID NO: 1818375 - RNA, 15 nt, Homo sapiens
uuuugugaagcccug

SEQ ID NO: 1818376 - RNA, 16 nt, Homo sapiens
ccucaagugauccucc

SEQ ID NO: 1818377 - RNA, 13 nt, Homo sapiens
guaacagccaaac

SEQ ID NO: 1818378 - RNA, 13 nt, Homo sapiens
gacauagccucau

SEQ ID NO: 1818379 - RNA, 14 nt, Homo sapiens
caagcacucggggu

SEQ ID NO: 1818380 - RNA, 13 nt, Homo sapiens
guuucacauucau

SEQ ID NO: 1818381 - RNA, 12 nt, Homo sapiens
uguguguagcca

SEQ ID NO: 1818382 - RNA, 12 nt, Homo sapiens
cacaacacugaa

SEQ ID NO: 1818383 - RNA, 15 nt, Homo sapiens
ucuuccaacccacug

SEQ ID NO: 1818384 - RNA, 16 nt, Homo sapiens
cuuguccuagcacaga

SEQ ID NO: 1818385 - RNA, 19 nt, Homo sapiens
uccagucuuccaccuggaa

SEQ ID NO: 1818386 - RNA, 13 nt, Homo sapiens
caagcugcugaaa

SEQ ID NO: 1818387 - RNA, 21 nt, Homo sapiens
ccauccuugacuuugaacuaa

SEQ ID NO: 1818388 - RNA, 13 nt, Homo sapiens
gcaaaagcaucca

SEQ ID NO: 1818389 - RNA, 23 nt, Homo sapiens
cccaggaacaauaaaaugucuuc

SEQ ID NO: 1818390 - RNA, 16 nt, Homo sapiens
aguuaguauagcuuua

SEQ ID NO: 1818391 - RNA, 17 nt, Homo sapiens
ucggaugaggcccucau

SEQ ID NO: 1818392 - RNA, 21 nt, Homo sapiens
agagcagcuccccaggagcuc

SEQ ID NO: 1818393 - RNA, 14 nt, Homo sapiens
ccagcacaaagugg

SEQ ID NO: 1818394 - RNA, 12 nt, Homo sapiens
accacauggcuu

SEQ ID NO: 1818395 - RNA, 17 nt, Homo sapiens
caggcugcggugggcag

SEQ ID NO: 1818396 - RNA, 15 nt, Homo sapiens
uaaagucaggauuua

SEQ ID NO: 1818397 - RNA, 13 nt, Homo sapiens
cugggcauggugg

SEQ ID NO: 1818398 - RNA, 13 nt, Homo sapiens
ugcaucccugaaa

SEQ ID NO: 1818399 - RNA, 16 nt, Homo sapiens
uuaaguuuccuuccag

SEQ ID NO: 1818400 - RNA, 14 nt, Homo sapiens
uugaauaauguagu

SEQ ID NO: 1818401 - RNA, 17 nt, Homo sapiens
uggagugaugguguccu

SEQ ID NO: 1818402 - RNA, 14 nt, Homo sapiens
ggagggaccaggug

SEQ ID NO: 1818403 - RNA, 13 nt, Homo sapiens
uuugaccagugaa

SEQ ID NO: 1818404 - RNA, 13 nt, Homo sapiens
augaucccaguca

SEQ ID NO: 1818405 - RNA, 23 nt, Homo sapiens
aauucucucccccuauuuauuga

SEQ ID NO: 1818406 - RNA, 17 nt, Homo sapiens
gugcacauuucuuugca

SEQ ID NO: 1818407 - RNA, 22 nt, Homo sapiens
aaugaaaaaggauaaugcaaaa

SEQ ID NO: 1818408 - RNA, 18 nt, Homo sapiens
aaacauagcuuucuuccc

SEQ ID NO: 1818409 - RNA, 21 nt, Homo sapiens
agaauuaaugacaacaaaagg

SEQ ID NO: 1818410 - RNA, 16 nt, Homo sapiens
cccagggagagggggc

SEQ ID NO: 1818411 - RNA, 22 nt, Homo sapiens
cauacuacaguaacugugacug

SEQ ID NO: 1818412 - RNA, 17 nt, Homo sapiens
ucacccaggaaucucaa

SEQ ID NO: 1818413 - RNA, 20 nt, Homo sapiens
ugcuuaacagggaacgugau

SEQ ID NO: 1818414 - RNA, 19 nt, Homo sapiens
auuauugacacugaacuua

SEQ ID NO: 1818415 - RNA, 15 nt, Homo sapiens
cuucugccuguuaua

SEQ ID NO: 1818416 - RNA, 18 nt, Homo sapiens
uggcuccacccucuuuag

SEQ ID NO: 1818417 - RNA, 18 nt, Homo sapiens
uaacaacagcuucuugcu

SEQ ID NO: 1818418 - RNA, 24 nt, Homo sapiens
uuaugucauauaucaaaucaucuc

SEQ ID NO: 1818419 - RNA, 19 nt, Homo sapiens
ucaaauuacuuugugaaua

SEQ ID NO: 1818420 - RNA, 16 nt, Homo sapiens
cagccccugaucucug

SEQ ID NO: 1818421 - RNA, 15 nt, Homo sapiens
ugguuccacucagcu

SEQ ID NO: 1818422 - RNA, 16 nt, Homo sapiens
caauaaaggcaccucc

SEQ ID NO: 1818423 - RNA, 12 nt, Homo sapiens
ucaguacagagg

SEQ ID NO: 1818424 - RNA, 21 nt, Homo sapiens
uaccuauaugcagucucuuua

SEQ ID NO: 1818425 - RNA, 23 nt, Homo sapiens
gaccagagugauguccucucuca

SEQ ID NO: 1818426 - RNA, 21 nt, Homo sapiens
auuuuuaagcuaugaaaaaua

SEQ ID NO: 1818427 - RNA, 15 nt, Homo sapiens
agaucccaagagauu

SEQ ID NO: 1818428 - RNA, 16 nt, Homo sapiens
caugccaaauguucca

SEQ ID NO: 1818429 - RNA, 16 nt, Homo sapiens
caagagggaaggugac

SEQ ID NO: 1818430 - RNA, 21 nt, Homo sapiens
ugugugagugugugcaaguau

SEQ ID NO: 1818431 - RNA, 21 nt, Homo sapiens
acccauccgguuugccauguu

SEQ ID NO: 1818432 - RNA, 14 nt, Homo sapiens
cggggcaggugcag

SEQ ID NO: 1818433 - RNA, 23 nt, Homo sapiens
aucauguuuuuucugcaaugacu

SEQ ID NO: 1818434 - RNA, 19 nt, Homo sapiens
aguaccacauuccaugacg

SEQ ID NO: 1818435 - RNA, 18 nt, Homo sapiens
caaaaccccacuacacag

SEQ ID NO: 1818436 - RNA, 20 nt, Homo sapiens
cuaccuagcgggauggggcu

SEQ ID NO: 1818437 - RNA, 20 nt, Homo sapiens
accuggauccagcacuggug

SEQ ID NO: 1818438 - RNA, 11 nt, Homo sapiens
uauauauagua

SEQ ID NO: 1818439 - RNA, 23 nt, Homo sapiens
cuuaauucuuaccucauuugcau

SEQ ID NO: 1818440 - RNA, 19 nt, Homo sapiens
agagcuucaacuacuucuc

SEQ ID NO: 1818441 - RNA, 22 nt, Homo sapiens
uggucccucugugucugcucuc

SEQ ID NO: 1818442 - RNA, 18 nt, Homo sapiens
uggaaagcauauacuaua

SEQ ID NO: 1818443 - RNA, 18 nt, Homo sapiens
uacauuuagcuuguucac

SEQ ID NO: 1818444 - RNA, 19 nt, Homo sapiens
acauagguuagauucucau

SEQ ID NO: 1818445 - RNA, 16 nt, Homo sapiens
uccccaagagcuguua

SEQ ID NO: 1818446 - RNA, 15 nt, Homo sapiens
cccuuuacaaauaga

SEQ ID NO: 1818447 - RNA, 16 nt, Homo sapiens
aacuccacaugcuggu

SEQ ID NO: 1818448 - RNA, 18 nt, Homo sapiens
ccagagaccugaggcaga

SEQ ID NO: 1818449 - RNA, 22 nt, Homo sapiens
cgugauguggagggcacauucc

SEQ ID NO: 1818450 - RNA, 17 nt, Homo sapiens
auuucucuuucucucuc

SEQ ID NO: 1818451 - RNA, 17 nt, Homo sapiens
aauagagacacagagau

SEQ ID NO: 1818452 - RNA, 17 nt, Homo sapiens
accaaaaaccuaaaaau

SEQ ID NO: 1818453 - RNA, 18 nt, Homo sapiens
gcaggugcuccucgagag

SEQ ID NO: 1818454 - RNA, 15 nt, Homo sapiens
auuucccucccggga

SEQ ID NO: 1818455 - RNA, 19 nt, Homo sapiens
cccugcuaaagaguguuca

SEQ ID NO: 1818456 - RNA, 17 nt, Homo sapiens
uguaaacuuuaucacuu

SEQ ID NO: 1818457 - RNA, 21 nt, Homo sapiens
uuaauaaaacuuuauguacug

SEQ ID NO: 1818458 - RNA, 18 nt, Homo sapiens
gccucucuguacacugcc

SEQ ID NO: 1818459 - RNA, 15 nt, Homo sapiens
aaacccuguccuccc

SEQ ID NO: 1818460 - RNA, 19 nt, Homo sapiens
uucacaauauccaaugaag

SEQ ID NO: 1818461 - RNA, 13 nt, Homo sapiens
caacagauuuaca

SEQ ID NO: 1818462 - RNA, 13 nt, Homo sapiens
gcagugggaccaa

SEQ ID NO: 1818463 - RNA, 13 nt, Homo sapiens
cagugcagacuca

SEQ ID NO: 1818464 - RNA, 12 nt, Homo sapiens
aacacacaugca

SEQ ID NO: 1818465 - RNA, 21 nt, Homo sapiens
cucuaccuucaacaugugcuc

SEQ ID NO: 1818466 - RNA, 17 nt, Homo sapiens
cagagagggacugacac

SEQ ID NO: 1818467 - RNA, 14 nt, Homo sapiens
ggcuucuccaggga

SEQ ID NO: 1818468 - RNA, 13 nt, Homo sapiens
uauguuucacugu

SEQ ID NO: 1818469 - RNA, 15 nt, Homo sapiens
gcucccuuccugggg

SEQ ID NO: 1818470 - RNA, 20 nt, Homo sapiens
aaaauaccuuuguaacggcu

SEQ ID NO: 1818471 - RNA, 18 nt, Homo sapiens
cuauccuggcaacucaag

SEQ ID NO: 1818472 - RNA, 22 nt, Homo sapiens
auaaacaacuuaauguucugaa

SEQ ID NO: 1818473 - RNA, 19 nt, Homo sapiens
uuaauacacaaugcaucau

SEQ ID NO: 1818474 - RNA, 23 nt, Homo sapiens
uccauuuuugucagucugaguca

SEQ ID NO: 1818475 - RNA, 20 nt, Homo sapiens
accccaacacccccaagaca

SEQ ID NO: 1818476 - RNA, 13 nt, Homo sapiens
cuaauacagcaga

SEQ ID NO: 1818477 - RNA, 20 nt, Homo sapiens
cucgguggcugcacagaagg

SEQ ID NO: 1818478 - RNA, 18 nt, Homo sapiens
ggagaugaccugccuuau

SEQ ID NO: 1818479 - RNA, 15 nt, Homo sapiens
cugaggggugggggu

SEQ ID NO: 1818480 - RNA, 22 nt, Homo sapiens
cccaagagucuggggaccagcu

SEQ ID NO: 1818481 - RNA, 11 nt, Homo sapiens
ccagucuuccu

SEQ ID NO: 1818482 - RNA, 15 nt, Homo sapiens
acaugaaaacauuga

SEQ ID NO: 1818483 - RNA, 15 nt, Homo sapiens
gcugugcgcuccccc

SEQ ID NO: 1818484 - RNA, 12 nt, Homo sapiens
aucccaagccaa

SEQ ID NO: 1818485 - RNA, 15 nt, Homo sapiens
gcugcugcugcucca

SEQ ID NO: 1818486 - RNA, 14 nt, Homo sapiens
ccuggggugcccuc

SEQ ID NO: 1818487 - RNA, 12 nt, Homo sapiens
aguucucagggg

SEQ ID NO: 1818488 - RNA, 17 nt, Homo sapiens
uuucccgcccagccuca

SEQ ID NO: 1818489 - RNA, 17 nt, Homo sapiens
uagaguuucuguuugau

SEQ ID NO: 1818490 - RNA, 18 nt, Homo sapiens
gccaagaaagaaaccaga

SEQ ID NO: 1818491 - RNA, 19 nt, Homo sapiens
caacaaauuucauugcacu

SEQ ID NO: 1818492 - RNA, 18 nt, Homo sapiens
auuuucucccuuuaugua

SEQ ID NO: 1818493 - RNA, 19 nt, Homo sapiens
gaucagacgaaagugagaa

SEQ ID NO: 1818494 - RNA, 22 nt, Homo sapiens
uuaauuggcccuguacaguuug

SEQ ID NO: 1818495 - RNA, 19 nt, Homo sapiens
aauucuguaggacuuugaa

SEQ ID NO: 1818496 - RNA, 18 nt, Homo sapiens
cauuguuagaaaucccug

SEQ ID NO: 1818497 - RNA, 21 nt, Homo sapiens
auucaacaucaaaacuuaaga

SEQ ID NO: 1818498 - RNA, 23 nt, Homo sapiens
uccucugccucccauucugacca

SEQ ID NO: 1818499 - RNA, 14 nt, Homo sapiens
guauuuaacucaua

SEQ ID NO: 1818500 - RNA, 19 nt, Homo sapiens
aacaaauucaaauaaucca

SEQ ID NO: 1818501 - RNA, 14 nt, Homo sapiens
aaugcaucuggcua

SEQ ID NO: 1818502 - RNA, 14 nt, Homo sapiens
guguggcuuuccag

SEQ ID NO: 1818503 - RNA, 17 nt, Homo sapiens
aaaauacuauuggacag

SEQ ID NO: 1818504 - RNA, 20 nt, Homo sapiens
agggcaguucugaguguuua

SEQ ID NO: 1818505 - RNA, 23 nt, Homo sapiens
cauugguucuuucauuugcuuug

SEQ ID NO: 1818506 - RNA, 19 nt, Homo sapiens
uguuggagaugcagccuuc

SEQ ID NO: 1818507 - RNA, 14 nt, Homo sapiens
cuauaaaacacauc

SEQ ID NO: 1818508 - RNA, 18 nt, Homo sapiens
agcccuucacugccauga

SEQ ID NO: 1818509 - RNA, 14 nt, Homo sapiens
auuaggcaugccua

SEQ ID NO: 1818510 - RNA, 14 nt, Homo sapiens
caguacucacuuuu

SEQ ID NO: 1818511 - RNA, 12 nt, Homo sapiens
ccaguccaugcu

SEQ ID NO: 1818512 - RNA, 13 nt, Homo sapiens
acuccagugccca

SEQ ID NO: 1818513 - RNA, 19 nt, Homo sapiens
caaguacagccuucacugg

SEQ ID NO: 1818514 - RNA, 17 nt, Homo sapiens
cugcaauuaaagugaua

SEQ ID NO: 1818515 - RNA, 13 nt, Homo sapiens
cuacccacuucca

SEQ ID NO: 1818516 - RNA, 15 nt, Homo sapiens
ggaggugucucaggc

SEQ ID NO: 1818517 - RNA, 22 nt, Homo sapiens
acuuacuuagagaugcuacugu

SEQ ID NO: 1818518 - RNA, 13 nt, Homo sapiens
aaagugucuugaa

SEQ ID NO: 1818519 - RNA, 17 nt, Homo sapiens
agcuacuguaacuuuuu

SEQ ID NO: 1818520 - RNA, 20 nt, Homo sapiens
uccccugguccugcacuguc

SEQ ID NO: 1818521 - RNA, 14 nt, Homo sapiens
cacaucuaaugucu

SEQ ID NO: 1818522 - RNA, 21 nt, Homo sapiens
cugugaagucaagaaucacuu

SEQ ID NO: 1818523 - RNA, 12 nt, Homo sapiens
acacccagguga

SEQ ID NO: 1818524 - RNA, 18 nt, Homo sapiens
ugagauuucuuaaauaau

SEQ ID NO: 1818525 - RNA, 15 nt, Homo sapiens
gaguccaaaaucauu

SEQ ID NO: 1818526 - RNA, 17 nt, Homo sapiens
cacaggcgaggacccug

SEQ ID NO: 1818527 - RNA, 19 nt, Homo sapiens
aaacacucuugaaaaaugc

SEQ ID NO: 1818528 - RNA, 20 nt, Homo sapiens
cuuggcuguuccaccagagc

SEQ ID NO: 1818529 - RNA, 14 nt, Homo sapiens
cuguuacaguaaug

SEQ ID NO: 1818530 - RNA, 17 nt, Homo sapiens
cuggacucauugcuuca

SEQ ID NO: 1818531 - RNA, 24 nt, Homo sapiens
gcuccucacuuccucuucuucauu

SEQ ID NO: 1818532 - RNA, 19 nt, Homo sapiens
cauuauuuuucacugcccc

SEQ ID NO: 1818533 - RNA, 14 nt, Homo sapiens
ucaccuuuguccug

SEQ ID NO: 1818534 - RNA, 13 nt, Homo sapiens
cagguuaccucac

SEQ ID NO: 1818535 - RNA, 22 nt, Homo sapiens
auucuuaaaauauauuucagau

SEQ ID NO: 1818536 - RNA, 20 nt, Homo sapiens
aagaacuuucucugccauca

SEQ ID NO: 1818537 - RNA, 13 nt, Homo sapiens
guuucacauauuu

SEQ ID NO: 1818538 - RNA, 13 nt, Homo sapiens
uacucacagucuu

SEQ ID NO: 1818539 - RNA, 15 nt, Homo sapiens
ugcacucagacugua

SEQ ID NO: 1818540 - RNA, 20 nt, Homo sapiens
uaacaaccaaagacuacaua

SEQ ID NO: 1818541 - RNA, 14 nt, Homo sapiens
ugaguagauauuac

SEQ ID NO: 1818542 - RNA, 22 nt, Homo sapiens
acaccaugagccuccucgucac

SEQ ID NO: 1818543 - RNA, 20 nt, Homo sapiens
acagcacuggcucucuccag

SEQ ID NO: 1818544 - RNA, 15 nt, Homo sapiens
uacaaauucuucuaa

SEQ ID NO: 1818545 - RNA, 11 nt, Homo sapiens
aguccauuucc

SEQ ID NO: 1818546 - RNA, 21 nt, Homo sapiens
guaccauuuauuuuaugacau

SEQ ID NO: 1818547 - RNA, 23 nt, Homo sapiens
gcagagaccuugcgaccaugugu

SEQ ID NO: 1818548 - RNA, 15 nt, Homo sapiens
acaauggagugugua

SEQ ID NO: 1818549 - RNA, 17 nt, Homo sapiens
ucuuccaaguucauuca

SEQ ID NO: 1818550 - RNA, 18 nt, Homo sapiens
uaacaggauauuuaauga

SEQ ID NO: 1818551 - RNA, 17 nt, Homo sapiens
gaacuucacagugacac

SEQ ID NO: 1818552 - RNA, 17 nt, Homo sapiens
acaacuucuaauugcca

SEQ ID NO: 1818553 - RNA, 15 nt, Homo sapiens
acucccagcacuuug

SEQ ID NO: 1818554 - RNA, 15 nt, Homo sapiens
gguucugagcaaaua

SEQ ID NO: 1818555 - RNA, 18 nt, Homo sapiens
aaaaaaccuucagugaaa

SEQ ID NO: 1818556 - RNA, 19 nt, Homo sapiens
cuguaaauggaacaaacaa

SEQ ID NO: 1818557 - RNA, 11 nt, Homo sapiens
cauccuuucag

SEQ ID NO: 1818558 - RNA, 19 nt, Homo sapiens
gagcuaggggggucagcca

SEQ ID NO: 1818559 - RNA, 21 nt, Homo sapiens
acauauuuguggaauaaugua

SEQ ID NO: 1818560 - RNA, 22 nt, Homo sapiens
acuucugucuguugaggcauca

SEQ ID NO: 1818561 - RNA, 14 nt, Homo sapiens
cagggcugugaucg

SEQ ID NO: 1818562 - RNA, 12 nt, Homo sapiens
gagaaccaggcu

SEQ ID NO: 1818563 - RNA, 15 nt, Homo sapiens
acuuagauucauuaa

SEQ ID NO: 1818564 - RNA, 23 nt, Homo sapiens
acucaugaauuaauuaaagcaaa

SEQ ID NO: 1818565 - RNA, 14 nt, Homo sapiens
aauccaacccgggg

SEQ ID NO: 1818566 - RNA, 16 nt, Homo sapiens
ccaagcaggaagcuca

SEQ ID NO: 1818567 - RNA, 18 nt, Homo sapiens
aaugaguaaaaucacaga

SEQ ID NO: 1818568 - RNA, 18 nt, Homo sapiens
ucaaguauaacaacuuug

SEQ ID NO: 1818569 - RNA, 16 nt, Homo sapiens
cuuggagaucuuugcu

SEQ ID NO: 1818570 - RNA, 18 nt, Homo sapiens
uuccagccuuuggugcuu

SEQ ID NO: 1818571 - RNA, 17 nt, Homo sapiens
aagucacguagcacaga

SEQ ID NO: 1818572 - RNA, 13 nt, Homo sapiens
uauagcucaggac

SEQ ID NO: 1818573 - RNA, 13 nt, Homo sapiens
aaggccucugugg

SEQ ID NO: 1818574 - RNA, 15 nt, Homo sapiens
cagccguccauagca

SEQ ID NO: 1818575 - RNA, 14 nt, Homo sapiens
cuguaauuccagca

SEQ ID NO: 1818576 - RNA, 16 nt, Homo sapiens
uggggcugguuuugcu

SEQ ID NO: 1818577 - RNA, 21 nt, Homo sapiens
gugcuuuaaccucacauaccc

SEQ ID NO: 1818578 - RNA, 16 nt, Homo sapiens
uauguaaaguauguaa

SEQ ID NO: 1818579 - RNA, 22 nt, Homo sapiens
ucaccauuaugcugguguaugu

SEQ ID NO: 1818580 - RNA, 18 nt, Homo sapiens
caaagugcugggauuaca

SEQ ID NO: 1818581 - RNA, 16 nt, Homo sapiens
auccuguguuaucugu

SEQ ID NO: 1818582 - RNA, 15 nt, Homo sapiens
gcgcgcucaucccac

SEQ ID NO: 1818583 - RNA, 15 nt, Homo sapiens
aaccccauguccuca

SEQ ID NO: 1818584 - RNA, 14 nt, Homo sapiens
ugauucuccugccu

SEQ ID NO: 1818585 - RNA, 14 nt, Homo sapiens
cacugcaggcauca

SEQ ID NO: 1818586 - RNA, 19 nt, Homo sapiens
uugagaagggacaagccac

SEQ ID NO: 1818587 - RNA, 16 nt, Homo sapiens
cauggcucuaaaaagu

SEQ ID NO: 1818588 - RNA, 23 nt, Homo sapiens
uucaaguuaaugcaaaugacugu

SEQ ID NO: 1818589 - RNA, 12 nt, Homo sapiens
uaggaacaugug

SEQ ID NO: 1818590 - RNA, 17 nt, Homo sapiens
uauucaagccuguuguc

SEQ ID NO: 1818591 - RNA, 16 nt, Homo sapiens
cuggaaagaaaacaca

SEQ ID NO: 1818592 - RNA, 20 nt, Homo sapiens
ugccccccagauugcugcaa

SEQ ID NO: 1818593 - RNA, 22 nt, Homo sapiens
auucugcauguacuaguccucu

SEQ ID NO: 1818594 - RNA, 21 nt, Homo sapiens
uucacuuaauaauguguacau

SEQ ID NO: 1818595 - RNA, 16 nt, Homo sapiens
agggucugucccgggu

SEQ ID NO: 1818596 - RNA, 15 nt, Homo sapiens
aagcuacuguagaaa

SEQ ID NO: 1818597 - RNA, 23 nt, Homo sapiens
gaacaugcccacaacuugucacc

SEQ ID NO: 1818598 - RNA, 17 nt, Homo sapiens
aaucuggcauucuacac

SEQ ID NO: 1818599 - RNA, 23 nt, Homo sapiens
ccucuugaguuccucugcaguuu

SEQ ID NO: 1818600 - RNA, 17 nt, Homo sapiens
uccugccauagucuuaa

SEQ ID NO: 1818601 - RNA, 15 nt, Homo sapiens
aucagggaccagcuu

SEQ ID NO: 1818602 - RNA, 20 nt, Homo sapiens
acgagguuaaagaagcugca

SEQ ID NO: 1818603 - RNA, 13 nt, Homo sapiens
ucuuuaccagaac

SEQ ID NO: 1818604 - RNA, 14 nt, Homo sapiens
cuuggccucaugau

SEQ ID NO: 1818605 - RNA, 14 nt, Homo sapiens
cagaaucucugagc

SEQ ID NO: 1818606 - RNA, 14 nt, Homo sapiens
caggucaacucuga

SEQ ID NO: 1818607 - RNA, 13 nt, Homo sapiens
aacucagcugucu

SEQ ID NO: 1818608 - RNA, 15 nt, Homo sapiens
uuauuuaaucuccau

SEQ ID NO: 1818609 - RNA, 16 nt, Homo sapiens
uugcacacguccaugu

SEQ ID NO: 1818610 - RNA, 20 nt, Homo sapiens
uugagaauaugaucauguaa

SEQ ID NO: 1818611 - RNA, 17 nt, Homo sapiens
accucacgacuggucac

SEQ ID NO: 1818612 - RNA, 18 nt, Homo sapiens
caaaagaugccauucaua

SEQ ID NO: 1818613 - RNA, 20 nt, Homo sapiens
acauuuagaugcacuaccau

SEQ ID NO: 1818614 - RNA, 15 nt, Homo sapiens
gccugcugcugccaa

SEQ ID NO: 1818615 - RNA, 22 nt, Homo sapiens
agcugccacuuucacguggccu

SEQ ID NO: 1818616 - RNA, 15 nt, Homo sapiens
aggcacucaaaagcu

SEQ ID NO: 1818617 - RNA, 16 nt, Homo sapiens
guuuaaaaaaaguaua

SEQ ID NO: 1818618 - RNA, 17 nt, Homo sapiens
ggcgcucagcagcccua

SEQ ID NO: 1818619 - RNA, 16 nt, Homo sapiens
cuauuuuggacgugug

SEQ ID NO: 1818620 - RNA, 22 nt, Homo sapiens
uauuuuauguguaauucuucca

SEQ ID NO: 1818621 - RNA, 21 nt, Homo sapiens
uuugggcccagggacaccagc

SEQ ID NO: 1818622 - RNA, 15 nt, Homo sapiens
cucuagaagaccaaa

SEQ ID NO: 1818623 - RNA, 19 nt, Homo sapiens
uguuggauuuuaagcaaaa

SEQ ID NO: 1818624 - RNA, 22 nt, Homo sapiens
ugugcuucaaggacauugguga

SEQ ID NO: 1818625 - RNA, 15 nt, Homo sapiens
ugcaguuucuucauc

SEQ ID NO: 1818626 - RNA, 21 nt, Homo sapiens
ccagacugcggagcagccucc

SEQ ID NO: 1818627 - RNA, 14 nt, Homo sapiens
cacggcauuacccc

SEQ ID NO: 1818628 - RNA, 17 nt, Homo sapiens
ucccuuuaucauguguu

SEQ ID NO: 1818629 - RNA, 21 nt, Homo sapiens
ucaaauucagcucugaucuga

SEQ ID NO: 1818630 - RNA, 14 nt, Homo sapiens
gugcucacaaagga

SEQ ID NO: 1818631 - RNA, 16 nt, Homo sapiens
uauggugagaugcagc

SEQ ID NO: 1818632 - RNA, 18 nt, Homo sapiens
ucugcuuaaucugagaau

SEQ ID NO: 1818633 - RNA, 15 nt, Homo sapiens
acuucacacacaccu

SEQ ID NO: 1818634 - RNA, 20 nt, Homo sapiens
accacgugagaucauucacu

SEQ ID NO: 1818635 - RNA, 23 nt, Homo sapiens
cccaguauaugcuauucaaugau

SEQ ID NO: 1818636 - RNA, 14 nt, Homo sapiens
auuuccacuuggga
